United States Patent 7,323,308 (METHODS OF GENETIC ANALYSIS OF E. COLI) - sequence listing, part 4

SEQ ID NO: 123093 - DNA, 25 bp, E. coli
tctggcaatgccgaaaccgtcttta

SEQ ID NO: 123094 - DNA, 25 bp, E. coli
tctggcaatgcccaaaccgtcttta

SEQ ID NO: 123095 - DNA, 25 bp, E. coli
gcactgatcctgtgggcgaaagccc

SEQ ID NO: 123096 - DNA, 25 bp, E. coli
gcactgatcctgagggcgaaagccc

SEQ ID NO: 123097 - DNA, 25 bp, E. coli
gaaatgtctgattacgatccgcgcg

SEQ ID NO: 123098 - DNA, 25 bp, E. coli
gaaatgtctgataacgatccgcgcg

SEQ ID NO: 123099 - DNA, 25 bp, E. coli
ccgcgaggcgatcggcttttctgaa

SEQ ID NO: 123100 - DNA, 25 bp, E. coli
ccgcgcactcgatgaagggcaaatt

SEQ ID NO: 123101 - DNA, 25 bp, E. coli
ccgcgaggcgatgggcttttctgaa

SEQ ID NO: 123102 - DNA, 25 bp, E. coli
ccgcgcactcgaagaagggcaaatt

SEQ ID NO: 123103 - DNA, 25 bp, E. coli
ggtaaatctgtttcccggccgcgca

SEQ ID NO: 123104 - DNA, 25 bp, E. coli
ggtaaatctgttacccggccgcgca

SEQ ID NO: 123105 - DNA, 25 bp, E. coli
taatgagagcgagcaaagcggttcc

SEQ ID NO: 123106 - DNA, 25 bp, E. coli
taatgagagcgaccaaagcggttcc

SEQ ID NO: 123107 - DNA, 25 bp, E. coli
cataactatggctggaacggcgtcg

SEQ ID NO: 123108 - DNA, 25 bp, E. coli
cataactatggcaggaacggcgtcg

SEQ ID NO: 123109 - DNA, 25 bp, E. coli
tactttcgacaatgatgaccagctg

SEQ ID NO: 123110 - DNA, 25 bp, E. coli
tactttcgacaaagatgaccagctg

SEQ ID NO: 123111 - DNA, 25 bp, E. coli
aactttcgtctgcactggcgtgacc

SEQ ID NO: 123112 - DNA, 25 bp, E. coli
aactttcgtctggactggcgtgacc

SEQ ID NO: 123113 - DNA, 25 bp, E. coli
tatttgaccggtacatggagctcac

SEQ ID NO: 123114 - DNA, 25 bp, E. coli
tatatcagcggcaactcaattggcg

SEQ ID NO: 123115 - DNA, 25 bp, E. coli
tatatcagcggctactcaattggcg

SEQ ID NO: 123116 - DNA, 25 bp, E. coli
tatttgaccggttcatggagctcac

SEQ ID NO: 123117 - DNA, 25 bp, E. coli
tcattgctctgcaggtcgggacgcg

SEQ ID NO: 123118 - DNA, 25 bp, E. coli
tcattgctctgctggtcgggacgcg

SEQ ID NO: 123119 - DNA, 25 bp, E. coli
gcctcggcgttgatgttctggaaaa

SEQ ID NO: 123120 - DNA, 25 bp, E. coli
gcctcggcgttgttgttctggaaaa

SEQ ID NO: 123121 - DNA, 25 bp, E. coli
ctacaactgttgttggcgctccggc

SEQ ID NO: 123122 - DNA, 25 bp, E. coli
ctacaactgttgatggcgctccggc

SEQ ID NO: 123123 - DNA, 25 bp, E. coli
ggcatgacttatgttagcgaggaaa

SEQ ID NO: 123124 - DNA, 25 bp, E. coli
ggcatgacttatcttagcgaggaaa

SEQ ID NO: 123125 - DNA, 25 bp, E. coli
tcaatttattaaacgcggtacgccg

SEQ ID NO: 123126 - DNA, 25 bp, E. coli
tcaattggcggcatgagcggacgct

SEQ ID NO: 123127 - DNA, 25 bp, E. coli
tcaattggcggcttgagcggacgct

SEQ ID NO: 123128 - DNA, 25 bp, E. coli
tcaatttattaatcgcggtacgccg

SEQ ID NO: 123129 - DNA, 25 bp, E. coli
aatgatgtactgatgcagaaggcgg

SEQ ID NO: 123130 - DNA, 25 bp, E. coli
aatgatgtactgttgcagaaggcgg

SEQ ID NO: 123131 - DNA, 25 bp, E. coli
cagcctgttcgctccggaggcagag

SEQ ID NO: 123132 - DNA, 25 bp, E. coli
cagcctgttcgcaccggaggcagag

SEQ ID NO: 123133 - DNA, 25 bp, E. coli
aggcagaggaaggacaggcggagac

SEQ ID NO: 123134 - DNA, 25 bp, E. coli
aggcagaggaagcacaggcggagac

SEQ ID NO: 123135 - DNA, 25 bp, E. coli
actgatgcagaaggcggcgggcctc

SEQ ID NO: 123136 - DNA, 25 bp, E. coli
actgatgcagaacgcggcgggcctc

SEQ ID NO: 123137 - DNA, 25 bp, E. coli
tccggcggatttcagcctgttcgct

SEQ ID NO: 123138 - DNA, 25 bp, E. coli
tccggcggatttgagcctgttcgct

SEQ ID NO: 123139 - DNA, 25 bp, E. coli
gcctcgccggtggagtccgtttcgg

SEQ ID NO: 123140 - DNA, 25 bp, E. coli
ccggacgaaaatcatgtactgatgc

SEQ ID NO: 123141 - DNA, 25 bp, E. coli
ccggacgaaaatgatgtactgatgc

SEQ ID NO: 123142 - DNA, 25 bp, E. coli
gcctcgccggtgcagtccgtttcgg

SEQ ID NO: 123143 - DNA, 25 bp, E. coli
gacgccggacgaaaatgatgtactg

SEQ ID NO: 123144 - DNA, 25 bp, E. coli
gacgccggacgataatgatgtactg

SEQ ID NO: 123145 - DNA, 25 bp, E. coli
cgaaaatgatgtactgatgcagaag

SEQ ID NO: 123146 - DNA, 25 bp, E. coli
cgaaaatgatgttctgatgcagaag

SEQ ID NO: 123147 - DNA, 25 bp, E. coli
cggagacgccggtcgaaaatgatgt

SEQ ID NO: 123148 - DNA, 25 bp, E. coli
cggagacgccggacgaaaatgatgt

SEQ ID NO: 123149 - DNA, 25 bp, E. coli
gatttcagcctgttcgctccggagg

SEQ ID NO: 123150 - DNA, 25 bp, E. coli
gatttcagcctgatcgctccggagg

SEQ ID NO: 123151 - DNA, 25 bp, E. coli
aatacagttgctttcgaggatgtcg

SEQ ID NO: 123152 - DNA, 25 bp, E. coli
aatacagttgctatcgaggatgtcg

SEQ ID NO: 123153 - DNA, 25 bp, E. coli
tactaaaatcaggaggtgagactct

SEQ ID NO: 123154 - DNA, 25 bp, E. coli
tactaaaatcagcaggtgagactct

SEQ ID NO: 123155 - DNA, 25 bp, E. coli
tcgtggagtaaaccaggaagttcat

SEQ ID NO: 123156 - DNA, 25 bp, E. coli
tcgtggagtaaagcaggaagttcat

SEQ ID NO: 123157 - DNA, 25 bp, E. coli
tctagactcgaaaaggcaacttgaa

SEQ ID NO: 123158 - DNA, 25 bp, E. coli
tctgccgttccttgtcgggatacaa

SEQ ID NO: 123159 - DNA, 25 bp, E. coli
tctgccgttcctagtcgggatacaa

SEQ ID NO: 123160 - DNA, 25 bp, E. coli
tctagactcgaataggcaacttgaa

SEQ ID NO: 123161 - DNA, 25 bp, E. coli
gaatgcagcaaatcctcatacgatg

SEQ ID NO: 123162 - DNA, 25 bp, E. coli
gaatgcagcaaaacctcatacgatg

SEQ ID NO: 123163 - DNA, 25 bp, E. coli
gaaatatgttctacacatggccttg

SEQ ID NO: 123164 - DNA, 25 bp, E. coli
gaaatatgttcttcacatggccttg

SEQ ID NO: 123165 - DNA, 25 bp, E. coli
cattgagaaaaaaggccacgccctt

SEQ ID NO: 123166 - DNA, 25 bp, E. coli
cattgagaaaaatggccacgccctt

SEQ ID NO: 123167 - DNA, 25 bp, E. coli
gattactcgatgaactcgcagtgca

SEQ ID NO: 123168 - DNA, 25 bp, E. coli
gattactcgatgtactcgcagtgca

SEQ ID NO: 123169 - DNA, 25 bp, E. coli
taatattcgctctgagaatgcagca

SEQ ID NO: 123170 - DNA, 25 bp, E. coli
taatattcgctcagagaatgcagca

SEQ ID NO: 123171 - DNA, 25 bp, E. coli
gatgccctctagttatctttgcgag

SEQ ID NO: 123172 - DNA, 25 bp, E. coli
gatgccctctagatatctttgcgag

SEQ ID NO: 123173 - DNA, 25 bp, E. coli
caaaagcgtcgctgcgctgatggaa

SEQ ID NO: 123174 - DNA, 25 bp, E. coli
caaaagcgtcgcagcgctgatggaa

SEQ ID NO: 123175 - DNA, 25 bp, E. coli
tactgtttaccgctgcactgctggc

SEQ ID NO: 123176 - DNA, 25 bp, E. coli
tactgtttaccggtgcactgctggc

SEQ ID NO: 123177 - DNA, 25 bp, E. coli
tttccggacggcaccaagctggtta

SEQ ID NO: 123178 - DNA, 25 bp, E. coli
tttccggacggctccaagctggtta

SEQ ID NO: 123179 - DNA, 25 bp, E. coli
tgatccccgataaccaggtcgaagc

SEQ ID NO: 123180 - DNA, 25 bp, E. coli
tgatccccgatatccaggtcgaagc

SEQ ID NO: 123181 - DNA, 25 bp, E. coli
gctggttaccgtccataatccgata

SEQ ID NO: 123182 - DNA, 25 bp, E. coli
gctggttaccgtgcataatccgata

SEQ ID NO: 123183 - DNA, 25 bp, E. coli
gcttttataatgcagggcgctcgcg

SEQ ID NO: 123184 - DNA, 25 bp, E. coli
gcttttataatggagggcgctcgcg

SEQ ID NO: 123185 - DNA, 25 bp, E. coli
gaatccgtggccgtgattagcgctt

SEQ ID NO: 123186 - DNA, 25 bp, E. coli
gaatccgtggccctgattagcgctt

SEQ ID NO: 123187 - DNA, 25 bp, E. coli
gaaggcataccagaaatgatccccg

SEQ ID NO: 123188 - DNA, 25 bp, E. coli
gaaggcataccacaaatgatccccg

SEQ ID NO: 123189 - DNA, 25 bp, E. coli
gaaacttaactaacccgaatccgtg

SEQ ID NO: 123190 - DNA, 25 bp, E. coli
gaaacttaactatcccgaatccgtg

SEQ ID NO: 123191 - DNA, 25 bp, E. coli
cgcgagcaggtcatggaaggcatac

SEQ ID NO: 123192 - DNA, 25 bp, E. coli
cgcgagcaggtcttggaaggcatac

SEQ ID NO: 123193 - DNA, 25 bp, E. coli
tggcccgcggccagaaacttaacta

SEQ ID NO: 123194 - DNA, 25 bp, E. coli
tggcccgcggcctgaaacttaacta

SEQ ID NO: 123195 - DNA, 25 bp, E. coli
cacggttgacgtcaccttttcagga

SEQ ID NO: 123196 - DNA, 25 bp, E. coli
cacggttgacgtgaccttttcagga

SEQ ID NO: 123197 - DNA, 25 bp, E. coli
caggattgcggatcagatgtcagca

SEQ ID NO: 123198 - DNA, 25 bp, E. coli
caggattgcggaacagatgtcagca

SEQ ID NO: 123199 - DNA, 25 bp, E. coli
tacagcctacattgcggtaaggtgc

SEQ ID NO: 123200 - DNA, 25 bp, E. coli
tacagcctacatagcggtaaggtgc

SEQ ID NO: 123201 - DNA, 25 bp, E. coli
tattgattccgcttaaccaggcgag

SEQ ID NO: 123202 - DNA, 25 bp, E. coli
tattgattccgcataaccaggcgag

SEQ ID NO: 123203 - DNA, 25 bp, E. coli
tgtcaatagcgatgtgcagtcgggt

SEQ ID NO: 123204 - DNA, 25 bp, E. coli
tgtcaatagcgaagtgcagtcgggt

SEQ ID NO: 123205 - DNA, 25 bp, E. coli
cgtaatacatgcctgctggcacagg

SEQ ID NO: 123206 - DNA, 25 bp, E. coli
ccgacggagtgctgagcgaaatgtt

SEQ ID NO: 123207 - DNA, 25 bp, E. coli
ccgacggagtgcagagcgaaatgtt

SEQ ID NO: 123208 - DNA, 25 bp, E. coli
cgtaatacatgcgtgctggcacagg

SEQ ID NO: 123209 - DNA, 25 bp, E. coli
cattgaaagtggaacggatgcagcc

SEQ ID NO: 123210 - DNA, 25 bp, E. coli
cattgaaagtggtacggatgcagcc

SEQ ID NO: 123211 - DNA, 25 bp, E. coli
tggcacggtcaacattagcggatcg

SEQ ID NO: 123212 - DNA, 25 bp, E. coli
tggcacggtcaagattagcggatcg

SEQ ID NO: 123213 - DNA, 25 bp, E. coli
taaccaggcgagtaaagactacagc

SEQ ID NO: 123214 - DNA, 25 bp, E. coli
taaccaggcgagaaaagactacagc

SEQ ID NO: 123215 - DNA, 25 bp, E. coli
tcaatgtgcagttaggcgatgtctc

SEQ ID NO: 123216 - DNA, 25 bp, E. coli
tcaatgtgcagtaaggcgatgtctc

SEQ ID NO: 123217 - DNA, 25 bp, E. coli
caaaaaagatcaccacagccgtcgt

SEQ ID NO: 123218 - DNA, 25 bp, E. coli
caaaaaagatcagcacagccgtcgt

SEQ ID NO: 123219 - DNA, 25 bp, E. coli
taaactgctcgactacctgaaacgt

SEQ ID NO: 123220 - DNA, 25 bp, E. coli
taaactgctcgagtacctgaaacgt

SEQ ID NO: 123221 - DNA, 25 bp, E. coli
aatcgtttctgactttggtcgtgac

SEQ ID NO: 123222 - DNA, 25 bp, E. coli
aatcgtttctgagtttggtcgtgac

SEQ ID NO: 123223 - DNA, 25 bp, E. coli
tggtcgtgacgctaacgacaccggt

SEQ ID NO: 123224 - DNA, 25 bp, E. coli
tgcacagatcaagcacctgcagggc

SEQ ID NO: 123225 - DNA, 25 bp, E. coli
tgcacagatcaaccacctgcagggc

SEQ ID NO: 123226 - DNA, 25 bp, E. coli
gacaccggttcttccgaagttcagg

SEQ ID NO: 123227 - DNA, 25 bp, E. coli
gcagggccacttagcagagcacaaa

SEQ ID NO: 123228 - DNA, 25 bp, E. coli
gacaccggttctaccgaagttcagg

SEQ ID NO: 123229 - DNA, 25 bp, E. coli
gcagggccactttgcagagcacaaa

SEQ ID NO: 123230 - DNA, 25 bp, E. coli
cctgaaacgtaatgacgtagcacgt

SEQ ID NO: 123231 - DNA, 25 bp, E. coli
cctgaaacgtaaagacgtagcacgt

SEQ ID NO: 123232 - DNA, 25 bp, E. coli
cgcatggtttctcagcgtcgtaaac

SEQ ID NO: 123233 - DNA, 25 bp, E. coli
cgcatggtttctgagcgtcgtaaac

SEQ ID NO: 123234 - DNA, 25 bp, E. coli
gtctctaagtacagaagcaacagct

SEQ ID NO: 123235 - DNA, 25 bp, E. coli
gtctctaagtactgaagcaacagct

SEQ ID NO: 123236 - DNA, 25 bp, E. coli
ggtagcactgctgactgcacagatc

SEQ ID NO: 123237 - DNA, 25 bp, E. coli
ggtagcactgctcactgcacagatc

SEQ ID NO: 123238 - DNA, 25 bp, E. coli
tggtcgtgacgcaaacgacaccggt

SEQ ID NO: 123239 - DNA, 25 bp, E. coli
caaggtggcattggctatctgatcc

SEQ ID NO: 123240 - DNA, 25 bp, E. coli
caaggtggcattcgctatctgatcc

SEQ ID NO: 123241 - DNA, 25 bp, E. coli
catcaaacccataggcgcattcttt

SEQ ID NO: 123242 - DNA, 25 bp, E. coli
catcaaacccattggcgcattcttt

SEQ ID NO: 123243 - DNA, 25 bp, E. coli
tactggctcgcgtaattcacgccga

SEQ ID NO: 123244 - DNA, 25 bp, E. coli
tacgcaaggtgggattggctatctg

SEQ ID NO: 123245 - DNA, 25 bp, E. coli
tacgcaaggtggcattggctatctg

SEQ ID NO: 123246 - DNA, 25 bp, E. coli
tactggctcgcgaaattcacgccga

SEQ ID NO: 123247 - DNA, 25 bp, E. coli
acgatccggggtttgcccatcccat

SEQ ID NO: 123248 - DNA, 25 bp, E. coli
acgatccggggtatgcccatcccat

SEQ ID NO: 123249 - DNA, 25 bp, E. coli
actggctcgcgatattcacgccgac

SEQ ID NO: 123250 - DNA, 25 bp, E. coli
aactgtgtggcggatacgcaaggtg

SEQ ID NO: 123251 - DNA, 25 bp, E. coli
aactgtgtggcgcatacgcaaggtg

SEQ ID NO: 123252 - DNA, 25 bp, E. coli
actggctcgcgaaattcacgccgac

SEQ ID NO: 123253 - DNA, 25 bp, E. coli
tctaccgcgctagtggctcgcgaaa

SEQ ID NO: 123254 - DNA, 25 bp, E. coli
tctaccgcgctactggctcgcgaaa

SEQ ID NO: 123255 - DNA, 25 bp, E. coli
gcgctactggctcgcgaaattcacg

SEQ ID NO: 123256 - DNA, 25 bp, E. coli
gcgctactggctggcgaaattcacg

SEQ ID NO: 123257 - DNA, 25 bp, E. coli
cggatacgcaaggtggcattggcta

SEQ ID NO: 123258 - DNA, 25 bp, E. coli
cggatacgcaagctggcattggcta

SEQ ID NO: 123259 - DNA, 25 bp, E. coli
tggcattggctaactgatccagcag

SEQ ID NO: 123260 - DNA, 25 bp, E. coli
tggcattggctatctgatccagcag

SEQ ID NO: 123261 - DNA, 25 bp, E. coli
cacccttaatgtctttgcaatctct

SEQ ID NO: 123262 - DNA, 25 bp, E. coli
cagtgccatcttgtttattccagat

SEQ ID NO: 123263 - DNA, 25 bp, E. coli
cagtgccatcttctttattccagat

SEQ ID NO: 123264 - DNA, 25 bp, E. coli
cacccttaatgtgtttgcaatctct

SEQ ID NO: 123265 - DNA, 25 bp, E. coli
agtgccatcttcattattccagata

SEQ ID NO: 123266 - DNA, 25 bp, E. coli
agtgccatcttctttattccagata

SEQ ID NO: 123267 - DNA, 25 bp, E. coli
ttgcaatctctttataaattcagtg

SEQ ID NO: 123268 - DNA, 25 bp, E. coli
ttgcaatctcttaataaattcagtg

SEQ ID NO: 123269 - DNA, 25 bp, E. coli
ttcagtgccatcttctttattccag

SEQ ID NO: 123270 - DNA, 25 bp, E. coli
ttcagtgccatcatctttattccag

SEQ ID NO: 123271 - DNA, 25 bp, E. coli
tcagtgccatcttctttattccaga

SEQ ID NO: 123272 - DNA, 25 bp, E. coli
tcagtgccatctactttattccaga

SEQ ID NO: 123273 - DNA, 25 bp, E. coli
gccatcttctttattccagatatta

SEQ ID NO: 123274 - DNA, 25 bp, E. coli
gccatcttcttttttccagatatta

SEQ ID NO: 123275 - DNA, 25 bp, E. coli
cccttaatgtctttgcaatctctta

SEQ ID NO: 123276 - DNA, 25 bp, E. coli
cccttaatgtctatgcaatctctta

SEQ ID NO: 123277 - DNA, 25 bp, E. coli
gtctttgcaatctcttaataaattc

SEQ ID NO: 123278 - DNA, 25 bp, E. coli
gtctttgcaatcacttaataaattc

SEQ ID NO: 123279 - DNA, 25 bp, E. coli
taataaattcagagccatcttcttt

SEQ ID NO: 123280 - DNA, 25 bp, E. coli
taatgtctttgctatctcttaataa

SEQ ID NO: 123281 - DNA, 25 bp, E. coli
taataaattcagtgccatcttcttt

SEQ ID NO: 123282 - DNA, 25 bp, E. coli
taatgtctttgcaatctcttaataa

SEQ ID NO: 123283 - DNA, 25 bp, E. coli
caaagagatgcagcacgtcagcgta

SEQ ID NO: 123284 - DNA, 25 bp, E. coli
caaagagatgcaccacgtcagcgta

SEQ ID NO: 123285 - DNA, 25 bp, E. coli
cagttgggccaaaaccgcttatccg

SEQ ID NO: 123286 - DNA, 25 bp, E. coli
cagttgggccaataccgcttatccg

SEQ ID NO: 123287 - DNA, 25 bp, E. coli
agaggcggcacgtcagcgtattcag

SEQ ID NO: 123288 - DNA, 25 bp, E. coli
agaggcggcacgacagcgtattcag

SEQ ID NO: 123289 - DNA, 25 bp, E. coli
ttgaataatgaggaacggtcagcgg

SEQ ID NO: 123290 - DNA, 25 bp, E. coli
ttgaataatgagcaacggtcagcgg

SEQ ID NO: 123291 - DNA, 25 bp, E. coli
tgagccagccaaaccggatgtggtt

SEQ ID NO: 123292 - DNA, 25 bp, E. coli
tgagccagccaatccggatgtggtt

SEQ ID NO: 123293 - DNA, 25 bp, E. coli
gcagcgtcaggtttttcgagagaaa

SEQ ID NO: 123294 - DNA, 25 bp, E. coli
gcagcgtcaggtatttcgagagaaa

SEQ ID NO: 123295 - DNA, 25 bp, E. coli
gaagcgcaatcgacacaacagactg

SEQ ID NO: 123296 - DNA, 25 bp, E. coli
gaagcgcaatcgtcacaacagactg

SEQ ID NO: 123297 - DNA, 25 bp, E. coli
gacagtaatagcgattgagccagcc

SEQ ID NO: 123298 - DNA, 25 bp, E. coli
gacagtaatagccattgagccagcc

SEQ ID NO: 123299 - DNA, 25 bp, E. coli
gatcaatgggttgcacctgtcgcgc

SEQ ID NO: 123300 - DNA, 25 bp, E. coli
gatcaatgggttccacctgtcgcgc

SEQ ID NO: 123301 - DNA, 25 bp, E. coli
gtcgtaccggtaaatcagcccgcca

SEQ ID NO: 123302 - DNA, 25 bp, E. coli
gtcgtaccggtatatcagcccgcca

SEQ ID NO: 123303 - DNA, 25 bp, E. coli
ggcacaatccgatttaccgcgatgg

SEQ ID NO: 123304 - DNA, 25 bp, E. coli
ggcacaatccgaattaccgcgatgg

SEQ ID NO: 123305 - DNA, 25 bp, E. coli
caatacttcccatatcatctggaga

SEQ ID NO: 123306 - DNA, 25 bp, E. coli
caatacttcccaaatcatctggaga

SEQ ID NO: 123307 - DNA, 25 bp, E. coli
cacgtatggagtgtgatattgaggt

SEQ ID NO: 123308 - DNA, 25 bp, E. coli
cacgtatggagtctgatattgaggt

SEQ ID NO: 123309 - DNA, 25 bp, E. coli
catctggagaaaccacgtatggagt

SEQ ID NO: 123310 - DNA, 25 bp, E. coli
catctggagaaagcacgtatggagt

SEQ ID NO: 123311 - DNA, 25 bp, E. coli
agaatgtaattcatttgaagagaca

SEQ ID NO: 123312 - DNA, 25 bp, E. coli
agaatgtaattcttttgaagagaca

SEQ ID NO: 123313 - DNA, 25 bp, E. coli
tgtgatattgagcttgtctctgcga

SEQ ID NO: 123314 - DNA, 25 bp, E. coli
tgtgatattgaggttgtctctgcga

SEQ ID NO: 123315 - DNA, 25 bp, E. coli
tgcctgagactagtaagctgtttaa

SEQ ID NO: 123316 - DNA, 25 bp, E. coli
tgcctgagactactaagctgtttaa

SEQ ID NO: 123317 - DNA, 25 bp, E. coli
gcgatatatagctataaagaattac

SEQ ID NO: 123318 - DNA, 25 bp, E. coli
gcgatatatagcaataaagaattac

SEQ ID NO: 123319 - DNA, 25 bp, E. coli
gaagagacatttttatatcatggac

SEQ ID NO: 123320 - DNA, 25 bp, E. coli
gaagagacatttatatatcatggac

SEQ ID NO: 123321 - DNA, 25 bp, E. coli
ctaagctgtttaattgtggcgataa

SEQ ID NO: 123322 - DNA, 25 bp, E. coli
ctaagctgtttatttgtggcgataa

SEQ ID NO: 123323 - DNA, 25 bp, E. coli
gaggttgtctctccgatatatagca

SEQ ID NO: 123324 - DNA, 25 bp, E. coli
gataaaagaaatacaatacttccca

SEQ ID NO: 123325 - DNA, 25 bp, E. coli
gaggttgtctctgcgatatatagca

SEQ ID NO: 123326 - DNA, 25 bp, E. coli
gataaaagaaattcaatacttccca

SEQ ID NO: 123327 - DNA, 25 bp, E. coli
cacagtcataagtagcgcatgcgga

SEQ ID NO: 123328 - DNA, 25 bp, E. coli
cacacgcaagcgtccaaatttcaaa

SEQ ID NO: 123329 - DNA, 25 bp, E. coli
caaatggtcttatgccgtgcgcaca

SEQ ID NO: 123330 - DNA, 25 bp, E. coli
caaatttcaaatcgtcttatgccgt

SEQ ID NO: 123331 - DNA, 25 bp, E. coli
cacacgcaagcgaccaaatttcaaa

SEQ ID NO: 123332 - DNA, 25 bp, E. coli
cacagtcataagaagcgcatgcgga

SEQ ID NO: 123333 - DNA, 25 bp, E. coli
caaatggtcttaagccgtgcgcaca

SEQ ID NO: 123334 - DNA, 25 bp, E. coli
caaatttcaaatggtcttatgccgt

SEQ ID NO: 123335 - DNA, 25 bp, E. coli
taaaggcgttttaatgccagtctgc

SEQ ID NO: 123336 - DNA, 25 bp, E. coli
taaaggcgtttttatgccagtctgc

SEQ ID NO: 123337 - DNA, 25 bp, E. coli
tgccgtgcgcactgtcataagaagc

SEQ ID NO: 123338 - DNA, 25 bp, E. coli
tgccgtgcgcacagtcataagaagc

SEQ ID NO: 123339 - DNA, 25 bp, E. coli
tcataagaagcgcatgcggaaagtc

SEQ ID NO: 123340 - DNA, 25 bp, E. coli
tcataagaagcggatgcggaaagtc

SEQ ID NO: 123341 - DNA, 25 bp, E. coli
ccagtctgccgggaatacacagtag

SEQ ID NO: 123342 - DNA, 25 bp, E. coli
ccagtctgccggcaatacacagtag

SEQ ID NO: 123343 - DNA, 25 bp, E. coli
cgcatgcggaaactcagaaaatatc

SEQ ID NO: 123344 - DNA, 25 bp, E. coli
cgcatgcggaaagtcagaaaatatc

SEQ ID NO: 123345 - DNA, 25 bp, E. coli
gtcagaaaatatgttaagacgcaga

SEQ ID NO: 123346 - DNA, 25 bp, E. coli
gtcagaaaatatcttaagacgcaga

SEQ ID NO: 123347 - DNA, 25 bp, E. coli
taagacgcagatattaaaggcgttt

SEQ ID NO: 123348 - DNA, 25 bp, E. coli
taagacgcagattttaaaggcgttt

SEQ ID NO: 123349 - DNA, 25 bp, E. coli
caaggcattcttgcggcgatggcag

SEQ ID NO: 123350 - DNA, 25 bp, E. coli
caaggcattcttccggcgatggcag

SEQ ID NO: 123351 - DNA, 25 bp, E. coli
atcaccgctacggtggcctatctga

SEQ ID NO: 123352 - DNA, 25 bp, E. coli
atcaccgctacgctggcctatctga

SEQ ID NO: 123353 - DNA, 25 bp, E. coli
ttcagcacaaggcattcttccggcg

SEQ ID NO: 123354 - DNA, 25 bp, E. coli
ttcagcacaagggattcttccggcg

SEQ ID NO: 123355 - DNA, 25 bp, E. coli
tcttccggcgatggcagtctacgct

SEQ ID NO: 123356 - DNA, 25 bp, E. coli
tcttccggcgatcgcagtctacgct

SEQ ID NO: 123357 - DNA, 25 bp, E. coli
gctggcctatctgatcattatgccg

SEQ ID NO: 123358 - DNA, 25 bp, E. coli
gctacgctggccaatctgatcatta

SEQ ID NO: 123359 - DNA, 25 bp, E. coli
gctggcctatctcatcattatgccg

SEQ ID NO: 123360 - DNA, 25 bp, E. coli
gctacgctggcctatctgatcatta

SEQ ID NO: 123361 - DNA, 25 bp, E. coli
gaaccgttgatttatggcgtcaccc

SEQ ID NO: 123362 - DNA, 25 bp, E. coli
gaaccgttgattaatggcgtcaccc

SEQ ID NO: 123363 - DNA, 25 bp, E. coli
ccgttgatttatcgcgtcaccctgc

SEQ ID NO: 123364 - DNA, 25 bp, E. coli
ccgttgatttatggcgtcaccctgc

SEQ ID NO: 123365 - DNA, 25 bp, E. coli
cgtcaatggcgctattattgccgca

SEQ ID NO: 123366 - DNA, 25 bp, E. coli
cgtcaatggcgcaattattgccgca

SEQ ID NO: 123367 - DNA, 25 bp, E. coli
gggcgttggcgaaccgttgatttat

SEQ ID NO: 123368 - DNA, 25 bp, E. coli
gggcgttggcgatccgttgatttat

SEQ ID NO: 123369 - DNA, 25 bp, E. coli
tggcagtctacgctggcgggattct

SEQ ID NO: 123370 - DNA, 25 bp, E. coli
tggcagtctacggtggcgggattct

SEQ ID NO: 123371 - DNA, 25 bp, E. coli
caaatggagatgtcagaaactgggc

SEQ ID NO: 123372 - DNA, 25 bp, E. coli
caaatggagatgacagaaactgggc

SEQ ID NO: 123373 - DNA, 25 bp, E. coli
tataacttccgcaattgataagctg

SEQ ID NO: 123374 - DNA, 25 bp, E. coli
tataacttccgctattgataagctg

SEQ ID NO: 123375 - DNA, 25 bp, E. coli
tattgaagcaattatcggactttcc

SEQ ID NO: 123376 - DNA, 25 bp, E. coli
tattgaagcaataatcggactttcc

SEQ ID NO: 123377 - DNA, 25 bp, E. coli
tgatatcattgatgctgcgggtgaa

SEQ ID NO: 123378 - DNA, 25 bp, E. coli
tgatatcattgaagctgcgggtgaa

SEQ ID NO: 123379 - DNA, 25 bp, E. coli
tcgagtcaacggctcagcgatgcaa

SEQ ID NO: 123380 - DNA, 25 bp, E. coli
tcgagtcaacgggtcagcgatgcaa

SEQ ID NO: 123381 - DNA, 25 bp, E. coli
tcagcgatgcaagaaaaacccaatt

SEQ ID NO: 123382 - DNA, 25 bp, E. coli
tcagcgatgcaacaaaaacccaatt

SEQ ID NO: 123383 - DNA, 25 bp, E. coli
tcaggataaaaaagaggaagtccgt

SEQ ID NO: 123384 - DNA, 25 bp, E. coli
tcaggataaaaatgaggaagtccgt

SEQ ID NO: 123385 - DNA, 25 bp, E. coli
gaaactgggccggatttgcaataaa

SEQ ID NO: 123386 - DNA, 25 bp, E. coli
gactaatgtcagacgtgctacagca

SEQ ID NO: 123387 - DNA, 25 bp, E. coli
gactaatgtcagtcgtgctacagca

SEQ ID NO: 123388 - DNA, 25 bp, E. coli
gaaactgggccgcatttgcaataaa

SEQ ID NO: 123389 - DNA, 25 bp, E. coli
ggtgaattaggtgataaaacgctac

SEQ ID NO: 123390 - DNA, 25 bp, E. coli
ggtgaattaggtcataaaacgctac

SEQ ID NO: 123391 - DNA, 25 bp, E. coli
ggcaattgagttctgctctgataaa

SEQ ID NO: 123392 - DNA, 25 bp, E. coli
ggcaattgagttgtgctctgataaa

SEQ ID NO: 123393 - DNA, 25 bp, E. coli
caaaatcggctctaccgttcacggg

SEQ ID NO: 123394 - DNA, 25 bp, E. coli
caaaatcggctcaaccgttcacggg

SEQ ID NO: 123395 - DNA, 25 bp, E. coli
cagtcatgggatttagtccacgggc

SEQ ID NO: 123396 - DNA, 25 bp, E. coli
catggattgctgaactgcctctgaa

SEQ ID NO: 123397 - DNA, 25 bp, E. coli
catggattgctgtactgcctctgaa

SEQ ID NO: 123398 - DNA, 25 bp, E. coli
cagtcatgggatatagtccacgggc

SEQ ID NO: 123399 - DNA, 25 bp, E. coli
taaatcgcaatttctggagagactg

SEQ ID NO: 123400 - DNA, 25 bp, E. coli
taaatcgcaattactggagagactg

SEQ ID NO: 123401 - DNA, 25 bp, E. coli
ttttgagcaaggtgagcgattcagc

SEQ ID NO: 123402 - DNA, 25 bp, E. coli
ttttgagcaaggagagcgattcagc

SEQ ID NO: 123403 - DNA, 25 bp, E. coli
tcacgtcgctttttaaccagggatg

SEQ ID NO: 123404 - DNA, 25 bp, E. coli
tcacgtcgctttataaccagggatg

SEQ ID NO: 123405 - DNA, 25 bp, E. coli
tcagctaagctggacgcatggattg

SEQ ID NO: 123406 - DNA, 25 bp, E. coli
gcatttgtaaaagtcaggcctggaa

SEQ ID NO: 123407 - DNA, 25 bp, E. coli
gcatttgtaaaactcaggcctggaa

SEQ ID NO: 123408 - DNA, 25 bp, E. coli
gaagcgttctgcaacaaaatgacgg

SEQ ID NO: 123409 - DNA, 25 bp, E. coli
gaagcgttctgctacaaaatgacgg

SEQ ID NO: 123410 - DNA, 25 bp, E. coli
gattaatacgcttcgccgaatgagc

SEQ ID NO: 123411 - DNA, 25 bp, E. coli
gattaatacgctacgccgaatgagc

SEQ ID NO: 123412 - DNA, 25 bp, E. coli
ggaaaaatacctgatgcccgcagca

SEQ ID NO: 123413 - DNA, 25 bp, E. coli
ggaaaaatacctcatgcccgcagca

SEQ ID NO: 123414 - DNA, 25 bp, E. coli
tcagctaagctgcacgcatggattg

SEQ ID NO: 123415 - DNA, 25 bp, E. coli
caatctgaccgaaattaacgccgcg

SEQ ID NO: 123416 - DNA, 25 bp, E. coli
caatctgaccgatattaacgccgcg

SEQ ID NO: 123417 - DNA, 25 bp, E. coli
caatatcagcaagcactggcagctc

SEQ ID NO: 123418 - DNA, 25 bp, E. coli
caatatcagcaaccactggcagctc

SEQ ID NO: 123419 - DNA, 25 bp, E. coli
caacgccggtaaaggtggatgtcga

SEQ ID NO: 123420 - DNA, 25 bp, E. coli
caacgccggtaatggtggatgtcga

SEQ ID NO: 123421 - DNA, 25 bp, E. coli
cagttatcgaagatgctgcccatgc

SEQ ID NO: 123422 - DNA, 25 bp, E. coli
cagttatcgaagttgctgcccatgc

SEQ ID NO: 123423 - DNA, 25 bp, E. coli
tacaaagggcgagatattggcgcaa

SEQ ID NO: 123424 - DNA, 25 bp, E. coli
tacaaagggcgacatattggcgcaa

SEQ ID NO: 123425 - DNA, 25 bp, E. coli
aacaacgttgtgctatcagtcgcga

SEQ ID NO: 123426 - DNA, 25 bp, E. coli
aacaacgttgtggtatcagtcgcga

SEQ ID NO: 123427 - DNA, 25 bp, E. coli
tcagcatgccatcgcggtcagttca

SEQ ID NO: 123428 - DNA, 25 bp, E. coli
tcagcatgccatggcggtcagttca

SEQ ID NO: 123429 - DNA, 25 bp, E. coli
gccgcgattgccgtgacacagttag

SEQ ID NO: 123430 - DNA, 25 bp, E. coli
gccgcgattgccctgacacagttag

SEQ ID NO: 123431 - DNA, 25 bp, E. coli
gaacgttacggcttcgcagttatcg

SEQ ID NO: 123432 - DNA, 25 bp, E. coli
gaacgttacggcatcgcagttatcg

SEQ ID NO: 123433 - DNA, 25 bp, E. coli
gatacgctgatggtcacgcctgaag

SEQ ID NO: 123434 - DNA, 25 bp, E. coli
gatacgctgatgctcacgcctgaag

SEQ ID NO: 123435 - DNA, 25 bp, E. coli
gtgattacgcctaccctgacctggg

SEQ ID NO: 123436 - DNA, 25 bp, E. coli
gtgattacgccttccctgacctggg

SEQ ID NO: 123437 - DNA, 25 bp, E. coli
tattacaccaactgcgaattatcgc

SEQ ID NO: 123438 - DNA, 25 bp, E. coli
tattacaccaacagcgaattatcgc

SEQ ID NO: 123439 - DNA, 25 bp, E. coli
ttgaggcattttcccgacatcgtag

SEQ ID NO: 123440 - DNA, 25 bp, E. coli
ttgaggcattttgccgacatcgtag

SEQ ID NO: 123441 - DNA, 25 bp, E. coli
tcacggtaattgactggttgcgctt

SEQ ID NO: 123442 - DNA, 25 bp, E. coli
tcttatttaggcattgcatttggca

SEQ ID NO: 123443 - DNA, 25 bp, E. coli
tcacggtaattgtctggttgcgctt

SEQ ID NO: 123444 - DNA, 25 bp, E. coli
tcttatttaggctttgcatttggca

SEQ ID NO: 123445 - DNA, 25 bp, E. coli
gccatttggagcgaaattttaagga

SEQ ID NO: 123446 - DNA, 25 bp, E. coli
gccatttggagccaaattttaagga

SEQ ID NO: 123447 - DNA, 25 bp, E. coli
gcatttggcaaaattttgaggcatt

SEQ ID NO: 123448 - DNA, 25 bp, E. coli
gaattatcgccagaaatgtagctca

SEQ ID NO: 123449 - DNA, 25 bp, E. coli
gaattatcgccacaaatgtagctca

SEQ ID NO: 123450 - DNA, 25 bp, E. coli
gcatttggcaaatttttgaggcatt

SEQ ID NO: 123451 - DNA, 25 bp, E. coli
gaaatgtagctcaatttcacggtaa

SEQ ID NO: 123452 - DNA, 25 bp, E. coli
gaaatgtagctctatttcacggtaa

SEQ ID NO: 123453 - DNA, 25 bp, E. coli
ctggttgcgcttgtctataggtgga

SEQ ID NO: 123454 - DNA, 25 bp, E. coli
ctggttgcgcttctctataggtgga

SEQ ID NO: 123455 - DNA, 25 bp, E. coli
tgccgacatcgttggatttttaata

SEQ ID NO: 123456 - DNA, 25 bp, E. coli
tgccgacatcgtaggatttttaata

SEQ ID NO: 123457 - DNA, 25 bp, E. coli
tgtgtatattttcccatttggagcg

SEQ ID NO: 123458 - DNA, 25 bp, E. coli
tgtgtatattttgccatttggagcg

SEQ ID NO: 123459 - DNA, 25 bp, E. coli
cagggtgtaccttcttttatgcagg

SEQ ID NO: 123460 - DNA, 25 bp, E. coli
cagggtgtacctacttttatgcagg

SEQ ID NO: 123461 - DNA, 25 bp, E. coli
aaagtacaacgcgtatcgatatggc

SEQ ID NO: 123462 - DNA, 25 bp, E. coli
aaagtacaacgcctatcgatatggc

SEQ ID NO: 123463 - DNA, 25 bp, E. coli
tgctggtttaccgatccccaaaagt

SEQ ID NO: 123464 - DNA, 25 bp, E. coli
tgctggtttacccatccccaaaagt

SEQ ID NO: 123465 - DNA, 25 bp, E. coli
tgaaattcgttagaccacgcatgaa

SEQ ID NO: 123466 - DNA, 25 bp, E. coli
tgaaattcgttacaccacgcatgaa

SEQ ID NO: 123467 - DNA, 25 bp, E. coli
tcgatatggcattaacccagggtgt

SEQ ID NO: 123468 - DNA, 25 bp, E. coli
tcgatatggcataaacccagggtgt

SEQ ID NO: 123469 - DNA, 25 bp, E. coli
gaatatcattctctgtgctggcgtg

SEQ ID NO: 123470 - DNA, 25 bp, E. coli
gaatatcattctgtgtgctggcgtg

SEQ ID NO: 123471 - DNA, 25 bp, E. coli
gaaagtcaggcgctaattcgcagcg

SEQ ID NO: 123472 - DNA, 25 bp, E. coli
gaacaattcaaagaacaaaccgcag

SEQ ID NO: 123473 - DNA, 25 bp, E. coli
gaacaattcaaacaacaaaccgcag

SEQ ID NO: 123474 - DNA, 25 bp, E. coli
gaaagtcaggcggtaattcgcagcg

SEQ ID NO: 123475 - DNA, 25 bp, E. coli
taattcgcagcggagaatgttctcc

SEQ ID NO: 123476 - DNA, 25 bp, E. coli
taatccgcaactccacgaaacgttg

SEQ ID NO: 123477 - DNA, 25 bp, E. coli
taatccgcaactgcacgaaacgttg

SEQ ID NO: 123478 - DNA, 25 bp, E. coli
tcacaaatgaaaagcaggtcgaggc

SEQ ID NO: 123479 - DNA, 25 bp, E. coli
tcacaaatgaaatgcaggtcgaggc

SEQ ID NO: 123480 - DNA, 25 bp, E. coli
taattcgcagcgcagaatgttctcc

SEQ ID NO: 123481 - DNA, 25 bp, E. coli
cagcacgttcggcaaatatgtcggc

SEQ ID NO: 123482 - DNA, 25 bp, E. coli
catcaacgatgtggctgagcacgtc

SEQ ID NO: 123483 - DNA, 25 bp, E. coli
cagatacgtttaagtgcagcagcga

SEQ ID NO: 123484 - DNA, 25 bp, E. coli
cagcacgttcgggaaatatgtcggc

SEQ ID NO: 123485 - DNA, 25 bp, E. coli
catcaacgatgtcgctgagcacgtc

SEQ ID NO: 123486 - DNA, 25 bp, E. coli
catatcacgctgatctgggcctgta

SEQ ID NO: 123487 - DNA, 25 bp, E. coli
catatcacgctgttctgggcctgta

SEQ ID NO: 123488 - DNA, 25 bp, E. coli
cagatacgtttatgtgcagcagcga

SEQ ID NO: 123489 - DNA, 25 bp, E. coli
agtattctcgatattgccctgacgg

SEQ ID NO: 123490 - DNA, 25 bp, E. coli
agtattctcgattttgccctgacgg

SEQ ID NO: 123491 - DNA, 25 bp, E. coli
aacttagcccgtttgaagtgcgccg

SEQ ID NO: 123492 - DNA, 25 bp, E. coli
aaattcgccagctcgccattgatga

SEQ ID NO: 123493 - DNA, 25 bp, E. coli
aacttagcccgtatgaagtgcgccg

SEQ ID NO: 123494 - DNA, 25 bp, E. coli
aaattcgccagcacgccattgatga

SEQ ID NO: 123495 - DNA, 25 bp, E. coli
gccgctggcagctggaattaaacag

SEQ ID NO: 123496 - DNA, 25 bp, E. coli
gcctctctggctgggaaccgattct

SEQ ID NO: 123497 - DNA, 25 bp, E. coli
gccgctggcagcaggaattaaacag

SEQ ID NO: 123498 - DNA, 25 bp, E. coli
gcctctctggctcggaaccgattct

SEQ ID NO: 123499 - DNA, 25 bp, E. coli
gcgcgttactgaccgataccgataa

SEQ ID NO: 123500 - DNA, 25 bp, E. coli
gcgcgttactgagcgataccgataa

SEQ ID NO: 123501 - DNA, 25 bp, E. coli
gatgcatctgtttctctcctggccg

SEQ ID NO: 123502 - DNA, 25 bp, E. coli
gatgcatctgttactctcctggccg

SEQ ID NO: 123503 - DNA, 25 bp, E. coli
cagcttgaaggatgtgaaaatcgga

SEQ ID NO: 123504 - DNA, 25 bp, E. coli
cagcttgaaggaagtgaaaatcgga

SEQ ID NO: 123505 - DNA, 25 bp, E. coli
caggaactctatgaaaatttaatgg

SEQ ID NO: 123506 - DNA, 25 bp, E. coli
caggaactctatcaaaatttaatgg

SEQ ID NO: 123507 - DNA, 25 bp, E. coli
taccctgagttaaaatctcaggaac

SEQ ID NO: 123508 - DNA, 25 bp, E. coli
taaaatctcaggtactctatcaaaa

SEQ ID NO: 123509 - DNA, 25 bp, E. coli
taaaatctcaggaactctatcaaaa

SEQ ID NO: 123510 - DNA, 25 bp, E. coli
taccctgagttataatctcaggaac

SEQ ID NO: 123511 - DNA, 25 bp, E. coli
tgaaggaagtgataatcggattgcc

SEQ ID NO: 123512 - DNA, 25 bp, E. coli
tgaaggaagtgaaaatcggattgcc

SEQ ID NO: 123513 - DNA, 25 bp, E. coli
gcttgaaggaagtgaaaatcggatt

SEQ ID NO: 123514 - DNA, 25 bp, E. coli
gcttgaaggaagagaaaatcggatt

SEQ ID NO: 123515 - DNA, 25 bp, E. coli
gcgttaccctgagttaaaatctcag

SEQ ID NO: 123516 - DNA, 25 bp, E. coli
gcgttaccctgacttaaaatctcag

SEQ ID NO: 123517 - DNA, 25 bp, E. coli
gtgagcgttaccctgagttaaaatc

SEQ ID NO: 123518 - DNA, 25 bp, E. coli
gtgagcgttaccgtgagttaaaatc

SEQ ID NO: 123519 - DNA, 25 bp, E. coli
ggaactctatcaaaatttaatggta

SEQ ID NO: 123520 - DNA, 25 bp, E. coli
ggaactctatcataatttaatggta

SEQ ID NO: 123521 - DNA, 25 bp, E. coli
gagttaaaatctgaggaactctatc

SEQ ID NO: 123522 - DNA, 25 bp, E. coli
gagttaaaatctcaggaactctatc

SEQ ID NO: 123523 - DNA, 25 bp, E. coli
gagcgttaccctgagttaaaatctc

SEQ ID NO: 123524 - DNA, 25 bp, E. coli
gagcgttaccctcagttaaaatctc

SEQ ID NO: 123525 - DNA, 25 bp, E. coli
caaactgaagagtgatagcctgccc

SEQ ID NO: 123526 - DNA, 25 bp, E. coli
caaactgaagagagatagcctgccc

SEQ ID NO: 123527 - DNA, 25 bp, E. coli
tacttagcagcatataaataacgcg

SEQ ID NO: 123528 - DNA, 25 bp, E. coli
tacttagcagcaaataaataacgcg

SEQ ID NO: 123529 - DNA, 25 bp, E. coli
aaattagtctttagcagccgcgcgg

SEQ ID NO: 123530 - DNA, 25 bp, E. coli
aaattagtcttttgcagccgcgcgg

SEQ ID NO: 123531 - DNA, 25 bp, E. coli
tatcaatatgagtattacggcggtg

SEQ ID NO: 123532 - DNA, 25 bp, E. coli
tattttacaaactaccagaagctgg

SEQ ID NO: 123533 - DNA, 25 bp, E. coli
tattttacaaacaaccagaagctgg

SEQ ID NO: 123534 - DNA, 25 bp, E. coli
tatcaatatgagaattacggcggtg

SEQ ID NO: 123535 - DNA, 25 bp, E. coli
tcccaggtataggtgtgaaaacacc

SEQ ID NO: 123536 - DNA, 25 bp, E. coli
tcccaggtatagctgtgaaaacacc

SEQ ID NO: 123537 - DNA, 25 bp, E. coli
ccactaccgggactttatgatgaaa

SEQ ID NO: 123538 - DNA, 25 bp, E. coli
ccactaccgggagtttatgatgaaa

SEQ ID NO: 123539 - DNA, 25 bp, E. coli
gaagacgttgatggttcacagatca

SEQ ID NO: 123540 - DNA, 25 bp, E. coli
gcacacttattgatagtcccaggta

SEQ ID NO: 123541 - DNA, 25 bp, E. coli
gaagacgttgatcgttcacagatca

SEQ ID NO: 123542 - DNA, 25 bp, E. coli
gcacacttattgttagtcccaggta

SEQ ID NO: 123543 - DNA, 25 bp, E. coli
cgcgcggataattctggcacactta

SEQ ID NO: 123544 - DNA, 25 bp, E. coli
cgcgcggataatactggcacactta

SEQ ID NO: 123545 - DNA, 25 bp, E. coli
gatattaactcacgcgaaattggct

SEQ ID NO: 123546 - DNA, 25 bp, E. coli
gatattaactcaggcgaaattggct

SEQ ID NO: 123547 - DNA, 25 bp, E. coli
taaagccagacgtatgggcggcgta

SEQ ID NO: 123548 - DNA, 25 bp, E. coli
taaagccagacgaatgggcggcgta

SEQ ID NO: 123549 - DNA, 25 bp, E. coli
atctgcaagcaggagaacgccgggt

SEQ ID NO: 123550 - DNA, 25 bp, E. coli
atctgcaagcagcagaacgccgggt

SEQ ID NO: 123551 - DNA, 25 bp, E. coli
ttgaagattcactggcggattaccc

SEQ ID NO: 123552 - DNA, 25 bp, E. coli
ttgaagattcacaggcggattaccc

SEQ ID NO: 123553 - DNA, 25 bp, E. coli
tgaacgcgatcacccgactattgct

SEQ ID NO: 123554 - DNA, 25 bp, E. coli
tgaacgcgatcagccgactattgct

SEQ ID NO: 123555 - DNA, 25 bp, E. coli
tgctttcagtaatgcagcaggaagc

SEQ ID NO: 123556 - DNA, 25 bp, E. coli
tgctttcagtaaagcagcaggaagc

SEQ ID NO: 123557 - DNA, 25 bp, E. coli
tcgctgacgcgcatatgacgcagct

SEQ ID NO: 123558 - DNA, 25 bp, E. coli
tcgctgacgcgcttatgacgcagct

SEQ ID NO: 123559 - DNA, 25 bp, E. coli
gcggtcatgcggttgatttcagcga

SEQ ID NO: 123560 - DNA, 25 bp, E. coli
gcggtcatgcggatgatttcagcga

SEQ ID NO: 123561 - DNA, 25 bp, E. coli
cgtgaatacgccagaggagcttgcc

SEQ ID NO: 123562 - DNA, 25 bp, E. coli
ctcacgtcgtggttaatgctaatcg

SEQ ID NO: 123563 - DNA, 25 bp, E. coli
cgtgaatacgcctgaggagcttgcc

SEQ ID NO: 123564 - DNA, 25 bp, E. coli
ctcacgtcgtggataatgctaatcg

SEQ ID NO: 123565 - DNA, 25 bp, E. coli
ggagcttgcccgatggcaggaaaaa

SEQ ID NO: 123566 - DNA, 25 bp, E. coli
ggagcttgcccgttggcaggaaaaa

SEQ ID NO: 123567 - DNA, 25 bp, E. coli
taatcgtcatcaggaaatctatcag

SEQ ID NO: 123568 - DNA, 25 bp, E. coli
taatcgtcatcacgaaatctatcag

SEQ ID NO: 123569 - DNA, 25 bp, E. coli
cactgatttcgataagcggagccaa

SEQ ID NO: 123570 - DNA, 25 bp, E. coli
cactgatttcgaaaagcggagccaa

SEQ ID NO: 123571 - DNA, 25 bp, E. coli
tatgaacgccggtaagcggctggtt

SEQ ID NO: 123572 - DNA, 25 bp, E. coli
tatgaacgccggaaagcggctggtt

SEQ ID NO: 123573 - DNA, 25 bp, E. coli
ttagtaacggccagagcgttccgcc

SEQ ID NO: 123574 - DNA, 25 bp, E. coli
ttagtaacggcctgagcgttccgcc

SEQ ID NO: 123575 - DNA, 25 bp, E. coli
ttgtggcactgatttcgaaaagcgg

SEQ ID NO: 123576 - DNA, 25 bp, E. coli
ttgtggcactgaattcgaaaagcgg

SEQ ID NO: 123577 - DNA, 25 bp, E. coli
tcagcctgtgctgtatcacatttgc

SEQ ID NO: 123578 - DNA, 25 bp, E. coli
tcagcctgtgctctatcacatttgc

SEQ ID NO: 123579 - DNA, 25 bp, E. coli
ccattcggtctgacggtggatgctg

SEQ ID NO: 123580 - DNA, 25 bp, E. coli
ccattcggtctgtcggtggatgctg

SEQ ID NO: 123581 - DNA, 25 bp, E. coli
gaaaagcggagcgaatccattcggt

SEQ ID NO: 123582 - DNA, 25 bp, E. coli
gaaaagcggagccaatccattcggt

SEQ ID NO: 123583 - DNA, 25 bp, E. coli
ggaagtgataagaacccgtggtctc

SEQ ID NO: 123584 - DNA, 25 bp, E. coli
ggaagtgataagtacccgtggtctc

SEQ ID NO: 123585 - DNA, 25 bp, E. coli
ggcaaagcatgttagtaacggcctg

SEQ ID NO: 123586 - DNA, 25 bp, E. coli
ggcaaagcatgtaagtaacggcctg

SEQ ID NO: 123587 - DNA, 25 bp, E. coli
taagtacccgtgctctcagcctgtg

SEQ ID NO: 123588 - DNA, 25 bp, E. coli
taagtacccgtggtctcagcctgtg

SEQ ID NO: 123589 - DNA, 25 bp, E. coli
gagccaatccattcggtctgacggt

SEQ ID NO: 123590 - DNA, 25 bp, E. coli
gagccaatccatacggtctgacggt

SEQ ID NO: 123591 - DNA, 25 bp, E. coli
cagggtactgcgctgctaaatctgt

SEQ ID NO: 123592 - DNA, 25 bp, E. coli
cagggtactgcggtgctaaatctgt

SEQ ID NO: 123593 - DNA, 25 bp, E. coli
taaatctgttttatcccgatcacga

SEQ ID NO: 123594 - DNA, 25 bp, E. coli
taaatctgttttttcccgatcacga

SEQ ID NO: 123595 - DNA, 25 bp, E. coli
agagtactgagtatcatcctgtcca

SEQ ID NO: 123596 - DNA, 25 bp, E. coli
acctgggtgctgattgtcattgccg

SEQ ID NO: 123597 - DNA, 25 bp, E. coli
acctgggtgctgtttgtcattgccg

SEQ ID NO: 123598 - DNA, 25 bp, E. coli
agagtactgagtttcatcctgtcca

SEQ ID NO: 123599 - DNA, 25 bp, E. coli
tgtgctattgcttcaggcgcgaacc

SEQ ID NO: 123600 - DNA, 25 bp, E. coli
tgtgctattgctacaggcgcgaacc

SEQ ID NO: 123601 - DNA, 25 bp, E. coli
tgctgaccaatccacgtttacgcgc

SEQ ID NO: 123602 - DNA, 25 bp, E. coli
tgctgaccaatcgacgtttacgcgc

SEQ ID NO: 123603 - DNA, 25 bp, E. coli
tccgttagcggtatcggtctggcgc

SEQ ID NO: 123604 - DNA, 25 bp, E. coli
tccgttagcggtttcggtctggcgc

SEQ ID NO: 123605 - DNA, 25 bp, E. coli
ccgatcacgatattttctggctggg

SEQ ID NO: 123606 - DNA, 25 bp, E. coli
ccgatcacgataatttctggctggg

SEQ ID NO: 123607 - DNA, 25 bp, E. coli
ctgtccattatgatgcgcacggtcg

SEQ ID NO: 123608 - DNA, 25 bp, E. coli
ctctattttctgatgctgttggcgc

SEQ ID NO: 123609 - DNA, 25 bp, E. coli
ctctattttctgttgctgttggcgc

SEQ ID NO: 123610 - DNA, 25 bp, E. coli
ctgtccattatgttgcgcacggtcg

SEQ ID NO: 123611 - DNA, 25 bp, E. coli
tggcgttaatctggctgctgaccaa

SEQ ID NO: 123612 - DNA, 25 bp, E. coli
tggcgttaatctcgctgctgaccaa

SEQ ID NO: 123613 - DNA, 25 bp, E. coli
aagctgcgcgggtaaaagtggcaca

SEQ ID NO: 123614 - DNA, 25 bp, E. coli
aagctgcgcgggaaaaagtggcaca

SEQ ID NO: 123615 - DNA, 25 bp, E. coli
catcggatgacataaatatcgtctg

SEQ ID NO: 123616 - DNA, 25 bp, E. coli
catcggatgacaaaaatatcgtctg

SEQ ID NO: 123617 - DNA, 25 bp, E. coli
aagccgaggagtaccatgaacgttt

SEQ ID NO: 123618 - DNA, 25 bp, E. coli
acaattactgaaagcatcggatgac

SEQ ID NO: 123619 - DNA, 25 bp, E. coli
aagccgaggagttccatgaacgttt

SEQ ID NO: 123620 - DNA, 25 bp, E. coli
acaattactgaatgcatcggatgac

SEQ ID NO: 123621 - DNA, 25 bp, E. coli
tgccagatgtcgtacgtcactggcg

SEQ ID NO: 123622 - DNA, 25 bp, E. coli
tgccagatgtcgaacgtcactggcg

SEQ ID NO: 123623 - DNA, 25 bp, E. coli
gcgttacgaagctgcgcgggaaaaa

SEQ ID NO: 123624 - DNA, 25 bp, E. coli
gcttagcaacgcttgcagaagaagc

SEQ ID NO: 123625 - DNA, 25 bp, E. coli
gcgttacgaagcagcgcgggaaaaa

SEQ ID NO: 123626 - DNA, 25 bp, E. coli
gcttagcaacgcatgcagaagaagc

SEQ ID NO: 123627 - DNA, 25 bp, E. coli
gcaacgcttgcagaagaagcgctgg

SEQ ID NO: 123628 - DNA, 25 bp, E. coli
gcaacgcttgcacaagaagcgctgg

SEQ ID NO: 123629 - DNA, 25 bp, E. coli
cgcgggaaaaagaggcacaattact

SEQ ID NO: 123630 - DNA, 25 bp, E. coli
cgcgggaaaaagtggcacaattact

SEQ ID NO: 123631 - DNA, 25 bp, E. coli
cgttgtgccagaagtcgaacgtcac

SEQ ID NO: 123632 - DNA, 25 bp, E. coli
cgttgtgccagatgtcgaacgtcac

SEQ ID NO: 123633 - DNA, 25 bp, E. coli
gaggagtaccatgaacgtttttaat

SEQ ID NO: 123634 - DNA, 25 bp, E. coli
gaggagtaccatcaacgtttttaat

SEQ ID NO: 123635 - DNA, 25 bp, E. coli
atcttctgcgcctacgcggcatcag

SEQ ID NO: 123636 - DNA, 25 bp, E. coli
atcttctgcgccaacgcggcatcag

SEQ ID NO: 123637 - DNA, 25 bp, E. coli
aaacgtctgacaactattgccaatg

SEQ ID NO: 123638 - DNA, 25 bp, E. coli
aaacgtctgacatctattgccaatg

SEQ ID NO: 123639 - DNA, 25 bp, E. coli
tagcgaatacgctaaacgtctgaca

SEQ ID NO: 123640 - DNA, 25 bp, E. coli
taggcaacaatatcaacggtcagcc

SEQ ID NO: 123641 - DNA, 25 bp, E. coli
tagcgaatacgcaaaacgtctgaca

SEQ ID NO: 123642 - DNA, 25 bp, E. coli
taggcaacaataacaacggtcagcc

SEQ ID NO: 123643 - DNA, 25 bp, E. coli
tattcttacgatcttctgcgccaac

SEQ ID NO: 123644 - DNA, 25 bp, E. coli
tattcttacgatgttctgcgccaac

SEQ ID NO: 123645 - DNA, 25 bp, E. coli
ttctcccagcgccaggaagcagaag

SEQ ID NO: 123646 - DNA, 25 bp, E. coli
ttctcccagcgcgaggaagcagaag

SEQ ID NO: 123647 - DNA, 25 bp, E. coli
tgcgctaggcaagaatatcaacggt

SEQ ID NO: 123648 - DNA, 25 bp, E. coli
tgcgctaggcaacaatatcaacggt

SEQ ID NO: 123649 - DNA, 25 bp, E. coli
gcaggtggcacttggtacaaatgcc

SEQ ID NO: 123650 - DNA, 25 bp, E. coli
gcaggtggcactaggtacaaatgcc

SEQ ID NO: 123651 - DNA, 25 bp, E. coli
gcagaagccgatcattattcttacg

SEQ ID NO: 123652 - DNA, 25 bp, E. coli
gcagaagccgatgattattcttacg

SEQ ID NO: 123653 - DNA, 25 bp, E. coli
gacaactattgccaatgcgctaggc

SEQ ID NO: 123654 - DNA, 25 bp, E. coli
gacaactattgcgaatgcgctaggc

SEQ ID NO: 123655 - DNA, 25 bp, E. coli
cgccaggaagcagaagccgatgatt

SEQ ID NO: 123656 - DNA, 25 bp, E. coli
cgccaggaagcacaagccgatgatt

SEQ ID NO: 123657 - DNA, 25 bp, E. coli
caatgatcggctggaaaggcgtgtc

SEQ ID NO: 123658 - DNA, 25 bp, E. coli
caatgatcggctcgaaaggcgtgtc

SEQ ID NO: 123659 - DNA, 25 bp, E. coli
taaatcgcaggaacgcatggcggcc

SEQ ID NO: 123660 - DNA, 25 bp, E. coli
taaatcgcaggatcgcatggcggcc

SEQ ID NO: 123661 - DNA, 25 bp, E. coli
tatggtggcgatcaaagccgcgacc

SEQ ID NO: 123662 - DNA, 25 bp, E. coli
tatggtggcgatgaaagccgcgacc

SEQ ID NO: 123663 - DNA, 25 bp, E. coli
tatacaacaaagctcgtcaggccag

SEQ ID NO: 123664 - DNA, 25 bp, E. coli
tatacaacaaaggtcgtcaggccag

SEQ ID NO: 123665 - DNA, 25 bp, E. coli
tcgttcttcaactccgtgggcggca

SEQ ID NO: 123666 - DNA, 25 bp, E. coli
tcgttcttcaacaccgtgggcggca

SEQ ID NO: 123667 - DNA, 25 bp, E. coli
tgctggcggaaaagaagacctggac

SEQ ID NO: 123668 - DNA, 25 bp, E. coli
tgctggcggaaatgaagacctggac

SEQ ID NO: 123669 - DNA, 25 bp, E. coli
gacgttaaacgcctgggctacctgg

SEQ ID NO: 123670 - DNA, 25 bp, E. coli
gacgttaaacgcgtgggctacctgg

SEQ ID NO: 123671 - DNA, 25 bp, E. coli
cgaatctcaggtttatcagggcgtg

SEQ ID NO: 123672 - DNA, 25 bp, E. coli
cgaatctcaggtatatcagggcgtg

SEQ ID NO: 123673 - DNA, 25 bp, E. coli
tgtacgaacccgttccgaaggcgtt

SEQ ID NO: 123674 - DNA, 25 bp, E. coli
tgtacgaacccgatccgaaggcgtt

SEQ ID NO: 123675 - DNA, 25 bp, E. coli
tggttgaaaaccaggccagcgagca

SEQ ID NO: 123676 - DNA, 25 bp, E. coli
tggttgaaaacctggccagcgagca

SEQ ID NO: 123677 - DNA, 25 bp, E. coli
taacctgttcaaaaaactgctggcg

SEQ ID NO: 123678 - DNA, 25 bp, E. coli
taacctgttcaataaactgctggcg

SEQ ID NO: 123679 - DNA, 25 bp, E. coli
aatttggcgcgtagctgatcatcga

SEQ ID NO: 123680 - DNA, 25 bp, E. coli
aatttggcgcgttgctgatcatcga

SEQ ID NO: 123681 - DNA, 25 bp, E. coli
tagctggcgcacaggattattacgg

SEQ ID NO: 123682 - DNA, 25 bp, E. coli
tagctggcgcactggattattacgg

SEQ ID NO: 123683 - DNA, 25 bp, E. coli
tattatcgtcgacccggtggcaggc

SEQ ID NO: 123684 - DNA, 25 bp, E. coli
tattatcgtcgagccggtggcaggc

SEQ ID NO: 123685 - DNA, 25 bp, E. coli
tgtttatcgaaaaagcggacggcgc

SEQ ID NO: 123686 - DNA, 25 bp, E. coli
tgtttatcgaaatagcggacggcgc

SEQ ID NO: 123687 - DNA, 25 bp, E. coli
tgaaaatctttagagcgcagcgcgc

SEQ ID NO: 123688 - DNA, 25 bp, E. coli
tgaaaatctttacagcgcagcgcgc

SEQ ID NO: 123689 - DNA, 25 bp, E. coli
tctgtacgatgttgatggcaaagcc

SEQ ID NO: 123690 - DNA, 25 bp, E. coli
tctgtacgatgtagatggcaaagcc

SEQ ID NO: 123691 - DNA, 25 bp, E. coli
tctatcaggcgggtacgctttccgg

SEQ ID NO: 123692 - DNA, 25 bp, E. coli
tctatcaggcggctacgctttccgg

SEQ ID NO: 123693 - DNA, 25 bp, E. coli
gcaatgccgtgattgaagccgccga

SEQ ID NO: 123694 - DNA, 25 bp, E. coli
gcaatgccgtgaatgaagccgccga

SEQ ID NO: 123695 - DNA, 25 bp, E. coli
cgctggatgagcagacaacacgtct

SEQ ID NO: 123696 - DNA, 25 bp, E. coli
cgctggatgagctgacaacacgtct

SEQ ID NO: 123697 - DNA, 25 bp, E. coli
cgtgatgtaatgcatgcgctggccc

SEQ ID NO: 123698 - DNA, 25 bp, E. coli
cgtgatgtaatggatgcgctggccc

SEQ ID NO: 123699 - DNA, 25 bp, E. coli
gatatggtgcgcttggtgaactccg

SEQ ID NO: 123700 - DNA, 25 bp, E. coli
gatatggtgcgcatggtgaactccg

SEQ ID NO: 123701 - DNA, 25 bp, E. coli
agattcccgtctgattgccgccaaa

SEQ ID NO: 123702 - DNA, 25 bp, E. coli
acgtctggatgctgcactgcaggat

SEQ ID NO: 123703 - DNA, 25 bp, E. coli
agattcccgtctcattgccgccaaa

SEQ ID NO: 123704 - DNA, 25 bp, E. coli
acgtctggatgcagcactgcaggat

SEQ ID NO: 123705 - DNA, 25 bp, E. coli
ttccagctatgcggcattgccggag

SEQ ID NO: 123706 - DNA, 25 bp, E. coli
ttccagctatgccgcattgccggag

SEQ ID NO: 123707 - DNA, 25 bp, E. coli
tgctgcactgcaggatgaagttgct

SEQ ID NO: 123708 - DNA, 25 bp, E. coli
tgcactgcaggaagaagttgctgcc

SEQ ID NO: 123709 - DNA, 25 bp, E. coli
tgcactgcaggatgaagttgctgcc

SEQ ID NO: 123710 - DNA, 25 bp, E. coli
tgctgcactgcacgatgaagttgct

SEQ ID NO: 123711 - DNA, 25 bp, E. coli
tcccgtctgattcccgccaaaggtt

SEQ ID NO: 123712 - DNA, 25 bp, E. coli
tcccgtctgattgccgccaaaggtt

SEQ ID NO: 123713 - DNA, 25 bp, E. coli
tcggtatttccggagcggcttccag

SEQ ID NO: 123714 - DNA, 25 bp, E. coli
tcggtatttccgcagcggcttccag

SEQ ID NO: 123715 - DNA, 25 bp, E. coli
ccaaaggtgactatgtcggctttga

SEQ ID NO: 123716 - DNA, 25 bp, E. coli
ccaaaggtgactttgtcggctttga

SEQ ID NO: 123717 - DNA, 25 bp, E. coli
gcagattcccgtctgattgccgcca

SEQ ID NO: 123718 - DNA, 25 bp, E. coli
gcagattcccgtgtgattgccgcca

SEQ ID NO: 123719 - DNA, 25 bp, E. coli
ctgattgccgcctaaggttcgccga

SEQ ID NO: 123720 - DNA, 25 bp, E. coli
ctgattgccgccaaaggttcgccga

SEQ ID NO: 123721 - DNA, 25 bp, E. coli
gttagtcggtatatccgcagcggct

SEQ ID NO: 123722 - DNA, 25 bp, E. coli
gttagtcggtatttccgcagcggct

SEQ ID NO: 123723 - DNA, 25 bp, E. coli
aatatctcttcgctgacctggtcgg

SEQ ID NO: 123724 - DNA, 25 bp, E. coli
aatatctcttcggtgacctggtcgg

SEQ ID NO: 123725 - DNA, 25 bp, E. coli
tactttagatgatgtgtccggcgca

SEQ ID NO: 123726 - DNA, 25 bp, E. coli
tactttagatgaagtgtccggcgca

SEQ ID NO: 123727 - DNA, 25 bp, E. coli
aaatgtcactaaccaaaggcagtcg

SEQ ID NO: 123728 - DNA, 25 bp, E. coli
aaatgtcactaagcaaaggcagtcg

SEQ ID NO: 123729 - DNA, 25 bp, E. coli
aaaatacgcttcaggtgctgtctca

SEQ ID NO: 123730 - DNA, 25 bp, E. coli
aaaatacgcttctggtgctgtctca

SEQ ID NO: 123731 - DNA, 25 bp, E. coli
ttgtcgcataacttcaaacaggccg

SEQ ID NO: 123732 - DNA, 25 bp, E. coli
ttgtcgcataacatcaaacaggccg

SEQ ID NO: 123733 - DNA, 25 bp, E. coli
tgatttcactgagcccaaactcgga

SEQ ID NO: 123734 - DNA, 25 bp, E. coli
tgatttcactgaccccaaactcgga

SEQ ID NO: 123735 - DNA, 25 bp, E. coli
tgaggtctacaatgttaacgggctg

SEQ ID NO: 123736 - DNA, 25 bp, E. coli
tgaggtctacaaagttaacgggctg

SEQ ID NO: 123737 - DNA, 25 bp, E. coli
tgcgcccgtaaaagcaatcatgcag

SEQ ID NO: 123738 - DNA, 25 bp, E. coli
tgcgcccgtaaatgcaatcatgcag

SEQ ID NO: 123739 - DNA, 25 bp, E. coli
cctggtcggcacaaagcaatactct

SEQ ID NO: 123740 - DNA, 25 bp, E. coli
cctggtcggcactaagcaatactct

SEQ ID NO: 123741 - DNA, 25 bp, E. coli
gaatctcgcgcactccaggaagtaa

SEQ ID NO: 123742 - DNA, 25 bp, E. coli
gaatctcgcgcagtccaggaagtaa

SEQ ID NO: 123743 - DNA, 25 bp, E. coli
cattgacggcaatgaaattgcaggc

SEQ ID NO: 123744 - DNA, 25 bp, E. coli
cattgacggcaaagaaattgcaggc

SEQ ID NO: 123745 - DNA, 25 bp, E. coli
cacttagaagtgtgtatgagtaccc

SEQ ID NO: 123746 - DNA, 25 bp, E. coli
cacttagaagtgagtatgagtaccc

SEQ ID NO: 123747 - DNA, 25 bp, E. coli
taacacaagagctgcttgaggacgc

SEQ ID NO: 123748 - DNA, 25 bp, E. coli
tataacgccgcattgcttgcaaaaa

SEQ ID NO: 123749 - DNA, 25 bp, E. coli
tataacgccgcaatgcttgcaaaaa

SEQ ID NO: 123750 - DNA, 25 bp, E. coli
tgttcaggccgggatgttctcgcct

SEQ ID NO: 123751 - DNA, 25 bp, E. coli
tgttcaggccggcatgttctcgcct

SEQ ID NO: 123752 - DNA, 25 bp, E. coli
tgcaaaaattctgaacgttagcgtt

SEQ ID NO: 123753 - DNA, 25 bp, E. coli
tgcaaaaattctcaacgttagcgtt

SEQ ID NO: 123754 - DNA, 25 bp, E. coli
gcctgagcttagtacctttaccaaa

SEQ ID NO: 123755 - DNA, 25 bp, E. coli
gcctgagcttagaacctttaccaaa

SEQ ID NO: 123756 - DNA, 25 bp, E. coli
gcttatcccaggtatctgtcgcaga

SEQ ID NO: 123757 - DNA, 25 bp, E. coli
gcttatcccaggaatctgtcgcaga

SEQ ID NO: 123758 - DNA, 25 bp, E. coli
gaagcggttagtatgcagccgtcac

SEQ ID NO: 123759 - DNA, 25 bp, E. coli
gaatttagcccttcaatcgccagag

SEQ ID NO: 123760 - DNA, 25 bp, E. coli
gaagcggttagtttgcagccgtcac

SEQ ID NO: 123761 - DNA, 25 bp, E. coli
gaatttagccctacaatcgccagag

SEQ ID NO: 123762 - DNA, 25 bp, E. coli
gaaagttatcgctagtcagtggcct

SEQ ID NO: 123763 - DNA, 25 bp, E. coli
gaaagttatcgcaagtcagtggcct

SEQ ID NO: 123764 - DNA, 25 bp, E. coli
taacacaagagcagcttgaggacgc

SEQ ID NO: 123765 - DNA, 25 bp, E. coli
gaggacgcacgtcgccttaaagcta

SEQ ID NO: 123766 - DNA, 25 bp, E. coli
gaggacgcacgtggccttaaagcta

SEQ ID NO: 123767 - DNA, 25 bp, E. coli
cattagccctggtcggtggaatcca

SEQ ID NO: 123768 - DNA, 25 bp, E. coli
cattagccctggacggtggaatcca

SEQ ID NO: 123769 - DNA, 25 bp, E. coli
taaagaagagtatgaaatggatcgc

SEQ ID NO: 123770 - DNA, 25 bp, E. coli
taaagaagagtaagaaatggatcgc

SEQ ID NO: 123771 - DNA, 25 bp, E. coli
atcgcttgactcgaggcaaacgcca

SEQ ID NO: 123772 - DNA, 25 bp, E. coli
atcgcttgactccaggcaaacgcca

SEQ ID NO: 123773 - DNA, 25 bp, E. coli
tagccctggacgctggaatccactt

SEQ ID NO: 123774 - DNA, 25 bp, E. coli
tagccctggacggtggaatccactt

SEQ ID NO: 123775 - DNA, 25 bp, E. coli
tatgaaatggatggcttgactccag

SEQ ID NO: 123776 - DNA, 25 bp, E. coli
tatgaaatggatcgcttgactccag

SEQ ID NO: 123777 - DNA, 25 bp, E. coli
tgaaaacaagaagaagaaaggaagg

SEQ ID NO: 123778 - DNA, 25 bp, E. coli
tgaaaacaagaacaagaaaggaagg

SEQ ID NO: 123779 - DNA, 25 bp, E. coli
gaaatggatcgcttgactccaggca

SEQ ID NO: 123780 - DNA, 25 bp, E. coli
gaaatggatcgcatgactccaggca

SEQ ID NO: 123781 - DNA, 25 bp, E. coli
cggtggaatccagttcacggaaatg

SEQ ID NO: 123782 - DNA, 25 bp, E. coli
cggtggaatccacttcacggaaatg

SEQ ID NO: 123783 - DNA, 25 bp, E. coli
tggatcgcttgactccaggcaaacg

SEQ ID NO: 123784 - DNA, 25 bp, E. coli
tggcattagccctggacggtggaat

SEQ ID NO: 123785 - DNA, 25 bp, E. coli
tggcattagcccaggacggtggaat

SEQ ID NO: 123786 - DNA, 25 bp, E. coli
tggatcgcttgagtccaggcaaacg

SEQ ID NO: 123787 - DNA, 25 bp, E. coli
tcacggaaatgaaaacaagaacaag

SEQ ID NO: 123788 - DNA, 25 bp, E. coli
tcacggaaatgataacaagaacaag

SEQ ID NO: 123789 - DNA, 25 bp, E. coli
caaactgacgctcaagtgatgcaac

SEQ ID NO: 123790 - DNA, 25 bp, E. coli
caaaacgcgtttttctcgctggcta

SEQ ID NO: 123791 - DNA, 25 bp, E. coli
caaactgacgctgaagtgatgcaac

SEQ ID NO: 123792 - DNA, 25 bp, E. coli
caaaacgcgtttatctcgctggcta

SEQ ID NO: 123793 - DNA, 25 bp, E. coli
catgtgatggatctccgttccggga

SEQ ID NO: 123794 - DNA, 25 bp, E. coli
catgtgatggatgtccgttccggga

SEQ ID NO: 123795 - DNA, 25 bp, E. coli
aaaatgacggtgcttctctggaagc

SEQ ID NO: 123796 - DNA, 25 bp, E. coli
aaaatgacggtggttctctggaagc

SEQ ID NO: 123797 - DNA, 25 bp, E. coli
tctgcgggatgaggatatcaaaaca

SEQ ID NO: 123798 - DNA, 25 bp, E. coli
tctgcgggatgacgatatcaaaaca

SEQ ID NO: 123799 - DNA, 25 bp, E. coli
tcatgcgattcgtctggcggcctat

SEQ ID NO: 123800 - DNA, 25 bp, E. coli
tcatgcgattcgactggcggcctat

SEQ ID NO: 123801 - DNA, 25 bp, E. coli
ccgcgcgaaggctttgtgatcaaca

SEQ ID NO: 123802 - DNA, 25 bp, E. coli
ccgcgcgaaggcattgtgatcaaca

SEQ ID NO: 123803 - DNA, 25 bp, E. coli
gattgatgacgatccgcagctgctg

SEQ ID NO: 123804 - DNA, 25 bp, E. coli
gattgatgacgaaccgcagctgctg

SEQ ID NO: 123805 - DNA, 25 bp, E. coli
ggtgacacgctgacaccgacaatgg

SEQ ID NO: 123806 - DNA, 25 bp, E. coli
ggtgacacgctgtcaccgacaatgg

SEQ ID NO: 123807 - DNA, 25 bp, E. coli
tggttgaagtacatcagccgctgtc

SEQ ID NO: 123808 - DNA, 25 bp, E. coli
tggttgaagtacttcagccgctgtc

SEQ ID NO: 123809 - DNA, 25 bp, E. coli
gatgtccgccgtgatcaagtgagcc

SEQ ID NO: 123810 - DNA, 25 bp, E. coli
gatgtccgccgtcatcaagtgagcc

SEQ ID NO: 123811 - DNA, 25 bp, E. coli
taccgggcgcgatgtgatcgttcta

SEQ ID NO: 123812 - DNA, 25 bp, E. coli
taccgggcgcgaagtgatcgttcta

SEQ ID NO: 123813 - DNA, 25 bp, E. coli
tatgataagcgtgatctgttccgca

SEQ ID NO: 123814 - DNA, 25 bp, E. coli
taccagcggcttagccatggaagcg

SEQ ID NO: 123815 - DNA, 25 bp, E. coli
taccagcggctttgccatggaagcg

SEQ ID NO: 123816 - DNA, 25 bp, E. coli
tatgataagcgtcatctgttccgca

SEQ ID NO: 123817 - DNA, 25 bp, E. coli
tgttccgcatgggagatgagcatct

SEQ ID NO: 123818 - DNA, 25 bp, E. coli
tgtggtcgcgcattctcaacgatta

SEQ ID NO: 123819 - DNA, 25 bp, E. coli
tgttccgcatggcagatgagcatct

SEQ ID NO: 123820 - DNA, 25 bp, E. coli
tgttgcattacatacggagtctggt

SEQ ID NO: 123821 - DNA, 25 bp, E. coli
tgttgcattacaaacggagtctggt

SEQ ID NO: 123822 - DNA, 25 bp, E. coli
tctgcactggcaggcattgctgacg

SEQ ID NO: 123823 - DNA, 25 bp, E. coli
tctgcactggcacgcattgctgacg

SEQ ID NO: 123824 - DNA, 25 bp, E. coli
gcttttgcagcaaccactggtgtgg

SEQ ID NO: 123825 - DNA, 25 bp, E. coli
gcttttgcagcatccactggtgtgg

SEQ ID NO: 123826 - DNA, 25 bp, E. coli
cgggcggcacggaacatttttatga

SEQ ID NO: 123827 - DNA, 25 bp, E. coli
cgggcggcacggtacatttttatga

SEQ ID NO: 123828 - DNA, 25 bp, E. coli
cattatcgcggtgacagccgggtga

SEQ ID NO: 123829 - DNA, 25 bp, E. coli
cattatcgcggtcacagccgggtga

SEQ ID NO: 123830 - DNA, 25 bp, E. coli
tgtggtcgcgcaatctcaacgatta

SEQ ID NO: 123831 - DNA, 25 bp, E. coli
tcaactggaaggaattaccgggcgc

SEQ ID NO: 123832 - DNA, 25 bp, E. coli
tcaactggaaggtattaccgggcgc

SEQ ID NO: 123833 - DNA, 25 bp, E. coli
taaatcgagcatactggatgccacc

SEQ ID NO: 123834 - DNA, 25 bp, E. coli
tacactggtgtaccggaaaacctcg

SEQ ID NO: 123835 - DNA, 25 bp, E. coli
taaatcgagcattctggatgccacc

SEQ ID NO: 123836 - DNA, 25 bp, E. coli
tacactggtgtagcggaaaacctcg

SEQ ID NO: 123837 - DNA, 25 bp, E. coli
acttcgcggcgatgaataaagcgtg

SEQ ID NO: 123838 - DNA, 25 bp, E. coli
aaaacagggcagcaataaatcgagc

SEQ ID NO: 123839 - DNA, 25 bp, E. coli
aacaacacgctcaactacactggtg

SEQ ID NO: 123840 - DNA, 25 bp, E. coli
aacaacacgctctactacactggtg

SEQ ID NO: 123841 - DNA, 25 bp, E. coli
aaaacagggcaggaataaatcgagc

SEQ ID NO: 123842 - DNA, 25 bp, E. coli
acttcgcggcgaagaataaagcgtg

SEQ ID NO: 123843 - DNA, 25 bp, E. coli
ttgacgccgtgctggaaaaacaggg

SEQ ID NO: 123844 - DNA, 25 bp, E. coli
ttgacgccgtgcaggaaaaacaggg

SEQ ID NO: 123845 - DNA, 25 bp, E. coli
gcagtctttgcaccacgaaaatgga

SEQ ID NO: 123846 - DNA, 25 bp, E. coli
gcagtctttgcagcacgaaaatgga

SEQ ID NO: 123847 - DNA, 25 bp, E. coli
gaaattaagattgtggctgcggtgt

SEQ ID NO: 123848 - DNA, 25 bp, E. coli
gaaattaagattctggctgcggtgt

SEQ ID NO: 123849 - DNA, 25 bp, E. coli
cgataaaaacgagttcgcggcgatg

SEQ ID NO: 123850 - DNA, 25 bp, E. coli
cgataaaaacgacttcgcggcgatg

SEQ ID NO: 123851 - DNA, 25 bp, E. coli
ggaaaacctcgaggccgatgccttt

SEQ ID NO: 123852 - DNA, 25 bp, E. coli
ggaaaacctcgacgccgatgccttt

SEQ ID NO: 123853 - DNA, 25 bp, E. coli
gatgcctttgagcaaaccgccaaca

SEQ ID NO: 123854 - DNA, 25 bp, E. coli
gatgcctttgaggaaaccgccaaca

SEQ ID NO: 123855 - DNA, 25 bp, E. coli
cactctttgcgacgcattcgcgaca

SEQ ID NO: 123856 - DNA, 25 bp, E. coli
cactctttgcgaggcattcgcgaca

SEQ ID NO: 123857 - DNA, 25 bp, E. coli
tacgtttgttctttgctaaacctcg

SEQ ID NO: 123858 - DNA, 25 bp, E. coli
atatttttcccggtgggctatctgg

SEQ ID NO: 123859 - DNA, 25 bp, E. coli
cgcacggaaaaacccagggcaacca

SEQ ID NO: 123860 - DNA, 25 bp, E. coli
atatttttcccgctgggctatctgg

SEQ ID NO: 123861 - DNA, 25 bp, E. coli
atgaccatcagcgatatcattgaaa

SEQ ID NO: 123862 - DNA, 25 bp, E. coli
cgcacggaaaaagccagggcaacca

SEQ ID NO: 123863 - DNA, 25 bp, E. coli
atgaccatcagccatatcattgaaa

SEQ ID NO: 123864 - DNA, 25 bp, E. coli
tacgtttgttctatgctaaacctcg

SEQ ID NO: 123865 - DNA, 25 bp, E. coli
tatctggcgcggcactctttgcgac

SEQ ID NO: 123866 - DNA, 25 bp, E. coli
tatctggcgcgggactctttgcgac

SEQ ID NO: 123867 - DNA, 25 bp, E. coli
ttacgccgcacggaaaaagccaggg

SEQ ID NO: 123868 - DNA, 25 bp, E. coli
ttacgccgcacgcaaaaagccaggg

SEQ ID NO: 123869 - DNA, 25 bp, E. coli
tgctaaacctcgttatgttaaaccg

SEQ ID NO: 123870 - DNA, 25 bp, E. coli
tgctaaacctcgatatgttaaaccg

SEQ ID NO: 123871 - DNA, 25 bp, E. coli
gcattcgcgacaccttacgtttgtt

SEQ ID NO: 123872 - DNA, 25 bp, E. coli
gcattcgcgacagcttacgtttgtt

SEQ ID NO: 123873 - DNA, 25 bp, E. coli
gaaattattgtcgtttgcgcactga

SEQ ID NO: 123874 - DNA, 25 bp, E. coli
gaaattattgtcctttgcgcactga

SEQ ID NO: 123875 - DNA, 25 bp, E. coli
cgcactgatattattcccgctgggc

SEQ ID NO: 123876 - DNA, 25 bp, E. coli
cgcactgatatttttcccgctgggc

SEQ ID NO: 123877 - DNA, 25 bp, E. coli
aagccgcgtcattgccgaactgttg

SEQ ID NO: 123878 - DNA, 25 bp, E. coli
aagccgcgtcatagccgaactgttg

SEQ ID NO: 123879 - DNA, 25 bp, E. coli
caagagcaaattgttggccacaaca

SEQ ID NO: 123880 - DNA, 25 bp, E. coli
caagagcaaattcttggccacaaca

SEQ ID NO: 123881 - DNA, 25 bp, E. coli
cagaggctctcaccggattacttga

SEQ ID NO: 123882 - DNA, 25 bp, E. coli
cagaggctctcagcggattacttga

SEQ ID NO: 123883 - DNA, 25 bp, E. coli
taaaaagcttccgatacagaggctc

SEQ ID NO: 123884 - DNA, 25 bp, E. coli
taaaaagcttcccatacagaggctc

SEQ ID NO: 123885 - DNA, 25 bp, E. coli
aaatgacaaggcatgggtaggagac

SEQ ID NO: 123886 - DNA, 25 bp, E. coli
aaatgacaaggcttgggtaggagac

SEQ ID NO: 123887 - DNA, 25 bp, E. coli
tatatgtcaacgctattcaggacgg

SEQ ID NO: 123888 - DNA, 25 bp, E. coli
tatatgtcaacggtattcaggacgg

SEQ ID NO: 123889 - DNA, 25 bp, E. coli
tcaggacgggtcactttggtgtaaa

SEQ ID NO: 123890 - DNA, 25 bp, E. coli
tcatgagcagggaaagccgcgtcat

SEQ ID NO: 123891 - DNA, 25 bp, E. coli
tcaggacgggtctctttggtgtaaa

SEQ ID NO: 123892 - DNA, 25 bp, E. coli
tcatgagcagggtaagccgcgtcat

SEQ ID NO: 123893 - DNA, 25 bp, E. coli
gaactgttgctaaccgatcccgatg

SEQ ID NO: 123894 - DNA, 25 bp, E. coli
gaactgttgctatccgatcccgatg

SEQ ID NO: 123895 - DNA, 25 bp, E. coli
gatcccgatgaacagacatggcaag

SEQ ID NO: 123896 - DNA, 25 bp, E. coli
gagctgcattccagtcttcagaggg

SEQ ID NO: 123897 - DNA, 25 bp, E. coli
gatcccgatgaagagacatggcaag

SEQ ID NO: 123898 - DNA, 25 bp, E. coli
gagctgcattcctgtcttcagaggg

SEQ ID NO: 123899 - DNA, 25 bp, E. coli
cactgaaagccgctgatatcgcacc

SEQ ID NO: 123900 - DNA, 25 bp, E. coli
cactgaaagccggtgatatcgcacc

SEQ ID NO: 123901 - DNA, 25 bp, E. coli
catggatgagttcaaaaaagcgggc

SEQ ID NO: 123902 - DNA, 25 bp, E. coli
catggatgagttgaaaaaagcgggc

SEQ ID NO: 123903 - DNA, 25 bp, E. coli
tttagcttgccgcatcaagacggag

SEQ ID NO: 123904 - DNA, 25 bp, E. coli
tttagcttgccggatcaagacggag

SEQ ID NO: 123905 - DNA, 25 bp, E. coli
tgtctgatgaggaccaccaggtgtg

SEQ ID NO: 123906 - DNA, 25 bp, E. coli
tgtctgatgaggtccaccaggtgtg

SEQ ID NO: 123907 - DNA, 25 bp, E. coli
tgaactggctgatagaacacgcctg

SEQ ID NO: 123908 - DNA, 25 bp, E. coli
tgaactggctgaaagaacacgcctg

SEQ ID NO: 123909 - DNA, 25 bp, E. coli
tccttcatgggcaaaacctacgatg

SEQ ID NO: 123910 - DNA, 25 bp, E. coli
tcccgttttgcggaaaaagagctgc

SEQ ID NO: 123911 - DNA, 25 bp, E. coli
tcccgttttgcgcaaaaagagctgc

SEQ ID NO: 123912 - DNA, 25 bp, E. coli
tccttcatgggctaaacctacgatg

SEQ ID NO: 123913 - DNA, 25 bp, E. coli
tcaccacgacgtagtgctgaactgg

SEQ ID NO: 123914 - DNA, 25 bp, E. coli
tcaccacgacgttgtgctgaactgg

SEQ ID NO: 123915 - DNA, 25 bp, E. coli
gcttcctgattgacgctgatggcaa

SEQ ID NO: 123916 - DNA, 25 bp, E. coli
gcggcttacgcgttaacatggatga

SEQ ID NO: 123917 - DNA, 25 bp, E. coli
gcggcttacgcgataacatggatga

SEQ ID NO: 123918 - DNA, 25 bp, E. coli
gcttcctgattgtcgctgatggcaa

SEQ ID NO: 123919 - DNA, 25 bp, E. coli
taatttgaccgacttccagggacag

SEQ ID NO: 123920 - DNA, 25 bp, E. coli
taatttgaccgagttccagggacag

SEQ ID NO: 123921 - DNA, 25 bp, E. coli
caaccaacgcctgctggaagtcatt

SEQ ID NO: 123922 - DNA, 25 bp, E. coli
caaccaacgcctcctggaagtcatt

SEQ ID NO: 123923 - DNA, 25 bp, E. coli
caaagttgccgggtggttacgctga

SEQ ID NO: 123924 - DNA, 25 bp, E. coli
caaagttgccggctggttacgctga

SEQ ID NO: 123925 - DNA, 25 bp, E. coli
acgatgaggctatccgtgggtaagc

SEQ ID NO: 123926 - DNA, 25 bp, E. coli
acgatgaggctaaccgtgggtaagc

SEQ ID NO: 123927 - DNA, 25 bp, E. coli
ttgcaacgtgctcgtggaactcact

SEQ ID NO: 123928 - DNA, 25 bp, E. coli
ttgcaacgtgctggtggaactcact

SEQ ID NO: 123929 - DNA, 25 bp, E. coli
gctggatgtaactgagaacgcatta

SEQ ID NO: 123930 - DNA, 25 bp, E. coli
gcactggtctactaaatcttttgcg

SEQ ID NO: 123931 - DNA, 25 bp, E. coli
gctggatgtaacagagaacgcatta

SEQ ID NO: 123932 - DNA, 25 bp, E. coli
gcactggtctacaaaatcttttgcg

SEQ ID NO: 123933 - DNA, 25 bp, E. coli
gaaaaactatcggaaagttgccggg

SEQ ID NO: 123934 - DNA, 25 bp, E. coli
gaaaaactatcgcaaagttgccggg

SEQ ID NO: 123935 - DNA, 25 bp, E. coli
cgcattatttaagcgccttcgtgcc

SEQ ID NO: 123936 - DNA, 25 bp, E. coli
cgcattatttaaccgccttcgtgcc

SEQ ID NO: 123937 - DNA, 25 bp, E. coli
cgtgtcgtgactctggagaaactaa

SEQ ID NO: 123938 - DNA, 25 bp, E. coli
cgtgtcgtgactgtggagaaactaa

SEQ ID NO: 123939 - DNA, 25 bp, E. coli
gattaacagaaagcacagaacgatg

SEQ ID NO: 123940 - DNA, 25 bp, E. coli
gattaacagaaaccacagaacgatg

SEQ ID NO: 123941 - DNA, 25 bp, E. coli
ggacaacgccgatatcaaccaacgc

SEQ ID NO: 123942 - DNA, 25 bp, E. coli
ggacaacgccgaaatcaaccaacgc

SEQ ID NO: 123943 - DNA, 25 bp, E. coli
cacattgccaatagccagagaaata

SEQ ID NO: 123944 - DNA, 25 bp, E. coli
cacattgccaattgccagagaaata

SEQ ID NO: 123945 - DNA, 25 bp, E. coli
caggtcatcagatgccagggatgca

SEQ ID NO: 123946 - DNA, 25 bp, E. coli
caggtcatcagaagccagggatgca

SEQ ID NO: 123947 - DNA, 25 bp, E. coli
tacgtcgcactaatccgcctcctga

SEQ ID NO: 123948 - DNA, 25 bp, E. coli
tacgtcgcactattccgcctcctga

SEQ ID NO: 123949 - DNA, 25 bp, E. coli
atgaattacaccctacagaaagcgt

SEQ ID NO: 123950 - DNA, 25 bp, E. coli
atgaattacaccgtacagaaagcgt

SEQ ID NO: 123951 - DNA, 25 bp, E. coli
acgagtctataagcattcccgttat

SEQ ID NO: 123952 - DNA, 25 bp, E. coli
acgagtctataaccattcccgttat

SEQ ID NO: 123953 - DNA, 25 bp, E. coli
tattttcccctttctacgtcgcact

SEQ ID NO: 123954 - DNA, 25 bp, E. coli
tattttccccttactacgtcgcact

SEQ ID NO: 123955 - DNA, 25 bp, E. coli
tgcaacgagtctataaccattcccg

SEQ ID NO: 123956 - DNA, 25 bp, E. coli
tgcaacgagtctttaaccattcccg

SEQ ID NO: 123957 - DNA, 25 bp, E. coli
tgcgaaacgtgaggcgctggatatg

SEQ ID NO: 123958 - DNA, 25 bp, E. coli
tgcgaaacgtgacgcgctggatatg

SEQ ID NO: 123959 - DNA, 25 bp, E. coli
ccagggatgcaaggagtctataacc

SEQ ID NO: 123960 - DNA, 25 bp, E. coli
ccagggatgcaacgagtctataacc

SEQ ID NO: 123961 - DNA, 25 bp, E. coli
gaaaacgtaacctcattgccaatag

SEQ ID NO: 123962 - DNA, 25 bp, E. coli
gaaaacgtaaccacattgccaatag

SEQ ID NO: 123963 - DNA, 25 bp, E. coli
cgttatctggatgcgaaacgtgacg

SEQ ID NO: 123964 - DNA, 25 bp, E. coli
cgttatctggatccgaaacgtgacg

SEQ ID NO: 123965 - DNA, 25 bp, E. coli
cagattgaacgtcataccgagcgcg

SEQ ID NO: 123966 - DNA, 25 bp, E. coli
cagattgaacgtgataccgagcgcg

SEQ ID NO: 123967 - DNA, 25 bp, E. coli
tacagcggcgaacgagataactttg

SEQ ID NO: 123968 - DNA, 25 bp, E. coli
tacagcggcgaaggagataactttg

SEQ ID NO: 123969 - DNA, 25 bp, E. coli
agggccaggcgagcgatatcgaaat

SEQ ID NO: 123970 - DNA, 25 bp, E. coli
agggccaggcgaccgatatcgaaat

SEQ ID NO: 123971 - DNA, 25 bp, E. coli
aacttatggcgcatcatacgggtca

SEQ ID NO: 123972 - DNA, 25 bp, E. coli
aacttatggcgcttcatacgggtca

SEQ ID NO: 123973 - DNA, 25 bp, E. coli
tattctcgtctagttaaggaacgcg

SEQ ID NO: 123974 - DNA, 25 bp, E. coli
tattctcgtctacttaaggaacgcg

SEQ ID NO: 123975 - DNA, 25 bp, E. coli
tgcctgccgaattcgcgcgtgatga

SEQ ID NO: 123976 - DNA, 25 bp, E. coli
tgcctgccgaatacgcgcgtgatga

SEQ ID NO: 123977 - DNA, 25 bp, E. coli
gacaccatgcagtttatcaagcctg

SEQ ID NO: 123978 - DNA, 25 bp, E. coli
gacaccatgcagattatcaagcctg

SEQ ID NO: 123979 - DNA, 25 bp, E. coli
cgctggtgccgaaggtcattgaaca

SEQ ID NO: 123980 - DNA, 25 bp, E. coli
cccctgaagcggtggaatacggtct

SEQ ID NO: 123981 - DNA, 25 bp, E. coli
cgctggtgccgatggtcattgaaca

SEQ ID NO: 123982 - DNA, 25 bp, E. coli
cccctgaagcggaggaatacggtct

SEQ ID NO: 123983 - DNA, 25 bp, E. coli
gataactttgcaccccatatggcgc

SEQ ID NO: 123984 - DNA, 25 bp, E. coli
gataactttgcagcccatatggcgc

SEQ ID NO: 123985 - DNA, 25 bp, E. coli
tcagcaccatctgtatgggccaggc

SEQ ID NO: 123986 - DNA, 25 bp, E. coli
tcagcaccatctctatgggccaggc

SEQ ID NO: 123987 - DNA, 25 bp, E. coli
tactgcggtggtcctgatgatcctc

SEQ ID NO: 123988 - DNA, 25 bp, E. coli
tactgcggtggtgctgatgatcctc

SEQ ID NO: 123989 - DNA, 25 bp, E. coli
ataattcagcggtaggtgcgcgcga

SEQ ID NO: 123990 - DNA, 25 bp, E. coli
ataattcagcggaaggtgcgcgcga

SEQ ID NO: 123991 - DNA, 25 bp, E. coli
tattctcggcaacggataattcagc

SEQ ID NO: 123992 - DNA, 25 bp, E. coli
tattctcggcaagggataattcagc

SEQ ID NO: 123993 - DNA, 25 bp, E. coli
tcgaaactgactacccgtggcgcaa

SEQ ID NO: 123994 - DNA, 25 bp, E. coli
tcgaaactgacttcccgtggcgcaa

SEQ ID NO: 123995 - DNA, 25 bp, E. coli
gccaccattcttccggtggttgcgg

SEQ ID NO: 123996 - DNA, 25 bp, E. coli
gccaccattcttgcggtggttgcgg

SEQ ID NO: 123997 - DNA, 25 bp, E. coli
gcggctggttagcactgattactgc

SEQ ID NO: 123998 - DNA, 25 bp, E. coli
gcatcggcggtgtctcacgacctgt

SEQ ID NO: 123999 - DNA, 25 bp, E. coli
gcatcggcggtgactcacgacctgt

SEQ ID NO: 124000 - DNA, 25 bp, E. coli
gcggctggttaggactgattactgc

SEQ ID NO: 124001 - DNA, 25 bp, E. coli
ctgactacccgtcgcgcaatgctgg

SEQ ID NO: 124002 - DNA, 25 bp, E. coli
ctgactacccgtggcgcaatgctgg

SEQ ID NO: 124003 - DNA, 25 bp, E. coli
gttgctttcgccaccattcttgcgg

SEQ ID NO: 124004 - DNA, 25 bp, E. coli
gttgctttcgcctccattcttgcgg

SEQ ID NO: 124005 - DNA, 25 bp, E. coli
ggtgtctcacgagctgtacgctaac

SEQ ID NO: 124006 - DNA, 25 bp, E. coli
ggtatctggttaatctcggcaacgg

SEQ ID NO: 124007 - DNA, 25 bp, E. coli
ggtgtctcacgacctgtacgctaac

SEQ ID NO: 124008 - DNA, 25 bp, E. coli
ggtatctggttattctcggcaacgg

SEQ ID NO: 124009 - DNA, 25 bp, E. coli
tacgagcggatgaagcaggtgctac

SEQ ID NO: 124010 - DNA, 25 bp, E. coli
atttcttcaacagcctgcaggccgg

SEQ ID NO: 124011 - DNA, 25 bp, E. coli
atttcttcaacaccctgcaggccgg

SEQ ID NO: 124012 - DNA, 25 bp, E. coli
tacgagcggatgtagcaggtgctac

SEQ ID NO: 124013 - DNA, 25 bp, E. coli
tatttcgacgctcaacgggcaggtc

SEQ ID NO: 124014 - DNA, 25 bp, E. coli
tatttcgacgctgaacgggcaggtc

SEQ ID NO: 124015 - DNA, 25 bp, E. coli
tctggctggtaagactggcgctgct

SEQ ID NO: 124016 - DNA, 25 bp, E. coli
tcagtcgggagatcgtggagcacat

SEQ ID NO: 124017 - DNA, 25 bp, E. coli
tctggctggtaacactggcgctgct

SEQ ID NO: 124018 - DNA, 25 bp, E. coli
tcagtcgggagaacgtggagcacat

SEQ ID NO: 124019 - DNA, 25 bp, E. coli
gcgccatttggtctgctgccggaaa

SEQ ID NO: 124020 - DNA, 25 bp, E. coli
gcgccatttggtgtgctgccggaaa

SEQ ID NO: 124021 - DNA, 25 bp, E. coli
gtatggagctgtatcgccactgcca

SEQ ID NO: 124022 - DNA, 25 bp, E. coli
ggatatcaatatcgacgcgctgctg

SEQ ID NO: 124023 - DNA, 25 bp, E. coli
ggatgaaggatcgactccagtcgca

SEQ ID NO: 124024 - DNA, 25 bp, E. coli
ggatatcaatatggacgcgctgctg

SEQ ID NO: 124025 - DNA, 25 bp, E. coli
gtatggagctgtttcgccactgcca

SEQ ID NO: 124026 - DNA, 25 bp, E. coli
ggatgaaggatccactccagtcgca

SEQ ID NO: 124027 - DNA, 25 bp, E. coli
tggatgaactgcagccgcaaagcct

SEQ ID NO: 124028 - DNA, 25 bp, E. coli
tggtccgcgaacgtctgaaagatgc

SEQ ID NO: 124029 - DNA, 25 bp, E. coli
tggatgaactgctgccgcaaagcct

SEQ ID NO: 124030 - DNA, 25 bp, E. coli
tggtccgcgaacctctgaaagatgc

SEQ ID NO: 124031 - DNA, 25 bp, E. coli
aagatggtctgcgtactcacgggag

SEQ ID NO: 124032 - DNA, 25 bp, E. coli
aagatggtctgcctactcacgggag

SEQ ID NO: 124033 - DNA, 25 bp, E. coli
cacgaatgttttctaagaggcgcaa

SEQ ID NO: 124034 - DNA, 25 bp, E. coli
cacgaatgttttgtaagaggcgcaa

SEQ ID NO: 124035 - DNA, 25 bp, E. coli
taaactgggttaaccggcactgcac

SEQ ID NO: 124036 - DNA, 25 bp, E. coli
taaactgggttatccggcactgcac

SEQ ID NO: 124037 - DNA, 25 bp, E. coli
agaaagaaattacgcatccccaggc

SEQ ID NO: 124038 - DNA, 25 bp, E. coli
agaaagaaattaggcatccccaggc

SEQ ID NO: 124039 - DNA, 25 bp, E. coli
tatggtcacaatgcacagggttcgc

SEQ ID NO: 124040 - DNA, 25 bp, E. coli
tatggcagtgctctactcaagcgca

SEQ ID NO: 124041 - DNA, 25 bp, E. coli
tatggcagtgctgtactcaagcgca

SEQ ID NO: 124042 - DNA, 25 bp, E. coli
tatggtcacaatccacagggttcgc

SEQ ID NO: 124043 - DNA, 25 bp, E. coli
tgacagtaacgctgatacgccctgg

SEQ ID NO: 124044 - DNA, 25 bp, E. coli
tgacagtaacgcagatacgccctgg

SEQ ID NO: 124045 - DNA, 25 bp, E. coli
tgcgccggagcctgttcgatgaaat

SEQ ID NO: 124046 - DNA, 25 bp, E. coli
tgcgccggagccagttcgatgaaat

SEQ ID NO: 124047 - DNA, 25 bp, E. coli
cggttatcacgggacacgggcattt

SEQ ID NO: 124048 - DNA, 25 bp, E. coli
cggttatcacggcacacgggcattt

SEQ ID NO: 124049 - DNA, 25 bp, E. coli
gatcagttccgcgaacaacaaggtg

SEQ ID NO: 124050 - DNA, 25 bp, E. coli
tcaagcgcaacggtaagggagccat

SEQ ID NO: 124051 - DNA, 25 bp, E. coli
tcaagcgcaacgctaagggagccat

SEQ ID NO: 124052 - DNA, 25 bp, E. coli
gatcagttccgccaacaacaaggtg

SEQ ID NO: 124053 - DNA, 25 bp, E. coli
aagtgctgcgtaccttcctggacga

SEQ ID NO: 124054 - DNA, 25 bp, E. coli
caacctggtggatccgtcaggcgat

SEQ ID NO: 124055 - DNA, 25 bp, E. coli
aagtgctgcgtagcttcctggacga

SEQ ID NO: 124056 - DNA, 25 bp, E. coli
caacctggtggaaccgtcaggcgat

SEQ ID NO: 124057 - DNA, 25 bp, E. coli
tgataaattcgattaccgccgtggt

SEQ ID NO: 124058 - DNA, 25 bp, E. coli
tgataaattcgaataccgccgtggt

SEQ ID NO: 124059 - DNA, 25 bp, E. coli
tgctgcaagagatgggccgtgaacc

SEQ ID NO: 124060 - DNA, 25 bp, E. coli
tgctgcaagagaagggccgtgaacc

SEQ ID NO: 124061 - DNA, 25 bp, E. coli
tgctgatgccggtagacaagatccg

SEQ ID NO: 124062 - DNA, 25 bp, E. coli
tgctgatgccggaagacaagatccg

SEQ ID NO: 124063 - DNA, 25 bp, E. coli
tccgtcagatcgaagcgaaggcgct

SEQ ID NO: 124064 - DNA, 25 bp, E. coli
tccgtcagatcgtagcgaaggcgct

SEQ ID NO: 124065 - DNA, 25 bp, E. coli
tccgcaaagtgcagaagatcgccaa

SEQ ID NO: 124066 - DNA, 25 bp, E. coli
tccgcaaagtgctgaagatcgccaa

SEQ ID NO: 124067 - DNA, 25 bp, E. coli
tctccatggaaacgccgatcggtga

SEQ ID NO: 124068 - DNA, 25 bp, E. coli
tctccatggaaaggccgatcggtga

SEQ ID NO: 124069 - DNA, 25 bp, E. coli
gaaatacaccaagcgtggcttgcag

SEQ ID NO: 124070 - DNA, 25 bp, E. coli
gaaatacaccaaccgtggcttgcag

SEQ ID NO: 124071 - DNA, 25 bp, E. coli
cccgccgtgcgatgaaagagatggt

SEQ ID NO: 124072 - DNA, 25 bp, E. coli
cgtattccggtggatatgattgaga

SEQ ID NO: 124073 - DNA, 25 bp, E. coli
cccgccgtgcgaagaaagagatggt

SEQ ID NO: 124074 - DNA, 25 bp, E. coli
cgtattccggtgcatatgattgaga

SEQ ID NO: 124075 - DNA, 25 bp, E. coli
aatcgctggctgcatcatctggtgc

SEQ ID NO: 124076 - DNA, 25 bp, E. coli
aatcgctggctggatcatctggtgc

SEQ ID NO: 124077 - DNA, 25 bp, E. coli
catcttaccggctttaacgctggcg

SEQ ID NO: 124078 - DNA, 25 bp, E. coli
catcttaccggcattaacgctggcg

SEQ ID NO: 124079 - DNA, 25 bp, E. coli
taccggcttttaactgctcgatgcg

SEQ ID NO: 124080 - DNA, 25 bp, E. coli
taccggcttttatctgctcgatgcg

SEQ ID NO: 124081 - DNA, 25 bp, E. coli
tgttatgcgctagccaatgcgttga

SEQ ID NO: 124082 - DNA, 25 bp, E. coli
tgttatgcgctacccaatgcgttga

SEQ ID NO: 124083 - DNA, 25 bp, E. coli
tgaagactacattcgtaccgcccgg

SEQ ID NO: 124084 - DNA, 25 bp, E. coli
tgatgactggctggatccaccaacg

SEQ ID NO: 124085 - DNA, 25 bp, E. coli
tgatgactggctcgatccaccaacg

SEQ ID NO: 124086 - DNA, 25 bp, E. coli
tgaagactacatacgtaccgcccgg

SEQ ID NO: 124087 - DNA, 25 bp, E. coli
gcagtgctcaccgaaaccgtttttg

SEQ ID NO: 124088 - DNA, 25 bp, E. coli
gcagtgctcacccaaaccgtttttg

SEQ ID NO: 124089 - DNA, 25 bp, E. coli
gacttcccggcactgatgggctttg

SEQ ID NO: 124090 - DNA, 25 bp, E. coli
gacttcccggcagtgatgggctttg

SEQ ID NO: 124091 - DNA, 25 bp, E. coli
gatttgttgtatcgcgcagtgctca

SEQ ID NO: 124092 - DNA, 25 bp, E. coli
gattgatccgcgaatcggacgtgga

SEQ ID NO: 124093 - DNA, 25 bp, E. coli
gattgatccgcgtatcggacgtgga

SEQ ID NO: 124094 - DNA, 25 bp, E. coli
gatttgttgtatggcgcagtgctca

SEQ ID NO: 124095 - DNA, 25 bp, E. coli
ggcatactctctccagtctggcgaa

SEQ ID NO: 124096 - DNA, 25 bp, E. coli
ggcatactctctgcagtctggcgaa

SEQ ID NO: 124097 - DNA, 25 bp, E. coli
catggtcctgtattaatcttcggta

SEQ ID NO: 124098 - DNA, 25 bp, E. coli
catggtcctgtaataatcttcggta

SEQ ID NO: 124099 - DNA, 25 bp, E. coli
ctcccctttttggatggtcctgtaa

SEQ ID NO: 124100 - DNA, 25 bp, E. coli
ctcccctttttgcatggtcctgtaa

SEQ ID NO: 124101 - DNA, 25 bp, E. coli
tgttttaacgggaggcgcaatgcct

SEQ ID NO: 124102 - DNA, 25 bp, E. coli
tgttttaacgggtggcgcaatgcct

SEQ ID NO: 124103 - DNA, 25 bp, E. coli
tgcatggtcctgaaataatcttcgg

SEQ ID NO: 124104 - DNA, 25 bp, E. coli
tgcatggtcctgtaataatcttcgg

SEQ ID NO: 124105 - DNA, 25 bp, E. coli
tcttcggtatatagcaggacatttt

SEQ ID NO: 124106 - DNA, 25 bp, E. coli
tcttcggtatattgcaggacatttt

SEQ ID NO: 124107 - DNA, 25 bp, E. coli
tgcaggacattttttaaactttttg

SEQ ID NO: 124108 - DNA, 25 bp, E. coli
tgcaggacatttattaaactttttg

SEQ ID NO: 124109 - DNA, 25 bp, E. coli
gcaatgcctcccgtttttgcatggt

SEQ ID NO: 124110 - DNA, 25 bp, E. coli
gcaatgcctcccctttttgcatggt

SEQ ID NO: 124111 - DNA, 25 bp, E. coli
cggtatattgcacgacattttttaa

SEQ ID NO: 124112 - DNA, 25 bp, E. coli
cggtatattgcaggacattttttaa

SEQ ID NO: 124113 - DNA, 25 bp, E. coli
ggataatcaaatctttacagacact

SEQ ID NO: 124114 - DNA, 25 bp, E. coli
ggataatcaaatgtttacagacact

SEQ ID NO: 124115 - DNA, 25 bp, E. coli
taacgggaggcgcaatgcctcccct

SEQ ID NO: 124116 - DNA, 25 bp, E. coli
taatcttcggtaaattgcaggacat

SEQ ID NO: 124117 - DNA, 25 bp, E. coli
taacgggaggcggaatgcctcccct

SEQ ID NO: 124118 - DNA, 25 bp, E. coli
taatcttcggtatattgcaggacat

SEQ ID NO: 124119 - DNA, 25 bp, E. coli
tacagcatttacatcctaaaggaca

SEQ ID NO: 124120 - DNA, 25 bp, E. coli
tacatttgatttcatgagcgctgat

SEQ ID NO: 124121 - DNA, 25 bp, E. coli
tacagcatttacttcctaaaggaca

SEQ ID NO: 124122 - DNA, 25 bp, E. coli
tacatttgatttgatgagcgctgat

SEQ ID NO: 124123 - DNA, 25 bp, E. coli
tgaattaccagattcatcacaatgg

SEQ ID NO: 124124 - DNA, 25 bp, E. coli
tgaattaccagaatcatcacaatgg

SEQ ID NO: 124125 - DNA, 25 bp, E. coli
tgccgattacgcattctttgatgac

SEQ ID NO: 124126 - DNA, 25 bp, E. coli
tgccgattacgctttctttgatgac

SEQ ID NO: 124127 - DNA, 25 bp, E. coli
tctttgatgacgtaatgccatttac

SEQ ID NO: 124128 - DNA, 25 bp, E. coli
tctttgatgacgaaatgccatttac

SEQ ID NO: 124129 - DNA, 25 bp, E. coli
gacaactacagaagatacaacagag

SEQ ID NO: 124130 - DNA, 25 bp, E. coli
gacaactacagatgatacaacagag

SEQ ID NO: 124131 - DNA, 25 bp, E. coli
ggataatcttattggcacaccacca

SEQ ID NO: 124132 - DNA, 25 bp, E. coli
ggataatcttataggcacaccacca

SEQ ID NO: 124133 - DNA, 25 bp, E. coli
tcaataaacaacgataactcacagg

SEQ ID NO: 124134 - DNA, 25 bp, E. coli
taataaatggtcgaagagaggacct

SEQ ID NO: 124135 - DNA, 25 bp, E. coli
taataaatggtccaagagaggacct

SEQ ID NO: 124136 - DNA, 25 bp, E. coli
tcaataaacaaccataactcacagg

SEQ ID NO: 124137 - DNA, 25 bp, E. coli
gagtattcctctcccaaatgccgat

SEQ ID NO: 124138 - DNA, 25 bp, E. coli
gagcgctgatcaccactataatttt

SEQ ID NO: 124139 - DNA, 25 bp, E. coli
gagtattcctctgccaaatgccgat

SEQ ID NO: 124140 - DNA, 25 bp, E. coli
gagcgctgatcagcactataatttt

SEQ ID NO: 124141 - DNA, 25 bp, E. coli
caggtgcatacctgcaacgtgcggg

SEQ ID NO: 124142 - DNA, 25 bp, E. coli
caggtgcataccagcaacgtgcggg

SEQ ID NO: 124143 - DNA, 25 bp, E. coli
ttgtcaggtgcatacctgcaacgtg

SEQ ID NO: 124144 - DNA, 25 bp, E. coli
ttgtcaggtgcaaacctgcaacgtg

SEQ ID NO: 124145 - DNA, 25 bp, E. coli
tgttgtcaggtgcatacctgcaacg

SEQ ID NO: 124146 - DNA, 25 bp, E. coli
tgtcaggtgcatacctgcaacgtgc

SEQ ID NO: 124147 - DNA, 25 bp, E. coli
tgttgtcaggtggatacctgcaacg

SEQ ID NO: 124148 - DNA, 25 bp, E. coli
tgtcaggtgcattcctgcaacgtgc

SEQ ID NO: 124149 - DNA, 25 bp, E. coli
tgcatacctgcatcgtgcgggggtt

SEQ ID NO: 124150 - DNA, 25 bp, E. coli
tgcatacctgcaacgtgcgggggtt

SEQ ID NO: 124151 - DNA, 25 bp, E. coli
tcaggtgcatacgtgcaacgtgcgg

SEQ ID NO: 124152 - DNA, 25 bp, E. coli
tcaggtgcatacctgcaacgtgcgg

SEQ ID NO: 124153 - DNA, 25 bp, E. coli
ccgtggtgttgtgaggtgcatacct

SEQ ID NO: 124154 - DNA, 25 bp, E. coli
ccgtggtgttgtcaggtgcatacct

SEQ ID NO: 124155 - DNA, 25 bp, E. coli
cccgtggtgttgacaggtgcatacc

SEQ ID NO: 124156 - DNA, 25 bp, E. coli
ccccgtggtgttctcaggtgcatac

SEQ ID NO: 124157 - DNA, 25 bp, E. coli
ccccgtggtgttgtcaggtgcatac

SEQ ID NO: 124158 - DNA, 25 bp, E. coli
cccgtggtgttgtcaggtgcatacc

SEQ ID NO: 124159 - DNA, 25 bp, E. coli
cgtggtgttgtctggtgcatacctg

SEQ ID NO: 124160 - DNA, 25 bp, E. coli
cgtggtgttgtcaggtgcatacctg

SEQ ID NO: 124161 - DNA, 25 bp, E. coli
ggtgttgtcaggtgcatacctgcaa

SEQ ID NO: 124162 - DNA, 25 bp, E. coli
ggtgttgtcaggagcatacctgcaa

SEQ ID NO: 124163 - DNA, 25 bp, E. coli
caacgccagattgctgaaaacccga

SEQ ID NO: 124164 - DNA, 25 bp, E. coli
caacgccagattcctgaaaacccga

SEQ ID NO: 124165 - DNA, 25 bp, E. coli
catgaaaggttcaccgaaactgccg

SEQ ID NO: 124166 - DNA, 25 bp, E. coli
catgaaaggttctccgaaactgccg

SEQ ID NO: 124167 - DNA, 25 bp, E. coli
taaatacaagtcagaagagccggac

SEQ ID NO: 124168 - DNA, 25 bp, E. coli
taaatacaagtctgaagagccggac

SEQ ID NO: 124169 - DNA, 25 bp, E. coli
aaactgccgagctgcggtttctctg

SEQ ID NO: 124170 - DNA, 25 bp, E. coli
aaactgccgagcagcggtttctctg

SEQ ID NO: 124171 - DNA, 25 bp, E. coli
tattctgcagaaaccggacattcgt

SEQ ID NO: 124172 - DNA, 25 bp, E. coli
tattctgcagaatccggacattcgt

SEQ ID NO: 124173 - DNA, 25 bp, E. coli
tcgtgatcgaaatgtatcagcgtgg

SEQ ID NO: 124174 - DNA, 25 bp, E. coli
tcgtgatcgaaaagtatcagcgtgg

SEQ ID NO: 124175 - DNA, 25 bp, E. coli
gctgatcaaagatactgccgctaaa

SEQ ID NO: 124176 - DNA, 25 bp, E. coli
gctgatcaaagaaactgccgctaaa

SEQ ID NO: 124177 - DNA, 25 bp, E. coli
gaaaacccgatcgtgctgtacatga

SEQ ID NO: 124178 - DNA, 25 bp, E. coli
gaaaacccgatcctgctgtacatga

SEQ ID NO: 124179 - DNA, 25 bp, E. coli
cgaccttcccgcaactgtgggttga

SEQ ID NO: 124180 - DNA, 25 bp, E. coli
ccgcatgtggcgaacgttttgccta

SEQ ID NO: 124181 - DNA, 25 bp, E. coli
ccgcatgtggcgtacgttttgccta

SEQ ID NO: 124182 - DNA, 25 bp, E. coli
cgaccttcccgctactgtgggttga

SEQ ID NO: 124183 - DNA, 25 bp, E. coli
ggtttctctgcccaggcagtccagg

SEQ ID NO: 124184 - DNA, 25 bp, E. coli
ggtttctctgccgaggcagtccagg

SEQ ID NO: 124185 - DNA, 25 bp, E. coli
aattcgcgatcttttgccgcccggg

SEQ ID NO: 124186 - DNA, 25 bp, E. coli
aattcgcgatctattgccgcccggg

SEQ ID NO: 124187 - DNA, 25 bp, E. coli
caattccggcgacaatgcggctatc

SEQ ID NO: 124188 - DNA, 25 bp, E. coli
caattccggcgagaatgcggctatc

SEQ ID NO: 124189 - DNA, 25 bp, E. coli
cagcatccgcaggtaaaagtacgca

SEQ ID NO: 124190 - DNA, 25 bp, E. coli
cacaggtcggtgtagtctgcgagac

SEQ ID NO: 124191 - DNA, 25 bp, E. coli
cacaggtcggtgaagtctgcgagac

SEQ ID NO: 124192 - DNA, 25 bp, E. coli
cagcatccgcagctaaaagtacgca

SEQ ID NO: 124193 - DNA, 25 bp, E. coli
aaatgggctgcgatcccttgcacgg

SEQ ID NO: 124194 - DNA, 25 bp, E. coli
aaatgggctgcgttcccttgcacgg

SEQ ID NO: 124195 - DNA, 25 bp, E. coli
tgaatatgtcgcaaccggcactgag

SEQ ID NO: 124196 - DNA, 25 bp, E. coli
tgaatatgtcgctaccggcactgag

SEQ ID NO: 124197 - DNA, 25 bp, E. coli
tgcgcgcagccctagaggatattcg

SEQ ID NO: 124198 - DNA, 25 bp, E. coli
tgcgcgcagcccaagaggatattcg

SEQ ID NO: 124199 - DNA, 25 bp, E. coli
gaaagtttttatcagcacgccagtc

SEQ ID NO: 124200 - DNA, 25 bp, E. coli
gaaagtttttatgagcacgccagtc

SEQ ID NO: 124201 - DNA, 25 bp, E. coli
cgtgacgttaactgatgccggtgaa

SEQ ID NO: 124202 - DNA, 25 bp, E. coli
cattggtgcccgatcgatcaaacag

SEQ ID NO: 124203 - DNA, 25 bp, E. coli
cgtgacgttaacagatgccggtgaa

SEQ ID NO: 124204 - DNA, 25 bp, E. coli
cattggtgcccgttcgatcaaacag

SEQ ID NO: 124205 - DNA, 25 bp, E. coli
ggattacagctggacaatgccgacg

SEQ ID NO: 124206 - DNA, 25 bp, E. coli
ggattacagctgcacaatgccgacg

SEQ ID NO: 124207 - DNA, 25 bp, E. coli
aagacctgaaatgggtaatcctgat

SEQ ID NO: 124208 - DNA, 25 bp, E. coli
aagacctgaaatcggtaatcctgat

SEQ ID NO: 124209 - DNA, 25 bp, E. coli
ttggctggaaaagcttgcggattat

SEQ ID NO: 124210 - DNA, 25 bp, E. coli
ttggctggaaaaccttgcggattat

SEQ ID NO: 124211 - DNA, 25 bp, E. coli
tgctttggctggtaaagcttgcgga

SEQ ID NO: 124212 - DNA, 25 bp, E. coli
tgctttggctggaaaagcttgcgga

SEQ ID NO: 124213 - DNA, 25 bp, E. coli
tcgacctggaagacctgaaatgggt

SEQ ID NO: 124214 - DNA, 25 bp, E. coli
tcgacctggaagtcctgaaatgggt

SEQ ID NO: 124215 - DNA, 25 bp, E. coli
cctgctttggctcgaaaagcttgcg

SEQ ID NO: 124216 - DNA, 25 bp, E. coli
cctgctttggctggaaaagcttgcg

SEQ ID NO: 124217 - DNA, 25 bp, E. coli
gaagacctgaaatgggtaatcctga

SEQ ID NO: 124218 - DNA, 25 bp, E. coli
gaagacctgaaaagggtaatcctga

SEQ ID NO: 124219 - DNA, 25 bp, E. coli
cctggaagacctcaaatgggtaatc

SEQ ID NO: 124220 - DNA, 25 bp, E. coli
cctggaagacctgaaatgggtaatc

SEQ ID NO: 124221 - DNA, 25 bp, E. coli
ctttggctggaaaagcttgcggatt

SEQ ID NO: 124222 - DNA, 25 bp, E. coli
ctttggctggaatagcttgcggatt

SEQ ID NO: 124223 - DNA, 25 bp, E. coli
gttcgacctggatgacctgaaatgg

SEQ ID NO: 124224 - DNA, 25 bp, E. coli
gttcgacctggaagacctgaaatgg

SEQ ID NO: 124225 - DNA, 25 bp, E. coli
gacctggaagacgtgaaatgggtaa

SEQ ID NO: 124226 - DNA, 25 bp, E. coli
gagttcgacctggaagacctgaaat

SEQ ID NO: 124227 - DNA, 25 bp, E. coli
gacctggaagacctgaaatgggtaa

SEQ ID NO: 124228 - DNA, 25 bp, E. coli
gagttcgacctgcaagacctgaaat

SEQ ID NO: 124229 - DNA, 25 bp, E. coli
cagagcagttggctaccggagactt

SEQ ID NO: 124230 - DNA, 25 bp, E. coli
catgccgggctgacaaaagaagtga

SEQ ID NO: 124231 - DNA, 25 bp, E. coli
cagagcagttgggtaccggagactt

SEQ ID NO: 124232 - DNA, 25 bp, E. coli
catgccgggctgtcaaaagaagtga

SEQ ID NO: 124233 - DNA, 25 bp, E. coli
tagtcaatctcgtcagcaaagggcg

SEQ ID NO: 124234 - DNA, 25 bp, E. coli
tagtcaatctcgacagcaaagggcg

SEQ ID NO: 124235 - DNA, 25 bp, E. coli
taggtcatgccaccgaatgtcagat

SEQ ID NO: 124236 - DNA, 25 bp, E. coli
taggtcatgccagcgaatgtcagat

SEQ ID NO: 124237 - DNA, 25 bp, E. coli
tatcggagcgactgcaggacttgtc

SEQ ID NO: 124238 - DNA, 25 bp, E. coli
tatcggagcgacagcaggacttgtc

SEQ ID NO: 124239 - DNA, 25 bp, E. coli
ttatcagtgccttcccgttatcggg

SEQ ID NO: 124240 - DNA, 25 bp, E. coli
ttatcagtgcctacccgttatcggg

SEQ ID NO: 124241 - DNA, 25 bp, E. coli
tgttaatcgcgccagtactgcggca

SEQ ID NO: 124242 - DNA, 25 bp, E. coli
tgttaatcgcgcgagtactgcggca

SEQ ID NO: 124243 - DNA, 25 bp, E. coli
tcgggaacagctccttgagaacgct

SEQ ID NO: 124244 - DNA, 25 bp, E. coli
tcgggaacagctgcttgagaacgct

SEQ ID NO: 124245 - DNA, 25 bp, E. coli
tctgtcgagcatgaacccggttgag

SEQ ID NO: 124246 - DNA, 25 bp, E. coli
tctgtcgagcatcaacccggttgag

SEQ ID NO: 124247 - DNA, 25 bp, E. coli
gctgtgggatgatacaacctggcat

SEQ ID NO: 124248 - DNA, 25 bp, E. coli
gctgtgggatgaaacaacctggcat

SEQ ID NO: 124249 - DNA, 25 bp, E. coli
tcaaggaagatatcgacgcagagca

SEQ ID NO: 124250 - DNA, 25 bp, E. coli
tcaaggaagataacgacgcagagca

SEQ ID NO: 124251 - DNA, 25 bp, E. coli
aagtctgggtggtttcagcgtgacc

SEQ ID NO: 124252 - DNA, 25 bp, E. coli
aagtctgggtggattcagcgtgacc

SEQ ID NO: 124253 - DNA, 25 bp, E. coli
caacattggtgtggaattactggca

SEQ ID NO: 124254 - DNA, 25 bp, E. coli
caacattggtgtcgaattactggca

SEQ ID NO: 124255 - DNA, 25 bp, E. coli
aaagttaacagtggcggctttggca

SEQ ID NO: 124256 - DNA, 25 bp, E. coli
aaagttaacagtcgcggctttggca

SEQ ID NO: 124257 - DNA, 25 bp, E. coli
ttccgccataaattcggcacccggg

SEQ ID NO: 124258 - DNA, 25 bp, E. coli
ttccgccataaaatcggcacccggg

SEQ ID NO: 124259 - DNA, 25 bp, E. coli
tggtgatgccaggagcaaattccgt

SEQ ID NO: 124260 - DNA, 25 bp, E. coli
tggtgatgccagcagcaaattccgt

SEQ ID NO: 124261 - DNA, 25 bp, E. coli
gcaggttctgcatccgtacgtccaa

SEQ ID NO: 124262 - DNA, 25 bp, E. coli
gcaggttctgcaaccgtacgtccaa

SEQ ID NO: 124263 - DNA, 25 bp, E. coli
cgtacgtccaacagaaggtgctggt

SEQ ID NO: 124264 - DNA, 25 bp, E. coli
cgtacgtccaactgaaggtgctggt

SEQ ID NO: 124265 - DNA, 25 bp, E. coli
cgtttacttatatggcgaccgacaa

SEQ ID NO: 124266 - DNA, 25 bp, E. coli
cgtttacttataaggcgaccgacaa

SEQ ID NO: 124267 - DNA, 25 bp, E. coli
gattatctgattaaccgtgactggt

SEQ ID NO: 124268 - DNA, 25 bp, E. coli
gattatctgatttaccgtgactggt

SEQ ID NO: 124269 - DNA, 25 bp, E. coli
gatttaacgatcatggcaaagaggc

SEQ ID NO: 124270 - DNA, 25 bp, E. coli
gatttaacgatcttggcaaagaggc

SEQ ID NO: 124271 - DNA, 25 bp, E. coli
ggcgaccggcgaaattgcaaccgtt

SEQ ID NO: 124272 - DNA, 25 bp, E. coli
ggcgaccggcgatattgcaaccgtt

SEQ ID NO: 124273 - DNA, 25 bp, E. coli
cagccagtggcgacatctcaattcg

SEQ ID NO: 124274 - DNA, 25 bp, E. coli
cagccagtggcgtcatctcaattcg

SEQ ID NO: 124275 - DNA, 25 bp, E. coli
caggtcagagtgtgtcatgcgcaat

SEQ ID NO: 124276 - DNA, 25 bp, E. coli
caggtcagagtgagtcatgcgcaat

SEQ ID NO: 124277 - DNA, 25 bp, E. coli
catcgtgcagtgagcgcgttttgcg

SEQ ID NO: 124278 - DNA, 25 bp, E. coli
catcgtgcagtgtgcgcgttttgcg

SEQ ID NO: 124279 - DNA, 25 bp, E. coli
ttctctggccgaggtagccacggtg

SEQ ID NO: 124280 - DNA, 25 bp, E. coli
ttctctggccgacgtagccacggtg

SEQ ID NO: 124281 - DNA, 25 bp, E. coli
tgtggctgaccgatatccgcaagat

SEQ ID NO: 124282 - DNA, 25 bp, E. coli
tgtggctgaccgttatccgcaagat

SEQ ID NO: 124283 - DNA, 25 bp, E. coli
tgaatcgccatccttacaccagtga

SEQ ID NO: 124284 - DNA, 25 bp, E. coli
tgaatcgccatcgttacaccagtga

SEQ ID NO: 124285 - DNA, 25 bp, E. coli
ccacggtggcgcatcagttaaaact

SEQ ID NO: 124286 - DNA, 25 bp, E. coli
ccacggtggcgcttcagttaaaact

SEQ ID NO: 124287 - DNA, 25 bp, E. coli
gacgataaacacacctacgcttccg

SEQ ID NO: 124288 - DNA, 25 bp, E. coli
gacgataaacactcctacgcttccg

SEQ ID NO: 124289 - DNA, 25 bp, E. coli
gggcaaccacactggcgcttaggta

SEQ ID NO: 124290 - DNA, 25 bp, E. coli
gggcaaccacacaggcgcttaggta

SEQ ID NO: 124291 - DNA, 25 bp, E. coli
ggcaggttatcgctcagcttgagca

SEQ ID NO: 124292 - DNA, 25 bp, E. coli
tggcggctagcctgaaaagtccctt

SEQ ID NO: 124293 - DNA, 25 bp, E. coli
tggcggctagccagaaaagtccctt

SEQ ID NO: 124294 - DNA, 25 bp, E. coli
ggcaggttatcggtcagcttgagca

SEQ ID NO: 124295 - DNA, 25 bp, E. coli
cccttacctttatagcggatgcgat

SEQ ID NO: 124296 - DNA, 25 bp, E. coli
cccttacctttaaagcggatgcgat

SEQ ID NO: 124297 - DNA, 25 bp, E. coli
catatccttcctgaaaatcgcgcaa

SEQ ID NO: 124298 - DNA, 25 bp, E. coli
catatccttcctcaaaatcgcgcaa

SEQ ID NO: 124299 - DNA, 25 bp, E. coli
taaagcggatgccatttatatcgca

SEQ ID NO: 124300 - DNA, 25 bp, E. coli
taaagcggatgcgatttatatcgca

SEQ ID NO: 124301 - DNA, 25 bp, E. coli
agtgcagtactcttgccggatgcgg

SEQ ID NO: 124302 - DNA, 25 bp, E. coli
atcgcgcaaattctatatattgcag

SEQ ID NO: 124303 - DNA, 25 bp, E. coli
atcgcgcaaattgtatatattgcag

SEQ ID NO: 124304 - DNA, 25 bp, E. coli
agtgcagtactcatgccggatgcgg

SEQ ID NO: 124305 - DNA, 25 bp, E. coli
tagctaaaaatattcaggcgagtgg

SEQ ID NO: 124306 - DNA, 25 bp, E. coli
tagctaaaaataatcaggcgagtgg

SEQ ID NO: 124307 - DNA, 25 bp, E. coli
tatatcgcataacagtgcagtactc

SEQ ID NO: 124308 - DNA, 25 bp, E. coli
tataaaccgtgggaaaatccaacat

SEQ ID NO: 124309 - DNA, 25 bp, E. coli
tatatcgcataagagtgcagtactc

SEQ ID NO: 124310 - DNA, 25 bp, E. coli
tataaaccgtggcaaaatccaacat

SEQ ID NO: 124311 - DNA, 25 bp, E. coli
gcaatgttacaataaaagccacggt

SEQ ID NO: 124312 - DNA, 25 bp, E. coli
gcaatgttacaaaaaaagccacggt

SEQ ID NO: 124313 - DNA, 25 bp, E. coli
ggcaaaatccaacatagctaaaaat

SEQ ID NO: 124314 - DNA, 25 bp, E. coli
ggcaaaatccaagatagctaaaaat

SEQ ID NO: 124315 - DNA, 25 bp, E. coli
gatgcggcatgactaccatatcctt

SEQ ID NO: 124316 - DNA, 25 bp, E. coli
gatgcggcatgagtaccatatcctt

SEQ ID NO: 124317 - DNA, 25 bp, E. coli
tacaaaaaagaatacgcgtcgtctc

SEQ ID NO: 124318 - DNA, 25 bp, E. coli
tacaaaaaagaaaacgcgtcgtctc

SEQ ID NO: 124319 - DNA, 25 bp, E. coli
agaatacgcgtcgtctcgcaaaaaa

SEQ ID NO: 124320 - DNA, 25 bp, E. coli
agaatacgcgtcctctcgcaaaaaa

SEQ ID NO: 124321 - DNA, 25 bp, E. coli
aaaagaatacgcctcgtctcgcaaa

SEQ ID NO: 124322 - DNA, 25 bp, E. coli
aacggatatggatagcggctcggaa

SEQ ID NO: 124323 - DNA, 25 bp, E. coli
aaaagaatacgcgtcgtctcgcaaa

SEQ ID NO: 124324 - DNA, 25 bp, E. coli
aacggatatggaaagcggctcggaa

SEQ ID NO: 124325 - DNA, 25 bp, E. coli
ttttacccctgctcatttgttaacg

SEQ ID NO: 124326 - DNA, 25 bp, E. coli
ttttacccctgcacatttgttaacg

SEQ ID NO: 124327 - DNA, 25 bp, E. coli
gcagagttttacatgcgttaacgga

SEQ ID NO: 124328 - DNA, 25 bp, E. coli
gctcggaaggaatagcaaaaggcga

SEQ ID NO: 124329 - DNA, 25 bp, E. coli
gcagagttttacttgcgttaacgga

SEQ ID NO: 124330 - DNA, 25 bp, E. coli
gctcggaaggaaaagcaaaaggcga

SEQ ID NO: 124331 - DNA, 25 bp, E. coli
gcacatttgttaacgccagcagagt

SEQ ID NO: 124332 - DNA, 25 bp, E. coli
gcacatttgttatcgccagcagagt

SEQ ID NO: 124333 - DNA, 25 bp, E. coli
gaaagcggctcggaaggaaaagcaa

SEQ ID NO: 124334 - DNA, 25 bp, E. coli
gaaagcggctcgcaaggaaaagcaa

SEQ ID NO: 124335 - DNA, 25 bp, E. coli
cgttaacggataaggaaagcggctc

SEQ ID NO: 124336 - DNA, 25 bp, E. coli
cgttaacggatatggaaagcggctc

SEQ ID NO: 124337 - DNA, 25 bp, E. coli
taacgccagcagtgttttacatgcg

SEQ ID NO: 124338 - DNA, 25 bp, E. coli
taacgccagcagagttttacatgcg

SEQ ID NO: 124339 - DNA, 25 bp, E. coli
taccgagcgaagagtaacggatgcg

SEQ ID NO: 124340 - DNA, 25 bp, E. coli
taccgagcgaagtgtaacggatgcg

SEQ ID NO: 124341 - DNA, 25 bp, E. coli
atgttaaaccatgtccattttgtgg

SEQ ID NO: 124342 - DNA, 25 bp, E. coli
atgttaaaccatctccattttgtgg

SEQ ID NO: 124343 - DNA, 25 bp, E. coli
tgtccattttgtcgttgtccatcag

SEQ ID NO: 124344 - DNA, 25 bp, E. coli
tgtccattttgtggttgtccatcag

SEQ ID NO: 124345 - DNA, 25 bp, E. coli
ttgtggttgtccatcagtaacggtg

SEQ ID NO: 124346 - DNA, 25 bp, E. coli
ttgtggttgtccttcagtaacggtg

SEQ ID NO: 124347 - DNA, 25 bp, E. coli
tcagtaacggtgtaagccatttcag

SEQ ID NO: 124348 - DNA, 25 bp, E. coli
tcagtaacggtgaaagccatttcag

SEQ ID NO: 124349 - DNA, 25 bp, E. coli
gccatttcaggaaattaccgagcga

SEQ ID NO: 124350 - DNA, 25 bp, E. coli
gccatttcaggatattaccgagcga

SEQ ID NO: 124351 - DNA, 25 bp, E. coli
gaagtgtaacggttgcgaatcccga

SEQ ID NO: 124352 - DNA, 25 bp, E. coli
gaagtgtaacggatgcgaatcccga

SEQ ID NO: 124353 - DNA, 25 bp, E. coli
tcccgaaccggttatggtggaagtg

SEQ ID NO: 124354 - DNA, 25 bp, E. coli
tcccgaaccggtaatggtggaagtg

SEQ ID NO: 124355 - DNA, 25 bp, E. coli
taacggatgcgattcccgaaccggt

SEQ ID NO: 124356 - DNA, 25 bp, E. coli
taacggatgcgaatcccgaaccggt

SEQ ID NO: 124357 - DNA, 25 bp, E. coli
gatgcgaatccccaaccggttatgg

SEQ ID NO: 124358 - DNA, 25 bp, E. coli
gatgcgaatcccgaaccggttatgg

SEQ ID NO: 124359 - DNA, 25 bp, E. coli
gagatatgacaatgttaaaccatgt

SEQ ID NO: 124360 - DNA, 25 bp, E. coli
gagatatgacaaagttaaaccatgt

SEQ ID NO: 124361 - DNA, 25 bp, E. coli
caagctggtgctggaacactgcgac

SEQ ID NO: 124362 - DNA, 25 bp, E. coli
caagctggtgctcgaacactgcgac

SEQ ID NO: 124363 - DNA, 25 bp, E. coli
taaatgcgacgggtgatgtgcacca

SEQ ID NO: 124364 - DNA, 25 bp, E. coli
taaatgcgacggctgatgtgcacca

SEQ ID NO: 124365 - DNA, 25 bp, E. coli
tattatcggcgcgtatccctgtgca

SEQ ID NO: 124366 - DNA, 25 bp, E. coli
tattatcggcgcctatccctgtgca

SEQ ID NO: 124367 - DNA, 25 bp, E. coli
tgttctctggtaggacgctaaacgg

SEQ ID NO: 124368 - DNA, 25 bp, E. coli
tgttctctggtacgacgctaaacgg

SEQ ID NO: 124369 - DNA, 25 bp, E. coli
tgaagggcgcaaaacaacgctgccg

SEQ ID NO: 124370 - DNA, 25 bp, E. coli
tgaagggcgcaatacaacgctgccg

SEQ ID NO: 124371 - DNA, 25 bp, E. coli
cctccagtgatgtagaacagcgcca

SEQ ID NO: 124372 - DNA, 25 bp, E. coli
cctccagtgatgaagaacagcgcca

SEQ ID NO: 124373 - DNA, 25 bp, E. coli
gcatctgtatcatctgggcgcgctc

SEQ ID NO: 124374 - DNA, 25 bp, E. coli
gcatctgtatcaactgggcgcgctc

SEQ ID NO: 124375 - DNA, 25 bp, E. coli
gaatggcaggatttacacgcaccgt

SEQ ID NO: 124376 - DNA, 25 bp, E. coli
gaatggcaggatatacacgcaccgt

SEQ ID NO: 124377 - DNA, 25 bp, E. coli
ggttactccgtcatacgccagagag

SEQ ID NO: 124378 - DNA, 25 bp, E. coli
ggttactccgtcttacgccagagag

SEQ ID NO: 124379 - DNA, 25 bp, E. coli
tggaaaattttcacccgctgggcga

SEQ ID NO: 124380 - DNA, 25 bp, E. coli
tggaaaattttctcccgctgggcga

SEQ ID NO: 124381 - DNA, 25 bp, E. coli
taatgttatgcatgcgacggacgct

SEQ ID NO: 124382 - DNA, 25 bp, E. coli
taatgttatgcaagcgacggacgct

SEQ ID NO: 124383 - DNA, 25 bp, E. coli
cagaacgctgaaggtggatatcaac

SEQ ID NO: 124384 - DNA, 25 bp, E. coli
cagaacgctgaacgtggatatcaac

SEQ ID NO: 124385 - DNA, 25 bp, E. coli
tatcaacaccgtgattctcacttta

SEQ ID NO: 124386 - DNA, 25 bp, E. coli
tatcaacaccgtcattctcacttta

SEQ ID NO: 124387 - DNA, 25 bp, E. coli
tcgcgatagctccagaacgctgaag

SEQ ID NO: 124388 - DNA, 25 bp, E. coli
tcgcgatagctcgagaacgctgaag

SEQ ID NO: 124389 - DNA, 25 bp, E. coli
gcgatagctccagaacgctgaaggt

SEQ ID NO: 124390 - DNA, 25 bp, E. coli
gcgatagctccacaacgctgaaggt

SEQ ID NO: 124391 - DNA, 25 bp, E. coli
gctccagaacgctgaaggtggatat

SEQ ID NO: 124392 - DNA, 25 bp, E. coli
gctccagaacgcagaaggtggatat

SEQ ID NO: 124393 - DNA, 25 bp, E. coli
gaacgctgaaggaggatatcaacac

SEQ ID NO: 124394 - DNA, 25 bp, E. coli
gaaggtggatatgaacaccgtcatt

SEQ ID NO: 124395 - DNA, 25 bp, E. coli
gaacgctgaaggtggatatcaacac

SEQ ID NO: 124396 - DNA, 25 bp, E. coli
gaaggtggatatcaacaccgtcatt

SEQ ID NO: 124397 - DNA, 25 bp, E. coli
cgctgaaggtggttatcaacaccgt

SEQ ID NO: 124398 - DNA, 25 bp, E. coli
cgctgaaggtggatatcaacaccgt

SEQ ID NO: 124399 - DNA, 25 bp, E. coli
gatagctccagatcgctgaaggtgg

SEQ ID NO: 124400 - DNA, 25 bp, E. coli
gatagctccagaacgctgaaggtgg

SEQ ID NO: 124401 - DNA, 25 bp, E. coli
gggttcgcgatagctccagaacgct

SEQ ID NO: 124402 - DNA, 25 bp, E. coli
gggttcgcgatacctccagaacgct

SEQ ID NO: 124403 - DNA, 25 bp, E. coli
tggatatcaacagcgtcattctcac

SEQ ID NO: 124404 - DNA, 25 bp, E. coli
tggatatcaacaccgtcattctcac

SEQ ID NO: 124405 - DNA, 25 bp, E. coli
aacgaaatgccaacgagcgaatgcg

SEQ ID NO: 124406 - DNA, 25 bp, E. coli
tactggcgatgagtattttcaccgc

SEQ ID NO: 124407 - DNA, 25 bp, E. coli
aacgaaatgccatcgagcgaatgcg

SEQ ID NO: 124408 - DNA, 25 bp, E. coli
tatccactcaagcaaagacggcacg

SEQ ID NO: 124409 - DNA, 25 bp, E. coli
tatccactcaaggaaagacggcacg

SEQ ID NO: 124410 - DNA, 25 bp, E. coli
tactggcgatgactattttcaccgc

SEQ ID NO: 124411 - DNA, 25 bp, E. coli
gcccatgaacaatcaatcagggatg

SEQ ID NO: 124412 - DNA, 25 bp, E. coli
gcccatgaacaaacaatcagggatg

SEQ ID NO: 124413 - DNA, 25 bp, E. coli
gacactgcttgatgtcttactggcg

SEQ ID NO: 124414 - DNA, 25 bp, E. coli
gacactgcttgaagtcttactggcg

SEQ ID NO: 124415 - DNA, 25 bp, E. coli
ctggcattgtggttagcggataacc

SEQ ID NO: 124416 - DNA, 25 bp, E. coli
ctggcattgtggatagcggataacc

SEQ ID NO: 124417 - DNA, 25 bp, E. coli
ggataaccagcttcagtcacaagat

SEQ ID NO: 124418 - DNA, 25 bp, E. coli
ggataaccagctacagtcacaagat

SEQ ID NO: 124419 - DNA, 25 bp, E. coli
ggaactggcgcaccgatatccactc

SEQ ID NO: 124420 - DNA, 25 bp, E. coli
ggaactggcgcagcgatatccactc

SEQ ID NO: 124421 - DNA, 25 bp, E. coli
taatgagcagtaagcaagggcaacg

SEQ ID NO: 124422 - DNA, 25 bp, E. coli
taatgagcagtatgcaagggcaacg

SEQ ID NO: 124423 - DNA, 25 bp, E. coli
tcacaagattcaatcggcgaggaaa

SEQ ID NO: 124424 - DNA, 25 bp, E. coli
tcacaagattcattcggcgaggaaa

SEQ ID NO: 124425 - DNA, 25 bp, E. coli
gaggaaaacacgaccagttctggca

SEQ ID NO: 124426 - DNA, 25 bp, E. coli
gaggaaaacacgtccagttctggca

SEQ ID NO: 124427 - DNA, 25 bp, E. coli
gagtgggaagactgcgacctttcgt

SEQ ID NO: 124428 - DNA, 25 bp, E. coli
gagtgggaagacagcgacctttcgt

SEQ ID NO: 124429 - DNA, 25 bp, E. coli
tatgcctcgcgaattgccgtcgttg

SEQ ID NO: 124430 - DNA, 25 bp, E. coli
tatgcctcgcgatttgccgtcgttg

SEQ ID NO: 124431 - DNA, 25 bp, E. coli
tgtaattgtgcagcttcccaacgac

SEQ ID NO: 124432 - DNA, 25 bp, E. coli
tgtcatcactggctttgcgttcggg

SEQ ID NO: 124433 - DNA, 25 bp, E. coli
tgtcatcactgggtttgcgttcggg

SEQ ID NO: 124434 - DNA, 25 bp, E. coli
tgtaattgtgcaccttcccaacgac

SEQ ID NO: 124435 - DNA, 25 bp, E. coli
tgcggcatcagcgaacagagcgtgt

SEQ ID NO: 124436 - DNA, 25 bp, E. coli
tgcggcatcagccaacagagcgtgt

SEQ ID NO: 124437 - DNA, 25 bp, E. coli
gcaagggttttagcgcacaggcgac

SEQ ID NO: 124438 - DNA, 25 bp, E. coli
gcaagggttttaccgcacaggcgac

SEQ ID NO: 124439 - DNA, 25 bp, E. coli
gaaaccgggcaattgttaacgcgcg

SEQ ID NO: 124440 - DNA, 25 bp, E. coli
gaaaccgggcaaatgttaacgcgcg

SEQ ID NO: 124441 - DNA, 25 bp, E. coli
gaacctgcacgttgaggacgcataa

SEQ ID NO: 124442 - DNA, 25 bp, E. coli
gaacctgcacgtagaggacgcataa

SEQ ID NO: 124443 - DNA, 25 bp, E. coli
gttttacccggcaggacgatccgca

SEQ ID NO: 124444 - DNA, 25 bp, E. coli
gttttacccggctggacgatccgca

SEQ ID NO: 124445 - DNA, 25 bp, E. coli
ggtcgttaaccttcagcgcgcttga

SEQ ID NO: 124446 - DNA, 25 bp, E. coli
ggtcgttaacctacagcgcgcttga

SEQ ID NO: 124447 - DNA, 25 bp, E. coli
taatcgcgcaggtaagagtgactca

SEQ ID NO: 124448 - DNA, 25 bp, E. coli
taatcgcgcaggaaagagtgactca

SEQ ID NO: 124449 - DNA, 25 bp, E. coli
caaaacgctgttagtacaacaacag

SEQ ID NO: 124450 - DNA, 25 bp, E. coli
caaaacgctgtttgtacaacaacag

SEQ ID NO: 124451 - DNA, 25 bp, E. coli
acgtcggctgggactacaacgctat

SEQ ID NO: 124452 - DNA, 25 bp, E. coli
acgtcggctgggtctacaacgctat

SEQ ID NO: 124453 - DNA, 25 bp, E. coli
ttgtgcaacgctggctgcatgacgc

SEQ ID NO: 124454 - DNA, 25 bp, E. coli
ttgtgcaacgctcgctgcatgacgc

SEQ ID NO: 124455 - DNA, 25 bp, E. coli
ttaaacgtcggcagggactacaacg

SEQ ID NO: 124456 - DNA, 25 bp, E. coli
ttaaacgtcggctgggactacaacg

SEQ ID NO: 124457 - DNA, 25 bp, E. coli
gcggcaaaacgcagttagtacaaca

SEQ ID NO: 124458 - DNA, 25 bp, E. coli
ccatcgcggttcagcttttggtcgc

SEQ ID NO: 124459 - DNA, 25 bp, E. coli
gcggcaaaacgctgttagtacaaca

SEQ ID NO: 124460 - DNA, 25 bp, E. coli
ccatcgcggttctgcttttggtcgc

SEQ ID NO: 124461 - DNA, 25 bp, E. coli
gcgccatcgcggatctgcttttggt

SEQ ID NO: 124462 - DNA, 25 bp, E. coli
gctcgcatattgagcaacgctggct

SEQ ID NO: 124463 - DNA, 25 bp, E. coli
gcatattgtgcaacgctggctgcat

SEQ ID NO: 124464 - DNA, 25 bp, E. coli
gcatattgtgcatcgctggctgcat

SEQ ID NO: 124465 - DNA, 25 bp, E. coli
gctcgcatattgtgcaacgctggct

SEQ ID NO: 124466 - DNA, 25 bp, E. coli
gctggcgcgccatcgcggttctgct

SEQ ID NO: 124467 - DNA, 25 bp, E. coli
gctggcgcgccaacgcggttctgct

SEQ ID NO: 124468 - DNA, 25 bp, E. coli
gcgccatcgcggttctgcttttggt

SEQ ID NO: 124469 - DNA, 25 bp, E. coli
cggcgctggcactggggcataaact

SEQ ID NO: 124470 - DNA, 25 bp, E. coli
cggcgctggcacaggggcataaact

SEQ ID NO: 124471 - DNA, 25 bp, E. coli
tgattgccaaaggtctggtgccgtg

SEQ ID NO: 124472 - DNA, 25 bp, E. coli
tgttgccgtgataaccggagccgca

SEQ ID NO: 124473 - DNA, 25 bp, E. coli
tgattaatgatcgtccggatgcgga

SEQ ID NO: 124474 - DNA, 25 bp, E. coli
tgattaatgatcctccggatgcgga

SEQ ID NO: 124475 - DNA, 25 bp, E. coli
tgatattgcttccactgtccgcgcg

SEQ ID NO: 124476 - DNA, 25 bp, E. coli
tgattgccaaagctctggtgccgtg

SEQ ID NO: 124477 - DNA, 25 bp, E. coli
tgatattgcttcgactgtccgcgcg

SEQ ID NO: 124478 - DNA, 25 bp, E. coli
tgttgccgtgattaccggagccgca

SEQ ID NO: 124479 - DNA, 25 bp, E. coli
tcagtgaaaaaacgcggtgaccttc

SEQ ID NO: 124480 - DNA, 25 bp, E. coli
tcagtgaaaaaaggcggtgaccttc

SEQ ID NO: 124481 - DNA, 25 bp, E. coli
gaagtgcgtcctcgtctcatcaaaa

SEQ ID NO: 124482 - DNA, 25 bp, E. coli
gaatcgcggcgattataccattgcc

SEQ ID NO: 124483 - DNA, 25 bp, E. coli
gaatcgcggcgaatataccattgcc

SEQ ID NO: 124484 - DNA, 25 bp, E. coli
gcaacggcctattacgacgaactga

SEQ ID NO: 124485 - DNA, 25 bp, E. coli
gcaacggcctataacgacgaactga

SEQ ID NO: 124486 - DNA, 25 bp, E. coli
gaagtgcgtcctggtctcatcaaaa

SEQ ID NO: 124487 - DNA, 25 bp, E. coli
gaaatccactcgacctgttgccgtg

SEQ ID NO: 124488 - DNA, 25 bp, E. coli
gaaatccactcgtcctgttgccgtg

SEQ ID NO: 124489 - DNA, 25 bp, E. coli
gatatgactattgcggcaacggcct

SEQ ID NO: 124490 - DNA, 25 bp, E. coli
gatatgactattccggcaacggcct

SEQ ID NO: 124491 - DNA, 25 bp, E. coli
taagcgcttactggcacagccgaaa

SEQ ID NO: 124492 - DNA, 25 bp, E. coli
taagcgcttactcgcacagccgaaa

SEQ ID NO: 124493 - DNA, 25 bp, E. coli
aaccttactacgctcctgcggcgga

SEQ ID NO: 124494 - DNA, 25 bp, E. coli
caacctgttcaggaaccgtattacg

SEQ ID NO: 124495 - DNA, 25 bp, E. coli
aaccttactacggtcctgcggcgga

SEQ ID NO: 124496 - DNA, 25 bp, E. coli
caacctgttcagcaaccgtattacg

SEQ ID NO: 124497 - DNA, 25 bp, E. coli
agccggttacactgcagccgcagta

SEQ ID NO: 124498 - DNA, 25 bp, E. coli
atgcgcctgcgggtgaacaacctgt

SEQ ID NO: 124499 - DNA, 25 bp, E. coli
agccggttacacagcagccgcagta

SEQ ID NO: 124500 - DNA, 25 bp, E. coli
atgcgcctgcggctgaacaacctgt

SEQ ID NO: 124501 - DNA, 25 bp, E. coli
tgctgaccctgacgacgtcctgttt

SEQ ID NO: 124502 - DNA, 25 bp, E. coli
tgctgaccctgaggacgtcctgttt

SEQ ID NO: 124503 - DNA, 25 bp, E. coli
tcctgcggcggaacaacctgttcag

SEQ ID NO: 124504 - DNA, 25 bp, E. coli
tcctgcggcggatcaacctgttcag

SEQ ID NO: 124505 - DNA, 25 bp, E. coli
gcaaacgggagaaccggttattgca

SEQ ID NO: 124506 - DNA, 25 bp, E. coli
gctgaacaacctctgcaacaacctt

SEQ ID NO: 124507 - DNA, 25 bp, E. coli
gcaaacgggagatccggttattgca

SEQ ID NO: 124508 - DNA, 25 bp, E. coli
gctgaacaacctgtgcaacaacctt

SEQ ID NO: 124509 - DNA, 25 bp, E. coli
ccgacagtgaaaccgaaggtggcgt

SEQ ID NO: 124510 - DNA, 25 bp, E. coli
ccgacagtgaaagcgaaggtggcgt

SEQ ID NO: 124511 - DNA, 25 bp, E. coli
gttcagcaaccgaattacgcccctg

SEQ ID NO: 124512 - DNA, 25 bp, E. coli
gttcagcaaccgtattacgcccctg

SEQ ID NO: 124513 - DNA, 25 bp, E. coli
gtgcaacaacctaactacgctcctg

SEQ ID NO: 124514 - DNA, 25 bp, E. coli
gtgcaacaaccttactacgctcctg

SEQ ID NO: 124515 - DNA, 25 bp, E. coli
agtttatcttgacccaatgttcccg

SEQ ID NO: 124516 - DNA, 25 bp, E. coli
agtttatcttgagccaatgttcccg

SEQ ID NO: 124517 - DNA, 25 bp, E. coli
tgagccgaagctgggcggcatcttt

SEQ ID NO: 124518 - DNA, 25 bp, E. coli
tgagccgaagctcggcggcatcttt

SEQ ID NO: 124519 - DNA, 25 bp, E. coli
tctgacggcgctcagcgatatcacc

SEQ ID NO: 124520 - DNA, 25 bp, E. coli
tctgacggcgctgagcgatatcacc

SEQ ID NO: 124521 - DNA, 25 bp, E. coli
gcacctggaactccgcaagcgtgat

SEQ ID NO: 124522 - DNA, 25 bp, E. coli
gcacctggaactgcgcaagcgtgat

SEQ ID NO: 124523 - DNA, 25 bp, E. coli
cgccaccgcaggattagggcgcgat

SEQ ID NO: 124524 - DNA, 25 bp, E. coli
cgccaccgcaggtttagggcgcgat

SEQ ID NO: 124525 - DNA, 25 bp, E. coli
cccgcgtccgcaggtagtttatctt

SEQ ID NO: 124526 - DNA, 25 bp, E. coli
cccgcgtccgcacgtagtttatctt

SEQ ID NO: 124527 - DNA, 25 bp, E. coli
ctttgatatttaggccggaacgccg

SEQ ID NO: 124528 - DNA, 25 bp, E. coli
ctttgatatttacgccggaacgccg

SEQ ID NO: 124529 - DNA, 25 bp, E. coli
gtgaagcgtccgcactatgcgccgc

SEQ ID NO: 124530 - DNA, 25 bp, E. coli
gtgaagcgtccggactatgcgccgc

SEQ ID NO: 124531 - DNA, 25 bp, E. coli
tggttacaggaaggtttgcagttga

SEQ ID NO: 124532 - DNA, 25 bp, E. coli
tggttacaggaacgtttgcagttga

SEQ ID NO: 124533 - DNA, 25 bp, E. coli
ggcattatgggcagaacattcagtg

SEQ ID NO: 124534 - DNA, 25 bp, E. coli
ggcattatgggctgaacattcagtg

SEQ ID NO: 124535 - DNA, 25 bp, E. coli
gagcctgcgcggttgctggcaacca

SEQ ID NO: 124536 - DNA, 25 bp, E. coli
gagcctgcgcggatgctggcaacca

SEQ ID NO: 124537 - DNA, 25 bp, E. coli
atattcgagccggagtccgctatcg

SEQ ID NO: 124538 - DNA, 25 bp, E. coli
atattcgagccgcagtccgctatcg

SEQ ID NO: 124539 - DNA, 25 bp, E. coli
atgacggcgaaacagttcgcttcgc

SEQ ID NO: 124540 - DNA, 25 bp, E. coli
atgacggcgaaagagttcgcttcgc

SEQ ID NO: 124541 - DNA, 25 bp, E. coli
aaaacaatattccagccggagtccg

SEQ ID NO: 124542 - DNA, 25 bp, E. coli
aaaacaatattcgagccggagtccg

SEQ ID NO: 124543 - DNA, 25 bp, E. coli
acagcatcagtttgttgagtgctga

SEQ ID NO: 124544 - DNA, 25 bp, E. coli
aacaatattcgacccggagtccgct

SEQ ID NO: 124545 - DNA, 25 bp, E. coli
aacaatattcgagccggagtccgct

SEQ ID NO: 124546 - DNA, 25 bp, E. coli
acagcatcagttagttgagtgctga

SEQ ID NO: 124547 - DNA, 25 bp, E. coli
tgaaaacaatatacgagccggagtc

SEQ ID NO: 124548 - DNA, 25 bp, E. coli
tgaacagcatcactttgttgagtgc

SEQ ID NO: 124549 - DNA, 25 bp, E. coli
tgaacagcatcagtttgttgagtgc

SEQ ID NO: 124550 - DNA, 25 bp, E. coli
tgaaaacaatattcgagccggagtc

SEQ ID NO: 124551 - DNA, 25 bp, E. coli
gaaggtgaaaactatattcgagccg

SEQ ID NO: 124552 - DNA, 25 bp, E. coli
gaaggtgaaaacaatattcgagccg

SEQ ID NO: 124553 - DNA, 25 bp, E. coli
gaaagagttcgcatcgccgtcgcca

SEQ ID NO: 124554 - DNA, 25 bp, E. coli
gaaagagttcgcttcgccgtcgcca

SEQ ID NO: 124555 - DNA, 25 bp, E. coli
cttaatgaacagcatcagtttgttg

SEQ ID NO: 124556 - DNA, 25 bp, E. coli
cttaatgaacaggatcagtttgttg

SEQ ID NO: 124557 - DNA, 25 bp, E. coli
ggtgaaaacaattttcgagccggag

SEQ ID NO: 124558 - DNA, 25 bp, E. coli
ggtgaaaacaatattcgagccggag

SEQ ID NO: 124559 - DNA, 25 bp, E. coli
tactggctttaaccgccagccgaag

SEQ ID NO: 124560 - DNA, 25 bp, E. coli
tactggctttaagcgccagccgaag

SEQ ID NO: 124561 - DNA, 25 bp, E. coli
agatcggtcggccagacgatgacac

SEQ ID NO: 124562 - DNA, 25 bp, E. coli
agatcggtcggcgagacgatgacac

SEQ ID NO: 124563 - DNA, 25 bp, E. coli
tgcccactttgggtggccgctggaa

SEQ ID NO: 124564 - DNA, 25 bp, E. coli
tgcccactttggctggccgctggaa

SEQ ID NO: 124565 - DNA, 25 bp, E. coli
gccagaaatgcggtcgaacagctct

SEQ ID NO: 124566 - DNA, 25 bp, E. coli
gccagaaatgcgctcgaacagctct

SEQ ID NO: 124567 - DNA, 25 bp, E. coli
gcgccagttatcgtcgcggaatctg

SEQ ID NO: 124568 - DNA, 25 bp, E. coli
gcgccagttatcctcgcggaatctg

SEQ ID NO: 124569 - DNA, 25 bp, E. coli
gctgttaacatctgtacgtcaggga

SEQ ID NO: 124570 - DNA, 25 bp, E. coli
gctaacgttcgtctgctcagtcacg

SEQ ID NO: 124571 - DNA, 25 bp, E. coli
gctgacgagttgatggcgctgttaa

SEQ ID NO: 124572 - DNA, 25 bp, E. coli
gctgacgagttgttggcgctgttaa

SEQ ID NO: 124573 - DNA, 25 bp, E. coli
gctgttaacatcagtacgtcaggga

SEQ ID NO: 124574 - DNA, 25 bp, E. coli
gctaacgttcgtgtgctcagtcacg

SEQ ID NO: 124575 - DNA, 25 bp, E. coli
gacgttacgtaatcgcagtagtcgt

SEQ ID NO: 124576 - DNA, 25 bp, E. coli
gacgttacgtaaacgcagtagtcgt

SEQ ID NO: 124577 - DNA, 25 bp, E. coli
gatcaatgcactcggattgctggaa

SEQ ID NO: 124578 - DNA, 25 bp, E. coli
gatcaatgcactgggattgctggaa

SEQ ID NO: 124579 - DNA, 25 bp, E. coli
gatgccatgctcaaagcagctaacg

SEQ ID NO: 124580 - DNA, 25 bp, E. coli
gatgccatgctctaagcagctaacg

SEQ ID NO: 124581 - DNA, 25 bp, E. coli
caatggtgcagcaagatccggtggt

SEQ ID NO: 124582 - DNA, 25 bp, E. coli
caatggtgcagctagatccggtggt

SEQ ID NO: 124583 - DNA, 25 bp, E. coli
cagtaggcgtagagcaacagttgcg

SEQ ID NO: 124584 - DNA, 25 bp, E. coli
cagtaggcgtagtgcaacagttgcg

SEQ ID NO: 124585 - DNA, 25 bp, E. coli
tatggtagcgaataataacctgccg

SEQ ID NO: 124586 - DNA, 25 bp, E. coli
tatggtagcgaaaaataacctgccg

SEQ ID NO: 124587 - DNA, 25 bp, E. coli
tatatggcgaggatgcaaaccctgc

SEQ ID NO: 124588 - DNA, 25 bp, E. coli
tatatggcgaggttgcaaaccctgc

SEQ ID NO: 124589 - DNA, 25 bp, E. coli
ttaccgtagtggcaactgtcctgcg

SEQ ID NO: 124590 - DNA, 25 bp, E. coli
ttaccgtagtgggaactgtcctgcg

SEQ ID NO: 124591 - DNA, 25 bp, E. coli
ccgctaacggaaggtgagattcgcc

SEQ ID NO: 124592 - DNA, 25 bp, E. coli
ccgctaacggaacgtgagattcgcc

SEQ ID NO: 124593 - DNA, 25 bp, E. coli
cattgactccggaactgaacaggcg

SEQ ID NO: 124594 - DNA, 25 bp, E. coli
cattgactccggtactgaacaggcg

SEQ ID NO: 124595 - DNA, 25 bp, E. coli
gatatctccgaagaacgcgtctggc

SEQ ID NO: 124596 - DNA, 25 bp, E. coli
gattcaacatgcactggcggcggtg

SEQ ID NO: 124597 - DNA, 25 bp, E. coli
gatatctccgaacaacgcgtctggc

SEQ ID NO: 124598 - DNA, 25 bp, E. coli
gattcaacatgctctggcggcggtg

SEQ ID NO: 124599 - DNA, 25 bp, E. coli
taagcgagtttgatacccaacccgt

SEQ ID NO: 124600 - DNA, 25 bp, E. coli
taagcgagtttgttacccaacccgt

SEQ ID NO: 124601 - DNA, 25 bp, E. coli
gatgtatcaactgcaacttgcgggc

SEQ ID NO: 124602 - DNA, 25 bp, E. coli
gatgtatcaactccaacttgcgggc

SEQ ID NO: 124603 - DNA, 25 bp, E. coli
aacctggaataatagcagttgccgc

SEQ ID NO: 124604 - DNA, 25 bp, E. coli
cagtgggaacctggaataaaagcag

SEQ ID NO: 124605 - DNA, 25 bp, E. coli
cagtgggaacctcgaataaaagcag

SEQ ID NO: 124606 - DNA, 25 bp, E. coli
aacctggaataaaagcagttgccgc

SEQ ID NO: 124607 - DNA, 25 bp, E. coli
ttgcgaaatcagagggaacctggaa

SEQ ID NO: 124608 - DNA, 25 bp, E. coli
ttgcgaaatcagtgggaacctggaa

SEQ ID NO: 124609 - DNA, 25 bp, E. coli
tgggaacctggaataaaagcagttg

SEQ ID NO: 124610 - DNA, 25 bp, E. coli
tgggaacctggattaaaagcagttg

SEQ ID NO: 124611 - DNA, 25 bp, E. coli
tgcgaaatcagtgggaacctggaat

SEQ ID NO: 124612 - DNA, 25 bp, E. coli
tgcgaaatcagtcggaacctggaat

SEQ ID NO: 124613 - DNA, 25 bp, E. coli
tcagtgggaacctggaataaaagca

SEQ ID NO: 124614 - DNA, 25 bp, E. coli
tcagtgggaaccaggaataaaagca

SEQ ID NO: 124615 - DNA, 25 bp, E. coli
cctggaataaaagcagttgccgcag

SEQ ID NO: 124616 - DNA, 25 bp, E. coli
cctggaataaaaccagttgccgcag

SEQ ID NO: 124617 - DNA, 25 bp, E. coli
gaataaaagcagatgccgcagttaa

SEQ ID NO: 124618 - DNA, 25 bp, E. coli
gaataaaagcagttgccgcagttaa

SEQ ID NO: 124619 - DNA, 25 bp, E. coli
gaacctggaatataagcagttgccg

SEQ ID NO: 124620 - DNA, 25 bp, E. coli
gaacctggaataaaagcagttgccg

SEQ ID NO: 124621 - DNA, 25 bp, E. coli
cgaaatcagtgggaacctggaataa

SEQ ID NO: 124622 - DNA, 25 bp, E. coli
cgaaatcagtggcaacctggaataa

SEQ ID NO: 124623 - DNA, 25 bp, E. coli
tggaataaaagctgttgccgcagtt

SEQ ID NO: 124624 - DNA, 25 bp, E. coli
tggaataaaagcagttgccgcagtt

SEQ ID NO: 124625 - DNA, 25 bp, E. coli
cataacccataaaatgctagctgta

SEQ ID NO: 124626 - DNA, 25 bp, E. coli
cataacccataatatgctagctgta

SEQ ID NO: 124627 - DNA, 25 bp, E. coli
taaaatgctagctgtaccaggaacc

SEQ ID NO: 124628 - DNA, 25 bp, E. coli
taaaatgctagcagtaccaggaacc

SEQ ID NO: 124629 - DNA, 25 bp, E. coli
gctgtaccaggaaccacctccttag

SEQ ID NO: 124630 - DNA, 25 bp, E. coli
gctgtaccaggatccacctccttag

SEQ ID NO: 124631 - DNA, 25 bp, E. coli
aaatgctagctgtaccaggaaccac

SEQ ID NO: 124632 - DNA, 25 bp, E. coli
aaatgctagctgaaccaggaaccac

SEQ ID NO: 124633 - DNA, 25 bp, E. coli
tccttagcctgtctaatctccctta

SEQ ID NO: 124634 - DNA, 25 bp, E. coli
tgtgtaatctcccttacacgggctt

SEQ ID NO: 124635 - DNA, 25 bp, E. coli
tgtgtaatctccgttacacgggctt

SEQ ID NO: 124636 - DNA, 25 bp, E. coli
tccttagcctgtgtaatctccctta

SEQ ID NO: 124637 - DNA, 25 bp, E. coli
tgctagctgtaccaggaaccacctc

SEQ ID NO: 124638 - DNA, 25 bp, E. coli
tgctagctgtacgaggaaccacctc

SEQ ID NO: 124639 - DNA, 25 bp, E. coli
tcgctgaaaaacataacccataaaa

SEQ ID NO: 124640 - DNA, 25 bp, E. coli
tcgctgaaaaacttaacccataaaa

SEQ ID NO: 124641 - DNA, 25 bp, E. coli
taatctcccttagacgggcttattt

SEQ ID NO: 124642 - DNA, 25 bp, E. coli
taatctcccttacacgggcttattt

SEQ ID NO: 124643 - DNA, 25 bp, E. coli
cccataaaatgctagctgtaccagg

SEQ ID NO: 124644 - DNA, 25 bp, E. coli
cccataaaatgcaagctgtaccagg

SEQ ID NO: 124645 - DNA, 25 bp, E. coli
ggaaccacctccatagcctgtgtaa

SEQ ID NO: 124646 - DNA, 25 bp, E. coli
ggaaccacctccttagcctgtgtaa

SEQ ID NO: 124647 - DNA, 25 bp, E. coli
taaagccctgttggcttcaggcggt

SEQ ID NO: 124648 - DNA, 25 bp, E. coli
taaagccctgttcgcttcaggcggt

SEQ ID NO: 124649 - DNA, 25 bp, E. coli
tgaccgccaccgtaacgctgtggag

SEQ ID NO: 124650 - DNA, 25 bp, E. coli
tgaccgccaccgaaacgctgtggag

SEQ ID NO: 124651 - DNA, 25 bp, E. coli
tctgggctttaaaccactgtacgcc

SEQ ID NO: 124652 - DNA, 25 bp, E. coli
tctgggctttaatccactgtacgcc

SEQ ID NO: 124653 - DNA, 25 bp, E. coli
cgggtggttcgtttgctatcgcaca

SEQ ID NO: 124654 - DNA, 25 bp, E. coli
cgggtggttcgtatgctatcgcaca

SEQ ID NO: 124655 - DNA, 25 bp, E. coli
gttgctgccaacaccaccggtggtg

SEQ ID NO: 124656 - DNA, 25 bp, E. coli
gttgctgccaactccaccggtggtg

SEQ ID NO: 124657 - DNA, 25 bp, E. coli
ggtcagcgaagcgacagcgtatgcc

SEQ ID NO: 124658 - DNA, 25 bp, E. coli
ggtatcgctgctgtgtctgacactg

SEQ ID NO: 124659 - DNA, 25 bp, E. coli
ggtcagcgaagccacagcgtatgcc

SEQ ID NO: 124660 - DNA, 25 bp, E. coli
ggtatcgctgctctgtctgacactg

SEQ ID NO: 124661 - DNA, 25 bp, E. coli
ggctaccgccgctcaacaaattggc

SEQ ID NO: 124662 - DNA, 25 bp, E. coli
ggctaccgccgcacaacaaattggc

SEQ ID NO: 124663 - DNA, 25 bp, E. coli
ggctcacacaggatacacggcaggt

SEQ ID NO: 124664 - DNA, 25 bp, E. coli
ggctcacacaggttacacggcaggt

SEQ ID NO: 124665 - DNA, 25 bp, E. coli
gagacctgcaatcaatctctggcaa

SEQ ID NO: 124666 - DNA, 25 bp, E. coli
gatgggtattccgattctggtcgcc

SEQ ID NO: 124667 - DNA, 25 bp, E. coli
gagacctgcaatgaatctctggcaa

SEQ ID NO: 124668 - DNA, 25 bp, E. coli
gatgggtattcccattctggtcgcc

SEQ ID NO: 124669 - DNA, 25 bp, E. coli
acactccatcggtcacctgaggcgg

SEQ ID NO: 124670 - DNA, 25 bp, E. coli
acattgcggtaagacgcttttaccg

SEQ ID NO: 124671 - DNA, 25 bp, E. coli
acattgcggtaacacgcttttaccg

SEQ ID NO: 124672 - DNA, 25 bp, E. coli
acactccatcggacacctgaggcgg

SEQ ID NO: 124673 - DNA, 25 bp, E. coli
tattccagagaagagagaacattgc

SEQ ID NO: 124674 - DNA, 25 bp, E. coli
tattccagagaacagagaacattgc

SEQ ID NO: 124675 - DNA, 25 bp, E. coli
ttaaggtgatgatttctcggcggtg

SEQ ID NO: 124676 - DNA, 25 bp, E. coli
ttaaggtgatgaattctcggcggtg

SEQ ID NO: 124677 - DNA, 25 bp, E. coli
tgaggcggagctacgcccctttgaa

SEQ ID NO: 124678 - DNA, 25 bp, E. coli
tgaggcggagcttcgcccctttgaa

SEQ ID NO: 124679 - DNA, 25 bp, E. coli
tcttgtccggtatatgacgattatc

SEQ ID NO: 124680 - DNA, 25 bp, E. coli
tcggcggtgtatgatattccagaga

SEQ ID NO: 124681 - DNA, 25 bp, E. coli
tcttgtccggtaaatgacgattatc

SEQ ID NO: 124682 - DNA, 25 bp, E. coli
tcggcggtgtatcatattccagaga

SEQ ID NO: 124683 - DNA, 25 bp, E. coli
gctgaaatccacaagtcttgtccgg

SEQ ID NO: 124684 - DNA, 25 bp, E. coli
gcttcgccccttagaaataccttgc

SEQ ID NO: 124685 - DNA, 25 bp, E. coli
gctgaaatccactagtcttgtccgg

SEQ ID NO: 124686 - DNA, 25 bp, E. coli
gcttcgcccctttgaaataccttgc

SEQ ID NO: 124687 - DNA, 25 bp, E. coli
gaagagagaacaatgcggtaacacg

SEQ ID NO: 124688 - DNA, 25 bp, E. coli
gaagagagaacattgcggtaacacg

SEQ ID NO: 124689 - DNA, 25 bp, E. coli
tgacgattatcagaggttaaggtga

SEQ ID NO: 124690 - DNA, 25 bp, E. coli
tgacgattatcacaggttaaggtga

SEQ ID NO: 124691 - DNA, 25 bp, E. coli
caggaatagccctgcctgtatggca

SEQ ID NO: 124692 - DNA, 25 bp, E. coli
caggaatagcccagcctgtatggca

SEQ ID NO: 124693 - DNA, 25 bp, E. coli
taactttttaactgccatcacaggc

SEQ ID NO: 124694 - DNA, 25 bp, E. coli
tagtaatcagatcagtatgtccgta

SEQ ID NO: 124695 - DNA, 25 bp, E. coli
tatagaccgtagcaccaaatacagg

SEQ ID NO: 124696 - DNA, 25 bp, E. coli
tagtaatcagatgagtatgtccgta

SEQ ID NO: 124697 - DNA, 25 bp, E. coli
tatagaccgtaggaccaaatacagg

SEQ ID NO: 124698 - DNA, 25 bp, E. coli
tgtatggcatccctgtacggtctgc

SEQ ID NO: 124699 - DNA, 25 bp, E. coli
tgtatggcatccgtgtacggtctgc

SEQ ID NO: 124700 - DNA, 25 bp, E. coli
tgtccgtactaaaatctgataccag

SEQ ID NO: 124701 - DNA, 25 bp, E. coli
tgtccgtactaatatctgataccag

SEQ ID NO: 124702 - DNA, 25 bp, E. coli
tccagaagctaaatgcagagtaact

SEQ ID NO: 124703 - DNA, 25 bp, E. coli
tccagaagctaattgcagagtaact

SEQ ID NO: 124704 - DNA, 25 bp, E. coli
cctgtattcaccagtaagagtagta

SEQ ID NO: 124705 - DNA, 25 bp, E. coli
cctgtattcacctgtaagagtagta

SEQ ID NO: 124706 - DNA, 25 bp, E. coli
gtatataccgacaacagtgaccagg

SEQ ID NO: 124707 - DNA, 25 bp, E. coli
gtatataccgactacagtgaccagg

SEQ ID NO: 124708 - DNA, 25 bp, E. coli
gggctaccttcgactcaaatttaga

SEQ ID NO: 124709 - DNA, 25 bp, E. coli
gggctaccttcgtctcaaatttaga

SEQ ID NO: 124710 - DNA, 25 bp, E. coli
tggcattgtgtagtcttactacctg

SEQ ID NO: 124711 - DNA, 25 bp, E. coli
tggcattgtgtactcttactacctg

SEQ ID NO: 124712 - DNA, 25 bp, E. coli
taactttttaacagccatcacaggc

SEQ ID NO: 124713 - DNA, 25 bp, E. coli
cactacaacctgtagcgccggatgt

SEQ ID NO: 124714 - DNA, 25 bp, E. coli
cactacaacctgaagcgccggatgt

SEQ ID NO: 124715 - DNA, 25 bp, E. coli
aggtcgctccaaaagttaccgcaga

SEQ ID NO: 124716 - DNA, 25 bp, E. coli
aggtcgctccaatagttaccgcaga

SEQ ID NO: 124717 - DNA, 25 bp, E. coli
taaccgaagaggacgctccaaaagt

SEQ ID NO: 124718 - DNA, 25 bp, E. coli
taaccgaagaggtcgctccaaaagt

SEQ ID NO: 124719 - DNA, 25 bp, E. coli
tgaagcgccggaagtggtaaccgaa

SEQ ID NO: 124720 - DNA, 25 bp, E. coli
tgaagcgccggatgtggtaaccgaa

SEQ ID NO: 124721 - DNA, 25 bp, E. coli
gccgcgccggtatcgaaaaatgatg

SEQ ID NO: 124722 - DNA, 25 bp, E. coli
gccgcgccggtaacgaaaaatgatg

SEQ ID NO: 124723 - DNA, 25 bp, E. coli
gccggtaacgaataatgatggtaag

SEQ ID NO: 124724 - DNA, 25 bp, E. coli
gccggtaacgaaaaatgatggtaag

SEQ ID NO: 124725 - DNA, 25 bp, E. coli
gaagggcaggcactacaacctgaag

SEQ ID NO: 124726 - DNA, 25 bp, E. coli
gaagaggtcgctgcaaaagttaccg

SEQ ID NO: 124727 - DNA, 25 bp, E. coli
gaagaggtcgctccaaaagttaccg

SEQ ID NO: 124728 - DNA, 25 bp, E. coli
gaagggcaggcagtacaacctgaag

SEQ ID NO: 124729 - DNA, 25 bp, E. coli
gggtaatttaccagcagatccgaaa

SEQ ID NO: 124730 - DNA, 25 bp, E. coli
gggtaatttacctgcagatccgaaa

SEQ ID NO: 124731 - DNA, 25 bp, E. coli
tgtggtaaccgaagaggtcgctcca

SEQ ID NO: 124732 - DNA, 25 bp, E. coli
tgtggtaaccgatgaggtcgctcca

SEQ ID NO: 124733 - DNA, 25 bp, E. coli
taaccgaagggctggcactacaacc

SEQ ID NO: 124734 - DNA, 25 bp, E. coli
taaccgaagggcaggcactacaacc

SEQ ID NO: 124735 - DNA, 25 bp, E. coli
cacacgaaagttaacgttgacggag

SEQ ID NO: 124736 - DNA, 25 bp, E. coli
cacacgaaagtttacgttgacggag

SEQ ID NO: 124737 - DNA, 25 bp, E. coli
taaagagccactttaccaaagacga

SEQ ID NO: 124738 - DNA, 25 bp, E. coli
taaagagccactataccaaagacga

SEQ ID NO: 124739 - DNA, 25 bp, E. coli
agtgtagccgcaaaaaaggttctgc

SEQ ID NO: 124740 - DNA, 25 bp, E. coli
agtgtagccgcataaaaggttctgc

SEQ ID NO: 124741 - DNA, 25 bp, E. coli
aaaaggttctgcacaccctgtggga

SEQ ID NO: 124742 - DNA, 25 bp, E. coli
aaaaggttctgctcaccctgtggga

SEQ ID NO: 124743 - DNA, 25 bp, E. coli
ttagcaacccaaaacgactggatgg

SEQ ID NO: 124744 - DNA, 25 bp, E. coli
ttttcgtgcggcacatgccaggcga

SEQ ID NO: 124745 - DNA, 25 bp, E. coli
ttagcaacccaatacgactggatgg

SEQ ID NO: 124746 - DNA, 25 bp, E. coli
ttttcgtgcggctcatgccaggcga

SEQ ID NO: 124747 - DNA, 25 bp, E. coli
gcattaactcttgtgctcgctggta

SEQ ID NO: 124748 - DNA, 25 bp, E. coli
gcggcagaaacccactatgatgctg

SEQ ID NO: 124749 - DNA, 25 bp, E. coli
gcggcagaaaccgactatgatgctg

SEQ ID NO: 124750 - DNA, 25 bp, E. coli
gcattaactcttctgctcgctggta

SEQ ID NO: 124751 - DNA, 25 bp, E. coli
cgaccagattaagcggatgcaggac

SEQ ID NO: 124752 - DNA, 25 bp, E. coli
cgaccagattaaccggatgcaggac

SEQ ID NO: 124753 - DNA, 25 bp, E. coli
ctttcgaagatgacaaaacagcggc

SEQ ID NO: 124754 - DNA, 25 bp, E. coli
ctttcgaagatgtcaaaacagcggc

SEQ ID NO: 124755 - DNA, 25 bp, E. coli
gattatatgtctacgcccgaccaga

SEQ ID NO: 124756 - DNA, 25 bp, E. coli
gattatatgtcttcgcccgaccaga

SEQ ID NO: 124757 - DNA, 25 bp, E. coli
aatcgactttatccttcagcacccg

SEQ ID NO: 124758 - DNA, 25 bp, E. coli
aaggaagatggcgagaaagtggttg

SEQ ID NO: 124759 - DNA, 25 bp, E. coli
aatcgactttatgcttcagcacccg

SEQ ID NO: 124760 - DNA, 25 bp, E. coli
aaggaagatggccagaaagtggttg

SEQ ID NO: 124761 - DNA, 25 bp, E. coli
cacccgattctgtttaatcgcccga

SEQ ID NO: 124762 - DNA, 25 bp, E. coli
cacccgattctgattaatcgcccga

SEQ ID NO: 124763 - DNA, 25 bp, E. coli
tacgctggagatgatccgcaacagc

SEQ ID NO: 124764 - DNA, 25 bp, E. coli
attctgccagatgcgcaaaaaggcg

SEQ ID NO: 124765 - DNA, 25 bp, E. coli
attctgccagatccgcaaaaaggcg

SEQ ID NO: 124766 - DNA, 25 bp, E. coli
tacgctggagatcatccgcaacagc

SEQ ID NO: 124767 - DNA, 25 bp, E. coli
tttatgcttcaggacccgattctga

SEQ ID NO: 124768 - DNA, 25 bp, E. coli
tttatgcttcagcacccgattctga

SEQ ID NO: 124769 - DNA, 25 bp, E. coli
gcttcagcaccccattctgattaat

SEQ ID NO: 124770 - DNA, 25 bp, E. coli
gcttcagcacccgattctgattaat

SEQ ID NO: 124771 - DNA, 25 bp, E. coli
cgtaatacgctggagatgatccgca

SEQ ID NO: 124772 - DNA, 25 bp, E. coli
cgtaatacgctgcagatgatccgca

SEQ ID NO: 124773 - DNA, 25 bp, E. coli
gattaatcgccccattgtggtgacg

SEQ ID NO: 124774 - DNA, 25 bp, E. coli
gattctgattaatcgcccgattgtg

SEQ ID NO: 124775 - DNA, 25 bp, E. coli
gattaatcgcccgattgtggtgacg

SEQ ID NO: 124776 - DNA, 25 bp, E. coli
gttaatcgactttatgcttcagcac

SEQ ID NO: 124777 - DNA, 25 bp, E. coli
gttaatcgacttaatgcttcagcac

SEQ ID NO: 124778 - DNA, 25 bp, E. coli
gattctgattaaacgcccgattgtg

SEQ ID NO: 124779 - DNA, 25 bp, E. coli
caagtgcccgtcgaagaggacgctt

SEQ ID NO: 124780 - DNA, 25 bp, E. coli
caagtgcccgtccaagaggacgctt

SEQ ID NO: 124781 - DNA, 25 bp, E. coli
cgttaaacaagtccccgtcgaagag

SEQ ID NO: 124782 - DNA, 25 bp, E. coli
cgttaaacaagtgcccgtcgaagag

SEQ ID NO: 124783 - DNA, 25 bp, E. coli
aaataaaccccatgtatccatcgaa

SEQ ID NO: 124784 - DNA, 25 bp, E. coli
aataaaccccatctatccatcgaat

SEQ ID NO: 124785 - DNA, 25 bp, E. coli
aaataaaccccaagtatccatcgaa

SEQ ID NO: 124786 - DNA, 25 bp, E. coli
aataaaccccatgtatccatcgaat

SEQ ID NO: 124787 - DNA, 25 bp, E. coli
tgcccgtcgaagtggacgcttataa

SEQ ID NO: 124788 - DNA, 25 bp, E. coli
tgcccgtcgaagaggacgcttataa

SEQ ID NO: 124789 - DNA, 25 bp, E. coli
tcaggcagttatgagcaaattgatt

SEQ ID NO: 124790 - DNA, 25 bp, E. coli
tcaggcagttatcagcaaattgatt

SEQ ID NO: 124791 - DNA, 25 bp, E. coli
gcgtcaggcagttatcagcaaattg

SEQ ID NO: 124792 - DNA, 25 bp, E. coli
gcgtcaggcagtaatcagcaaattg

SEQ ID NO: 124793 - DNA, 25 bp, E. coli
gcaggagcgtcaggcagttatcagc

SEQ ID NO: 124794 - DNA, 25 bp, E. coli
gcaggagcgtcacgcagttatcagc

SEQ ID NO: 124795 - DNA, 25 bp, E. coli
cgaagaggacgcttataacaccaaa

SEQ ID NO: 124796 - DNA, 25 bp, E. coli
cccgtcgaagagcacgcttataaca

SEQ ID NO: 124797 - DNA, 25 bp, E. coli
cccgtcgaagaggacgcttataaca

SEQ ID NO: 124798 - DNA, 25 bp, E. coli
cgaagaggacgcatataacaccaaa

SEQ ID NO: 124799 - DNA, 25 bp, E. coli
ggagcgtcaggcagttatcagcaaa

SEQ ID NO: 124800 - DNA, 25 bp, E. coli
ggagcgtcaggctgttatcagcaaa

SEQ ID NO: 124801 - DNA, 25 bp, E. coli
tactggcatcctctgcgttcggcgc

SEQ ID NO: 124802 - DNA, 25 bp, E. coli
tactggcatcctgtgcgttcggcgc

SEQ ID NO: 124803 - DNA, 25 bp, E. coli
aaatcagcgatctgtggttcccgca

SEQ ID NO: 124804 - DNA, 25 bp, E. coli
aaatcagcgatcagtggttcccgca

SEQ ID NO: 124805 - DNA, 25 bp, E. coli
tatggatatcactccagatcgtagc

SEQ ID NO: 124806 - DNA, 25 bp, E. coli
tatggatatcacaccagatcgtagc

SEQ ID NO: 124807 - DNA, 25 bp, E. coli
tatcgacctagcaaaagcgttatgc

SEQ ID NO: 124808 - DNA, 25 bp, E. coli
tatcgacctagctaaagcgttatgc

SEQ ID NO: 124809 - DNA, 25 bp, E. coli
ttttggcgtatcagcgacctatccg

SEQ ID NO: 124810 - DNA, 25 bp, E. coli
ttttggcgtatctgcgacctatccg

SEQ ID NO: 124811 - DNA, 25 bp, E. coli
tcgtagcaagcaggtatcgttcacc

SEQ ID NO: 124812 - DNA, 25 bp, E. coli
tcgtagcaagcacgtatcgttcacc

SEQ ID NO: 124813 - DNA, 25 bp, E. coli
gacactgcggtggttaatgaatggc

SEQ ID NO: 124814 - DNA, 25 bp, E. coli
gacactgcggtgcttaatgaatggc

SEQ ID NO: 124815 - DNA, 25 bp, E. coli
cgttatgcaaacagatgcaggcaga

SEQ ID NO: 124816 - DNA, 25 bp, E. coli
cgttatgcaaactgatgcaggcaga

SEQ ID NO: 124817 - DNA, 25 bp, E. coli
gacctatccgccgttcgagtcgatg

SEQ ID NO: 124818 - DNA, 25 bp, E. coli
gacggtacatatcaacaaatcagcg

SEQ ID NO: 124819 - DNA, 25 bp, E. coli
gagtcgatggatgccaataaccaga

SEQ ID NO: 124820 - DNA, 25 bp, E. coli
gacggtacatatgaacaaatcagcg

SEQ ID NO: 124821 - DNA, 25 bp, E. coli
gagtcgatggatcccaataaccaga

SEQ ID NO: 124822 - DNA, 25 bp, E. coli
gacctatccgcccttcgagtcgatg

SEQ ID NO: 124823 - DNA, 25 bp, E. coli
caacggctgcccgatgatattcagt

SEQ ID NO: 124824 - DNA, 25 bp, E. coli
aatggcctccttgctgctgatcatg

SEQ ID NO: 124825 - DNA, 25 bp, E. coli
aatggcctccttcctgctgatcatg

SEQ ID NO: 124826 - DNA, 25 bp, E. coli
caacggctgccccatgatattcagt

SEQ ID NO: 124827 - DNA, 25 bp, E. coli
tactgacctttatccggctggtggc

SEQ ID NO: 124828 - DNA, 25 bp, E. coli
tactgacctttaaccggctggtggc

SEQ ID NO: 124829 - DNA, 25 bp, E. coli
atgatattcagttcacgccccgcca

SEQ ID NO: 124830 - DNA, 25 bp, E. coli
atgatattcagtacacgccccgcca

SEQ ID NO: 124831 - DNA, 25 bp, E. coli
tgatcatgttcacgcttgcccagag

SEQ ID NO: 124832 - DNA, 25 bp, E. coli
tgatcatgttcaggcttgcccagag

SEQ ID NO: 124833 - DNA, 25 bp, E. coli
ccggctggtggcgttgatgtccttc

SEQ ID NO: 124834 - DNA, 25 bp, E. coli
gcgccctcacgacaaagaatttcaa

SEQ ID NO: 124835 - DNA, 25 bp, E. coli
ccggctggtggccttgatgtccttc

SEQ ID NO: 124836 - DNA, 25 bp, E. coli
gcgccctcacgagaaagaatttcaa

SEQ ID NO: 124837 - DNA, 25 bp, E. coli
gctctgcgcccgttgaaatggcctc

SEQ ID NO: 124838 - DNA, 25 bp, E. coli
gctctgcgcccgatgaaatggcctc

SEQ ID NO: 124839 - DNA, 25 bp, E. coli
gaatttcaaggcctgtcctggcgac

SEQ ID NO: 124840 - DNA, 25 bp, E. coli
gaatttcaaggcgtgtcctggcgac

SEQ ID NO: 124841 - DNA, 25 bp, E. coli
gatccttacggttccaatcgccagc

SEQ ID NO: 124842 - DNA, 25 bp, E. coli
gatgtccttccggtaccgtatccag

SEQ ID NO: 124843 - DNA, 25 bp, E. coli
gatgtccttccgctaccgtatccag

SEQ ID NO: 124844 - DNA, 25 bp, E. coli
gatccttacggtaccaatcgccagc

SEQ ID NO: 124845 - DNA, 25 bp, E. coli
cagtctgtttcgctggtaagttcag

SEQ ID NO: 124846 - DNA, 25 bp, E. coli
cagtctgtttcggtggtaagttcag

SEQ ID NO: 124847 - DNA, 25 bp, E. coli
catgaaaaagttctcagccccgctt

SEQ ID NO: 124848 - DNA, 25 bp, E. coli
catgaaaaagttgtcagccccgctt

SEQ ID NO: 124849 - DNA, 25 bp, E. coli
accttatggttatcagtctgtttcg

SEQ ID NO: 124850 - DNA, 25 bp, E. coli
accttatggttaacagtctgtttcg

SEQ ID NO: 124851 - DNA, 25 bp, E. coli
tttcaccatgaaaaagttgtcagcc

SEQ ID NO: 124852 - DNA, 25 bp, E. coli
tttcaccatgaataagttgtcagcc

SEQ ID NO: 124853 - DNA, 25 bp, E. coli
tcaggcaaaagagaacgattgcgtt

SEQ ID NO: 124854 - DNA, 25 bp, E. coli
tcaggcaaaagacaacgattgcgtt

SEQ ID NO: 124855 - DNA, 25 bp, E. coli
ccgatgctgggtatcgtggtgataa

SEQ ID NO: 124856 - DNA, 25 bp, E. coli
ccgatgctgggtttcgtggtgataa

SEQ ID NO: 124857 - DNA, 25 bp, E. coli
gctgggtttcgtcgtgataatttca

SEQ ID NO: 124858 - DNA, 25 bp, E. coli
gctgggtttcgtggtgataatttca

SEQ ID NO: 124859 - DNA, 25 bp, E. coli
gaaaaagttgtctgccccgcttatt

SEQ ID NO: 124860 - DNA, 25 bp, E. coli
gaaaaagttgtcagccccgcttatt

SEQ ID NO: 124861 - DNA, 25 bp, E. coli
gtttcgtggtgataatttcaccatg

SEQ ID NO: 124862 - DNA, 25 bp, E. coli
gtttcgtggtgaaaatttcaccatg

SEQ ID NO: 124863 - DNA, 25 bp, E. coli
gggaccgggagtggctccgatgctg

SEQ ID NO: 124864 - DNA, 25 bp, E. coli
gggaccgggagtcgctccgatgctg

SEQ ID NO: 124865 - DNA, 25 bp, E. coli
ggtaagttcaggcaaaagagaacga

SEQ ID NO: 124866 - DNA, 25 bp, E. coli
ggtaagttcagggaaaagagaacga

SEQ ID NO: 124867 - DNA, 25 bp, E. coli
aatatctggatgtgcgtttcccgca

SEQ ID NO: 124868 - DNA, 25 bp, E. coli
aatatctggatgagcgtttcccgca

SEQ ID NO: 124869 - DNA, 25 bp, E. coli
cagaacgtgaaatgcgtctgggccg

SEQ ID NO: 124870 - DNA, 25 bp, E. coli
cagaacgtgaaaagcgtctgggccg

SEQ ID NO: 124871 - DNA, 25 bp, E. coli
catgcatcgcatggaaaaagactgg

SEQ ID NO: 124872 - DNA, 25 bp, E. coli
catgcatcgcatcgaaaaagactgg

SEQ ID NO: 124873 - DNA, 25 bp, E. coli
aaaagactggtacacgctgatgaac

SEQ ID NO: 124874 - DNA, 25 bp, E. coli
aaaagactggtagacgctgatgaac

SEQ ID NO: 124875 - DNA, 25 bp, E. coli
tatagccatcagctccgcattgtgc

SEQ ID NO: 124876 - DNA, 25 bp, E. coli
tatagccatcaggtccgcattgtgc

SEQ ID NO: 124877 - DNA, 25 bp, E. coli
tcgaacacgtggtaaaggacaatcc

SEQ ID NO: 124878 - DNA, 25 bp, E. coli
tcgaacacgtggaaaaggacaatcc

SEQ ID NO: 124879 - DNA, 25 bp, E. coli
gccactgatgcctgtttacccggta

SEQ ID NO: 124880 - DNA, 25 bp, E. coli
gccactgatgccagtttacccggta

SEQ ID NO: 124881 - DNA, 25 bp, E. coli
gctgaaaggctaaatgacccgcgtc

SEQ ID NO: 124882 - DNA, 25 bp, E. coli
gctgaaaggctatatgacccgcgtc

SEQ ID NO: 124883 - DNA, 25 bp, E. coli
gaagccgtacttcctgagcgatgag

SEQ ID NO: 124884 - DNA, 25 bp, E. coli
gaagccgtacttgctgagcgatgag

SEQ ID NO: 124885 - DNA, 25 bp, E. coli
gaccctggtggatcgtgagctgacc

SEQ ID NO: 124886 - DNA, 25 bp, E. coli
gaccctggtggaacgtgagctgacc

SEQ ID NO: 124887 - DNA, 25 bp, E. coli
gagctgaccctgagggaatctcgca

SEQ ID NO: 124888 - DNA, 25 bp, E. coli
gagctgaccctgtgggaatctcgca

SEQ ID NO: 124889 - DNA, 25 bp, E. coli
caggaaagcgcattagcctgttggg

SEQ ID NO: 124890 - DNA, 25 bp, E. coli
caggaaagcgcaatagcctgttggg

SEQ ID NO: 124891 - DNA, 25 bp, E. coli
cataccgggaatcaggctgtcgaag

SEQ ID NO: 124892 - DNA, 25 bp, E. coli
cataccgggaatgaggctgtcgaag

SEQ ID NO: 124893 - DNA, 25 bp, E. coli
ataaaagatggtcggcgcgattgcc

SEQ ID NO: 124894 - DNA, 25 bp, E. coli
ataaaagatggtgggcgcgattgcc

SEQ ID NO: 124895 - DNA, 25 bp, E. coli
actgctatggactggttattcgtcg

SEQ ID NO: 124896 - DNA, 25 bp, E. coli
actgctatggacaggttattcgtcg

SEQ ID NO: 124897 - DNA, 25 bp, E. coli
tcgtggtgccactatggtggatggt

SEQ ID NO: 124898 - DNA, 25 bp, E. coli
tcgtggtgccacaatggtggatggt

SEQ ID NO: 124899 - DNA, 25 bp, E. coli
ccgcatacgttctaataactgctat

SEQ ID NO: 124900 - DNA, 25 bp, E. coli
ccgcatacgttcaaataactgctat

SEQ ID NO: 124901 - DNA, 25 bp, E. coli
cgttcaaataactgctatggacagg

SEQ ID NO: 124902 - DNA, 25 bp, E. coli
cgttcaaataacagctatggacagg

SEQ ID NO: 124903 - DNA, 25 bp, E. coli
gtgggcgcgattcccgcatacgttc

SEQ ID NO: 124904 - DNA, 25 bp, E. coli
ggtggatggtaaccccgtcataccg

SEQ ID NO: 124905 - DNA, 25 bp, E. coli
gtgggcgcgattgccgcatacgttc

SEQ ID NO: 124906 - DNA, 25 bp, E. coli
ggtggatggtaagcccgtcataccg

SEQ ID NO: 124907 - DNA, 25 bp, E. coli
taagcccgtcattccgggaatgagg

SEQ ID NO: 124908 - DNA, 25 bp, E. coli
taagcccgtcataccgggaatgagg

SEQ ID NO: 124909 - DNA, 25 bp, E. coli
gatggtaagcccctcataccgggaa

SEQ ID NO: 124910 - DNA, 25 bp, E. coli
gatggtaagcccgtcataccgggaa

SEQ ID NO: 124911 - DNA, 25 bp, E. coli
tatcacaggcgatttctctgaagac

SEQ ID NO: 124912 - DNA, 25 bp, E. coli
tatcacaggcgaattctctgaagac

SEQ ID NO: 124913 - DNA, 25 bp, E. coli
tatatttctggtgggcgttcatcgg

SEQ ID NO: 124914 - DNA, 25 bp, E. coli
tatatttctggtcggcgttcatcgg

SEQ ID NO: 124915 - DNA, 25 bp, E. coli
tttgaaggtgatgagacctacaccg

SEQ ID NO: 124916 - DNA, 25 bp, E. coli
tttgaaggtgatcagacctacaccg

SEQ ID NO: 124917 - DNA, 25 bp, E. coli
tttattactcaaatgggcactagca

SEQ ID NO: 124918 - DNA, 25 bp, E. coli
tttattactcaattgggcactagca

SEQ ID NO: 124919 - DNA, 25 bp, E. coli
tgctgcaatttgacatggcccacaa

SEQ ID NO: 124920 - DNA, 25 bp, E. coli
tgctgcaatttgtcatggcccacaa

SEQ ID NO: 124921 - DNA, 25 bp, E. coli
gcccacaaattctggccgctgctgg

SEQ ID NO: 124922 - DNA, 25 bp, E. coli
gcccacaaattcaggccgctgctgg

SEQ ID NO: 124923 - DNA, 25 bp, E. coli
gactatgaagtcatggtgccatggc

SEQ ID NO: 124924 - DNA, 25 bp, E. coli
gactatgaagtcttggtgccatggc

SEQ ID NO: 124925 - DNA, 25 bp, E. coli
ccgcagatgatgaagccattgtgga

SEQ ID NO: 124926 - DNA, 25 bp, E. coli
ccgcagatgatgtagccattgtgga

SEQ ID NO: 124927 - DNA, 25 bp, E. coli
gataaccagttttgagagtccgctt

SEQ ID NO: 124928 - DNA, 25 bp, E. coli
gataaccagtttagagagtccgctt

SEQ ID NO: 124929 - DNA, 25 bp, E. coli
gggcatccagcaatattacgtcact

SEQ ID NO: 124930 - DNA, 25 bp, E. coli
gggcatccagcattattacgtcact

SEQ ID NO: 124931 - DNA, 25 bp, E. coli
taataaccgcgactacctggatggg

SEQ ID NO: 124932 - DNA, 25 bp, E. coli
taataaccgcgagtacctggatggg

SEQ ID NO: 124933 - DNA, 25 bp, E. coli
cacggcctgcatcacggaatggaaa

SEQ ID NO: 124934 - DNA, 25 bp, E. coli
cacggcctgcatgacggaatggaaa

SEQ ID NO: 124935 - DNA, 25 bp, E. coli
caaaaggcgagcacaacaaagtgcg

SEQ ID NO: 124936 - DNA, 25 bp, E. coli
caaaaggcgagctcaacaaagtgcg

SEQ ID NO: 124937 - DNA, 25 bp, E. coli
taccgttcgcggcataaaacaggct

SEQ ID NO: 124938 - DNA, 25 bp, E. coli
tatggaagaagcaaacggcgtcggt

SEQ ID NO: 124939 - DNA, 25 bp, E. coli
tatgccgccgaacagatggtgacgc

SEQ ID NO: 124940 - DNA, 25 bp, E. coli
tatgccgccgaagagatggtgacgc

SEQ ID NO: 124941 - DNA, 25 bp, E. coli
tatggaagaagctaacggcgtcggt

SEQ ID NO: 124942 - DNA, 25 bp, E. coli
taccgttcgcgggataaaacaggct

SEQ ID NO: 124943 - DNA, 25 bp, E. coli
tttgcgctgggcactaaagctccgg

SEQ ID NO: 124944 - DNA, 25 bp, E. coli
tttgcgctgggctctaaagctccgg

SEQ ID NO: 124945 - DNA, 25 bp, E. coli
tcgatgtgcaaagaaacggtccgcg

SEQ ID NO: 124946 - DNA, 25 bp, E. coli
tcgatgtgcaaacaaacggtccgcg

SEQ ID NO: 124947 - DNA, 25 bp, E. coli
tcagccatgtagtggtacgcgtcac

SEQ ID NO: 124948 - DNA, 25 bp, E. coli
gaatattccggtcggcgtgtccaac

SEQ ID NO: 124949 - DNA, 25 bp, E. coli
gaatattccggtgggcgtgtccaac

SEQ ID NO: 124950 - DNA, 25 bp, E. coli
gaattacaccgaacaacaagccgag

SEQ ID NO: 124951 - DNA, 25 bp, E. coli
gaattacaccgatcaacaagccgag

SEQ ID NO: 124952 - DNA, 25 bp, E. coli
gtggaaatctctgtggccgacggct

SEQ ID NO: 124953 - DNA, 25 bp, E. coli
gtggaaatctctctggccgacggct

SEQ ID NO: 124954 - DNA, 25 bp, E. coli
tcagccatgtagaggtacgcgtcac

SEQ ID NO: 124955 - DNA, 25 bp, E. coli
taaagccaaacggtatcgttatgcc

SEQ ID NO: 124956 - DNA, 25 bp, E. coli
taaagccaaacgctatcgttatgcc

SEQ ID NO: 124957 - DNA, 25 bp, E. coli
tacgttgggtaatgcattgggcggg

SEQ ID NO: 124958 - DNA, 25 bp, E. coli
tacgttgggtaaagcattgggcggg

SEQ ID NO: 124959 - DNA, 25 bp, E. coli
tttgaaacgctgctgagcgcggagg

SEQ ID NO: 124960 - DNA, 25 bp, E. coli
tttgaaacgctggtgagcgcggagg

SEQ ID NO: 124961 - DNA, 25 bp, E. coli
taccggtacgttcggtaaagcattg

SEQ ID NO: 124962 - DNA, 25 bp, E. coli
taccggtacgttgggtaaagcattg

SEQ ID NO: 124963 - DNA, 25 bp, E. coli
tgagcgcggaggtcgccattatctc

SEQ ID NO: 124964 - DNA, 25 bp, E. coli
tgagcgcggaggacgccattatctc

SEQ ID NO: 124965 - DNA, 25 bp, E. coli
tctgtgtaaagccaaacgctatcgt

SEQ ID NO: 124966 - DNA, 25 bp, E. coli
tctgtgtaaagcgaaacgctatcgt

SEQ ID NO: 124967 - DNA, 25 bp, E. coli
cgccgcatccatcaaagtgctggag

SEQ ID NO: 124968 - DNA, 25 bp, E. coli
cgccgcatccatgaaagtgctggag

SEQ ID NO: 124969 - DNA, 25 bp, E. coli
ctggcaccggcgtttgtcgccgcat

SEQ ID NO: 124970 - DNA, 25 bp, E. coli
ctggcaccggcgattgtcgccgcat

SEQ ID NO: 124971 - DNA, 25 bp, E. coli
gattgtcgccgcatccatcaaagtg

SEQ ID NO: 124972 - DNA, 25 bp, E. coli
gattgtcgccgcttccatcaaagtg

SEQ ID NO: 124973 - DNA, 25 bp, E. coli
tagacatcattaccggtacgttggg

SEQ ID NO: 124974 - DNA, 25 bp, E. coli
tagacatcattagcggtacgttggg

SEQ ID NO: 124975 - DNA, 25 bp, E. coli
gggcgtgtagacatcattaccggta

SEQ ID NO: 124976 - DNA, 25 bp, E. coli
gggcgtgtagacttcattaccggta

SEQ ID NO: 124977 - DNA, 25 bp, E. coli
caaagatttcgacgacgccgttgcc

SEQ ID NO: 124978 - DNA, 25 bp, E. coli
cacctggtgcatgaagtgacctcac

SEQ ID NO: 124979 - DNA, 25 bp, E. coli
caaagatttcgaggacgccgttgcc

SEQ ID NO: 124980 - DNA, 25 bp, E. coli
cacctggtgcatcaagtgacctcac

SEQ ID NO: 124981 - DNA, 25 bp, E. coli
aaattgaagtccagggcaaagccgc

SEQ ID NO: 124982 - DNA, 25 bp, E. coli
aaattgaagtcctgggcaaagccgc

SEQ ID NO: 124983 - DNA, 25 bp, E. coli
ttgaacgcgcgtcggcagaaaaagc

SEQ ID NO: 124984 - DNA, 25 bp, E. coli
ttaatgcctgcggtgaaatggcgcg

SEQ ID NO: 124985 - DNA, 25 bp, E. coli
ttgaacgcgcgtgggcagaaaaagc

SEQ ID NO: 124986 - DNA, 25 bp, E. coli
ttaatgcctgcgctgaaatggcgcg

SEQ ID NO: 124987 - DNA, 25 bp, E. coli
tgaacgacaataatcccgatccggc

SEQ ID NO: 124988 - DNA, 25 bp, E. coli
tgaacgacaatattcccgatccggc

SEQ ID NO: 124989 - DNA, 25 bp, E. coli
gcctactggaaaaccctgcaaaccg

SEQ ID NO: 124990 - DNA, 25 bp, E. coli
gcctactggaaatccctgcaaaccg

SEQ ID NO: 124991 - DNA, 25 bp, E. coli
gttatatatcgagcgccacctggtg

SEQ ID NO: 124992 - DNA, 25 bp, E. coli
gtactggcaacgcaaaccctgaaac

SEQ ID NO: 124993 - DNA, 25 bp, E. coli
gttatatatcgaccgccacctggtg

SEQ ID NO: 124994 - DNA, 25 bp, E. coli
gtactggcaacggaaaccctgaaac

SEQ ID NO: 124995 - DNA, 25 bp, E. coli
gggcattaccgcaaaagatatcgtg

SEQ ID NO: 124996 - DNA, 25 bp, E. coli
gggcattaccgctaaagatatcgtg

SEQ ID NO: 124997 - DNA, 25 bp, E. coli
gaccctgtgcaaaatggcaatcgaa

SEQ ID NO: 124998 - DNA, 25 bp, E. coli
gaccctgtgcaatatggcaatcgaa

SEQ ID NO: 124999 - DNA, 25 bp, E. coli
caatgatgtcagtgggtctgtcgac

SEQ ID NO: 125000 - DNA, 25 bp, E. coli
caatgatgtcagagggtctgtcgac

SEQ ID NO: 125001 - DNA, 25 bp, E. coli
acattttgggcgcacttttcaaccg

SEQ ID NO: 125002 - DNA, 25 bp, E. coli
cacttttcaaccgttttatcagcga

SEQ ID NO: 125003 - DNA, 25 bp, E. coli
acattttgggcggacttttcaaccg

SEQ ID NO: 125004 - DNA, 25 bp, E. coli
cacttttcaacccttttatcagcga

SEQ ID NO: 125005 - DNA, 25 bp, E. coli
tatgaagacctattacctgaaggat

SEQ ID NO: 125006 - DNA, 25 bp, E. coli
tatgaagacctaatacctgaaggat

SEQ ID NO: 125007 - DNA, 25 bp, E. coli
tttaaacagtactttttgggcgcac

SEQ ID NO: 125008 - DNA, 25 bp, E. coli
tttaaacagtacattttgggcgcac

SEQ ID NO: 125009 - DNA, 25 bp, E. coli
ttactttattaagccaggctatatg

SEQ ID NO: 125010 - DNA, 25 bp, E. coli
ttactttattaacccaggctatatg

SEQ ID NO: 125011 - DNA, 25 bp, E. coli
tctgtcgacggatgggattttaaac

SEQ ID NO: 125012 - DNA, 25 bp, E. coli
tcatcgcttgacctatatgaagacc

SEQ ID NO: 125013 - DNA, 25 bp, E. coli
tcatcgcttgacgtatatgaagacc

SEQ ID NO: 125014 - DNA, 25 bp, E. coli
tctgtcgacggaagggattttaaac

SEQ ID NO: 125015 - DNA, 25 bp, E. coli
ccagctatatggtatattgtcgatc

SEQ ID NO: 125016 - DNA, 25 bp, E. coli
ccagaaaaaataattcaaaggcatg

SEQ ID NO: 125017 - DNA, 25 bp, E. coli
ccagaaaaaatatttcaaaggcatg

SEQ ID NO: 125018 - DNA, 25 bp, E. coli
ccagctatatggaatattgtcgatc

SEQ ID NO: 125019 - DNA, 25 bp, E. coli
gcgaaaatttttccagctatatgga

SEQ ID NO: 125020 - DNA, 25 bp, E. coli
gcgaaaatttttgcagctatatgga

SEQ ID NO: 125021 - DNA, 25 bp, E. coli
taaaaaagcgatcgccgcactggat

SEQ ID NO: 125022 - DNA, 25 bp, E. coli
taaaaaagcgatggccgcactggat

SEQ ID NO: 125023 - DNA, 25 bp, E. coli
actggattgcaacgaccgcctggtt

SEQ ID NO: 125024 - DNA, 25 bp, E. coli
actggattgcaaggaccgcctggtt

SEQ ID NO: 125025 - DNA, 25 bp, E. coli
tagcccggaaggtctggctcctgaa

SEQ ID NO: 125026 - DNA, 25 bp, E. coli
tatgataacgaagccgcagtaggtc

SEQ ID NO: 125027 - DNA, 25 bp, E. coli
tagcccggaaggactggctcctgaa

SEQ ID NO: 125028 - DNA, 25 bp, E. coli
tatgataacgaacccgcagtaggtc

SEQ ID NO: 125029 - DNA, 25 bp, E. coli
tgatctgacgctaatccactggccg

SEQ ID NO: 125030 - DNA, 25 bp, E. coli
tgcaggcgctgcaggaagccaaaaa

SEQ ID NO: 125031 - DNA, 25 bp, E. coli
tgcaggcgctgctggaagccaaaaa

SEQ ID NO: 125032 - DNA, 25 bp, E. coli
tgatctgacgcttatccactggccg

SEQ ID NO: 125033 - DNA, 25 bp, E. coli
ccttatctgcaaaaccgtaaagtgg

SEQ ID NO: 125034 - DNA, 25 bp, E. coli
ccttatctgcaataccgtaaagtgg

SEQ ID NO: 125035 - DNA, 25 bp, E. coli
gcgattgcagaaagtggcgtgccac

SEQ ID NO: 125036 - DNA, 25 bp, E. coli
gcgattgcagaatgtggcgtgccac

SEQ ID NO: 125037 - DNA, 25 bp, E. coli
gcagctaaacacaatgcgactccgg

SEQ ID NO: 125038 - DNA, 25 bp, E. coli
gcagctaaacactatgcgactccgg

SEQ ID NO: 125039 - DNA, 25 bp, E. coli
ggcgtgccacgtgatgaactctaca

SEQ ID NO: 125040 - DNA, 25 bp, E. coli
ggcgtgccacgtcatgaactctaca

SEQ ID NO: 125041 - DNA, 25 bp, E. coli
gacgcgtgagatcggtatttccaac

SEQ ID NO: 125042 - DNA, 25 bp, E. coli
gacgcgtgagatgggtatttccaac

SEQ ID NO: 125043 - DNA, 25 bp, E. coli
tactgaggataatgatgaggcggca

SEQ ID NO: 125044 - DNA, 25 bp, E. coli
tactgaggataaagatgaggcggca

SEQ ID NO: 125045 - DNA, 25 bp, E. coli
tattatcgtgaaggcccgtgtccgg

SEQ ID NO: 125046 - DNA, 25 bp, E. coli
tattatcgtgaacgcccgtgtccgg

SEQ ID NO: 125047 - DNA, 25 bp, E. coli
ttatctgacgatgaaaactatgacg

SEQ ID NO: 125048 - DNA, 25 bp, E. coli
ttatctgacgatcaaaactatgacg

SEQ ID NO: 125049 - DNA, 25 bp, E. coli
tggtgaatcatattcagaatacgac

SEQ ID NO: 125050 - DNA, 25 bp, E. coli
tggtgaatcataatcagaatacgac

SEQ ID NO: 125051 - DNA, 25 bp, E. coli
tgaacgcccgtgtccgggagaagtt

SEQ ID NO: 125052 - DNA, 25 bp, E. coli
tgaacgcccgtgaccgggagaagtt

SEQ ID NO: 125053 - DNA, 25 bp, E. coli
tcggctatgataatactgaggataa

SEQ ID NO: 125054 - DNA, 25 bp, E. coli
tcggctatgatattactgaggataa

SEQ ID NO: 125055 - DNA, 25 bp, E. coli
gaatacgacataacattatctgacg

SEQ ID NO: 125056 - DNA, 25 bp, E. coli
gaatacgacatatcattatctgacg

SEQ ID NO: 125057 - DNA, 25 bp, E. coli
cgatgaaaactatgacgatgactat

SEQ ID NO: 125058 - DNA, 25 bp, E. coli
cgatgaaaactaagacgatgactat

SEQ ID NO: 125059 - DNA, 25 bp, E. coli
ccgggagaagttttcggctatgata

SEQ ID NO: 125060 - DNA, 25 bp, E. coli
ccgggagaagttatcggctatgata

SEQ ID NO: 125061 - DNA, 25 bp, E. coli
gaggcggcatctcattatgcattaa

SEQ ID NO: 125062 - DNA, 25 bp, E. coli
gaggcggcatctgattatgcattaa

SEQ ID NO: 125063 - DNA, 25 bp, E. coli
gatgactattatcgtgaacgcccgt

SEQ ID NO: 125064 - DNA, 25 bp, E. coli
gatgactattatggtgaacgcccgt

SEQ ID NO: 125065 - DNA, 25 bp, E. coli
aacgaggagcgcaattttcaccatg

SEQ ID NO: 125066 - DNA, 25 bp, E. coli
caccatgttatgaggcttttgacgc

SEQ ID NO: 125067 - DNA, 25 bp, E. coli
caccatgttatgtggcttttgacgc

SEQ ID NO: 125068 - DNA, 25 bp, E. coli
taaaaccttgtcctctggtgcagag

SEQ ID NO: 125069 - DNA, 25 bp, E. coli
taaagcaatctcaagtactgcccgg

SEQ ID NO: 125070 - DNA, 25 bp, E. coli
taaagcaatctctagtactgcccgg

SEQ ID NO: 125071 - DNA, 25 bp, E. coli
taaaaccttgtcgtctggtgcagag

SEQ ID NO: 125072 - DNA, 25 bp, E. coli
aaacttgaggcgatttgttccaggc

SEQ ID NO: 125073 - DNA, 25 bp, E. coli
aacgaggagcgctattttcaccatg

SEQ ID NO: 125074 - DNA, 25 bp, E. coli
aaacttgaggcgttttgttccaggc

SEQ ID NO: 125075 - DNA, 25 bp, E. coli
tttgcgacaaaatgtgaggcgctct

SEQ ID NO: 125076 - DNA, 25 bp, E. coli
tttgcgacaaaaagtgaggcgctct

SEQ ID NO: 125077 - DNA, 25 bp, E. coli
tccgtattgggcttgcgactggtgc

SEQ ID NO: 125078 - DNA, 25 bp, E. coli
tccgtattgggcatgcgactggtgc

SEQ ID NO: 125079 - DNA, 25 bp, E. coli
gctttgtgaatgatatccctacggg

SEQ ID NO: 125080 - DNA, 25 bp, E. coli
gctttgtgaatgttatccctacggg

SEQ ID NO: 125081 - DNA, 25 bp, E. coli
gaagatcgagctacctgatgggcaa

SEQ ID NO: 125082 - DNA, 25 bp, E. coli
gaagcaaccgtttatcgcgagcagt

SEQ ID NO: 125083 - DNA, 25 bp, E. coli
gaagatcgagcttcctgatgggcaa

SEQ ID NO: 125084 - DNA, 25 bp, E. coli
gaagcaaccgttaatcgcgagcagt

SEQ ID NO: 125085 - DNA, 25 bp, E. coli
gggcatcgggaaaacgcattcgtaa

SEQ ID NO: 125086 - DNA, 25 bp, E. coli
gggcatcgggaatacgcattcgtaa

SEQ ID NO: 125087 - DNA, 25 bp, E. coli
caaagcatggctagttacctgacag

SEQ ID NO: 125088 - DNA, 25 bp, E. coli
caaagcatggcttgttacctgacag

SEQ ID NO: 125089 - DNA, 25 bp, E. coli
acgactggttttccttgctgcctca

SEQ ID NO: 125090 - DNA, 25 bp, E. coli
acgactggttttgcttgctgcctca

SEQ ID NO: 125091 - DNA, 25 bp, E. coli
tacctgacagatatacgtgcccgtt

SEQ ID NO: 125092 - DNA, 25 bp, E. coli
tacctgacagatttacgtgcccgtt

SEQ ID NO: 125093 - DNA, 25 bp, E. coli
tattggttacggcacattcgctgtc

SEQ ID NO: 125094 - DNA, 25 bp, E. coli
tattggttacgggacattcgctgtc

SEQ ID NO: 125095 - DNA, 25 bp, E. coli
tgatgtgaagttactcgccgccctt

SEQ ID NO: 125096 - DNA, 25 bp, E. coli
tgatgtgaagtttctcgccgccctt

SEQ ID NO: 125097 - DNA, 25 bp, E. coli
tcatgggccttcataccacgactgg

SEQ ID NO: 125098 - DNA, 25 bp, E. coli
tcatcctgatggtttagccgatgcg

SEQ ID NO: 125099 - DNA, 25 bp, E. coli
tcatgggccttcttaccacgactgg

SEQ ID NO: 125100 - DNA, 25 bp, E. coli
tcatcctgatggattagccgatgcg

SEQ ID NO: 125101 - DNA, 25 bp, E. coli
gccgtagttattggtctgctcatga

SEQ ID NO: 125102 - DNA, 25 bp, E. coli
gcctcattcgctagcggagccgtag

SEQ ID NO: 125103 - DNA, 25 bp, E. coli
gcctcattcgcttgcggagccgtag

SEQ ID NO: 125104 - DNA, 25 bp, E. coli
gccgtagttattcgtctgctcatga

SEQ ID NO: 125105 - DNA, 25 bp, E. coli
gaatcattaaaatacccgctgcctt

SEQ ID NO: 125106 - DNA, 25 bp, E. coli
gaatcattaaaaaacccgctgcctt

SEQ ID NO: 125107 - DNA, 25 bp, E. coli
cgcatactgcgcgataaagaaggat

SEQ ID NO: 125108 - DNA, 25 bp, E. coli
cgcatactgcgccataaagaaggat

SEQ ID NO: 125109 - DNA, 25 bp, E. coli
tactgctgggatatggtgtaccgag

SEQ ID NO: 125110 - DNA, 25 bp, E. coli
tactgctgggatttggtgtaccgag

SEQ ID NO: 125111 - DNA, 25 bp, E. coli
actaaactcttcctgtctccgataa

SEQ ID NO: 125112 - DNA, 25 bp, E. coli
actaaactcttcgtgtctccgataa

SEQ ID NO: 125113 - DNA, 25 bp, E. coli
taccgagacgggtcgtaaaatctgc

SEQ ID NO: 125114 - DNA, 25 bp, E. coli
tatccagttcacattcatttgttga

SEQ ID NO: 125115 - DNA, 25 bp, E. coli
tatccagttcactttcatttgttga

SEQ ID NO: 125116 - DNA, 25 bp, E. coli
taccgagacgggacgtaaaatctgc

SEQ ID NO: 125117 - DNA, 25 bp, E. coli
cctgaaacgtgggaaattctactcg

SEQ ID NO: 125118 - DNA, 25 bp, E. coli
cctgtctccgataaaagatgattaa

SEQ ID NO: 125119 - DNA, 25 bp, E. coli
cctgaaacgtggcaaattctactcg

SEQ ID NO: 125120 - DNA, 25 bp, E. coli
cctgtctccgattaaagatgattaa

SEQ ID NO: 125121 - DNA, 25 bp, E. coli
gcaggcattatagtgatccacgcca

SEQ ID NO: 125122 - DNA, 25 bp, E. coli
gcaggcattatactgatccacgcca

SEQ ID NO: 125123 - DNA, 25 bp, E. coli
cgggacgtaaaatctgcaggcatta

SEQ ID NO: 125124 - DNA, 25 bp, E. coli
cgggacgtaaaaactgcaggcatta

SEQ ID NO: 125125 - DNA, 25 bp, E. coli
tcccttaagcgcattattttacaaa

SEQ ID NO: 125126 - DNA, 25 bp, E. coli
gatccacgccactttttgtcaacgt

SEQ ID NO: 125127 - DNA, 25 bp, E. coli
ggtaaaaaatgcaaatactgctggg

SEQ ID NO: 125128 - DNA, 25 bp, E. coli
tcccttaagcgctttattttacaaa

SEQ ID NO: 125129 - DNA, 25 bp, E. coli
ggtaaaaaatgctaatactgctggg

SEQ ID NO: 125130 - DNA, 25 bp, E. coli
gatccacgccacattttgtcaacgt

SEQ ID NO: 125131 - DNA, 25 bp, E. coli
caagcaaacacaacaagcaacaaat

SEQ ID NO: 125132 - DNA, 25 bp, E. coli
caatcgacaatcaccattacgtttt

SEQ ID NO: 125133 - DNA, 25 bp, E. coli
caatcgacaatctccattacgtttt

SEQ ID NO: 125134 - DNA, 25 bp, E. coli
cactttgtcagctatttggcccccg

SEQ ID NO: 125135 - DNA, 25 bp, E. coli
caagcaaacacatcaagcaacaaat

SEQ ID NO: 125136 - DNA, 25 bp, E. coli
cactttgtcagcaatttggcccccg

SEQ ID NO: 125137 - DNA, 25 bp, E. coli
agcaacaaatacgaggttaacggag

SEQ ID NO: 125138 - DNA, 25 bp, E. coli
agcaacaaataccaggttaacggag

SEQ ID NO: 125139 - DNA, 25 bp, E. coli
atagcaaccacgtctgcggacgtgg

SEQ ID NO: 125140 - DNA, 25 bp, E. coli
atagcaaccacgactgcggacgtgg

SEQ ID NO: 125141 - DNA, 25 bp, E. coli
tatatcctcacagcagacctttttt

SEQ ID NO: 125142 - DNA, 25 bp, E. coli
tatatcctcacaccagacctttttt

SEQ ID NO: 125143 - DNA, 25 bp, E. coli
ccttttttcacctatcgacaatcac

SEQ ID NO: 125144 - DNA, 25 bp, E. coli
ccttttttcaccaatcgacaatcac

SEQ ID NO: 125145 - DNA, 25 bp, E. coli
gacgtggttggctctgatgacaaac

SEQ ID NO: 125146 - DNA, 25 bp, E. coli
gacgtggttggcactgatgacaaac

SEQ ID NO: 125147 - DNA, 25 bp, E. coli
cccgctaaaaataatcgattcatca

SEQ ID NO: 125148 - DNA, 25 bp, E. coli
cccgctaaaaattatcgattcatca

SEQ ID NO: 125149 - DNA, 25 bp, E. coli
gattcatcaatatatatatcctcac

SEQ ID NO: 125150 - DNA, 25 bp, E. coli
gattcatcaataaatatatcctcac

SEQ ID NO: 125151 - DNA, 25 bp, E. coli
gtggttggctctcatgacaaacgcc

SEQ ID NO: 125152 - DNA, 25 bp, E. coli
gtggttggctctgatgacaaacgcc

SEQ ID NO: 125153 - DNA, 25 bp, E. coli
cacaaactctgttaattaatgtatg

SEQ ID NO: 125154 - DNA, 25 bp, E. coli
cacaaactctgtaaattaatgtatg

SEQ ID NO: 125155 - DNA, 25 bp, E. coli
catctcccgggtggttaactgacta

SEQ ID NO: 125156 - DNA, 25 bp, E. coli
catctcccgggtcgttaactgacta

SEQ ID NO: 125157 - DNA, 25 bp, E. coli
agacgttctttgttccttgctttgc

SEQ ID NO: 125158 - DNA, 25 bp, E. coli
ataatagacgttctttgttccttgc

SEQ ID NO: 125159 - DNA, 25 bp, E. coli
agacgttctttgatccttgctttgc

SEQ ID NO: 125160 - DNA, 25 bp, E. coli
ataatagacgttgtttgttccttgc

SEQ ID NO: 125161 - DNA, 25 bp, E. coli
aaattaatgtatcaataatccgggc

SEQ ID NO: 125162 - DNA, 25 bp, E. coli
aaattaatgtatgaataatccgggc

SEQ ID NO: 125163 - DNA, 25 bp, E. coli
tgttccttgcttagctaatacgccc

SEQ ID NO: 125164 - DNA, 25 bp, E. coli
tgttccttgctttgctaatacgccc

SEQ ID NO: 125165 - DNA, 25 bp, E. coli
tcccgggtcgttaactgactataat

SEQ ID NO: 125166 - DNA, 25 bp, E. coli
tccttgctttgcaaatacgcccaca

SEQ ID NO: 125167 - DNA, 25 bp, E. coli
tccttgctttgctaatacgcccaca

SEQ ID NO: 125168 - DNA, 25 bp, E. coli
tcccgggtcgtttactgactataat

SEQ ID NO: 125169 - DNA, 25 bp, E. coli
gctttgctaatacgcccacaaactc

SEQ ID NO: 125170 - DNA, 25 bp, E. coli
gctttgctaataggcccacaaactc

SEQ ID NO: 125171 - DNA, 25 bp, E. coli
ggtcgttaactgtctataataatag

SEQ ID NO: 125172 - DNA, 25 bp, E. coli
ggtcgttaactgactataataatag

SEQ ID NO: 125173 - DNA, 25 bp, E. coli
taactgactataataatagacgttc

SEQ ID NO: 125174 - DNA, 25 bp, E. coli
taactgactatattaatagacgttc

SEQ ID NO: 125175 - DNA, 25 bp, E. coli
ttaccgccactattgaaaaggaagg

SEQ ID NO: 125176 - DNA, 25 bp, E. coli
ttaccgccactaatgaaaaggaagg

SEQ ID NO: 125177 - DNA, 25 bp, E. coli
tcagaatgcgaaaaaatgctctcag

SEQ ID NO: 125178 - DNA, 25 bp, E. coli
tctaaactaacgaaatcagaatgcg

SEQ ID NO: 125179 - DNA, 25 bp, E. coli
tctaaactaacgtaatcagaatgcg

SEQ ID NO: 125180 - DNA, 25 bp, E. coli
ccagagagcagatagtaaaactgat

SEQ ID NO: 125181 - DNA, 25 bp, E. coli
ccagagagcagaaagtaaaactgat

SEQ ID NO: 125182 - DNA, 25 bp, E. coli
cctactaactggtcaagatattcaa

SEQ ID NO: 125183 - DNA, 25 bp, E. coli
cctactaactggacaagatattcaa

SEQ ID NO: 125184 - DNA, 25 bp, E. coli
gcgaaaaaatgcactcaggtaaaaa

SEQ ID NO: 125185 - DNA, 25 bp, E. coli
gcgaaaaaatgctctcaggtaaaaa

SEQ ID NO: 125186 - DNA, 25 bp, E. coli
gaaggtggcactgctactaactgga

SEQ ID NO: 125187 - DNA, 25 bp, E. coli
gaaggtggcactcctactaactgga

SEQ ID NO: 125188 - DNA, 25 bp, E. coli
gaagcaggcgttaccagagagcaga

SEQ ID NO: 125189 - DNA, 25 bp, E. coli
gaagcaggcgtttccagagagcaga

SEQ ID NO: 125190 - DNA, 25 bp, E. coli
ctcaggtaaaaaagaagcaggcgtt

SEQ ID NO: 125191 - DNA, 25 bp, E. coli
ctattgaaaaggtaggtggcactcc

SEQ ID NO: 125192 - DNA, 25 bp, E. coli
ctcaggtaaaaatgaagcaggcgtt

SEQ ID NO: 125193 - DNA, 25 bp, E. coli
ctattgaaaaggaaggtggcactcc

SEQ ID NO: 125194 - DNA, 25 bp, E. coli
taattgcgagaaacttcagtcctcg

SEQ ID NO: 125195 - DNA, 25 bp, E. coli
tcagaatgcgaataaatgctctcag

SEQ ID NO: 125196 - DNA, 25 bp, E. coli
taattgcgagaatcttcagtcctcg

SEQ ID NO: 125197 - DNA, 25 bp, E. coli
caatgaccgagcttttgggacgagg

SEQ ID NO: 125198 - DNA, 25 bp, E. coli
caatgaccgagcatttgggacgagg

SEQ ID NO: 125199 - DNA, 25 bp, E. coli
caaatgcccggtatggtgctgatca

SEQ ID NO: 125200 - DNA, 25 bp, E. coli
caaatgcccggtttggtgctgatca

SEQ ID NO: 125201 - DNA, 25 bp, E. coli
catttggcgaaccagacgaaagcgg

SEQ ID NO: 125202 - DNA, 25 bp, E. coli
cataaaggatgttgcccgactggca

SEQ ID NO: 125203 - DNA, 25 bp, E. coli
catttggcgaacgagacgaaagcgg

SEQ ID NO: 125204 - DNA, 25 bp, E. coli
cataaaggatgtagcccgactggca

SEQ ID NO: 125205 - DNA, 25 bp, E. coli
aaaaccgttgtattgctctggacga

SEQ ID NO: 125206 - DNA, 25 bp, E. coli
aaaaccgttgtaatgctctggacga

SEQ ID NO: 125207 - DNA, 25 bp, E. coli
tttaattcagcaaggtcatacccgc

SEQ ID NO: 125208 - DNA, 25 bp, E. coli
tttaattcagcatggtcatacccgc

SEQ ID NO: 125209 - DNA, 25 bp, E. coli
tgttataacgatacaatggcggcgg

SEQ ID NO: 125210 - DNA, 25 bp, E. coli
tgttataacgattcaatggcggcgg

SEQ ID NO: 125211 - DNA, 25 bp, E. coli
tcctgcctggctttgaaaaccgttg

SEQ ID NO: 125212 - DNA, 25 bp, E. coli
tccgtcgctggacgcaagtcatcat

SEQ ID NO: 125213 - DNA, 25 bp, E. coli
tccgtcgctggaggcaagtcatcat

SEQ ID NO: 125214 - DNA, 25 bp, E. coli
tcctgcctggctatgaaaaccgttg

SEQ ID NO: 125215 - DNA, 25 bp, E. coli
cgaagatcgtctgcaagggtattac

SEQ ID NO: 125216 - DNA, 25 bp, E. coli
cgaagatcgtctccaagggtattac

SEQ ID NO: 125217 - DNA, 25 bp, E. coli
gagtctcttagctatcacccgaacg

SEQ ID NO: 125218 - DNA, 25 bp, E. coli
gagtctcttagcaatcacccgaacg

SEQ ID NO: 125219 - DNA, 25 bp, E. coli
taaaacctggcgaaatcactggtga

SEQ ID NO: 125220 - DNA, 25 bp, E. coli
taaaacctggcgtaatcactggtga

SEQ ID NO: 125221 - DNA, 25 bp, E. coli
taaagcgccggttatcgttcagttc

SEQ ID NO: 125222 - DNA, 25 bp, E. coli
taaagcgccggtaatcgttcagttc

SEQ ID NO: 125223 - DNA, 25 bp, E. coli
taaactgcgtcgctactgactccat

SEQ ID NO: 125224 - DNA, 25 bp, E. coli
taaactgcgtcggtactgactccat

SEQ ID NO: 125225 - DNA, 25 bp, E. coli
taaaggcgtgaattctgacgttccg

SEQ ID NO: 125226 - DNA, 25 bp, E. coli
taaaggcgtgaaatctgacgttccg

SEQ ID NO: 125227 - DNA, 25 bp, E. coli
actctggaaatccaactgggttgca

SEQ ID NO: 125228 - DNA, 25 bp, E. coli
aacaagaaatacaacgatccgcgcg

SEQ ID NO: 125229 - DNA, 25 bp, E. coli
aacaagaaatactacgatccgcgcg

SEQ ID NO: 125230 - DNA, 25 bp, E. coli
actctggaaatcgaactgggttgca

SEQ ID NO: 125231 - DNA, 25 bp, E. coli
tacctggagcgcttgtccaaaatcg

SEQ ID NO: 125232 - DNA, 25 bp, E. coli
tacctggagcgcatgtccaaaatcg

SEQ ID NO: 125233 - DNA, 25 bp, E. coli
ttccaggaactgaacgcgatcgacg

SEQ ID NO: 125234 - DNA, 25 bp, E. coli
ttccaggaactgtacgcgatcgacg

SEQ ID NO: 125235 - DNA, 25 bp, E. coli
gaagaaactgctcccgtggatcgac

SEQ ID NO: 125236 - DNA, 25 bp, E. coli
gaagaaactgctgccgtggatcgac

SEQ ID NO: 125237 - DNA, 25 bp, E. coli
tggacgcgggtgtaaaacacttcgc

SEQ ID NO: 125238 - DNA, 25 bp, E. coli
tggacgcgggtgaaaaacacttcgc

SEQ ID NO: 125239 - DNA, 25 bp, E. coli
tacacccagccgcaagacgttgatt

SEQ ID NO: 125240 - DNA, 25 bp, E. coli
tacacccagccggaagacgttgatt

SEQ ID NO: 125241 - DNA, 25 bp, E. coli
aatcagttcagatgcaagcgcccgc

SEQ ID NO: 125242 - DNA, 25 bp, E. coli
aatcagttcagaagcaagcgcccgc

SEQ ID NO: 125243 - DNA, 25 bp, E. coli
tatgccggttctcctacaactatga

SEQ ID NO: 125244 - DNA, 25 bp, E. coli
tatgccggttctgctacaactatga

SEQ ID NO: 125245 - DNA, 25 bp, E. coli
tattgtccatcatacgcggaatacg

SEQ ID NO: 125246 - DNA, 25 bp, E. coli
tattgtccatcaaacgcggaatacg

SEQ ID NO: 125247 - DNA, 25 bp, E. coli
tgttagcgctggtatggcgacgcac

SEQ ID NO: 125248 - DNA, 25 bp, E. coli
tgttgatccccaaaaacgcctcggg

SEQ ID NO: 125249 - DNA, 25 bp, E. coli
tgttagcgctggaatggcgacgcac

SEQ ID NO: 125250 - DNA, 25 bp, E. coli
tgttgatccccataaacgcctcggg

SEQ ID NO: 125251 - DNA, 25 bp, E. coli
tgcaggcctattcttcaacaatcgg

SEQ ID NO: 125252 - DNA, 25 bp, E. coli
tgcaggcctattgttcaacaatcgg

SEQ ID NO: 125253 - DNA, 25 bp, E. coli
tattaaccggttctgggcaaagtga

SEQ ID NO: 125254 - DNA, 25 bp, E. coli
tattaaccggttgtgggcaaagtga

SEQ ID NO: 125255 - DNA, 25 bp, E. coli
cctcgggcagtaagagtgacggtac

SEQ ID NO: 125256 - DNA, 25 bp, E. coli
ccacattatgttgcaggtcacgtac

SEQ ID NO: 125257 - DNA, 25 bp, E. coli
ccacattatgttccaggtcacgtac

SEQ ID NO: 125258 - DNA, 25 bp, E. coli
cctcgggcagtatgagtgacggtac

SEQ ID NO: 125259 - DNA, 25 bp, E. coli
gctgaaattgcgcaaaccgatatgg

SEQ ID NO: 125260 - DNA, 25 bp, E. coli
gctgaaattgcggaaaccgatatgg

SEQ ID NO: 125261 - DNA, 25 bp, E. coli
gattgccgcttgtgtatcaaccgta

SEQ ID NO: 125262 - DNA, 25 bp, E. coli
gattgccgcttgagtatcaaccgta

SEQ ID NO: 125263 - DNA, 25 bp, E. coli
cagtatccaaatatgtagcgctgct

SEQ ID NO: 125264 - DNA, 25 bp, E. coli
cagtatccaaatttgtagcgctgct

SEQ ID NO: 125265 - DNA, 25 bp, E. coli
tacgggaaccttccaaagatataat

SEQ ID NO: 125266 - DNA, 25 bp, E. coli
taaaacctccagaagtgaagggatc

SEQ ID NO: 125267 - DNA, 25 bp, E. coli
tacttgcggtgatttgcagtatcca

SEQ ID NO: 125268 - DNA, 25 bp, E. coli
tactataagataccaagtggtgggc

SEQ ID NO: 125269 - DNA, 25 bp, E. coli
taaaacctccagtagtgaagggatc

SEQ ID NO: 125270 - DNA, 25 bp, E. coli
tacgggaaccttgcaaagatataat

SEQ ID NO: 125271 - DNA, 25 bp, E. coli
tacttgcggtgaattgcagtatcca

SEQ ID NO: 125272 - DNA, 25 bp, E. coli
tactataagatagcaagtggtgggc

SEQ ID NO: 125273 - DNA, 25 bp, E. coli
tgatgtactcagtcagtatgacggg

SEQ ID NO: 125274 - DNA, 25 bp, E. coli
tgatgtactcagacagtatgacggg

SEQ ID NO: 125275 - DNA, 25 bp, E. coli
tatatgtcgtttcgaatacgggaac

SEQ ID NO: 125276 - DNA, 25 bp, E. coli
tatatgtcgtttggaatacgggaac

SEQ ID NO: 125277 - DNA, 25 bp, E. coli
gcgagtcctgatgcaaagaattata

SEQ ID NO: 125278 - DNA, 25 bp, E. coli
gctggcgaaggtttggctattatac

SEQ ID NO: 125279 - DNA, 25 bp, E. coli
gcgagtcctgatccaaagaattata

SEQ ID NO: 125280 - DNA, 25 bp, E. coli
gctggcgaaggtatggctattatac

SEQ ID NO: 125281 - DNA, 25 bp, E. coli
gatatattgtatcagatgcgagtcc

SEQ ID NO: 125282 - DNA, 25 bp, E. coli
gatatattgtatgagatgcgagtcc

SEQ ID NO: 125283 - DNA, 25 bp, E. coli
taaccaattttccatgagtcaagac

SEQ ID NO: 125284 - DNA, 25 bp, E. coli
taaccaattttcgatgagtcaagac

SEQ ID NO: 125285 - DNA, 25 bp, E. coli
aatcagacccggtgatggcagcatc

SEQ ID NO: 125286 - DNA, 25 bp, E. coli
aatcagacccggagatggcagcatc

SEQ ID NO: 125287 - DNA, 25 bp, E. coli
cagcaggctgacgaagatgttgtac

SEQ ID NO: 125288 - DNA, 25 bp, E. coli
cagcaggctgaccaagatgttgtac

SEQ ID NO: 125289 - DNA, 25 bp, E. coli
tatctttgcgggaggtcagcacata

SEQ ID NO: 125290 - DNA, 25 bp, E. coli
tatctttgcgggtggtcagcacata

SEQ ID NO: 125291 - DNA, 25 bp, E. coli
gccagcgtcagggtcagcagaaaat

SEQ ID NO: 125292 - DNA, 25 bp, E. coli
gccagcgtcaggctcagcagaaaat

SEQ ID NO: 125293 - DNA, 25 bp, E. coli
gcgaagcccagattgctcagcaggc

SEQ ID NO: 125294 - DNA, 25 bp, E. coli
gcgaagcccagaatgctcagcaggc

SEQ ID NO: 125295 - DNA, 25 bp, E. coli
gaatgcggagataatcccggtcggc

SEQ ID NO: 125296 - DNA, 25 bp, E. coli
gaatgcggagattatcccggtcggc

SEQ ID NO: 125297 - DNA, 25 bp, E. coli
gaaacatacaggctaaccgtggcac

SEQ ID NO: 125298 - DNA, 25 bp, E. coli
gaaacatacagggtaaccgtggcac

SEQ ID NO: 125299 - DNA, 25 bp, E. coli
cgtactggcagtagcggtaatcgcc

SEQ ID NO: 125300 - DNA, 25 bp, E. coli
cgtactggcagttgcggtaatcgcc

SEQ ID NO: 125301 - DNA, 25 bp, E. coli
ggtaatcgccgaaaaggccagcgtc

SEQ ID NO: 125302 - DNA, 25 bp, E. coli
ggtaatcgccgataaggccagcgtc

SEQ ID NO: 125303 - DNA, 25 bp, E. coli
tggcagcatcaggaccgtactggca

SEQ ID NO: 125304 - DNA, 25 bp, E. coli
tggcagcatcagcaccgtactggca

SEQ ID NO: 125305 - DNA, 25 bp, E. coli
tcaccgccatgaatgatgttgctgg

SEQ ID NO: 125306 - DNA, 25 bp, E. coli
tcaccgccatgattgatgttgctgg

SEQ ID NO: 125307 - DNA, 25 bp, E. coli
catgatgtgcctgattacgccagcg

SEQ ID NO: 125308 - DNA, 25 bp, E. coli
catgatgtgcctcattacgccagcg

SEQ ID NO: 125309 - DNA, 25 bp, E. coli
tacaaaaaaggcacaatggcgaagc

SEQ ID NO: 125310 - DNA, 25 bp, E. coli
tacaaaaaaggctcaatggcgaagc

SEQ ID NO: 125311 - DNA, 25 bp, E. coli
attcactgggcgtcaccaactccgg

SEQ ID NO: 125312 - DNA, 25 bp, E. coli
attcactgggcgacaccaactccgg

SEQ ID NO: 125313 - DNA, 25 bp, E. coli
gaatgcagcatgtgcatgatgtgcc

SEQ ID NO: 125314 - DNA, 25 bp, E. coli
gaatgcagcatgagcatgatgtgcc

SEQ ID NO: 125315 - DNA, 25 bp, E. coli
aaaaggctcaatcgcgaagcgctgg

SEQ ID NO: 125316 - DNA, 25 bp, E. coli
aaaaggctcaatggcgaagcgctgg

SEQ ID NO: 125317 - DNA, 25 bp, E. coli
gaatacgttaaagctatcggcggcg

SEQ ID NO: 125318 - DNA, 25 bp, E. coli
gaatacgttaaacctatcggcggcg

SEQ ID NO: 125319 - DNA, 25 bp, E. coli
gaacagcagacgttttttggccgtg

SEQ ID NO: 125320 - DNA, 25 bp, E. coli
gaacagcagacgatttttggccgtg

SEQ ID NO: 125321 - DNA, 25 bp, E. coli
ctgattacgccagcgacccggaagg

SEQ ID NO: 125322 - DNA, 25 bp, E. coli
ctgattacgccaccgacccggaagg

SEQ ID NO: 125323 - DNA, 25 bp, E. coli
gggtttcaaagacggcactgccaat

SEQ ID NO: 125324 - DNA, 25 bp, E. coli
gggtttcaaagagggcactgccaat

SEQ ID NO: 125325 - DNA, 25 bp, E. coli
taatttgctgggattcaaagacggc

SEQ ID NO: 125326 - DNA, 25 bp, E. coli
taatttgctgggtttcaaagacggc

SEQ ID NO: 125327 - DNA, 25 bp, E. coli
gacgccgattaaattgctgggtttc

SEQ ID NO: 125328 - DNA, 25 bp, E. coli
gacgccgattaatttgctgggtttc

SEQ ID NO: 125329 - DNA, 25 bp, E. coli
aatctctgaagccgcgaaacacggt

SEQ ID NO: 125330 - DNA, 25 bp, E. coli
aatctctgaagcggcgaaacacggt

SEQ ID NO: 125331 - DNA, 25 bp, E. coli
cttcggcaattttcttaagtcgcgg

SEQ ID NO: 125332 - DNA, 25 bp, E. coli
cttcggcaatttacttaagtcgcgg

SEQ ID NO: 125333 - DNA, 25 bp, E. coli
acgaatctctgaagcggcgaaacac

SEQ ID NO: 125334 - DNA, 25 bp, E. coli
agtcagcaacccttcggcaattttc

SEQ ID NO: 125335 - DNA, 25 bp, E. coli
agtcagcaacccatcggcaattttc

SEQ ID NO: 125336 - DNA, 25 bp, E. coli
acgaatctctgatgcggcgaaacac

SEQ ID NO: 125337 - DNA, 25 bp, E. coli
tgaagtcagcaagccttcggcaatt

SEQ ID NO: 125338 - DNA, 25 bp, E. coli
tgaagtcagcaacccttcggcaatt

SEQ ID NO: 125339 - DNA, 25 bp, E. coli
gcgtgaagtcagcaacccttcggca

SEQ ID NO: 125340 - DNA, 25 bp, E. coli
gcgtggtgccagcaagtgccattct

SEQ ID NO: 125341 - DNA, 25 bp, E. coli
gcgtggtgccaggaagtgccattct

SEQ ID NO: 125342 - DNA, 25 bp, E. coli
gcgtgaagtcaggaacccttcggca

SEQ ID NO: 125343 - DNA, 25 bp, E. coli
gcaacccttcggcaattttcttaag

SEQ ID NO: 125344 - DNA, 25 bp, E. coli
gcaacccttcgggaattttcttaag

SEQ ID NO: 125345 - DNA, 25 bp, E. coli
cgaatctctgaaccggcgaaacacg

SEQ ID NO: 125346 - DNA, 25 bp, E. coli
cgaatctctgaagcggcgaaacacg

SEQ ID NO: 125347 - DNA, 25 bp, E. coli
ctaggcggcggcctggtgccaggaa

SEQ ID NO: 125348 - DNA, 25 bp, E. coli
cgtggtgccaggtagtgccattctg

SEQ ID NO: 125349 - DNA, 25 bp, E. coli
ctaggcggcggcgtggtgccaggaa

SEQ ID NO: 125350 - DNA, 25 bp, E. coli
cgtggtgccaggaagtgccattctg

SEQ ID NO: 125351 - DNA, 25 bp, E. coli
aatcagcccggtcatacatagttac

SEQ ID NO: 125352 - DNA, 25 bp, E. coli
aatcagcccggtgatacatagttac

SEQ ID NO: 125353 - DNA, 25 bp, E. coli
ataaagctttttcccgcatctggca

SEQ ID NO: 125354 - DNA, 25 bp, E. coli
ataaagctttttgccgcatctggca

SEQ ID NO: 125355 - DNA, 25 bp, E. coli
agagtagtgctatctgtaggccaga

SEQ ID NO: 125356 - DNA, 25 bp, E. coli
agagtagtgctaactgtaggccaga

SEQ ID NO: 125357 - DNA, 25 bp, E. coli
tattgccacacaaactcacctcgaa

SEQ ID NO: 125358 - DNA, 25 bp, E. coli
tattgccacacatactcacctcgaa

SEQ ID NO: 125359 - DNA, 25 bp, E. coli
tctcactgaaattttgccacacaaa

SEQ ID NO: 125360 - DNA, 25 bp, E. coli
tctcactgaaatattgccacacaaa

SEQ ID NO: 125361 - DNA, 25 bp, E. coli
gcatctggcaatcagcccggtcata

SEQ ID NO: 125362 - DNA, 25 bp, E. coli
gcatctggcaatgagcccggtcata

SEQ ID NO: 125363 - DNA, 25 bp, E. coli
ctgtaggccagaaaaagctttttgc

SEQ ID NO: 125364 - DNA, 25 bp, E. coli
ctgtaggccagataaagctttttgc

SEQ ID NO: 125365 - DNA, 25 bp, E. coli
gttaccgggctgatacactttctca

SEQ ID NO: 125366 - DNA, 25 bp, E. coli
gttaccgggctgttacactttctca

SEQ ID NO: 125367 - DNA, 25 bp, E. coli
gggctgatacactttctcactgaaa

SEQ ID NO: 125368 - DNA, 25 bp, E. coli
gggctgatacacattctcactgaaa

SEQ ID NO: 125369 - DNA, 25 bp, E. coli
ggtcatacatagttaccgggctgat

SEQ ID NO: 125370 - DNA, 25 bp, E. coli
ggtcatacatagataccgggctgat

SEQ ID NO: 125371 - DNA, 25 bp, E. coli
gaccccaaagagaagtgctaactgt

SEQ ID NO: 125372 - DNA, 25 bp, E. coli
gaccccaaagagtagtgctaactgt

SEQ ID NO: 125373 - DNA, 25 bp, E. coli
caggcactacgaaatgcggcgatga

SEQ ID NO: 125374 - DNA, 25 bp, E. coli
cagaatcgttttcgcttcatcggat

SEQ ID NO: 125375 - DNA, 25 bp, E. coli
caggcactacgatatgcggcgatga

SEQ ID NO: 125376 - DNA, 25 bp, E. coli
cagaatcgttttggcttcatcggat

SEQ ID NO: 125377 - DNA, 25 bp, E. coli
tactcaataaacctcaagatgcggg

SEQ ID NO: 125378 - DNA, 25 bp, E. coli
tactcaataaacgtcaagatgcggg

SEQ ID NO: 125379 - DNA, 25 bp, E. coli
aaacaaaactgccatgccgatgcga

SEQ ID NO: 125380 - DNA, 25 bp, E. coli
aaacaaaactgcgatgccgatgcga

SEQ ID NO: 125381 - DNA, 25 bp, E. coli
ttactgggaagaaagccgtcggcga

SEQ ID NO: 125382 - DNA, 25 bp, E. coli
ttactgggaagatagccgtcggcga

SEQ ID NO: 125383 - DNA, 25 bp, E. coli
tgcagagcaaatcataccggttcct

SEQ ID NO: 125384 - DNA, 25 bp, E. coli
tgcagagcaaatgataccggttcct

SEQ ID NO: 125385 - DNA, 25 bp, E. coli
tcgtgaaaaacgagatgagcagcta

SEQ ID NO: 125386 - DNA, 25 bp, E. coli
tcgtgaaaaacgtgatgagcagcta

SEQ ID NO: 125387 - DNA, 25 bp, E. coli
gcgcatatggagttacaggcactac

SEQ ID NO: 125388 - DNA, 25 bp, E. coli
gcgcatatggagatacaggcactac

SEQ ID NO: 125389 - DNA, 25 bp, E. coli
gcggcgatgatttccacaatgagtt

SEQ ID NO: 125390 - DNA, 25 bp, E. coli
gcggcgatgattaccacaatgagtt

SEQ ID NO: 125391 - DNA, 25 bp, E. coli
ccgtcggcgaattgatttattggca

SEQ ID NO: 125392 - DNA, 25 bp, E. coli
ccgtcggcgaatagatttattggca

SEQ ID NO: 125393 - DNA, 25 bp, E. coli
taaggaactgactaccactgcgatt

SEQ ID NO: 125394 - DNA, 25 bp, E. coli
taaggaactgacaaccactgcgatt

SEQ ID NO: 125395 - DNA, 25 bp, E. coli
aatcaaagattcaagggtgtttgag

SEQ ID NO: 125396 - DNA, 25 bp, E. coli
aatcaaagattctagggtgtttgag

SEQ ID NO: 125397 - DNA, 25 bp, E. coli
cacccgcataagttgatgtaaaaca

SEQ ID NO: 125398 - DNA, 25 bp, E. coli
cacccgcataagatgatgtaaaaca

SEQ ID NO: 125399 - DNA, 25 bp, E. coli
catttgcgaccatacttgatgtgtg

SEQ ID NO: 125400 - DNA, 25 bp, E. coli
cattttttagacttaaacgagtgca

SEQ ID NO: 125401 - DNA, 25 bp, E. coli
catttgcgaccaaacttgatgtgtg

SEQ ID NO: 125402 - DNA, 25 bp, E. coli
cattttttagacataaacgagtgca

SEQ ID NO: 125403 - DNA, 25 bp, E. coli
taaaatttcacagccgcataagttg

SEQ ID NO: 125404 - DNA, 25 bp, E. coli
taaaatttcacacccgcataagttg

SEQ ID NO: 125405 - DNA, 25 bp, E. coli
taaaatccatttccgaccatacttg

SEQ ID NO: 125406 - DNA, 25 bp, E. coli
tttctacagaacaaaatcatgctca

SEQ ID NO: 125407 - DNA, 25 bp, E. coli
tttctacagaactaaatcatgctca

SEQ ID NO: 125408 - DNA, 25 bp, E. coli
tgtaaaacaatataatccatttgcg

SEQ ID NO: 125409 - DNA, 25 bp, E. coli
tgtaaaacaataaaatccatttgcg

SEQ ID NO: 125410 - DNA, 25 bp, E. coli
tcctgcgaatcttcaatccgcctag

SEQ ID NO: 125411 - DNA, 25 bp, E. coli
tcctgcgaatctacaatccgcctag

SEQ ID NO: 125412 - DNA, 25 bp, E. coli
tcttcaatccgcctagcttaactgc

SEQ ID NO: 125413 - DNA, 25 bp, E. coli
tcttcaatccgcgtagcttaactgc

SEQ ID NO: 125414 - DNA, 25 bp, E. coli
gcttaactgcttgtttctacagaac

SEQ ID NO: 125415 - DNA, 25 bp, E. coli
gcttaactgcttctttctacagaac

SEQ ID NO: 125416 - DNA, 25 bp, E. coli
taaaatccatttgcgaccatacttg

SEQ ID NO: 125417 - DNA, 25 bp, E. coli
caaccgatggctacacaggcaaaga

SEQ ID NO: 125418 - DNA, 25 bp, E. coli
caaccgatggcttcacaggcaaaga

SEQ ID NO: 125419 - DNA, 25 bp, E. coli
tattacaatagcgtcaggcctcacc

SEQ ID NO: 125420 - DNA, 25 bp, E. coli
tattacaatagcctcaggcctcacc

SEQ ID NO: 125421 - DNA, 25 bp, E. coli
tgagcagttgtcagcccggaaaaca

SEQ ID NO: 125422 - DNA, 25 bp, E. coli
tgagcagttgtctgcccggaaaaca

SEQ ID NO: 125423 - DNA, 25 bp, E. coli
tctgaaaacagattgggtgccaacc

SEQ ID NO: 125424 - DNA, 25 bp, E. coli
tcatggatctttttgcccgcagggt

SEQ ID NO: 125425 - DNA, 25 bp, E. coli
tctgaaaacagaatgggtgccaacc

SEQ ID NO: 125426 - DNA, 25 bp, E. coli
tcatggatctttatgcccgcagggt

SEQ ID NO: 125427 - DNA, 25 bp, E. coli
gcgaatgccgatactgccctgataa

SEQ ID NO: 125428 - DNA, 25 bp, E. coli
gcgaatgccgattctgccctgataa

SEQ ID NO: 125429 - DNA, 25 bp, E. coli
gacgtcatgttccatagcgaccagg

SEQ ID NO: 125430 - DNA, 25 bp, E. coli
gacgtcatgttcgatagcgaccagg

SEQ ID NO: 125431 - DNA, 25 bp, E. coli
cgtgccgggcgtgtgatgaaatatc

SEQ ID NO: 125432 - DNA, 25 bp, E. coli
cattataacggagggctgacgccgg

SEQ ID NO: 125433 - DNA, 25 bp, E. coli
cgtgccgggcgtctgatgaaatatc

SEQ ID NO: 125434 - DNA, 25 bp, E. coli
cattataacggacggctgacgccgg

SEQ ID NO: 125435 - DNA, 25 bp, E. coli
gataaagcaaagagtcagccgacgg

SEQ ID NO: 125436 - DNA, 25 bp, E. coli
gataaagcaaagtgtcagccgacgg

SEQ ID NO: 125437 - DNA, 25 bp, E. coli
ggaacgcttcttgcgcagtctgaaa

SEQ ID NO: 125438 - DNA, 25 bp, E. coli
ggaacgcttcttccgcagtctgaaa

SEQ ID NO: 125439 - DNA, 25 bp, E. coli
caaatgaaaccggttggcgacggct

SEQ ID NO: 125440 - DNA, 25 bp, E. coli
caaatgaaaccgcttggcgacggct

SEQ ID NO: 125441 - DNA, 25 bp, E. coli
taccatcggtaattacggcgtcggc

SEQ ID NO: 125442 - DNA, 25 bp, E. coli
taccatcggtaaatacggcgtcggc

SEQ ID NO: 125443 - DNA, 25 bp, E. coli
tgaaattgtcagtaccatcgcgctg

SEQ ID NO: 125444 - DNA, 25 bp, E. coli
tgaaattgtcagaaccatcgcgctg

SEQ ID NO: 125445 - DNA, 25 bp, E. coli
tcgatatacctgtcaatggcggcgg

SEQ ID NO: 125446 - DNA, 25 bp, E. coli
tcgatatacctgacaatggcggcgg

SEQ ID NO: 125447 - DNA, 25 bp, E. coli
cctggtgccggattgaacgtcgatc

SEQ ID NO: 125448 - DNA, 25 bp, E. coli
gccggatggcaaaacgcacgaatta

SEQ ID NO: 125449 - DNA, 25 bp, E. coli
cctggtgccggaatgaacgtcgatc

SEQ ID NO: 125450 - DNA, 25 bp, E. coli
gccggatggcaatacgcacgaatta

SEQ ID NO: 125451 - DNA, 25 bp, E. coli
gaagctcgtgcggtgactaacctgg

SEQ ID NO: 125452 - DNA, 25 bp, E. coli
gaagctcgtgcgctgactaacctgg

SEQ ID NO: 125453 - DNA, 25 bp, E. coli
gacaagatggagtaactcggctgcc

SEQ ID NO: 125454 - DNA, 25 bp, E. coli
gacaagatggagaaactcggctgcc

SEQ ID NO: 125455 - DNA, 25 bp, E. coli
cgatcaggcgaatgaccagggcatt

SEQ ID NO: 125456 - DNA, 25 bp, E. coli
cgatcaggcgaaagaccagggcatt

SEQ ID NO: 125457 - DNA, 25 bp, E. coli
ggtcctgacagcgatagccattggt

SEQ ID NO: 125458 - DNA, 25 bp, E. coli
ggtcctgacagccatagccattggt

SEQ ID NO: 125459 - DNA, 25 bp, E. coli
taacctggtcggaaacggcgtagcg

SEQ ID NO: 125460 - DNA, 25 bp, E. coli
taacctggtcggtaacggcgtagcg

SEQ ID NO: 125461 - DNA, 25 bp, E. coli
cagtaatttgatacgccagacacag

SEQ ID NO: 125462 - DNA, 25 bp, E. coli
cagaaatagccatcttgctgggatg

SEQ ID NO: 125463 - DNA, 25 bp, E. coli
cagacacagtctcgcgaattcattg

SEQ ID NO: 125464 - DNA, 25 bp, E. coli
cagacacagtctggcgaattcattg

SEQ ID NO: 125465 - DNA, 25 bp, E. coli
cagaaatagccaacttgctgggatg

SEQ ID NO: 125466 - DNA, 25 bp, E. coli
cagtaatttgattcgccagacacag

SEQ ID NO: 125467 - DNA, 25 bp, E. coli
taggaaaggtcatacgctcatgccg

SEQ ID NO: 125468 - DNA, 25 bp, E. coli
taggaaaggtcaaacgctcatgccg

SEQ ID NO: 125469 - DNA, 25 bp, E. coli
tcatcagacttgctgaacaaagcac

SEQ ID NO: 125470 - DNA, 25 bp, E. coli
tcatcagacttggtgaacaaagcac

SEQ ID NO: 125471 - DNA, 25 bp, E. coli
gccgcatttgcctgaaaacaacgcg

SEQ ID NO: 125472 - DNA, 25 bp, E. coli
gccgcatttgccagaaaacaacgcg

SEQ ID NO: 125473 - DNA, 25 bp, E. coli
gaatgtttgcgctgaaaaataggaa

SEQ ID NO: 125474 - DNA, 25 bp, E. coli
gcagaatcggtattgtcagaggtgt

SEQ ID NO: 125475 - DNA, 25 bp, E. coli
gaatgtttgcgcagaaaaataggaa

SEQ ID NO: 125476 - DNA, 25 bp, E. coli
gcagaatcggtaatgtcagaggtgt

SEQ ID NO: 125477 - DNA, 25 bp, E. coli
gaaaacaacgcgcacttcgtcagta

SEQ ID NO: 125478 - DNA, 25 bp, E. coli
gactgaatagctagcagaatcggta

SEQ ID NO: 125479 - DNA, 25 bp, E. coli
gaaaacaacgcggacttcgtcagta

SEQ ID NO: 125480 - DNA, 25 bp, E. coli
gaaattgcttgaagtgcttcactca

SEQ ID NO: 125481 - DNA, 25 bp, E. coli
gaaattgcttgatgtgcttcactca

SEQ ID NO: 125482 - DNA, 25 bp, E. coli
gactgaatagcttgcagaatcggta

SEQ ID NO: 125483 - DNA, 25 bp, E. coli
acgtaaagccagctggtactgcagg

SEQ ID NO: 125484 - DNA, 25 bp, E. coli
acgtaaagccaggtggtactgcagg

SEQ ID NO: 125485 - DNA, 25 bp, E. coli
aaaatcttttctggcacttgatggc

SEQ ID NO: 125486 - DNA, 25 bp, E. coli
aaaatcttttctcgcacttgatggc

SEQ ID NO: 125487 - DNA, 25 bp, E. coli
tatgcttactacacctgccaccttt

SEQ ID NO: 125488 - DNA, 25 bp, E. coli
tatgcttactactcctgccaccttt

SEQ ID NO: 125489 - DNA, 25 bp, E. coli
ttttctcgcacttgatggcaacgga

SEQ ID NO: 125490 - DNA, 25 bp, E. coli
ttttctcgcactagatggcaacgga

SEQ ID NO: 125491 - DNA, 25 bp, E. coli
tcgtctggcggttaggaaccacact

SEQ ID NO: 125492 - DNA, 25 bp, E. coli
tcgtctggcggtaaggaaccacact

SEQ ID NO: 125493 - DNA, 25 bp, E. coli
ccacactatgtacgcaaaatctttt

SEQ ID NO: 125494 - DNA, 25 bp, E. coli
ccacactatgtaggcaaaatctttt

SEQ ID NO: 125495 - DNA, 25 bp, E. coli
gcagcaatgtccatatgtcaggccg

SEQ ID NO: 125496 - DNA, 25 bp, E. coli
gcagcaatgtccttatgtcaggccg

SEQ ID NO: 125497 - DNA, 25 bp, E. coli
gcacagaccgcaccttatgcttact

SEQ ID NO: 125498 - DNA, 25 bp, E. coli
gcacagaccgcagcttatgcttact

SEQ ID NO: 125499 - DNA, 25 bp, E. coli
gcacgacacggaacgtccctggttt

SEQ ID NO: 125500 - DNA, 25 bp, E. coli
gcacgacacggatcgtccctggttt

SEQ ID NO: 125501 - DNA, 25 bp, E. coli
cggagcacgcgcagcaatgtcctta

SEQ ID NO: 125502 - DNA, 25 bp, E. coli
cggagcacgcgctgcaatgtcctta

SEQ ID NO: 125503 - DNA, 25 bp, E. coli
ggtaaggaaccagactatgtacgca

SEQ ID NO: 125504 - DNA, 25 bp, E. coli
ggtaaggaaccacactatgtacgca

SEQ ID NO: 125505 - DNA, 25 bp, E. coli
caaagctgcgtcttgcgtgatatgc

SEQ ID NO: 125506 - DNA, 25 bp, E. coli
caaagctgcgtcatgcgtgatatgc

SEQ ID NO: 125507 - DNA, 25 bp, E. coli
aaagaggttattcgcctcacaccag

SEQ ID NO: 125508 - DNA, 25 bp, E. coli
aaagaggttattggcctcacaccag

SEQ ID NO: 125509 - DNA, 25 bp, E. coli
tattggcctcacaccagaacagatc

SEQ ID NO: 125510 - DNA, 25 bp, E. coli
tattggcctcactccagaacagatc

SEQ ID NO: 125511 - DNA, 25 bp, E. coli
tgttaaagaggtaattggcctcaca

SEQ ID NO: 125512 - DNA, 25 bp, E. coli
tgttaaagaggttattggcctcaca

SEQ ID NO: 125513 - DNA, 25 bp, E. coli
tgagctggaacaaagctgcgtcatg

SEQ ID NO: 125514 - DNA, 25 bp, E. coli
tgagctggaacatagctgcgtcatg

SEQ ID NO: 125515 - DNA, 25 bp, E. coli
tctctataccaagaaggattccata

SEQ ID NO: 125516 - DNA, 25 bp, E. coli
tctctataccaacaaggattccata

SEQ ID NO: 125517 - DNA, 25 bp, E. coli
ccaacaaggattccatatccttggg

SEQ ID NO: 125518 - DNA, 25 bp, E. coli
ccaacaaggattgcatatccttggg

SEQ ID NO: 125519 - DNA, 25 bp, E. coli
gctgcgtcatgcgtgatatgcagca

SEQ ID NO: 125520 - DNA, 25 bp, E. coli
gctgcgtcatgcctgatatgcagca

SEQ ID NO: 125521 - DNA, 25 bp, E. coli
ggttattggcctgacaccagaacag

SEQ ID NO: 125522 - DNA, 25 bp, E. coli
gggatttctctaaaccaacaaggat

SEQ ID NO: 125523 - DNA, 25 bp, E. coli
gggatttctctataccaacaaggat

SEQ ID NO: 125524 - DNA, 25 bp, E. coli
ggttattggcctcacaccagaacag

SEQ ID NO: 125525 - DNA, 25 bp, E. coli
tggaacaaagctgcgtcatgcgtga

SEQ ID NO: 125526 - DNA, 25 bp, E. coli
tggaacaaagctccgtcatgcgtga

SEQ ID NO: 125527 - DNA, 25 bp, E. coli
caactgtggattgcgcgtatcaacg

SEQ ID NO: 125528 - DNA, 25 bp, E. coli
aagctaaaggcttctacggtgcgcg

SEQ ID NO: 125529 - DNA, 25 bp, E. coli
aagctaaaggctactacggtgcgcg

SEQ ID NO: 125530 - DNA, 25 bp, E. coli
caactgtggattccgcgtatcaacg

SEQ ID NO: 125531 - DNA, 25 bp, E. coli
tattcgacaaagtagcgttcaccgc

SEQ ID NO: 125532 - DNA, 25 bp, E. coli
tattcgacaaagaagcgttcaccgc

SEQ ID NO: 125533 - DNA, 25 bp, E. coli
ttgaaaaagcgatagcagctctggc

SEQ ID NO: 125534 - DNA, 25 bp, E. coli
ttgaaaaagcgaaagcagctctggc

SEQ ID NO: 125535 - DNA, 25 bp, E. coli
cctggctgatatggcagtattcgac

SEQ ID NO: 125536 - DNA, 25 bp, E. coli
cctggctgatatcgcagtattcgac

SEQ ID NO: 125537 - DNA, 25 bp, E. coli
gaaatcgaccgtaagatcctggctg

SEQ ID NO: 125538 - DNA, 25 bp, E. coli
gaaatcgaccgttagatcctggctg

SEQ ID NO: 125539 - DNA, 25 bp, E. coli
cgtatcaacgcagcagcacgtcaga

SEQ ID NO: 125540 - DNA, 25 bp, E. coli
cgtatcaacgcaccagcacgtcaga

SEQ ID NO: 125541 - DNA, 25 bp, E. coli
gtataccgcgttcccttccaggctg

SEQ ID NO: 125542 - DNA, 25 bp, E. coli
gtataccgcgttgccttccaggctg

SEQ ID NO: 125543 - DNA, 25 bp, E. coli
tcaatggcctgataaaagcctctgt

SEQ ID NO: 125544 - DNA, 25 bp, E. coli
tcaaagctggtcagtatgcttaccg

SEQ ID NO: 125545 - DNA, 25 bp, E. coli
tcaatggcctgaaaaaagcctctgt

SEQ ID NO: 125546 - DNA, 25 bp, E. coli
tcaaagctggtctgtatgcttaccg

SEQ ID NO: 125547 - DNA, 25 bp, E. coli
gaccgtcgtcaaggtaagcgtcagt

SEQ ID NO: 125548 - DNA, 25 bp, E. coli
gaccgtcgtcaacgtaagcgtcagt

SEQ ID NO: 125549 - DNA, 25 bp, E. coli
aatcacagtgctcggtcaactctta

SEQ ID NO: 125550 - DNA, 25 bp, E. coli
aatcacagtgctgggtcaactctta

SEQ ID NO: 125551 - DNA, 25 bp, E. coli
taggacgcggcaatatagcggcatc

SEQ ID NO: 125552 - DNA, 25 bp, E. coli
taggacgcggcattatagcggcatc

SEQ ID NO: 125553 - DNA, 25 bp, E. coli
ttggcttcgcggaaccgggatgttc

SEQ ID NO: 125554 - DNA, 25 bp, E. coli
ttggcttcgcggtaccgggatgttc

SEQ ID NO: 125555 - DNA, 25 bp, E. coli
ttaccagaatcaacccgaaagcatt

SEQ ID NO: 125556 - DNA, 25 bp, E. coli
ttaccagaatcatcccgaaagcatt

SEQ ID NO: 125557 - DNA, 25 bp, E. coli
tgttacctcaaataatcacagtgct

SEQ ID NO: 125558 - DNA, 25 bp, E. coli
tgttacctcaaaaaatcacagtgct

SEQ ID NO: 125559 - DNA, 25 bp, E. coli
tcttaccccgcaagcacaggttgtt

SEQ ID NO: 125560 - DNA, 25 bp, E. coli
tcttataatcaatcacattccctgt

SEQ ID NO: 125561 - DNA, 25 bp, E. coli
tcttaccccgcatgcacaggttgtt

SEQ ID NO: 125562 - DNA, 25 bp, E. coli
tcttataatcaaacacattccctgt

SEQ ID NO: 125563 - DNA, 25 bp, E. coli
gcacaggttgttcgcttcgcggaac

SEQ ID NO: 125564 - DNA, 25 bp, E. coli
gcacaggttgttggcttcgcggaac

SEQ ID NO: 125565 - DNA, 25 bp, E. coli
gaaagcattcaaataggacgcggca

SEQ ID NO: 125566 - DNA, 25 bp, E. coli
gaaagcattcaattaggacgcggca

SEQ ID NO: 125567 - DNA, 25 bp, E. coli
cggaaccgggatgttcttataatca

SEQ ID NO: 125568 - DNA, 25 bp, E. coli
cggaaccgggatcttcttataatca

SEQ ID NO: 125569 - DNA, 25 bp, E. coli
ttccctgttaccagaatcatcccga

SEQ ID NO: 125570 - DNA, 25 bp, E. coli
ttccctgttacctgaatcatcccga

SEQ ID NO: 125571 - DNA, 25 bp, E. coli
caagcttcgggatgatgtaaatgcc

SEQ ID NO: 125572 - DNA, 25 bp, E. coli
caagcttcgggaagatgtaaatgcc

SEQ ID NO: 125573 - DNA, 25 bp, E. coli
caaaattctttctagtggctggcgg

SEQ ID NO: 125574 - DNA, 25 bp, E. coli
caaaattctttcaagtggctggcgg

SEQ ID NO: 125575 - DNA, 25 bp, E. coli
tactgtcgcattatcatatctggca

SEQ ID NO: 125576 - DNA, 25 bp, E. coli
tactgtcgcattttcatatctggca

SEQ ID NO: 125577 - DNA, 25 bp, E. coli
tatctggcattctcaattcccaagg

SEQ ID NO: 125578 - DNA, 25 bp, E. coli
tatctggcattcacaattcccaagg

SEQ ID NO: 125579 - DNA, 25 bp, E. coli
tggtcccagcaacaacaaaattctt

SEQ ID NO: 125580 - DNA, 25 bp, E. coli
tggtcccagcaagaacaaaattctt

SEQ ID NO: 125581 - DNA, 25 bp, E. coli
tgaatcactcaaccccaaatggtcc

SEQ ID NO: 125582 - DNA, 25 bp, E. coli
tgaatcactcaagcccaaatggtcc

SEQ ID NO: 125583 - DNA, 25 bp, E. coli
tcgactgcatttgcaagcttcggga

SEQ ID NO: 125584 - DNA, 25 bp, E. coli
tcgactgcatttccaagcttcggga

SEQ ID NO: 125585 - DNA, 25 bp, E. coli
tctctacaggagttgctcgactgca

SEQ ID NO: 125586 - DNA, 25 bp, E. coli
tctctacaggagatgctcgactgca

SEQ ID NO: 125587 - DNA, 25 bp, E. coli
gacaatagcaccatttctctacagg

SEQ ID NO: 125588 - DNA, 25 bp, E. coli
gacaatagcaccttttctctacagg

SEQ ID NO: 125589 - DNA, 25 bp, E. coli
ggaacaaatgcaaccaacactggca

SEQ ID NO: 125590 - DNA, 25 bp, E. coli
ggaacaaatgcatccaacactggca

SEQ ID NO: 125591 - DNA, 25 bp, E. coli
tggcatcgctcctgcttgaatcact

SEQ ID NO: 125592 - DNA, 25 bp, E. coli
tggcatcgctccagcttgaatcact

SEQ ID NO: 125593 - DNA, 25 bp, E. coli
tatgttgaaattatcactgccacga

SEQ ID NO: 125594 - DNA, 25 bp, E. coli
tatgttgaaattttcactgccacga

SEQ ID NO: 125595 - DNA, 25 bp, E. coli
tgattacaaaacagacgaaaactgc

SEQ ID NO: 125596 - DNA, 25 bp, E. coli
tgattacaaaactgacgaaaactgc

SEQ ID NO: 125597 - DNA, 25 bp, E. coli
tccagaggcgaaagcagttacgttg

SEQ ID NO: 125598 - DNA, 25 bp, E. coli
tccagaggcgaatgcagttacgttg

SEQ ID NO: 125599 - DNA, 25 bp, E. coli
tctgcggatgcgatgccactgttaa

SEQ ID NO: 125600 - DNA, 25 bp, E. coli
tctgcggatgcgttgccactgttaa

SEQ ID NO: 125601 - DNA, 25 bp, E. coli
gacgaaaactgcatccagaggcgaa

SEQ ID NO: 125602 - DNA, 25 bp, E. coli
cccattgcgcgataaagaaatacat

SEQ ID NO: 125603 - DNA, 25 bp, E. coli
cccgtgatagtggtcgtgaaagtga

SEQ ID NO: 125604 - DNA, 25 bp, E. coli
cccgtgatagtgctcgtgaaagtga

SEQ ID NO: 125605 - DNA, 25 bp, E. coli
cccattgcgcgaaaaagaaatacat

SEQ ID NO: 125606 - DNA, 25 bp, E. coli
gataagcattatgacttggagcgat

SEQ ID NO: 125607 - DNA, 25 bp, E. coli
gataagcattatcacttggagcgat

SEQ ID NO: 125608 - DNA, 25 bp, E. coli
gagaaagcctctctgcggatgcgat

SEQ ID NO: 125609 - DNA, 25 bp, E. coli
gatgccactgtttatcccgtgatag

SEQ ID NO: 125610 - DNA, 25 bp, E. coli
gatgccactgttaatcccgtgatag

SEQ ID NO: 125611 - DNA, 25 bp, E. coli
gacgaaaactgcttccagaggcgaa

SEQ ID NO: 125612 - DNA, 25 bp, E. coli
gagcgattttctttcacccattgcg

SEQ ID NO: 125613 - DNA, 25 bp, E. coli
gagaaagcctctgtgcggatgcgat

SEQ ID NO: 125614 - DNA, 25 bp, E. coli
gagcgattttctatcacccattgcg

SEQ ID NO: 125615 - DNA, 25 bp, E. coli
caaagcgtgcggtggatcacgttta

SEQ ID NO: 125616 - DNA, 25 bp, E. coli
caaagcgtgcggaggatcacgttta

SEQ ID NO: 125617 - DNA, 25 bp, E. coli
catgatatgccaatcctgatctggg

SEQ ID NO: 125618 - DNA, 25 bp, E. coli
catgatatgccattcctgatctggg

SEQ ID NO: 125619 - DNA, 25 bp, E. coli
agaacattcaatcctgctctcgccg

SEQ ID NO: 125620 - DNA, 25 bp, E. coli
aggatccaacctgcgaaattcgtcg

SEQ ID NO: 125621 - DNA, 25 bp, E. coli
agaacattcaatgctgctctcgccg

SEQ ID NO: 125622 - DNA, 25 bp, E. coli
aggatccaacctccgaaattcgtcg

SEQ ID NO: 125623 - DNA, 25 bp, E. coli
tatgatggctttgtctcgcagagac

SEQ ID NO: 125624 - DNA, 25 bp, E. coli
tatgatggctttctctcgcagagac

SEQ ID NO: 125625 - DNA, 25 bp, E. coli
tgggtcacaataactcaccaccgtg

SEQ ID NO: 125626 - DNA, 25 bp, E. coli
tgggtcacaatatctcaccaccgtg

SEQ ID NO: 125627 - DNA, 25 bp, E. coli
tgctctcgccgcaatcatgatatgc

SEQ ID NO: 125628 - DNA, 25 bp, E. coli
tgctctcgccgctatcatgatatgc

SEQ ID NO: 125629 - DNA, 25 bp, E. coli
tcctatcaaaaagcgtatctccctg

SEQ ID NO: 125630 - DNA, 25 bp, E. coli
tcgcagagacgtttgcagcattctg

SEQ ID NO: 125631 - DNA, 25 bp, E. coli
tcgcagagacgtatgcagcattctg

SEQ ID NO: 125632 - DNA, 25 bp, E. coli
tcctatcaaaaaccgtatctccctg

SEQ ID NO: 125633 - DNA, 25 bp, E. coli
tctttaagggtactcattcgctccg

SEQ ID NO: 125634 - DNA, 25 bp, E. coli
tctttaagggtagtcattcgctccg

SEQ ID NO: 125635 - DNA, 25 bp, E. coli
ctgatctgggtaataggcacaggct

SEQ ID NO: 125636 - DNA, 25 bp, E. coli
ctgatctgggtattaggcacaggct

SEQ ID NO: 125637 - DNA, 25 bp, E. coli
tacggcagcagagggcattcgttgc

SEQ ID NO: 125638 - DNA, 25 bp, E. coli
taaaaaatggtctgagcaggaccgt

SEQ ID NO: 125639 - DNA, 25 bp, E. coli
tacggcagcagacggcattcgttgc

SEQ ID NO: 125640 - DNA, 25 bp, E. coli
taaaaaatggtcagagcaggaccgt

SEQ ID NO: 125641 - DNA, 25 bp, E. coli
aaatgcaggcggagaatgccgtgct

SEQ ID NO: 125642 - DNA, 25 bp, E. coli
aaatgcaggcggtgaatgccgtgct

SEQ ID NO: 125643 - DNA, 25 bp, E. coli
ttcgggcgctctcaaggaaataaca

SEQ ID NO: 125644 - DNA, 25 bp, E. coli
ttcgggcgctctgaaggaaataaca

SEQ ID NO: 125645 - DNA, 25 bp, E. coli
tgatccgacgcatgatattgacctc

SEQ ID NO: 125646 - DNA, 25 bp, E. coli
tgatccgacgcaagatattgacctc

SEQ ID NO: 125647 - DNA, 25 bp, E. coli
tgaagatccggctcagctgaacgac

SEQ ID NO: 125648 - DNA, 25 bp, E. coli
tgaagatccggcacagctgaacgac

SEQ ID NO: 125649 - DNA, 25 bp, E. coli
tcttatgtggcacaggacggtaccg

SEQ ID NO: 125650 - DNA, 25 bp, E. coli
tcttatgtggcagaggacggtaccg

SEQ ID NO: 125651 - DNA, 25 bp, E. coli
gaaaaacgttatctgccggagggca

SEQ ID NO: 125652 - DNA, 25 bp, E. coli
gaaaaacgttatgtgccggagggca

SEQ ID NO: 125653 - DNA, 25 bp, E. coli
gaaacactggctcactgtgggcgat

SEQ ID NO: 125654 - DNA, 25 bp, E. coli
gaaacactggctgactgtgggcgat

SEQ ID NO: 125655 - DNA, 25 bp, E. coli
ggaccgtgatacctttgatccgacg

SEQ ID NO: 125656 - DNA, 25 bp, E. coli
ggaccgtgatacgtttgatccgacg

SEQ ID NO: 125657 - DNA, 25 bp, E. coli
ggaaataacattgagcaggctgacg

SEQ ID NO: 125658 - DNA, 25 bp, E. coli
ggaaataacattcagcaggctgacg

SEQ ID NO: 125659 - DNA, 25 bp, E. coli
caacgcctgaagagatcctgcgacg

SEQ ID NO: 125660 - DNA, 25 bp, E. coli
caacctgtggtaaatggtcgggaag

SEQ ID NO: 125661 - DNA, 25 bp, E. coli
caacctgtggtatatggtcgggaag

SEQ ID NO: 125662 - DNA, 25 bp, E. coli
caacgcctgaagtgatcctgcgacg

SEQ ID NO: 125663 - DNA, 25 bp, E. coli
taaaccttgttctggaagtcaccga

SEQ ID NO: 125664 - DNA, 25 bp, E. coli
taaaccttgttcaggaagtcaccga

SEQ ID NO: 125665 - DNA, 25 bp, E. coli
attgatcacagtttcgttggccgcg

SEQ ID NO: 125666 - DNA, 25 bp, E. coli
attgatcacagtatcgttggccgcg

SEQ ID NO: 125667 - DNA, 25 bp, E. coli
tatttcaataaatgcgcaacgcctg

SEQ ID NO: 125668 - DNA, 25 bp, E. coli
tatttcaataaaagcgcaacgcctg

SEQ ID NO: 125669 - DNA, 25 bp, E. coli
ttattctgttaatcgcctgcgccgc

SEQ ID NO: 125670 - DNA, 25 bp, E. coli
ttattctgttaaacgcctgcgccgc

SEQ ID NO: 125671 - DNA, 25 bp, E. coli
tgccagacagatgaacgctatcgcg

SEQ ID NO: 125672 - DNA, 25 bp, E. coli
tgccagacagatcaacgctatcgcg

SEQ ID NO: 125673 - DNA, 25 bp, E. coli
gcgccgctgccttcctgcttgatag

SEQ ID NO: 125674 - DNA, 25 bp, E. coli
gcgccgctgcctacctgcttgatag

SEQ ID NO: 125675 - DNA, 25 bp, E. coli
cgctggaaacaagctcacggtggat

SEQ ID NO: 125676 - DNA, 25 bp, E. coli
cgctggaaacaacctcacggtggat

SEQ ID NO: 125677 - DNA, 25 bp, E. coli
gtggatatatatcacccgcggcatt

SEQ ID NO: 125678 - DNA, 25 bp, E. coli
gtggatatatatgacccgcggcatt

SEQ ID NO: 125679 - DNA, 25 bp, E. coli
tggatctggcgcctaaactttcgat

SEQ ID NO: 125680 - DNA, 25 bp, E. coli
tggatctggcgcgtaaactttcgat

SEQ ID NO: 125681 - DNA, 25 bp, E. coli
cacgcccatggtctctgaatatcca

SEQ ID NO: 125682 - DNA, 25 bp, E. coli
cacgcccatggtgtctgaatatcca

SEQ ID NO: 125683 - DNA, 25 bp, E. coli
tacgctggtttatgacacgcccatg

SEQ ID NO: 125684 - DNA, 25 bp, E. coli
tacgctggtttaagacacgcccatg

SEQ ID NO: 125685 - DNA, 25 bp, E. coli
tatcaactctcacatgagcgctggg

SEQ ID NO: 125686 - DNA, 25 bp, E. coli
tattcgctaatgcaaaactggtgtc

SEQ ID NO: 125687 - DNA, 25 bp, E. coli
tatcaactctcagatgagcgctggg

SEQ ID NO: 125688 - DNA, 25 bp, E. coli
tattcgctaatggaaaactggtgtc

SEQ ID NO: 125689 - DNA, 25 bp, E. coli
ttcagaagcaaagaggaacgactgc

SEQ ID NO: 125690 - DNA, 25 bp, E. coli
ttcagaagcaaacaggaacgactgc

SEQ ID NO: 125691 - DNA, 25 bp, E. coli
ttgtctgccgttagtgggacgcccc

SEQ ID NO: 125692 - DNA, 25 bp, E. coli
ttgtctgccgtttgtgggacgcccc

SEQ ID NO: 125693 - DNA, 25 bp, E. coli
tgcaattgaatgtgcccgaaggcgt

SEQ ID NO: 125694 - DNA, 25 bp, E. coli
tgcaattgaatgagcccgaaggcgt

SEQ ID NO: 125695 - DNA, 25 bp, E. coli
tctcaatgatacttggaaacggcgt

SEQ ID NO: 125696 - DNA, 25 bp, E. coli
tctcaatgatacatggaaacggcgt

SEQ ID NO: 125697 - DNA, 25 bp, E. coli
gaatgtcttgcattggcgctggaaa

SEQ ID NO: 125698 - DNA, 25 bp, E. coli
gaatgtcttgcaatggcgctggaaa

SEQ ID NO: 125699 - DNA, 25 bp, E. coli
ggaaagagccaccacaacaagacta

SEQ ID NO: 125700 - DNA, 25 bp, E. coli
ggcagtggcttaggctaccaagaaa

SEQ ID NO: 125701 - DNA, 25 bp, E. coli
ggaaagagccacgacaacaagacta

SEQ ID NO: 125702 - DNA, 25 bp, E. coli
ggcagtggcttacgctaccaagaaa

SEQ ID NO: 125703 - DNA, 25 bp, E. coli
cagctcgtccggcaaagaagttagc

SEQ ID NO: 125704 - DNA, 25 bp, E. coli
caaagaagttaggaaaggcggcttg

SEQ ID NO: 125705 - DNA, 25 bp, E. coli
cagctcgtccgggaaagaagttagc

SEQ ID NO: 125706 - DNA, 25 bp, E. coli
caaagaagttagcaaaggcggcttg

SEQ ID NO: 125707 - DNA, 25 bp, E. coli
catcattcagccttatgtattcagg

SEQ ID NO: 125708 - DNA, 25 bp, E. coli
catcattcagccatatgtattcagg

SEQ ID NO: 125709 - DNA, 25 bp, E. coli
taaacgcgctgggagtgaactcagc

SEQ ID NO: 125710 - DNA, 25 bp, E. coli
taaacgcgctggcagtgaactcagc

SEQ ID NO: 125711 - DNA, 25 bp, E. coli
tattcaggctctattttgagcgccg

SEQ ID NO: 125712 - DNA, 25 bp, E. coli
tattcaggctcttttttgagcgccg

SEQ ID NO: 125713 - DNA, 25 bp, E. coli
ttttgagcgccgaaaggcgagcgtt

SEQ ID NO: 125714 - DNA, 25 bp, E. coli
ttttgagcgccgtaaggcgagcgtt

SEQ ID NO: 125715 - DNA, 25 bp, E. coli
tgtgccgtttgcatttgaaagccgg

SEQ ID NO: 125716 - DNA, 25 bp, E. coli
tgtgccgtttgcttttgaaagccgg

SEQ ID NO: 125717 - DNA, 25 bp, E. coli
tgttggtggcgcaacgactgctgga

SEQ ID NO: 125718 - DNA, 25 bp, E. coli
tgttggtggcgctacgactgctgga

SEQ ID NO: 125719 - DNA, 25 bp, E. coli
tgaaagccggatatgcagctcgtcc

SEQ ID NO: 125720 - DNA, 25 bp, E. coli
tgaaagccggatttgcagctcgtcc

SEQ ID NO: 125721 - DNA, 25 bp, E. coli
tgaactcagccagctgtttgtgccg

SEQ ID NO: 125722 - DNA, 25 bp, E. coli
tgaactcagccacctgtttgtgccg

SEQ ID NO: 125723 - DNA, 25 bp, E. coli
ggaacgcaggaatcatcattcagcc

SEQ ID NO: 125724 - DNA, 25 bp, E. coli
ggaacgcaggaaacatcattcagcc

SEQ ID NO: 125725 - DNA, 25 bp, E. coli
aatttcgcaaatggcagatagcaaa

SEQ ID NO: 125726 - DNA, 25 bp, E. coli
aatagtagtctgctaagtgaagcgc

SEQ ID NO: 125727 - DNA, 25 bp, E. coli
aatttcgcaaatcgcagatagcaaa

SEQ ID NO: 125728 - DNA, 25 bp, E. coli
aatagtagtctggtaagtgaagcgc

SEQ ID NO: 125729 - DNA, 25 bp, E. coli
caggcaatttcgcaaatcgcagata

SEQ ID NO: 125730 - DNA, 25 bp, E. coli
caggcaatttcggaaatcgcagata

SEQ ID NO: 125731 - DNA, 25 bp, E. coli
tagtctgctaagtgaagcgcatcag

SEQ ID NO: 125732 - DNA, 25 bp, E. coli
tagtctgctaagagaagcgcatcag

SEQ ID NO: 125733 - DNA, 25 bp, E. coli
tgaggagacaggtattgccggaaat

SEQ ID NO: 125734 - DNA, 25 bp, E. coli
tgaggagacaggaattgccggaaat

SEQ ID NO: 125735 - DNA, 25 bp, E. coli
tgccggaaatagtagtctgctaagt

SEQ ID NO: 125736 - DNA, 25 bp, E. coli
tgccggaaatagaagtctgctaagt

SEQ ID NO: 125737 - DNA, 25 bp, E. coli
tctgctaagtgatgcgcatcaggca

SEQ ID NO: 125738 - DNA, 25 bp, E. coli
tctgctaagtgaagcgcatcaggca

SEQ ID NO: 125739 - DNA, 25 bp, E. coli
ccggaaatagtactctgctaagtga

SEQ ID NO: 125740 - DNA, 25 bp, E. coli
ccggaaatagtagtctgctaagtga

SEQ ID NO: 125741 - DNA, 25 bp, E. coli
gcatcaggcaatttcgcaaatcgca

SEQ ID NO: 125742 - DNA, 25 bp, E. coli
gcaatttcgcaattcgcagatagca

SEQ ID NO: 125743 - DNA, 25 bp, E. coli
gcaatttcgcaaatcgcagatagca

SEQ ID NO: 125744 - DNA, 25 bp, E. coli
gaattgccggaaatagtagtctgct

SEQ ID NO: 125745 - DNA, 25 bp, E. coli
gaattgccggaattagtagtctgct

SEQ ID NO: 125746 - DNA, 25 bp, E. coli
gcatcaggcaatatcgcaaatcgca

SEQ ID NO: 125747 - DNA, 25 bp, E. coli
aaggacccaaaccatgagccagcaa

SEQ ID NO: 125748 - DNA, 25 bp, E. coli
aaggacccaaacgatgagccagcaa

SEQ ID NO: 125749 - DNA, 25 bp, E. coli
cagtcaggttctaacgatattgcca

SEQ ID NO: 125750 - DNA, 25 bp, E. coli
cagtcaggttcttacgatattgcca

SEQ ID NO: 125751 - DNA, 25 bp, E. coli
agcacggcaggttgaaggcgcaatg

SEQ ID NO: 125752 - DNA, 25 bp, E. coli
agcacggcaggtagaaggcgcaatg

SEQ ID NO: 125753 - DNA, 25 bp, E. coli
aatttagacaacctgtacgacgctt

SEQ ID NO: 125754 - DNA, 25 bp, E. coli
acatgccggagctcggcaggtagaa

SEQ ID NO: 125755 - DNA, 25 bp, E. coli
aatttagacaacgtgtacgacgctt

SEQ ID NO: 125756 - DNA, 25 bp, E. coli
acatgccggagcacggcaggtagaa

SEQ ID NO: 125757 - DNA, 25 bp, E. coli
ttctaacgatattgccactgccgcc

SEQ ID NO: 125758 - DNA, 25 bp, E. coli
ttctaacgatatagccactgccgcc

SEQ ID NO: 125759 - DNA, 25 bp, E. coli
gaagatgccggaggcaccccaattg

SEQ ID NO: 125760 - DNA, 25 bp, E. coli
gaagatgccggacgcaccccaattg

SEQ ID NO: 125761 - DNA, 25 bp, E. coli
gacaacctgtaccacgctttcctga

SEQ ID NO: 125762 - DNA, 25 bp, E. coli
gacaacctgtacgacgctttcctga

SEQ ID NO: 125763 - DNA, 25 bp, E. coli
cctgtacgacgcattcctgaagctg

SEQ ID NO: 125764 - DNA, 25 bp, E. coli
cctgtacgacgctttcctgaagctg

SEQ ID NO: 125765 - DNA, 25 bp, E. coli
ggacgcaccccatttgccgatctgg

SEQ ID NO: 125766 - DNA, 25 bp, E. coli
ggacgcaccccaattgccgatctgg

SEQ ID NO: 125767 - DNA, 25 bp, E. coli
ggacccaaaccatgagccagcaagt

SEQ ID NO: 125768 - DNA, 25 bp, E. coli
ggacccaaaccaagagccagcaagt

SEQ ID NO: 125769 - DNA, 25 bp, E. coli
cactgatgagatcctgtcaggacgc

SEQ ID NO: 125770 - DNA, 25 bp, E. coli
cactgatgagatgctgtcaggacgc

SEQ ID NO: 125771 - DNA, 25 bp, E. coli
cagtagacgcctttatgacgacgca

SEQ ID NO: 125772 - DNA, 25 bp, E. coli
cagtagacgcctatatgacgacgca

SEQ ID NO: 125773 - DNA, 25 bp, E. coli
taaagatcgccacgcagtagacgcc

SEQ ID NO: 125774 - DNA, 25 bp, E. coli
taaagatcgccaggcagtagacgcc

SEQ ID NO: 125775 - DNA, 25 bp, E. coli
agtgaattccgctctacaactgtcg

SEQ ID NO: 125776 - DNA, 25 bp, E. coli
agtgaattccgcactacaactgtcg

SEQ ID NO: 125777 - DNA, 25 bp, E. coli
ttcttatgccaaccagctcggcgcg

SEQ ID NO: 125778 - DNA, 25 bp, E. coli
ttcttatgccaagcagctcggcgcg

SEQ ID NO: 125779 - DNA, 25 bp, E. coli
tctcgatacaaaccgggaaaatgcc

SEQ ID NO: 125780 - DNA, 25 bp, E. coli
tctcgatacaaagcgggaaaatgcc

SEQ ID NO: 125781 - DNA, 25 bp, E. coli
gcgatgaaacactggcgacgcagct

SEQ ID NO: 125782 - DNA, 25 bp, E. coli
gcgatgaaacacaggcgacgcagct

SEQ ID NO: 125783 - DNA, 25 bp, E. coli
gaacactatgccgaactggttaccg

SEQ ID NO: 125784 - DNA, 25 bp, E. coli
gaacactatgcccaactggttaccg

SEQ ID NO: 125785 - DNA, 25 bp, E. coli
gatatcgccatcagtgaacactatg

SEQ ID NO: 125786 - DNA, 25 bp, E. coli
gattggccgggctgtgaattccgca

SEQ ID NO: 125787 - DNA, 25 bp, E. coli
gattggccgggcagtgaattccgca

SEQ ID NO: 125788 - DNA, 25 bp, E. coli
gatatcgccatctgtgaacactatg

SEQ ID NO: 125789 - DNA, 25 bp, E. coli
ggcaagccgtttcctgatatcgcca

SEQ ID NO: 125790 - DNA, 25 bp, E. coli
ggcaagccgtttgctgatatcgcca

SEQ ID NO: 125791 - DNA, 25 bp, E. coli
cagaagcattggtgcaccgtgcagt

SEQ ID NO: 125792 - DNA, 25 bp, E. coli
cagtgatttacgacctgcacagcca

SEQ ID NO: 125793 - DNA, 25 bp, E. coli
cagtgatttacgtcctgcacagcca

SEQ ID NO: 125794 - DNA, 25 bp, E. coli
catcctgggcggaacaatcttagtg

SEQ ID NO: 125795 - DNA, 25 bp, E. coli
cagaagcattggagcaccgtgcagt

SEQ ID NO: 125796 - DNA, 25 bp, E. coli
catcctgggcggtacaatcttagtg

SEQ ID NO: 125797 - DNA, 25 bp, E. coli
aactgggtcgtatactctggctgcc

SEQ ID NO: 125798 - DNA, 25 bp, E. coli
aactgggtcgtaaactctggctgcc

SEQ ID NO: 125799 - DNA, 25 bp, E. coli
tgattttcatcacccatgcccgtgg

SEQ ID NO: 125800 - DNA, 25 bp, E. coli
tgattttcatcagccatgcccgtgg

SEQ ID NO: 125801 - DNA, 25 bp, E. coli
tctttaaaaagtttctggcgcgcgg

SEQ ID NO: 125802 - DNA, 25 bp, E. coli
tcattctggcggtaaggcggtgcta

SEQ ID NO: 125803 - DNA, 25 bp, E. coli
tctttaaaaagtatctggcgcgcgg

SEQ ID NO: 125804 - DNA, 25 bp, E. coli
tctggcagctatcggaacagccgca

SEQ ID NO: 125805 - DNA, 25 bp, E. coli
tcattctggcggaaaggcggtgcta

SEQ ID NO: 125806 - DNA, 25 bp, E. coli
tctggcagctatgggaacagccgca

SEQ ID NO: 125807 - DNA, 25 bp, E. coli
gaaaaccggataggttccgccacag

SEQ ID NO: 125808 - DNA, 25 bp, E. coli
gaaaaccggatacgttccgccacag

SEQ ID NO: 125809 - DNA, 25 bp, E. coli
ggaaatttcacgttcgggactggcg

SEQ ID NO: 125810 - DNA, 25 bp, E. coli
ggaaatttcacgatcgggactggcg

SEQ ID NO: 125811 - DNA, 25 bp, E. coli
taatgtgtgagtacctcgcgcagca

SEQ ID NO: 125812 - DNA, 25 bp, E. coli
taatgtgtgagttcctcgcgcagca

SEQ ID NO: 125813 - DNA, 25 bp, E. coli
caagcactgatcacatctgcgcagg

SEQ ID NO: 125814 - DNA, 25 bp, E. coli
caagcactgatctcatctgcgcagg

SEQ ID NO: 125815 - DNA, 25 bp, E. coli
cactattgatatggagatgtctggc

SEQ ID NO: 125816 - DNA, 25 bp, E. coli
cactattgatatcgagatgtctggc

SEQ ID NO: 125817 - DNA, 25 bp, E. coli
ttactgcaggaaaaaaccaaaggcg

SEQ ID NO: 125818 - DNA, 25 bp, E. coli
ttactgcaggaataaaccaaaggcg

SEQ ID NO: 125819 - DNA, 25 bp, E. coli
tctaacaacttttcgggactctcgc

SEQ ID NO: 125820 - DNA, 25 bp, E. coli
tctgcgcaggaaccgggtagctatc

SEQ ID NO: 125821 - DNA, 25 bp, E. coli
tctgcgcaggaagcgggtagctatc

SEQ ID NO: 125822 - DNA, 25 bp, E. coli
tctaacaactttacgggactctcgc

SEQ ID NO: 125823 - DNA, 25 bp, E. coli
cgcctgccgaccagaaagggttgaa

SEQ ID NO: 125824 - DNA, 25 bp, E. coli
cccaggtccgtgacatgtttgttaa

SEQ ID NO: 125825 - DNA, 25 bp, E. coli
cccaggtccgtgtcatgtttgttaa

SEQ ID NO: 125826 - DNA, 25 bp, E. coli
cgcctgccgacctgaaagggttgaa

SEQ ID NO: 125827 - DNA, 25 bp, E. coli
gatagcacccttggtaatgcgcagg

SEQ ID NO: 125828 - DNA, 25 bp, E. coli
gatagcacccttcgtaatgcgcagg

SEQ ID NO: 125829 - DNA, 25 bp, E. coli
ggcttaaccccgcagttccagcaag

SEQ ID NO: 125830 - DNA, 25 bp, E. coli
ggcttaaccccggagttccagcaag

SEQ ID NO: 125831 - DNA, 25 bp, E. coli
ttagcgatgcgctgggtacccaggt

SEQ ID NO: 125832 - DNA, 25 bp, E. coli
ttagcgatgcgcagggtacccaggt

SEQ ID NO: 125833 - DNA, 25 bp, E. coli
gatgacctgaaagtctcccttgaag

SEQ ID NO: 125834 - DNA, 25 bp, E. coli
gatgacctgaaactctcccttgaag

SEQ ID NO: 125835 - DNA, 25 bp, E. coli
caacataccagtccgcagcttcatg

SEQ ID NO: 125836 - DNA, 25 bp, E. coli
caacataccagtgcgcagcttcatg

SEQ ID NO: 125837 - DNA, 25 bp, E. coli
tcgcgccgaaatgttcctcaaagag

SEQ ID NO: 125838 - DNA, 25 bp, E. coli
tcgcgccgaaatcttcctcaaagag

SEQ ID NO: 125839 - DNA, 25 bp, E. coli
tgcgcagcttcatgcaggcgagaca

SEQ ID NO: 125840 - DNA, 25 bp, E. coli
tgcgcagcttcaagcaggcgagaca

SEQ ID NO: 125841 - DNA, 25 bp, E. coli
gcgctgaatattccccgccagttcg

SEQ ID NO: 125842 - DNA, 25 bp, E. coli
gcgctgaatattgcccgccagttcg

SEQ ID NO: 125843 - DNA, 25 bp, E. coli
ccagttcggctgaagcgacgatgcg

SEQ ID NO: 125844 - DNA, 25 bp, E. coli
cctcaaagagctttggatgccagaa

SEQ ID NO: 125845 - DNA, 25 bp, E. coli
cctcaaagagctatggatgccagaa

SEQ ID NO: 125846 - DNA, 25 bp, E. coli
ccagttcggctgtagcgacgatgcg

SEQ ID NO: 125847 - DNA, 25 bp, E. coli
gctacaacgttctacaggcgctgaa

SEQ ID NO: 125848 - DNA, 25 bp, E. coli
gctacaacgttcaacaggcgctgaa

SEQ ID NO: 125849 - DNA, 25 bp, E. coli
ccgcatagttgtcatgatggtatcc

SEQ ID NO: 125850 - DNA, 25 bp, E. coli
ccgcatagttgtgatgatggtatcc

SEQ ID NO: 125851 - DNA, 25 bp, E. coli
gttttctcgttatcccacgaagcct

SEQ ID NO: 125852 - DNA, 25 bp, E. coli
gttttctcgttaacccacgaagcct

SEQ ID NO: 125853 - DNA, 25 bp, E. coli
tatatggcccgcaacaacgttcaac

SEQ ID NO: 125854 - DNA, 25 bp, E. coli
tatatggcccgctacaacgttcaac

SEQ ID NO: 125855 - DNA, 25 bp, E. coli
gatgcgtttatcgatcgcgccgaaa

SEQ ID NO: 125856 - DNA, 25 bp, E. coli
gatgcgtttatccatcgcgccgaaa

SEQ ID NO: 125857 - DNA, 25 bp, E. coli
atttcactggcattggaaggtgcgc

SEQ ID NO: 125858 - DNA, 25 bp, E. coli
atttcactggcaatggaaggtgcgc

SEQ ID NO: 125859 - DNA, 25 bp, E. coli
actggcaatggaaggtgcgctggct

SEQ ID NO: 125860 - DNA, 25 bp, E. coli
actggcaatggatggtgcgctggct

SEQ ID NO: 125861 - DNA, 25 bp, E. coli
tttgatggatcgtctagggaactga

SEQ ID NO: 125862 - DNA, 25 bp, E. coli
tttgatggatcgactagggaactga

SEQ ID NO: 125863 - DNA, 25 bp, E. coli
tatttcactggctatggaaggtgcg

SEQ ID NO: 125864 - DNA, 25 bp, E. coli
tatttcactggcaatggaaggtgcg

SEQ ID NO: 125865 - DNA, 25 bp, E. coli
tttttgatggatcgactagggaact

SEQ ID NO: 125866 - DNA, 25 bp, E. coli
ttcactggcaatcgaaggtgcgctg

SEQ ID NO: 125867 - DNA, 25 bp, E. coli
ttttgatggatccactagggaactg

SEQ ID NO: 125868 - DNA, 25 bp, E. coli
tttcactggcaaaggaaggtgcgct

SEQ ID NO: 125869 - DNA, 25 bp, E. coli
ttttgatggatcgactagggaactg

SEQ ID NO: 125870 - DNA, 25 bp, E. coli
ttcactggcaatggaaggtgcgctg

SEQ ID NO: 125871 - DNA, 25 bp, E. coli
tttttgatggatggactagggaact

SEQ ID NO: 125872 - DNA, 25 bp, E. coli
tttcactggcaatggaaggtgcgct

SEQ ID NO: 125873 - DNA, 25 bp, E. coli
tgtgtttttgatggatcgactaggg

SEQ ID NO: 125874 - DNA, 25 bp, E. coli
tgtttttgatggatcgactagggaa

SEQ ID NO: 125875 - DNA, 25 bp, E. coli
tgtttttgatggttcgactagggaa

SEQ ID NO: 125876 - DNA, 25 bp, E. coli
tgtgtttttgatcgatcgactaggg

SEQ ID NO: 125877 - DNA, 25 bp, E. coli
gtttttgatggatcgactagggaac

SEQ ID NO: 125878 - DNA, 25 bp, E. coli
gtttttgatggaacgactagggaac

SEQ ID NO: 125879 - DNA, 25 bp, E. coli
caggcataaactcgttgtagagtac

SEQ ID NO: 125880 - DNA, 25 bp, E. coli
caggcataaactggttgtagagtac

SEQ ID NO: 125881 - DNA, 25 bp, E. coli
tacaaggatgctgtgcaacctgccg

SEQ ID NO: 125882 - DNA, 25 bp, E. coli
tacaaggatgctctgcaacctgccg

SEQ ID NO: 125883 - DNA, 25 bp, E. coli
aaagcagcatcgttctcccatggag

SEQ ID NO: 125884 - DNA, 25 bp, E. coli
aaatggtgtggcagcgaaaacccgc

SEQ ID NO: 125885 - DNA, 25 bp, E. coli
aaatggtgtggctgcgaaaacccgc

SEQ ID NO: 125886 - DNA, 25 bp, E. coli
aaagcagcatcgatctcccatggag

SEQ ID NO: 125887 - DNA, 25 bp, E. coli
tttgtgcgggctttcaggcgtttta

SEQ ID NO: 125888 - DNA, 25 bp, E. coli
tttgtgcgggctatcaggcgtttta

SEQ ID NO: 125889 - DNA, 25 bp, E. coli
tgcaacctgccgatttttatcacaa

SEQ ID NO: 125890 - DNA, 25 bp, E. coli
tgcaacctgccgttttttatcacaa

SEQ ID NO: 125891 - DNA, 25 bp, E. coli
tgcgtgatctgataaagcagcatcg

SEQ ID NO: 125892 - DNA, 25 bp, E. coli
tgcgtgatctgaaaaagcagcatcg

SEQ ID NO: 125893 - DNA, 25 bp, E. coli
tcattgatgctgtagaggacaggca

SEQ ID NO: 125894 - DNA, 25 bp, E. coli
tcattgatgctgaagaggacaggca

SEQ ID NO: 125895 - DNA, 25 bp, E. coli
gccgcttcggtgacagcagagctgt

SEQ ID NO: 125896 - DNA, 25 bp, E. coli
gccgcttcggtgtcagcagagctgt

SEQ ID NO: 125897 - DNA, 25 bp, E. coli
gacaggaagtcaggtcattgatgct

SEQ ID NO: 125898 - DNA, 25 bp, E. coli
gacaggaagtcacgtcattgatgct

SEQ ID NO: 125899 - DNA, 25 bp, E. coli
cccatggagctgttgacgatgctgc

SEQ ID NO: 125900 - DNA, 25 bp, E. coli
cccatggagctgatgacgatgctgc

SEQ ID NO: 125901 - DNA, 25 bp, E. coli
caaggaaacataacgaggagatcgc

SEQ ID NO: 125902 - DNA, 25 bp, E. coli
caaggaaacatatcgaggagatcgc

SEQ ID NO: 125903 - DNA, 25 bp, E. coli
acacttggttcccatgcgctggcaa

SEQ ID NO: 125904 - DNA, 25 bp, E. coli
acacttggttccgatgcgctggcaa

SEQ ID NO: 125905 - DNA, 25 bp, E. coli
tgggtaagatcagtcaggcgaaccg

SEQ ID NO: 125906 - DNA, 25 bp, E. coli
tgggtaagatcactcaggcgaaccg

SEQ ID NO: 125907 - DNA, 25 bp, E. coli
tgacgtccagttgagccatccaaag

SEQ ID NO: 125908 - DNA, 25 bp, E. coli
tgacgtccagttcagccatccaaag

SEQ ID NO: 125909 - DNA, 25 bp, E. coli
gctggcaagcatcaacgcaatgacg

SEQ ID NO: 125910 - DNA, 25 bp, E. coli
gctggcaagcatgaacgcaatgacg

SEQ ID NO: 125911 - DNA, 25 bp, E. coli
gcattggcgcaagtcgaaagcatcg

SEQ ID NO: 125912 - DNA, 25 bp, E. coli
gcattggcgcaactcgaaagcatcg

SEQ ID NO: 125913 - DNA, 25 bp, E. coli
gcaagctgtacgatgggcggacact

SEQ ID NO: 125914 - DNA, 25 bp, E. coli
gcaagctgtacgttgggcggacact

SEQ ID NO: 125915 - DNA, 25 bp, E. coli
gaaagcatcgctcaaaccgaaaggg

SEQ ID NO: 125916 - DNA, 25 bp, E. coli
gaaagcatcgctgaaaccgaaaggg

SEQ ID NO: 125917 - DNA, 25 bp, E. coli
cgcagagcctaattgacgagtcaag

SEQ ID NO: 125918 - DNA, 25 bp, E. coli
cgcagagcctaaatgacgagtcaag

SEQ ID NO: 125919 - DNA, 25 bp, E. coli
gatcgctggtgatgcattggcgcaa

SEQ ID NO: 125920 - DNA, 25 bp, E. coli
ggcgaaccgcgaaaaccatcaggta

SEQ ID NO: 125921 - DNA, 25 bp, E. coli
ggcgaaccgcgataaccatcaggta

SEQ ID NO: 125922 - DNA, 25 bp, E. coli
gatcgctggtgaagcattggcgcaa

SEQ ID NO: 125923 - DNA, 25 bp, E. coli
caatttacggcaatcatgtcgggca

SEQ ID NO: 125924 - DNA, 25 bp, E. coli
caatttacggcattcatgtcgggca

SEQ ID NO: 125925 - DNA, 25 bp, E. coli
tacggcattcatgtcgggcagatgt

SEQ ID NO: 125926 - DNA, 25 bp, E. coli
tatcgcttcaaaacagctgctggcg

SEQ ID NO: 125927 - DNA, 25 bp, E. coli
tacggcattcatctcgggcagatgt

SEQ ID NO: 125928 - DNA, 25 bp, E. coli
tatcgcttcaaatcagctgctggcg

SEQ ID NO: 125929 - DNA, 25 bp, E. coli
ttcaaaacagctcctggcggcggta

SEQ ID NO: 125930 - DNA, 25 bp, E. coli
ttcaaaacagctgctggcggcggta

SEQ ID NO: 125931 - DNA, 25 bp, E. coli
tgtcgggcagatgttgctgacccgt

SEQ ID NO: 125932 - DNA, 25 bp, E. coli
tgtcgggcagatcttgctgacccgt

SEQ ID NO: 125933 - DNA, 25 bp, E. coli
tcatgtcgggcacatgttgctgacc

SEQ ID NO: 125934 - DNA, 25 bp, E. coli
tcatgtcgggcagatgttgctgacc

SEQ ID NO: 125935 - DNA, 25 bp, E. coli
gccagcgactatcgcttcaaaacag

SEQ ID NO: 125936 - DNA, 25 bp, E. coli
gccagcgactatggcttcaaaacag

SEQ ID NO: 125937 - DNA, 25 bp, E. coli
gctgttttcaatatacggcattcat

SEQ ID NO: 125938 - DNA, 25 bp, E. coli
gctgttttcaatttacggcattcat

SEQ ID NO: 125939 - DNA, 25 bp, E. coli
gcagagaatcatcagtgacagccag

SEQ ID NO: 125940 - DNA, 25 bp, E. coli
gaatggcagagattcatgagtgaca

SEQ ID NO: 125941 - DNA, 25 bp, E. coli
gaatggcagagaatcatgagtgaca

SEQ ID NO: 125942 - DNA, 25 bp, E. coli
gcagagaatcatgagtgacagccag

SEQ ID NO: 125943 - DNA, 25 bp, E. coli
gactatcgcttcaaaacagctgctg

SEQ ID NO: 125944 - DNA, 25 bp, E. coli
gactatcgcttctaaacagctgctg

SEQ ID NO: 125945 - DNA, 25 bp, E. coli
caagccttcattgcaggacgtactg

SEQ ID NO: 125946 - DNA, 25 bp, E. coli
aagatccgtgactaccagaagcgcg

SEQ ID NO: 125947 - DNA, 25 bp, E. coli
gaatttgttcgtgtgttccgtcgta

SEQ ID NO: 125948 - DNA, 25 bp, E. coli
aagatccgtgacaaccagaagcgcg

SEQ ID NO: 125949 - DNA, 25 bp, E. coli
gaatttgttcgtctgttccgtcgta

SEQ ID NO: 125950 - DNA, 25 bp, E. coli
caagccttcattccaggacgtactg

SEQ ID NO: 125951 - DNA, 25 bp, E. coli
aaaatgccgagctctccaaagaacg

SEQ ID NO: 125952 - DNA, 25 bp, E. coli
aaaatgccgagcactccaaagaacg

SEQ ID NO: 125953 - DNA, 25 bp, E. coli
tgagcgttgaaggaatccagggcat

SEQ ID NO: 125954 - DNA, 25 bp, E. coli
tgagcgttgaagcaatccagggcat

SEQ ID NO: 125955 - DNA, 25 bp, E. coli
tccgtcgtaagatcaaactgcaacg

SEQ ID NO: 125956 - DNA, 25 bp, E. coli
tccgtcgtaagaacaaactgcaacg

SEQ ID NO: 125957 - DNA, 25 bp, E. coli
tcaggacgttgagaaaaagatccgt

SEQ ID NO: 125958 - DNA, 25 bp, E. coli
tcaggacgttgacaaaaagatccgt

SEQ ID NO: 125959 - DNA, 25 bp, E. coli
gccgcgatatctgcaaaaagctgaa

SEQ ID NO: 125960 - DNA, 25 bp, E. coli
gccgcgatatctccaaaaagctgaa

SEQ ID NO: 125961 - DNA, 25 bp, E. coli
gacaacctgagccattacatcaagc

SEQ ID NO: 125962 - DNA, 25 bp, E. coli
gacaacctgagcgattacatcaagc

SEQ ID NO: 125963 - DNA, 25 bp, E. coli
ctatgggcgaaatgaaaaacggcga

SEQ ID NO: 125964 - DNA, 25 bp, E. coli
ctatgggcgaaaagaaaaacggcga

SEQ ID NO: 125965 - DNA, 25 bp, E. coli
gtgactatgaagatcgcgttgacga

SEQ ID NO: 125966 - DNA, 25 bp, E. coli
gtgactatgaagttcgcgttgacga

SEQ ID NO: 125967 - DNA, 25 bp, E. coli
cataaatatacaatagctgaagcgt

SEQ ID NO: 125968 - DNA, 25 bp, E. coli
cataaatatacattagctgaagcgt

SEQ ID NO: 125969 - DNA, 25 bp, E. coli
aacaatttgcgtgttttggcgtcgg

SEQ ID NO: 125970 - DNA, 25 bp, E. coli
aaaagattggctttcgacgaactgg

SEQ ID NO: 125971 - DNA, 25 bp, E. coli
aacgtcacgtaaaagttgcgcggcg

SEQ ID NO: 125972 - DNA, 25 bp, E. coli
aaaagattggctatcgacgaactgg

SEQ ID NO: 125973 - DNA, 25 bp, E. coli
aacaatttgcgtcttttggcgtcgg

SEQ ID NO: 125974 - DNA, 25 bp, E. coli
aacgtcacgtaatagttgcgcggcg

SEQ ID NO: 125975 - DNA, 25 bp, E. coli
tagctatcagaatacggaaggcgcg

SEQ ID NO: 125976 - DNA, 25 bp, E. coli
tagctatcagaaaacggaaggcgcg

SEQ ID NO: 125977 - DNA, 25 bp, E. coli
taattccacaatagacggcaacgtc

SEQ ID NO: 125978 - DNA, 25 bp, E. coli
taattccacaattgacggcaacgtc

SEQ ID NO: 125979 - DNA, 25 bp, E. coli
gctgaagcgtgaagatataaacaat

SEQ ID NO: 125980 - DNA, 25 bp, E. coli
gctgaagcgtgatgatataaacaat

SEQ ID NO: 125981 - DNA, 25 bp, E. coli
gacgaactggcgaggtaacgctatg

SEQ ID NO: 125982 - DNA, 25 bp, E. coli
gacgaactggcgtggtaacgctatg

SEQ ID NO: 125983 - DNA, 25 bp, E. coli
cgcggcgtgcttgtgtttccttaaa

SEQ ID NO: 125984 - DNA, 25 bp, E. coli
cgcggcgtgcttctgtttccttaaa

SEQ ID NO: 125985 - DNA, 25 bp, E. coli
tggcgtcgggttagtttcttaatat

SEQ ID NO: 125986 - DNA, 25 bp, E. coli
tggcgtcgggtttgtttcttaatat

SEQ ID NO: 125987 - DNA, 25 bp, E. coli
taacgctatgtttacggtgtagcta

SEQ ID NO: 125988 - DNA, 25 bp, E. coli
taacgctatgttaacggtgtagcta

SEQ ID NO: 125989 - DNA, 25 bp, E. coli
cagtggaagtgtgctaagtatagcc

SEQ ID NO: 125990 - DNA, 25 bp, E. coli
cagtggaagtgtcctaagtatagcc

SEQ ID NO: 125991 - DNA, 25 bp, E. coli
tacccttatttatccatcacgggaa

SEQ ID NO: 125992 - DNA, 25 bp, E. coli
tacttttgtacggtccggttgctgc

SEQ ID NO: 125993 - DNA, 25 bp, E. coli
tacttttgtacgctccggttgctgc

SEQ ID NO: 125994 - DNA, 25 bp, E. coli
tagccctgattatacatattacggg

SEQ ID NO: 125995 - DNA, 25 bp, E. coli
tagccctgattaaacatattacggg

SEQ ID NO: 125996 - DNA, 25 bp, E. coli
tacccttatttaaccatcacgggaa

SEQ ID NO: 125997 - DNA, 25 bp, E. coli
ttgctgcgcgctggccgtgaccaaa

SEQ ID NO: 125998 - DNA, 25 bp, E. coli
ttgctgcgcgctcgccgtgaccaaa

SEQ ID NO: 125999 - DNA, 25 bp, E. coli
tgctcgccatcctcacgtacttttg

SEQ ID NO: 126000 - DNA, 25 bp, E. coli
tgctcgccatccacacgtacttttg

SEQ ID NO: 126001 - DNA, 25 bp, E. coli
gaaaacttgtctgagtcagaccaga

SEQ ID NO: 126002 - DNA, 25 bp, E. coli
gaaaacttgtctcagtcagaccaga

SEQ ID NO: 126003 - DNA, 25 bp, E. coli
gatacttacgcgcaatcttaccctt

SEQ ID NO: 126004 - DNA, 25 bp, E. coli
gatacttacgcggaatcttaccctt

SEQ ID NO: 126005 - DNA, 25 bp, E. coli
taacgccttatatccagacttacgc

SEQ ID NO: 126006 - DNA, 25 bp, E. coli
taacgccttataaccagacttacgc

SEQ ID NO: 126007 - DNA, 25 bp, E. coli
gaccaaactgccagcaacaataacg

SEQ ID NO: 126008 - DNA, 25 bp, E. coli
gaccaaactgcctgcaacaataacg

SEQ ID NO: 126009 - DNA, 25 bp, E. coli
gaccagacagtcacacacagtggaa

SEQ ID NO: 126010 - DNA, 25 bp, E. coli
gaccagacagtctcacacagtggaa

SEQ ID NO: 126011 - DNA, 25 bp, E. coli
aatgatcatcatggtgcacgccagg

SEQ ID NO: 126012 - DNA, 25 bp, E. coli
aatgatcatcatcgtgcacgccagg

SEQ ID NO: 126013 - DNA, 25 bp, E. coli
cactatcgtggtgcattgaaatgca

SEQ ID NO: 126014 - DNA, 25 bp, E. coli
cactatcgtggtccattgaaatgca

SEQ ID NO: 126015 - DNA, 25 bp, E. coli
tacgtcgctgggaagctgtacctga

SEQ ID NO: 126016 - DNA, 25 bp, E. coli
tgtaacaaacctgtaaatattccct

SEQ ID NO: 126017 - DNA, 25 bp, E. coli
tgtaacaaacctctaaatattccct

SEQ ID NO: 126018 - DNA, 25 bp, E. coli
tatggcacgataagtgtaacaaacc

SEQ ID NO: 126019 - DNA, 25 bp, E. coli
tatggcacgatatgtgtaacaaacc

SEQ ID NO: 126020 - DNA, 25 bp, E. coli
tacgtcgctgggtagctgtacctga

SEQ ID NO: 126021 - DNA, 25 bp, E. coli
tattccctataaaaagactgtcagt

SEQ ID NO: 126022 - DNA, 25 bp, E. coli
tattccctataataagactgtcagt

SEQ ID NO: 126023 - DNA, 25 bp, E. coli
gcgggatattttcccttgatggtca

SEQ ID NO: 126024 - DNA, 25 bp, E. coli
gcgggatattttgccttgatggtca

SEQ ID NO: 126025 - DNA, 25 bp, E. coli
gcacgccaggtttgttgcactatcg

SEQ ID NO: 126026 - DNA, 25 bp, E. coli
gcacgccaggttagttgcactatcg

SEQ ID NO: 126027 - DNA, 25 bp, E. coli
gaagctgtacctcatggaatgatca

SEQ ID NO: 126028 - DNA, 25 bp, E. coli
gaagctgtacctgatggaatgatca

SEQ ID NO: 126029 - DNA, 25 bp, E. coli
cttgatggtcaaatttatggcacga

SEQ ID NO: 126030 - DNA, 25 bp, E. coli
cttgatggtcaattttatggcacga

SEQ ID NO: 126031 - DNA, 25 bp, E. coli
taatgaaaaatattacgtctaacgg

SEQ ID NO: 126032 - DNA, 25 bp, E. coli
taatgaaaaataatacgtctaacgg

SEQ ID NO: 126033 - DNA, 25 bp, E. coli
cagtttgcgccctaccgctgcttat

SEQ ID NO: 126034 - DNA, 25 bp, E. coli
cagtttgcgcccaaccgctgcttat

SEQ ID NO: 126035 - DNA, 25 bp, E. coli
agtttgcgcccaaccgctgcttatt

SEQ ID NO: 126036 - DNA, 25 bp, E. coli
agtttgcgcccatccgctgcttatt

SEQ ID NO: 126037 - DNA, 25 bp, E. coli
tgaagtgccagtatgcgcccaaccg

SEQ ID NO: 126038 - DNA, 25 bp, E. coli
tgaagtgccagtttgcgcccaaccg

SEQ ID NO: 126039 - DNA, 25 bp, E. coli
tgaaattattcgccgcattgcgctg

SEQ ID NO: 126040 - DNA, 25 bp, E. coli
tgaaattattcggcgcattgcgctg

SEQ ID NO: 126041 - DNA, 25 bp, E. coli
tcgatgaaattattcgccgcattgc

SEQ ID NO: 126042 - DNA, 25 bp, E. coli
tcgatgaaattaatcgccgcattgc

SEQ ID NO: 126043 - DNA, 25 bp, E. coli
gcgctactctccagcgcccgcctca

SEQ ID NO: 126044 - DNA, 25 bp, E. coli
gcgctactctcctgcgcccgcctca

SEQ ID NO: 126045 - DNA, 25 bp, E. coli
cgatgaaattatacgccgcattgcg

SEQ ID NO: 126046 - DNA, 25 bp, E. coli
cgatgaaattattcgccgcattgcg

SEQ ID NO: 126047 - DNA, 25 bp, E. coli
gggtgaagtgccagtttgcgcccaa

SEQ ID NO: 126048 - DNA, 25 bp, E. coli
ggtgaagtgccagtttgcgcccaac

SEQ ID NO: 126049 - DNA, 25 bp, E. coli
gtgaagtgccagtttgcgcccaacc

SEQ ID NO: 126050 - DNA, 25 bp, E. coli
gtgaagtgccagattgcgcccaacc

SEQ ID NO: 126051 - DNA, 25 bp, E. coli
ggtgaagtgccactttgcgcccaac

SEQ ID NO: 126052 - DNA, 25 bp, E. coli
gggtgaagtgcctgtttgcgcccaa

SEQ ID NO: 126053 - DNA, 25 bp, E. coli
gatgaaattattcgccgcattgcgc

SEQ ID NO: 126054 - DNA, 25 bp, E. coli
gatgaaattattggccgcattgcgc

SEQ ID NO: 126055 - DNA, 25 bp, E. coli
aatgcagtagttacttgggaacacc

SEQ ID NO: 126056 - DNA, 25 bp, E. coli
caaagctaaaggcaatggagttaca

SEQ ID NO: 126057 - DNA, 25 bp, E. coli
aatgcagtagtttcttgggaacacc

SEQ ID NO: 126058 - DNA, 25 bp, E. coli
caaagctaaagggaatggagttaca

SEQ ID NO: 126059 - DNA, 25 bp, E. coli
taggcgattatctcactcacggttt

SEQ ID NO: 126060 - DNA, 25 bp, E. coli
taggcgattatcacactcacggttt

SEQ ID NO: 126061 - DNA, 25 bp, E. coli
tatacatatccgctgagcccggtga

SEQ ID NO: 126062 - DNA, 25 bp, E. coli
tatacatatccggtgagcccggtga

SEQ ID NO: 126063 - DNA, 25 bp, E. coli
tgggaacaccaaataacacctatct

SEQ ID NO: 126064 - DNA, 25 bp, E. coli
tgggaacaccaattaacacctatct

SEQ ID NO: 126065 - DNA, 25 bp, E. coli
taagaagcaaggagaatatttcccc

SEQ ID NO: 126066 - DNA, 25 bp, E. coli
taagaagcaaggtgaatatttcccc

SEQ ID NO: 126067 - DNA, 25 bp, E. coli
gaatatttccccttgaatccgataa

SEQ ID NO: 126068 - DNA, 25 bp, E. coli
gaatatttccccatgaatccgataa

SEQ ID NO: 126069 - DNA, 25 bp, E. coli
gagttacaattatcaggcaagggag

SEQ ID NO: 126070 - DNA, 25 bp, E. coli
gacttgcgaaatataaaatgccctg

SEQ ID NO: 126071 - DNA, 25 bp, E. coli
gagttacaattaacaggcaagggag

SEQ ID NO: 126072 - DNA, 25 bp, E. coli
gacttgcgaaatttaaaatgccctg

SEQ ID NO: 126073 - DNA, 25 bp, E. coli
ccctgaaggttctgagagagtaggc

SEQ ID NO: 126074 - DNA, 25 bp, E. coli
ccctgaaggttcagagagagtaggc

SEQ ID NO: 126075 - DNA, 25 bp, E. coli
gagcccggtgaaaggcatggatcca

SEQ ID NO: 126076 - DNA, 25 bp, E. coli
gagcccggtgaatggcatggatcca

SEQ ID NO: 126077 - DNA, 25 bp, E. coli
cacgctggtgcgtccgcaagatgcg

SEQ ID NO: 126078 - DNA, 25 bp, E. coli
cacgctggtgcgaccgcaagatgcg

SEQ ID NO: 126079 - DNA, 25 bp, E. coli
catatgggctatcgcgtcgatgaaa

SEQ ID NO: 126080 - DNA, 25 bp, E. coli
catatgggctatggcgtcgatgaaa

SEQ ID NO: 126081 - DNA, 25 bp, E. coli
tgttaaccgacagtcaacgcattct

SEQ ID NO: 126082 - DNA, 25 bp, E. coli
tgttaaccgacactcaacgcattct

SEQ ID NO: 126083 - DNA, 25 bp, E. coli
tcaggaaatttttggcacgcgcccg

SEQ ID NO: 126084 - DNA, 25 bp, E. coli
tcaggaaattttaggcacgcgcccg

SEQ ID NO: 126085 - DNA, 25 bp, E. coli
ccaggtcgtgcatatgggctatggc

SEQ ID NO: 126086 - DNA, 25 bp, E. coli
ccaggtcgtgcaaatgggctatggc

SEQ ID NO: 126087 - DNA, 25 bp, E. coli
gcaccaacattcaggaaaccgacct

SEQ ID NO: 126088 - DNA, 25 bp, E. coli
gcaccaacattctggaaaccgacct

SEQ ID NO: 126089 - DNA, 25 bp, E. coli
gacggcgtttatttgcaccaacatt

SEQ ID NO: 126090 - DNA, 25 bp, E. coli
cgcaagatgcgggagcgaatacatg

SEQ ID NO: 126091 - DNA, 25 bp, E. coli
cgcaagatgcggcagcgaatacatg

SEQ ID NO: 126092 - DNA, 25 bp, E. coli
cgggagcgaatagatgtggtcacat

SEQ ID NO: 126093 - DNA, 25 bp, E. coli
ctatggcgtcgatgaaaaagtgcag

SEQ ID NO: 126094 - DNA, 25 bp, E. coli
ctatggcgtcgaagaaaaagtgcag

SEQ ID NO: 126095 - DNA, 25 bp, E. coli
cgggagcgaatacatgtggtcacat

SEQ ID NO: 126096 - DNA, 25 bp, E. coli
gtcaacgcattcacgatgccgcaga

SEQ ID NO: 126097 - DNA, 25 bp, E. coli
gtcaacgcattctcgatgccgcaga

SEQ ID NO: 126098 - DNA, 25 bp, E. coli
gacggcgtttatatgcaccaacatt

SEQ ID NO: 126099 - DNA, 25 bp, E. coli
agcggcacaggaatttgtagatatc

SEQ ID NO: 126100 - DNA, 25 bp, E. coli
actcgaactggaagcgggctacagc

SEQ ID NO: 126101 - DNA, 25 bp, E. coli
agcggcacaggattttgtagatatc

SEQ ID NO: 126102 - DNA, 25 bp, E. coli
atcggagatcattcgtaccatgcct

SEQ ID NO: 126103 - DNA, 25 bp, E. coli
atcggagatcatacgtaccatgcct

SEQ ID NO: 126104 - DNA, 25 bp, E. coli
acgtggtatatgtgcattaatactc

SEQ ID NO: 126105 - DNA, 25 bp, E. coli
acgtggtatatgagcattaatactc

SEQ ID NO: 126106 - DNA, 25 bp, E. coli
actcgaactggatgcgggctacagc

SEQ ID NO: 126107 - DNA, 25 bp, E. coli
tatgagcattaaaactcacttctga

SEQ ID NO: 126108 - DNA, 25 bp, E. coli
tatgagcattaatactcacttctga

SEQ ID NO: 126109 - DNA, 25 bp, E. coli
tgcagtcactcgaactggaagcggg

SEQ ID NO: 126110 - DNA, 25 bp, E. coli
tgcagtcactcgtactggaagcggg

SEQ ID NO: 126111 - DNA, 25 bp, E. coli
gaataccggcggtgctattgatggt

SEQ ID NO: 126112 - DNA, 25 bp, E. coli
gcacaggattttgtagatatcgatc

SEQ ID NO: 126113 - DNA, 25 bp, E. coli
gaataccggcggagctattgatggt

SEQ ID NO: 126114 - DNA, 25 bp, E. coli
gcacaggattttctagatatcgatc

SEQ ID NO: 126115 - DNA, 25 bp, E. coli
ggcgctgaccgggacgaataccggc

SEQ ID NO: 126116 - DNA, 25 bp, E. coli
ggcgctgaccggcacgaataccggc

SEQ ID NO: 126117 - DNA, 25 bp, E. coli
gggacttcgcgcgtctgcagtcact

SEQ ID NO: 126118 - DNA, 25 bp, E. coli
gggacttcgcgcctctgcagtcact

SEQ ID NO: 126119 - DNA, 25 bp, E. coli
tcactcgaactgcaagcgggctaca

SEQ ID NO: 126120 - DNA, 25 bp, E. coli
tcactcgaactggaagcgggctaca

SEQ ID NO: 126121 - DNA, 25 bp, E. coli
caactggaaaactttagcgcctgga

SEQ ID NO: 126122 - DNA, 25 bp, E. coli
caactggaaaacattagcgcctgga

SEQ ID NO: 126123 - DNA, 25 bp, E. coli
caggtgaaacacatcgccatgctcg

SEQ ID NO: 126124 - DNA, 25 bp, E. coli
caggtgaaacacttcgccatgctcg

SEQ ID NO: 126125 - DNA, 25 bp, E. coli
aaagaggtggattctctggcccaac

SEQ ID NO: 126126 - DNA, 25 bp, E. coli
aaagaggtggatactctggcccaac

SEQ ID NO: 126127 - DNA, 25 bp, E. coli
aaaacctggcaggatctggcggact

SEQ ID NO: 126128 - DNA, 25 bp, E. coli
aaaacctggcagcatctggcggact

SEQ ID NO: 126129 - DNA, 25 bp, E. coli
tatacagcttcagcactggcgctcg

SEQ ID NO: 126130 - DNA, 25 bp, E. coli
tatacagcttcaccactggcgctcg

SEQ ID NO: 126131 - DNA, 25 bp, E. coli
tgcgccgctttgtgaaatcgacgaa

SEQ ID NO: 126132 - DNA, 25 bp, E. coli
tgcgccgctttgagaaatcgacgaa

SEQ ID NO: 126133 - DNA, 25 bp, E. coli
gcaacatgccgcagatccgcgtgat

SEQ ID NO: 126134 - DNA, 25 bp, E. coli
gcaacatgccgctgatccgcgtgat

SEQ ID NO: 126135 - DNA, 25 bp, E. coli
gtttgccagcaaaaacaacggcttt

SEQ ID NO: 126136 - DNA, 25 bp, E. coli
gtttgccagcaataacaacggcttt

SEQ ID NO: 126137 - DNA, 25 bp, E. coli
ggtttatgaagttggcaccgccacc

SEQ ID NO: 126138 - DNA, 25 bp, E. coli
ggtttatgaagtaggcaccgccacc

SEQ ID NO: 126139 - DNA, 25 bp, E. coli
tggaccggtaagtagacaccacagc

SEQ ID NO: 126140 - DNA, 25 bp, E. coli
ggcatgatgccttacgacgccgatg

SEQ ID NO: 126141 - DNA, 25 bp, E. coli
tggaccggtaagaagacaccacagc

SEQ ID NO: 126142 - DNA, 25 bp, E. coli
ggcatgatgcctaacgacgccgatg

SEQ ID NO: 126143 - DNA, 25 bp, E. coli
caatgcagccgaaggtcagtaagat

SEQ ID NO: 126144 - DNA, 25 bp, E. coli
caatgcagccgatggtcagtaagat

SEQ ID NO: 126145 - DNA, 25 bp, E. coli
agaagaagtgaaaccagcgccggaa

SEQ ID NO: 126146 - DNA, 25 bp, E. coli
agaagaagtgaatccagcgccggaa

SEQ ID NO: 126147 - DNA, 25 bp, E. coli
tagtaaagccattggcattgcccgc

SEQ ID NO: 126148 - DNA, 25 bp, E. coli
tagtaaagccataggcattgcccgc

SEQ ID NO: 126149 - DNA, 25 bp, E. coli
tatgactggaatggcgcaatgcagc

SEQ ID NO: 126150 - DNA, 25 bp, E. coli
tatgactggaatcgcgcaatgcagc

SEQ ID NO: 126151 - DNA, 25 bp, E. coli
tgagcacgaagaacaaactgcaccg

SEQ ID NO: 126152 - DNA, 25 bp, E. coli
tgagcacgaagatcaaactgcaccg

SEQ ID NO: 126153 - DNA, 25 bp, E. coli
tgacaaaaatgactcgctacgcctt

SEQ ID NO: 126154 - DNA, 25 bp, E. coli
tgacaaaaatgagtcgctacgcctt

SEQ ID NO: 126155 - DNA, 25 bp, E. coli
tccgaccctacatatgcagctgatg

SEQ ID NO: 126156 - DNA, 25 bp, E. coli
tccgaccctacaaatgcagctgatg

SEQ ID NO: 126157 - DNA, 25 bp, E. coli
tctggtcaggtaaaggtgccgtttc

SEQ ID NO: 126158 - DNA, 25 bp, E. coli
tctggtcaggtataggtgccgtttc

SEQ ID NO: 126159 - DNA, 25 bp, E. coli
gcaacgtgaacctgcaccggtagaa

SEQ ID NO: 126160 - DNA, 25 bp, E. coli
gcaacgtgaaccagcaccggtagaa

SEQ ID NO: 126161 - DNA, 25 bp, E. coli
gaaacgctgcgatatgcgctggcta

SEQ ID NO: 126162 - DNA, 25 bp, E. coli
gaaacgctgcgaaatgcgctggcta

SEQ ID NO: 126163 - DNA, 25 bp, E. coli
ggcgctcattacctgctgtactcca

SEQ ID NO: 126164 - DNA, 25 bp, E. coli
ggcgctcattacgtgctgtactcca

SEQ ID NO: 126165 - DNA, 25 bp, E. coli
catgctgacagagatttttctgaag

SEQ ID NO: 126166 - DNA, 25 bp, E. coli
cagagatttttcagaagcaggcgat

SEQ ID NO: 126167 - DNA, 25 bp, E. coli
catgctgacagacatttttctgaag

SEQ ID NO: 126168 - DNA, 25 bp, E. coli
cagagatttttctgaagcaggcgat

SEQ ID NO: 126169 - DNA, 25 bp, E. coli
agatttttctgaagcaggcgatggt

SEQ ID NO: 126170 - DNA, 25 bp, E. coli
agatttttctgatgcaggcgatggt

SEQ ID NO: 126171 - DNA, 25 bp, E. coli
tgtccatgctgagagagatttttct

SEQ ID NO: 126172 - DNA, 25 bp, E. coli
tgtccatgctgacagagatttttct

SEQ ID NO: 126173 - DNA, 25 bp, E. coli
tgacagagatttatctgaagcaggc

SEQ ID NO: 126174 - DNA, 25 bp, E. coli
tgacagagatttttctgaagcaggc

SEQ ID NO: 126175 - DNA, 25 bp, E. coli
tccatgctgacagagatttttctga

SEQ ID NO: 126176 - DNA, 25 bp, E. coli
tccatgctgacacagatttttctga

SEQ ID NO: 126177 - DNA, 25 bp, E. coli
gctgtccatgctgacagagattttt

SEQ ID NO: 126178 - DNA, 25 bp, E. coli
gctgtccatgctcacagagattttt

SEQ ID NO: 126179 - DNA, 25 bp, E. coli
gctgacagagatatttctgaagcag

SEQ ID NO: 126180 - DNA, 25 bp, E. coli
gctgacagagatttttctgaagcag

SEQ ID NO: 126181 - DNA, 25 bp, E. coli
gacagagatttttctgaagcaggcg

SEQ ID NO: 126182 - DNA, 25 bp, E. coli
gacagagattttactgaagcaggcg

SEQ ID NO: 126183 - DNA, 25 bp, E. coli
ggtgctgtccatgctgacagagatt

SEQ ID NO: 126184 - DNA, 25 bp, E. coli
ggtgctgtccatcctgacagagatt

SEQ ID NO: 126185 - DNA, 25 bp, E. coli
gagatttttctgtagcaggcgatgg

SEQ ID NO: 126186 - DNA, 25 bp, E. coli
gagatttttctgaagcaggcgatgg

SEQ ID NO: 126187 - DNA, 25 bp, E. coli
cagaagttgcgaaaggtatgggaat

SEQ ID NO: 126188 - DNA, 25 bp, E. coli
catttctggctggtgggaatttcga

SEQ ID NO: 126189 - DNA, 25 bp, E. coli
cagaagttgcgataggtatgggaat

SEQ ID NO: 126190 - DNA, 25 bp, E. coli
catttctggctgctgggaatttcga

SEQ ID NO: 126191 - DNA, 25 bp, E. coli
acaactgccacgacccgtttatcag

SEQ ID NO: 126192 - DNA, 25 bp, E. coli
acaactgccacgtcccgtttatcag

SEQ ID NO: 126193 - DNA, 25 bp, E. coli
ttaataccgcgtatgtgatccaggg

SEQ ID NO: 126194 - DNA, 25 bp, E. coli
ttaataccgcgtttgtgatccaggg

SEQ ID NO: 126195 - DNA, 25 bp, E. coli
tgatgccagcgtgacagaagttgcg

SEQ ID NO: 126196 - DNA, 25 bp, E. coli
tgatgccagcgtcacagaagttgcg

SEQ ID NO: 126197 - DNA, 25 bp, E. coli
tgcgtaaggtcgtgctaccgctggc

SEQ ID NO: 126198 - DNA, 25 bp, E. coli
tgcgtaaggtcgagctaccgctggc

SEQ ID NO: 126199 - DNA, 25 bp, E. coli
tcatcatcgggcttagcggatttaa

SEQ ID NO: 126200 - DNA, 25 bp, E. coli
tcatcatcgggcatagcggatttaa

SEQ ID NO: 126201 - DNA, 25 bp, E. coli
gcccactggtggaaactattgccgc

SEQ ID NO: 126202 - DNA, 25 bp, E. coli
gcccactggtggtaactattgccgc

SEQ ID NO: 126203 - DNA, 25 bp, E. coli
gctgtttgctgcgttgttcccacaa

SEQ ID NO: 126204 - DNA, 25 bp, E. coli
gctgtttgctgccttgttcccacaa

SEQ ID NO: 126205 - DNA, 25 bp, E. coli
gatcatcgcagagcgcctgtttgaa

SEQ ID NO: 126206 - DNA, 25 bp, E. coli
tggcactggctcttttctggctggt

SEQ ID NO: 126207 - DNA, 25 bp, E. coli
tggcactggctcatttctggctggt

SEQ ID NO: 126208 - DNA, 25 bp, E. coli
gatcatcgcagaccgcctgtttgaa

SEQ ID NO: 126209 - DNA, 25 bp, E. coli
acgcggaagatcccactccgctggt

SEQ ID NO: 126210 - DNA, 25 bp, E. coli
acgcggaagatcgcactccgctggt

SEQ ID NO: 126211 - DNA, 25 bp, E. coli
tcacgcggaagatcccactccgctg

SEQ ID NO: 126212 - DNA, 25 bp, E. coli
gccgggcgtgataactcgtgaacca

SEQ ID NO: 126213 - DNA, 25 bp, E. coli
ccgggcgtgatttctcgtgaaccag

SEQ ID NO: 126214 - DNA, 25 bp, E. coli
gccgggcgtgattactcgtgaacca

SEQ ID NO: 126215 - DNA, 25 bp, E. coli
gcgtcacgcggatgatcccactccg

SEQ ID NO: 126216 - DNA, 25 bp, E. coli
gcgtcacgcggaagatcccactccg

SEQ ID NO: 126217 - DNA, 25 bp, E. coli
gcgtgattactcgtgaaccagcggg

SEQ ID NO: 126218 - DNA, 25 bp, E. coli
gcgtgattactcctgaaccagcggg

SEQ ID NO: 126219 - DNA, 25 bp, E. coli
ccgggcgtgattactcgtgaaccag

SEQ ID NO: 126220 - DNA, 25 bp, E. coli
cgtgattactcgtgaaccagcgggc

SEQ ID NO: 126221 - DNA, 25 bp, E. coli
cgggcgtgattagtcgtgaaccagc

SEQ ID NO: 126222 - DNA, 25 bp, E. coli
cgggcgtgattactcgtgaaccagc

SEQ ID NO: 126223 - DNA, 25 bp, E. coli
cgtgattactcgagaaccagcgggc

SEQ ID NO: 126224 - DNA, 25 bp, E. coli
ctgcgtcacgcgcaagatcccactc

SEQ ID NO: 126225 - DNA, 25 bp, E. coli
ctgcgtcacgcggaagatcccactc

SEQ ID NO: 126226 - DNA, 25 bp, E. coli
gtcacgcggaagttcccactccgct

SEQ ID NO: 126227 - DNA, 25 bp, E. coli
gtcacgcggaagatcccactccgct

SEQ ID NO: 126228 - DNA, 25 bp, E. coli
gggcgtgattactcgtgaaccagcg

SEQ ID NO: 126229 - DNA, 25 bp, E. coli
gggcgtgattacacgtgaaccagcg

SEQ ID NO: 126230 - DNA, 25 bp, E. coli
tcacgcggaagaacccactccgctg

SEQ ID NO: 126231 - DNA, 25 bp, E. coli
cagttacgtcgcaatgatgaagccc

SEQ ID NO: 126232 - DNA, 25 bp, E. coli
cagttacgtcgctatgatgaagccc

SEQ ID NO: 126233 - DNA, 25 bp, E. coli
agcaactgatggaacttttccccga

SEQ ID NO: 126234 - DNA, 25 bp, E. coli
agcaactgatggtacttttccccga

SEQ ID NO: 126235 - DNA, 25 bp, E. coli
tatcccggcggaagagcagttacgt

SEQ ID NO: 126236 - DNA, 25 bp, E. coli
tatcccggcggatgagcagttacgt

SEQ ID NO: 126237 - DNA, 25 bp, E. coli
tgatgaagcccgaaaccagaatggc

SEQ ID NO: 126238 - DNA, 25 bp, E. coli
tgatgaagcccgtaaccagaatggc

SEQ ID NO: 126239 - DNA, 25 bp, E. coli
ccagaatggcagtgaacagcagcaa

SEQ ID NO: 126240 - DNA, 25 bp, E. coli
ccagaatggcagagaacagcagcaa

SEQ ID NO: 126241 - DNA, 25 bp, E. coli
gaatgaaggcatgacccgcttacag

SEQ ID NO: 126242 - DNA, 25 bp, E. coli
gcaggcttttaaccggcatatcccg

SEQ ID NO: 126243 - DNA, 25 bp, E. coli
gaatgaaggcatcacccgcttacag

SEQ ID NO: 126244 - DNA, 25 bp, E. coli
gcaggcttttaagcggcatatcccg

SEQ ID NO: 126245 - DNA, 25 bp, E. coli
gaacggaggtgtatggcatcatgca

SEQ ID NO: 126246 - DNA, 25 bp, E. coli
gaacggaggtgtttggcatcatgca

SEQ ID NO: 126247 - DNA, 25 bp, E. coli
cgttatcaggtgcaacacgctggca

SEQ ID NO: 126248 - DNA, 25 bp, E. coli
cgttatcaggtggaacacgctggca

SEQ ID NO: 126249 - DNA, 25 bp, E. coli
tggcaaaccggagaggcagccatga

SEQ ID NO: 126250 - DNA, 25 bp, E. coli
ggctgaacgcctgaaccgtctggat

SEQ ID NO: 126251 - DNA, 25 bp, E. coli
ggctgaacgcctcaaccgtctggat

SEQ ID NO: 126252 - DNA, 25 bp, E. coli
tggcaaaccggacaggcagccatga

SEQ ID NO: 126253 - DNA, 25 bp, E. coli
tacggctgggaaccgttatccgaac

SEQ ID NO: 126254 - DNA, 25 bp, E. coli
tacggctgggaagcgttatccgaac

SEQ ID NO: 126255 - DNA, 25 bp, E. coli
tagccgaacgcttcctcgatgacgg

SEQ ID NO: 126256 - DNA, 25 bp, E. coli
tagccgaacgctacctcgatgacgg

SEQ ID NO: 126257 - DNA, 25 bp, E. coli
tattttcagctctttgccgatccgg

SEQ ID NO: 126258 - DNA, 25 bp, E. coli
tattttcagctcattgccgatccgg

SEQ ID NO: 126259 - DNA, 25 bp, E. coli
tctgccgtcacggaaaccattgagg

SEQ ID NO: 126260 - DNA, 25 bp, E. coli
tcctgcgcgggcataataggctggc

SEQ ID NO: 126261 - DNA, 25 bp, E. coli
tctgccgtcacgcaaaccattgagg

SEQ ID NO: 126262 - DNA, 25 bp, E. coli
tcctgcgcgggcttaataggctggc

SEQ ID NO: 126263 - DNA, 25 bp, E. coli
gcgccccgtggtggatcagatgtat

SEQ ID NO: 126264 - DNA, 25 bp, E. coli
gcgccccgtggtcgatcagatgtat

SEQ ID NO: 126265 - DNA, 25 bp, E. coli
gctggacatcactggcaacctgctg

SEQ ID NO: 126266 - DNA, 25 bp, E. coli
gctggacatcacaggcaacctgctg

SEQ ID NO: 126267 - DNA, 25 bp, E. coli
gaaaatacttcggtcaacgccctag

SEQ ID NO: 126268 - DNA, 25 bp, E. coli
gaaaatacttcgctcaacgccctag

SEQ ID NO: 126269 - DNA, 25 bp, E. coli
ggaacacagaactggcaagaacgct

SEQ ID NO: 126270 - DNA, 25 bp, E. coli
tggttcacgtcacggaggccttcct

SEQ ID NO: 126271 - DNA, 25 bp, E. coli
tggttcacgtcagggaggccttcct

SEQ ID NO: 126272 - DNA, 25 bp, E. coli
ggaacacagaacaggcaagaacgct

SEQ ID NO: 126273 - DNA, 25 bp, E. coli
tcacaaaaaacttatcgaggcgctg

SEQ ID NO: 126274 - DNA, 25 bp, E. coli
tcacaaaaaactaatcgaggcgctg

SEQ ID NO: 126275 - DNA, 25 bp, E. coli
cactgtgggagtttgttcgcgatct

SEQ ID NO: 126276 - DNA, 25 bp, E. coli
cactgtgggagtatgttcgcgatct

SEQ ID NO: 126277 - DNA, 25 bp, E. coli
catgtatatggaactggacggagct

SEQ ID NO: 126278 - DNA, 25 bp, E. coli
catgtatatggatctggacggagct

SEQ ID NO: 126279 - DNA, 25 bp, E. coli
taaaaacatcagagacgcgatgcgt

SEQ ID NO: 126280 - DNA, 25 bp, E. coli
taaaaacatcagtgacgcgatgcgt

SEQ ID NO: 126281 - DNA, 25 bp, E. coli
taaataaaatgaatccgccgccaga

SEQ ID NO: 126282 - DNA, 25 bp, E. coli
taaataaaatgattccgccgccaga

SEQ ID NO: 126283 - DNA, 25 bp, E. coli
tattctgtaaaacttgcgacgctga

SEQ ID NO: 126284 - DNA, 25 bp, E. coli
tattctgtaaaagttgcgacgctga

SEQ ID NO: 126285 - DNA, 25 bp, E. coli
tgtcctggctcgtgtatacttctga

SEQ ID NO: 126286 - DNA, 25 bp, E. coli
tgtcctggctcgagtatacttctga

SEQ ID NO: 126287 - DNA, 25 bp, E. coli
gccgccagatggtacaatacttact

SEQ ID NO: 126288 - DNA, 25 bp, E. coli
gccgccagatggaacaatacttact

SEQ ID NO: 126289 - DNA, 25 bp, E. coli
tcaaggctcaattagtatgctcgcg

SEQ ID NO: 126290 - DNA, 25 bp, E. coli
taagacagattacgactcaaggctc

SEQ ID NO: 126291 - DNA, 25 bp, E. coli
taagacagattaggactcaaggctc

SEQ ID NO: 126292 - DNA, 25 bp, E. coli
tcaaggctcaataagtatgctcgcg

SEQ ID NO: 126293 - DNA, 25 bp, E. coli
gatggtcttacagcgcaaaaataca

SEQ ID NO: 126294 - DNA, 25 bp, E. coli
gagtgataaacacccctaaccttga

SEQ ID NO: 126295 - DNA, 25 bp, E. coli
gatggtcttacaccgcaaaaataca

SEQ ID NO: 126296 - DNA, 25 bp, E. coli
gagtgataaacagccctaaccttga

SEQ ID NO: 126297 - DNA, 25 bp, E. coli
caacggcaacagagattatgaccac

SEQ ID NO: 126298 - DNA, 25 bp, E. coli
caacggcaacagtgattatgaccac

SEQ ID NO: 126299 - DNA, 25 bp, E. coli
aaaaatagggctggcgctgggatct

SEQ ID NO: 126300 - DNA, 25 bp, E. coli
aaaaatagggctcgcgctgggatct

SEQ ID NO: 126301 - DNA, 25 bp, E. coli
ttatggtttactcaaggcgatctcc

SEQ ID NO: 126302 - DNA, 25 bp, E. coli
ttatggtttactgaaggcgatctcc

SEQ ID NO: 126303 - DNA, 25 bp, E. coli
tgcgctggaagattgggtgacctct

SEQ ID NO: 126304 - DNA, 25 bp, E. coli
tgcgctggaagaatgggtgacctct

SEQ ID NO: 126305 - DNA, 25 bp, E. coli
ccttaaaaggaaccgcatggcaggt

SEQ ID NO: 126306 - DNA, 25 bp, E. coli
ccttaaaaggaagcgcatggcaggt

SEQ ID NO: 126307 - DNA, 25 bp, E. coli
gcggcgagcgtgacttcaatcaata

SEQ ID NO: 126308 - DNA, 25 bp, E. coli
gcggcgagcgtgtcttcaatcaata

SEQ ID NO: 126309 - DNA, 25 bp, E. coli
gaatggtgattcactgccgtggcat

SEQ ID NO: 126310 - DNA, 25 bp, E. coli
gaatggtgattctctgccgtggcat

SEQ ID NO: 126311 - DNA, 25 bp, E. coli
gaacttttgccgatggtacgcacca

SEQ ID NO: 126312 - DNA, 25 bp, E. coli
gaacttttgccgttggtacgcacca

SEQ ID NO: 126313 - DNA, 25 bp, E. coli
ccaggtgctggagaaccgccttaaa

SEQ ID NO: 126314 - DNA, 25 bp, E. coli
ccaggtgctggacaaccgccttaaa

SEQ ID NO: 126315 - DNA, 25 bp, E. coli
ctgatggatctcacctggcagcgcg

SEQ ID NO: 126316 - DNA, 25 bp, E. coli
ctgatggatctctcctggcagcgcg

SEQ ID NO: 126317 - DNA, 25 bp, E. coli
gtttgcccgcaattatctacgcttg

SEQ ID NO: 126318 - DNA, 25 bp, E. coli
gtttgcccgcaaatatctacgcttg

SEQ ID NO: 126319 - DNA, 25 bp, E. coli
cacctcatgaaagatgtcctgacga

SEQ ID NO: 126320 - DNA, 25 bp, E. coli
cacctcatgaaacatgtcctgacga

SEQ ID NO: 126321 - DNA, 25 bp, E. coli
caggtgtttctggattagccggaca

SEQ ID NO: 126322 - DNA, 25 bp, E. coli
caggtgtttctgcattagccggaca

SEQ ID NO: 126323 - DNA, 25 bp, E. coli
aacagcggagcgatttgcagtagca

SEQ ID NO: 126324 - DNA, 25 bp, E. coli
aacagcggagcgttttgcagtagca

SEQ ID NO: 126325 - DNA, 25 bp, E. coli
tataggaggaaccaaaatttcagcg

SEQ ID NO: 126326 - DNA, 25 bp, E. coli
tataggaggaacgaaaatttcagcg

SEQ ID NO: 126327 - DNA, 25 bp, E. coli
tattggtgcaacactttgggaccgg

SEQ ID NO: 126328 - DNA, 25 bp, E. coli
tattggtgcaactctttgggaccgg

SEQ ID NO: 126329 - DNA, 25 bp, E. coli
tgtgataaatgaagcccaggcagcc

SEQ ID NO: 126330 - DNA, 25 bp, E. coli
tgggcatatattctccggagtaacg

SEQ ID NO: 126331 - DNA, 25 bp, E. coli
tgggcatatattgtccggagtaacg

SEQ ID NO: 126332 - DNA, 25 bp, E. coli
tgtgataaatgatgcccaggcagcc

SEQ ID NO: 126333 - DNA, 25 bp, E. coli
tctgaatccagacaatcttggaggg

SEQ ID NO: 126334 - DNA, 25 bp, E. coli
tcttggagggctcaaagagtatcct

SEQ ID NO: 126335 - DNA, 25 bp, E. coli
tctgaatccagagaatcttggaggg

SEQ ID NO: 126336 - DNA, 25 bp, E. coli
tcttggagggctgaaagagtatcct

SEQ ID NO: 126337 - DNA, 25 bp, E. coli
gaagcggtttcatctggtcgggcca

SEQ ID NO: 126338 - DNA, 25 bp, E. coli
gaatttttgacagagcgttctgcca

SEQ ID NO: 126339 - DNA, 25 bp, E. coli
gaagcggtttcaactggtcgggcca

SEQ ID NO: 126340 - DNA, 25 bp, E. coli
gaatttttgacacagcgttctgcca

SEQ ID NO: 126341 - DNA, 25 bp, E. coli
agcagccggaaaccgggcgaccatc

SEQ ID NO: 126342 - DNA, 25 bp, E. coli
agcagccggaaagcgggcgaccatc

SEQ ID NO: 126343 - DNA, 25 bp, E. coli
actgaaggtgaatgagaagaagagc

SEQ ID NO: 126344 - DNA, 25 bp, E. coli
actgaaggtgaaagagaagaagagc

SEQ ID NO: 126345 - DNA, 25 bp, E. coli
tcgtggacacaggttctgccgctac

SEQ ID NO: 126346 - DNA, 25 bp, E. coli
tcgtggacacagcttctgccgctac

SEQ ID NO: 126347 - DNA, 25 bp, E. coli
tcgtggagaacatactgaaggtgaa

SEQ ID NO: 126348 - DNA, 25 bp, E. coli
tcgtggagaacaaactgaaggtgaa

SEQ ID NO: 126349 - DNA, 25 bp, E. coli
gctacgcagacgactgcaacatcta

SEQ ID NO: 126350 - DNA, 25 bp, E. coli
gctacgcagacgtctgcaacatcta

SEQ ID NO: 126351 - DNA, 25 bp, E. coli
gcaacatctacgaaagcagccggaa

SEQ ID NO: 126352 - DNA, 25 bp, E. coli
gcaacatctacgtaagcagccggaa

SEQ ID NO: 126353 - DNA, 25 bp, E. coli
gaacatcagggccttcgtggagaac

SEQ ID NO: 126354 - DNA, 25 bp, E. coli
gaacatcagggcgttcgtggagaac

SEQ ID NO: 126355 - DNA, 25 bp, E. coli
cgttactgtcgaacatcctgctgga

SEQ ID NO: 126356 - DNA, 25 bp, E. coli
cgttactgtcgatcatcctgctgga

SEQ ID NO: 126357 - DNA, 25 bp, E. coli
ggcggcccactgtcgccgttactgt

SEQ ID NO: 126358 - DNA, 25 bp, E. coli
ggcggcccactgacgccgttactgt

SEQ ID NO: 126359 - DNA, 25 bp, E. coli
ggcgaccatctggtgaagaacatca

SEQ ID NO: 126360 - DNA, 25 bp, E. coli
ggcgaccatctgctgaagaacatca

SEQ ID NO: 126361 - DNA, 25 bp, E. coli
taaagaactggaccgtcgtggacac

SEQ ID NO: 126362 - DNA, 25 bp, E. coli
taaagaactggagcgtcgtggacac

SEQ ID NO: 126363 - DNA, 25 bp, E. coli
tacgaatcgccgcagaagtattgaa

SEQ ID NO: 126364 - DNA, 25 bp, E. coli
tacgaatcgccggagaagtattgaa

SEQ ID NO: 126365 - DNA, 25 bp, E. coli
acaaaacgcaccacttcccagtgtt

SEQ ID NO: 126366 - DNA, 25 bp, E. coli
acaaaacgcacctcttcccagtgtt

SEQ ID NO: 126367 - DNA, 25 bp, E. coli
tatctctttaccatcgaagatcagc

SEQ ID NO: 126368 - DNA, 25 bp, E. coli
tatctctttaccttcgaagatcagc

SEQ ID NO: 126369 - DNA, 25 bp, E. coli
tttattcgccatcgcttttaccagc

SEQ ID NO: 126370 - DNA, 25 bp, E. coli
tttattcgccatggcttttaccagc

SEQ ID NO: 126371 - DNA, 25 bp, E. coli
ttttaccagcattcgaatcgccgga

SEQ ID NO: 126372 - DNA, 25 bp, E. coli
ttttaccagcatacgaatcgccgga

SEQ ID NO: 126373 - DNA, 25 bp, E. coli
tcttcgccaaatatattcgccatcg

SEQ ID NO: 126374 - DNA, 25 bp, E. coli
tcttcgccaaatttattcgccatcg

SEQ ID NO: 126375 - DNA, 25 bp, E. coli
gctgctttctttgagatagccttcg

SEQ ID NO: 126376 - DNA, 25 bp, E. coli
gctgctttctttcagatagccttcg

SEQ ID NO: 126377 - DNA, 25 bp, E. coli
gaattccagatacaaatcacgcaca

SEQ ID NO: 126378 - DNA, 25 bp, E. coli
gaattccagatagaaatcacgcaca

SEQ ID NO: 126379 - DNA, 25 bp, E. coli
cgccggagaagttttgaattccaga

SEQ ID NO: 126380 - DNA, 25 bp, E. coli
cgccggagaagtattgaattccaga

SEQ ID NO: 126381 - DNA, 25 bp, E. coli
gatagccttcggaatccgtttctat

SEQ ID NO: 126382 - DNA, 25 bp, E. coli
gatagccttcggtatccgtttctat

SEQ ID NO: 126383 - DNA, 25 bp, E. coli
ggctcactccacaggctgctttctt

SEQ ID NO: 126384 - DNA, 25 bp, E. coli
ggctcactccactggctgctttctt

SEQ ID NO: 126385 - DNA, 25 bp, E. coli
tactttgttcacagctacgcaatgc

SEQ ID NO: 126386 - DNA, 25 bp, E. coli
tactttgttcactgctacgcaatgc

SEQ ID NO: 126387 - DNA, 25 bp, E. coli
aaaagataacttctacggcgtgcag

SEQ ID NO: 126388 - DNA, 25 bp, E. coli
aaaagataacttgtacggcgtgcag

SEQ ID NO: 126389 - DNA, 25 bp, E. coli
tgatctcatcaaagcctgtacccaa

SEQ ID NO: 126390 - DNA, 25 bp, E. coli
tgatctcatcaatgcctgtacccaa

SEQ ID NO: 126391 - DNA, 25 bp, E. coli
ccaaccggtgctcggcatctgctta

SEQ ID NO: 126392 - DNA, 25 bp, E. coli
ccaaccggtgctgggcatctgctta

SEQ ID NO: 126393 - DNA, 25 bp, E. coli
gaagacggcgcgtacttttactttg

SEQ ID NO: 126394 - DNA, 25 bp, E. coli
gcaggcaggcaagcgcctgtttcag

SEQ ID NO: 126395 - DNA, 25 bp, E. coli
gaagacggcgcgaacttttactttg

SEQ ID NO: 126396 - DNA, 25 bp, E. coli
gcaggcaggcaaccgcctgtttcag

SEQ ID NO: 126397 - DNA, 25 bp, E. coli
gttgctgaaaaagttcctggagatg

SEQ ID NO: 126398 - DNA, 25 bp, E. coli
gttgctgaaaaacttcctggagatg

SEQ ID NO: 126399 - DNA, 25 bp, E. coli
ggttatgaacccaaagtcagccgtg

SEQ ID NO: 126400 - DNA, 25 bp, E. coli
ggaccatcgcccagtgtaattacgg

SEQ ID NO: 126401 - DNA, 25 bp, E. coli
ggttatgaaccctaagtcagccgtg

SEQ ID NO: 126402 - DNA, 25 bp, E. coli
ggaccatcgccctgtgtaattacgg

SEQ ID NO: 126403 - DNA, 25 bp, E. coli
tcaccgcggcggaacaaaaagataa

SEQ ID NO: 126404 - DNA, 25 bp, E. coli
tcaccgcggcggtacaaaaagataa

SEQ ID NO: 126405 - DNA, 25 bp, E. coli
gacgtgccgaaattgaccgactttg

SEQ ID NO: 126406 - DNA, 25 bp, E. coli
gacgtgccgaaaatgaccgactttg

SEQ ID NO: 126407 - DNA, 25 bp, E. coli
caggtgcggctctgtttcttgatca

SEQ ID NO: 126408 - DNA, 25 bp, E. coli
caggtgcggctcagtttcttgatca

SEQ ID NO: 126409 - DNA, 25 bp, E. coli
aacagcgggagtctcttctccagaa

SEQ ID NO: 126410 - DNA, 25 bp, E. coli
aacagcgggagtgtcttctccagaa

SEQ ID NO: 126411 - DNA, 25 bp, E. coli
tagcaagcctccattcaacatcggt

SEQ ID NO: 126412 - DNA, 25 bp, E. coli
tagcaagcctcctttcaacatcggt

SEQ ID NO: 126413 - DNA, 25 bp, E. coli
tgggctctcgcctgaagacgtgctc

SEQ ID NO: 126414 - DNA, 25 bp, E. coli
tgggctctcgccagaagacgtgctc

SEQ ID NO: 126415 - DNA, 25 bp, E. coli
tgaacagcgatctcagtttcgatgc

SEQ ID NO: 126416 - DNA, 25 bp, E. coli
tgaacagcgatcacagtttcgatgc

SEQ ID NO: 126417 - DNA, 25 bp, E. coli
tgctctatctgcaggtgggctctcg

SEQ ID NO: 126418 - DNA, 25 bp, E. coli
tgctctatctgctggtgggctctcg

SEQ ID NO: 126419 - DNA, 25 bp, E. coli
gaatgtgctcaacgcaaacgtcaac

SEQ ID NO: 126420 - DNA, 25 bp, E. coli
gaatgtgctcaaggcaaacgtcaac

SEQ ID NO: 126421 - DNA, 25 bp, E. coli
gacgtgctcaccttacaaaagaatg

SEQ ID NO: 126422 - DNA, 25 bp, E. coli
gacatcttgcaagaatgaacagcga

SEQ ID NO: 126423 - DNA, 25 bp, E. coli
gacatcttgcaacaatgaacagcga

SEQ ID NO: 126424 - DNA, 25 bp, E. coli
cgttgatgagcaaacctcgttagcc

SEQ ID NO: 126425 - DNA, 25 bp, E. coli
cgttgatgagcatacctcgttagcc

SEQ ID NO: 126426 - DNA, 25 bp, E. coli
tcaattactcccaaaaacagcggga

SEQ ID NO: 126427 - DNA, 25 bp, E. coli
tcaattactccctaaaacagcggga

SEQ ID NO: 126428 - DNA, 25 bp, E. coli
gacgtgctcaccatacaaaagaatg

SEQ ID NO: 126429 - DNA, 25 bp, E. coli
cacgaagcgactctggatatggcga

SEQ ID NO: 126430 - DNA, 25 bp, E. coli
cacgaagcgactgtggatatggcga

SEQ ID NO: 126431 - DNA, 25 bp, E. coli
catagttctacaggccaggcggcgg

SEQ ID NO: 126432 - DNA, 25 bp, E. coli
catagttctacacgccaggcggcgg

SEQ ID NO: 126433 - DNA, 25 bp, E. coli
taaaggcgtcgacgtaatggttcac

SEQ ID NO: 126434 - DNA, 25 bp, E. coli
taaaggcgtcgaggtaatggttcac

SEQ ID NO: 126435 - DNA, 25 bp, E. coli
tagccgttccagagccgggtaaagc

SEQ ID NO: 126436 - DNA, 25 bp, E. coli
tagccgttccagtgccgggtaaagc

SEQ ID NO: 126437 - DNA, 25 bp, E. coli
tgatttcgcggtctttagcatttaa

SEQ ID NO: 126438 - DNA, 25 bp, E. coli
tgatttcgcggtgtttagcatttaa

SEQ ID NO: 126439 - DNA, 25 bp, E. coli
cgatgccgcgctcgagctggctaaa

SEQ ID NO: 126440 - DNA, 25 bp, E. coli
cgatgccgcgctggagctggctaaa

SEQ ID NO: 126441 - DNA, 25 bp, E. coli
gattacttagccgttccagtgccgg

SEQ ID NO: 126442 - DNA, 25 bp, E. coli
gatatggcgatggaggccaaagcca

SEQ ID NO: 126443 - DNA, 25 bp, E. coli
gatatggcgatgcaggccaaagcca

SEQ ID NO: 126444 - DNA, 25 bp, E. coli
gattacttagcccttccagtgccgg

SEQ ID NO: 126445 - DNA, 25 bp, E. coli
taatggttcacgtagcgactctgga

SEQ ID NO: 126446 - DNA, 25 bp, E. coli
taatggttcacgaagcgactctgga

SEQ ID NO: 126447 - DNA, 25 bp, E. coli
gatggaggccaaagccaacagtcgc

SEQ ID NO: 126448 - DNA, 25 bp, E. coli
gagctggctaaacgcgtcgacgtaa

SEQ ID NO: 126449 - DNA, 25 bp, E. coli
gatggaggccaatgccaacagtcgc

SEQ ID NO: 126450 - DNA, 25 bp, E. coli
gagctggctaaaggcgtcgacgtaa

SEQ ID NO: 126451 - DNA, 25 bp, E. coli
aatccgctgatgcatatttttccag

SEQ ID NO: 126452 - DNA, 25 bp, E. coli
aatccgctgatggatatttttccag

SEQ ID NO: 126453 - DNA, 25 bp, E. coli
cacctctgtcgaaaattaactattg

SEQ ID NO: 126454 - DNA, 25 bp, E. coli
cacctctgtcgataattaactattg

SEQ ID NO: 126455 - DNA, 25 bp, E. coli
acgccttatctgaccgacaaacgaa

SEQ ID NO: 126456 - DNA, 25 bp, E. coli
atgtcgccgcataccgtgtcggatg

SEQ ID NO: 126457 - DNA, 25 bp, E. coli
acgccttatctgtccgacaaacgaa

SEQ ID NO: 126458 - DNA, 25 bp, E. coli
atgtcgccgcattccgtgtcggatg

SEQ ID NO: 126459 - DNA, 25 bp, E. coli
tatttttccagctattacacctctg

SEQ ID NO: 126460 - DNA, 25 bp, E. coli
tatttttccagcaattacacctctg

SEQ ID NO: 126461 - DNA, 25 bp, E. coli
tatctgaccgactaacgaattatcc

SEQ ID NO: 126462 - DNA, 25 bp, E. coli
tatctgaccgacaaacgaattatcc

SEQ ID NO: 126463 - DNA, 25 bp, E. coli
tcgccgcataccctgtcggatgcgg

SEQ ID NO: 126464 - DNA, 25 bp, E. coli
tcgccgcataccgtgtcggatgcgg

SEQ ID NO: 126465 - DNA, 25 bp, E. coli
ccagcaattacacctctgtcgataa

SEQ ID NO: 126466 - DNA, 25 bp, E. coli
ccagcaattacagctctgtcgataa

SEQ ID NO: 126467 - DNA, 25 bp, E. coli
gcgtacacgcctaatctgaccgaca

SEQ ID NO: 126468 - DNA, 25 bp, E. coli
gcgtacacgccttatctgaccgaca

SEQ ID NO: 126469 - DNA, 25 bp, E. coli
gaattatccacattccgctgatgga

SEQ ID NO: 126470 - DNA, 25 bp, E. coli
gaattatccacaatccgctgatgga

SEQ ID NO: 126471 - DNA, 25 bp, E. coli
gaccgacaaacgtattatccacaat

SEQ ID NO: 126472 - DNA, 25 bp, E. coli
gaccgacaaacgaattatccacaat

SEQ ID NO: 126473 - DNA, 25 bp, E. coli
aattgagagcgaccaaataaaccgc

SEQ ID NO: 126474 - DNA, 25 bp, E. coli
aattgagagcgagcaaataaaccgc

SEQ ID NO: 126475 - DNA, 25 bp, E. coli
taaaccgcataattaataagccatt

SEQ ID NO: 126476 - DNA, 25 bp, E. coli
taaaccgcataaataataagccatt

SEQ ID NO: 126477 - DNA, 25 bp, E. coli
ataagccattttaatagccgctaag

SEQ ID NO: 126478 - DNA, 25 bp, E. coli
ataagccatttttatagccgctaag

SEQ ID NO: 126479 - DNA, 25 bp, E. coli
gccgctaagatattaaaggatgtgt

SEQ ID NO: 126480 - DNA, 25 bp, E. coli
gccgctaagataataaaggatgtgt

SEQ ID NO: 126481 - DNA, 25 bp, E. coli
gcgacatcatcggtgaaaacctata

SEQ ID NO: 126482 - DNA, 25 bp, E. coli
gcgacatcatcgctgaaaacctata

SEQ ID NO: 126483 - DNA, 25 bp, E. coli
ctgctggtttgcactctcattagaa

SEQ ID NO: 126484 - DNA, 25 bp, E. coli
cattaacgcgctctgaaaattgaga

SEQ ID NO: 126485 - DNA, 25 bp, E. coli
cggtgaaaacctataaatgaagaag

SEQ ID NO: 126486 - DNA, 25 bp, E. coli
cattaacgcgctgtgaaaattgaga

SEQ ID NO: 126487 - DNA, 25 bp, E. coli
cggtgaaaacctttaaatgaagaag

SEQ ID NO: 126488 - DNA, 25 bp, E. coli
ctgctggtttgctctctcattagaa

SEQ ID NO: 126489 - DNA, 25 bp, E. coli
taaccttcagcgtcatcatcggtga

SEQ ID NO: 126490 - DNA, 25 bp, E. coli
taaccttcagcgacatcatcggtga

SEQ ID NO: 126491 - DNA, 25 bp, E. coli
gatgaatatgtttaccttcagcgac

SEQ ID NO: 126492 - DNA, 25 bp, E. coli
gaccttccatcattaacgcgctctg

SEQ ID NO: 126493 - DNA, 25 bp, E. coli
gatgaatatgttaaccttcagcgac

SEQ ID NO: 126494 - DNA, 25 bp, E. coli
gaccttccatcaataacgcgctctg

SEQ ID NO: 126495 - DNA, 25 bp, E. coli
aatgactctttgctcggcagtggat

SEQ ID NO: 126496 - DNA, 25 bp, E. coli
aatgactctttggtcggcagtggat

SEQ ID NO: 126497 - DNA, 25 bp, E. coli
taaatgactcttagctcggcagtgg

SEQ ID NO: 126498 - DNA, 25 bp, E. coli
taaatgactctttgctcggcagtgg

SEQ ID NO: 126499 - DNA, 25 bp, E. coli
aaatgactctttcctcggcagtgga

SEQ ID NO: 126500 - DNA, 25 bp, E. coli
aaatgactctttgctcggcagtgga

SEQ ID NO: 126501 - DNA, 25 bp, E. coli
tagtaaatgactctttgctcggcag

SEQ ID NO: 126502 - DNA, 25 bp, E. coli
tagtaaatgactgtttgctcggcag

SEQ ID NO: 126503 - DNA, 25 bp, E. coli
tatgctgtagtaaatgactctttgc

SEQ ID NO: 126504 - DNA, 25 bp, E. coli
tatgctgtagtatatgactctttgc

SEQ ID NO: 126505 - DNA, 25 bp, E. coli
tgtagtaaatgactctttgctcggc

SEQ ID NO: 126506 - DNA, 25 bp, E. coli
tgtagtaaatgagtctttgctcggc

SEQ ID NO: 126507 - DNA, 25 bp, E. coli
tgctcggcagtgcattctgttttta

SEQ ID NO: 126508 - DNA, 25 bp, E. coli
tgactctttgctgggcagtggattc

SEQ ID NO: 126509 - DNA, 25 bp, E. coli
tgctcggcagtggattctgttttta

SEQ ID NO: 126510 - DNA, 25 bp, E. coli
tgactctttgctcggcagtggattc

SEQ ID NO: 126511 - DNA, 25 bp, E. coli
ctttgctcggcagtggattctgttt

SEQ ID NO: 126512 - DNA, 25 bp, E. coli
ctctttgctcggcagtggattctgt

SEQ ID NO: 126513 - DNA, 25 bp, E. coli
ctctttgctcgggagtggattctgt

SEQ ID NO: 126514 - DNA, 25 bp, E. coli
ctttgctcggcactggattctgttt

SEQ ID NO: 126515 - DNA, 25 bp, E. coli
ggattattatgctgtagtaaatgac

SEQ ID NO: 126516 - DNA, 25 bp, E. coli
ggattattatgcagtagtaaatgac

SEQ ID NO: 126517 - DNA, 25 bp, E. coli
agaaagtcgccgtcgtcaaacgcca

SEQ ID NO: 126518 - DNA, 25 bp, E. coli
agaaagtcgccgacgtcaaacgcca

SEQ ID NO: 126519 - DNA, 25 bp, E. coli
tgttgattccgtcgcaagacctctc

SEQ ID NO: 126520 - DNA, 25 bp, E. coli
tgttgattccgtggcaagacctctc

SEQ ID NO: 126521 - DNA, 25 bp, E. coli
gccgcgcagtcactttcgcgaataa

SEQ ID NO: 126522 - DNA, 25 bp, E. coli
gccgcgcagtcagtttcgcgaataa

SEQ ID NO: 126523 - DNA, 25 bp, E. coli
gaacatgagcgtacacttgaacaga

SEQ ID NO: 126524 - DNA, 25 bp, E. coli
gaaagctttgtgttacgtgaaggca

SEQ ID NO: 126525 - DNA, 25 bp, E. coli
gaaagctttgtgatacgtgaaggca

SEQ ID NO: 126526 - DNA, 25 bp, E. coli
gaacatgagcgttcacttgaacaga

SEQ ID NO: 126527 - DNA, 25 bp, E. coli
ccgattatggtgaacatgagcgtac

SEQ ID NO: 126528 - DNA, 25 bp, E. coli
ccgattatggtgtacatgagcgtac

SEQ ID NO: 126529 - DNA, 25 bp, E. coli
cggagctgcacgtaacggtcaatat

SEQ ID NO: 126530 - DNA, 25 bp, E. coli
ctggtatggtcggagctgcacgaaa

SEQ ID NO: 126531 - DNA, 25 bp, E. coli
ctggtatggtcgcagctgcacgaaa

SEQ ID NO: 126532 - DNA, 25 bp, E. coli
cggagctgcacgaaacggtcaatat

SEQ ID NO: 126533 - DNA, 25 bp, E. coli
gttacgtgaagggaccgattatggt

SEQ ID NO: 126534 - DNA, 25 bp, E. coli
gttacgtgaaggcaccgattatggt

SEQ ID NO: 126535 - DNA, 25 bp, E. coli
tacacttgaacacaaagtcgccgac

SEQ ID NO: 126536 - DNA, 25 bp, E. coli
tcaaacgccagctacagtgcggaga

SEQ ID NO: 126537 - DNA, 25 bp, E. coli
tacacttgaacagaaagtcgccgac

SEQ ID NO: 126538 - DNA, 25 bp, E. coli
tcaaacgccagcaacagtgcggaga

SEQ ID NO: 126539 - DNA, 25 bp, E. coli
caggcaattaaaagaggtcgtatga

SEQ ID NO: 126540 - DNA, 25 bp, E. coli
caggcaattaaatgaggtcgtatga

SEQ ID NO: 126541 - DNA, 25 bp, E. coli
caggcttgtatgataatagcgcagc

SEQ ID NO: 126542 - DNA, 25 bp, E. coli
caggcttgtatgttaatagcgcagc

SEQ ID NO: 126543 - DNA, 25 bp, E. coli
tactggagaacgacatctgtttggc

SEQ ID NO: 126544 - DNA, 25 bp, E. coli
tagcgcagcgacagatgtatttgca

SEQ ID NO: 126545 - DNA, 25 bp, E. coli
tagcgcagcgactgatgtatttgca

SEQ ID NO: 126546 - DNA, 25 bp, E. coli
tactggagaacgtcatctgtttggc

SEQ ID NO: 126547 - DNA, 25 bp, E. coli
aaatatccgatttggagggcagacg

SEQ ID NO: 126548 - DNA, 25 bp, E. coli
aaatatccgattaggagggcagacg

SEQ ID NO: 126549 - DNA, 25 bp, E. coli
tatttgcagagataaccacatttgg

SEQ ID NO: 126550 - DNA, 25 bp, E. coli
tatttgcagagaaaaccacatttgg

SEQ ID NO: 126551 - DNA, 25 bp, E. coli
tgtttggccatattcgcaatttccg

SEQ ID NO: 126552 - DNA, 25 bp, E. coli
tgtattgcaaaacctgatggtcact

SEQ ID NO: 126553 - DNA, 25 bp, E. coli
tgtattgcaaaagctgatggtcact

SEQ ID NO: 126554 - DNA, 25 bp, E. coli
tgtttggccataatcgcaatttccg

SEQ ID NO: 126555 - DNA, 25 bp, E. coli
tcatgtggtgactaatggtaaagcg

SEQ ID NO: 126556 - DNA, 25 bp, E. coli
tcatgtggtgacaaatggtaaagcg

SEQ ID NO: 126557 - DNA, 25 bp, E. coli
gcaatttccgcatatggcataaaga

SEQ ID NO: 126558 - DNA, 25 bp, E. coli
gcaatttccgcaaatggcataaaga

SEQ ID NO: 126559 - DNA, 25 bp, E. coli
gagtctgtcaaacccttcaggcttg

SEQ ID NO: 126560 - DNA, 25 bp, E. coli
gagtctgtcaaagccttcaggcttg

SEQ ID NO: 126561 - DNA, 25 bp, E. coli
aagcgatgaaaaagacgcgcagatc

SEQ ID NO: 126562 - DNA, 25 bp, E. coli
aatgacgcgcagttcgcagagcggt

SEQ ID NO: 126563 - DNA, 25 bp, E. coli
aagcgatgaaaatgacgcgcagatc

SEQ ID NO: 126564 - DNA, 25 bp, E. coli
aatgacgcgcagatcgcagagcggt

SEQ ID NO: 126565 - DNA, 25 bp, E. coli
acgcgcagatcgcagagcggttaac

SEQ ID NO: 126566 - DNA, 25 bp, E. coli
acgcgcagatcggagagcggttaac

SEQ ID NO: 126567 - DNA, 25 bp, E. coli
aaaaatctctataaagaaagcgatg

SEQ ID NO: 126568 - DNA, 25 bp, E. coli
aaaaatctctattaagaaagcgatg

SEQ ID NO: 126569 - DNA, 25 bp, E. coli
taccgcacgactggtgtctgatgag

SEQ ID NO: 126570 - DNA, 25 bp, E. coli
taccgcacgactcgtgtctgatgag

SEQ ID NO: 126571 - DNA, 25 bp, E. coli
tctctataaagatagcgatgaaaat

SEQ ID NO: 126572 - DNA, 25 bp, E. coli
tctctataaagaaagcgatgaaaat

SEQ ID NO: 126573 - DNA, 25 bp, E. coli
gaaagcgatgaatatgacgcgcaga

SEQ ID NO: 126574 - DNA, 25 bp, E. coli
gaaactaccgcacgactggtgtctg

SEQ ID NO: 126575 - DNA, 25 bp, E. coli
gaaaatgacgcggagatcgcagagc

SEQ ID NO: 126576 - DNA, 25 bp, E. coli
gaaaatgacgcgcagatcgcagagc

SEQ ID NO: 126577 - DNA, 25 bp, E. coli
gaaagcgatgaaaatgacgcgcaga

SEQ ID NO: 126578 - DNA, 25 bp, E. coli
gaaactaccgcaggactggtgtctg

SEQ ID NO: 126579 - DNA, 25 bp, E. coli
ccgcacgactggtgtctgatgaggt

SEQ ID NO: 126580 - DNA, 25 bp, E. coli
ccgcacgactggagtctgatgaggt

SEQ ID NO: 126581 - DNA, 25 bp, E. coli
cgatgaaaatgaggcgcagatcgca

SEQ ID NO: 126582 - DNA, 25 bp, E. coli
cgatgaaaatgacgcgcagatcgca

SEQ ID NO: 126583 - DNA, 25 bp, E. coli
aatcagccgcgaagatgctgtcaac

SEQ ID NO: 126584 - DNA, 25 bp, E. coli
aatcagccgcgatgatgctgtcaac

SEQ ID NO: 126585 - DNA, 25 bp, E. coli
cagccgcgaagaagctgtcaacgaa

SEQ ID NO: 126586 - DNA, 25 bp, E. coli
cagccgcgaagatgctgtcaacgaa

SEQ ID NO: 126587 - DNA, 25 bp, E. coli
caggtagtggcaacgcgccttggaa

SEQ ID NO: 126588 - DNA, 25 bp, E. coli
caggtagtggcatcgcgccttggaa

SEQ ID NO: 126589 - DNA, 25 bp, E. coli
aaagcctcttcagaggtagtggcat

SEQ ID NO: 126590 - DNA, 25 bp, E. coli
aaagcctcttcacaggtagtggcat

SEQ ID NO: 126591 - DNA, 25 bp, E. coli
ttcacaggtagtcgcatcgcgcctt

SEQ ID NO: 126592 - DNA, 25 bp, E. coli
ttcacaggtagtggcatcgcgcctt

SEQ ID NO: 126593 - DNA, 25 bp, E. coli
tcttcacaggtactggcatcgcgcc

SEQ ID NO: 126594 - DNA, 25 bp, E. coli
tcttcacaggtagtggcatcgcgcc

SEQ ID NO: 126595 - DNA, 25 bp, E. coli
gccttggaatcacccgcgaagatgc

SEQ ID NO: 126596 - DNA, 25 bp, E. coli
gccttggaatcagccgcgaagatgc

SEQ ID NO: 126597 - DNA, 25 bp, E. coli
gcgccttggaatgagccgcgaagat

SEQ ID NO: 126598 - DNA, 25 bp, E. coli
gcgccttggaatcagccgcgaagat

SEQ ID NO: 126599 - DNA, 25 bp, E. coli
ccgcgaagatgctgtcaacgaactg

SEQ ID NO: 126600 - DNA, 25 bp, E. coli
ccgcgaagatgcagtcaacgaactg

SEQ ID NO: 126601 - DNA, 25 bp, E. coli
ggaatcagccgcgaagatgctgtca

SEQ ID NO: 126602 - DNA, 25 bp, E. coli
tggcatcgcgccatggaatcagccg

SEQ ID NO: 126603 - DNA, 25 bp, E. coli
tggcatcgcgccttggaatcagccg

SEQ ID NO: 126604 - DNA, 25 bp, E. coli
ggaatcagccgccaagatgctgtca

SEQ ID NO: 126605 - DNA, 25 bp, E. coli
caagatcctttactggtgccgctgt

SEQ ID NO: 126606 - DNA, 25 bp, E. coli
caagtctctgccgattacaatgcgt

SEQ ID NO: 126607 - DNA, 25 bp, E. coli
caatgcgttgtttatcggcgatgaa

SEQ ID NO: 126608 - DNA, 25 bp, E. coli
caatgcgttgttaatcggcgatgaa

SEQ ID NO: 126609 - DNA, 25 bp, E. coli
caagtctctgcccattacaatgcgt

SEQ ID NO: 126610 - DNA, 25 bp, E. coli
caagatcctttagtggtgccgctgt

SEQ ID NO: 126611 - DNA, 25 bp, E. coli
taccctggtgtgctgcgttccttgg

SEQ ID NO: 126612 - DNA, 25 bp, E. coli
tatcctctgtcgagtgctgggttcg

SEQ ID NO: 126613 - DNA, 25 bp, E. coli
taccctggtgtggtgcgttccttgg

SEQ ID NO: 126614 - DNA, 25 bp, E. coli
tatcctctgtcgtgtgctgggttcg

SEQ ID NO: 126615 - DNA, 25 bp, E. coli
tccttggcaaagtggaggcccatgc

SEQ ID NO: 126616 - DNA, 25 bp, E. coli
tgccgccatatcctagcgcatgggt

SEQ ID NO: 126617 - DNA, 25 bp, E. coli
tccttggcaaagaggaggcccatgc

SEQ ID NO: 126618 - DNA, 25 bp, E. coli
tgccgccatatcgtagcgcatgggt

SEQ ID NO: 126619 - DNA, 25 bp, E. coli
gctgggttcgctgtattaccgccaa

SEQ ID NO: 126620 - DNA, 25 bp, E. coli
gctgggttcgctctattaccgccaa

SEQ ID NO: 126621 - DNA, 25 bp, E. coli
gaaactggctgcgaactggccactg

SEQ ID NO: 126622 - DNA, 25 bp, E. coli
gaaactggctgccaactggccactg

SEQ ID NO: 126623 - DNA, 25 bp, E. coli
tcaacggaagatcagagcgaagcac

SEQ ID NO: 126624 - DNA, 25 bp, E. coli
tcaacggaagatgagagcgaagcac

SEQ ID NO: 126625 - DNA, 25 bp, E. coli
gagcgaagcactcgaaacactgttc

SEQ ID NO: 126626 - DNA, 25 bp, E. coli
gagcgaagcactggaaacactgttc

SEQ ID NO: 126627 - DNA, 25 bp, E. coli
caagaatgtccgatccatattgcgt

SEQ ID NO: 126628 - DNA, 25 bp, E. coli
aagagcggctgttaggcactgcagc

SEQ ID NO: 126629 - DNA, 25 bp, E. coli
aagagcggctgtaaggcactgcagc

SEQ ID NO: 126630 - DNA, 25 bp, E. coli
caagaatgtccgttccatattgcgt

SEQ ID NO: 126631 - DNA, 25 bp, E. coli
agaagagcggctcttaggcactgca

SEQ ID NO: 126632 - DNA, 25 bp, E. coli
agaagagcggctgttaggcactgca

SEQ ID NO: 126633 - DNA, 25 bp, E. coli
ttaggcactgcaccgtttcgccaga

SEQ ID NO: 126634 - DNA, 25 bp, E. coli
ttaggcactgcagcgtttcgccaga

SEQ ID NO: 126635 - DNA, 25 bp, E. coli
tcaattcacgccgacggttttacca

SEQ ID NO: 126636 - DNA, 25 bp, E. coli
tcaattcacgcccacggttttacca

SEQ ID NO: 126637 - DNA, 25 bp, E. coli
ccagaaagcacactcgagaaagcgg

SEQ ID NO: 126638 - DNA, 25 bp, E. coli
ccagaaagcacagtcgagaaagcgg

SEQ ID NO: 126639 - DNA, 25 bp, E. coli
gcaattgccaagtatgtccgttcca

SEQ ID NO: 126640 - DNA, 25 bp, E. coli
gcaattgccaagaatgtccgttcca

SEQ ID NO: 126641 - DNA, 25 bp, E. coli
gaatgtccgttcgatattgcgtaat

SEQ ID NO: 126642 - DNA, 25 bp, E. coli
gaatgtccgttccatattgcgtaat

SEQ ID NO: 126643 - DNA, 25 bp, E. coli
gaaagcacactcgagaaagcggtaa

SEQ ID NO: 126644 - DNA, 25 bp, E. coli
gaaagcacactccagaaagcggtaa

SEQ ID NO: 126645 - DNA, 25 bp, E. coli
gtttatgtcaatacacgccgacggt

SEQ ID NO: 126646 - DNA, 25 bp, E. coli
gtttatgtcaattcacgccgacggt

SEQ ID NO: 126647 - DNA, 25 bp, E. coli
ggtgctggcaattgccaagaatgtc

SEQ ID NO: 126648 - DNA, 25 bp, E. coli
ggtgctggcaatagccaagaatgtc

SEQ ID NO: 126649 - DNA, 25 bp, E. coli
cagtaacgaccactgttaatggcgg

SEQ ID NO: 126650 - DNA, 25 bp, E. coli
cagtaacgaccagtgttaatggcgg

SEQ ID NO: 126651 - DNA, 25 bp, E. coli
gctgcagagttctgcggcaggctct

SEQ ID NO: 126652 - DNA, 25 bp, E. coli
gctcgttatattgctctcgggcagt

SEQ ID NO: 126653 - DNA, 25 bp, E. coli
gcattcctgggttctactgtcacca

SEQ ID NO: 126654 - DNA, 25 bp, E. coli
gctcgttatattcctctcgggcagt

SEQ ID NO: 126655 - DNA, 25 bp, E. coli
gcaggctctgcccaaaatgtcggta

SEQ ID NO: 126656 - DNA, 25 bp, E. coli
gctgcagagttcagcggcaggctct

SEQ ID NO: 126657 - DNA, 25 bp, E. coli
gcattcctgggtactactgtcacca

SEQ ID NO: 126658 - DNA, 25 bp, E. coli
gcaggctctgccgaaaatgtcggta

SEQ ID NO: 126659 - DNA, 25 bp, E. coli
gataccaatgtttccagtaatgcag

SEQ ID NO: 126660 - DNA, 25 bp, E. coli
gataccaatgttaccagtaatgcag

SEQ ID NO: 126661 - DNA, 25 bp, E. coli
ggttcgttcttctcgcctggctaaa

SEQ ID NO: 126662 - DNA, 25 bp, E. coli
ggttcgttcttcacgcctggctaaa

SEQ ID NO: 126663 - DNA, 25 bp, E. coli
tggctaaagcggctgacctcagctc

SEQ ID NO: 126664 - DNA, 25 bp, E. coli
tggctaaagcgggtgacctcagctc

SEQ ID NO: 126665 - DNA, 25 bp, E. coli
taagcgcagccgtgggtgatgaatc

SEQ ID NO: 126666 - DNA, 25 bp, E. coli
taagcgcagccgagggtgatgaatc

SEQ ID NO: 126667 - DNA, 25 bp, E. coli
ttaaaggtgaagaggtaaatgccgc

SEQ ID NO: 126668 - DNA, 25 bp, E. coli
ttaaaggtgaagtggtaaatgccgc

SEQ ID NO: 126669 - DNA, 25 bp, E. coli
gatgtcgtctgctgcggtaagcgca

SEQ ID NO: 126670 - DNA, 25 bp, E. coli
gatgtcgtctgcagcggtaagcgca

SEQ ID NO: 126671 - DNA, 25 bp, E. coli
caaaatgtggacattagcgaggcta

SEQ ID NO: 126672 - DNA, 25 bp, E. coli
caaaatgtggactttagcgaggcta

SEQ ID NO: 126673 - DNA, 25 bp, E. coli
taaaattgcatcctcattgccagag

SEQ ID NO: 126674 - DNA, 25 bp, E. coli
taaaattgcatcgtcattgccagag

SEQ ID NO: 126675 - DNA, 25 bp, E. coli
aaagctggattttgatcgcctctcg

SEQ ID NO: 126676 - DNA, 25 bp, E. coli
aactaactgctcctgtgtgaaaacc

SEQ ID NO: 126677 - DNA, 25 bp, E. coli
aactaactgctcgtgtgtgaaaacc

SEQ ID NO: 126678 - DNA, 25 bp, E. coli
aaagctggatttagatcgcctctcg

SEQ ID NO: 126679 - DNA, 25 bp, E. coli
tagatatgggaaactgtaactgctc

SEQ ID NO: 126680 - DNA, 25 bp, E. coli
tagatatgggaatctgtaactgctc

SEQ ID NO: 126681 - DNA, 25 bp, E. coli
taattcagcgtttactccagatccc

SEQ ID NO: 126682 - DNA, 25 bp, E. coli
taattcagcgttaactccagatccc

SEQ ID NO: 126683 - DNA, 25 bp, E. coli
tctggacagtgataaacaaaaggca

SEQ ID NO: 126684 - DNA, 25 bp, E. coli
tctggacagtgaaaaacaaaaggca

SEQ ID NO: 126685 - DNA, 25 bp, E. coli
tctagcacacaggaatatttccggt

SEQ ID NO: 126686 - DNA, 25 bp, E. coli
tctagcacacagcaatatttccggt

SEQ ID NO: 126687 - DNA, 25 bp, E. coli
gacaaatatgaaatgcactggcgca

SEQ ID NO: 126688 - DNA, 25 bp, E. coli
gacaaatatgaattgcactggcgca

SEQ ID NO: 126689 - DNA, 25 bp, E. coli
gacatcgtcaggttgaaaggcacga

SEQ ID NO: 126690 - DNA, 25 bp, E. coli
gacatcgtcaggatgaaaggcacga

SEQ ID NO: 126691 - DNA, 25 bp, E. coli
gatgtaccggttccagatttaagaa

SEQ ID NO: 126692 - DNA, 25 bp, E. coli
gatgtaccggttgcagatttaagaa

SEQ ID NO: 126693 - DNA, 25 bp, E. coli
aatcactggaaaccggcaacttccg

SEQ ID NO: 126694 - DNA, 25 bp, E. coli
aatcactggaaagcggcaacttccg

SEQ ID NO: 126695 - DNA, 25 bp, E. coli
caacgttgctggatcaggatgtgga

SEQ ID NO: 126696 - DNA, 25 bp, E. coli
caacgttgctggttcaggatgtgga

SEQ ID NO: 126697 - DNA, 25 bp, E. coli
cagaagggcgttatcaacatgctgc

SEQ ID NO: 126698 - DNA, 25 bp, E. coli
cagaagggcgttttcaacatgctgc

SEQ ID NO: 126699 - DNA, 25 bp, E. coli
tttacgaaggtaaaggctgtcgcac

SEQ ID NO: 126700 - DNA, 25 bp, E. coli
tttacgaaggtataggctgtcgcac

SEQ ID NO: 126701 - DNA, 25 bp, E. coli
gctcgcagaccagaccgaatgatgt

SEQ ID NO: 126702 - DNA, 25 bp, E. coli
gctcgcagaccacaccgaatgatgt

SEQ ID NO: 126703 - DNA, 25 bp, E. coli
gaattgctcgggatgagcgccaacg

SEQ ID NO: 126704 - DNA, 25 bp, E. coli
gaattgctcgggttgagcgccaacg

SEQ ID NO: 126705 - DNA, 25 bp, E. coli
cgctgacgggcaatgaaacctggca

SEQ ID NO: 126706 - DNA, 25 bp, E. coli
cgctgacgggcattgaaacctggca

SEQ ID NO: 126707 - DNA, 25 bp, E. coli
ggactacccgataaaatcctgttcg

SEQ ID NO: 126708 - DNA, 25 bp, E. coli
ggactacccgattaaatcctgttcg

SEQ ID NO: 126709 - DNA, 25 bp, E. coli
tgtggaaatcgacttcagctcgcag

SEQ ID NO: 126710 - DNA, 25 bp, E. coli
tgtggaaatcgagttcagctcgcag

SEQ ID NO: 126711 - DNA, 25 bp, E. coli
tggaaccgggccacataaagatggc

SEQ ID NO: 126712 - DNA, 25 bp, E. coli
tggaaccgggcctcataaagatggc

SEQ ID NO: 126713 - DNA, 25 bp, E. coli
tcactggcggatgaactgcggcaga

SEQ ID NO: 126714 - DNA, 25 bp, E. coli
tcactggcggatcaactgcggcaga

SEQ ID NO: 126715 - DNA, 25 bp, E. coli
caatgacaccggctgaactggctac

SEQ ID NO: 126716 - DNA, 25 bp, E. coli
caatgacaccgggtgaactggctac

SEQ ID NO: 126717 - DNA, 25 bp, E. coli
cagccgaattaaccgccacagtgaa

SEQ ID NO: 126718 - DNA, 25 bp, E. coli
cagccgaattaagcgccacagtgaa

SEQ ID NO: 126719 - DNA, 25 bp, E. coli
taacagccgaataaagcgccacagt

SEQ ID NO: 126720 - DNA, 25 bp, E. coli
accgggtgaactggctacctggctt

SEQ ID NO: 126721 - DNA, 25 bp, E. coli
accgggtgaactcgctacctggctt

SEQ ID NO: 126722 - DNA, 25 bp, E. coli
acaccgggtgaactggctacctggc

SEQ ID NO: 126723 - DNA, 25 bp, E. coli
acaccgggtgaagtggctacctggc

SEQ ID NO: 126724 - DNA, 25 bp, E. coli
tttaacagccgaattaagcgccaca

SEQ ID NO: 126725 - DNA, 25 bp, E. coli
tttaacagccgatttaagcgccaca

SEQ ID NO: 126726 - DNA, 25 bp, E. coli
tgaactggctacctggcttgcggag

SEQ ID NO: 126727 - DNA, 25 bp, E. coli
tgacaccgggtgtactggctacctg

SEQ ID NO: 126728 - DNA, 25 bp, E. coli
tgacaccgggtgaactggctacctg

SEQ ID NO: 126729 - DNA, 25 bp, E. coli
tgaactggctacgtggcttgcggag

SEQ ID NO: 126730 - DNA, 25 bp, E. coli
gcgccacagtgaacaatggcaactg

SEQ ID NO: 126731 - DNA, 25 bp, E. coli
gcgccacagtgatcaatggcaactg

SEQ ID NO: 126732 - DNA, 25 bp, E. coli
gaattaagcgcctcagtgaacaatg

SEQ ID NO: 126733 - DNA, 25 bp, E. coli
gaattaagcgccacagtgaacaatg

SEQ ID NO: 126734 - DNA, 25 bp, E. coli
taacagccgaattaagcgccacagt

SEQ ID NO: 126735 - DNA, 25 bp, E. coli
taagcgccacagagaacaatggcaa

SEQ ID NO: 126736 - DNA, 25 bp, E. coli
taagcgccacagtgaacaatggcaa

SEQ ID NO: 126737 - DNA, 25 bp, E. coli
caatgtgtccatagacggcaccgga

SEQ ID NO: 126738 - DNA, 25 bp, E. coli
caatgtgtccattgacggcaccgga

SEQ ID NO: 126739 - DNA, 25 bp, E. coli
cacgataacggtcaaggcagcaaac

SEQ ID NO: 126740 - DNA, 25 bp, E. coli
cacgataacggtgaaggcagcaaac

SEQ ID NO: 126741 - DNA, 25 bp, E. coli
tatacgtctgacaaagaacggccgg

SEQ ID NO: 126742 - DNA, 25 bp, E. coli
tatacgtctgactaagaacggccgg

SEQ ID NO: 126743 - DNA, 25 bp, E. coli
tcaggtggatacaccggaggctcac

SEQ ID NO: 126744 - DNA, 25 bp, E. coli
tcaggtggatactccggaggctcac

SEQ ID NO: 126745 - DNA, 25 bp, E. coli
cctgcatgtcaaaggcaatgtgtcc

SEQ ID NO: 126746 - DNA, 25 bp, E. coli
cctgcatgtcaatggcaatgtgtcc

SEQ ID NO: 126747 - DNA, 25 bp, E. coli
gacgttcacgatgtccgaagcggtt

SEQ ID NO: 126748 - DNA, 25 bp, E. coli
gacgttcacgatctccgaagcggtt

SEQ ID NO: 126749 - DNA, 25 bp, E. coli
gaaacctttgatcacgttgaacgcc

SEQ ID NO: 126750 - DNA, 25 bp, E. coli
gaaacctttgatgacgttgaacgcc

SEQ ID NO: 126751 - DNA, 25 bp, E. coli
cgaagcggttatagccgggatcacc

SEQ ID NO: 126752 - DNA, 25 bp, E. coli
cgaagcggttattgccgggatcacc

SEQ ID NO: 126753 - DNA, 25 bp, E. coli
gataccggcgtgtatcaccatgagg

SEQ ID NO: 126754 - DNA, 25 bp, E. coli
gatcattgtgacgtgtaagacgctg

SEQ ID NO: 126755 - DNA, 25 bp, E. coli
gataccggcgtgaatcaccatgagg

SEQ ID NO: 126756 - DNA, 25 bp, E. coli
taagacgctggagatttacgccgat

SEQ ID NO: 126757 - DNA, 25 bp, E. coli
taagacgctggacatttacgccgat

SEQ ID NO: 126758 - DNA, 25 bp, E. coli
gatcattgtgacctgtaagacgctg

SEQ ID NO: 126759 - DNA, 25 bp, E. coli
tgaaggccgtttctcgatcaaccca

SEQ ID NO: 126760 - DNA, 25 bp, E. coli
tgaaggccgtttgtcgatcaaccca

SEQ ID NO: 126761 - DNA, 25 bp, E. coli
tgaagcctggcttgatgaaggccgt

SEQ ID NO: 126762 - DNA, 25 bp, E. coli
tgaagcctggctagatgaaggccgt

SEQ ID NO: 126763 - DNA, 25 bp, E. coli
tccgccagtggagcgtattaacggc

SEQ ID NO: 126764 - DNA, 25 bp, E. coli
tccgccagtggaccgtattaacggc

SEQ ID NO: 126765 - DNA, 25 bp, E. coli
tctgtgtgaccgagatattgaagcc

SEQ ID NO: 126766 - DNA, 25 bp, E. coli
tctgtgtgaccgtgatattgaagcc

SEQ ID NO: 126767 - DNA, 25 bp, E. coli
gcgcggtagccacccgaatcgataa

SEQ ID NO: 126768 - DNA, 25 bp, E. coli
gcgcggtagccagccgaatcgataa

SEQ ID NO: 126769 - DNA, 25 bp, E. coli
gcaataaatttcgtaccttccgtgg

SEQ ID NO: 126770 - DNA, 25 bp, E. coli
gcaataaatttcctaccttccgtgg

SEQ ID NO: 126771 - DNA, 25 bp, E. coli
cgtttatcgatctgagcggtcccaa

SEQ ID NO: 126772 - DNA, 25 bp, E. coli
cgtttatcgatcagagcggtcccaa

SEQ ID NO: 126773 - DNA, 25 bp, E. coli
cttacaaccgccgtgaagatgcgaa

SEQ ID NO: 126774 - DNA, 25 bp, E. coli
cttacaaccgccctgaagatgcgaa

SEQ ID NO: 126775 - DNA, 25 bp, E. coli
cttgaccgcgtgatgagcgatgaga

SEQ ID NO: 126776 - DNA, 25 bp, E. coli
cttgaccgcgtgttgagcgatgaga

SEQ ID NO: 126777 - DNA, 25 bp, E. coli
gtcccaaagatgaagtgagcgccgc

SEQ ID NO: 126778 - DNA, 25 bp, E. coli
gtcccaaagatgtagtgagcgccgc

SEQ ID NO: 126779 - DNA, 25 bp, E. coli
gaggcgttctatgttcacccaggag

SEQ ID NO: 126780 - DNA, 25 bp, E. coli
gaggcgttctatcttcacccaggag

SEQ ID NO: 126781 - DNA, 25 bp, E. coli
aagtgcttagcgtaatcacctccag

SEQ ID NO: 126782 - DNA, 25 bp, E. coli
aagtgcttagcgaaatcacctccag

SEQ ID NO: 126783 - DNA, 25 bp, E. coli
aaagatatggtctgctcaccgggag

SEQ ID NO: 126784 - DNA, 25 bp, E. coli
aaagatatggtcagctcaccgggag

SEQ ID NO: 126785 - DNA, 25 bp, E. coli
tatgtttatcgatgcgatggccgac

SEQ ID NO: 126786 - DNA, 25 bp, E. coli
tatgtttatcgaagcgatggccgac

SEQ ID NO: 126787 - DNA, 25 bp, E. coli
taatgccgggatgacctccgtaacg

SEQ ID NO: 126788 - DNA, 25 bp, E. coli
taatgccgggatcacctccgtaacg

SEQ ID NO: 126789 - DNA, 25 bp, E. coli
tccgtaacgccatacgcgctggtaa

SEQ ID NO: 126790 - DNA, 25 bp, E. coli
tccgtaacgccaaacgcgctggtaa

SEQ ID NO: 126791 - DNA, 25 bp, E. coli
gcgtataaatttcccgctcaggcgg

SEQ ID NO: 126792 - DNA, 25 bp, E. coli
gcgtataaatttgccgctcaggcgg

SEQ ID NO: 126793 - DNA, 25 bp, E. coli
gctgggccatgagcggaaaattatc

SEQ ID NO: 126794 - DNA, 25 bp, E. coli
gcggtcaggtgcttccagggcaaat

SEQ ID NO: 126795 - DNA, 25 bp, E. coli
gctgggccatgaccggaaaattatc

SEQ ID NO: 126796 - DNA, 25 bp, E. coli
gcggtcaggtgcatccagggcaaat

SEQ ID NO: 126797 - DNA, 25 bp, E. coli
gaaaatcggttttattggctgcggc

SEQ ID NO: 126798 - DNA, 25 bp, E. coli
gaaaatcggtttaattggctgcggc

SEQ ID NO: 126799 - DNA, 25 bp, E. coli
gtaaccccagaacataccgctgatg

SEQ ID NO: 126800 - DNA, 25 bp, E. coli
gtaaccccagaagataccgctgatg

SEQ ID NO: 126801 - DNA, 25 bp, E. coli
taatgggttccggaaaaatggtgct

SEQ ID NO: 126802 - DNA, 25 bp, E. coli
taatgggttccgcaaaaatggtgct

SEQ ID NO: 126803 - DNA, 25 bp, E. coli
cacttcgcgtgacgccattgagcaa

SEQ ID NO: 126804 - DNA, 25 bp, E. coli
cacttcgcgtgaggccattgagcaa

SEQ ID NO: 126805 - DNA, 25 bp, E. coli
tgtgaatgatgacttcgataccgcg

SEQ ID NO: 126806 - DNA, 25 bp, E. coli
tgtgaatgatgagttcgataccgcg

SEQ ID NO: 126807 - DNA, 25 bp, E. coli
tgagccgccaaaagcagcgtcatga

SEQ ID NO: 126808 - DNA, 25 bp, E. coli
tgagccgccaaatgcagcgtcatga

SEQ ID NO: 126809 - DNA, 25 bp, E. coli
tcctggtgaagtgcacggtgaacat

SEQ ID NO: 126810 - DNA, 25 bp, E. coli
tcctggtgaagtccacggtgaacat

SEQ ID NO: 126811 - DNA, 25 bp, E. coli
tcaggacagcgaagaggtcattgca

SEQ ID NO: 126812 - DNA, 25 bp, E. coli
tcattgcaaagcgtatggcgcaagc

SEQ ID NO: 126813 - DNA, 25 bp, E. coli
tcattgcaaagcctatggcgcaagc

SEQ ID NO: 126814 - DNA, 25 bp, E. coli
tcaggacagcgatgaggtcattgca

SEQ ID NO: 126815 - DNA, 25 bp, E. coli
ccgcacgcgcggagtatctttattt

SEQ ID NO: 126816 - DNA, 25 bp, E. coli
ccgcacgcgcggtgtatctttattt

SEQ ID NO: 126817 - DNA, 25 bp, E. coli
cattgagcaagttctggcgaccggt

SEQ ID NO: 126818 - DNA, 25 bp, E. coli
cattgagcaagtactggcgaccggt

SEQ ID NO: 126819 - DNA, 25 bp, E. coli
gataccgcgttgtccgatttgaaga

SEQ ID NO: 126820 - DNA, 25 bp, E. coli
gatttgaagaccattattcgcgccg

SEQ ID NO: 126821 - DNA, 25 bp, E. coli
gataccgcgttgaccgatttgaaga

SEQ ID NO: 126822 - DNA, 25 bp, E. coli
gatttgaagacctttattcgcgccg

SEQ ID NO: 126823 - DNA, 25 bp, E. coli
ggtaattactatcgcacttcgcgtg

SEQ ID NO: 126824 - DNA, 25 bp, E. coli
ggtaattactatggcacttcgcgtg

SEQ ID NO: 126825 - DNA, 25 bp, E. coli
catgggctggttcccgctgttattt

SEQ ID NO: 126826 - DNA, 25 bp, E. coli
catgggctggttgccgctgttattt

SEQ ID NO: 126827 - DNA, 25 bp, E. coli
aacggcaacatttatggctggcagc

SEQ ID NO: 126828 - DNA, 25 bp, E. coli
aacggcaacattaatggctggcagc

SEQ ID NO: 126829 - DNA, 25 bp, E. coli
tttgattgcgttcgcagccagcggc

SEQ ID NO: 126830 - DNA, 25 bp, E. coli
tttgattgcgttggcagccagcggc

SEQ ID NO: 126831 - DNA, 25 bp, E. coli
tctgatttgcgcctctcctggcgcg

SEQ ID NO: 126832 - DNA, 25 bp, E. coli
tctgatttgcgcgtctcctggcgcg

SEQ ID NO: 126833 - DNA, 25 bp, E. coli
cctgtggcaatcagatttgcgcgtc

SEQ ID NO: 126834 - DNA, 25 bp, E. coli
ccgtggatgattaagagcggcatga

SEQ ID NO: 126835 - DNA, 25 bp, E. coli
cctgtggcaatctgatttgcgcgtc

SEQ ID NO: 126836 - DNA, 25 bp, E. coli
ccgtggatgatttagagcggcatga

SEQ ID NO: 126837 - DNA, 25 bp, E. coli
gctgttattttactcatgccctggc

SEQ ID NO: 126838 - DNA, 25 bp, E. coli
gctgttattttagtcatgccctggc

SEQ ID NO: 126839 - DNA, 25 bp, E. coli
gaaattcgcttgatgatggacgggc

SEQ ID NO: 126840 - DNA, 25 bp, E. coli
gaaattcgcttgttgatggacgggc

SEQ ID NO: 126841 - DNA, 25 bp, E. coli
ccgttatggatgctgttactttcgc

SEQ ID NO: 126842 - DNA, 25 bp, E. coli
ccgttatggatggtgttactttcgc

SEQ ID NO: 126843 - DNA, 25 bp, E. coli
ctttccttgctgattcatgggctgg

SEQ ID NO: 126844 - DNA, 25 bp, E. coli
ctttccttgctgtttcatgggctgg

SEQ ID NO: 126845 - DNA, 25 bp, E. coli
tggcgcgcacagaggctttccttgc

SEQ ID NO: 126846 - DNA, 25 bp, E. coli
tggcgcgcacagtggctttccttgc

SEQ ID NO: 126847 - DNA, 25 bp, E. coli
caccttcgcatgtgctactggacgc

SEQ ID NO: 126848 - DNA, 25 bp, E. coli
caccttcgcatgagctactggacgc

SEQ ID NO: 126849 - DNA, 25 bp, E. coli
catgttgcggtagtcgatgcacctt

SEQ ID NO: 126850 - DNA, 25 bp, E. coli
catgttgcggtactcgatgcacctt

SEQ ID NO: 126851 - DNA, 25 bp, E. coli
tagtcgatgcacgttcgcatgagct

SEQ ID NO: 126852 - DNA, 25 bp, E. coli
tagtcgatgcaccttcgcatgagct

SEQ ID NO: 126853 - DNA, 25 bp, E. coli
ttcgcatgagctactggacgcattg

SEQ ID NO: 126854 - DNA, 25 bp, E. coli
ttcgcatgagcttctggacgcattg

SEQ ID NO: 126855 - DNA, 25 bp, E. coli
tgttgcggtagtcgatgcaccttcg

SEQ ID NO: 126856 - DNA, 25 bp, E. coli
tgttgcggtagtggatgcaccttcg

SEQ ID NO: 126857 - DNA, 25 bp, E. coli
tgcaccttcgcaagagctactggac

SEQ ID NO: 126858 - DNA, 25 bp, E. coli
tgcaccttcgcatgagctactggac

SEQ ID NO: 126859 - DNA, 25 bp, E. coli
ccttcgcatgagctactggacgcat

SEQ ID NO: 126860 - DNA, 25 bp, E. coli
gcatgagctactggacgcattgcat

SEQ ID NO: 126861 - DNA, 25 bp, E. coli
ccttcgcatgaggtactggacgcat

SEQ ID NO: 126862 - DNA, 25 bp, E. coli
gcatgagctactcgacgcattgcat

SEQ ID NO: 126863 - DNA, 25 bp, E. coli
gcggtagtcgatgcaccttcgcatg

SEQ ID NO: 126864 - DNA, 25 bp, E. coli
gcggtagtcgatccaccttcgcatg

SEQ ID NO: 126865 - DNA, 25 bp, E. coli
ggtagtcgatgcaccttcgcatgag

SEQ ID NO: 126866 - DNA, 25 bp, E. coli
ggtagtcgatgctccttcgcatgag

SEQ ID NO: 126867 - DNA, 25 bp, E. coli
gatgcaccttcggatgagctactgg

SEQ ID NO: 126868 - DNA, 25 bp, E. coli
gatgcaccttcgcatgagctactgg

SEQ ID NO: 126869 - DNA, 25 bp, E. coli
caattgattttacgtctggagcttc

SEQ ID NO: 126870 - DNA, 25 bp, E. coli
caattgattttaggtctggagcttc

SEQ ID NO: 126871 - DNA, 25 bp, E. coli
tacttctggcagcaatcgttacgga

SEQ ID NO: 126872 - DNA, 25 bp, E. coli
tacttctggcaggaatcgttacgga

SEQ ID NO: 126873 - DNA, 25 bp, E. coli
tacacgataccgtccgttcaggtgc

SEQ ID NO: 126874 - DNA, 25 bp, E. coli
tacacgataccgaccgttcaggtgc

SEQ ID NO: 126875 - DNA, 25 bp, E. coli
tatgttggtttctctggtcgcgcac

SEQ ID NO: 126876 - DNA, 25 bp, E. coli
tatgttggtttcactggtcgcgcac

SEQ ID NO: 126877 - DNA, 25 bp, E. coli
tattggctggctggtgcttctggtt

SEQ ID NO: 126878 - DNA, 25 bp, E. coli
tattggctggctcgtgcttctggtt

SEQ ID NO: 126879 - DNA, 25 bp, E. coli
tatttgctggcatccttccttcccg

SEQ ID NO: 126880 - DNA, 25 bp, E. coli
tatttgctggcaaccttccttcccg

SEQ ID NO: 126881 - DNA, 25 bp, E. coli
tgattaacgccatcgtcggcgctat

SEQ ID NO: 126882 - DNA, 25 bp, E. coli
tgattaacgccaacgtcggcgctat

SEQ ID NO: 126883 - DNA, 25 bp, E. coli
tggtcgcgcacgacgtaaagagtac

SEQ ID NO: 126884 - DNA, 25 bp, E. coli
tcgtcggcgctattatcaatgtcat

SEQ ID NO: 126885 - DNA, 25 bp, E. coli
tcgtcggcgctaatatcaatgtcat

SEQ ID NO: 126886 - DNA, 25 bp, E. coli
gcttgctatccgacgcttacacgat

SEQ ID NO: 126887 - DNA, 25 bp, E. coli
gcttgctatccgtcgcttacacgat

SEQ ID NO: 126888 - DNA, 25 bp, E. coli
gttcaggtgcctcggccttgctctt

SEQ ID NO: 126889 - DNA, 25 bp, E. coli
gttcaggtgcctgggccttgctctt

SEQ ID NO: 126890 - DNA, 25 bp, E. coli
tggtcgcgcacgtcgtaaagagtac

SEQ ID NO: 126891 - DNA, 25 bp, E. coli
caaaagctggatatgcgtcgctcac

SEQ ID NO: 126892 - DNA, 25 bp, E. coli
caaaagctggatttgcgtcgctcac

SEQ ID NO: 126893 - DNA, 25 bp, E. coli
catttccataatctgctggcgcagg

SEQ ID NO: 126894 - DNA, 25 bp, E. coli
caggtttctccgtctccgtacaggt

SEQ ID NO: 126895 - DNA, 25 bp, E. coli
caggtttctccgactccgtacaggt

SEQ ID NO: 126896 - DNA, 25 bp, E. coli
aaagcatcgtgctggtacgcggtcg

SEQ ID NO: 126897 - DNA, 25 bp, E. coli
aaatcgcgtggcaatcgtggtcagg

SEQ ID NO: 126898 - DNA, 25 bp, E. coli
aaatcgcgtggctatcgtggtcagg

SEQ ID NO: 126899 - DNA, 25 bp, E. coli
aaagcatcgtgcaggtacgcggtcg

SEQ ID NO: 126900 - DNA, 25 bp, E. coli
tataacgtgtgtccgcaccgtggtc

SEQ ID NO: 126901 - DNA, 25 bp, E. coli
tataacgtgtgtgcgcaccgtggtc

SEQ ID NO: 126902 - DNA, 25 bp, E. coli
tccggtgcgtctcgaagaatatgcc

SEQ ID NO: 126903 - DNA, 25 bp, E. coli
tccggtgcgtctggaagaatatgcc

SEQ ID NO: 126904 - DNA, 25 bp, E. coli
gaagtccacgatctgaaactggcgg

SEQ ID NO: 126905 - DNA, 25 bp, E. coli
gaagtccacgatgtgaaactggcgg

SEQ ID NO: 126906 - DNA, 25 bp, E. coli
catttccataatgtgctggcgcagg

SEQ ID NO: 126907 - DNA, 25 bp, E. coli
gatcgttactggcacaccatgcacg

SEQ ID NO: 126908 - DNA, 25 bp, E. coli
gttaaccgacgaccaaaaatcgctg

SEQ ID NO: 126909 - DNA, 25 bp, E. coli
gatcgttactgggacaccatgcacg

SEQ ID NO: 126910 - DNA, 25 bp, E. coli
gttaaccgacgagcaaaaatcgctg

SEQ ID NO: 126911 - DNA, 25 bp, E. coli
gagccctgactttgtactacccgaa

SEQ ID NO: 126912 - DNA, 25 bp, E. coli
gagccctgacttagtactacccgaa

SEQ ID NO: 126913 - DNA, 25 bp, E. coli
caagcctgatggatgttactgtgct

SEQ ID NO: 126914 - DNA, 25 bp, E. coli
caatcagctgttcgaaaatggcaag

SEQ ID NO: 126915 - DNA, 25 bp, E. coli
caagcggattaaaatgccatggcgg

SEQ ID NO: 126916 - DNA, 25 bp, E. coli
caatcagctgttggaaaatggcaag

SEQ ID NO: 126917 - DNA, 25 bp, E. coli
caagcggattaatatgccatggcgg

SEQ ID NO: 126918 - DNA, 25 bp, E. coli
caccggaccaaaccaatcagctgtt

SEQ ID NO: 126919 - DNA, 25 bp, E. coli
caagcctgatggttgttactgtgct

SEQ ID NO: 126920 - DNA, 25 bp, E. coli
caccggaccaaagcaatcagctgtt

SEQ ID NO: 126921 - DNA, 25 bp, E. coli
cgtctttgctggactggttgttggt

SEQ ID NO: 126922 - DNA, 25 bp, E. coli
cgtctttgctggtctggttgttggt

SEQ ID NO: 126923 - DNA, 25 bp, E. coli
actgtgcttgtgctggcgtctttgc

SEQ ID NO: 126924 - DNA, 25 bp, E. coli
actgtgcttgtggtggcgtctttgc

SEQ ID NO: 126925 - DNA, 25 bp, E. coli
tctggttgttggataatcgcgaaaa

SEQ ID NO: 126926 - DNA, 25 bp, E. coli
tctggttgttggttaatcgcgaaaa

SEQ ID NO: 126927 - DNA, 25 bp, E. coli
ccatggcggcttagagccgcacgca

SEQ ID NO: 126928 - DNA, 25 bp, E. coli
ccatggcggctttgagccgcacgca

SEQ ID NO: 126929 - DNA, 25 bp, E. coli
ctgttcgaaaatcgcaagcggatta

SEQ ID NO: 126930 - DNA, 25 bp, E. coli
ctgttcgaaaatggcaagcggatta

SEQ ID NO: 126931 - DNA, 25 bp, E. coli
gtgcaagcagggtaacaccggacca

SEQ ID NO: 126932 - DNA, 25 bp, E. coli
gtgcaagcagggaaacaccggacca

SEQ ID NO: 126933 - DNA, 25 bp, E. coli
taatcgcgaaaatcattatgcctga

SEQ ID NO: 126934 - DNA, 25 bp, E. coli
taatcgcgaaaaacattatgcctga

SEQ ID NO: 126935 - DNA, 25 bp, E. coli
tactgggaatatgattgagtgtgca

SEQ ID NO: 126936 - DNA, 25 bp, E. coli
tactgggaatatcattgagtgtgca

SEQ ID NO: 126937 - DNA, 25 bp, E. coli
gtttaaagtcggtagtcgtcattat

SEQ ID NO: 126938 - DNA, 25 bp, E. coli
gtttaaagtcggaagtcgtcattat

SEQ ID NO: 126939 - DNA, 25 bp, E. coli
aaatagcgcttccagggaagtcatc

SEQ ID NO: 126940 - DNA, 25 bp, E. coli
aaatagcgcttcgagggaagtcatc

SEQ ID NO: 126941 - DNA, 25 bp, E. coli
tattgtgcaaagtgctccctgtgga

SEQ ID NO: 126942 - DNA, 25 bp, E. coli
tattgtgcaaagagctccctgtgga

SEQ ID NO: 126943 - DNA, 25 bp, E. coli
tgcagacttgcatgagacgaccaac

SEQ ID NO: 126944 - DNA, 25 bp, E. coli
tgcagacttgcaagagacgaccaac

SEQ ID NO: 126945 - DNA, 25 bp, E. coli
tccctgtggattgaccaatgtcggg

SEQ ID NO: 126946 - DNA, 25 bp, E. coli
tccctgtggattcaccaatgtcggg

SEQ ID NO: 126947 - DNA, 25 bp, E. coli
tctcaccgccgaaaaaattgaaaat

SEQ ID NO: 126948 - DNA, 25 bp, E. coli
tctcaccgccgataaaattgaaaat

SEQ ID NO: 126949 - DNA, 25 bp, E. coli
gacgaccaacgccattaaagttcat

SEQ ID NO: 126950 - DNA, 25 bp, E. coli
gacgaccaacgcgattaaagttcat

SEQ ID NO: 126951 - DNA, 25 bp, E. coli
gggaacaacgtgcaacatatatact

SEQ ID NO: 126952 - DNA, 25 bp, E. coli
gggaacaacgtggaacatatatact

SEQ ID NO: 126953 - DNA, 25 bp, E. coli
taatttccccttagaatctgacggt

SEQ ID NO: 126954 - DNA, 25 bp, E. coli
taatttcccctttgaatctgacggt

SEQ ID NO: 126955 - DNA, 25 bp, E. coli
gagtatgaaaggtaatctcaccgcc

SEQ ID NO: 126956 - DNA, 25 bp, E. coli
gagtatgaaaggaaatctcaccgcc

SEQ ID NO: 126957 - DNA, 25 bp, E. coli
taaaccgagccgagtggatgcaaaa

SEQ ID NO: 126958 - DNA, 25 bp, E. coli
taaaccgagccgtgtggatgcaaaa

SEQ ID NO: 126959 - DNA, 25 bp, E. coli
ttgcagggtgaatcgcttggctctc

SEQ ID NO: 126960 - DNA, 25 bp, E. coli
ttgcagggtgaaacgcttggctctc

SEQ ID NO: 126961 - DNA, 25 bp, E. coli
tgtgcctgtggctgaaacgcgtctt

SEQ ID NO: 126962 - DNA, 25 bp, E. coli
tgtgcctgtggcagaaacgcgtctt

SEQ ID NO: 126963 - DNA, 25 bp, E. coli
tgaggaaatcaagcgcgaccatgtg

SEQ ID NO: 126964 - DNA, 25 bp, E. coli
tgaggaaatcaaccgcgaccatgtg

SEQ ID NO: 126965 - DNA, 25 bp, E. coli
tgctgtgaccaagaaaaaagccgtc

SEQ ID NO: 126966 - DNA, 25 bp, E. coli
tgctgtgaccaacaaaaaagccgtc

SEQ ID NO: 126967 - DNA, 25 bp, E. coli
tcgatgccagcgctttcaaggaagg

SEQ ID NO: 126968 - DNA, 25 bp, E. coli
tcgatgccagcggtttcaaggaagg

SEQ ID NO: 126969 - DNA, 25 bp, E. coli
tcagtgtgccagttgagatcccggc

SEQ ID NO: 126970 - DNA, 25 bp, E. coli
tctggcagaagacgaacgttccact

SEQ ID NO: 126971 - DNA, 25 bp, E. coli
tcagtgtgccagatgagatcccggc

SEQ ID NO: 126972 - DNA, 25 bp, E. coli
tctggcagaagaggaacgttccact

SEQ ID NO: 126973 - DNA, 25 bp, E. coli
ccgtcagtgacgtagcaaagcaagc

SEQ ID NO: 126974 - DNA, 25 bp, E. coli
ccgtcagtgacgaagcaaagcaagc

SEQ ID NO: 126975 - DNA, 25 bp, E. coli
gtaaaacaaccccaacctgtgcctg

SEQ ID NO: 126976 - DNA, 25 bp, E. coli
gtaaaacaacccgaacctgtgcctg

SEQ ID NO: 126977 - DNA, 25 bp, E. coli
tgcccgccttactggaagaagagct

SEQ ID NO: 126978 - DNA, 25 bp, E. coli
tgcccgccttacaggaagaagagct

SEQ ID NO: 126979 - DNA, 25 bp, E. coli
taaaatcccacatttctgaagccga

SEQ ID NO: 126980 - DNA, 25 bp, E. coli
taaaatcccacaattctgaagccga

SEQ ID NO: 126981 - DNA, 25 bp, E. coli
atctgccacggacacatgcctgcta

SEQ ID NO: 126982 - DNA, 25 bp, E. coli
atctgccacggagacatgcctgcta

SEQ ID NO: 126983 - DNA, 25 bp, E. coli
tatcttcctgttcgtgcacatctgc

SEQ ID NO: 126984 - DNA, 25 bp, E. coli
tatcttcctgttggtgcacatctgc

SEQ ID NO: 126985 - DNA, 25 bp, E. coli
ttttcgtgcgccacagtatggctgg

SEQ ID NO: 126986 - DNA, 25 bp, E. coli
ttttcgtgcgcctcagtatggctgg

SEQ ID NO: 126987 - DNA, 25 bp, E. coli
tgaggcagatatgcttcaagaggcg

SEQ ID NO: 126988 - DNA, 25 bp, E. coli
tgacctggaccgattctgtatatct

SEQ ID NO: 126989 - DNA, 25 bp, E. coli
tgacctggaccgtttctgtatatct

SEQ ID NO: 126990 - DNA, 25 bp, E. coli
tgaacgctgatcgtctgacctggac

SEQ ID NO: 126991 - DNA, 25 bp, E. coli
tgaggcagatatccttcaagaggcg

SEQ ID NO: 126992 - DNA, 25 bp, E. coli
tgaacgctgatcctctgacctggac

SEQ ID NO: 126993 - DNA, 25 bp, E. coli
tctgttctgtaccatcgatgaggca

SEQ ID NO: 126994 - DNA, 25 bp, E. coli
tctgttctgtacgatcgatgaggca

SEQ ID NO: 126995 - DNA, 25 bp, E. coli
gaagccgacccggaaattaagcagg

SEQ ID NO: 126996 - DNA, 25 bp, E. coli
gaagccgacccgcaaattaagcagg

SEQ ID NO: 126997 - DNA, 25 bp, E. coli
gtatggctggtttcactatctgttc

SEQ ID NO: 126998 - DNA, 25 bp, E. coli
gtatggctggttacactatctgttc

SEQ ID NO: 126999 - DNA, 25 bp, E. coli
tcaagaggcgtaactgcgtcgcggt

SEQ ID NO: 127000 - DNA, 25 bp, E. coli
tcaagaggcgtatctgcgtcgcggt

SEQ ID NO: 127001 - DNA, 25 bp, E. coli
aatggcatcattggacgttctaacg

SEQ ID NO: 127002 - DNA, 25 bp, E. coli
aatggcatcattcgacgttctaacg

SEQ ID NO: 127003 - DNA, 25 bp, E. coli
caacagtctttttaatgtatttacg

SEQ ID NO: 127004 - DNA, 25 bp, E. coli
caacagtcttttaaatgtatttacg

SEQ ID NO: 127005 - DNA, 25 bp, E. coli
cattcgacgttctaacggatttagt

SEQ ID NO: 127006 - DNA, 25 bp, E. coli
cattcgacgttcaaacggatttagt

SEQ ID NO: 127007 - DNA, 25 bp, E. coli
tttaatgtattttcgaatggcatca

SEQ ID NO: 127008 - DNA, 25 bp, E. coli
tttaatgtatttacgaatggcatca

SEQ ID NO: 127009 - DNA, 25 bp, E. coli
ttacgaatggcaacattcgacgttc

SEQ ID NO: 127010 - DNA, 25 bp, E. coli
ttacgaatggcatcattcgacgttc

SEQ ID NO: 127011 - DNA, 25 bp, E. coli
tctaacggattttgtcgatggtggg

SEQ ID NO: 127012 - DNA, 25 bp, E. coli
tctaacggatttagtcgatggtggg

SEQ ID NO: 127013 - DNA, 25 bp, E. coli
gcatcattcgacgttctaacggatt

SEQ ID NO: 127014 - DNA, 25 bp, E. coli
gcatcattcgaccttctaacggatt

SEQ ID NO: 127015 - DNA, 25 bp, E. coli
gacgttctaacgcatttagtcgatg

SEQ ID NO: 127016 - DNA, 25 bp, E. coli
gacgttctaacggatttagtcgatg

SEQ ID NO: 127017 - DNA, 25 bp, E. coli
cgttctaacggatttagtcgatggt

SEQ ID NO: 127018 - DNA, 25 bp, E. coli
cgttctaacggaattagtcgatggt

SEQ ID NO: 127019 - DNA, 25 bp, E. coli
gtatttacgaatggcatcattcgac

SEQ ID NO: 127020 - DNA, 25 bp, E. coli
gtatttacgaatcgcatcattcgac

SEQ ID NO: 127021 - DNA, 25 bp, E. coli
tggcatcattcgacgttctaacgga

SEQ ID NO: 127022 - DNA, 25 bp, E. coli
tggcatcattcgtcgttctaacgga

SEQ ID NO: 127023 - DNA, 25 bp, E. coli
caaggagctgttgccctcgttgatg

SEQ ID NO: 127024 - DNA, 25 bp, E. coli
caaggagctgttcccctcgttgatg

SEQ ID NO: 127025 - DNA, 25 bp, E. coli
cattacaaggagctgttcccctcgt

SEQ ID NO: 127026 - DNA, 25 bp, E. coli
tacccacctcataaccaggttgatg

SEQ ID NO: 127027 - DNA, 25 bp, E. coli
tacccacctcattaccaggttgatg

SEQ ID NO: 127028 - DNA, 25 bp, E. coli
ttatagggatacgattacaaggagc

SEQ ID NO: 127029 - DNA, 25 bp, E. coli
ttatagggataccattacaaggagc

SEQ ID NO: 127030 - DNA, 25 bp, E. coli
gctgttcccctcgttgatgtcgcgg

SEQ ID NO: 127031 - DNA, 25 bp, E. coli
gcggtttacccagctcattaccagg

SEQ ID NO: 127032 - DNA, 25 bp, E. coli
gctgttcccctccttgatgtcgcgg

SEQ ID NO: 127033 - DNA, 25 bp, E. coli
gcggtttacccacctcattaccagg

SEQ ID NO: 127034 - DNA, 25 bp, E. coli
cctcgttgatgtggcggtttaccca

SEQ ID NO: 127035 - DNA, 25 bp, E. coli
cctcgttgatgtcgcggtttaccca

SEQ ID NO: 127036 - DNA, 25 bp, E. coli
cattacaaggaggtgttcccctcgt

SEQ ID NO: 127037 - DNA, 25 bp, E. coli
cattaccaggttgatgacctgatgg

SEQ ID NO: 127038 - DNA, 25 bp, E. coli
cattaccaggttcatgacctgatgg

SEQ ID NO: 127039 - DNA, 25 bp, E. coli
gataccattacaaggagctgttccc

SEQ ID NO: 127040 - DNA, 25 bp, E. coli
gataccattacatggagctgttccc

SEQ ID NO: 127041 - DNA, 25 bp, E. coli
gatgatattgataatagggatacca

SEQ ID NO: 127042 - DNA, 25 bp, E. coli
gatgtcgcggtttacccacctcatt

SEQ ID NO: 127043 - DNA, 25 bp, E. coli
gatgtcgcggttaacccacctcatt

SEQ ID NO: 127044 - DNA, 25 bp, E. coli
gatgatattgattatagggatacca

SEQ ID NO: 127045 - DNA, 25 bp, E. coli
cagtgccaacttcagtggattgcca

SEQ ID NO: 127046 - DNA, 25 bp, E. coli
catccgttggtgcttgctttgtgcc

SEQ ID NO: 127047 - DNA, 25 bp, E. coli
catccgttggtggttgctttgtgcc

SEQ ID NO: 127048 - DNA, 25 bp, E. coli
cagtgccaacttgagtggattgcca

SEQ ID NO: 127049 - DNA, 25 bp, E. coli
taaatccttcagtaatccgcgatgc

SEQ ID NO: 127050 - DNA, 25 bp, E. coli
taaatccttcagaaatccgcgatgc

SEQ ID NO: 127051 - DNA, 25 bp, E. coli
ttgacgggccgcattgattcgcttg

SEQ ID NO: 127052 - DNA, 25 bp, E. coli
ttgacgggccgctttgattcgcttg

SEQ ID NO: 127053 - DNA, 25 bp, E. coli
tgccctgacgggagaactgtttcga

SEQ ID NO: 127054 - DNA, 25 bp, E. coli
tgccctgacgggtgaactgtttcga

SEQ ID NO: 127055 - DNA, 25 bp, E. coli
gaagaacgtgtcatcgcctatccaa

SEQ ID NO: 127056 - DNA, 25 bp, E. coli
gaagaacgtgtcttcgcctatccaa

SEQ ID NO: 127057 - DNA, 25 bp, E. coli
gaaaccattttttcccgctggccag

SEQ ID NO: 127058 - DNA, 25 bp, E. coli
gaacagtagacgaagttcgcgcaca

SEQ ID NO: 127059 - DNA, 25 bp, E. coli
gaaaccatttttacccgctggccag

SEQ ID NO: 127060 - DNA, 25 bp, E. coli
gaacagtagacgtagttcgcgcaca

SEQ ID NO: 127061 - DNA, 25 bp, E. coli
gattcgcttgctgtacgagtcaccg

SEQ ID NO: 127062 - DNA, 25 bp, E. coli
gatcctgatagccaaacagcagtga

SEQ ID NO: 127063 - DNA, 25 bp, E. coli
gattcgcttgctctacgagtcaccg

SEQ ID NO: 127064 - DNA, 25 bp, E. coli
ggattgccaccttgtcgaacagtag

SEQ ID NO: 127065 - DNA, 25 bp, E. coli
ggattgccacctagtcgaacagtag

SEQ ID NO: 127066 - DNA, 25 bp, E. coli
gatcctgatagcgaaacagcagtga

SEQ ID NO: 127067 - DNA, 25 bp, E. coli
caggcggcgttcaggaacgtatccg

SEQ ID NO: 127068 - DNA, 25 bp, E. coli
caggcggcgttctggaacgtatccg

SEQ ID NO: 127069 - DNA, 25 bp, E. coli
atctggcggcggctatcgggaatcg

SEQ ID NO: 127070 - DNA, 25 bp, E. coli
atctggcggcgggtatcgggaatcg

SEQ ID NO: 127071 - DNA, 25 bp, E. coli
aaaaatcctgaatcgctccggcata

SEQ ID NO: 127072 - DNA, 25 bp, E. coli
aaaaatcctgaaacgctccggcata

SEQ ID NO: 127073 - DNA, 25 bp, E. coli
tatcgctgacgaactggttaccgga

SEQ ID NO: 127074 - DNA, 25 bp, E. coli
tatcgctgacgatctggttaccgga

SEQ ID NO: 127075 - DNA, 25 bp, E. coli
tggtaccggaaataaccatctggcg

SEQ ID NO: 127076 - DNA, 25 bp, E. coli
tggtaccggaaaaaaccatctggcg

SEQ ID NO: 127077 - DNA, 25 bp, E. coli
gctggcgcccgattgttggtcagcc

SEQ ID NO: 127078 - DNA, 25 bp, E. coli
gctggcgcccgaatgttggtcagcc

SEQ ID NO: 127079 - DNA, 25 bp, E. coli
gaatcgctccgggatacagccgttg

SEQ ID NO: 127080 - DNA, 25 bp, E. coli
gaatcgctccggcatacagccgttg

SEQ ID NO: 127081 - DNA, 25 bp, E. coli
cgacaggcggcgttctggaacgtat

SEQ ID NO: 127082 - DNA, 25 bp, E. coli
cgaaatctatcggtgacgaactggt

SEQ ID NO: 127083 - DNA, 25 bp, E. coli
cgacaggcggcgatctggaacgtat

SEQ ID NO: 127084 - DNA, 25 bp, E. coli
cgaaatctatcgctgacgaactggt

SEQ ID NO: 127085 - DNA, 25 bp, E. coli
ggttaccggatggacaaatttcgcg

SEQ ID NO: 127086 - DNA, 25 bp, E. coli
ggttaccggatgcacaaatttcgcg

SEQ ID NO: 127087 - DNA, 25 bp, E. coli
gatgcacaaatttcgcgttcagcgg

SEQ ID NO: 127088 - DNA, 25 bp, E. coli
gatgcacaaattacgcgttcagcgg

SEQ ID NO: 127089 - DNA, 25 bp, E. coli
tacgtgtcgaagtaggcaccctgaa

SEQ ID NO: 127090 - DNA, 25 bp, E. coli
tacgtgtcgaagaaggcaccctgaa

SEQ ID NO: 127091 - DNA, 25 bp, E. coli
aacttttgtgcacgcattgacgggc

SEQ ID NO: 127092 - DNA, 25 bp, E. coli
aacttttgtgcaggcattgacgggc

SEQ ID NO: 127093 - DNA, 25 bp, E. coli
ttgggcacaacacaaatcgcctccg

SEQ ID NO: 127094 - DNA, 25 bp, E. coli
ttgggcacaacagaaatcgcctccg

SEQ ID NO: 127095 - DNA, 25 bp, E. coli
tgtcgcggcggtgactgattcatgc

SEQ ID NO: 127096 - DNA, 25 bp, E. coli
tgtcgcggcggtcactgattcatgc

SEQ ID NO: 127097 - DNA, 25 bp, E. coli
tgacacgcgttctgatgcggcaggc

SEQ ID NO: 127098 - DNA, 25 bp, E. coli
tgacacgcgttcagatgcggcaggc

SEQ ID NO: 127099 - DNA, 25 bp, E. coli
tccgaacaagaacatggcacagatc

SEQ ID NO: 127100 - DNA, 25 bp, E. coli
tccgaacaagaagatggcacagatc

SEQ ID NO: 127101 - DNA, 25 bp, E. coli
gacgggcaggtaagtctggcaaaca

SEQ ID NO: 127102 - DNA, 25 bp, E. coli
cattacgcaggactggagtatcgct

SEQ ID NO: 127103 - DNA, 25 bp, E. coli
cattacgcaggagtggagtatcgct

SEQ ID NO: 127104 - DNA, 25 bp, E. coli
gattacctccgaggttgacacgcgt

SEQ ID NO: 127105 - DNA, 25 bp, E. coli
gattacctccgacgttgacacgcgt

SEQ ID NO: 127106 - DNA, 25 bp, E. coli
tgagctaaacgttggctcgacccaa

SEQ ID NO: 127107 - DNA, 25 bp, E. coli
tgagctaaacgtaggctcgacccaa

SEQ ID NO: 127108 - DNA, 25 bp, E. coli
tggcgacaatttgcatatcggcggc

SEQ ID NO: 127109 - DNA, 25 bp, E. coli
tggcgacaatttccatatcggcggc

SEQ ID NO: 127110 - DNA, 25 bp, E. coli
gacgggcaggtatgtctggcaaaca

SEQ ID NO: 127111 - DNA, 25 bp, E. coli
cagttgaaagaacatattggcgaag

SEQ ID NO: 127112 - DNA, 25 bp, E. coli
cagttgaaagaagatattggcgaag

SEQ ID NO: 127113 - DNA, 25 bp, E. coli
attgacggcggttgcgcaccggaaa

SEQ ID NO: 127114 - DNA, 25 bp, E. coli
attgacggcggtagcgcaccggaaa

SEQ ID NO: 127115 - DNA, 25 bp, E. coli
ttatgatgactacccataacatgcc

SEQ ID NO: 127116 - DNA, 25 bp, E. coli
ttatgatgactagccataacatgcc

SEQ ID NO: 127117 - DNA, 25 bp, E. coli
tcgccgagatgtttatgatgactac

SEQ ID NO: 127118 - DNA, 25 bp, E. coli
tcgacgccacggatatggggctaaa

SEQ ID NO: 127119 - DNA, 25 bp, E. coli
tcgtcggcttttactacccgatgac

SEQ ID NO: 127120 - DNA, 25 bp, E. coli
tcgccgagatgtatatgatgactac

SEQ ID NO: 127121 - DNA, 25 bp, E. coli
tcgacgccacggttatggggctaaa

SEQ ID NO: 127122 - DNA, 25 bp, E. coli
tcgtcggctttttctacccgatgac

SEQ ID NO: 127123 - DNA, 25 bp, E. coli
tctgtgttggcattagcatgatggg

SEQ ID NO: 127124 - DNA, 25 bp, E. coli
tctgtgttggcaatagcatgatggg

SEQ ID NO: 127125 - DNA, 25 bp, E. coli
gccggatatcgtgggcttttactac

SEQ ID NO: 127126 - DNA, 25 bp, E. coli
gccggatatcgtcggcttttactac

SEQ ID NO: 127127 - DNA, 25 bp, E. coli
gaagatattggcgaagtgattttcc

SEQ ID NO: 127128 - DNA, 25 bp, E. coli
gaagatattggccaagtgattttcc

SEQ ID NO: 127129 - DNA, 25 bp, E. coli
gactgacgttttactctgtgttggc

SEQ ID NO: 127130 - DNA, 25 bp, E. coli
gactgacgtttttctctgtgttggc

SEQ ID NO: 127131 - DNA, 25 bp, E. coli
cgttttactctgagttggcaatagc

SEQ ID NO: 127132 - DNA, 25 bp, E. coli
cgttttactctgtgttggcaatagc

SEQ ID NO: 127133 - DNA, 25 bp, E. coli
caaagaacgctgctaactgagggag

SEQ ID NO: 127134 - DNA, 25 bp, E. coli
caaagaacgctggtaactgagggag

SEQ ID NO: 127135 - DNA, 25 bp, E. coli
catgccggaggtattgtcagcttcg

SEQ ID NO: 127136 - DNA, 25 bp, E. coli
catttacgtttaaggtccgccccag

SEQ ID NO: 127137 - DNA, 25 bp, E. coli
catttacgtttatggtccgccccag

SEQ ID NO: 127138 - DNA, 25 bp, E. coli
catgccggaggttttgtcagcttcg

SEQ ID NO: 127139 - DNA, 25 bp, E. coli
tacaactggcggttgtcgtcaagct

SEQ ID NO: 127140 - DNA, 25 bp, E. coli
tacaactggcggatgtcgtcaagct

SEQ ID NO: 127141 - DNA, 25 bp, E. coli
tatcgatctcgctcaacgttgcgga

SEQ ID NO: 127142 - DNA, 25 bp, E. coli
tatcgatctcgcacaacgttgcgga

SEQ ID NO: 127143 - DNA, 25 bp, E. coli
tttactgcgatgtcggagatccggc

SEQ ID NO: 127144 - DNA, 25 bp, E. coli
ttttttagagacgacagacttgccc

SEQ ID NO: 127145 - DNA, 25 bp, E. coli
ttttttagagaccacagacttgccc

SEQ ID NO: 127146 - DNA, 25 bp, E. coli
tttactgcgatgacggagatccggc

SEQ ID NO: 127147 - DNA, 25 bp, E. coli
tccacggtgcttctcgatctgaacg

SEQ ID NO: 127148 - DNA, 25 bp, E. coli
tccacggtgcttgtcgatctgaacg

SEQ ID NO: 127149 - DNA, 25 bp, E. coli
tctgaagcaagatgaatggcaccgg

SEQ ID NO: 127150 - DNA, 25 bp, E. coli
tctgaagcaagaagaatggcaccgg

SEQ ID NO: 127151 - DNA, 25 bp, E. coli
tcaagctctcggtagaagaatggcg

SEQ ID NO: 127152 - DNA, 25 bp, E. coli
tcaagctctcggaagaagaatggcg

SEQ ID NO: 127153 - DNA, 25 bp, E. coli
gatgcgttcgttgccgggttactca

SEQ ID NO: 127154 - DNA, 25 bp, E. coli
gatgcgttcgttcccgggttactca

SEQ ID NO: 127155 - DNA, 25 bp, E. coli
catctgcgggtctgtgccacagttg

SEQ ID NO: 127156 - DNA, 25 bp, E. coli
catctgcgggtcagtgccacagttg

SEQ ID NO: 127157 - DNA, 25 bp, E. coli
caggcgagcatttgccatctgcggg

SEQ ID NO: 127158 - DNA, 25 bp, E. coli
catttgctggcattttacttcacac

SEQ ID NO: 127159 - DNA, 25 bp, E. coli
caggcgagcattagccatctgcggg

SEQ ID NO: 127160 - DNA, 25 bp, E. coli
actggttattgcaacaattatccgg

SEQ ID NO: 127161 - DNA, 25 bp, E. coli
actggttattgctacaattatccgg

SEQ ID NO: 127162 - DNA, 25 bp, E. coli
tgatgccactggttattgcaacaat

SEQ ID NO: 127163 - DNA, 25 bp, E. coli
tgatgccactggatattgcaacaat

SEQ ID NO: 127164 - DNA, 25 bp, E. coli
tgcattctgtactgccttttaccga

SEQ ID NO: 127165 - DNA, 25 bp, E. coli
tgcattctgtacagccttttaccga

SEQ ID NO: 127166 - DNA, 25 bp, E. coli
tgccttttaccgtcaggtgcaagaa

SEQ ID NO: 127167 - DNA, 25 bp, E. coli
tgccttttaccgacaggtgcaagaa

SEQ ID NO: 127168 - DNA, 25 bp, E. coli
gccagtccagcagcgccggtggtat

SEQ ID NO: 127169 - DNA, 25 bp, E. coli
ccacagttgatgtagaatgttcgca

SEQ ID NO: 127170 - DNA, 25 bp, E. coli
gccagtccagcaccgccggtggtat

SEQ ID NO: 127171 - DNA, 25 bp, E. coli
ccacagttgatgaagaatgttcgca

SEQ ID NO: 127172 - DNA, 25 bp, E. coli
catttgctggcaatttacttcacac

SEQ ID NO: 127173 - DNA, 25 bp, E. coli
ggtgcaagaacaaattactgagcgt

SEQ ID NO: 127174 - DNA, 25 bp, E. coli
ggtgcaagaacatattactgagcgt

SEQ ID NO: 127175 - DNA, 25 bp, E. coli
gaccactggccggatttgctggcat

SEQ ID NO: 127176 - DNA, 25 bp, E. coli
gaccactggccgcatttgctggcat

SEQ ID NO: 127177 - DNA, 25 bp, E. coli
aatatctgcaggacgtctgacacag

SEQ ID NO: 127178 - DNA, 25 bp, E. coli
caatatctgcaggtcgtctgacaca

SEQ ID NO: 127179 - DNA, 25 bp, E. coli
caatatctgcagctcgtctgacaca

SEQ ID NO: 127180 - DNA, 25 bp, E. coli
aatgacggaagaatgggtgtcatgc

SEQ ID NO: 127181 - DNA, 25 bp, E. coli
aatatctgcaggtcgtctgacacag

SEQ ID NO: 127182 - DNA, 25 bp, E. coli
aatgacggaagattgggtgtcatgc

SEQ ID NO: 127183 - DNA, 25 bp, E. coli
agaaatgacggatgaatgggtgtca

SEQ ID NO: 127184 - DNA, 25 bp, E. coli
atggcaatatctccaggtcgtctga

SEQ ID NO: 127185 - DNA, 25 bp, E. coli
agaaatgacggaagaatgggtgtca

SEQ ID NO: 127186 - DNA, 25 bp, E. coli
atggcaatatctgcaggtcgtctga

SEQ ID NO: 127187 - DNA, 25 bp, E. coli
tatctgcaggtcctctgacacagat

SEQ ID NO: 127188 - DNA, 25 bp, E. coli
tatctgcaggtcgtctgacacagat

SEQ ID NO: 127189 - DNA, 25 bp, E. coli
gctgccggagaattgacggaagaat

SEQ ID NO: 127190 - DNA, 25 bp, E. coli
gctgccggagaaatgacggaagaat

SEQ ID NO: 127191 - DNA, 25 bp, E. coli
ctgcaggtcgtcagacacagatgat

SEQ ID NO: 127192 - DNA, 25 bp, E. coli
ctgcaggtcgtctgacacagatgat

SEQ ID NO: 127193 - DNA, 25 bp, E. coli
ctgccggagaaatgacggaagaatg

SEQ ID NO: 127194 - DNA, 25 bp, E. coli
ctgccggagaaaagacggaagaatg

SEQ ID NO: 127195 - DNA, 25 bp, E. coli
ggaagaatgggtgtcatgcgggaaa

SEQ ID NO: 127196 - DNA, 25 bp, E. coli
ggcaatatctgcaggtcgtctgaca

SEQ ID NO: 127197 - DNA, 25 bp, E. coli
ggcaatatctgctggtcgtctgaca

SEQ ID NO: 127198 - DNA, 25 bp, E. coli
ggaagaatgggtctcatgcgggaaa

SEQ ID NO: 127199 - DNA, 25 bp, E. coli
aatccttgtgggtgggttgatccgc

SEQ ID NO: 127200 - DNA, 25 bp, E. coli
aatccttgtgggagggttgatccgc

SEQ ID NO: 127201 - DNA, 25 bp, E. coli
acgaacagagaaacgctgcgaccgg

SEQ ID NO: 127202 - DNA, 25 bp, E. coli
acgaacagagaatcgctgcgaccgg

SEQ ID NO: 127203 - DNA, 25 bp, E. coli
tatggcgaaggccatgagtcctatg

SEQ ID NO: 127204 - DNA, 25 bp, E. coli
tatggcgaaggcgatgagtcctatg

SEQ ID NO: 127205 - DNA, 25 bp, E. coli
tatttgccaccaaatgctagggcag

SEQ ID NO: 127206 - DNA, 25 bp, E. coli
tatttgccaccatatgctagggcag

SEQ ID NO: 127207 - DNA, 25 bp, E. coli
tttatctagggacgaacacgttcta

SEQ ID NO: 127208 - DNA, 25 bp, E. coli
tttatctagggaggaacacgttcta

SEQ ID NO: 127209 - DNA, 25 bp, E. coli
tgttagtgggcaaacgggtttcctg

SEQ ID NO: 127210 - DNA, 25 bp, E. coli
tgttagtgggcatacgggtttcctg

SEQ ID NO: 127211 - DNA, 25 bp, E. coli
gcgaaaattggacgagaagcatacg

SEQ ID NO: 127212 - DNA, 25 bp, E. coli
gcgaaaattggaggagaagcatacg

SEQ ID NO: 127213 - DNA, 25 bp, E. coli
gaagcatacgaaccactaggacgtt

SEQ ID NO: 127214 - DNA, 25 bp, E. coli
gaagcggaaatagctcatgccataa

SEQ ID NO: 127215 - DNA, 25 bp, E. coli
gaagcggaaatacctcatgccataa

SEQ ID NO: 127216 - DNA, 25 bp, E. coli
gaagcatacgaagcactaggacgtt

SEQ ID NO: 127217 - DNA, 25 bp, E. coli
cgggcaccggataagtgaagagact

SEQ ID NO: 127218 - DNA, 25 bp, E. coli
cgggcaccggattagtgaagagact

SEQ ID NO: 127219 - DNA, 25 bp, E. coli
gatccgctgggaatggctgcaagtt

SEQ ID NO: 127220 - DNA, 25 bp, E. coli
gatccgctgggattggctgcaagtt

SEQ ID NO: 127221 - DNA, 25 bp, E. coli
tacggaagaggtatcaaatgcgttt

SEQ ID NO: 127222 - DNA, 25 bp, E. coli
attttgcaagattttgtaggtcggg

SEQ ID NO: 127223 - DNA, 25 bp, E. coli
attttgcaagatattgtaggtcggg

SEQ ID NO: 127224 - DNA, 25 bp, E. coli
tacggaagaggtttcaaatgcgttt

SEQ ID NO: 127225 - DNA, 25 bp, E. coli
ttttacggaagaggtatcaaatgcg

SEQ ID NO: 127226 - DNA, 25 bp, E. coli
ttttacggaagacgtatcaaatgcg

SEQ ID NO: 127227 - DNA, 25 bp, E. coli
tttacggaagaggtatcaaatgcgt

SEQ ID NO: 127228 - DNA, 25 bp, E. coli
ttgtaggtcgggtaaagcgttcacg

SEQ ID NO: 127229 - DNA, 25 bp, E. coli
tttacggaagagctatcaaatgcgt

SEQ ID NO: 127230 - DNA, 25 bp, E. coli
ttgtaggtcgggaaaagcgttcacg

SEQ ID NO: 127231 - DNA, 25 bp, E. coli
tgcaagattttgaaggtcgggtaaa

SEQ ID NO: 127232 - DNA, 25 bp, E. coli
gcaagattttgtaggtcgggtaaag

SEQ ID NO: 127233 - DNA, 25 bp, E. coli
tgcaagattttgtaggtcgggtaaa

SEQ ID NO: 127234 - DNA, 25 bp, E. coli
gcaagattttgttggtcgggtaaag

SEQ ID NO: 127235 - DNA, 25 bp, E. coli
cggaagaggtatgaaatgcgtttaa

SEQ ID NO: 127236 - DNA, 25 bp, E. coli
cggaagaggtatcaaatgcgtttaa

SEQ ID NO: 127237 - DNA, 25 bp, E. coli
tgtaggtcgggtaaagcgttcacgc

SEQ ID NO: 127238 - DNA, 25 bp, E. coli
tgtaggtcgggttaagcgttcacgc

SEQ ID NO: 127239 - DNA, 25 bp, E. coli
ggaagaggtatctaatgcgtttaat

SEQ ID NO: 127240 - DNA, 25 bp, E. coli
ggaagaggtatcaaatgcgtttaat

SEQ ID NO: 127241 - DNA, 25 bp, E. coli
gaggtatcaaatgcgtttaattgtg

SEQ ID NO: 127242 - DNA, 25 bp, E. coli
gaggtatcaaatccgtttaattgtg

SEQ ID NO: 127243 - DNA, 25 bp, E. coli
caaacaaaaacagatgcgttacgga

SEQ ID NO: 127244 - DNA, 25 bp, E. coli
caaacaaaaacacatgcgttacgga

SEQ ID NO: 127245 - DNA, 25 bp, E. coli
tactcttcaggctgttaaatgggca

SEQ ID NO: 127246 - DNA, 25 bp, E. coli
taaacatggtttggtcagcatagca

SEQ ID NO: 127247 - DNA, 25 bp, E. coli
tacagttgctaaacacgctgacgca

SEQ ID NO: 127248 - DNA, 25 bp, E. coli
tactcttcaggcagttaaatgggca

SEQ ID NO: 127249 - DNA, 25 bp, E. coli
tacagttgctaatcacgctgacgca

SEQ ID NO: 127250 - DNA, 25 bp, E. coli
taaacatggtttcgtcagcatagca

SEQ ID NO: 127251 - DNA, 25 bp, E. coli
tgttgtgcggataaacacctgctat

SEQ ID NO: 127252 - DNA, 25 bp, E. coli
tgttgtgcggattaacacctgctat

SEQ ID NO: 127253 - DNA, 25 bp, E. coli
tcgatagcgcgtggaaatttggttt

SEQ ID NO: 127254 - DNA, 25 bp, E. coli
tcgatagcgcgtcgaaatttggttt

SEQ ID NO: 127255 - DNA, 25 bp, E. coli
gataatgatccgtctacagcatgac

SEQ ID NO: 127256 - DNA, 25 bp, E. coli
gataatgatccgactacagcatgac

SEQ ID NO: 127257 - DNA, 25 bp, E. coli
ggcggcgagaaatagagaagttact

SEQ ID NO: 127258 - DNA, 25 bp, E. coli
ggcggcgagaaaaagagaagttact

SEQ ID NO: 127259 - DNA, 25 bp, E. coli
taatggagtggcctttcgatagcgc

SEQ ID NO: 127260 - DNA, 25 bp, E. coli
taatggagtggcgtttcgatagcgc

SEQ ID NO: 127261 - DNA, 25 bp, E. coli
tcaaattgcagctaatggagtggcg

SEQ ID NO: 127262 - DNA, 25 bp, E. coli
tcaaattgcagcaaatggagtggcg

SEQ ID NO: 127263 - DNA, 25 bp, E. coli
gagacactctaaccctttgcttgct

SEQ ID NO: 127264 - DNA, 25 bp, E. coli
gagacactctaagcctttgcttgct

SEQ ID NO: 127265 - DNA, 25 bp, E. coli
caagaggacaaaaaatcaccttgcg

SEQ ID NO: 127266 - DNA, 25 bp, E. coli
caagaggacaaataatcaccttgcg

SEQ ID NO: 127267 - DNA, 25 bp, E. coli
agcgcaagaggagaaaaaatcacct

SEQ ID NO: 127268 - DNA, 25 bp, E. coli
agcgcaagaggacaaaaaatcacct

SEQ ID NO: 127269 - DNA, 25 bp, E. coli
tagcgcaagaggacaaaaaatcacc

SEQ ID NO: 127270 - DNA, 25 bp, E. coli
tagcgcaagaggtcaaaaaatcacc

SEQ ID NO: 127271 - DNA, 25 bp, E. coli
ttagcgcaagagcacaaaaaatcac

SEQ ID NO: 127272 - DNA, 25 bp, E. coli
ttagcgcaagaggacaaaaaatcac

SEQ ID NO: 127273 - DNA, 25 bp, E. coli
tgtctcaggtcactaatcacatcta

SEQ ID NO: 127274 - DNA, 25 bp, E. coli
tgtttgatgacaaaaaattagcgca

SEQ ID NO: 127275 - DNA, 25 bp, E. coli
tgtctcaggtcagtaatcacatcta

SEQ ID NO: 127276 - DNA, 25 bp, E. coli
tgtttgatgacataaaattagcgca

SEQ ID NO: 127277 - DNA, 25 bp, E. coli
tctgtctcaggtgactaatcacatc

SEQ ID NO: 127278 - DNA, 25 bp, E. coli
tctgtctcaggtcactaatcacatc

SEQ ID NO: 127279 - DNA, 25 bp, E. coli
gctctgtctcagctcactaatcaca

SEQ ID NO: 127280 - DNA, 25 bp, E. coli
gctctgtctcaggtcactaatcaca

SEQ ID NO: 127281 - DNA, 25 bp, E. coli
cgcaagaggacataaaatcaccttg

SEQ ID NO: 127282 - DNA, 25 bp, E. coli
cgcaagaggacaaaaaatcaccttg

SEQ ID NO: 127283 - DNA, 25 bp, E. coli
gtttgatgacaataaattagcgcaa

SEQ ID NO: 127284 - DNA, 25 bp, E. coli
gtctcaggtcacaaatcacatctaa

SEQ ID NO: 127285 - DNA, 25 bp, E. coli
gtctcaggtcactaatcacatctaa

SEQ ID NO: 127286 - DNA, 25 bp, E. coli
gtttgatgacaaaaaattagcgcaa

SEQ ID NO: 127287 - DNA, 25 bp, E. coli
atcccggcggatcggatatattacc

SEQ ID NO: 127288 - DNA, 25 bp, E. coli
atcccggcggatgggatatattacc

SEQ ID NO: 127289 - DNA, 25 bp, E. coli
aacacagctgaatcccggcggatgg

SEQ ID NO: 127290 - DNA, 25 bp, E. coli
aacacagctgaaacccggcggatgg

SEQ ID NO: 127291 - DNA, 25 bp, E. coli
tattacccggtggtatttatagtga

SEQ ID NO: 127292 - DNA, 25 bp, E. coli
tattacccggtgctatttatagtga

SEQ ID NO: 127293 - DNA, 25 bp, E. coli
tgctgttttctgacaacaaaataac

SEQ ID NO: 127294 - DNA, 25 bp, E. coli
tgctgttttctgtcaacaaaataac

SEQ ID NO: 127295 - DNA, 25 bp, E. coli
tgctggaacacacctgaatcccggc

SEQ ID NO: 127296 - DNA, 25 bp, E. coli
tgctggaacacagctgaatcccggc

SEQ ID NO: 127297 - DNA, 25 bp, E. coli
gaatcccggcggatgggatatatta

SEQ ID NO: 127298 - DNA, 25 bp, E. coli
gaatcccggcggttgggatatatta

SEQ ID NO: 127299 - DNA, 25 bp, E. coli
ctggaacacagctgaatcccggcgg

SEQ ID NO: 127300 - DNA, 25 bp, E. coli
cggatgggatatattacccggtgct

SEQ ID NO: 127301 - DNA, 25 bp, E. coli
cttcttcttaaccagaaaagaatct

SEQ ID NO: 127302 - DNA, 25 bp, E. coli
ctggaacacagcagaatcccggcgg

SEQ ID NO: 127303 - DNA, 25 bp, E. coli
cggcggatgggatatattacccggt

SEQ ID NO: 127304 - DNA, 25 bp, E. coli
cggatgggatattttacccggtgct

SEQ ID NO: 127305 - DNA, 25 bp, E. coli
cggcggatgggaaatattacccggt

SEQ ID NO: 127306 - DNA, 25 bp, E. coli
cttcttcttaacgagaaaagaatct

SEQ ID NO: 127307 - DNA, 25 bp, E. coli
gatgggatatataacccggtgctat

SEQ ID NO: 127308 - DNA, 25 bp, E. coli
gatgggatatattacccggtgctat

SEQ ID NO: 127309 - DNA, 25 bp, E. coli
aaatcaatatcgttcgtggtcagcc

SEQ ID NO: 127310 - DNA, 25 bp, E. coli
aaatcaatatcgatcgtggtcagcc

SEQ ID NO: 127311 - DNA, 25 bp, E. coli
tgacgcatgcgggagtgttaatgga

SEQ ID NO: 127312 - DNA, 25 bp, E. coli
tgacgcatgcggcagtgttaatgga

SEQ ID NO: 127313 - DNA, 25 bp, E. coli
tcgttcgtggtcagccagtatctgg

SEQ ID NO: 127314 - DNA, 25 bp, E. coli
tcgttcgtggtctgccagtatctgg

SEQ ID NO: 127315 - DNA, 25 bp, E. coli
gcgggagtgttaatggacgatgagc

SEQ ID NO: 127316 - DNA, 25 bp, E. coli
gcgggagtgttattggacgatgagc

SEQ ID NO: 127317 - DNA, 25 bp, E. coli
gaagatttacccgataatgcattaa

SEQ ID NO: 127318 - DNA, 25 bp, E. coli
gaagatttaccccataatgcattaa

SEQ ID NO: 127319 - DNA, 25 bp, E. coli
gcatgcgggagtgttaatggacgat

SEQ ID NO: 127320 - DNA, 25 bp, E. coli
gcatgcgggagtcttaatggacgat

SEQ ID NO: 127321 - DNA, 25 bp, E. coli
cgcatgcgggagagttaatggacga

SEQ ID NO: 127322 - DNA, 25 bp, E. coli
cgcatgcgggagtgttaatggacga

SEQ ID NO: 127323 - DNA, 25 bp, E. coli
gtcagccagtatctggtggacgtct

SEQ ID NO: 127324 - DNA, 25 bp, E. coli
gtgaagatttaccccataatgcatt

SEQ ID NO: 127325 - DNA, 25 bp, E. coli
gggtgaagattttccccataatgca

SEQ ID NO: 127326 - DNA, 25 bp, E. coli
ggtgaagatttagcccataatgcat

SEQ ID NO: 127327 - DNA, 25 bp, E. coli
gtgaagatttacgccataatgcatt

SEQ ID NO: 127328 - DNA, 25 bp, E. coli
gtcagccagtatgtggtggacgtct

SEQ ID NO: 127329 - DNA, 25 bp, E. coli
ggtgaagatttaccccataatgcat

SEQ ID NO: 127330 - DNA, 25 bp, E. coli
gggtgaagatttaccccataatgca

SEQ ID NO: 127331 - DNA, 25 bp, E. coli
cacattggtgagaatataggcatca

SEQ ID NO: 127332 - DNA, 25 bp, E. coli
cacattggtgagtatataggcatca

SEQ ID NO: 127333 - DNA, 25 bp, E. coli
tataggcatcaatcaacccgggact

SEQ ID NO: 127334 - DNA, 25 bp, E. coli
tatacaattcttcgccctgcctggc

SEQ ID NO: 127335 - DNA, 25 bp, E. coli
tattcaggcaaaatcagtgatcgct

SEQ ID NO: 127336 - DNA, 25 bp, E. coli
tatacaattcttggccctgcctggc

SEQ ID NO: 127337 - DNA, 25 bp, E. coli
tataggcatcaaacaacccgggact

SEQ ID NO: 127338 - DNA, 25 bp, E. coli
tattcaggcaaattcagtgatcgct

SEQ ID NO: 127339 - DNA, 25 bp, E. coli
tgatcgctgcgatgaaagcctgtga

SEQ ID NO: 127340 - DNA, 25 bp, E. coli
tgatcgctgcgaagaaagcctgtga

SEQ ID NO: 127341 - DNA, 25 bp, E. coli
cctaaaaccattccgcagggctgcg

SEQ ID NO: 127342 - DNA, 25 bp, E. coli
cctaaaaccattgcgcagggctgcg

SEQ ID NO: 127343 - DNA, 25 bp, E. coli
gctgcggatgcatttgaggcttctg

SEQ ID NO: 127344 - DNA, 25 bp, E. coli
gagcttacctcacgcaatgaaccat

SEQ ID NO: 127345 - DNA, 25 bp, E. coli
gctgcggatgcaattgaggcttctg

SEQ ID NO: 127346 - DNA, 25 bp, E. coli
gagcttacctcaggcaatgaaccat

SEQ ID NO: 127347 - DNA, 25 bp, E. coli
gaatcatgcagctctgaagcaggcc

SEQ ID NO: 127348 - DNA, 25 bp, E. coli
gaatcatgcagcactgaagcaggcc

SEQ ID NO: 127349 - DNA, 25 bp, E. coli
gaaagcctgtgatgttaaacgtctg

SEQ ID NO: 127350 - DNA, 25 bp, E. coli
gaaagcctgtgaagttaaacgtctg

SEQ ID NO: 127351 - DNA, 25 bp, E. coli
gaggcttctggagtggaatatacaa

SEQ ID NO: 127352 - DNA, 25 bp, E. coli
gaggcttctggactggaatatacaa

SEQ ID NO: 127353 - DNA, 25 bp, E. coli
caagccgtgacatacctcgtctttt

SEQ ID NO: 127354 - DNA, 25 bp, E. coli
caagccgtgacaaacctcgtctttt

SEQ ID NO: 127355 - DNA, 25 bp, E. coli
accagacagtcattcttcttgcccg

SEQ ID NO: 127356 - DNA, 25 bp, E. coli
agtcattcttcttgcccgtcgctga

SEQ ID NO: 127357 - DNA, 25 bp, E. coli
agtcattcttctagcccgtcgctga

SEQ ID NO: 127358 - DNA, 25 bp, E. coli
accagacagtcaatcttcttgcccg

SEQ ID NO: 127359 - DNA, 25 bp, E. coli
tatgtcttgcgcacaagccgtgaca

SEQ ID NO: 127360 - DNA, 25 bp, E. coli
tatgtcttgcgctcaagccgtgaca

SEQ ID NO: 127361 - DNA, 25 bp, E. coli
tgtcttgcgcactagccgtgacaaa

SEQ ID NO: 127362 - DNA, 25 bp, E. coli
tgtcttgcgcacaagccgtgacaaa

SEQ ID NO: 127363 - DNA, 25 bp, E. coli
tgcgatatgtcttgcgcacaagccg

SEQ ID NO: 127364 - DNA, 25 bp, E. coli
tgcgatatgtctagcgcacaagccg

SEQ ID NO: 127365 - DNA, 25 bp, E. coli
tgcccgtcgctgtttgctgcgatat

SEQ ID NO: 127366 - DNA, 25 bp, E. coli
tgcccgtcgctgattgctgcgatat

SEQ ID NO: 127367 - DNA, 25 bp, E. coli
tcttcttgcccgtcgctgattgctg

SEQ ID NO: 127368 - DNA, 25 bp, E. coli
tcttcttgcccgacgctgattgctg

SEQ ID NO: 127369 - DNA, 25 bp, E. coli
gctgattgctgccatatgtcttgcg

SEQ ID NO: 127370 - DNA, 25 bp, E. coli
gctgattgctgcgatatgtcttgcg

SEQ ID NO: 127371 - DNA, 25 bp, E. coli
gcacaagccgtgacaaacctcgtct

SEQ ID NO: 127372 - DNA, 25 bp, E. coli
gcacaagccgtgtcaaacctcgtct

SEQ ID NO: 127373 - DNA, 25 bp, E. coli
gacaaacctcgtctttttgcagtaa

SEQ ID NO: 127374 - DNA, 25 bp, E. coli
gacaaacctcgtgtttttgcagtaa

SEQ ID NO: 127375 - DNA, 25 bp, E. coli
aatcgccgtattacgctggaagagg

SEQ ID NO: 127376 - DNA, 25 bp, E. coli
aatcgccgtatttcgctggaagagg

SEQ ID NO: 127377 - DNA, 25 bp, E. coli
caaacggcggcatcgctgtgtaacc

SEQ ID NO: 127378 - DNA, 25 bp, E. coli
caaacggcggcaacgctgtgtaacc

SEQ ID NO: 127379 - DNA, 25 bp, E. coli
accggcggacatgacatctctctga

SEQ ID NO: 127380 - DNA, 25 bp, E. coli
accggcggacatcacatctctctga

SEQ ID NO: 127381 - DNA, 25 bp, E. coli
acgtactcggcgcatgaagccaccg

SEQ ID NO: 127382 - DNA, 25 bp, E. coli
acgtactcggcggatgaagccaccg

SEQ ID NO: 127383 - DNA, 25 bp, E. coli
acagtttgtttatgaccccgctggc

SEQ ID NO: 127384 - DNA, 25 bp, E. coli
acagtttgtttaagaccccgctggc

SEQ ID NO: 127385 - DNA, 25 bp, E. coli
tgcatttaccgctgcacagtttgtt

SEQ ID NO: 127386 - DNA, 25 bp, E. coli
tgcatttaccgcagcacagtttgtt

SEQ ID NO: 127387 - DNA, 25 bp, E. coli
ccggcatattgatgggcagggcatt

SEQ ID NO: 127388 - DNA, 25 bp, E. coli
ccggcatattgaagggcagggcatt

SEQ ID NO: 127389 - DNA, 25 bp, E. coli
gacaacgccggtctagtggatatcg

SEQ ID NO: 127390 - DNA, 25 bp, E. coli
gagccatgtgctcgatgagccaacc

SEQ ID NO: 127391 - DNA, 25 bp, E. coli
gacaacgccggtgtagtggatatcg

SEQ ID NO: 127392 - DNA, 25 bp, E. coli
gagccatgtgctggatgagccaacc

SEQ ID NO: 127393 - DNA, 25 bp, E. coli
ggacccgcgtatatccatcaacgtg

SEQ ID NO: 127394 - DNA, 25 bp, E. coli
ggatctgctgcatctggacaacgcc

SEQ ID NO: 127395 - DNA, 25 bp, E. coli
ggacccgcgtatttccatcaacgtg

SEQ ID NO: 127396 - DNA, 25 bp, E. coli
ggatctgctgcaactggacaacgcc

SEQ ID NO: 127397 - DNA, 25 bp, E. coli
caaaaacgctttcccgaggccgatg

SEQ ID NO: 127398 - DNA, 25 bp, E. coli
caaaaacgctttgccgaggccgatg

SEQ ID NO: 127399 - DNA, 25 bp, E. coli
caggcgcgcgtctgtttgaaagtac

SEQ ID NO: 127400 - DNA, 25 bp, E. coli
caggcgcgcgtcagtttgaaagtac

SEQ ID NO: 127401 - DNA, 25 bp, E. coli
tatcgtcattatcagtgtcggtggc

SEQ ID NO: 127402 - DNA, 25 bp, E. coli
tatgacctggatgatcctctgcctg

SEQ ID NO: 127403 - DNA, 25 bp, E. coli
tatgacctggatcatcctctgcctg

SEQ ID NO: 127404 - DNA, 25 bp, E. coli
tatcgtcattatgagtgtcggtggc

SEQ ID NO: 127405 - DNA, 25 bp, E. coli
tttcctcgcggtcagctggactgac

SEQ ID NO: 127406 - DNA, 25 bp, E. coli
tttcctcgcggtgagctggactgac

SEQ ID NO: 127407 - DNA, 25 bp, E. coli
tcgtctggaaactgttcggctggct

SEQ ID NO: 127408 - DNA, 25 bp, E. coli
tcgcctggcgatgaacgaaaaactt

SEQ ID NO: 127409 - DNA, 25 bp, E. coli
tcgtctggaaacagttcggctggct

SEQ ID NO: 127410 - DNA, 25 bp, E. coli
tcgcctggcgatcaacgaaaaactt

SEQ ID NO: 127411 - DNA, 25 bp, E. coli
gcggcgacgatcctttacaccttta

SEQ ID NO: 127412 - DNA, 25 bp, E. coli
gcggcgacgatcgtttacaccttta

SEQ ID NO: 127413 - DNA, 25 bp, E. coli
gaaagtacctttggcatgagctacg

SEQ ID NO: 127414 - DNA, 25 bp, E. coli
gaaagtacctttcgcatgagctacg

SEQ ID NO: 127415 - DNA, 25 bp, E. coli
cggaaaaccgcgagctgggcttagt

SEQ ID NO: 127416 - DNA, 25 bp, E. coli
cggaaaaccgcgtgctgggcttagt

SEQ ID NO: 127417 - DNA, 25 bp, E. coli
tggctattagcacaccgatgttggt

SEQ ID NO: 127418 - DNA, 25 bp, E. coli
tggctattagcagaccgatgttggt

SEQ ID NO: 127419 - DNA, 25 bp, E. coli
tatcattactggagccggtagtcgg

SEQ ID NO: 127420 - DNA, 25 bp, E. coli
tatcattactggtgccggtagtcgg

SEQ ID NO: 127421 - DNA, 25 bp, E. coli
ttacttttggcgaacggctgcacgg

SEQ ID NO: 127422 - DNA, 25 bp, E. coli
ttacttttggcgtacggctgcacgg

SEQ ID NO: 127423 - DNA, 25 bp, E. coli
tgggcgagtggcaatatcttcaaca

SEQ ID NO: 127424 - DNA, 25 bp, E. coli
tgggcgagtggctatatcttcaaca

SEQ ID NO: 127425 - DNA, 25 bp, E. coli
ccggcaatctttttcgtggcacgac

SEQ ID NO: 127426 - DNA, 25 bp, E. coli
ccggcaatctttatcgtggcacgac

SEQ ID NO: 127427 - DNA, 25 bp, E. coli
gctatgaaacatggcgtgtcgcacc

SEQ ID NO: 127428 - DNA, 25 bp, E. coli
gctatgaaacatcgcgtgtcgcacc

SEQ ID NO: 127429 - DNA, 25 bp, E. coli
cgatggctccggtaaaatgattcac

SEQ ID NO: 127430 - DNA, 25 bp, E. coli
cgatggctccggaaaaatgattcac

SEQ ID NO: 127431 - DNA, 25 bp, E. coli
ctttatgttgacactggcagcggca

SEQ ID NO: 127432 - DNA, 25 bp, E. coli
ctttatgttgactctggcagcggca

SEQ ID NO: 127433 - DNA, 25 bp, E. coli
cattctggcgttcatgtatctggca

SEQ ID NO: 127434 - DNA, 25 bp, E. coli
cattctggcgttgatgtatctggca

SEQ ID NO: 127435 - DNA, 25 bp, E. coli
ggtacgctgcttcgacgctatgaaa

SEQ ID NO: 127436 - DNA, 25 bp, E. coli
ggtacgctgcttggacgctatgaaa

SEQ ID NO: 127437 - DNA, 25 bp, E. coli
ggcacgaccaaaagtaccgctgaat

SEQ ID NO: 127438 - DNA, 25 bp, E. coli
ggcacgaccaaatgtaccgctgaat

SEQ ID NO: 127439 - DNA, 25 bp, E. coli
taatgtctctggtcgtctggagcgc

SEQ ID NO: 127440 - DNA, 25 bp, E. coli
taatgtctctggacgtctggagcgc

SEQ ID NO: 127441 - DNA, 25 bp, E. coli
gatgaaggtttatgggacaccctga

SEQ ID NO: 127442 - DNA, 25 bp, E. coli
gatgaaggtttaagggacaccctga

SEQ ID NO: 127443 - DNA, 25 bp, E. coli
aaagtactgaagtctctgcgccgca

SEQ ID NO: 127444 - DNA, 25 bp, E. coli
aaagtactgaagactctgcgccgca

SEQ ID NO: 127445 - DNA, 25 bp, E. coli
aaaccggcacgcctagtcatggaga

SEQ ID NO: 127446 - DNA, 25 bp, E. coli
aaaccggcacgcgtagtcatggaga

SEQ ID NO: 127447 - DNA, 25 bp, E. coli
tagactccattagtgaggcgtgggc

SEQ ID NO: 127448 - DNA, 25 bp, E. coli
tagactccattactgaggcgtgggc

SEQ ID NO: 127449 - DNA, 25 bp, E. coli
tatccgtctgcaacctgatgaaggc

SEQ ID NO: 127450 - DNA, 25 bp, E. coli
tataccaaagttctccgcgaggcgc

SEQ ID NO: 127451 - DNA, 25 bp, E. coli
tatccgtctgcatcctgatgaaggc

SEQ ID NO: 127452 - DNA, 25 bp, E. coli
tataccaaagttgtccgcgaggcgc

SEQ ID NO: 127453 - DNA, 25 bp, E. coli
ttttcggcgcgataggcgaccttgc

SEQ ID NO: 127454 - DNA, 25 bp, E. coli
ttgataaagccggtcagatgcgcga

SEQ ID NO: 127455 - DNA, 25 bp, E. coli
ttttcggcgcgaaaggcgaccttgc

SEQ ID NO: 127456 - DNA, 25 bp, E. coli
ttgataaagccgctcagatgcgcga

SEQ ID NO: 127457 - DNA, 25 bp, E. coli
tcgacattgataactggcgctgggc

SEQ ID NO: 127458 - DNA, 25 bp, E. coli
tcgacattgatatctggcgctgggc

SEQ ID NO: 127459 - DNA, 25 bp, E. coli
tctcggcgcgatgctggatcaaaaa

SEQ ID NO: 127460 - DNA, 25 bp, E. coli
tacttcgaggagagccaggtttacc

SEQ ID NO: 127461 - DNA, 25 bp, E. coli
tacttcgaggagtgccaggtttacc

SEQ ID NO: 127462 - DNA, 25 bp, E. coli
tctcggcgcgatcctggatcaaaaa

SEQ ID NO: 127463 - DNA, 25 bp, E. coli
cattggacgcgtggcgaagttcttt

SEQ ID NO: 127464 - DNA, 25 bp, E. coli
catccggaatacattggacgcgtcg

SEQ ID NO: 127465 - DNA, 25 bp, E. coli
cattggacgcgtcgcgaagttcttt

SEQ ID NO: 127466 - DNA, 25 bp, E. coli
catccggaatactttggacgcgtcg

SEQ ID NO: 127467 - DNA, 25 bp, E. coli
tacattggacgcgtcgcgaagttct

SEQ ID NO: 127468 - DNA, 25 bp, E. coli
tacattggacgcctcgcgaagttct

SEQ ID NO: 127469 - DNA, 25 bp, E. coli
atccggaatacaatggacgcgtcgc

SEQ ID NO: 127470 - DNA, 25 bp, E. coli
atccggaatacattggacgcgtcgc

SEQ ID NO: 127471 - DNA, 25 bp, E. coli
acattggacgcgacgcgaagttctt

SEQ ID NO: 127472 - DNA, 25 bp, E. coli
acattggacgcgtcgcgaagttctt

SEQ ID NO: 127473 - DNA, 25 bp, E. coli
tccggaatacattggacgcgtcgcg

SEQ ID NO: 127474 - DNA, 25 bp, E. coli
tccggaatacataggacgcgtcgcg

SEQ ID NO: 127475 - DNA, 25 bp, E. coli
ccggaatacattggacgcgtcgcga

SEQ ID NO: 127476 - DNA, 25 bp, E. coli
ccggaatacattcgacgcgtcgcga

SEQ ID NO: 127477 - DNA, 25 bp, E. coli
gcatccggaatagattggacgcgtc

SEQ ID NO: 127478 - DNA, 25 bp, E. coli
gcatccggaatacattggacgcgtc

SEQ ID NO: 127479 - DNA, 25 bp, E. coli
gaatacattggaggcgtcgcgaagt

SEQ ID NO: 127480 - DNA, 25 bp, E. coli
gaatacattggacgcgtcgcgaagt

SEQ ID NO: 127481 - DNA, 25 bp, E. coli
cggaatacattgcacgcgtcgcgaa

SEQ ID NO: 127482 - DNA, 25 bp, E. coli
cggaatacattggacgcgtcgcgaa

SEQ ID NO: 127483 - DNA, 25 bp, E. coli
ggaatacattggtcgcgtcgcgaag

SEQ ID NO: 127484 - DNA, 25 bp, E. coli
ggaatacattggacgcgtcgcgaag

SEQ ID NO: 127485 - DNA, 25 bp, E. coli
aaggcgcgaaagtctatggttaccg

SEQ ID NO: 127486 - DNA, 25 bp, E. coli
aaggcgcgaaagactatggttaccg

SEQ ID NO: 127487 - DNA, 25 bp, E. coli
cacgtgaagcgacgctggactgcaa

SEQ ID NO: 127488 - DNA, 25 bp, E. coli
cacgtgaagcgaggctggactgcaa

SEQ ID NO: 127489 - DNA, 25 bp, E. coli
tacggccactatgcgtgtgaacggt

SEQ ID NO: 127490 - DNA, 25 bp, E. coli
tacggccactatccgtgtgaacggt

SEQ ID NO: 127491 - DNA, 25 bp, E. coli
tatcgagtttgtcgcggataccggc

SEQ ID NO: 127492 - DNA, 25 bp, E. coli
tatcgagtttgtggcggataccggc

SEQ ID NO: 127493 - DNA, 25 bp, E. coli
tgacgaaggcctcgagcagtgaacc

SEQ ID NO: 127494 - DNA, 25 bp, E. coli
tgaacggtcaggtatacgagacgct

SEQ ID NO: 127495 - DNA, 25 bp, E. coli
tgaacggtcaggaatacgagacgct

SEQ ID NO: 127496 - DNA, 25 bp, E. coli
tgacgaaggcctggagcagtgaacc

SEQ ID NO: 127497 - DNA, 25 bp, E. coli
gaaatcaacaactggactgcggtca

SEQ ID NO: 127498 - DNA, 25 bp, E. coli
gaaaacagtatctgggtacggccac

SEQ ID NO: 127499 - DNA, 25 bp, E. coli
gaaaacagtatcagggtacggccac

SEQ ID NO: 127500 - DNA, 25 bp, E. coli
gaaatcaacaacaggactgcggtca

SEQ ID NO: 127501 - DNA, 25 bp, E. coli
gataccggcgaagtccacatgatga

SEQ ID NO: 127502 - DNA, 25 bp, E. coli
gataccggcgaactccacatgatga

SEQ ID NO: 127503 - DNA, 25 bp, E. coli
ggttaccgccagaaaccacgtgaag

SEQ ID NO: 127504 - DNA, 25 bp, E. coli
ggttaccgccagtaaccacgtgaag

SEQ ID NO: 127505 - DNA, 25 bp, E. coli
gagatctccgtgaagttcgccagcg

SEQ ID NO: 127506 - DNA, 25 bp, E. coli
gagatctccgtgtagttcgccagcg

SEQ ID NO: 127507 - DNA, 25 bp, E. coli
cacttgattcgcaatggatctgaca

SEQ ID NO: 127508 - DNA, 25 bp, E. coli
cacttgattcgctatggatctgaca

SEQ ID NO: 127509 - DNA, 25 bp, E. coli
catggttcacatttccttgtaaggg

SEQ ID NO: 127510 - DNA, 25 bp, E. coli
catggttcacatatccttgtaaggg

SEQ ID NO: 127511 - DNA, 25 bp, E. coli
actgaagttgcgtagagaagggttc

SEQ ID NO: 127512 - DNA, 25 bp, E. coli
actgaagttgcgaagagaagggttc

SEQ ID NO: 127513 - DNA, 25 bp, E. coli
ttgagtcaaaaaaggaacgcggccg

SEQ ID NO: 127514 - DNA, 25 bp, E. coli
ttgagtcaaaaatggaacgcggccg

SEQ ID NO: 127515 - DNA, 25 bp, E. coli
tcagtcgttttcttatcgctcacca

SEQ ID NO: 127516 - DNA, 25 bp, E. coli
tcagtcgttttcatatcgctcacca

SEQ ID NO: 127517 - DNA, 25 bp, E. coli
tcatcctatgaatctgccgcaaagt

SEQ ID NO: 127518 - DNA, 25 bp, E. coli
tcttgaagggttagatcgtcactgt

SEQ ID NO: 127519 - DNA, 25 bp, E. coli
tcttgaagggtttgatcgtcactgt

SEQ ID NO: 127520 - DNA, 25 bp, E. coli
tcatcctatgaaactgccgcaaagt

SEQ ID NO: 127521 - DNA, 25 bp, E. coli
gaacgcggccgtgagattaaagccg

SEQ ID NO: 127522 - DNA, 25 bp, E. coli
gaacgcggccgtcagattaaagccg

SEQ ID NO: 127523 - DNA, 25 bp, E. coli
cgatactgtgactttcagcacttga

SEQ ID NO: 127524 - DNA, 25 bp, E. coli
cgatactgtgacattcagcacttga

SEQ ID NO: 127525 - DNA, 25 bp, E. coli
ctttcgagcgaatatgtgcagttat

SEQ ID NO: 127526 - DNA, 25 bp, E. coli
ctttcgagcgaaaatgtgcagttat

SEQ ID NO: 127527 - DNA, 25 bp, E. coli
gatctgacaggatgctttcgagcga

SEQ ID NO: 127528 - DNA, 25 bp, E. coli
gatctgacaggaagctttcgagcga

SEQ ID NO: 127529 - DNA, 25 bp, E. coli
caccgatttgggaacgcaagatgcc

SEQ ID NO: 127530 - DNA, 25 bp, E. coli
caccgatttgggtacgcaagatgcc

SEQ ID NO: 127531 - DNA, 25 bp, E. coli
cagagcgtacgagggcatttttatc

SEQ ID NO: 127532 - DNA, 25 bp, E. coli
caggaagtgggattggtctttcagc

SEQ ID NO: 127533 - DNA, 25 bp, E. coli
cagagcgtacgacggcatttttatc

SEQ ID NO: 127534 - DNA, 25 bp, E. coli
caggaagtgggaatggtctttcagc

SEQ ID NO: 127535 - DNA, 25 bp, E. coli
cgtgcaaccgggtgaacggatcgtt

SEQ ID NO: 127536 - DNA, 25 bp, E. coli
aacggatcgttctgtgtggcccttc

SEQ ID NO: 127537 - DNA, 25 bp, E. coli
cgtgcaaccgggagaacggatcgtt

SEQ ID NO: 127538 - DNA, 25 bp, E. coli
aacggatcgttcagtgtggcccttc

SEQ ID NO: 127539 - DNA, 25 bp, E. coli
tgagccaaattttactgcaacctgc

SEQ ID NO: 127540 - DNA, 25 bp, E. coli
tgagccaaatttaactgcaacctgc

SEQ ID NO: 127541 - DNA, 25 bp, E. coli
tccggtaaatcgtcaaccattcgtt

SEQ ID NO: 127542 - DNA, 25 bp, E. coli
tccgcaatattgagcgcgtcaggca

SEQ ID NO: 127543 - DNA, 25 bp, E. coli
tccggtaaatcgacaaccattcgtt

SEQ ID NO: 127544 - DNA, 25 bp, E. coli
tccgcaatattgtgcgcgtcaggca

SEQ ID NO: 127545 - DNA, 25 bp, E. coli
gaagaacatcaagagggacggatcg

SEQ ID NO: 127546 - DNA, 25 bp, E. coli
gcaacctgctaacgcgatgattacg

SEQ ID NO: 127547 - DNA, 25 bp, E. coli
gcaacctgctaaggcgatgattacg

SEQ ID NO: 127548 - DNA, 25 bp, E. coli
gaagaacatcaacagggacggatcg

SEQ ID NO: 127549 - DNA, 25 bp, E. coli
gaactgtaccctcgcaccgatttgg

SEQ ID NO: 127550 - DNA, 25 bp, E. coli
gaactgtaccctggcaccgatttgg

SEQ ID NO: 127551 - DNA, 25 bp, E. coli
cagaatgctctaacattggcgctta

SEQ ID NO: 127552 - DNA, 25 bp, E. coli
catgatccactatcacagaatgctc

SEQ ID NO: 127553 - DNA, 25 bp, E. coli
cagaatgctctatcattggcgctta

SEQ ID NO: 127554 - DNA, 25 bp, E. coli
catgatccactaacacagaatgctc

SEQ ID NO: 127555 - DNA, 25 bp, E. coli
tatgaaaggactcaccgtcttcgcc

SEQ ID NO: 127556 - DNA, 25 bp, E. coli
tatgaaaggactgaccgtcttcgcc

SEQ ID NO: 127557 - DNA, 25 bp, E. coli
tgggccgttccagcgggcgctttaa

SEQ ID NO: 127558 - DNA, 25 bp, E. coli
tgggccgttccaccgggcgctttaa

SEQ ID NO: 127559 - DNA, 25 bp, E. coli
tccagcgggcgcattaaaccgcggg

SEQ ID NO: 127560 - DNA, 25 bp, E. coli
tccagcgggcgctttaaaccgcggg

SEQ ID NO: 127561 - DNA, 25 bp, E. coli
cgacaccttgttaatgaaaggactg

SEQ ID NO: 127562 - DNA, 25 bp, E. coli
cgccgttatcgcctggtgtgcgcaa

SEQ ID NO: 127563 - DNA, 25 bp, E. coli
cgacaccttgtttatgaaaggactg

SEQ ID NO: 127564 - DNA, 25 bp, E. coli
cgccgttatcgcgtggtgtgcgcaa

SEQ ID NO: 127565 - DNA, 25 bp, E. coli
ctggtgtgcgcaactggccttaggc

SEQ ID NO: 127566 - DNA, 25 bp, E. coli
ctggtgtgcgcatctggccttaggc

SEQ ID NO: 127567 - DNA, 25 bp, E. coli
tggcaaatttctggttttaaccgtg

SEQ ID NO: 127568 - DNA, 25 bp, E. coli
tggcgcttaaactgaaacgtggata

SEQ ID NO: 127569 - DNA, 25 bp, E. coli
tggcgcttaaacagaaacgtggata

SEQ ID NO: 127570 - DNA, 25 bp, E. coli
tggcaaatttctcgttttaaccgtg

SEQ ID NO: 127571 - DNA, 25 bp, E. coli
gatgtgatctttccccatgatccac

SEQ ID NO: 127572 - DNA, 25 bp, E. coli
gatgtgatctttgcccatgatccac

SEQ ID NO: 127573 - DNA, 25 bp, E. coli
cagaaagcgtcaagcgccaggtggt

SEQ ID NO: 127574 - DNA, 25 bp, E. coli
caggaccagggcttcactgaagata

SEQ ID NO: 127575 - DNA, 25 bp, E. coli
cagaaagcgtcatgcgccaggtggt

SEQ ID NO: 127576 - DNA, 25 bp, E. coli
caggaccagggcatcactgaagata

SEQ ID NO: 127577 - DNA, 25 bp, E. coli
agtttcctgcctaatctcgcctggg

SEQ ID NO: 127578 - DNA, 25 bp, E. coli
agtttcctgccttatctcgcctggg

SEQ ID NO: 127579 - DNA, 25 bp, E. coli
tacctatctggatcttgagcgactg

SEQ ID NO: 127580 - DNA, 25 bp, E. coli
tacctatctggaacttgagcgactg

SEQ ID NO: 127581 - DNA, 25 bp, E. coli
tattcatcagcaaaaagggaccacc

SEQ ID NO: 127582 - DNA, 25 bp, E. coli
tattcatcagcataaagggaccacc

SEQ ID NO: 127583 - DNA, 25 bp, E. coli
tctatcaatctggaaaccagcggcc

SEQ ID NO: 127584 - DNA, 25 bp, E. coli
tctatcaatctgcaaaccagcggcc

SEQ ID NO: 127585 - DNA, 25 bp, E. coli
gccgctgcgtaacttgtggaatccg

SEQ ID NO: 127586 - DNA, 25 bp, E. coli
gccgctgcgtaagttgtggaatccg

SEQ ID NO: 127587 - DNA, 25 bp, E. coli
ccgcattattgagtggtggcagacc

SEQ ID NO: 127588 - DNA, 25 bp, E. coli
ccgcattattgactggtggcagacc

SEQ ID NO: 127589 - DNA, 25 bp, E. coli
gatttctgatctccaggtgccgctg

SEQ ID NO: 127590 - DNA, 25 bp, E. coli
gatttctgatctgcaggtgccgctg

SEQ ID NO: 127591 - DNA, 25 bp, E. coli
taagcgatgccaaaccatgtagccg

SEQ ID NO: 127592 - DNA, 25 bp, E. coli
taagcgatgccataccatgtagccg

SEQ ID NO: 127593 - DNA, 25 bp, E. coli
gagccgttcggcattctgatccgca

SEQ ID NO: 127594 - DNA, 25 bp, E. coli
gagccgttcggctttctgatccgca

SEQ ID NO: 127595 - DNA, 25 bp, E. coli
caaaatgcaggttgcgaaggtggta

SEQ ID NO: 127596 - DNA, 25 bp, E. coli
caaaatgcaggtagcgaaggtggta

SEQ ID NO: 127597 - DNA, 25 bp, E. coli
catgatgatattagtagctgaccag

SEQ ID NO: 127598 - DNA, 25 bp, E. coli
catgatgatatttgtagctgaccag

SEQ ID NO: 127599 - DNA, 25 bp, E. coli
taaaactggacttgcatatgtgcgg

SEQ ID NO: 127600 - DNA, 25 bp, E. coli
taaaactggactagcatatgtgcgg

SEQ ID NO: 127601 - DNA, 25 bp, E. coli
agaaacacgagtatgattaaacgcg

SEQ ID NO: 127602 - DNA, 25 bp, E. coli
agaaacacgagtttgattaaacgcg

SEQ ID NO: 127603 - DNA, 25 bp, E. coli
aaaatgcgccggcagaagcagaaga

SEQ ID NO: 127604 - DNA, 25 bp, E. coli
aaaatgcgccgggagaagcagaaga

SEQ ID NO: 127605 - DNA, 25 bp, E. coli
tagctgaccagacaaattatatccg

SEQ ID NO: 127606 - DNA, 25 bp, E. coli
tagctgaccagagaaattatatccg

SEQ ID NO: 127607 - DNA, 25 bp, E. coli
gaagcagaagattgtcccgcgatgt

SEQ ID NO: 127608 - DNA, 25 bp, E. coli
gaagcagaagatagtcccgcgatgt

SEQ ID NO: 127609 - DNA, 25 bp, E. coli
cccgcgatgtccgtttgagaaacac

SEQ ID NO: 127610 - DNA, 25 bp, E. coli
cccgcgatgtccctttgagaaacac

SEQ ID NO: 127611 - DNA, 25 bp, E. coli
gattaaacgcgtgagcatgatgata

SEQ ID NO: 127612 - DNA, 25 bp, E. coli
gattaaacgcgtcagcatgatgata

SEQ ID NO: 127613 - DNA, 25 bp, E. coli
gggccagaaaaaagcggatcttccg

SEQ ID NO: 127614 - DNA, 25 bp, E. coli
gggccagaaaaatgcggatcttccg

SEQ ID NO: 127615 - DNA, 25 bp, E. coli
ggatcttccgctcaaaatgcaggta

SEQ ID NO: 127616 - DNA, 25 bp, E. coli
ggatcttccgctgaaaatgcaggta

SEQ ID NO: 127617 - DNA, 25 bp, E. coli
cactgacccgtatgctggatcgcct

SEQ ID NO: 127618 - DNA, 25 bp, E. coli
cactgacccgtaagctggatcgcct

SEQ ID NO: 127619 - DNA, 25 bp, E. coli
catcaattagttggccaggacctgc

SEQ ID NO: 127620 - DNA, 25 bp, E. coli
catcaattagttcgccaggacctgc

SEQ ID NO: 127621 - DNA, 25 bp, E. coli
tattaccgcggctcagtttaaggtg

SEQ ID NO: 127622 - DNA, 25 bp, E. coli
tattaccgcggcacagtttaaggtg

SEQ ID NO: 127623 - DNA, 25 bp, E. coli
tgcttaacgagtttctgtctccgct

SEQ ID NO: 127624 - DNA, 25 bp, E. coli
tgcttaacgagtatctgtctccgct

SEQ ID NO: 127625 - DNA, 25 bp, E. coli
tctgtctccgctcgatattaccgcg

SEQ ID NO: 127626 - DNA, 25 bp, E. coli
tctgtctccgctggatattaccgcg

SEQ ID NO: 127627 - DNA, 25 bp, E. coli
gcggcgcggcaaaatgtgaacaatg

SEQ ID NO: 127628 - DNA, 25 bp, E. coli
gcggcgcggcaatatgtgaacaatg

SEQ ID NO: 127629 - DNA, 25 bp, E. coli
gacggcggacgaagtggcaacactt

SEQ ID NO: 127630 - DNA, 25 bp, E. coli
cgctgcgcggcgagtattactccgg

SEQ ID NO: 127631 - DNA, 25 bp, E. coli
cgctgcgcggcgtgtattactccgg

SEQ ID NO: 127632 - DNA, 25 bp, E. coli
tggatcgcctggactgtaaaggctg

SEQ ID NO: 127633 - DNA, 25 bp, E. coli
tggatcgcctggtctgtaaaggctg

SEQ ID NO: 127634 - DNA, 25 bp, E. coli
tttgcttaagaaagtcctgccgtaa

SEQ ID NO: 127635 - DNA, 25 bp, E. coli
taaggtgctctgctctatccgctgc

SEQ ID NO: 127636 - DNA, 25 bp, E. coli
tttgcttaagaatgtcctgccgtaa

SEQ ID NO: 127637 - DNA, 25 bp, E. coli
taaggtgctctggtctatccgctgc

SEQ ID NO: 127638 - DNA, 25 bp, E. coli
gacggcggacgatgtggcaacactt

SEQ ID NO: 127639 - DNA, 25 bp, E. coli
aagaggccaacataatcattcgtga

SEQ ID NO: 127640 - DNA, 25 bp, E. coli
aagaggccaacaaaatcattcgtga

SEQ ID NO: 127641 - DNA, 25 bp, E. coli
taccggcgactactttttagatgaa

SEQ ID NO: 127642 - DNA, 25 bp, E. coli
taccggcgactagtttttagatgaa

SEQ ID NO: 127643 - DNA, 25 bp, E. coli
tatgttcaaacagctggcccatgtg

SEQ ID NO: 127644 - DNA, 25 bp, E. coli
tatgttcaaacacctggcccatgtg

SEQ ID NO: 127645 - DNA, 25 bp, E. coli
tcattcgtgagcttgaggatacgct

SEQ ID NO: 127646 - DNA, 25 bp, E. coli
tcattcgtgagcatgaggatacgct

SEQ ID NO: 127647 - DNA, 25 bp, E. coli
ccatcgaccgcgtaacgctgttgaa

SEQ ID NO: 127648 - DNA, 25 bp, E. coli
ccatcgaccgcgaaacgctgttgaa

SEQ ID NO: 127649 - DNA, 25 bp, E. coli
gcagggattgaacccaccggcgtca

SEQ ID NO: 127650 - DNA, 25 bp, E. coli
gcagggattgaagccaccggcgtca

SEQ ID NO: 127651 - DNA, 25 bp, E. coli
gcaccgcggtgtataatatgttcaa

SEQ ID NO: 127652 - DNA, 25 bp, E. coli
gcaccgcggtgtttaatatgttcaa

SEQ ID NO: 127653 - DNA, 25 bp, E. coli
cgaaacgctgttgaaagaggccaac

SEQ ID NO: 127654 - DNA, 25 bp, E. coli
cgaaacgctgttcaaagaggccaac

SEQ ID NO: 127655 - DNA, 25 bp, E. coli
gatacgctcgcagggattgaagcca

SEQ ID NO: 127656 - DNA, 25 bp, E. coli
gatacgctcgcacggattgaagcca

SEQ ID NO: 127657 - DNA, 25 bp, E. coli
tggcccatgtgcattcagaaaaata

SEQ ID NO: 127658 - DNA, 25 bp, E. coli
tggcccatgtgctttcagaaaaata

SEQ ID NO: 127659 - DNA, 25 bp, E. coli
taatggcgtgctcgtatttaccggc

SEQ ID NO: 127660 - DNA, 25 bp, E. coli
taatggcgtgctggtatttaccggc

SEQ ID NO: 127661 - DNA, 25 bp, E. coli
tatgccgctggtgtgtaaatccctc

SEQ ID NO: 127662 - DNA, 25 bp, E. coli
tatgccgctggtctgtaaatccctc

SEQ ID NO: 127663 - DNA, 25 bp, E. coli
tttgtcgttgacgtcaccatgtcga

SEQ ID NO: 127664 - DNA, 25 bp, E. coli
ttactggctgactaccccactatgc

SEQ ID NO: 127665 - DNA, 25 bp, E. coli
tattcccctggtttgtgtatccacc

SEQ ID NO: 127666 - DNA, 25 bp, E. coli
tttgtcgttgacctcaccatgtcga

SEQ ID NO: 127667 - DNA, 25 bp, E. coli
ttactggctgacaaccccactatgc

SEQ ID NO: 127668 - DNA, 25 bp, E. coli
tattcccctggtatgtgtatccacc

SEQ ID NO: 127669 - DNA, 25 bp, E. coli
tgtatccaccagaagaacccttcgt

SEQ ID NO: 127670 - DNA, 25 bp, E. coli
tgtatccaccagtagaacccttcgt

SEQ ID NO: 127671 - DNA, 25 bp, E. coli
gcctgtatcccaccttactggctga

SEQ ID NO: 127672 - DNA, 25 bp, E. coli
gcctgtatcccagcttactggctga

SEQ ID NO: 127673 - DNA, 25 bp, E. coli
gaacccttcgttccccgaatgctgg

SEQ ID NO: 127674 - DNA, 25 bp, E. coli
gaacccttcgttgcccgaatgctgg

SEQ ID NO: 127675 - DNA, 25 bp, E. coli
cgaatgctggcaggaactgttggca

SEQ ID NO: 127676 - DNA, 25 bp, E. coli
cgaatgctggcacgaactgttggca

SEQ ID NO: 127677 - DNA, 25 bp, E. coli
tactaaaggagaggctaaaacgact

SEQ ID NO: 127678 - DNA, 25 bp, E. coli
taagcaactgaatttgatggctggc

SEQ ID NO: 127679 - DNA, 25 bp, E. coli
tactaaaggagacgctaaaacgact

SEQ ID NO: 127680 - DNA, 25 bp, E. coli
taagcaactgaaattgatggctggc

SEQ ID NO: 127681 - DNA, 25 bp, E. coli
gatgcagatgctgatttcattaccc

SEQ ID NO: 127682 - DNA, 25 bp, E. coli
gatgcagatgctcatttcattaccc

SEQ ID NO: 127683 - DNA, 25 bp, E. coli
aaggtccgtacgtccatcagccgga

SEQ ID NO: 127684 - DNA, 25 bp, E. coli
aaggtccgtacgaccatcagccgga

SEQ ID NO: 127685 - DNA, 25 bp, E. coli
taaaaaggtccgaacgaccatcagc

SEQ ID NO: 127686 - DNA, 25 bp, E. coli
taaaaaggtccgtacgaccatcagc

SEQ ID NO: 127687 - DNA, 25 bp, E. coli
gtccgtacgaccttcagccggaaag

SEQ ID NO: 127688 - DNA, 25 bp, E. coli
gtccgtacgaccatcagccggaaag

SEQ ID NO: 127689 - DNA, 25 bp, E. coli
aggtccgtacgaccatcagccggaa

SEQ ID NO: 127690 - DNA, 25 bp, E. coli
aggtccgtacgagcatcagccggaa

SEQ ID NO: 127691 - DNA, 25 bp, E. coli
aaaaggtccgtacgaccatcagccg

SEQ ID NO: 127692 - DNA, 25 bp, E. coli
aaaggtccgtaccaccatcagccgg

SEQ ID NO: 127693 - DNA, 25 bp, E. coli
aaaaggtccgtaggaccatcagccg

SEQ ID NO: 127694 - DNA, 25 bp, E. coli
aaaggtccgtacgaccatcagccgg

SEQ ID NO: 127695 - DNA, 25 bp, E. coli
tccgtacgaccaacagccggaaagc

SEQ ID NO: 127696 - DNA, 25 bp, E. coli
tccgtacgaccatcagccggaaagc

SEQ ID NO: 127697 - DNA, 25 bp, E. coli
cgtacgaccatcagccggaaagccg

SEQ ID NO: 127698 - DNA, 25 bp, E. coli
gtaaaaaggtccctacgaccatcag

SEQ ID NO: 127699 - DNA, 25 bp, E. coli
cgtctatgtggcctttatcaattga

SEQ ID NO: 127700 - DNA, 25 bp, E. coli
cgtacgaccatctgccggaaagccg

SEQ ID NO: 127701 - DNA, 25 bp, E. coli
cgtctatgtggcgtttatcaattga

SEQ ID NO: 127702 - DNA, 25 bp, E. coli
gtaaaaaggtccgtacgaccatcag

SEQ ID NO: 127703 - DNA, 25 bp, E. coli
ggtccgtacgacgatcagccggaaa

SEQ ID NO: 127704 - DNA, 25 bp, E. coli
ggtccgtacgaccatcagccggaaa

SEQ ID NO: 127705 - DNA, 25 bp, E. coli
cagacattctgcaggtggtttacca

SEQ ID NO: 127706 - DNA, 25 bp, E. coli
cagacattctgctggtggtttacca

SEQ ID NO: 127707 - DNA, 25 bp, E. coli
taccaggtatgtttcagcccgtccg

SEQ ID NO: 127708 - DNA, 25 bp, E. coli
taccaggtatgtatcagcccgtccg

SEQ ID NO: 127709 - DNA, 25 bp, E. coli
ttacaacactggatcgccgtatcag

SEQ ID NO: 127710 - DNA, 25 bp, E. coli
ttacaacactggttcgccgtatcag

SEQ ID NO: 127711 - DNA, 25 bp, E. coli
gccgtatcagtgatctattggatga

SEQ ID NO: 127712 - DNA, 25 bp, E. coli
gcccgtccgttgaaatcaaccagga

SEQ ID NO: 127713 - DNA, 25 bp, E. coli
gcccgtccgttgtaatcaaccagga

SEQ ID NO: 127714 - DNA, 25 bp, E. coli
gccgtatcagtgttctattggatga

SEQ ID NO: 127715 - DNA, 25 bp, E. coli
gacggcacacaaaaatatctccggg

SEQ ID NO: 127716 - DNA, 25 bp, E. coli
cgtcgcactggctgcgcgtacttca

SEQ ID NO: 127717 - DNA, 25 bp, E. coli
cgtcgcactggcagcgcgtacttca

SEQ ID NO: 127718 - DNA, 25 bp, E. coli
gggacataccacgtctctgttgcag

SEQ ID NO: 127719 - DNA, 25 bp, E. coli
gtgagtttcagctgagcgcgtcgca

SEQ ID NO: 127720 - DNA, 25 bp, E. coli
gtgagtttcagcagagcgcgtcgca

SEQ ID NO: 127721 - DNA, 25 bp, E. coli
gggacataccacctctctgttgcag

SEQ ID NO: 127722 - DNA, 25 bp, E. coli
tggctgcgctgattacaacactgga

SEQ ID NO: 127723 - DNA, 25 bp, E. coli
tggctgcgctgaatacaacactgga

SEQ ID NO: 127724 - DNA, 25 bp, E. coli
tcaaccaggatgctgtggctgcgct

SEQ ID NO: 127725 - DNA, 25 bp, E. coli
tcaaccaggatggtgtggctgcgct

SEQ ID NO: 127726 - DNA, 25 bp, E. coli
gacggcacacaataatatctccggg

SEQ ID NO: 127727 - DNA, 25 bp, E. coli
caattggttacatggtgaagcggtc

SEQ ID NO: 127728 - DNA, 25 bp, E. coli
caattggttacaaggtgaagcggtc

SEQ ID NO: 127729 - DNA, 25 bp, E. coli
catatgctgcgtgacaagaaagtcc

SEQ ID NO: 127730 - DNA, 25 bp, E. coli
catatgctgcgtcacaagaaagtcc

SEQ ID NO: 127731 - DNA, 25 bp, E. coli
tactgaatctgggacacacctttgg

SEQ ID NO: 127732 - DNA, 25 bp, E. coli
tactgaatctggcacacacctttgg

SEQ ID NO: 127733 - DNA, 25 bp, E. coli
aaaagcctggctctactcgataccg

SEQ ID NO: 127734 - DNA, 25 bp, E. coli
aaaagcctggctgtactcgataccg

SEQ ID NO: 127735 - DNA, 25 bp, E. coli
tgtatctcgatatggtccgcggcgt

SEQ ID NO: 127736 - DNA, 25 bp, E. coli
tgttggtcaccaacgaaaccctggc

SEQ ID NO: 127737 - DNA, 25 bp, E. coli
tgttggtcaccatcgaaaccctggc

SEQ ID NO: 127738 - DNA, 25 bp, E. coli
tgtatctcgataaggtccgcggcgt

SEQ ID NO: 127739 - DNA, 25 bp, E. coli
tgacggcgagcagtataaaagcctg

SEQ ID NO: 127740 - DNA, 25 bp, E. coli
tgacggcgagcactataaaagcctg

SEQ ID NO: 127741 - DNA, 25 bp, E. coli
tccgttggcggctaaactgcggtca

SEQ ID NO: 127742 - DNA, 25 bp, E. coli
tccgttggcggcaaaactgcggtca

SEQ ID NO: 127743 - DNA, 25 bp, E. coli
tcattcttaccggtgaaatcgggcg

SEQ ID NO: 127744 - DNA, 25 bp, E. coli
tcattcttaccgctgaaatcgggcg

SEQ ID NO: 127745 - DNA, 25 bp, E. coli
cctcggtaaaaagatgattggcgcg

SEQ ID NO: 127746 - DNA, 25 bp, E. coli
cctcggtaaaaacatgattggcgcg

SEQ ID NO: 127747 - DNA, 25 bp, E. coli
ggcagaagtcatcaaatacggcatt

SEQ ID NO: 127748 - DNA, 25 bp, E. coli
ggcagaagtcatgaaatacggcatt

SEQ ID NO: 127749 - DNA, 25 bp, E. coli
aatatctggaagtgttttacgcgcg

SEQ ID NO: 127750 - DNA, 25 bp, E. coli
aatatctggaagagttttacgcgcg

SEQ ID NO: 127751 - DNA, 25 bp, E. coli
caggcgctggcgtatccgttatttc

SEQ ID NO: 127752 - DNA, 25 bp, E. coli
caggaactgtaccacgaactgctca

SEQ ID NO: 127753 - DNA, 25 bp, E. coli
caggaactgtacgacgaactgctca

SEQ ID NO: 127754 - DNA, 25 bp, E. coli
caggcgctggcgaatccgttatttc

SEQ ID NO: 127755 - DNA, 25 bp, E. coli
tacgttcttcgctcaaccgtctgcg

SEQ ID NO: 127756 - DNA, 25 bp, E. coli
tacgttcttcgcacaaccgtctgcg

SEQ ID NO: 127757 - DNA, 25 bp, E. coli
aaactgctgaaagtggtgaacaacc

SEQ ID NO: 127758 - DNA, 25 bp, E. coli
aaactgctgaaactggtgaacaacc

SEQ ID NO: 127759 - DNA, 25 bp, E. coli
tatgatggtcgggaaaatcctctgt

SEQ ID NO: 127760 - DNA, 25 bp, E. coli
tatgatggtcggcaaaatcctctgt

SEQ ID NO: 127761 - DNA, 25 bp, E. coli
ttatctctatctgagcccggaacgg

SEQ ID NO: 127762 - DNA, 25 bp, E. coli
ttatctctatctcagcccggaacgg

SEQ ID NO: 127763 - DNA, 25 bp, E. coli
tggtttatgggcgacgacagcagca

SEQ ID NO: 127764 - DNA, 25 bp, E. coli
gcctcgacgaactggataatcatgc

SEQ ID NO: 127765 - DNA, 25 bp, E. coli
gcctcgacgaacaggataatcatgc

SEQ ID NO: 127766 - DNA, 25 bp, E. coli
gaagcacagcgtcgcctgattcgtg

SEQ ID NO: 127767 - DNA, 25 bp, E. coli
gaagcacagcgtggcctgattcgtg

SEQ ID NO: 127768 - DNA, 25 bp, E. coli
ccgtcttgtcggaactggatatgat

SEQ ID NO: 127769 - DNA, 25 bp, E. coli
ccgtcttgtcggtactggatatgat

SEQ ID NO: 127770 - DNA, 25 bp, E. coli
tggtttatgggccacgacagcagca

SEQ ID NO: 127771 - DNA, 25 bp, E. coli
accgaaacgctgcacggtccgctgt

SEQ ID NO: 127772 - DNA, 25 bp, E. coli
atcagcggcagctccctcggcggtg

SEQ ID NO: 127773 - DNA, 25 bp, E. coli
atcagcggcagcaccctcggcggtg

SEQ ID NO: 127774 - DNA, 25 bp, E. coli
accgaaacgctggacggtccgctgt

SEQ ID NO: 127775 - DNA, 25 bp, E. coli
aacattcttgatgacgacattccgg

SEQ ID NO: 127776 - DNA, 25 bp, E. coli
aacattcttgatcacgacattccgg

SEQ ID NO: 127777 - DNA, 25 bp, E. coli
tccgctttggcggaatcggtattgg

SEQ ID NO: 127778 - DNA, 25 bp, E. coli
tccgctttggcgcaatcggtattgg

SEQ ID NO: 127779 - DNA, 25 bp, E. coli
tcggcggtgccgtatatgtagcaga

SEQ ID NO: 127780 - DNA, 25 bp, E. coli
tctcctttctatcaagcattgcagg

SEQ ID NO: 127781 - DNA, 25 bp, E. coli
tctcctttctatgaagcattgcagg

SEQ ID NO: 127782 - DNA, 25 bp, E. coli
tcggcggtgccgaatatgtagcaga

SEQ ID NO: 127783 - DNA, 25 bp, E. coli
gaatatgtagcagaacacctggctg

SEQ ID NO: 127784 - DNA, 25 bp, E. coli
gaatatgtagcacaacacctggctg

SEQ ID NO: 127785 - DNA, 25 bp, E. coli
gaacacctggctgaaaagctggaag

SEQ ID NO: 127786 - DNA, 25 bp, E. coli
gaacacctggctcaaaagctggaag

SEQ ID NO: 127787 - DNA, 25 bp, E. coli
cattgcaggaactgaagcccgatct

SEQ ID NO: 127788 - DNA, 25 bp, E. coli
cattgcaggaacagaagcccgatct

SEQ ID NO: 127789 - DNA, 25 bp, E. coli
ggagatattccgcacaacctttctc

SEQ ID NO: 127790 - DNA, 25 bp, E. coli
ggagatattccggacaacctttctc

SEQ ID NO: 127791 - DNA, 25 bp, E. coli
ggcgaaacactgtagatcaacattc

SEQ ID NO: 127792 - DNA, 25 bp, E. coli
ggcgaaacactgaagatcaacattc

SEQ ID NO: 127793 - DNA, 25 bp, E. coli
caacgttgcctggtttgtgcttgcg

SEQ ID NO: 127794 - DNA, 25 bp, E. coli
caacgttgcctgctttgtgcttgcg

SEQ ID NO: 127795 - DNA, 25 bp, E. coli
gacgtatcggtaaggtttctggact

SEQ ID NO: 127796 - DNA, 25 bp, E. coli
gacgtatcggtatggtttctggact

SEQ ID NO: 127797 - DNA, 25 bp, E. coli
tttctatatggcgagcatcagcagc

SEQ ID NO: 127798 - DNA, 25 bp, E. coli
tttctatatggccagcatcagcagc

SEQ ID NO: 127799 - DNA, 25 bp, E. coli
tgttggcgcaaatcagccgttggta

SEQ ID NO: 127800 - DNA, 25 bp, E. coli
tgttggcgcaaaacagccgttggta

SEQ ID NO: 127801 - DNA, 25 bp, E. coli
tgattatcgcgccttatggcaaagg

SEQ ID NO: 127802 - DNA, 25 bp, E. coli
tgattatcgcgcgttatggcaaagg

SEQ ID NO: 127803 - DNA, 25 bp, E. coli
tggtactcggcagagcaccgaatga

SEQ ID NO: 127804 - DNA, 25 bp, E. coli
gctgaacgacatcatccaatcgctg

SEQ ID NO: 127805 - DNA, 25 bp, E. coli
gctgaacgacatgatccaatcgctg

SEQ ID NO: 127806 - DNA, 25 bp, E. coli
gcagattggcatcataaccctcacc

SEQ ID NO: 127807 - DNA, 25 bp, E. coli
gaatcttctcgcgtggcccgtatgg

SEQ ID NO: 127808 - DNA, 25 bp, E. coli
gaatcttctcgcctggcccgtatgg

SEQ ID NO: 127809 - DNA, 25 bp, E. coli
gcagattggcatgataaccctcacc

SEQ ID NO: 127810 - DNA, 25 bp, E. coli
tggtactcggcacagcaccgaatga

SEQ ID NO: 127811 - DNA, 25 bp, E. coli
ggctactggaccgataaatatccga

SEQ ID NO: 127812 - DNA, 25 bp, E. coli
ggctactggacccataaatatccga

SEQ ID NO: 127813 - DNA, 25 bp, E. coli
gaccatattcctccctgataaccgg

SEQ ID NO: 127814 - DNA, 25 bp, E. coli
gaccatattcctgcctgataaccgg

SEQ ID NO: 127815 - DNA, 25 bp, E. coli
caaattgtcgcatacctggagcagg

SEQ ID NO: 127816 - DNA, 25 bp, E. coli
caaattgtcgcaaacctggagcagg

SEQ ID NO: 127817 - DNA, 25 bp, E. coli
cttgacgaaaataaaactctcaggg

SEQ ID NO: 127818 - DNA, 25 bp, E. coli
cttgacgaaaattaaactctcaggg

SEQ ID NO: 127819 - DNA, 25 bp, E. coli
aggaagataacgtttcgctggcagg

SEQ ID NO: 127820 - DNA, 25 bp, E. coli
aggaagataacgattcgctggcagg

SEQ ID NO: 127821 - DNA, 25 bp, E. coli
ttttttgcgacgcagcaaattgtcg

SEQ ID NO: 127822 - DNA, 25 bp, E. coli
ttttttgcgacggagcaaattgtcg

SEQ ID NO: 127823 - DNA, 25 bp, E. coli
tgtcgcaaacctcgagcaggaagat

SEQ ID NO: 127824 - DNA, 25 bp, E. coli
tgtcgcaaacctggagcaggaagat

SEQ ID NO: 127825 - DNA, 25 bp, E. coli
tccgccacgcatcttgacgaaaatt

SEQ ID NO: 127826 - DNA, 25 bp, E. coli
tgcgcggagctatacgtttgctttt

SEQ ID NO: 127827 - DNA, 25 bp, E. coli
tgcgcggagctaaacgtttgctttt

SEQ ID NO: 127828 - DNA, 25 bp, E. coli
tccgccacgcatgttgacgaaaatt

SEQ ID NO: 127829 - DNA, 25 bp, E. coli
cctggagcaggaagataacgtttcg

SEQ ID NO: 127830 - DNA, 25 bp, E. coli
cctggagcaggatgataacgtttcg

SEQ ID NO: 127831 - DNA, 25 bp, E. coli
gcagcaaattgtcgcaaacctggag

SEQ ID NO: 127832 - DNA, 25 bp, E. coli
gcagcaaattgtggcaaacctggag

SEQ ID NO: 127833 - DNA, 25 bp, E. coli
ctggcaggggattgtccgccacgca

SEQ ID NO: 127834 - DNA, 25 bp, E. coli
ctggcaggggatagtccgccacgca

SEQ ID NO: 127835 - DNA, 25 bp, E. coli
gggatgttttctaatgtctacgcca

SEQ ID NO: 127836 - DNA, 25 bp, E. coli
gggatgttttcttatgtctacgcca

SEQ ID NO: 127837 - DNA, 25 bp, E. coli
cagcaagtactaggctgtagcacaa

SEQ ID NO: 127838 - DNA, 25 bp, E. coli
cagcaagtactacgctgtagcacaa

SEQ ID NO: 127839 - DNA, 25 bp, E. coli
tactacgctgtagcacaaattcagc

SEQ ID NO: 127840 - DNA, 25 bp, E. coli
tactacgctgtaccacaaattcagc

SEQ ID NO: 127841 - DNA, 25 bp, E. coli
tattccgttactgattggcggcgcg

SEQ ID NO: 127842 - DNA, 25 bp, E. coli
tattccgttactcattggcggcgcg

SEQ ID NO: 127843 - DNA, 25 bp, E. coli
ttcactattccgttactgattggcg

SEQ ID NO: 127844 - DNA, 25 bp, E. coli
ttcactattccgatactgattggcg

SEQ ID NO: 127845 - DNA, 25 bp, E. coli
gcattttacaactcattgcgccacg

SEQ ID NO: 127846 - DNA, 25 bp, E. coli
gcgtcatgaaactggcggtggccta

SEQ ID NO: 127847 - DNA, 25 bp, E. coli
gcgtcatgaaacaggcggtggccta

SEQ ID NO: 127848 - DNA, 25 bp, E. coli
gcattttacaacacattgcgccacg

SEQ ID NO: 127849 - DNA, 25 bp, E. coli
cgttaccgaagttgagcgctggctg

SEQ ID NO: 127850 - DNA, 25 bp, E. coli
cgttaccgaagtagagcgctggctg

SEQ ID NO: 127851 - DNA, 25 bp, E. coli
cgatccggcatttcgtaatatcact

SEQ ID NO: 127852 - DNA, 25 bp, E. coli
cgctgtagcacatattcagcgcgat

SEQ ID NO: 127853 - DNA, 25 bp, E. coli
cgctgtagcacaaattcagcgcgat

SEQ ID NO: 127854 - DNA, 25 bp, E. coli
cgatccggcattacgtaatatcact

SEQ ID NO: 127855 - DNA, 25 bp, E. coli
ggtcaaatcggcccgcgtcatgaaa

SEQ ID NO: 127856 - DNA, 25 bp, E. coli
ggtcaaatcggcgcgcgtcatgaaa

SEQ ID NO: 127857 - DNA, 25 bp, E. coli
taatatcactttagacgggctggtg

SEQ ID NO: 127858 - DNA, 25 bp, E. coli
taatatcacttttgacgggctggtg

SEQ ID NO: 127859 - DNA, 25 bp, E. coli
tattgaaatggccatgctccgcgac

SEQ ID NO: 127860 - DNA, 25 bp, E. coli
tattgaaatggcgatgctccgcgac

SEQ ID NO: 127861 - DNA, 25 bp, E. coli
tgtatcccgaaaaaatccggcggtg

SEQ ID NO: 127862 - DNA, 25 bp, E. coli
tgtatcccgaaataatccggcggtg

SEQ ID NO: 127863 - DNA, 25 bp, E. coli
tgatctggccggtgaaaaagccctg

SEQ ID NO: 127864 - DNA, 25 bp, E. coli
tgatctggccggagaaaaagccctg

SEQ ID NO: 127865 - DNA, 25 bp, E. coli
tgatgatctctagaaaaacgccccg

SEQ ID NO: 127866 - DNA, 25 bp, E. coli
tgatgatctctacaaaaacgccccg

SEQ ID NO: 127867 - DNA, 25 bp, E. coli
tgagcttctcaaggcggcaatggcg

SEQ ID NO: 127868 - DNA, 25 bp, E. coli
tgagcttctcaacgcggcaatggcg

SEQ ID NO: 127869 - DNA, 25 bp, E. coli
tgaatccctggcaaaacgcgaggtg

SEQ ID NO: 127870 - DNA, 25 bp, E. coli
tgaatccctggctaaacgcgaggtg

SEQ ID NO: 127871 - DNA, 25 bp, E. coli
gctctgtatggctaaccgggcgtca

SEQ ID NO: 127872 - DNA, 25 bp, E. coli
gctctgtatggcaaaccgggcgtca

SEQ ID NO: 127873 - DNA, 25 bp, E. coli
cgtatctgttatctcaccggccgcg

SEQ ID NO: 127874 - DNA, 25 bp, E. coli
cgtatctgttatgtcaccggccgcg

SEQ ID NO: 127875 - DNA, 25 bp, E. coli
gattctgacgttagaagccccggac

SEQ ID NO: 127876 - DNA, 25 bp, E. coli
gattctgacgtttgaagccccggac

SEQ ID NO: 127877 - DNA, 25 bp, E. coli
taatcagtacattcaggaagcccgc

SEQ ID NO: 127878 - DNA, 25 bp, E. coli
taatcagtacatacaggaagcccgc

SEQ ID NO: 127879 - DNA, 25 bp, E. coli
gatgatgtacatgctgacccgcgtt

SEQ ID NO: 127880 - DNA, 25 bp, E. coli
gatgatgtacatcctgacccgcgtt

SEQ ID NO: 127881 - DNA, 25 bp, E. coli
caatactacacccaagccgaagctt

SEQ ID NO: 127882 - DNA, 25 bp, E. coli
caatactacaccgaagccgaagctt

SEQ ID NO: 127883 - DNA, 25 bp, E. coli
catttctgtgttactcagggcaaaa

SEQ ID NO: 127884 - DNA, 25 bp, E. coli
catttctgtgtttctcagggcaaaa

SEQ ID NO: 127885 - DNA, 25 bp, E. coli
tatgtctggttgtgctgtgcataat

SEQ ID NO: 127886 - DNA, 25 bp, E. coli
tatgtctggttgagctgtgcataat

SEQ ID NO: 127887 - DNA, 25 bp, E. coli
tatctggtgcagaaaatatagtaaa

SEQ ID NO: 127888 - DNA, 25 bp, E. coli
tatctggtgcagtaaatatagtaaa

SEQ ID NO: 127889 - DNA, 25 bp, E. coli
tattcagcgtaatctcgataaccaa

SEQ ID NO: 127890 - DNA, 25 bp, E. coli
tattcagcgtaaactcgataaccaa

SEQ ID NO: 127891 - DNA, 25 bp, E. coli
tgcatataaaagaaatattcagcgt

SEQ ID NO: 127892 - DNA, 25 bp, E. coli
tgcatataaaagtaatattcagcgt

SEQ ID NO: 127893 - DNA, 25 bp, E. coli
tgcataatgatgagacaagtatcgg

SEQ ID NO: 127894 - DNA, 25 bp, E. coli
tgcataatgatgtgacaagtatcgg

SEQ ID NO: 127895 - DNA, 25 bp, E. coli
tcgctcgtctgagattcaaatgtgg

SEQ ID NO: 127896 - DNA, 25 bp, E. coli
tcgctcgtctgacattcaaatgtgg

SEQ ID NO: 127897 - DNA, 25 bp, E. coli
gaagccgaagcttctttagccaggg

SEQ ID NO: 127898 - DNA, 25 bp, E. coli
gaagccgaagctactttagccaggg

SEQ ID NO: 127899 - DNA, 25 bp, E. coli
gataaccaatactacaccgaagccg

SEQ ID NO: 127900 - DNA, 25 bp, E. coli
gataaccaatacaacaccgaagccg

SEQ ID NO: 127901 - DNA, 25 bp, E. coli
gatgagacaagtatcggtaaatttg

SEQ ID NO: 127902 - DNA, 25 bp, E. coli
gatgagacaagtttcggtaaatttg

SEQ ID NO: 127903 - DNA, 25 bp, E. coli
aagcgacgtcccagtagcaaggcaa

SEQ ID NO: 127904 - DNA, 25 bp, E. coli
aagcgacgtccctgtagcaaggcaa

SEQ ID NO: 127905 - DNA, 25 bp, E. coli
tagcaaggcaaagcatcgcttcacg

SEQ ID NO: 127906 - DNA, 25 bp, E. coli
tagcaaggcaaaccatcgcttcacg

SEQ ID NO: 127907 - DNA, 25 bp, E. coli
ttgcgacaccgggaggacaccgggc

SEQ ID NO: 127908 - DNA, 25 bp, E. coli
ttgcgacaccggcaggacaccgggc

SEQ ID NO: 127909 - DNA, 25 bp, E. coli
tggtcggcaagccacgtccctgtag

SEQ ID NO: 127910 - DNA, 25 bp, E. coli
tctgcactggcgcacgtcgccagaa

SEQ ID NO: 127911 - DNA, 25 bp, E. coli
tctgcactggcggacgtcgccagaa

SEQ ID NO: 127912 - DNA, 25 bp, E. coli
ccatcgcttcacctgagatgctgaa

SEQ ID NO: 127913 - DNA, 25 bp, E. coli
ccatcgcttcacgtgagatgctgaa

SEQ ID NO: 127914 - DNA, 25 bp, E. coli
gcacgtcgccagaaagtattgttaa

SEQ ID NO: 127915 - DNA, 25 bp, E. coli
gcacgtcgccagtaagtattgttaa

SEQ ID NO: 127916 - DNA, 25 bp, E. coli
gaaagctcatccatctgcactggcg

SEQ ID NO: 127917 - DNA, 25 bp, E. coli
gaaagctcatccttctgcactggcg

SEQ ID NO: 127918 - DNA, 25 bp, E. coli
gtccctgtagcaaggcaaaccatcg

SEQ ID NO: 127919 - DNA, 25 bp, E. coli
gtccctgtagcatggcaaaccatcg

SEQ ID NO: 127920 - DNA, 25 bp, E. coli
ggcaaaccatcgcttcacgtgagat

SEQ ID NO: 127921 - DNA, 25 bp, E. coli
ggcaaaccatcggttcacgtgagat

SEQ ID NO: 127922 - DNA, 25 bp, E. coli
tggtcggcaagcgacgtccctgtag

SEQ ID NO: 127923 - DNA, 25 bp, E. coli
gatgctgaaaacgaaagctcatcct

SEQ ID NO: 127924 - DNA, 25 bp, E. coli
gatgctgaaaaccaaagctcatcct

SEQ ID NO: 127925 - DNA, 25 bp, E. coli
taaagggcagatacgctacaccact

SEQ ID NO: 127926 - DNA, 25 bp, E. coli
taaagggcagattcgctacaccact

SEQ ID NO: 127927 - DNA, 25 bp, E. coli
aaactgatggcctattacccgtcgg

SEQ ID NO: 127928 - DNA, 25 bp, E. coli
aaactgatggccaattacccgtcgg

SEQ ID NO: 127929 - DNA, 25 bp, E. coli
aaagatgcaaacaggacgcctcctg

SEQ ID NO: 127930 - DNA, 25 bp, E. coli
aaagatgcaaactggacgcctcctg

SEQ ID NO: 127931 - DNA, 25 bp, E. coli
tatgggtaaaccgaccagcgttggt

SEQ ID NO: 127932 - DNA, 25 bp, E. coli
tatgggtaaacccaccagcgttggt

SEQ ID NO: 127933 - DNA, 25 bp, E. coli
tccggtacatcacagcgagacagtt

SEQ ID NO: 127934 - DNA, 25 bp, E. coli
tccggtacatcagagcgagacagtt

SEQ ID NO: 127935 - DNA, 25 bp, E. coli
tctcattatgcagcacatcagggcg

SEQ ID NO: 127936 - DNA, 25 bp, E. coli
tctcattatgcaccacatcagggcg

SEQ ID NO: 127937 - DNA, 25 bp, E. coli
gttttatgatcgtcgcagacggcac

SEQ ID NO: 127938 - DNA, 25 bp, E. coli
gattatcaatctgtggctgccggcg

SEQ ID NO: 127939 - DNA, 25 bp, E. coli
gattatcaatctctggctgccggcg

SEQ ID NO: 127940 - DNA, 25 bp, E. coli
gttttatgatcgacgcagacggcac

SEQ ID NO: 127941 - DNA, 25 bp, E. coli
taaccgagggtggtattggctacgc

SEQ ID NO: 127942 - DNA, 25 bp, E. coli
taagtgttgatacccgaaatctgcc

SEQ ID NO: 127943 - DNA, 25 bp, E. coli
taaccgagggtgctattggctacgc

SEQ ID NO: 127944 - DNA, 25 bp, E. coli
taagtgttgatagccgaaatctgcc

SEQ ID NO: 127945 - DNA, 25 bp, E. coli
gatgagaatatgttaccgccagacc

SEQ ID NO: 127946 - DNA, 25 bp, E. coli
gatgagaatatgataccgccagacc

SEQ ID NO: 127947 - DNA, 25 bp, E. coli
taacaccattggcaattccgcagac

SEQ ID NO: 127948 - DNA, 25 bp, E. coli
taacaccattgggaattccgcagac

SEQ ID NO: 127949 - DNA, 25 bp, E. coli
agaaggaaccactgcaggctaccag

SEQ ID NO: 127950 - DNA, 25 bp, E. coli
agaaggaaccacagcaggctaccag

SEQ ID NO: 127951 - DNA, 25 bp, E. coli
ttgggaattccgcagacaccgtctg

SEQ ID NO: 127952 - DNA, 25 bp, E. coli
ttgggaattccggagacaccgtctg

SEQ ID NO: 127953 - DNA, 25 bp, E. coli
tgcagaattcccttcggcaaagatt

SEQ ID NO: 127954 - DNA, 25 bp, E. coli
tgcagaattcccatcggcaaagatt

SEQ ID NO: 127955 - DNA, 25 bp, E. coli
gctgtctgccaaatctttccccttg

SEQ ID NO: 127956 - DNA, 25 bp, E. coli
gctgtctgccaattctttccccttg

SEQ ID NO: 127957 - DNA, 25 bp, E. coli
gaatcgctctcacaaggaaccacag

SEQ ID NO: 127958 - DNA, 25 bp, E. coli
gaatcgctctcagaaggaaccacag

SEQ ID NO: 127959 - DNA, 25 bp, E. coli
gacaccgtctgcagaattcccatcg

SEQ ID NO: 127960 - DNA, 25 bp, E. coli
gacaccgtctgctgaattcccatcg

SEQ ID NO: 127961 - DNA, 25 bp, E. coli
cgttaacgcgttaatgaccgcgacg

SEQ ID NO: 127962 - DNA, 25 bp, E. coli
cgttaacgcgtttatgaccgcgacg

SEQ ID NO: 127963 - DNA, 25 bp, E. coli
cggcaaagatttcgcagacgctgtc

SEQ ID NO: 127964 - DNA, 25 bp, E. coli
cggcaaagatttggcagacgctgtc

SEQ ID NO: 127965 - DNA, 25 bp, E. coli
tgaccgcgacgtaccaggaaattgg

SEQ ID NO: 127966 - DNA, 25 bp, E. coli
tgaccgcgacgttccaggaaattgg

SEQ ID NO: 127967 - DNA, 25 bp, E. coli
gacccagttttaagagcggacacta

SEQ ID NO: 127968 - DNA, 25 bp, E. coli
gacccagttttatgagcggacacta

SEQ ID NO: 127969 - DNA, 25 bp, E. coli
caataaaccaaacgttcgcttcgtg

SEQ ID NO: 127970 - DNA, 25 bp, E. coli
aacccgcgaacaccaacttgaagtg

SEQ ID NO: 127971 - DNA, 25 bp, E. coli
caataaaccaaaggttcgcttcgtg

SEQ ID NO: 127972 - DNA, 25 bp, E. coli
atatgccgcgctcggtcagttgcgc

SEQ ID NO: 127973 - DNA, 25 bp, E. coli
atatgccgcgctgggtcagttgcgc

SEQ ID NO: 127974 - DNA, 25 bp, E. coli
aaattatcgacagtgtgctttccgg

SEQ ID NO: 127975 - DNA, 25 bp, E. coli
aacccgcgaacagcaacttgaagtg

SEQ ID NO: 127976 - DNA, 25 bp, E. coli
acagcaacttgatgtgatgacaggc

SEQ ID NO: 127977 - DNA, 25 bp, E. coli
aaattatcgacactgtgctttccgg

SEQ ID NO: 127978 - DNA, 25 bp, E. coli
acagcaacttgaagtgatgacaggc

SEQ ID NO: 127979 - DNA, 25 bp, E. coli
tcgagcgccacaaactcaatgcgat

SEQ ID NO: 127980 - DNA, 25 bp, E. coli
tcgagcgccacatactcaatgcgat

SEQ ID NO: 127981 - DNA, 25 bp, E. coli
tcgtctgctttaaatcgccccggaa

SEQ ID NO: 127982 - DNA, 25 bp, E. coli
tcgtctgctttatatcgccccggaa

SEQ ID NO: 127983 - DNA, 25 bp, E. coli
ggttcccgacgctgccgtttatggc

SEQ ID NO: 127984 - DNA, 25 bp, E. coli
ggttcccgacgcagccgtttatggc

SEQ ID NO: 127985 - DNA, 25 bp, E. coli
gtcagttgcgccagcggttcccgac

SEQ ID NO: 127986 - DNA, 25 bp, E. coli
gtcagttgcgcctgcggttcccgac

SEQ ID NO: 127987 - DNA, 25 bp, E. coli
gttgcaggatatggagcgccacaaa

SEQ ID NO: 127988 - DNA, 25 bp, E. coli
gttgcaggatatcgagcgccacaaa

SEQ ID NO: 127989 - DNA, 25 bp, E. coli
ggcatgggcatctataaaccaaacg

SEQ ID NO: 127990 - DNA, 25 bp, E. coli
ggcatgggcatcaataaaccaaacg

SEQ ID NO: 127991 - DNA, 25 bp, E. coli
acaactgagcaaaaccttcaaccag

SEQ ID NO: 127992 - DNA, 25 bp, E. coli
acaactgagcaataccttcaaccag

SEQ ID NO: 127993 - DNA, 25 bp, E. coli
aacaccggctacatcttccaacaat

SEQ ID NO: 127994 - DNA, 25 bp, E. coli
actttgcgtatcagcgtgtttccac

SEQ ID NO: 127995 - DNA, 25 bp, E. coli
aacaccggctacttcttccaacaat

SEQ ID NO: 127996 - DNA, 25 bp, E. coli
actttgcgtatctgcgtgtttccac

SEQ ID NO: 127997 - DNA, 25 bp, E. coli
tatggcgcactttgcgtatcagcgt

SEQ ID NO: 127998 - DNA, 25 bp, E. coli
tatggcgcacttagcgtatcagcgt

SEQ ID NO: 127999 - DNA, 25 bp, E. coli
tatcagcgtgttaccacgctctccg

SEQ ID NO: 128000 - DNA, 25 bp, E. coli
tatctgcgtcgatcaactgagcaaa

SEQ ID NO: 128001 - DNA, 25 bp, E. coli
tatcagcgtgtttccacgctctccg

SEQ ID NO: 128002 - DNA, 25 bp, E. coli
tatctgcgtcgaacaactgagcaaa

SEQ ID NO: 128003 - DNA, 25 bp, E. coli
tgcaaacgattaactgcgtcgaaca

SEQ ID NO: 128004 - DNA, 25 bp, E. coli
tgcaaacgattatctgcgtcgaaca

SEQ ID NO: 128005 - DNA, 25 bp, E. coli
gcgtcgaacaactgagcaaaacctt

SEQ ID NO: 128006 - DNA, 25 bp, E. coli
gcgtcgaacaacagagcaaaacctt

SEQ ID NO: 128007 - DNA, 25 bp, E. coli
cccgcgtcggtatggcgcactttgc

SEQ ID NO: 128008 - DNA, 25 bp, E. coli
cgctgacccgcgacggtatggcgca

SEQ ID NO: 128009 - DNA, 25 bp, E. coli
cccgcgtcggtaaggcgcactttgc

SEQ ID NO: 128010 - DNA, 25 bp, E. coli
cgctgacccgcgtcggtatggcgca

SEQ ID NO: 128011 - DNA, 25 bp, E. coli
gattatctgcgtggaacaactgagc

SEQ ID NO: 128012 - DNA, 25 bp, E. coli
gattatctgcgtcgaacaactgagc

SEQ ID NO: 128013 - DNA, 25 bp, E. coli
tatttagctgtagtaatcactcgcc

SEQ ID NO: 128014 - DNA, 25 bp, E. coli
tatttagctgtactaatcactcgcc

SEQ ID NO: 128015 - DNA, 25 bp, E. coli
tttaaacgccaccagatcccgtgga

SEQ ID NO: 128016 - DNA, 25 bp, E. coli
tttaaacgccacgagatcccgtgga

SEQ ID NO: 128017 - DNA, 25 bp, E. coli
tgtttacagtaatgtaaccttcccg

SEQ ID NO: 128018 - DNA, 25 bp, E. coli
tggttataccaaatgcccgcccaga

SEQ ID NO: 128019 - DNA, 25 bp, E. coli
tgtttacagtaaagtaaccttcccg

SEQ ID NO: 128020 - DNA, 25 bp, E. coli
tcttacacgattcagctaatgagtc

SEQ ID NO: 128021 - DNA, 25 bp, E. coli
tcttacacgattgagctaatgagtc

SEQ ID NO: 128022 - DNA, 25 bp, E. coli
gcaacatatgtgacctggcagccaa

SEQ ID NO: 128023 - DNA, 25 bp, E. coli
gcaacatatgtgtcctggcagccaa

SEQ ID NO: 128024 - DNA, 25 bp, E. coli
gttataacgcccttttgcaacagct

SEQ ID NO: 128025 - DNA, 25 bp, E. coli
gttataacgcccatttgcaacagct

SEQ ID NO: 128026 - DNA, 25 bp, E. coli
gtgcggcttagcctttggaaattat

SEQ ID NO: 128027 - DNA, 25 bp, E. coli
gtgcggcttagcgtttggaaattat

SEQ ID NO: 128028 - DNA, 25 bp, E. coli
tggcagccaaatgcaagtaacagga

SEQ ID NO: 128029 - DNA, 25 bp, E. coli
tggttataccaattgcccgcccaga

SEQ ID NO: 128030 - DNA, 25 bp, E. coli
tggcagccaaatccaagtaacagga

SEQ ID NO: 128031 - DNA, 25 bp, E. coli
gagtctttattttctcatcacccag

SEQ ID NO: 128032 - DNA, 25 bp, E. coli
gagtctttatttactcatcacccag

SEQ ID NO: 128033 - DNA, 25 bp, E. coli
gatcccgtggaaatgaggtcgttaa

SEQ ID NO: 128034 - DNA, 25 bp, E. coli
gatcccgtggaattgaggtcgttaa

SEQ ID NO: 128035 - DNA, 25 bp, E. coli
caaggcctggcaacaacttttggag

SEQ ID NO: 128036 - DNA, 25 bp, E. coli
caaggcctggcatcaacttttggag

SEQ ID NO: 128037 - DNA, 25 bp, E. coli
cacataataagaaggccgcagccag

SEQ ID NO: 128038 - DNA, 25 bp, E. coli
cacataataagatggccgcagccag

SEQ ID NO: 128039 - DNA, 25 bp, E. coli
atggctgccctttgcgaccggttca

SEQ ID NO: 128040 - DNA, 25 bp, E. coli
atggctgcccttagcgaccggttca

SEQ ID NO: 128041 - DNA, 25 bp, E. coli
aaaaacgtcgcggtactgctggcgt

SEQ ID NO: 128042 - DNA, 25 bp, E. coli
aaaaacgtcgcgctactgctggcgt

SEQ ID NO: 128043 - DNA, 25 bp, E. coli
tttgttggttgattcagctccggca

SEQ ID NO: 128044 - DNA, 25 bp, E. coli
tttgttggttgaatcagctccggca

SEQ ID NO: 128045 - DNA, 25 bp, E. coli
tttcggacgcaaacccgcgatggtg

SEQ ID NO: 128046 - DNA, 25 bp, E. coli
tttcggacgcaatcccgcgatggtg

SEQ ID NO: 128047 - DNA, 25 bp, E. coli
tttaggtttaagagcatggctgccc

SEQ ID NO: 128048 - DNA, 25 bp, E. coli
tttaggtttaagtgcatggctgccc

SEQ ID NO: 128049 - DNA, 25 bp, E. coli
tccgcccagtgctgataaaaacgtc

SEQ ID NO: 128050 - DNA, 25 bp, E. coli
tccgcccagtgcagataaaaacgtc

SEQ ID NO: 128051 - DNA, 25 bp, E. coli
tcaccattgcgctgatgagtcttgg

SEQ ID NO: 128052 - DNA, 25 bp, E. coli
ggcgaagtcggtccctcaatgtctt

SEQ ID NO: 128053 - DNA, 25 bp, E. coli
ggcgaagtcggtgcctcaatgtctt

SEQ ID NO: 128054 - DNA, 25 bp, E. coli
tcaccattgcgcagatgagtcttgg

SEQ ID NO: 128055 - DNA, 25 bp, E. coli
gagtcttggtacactgatgatcggc

SEQ ID NO: 128056 - DNA, 25 bp, E. coli
gagtcttggtactctgatgatcggc

SEQ ID NO: 128057 - DNA, 25 bp, E. coli
tttgtcgggcagtcgtggaatatac

SEQ ID NO: 128058 - DNA, 25 bp, E. coli
tattaaagcctctttcagcagtacg

SEQ ID NO: 128059 - DNA, 25 bp, E. coli
tttgtcgggcagacgtggaatatac

SEQ ID NO: 128060 - DNA, 25 bp, E. coli
tattaaagcctcattcagcagtacg

SEQ ID NO: 128061 - DNA, 25 bp, E. coli
ttaaagcctcatacagcagtacgtt

SEQ ID NO: 128062 - DNA, 25 bp, E. coli
ttaaagcctcattcagcagtacgtt

SEQ ID NO: 128063 - DNA, 25 bp, E. coli
tgtcgggcagacctggaatatacca

SEQ ID NO: 128064 - DNA, 25 bp, E. coli
tgtcgggcagacgtggaatatacca

SEQ ID NO: 128065 - DNA, 25 bp, E. coli
tgcgcaaagaatttgtcgatgataa

SEQ ID NO: 128066 - DNA, 25 bp, E. coli
tgcgcaaagaatatgtcgatgataa

SEQ ID NO: 128067 - DNA, 25 bp, E. coli
tcgggcagacgtggaatataccagg

SEQ ID NO: 128068 - DNA, 25 bp, E. coli
tcgggcagacgtcgaatataccagg

SEQ ID NO: 128069 - DNA, 25 bp, E. coli
cgggcagacgtggaatataccaggc

SEQ ID NO: 128070 - DNA, 25 bp, E. coli
cgggcagacgtgcaatataccaggc

SEQ ID NO: 128071 - DNA, 25 bp, E. coli
gtgcgcaaagaatttgtcgatgata

SEQ ID NO: 128072 - DNA, 25 bp, E. coli
gtgcgcaaagaaattgtcgatgata

SEQ ID NO: 128073 - DNA, 25 bp, E. coli
gtcgggcagacgaggaatataccag

SEQ ID NO: 128074 - DNA, 25 bp, E. coli
gggcagacgtggaatataccaggca

SEQ ID NO: 128075 - DNA, 25 bp, E. coli
gggcagacgtggtatataccaggca

SEQ ID NO: 128076 - DNA, 25 bp, E. coli
gtcgggcagacgtggaatataccag

SEQ ID NO: 128077 - DNA, 25 bp, E. coli
ggcagacgtggaatataccaggcag

SEQ ID NO: 128078 - DNA, 25 bp, E. coli
ggcagacgtggattataccaggcag

SEQ ID NO: 128079 - DNA, 25 bp, E. coli
catctggaagatctgactaagcgcc

SEQ ID NO: 128080 - DNA, 25 bp, E. coli
catctggaagatgtgactaagcgcc

SEQ ID NO: 128081 - DNA, 25 bp, E. coli
aaaatcaacaatttaccgtgcactg

SEQ ID NO: 128082 - DNA, 25 bp, E. coli
aaacgtgtgccattcatctgccgga

SEQ ID NO: 128083 - DNA, 25 bp, E. coli
aaaatcaacaatataccgtgcactg

SEQ ID NO: 128084 - DNA, 25 bp, E. coli
aaacgtgtgccaatcatctgccgga

SEQ ID NO: 128085 - DNA, 25 bp, E. coli
tgactaagcgcctgattttaccctg

SEQ ID NO: 128086 - DNA, 25 bp, E. coli
tgactaagcgccagattttaccctg

SEQ ID NO: 128087 - DNA, 25 bp, E. coli
tgccattcatctcccggaacatctg

SEQ ID NO: 128088 - DNA, 25 bp, E. coli
tgccattcatctgccggaacatctg

SEQ ID NO: 128089 - DNA, 25 bp, E. coli
cgaaaacggtcacgcatggctgagt

SEQ ID NO: 128090 - DNA, 25 bp, E. coli
cgaaaacggtcaggcatggctgagt

SEQ ID NO: 128091 - DNA, 25 bp, E. coli
gggcgaccagaaaacgtgtgccatt

SEQ ID NO: 128092 - DNA, 25 bp, E. coli
gggtcgatgaaattcaacaatttac

SEQ ID NO: 128093 - DNA, 25 bp, E. coli
gggtcgatgaaaatcaacaatttac

SEQ ID NO: 128094 - DNA, 25 bp, E. coli
tggttggcgaaatcggtcacgcatg

SEQ ID NO: 128095 - DNA, 25 bp, E. coli
gggcgaccagaatacgtgtgccatt

SEQ ID NO: 128096 - DNA, 25 bp, E. coli
tggttggcgaaaacggtcacgcatg

SEQ ID NO: 128097 - DNA, 25 bp, E. coli
tggaagatgtgagtaagcgcctgat

SEQ ID NO: 128098 - DNA, 25 bp, E. coli
tggaagatgtgactaagcgcctgat

SEQ ID NO: 128099 - DNA, 25 bp, E. coli
taagcgcctgatattaccctgtcat

SEQ ID NO: 128100 - DNA, 25 bp, E. coli
taagcgcctgattttaccctgtcat

SEQ ID NO: 128101 - DNA, 25 bp, E. coli
aagactgaagaccacctggcgcaga

SEQ ID NO: 128102 - DNA, 25 bp, E. coli
aagactgaagacgacctggcgcaga

SEQ ID NO: 128103 - DNA, 25 bp, E. coli
cagaacggcattgaccgtaatagcg

SEQ ID NO: 128104 - DNA, 25 bp, E. coli
catgctgcagaacggcattgaccgt

SEQ ID NO: 128105 - DNA, 25 bp, E. coli
catgctgcagaagggcattgaccgt

SEQ ID NO: 128106 - DNA, 25 bp, E. coli
cataaagactgatgacgacctggcg

SEQ ID NO: 128107 - DNA, 25 bp, E. coli
cataaagactgaagacgacctggcg

SEQ ID NO: 128108 - DNA, 25 bp, E. coli
cagaacggcattcaccgtaatagcg

SEQ ID NO: 128109 - DNA, 25 bp, E. coli
caagccactctgaaaattacccgta

SEQ ID NO: 128110 - DNA, 25 bp, E. coli
caagccactctgtaaattacccgta

SEQ ID NO: 128111 - DNA, 25 bp, E. coli
aaattacccgtaccatgctgcagaa

SEQ ID NO: 128112 - DNA, 25 bp, E. coli
aaattacccgtagcatgctgcagaa

SEQ ID NO: 128113 - DNA, 25 bp, E. coli
gcaaatcaccggagcacacgctaat

SEQ ID NO: 128114 - DNA, 25 bp, E. coli
gcaaatcaccggtgcacacgctaat

SEQ ID NO: 128115 - DNA, 25 bp, E. coli
gaaagtgagctcgaagccactctga

SEQ ID NO: 128116 - DNA, 25 bp, E. coli
gaaagtgagctccaagccactctga

SEQ ID NO: 128117 - DNA, 25 bp, E. coli
taagtcgttcagtaagtgagctcca

SEQ ID NO: 128118 - DNA, 25 bp, E. coli
taagtcgttcagaaagtgagctcca

SEQ ID NO: 128119 - DNA, 25 bp, E. coli
gagcacacgctattaagtcgttcag

SEQ ID NO: 128120 - DNA, 25 bp, E. coli
gaccgtaatagcgtcataaagactg

SEQ ID NO: 128121 - DNA, 25 bp, E. coli
gagcacacgctaataagtcgttcag

SEQ ID NO: 128122 - DNA, 25 bp, E. coli
gaccgtaatagcctcataaagactg

SEQ ID NO: 128123 - DNA, 25 bp, E. coli
aacgccggacggtcgtaaagcacat

SEQ ID NO: 128124 - DNA, 25 bp, E. coli
catgcgggtatgagtaacgatttcc

SEQ ID NO: 128125 - DNA, 25 bp, E. coli
catgcgggtatgtgtaacgatttcc

SEQ ID NO: 128126 - DNA, 25 bp, E. coli
aacgccggacggacgtaaagcacat

SEQ ID NO: 128127 - DNA, 25 bp, E. coli
tatgcgggcacaacgtctatctccg

SEQ ID NO: 128128 - DNA, 25 bp, E. coli
tatgcgggcacatcgtctatctccg

SEQ ID NO: 128129 - DNA, 25 bp, E. coli
tatccatactatcgccgtgacgttg

SEQ ID NO: 128130 - DNA, 25 bp, E. coli
tatccatactatggccgtgacgttg

SEQ ID NO: 128131 - DNA, 25 bp, E. coli
tgttcaggtgatgcgctgcggcttc

SEQ ID NO: 128132 - DNA, 25 bp, E. coli
tgttcaggtgatccgctgcggcttc

SEQ ID NO: 128133 - DNA, 25 bp, E. coli
tgacaacactaaaactggatacgct

SEQ ID NO: 128134 - DNA, 25 bp, E. coli
tgacaacactaatactggatacgct

SEQ ID NO: 128135 - DNA, 25 bp, E. coli
tctggaagatctgcacggcgagcaa

SEQ ID NO: 128136 - DNA, 25 bp, E. coli
tctggaagatctccacggcgagcaa

SEQ ID NO: 128137 - DNA, 25 bp, E. coli
gcgaaacattgcaggaggcgaagaa

SEQ ID NO: 128138 - DNA, 25 bp, E. coli
gcgaaacattgctggaggcgaagaa

SEQ ID NO: 128139 - DNA, 25 bp, E. coli
gaacgagcacaagactataccgaga

SEQ ID NO: 128140 - DNA, 25 bp, E. coli
gaacgagcacaacactataccgaga

SEQ ID NO: 128141 - DNA, 25 bp, E. coli
tggcggcaactattatgcgggcaca

SEQ ID NO: 128142 - DNA, 25 bp, E. coli
tggcggcaactaatatgcgggcaca

SEQ ID NO: 128143 - DNA, 25 bp, E. coli
gaggcgaagaaagatccggatcaat

SEQ ID NO: 128144 - DNA, 25 bp, E. coli
gaggcgaagaaacatccggatcaat

SEQ ID NO: 128145 - DNA, 25 bp, E. coli
caatgtgtgactgattttatgagta

SEQ ID NO: 128146 - DNA, 25 bp, E. coli
caatgtgtgactcattttatgagta

SEQ ID NO: 128147 - DNA, 25 bp, E. coli
cacaatgtgtgactgattttatgag

SEQ ID NO: 128148 - DNA, 25 bp, E. coli
cacaatgtgtgagtgattttatgag

SEQ ID NO: 128149 - DNA, 25 bp, E. coli
catgatccacaagcgcgtgatattg

SEQ ID NO: 128150 - DNA, 25 bp, E. coli
catgatccacaaccgcgtgatattg

SEQ ID NO: 128151 - DNA, 25 bp, E. coli
tgtgtgactgatattatgagtaccg

SEQ ID NO: 128152 - DNA, 25 bp, E. coli
tgtgactgattttatgagtaccgtg

SEQ ID NO: 128153 - DNA, 25 bp, E. coli
tgtgactgatttaatgagtaccgtg

SEQ ID NO: 128154 - DNA, 25 bp, E. coli
tgtgtgactgattttatgagtaccg

SEQ ID NO: 128155 - DNA, 25 bp, E. coli
gactgattttatcagtaccgtgatg

SEQ ID NO: 128156 - DNA, 25 bp, E. coli
gactgattttatgagtaccgtgatg

SEQ ID NO: 128157 - DNA, 25 bp, E. coli
cgcacaatgtgtcactgattttatg

SEQ ID NO: 128158 - DNA, 25 bp, E. coli
cgcacaatgtgtgactgattttatg

SEQ ID NO: 128159 - DNA, 25 bp, E. coli
ctgattttatgactaccgtgatgtc

SEQ ID NO: 128160 - DNA, 25 bp, E. coli
ctgattttatgagtaccgtgatgtc

SEQ ID NO: 128161 - DNA, 25 bp, E. coli
gatccacaagcgggtgatattgccg

SEQ ID NO: 128162 - DNA, 25 bp, E. coli
ggctttctgcgaaggcacgagaggg

SEQ ID NO: 128163 - DNA, 25 bp, E. coli
ggctttctgcgatggcacgagaggg

SEQ ID NO: 128164 - DNA, 25 bp, E. coli
tcaatattatcaggccgcagaaacg

SEQ ID NO: 128165 - DNA, 25 bp, E. coli
tcaatattatcacgccgcagaaacg

SEQ ID NO: 128166 - DNA, 25 bp, E. coli
gatccacaagcgcgtgatattgccg

SEQ ID NO: 128167 - DNA, 25 bp, E. coli
aacggtggagcgcattttcattacg

SEQ ID NO: 128168 - DNA, 25 bp, E. coli
cagtaatttcttcgtatttcgggtg

SEQ ID NO: 128169 - DNA, 25 bp, E. coli
cacttgctgcacacgtcgaggttca

SEQ ID NO: 128170 - DNA, 25 bp, E. coli
cacttgctgcactcgtcgaggttca

SEQ ID NO: 128171 - DNA, 25 bp, E. coli
cagtaatttcttggtatttcgggtg

SEQ ID NO: 128172 - DNA, 25 bp, E. coli
tacgttaccgcaagagcagctagca

SEQ ID NO: 128173 - DNA, 25 bp, E. coli
tacgttaccgcatgagcagctagca

SEQ ID NO: 128174 - DNA, 25 bp, E. coli
aacggtggagcggattttcattacg

SEQ ID NO: 128175 - DNA, 25 bp, E. coli
tatttcgggtgattatcttttttca

SEQ ID NO: 128176 - DNA, 25 bp, E. coli
tatttcgggtgaatatcttttttca

SEQ ID NO: 128177 - DNA, 25 bp, E. coli
ttcaggtcatgaccaacggtggagc

SEQ ID NO: 128178 - DNA, 25 bp, E. coli
ttcaggtcatgagcaacggtggagc

SEQ ID NO: 128179 - DNA, 25 bp, E. coli
tcatgaccaacgctggagcggattt

SEQ ID NO: 128180 - DNA, 25 bp, E. coli
tcatgaccaacggtggagcggattt

SEQ ID NO: 128181 - DNA, 25 bp, E. coli
gcacacgtcgaggttcaggtcatga

SEQ ID NO: 128182 - DNA, 25 bp, E. coli
gcacacgtcgagcttcaggtcatga

SEQ ID NO: 128183 - DNA, 25 bp, E. coli
gattttcattaccttaccgcaagag

SEQ ID NO: 128184 - DNA, 25 bp, E. coli
gattttcattacgttaccgcaagag

SEQ ID NO: 128185 - DNA, 25 bp, E. coli
gtggcacttgctccacacgtcgagg

SEQ ID NO: 128186 - DNA, 25 bp, E. coli
gtggcacttgctgcacacgtcgagg

SEQ ID NO: 128187 - DNA, 25 bp, E. coli
gagcagctagcagtaatttcttcgt

SEQ ID NO: 128188 - DNA, 25 bp, E. coli
gagcagctagcactaatttcttcgt

SEQ ID NO: 128189 - DNA, 25 bp, E. coli
aaatgttggctgtgtgccgaaaaaa

SEQ ID NO: 128190 - DNA, 25 bp, E. coli
aaatgttggctgagtgccgaaaaaa

SEQ ID NO: 128191 - DNA, 25 bp, E. coli
tgtgccgaaaaatgtgatgtggcac

SEQ ID NO: 128192 - DNA, 25 bp, E. coli
tgttggctgtgtgccgaaaaaagtg

SEQ ID NO: 128193 - DNA, 25 bp, E. coli
tgtgccgaaaaaagtgatgtggcac

SEQ ID NO: 128194 - DNA, 25 bp, E. coli
tgtgtgccgaaaaaagtgatgtggc

SEQ ID NO: 128195 - DNA, 25 bp, E. coli
tgtgtgccgaaataagtgatgtggc

SEQ ID NO: 128196 - DNA, 25 bp, E. coli
tgttggctgtgtcccgaaaaaagtg

SEQ ID NO: 128197 - DNA, 25 bp, E. coli
cctgcgtaaatgatggctgtgtgcc

SEQ ID NO: 128198 - DNA, 25 bp, E. coli
cctgcgtaaatgttggctgtgtgcc

SEQ ID NO: 128199 - DNA, 25 bp, E. coli
gctgtgtgccgataaaagtgatgtg

SEQ ID NO: 128200 - DNA, 25 bp, E. coli
gctgtgtgccgaaaaaagtgatgtg

SEQ ID NO: 128201 - DNA, 25 bp, E. coli
gcacctgcgtaaatgttggctgtgt

SEQ ID NO: 128202 - DNA, 25 bp, E. coli
gcacctgcgtaattgttggctgtgt

SEQ ID NO: 128203 - DNA, 25 bp, E. coli
cgtaaatgttgggtgtgtgccgaaa

SEQ ID NO: 128204 - DNA, 25 bp, E. coli
cgtaaatgttggctgtgtgccgaaa

SEQ ID NO: 128205 - DNA, 25 bp, E. coli
cggcacctgcgttaatgttggctgt

SEQ ID NO: 128206 - DNA, 25 bp, E. coli
cggcacctgcgtaaatgttggctgt

SEQ ID NO: 128207 - DNA, 25 bp, E. coli
ggcggcacctgcctaaatgttggct

SEQ ID NO: 128208 - DNA, 25 bp, E. coli
tggctgtgtgccgaaaaaagtgatg

SEQ ID NO: 128209 - DNA, 25 bp, E. coli
tggctgtgtgcccaaaaaagtgatg

SEQ ID NO: 128210 - DNA, 25 bp, E. coli
ggcggcacctgcgtaaatgttggct

SEQ ID NO: 128211 - DNA, 25 bp, E. coli
taccagaccccatataagtccgagc

SEQ ID NO: 128212 - DNA, 25 bp, E. coli
taccagaccccaaataagtccgagc

SEQ ID NO: 128213 - DNA, 25 bp, E. coli
ttcgatattagaagcaggaatcgcc

SEQ ID NO: 128214 - DNA, 25 bp, E. coli
ttcgatattagatgcaggaatcgcc

SEQ ID NO: 128215 - DNA, 25 bp, E. coli
tgatgttgcgtttgcactaccagac

SEQ ID NO: 128216 - DNA, 25 bp, E. coli
tgatgttgcgttagcactaccagac

SEQ ID NO: 128217 - DNA, 25 bp, E. coli
tcgtagggtgggtcatcagcaccgt

SEQ ID NO: 128218 - DNA, 25 bp, E. coli
tcgtagggtgggacatcagcaccgt

SEQ ID NO: 128219 - DNA, 25 bp, E. coli
taagtccgagcaggaagggactgaa

SEQ ID NO: 128220 - DNA, 25 bp, E. coli
taagtccgagcacgaagggactgaa

SEQ ID NO: 128221 - DNA, 25 bp, E. coli
gaatcgccaaaaatgaatccggtga

SEQ ID NO: 128222 - DNA, 25 bp, E. coli
gaatcgccaaaattgaatccggtga

SEQ ID NO: 128223 - DNA, 25 bp, E. coli
gcaccgttgatacctatgatgcgct

SEQ ID NO: 128224 - DNA, 25 bp, E. coli
gcaccgttgatagctatgatgcgct

SEQ ID NO: 128225 - DNA, 25 bp, E. coli
gactgaagttggacagacgctctgg

SEQ ID NO: 128226 - DNA, 25 bp, E. coli
gactgaagttggtcagacgctctgg

SEQ ID NO: 128227 - DNA, 25 bp, E. coli
cattcagactcatccgctcgtaggg

SEQ ID NO: 128228 - DNA, 25 bp, E. coli
cattcagactcaaccgctcgtaggg

SEQ ID NO: 128229 - DNA, 25 bp, E. coli
ggttaaccactgttgttgccagaca

SEQ ID NO: 128230 - DNA, 25 bp, E. coli
ggtaaacgagtaacggcgtcattaa

SEQ ID NO: 128231 - DNA, 25 bp, E. coli
ggtaaacgagtatcggcgtcattaa

SEQ ID NO: 128232 - DNA, 25 bp, E. coli
ggttaaccactgatgttgccagaca

SEQ ID NO: 128233 - DNA, 25 bp, E. coli
caagttaatatcatgccaaaagggc

SEQ ID NO: 128234 - DNA, 25 bp, E. coli
caagttaatatcttgccaaaagggc

SEQ ID NO: 128235 - DNA, 25 bp, E. coli
catcggattgttgaggagaatgata

SEQ ID NO: 128236 - DNA, 25 bp, E. coli
catcggattgttcaggagaatgata

SEQ ID NO: 128237 - DNA, 25 bp, E. coli
catttaccgggataggcatcatagg

SEQ ID NO: 128238 - DNA, 25 bp, E. coli
catttaccgggaaaggcatcatagg

SEQ ID NO: 128239 - DNA, 25 bp, E. coli
aaaacggcagaagcgcgaggttctg

SEQ ID NO: 128240 - DNA, 25 bp, E. coli
aaaacggcagaaccgcgaggttctg

SEQ ID NO: 128241 - DNA, 25 bp, E. coli
taggatttccagaaaattggtgaca

SEQ ID NO: 128242 - DNA, 25 bp, E. coli
taggatttccagtaaattggtgaca

SEQ ID NO: 128243 - DNA, 25 bp, E. coli
tgttccctatgctggacgttgtgag

SEQ ID NO: 128244 - DNA, 25 bp, E. coli
tgttccctatgcaggacgttgtgag

SEQ ID NO: 128245 - DNA, 25 bp, E. coli
tgaactcacagcaccatttaccggg

SEQ ID NO: 128246 - DNA, 25 bp, E. coli
tgaactcacagctccatttaccggg

SEQ ID NO: 128247 - DNA, 25 bp, E. coli
gcagaatctttctgaactcacagca

SEQ ID NO: 128248 - DNA, 25 bp, E. coli
gcagaatctttcagaactcacagca

SEQ ID NO: 128249 - DNA, 25 bp, E. coli
cgaggttctgcccttcatcggattg

SEQ ID NO: 128250 - DNA, 25 bp, E. coli
cgaggttctgccgttcatcggattg

SEQ ID NO: 128251 - DNA, 25 bp, E. coli
ggaaaacgtgttccctatgcaggac

SEQ ID NO: 128252 - DNA, 25 bp, E. coli
ggaaaacgtgttgcctatgcaggac

SEQ ID NO: 128253 - DNA, 25 bp, E. coli
tcaatgcacatagattgcagaatct

SEQ ID NO: 128254 - DNA, 25 bp, E. coli
tcaatgcacatacattgcagaatct

SEQ ID NO: 128255 - DNA, 25 bp, E. coli
cagatgatgtcgctttacggaaagg

SEQ ID NO: 128256 - DNA, 25 bp, E. coli
cagatgatgtcggtttacggaaagg

SEQ ID NO: 128257 - DNA, 25 bp, E. coli
catcagatgatgtcggtttacggaa

SEQ ID NO: 128258 - DNA, 25 bp, E. coli
catcagatgatgacggtttacggaa

SEQ ID NO: 128259 - DNA, 25 bp, E. coli
atccaccagactttttgtctgaagc

SEQ ID NO: 128260 - DNA, 25 bp, E. coli
cagcggatccaccagactttttgtc

SEQ ID NO: 128261 - DNA, 25 bp, E. coli
atccaccagactatttgtctgaagc

SEQ ID NO: 128262 - DNA, 25 bp, E. coli
agagcacagcggatccaccagactt

SEQ ID NO: 128263 - DNA, 25 bp, E. coli
cagcggatccacgagactttttgtc

SEQ ID NO: 128264 - DNA, 25 bp, E. coli
agagcacagcggttccaccagactt

SEQ ID NO: 128265 - DNA, 25 bp, E. coli
ttgacccagagctcagcggatccac

SEQ ID NO: 128266 - DNA, 25 bp, E. coli
ttgacccagagcacagcggatccac

SEQ ID NO: 128267 - DNA, 25 bp, E. coli
tgatgtcggttttcggaaaggcgtc

SEQ ID NO: 128268 - DNA, 25 bp, E. coli
tgatgtcggtttacggaaaggcgtc

SEQ ID NO: 128269 - DNA, 25 bp, E. coli
gcatcagatgatctcggtttacgga

SEQ ID NO: 128270 - DNA, 25 bp, E. coli
gcatcagatgatgtcggtttacgga

SEQ ID NO: 128271 - DNA, 25 bp, E. coli
gcacagcggatccaccagacttttt

SEQ ID NO: 128272 - DNA, 25 bp, E. coli
gcacagcggatcgaccagacttttt

SEQ ID NO: 128273 - DNA, 25 bp, E. coli
ggatccaccagactttttgtctgaa

SEQ ID NO: 128274 - DNA, 25 bp, E. coli
ggatccaccagagtttttgtctgaa

SEQ ID NO: 128275 - DNA, 25 bp, E. coli
ggcgagcatcagatgatgtcggttt

SEQ ID NO: 128276 - DNA, 25 bp, E. coli
ggcgagcatcagttgatgtcggttt

SEQ ID NO: 128277 - DNA, 25 bp, E. coli
caatagaacgtgctctttcaggacg

SEQ ID NO: 128278 - DNA, 25 bp, E. coli
caatagaacgtggtctttcaggacg

SEQ ID NO: 128279 - DNA, 25 bp, E. coli
taaagaagcatatcaggcagccgct

SEQ ID NO: 128280 - DNA, 25 bp, E. coli
taaagaagcataacaggcagccgct

SEQ ID NO: 128281 - DNA, 25 bp, E. coli
tatagagttatctaaggcatgcgac

SEQ ID NO: 128282 - DNA, 25 bp, E. coli
tatataggttttggtggtccgatgc

SEQ ID NO: 128283 - DNA, 25 bp, E. coli
tatataggttttcgtggtccgatgc

SEQ ID NO: 128284 - DNA, 25 bp, E. coli
tatagagttatcaaaggcatgcgac

SEQ ID NO: 128285 - DNA, 25 bp, E. coli
tcaggacgtaaggataagattcagt

SEQ ID NO: 128286 - DNA, 25 bp, E. coli
tcaggacgtaagcataagattcagt

SEQ ID NO: 128287 - DNA, 25 bp, E. coli
tggttagactatccctccccgaaaa

SEQ ID NO: 128288 - DNA, 25 bp, E. coli
ggcatgcgacctatctaactggcaa

SEQ ID NO: 128289 - DNA, 25 bp, E. coli
tggttagactatgcctccccgaaaa

SEQ ID NO: 128290 - DNA, 25 bp, E. coli
ggcagccgctgatgagttctcttta

SEQ ID NO: 128291 - DNA, 25 bp, E. coli
ggcagccgctgaagagttctcttta

SEQ ID NO: 128292 - DNA, 25 bp, E. coli
ggcatgcgacctttctaactggcaa

SEQ ID NO: 128293 - DNA, 25 bp, E. coli
tcaacaaattggcaagacgtgcaag

SEQ ID NO: 128294 - DNA, 25 bp, E. coli
tcaacaaattgggaagacgtgcaag

SEQ ID NO: 128295 - DNA, 25 bp, E. coli
gatggcagtcataccatgttgacaa

SEQ ID NO: 128296 - DNA, 25 bp, E. coli
ggtcaccttcccgataaatcctagt

SEQ ID NO: 128297 - DNA, 25 bp, E. coli
gatggcagtcattccatgttgacaa

SEQ ID NO: 128298 - DNA, 25 bp, E. coli
ggtcaccttccccataaatcctagt

SEQ ID NO: 128299 - DNA, 25 bp, E. coli
caagtacatacgatctctggataga

SEQ ID NO: 128300 - DNA, 25 bp, E. coli
caagtacatacgttctctggataga

SEQ ID NO: 128301 - DNA, 25 bp, E. coli
aattcattgaaagcataaggccgcc

SEQ ID NO: 128302 - DNA, 25 bp, E. coli
aattcattgaaaccataaggccgcc

SEQ ID NO: 128303 - DNA, 25 bp, E. coli
atagatatcggcgaacagcgccccg

SEQ ID NO: 128304 - DNA, 25 bp, E. coli
atagatatcggccaacagcgccccg

SEQ ID NO: 128305 - DNA, 25 bp, E. coli
tgtggcagggcattccaggtgaaac

SEQ ID NO: 128306 - DNA, 25 bp, E. coli
tgtggcagggcaatccaggtgaaac

SEQ ID NO: 128307 - DNA, 25 bp, E. coli
tgagcttgtgcgagctaacccggat

SEQ ID NO: 128308 - DNA, 25 bp, E. coli
tgagcttgtgcgtgctaacccggat

SEQ ID NO: 128309 - DNA, 25 bp, E. coli
tgccatcagcaacaatcaagtacat

SEQ ID NO: 128310 - DNA, 25 bp, E. coli
tgccatcagcaagaatcaagtacat

SEQ ID NO: 128311 - DNA, 25 bp, E. coli
gaactttcgctgtctgatgcgcttg

SEQ ID NO: 128312 - DNA, 25 bp, E. coli
gaactttcgctgactgatgcgcttg

SEQ ID NO: 128313 - DNA, 25 bp, E. coli
ggtgaaacaaacttcctgccatcag

SEQ ID NO: 128314 - DNA, 25 bp, E. coli
ggtgaaacaaacatcctgccatcag

SEQ ID NO: 128315 - DNA, 25 bp, E. coli
ggccgcctgaacttatccgcaatga

SEQ ID NO: 128316 - DNA, 25 bp, E. coli
ggccgcctgaacatatccgcaatga

SEQ ID NO: 128317 - DNA, 25 bp, E. coli
tcaatgaccaaaggatagatatcgg

SEQ ID NO: 128318 - DNA, 25 bp, E. coli
tcaatgaccaaacgatagatatcgg

SEQ ID NO: 128319 - DNA, 25 bp, E. coli
taacccggattgctgcttcttcgga

SEQ ID NO: 128320 - DNA, 25 bp, E. coli
taacccggattggtgcttcttcgga

SEQ ID NO: 128321 - DNA, 25 bp, E. coli
caccccggtcagtgcactcatgaca

SEQ ID NO: 128322 - DNA, 25 bp, E. coli
caccccggtcagagcactcatgaca

SEQ ID NO: 128323 - DNA, 25 bp, E. coli
tttttcaccgggtatacatgtatga

SEQ ID NO: 128324 - DNA, 25 bp, E. coli
tttttcaccgggaatacatgtatga

SEQ ID NO: 128325 - DNA, 25 bp, E. coli
tgccgccatcccactgatgacaccg

SEQ ID NO: 128326 - DNA, 25 bp, E. coli
tgccgccatccctctgatgacaccg

SEQ ID NO: 128327 - DNA, 25 bp, E. coli
tcaccgggaatacatgtatgaatcc

SEQ ID NO: 128328 - DNA, 25 bp, E. coli
tcaccgggaatagatgtatgaatcc

SEQ ID NO: 128329 - DNA, 25 bp, E. coli
ccgggaatacatctatgaatccgtc

SEQ ID NO: 128330 - DNA, 25 bp, E. coli
ccgggaatacatgtatgaatccgtc

SEQ ID NO: 128331 - DNA, 25 bp, E. coli
gaatacatgtatcaatccgtctgat

SEQ ID NO: 128332 - DNA, 25 bp, E. coli
gaatacatgtatgaatccgtctgat

SEQ ID NO: 128333 - DNA, 25 bp, E. coli
gacaccgcctgcaggacgaactgcg

SEQ ID NO: 128334 - DNA, 25 bp, E. coli
gacaccgcctgctggacgaactgcg

SEQ ID NO: 128335 - DNA, 25 bp, E. coli
tgtcttttttcagcgggaatacatg

SEQ ID NO: 128336 - DNA, 25 bp, E. coli
tgtcttttttcaccgggaatacatg

SEQ ID NO: 128337 - DNA, 25 bp, E. coli
ggaatacatgtatgaatccgtctga

SEQ ID NO: 128338 - DNA, 25 bp, E. coli
ggacatgccgccttccctctgatga

SEQ ID NO: 128339 - DNA, 25 bp, E. coli
ggaatacatgtaagaatccgtctga

SEQ ID NO: 128340 - DNA, 25 bp, E. coli
ggacatgccgccatccctctgatga

SEQ ID NO: 128341 - DNA, 25 bp, E. coli
gatgacaccgcctgcaggacgaact

SEQ ID NO: 128342 - DNA, 25 bp, E. coli
gatgacaccgccagcaggacgaact

SEQ ID NO: 128343 - DNA, 25 bp, E. coli
caatatcgacgagtatctggaaggg

SEQ ID NO: 128344 - DNA, 25 bp, E. coli
caatatcgacgactatctggaaggg

SEQ ID NO: 128345 - DNA, 25 bp, E. coli
ctttataagaaaccgccaacggccg

SEQ ID NO: 128346 - DNA, 25 bp, E. coli
ctttataagaaagcgccaacggccg

SEQ ID NO: 128347 - DNA, 25 bp, E. coli
aacaaataataatggcgctgggcgc

SEQ ID NO: 128348 - DNA, 25 bp, E. coli
cactaaatatggtgacggcggtacg

SEQ ID NO: 128349 - DNA, 25 bp, E. coli
cactaaatatggagacggcggtacg

SEQ ID NO: 128350 - DNA, 25 bp, E. coli
aacaaataataaaggcgctgggcgc

SEQ ID NO: 128351 - DNA, 25 bp, E. coli
tagcattgcgggaatgaccagcggt

SEQ ID NO: 128352 - DNA, 25 bp, E. coli
tagcattgcgggtatgaccagcggt

SEQ ID NO: 128353 - DNA, 25 bp, E. coli
tattaaccgttattatcaagggcgc

SEQ ID NO: 128354 - DNA, 25 bp, E. coli
tattaaccgttaatatcaagggcgc

SEQ ID NO: 128355 - DNA, 25 bp, E. coli
tgtatcgtctcaacaaacgtcaggg

SEQ ID NO: 128356 - DNA, 25 bp, E. coli
tgtccgtggcaatgaaaaagcgcgt

SEQ ID NO: 128357 - DNA, 25 bp, E. coli
tgtatcgtctcatcaaacgtcaggg

SEQ ID NO: 128358 - DNA, 25 bp, E. coli
tgtccgtggcaaagaaaaagcgcgt

SEQ ID NO: 128359 - DNA, 25 bp, E. coli
tctgaaaaccgatcataaacgccgt

SEQ ID NO: 128360 - DNA, 25 bp, E. coli
tctgaaaaccgaacataaacgccgt

SEQ ID NO: 128361 - DNA, 25 bp, E. coli
taaatcactggtgctcgggatcagc

SEQ ID NO: 128362 - DNA, 25 bp, E. coli
taaatcactggtcctcgggatcagc

SEQ ID NO: 128363 - DNA, 25 bp, E. coli
gacgaacaagatagccaggatgcca

SEQ ID NO: 128364 - DNA, 25 bp, E. coli
gacgaacaagattgccaggatgcca

SEQ ID NO: 128365 - DNA, 25 bp, E. coli
cacggtggtccggcgccgggtgtat

SEQ ID NO: 128366 - DNA, 25 bp, E. coli
cacggtggtccgccgccgggtgtat

SEQ ID NO: 128367 - DNA, 25 bp, E. coli
acggtggtccgccgccgggtgtatg

SEQ ID NO: 128368 - DNA, 25 bp, E. coli
acggtggtccgcggccgggtgtatg

SEQ ID NO: 128369 - DNA, 25 bp, E. coli
gccgccgggtgtttgcccgttttct

SEQ ID NO: 128370 - DNA, 25 bp, E. coli
gccgggtgtatgcccgttttctgga

SEQ ID NO: 128371 - DNA, 25 bp, E. coli
gccgggtgtatggccgttttctgga

SEQ ID NO: 128372 - DNA, 25 bp, E. coli
gccgccgggtgtatgcccgttttct

SEQ ID NO: 128373 - DNA, 25 bp, E. coli
ccgggtgtatgcgcgttttctggat

SEQ ID NO: 128374 - DNA, 25 bp, E. coli
cgccgggtgtatgcccgttttctgg

SEQ ID NO: 128375 - DNA, 25 bp, E. coli
ccgggtgtatgcccgttttctggat

SEQ ID NO: 128376 - DNA, 25 bp, E. coli
gccacggtggtcggccgccgggtgt

SEQ ID NO: 128377 - DNA, 25 bp, E. coli
ccgccgggtgtatgcccgttttctg

SEQ ID NO: 128378 - DNA, 25 bp, E. coli
ccgccgggtgtaagcccgttttctg

SEQ ID NO: 128379 - DNA, 25 bp, E. coli
gccacggtggtccgccgccgggtgt

SEQ ID NO: 128380 - DNA, 25 bp, E. coli
tccgccgccgggagtatgcccgttt

SEQ ID NO: 128381 - DNA, 25 bp, E. coli
cgccgggtgtatccccgttttctgg

SEQ ID NO: 128382 - DNA, 25 bp, E. coli
tccgccgccgggtgtatgcccgttt

SEQ ID NO: 128383 - DNA, 25 bp, E. coli
aaaaccaacgtcagtggcgtgccgc

SEQ ID NO: 128384 - DNA, 25 bp, E. coli
aaaaccaacgtctgtggcgtgccgc

SEQ ID NO: 128385 - DNA, 25 bp, E. coli
tatctgattaacctcggacatccgg

SEQ ID NO: 128386 - DNA, 25 bp, E. coli
tatctgggcagaagagatcgcctgg

SEQ ID NO: 128387 - DNA, 25 bp, E. coli
tatctgattaacgtcggacatccgg

SEQ ID NO: 128388 - DNA, 25 bp, E. coli
tatctgggcagatgagatcgcctgg

SEQ ID NO: 128389 - DNA, 25 bp, E. coli
tgaagctctggaaaaatcgcgcgat

SEQ ID NO: 128390 - DNA, 25 bp, E. coli
tgaagctctggataaatcgcgcgat

SEQ ID NO: 128391 - DNA, 25 bp, E. coli
tcgatgaattcatagccgcctgtga

SEQ ID NO: 128392 - DNA, 25 bp, E. coli
tcgatgaattcaaagccgcctgtga

SEQ ID NO: 128393 - DNA, 25 bp, E. coli
gctttaagtatcagcgcgggatgca

SEQ ID NO: 128394 - DNA, 25 bp, E. coli
gctttaagtatctgcgcgggatgca

SEQ ID NO: 128395 - DNA, 25 bp, E. coli
gaaaaatatcactacacatcggcgc

SEQ ID NO: 128396 - DNA, 25 bp, E. coli
gaaaaatatcacaacacatcggcgc

SEQ ID NO: 128397 - DNA, 25 bp, E. coli
cgaaaagcacctatggcagccgcgt

SEQ ID NO: 128398 - DNA, 25 bp, E. coli
cgaaaagcacctttggcagccgcgt

SEQ ID NO: 128399 - DNA, 25 bp, E. coli
tggaagataaatcccgcgtcggcgt

SEQ ID NO: 128400 - DNA, 25 bp, E. coli
tggaagataaatgccgcgtcggcgt

SEQ ID NO: 128401 - DNA, 25 bp, E. coli
gaggattgccttgcgcgtattgccg

SEQ ID NO: 128402 - DNA, 25 bp, E. coli
gatcgcctggctgaaagcgcaacaa

SEQ ID NO: 128403 - DNA, 25 bp, E. coli
gaggattgccttccgcgtattgccg

SEQ ID NO: 128404 - DNA, 25 bp, E. coli
gatcgcctggctcaaagcgcaacaa

SEQ ID NO: 128405 - DNA, 25 bp, E. coli
caacgctggttacgccagcggcagc

SEQ ID NO: 128406 - DNA, 25 bp, E. coli
cagcggcagcgttgctggcactgat

SEQ ID NO: 128407 - DNA, 25 bp, E. coli
caacgctggttaggccagcggcagc

SEQ ID NO: 128408 - DNA, 25 bp, E. coli
gttcaggtaatacccgtgttgcttt

SEQ ID NO: 128409 - DNA, 25 bp, E. coli
cagcggcagcgtagctggcactgat

SEQ ID NO: 128410 - DNA, 25 bp, E. coli
gttcaggtaatagccgtgttgcttt

SEQ ID NO: 128411 - DNA, 25 bp, E. coli
agcggcagcgttcctggcactgatc

SEQ ID NO: 128412 - DNA, 25 bp, E. coli
agcggcagcgttgctggcactgatc

SEQ ID NO: 128413 - DNA, 25 bp, E. coli
acaggctgatttccgttcaggtaat

SEQ ID NO: 128414 - DNA, 25 bp, E. coli
acaggctgatttgcgttcaggtaat

SEQ ID NO: 128415 - DNA, 25 bp, E. coli
tccgttcaggtaatacccgtgttgc

SEQ ID NO: 128416 - DNA, 25 bp, E. coli
tccgttcaggtattacccgtgttgc

SEQ ID NO: 128417 - DNA, 25 bp, E. coli
gctgatttccgtacaggtaataccc

SEQ ID NO: 128418 - DNA, 25 bp, E. coli
gctgatttccgttcaggtaataccc

SEQ ID NO: 128419 - DNA, 25 bp, E. coli
cgttcaggtaattcccgtgttgctt

SEQ ID NO: 128420 - DNA, 25 bp, E. coli
cgttcaggtaatacccgtgttgctt

SEQ ID NO: 128421 - DNA, 25 bp, E. coli
tgatttccgttctggtaatacccgt

SEQ ID NO: 128422 - DNA, 25 bp, E. coli
gatttccgttcacgtaatacccgtg

SEQ ID NO: 128423 - DNA, 25 bp, E. coli
tgatttccgttcaggtaatacccgt

SEQ ID NO: 128424 - DNA, 25 bp, E. coli
gatttccgttcaggtaatacccgtg

SEQ ID NO: 128425 - DNA, 25 bp, E. coli
ggcaacgctggtaacgccagcggca

SEQ ID NO: 128426 - DNA, 25 bp, E. coli
ggcaacgctggttacgccagcggca

SEQ ID NO: 128427 - DNA, 25 bp, E. coli
aatactgtaatattcacagcgcccc

SEQ ID NO: 128428 - DNA, 25 bp, E. coli
aatactgtaataatcacagcgcccc

SEQ ID NO: 128429 - DNA, 25 bp, E. coli
cagtgtcagtgaatagtgcaaacct

SEQ ID NO: 128430 - DNA, 25 bp, E. coli
cagtgtcagtgattagtgcaaacct

SEQ ID NO: 128431 - DNA, 25 bp, E. coli
acagttcctcctcaatcgcgttcgg

SEQ ID NO: 128432 - DNA, 25 bp, E. coli
acagttcctcctgaatcgcgttcgg

SEQ ID NO: 128433 - DNA, 25 bp, E. coli
tagtgcaaacctaccgacagcttca

SEQ ID NO: 128434 - DNA, 25 bp, E. coli
taccacgatagatttcattagcgcg

SEQ ID NO: 128435 - DNA, 25 bp, E. coli
taccacgatagaattcattagcgcg

SEQ ID NO: 128436 - DNA, 25 bp, E. coli
tagtgcaaaccttccgacagcttca

SEQ ID NO: 128437 - DNA, 25 bp, E. coli
ttagcgcggaaagcagaccaatgac

SEQ ID NO: 128438 - DNA, 25 bp, E. coli
ttagcgcggaaaccagaccaatgac

SEQ ID NO: 128439 - DNA, 25 bp, E. coli
gcctcctgggtacgcgttgatgcta

SEQ ID NO: 128440 - DNA, 25 bp, E. coli
gcctcctgggtaggcgttgatgcta

SEQ ID NO: 128441 - DNA, 25 bp, E. coli
gattattcgttttcaagctcggcct

SEQ ID NO: 128442 - DNA, 25 bp, E. coli
gattattcgtttacaagctcggcct

SEQ ID NO: 128443 - DNA, 25 bp, E. coli
tcaaaaatgacgctgatagcaatac

SEQ ID NO: 128444 - DNA, 25 bp, E. coli
tcaaaaatgacggtgatagcaatac

SEQ ID NO: 128445 - DNA, 25 bp, E. coli
gaccaatgacggctacagtgtcagt

SEQ ID NO: 128446 - DNA, 25 bp, E. coli
gatccggtggtgctatttaccaaac

SEQ ID NO: 128447 - DNA, 25 bp, E. coli
gaccaatgacgggtacagtgtcagt

SEQ ID NO: 128448 - DNA, 25 bp, E. coli
gatccggtggtggtatttaccaaac

SEQ ID NO: 128449 - DNA, 25 bp, E. coli
cagagaaatctttttgccgcgctcg

SEQ ID NO: 128450 - DNA, 25 bp, E. coli
cagagaaatcttattgccgcgctcg

SEQ ID NO: 128451 - DNA, 25 bp, E. coli
taaaacagagaaatctttttgccgc

SEQ ID NO: 128452 - DNA, 25 bp, E. coli
taaaacagagaattctttttgccgc

SEQ ID NO: 128453 - DNA, 25 bp, E. coli
agaaatctttttcccgcgctcgcaa

SEQ ID NO: 128454 - DNA, 25 bp, E. coli
agaaatctttttgccgcgctcgcaa

SEQ ID NO: 128455 - DNA, 25 bp, E. coli
aaacagagaaatgtttttgccgcgc

SEQ ID NO: 128456 - DNA, 25 bp, E. coli
aaacagagaaatctttttgccgcgc

SEQ ID NO: 128457 - DNA, 25 bp, E. coli
tttttgccgcgcacgcaaatggctg

SEQ ID NO: 128458 - DNA, 25 bp, E. coli
tttttgccgcgctcgcaaatggctg

SEQ ID NO: 128459 - DNA, 25 bp, E. coli
tgccgcgctcgcaaatggctgacaa

SEQ ID NO: 128460 - DNA, 25 bp, E. coli
tgccgcgctcgctaatggctgacaa

SEQ ID NO: 128461 - DNA, 25 bp, E. coli
gcgctcgcaaatcgctgacaagtgc

SEQ ID NO: 128462 - DNA, 25 bp, E. coli
gcgctcgcaaatggctgacaagtgc

SEQ ID NO: 128463 - DNA, 25 bp, E. coli
ccgcgctcgcaaatggctgacaagt

SEQ ID NO: 128464 - DNA, 25 bp, E. coli
ccgcgctcgcaattggctgacaagt

SEQ ID NO: 128465 - DNA, 25 bp, E. coli
ctcgcaaatggcagacaagtgcttg

SEQ ID NO: 128466 - DNA, 25 bp, E. coli
ctcgcaaatggctgacaagtgcttg

SEQ ID NO: 128467 - DNA, 25 bp, E. coli
tgggcgttaaaagagagaaatcttt

SEQ ID NO: 128468 - DNA, 25 bp, E. coli
tgggcgttaaaacagagaaatcttt

SEQ ID NO: 128469 - DNA, 25 bp, E. coli
gagaaatcttttagccgcgctcgca

SEQ ID NO: 128470 - DNA, 25 bp, E. coli
gagaaatctttttgccgcgctcgca

SEQ ID NO: 128471 - DNA, 25 bp, E. coli
aatctgcacatttcgctcctttttt

SEQ ID NO: 128472 - DNA, 25 bp, E. coli
aatatggaaaactacaaatctgcac

SEQ ID NO: 128473 - DNA, 25 bp, E. coli
aatatggaaaacaacaaatctgcac

SEQ ID NO: 128474 - DNA, 25 bp, E. coli
caaatctgcacaatacgctcctttt

SEQ ID NO: 128475 - DNA, 25 bp, E. coli
caacaaatctgctcattacgctcct

SEQ ID NO: 128476 - DNA, 25 bp, E. coli
caaatctgcacattacgctcctttt

SEQ ID NO: 128477 - DNA, 25 bp, E. coli
caacaaatctgcacattacgctcct

SEQ ID NO: 128478 - DNA, 25 bp, E. coli
taaatatggaaatcaacaaatctgc

SEQ ID NO: 128479 - DNA, 25 bp, E. coli
taaatatggaaaacaacaaatctgc

SEQ ID NO: 128480 - DNA, 25 bp, E. coli
aacaaatctgcacattacgctcctt

SEQ ID NO: 128481 - DNA, 25 bp, E. coli
aacaaatctgcagattacgctcctt

SEQ ID NO: 128482 - DNA, 25 bp, E. coli
aatctgcacattacgctcctttttt

SEQ ID NO: 128483 - DNA, 25 bp, E. coli
aacaacaaatctccacattacgctc

SEQ ID NO: 128484 - DNA, 25 bp, E. coli
aacaacaaatctgcacattacgctc

SEQ ID NO: 128485 - DNA, 25 bp, E. coli
tatggaaaacaagaaatctgcacat

SEQ ID NO: 128486 - DNA, 25 bp, E. coli
tatggaaaacaacaaatctgcacat

SEQ ID NO: 128487 - DNA, 25 bp, E. coli
gaaaacaacaaaactgcacattacg

SEQ ID NO: 128488 - DNA, 25 bp, E. coli
gaaaacaacaaatctgcacattacg

SEQ ID NO: 128489 - DNA, 25 bp, E. coli
gtgagtaaatatcgaaaacaacaaa

SEQ ID NO: 128490 - DNA, 25 bp, E. coli
gtgagtaaatatggaaaacaacaaa

SEQ ID NO: 128491 - DNA, 25 bp, E. coli
tggaaaacaacatatctgcacatta

SEQ ID NO: 128492 - DNA, 25 bp, E. coli
tggaaaacaacaaatctgcacatta

SEQ ID NO: 128493 - DNA, 25 bp, E. coli
taccgtttcgctggtgcttagtggc

SEQ ID NO: 128494 - DNA, 25 bp, E. coli
taccgtttcgctcgtgcttagtggc

SEQ ID NO: 128495 - DNA, 25 bp, E. coli
ttaacgccgccaatgaagagctggg

SEQ ID NO: 128496 - DNA, 25 bp, E. coli
ttaacgccgccattgaagagctggg

SEQ ID NO: 128497 - DNA, 25 bp, E. coli
ccggattgacggtagctctggaagc

SEQ ID NO: 128498 - DNA, 25 bp, E. coli
gcttagtggcaaagggcgaatctct

SEQ ID NO: 128499 - DNA, 25 bp, E. coli
gcttagtggcaatgggcgaatctct

SEQ ID NO: 128500 - DNA, 25 bp, E. coli
gcacagttgttgacggagcatctca

SEQ ID NO: 128501 - DNA, 25 bp, E. coli
gcacagttgttgtcggagcatctca

SEQ ID NO: 128502 - DNA, 25 bp, E. coli
gcagaagaaaaacctatcccggtga

SEQ ID NO: 128503 - DNA, 25 bp, E. coli
gcagaagaaaaagctatcccggtga

SEQ ID NO: 128504 - DNA, 25 bp, E. coli
ccggattgacggaagctctggaagc

SEQ ID NO: 128505 - DNA, 25 bp, E. coli
cattcatgatgtagcgctggctgcg

SEQ ID NO: 128506 - DNA, 25 bp, E. coli
cattcatgatgttgcgctggctgcg

SEQ ID NO: 128507 - DNA, 25 bp, E. coli
gatttgtgcgcaatcgccaggcgtc

SEQ ID NO: 128508 - DNA, 25 bp, E. coli
gatttgtgcgcattcgccaggcgtc

SEQ ID NO: 128509 - DNA, 25 bp, E. coli
ggtgattttcgcatcccgtgccagt

SEQ ID NO: 128510 - DNA, 25 bp, E. coli
ggtgattttcgcttcccgtgccagt

SEQ ID NO: 128511 - DNA, 25 bp, E. coli
tggagtgcacttgcagccagaagca

SEQ ID NO: 128512 - DNA, 25 bp, E. coli
tggagtgcacttccagccagaagca

SEQ ID NO: 128513 - DNA, 25 bp, E. coli
gagcaacaggtttcgctggcggcat

SEQ ID NO: 128514 - DNA, 25 bp, E. coli
gagcaacaggttacgctggcggcat

SEQ ID NO: 128515 - DNA, 25 bp, E. coli
taacatggcgcggatgatctccctt

SEQ ID NO: 128516 - DNA, 25 bp, E. coli
atgatctcccttggcggcctagagc

SEQ ID NO: 128517 - DNA, 25 bp, E. coli
atgatctcccttcgcggcctagagc

SEQ ID NO: 128518 - DNA, 25 bp, E. coli
ttcggctgtcccacgaggagcgagc

SEQ ID NO: 128519 - DNA, 25 bp, E. coli
ttcggctgtccctcgaggagcgagc

SEQ ID NO: 128520 - DNA, 25 bp, E. coli
tgaaatggcagcaaaagaacaacgc

SEQ ID NO: 128521 - DNA, 25 bp, E. coli
tccaagactggcacttcggctgtcc

SEQ ID NO: 128522 - DNA, 25 bp, E. coli
tgaaatggcagctaaagaacaacgc

SEQ ID NO: 128523 - DNA, 25 bp, E. coli
tccaagactggctcttcggctgtcc

SEQ ID NO: 128524 - DNA, 25 bp, E. coli
gaacaacgctcaacctctaacatgg

SEQ ID NO: 128525 - DNA, 25 bp, E. coli
gaaacaagttctacacgataccaga

SEQ ID NO: 128526 - DNA, 25 bp, E. coli
gaacaacgctcatcctctaacatgg

SEQ ID NO: 128527 - DNA, 25 bp, E. coli
gaaacaagttcttcacgataccaga

SEQ ID NO: 128528 - DNA, 25 bp, E. coli
cgataccagatcacgcattccgcgt

SEQ ID NO: 128529 - DNA, 25 bp, E. coli
cgataccagatctcgcattccgcgt

SEQ ID NO: 128530 - DNA, 25 bp, E. coli
gtaacaccgccagaggtccaagact

SEQ ID NO: 128531 - DNA, 25 bp, E. coli
gtaacaccgccacaggtccaagact

SEQ ID NO: 128532 - DNA, 25 bp, E. coli
ggcctagagctatcccagaaagaac

SEQ ID NO: 128533 - DNA, 25 bp, E. coli
ggcctagagctaacccagaaagaac

SEQ ID NO: 128534 - DNA, 25 bp, E. coli
taacatggcgcgcatgatctccctt

SEQ ID NO: 128535 - DNA, 25 bp, E. coli
gaggagcgagccctcattgatgaaa

SEQ ID NO: 128536 - DNA, 25 bp, E. coli
gaggagcgagccgtcattgatgaaa

SEQ ID NO: 128537 - DNA, 25 bp, E. coli
caaacctggcaacagtggtgcgatt

SEQ ID NO: 128538 - DNA, 25 bp, E. coli
caaacctggcaagagtggtgcgatt

SEQ ID NO: 128539 - DNA, 25 bp, E. coli
catttagcacctctgagttcattca

SEQ ID NO: 128540 - DNA, 25 bp, E. coli
catttagcacctgtgagttcattca

SEQ ID NO: 128541 - DNA, 25 bp, E. coli
agcccttaagtttcgagccgcctca

SEQ ID NO: 128542 - DNA, 25 bp, E. coli
agcccttaagttacgagccgcctca

SEQ ID NO: 128543 - DNA, 25 bp, E. coli
aaatatttaatccttccggcactca

SEQ ID NO: 128544 - DNA, 25 bp, E. coli
aaatatttaatcgttccggcactca

SEQ ID NO: 128545 - DNA, 25 bp, E. coli
tatctgtataaggtaaggagagggt

SEQ ID NO: 128546 - DNA, 25 bp, E. coli
tatatttcccgcgaaacctggcaag

SEQ ID NO: 128547 - DNA, 25 bp, E. coli
tatatttcccgccaaacctggcaag

SEQ ID NO: 128548 - DNA, 25 bp, E. coli
tatctgtataagctaaggagagggt

SEQ ID NO: 128549 - DNA, 25 bp, E. coli
gaaaaattgataaatgggctggcaa

SEQ ID NO: 128550 - DNA, 25 bp, E. coli
gaaaaattgatatatgggctggcaa

SEQ ID NO: 128551 - DNA, 25 bp, E. coli
ccggtcactcaatgatatctgtata

SEQ ID NO: 128552 - DNA, 25 bp, E. coli
ccggtcactcaaagatatctgtata

SEQ ID NO: 128553 - DNA, 25 bp, E. coli
ggatttctcaacaccggtcactcaa

SEQ ID NO: 128554 - DNA, 25 bp, E. coli
gtggtgcgattgatgctctatcccc

SEQ ID NO: 128555 - DNA, 25 bp, E. coli
ggatttctcaactccggtcactcaa

SEQ ID NO: 128556 - DNA, 25 bp, E. coli
gtggtgcgattgttgctctatcccc

SEQ ID NO: 128557 - DNA, 25 bp, E. coli
gagttcattcacaaaaagcccttaa

SEQ ID NO: 128558 - DNA, 25 bp, E. coli
gagttcattcactaaaagcccttaa

SEQ ID NO: 128559 - DNA, 25 bp, E. coli
caataaagacgaatctcaggaagcg

SEQ ID NO: 128560 - DNA, 25 bp, E. coli
caataaagacgattctcaggaagcg

SEQ ID NO: 128561 - DNA, 25 bp, E. coli
agcgtcctcgcacactccgtttttg

SEQ ID NO: 128562 - DNA, 25 bp, E. coli
agcgtcctcgcagactccgtttttg

SEQ ID NO: 128563 - DNA, 25 bp, E. coli
actgcaataaagacgattctcagga

SEQ ID NO: 128564 - DNA, 25 bp, E. coli
actgcaataaagtcgattctcagga

SEQ ID NO: 128565 - DNA, 25 bp, E. coli
tctcaggaagcgacctcgcagactc

SEQ ID NO: 128566 - DNA, 25 bp, E. coli
tctcaggaagcgtcctcgcagactc

SEQ ID NO: 128567 - DNA, 25 bp, E. coli
gcagactccgttattgccactcggc

SEQ ID NO: 128568 - DNA, 25 bp, E. coli
gcagactccgtttttgccactcggc

SEQ ID NO: 128569 - DNA, 25 bp, E. coli
gaagcgtcctcgcagactccgtttt

SEQ ID NO: 128570 - DNA, 25 bp, E. coli
gaagcgtcctcggagactccgtttt

SEQ ID NO: 128571 - DNA, 25 bp, E. coli
gactccgtttttgccactcggcttt

SEQ ID NO: 128572 - DNA, 25 bp, E. coli
gactccgtttttcccactcggcttt

SEQ ID NO: 128573 - DNA, 25 bp, E. coli
gtcctcgcagacaccgtttttgcca

SEQ ID NO: 128574 - DNA, 25 bp, E. coli
gtcctcgcagactccgtttttgcca

SEQ ID NO: 128575 - DNA, 25 bp, E. coli
gattctcaggaagcgtcctcgcaga

SEQ ID NO: 128576 - DNA, 25 bp, E. coli
gattctcaggaaccgtcctcgcaga

SEQ ID NO: 128577 - DNA, 25 bp, E. coli
taaagacgattcacaggaagcgtcc

SEQ ID NO: 128578 - DNA, 25 bp, E. coli
taaagacgattctcaggaagcgtcc

SEQ ID NO: 128579 - DNA, 25 bp, E. coli
gacgattctcaggaagcgtcctcgc

SEQ ID NO: 128580 - DNA, 25 bp, E. coli
gacgattctcagcaagcgtcctcgc

SEQ ID NO: 128581 - DNA, 25 bp, E. coli
tacaagcgtgaagaagatggcatcg

SEQ ID NO: 128582 - DNA, 25 bp, E. coli
tacaagcgtgaacaagatggcatcg

SEQ ID NO: 128583 - DNA, 25 bp, E. coli
tacgaagatcgctttgtggtgccga

SEQ ID NO: 128584 - DNA, 25 bp, E. coli
tacgaagatcgcattgtggtgccga

SEQ ID NO: 128585 - DNA, 25 bp, E. coli
tttacctttggtcatggctgccacg

SEQ ID NO: 128586 - DNA, 25 bp, E. coli
tttacctttggtgatggctgccacg

SEQ ID NO: 128587 - DNA, 25 bp, E. coli
tcccgactgactcggaaaaccagga

SEQ ID NO: 128588 - DNA, 25 bp, E. coli
tgctggcgatgcctcattacaaacg

SEQ ID NO: 128589 - DNA, 25 bp, E. coli
tcccgactgactgggaaaaccagga

SEQ ID NO: 128590 - DNA, 25 bp, E. coli
tgctggcgatgcgtcattacaaacg

SEQ ID NO: 128591 - DNA, 25 bp, E. coli
tctgccagacgtggaaagcctgcgt

SEQ ID NO: 128592 - DNA, 25 bp, E. coli
tctgccagacgtcgaaagcctgcgt

SEQ ID NO: 128593 - DNA, 25 bp, E. coli
ccttcccggagataaatggctgcgg

SEQ ID NO: 128594 - DNA, 25 bp, E. coli
ccttcccggagaaaaatggctgcgg

SEQ ID NO: 128595 - DNA, 25 bp, E. coli
cccgagcggtgcgatttacaagcgt

SEQ ID NO: 128596 - DNA, 25 bp, E. coli
cccgagcggtgccatttacaagcgt

SEQ ID NO: 128597 - DNA, 25 bp, E. coli
tcaacaacgtggaaaccaagccggg

SEQ ID NO: 128598 - DNA, 25 bp, E. coli
tcaacaacgtggtaaccaagccggg

SEQ ID NO: 128599 - DNA, 25 bp, E. coli
taaccgtgccatcctgctgggtaaa

SEQ ID NO: 128600 - DNA, 25 bp, E. coli
taaccgtgccatgctgctgggtaaa

SEQ ID NO: 128601 - DNA, 25 bp, E. coli
gatccgaaagtcttcgagcaggcga

SEQ ID NO: 128602 - DNA, 25 bp, E. coli
gatccgaaagtcatcgagcaggcga

SEQ ID NO: 128603 - DNA, 25 bp, E. coli
aatatagaccgcgatcgagtacccc

SEQ ID NO: 128604 - DNA, 25 bp, E. coli
aatatagaccgccatcgagtacccc

SEQ ID NO: 128605 - DNA, 25 bp, E. coli
cacttcttccttgaaatggcgttag

SEQ ID NO: 128606 - DNA, 25 bp, E. coli
cacttcttccttcaaatggcgttag

SEQ ID NO: 128607 - DNA, 25 bp, E. coli
cagagaatagttcagtgatttgagt

SEQ ID NO: 128608 - DNA, 25 bp, E. coli
cagagaatagttgagtgatttgagt

SEQ ID NO: 128609 - DNA, 25 bp, E. coli
tacatacattggatgtggtactcac

SEQ ID NO: 128610 - DNA, 25 bp, E. coli
tacatacattggttgtggtactcac

SEQ ID NO: 128611 - DNA, 25 bp, E. coli
tacggcattgttgtacatacattgg

SEQ ID NO: 128612 - DNA, 25 bp, E. coli
tacggcattgttctacatacattgg

SEQ ID NO: 128613 - DNA, 25 bp, E. coli
tgtggtactcacatatcatcagtga

SEQ ID NO: 128614 - DNA, 25 bp, E. coli
tgtacccttaacacttcctgatacg

SEQ ID NO: 128615 - DNA, 25 bp, E. coli
tgtggtactcacttatcatcagtga

SEQ ID NO: 128616 - DNA, 25 bp, E. coli
tgtacccttaactcttcctgatacg

SEQ ID NO: 128617 - DNA, 25 bp, E. coli
tcatcagtgagcgaacagagaatag

SEQ ID NO: 128618 - DNA, 25 bp, E. coli
tcatcagtgagccaacagagaatag

SEQ ID NO: 128619 - DNA, 25 bp, E. coli
gacatttcatccttactctacggca

SEQ ID NO: 128620 - DNA, 25 bp, E. coli
gacatttcatccatactctacggca

SEQ ID NO: 128621 - DNA, 25 bp, E. coli
cgttagtcatgaaatatagaccgcc

SEQ ID NO: 128622 - DNA, 25 bp, E. coli
cgttagtcatgatatatagaccgcc

SEQ ID NO: 128623 - DNA, 25 bp, E. coli
ggcgtggcagagacatttcatcctt

SEQ ID NO: 128624 - DNA, 25 bp, E. coli
ggcgtggcagagtcatttcatcctt

SEQ ID NO: 128625 - DNA, 25 bp, E. coli
aattgcgccgcacgagaacgtttaa

SEQ ID NO: 128626 - DNA, 25 bp, E. coli
aattgcgccgcaggagaacgtttaa

SEQ ID NO: 128627 - DNA, 25 bp, E. coli
tagaagatacgctaaacggaaacgg

SEQ ID NO: 128628 - DNA, 25 bp, E. coli
tagaagatacgcaaaacggaaacgg

SEQ ID NO: 128629 - DNA, 25 bp, E. coli
agtttccagaatcaagttcccgccg

SEQ ID NO: 128630 - DNA, 25 bp, E. coli
agtttccagaatgaagttcccgccg

SEQ ID NO: 128631 - DNA, 25 bp, E. coli
aaaagagcaacgaccgctgtccgaa

SEQ ID NO: 128632 - DNA, 25 bp, E. coli
aaaagagcaacgtccgctgtccgaa

SEQ ID NO: 128633 - DNA, 25 bp, E. coli
tatgcgcaattttctacgtgacctg

SEQ ID NO: 128634 - DNA, 25 bp, E. coli
tatgcgcaatttactacgtgacctg

SEQ ID NO: 128635 - DNA, 25 bp, E. coli
tatcaagcttgatctgcatacaggc

SEQ ID NO: 128636 - DNA, 25 bp, E. coli
tatcaagcttgaactgcatacaggc

SEQ ID NO: 128637 - DNA, 25 bp, E. coli
tgaaggattttgaacccgaacaggt

SEQ ID NO: 128638 - DNA, 25 bp, E. coli
tgaaggattttgtacccgaacaggt

SEQ ID NO: 128639 - DNA, 25 bp, E. coli
tcccgccgctcgtgtaaatatcaag

SEQ ID NO: 128640 - DNA, 25 bp, E. coli
tcccgccgctcgagtaaatatcaag

SEQ ID NO: 128641 - DNA, 25 bp, E. coli
gaaaatatcctgtaagacccgacgc

SEQ ID NO: 128642 - DNA, 25 bp, E. coli
gaaaatatcctgaaagacccgacgc

SEQ ID NO: 128643 - DNA, 25 bp, E. coli
cgtgacctgaaaaccaatctgctgg

SEQ ID NO: 128644 - DNA, 25 bp, E. coli
cgtgacctgaaatccaatctgctgg

SEQ ID NO: 128645 - DNA, 25 bp, E. coli
taacgcaacgttacgccgtgaactg

SEQ ID NO: 128646 - DNA, 25 bp, E. coli
taacgcaacgtttcgccgtgaactg

SEQ ID NO: 128647 - DNA, 25 bp, E. coli
cagtacaggaggctgcaacacagga

SEQ ID NO: 128648 - DNA, 25 bp, E. coli
cagtacaggagggtgcaacacagga

SEQ ID NO: 128649 - DNA, 25 bp, E. coli
tactgaaacgcgagcggatgacctg

SEQ ID NO: 128650 - DNA, 25 bp, E. coli
tacaggaggctggaacacaggaaga

SEQ ID NO: 128651 - DNA, 25 bp, E. coli
tacaggaggctgcaacacaggaaga

SEQ ID NO: 128652 - DNA, 25 bp, E. coli
tactgaaacgcgtgcggatgacctg

SEQ ID NO: 128653 - DNA, 25 bp, E. coli
taccagtacaggtggctgcaacaca

SEQ ID NO: 128654 - DNA, 25 bp, E. coli
taccagtacaggaggctgcaacaca

SEQ ID NO: 128655 - DNA, 25 bp, E. coli
tgttgcgttaccagtacaggaggct

SEQ ID NO: 128656 - DNA, 25 bp, E. coli
tgttgcgttacctgtacaggaggct

SEQ ID NO: 128657 - DNA, 25 bp, E. coli
gcgagcggatgacctggttttacca

SEQ ID NO: 128658 - DNA, 25 bp, E. coli
gcgttaccagtacaggaggctgcaa

SEQ ID NO: 128659 - DNA, 25 bp, E. coli
gcgttaccagtagaggaggctgcaa

SEQ ID NO: 128660 - DNA, 25 bp, E. coli
gcgagcggatgagctggttttacca

SEQ ID NO: 128661 - DNA, 25 bp, E. coli
gaaacgcgagcgcatgacctggttt

SEQ ID NO: 128662 - DNA, 25 bp, E. coli
gaaacgcgagcggatgacctggttt

SEQ ID NO: 128663 - DNA, 25 bp, E. coli
ccgcgaactgcgacgggcgaaaaat

SEQ ID NO: 128664 - DNA, 25 bp, E. coli
cgtttactgaaacgcgagcggatga

SEQ ID NO: 128665 - DNA, 25 bp, E. coli
ccgcgaactgcgtcgggcgaaaaat

SEQ ID NO: 128666 - DNA, 25 bp, E. coli
cgtttactgaaaggcgagcggatga

SEQ ID NO: 128667 - DNA, 25 bp, E. coli
ggatgacctggtattaccatcgctg

SEQ ID NO: 128668 - DNA, 25 bp, E. coli
ggatgacctggttttaccatcgctg

SEQ ID NO: 128669 - DNA, 25 bp, E. coli
tactggttacaagtctgaccaagcg

SEQ ID NO: 128670 - DNA, 25 bp, E. coli
tactggttacaactctgaccaagcg

SEQ ID NO: 128671 - DNA, 25 bp, E. coli
aggcttactcgacccgattatcgaa

SEQ ID NO: 128672 - DNA, 25 bp, E. coli
aggcttactcgagccgattatcgaa

SEQ ID NO: 128673 - DNA, 25 bp, E. coli
acagcagaagatgcatgaactggaa

SEQ ID NO: 128674 - DNA, 25 bp, E. coli
acagcagaagatccatgaactggaa

SEQ ID NO: 128675 - DNA, 25 bp, E. coli
ttacagcagaagatccatgaactgg

SEQ ID NO: 128676 - DNA, 25 bp, E. coli
ttacagcagaagttccatgaactgg

SEQ ID NO: 128677 - DNA, 25 bp, E. coli
tgagctgtttatagccgcgtcgtga

SEQ ID NO: 128678 - DNA, 25 bp, E. coli
tgagctgtttattgccgcgtcgtga

SEQ ID NO: 128679 - DNA, 25 bp, E. coli
gcgtgagctgtttattgccgcgtcg

SEQ ID NO: 128680 - DNA, 25 bp, E. coli
gcgtgagctgttaattgccgcgtcg

SEQ ID NO: 128681 - DNA, 25 bp, E. coli
gaacgcgtactgcttacaactctga

SEQ ID NO: 128682 - DNA, 25 bp, E. coli
gaacgcgtactggttacaactctga

SEQ ID NO: 128683 - DNA, 25 bp, E. coli
ggttacaactctcaccaagcggatg

SEQ ID NO: 128684 - DNA, 25 bp, E. coli
ggtggtgcgtcctacaggcttactc

SEQ ID NO: 128685 - DNA, 25 bp, E. coli
ggtggtgcgtccaacaggcttactc

SEQ ID NO: 128686 - DNA, 25 bp, E. coli
ggtgcgtccaactggcttactcgac

SEQ ID NO: 128687 - DNA, 25 bp, E. coli
ggtgcgtccaacaggcttactcgac

SEQ ID NO: 128688 - DNA, 25 bp, E. coli
ggttacaactctgaccaagcggatg

SEQ ID NO: 128689 - DNA, 25 bp, E. coli
tccaacaggcttactcgacccgatt

SEQ ID NO: 128690 - DNA, 25 bp, E. coli
tccaacaggctttctcgacccgatt

SEQ ID NO: 128691 - DNA, 25 bp, E. coli
caatatgaaggtctacatgacgcgc

SEQ ID NO: 128692 - DNA, 25 bp, E. coli
caatgcacaggatatgcaggacccg

SEQ ID NO: 128693 - DNA, 25 bp, E. coli
caatatgaaggtgtacatgacgcgc

SEQ ID NO: 128694 - DNA, 25 bp, E. coli
caatgcacaggaaatgcaggacccg

SEQ ID NO: 128695 - DNA, 25 bp, E. coli
caaaggcgacctggaaaagcaggtg

SEQ ID NO: 128696 - DNA, 25 bp, E. coli
caaaggcgacctcgaaaagcaggtg

SEQ ID NO: 128697 - DNA, 25 bp, E. coli
catgacgcgcaatgaagacatcttc

SEQ ID NO: 128698 - DNA, 25 bp, E. coli
catgacgcgcaaagaagacatcttc

SEQ ID NO: 128699 - DNA, 25 bp, E. coli
taaaaccgcagcagtttgcccttgc

SEQ ID NO: 128700 - DNA, 25 bp, E. coli
taaaaccgcagctgtttgcccttgc

SEQ ID NO: 128701 - DNA, 25 bp, E. coli
taaagagcgtctcgtgatggacctc

SEQ ID NO: 128702 - DNA, 25 bp, E. coli
taaagagcgtctggtgatggacctc

SEQ ID NO: 128703 - DNA, 25 bp, E. coli
tccattctggtccaaacggcgttta

SEQ ID NO: 128704 - DNA, 25 bp, E. coli
tccattctggtcgaaacggcgttta

SEQ ID NO: 128705 - DNA, 25 bp, E. coli
gctggaggattagaacaaaggcgac

SEQ ID NO: 128706 - DNA, 25 bp, E. coli
gctggaggattacaacaaaggcgac

SEQ ID NO: 128707 - DNA, 25 bp, E. coli
cattatgcttgagcctggccacggt

SEQ ID NO: 128708 - DNA, 25 bp, E. coli
cattatgcttgaccctggccacggt

SEQ ID NO: 128709 - DNA, 25 bp, E. coli
gatggacctctatccggccaatgca

SEQ ID NO: 128710 - DNA, 25 bp, E. coli
gatccaacactgcaatcagccgtcg

SEQ ID NO: 128711 - DNA, 25 bp, E. coli
gatccaacactggaatcagccgtcg

SEQ ID NO: 128712 - DNA, 25 bp, E. coli
gatggacctctaaccggccaatgca

SEQ ID NO: 128713 - DNA, 25 bp, E. coli
caaacgacagtataacccatcagcg

SEQ ID NO: 128714 - DNA, 25 bp, E. coli
caaacgacagtaaaacccatcagcg

SEQ ID NO: 128715 - DNA, 25 bp, E. coli
tattttccgagggttctcaacgcaa

SEQ ID NO: 128716 - DNA, 25 bp, E. coli
tattttccgaggcttctcaacgcaa

SEQ ID NO: 128717 - DNA, 25 bp, E. coli
tgtttccacattccatcgccgtctg

SEQ ID NO: 128718 - DNA, 25 bp, E. coli
tgtttccacattgcatcgccgtctg

SEQ ID NO: 128719 - DNA, 25 bp, E. coli
tgcttacctcagaaccccgagttaa

SEQ ID NO: 128720 - DNA, 25 bp, E. coli
tgcttacctcagtaccccgagttaa

SEQ ID NO: 128721 - DNA, 25 bp, E. coli
tgcgaattatccagaagcaggtctt

SEQ ID NO: 128722 - DNA, 25 bp, E. coli
tgctggcaaaagttaagtctaacct

SEQ ID NO: 128723 - DNA, 25 bp, E. coli
tgcgaattatcctgaagcaggtctt

SEQ ID NO: 128724 - DNA, 25 bp, E. coli
tgctggcaaaagataagtctaacct

SEQ ID NO: 128725 - DNA, 25 bp, E. coli
tctggcaagcgacggaataagtttt

SEQ ID NO: 128726 - DNA, 25 bp, E. coli
tctggcaagcgagggaataagtttt

SEQ ID NO: 128727 - DNA, 25 bp, E. coli
ccatcagcgagaatgccagggaaaa

SEQ ID NO: 128728 - DNA, 25 bp, E. coli
ccatcagcgagattgccagggaaaa

SEQ ID NO: 128729 - DNA, 25 bp, E. coli
gcgttctactttgattaggagcaca

SEQ ID NO: 128730 - DNA, 25 bp, E. coli
gcgttctactttcattaggagcaca

SEQ ID NO: 128731 - DNA, 25 bp, E. coli
gcaaacaaggtaccgagatatctct

SEQ ID NO: 128732 - DNA, 25 bp, E. coli
gcaaacaaggtagcgagatatctct

SEQ ID NO: 128733 - DNA, 25 bp, E. coli
taacctaatgctatccgaacctgga

SEQ ID NO: 128734 - DNA, 25 bp, E. coli
taacctaatgctttccgaacctgga

SEQ ID NO: 128735 - DNA, 25 bp, E. coli
cagctcgctccgagaggtgcattta

SEQ ID NO: 128736 - DNA, 25 bp, E. coli
cagctcgctccgtgaggtgcattta

SEQ ID NO: 128737 - DNA, 25 bp, E. coli
ttttatggttcggttgcccgactgg

SEQ ID NO: 128738 - DNA, 25 bp, E. coli
ttttatggttcgcttgcccgactgg

SEQ ID NO: 128739 - DNA, 25 bp, E. coli
tatggttcggttccccgactggcag

SEQ ID NO: 128740 - DNA, 25 bp, E. coli
tatggttcggttgcccgactggcag

SEQ ID NO: 128741 - DNA, 25 bp, E. coli
tttatggttcggttgcccgactggc

SEQ ID NO: 128742 - DNA, 25 bp, E. coli
tttgcagctcgctccgagaggtgca

SEQ ID NO: 128743 - DNA, 25 bp, E. coli
tttgcagctcgcaccgagaggtgca

SEQ ID NO: 128744 - DNA, 25 bp, E. coli
tttatggttcggatgcccgactggc

SEQ ID NO: 128745 - DNA, 25 bp, E. coli
ttatggttcggtagcccgactggca

SEQ ID NO: 128746 - DNA, 25 bp, E. coli
ttatggttcggttgcccgactggca

SEQ ID NO: 128747 - DNA, 25 bp, E. coli
tgcccgactggcagcggaaagaggc

SEQ ID NO: 128748 - DNA, 25 bp, E. coli
tcgctccgagagctgcatttaatct

SEQ ID NO: 128749 - DNA, 25 bp, E. coli
tgcccgactggctgcggaaagaggc

SEQ ID NO: 128750 - DNA, 25 bp, E. coli
tcgctccgagaggtgcatttaatct

SEQ ID NO: 128751 - DNA, 25 bp, E. coli
ccgactggcagccgaaagaggcatt

SEQ ID NO: 128752 - DNA, 25 bp, E. coli
ccgactggcagcggaaagaggcatt

SEQ ID NO: 128753 - DNA, 25 bp, E. coli
gttcggttgccccactggcagcgga

SEQ ID NO: 128754 - DNA, 25 bp, E. coli
gttcggttgcccgactggcagcgga

SEQ ID NO: 128755 - DNA, 25 bp, E. coli
ggttgcccgactcgcagcggaaaga

SEQ ID NO: 128756 - DNA, 25 bp, E. coli
ggttgcccgactggcagcggaaaga

SEQ ID NO: 128757 - DNA, 25 bp, E. coli
agatttacaaaattgagagtgagtg

SEQ ID NO: 128758 - DNA, 25 bp, E. coli
agatttacaaaaatgagagtgagtg

SEQ ID NO: 128759 - DNA, 25 bp, E. coli
tgggtgtgaagaattacaaaattga

SEQ ID NO: 128760 - DNA, 25 bp, E. coli
tgaagatttacaaaattgagagtga

SEQ ID NO: 128761 - DNA, 25 bp, E. coli
tgaagatttacataattgagagtga

SEQ ID NO: 128762 - DNA, 25 bp, E. coli
gaagatttacaatattgagagtgag

SEQ ID NO: 128763 - DNA, 25 bp, E. coli
gaagatttacaaaattgagagtgag

SEQ ID NO: 128764 - DNA, 25 bp, E. coli
ctgggtgtgaagatttacaaaattg

SEQ ID NO: 128765 - DNA, 25 bp, E. coli
ctgggtgtgaagttttacaaaattg

SEQ ID NO: 128766 - DNA, 25 bp, E. coli
gatttacaaaatagagagtgagtga

SEQ ID NO: 128767 - DNA, 25 bp, E. coli
gatttacaaaattgagagtgagtga

SEQ ID NO: 128768 - DNA, 25 bp, E. coli
gggtgtgaagatatacaaaattgag

SEQ ID NO: 128769 - DNA, 25 bp, E. coli
gggtgtgaagatttacaaaattgag

SEQ ID NO: 128770 - DNA, 25 bp, E. coli
ggtgtgaagattaacaaaattgaga

SEQ ID NO: 128771 - DNA, 25 bp, E. coli
gtgaagatttacaaaattgagagtg

SEQ ID NO: 128772 - DNA, 25 bp, E. coli
gtgaagatttactaaattgagagtg

SEQ ID NO: 128773 - DNA, 25 bp, E. coli
tgtgaagatttacaaaattgagagt

SEQ ID NO: 128774 - DNA, 25 bp, E. coli
ggtgtgaagatttacaaaattgaga

SEQ ID NO: 128775 - DNA, 25 bp, E. coli
gtgtgaagatttacaaaattgagag

SEQ ID NO: 128776 - DNA, 25 bp, E. coli
gtgtgaagattttcaaaattgagag

SEQ ID NO: 128777 - DNA, 25 bp, E. coli
tgtgaagatttagaaaattgagagt

SEQ ID NO: 128778 - DNA, 25 bp, E. coli
tgggtgtgaagatttacaaaattga

SEQ ID NO: 128779 - DNA, 25 bp, E. coli
cagccaggctattaaacggttacgc

SEQ ID NO: 128780 - DNA, 25 bp, E. coli
cagccaggctataaaacggttacgc

SEQ ID NO: 128781 - DNA, 25 bp, E. coli
catttacaacttacgcagtgcagcg

SEQ ID NO: 128782 - DNA, 25 bp, E. coli
aactggagcaggaacttggccgcaa

SEQ ID NO: 128783 - DNA, 25 bp, E. coli
aactggagcaggtacttggccgcaa

SEQ ID NO: 128784 - DNA, 25 bp, E. coli
aacttgacgatctgctacaggcggg

SEQ ID NO: 128785 - DNA, 25 bp, E. coli
aacttgacgatcagctacaggcggg

SEQ ID NO: 128786 - DNA, 25 bp, E. coli
ttgccggagcgccaaaaactggtat

SEQ ID NO: 128787 - DNA, 25 bp, E. coli
ttgccggagcgcgaaaaactggtat

SEQ ID NO: 128788 - DNA, 25 bp, E. coli
tcctacgatgagtggcgcgaagagc

SEQ ID NO: 128789 - DNA, 25 bp, E. coli
tcctacgatgagaggcgcgaagagc

SEQ ID NO: 128790 - DNA, 25 bp, E. coli
gaagcattgcgcgtgcaggttcgac

SEQ ID NO: 128791 - DNA, 25 bp, E. coli
gaatcgcgggtcagtcagttacaca

SEQ ID NO: 128792 - DNA, 25 bp, E. coli
gaatcgcgggtctgtcagttacaca

SEQ ID NO: 128793 - DNA, 25 bp, E. coli
gaagcattgcgcctgcaggttcgac

SEQ ID NO: 128794 - DNA, 25 bp, E. coli
catttacaactttcgcagtgcagcg

SEQ ID NO: 128795 - DNA, 25 bp, E. coli
tggataaacactcgctgtggcagcg

SEQ ID NO: 128796 - DNA, 25 bp, E. coli
tggataaacactggctgtggcagcg

SEQ ID NO: 128797 - DNA, 25 bp, E. coli
tggacagtaatcagcgccagcgggt

SEQ ID NO: 128798 - DNA, 25 bp, E. coli
tggacagtaatctgcgccagcgggt

SEQ ID NO: 128799 - DNA, 25 bp, E. coli
gatgaacttcgcagccgtgactggg

SEQ ID NO: 128800 - DNA, 25 bp, E. coli
gatgaacttcgctgccgtgactggg

SEQ ID NO: 128801 - DNA, 25 bp, E. coli
tacgacccgccacttactcggttat

SEQ ID NO: 128802 - DNA, 25 bp, E. coli
tacgacccgccagttactcggttat

SEQ ID NO: 128803 - DNA, 25 bp, E. coli
tgtttctggagctgtttttccgccg

SEQ ID NO: 128804 - DNA, 25 bp, E. coli
tgtttctggagcagtttttccgccg

SEQ ID NO: 128805 - DNA, 25 bp, E. coli
gccagttactcgcttataccgaaca

SEQ ID NO: 128806 - DNA, 25 bp, E. coli
gccagttactcggttataccgaaca

SEQ ID NO: 128807 - DNA, 25 bp, E. coli
gaagaggtgatggtggacaaaatta

SEQ ID NO: 128808 - DNA, 25 bp, E. coli
gaagaggtgatgctggacaaaatta

SEQ ID NO: 128809 - DNA, 25 bp, E. coli
gaaaaacgccggaggcggcctatgt

SEQ ID NO: 128810 - DNA, 25 bp, E. coli
gaaaaacgccggtggcggcctatgt

SEQ ID NO: 128811 - DNA, 25 bp, E. coli
cgtgcgctgtttctggagctgtttt

SEQ ID NO: 128812 - DNA, 25 bp, E. coli
cgtgcgctgtttgtggagctgtttt

SEQ ID NO: 128813 - DNA, 25 bp, E. coli
gattgtttacgacccgccagttact

SEQ ID NO: 128814 - DNA, 25 bp, E. coli
gattgtttacgagccgccagttact

SEQ ID NO: 128815 - DNA, 25 bp, E. coli
tgggattgtttacgacccgccagtt

SEQ ID NO: 128816 - DNA, 25 bp, E. coli
ggtgatgctggacaaaattaccgga

SEQ ID NO: 128817 - DNA, 25 bp, E. coli
ggtgatgctggagaaaattaccgga

SEQ ID NO: 128818 - DNA, 25 bp, E. coli
tgggattgtttaggacccgccagtt

SEQ ID NO: 128819 - DNA, 25 bp, E. coli
gaggtgatgctggacaaaattaccg

SEQ ID NO: 128820 - DNA, 25 bp, E. coli
gatgctggacaatattaccggaaaa

SEQ ID NO: 128821 - DNA, 25 bp, E. coli
gatgctggacaaaattaccggaaaa

SEQ ID NO: 128822 - DNA, 25 bp, E. coli
gaggtgatgctgcacaaaattaccg

SEQ ID NO: 128823 - DNA, 25 bp, E. coli
caccgggtgtcggagagtttcatgt

SEQ ID NO: 128824 - DNA, 25 bp, E. coli
caccgggtgtcgcagagtttcatgt

SEQ ID NO: 128825 - DNA, 25 bp, E. coli
tactgctggtgatactgcttcaggg

SEQ ID NO: 128826 - DNA, 25 bp, E. coli
tactgctggtgaaactgcttcaggg

SEQ ID NO: 128827 - DNA, 25 bp, E. coli
aaatggactggctgcgtgatgccgc

SEQ ID NO: 128828 - DNA, 25 bp, E. coli
aaaaaggctgtaacgttgcaccggg

SEQ ID NO: 128829 - DNA, 25 bp, E. coli
aaaaaggctgtatcgttgcaccggg

SEQ ID NO: 128830 - DNA, 25 bp, E. coli
aaatggactggcagcgtgatgccgc

SEQ ID NO: 128831 - DNA, 25 bp, E. coli
tatttttgcgatgcggtaatgggtc

SEQ ID NO: 128832 - DNA, 25 bp, E. coli
tattaagtggctttctgggatcggc

SEQ ID NO: 128833 - DNA, 25 bp, E. coli
tattaagtggctatctgggatcggc

SEQ ID NO: 128834 - DNA, 25 bp, E. coli
tatttttgcgatccggtaatgggtc

SEQ ID NO: 128835 - DNA, 25 bp, E. coli
ttggttaaacacctggcgcgagctg

SEQ ID NO: 128836 - DNA, 25 bp, E. coli
ttggttaaacacgtggcgcgagctg

SEQ ID NO: 128837 - DNA, 25 bp, E. coli
gaaattgtgcaacgcattgccgcca

SEQ ID NO: 128838 - DNA, 25 bp, E. coli
gaaattgtgcaaggcattgccgcca

SEQ ID NO: 128839 - DNA, 25 bp, E. coli
ggctacagccgtgaccgttttgaaa

SEQ ID NO: 128840 - DNA, 25 bp, E. coli
ggctacagccgtcaccgttttgaaa

SEQ ID NO: 128841 - DNA, 25 bp, E. coli
tcaccgccgatgaagcctggcatat

SEQ ID NO: 128842 - DNA, 25 bp, E. coli
tcaccgccgatgtagcctggcatat

SEQ ID NO: 128843 - DNA, 25 bp, E. coli
gagcagggtgaacatatcctcggta

SEQ ID NO: 128844 - DNA, 25 bp, E. coli
gagcagggtgaagatatcctcggta

SEQ ID NO: 128845 - DNA, 25 bp, E. coli
aagccggagcatcgcaggttattaa

SEQ ID NO: 128846 - DNA, 25 bp, E. coli
aacggcgcaaaatgcgcaaagcgcc

SEQ ID NO: 128847 - DNA, 25 bp, E. coli
cacaatcggcataaggcgcttacag

SEQ ID NO: 128848 - DNA, 25 bp, E. coli
cacaatcggcattaggcgcttacag

SEQ ID NO: 128849 - DNA, 25 bp, E. coli
taactatcgcgatgaaaacctggtc

SEQ ID NO: 128850 - DNA, 25 bp, E. coli
aggcgatcgcgtagtctatgcacaa

SEQ ID NO: 128851 - DNA, 25 bp, E. coli
aggcgatcgcgttgtctatgcacaa

SEQ ID NO: 128852 - DNA, 25 bp, E. coli
aagccggagcatggcaggttattaa

SEQ ID NO: 128853 - DNA, 25 bp, E. coli
aacggcgcaaaaagcgcaaagcgcc

SEQ ID NO: 128854 - DNA, 25 bp, E. coli
tatcgcgaagaatacctggtcgagc

SEQ ID NO: 128855 - DNA, 25 bp, E. coli
tatcgcgaagaaaacctggtcgagc

SEQ ID NO: 128856 - DNA, 25 bp, E. coli
tcgcgtagtctatgcacaatcggca

SEQ ID NO: 128857 - DNA, 25 bp, E. coli
tcgcgtagtctaagcacaatcggca

SEQ ID NO: 128858 - DNA, 25 bp, E. coli
ccttaaaagccggagcatggcaggt

SEQ ID NO: 128859 - DNA, 25 bp, E. coli
ccttaaaagccgcagcatggcaggt

SEQ ID NO: 128860 - DNA, 25 bp, E. coli
cctggtcgagcgattgaaagagatc

SEQ ID NO: 128861 - DNA, 25 bp, E. coli
cctggtcgagcgtttgaaagagatc

SEQ ID NO: 128862 - DNA, 25 bp, E. coli
gcaaagcgccttaaaagccggagca

SEQ ID NO: 128863 - DNA, 25 bp, E. coli
gaagaaaacctggtcgagcgattga

SEQ ID NO: 128864 - DNA, 25 bp, E. coli
gaagaaaacctgctcgagcgattga

SEQ ID NO: 128865 - DNA, 25 bp, E. coli
gcaaagcgcctttaaagccggagca

SEQ ID NO: 128866 - DNA, 25 bp, E. coli
taactatcgcgaagaaaacctggtc

SEQ ID NO: 128867 - DNA, 25 bp, E. coli
caacgtctcgcagtgttaaacggcg

SEQ ID NO: 128868 - DNA, 25 bp, E. coli
caacgtctcgcactgttaaacggcg

SEQ ID NO: 128869 - DNA, 25 bp, E. coli
catggtctttggtgaactgcctgaa

SEQ ID NO: 128870 - DNA, 25 bp, E. coli
catggtctttggagaactgcctgaa

SEQ ID NO: 128871 - DNA, 25 bp, E. coli
tagtcctgtgcgttcagacgaacag

SEQ ID NO: 128872 - DNA, 25 bp, E. coli
tagtcctgtgcgatcagacgaacag

SEQ ID NO: 128873 - DNA, 25 bp, E. coli
tgcgggaagccgattactcatcagg

SEQ ID NO: 128874 - DNA, 25 bp, E. coli
tgcgggaagccgtttactcatcagg

SEQ ID NO: 128875 - DNA, 25 bp, E. coli
tgacggtaacgcacgagtgtcagcg

SEQ ID NO: 128876 - DNA, 25 bp, E. coli
tgacggtaacgctcgagtgtcagcg

SEQ ID NO: 128877 - DNA, 25 bp, E. coli
gcgtcgccgaatccgtagtcagtgt

SEQ ID NO: 128878 - DNA, 25 bp, E. coli
gcgtcgccgaatgcgtagtcagtgt

SEQ ID NO: 128879 - DNA, 25 bp, E. coli
gaatgctccatgtcgttcgctatcg

SEQ ID NO: 128880 - DNA, 25 bp, E. coli
gaagcactgccggaagcgtatgaac

SEQ ID NO: 128881 - DNA, 25 bp, E. coli
gaagcactgccgcaagcgtatgaac

SEQ ID NO: 128882 - DNA, 25 bp, E. coli
gaatgctccatgacgttcgctatcg

SEQ ID NO: 128883 - DNA, 25 bp, E. coli
gaagaagcgcaatagccaaacccat

SEQ ID NO: 128884 - DNA, 25 bp, E. coli
gaagaagcgcaaaagccaaacccat

SEQ ID NO: 128885 - DNA, 25 bp, E. coli
gttcgtacggctgaaaaacgccttg

SEQ ID NO: 128886 - DNA, 25 bp, E. coli
gttcgtacggctcaaaaacgccttg

SEQ ID NO: 128887 - DNA, 25 bp, E. coli
ggtgaaatcgatgtgcttgcaatgg

SEQ ID NO: 128888 - DNA, 25 bp, E. coli
ggtgaaatcgatctgcttgcaatgg

SEQ ID NO: 128889 - DNA, 25 bp, E. coli
cgtcgctcggacttaaagggattaa

SEQ ID NO: 128890 - DNA, 25 bp, E. coli
cgtcgctcggacataaagggattaa

SEQ ID NO: 128891 - DNA, 25 bp, E. coli
tattcaatgcgcaggtcggcaaacc

SEQ ID NO: 128892 - DNA, 25 bp, E. coli
tattcaatgcgctggtcggcaaacc

SEQ ID NO: 128893 - DNA, 25 bp, E. coli
tgttaaatgcgcaggcgtcgctcgg

SEQ ID NO: 128894 - DNA, 25 bp, E. coli
tggtgcgccagcactataatgtcgg

SEQ ID NO: 128895 - DNA, 25 bp, E. coli
tggtgcgccagctctataatgtcgg

SEQ ID NO: 128896 - DNA, 25 bp, E. coli
tgttaaatgcgctggcgtcgctcgg

SEQ ID NO: 128897 - DNA, 25 bp, E. coli
tgcaaaatgccgtcgactggcgtat

SEQ ID NO: 128898 - DNA, 25 bp, E. coli
tgcaaaatgccgacgactggcgtat

SEQ ID NO: 128899 - DNA, 25 bp, E. coli
gctggttcggcggtaaccgcagaaa

SEQ ID NO: 128900 - DNA, 25 bp, E. coli
gctggttcggcgctaaccgcagaaa

SEQ ID NO: 128901 - DNA, 25 bp, E. coli
gcagaaatcggcctgatgcgcgcta

SEQ ID NO: 128902 - DNA, 25 bp, E. coli
gcagaaatcggcgtgatgcgcgcta

SEQ ID NO: 128903 - DNA, 25 bp, E. coli
cttatagtgcggtaaccagtctggg

SEQ ID NO: 128904 - DNA, 25 bp, E. coli
cttatagtgcggaaaccagtctggg

SEQ ID NO: 128905 - DNA, 25 bp, E. coli
gggttcttctggtcggcaatgcaaa

SEQ ID NO: 128906 - DNA, 25 bp, E. coli
gggttcttctggacggcaatgcaaa

SEQ ID NO: 128907 - DNA, 25 bp, E. coli
ggcaaaccggaaattcgcaaacatg

SEQ ID NO: 128908 - DNA, 25 bp, E. coli
ggcaaaccggaatttcgcaaacatg

SEQ ID NO: 128909 - DNA, 25 bp, E. coli
taatgtcggcgtcctgtcgatgctg

SEQ ID NO: 128910 - DNA, 25 bp, E. coli
taatgtcggcgtgctgtcgatgctg

SEQ ID NO: 128911 - DNA, 25 bp, E. coli
aatatgggccgcgagcgcatccgta

SEQ ID NO: 128912 - DNA, 25 bp, E. coli
aagcgttccgcgtcacgctgctgga

SEQ ID NO: 128913 - DNA, 25 bp, E. coli
aatatgggccgccagcgcatccgta

SEQ ID NO: 128914 - DNA, 25 bp, E. coli
aagcgttccgcgacacgctgctgga

SEQ ID NO: 128915 - DNA, 25 bp, E. coli
tacctgggaagcgttccgcgacacg

SEQ ID NO: 128916 - DNA, 25 bp, E. coli
tacctgggaagccttccgcgacacg

SEQ ID NO: 128917 - DNA, 25 bp, E. coli
tttggctgcgcgatgctctgttacg

SEQ ID NO: 128918 - DNA, 25 bp, E. coli
tttggctgcgcgttgctctgttacg

SEQ ID NO: 128919 - DNA, 25 bp, E. coli
gccgatgattattggtcgcaatttc

SEQ ID NO: 128920 - DNA, 25 bp, E. coli
gccgatgattataggtcgcaatttc

SEQ ID NO: 128921 - DNA, 25 bp, E. coli
cgttccgcgacacgctgctggaaca

SEQ ID NO: 128922 - DNA, 25 bp, E. coli
cgttccgcgacaggctgctggaaca

SEQ ID NO: 128923 - DNA, 25 bp, E. coli
gattattggtcgcaatttcctggta

SEQ ID NO: 128924 - DNA, 25 bp, E. coli
gattattggtcggaatttcctggta

SEQ ID NO: 128925 - DNA, 25 bp, E. coli
ggtgatggatctgtccaccggtcgc

SEQ ID NO: 128926 - DNA, 25 bp, E. coli
ggatacggtgatggatctctccacc

SEQ ID NO: 128927 - DNA, 25 bp, E. coli
ggatacggtgatcgatctctccacc

SEQ ID NO: 128928 - DNA, 25 bp, E. coli
tggtcgcaatttgctggtaaaagtt

SEQ ID NO: 128929 - DNA, 25 bp, E. coli
ggtgatggatctctccaccggtcgc

SEQ ID NO: 128930 - DNA, 25 bp, E. coli
tggtcgcaatttcctggtaaaagtt

SEQ ID NO: 128931 - DNA, 25 bp, E. coli
gatgctctgttaggtaacgccaaaa

SEQ ID NO: 128932 - DNA, 25 bp, E. coli
gatgctctgttacgtaacgccaaaa

SEQ ID NO: 128933 - DNA, 25 bp, E. coli
caagatttggctgttgtatcaactc

SEQ ID NO: 128934 - DNA, 25 bp, E. coli
aatgcctgttttctggagattccag

SEQ ID NO: 128935 - DNA, 25 bp, E. coli
aatgcctgttttgtggagattccag

SEQ ID NO: 128936 - DNA, 25 bp, E. coli
caagatttggctcttgtatcaactc

SEQ ID NO: 128937 - DNA, 25 bp, E. coli
ttgcgccggaagtaataccatttaa

SEQ ID NO: 128938 - DNA, 25 bp, E. coli
ttttaaaccagctccaaatcagtgg

SEQ ID NO: 128939 - DNA, 25 bp, E. coli
ttttaaaccagcaccaaatcagtgg

SEQ ID NO: 128940 - DNA, 25 bp, E. coli
ttgcgccggaagaaataccatttaa

SEQ ID NO: 128941 - DNA, 25 bp, E. coli
tgacaaaatcatggagcgtaccttt

SEQ ID NO: 128942 - DNA, 25 bp, E. coli
tgacaaaatcatcgagcgtaccttt

SEQ ID NO: 128943 - DNA, 25 bp, E. coli
ccattgaaagtttattgcgccggaa

SEQ ID NO: 128944 - DNA, 25 bp, E. coli
ccattgaaagttaattgcgccggaa

SEQ ID NO: 128945 - DNA, 25 bp, E. coli
gaaagatcttttccattcccaacga

SEQ ID NO: 128946 - DNA, 25 bp, E. coli
gaaactgaacatgatggaatgcctg

SEQ ID NO: 128947 - DNA, 25 bp, E. coli
gaaactgaacatcatggaatgcctg

SEQ ID NO: 128948 - DNA, 25 bp, E. coli
gaaagatcttttgcattcccaacga

SEQ ID NO: 128949 - DNA, 25 bp, E. coli
cattatgcatggatggttcctgcgc

SEQ ID NO: 128950 - DNA, 25 bp, E. coli
cattatgcatggttggttcctgcgc

SEQ ID NO: 128951 - DNA, 25 bp, E. coli
gattccaggcgagagttgaagaaga

SEQ ID NO: 128952 - DNA, 25 bp, E. coli
gattccaggcgacagttgaagaaga

SEQ ID NO: 128953 - DNA, 25 bp, E. coli
gagcgtacctttacctgaatcagaa

SEQ ID NO: 128954 - DNA, 25 bp, E. coli
gagcgtaccttttcctgaatcagaa

SEQ ID NO: 128955 - DNA, 25 bp, E. coli
aacgcttctggcgtgaactgcgcga

SEQ ID NO: 128956 - DNA, 25 bp, E. coli
aacgcttctggcctgaactgcgcga

SEQ ID NO: 128957 - DNA, 25 bp, E. coli
catccaacaagaaattcgcagcggg

SEQ ID NO: 128958 - DNA, 25 bp, E. coli
catccaacaagatattcgcagcggg

SEQ ID NO: 128959 - DNA, 25 bp, E. coli
agatgccgccgcactttacctgggc

SEQ ID NO: 128960 - DNA, 25 bp, E. coli
agatgccgccgctctttacctgggc

SEQ ID NO: 128961 - DNA, 25 bp, E. coli
taccggatgaattcccgcatgaatc

SEQ ID NO: 128962 - DNA, 25 bp, E. coli
taccggatgaatacccgcatgaatc

SEQ ID NO: 128963 - DNA, 25 bp, E. coli
ttttaaagcaggatgccctcgacgg

SEQ ID NO: 128964 - DNA, 25 bp, E. coli
ttttaaagcaggttgccctcgacgg

SEQ ID NO: 128965 - DNA, 25 bp, E. coli
tgttaccgtccaatatcagccagat

SEQ ID NO: 128966 - DNA, 25 bp, E. coli
tgttaccgtccattatcagccagat

SEQ ID NO: 128967 - DNA, 25 bp, E. coli
cctttcacgacgtagatttgctgga

SEQ ID NO: 128968 - DNA, 25 bp, E. coli
cctttcacgacgaagatttgctgga

SEQ ID NO: 128969 - DNA, 25 bp, E. coli
gctgcaactctcagaacaagggaaa

SEQ ID NO: 128970 - DNA, 25 bp, E. coli
gctgcaactctctgaacaagggaaa

SEQ ID NO: 128971 - DNA, 25 bp, E. coli
gaattacagccggaactcctacatg

SEQ ID NO: 128972 - DNA, 25 bp, E. coli
gaattacagccgcaactcctacatg

SEQ ID NO: 128973 - DNA, 25 bp, E. coli
gaaaatcttccaatcgcagatccgc

SEQ ID NO: 128974 - DNA, 25 bp, E. coli
gaaaatcttccattcgcagatccgc

SEQ ID NO: 128975 - DNA, 25 bp, E. coli
gatgaagcggtcgataaactgcgtg

SEQ ID NO: 128976 - DNA, 25 bp, E. coli
gatgaagcggtccataaactgcgtg

SEQ ID NO: 128977 - DNA, 25 bp, E. coli
cgtttgtcaaacctactctcgaaga

SEQ ID NO: 128978 - DNA, 25 bp, E. coli
cgtttgtcaaacgtactctcgaaga

SEQ ID NO: 128979 - DNA, 25 bp, E. coli
tacgcgaagctaaagtcaatgaact

SEQ ID NO: 128980 - DNA, 25 bp, E. coli
taaacattacagtgaagccgatgcg

SEQ ID NO: 128981 - DNA, 25 bp, E. coli
taaacaccagaacaaaagagcaagt

SEQ ID NO: 128982 - DNA, 25 bp, E. coli
taaacaccagaagaaaagagcaagt

SEQ ID NO: 128983 - DNA, 25 bp, E. coli
taaacattacagagaagccgatgcg

SEQ ID NO: 128984 - DNA, 25 bp, E. coli
tacgcgaagctatagtcaatgaact

SEQ ID NO: 128985 - DNA, 25 bp, E. coli
ttgtctctgattaactacgcgaagc

SEQ ID NO: 128986 - DNA, 25 bp, E. coli
ttgtctctgatttactacgcgaagc

SEQ ID NO: 128987 - DNA, 25 bp, E. coli
gccgatgcggctttacttaatgtta

SEQ ID NO: 128988 - DNA, 25 bp, E. coli
cctactctcgaacaaagactctgtt

SEQ ID NO: 128989 - DNA, 25 bp, E. coli
cctactctcgaagaaagactctgtt

SEQ ID NO: 128990 - DNA, 25 bp, E. coli
gccgatgcggctatacttaatgtta

SEQ ID NO: 128991 - DNA, 25 bp, E. coli
ggttgaaccaccacatagataaagg

SEQ ID NO: 128992 - DNA, 25 bp, E. coli
ggttgaaccacctcatagataaagg

SEQ ID NO: 128993 - DNA, 25 bp, E. coli
gggagaatccccaggttatctggaa

SEQ ID NO: 128994 - DNA, 25 bp, E. coli
gggagaatcccctggttatctggaa

SEQ ID NO: 128995 - DNA, 25 bp, E. coli
tcaatgaactggttgaaactctttc

SEQ ID NO: 128996 - DNA, 25 bp, E. coli
tcaatgaactggatgaaactctttc

SEQ ID NO: 128997 - DNA, 25 bp, E. coli
gacctctggactggaacgtttgtca

SEQ ID NO: 128998 - DNA, 25 bp, E. coli
gacctctggactcgaacgtttgtca

SEQ ID NO: 128999 - DNA, 25 bp, E. coli
agtacccgtactcttttcacgctgt

SEQ ID NO: 129000 - DNA, 25 bp, E. coli
agtacccgtactgttttcacgctgt

SEQ ID NO: 129001 - DNA, 25 bp, E. coli
gtttccttaagtcactttagtacag

SEQ ID NO: 129002 - DNA, 25 bp, E. coli
gtttccttaagtgactttagtacag

SEQ ID NO: 129003 - DNA, 25 bp, E. coli
tttcacgctgtctacaaaaaacgcg

SEQ ID NO: 129004 - DNA, 25 bp, E. coli
ttggcgatacactcaatataaagga

SEQ ID NO: 129005 - DNA, 25 bp, E. coli
tttcacgctgtcaacaaaaaacgcg

SEQ ID NO: 129006 - DNA, 25 bp, E. coli
ttggcgatacacacaatataaagga

SEQ ID NO: 129007 - DNA, 25 bp, E. coli
tgactttagtacagtacccgtactg

SEQ ID NO: 129008 - DNA, 25 bp, E. coli
tgactttagtactgtacccgtactg

SEQ ID NO: 129009 - DNA, 25 bp, E. coli
tgtcaacaaaaaacgcgcccgaagg

SEQ ID NO: 129010 - DNA, 25 bp, E. coli
tgtcaacaaaaatcgcgcccgaagg

SEQ ID NO: 129011 - DNA, 25 bp, E. coli
gcgcgttggcgatacactcaatata

SEQ ID NO: 129012 - DNA, 25 bp, E. coli
gcgcgttggcgaaacactcaatata

SEQ ID NO: 129013 - DNA, 25 bp, E. coli
ttaagtgactttagtacagtacccg

SEQ ID NO: 129014 - DNA, 25 bp, E. coli
ttaagtgacttttgtacagtacccg

SEQ ID NO: 129015 - DNA, 25 bp, E. coli
cccgaaggcgcgatggcgatacact

SEQ ID NO: 129016 - DNA, 25 bp, E. coli
cccgaaggcgcgttggcgatacact

SEQ ID NO: 129017 - DNA, 25 bp, E. coli
cgaaggcgcgttggcgatacactca

SEQ ID NO: 129018 - DNA, 25 bp, E. coli
cgaaggcgcgttcgcgatacactca

SEQ ID NO: 129019 - DNA, 25 bp, E. coli
cgtactgttttctcgctgtcaacaa

SEQ ID NO: 129020 - DNA, 25 bp, E. coli
cgtactgttttcacgctgtcaacaa

SEQ ID NO: 129021 - DNA, 25 bp, E. coli
aatgcgctgctctggcgtttgtcag

SEQ ID NO: 129022 - DNA, 25 bp, E. coli
aatgcgctgctcaggcgtttgtcag

SEQ ID NO: 129023 - DNA, 25 bp, E. coli
cagcgcaaggaatccagaataaagc

SEQ ID NO: 129024 - DNA, 25 bp, E. coli
cagcgcaaggaaaccagaataaagc

SEQ ID NO: 129025 - DNA, 25 bp, E. coli
taaagctggctgttgcagaagcgtg

SEQ ID NO: 129026 - DNA, 25 bp, E. coli
tacgaaaacagtgcgcacatctggc

SEQ ID NO: 129027 - DNA, 25 bp, E. coli
tacgaaaacagtccgcacatctggc

SEQ ID NO: 129028 - DNA, 25 bp, E. coli
taaagctggctgatgcagaagcgtg

SEQ ID NO: 129029 - DNA, 25 bp, E. coli
tttgtcagccagagaacagcgcaag

SEQ ID NO: 129030 - DNA, 25 bp, E. coli
tttgtcagccagtgaacagcgcaag

SEQ ID NO: 129031 - DNA, 25 bp, E. coli
tgatacataaaggtaatgcgctgct

SEQ ID NO: 129032 - DNA, 25 bp, E. coli
tgatacataaagctaatgcgctgct

SEQ ID NO: 129033 - DNA, 25 bp, E. coli
tgacactgagcgtttacgaaaacag

SEQ ID NO: 129034 - DNA, 25 bp, E. coli
tgacactgagcgattacgaaaacag

SEQ ID NO: 129035 - DNA, 25 bp, E. coli
gcacatctggcgaggcggtttatct

SEQ ID NO: 129036 - DNA, 25 bp, E. coli
gcacatctggcgtggcggtttatct

SEQ ID NO: 129037 - DNA, 25 bp, E. coli
cggtttatctgatgtggagctggca

SEQ ID NO: 129038 - DNA, 25 bp, E. coli
cggtttatctgaagtggagctggca

SEQ ID NO: 129039 - DNA, 25 bp, E. coli
cgtgtgccgggcatattgaggatta

SEQ ID NO: 129040 - DNA, 25 bp, E. coli
cgtgtgccgggcttattgaggatta

SEQ ID NO: 129041 - DNA, 25 bp, E. coli
gagctggcagagaggttgatacata

SEQ ID NO: 129042 - DNA, 25 bp, E. coli
gagctggcagagtggttgatacata

SEQ ID NO: 129043 - DNA, 25 bp, E. coli
caaattaggctcaggaaagacgctc

SEQ ID NO: 129044 - DNA, 25 bp, E. coli
caaattaggctctggaaagacgctc

SEQ ID NO: 129045 - DNA, 25 bp, E. coli
taaacaggcgcgatctgcattagct

SEQ ID NO: 129046 - DNA, 25 bp, E. coli
taaacaggcgcgttctgcattagct

SEQ ID NO: 129047 - DNA, 25 bp, E. coli
aaacggcttgcttgttctcgatgag

SEQ ID NO: 129048 - DNA, 25 bp, E. coli
aaacggcttgctagttctcgatgag

SEQ ID NO: 129049 - DNA, 25 bp, E. coli
tagcgacgatttacagaagcaaggt

SEQ ID NO: 129050 - DNA, 25 bp, E. coli
tagcgacgattttcagaagcaaggt

SEQ ID NO: 129051 - DNA, 25 bp, E. coli
tatataacccaagctaagccggagg

SEQ ID NO: 129052 - DNA, 25 bp, E. coli
tattgggcgcggtaatgattcctac

SEQ ID NO: 129053 - DNA, 25 bp, E. coli
tattgggcgcggaaatgattcctac

SEQ ID NO: 129054 - DNA, 25 bp, E. coli
tattactggctcgaaaatgcctctg

SEQ ID NO: 129055 - DNA, 25 bp, E. coli
tatataacccaacctaagccggagg

SEQ ID NO: 129056 - DNA, 25 bp, E. coli
tattactggctccaaaatgcctctg

SEQ ID NO: 129057 - DNA, 25 bp, E. coli
taaggcttcaaaacctcccgcaagt

SEQ ID NO: 129058 - DNA, 25 bp, E. coli
gccttatttatcacacggtcggtat

SEQ ID NO: 129059 - DNA, 25 bp, E. coli
gccttatttatctcacggtcggtat

SEQ ID NO: 129060 - DNA, 25 bp, E. coli
gcaagtcgggagcttcgctaaaacg

SEQ ID NO: 129061 - DNA, 25 bp, E. coli
gcaagtcgggaggttcgctaaaacg

SEQ ID NO: 129062 - DNA, 25 bp, E. coli
cttggaatgataaggaaagacagcc

SEQ ID NO: 129063 - DNA, 25 bp, E. coli
cttggaatgatatggaaagacagcc

SEQ ID NO: 129064 - DNA, 25 bp, E. coli
taaggcttcaaatcctcccgcaagt

SEQ ID NO: 129065 - DNA, 25 bp, E. coli
cagattcctctcatttaaaatcgcc

SEQ ID NO: 129066 - DNA, 25 bp, E. coli
cagattcctctcttttaaaatcgcc

SEQ ID NO: 129067 - DNA, 25 bp, E. coli
cgaaagggaggcacaccagattcct

SEQ ID NO: 129068 - DNA, 25 bp, E. coli
cgaaagggaggctcaccagattcct

SEQ ID NO: 129069 - DNA, 25 bp, E. coli
tttcacccgaaagggaggcacacca

SEQ ID NO: 129070 - DNA, 25 bp, E. coli
ttttgctctattttctcactggagg

SEQ ID NO: 129071 - DNA, 25 bp, E. coli
ttttgctctattatctcactggagg

SEQ ID NO: 129072 - DNA, 25 bp, E. coli
tttcacccgaaacggaggcacacca

SEQ ID NO: 129073 - DNA, 25 bp, E. coli
tggtggcaaattttgatgttgatcg

SEQ ID NO: 129074 - DNA, 25 bp, E. coli
tgtcagcaacctccttaatatccct

SEQ ID NO: 129075 - DNA, 25 bp, E. coli
tggtggcaaattatgatgttgatcg

SEQ ID NO: 129076 - DNA, 25 bp, E. coli
tgtcagcaacctgcttaatatccct

SEQ ID NO: 129077 - DNA, 25 bp, E. coli
tgaaccggtacctaaaatagtgccg

SEQ ID NO: 129078 - DNA, 25 bp, E. coli
tgaaccggtaccaaaaatagtgccg

SEQ ID NO: 129079 - DNA, 25 bp, E. coli
tcctccagcatctatacttatcttt

SEQ ID NO: 129080 - DNA, 25 bp, E. coli
tcctccagcatcaatacttatcttt

SEQ ID NO: 129081 - DNA, 25 bp, E. coli
cctgctgaaccggtaccaaaaatag

SEQ ID NO: 129082 - DNA, 25 bp, E. coli
cctgctgaaccgctaccaaaaatag

SEQ ID NO: 129083 - DNA, 25 bp, E. coli
tggttcggtggtcgcaaattatgat

SEQ ID NO: 129084 - DNA, 25 bp, E. coli
ggcacaccagattcctctcatttaa

SEQ ID NO: 129085 - DNA, 25 bp, E. coli
ggcacaccagatacctctcatttaa

SEQ ID NO: 129086 - DNA, 25 bp, E. coli
tggttcggtggtggcaaattatgat

SEQ ID NO: 129087 - DNA, 25 bp, E. coli
cagtaacggaccatccgcaagagat

SEQ ID NO: 129088 - DNA, 25 bp, E. coli
cagtaacggaccttccgcaagagat

SEQ ID NO: 129089 - DNA, 25 bp, E. coli
tagcgttatttaccggtttgccagt

SEQ ID NO: 129090 - DNA, 25 bp, E. coli
tacagcgaataggtagcgtaagcac

SEQ ID NO: 129091 - DNA, 25 bp, E. coli
tacagcgaatagctagcgtaagcac

SEQ ID NO: 129092 - DNA, 25 bp, E. coli
tagcgttatttagcggtttgccagt

SEQ ID NO: 129093 - DNA, 25 bp, E. coli
tattacgttgtcgtcatggtggacg

SEQ ID NO: 129094 - DNA, 25 bp, E. coli
tattacgttgtcctcatggtggacg

SEQ ID NO: 129095 - DNA, 25 bp, E. coli
tgtagcgcactgcaaggtacgccac

SEQ ID NO: 129096 - DNA, 25 bp, E. coli
tgttgatgttaagtgcctgtagcgc

SEQ ID NO: 129097 - DNA, 25 bp, E. coli
tgttgatgttaactgcctgtagcgc

SEQ ID NO: 129098 - DNA, 25 bp, E. coli
tgtagcgcactggaaggtacgccac

SEQ ID NO: 129099 - DNA, 25 bp, E. coli
gacaggacagtggtattcacaagcc

SEQ ID NO: 129100 - DNA, 25 bp, E. coli
gacaggacagtgctattcacaagcc

SEQ ID NO: 129101 - DNA, 25 bp, E. coli
ggttctccggatgacgcattagcag

SEQ ID NO: 129102 - DNA, 25 bp, E. coli
ggttctccggatcacgcattagcag

SEQ ID NO: 129103 - DNA, 25 bp, E. coli
tggacgaaaccatcgtgacaggaca

SEQ ID NO: 129104 - DNA, 25 bp, E. coli
tggacgaaaccaacgtgacaggaca

SEQ ID NO: 129105 - DNA, 25 bp, E. coli
tggttagcaggaaacgtaatagcgt

SEQ ID NO: 129106 - DNA, 25 bp, E. coli
tggttagcaggatacgtaatagcgt

SEQ ID NO: 129107 - DNA, 25 bp, E. coli
gaccagacgcaacggttacagcgaa

SEQ ID NO: 129108 - DNA, 25 bp, E. coli
gaccagacgcaagggttacagcgaa

SEQ ID NO: 129109 - DNA, 25 bp, E. coli
tacgtccctcagtcagaagatgttg

SEQ ID NO: 129110 - DNA, 25 bp, E. coli
tacgtccctcagacagaagatgttg

SEQ ID NO: 129111 - DNA, 25 bp, E. coli
aaattgtcaccgttgcgctggaacg

SEQ ID NO: 129112 - DNA, 25 bp, E. coli
aaattgtcaccgatgcgctggaacg

SEQ ID NO: 129113 - DNA, 25 bp, E. coli
tatgggatttgtccgtctgaccagc

SEQ ID NO: 129114 - DNA, 25 bp, E. coli
tatgggatttgtgcgtctgaccagc

SEQ ID NO: 129115 - DNA, 25 bp, E. coli
tttgtggctcatggaccgtcagcgg

SEQ ID NO: 129116 - DNA, 25 bp, E. coli
tttgtggctcatcgaccgtcagcgg

SEQ ID NO: 129117 - DNA, 25 bp, E. coli
ttacgcgcggaacgcaaaacgatgc

SEQ ID NO: 129118 - DNA, 25 bp, E. coli
ttactgtcacctggcgtaacgggca

SEQ ID NO: 129119 - DNA, 25 bp, E. coli
ttatacggtcatcgtcaaaggcacc

SEQ ID NO: 129120 - DNA, 25 bp, E. coli
ttatacggtcatggtcaaaggcacc

SEQ ID NO: 129121 - DNA, 25 bp, E. coli
ttacgcgcggaaggcaaaacgatgc

SEQ ID NO: 129122 - DNA, 25 bp, E. coli
ttactgtcacctcgcgtaacgggca

SEQ ID NO: 129123 - DNA, 25 bp, E. coli
tgggtattcccacgcgacaggcgtt

SEQ ID NO: 129124 - DNA, 25 bp, E. coli
tgggtattcccaggcgacaggcgtt

SEQ ID NO: 129125 - DNA, 25 bp, E. coli
tccggtggacaatagaaacgcgtct

SEQ ID NO: 129126 - DNA, 25 bp, E. coli
tccggtggacaaaagaaacgcgtct

SEQ ID NO: 129127 - DNA, 25 bp, E. coli
tcagcctgttgagggagttacgcgc

SEQ ID NO: 129128 - DNA, 25 bp, E. coli
gacagacaccacatttacagccgag

SEQ ID NO: 129129 - DNA, 25 bp, E. coli
gacagacaccacttttacagccgag

SEQ ID NO: 129130 - DNA, 25 bp, E. coli
tcagcctgttgacggagttacgcgc

SEQ ID NO: 129131 - DNA, 25 bp, E. coli
cggtaaaagcgtgttaccgcaatgt

SEQ ID NO: 129132 - DNA, 25 bp, E. coli
cggtaaaagcgtcttaccgcaatgt

SEQ ID NO: 129133 - DNA, 25 bp, E. coli
taccgcaatgttgtctcttctctgg

SEQ ID NO: 129134 - DNA, 25 bp, E. coli
taccgcaatgttctctcttctctgg

SEQ ID NO: 129135 - DNA, 25 bp, E. coli
tcttctctggaaaatgatacaccgc

SEQ ID NO: 129136 - DNA, 25 bp, E. coli
tcaccttaacctctgataatcgtca

SEQ ID NO: 129137 - DNA, 25 bp, E. coli
tcttctctggaatatgatacaccgc

SEQ ID NO: 129138 - DNA, 25 bp, E. coli
tcaccttaacctgtgataatcgtca

SEQ ID NO: 129139 - DNA, 25 bp, E. coli
ccggacaagacttgtggatttcagc

SEQ ID NO: 129140 - DNA, 25 bp, E. coli
ccggacaagactagtggatttcagc

SEQ ID NO: 129141 - DNA, 25 bp, E. coli
gaagctccgcctcaggtgaccgatg

SEQ ID NO: 129142 - DNA, 25 bp, E. coli
gaagctccgcctgaggtgaccgatg

SEQ ID NO: 129143 - DNA, 25 bp, E. coli
ccgcctcaggtgtccgatggagtgt

SEQ ID NO: 129144 - DNA, 25 bp, E. coli
ccgcctcaggtgaccgatggagtgt

SEQ ID NO: 129145 - DNA, 25 bp, E. coli
gataatcgtcatttaccggacaaga

SEQ ID NO: 129146 - DNA, 25 bp, E. coli
gataatcgtcatataccggacaaga

SEQ ID NO: 129147 - DNA, 25 bp, E. coli
gatacaccgccgagaaatcatcacc

SEQ ID NO: 129148 - DNA, 25 bp, E. coli
gatacaccgccgtgaaatcatcacc

SEQ ID NO: 129149 - DNA, 25 bp, E. coli
tggaatatgatacaccgccgagaaa

SEQ ID NO: 129150 - DNA, 25 bp, E. coli
tggaatatgatagaccgccgagaaa

SEQ ID NO: 129151 - DNA, 25 bp, E. coli
gagaaatcatcaccttaacctctga

SEQ ID NO: 129152 - DNA, 25 bp, E. coli
gagaaatcatcagcttaacctctga

SEQ ID NO: 129153 - DNA, 25 bp, E. coli
caagtagtgatactcgtcgccgcat

SEQ ID NO: 129154 - DNA, 25 bp, E. coli
caagtagtgatagtcgtcgccgcat

SEQ ID NO: 129155 - DNA, 25 bp, E. coli
aatactgcgggaatgcatgccaacg

SEQ ID NO: 129156 - DNA, 25 bp, E. coli
aatactgcgggattgcatgccaacg

SEQ ID NO: 129157 - DNA, 25 bp, E. coli
caacgtggcgagtggcattatgact

SEQ ID NO: 129158 - DNA, 25 bp, E. coli
caacgtggcgagaggcattatgact

SEQ ID NO: 129159 - DNA, 25 bp, E. coli
taacggcagacaccaaactgacaag

SEQ ID NO: 129160 - DNA, 25 bp, E. coli
tactgaaggctgagatgttcccggc

SEQ ID NO: 129161 - DNA, 25 bp, E. coli
tactgaaggctgtgatgttcccggc

SEQ ID NO: 129162 - DNA, 25 bp, E. coli
ttccgggaacacgacgactcaacta

SEQ ID NO: 129163 - DNA, 25 bp, E. coli
ttccgggaacaccacgactcaacta

SEQ ID NO: 129164 - DNA, 25 bp, E. coli
ttggcggagaatatggcaccagcgc

SEQ ID NO: 129165 - DNA, 25 bp, E. coli
ttggcggagaatttggcaccagcgc

SEQ ID NO: 129166 - DNA, 25 bp, E. coli
tgaaaggattatcgcgcaatcgccg

SEQ ID NO: 129167 - DNA, 25 bp, E. coli
tgaaaggattatggcgcaatcgccg

SEQ ID NO: 129168 - DNA, 25 bp, E. coli
gcaatcgccgtggattcatcatggt

SEQ ID NO: 129169 - DNA, 25 bp, E. coli
gcaatcgccgtgcattcatcatggt

SEQ ID NO: 129170 - DNA, 25 bp, E. coli
gaaacagccttcttctggtatgtga

SEQ ID NO: 129171 - DNA, 25 bp, E. coli
gaaacagccttcatctggtatgtga

SEQ ID NO: 129172 - DNA, 25 bp, E. coli
gggcctcttcaggtaatctggtcga

SEQ ID NO: 129173 - DNA, 25 bp, E. coli
gggcctcttcagctaatctggtcga

SEQ ID NO: 129174 - DNA, 25 bp, E. coli
taacggcagacagcaaactgacaag

SEQ ID NO: 129175 - DNA, 25 bp, E. coli
caatcctggtggattgtaccggcaa

SEQ ID NO: 129176 - DNA, 25 bp, E. coli
caatcctggtggtttgtaccggcaa

SEQ ID NO: 129177 - DNA, 25 bp, E. coli
aacatttgccgtacgcccattggcg

SEQ ID NO: 129178 - DNA, 25 bp, E. coli
aacatttgccgttcgcccattggcg

SEQ ID NO: 129179 - DNA, 25 bp, E. coli
tatctcttgaaggacatgccggacg

SEQ ID NO: 129180 - DNA, 25 bp, E. coli
tatctcttgaagcacatgccggacg

SEQ ID NO: 129181 - DNA, 25 bp, E. coli
tggtaaaacaccctgcagatgcgac

SEQ ID NO: 129182 - DNA, 25 bp, E. coli
tggtaaaacaccgtgcagatgcgac

SEQ ID NO: 129183 - DNA, 25 bp, E. coli
tctgccgggcgttaaagtcaaatcg

SEQ ID NO: 129184 - DNA, 25 bp, E. coli
tctgccgggcgtaaaagtcaaatcg

SEQ ID NO: 129185 - DNA, 25 bp, E. coli
gcttgctgcgtaaacgtctgccggg

SEQ ID NO: 129186 - DNA, 25 bp, E. coli
gcttgctgcgtatacgtctgccggg

SEQ ID NO: 129187 - DNA, 25 bp, E. coli
tggctggaacagtaagagatcccgg

SEQ ID NO: 129188 - DNA, 25 bp, E. coli
tggctggaacagaaagagatcccgg

SEQ ID NO: 129189 - DNA, 25 bp, E. coli
taagctcactgctgagatggcacga

SEQ ID NO: 129190 - DNA, 25 bp, E. coli
tcaaatcggcagctgttcatggtct

SEQ ID NO: 129191 - DNA, 25 bp, E. coli
tcaaatcggcaggtgttcatggtct

SEQ ID NO: 129192 - DNA, 25 bp, E. coli
taagctcactgcagagatggcacga

SEQ ID NO: 129193 - DNA, 25 bp, E. coli
ggtccgcgggaacacaatgctgttt

SEQ ID NO: 129194 - DNA, 25 bp, E. coli
gagatcccggatccctatcgtaaaa

SEQ ID NO: 129195 - DNA, 25 bp, E. coli
ggtccgcgggaagacaatgctgttt

SEQ ID NO: 129196 - DNA, 25 bp, E. coli
gagatcccggatgcctatcgtaaaa

SEQ ID NO: 129197 - DNA, 25 bp, E. coli
accgggctttgccaagatgtgattc

SEQ ID NO: 129198 - DNA, 25 bp, E. coli
acagttagacgaggcgattgcccag

SEQ ID NO: 129199 - DNA, 25 bp, E. coli
atgtgattcgccgacagttagacga

SEQ ID NO: 129200 - DNA, 25 bp, E. coli
atgtgattcgcccacagttagacga

SEQ ID NO: 129201 - DNA, 25 bp, E. coli
atgcaaggaaggaatctggaaagcc

SEQ ID NO: 129202 - DNA, 25 bp, E. coli
accgggctttgcgaagatgtgattc

SEQ ID NO: 129203 - DNA, 25 bp, E. coli
atgcaaggaaggtatctggaaagcc

SEQ ID NO: 129204 - DNA, 25 bp, E. coli
acagttagacgacgcgattgcccag

SEQ ID NO: 129205 - DNA, 25 bp, E. coli
tataccgggctttgcgaagatgtga

SEQ ID NO: 129206 - DNA, 25 bp, E. coli
tataccgggcttagcgaagatgtga

SEQ ID NO: 129207 - DNA, 25 bp, E. coli
cccacagttagacgaggcgattgcc

SEQ ID NO: 129208 - DNA, 25 bp, E. coli
cccacagttagaggaggcgattgcc

SEQ ID NO: 129209 - DNA, 25 bp, E. coli
cgtataccgggcattgcgaagatgt

SEQ ID NO: 129210 - DNA, 25 bp, E. coli
cgtataccgggctttgcgaagatgt

SEQ ID NO: 129211 - DNA, 25 bp, E. coli
cgggctttgcgaagatgtgattcgc

SEQ ID NO: 129212 - DNA, 25 bp, E. coli
cgtggttttatgcaaggaaggtatc

SEQ ID NO: 129213 - DNA, 25 bp, E. coli
cgtggttttatggaaggaaggtatc

SEQ ID NO: 129214 - DNA, 25 bp, E. coli
cgggctttgcgatgatgtgattcgc

SEQ ID NO: 129215 - DNA, 25 bp, E. coli
gattgcccagggttatctcaccgaa

SEQ ID NO: 129216 - DNA, 25 bp, E. coli
gttttatgcaaggaaggtatctgga

SEQ ID NO: 129217 - DNA, 25 bp, E. coli
gttttatgcaagcaaggtatctgga

SEQ ID NO: 129218 - DNA, 25 bp, E. coli
gattgcccagggatatctcaccgaa

SEQ ID NO: 129219 - DNA, 25 bp, E. coli
taaaaatcatcgtccgcaacacggg

SEQ ID NO: 129220 - DNA, 25 bp, E. coli
taaaaatcatcgaccgcaacacggg

SEQ ID NO: 129221 - DNA, 25 bp, E. coli
agaagcagcataaccgcgccattga

SEQ ID NO: 129222 - DNA, 25 bp, E. coli
agaagcagcatatccgcgccattga

SEQ ID NO: 129223 - DNA, 25 bp, E. coli
agaagaagcagcataaccgcgccat

SEQ ID NO: 129224 - DNA, 25 bp, E. coli
agaagaagcagcttaaccgcgccat

SEQ ID NO: 129225 - DNA, 25 bp, E. coli
ttgaccttacagagcactggctgag

SEQ ID NO: 129226 - DNA, 25 bp, E. coli
ttacagagcactggctgagagtggc

SEQ ID NO: 129227 - DNA, 25 bp, E. coli
ttacagagcactcgctgagagtggc

SEQ ID NO: 129228 - DNA, 25 bp, E. coli
ttgaccttacagtgcactggctgag

SEQ ID NO: 129229 - DNA, 25 bp, E. coli
tcaggaaaacttaataatcagaaga

SEQ ID NO: 129230 - DNA, 25 bp, E. coli
tcaggaaaactttataatcagaaga

SEQ ID NO: 129231 - DNA, 25 bp, E. coli
gcgccattgaccttacagagcactg

SEQ ID NO: 129232 - DNA, 25 bp, E. coli
gcgccattgaccatacagagcactg

SEQ ID NO: 129233 - DNA, 25 bp, E. coli
ctggctgagagtcgcgataaaaatc

SEQ ID NO: 129234 - DNA, 25 bp, E. coli
ctggctgagagtggcgataaaaatc

SEQ ID NO: 129235 - DNA, 25 bp, E. coli
taatcagaagaaccagcataaccgc

SEQ ID NO: 129236 - DNA, 25 bp, E. coli
taaccgcgccattgaccttacagag

SEQ ID NO: 129237 - DNA, 25 bp, E. coli
taaccgcgccatagaccttacagag

SEQ ID NO: 129238 - DNA, 25 bp, E. coli
taatcagaagaagcagcataaccgc

SEQ ID NO: 129239 - DNA, 25 bp, E. coli
gagtggcgataataatcatcgaccg

SEQ ID NO: 129240 - DNA, 25 bp, E. coli
gagtggcgataaaaatcatcgaccg

SEQ ID NO: 129241 - DNA, 25 bp, E. coli
cactggttgaacagctgcgcgaagc

SEQ ID NO: 129242 - DNA, 25 bp, E. coli
cactggttgaactgctgcgcgaagc

SEQ ID NO: 129243 - DNA, 25 bp, E. coli
accaaagtggatctcgaagcgcgcc

SEQ ID NO: 129244 - DNA, 25 bp, E. coli
accaaagtggatgtcgaagcgcgcc

SEQ ID NO: 129245 - DNA, 25 bp, E. coli
aagttattggtcgtctcggcggtga

SEQ ID NO: 129246 - DNA, 25 bp, E. coli
aagttattggtcctctcggcggtga

SEQ ID NO: 129247 - DNA, 25 bp, E. coli
tttgcgccgccaccagtgagaagcg

SEQ ID NO: 129248 - DNA, 25 bp, E. coli
tttgcgccgccagcagtgagaagcg

SEQ ID NO: 129249 - DNA, 25 bp, E. coli
tttctcattcaggttggcgagcgcc

SEQ ID NO: 129250 - DNA, 25 bp, E. coli
tttctcattcagcttggcgagcgcc

SEQ ID NO: 129251 - DNA, 25 bp, E. coli
tgagcacgccaattcacttaccgga

SEQ ID NO: 129252 - DNA, 25 bp, E. coli
tgagcacgccaaatcacttaccgga

SEQ ID NO: 129253 - DNA, 25 bp, E. coli
tctggagatgctggaaatggtcact

SEQ ID NO: 129254 - DNA, 25 bp, E. coli
tctggagatgctcgaaatggtcact

SEQ ID NO: 129255 - DNA, 25 bp, E. coli
tcattctatggcacgctttgcgccg

SEQ ID NO: 129256 - DNA, 25 bp, E. coli
tcattctatggctcgctttgcgccg

SEQ ID NO: 129257 - DNA, 25 bp, E. coli
gttattcgccggactgattgcacaa

SEQ ID NO: 129258 - DNA, 25 bp, E. coli
gattgcgcaatcctataccgactcg

SEQ ID NO: 129259 - DNA, 25 bp, E. coli
gttattcgccggtctgattgcacaa

SEQ ID NO: 129260 - DNA, 25 bp, E. coli
gattactcgttaagcaaacgcgcca

SEQ ID NO: 129261 - DNA, 25 bp, E. coli
gattactcgttatgcaaacgcgcca

SEQ ID NO: 129262 - DNA, 25 bp, E. coli
gattgcgcaatcgtataccgactcg

SEQ ID NO: 129263 - DNA, 25 bp, E. coli
aattctgtcgctgtactttttcgcg

SEQ ID NO: 129264 - DNA, 25 bp, E. coli
aattctgtcgctctactttttcgcg

SEQ ID NO: 129265 - DNA, 25 bp, E. coli
aattattttcccgattgcccagaca

SEQ ID NO: 129266 - DNA, 25 bp, E. coli
aattattttccccattgcccagaca

SEQ ID NO: 129267 - DNA, 25 bp, E. coli
cacgataaacagtatgagaaacaaa

SEQ ID NO: 129268 - DNA, 25 bp, E. coli
cacgataaacagaatgagaaacaaa

SEQ ID NO: 129269 - DNA, 25 bp, E. coli
cataccacgtcgttatacaactcaa

SEQ ID NO: 129270 - DNA, 25 bp, E. coli
cataccacgtcgatatacaactcaa

SEQ ID NO: 129271 - DNA, 25 bp, E. coli
attcttttctgaataatgtaggcac

SEQ ID NO: 129272 - DNA, 25 bp, E. coli
actttttcgcggatattcttttctg

SEQ ID NO: 129273 - DNA, 25 bp, E. coli
attcttttctgattaatgtaggcac

SEQ ID NO: 129274 - DNA, 25 bp, E. coli
actttttcgcggttattcttttctg

SEQ ID NO: 129275 - DNA, 25 bp, E. coli
ttgaacgacgcccataccacgtcgt

SEQ ID NO: 129276 - DNA, 25 bp, E. coli
ttgaacgacgccgataccacgtcgt

SEQ ID NO: 129277 - DNA, 25 bp, E. coli
taactagctcaaatattttcccgat

SEQ ID NO: 129278 - DNA, 25 bp, E. coli
taactagctcaattattttcccgat

SEQ ID NO: 129279 - DNA, 25 bp, E. coli
gaatgagaaacaaaaattctgtcgc

SEQ ID NO: 129280 - DNA, 25 bp, E. coli
gaatgagaaacataaattctgtcgc

SEQ ID NO: 129281 - DNA, 25 bp, E. coli
gattgcccagacaaaaattagcggg

SEQ ID NO: 129282 - DNA, 25 bp, E. coli
gttatacaactctataactagctca

SEQ ID NO: 129283 - DNA, 25 bp, E. coli
gttatacaactcaataactagctca

SEQ ID NO: 129284 - DNA, 25 bp, E. coli
gattgcccagactaaaattagcggg

SEQ ID NO: 129285 - DNA, 25 bp, E. coli
cacaaatagcgtttcgtcgggccat

SEQ ID NO: 129286 - DNA, 25 bp, E. coli
cacaaatagcgtatcgtcgggccat

SEQ ID NO: 129287 - DNA, 25 bp, E. coli
tataagccagagagtcatgaacatc

SEQ ID NO: 129288 - DNA, 25 bp, E. coli
tataagccagagtgtcatgaacatc

SEQ ID NO: 129289 - DNA, 25 bp, E. coli
tgtttcgacactgaagcgcgcgaga

SEQ ID NO: 129290 - DNA, 25 bp, E. coli
tgtttcgacactcaagcgcgcgaga

SEQ ID NO: 129291 - DNA, 25 bp, E. coli
tctgcaccgttagaatgtggccccg

SEQ ID NO: 129292 - DNA, 25 bp, E. coli
tctgcaccgttacaatgtggccccg

SEQ ID NO: 129293 - DNA, 25 bp, E. coli
gtccaaccacatgaagtaaaacgaa

SEQ ID NO: 129294 - DNA, 25 bp, E. coli
gtccaaccacatcaagtaaaacgaa

SEQ ID NO: 129295 - DNA, 25 bp, E. coli
gcaacttctggcttcgctgtggtaa

SEQ ID NO: 129296 - DNA, 25 bp, E. coli
gcaacttctggcatcgctgtggtaa

SEQ ID NO: 129297 - DNA, 25 bp, E. coli
gaaatcatcgccaatataagccaga

SEQ ID NO: 129298 - DNA, 25 bp, E. coli
gaaatcatcgcctatataagccaga

SEQ ID NO: 129299 - DNA, 25 bp, E. coli
gaacatcggcgctatctgtttcgac

SEQ ID NO: 129300 - DNA, 25 bp, E. coli
gaaaatgcgcctcagcaacttctgg

SEQ ID NO: 129301 - DNA, 25 bp, E. coli
gaacatcggcgcaatctgtttcgac

SEQ ID NO: 129302 - DNA, 25 bp, E. coli
gaaaatgcgcctgagcaacttctgg

SEQ ID NO: 129303 - DNA, 25 bp, E. coli
ctgggatatgcccacgcgcgaagtc

SEQ ID NO: 129304 - DNA, 25 bp, E. coli
cattcggccattgtttctgcggtca

SEQ ID NO: 129305 - DNA, 25 bp, E. coli
ctgggatatgccgacgcgcgaagtc

SEQ ID NO: 129306 - DNA, 25 bp, E. coli
cattcggccattctttctgcggtca

SEQ ID NO: 129307 - DNA, 25 bp, E. coli
tttattatcgataccgtggaggccg

SEQ ID NO: 129308 - DNA, 25 bp, E. coli
ttctggatcaataacgtgcgcaagg

SEQ ID NO: 129309 - DNA, 25 bp, E. coli
tttattatcgattccgtggaggccg

SEQ ID NO: 129310 - DNA, 25 bp, E. coli
ttctggatcaattacgtgcgcaagg

SEQ ID NO: 129311 - DNA, 25 bp, E. coli
tgtttcaacccgtcatggcgatgga

SEQ ID NO: 129312 - DNA, 25 bp, E. coli
tgtttcaacccgacatggcgatgga

SEQ ID NO: 129313 - DNA, 25 bp, E. coli
gcgtttgaacaaaaagcctgggaca

SEQ ID NO: 129314 - DNA, 25 bp, E. coli
gctatcattgtttcggcggcaccgc

SEQ ID NO: 129315 - DNA, 25 bp, E. coli
gcgtttgaacaataagcctgggaca

SEQ ID NO: 129316 - DNA, 25 bp, E. coli
gctatcattgttacggcggcaccgc

SEQ ID NO: 129317 - DNA, 25 bp, E. coli
cgccgtgccgcgtgaaaaattcgtt

SEQ ID NO: 129318 - DNA, 25 bp, E. coli
cgccgtgccgcgagaaaaattcgtt

SEQ ID NO: 129319 - DNA, 25 bp, E. coli
cgtcgccgcctgtaaaatcttgatt

SEQ ID NO: 129320 - DNA, 25 bp, E. coli
cggttgaacggaataaaggcttgca

SEQ ID NO: 129321 - DNA, 25 bp, E. coli
cgtgcgcaaggttttcaggatgagc

SEQ ID NO: 129322 - DNA, 25 bp, E. coli
cgtgcgcaaggtattcaggatgagc

SEQ ID NO: 129323 - DNA, 25 bp, E. coli
cggttgaacggattaaaggcttgca

SEQ ID NO: 129324 - DNA, 25 bp, E. coli
cgtcgccgcctgaaaaatcttgatt

SEQ ID NO: 129325 - DNA, 25 bp, E. coli
taagcagacgcgaacaagcacttct

SEQ ID NO: 129326 - DNA, 25 bp, E. coli
taagcagacgcgtacaagcacttct

SEQ ID NO: 129327 - DNA, 25 bp, E. coli
gaccgaattactggagctgacgccg

SEQ ID NO: 129328 - DNA, 25 bp, E. coli
gaccgaattactcgagctgacgccg

SEQ ID NO: 129329 - DNA, 25 bp, E. coli
caactggcctgtcatgcactgcaaa

SEQ ID NO: 129330 - DNA, 25 bp, E. coli
caactggcctgtgatgcactgcaaa

SEQ ID NO: 129331 - DNA, 25 bp, E. coli
catggcctgcccctattggagaatc

SEQ ID NO: 129332 - DNA, 25 bp, E. coli
catggcctgcccgtattggagaatc

SEQ ID NO: 129333 - DNA, 25 bp, E. coli
tacttgcgtaccgatgagggctggt

SEQ ID NO: 129334 - DNA, 25 bp, E. coli
tacttgcgtacccatgagggctggt

SEQ ID NO: 129335 - DNA, 25 bp, E. coli
tattaaaaccattgccgccagcctg

SEQ ID NO: 129336 - DNA, 25 bp, E. coli
tattaaaaccatagccgccagcctg

SEQ ID NO: 129337 - DNA, 25 bp, E. coli
tgctgaagctgacacaacctgcgtg

SEQ ID NO: 129338 - DNA, 25 bp, E. coli
tgctgaagctgagacaacctgcgtg

SEQ ID NO: 129339 - DNA, 25 bp, E. coli
tctttgaggcaaagcagcgatacgg

SEQ ID NO: 129340 - DNA, 25 bp, E. coli
tcatcgggcagacttcagcatcaaa

SEQ ID NO: 129341 - DNA, 25 bp, E. coli
tcatcgggcagagttcagcatcaaa

SEQ ID NO: 129342 - DNA, 25 bp, E. coli
tctttgaggcaatgcagcgatacgg

SEQ ID NO: 129343 - DNA, 25 bp, E. coli
cctgcgtggcagtatgagtgcgaaa

SEQ ID NO: 129344 - DNA, 25 bp, E. coli
cctgcgtggcagaatgagtgcgaaa

SEQ ID NO: 129345 - DNA, 25 bp, E. coli
ccttaaatgacaactggcggagcag

SEQ ID NO: 129346 - DNA, 25 bp, E. coli
gccttgctgacgaaatgccggagtt

SEQ ID NO: 129347 - DNA, 25 bp, E. coli
ccttaaatgacatctggcggagcag

SEQ ID NO: 129348 - DNA, 25 bp, E. coli
gccttgctgacgtaatgccggagtt

SEQ ID NO: 129349 - DNA, 25 bp, E. coli
cattggctggtccatgtcactgcga

SEQ ID NO: 129350 - DNA, 25 bp, E. coli
cattggctggtcgatgtcactgcga

SEQ ID NO: 129351 - DNA, 25 bp, E. coli
caatgatcccgcttagcgttgaagg

SEQ ID NO: 129352 - DNA, 25 bp, E. coli
caatgatcccgcatagcgttgaagg

SEQ ID NO: 129353 - DNA, 25 bp, E. coli
aagtggctccgcgtcgttatttctg

SEQ ID NO: 129354 - DNA, 25 bp, E. coli
aagtggctccgcctcgttatttctg

SEQ ID NO: 129355 - DNA, 25 bp, E. coli
tactcactttatggacagcgacggc

SEQ ID NO: 129356 - DNA, 25 bp, E. coli
tactcactttatcgacagcgacggc

SEQ ID NO: 129357 - DNA, 25 bp, E. coli
tgtcgaaagctaacgcaccactggc

SEQ ID NO: 129358 - DNA, 25 bp, E. coli
tgtcgaaagctatcgcaccactggc

SEQ ID NO: 129359 - DNA, 25 bp, E. coli
tcaatggacggccatgctggccctg

SEQ ID NO: 129360 - DNA, 25 bp, E. coli
tcaatggacggcgatgctggccctg

SEQ ID NO: 129361 - DNA, 25 bp, E. coli
ccattcggatgccaaaagagcagga

SEQ ID NO: 129362 - DNA, 25 bp, E. coli
ccattcggatgcgaaaagagcagga

SEQ ID NO: 129363 - DNA, 25 bp, E. coli
gctgcttgcagtcccacggtgtcga

SEQ ID NO: 129364 - DNA, 25 bp, E. coli
gctgcttgcagtgccacggtgtcga

SEQ ID NO: 129365 - DNA, 25 bp, E. coli
gaagaaagcgctgtgtcaatggacg

SEQ ID NO: 129366 - DNA, 25 bp, E. coli
gaagaaagcgctctgtcaatggacg

SEQ ID NO: 129367 - DNA, 25 bp, E. coli
gaaaagccatgacctgaagaaagcg

SEQ ID NO: 129368 - DNA, 25 bp, E. coli
gaaaagccatgagctgaagaaagcg

SEQ ID NO: 129369 - DNA, 25 bp, E. coli
gaactatgtgaaacagccgccaatg

SEQ ID NO: 129370 - DNA, 25 bp, E. coli
gaactatgtgaatcagccgccaatg

SEQ ID NO: 129371 - DNA, 25 bp, E. coli
cgattttagccagtcgccggaagta

SEQ ID NO: 129372 - DNA, 25 bp, E. coli
cgattttagccactcgccggaagta

SEQ ID NO: 129373 - DNA, 25 bp, E. coli
aatccaggcgctatccggcaatgga

SEQ ID NO: 129374 - DNA, 25 bp, E. coli
aatccaggcgctttccggcaatgga

SEQ ID NO: 129375 - DNA, 25 bp, E. coli
aagcagaaggtcgtcgacgcggcag

SEQ ID NO: 129376 - DNA, 25 bp, E. coli
aagcagaaggtcctcgacgcggcag

SEQ ID NO: 129377 - DNA, 25 bp, E. coli
tagtctcccgcgttgttggtgagct

SEQ ID NO: 129378 - DNA, 25 bp, E. coli
tagtctcccgcgatgttggtgagct

SEQ ID NO: 129379 - DNA, 25 bp, E. coli
ttccggcaatggagaagccctgttg

SEQ ID NO: 129380 - DNA, 25 bp, E. coli
ttccggcaatggtgaagccctgttg

SEQ ID NO: 129381 - DNA, 25 bp, E. coli
tgcacctagtctcccgcgttgttgg

SEQ ID NO: 129382 - DNA, 25 bp, E. coli
tgcacctagtctgccgcgttgttgg

SEQ ID NO: 129383 - DNA, 25 bp, E. coli
tcgacagccgcatcgaactggagat

SEQ ID NO: 129384 - DNA, 25 bp, E. coli
tgccgatggttccctggacagagac

SEQ ID NO: 129385 - DNA, 25 bp, E. coli
tgccgatggttcgctggacagagac

SEQ ID NO: 129386 - DNA, 25 bp, E. coli
tcgacagccgcaacgaactggagat

SEQ ID NO: 129387 - DNA, 25 bp, E. coli
gcatcgaactggtgatgcgtaccga

SEQ ID NO: 129388 - DNA, 25 bp, E. coli
gcgacaacccgagtgcgctttttca

SEQ ID NO: 129389 - DNA, 25 bp, E. coli
gcgacaacccgactgcgctttttca

SEQ ID NO: 129390 - DNA, 25 bp, E. coli
gctggacagagagctcgacagccgc

SEQ ID NO: 129391 - DNA, 25 bp, E. coli
gctggacagagacctcgacagccgc

SEQ ID NO: 129392 - DNA, 25 bp, E. coli
gcatcgaactggagatgcgtaccga

SEQ ID NO: 129393 - DNA, 25 bp, E. coli
tggagaagccctgttgacactactg

SEQ ID NO: 129394 - DNA, 25 bp, E. coli
tggagaagccctcttgacactactg

SEQ ID NO: 129395 - DNA, 25 bp, E. coli
caaagggagaacttcgatgagtcac

SEQ ID NO: 129396 - DNA, 25 bp, E. coli
caaagggagaacatcgatgagtcac

SEQ ID NO: 129397 - DNA, 25 bp, E. coli
tatgtcgaaacccagcctgctaatc

SEQ ID NO: 129398 - DNA, 25 bp, E. coli
tatgtcgaaaccgagcctgctaatc

SEQ ID NO: 129399 - DNA, 25 bp, E. coli
tattctgtatgcgtcattcccggtc

SEQ ID NO: 129400 - DNA, 25 bp, E. coli
tattctgtatgcctcattcccggtc

SEQ ID NO: 129401 - DNA, 25 bp, E. coli
cctcagtcagaccttttggcaagaa

SEQ ID NO: 129402 - DNA, 25 bp, E. coli
cctcagtcagacgttttggcaagaa

SEQ ID NO: 129403 - DNA, 25 bp, E. coli
gaactgctcctagggcgcaatggtt

SEQ ID NO: 129404 - DNA, 25 bp, E. coli
gaactgctcctacggcgcaatggtt

SEQ ID NO: 129405 - DNA, 25 bp, E. coli
cgcaagatcggtgcaaaaggtaagt

SEQ ID NO: 129406 - DNA, 25 bp, E. coli
cgcaagatcggtccaaaaggtaagt

SEQ ID NO: 129407 - DNA, 25 bp, E. coli
cggtcaccttacaggcgatcgccaa

SEQ ID NO: 129408 - DNA, 25 bp, E. coli
cggtcaccttactggcgatcgccaa

SEQ ID NO: 129409 - DNA, 25 bp, E. coli
gatcgccaactttgtcggcacaccg

SEQ ID NO: 129410 - DNA, 25 bp, E. coli
gatcgccaacttagtcggcacaccg

SEQ ID NO: 129411 - DNA, 25 bp, E. coli
tgcgtttaccgaaatgggtaccggc

SEQ ID NO: 129412 - DNA, 25 bp, E. coli
tgcgtttaccgatatgggtaccggc

SEQ ID NO: 129413 - DNA, 25 bp, E. coli
ggcgtattcctgatgcctgcctcag

SEQ ID NO: 129414 - DNA, 25 bp, E. coli
ggcattatgttgcattcccgacgca

SEQ ID NO: 129415 - DNA, 25 bp, E. coli
ggcattatgttggattcccgacgca

SEQ ID NO: 129416 - DNA, 25 bp, E. coli
ggcgtattcctgttgcctgcctcag

SEQ ID NO: 129417 - DNA, 25 bp, E. coli
caactgttactgaaaaaagatagcc

SEQ ID NO: 129418 - DNA, 25 bp, E. coli
caactgttactgtaaaaagatagcc

SEQ ID NO: 129419 - DNA, 25 bp, E. coli
catttcctgaaactgctgccactgg

SEQ ID NO: 129420 - DNA, 25 bp, E. coli
agcgcccgcattcgctttaaggtga

SEQ ID NO: 129421 - DNA, 25 bp, E. coli
agcgcccgcattggctttaaggtga

SEQ ID NO: 129422 - DNA, 25 bp, E. coli
cgcactccccttctatgttgttagg

SEQ ID NO: 129423 - DNA, 25 bp, E. coli
cgcactccccttgtatgttgttagg

SEQ ID NO: 129424 - DNA, 25 bp, E. coli
tatcccgttttggaccctatctggc

SEQ ID NO: 129425 - DNA, 25 bp, E. coli
tatcccgttttgcaccctatctggc

SEQ ID NO: 129426 - DNA, 25 bp, E. coli
tgaaaaaagatacccatttgcccat

SEQ ID NO: 129427 - DNA, 25 bp, E. coli
tgaaaaaagatagccatttgcccat

SEQ ID NO: 129428 - DNA, 25 bp, E. coli
ccatggcgttaccgtcgtggaatat

SEQ ID NO: 129429 - DNA, 25 bp, E. coli
ccatggcgttacggtcgtggaatat

SEQ ID NO: 129430 - DNA, 25 bp, E. coli
gcccatgcgcgcttatcccgttttg

SEQ ID NO: 129431 - DNA, 25 bp, E. coli
gcccatgcgcgcatatcccgttttg

SEQ ID NO: 129432 - DNA, 25 bp, E. coli
cccgcattggctataaggtgacagt

SEQ ID NO: 129433 - DNA, 25 bp, E. coli
cccgcattggctttaaggtgacagt

SEQ ID NO: 129434 - DNA, 25 bp, E. coli
cgatcagcgggcaactgttactgaa

SEQ ID NO: 129435 - DNA, 25 bp, E. coli
cgatcagcgggctactgttactgaa

SEQ ID NO: 129436 - DNA, 25 bp, E. coli
catttcctgaaagtgctgccactgg

SEQ ID NO: 129437 - DNA, 25 bp, E. coli
ggacctcagcgcgtgtgtgcatcag

SEQ ID NO: 129438 - DNA, 25 bp, E. coli
ggacctcagcgcctgtgtgcatcag

SEQ ID NO: 129439 - DNA, 25 bp, E. coli
aatgttggcgaattttctctgcggg

SEQ ID NO: 129440 - DNA, 25 bp, E. coli
aatgttggcgaaatttctctgcggg

SEQ ID NO: 129441 - DNA, 25 bp, E. coli
cactggcggtgcacagccaggcatt

SEQ ID NO: 129442 - DNA, 25 bp, E. coli
cactggcggtgctcagccaggcatt

SEQ ID NO: 129443 - DNA, 25 bp, E. coli
agccaggcatttcataccgaacggg

SEQ ID NO: 129444 - DNA, 25 bp, E. coli
agccaggcatttgataccgaacggg

SEQ ID NO: 129445 - DNA, 25 bp, E. coli
ttctgacggaaaaacgaaggaggag

SEQ ID NO: 129446 - DNA, 25 bp, E. coli
ttaatgtctcttgcggtgatgcccg

SEQ ID NO: 129447 - DNA, 25 bp, E. coli
ttctgacggaaatacgaaggaggag

SEQ ID NO: 129448 - DNA, 25 bp, E. coli
ttaatgtctcttccggtgatgcccg

SEQ ID NO: 129449 - DNA, 25 bp, E. coli
tgtggctactgaatttctggctttc

SEQ ID NO: 129450 - DNA, 25 bp, E. coli
tgtggctactgattttctggctttc

SEQ ID NO: 129451 - DNA, 25 bp, E. coli
tgcattgcgcgcgattaaaaaggag

SEQ ID NO: 129452 - DNA, 25 bp, E. coli
tgcattgcgcgccattaaaaaggag

SEQ ID NO: 129453 - DNA, 25 bp, E. coli
ccattaaaaaggagaatgttggcga

SEQ ID NO: 129454 - DNA, 25 bp, E. coli
ccattaaaaaggtgaatgttggcga

SEQ ID NO: 129455 - DNA, 25 bp, E. coli
tctggctttcatgtccctttaatgt

SEQ ID NO: 129456 - DNA, 25 bp, E. coli
tctggctttcatctccctttaatgt

SEQ ID NO: 129457 - DNA, 25 bp, E. coli
cgaacgggcctgtcgcgatgcattg

SEQ ID NO: 129458 - DNA, 25 bp, E. coli
cgaacgggcctgacgcgatgcattg

SEQ ID NO: 129459 - DNA, 25 bp, E. coli
gggcgtttgtgtttctgacggaaat

SEQ ID NO: 129460 - DNA, 25 bp, E. coli
gggcgtttgtgtatctgacggaaat

SEQ ID NO: 129461 - DNA, 25 bp, E. coli
cattgcaagaatcaggttaaaatca

SEQ ID NO: 129462 - DNA, 25 bp, E. coli
cattgcaagaatgaggttaaaatca

SEQ ID NO: 129463 - DNA, 25 bp, E. coli
aatttacacacggaacaaatattga

SEQ ID NO: 129464 - DNA, 25 bp, E. coli
aatcatttaaatttacacacgcaac

SEQ ID NO: 129465 - DNA, 25 bp, E. coli
aatttacacacgcaacaaatattga

SEQ ID NO: 129466 - DNA, 25 bp, E. coli
aatcatttaaatatacacacgcaac

SEQ ID NO: 129467 - DNA, 25 bp, E. coli
catttaaatttacacacgcaacaaa

SEQ ID NO: 129468 - DNA, 25 bp, E. coli
catttaaatttagacacgcaacaaa

SEQ ID NO: 129469 - DNA, 25 bp, E. coli
taaaaacattgcaagaatcaggtta

SEQ ID NO: 129470 - DNA, 25 bp, E. coli
taaaatcatttatatttacacacgc

SEQ ID NO: 129471 - DNA, 25 bp, E. coli
taaaaacattgctagaatcaggtta

SEQ ID NO: 129472 - DNA, 25 bp, E. coli
aaaacattgcaacaatcaggttaaa

SEQ ID NO: 129473 - DNA, 25 bp, E. coli
aaaacattgcaagaatcaggttaaa

SEQ ID NO: 129474 - DNA, 25 bp, E. coli
ttttaatagcgaaattttctattca

SEQ ID NO: 129475 - DNA, 25 bp, E. coli
ttgcaagaatcaggttaaaatcatt

SEQ ID NO: 129476 - DNA, 25 bp, E. coli
ttttaatagcgatattttctattca

SEQ ID NO: 129477 - DNA, 25 bp, E. coli
ttgcaagaatcacgttaaaatcatt

SEQ ID NO: 129478 - DNA, 25 bp, E. coli
tgtaaaaacattccaagaatcaggt

SEQ ID NO: 129479 - DNA, 25 bp, E. coli
tgtaaaaacattgcaagaatcaggt

SEQ ID NO: 129480 - DNA, 25 bp, E. coli
gcaagaatcaggttaaaatcattta

SEQ ID NO: 129481 - DNA, 25 bp, E. coli
gcaagaatcaggataaaatcattta

SEQ ID NO: 129482 - DNA, 25 bp, E. coli
taaaatcatttaaatttacacacgc

SEQ ID NO: 129483 - DNA, 25 bp, E. coli
cagcgtagtgcagttttggtgcaag

SEQ ID NO: 129484 - DNA, 25 bp, E. coli
cagcgtagtgcacttttggtgcaag

SEQ ID NO: 129485 - DNA, 25 bp, E. coli
catgccgggatatgcgccagaatgc

SEQ ID NO: 129486 - DNA, 25 bp, E. coli
catgccgggataagcgccagaatgc

SEQ ID NO: 129487 - DNA, 25 bp, E. coli
tatgcagatctcttgccatgccggg

SEQ ID NO: 129488 - DNA, 25 bp, E. coli
tatgcagatctcatgccatgccggg

SEQ ID NO: 129489 - DNA, 25 bp, E. coli
ccagaatgctgggttaaagttatat

SEQ ID NO: 129490 - DNA, 25 bp, E. coli
ccagaatgctggcttaaagttatat

SEQ ID NO: 129491 - DNA, 25 bp, E. coli
gcgctttccgcttatgcagatctca

SEQ ID NO: 129492 - DNA, 25 bp, E. coli
gcgctttccgctaatgcagatctca

SEQ ID NO: 129493 - DNA, 25 bp, E. coli
gacaaaaattgctgcgctttccgct

SEQ ID NO: 129494 - DNA, 25 bp, E. coli
gacaaaaattgcagcgctttccgct

SEQ ID NO: 129495 - DNA, 25 bp, E. coli
cccggaatcgtagctgaaatcacag

SEQ ID NO: 129496 - DNA, 25 bp, E. coli
cccggaatcgtacctgaaatcacag

SEQ ID NO: 129497 - DNA, 25 bp, E. coli
gttaaatgaaaacccgcgagtgcgg

SEQ ID NO: 129498 - DNA, 25 bp, E. coli
gatcaacatttgagcagcgtagtgc

SEQ ID NO: 129499 - DNA, 25 bp, E. coli
gatcaacatttgtgcagcgtagtgc

SEQ ID NO: 129500 - DNA, 25 bp, E. coli
gttaaatgaaaagccgcgagtgcgg

SEQ ID NO: 129501 - DNA, 25 bp, E. coli
ggttcctgtatatgacaaaaattgc

SEQ ID NO: 129502 - DNA, 25 bp, E. coli
ggttcctgtataagacaaaaattgc

SEQ ID NO: 129503 - DNA, 25 bp, E. coli
taaggaaggaatctcccggaatcgt

SEQ ID NO: 129504 - DNA, 25 bp, E. coli
taaggaaggaatgtcccggaatcgt

SEQ ID NO: 129505 - DNA, 25 bp, E. coli
aaacgcatccgtttcttaagcgcct

SEQ ID NO: 129506 - DNA, 25 bp, E. coli
aaacgcatccgtatcttaagcgcct

SEQ ID NO: 129507 - DNA, 25 bp, E. coli
tttctcacgataagaaacgcatccg

SEQ ID NO: 129508 - DNA, 25 bp, E. coli
tttctcacgatatgaaacgcatccg

SEQ ID NO: 129509 - DNA, 25 bp, E. coli
ttttatgcggttatggcagcaatcg

SEQ ID NO: 129510 - DNA, 25 bp, E. coli
ttttatgcggttttggcagcaatcg

SEQ ID NO: 129511 - DNA, 25 bp, E. coli
tgacgcatatttgcgcgcgttttat

SEQ ID NO: 129512 - DNA, 25 bp, E. coli
tgacgcatatttccgcgcgttttat

SEQ ID NO: 129513 - DNA, 25 bp, E. coli
tccgtttcttaaccgcctttctggt

SEQ ID NO: 129514 - DNA, 25 bp, E. coli
tccgtttcttaagcgcctttctggt

SEQ ID NO: 129515 - DNA, 25 bp, E. coli
gctggacgcccgaacatgtctctct

SEQ ID NO: 129516 - DNA, 25 bp, E. coli
gcccgtacatgtctctctatcaaca

SEQ ID NO: 129517 - DNA, 25 bp, E. coli
gctggacgcccgtacatgtctctct

SEQ ID NO: 129518 - DNA, 25 bp, E. coli
gcccgtacatgtgtctctatcaaca

SEQ ID NO: 129519 - DNA, 25 bp, E. coli
cgcgttttattcatctggctggacg

SEQ ID NO: 129520 - DNA, 25 bp, E. coli
cgcgttttattcttctggctggacg

SEQ ID NO: 129521 - DNA, 25 bp, E. coli
ggcaacatggccgatgagtttcccg

SEQ ID NO: 129522 - DNA, 25 bp, E. coli
ggcaacatggcccatgagtttcccg

SEQ ID NO: 129523 - DNA, 25 bp, E. coli
tgagtttcccggtggcgctgttgtt

SEQ ID NO: 129524 - DNA, 25 bp, E. coli
tgagtttcccggaggcgctgttgtt

SEQ ID NO: 129525 - DNA, 25 bp, E. coli
tggcagcaatcgcatttcttatcac

SEQ ID NO: 129526 - DNA, 25 bp, E. coli
tggcagcaatcggatttcttatcac

SEQ ID NO: 129527 - DNA, 25 bp, E. coli
agatggattggtcccttcgggaact

SEQ ID NO: 129528 - DNA, 25 bp, E. coli
agatggattggtgccttcgggaact

SEQ ID NO: 129529 - DNA, 25 bp, E. coli
actttccagagaaggattggtgcct

SEQ ID NO: 129530 - DNA, 25 bp, E. coli
aactttccagagatggattggtgcc

SEQ ID NO: 129531 - DNA, 25 bp, E. coli
aactttccagagttggattggtgcc

SEQ ID NO: 129532 - DNA, 25 bp, E. coli
actttccagagatggattggtgcct

SEQ ID NO: 129533 - DNA, 25 bp, E. coli
tttccagagatgcattggtgccttc

SEQ ID NO: 129534 - DNA, 25 bp, E. coli
tttccagagatggattggtgccttc

SEQ ID NO: 129535 - DNA, 25 bp, E. coli
ttccagagatggtttggtgccttcg

SEQ ID NO: 129536 - DNA, 25 bp, E. coli
ttggtgccttcgggaactgtgagac

SEQ ID NO: 129537 - DNA, 25 bp, E. coli
ttccagagatggattggtgccttcg

SEQ ID NO: 129538 - DNA, 25 bp, E. coli
ttggtgccttcgcgaactgtgagac

SEQ ID NO: 129539 - DNA, 25 bp, E. coli
tccagagatggattggtgccttcgg

SEQ ID NO: 129540 - DNA, 25 bp, E. coli
tccagagatggaatggtgccttcgg

SEQ ID NO: 129541 - DNA, 25 bp, E. coli
gaactttccagacatggattggtgc

SEQ ID NO: 129542 - DNA, 25 bp, E. coli
gaactttccagagatggattggtgc

SEQ ID NO: 129543 - DNA, 25 bp, E. coli
ctttccagagatcgattggtgcctt

SEQ ID NO: 129544 - DNA, 25 bp, E. coli
ctttccagagatggattggtgcctt

SEQ ID NO: 129545 - DNA, 25 bp, E. coli
ggattggtgccttcgggaactgtga

SEQ ID NO: 129546 - DNA, 25 bp, E. coli
tggattggtgccttcgggaactgtg

SEQ ID NO: 129547 - DNA, 25 bp, E. coli
ggattggtgcctacgggaactgtga

SEQ ID NO: 129548 - DNA, 25 bp, E. coli
tggattggtgccatcgggaactgtg

SEQ ID NO: 129549 - DNA, 25 bp, E. coli
aaccatacgatattcgctgtcaccg

SEQ ID NO: 129550 - DNA, 25 bp, E. coli
aaccatacgataatcgctgtcaccg

SEQ ID NO: 129551 - DNA, 25 bp, E. coli
cagttagtcgatctcgcacgttgcg

SEQ ID NO: 129552 - DNA, 25 bp, E. coli
cagttagtcgatgtcgcacgttgcg

SEQ ID NO: 129553 - DNA, 25 bp, E. coli
cattttgattccctctgatttccca

SEQ ID NO: 129554 - DNA, 25 bp, E. coli
cattttgattccgtctgatttccca

SEQ ID NO: 129555 - DNA, 25 bp, E. coli
tacgatgggctatactcttctgaag

SEQ ID NO: 129556 - DNA, 25 bp, E. coli
tacgatgggctaaactcttctgaag

SEQ ID NO: 129557 - DNA, 25 bp, E. coli
tcaggagaatatggtgcagttagtc

SEQ ID NO: 129558 - DNA, 25 bp, E. coli
tcaggagaatatcgtgcagttagtc

SEQ ID NO: 129559 - DNA, 25 bp, E. coli
tcttactttgtatcaagccggtgct

SEQ ID NO: 129560 - DNA, 25 bp, E. coli
tcaccgaaaaataattacgatgggc

SEQ ID NO: 129561 - DNA, 25 bp, E. coli
tcttactttgtaacaagccggtgct

SEQ ID NO: 129562 - DNA, 25 bp, E. coli
tcaccgaaaaattattacgatgggc

SEQ ID NO: 129563 - DNA, 25 bp, E. coli
ctcttctgaagatcagtagcgtaga

SEQ ID NO: 129564 - DNA, 25 bp, E. coli
ctcttctgaagaacagtagcgtaga

SEQ ID NO: 129565 - DNA, 25 bp, E. coli
gtagcgtagattcaaactgtcctaa

SEQ ID NO: 129566 - DNA, 25 bp, E. coli
gtagcgtagattgaaactgtcctaa

SEQ ID NO: 129567 - DNA, 25 bp, E. coli
gatttcccagccatataagggtgtg

SEQ ID NO: 129568 - DNA, 25 bp, E. coli
gatttcccagccttataagggtgtg

SEQ ID NO: 129569 - DNA, 25 bp, E. coli
taaccacacttacttaaacagccat

SEQ ID NO: 129570 - DNA, 25 bp, E. coli
taaccacacttagttaaacagccat

SEQ ID NO: 129571 - DNA, 25 bp, E. coli
catatgacactttgaatcaatgctc

SEQ ID NO: 129572 - DNA, 25 bp, E. coli
cattaatcagggttattttgtttga

SEQ ID NO: 129573 - DNA, 25 bp, E. coli
catatgacacttagaatcaatgctc

SEQ ID NO: 129574 - DNA, 25 bp, E. coli
aaacgtaataattcattaatcaggg

SEQ ID NO: 129575 - DNA, 25 bp, E. coli
aaacgtaataatacattaatcaggg

SEQ ID NO: 129576 - DNA, 25 bp, E. coli
tgggatgcctgtgtgaatacacctc

SEQ ID NO: 129577 - DNA, 25 bp, E. coli
tgggatgcctgtctgaatacacctc

SEQ ID NO: 129578 - DNA, 25 bp, E. coli
tgctctctatagtgatgaataatca

SEQ ID NO: 129579 - DNA, 25 bp, E. coli
tgctctctatagagatgaataatca

SEQ ID NO: 129580 - DNA, 25 bp, E. coli
tcaattggtactttcatatgacact

SEQ ID NO: 129581 - DNA, 25 bp, E. coli
tcaattggtactatcatatgacact

SEQ ID NO: 129582 - DNA, 25 bp, E. coli
tcattcgaagtctggtgggatgcct

SEQ ID NO: 129583 - DNA, 25 bp, E. coli
tcattcgaagtcaggtgggatgcct

SEQ ID NO: 129584 - DNA, 25 bp, E. coli
gaatcaatgctctctatagtgatga

SEQ ID NO: 129585 - DNA, 25 bp, E. coli
gaatacacctccttcaggatgtggg

SEQ ID NO: 129586 - DNA, 25 bp, E. coli
gaatcaatgctcactatagtgatga

SEQ ID NO: 129587 - DNA, 25 bp, E. coli
gaatacacctccatcaggatgtggg

SEQ ID NO: 129588 - DNA, 25 bp, E. coli
cattaatcagggatattttgtttga

SEQ ID NO: 129589 - DNA, 25 bp, E. coli
taatcatcattccaagtcaggtggg

SEQ ID NO: 129590 - DNA, 25 bp, E. coli
taatgatgaattaacatgataaacg

SEQ ID NO: 129591 - DNA, 25 bp, E. coli
taatgatgaatttacatgataaacg

SEQ ID NO: 129592 - DNA, 25 bp, E. coli
taatcatcattcgaagtcaggtggg

SEQ ID NO: 129593 - DNA, 25 bp, E. coli
caagtggatgaagaaggcaatgcgc

SEQ ID NO: 129594 - DNA, 25 bp, E. coli
caagtggatgaacaaggcaatgcgc

SEQ ID NO: 129595 - DNA, 25 bp, E. coli
caaatcgactgggatctggccctga

SEQ ID NO: 129596 - DNA, 25 bp, E. coli
caaatcgactggcatctggccctga

SEQ ID NO: 129597 - DNA, 25 bp, E. coli
aacttccagttcaatgccgatgcgg

SEQ ID NO: 129598 - DNA, 25 bp, E. coli
aacttccagttctatgccgatgcgg

SEQ ID NO: 129599 - DNA, 25 bp, E. coli
gcatgattggcgactgctacgcgca

SEQ ID NO: 129600 - DNA, 25 bp, E. coli
gcatgattggcgtctgctacgcgca

SEQ ID NO: 129601 - DNA, 25 bp, E. coli
gaagtgcaacgtgtggttaaccgcg

SEQ ID NO: 129602 - DNA, 25 bp, E. coli
gaagtgcaacgtctggttaaccgcg

SEQ ID NO: 129603 - DNA, 25 bp, E. coli
gaaatataactattccgggccacga

SEQ ID NO: 129604 - DNA, 25 bp, E. coli
gaaatataactaatccgggccacga

SEQ ID NO: 129605 - DNA, 25 bp, E. coli
cgtgatgactgttttcgccgcgatg

SEQ ID NO: 129606 - DNA, 25 bp, E. coli
cgtgatgactgtattcgccgcgatg

SEQ ID NO: 129607 - DNA, 25 bp, E. coli
gtatggatcactttgcccgtccgga

SEQ ID NO: 129608 - DNA, 25 bp, E. coli
gtatggatcactatgcccgtccgga

SEQ ID NO: 129609 - DNA, 25 bp, E. coli
tcaaagatgctgtcctgccgagtcc

SEQ ID NO: 129610 - DNA, 25 bp, E. coli
tcaaagatgctgacctgccgagtcc

SEQ ID NO: 129611 - DNA, 25 bp, E. coli
taagattgttactcgccagcagcac

SEQ ID NO: 129612 - DNA, 25 bp, E. coli
taagattgttacacgccagcagcac

SEQ ID NO: 129613 - DNA, 25 bp, E. coli
gatgtactcgatgatttacgcgccg

SEQ ID NO: 129614 - DNA, 25 bp, E. coli
gatgtactcgatcatttacgcgccg

SEQ ID NO: 129615 - DNA, 25 bp, E. coli
cagcattgaggacattgcgcccgag

SEQ ID NO: 129616 - DNA, 25 bp, E. coli
cagcattgaggagattgcgcccgag

SEQ ID NO: 129617 - DNA, 25 bp, E. coli
taacatgaaactgagtgcgcgctgg

SEQ ID NO: 129618 - DNA, 25 bp, E. coli
tacagcgagcggtgatggaagacat

SEQ ID NO: 129619 - DNA, 25 bp, E. coli
tacagcgagcggagatggaagacat

SEQ ID NO: 129620 - DNA, 25 bp, E. coli
aaagtatttggtgagccagcctggc

SEQ ID NO: 129621 - DNA, 25 bp, E. coli
aaagtatttggtcagccagcctggc

SEQ ID NO: 129622 - DNA, 25 bp, E. coli
tatgaacacgctagttgatgccgga

SEQ ID NO: 129623 - DNA, 25 bp, E. coli
tatgaacacgcttgttgatgccgga

SEQ ID NO: 129624 - DNA, 25 bp, E. coli
tataccatttcgtatgccacgctgg

SEQ ID NO: 129625 - DNA, 25 bp, E. coli
tataccatttcgaatgccacgctgg

SEQ ID NO: 129626 - DNA, 25 bp, E. coli
tccggactttcgtttgagcatgcaa

SEQ ID NO: 129627 - DNA, 25 bp, E. coli
tgcgcccgaggagcaacaatatgca

SEQ ID NO: 129628 - DNA, 25 bp, E. coli
tccggactttcgattgagcatgcaa

SEQ ID NO: 129629 - DNA, 25 bp, E. coli
tgcgcccgaggaccaacaatatgca

SEQ ID NO: 129630 - DNA, 25 bp, E. coli
gctttggagtatattcgacgggcac

SEQ ID NO: 129631 - DNA, 25 bp, E. coli
gctagcgaattagccggccaggtta

SEQ ID NO: 129632 - DNA, 25 bp, E. coli
gctagcgaattacccggccaggtta

SEQ ID NO: 129633 - DNA, 25 bp, E. coli
gctttggagtattttcgacgggcac

SEQ ID NO: 129634 - DNA, 25 bp, E. coli
ggaatgtcgccataatgccctagag

SEQ ID NO: 129635 - DNA, 25 bp, E. coli
ggaatgtcgccaaaatgccctagag

SEQ ID NO: 129636 - DNA, 25 bp, E. coli
taacatgaaactcagtgcgcgctgg

SEQ ID NO: 129637 - DNA, 25 bp, E. coli
tacgctggactccatcggcgaagcc

SEQ ID NO: 129638 - DNA, 25 bp, E. coli
aggctcggtactggtgattcaggac

SEQ ID NO: 129639 - DNA, 25 bp, E. coli
aggctcggtactcgtgattcaggac

SEQ ID NO: 129640 - DNA, 25 bp, E. coli
attgccgtgaaacatggcatccgcc

SEQ ID NO: 129641 - DNA, 25 bp, E. coli
attgccgtgaaagatggcatccgcc

SEQ ID NO: 129642 - DNA, 25 bp, E. coli
tacgctggactcgatcggcgaagcc

SEQ ID NO: 129643 - DNA, 25 bp, E. coli
tataggctcggtactggtgattcag

SEQ ID NO: 129644 - DNA, 25 bp, E. coli
tataggctcggttctggtgattcag

SEQ ID NO: 129645 - DNA, 25 bp, E. coli
tcgcattgccgtcaaagatggcatc

SEQ ID NO: 129646 - DNA, 25 bp, E. coli
tcgcattgccgtgaaagatggcatc

SEQ ID NO: 129647 - DNA, 25 bp, E. coli
gcctgctcggcattaatatggatat

SEQ ID NO: 129648 - DNA, 25 bp, E. coli
gcctgctcggcaataatatggatat

SEQ ID NO: 129649 - DNA, 25 bp, E. coli
gcaatataggctgggtactggtgat

SEQ ID NO: 129650 - DNA, 25 bp, E. coli
gcaatataggctcggtactggtgat

SEQ ID NO: 129651 - DNA, 25 bp, E. coli
gaaagatggcatccgccatatccgc

SEQ ID NO: 129652 - DNA, 25 bp, E. coli
gaaagatggcatgcgccatatccgc

SEQ ID NO: 129653 - DNA, 25 bp, E. coli
gtcgaacgcctgctcggcattaata

SEQ ID NO: 129654 - DNA, 25 bp, E. coli
ggacggcagcaatataggctcggta

SEQ ID NO: 129655 - DNA, 25 bp, E. coli
ggacggcagcaaaataggctcggta

SEQ ID NO: 129656 - DNA, 25 bp, E. coli
gtcgaacgcctggtcggcattaata

SEQ ID NO: 129657 - DNA, 25 bp, E. coli
ggaatttcgcattgccgtgaaagat

SEQ ID NO: 129658 - DNA, 25 bp, E. coli
ggaatttcgcatagccgtgaaagat

SEQ ID NO: 129659 - DNA, 25 bp, E. coli
tgcctgcggcaaggctctctcgctg

SEQ ID NO: 129660 - DNA, 25 bp, E. coli
tgcctgcggcaacgctctctcgctg

SEQ ID NO: 129661 - DNA, 25 bp, E. coli
tgcggcaacgctgtctcgctggcgc

SEQ ID NO: 129662 - DNA, 25 bp, E. coli
tcgttgcctgcggcaacgctctctc

SEQ ID NO: 129663 - DNA, 25 bp, E. coli
tgcggcaacgctctctcgctggcgc

SEQ ID NO: 129664 - DNA, 25 bp, E. coli
tcgttgcctgcgccaacgctctctc

SEQ ID NO: 129665 - DNA, 25 bp, E. coli
gcctgcggcaaccctctctcgctgg

SEQ ID NO: 129666 - DNA, 25 bp, E. coli
cctgcggcaacgctctctcgctggc

SEQ ID NO: 129667 - DNA, 25 bp, E. coli
cctgcggcaacggtctctcgctggc

SEQ ID NO: 129668 - DNA, 25 bp, E. coli
gcctgcggcaacgctctctcgctgg

SEQ ID NO: 129669 - DNA, 25 bp, E. coli
gcggcaacgctcactcgctggcgct

SEQ ID NO: 129670 - DNA, 25 bp, E. coli
gcggcaacgctctctcgctggcgct

SEQ ID NO: 129671 - DNA, 25 bp, E. coli
cggcaacgctctgtcgctggcgctc

SEQ ID NO: 129672 - DNA, 25 bp, E. coli
ctgcggcaacgctctctcgctggcg

SEQ ID NO: 129673 - DNA, 25 bp, E. coli
cggcaacgctctctcgctggcgctc

SEQ ID NO: 129674 - DNA, 25 bp, E. coli
ctgcggcaacgcactctcgctggcg

SEQ ID NO: 129675 - DNA, 25 bp, E. coli
gtcgttgcctgcggcaacgctctct

SEQ ID NO: 129676 - DNA, 25 bp, E. coli
ggtcgttgcctggggcaacgctctc

SEQ ID NO: 129677 - DNA, 25 bp, E. coli
ggtcgttgcctgcggcaacgctctc

SEQ ID NO: 129678 - DNA, 25 bp, E. coli
gtcgttgcctgccgcaacgctctct

SEQ ID NO: 129679 - DNA, 25 bp, E. coli
cagcactcagtgttctttcgacgca

SEQ ID NO: 129680 - DNA, 25 bp, E. coli
cagcactcagtgatctttcgacgca

SEQ ID NO: 129681 - DNA, 25 bp, E. coli
attacgcgcaatccaacggaggtga

SEQ ID NO: 129682 - DNA, 25 bp, E. coli
attacgcgcaatgcaacggaggtga

SEQ ID NO: 129683 - DNA, 25 bp, E. coli
acgggtacgcattggtgagttcaac

SEQ ID NO: 129684 - DNA, 25 bp, E. coli
acgggtacgcataggtgagttcaac

SEQ ID NO: 129685 - DNA, 25 bp, E. coli
ttctttcgacgcatggacgggcgct

SEQ ID NO: 129686 - DNA, 25 bp, E. coli
ttctttcgacgcttggacgggcgct

SEQ ID NO: 129687 - DNA, 25 bp, E. coli
tgttcgaacataatgaccaacagga

SEQ ID NO: 129688 - DNA, 25 bp, E. coli
tgttcgaacatattgaccaacagga

SEQ ID NO: 129689 - DNA, 25 bp, E. coli
tgaccaacaggagtaccgcaaaatt

SEQ ID NO: 129690 - DNA, 25 bp, E. coli
tgaccaacaggactaccgcaaaatt

SEQ ID NO: 129691 - DNA, 25 bp, E. coli
gaaatgcgcctgaaaaaattacgcg

SEQ ID NO: 129692 - DNA, 25 bp, E. coli
gaaatgcgcctgtaaaaattacgcg

SEQ ID NO: 129693 - DNA, 25 bp, E. coli
ccgcaaaattctcgcgggcactgag

SEQ ID NO: 129694 - DNA, 25 bp, E. coli
ccgcaaaattctggcgggcactgag

SEQ ID NO: 129695 - DNA, 25 bp, E. coli
cgggcactgagctggaaatgcgcct

SEQ ID NO: 129696 - DNA, 25 bp, E. coli
cgggcactgagcaggaaatgcgcct

SEQ ID NO: 129697 - DNA, 25 bp, E. coli
gattactcgcagtactcagcactca

SEQ ID NO: 129698 - DNA, 25 bp, E. coli
gattactcgcagaactcagcactca

SEQ ID NO: 129699 - DNA, 25 bp, E. coli
tggtgagttcaagaacctgttcgaa

SEQ ID NO: 129700 - DNA, 25 bp, E. coli
tggtgagttcaacaacctgttcgaa

SEQ ID NO: 129701 - DNA, 25 bp, E. coli
caaacatgcgtctgtatgtagcgga

SEQ ID NO: 129702 - DNA, 25 bp, E. coli
caaacatgcgtcagtatgtagcgga

SEQ ID NO: 129703 - DNA, 25 bp, E. coli
atgattttattgttttgcgcgccgc

SEQ ID NO: 129704 - DNA, 25 bp, E. coli
atgattttattgatttgcgcgccgc

SEQ ID NO: 129705 - DNA, 25 bp, E. coli
tattcaaagcccgtactctggtcac

SEQ ID NO: 129706 - DNA, 25 bp, E. coli
tattcaaagcccctactctggtcac

SEQ ID NO: 129707 - DNA, 25 bp, E. coli
tttatgacaaaataccgccgtccag

SEQ ID NO: 129708 - DNA, 25 bp, E. coli
tttatgacaaaaaaccgccgtccag

SEQ ID NO: 129709 - DNA, 25 bp, E. coli
taagtccgttaccagtaggcggctg

SEQ ID NO: 129710 - DNA, 25 bp, E. coli
taagtccgttacgagtaggcggctg

SEQ ID NO: 129711 - DNA, 25 bp, E. coli
tcatcggttcatctggtggagcacc

SEQ ID NO: 129712 - DNA, 25 bp, E. coli
tcatcggttcatgtggtggagcacc

SEQ ID NO: 129713 - DNA, 25 bp, E. coli
gctgattgaatagccaccgttggtg

SEQ ID NO: 129714 - DNA, 25 bp, E. coli
gctgattgaatacccaccgttggtg

SEQ ID NO: 129715 - DNA, 25 bp, E. coli
ggtgcaactcactaagctggtaaac

SEQ ID NO: 129716 - DNA, 25 bp, E. coli
ggtgcaactcacaaagctggtaaac

SEQ ID NO: 129717 - DNA, 25 bp, E. coli
tggcgccgagtttaaggaatgtgac

SEQ ID NO: 129718 - DNA, 25 bp, E. coli
tggcgccgagttaaaggaatgtgac

SEQ ID NO: 129719 - DNA, 25 bp, E. coli
tcagcttacctgttgcatgttcacg

SEQ ID NO: 129720 - DNA, 25 bp, E. coli
tcagcttacctgatgcatgttcacg

SEQ ID NO: 129721 - DNA, 25 bp, E. coli
gagggtcaatacgtgtgcgaaatca

SEQ ID NO: 129722 - DNA, 25 bp, E. coli
gagggtcaatacctgtgcgaaatca

SEQ ID NO: 129723 - DNA, 25 bp, E. coli
aatggctgccaggactgtcgctgtt

SEQ ID NO: 129724 - DNA, 25 bp, E. coli
aatggctgccagcactgtcgctgtt

SEQ ID NO: 129725 - DNA, 25 bp, E. coli
tactaccctggctaatattaattcc

SEQ ID NO: 129726 - DNA, 25 bp, E. coli
taccctggctaatattaattccctt

SEQ ID NO: 129727 - DNA, 25 bp, E. coli
taccctggctaaaattaattccctt

SEQ ID NO: 129728 - DNA, 25 bp, E. coli
tactaccctggcaaatattaattcc

SEQ ID NO: 129729 - DNA, 25 bp, E. coli
atgttactacccaggctaatattaa

SEQ ID NO: 129730 - DNA, 25 bp, E. coli
atggctgccagctctgtcgctgttc

SEQ ID NO: 129731 - DNA, 25 bp, E. coli
atggctgccagcactgtcgctgttc

SEQ ID NO: 129732 - DNA, 25 bp, E. coli
atgttactaccctggctaatattaa

SEQ ID NO: 129733 - DNA, 25 bp, E. coli
aaatggctgccagcactgtcgctgt

SEQ ID NO: 129734 - DNA, 25 bp, E. coli
aaatggctgccaccactgtcgctgt

SEQ ID NO: 129735 - DNA, 25 bp, E. coli
tgccagcactgtggctgttctttgc

SEQ ID NO: 129736 - DNA, 25 bp, E. coli
tgccagcactgtcgctgttctttgc

SEQ ID NO: 129737 - DNA, 25 bp, E. coli
cctggctaatattaattccctttat

SEQ ID NO: 129738 - DNA, 25 bp, E. coli
cctggctaatataaattccctttat

SEQ ID NO: 129739 - DNA, 25 bp, E. coli
gctgccagcactctcgctgttcttt

SEQ ID NO: 129740 - DNA, 25 bp, E. coli
gctgccagcactgtcgctgttcttt

SEQ ID NO: 129741 - DNA, 25 bp, E. coli
gaaatggctgccagcactgtcgctg

SEQ ID NO: 129742 - DNA, 25 bp, E. coli
gaaatggctgcctgcactgtcgctg

SEQ ID NO: 129743 - DNA, 25 bp, E. coli
tggctgccagcactgtcgctgttct

SEQ ID NO: 129744 - DNA, 25 bp, E. coli
tggctgccagcagtgtcgctgttct

SEQ ID NO: 129745 - DNA, 25 bp, E. coli
aatacttttgatggtgagtaccagc

SEQ ID NO: 129746 - DNA, 25 bp, E. coli
aatacttttgatcgtgagtaccagc

SEQ ID NO: 129747 - DNA, 25 bp, E. coli
tatgtcactggtacgtaaccagggc

SEQ ID NO: 129748 - DNA, 25 bp, E. coli
tatgtcactggttcgtaaccagggc

SEQ ID NO: 129749 - DNA, 25 bp, E. coli
tttaagaatttcgtgctgatgcagc

SEQ ID NO: 129750 - DNA, 25 bp, E. coli
ttaaaagtgtttggctgatcattgc

SEQ ID NO: 129751 - DNA, 25 bp, E. coli
ttaaaagtgtttcgctgatcattgc

SEQ ID NO: 129752 - DNA, 25 bp, E. coli
tttaagaatttcctgctgatgcagc

SEQ ID NO: 129753 - DNA, 25 bp, E. coli
tggtgagtaccaccgaaaggatgat

SEQ ID NO: 129754 - DNA, 25 bp, E. coli
gctgatgcagcataaaatggcggcg

SEQ ID NO: 129755 - DNA, 25 bp, E. coli
gctgatgcagcaaaaaatggcggcg

SEQ ID NO: 129756 - DNA, 25 bp, E. coli
cccagcggcggacatgattaaaagt

SEQ ID NO: 129757 - DNA, 25 bp, E. coli
cccagcggcggagatgattaaaagt

SEQ ID NO: 129758 - DNA, 25 bp, E. coli
ggtgcaaaagcaactgacagtgaag

SEQ ID NO: 129759 - DNA, 25 bp, E. coli
ggtttgctgcttttattaccgggct

SEQ ID NO: 129760 - DNA, 25 bp, E. coli
ggtttgctgcttatattaccgggct

SEQ ID NO: 129761 - DNA, 25 bp, E. coli
ggtgcaaaagcatctgacagtgaag

SEQ ID NO: 129762 - DNA, 25 bp, E. coli
tggtgagtaccagcgaaaggatgat

SEQ ID NO: 129763 - DNA, 25 bp, E. coli
taaccagggctttaagaatttcgtg

SEQ ID NO: 129764 - DNA, 25 bp, E. coli
taaccagggcttaaagaatttcgtg

SEQ ID NO: 129765 - DNA, 25 bp, E. coli
gaccggtggcggtaatacttttgat

SEQ ID NO: 129766 - DNA, 25 bp, E. coli
gaccggtggcggaaatacttttgat

SEQ ID NO: 129767 - DNA, 25 bp, E. coli
aattcaacagcagaacccgctctgg

SEQ ID NO: 129768 - DNA, 25 bp, E. coli
aattcaacagcacaacccgctctgg

SEQ ID NO: 129769 - DNA, 25 bp, E. coli
cagcaaacgatcaattatgtggtca

SEQ ID NO: 129770 - DNA, 25 bp, E. coli
cagtgatatctaccagcaaacgatc

SEQ ID NO: 129771 - DNA, 25 bp, E. coli
cagcaaacgatctattatgtggtca

SEQ ID NO: 129772 - DNA, 25 bp, E. coli
cagtgatatctagcagcaaacgatc

SEQ ID NO: 129773 - DNA, 25 bp, E. coli
tatcaggcagaatattcaacagcag

SEQ ID NO: 129774 - DNA, 25 bp, E. coli
tatcaggcagaaaattcaacagcag

SEQ ID NO: 129775 - DNA, 25 bp, E. coli
ttctcatggagctgaccaaatgggt

SEQ ID NO: 129776 - DNA, 25 bp, E. coli
ttctcatggagcagaccaaatgggt

SEQ ID NO: 129777 - DNA, 25 bp, E. coli
gaagcttctgattacgacatcctca

SEQ ID NO: 129778 - DNA, 25 bp, E. coli
gaacccgctctggttaatgccattg

SEQ ID NO: 129779 - DNA, 25 bp, E. coli
gaacccgctctgcttaatgccattg

SEQ ID NO: 129780 - DNA, 25 bp, E. coli
gaagcttctgataacgacatcctca

SEQ ID NO: 129781 - DNA, 25 bp, E. coli
gacatcctcagtcatatctaccagc

SEQ ID NO: 129782 - DNA, 25 bp, E. coli
gacatcctcagtgatatctaccagc

SEQ ID NO: 129783 - DNA, 25 bp, E. coli
ggtgttgtcactcaagatgacattc

SEQ ID NO: 129784 - DNA, 25 bp, E. coli
ggtgttgtcactgaagatgacattc

SEQ ID NO: 129785 - DNA, 25 bp, E. coli
taatgccattgagcaaggccttcgg

SEQ ID NO: 129786 - DNA, 25 bp, E. coli
taatgccattgaccaaggccttcgg

SEQ ID NO: 129787 - DNA, 25 bp, E. coli
gatgacattctcttggagctgacca

SEQ ID NO: 129788 - DNA, 25 bp, E. coli
gatgacattctcatggagctgacca

SEQ ID NO: 129789 - DNA, 25 bp, E. coli
aattgaatcgcttgcagggcaccgc

SEQ ID NO: 129790 - DNA, 25 bp, E. coli
aattgaatcgctagcagggcaccgc

SEQ ID NO: 129791 - DNA, 25 bp, E. coli
cagggcaccgccttcctggtggtta

SEQ ID NO: 129792 - DNA, 25 bp, E. coli
cagggcaccgccatcctggtggtta

SEQ ID NO: 129793 - DNA, 25 bp, E. coli
tgattggcaagataaagcccgctga

SEQ ID NO: 129794 - DNA, 25 bp, E. coli
tgtgcaaacgctatcaggaaggcag

SEQ ID NO: 129795 - DNA, 25 bp, E. coli
tgtgcaaacgctttcaggaaggcag

SEQ ID NO: 129796 - DNA, 25 bp, E. coli
tgattggcaagaaaaagcccgctga

SEQ ID NO: 129797 - DNA, 25 bp, E. coli
tgcaatgcgacatcctgtgcaaacg

SEQ ID NO: 129798 - DNA, 25 bp, E. coli
tgcaatgcgacaacctgtgcaaacg

SEQ ID NO: 129799 - DNA, 25 bp, E. coli
tgcaactggcgatacgtatgagccg

SEQ ID NO: 129800 - DNA, 25 bp, E. coli
tgcaactggcgaaacgtatgagccg

SEQ ID NO: 129801 - DNA, 25 bp, E. coli
tcaggaaggcagagtgcaaaccgat

SEQ ID NO: 129802 - DNA, 25 bp, E. coli
tcagtttcaccagctgctgccggat

SEQ ID NO: 129803 - DNA, 25 bp, E. coli
tcagtttcaccacctgctgccggat

SEQ ID NO: 129804 - DNA, 25 bp, E. coli
tcaggaaggcagtgtgcaaaccgat

SEQ ID NO: 129805 - DNA, 25 bp, E. coli
ccctggaaaacgaggctatgccgct

SEQ ID NO: 129806 - DNA, 25 bp, E. coli
ccctggaaaacgtggctatgccgct

SEQ ID NO: 129807 - DNA, 25 bp, E. coli
cgtctgacggcgcaactgagcctga

SEQ ID NO: 129808 - DNA, 25 bp, E. coli
cgtctgacggcggaactgagcctga

SEQ ID NO: 129809 - DNA, 25 bp, E. coli
ggtggttactcacgacctgcaactg

SEQ ID NO: 129810 - DNA, 25 bp, E. coli
ggtggttactcaggacctgcaactg

SEQ ID NO: 129811 - DNA, 25 bp, E. coli
cacatcaagtatggtcgcaaatgga

SEQ ID NO: 129812 - DNA, 25 bp, E. coli
cacatcaagtatcgtcgcaaatgga

SEQ ID NO: 129813 - DNA, 25 bp, E. coli
tagaaagaagcacttaagctaggcg

SEQ ID NO: 129814 - DNA, 25 bp, E. coli
tagaaagaagcagttaagctaggcg

SEQ ID NO: 129815 - DNA, 25 bp, E. coli
ctcaaacacccttgaatctttgatt

SEQ ID NO: 129816 - DNA, 25 bp, E. coli
ctcaaacaccctagaatctttgatt

SEQ ID NO: 129817 - DNA, 25 bp, E. coli
aaatcaataaaatccacacatcaag

SEQ ID NO: 129818 - DNA, 25 bp, E. coli
aaatcaataaaaaccacacatcaag

SEQ ID NO: 129819 - DNA, 25 bp, E. coli
tgttttacatcatcttatgcgggtg

SEQ ID NO: 129820 - DNA, 25 bp, E. coli
tgttttacatcaacttatgcgggtg

SEQ ID NO: 129821 - DNA, 25 bp, E. coli
cgcaaatggattttattgttttaca

SEQ ID NO: 129822 - DNA, 25 bp, E. coli
cgcaaatggattatattgttttaca

SEQ ID NO: 129823 - DNA, 25 bp, E. coli
ctaggcggattgtagattcgcagga

SEQ ID NO: 129824 - DNA, 25 bp, E. coli
cttatgcgggtgagaaattttacca

SEQ ID NO: 129825 - DNA, 25 bp, E. coli
cgtttaagtctaaaaaatgagcatg

SEQ ID NO: 129826 - DNA, 25 bp, E. coli
cttatgcgggtgtgaaattttacca

SEQ ID NO: 129827 - DNA, 25 bp, E. coli
ctaggcggattgaagattcgcagga

SEQ ID NO: 129828 - DNA, 25 bp, E. coli
cgtttaagtctataaaatgagcatg

SEQ ID NO: 129829 - DNA, 25 bp, E. coli
taagctaggcggtttgaagattcgc

SEQ ID NO: 129830 - DNA, 25 bp, E. coli
taagctaggcggattgaagattcgc

SEQ ID NO: 129831 - DNA, 25 bp, E. coli
gagcatgattttgttctgtagaaag

SEQ ID NO: 129832 - DNA, 25 bp, E. coli
gagcatgattttcttctgtagaaag

SEQ ID NO: 129833 - DNA, 25 bp, E. coli
cacgaatcagtaactcctggaccgc

SEQ ID NO: 129834 - DNA, 25 bp, E. coli
cacgaatcagtatctcctggaccgc

SEQ ID NO: 129835 - DNA, 25 bp, E. coli
catgctggccgtcgtcgtcgtggtc

SEQ ID NO: 129836 - DNA, 25 bp, E. coli
catgctggccgtggtcgtcgtggtc

SEQ ID NO: 129837 - DNA, 25 bp, E. coli
tacttaatgccgaaaagatattgag

SEQ ID NO: 129838 - DNA, 25 bp, E. coli
taaaggatacagcttgcccgagcca

SEQ ID NO: 129839 - DNA, 25 bp, E. coli
taaaggatacaggttgcccgagcca

SEQ ID NO: 129840 - DNA, 25 bp, E. coli
tacttaatgccgtaaagatattgag

SEQ ID NO: 129841 - DNA, 25 bp, E. coli
tattgagtcagcaggatgacggcag

SEQ ID NO: 129842 - DNA, 25 bp, E. coli
tattgagtcagctggatgacggcag

SEQ ID NO: 129843 - DNA, 25 bp, E. coli
ttgcccgagccattccagttactta

SEQ ID NO: 129844 - DNA, 25 bp, E. coli
ttgcccgagccaatccagttactta

SEQ ID NO: 129845 - DNA, 25 bp, E. coli
tcttgcggccatcctgatacgtgaa

SEQ ID NO: 129846 - DNA, 25 bp, E. coli
tcttgcggccatgctgatacgtgaa

SEQ ID NO: 129847 - DNA, 25 bp, E. coli
tctcgatcgtaatactcttgcggcc

SEQ ID NO: 129848 - DNA, 25 bp, E. coli
tctcgatcgtaaaactcttgcggcc

SEQ ID NO: 129849 - DNA, 25 bp, E. coli
cctggaccgcatgggagagcttaaa

SEQ ID NO: 129850 - DNA, 25 bp, E. coli
gccgaaaagataatgagtcagctgg

SEQ ID NO: 129851 - DNA, 25 bp, E. coli
gccgaaaagatattgagtcagctgg

SEQ ID NO: 129852 - DNA, 25 bp, E. coli
cctggaccgcatcggagagcttaaa

SEQ ID NO: 129853 - DNA, 25 bp, E. coli
cgtaatactcttgcggccatgctga

SEQ ID NO: 129854 - DNA, 25 bp, E. coli
cgtaatactcttccggccatgctga

SEQ ID NO: 129855 - DNA, 25 bp, E. coli
aaccatcctgtgattatggctatcc

SEQ ID NO: 129856 - DNA, 25 bp, E. coli
aatctatccagcatccagaaaacca

SEQ ID NO: 129857 - DNA, 25 bp, E. coli
aatctatccagcttccagaaaacca

SEQ ID NO: 129858 - DNA, 25 bp, E. coli
atgaaatctatccagcatccagaaa

SEQ ID NO: 129859 - DNA, 25 bp, E. coli
atcctgtgtttatggctatcccccc

SEQ ID NO: 129860 - DNA, 25 bp, E. coli
accatcctgtgtttatggctatccc

SEQ ID NO: 129861 - DNA, 25 bp, E. coli
atcctgtgtttaaggctatcccccc

SEQ ID NO: 129862 - DNA, 25 bp, E. coli
accatcctgtgtatatggctatccc

SEQ ID NO: 129863 - DNA, 25 bp, E. coli
atgaaatctatcgagcatccagaaa

SEQ ID NO: 129864 - DNA, 25 bp, E. coli
aaccatcctgtgtttatggctatcc

SEQ ID NO: 129865 - DNA, 25 bp, E. coli
aaatctatccagcatccagaaaacc

SEQ ID NO: 129866 - DNA, 25 bp, E. coli
aaatctatccaggatccagaaaacc

SEQ ID NO: 129867 - DNA, 25 bp, E. coli
tgtgtttatggcaatccccccacaa

SEQ ID NO: 129868 - DNA, 25 bp, E. coli
tgaaatctatccagcatccagaaaa

SEQ ID NO: 129869 - DNA, 25 bp, E. coli
tgaaatctatcctgcatccagaaaa

SEQ ID NO: 129870 - DNA, 25 bp, E. coli
ccatcctgtgttaatggctatcccc

SEQ ID NO: 129871 - DNA, 25 bp, E. coli
ccatcctgtgtttatggctatcccc

SEQ ID NO: 129872 - DNA, 25 bp, E. coli
gaaatctatccagcatccagaaaac

SEQ ID NO: 129873 - DNA, 25 bp, E. coli
gaaatctatccaccatccagaaaac

SEQ ID NO: 129874 - DNA, 25 bp, E. coli
gtgtttatggctttccccccacaac

SEQ ID NO: 129875 - DNA, 25 bp, E. coli
gtgtttatggctatccccccacaac

SEQ ID NO: 129876 - DNA, 25 bp, E. coli
tgtgtttatggctatccccccacaa

SEQ ID NO: 129877 - DNA, 25 bp, E. coli
aagtgtgagggccatcaatcaacga

SEQ ID NO: 129878 - DNA, 25 bp, E. coli
caatcaacgagtgaaaattgagggc

SEQ ID NO: 129879 - DNA, 25 bp, E. coli
caatcaacgagtcaaaattgagggc

SEQ ID NO: 129880 - DNA, 25 bp, E. coli
aagtgtgagggcgatcaatcaacga

SEQ ID NO: 129881 - DNA, 25 bp, E. coli
caggaagcgcaaaatagaagattgg

SEQ ID NO: 129882 - DNA, 25 bp, E. coli
caggaagcgcaatatagaagattgg

SEQ ID NO: 129883 - DNA, 25 bp, E. coli
taacgattaatttacaacgacagtg

SEQ ID NO: 129884 - DNA, 25 bp, E. coli
taaaaaagggactgcctgagctatc

SEQ ID NO: 129885 - DNA, 25 bp, E. coli
aaaattgagggcctaaggtgttcag

SEQ ID NO: 129886 - DNA, 25 bp, E. coli
aaaattgagggcgtaaggtgttcag

SEQ ID NO: 129887 - DNA, 25 bp, E. coli
tgagctatccctattctgcatgcgg

SEQ ID NO: 129888 - DNA, 25 bp, E. coli
tgagctatcccttttctgcatgcgg

SEQ ID NO: 129889 - DNA, 25 bp, E. coli
gaaattggtctggattgttaatgcg

SEQ ID NO: 129890 - DNA, 25 bp, E. coli
gaaattggtctgcattgttaatgcg

SEQ ID NO: 129891 - DNA, 25 bp, E. coli
cgacagtgtaaagttatatgacagc

SEQ ID NO: 129892 - DNA, 25 bp, E. coli
cgacagtgtaaacttatatgacagc

SEQ ID NO: 129893 - DNA, 25 bp, E. coli
gattgttaatgccatgaagtgtgag

SEQ ID NO: 129894 - DNA, 25 bp, E. coli
gattgttaatgcgatgaagtgtgag

SEQ ID NO: 129895 - DNA, 25 bp, E. coli
ggagtcacgtcttagtaacgattaa

SEQ ID NO: 129896 - DNA, 25 bp, E. coli
ggagtcacgtctaagtaacgattaa

SEQ ID NO: 129897 - DNA, 25 bp, E. coli
taaaaaagggacagcctgagctatc

SEQ ID NO: 129898 - DNA, 25 bp, E. coli
taacgattaattaacaacgacagtg

SEQ ID NO: 129899 - DNA, 25 bp, E. coli
caggcccaacttgaaggtgctcagc

SEQ ID NO: 129900 - DNA, 25 bp, E. coli
cataaccgagcagtgtttaaagtaa

SEQ ID NO: 129901 - DNA, 25 bp, E. coli
caggcccaacttcaaggtgctcagc

SEQ ID NO: 129902 - DNA, 25 bp, E. coli
cataaccgagcactgtttaaagtaa

SEQ ID NO: 129903 - DNA, 25 bp, E. coli
tgatgcaggcccaacttgaaggtgc

SEQ ID NO: 129904 - DNA, 25 bp, E. coli
tgatgcaggccctacttgaaggtgc

SEQ ID NO: 129905 - DNA, 25 bp, E. coli
tccgggaacgactggtaatgatgca

SEQ ID NO: 129906 - DNA, 25 bp, E. coli
tccgggaacgacaggtaatgatgca

SEQ ID NO: 129907 - DNA, 25 bp, E. coli
tcagcaatacataaccgagcagtgt

SEQ ID NO: 129908 - DNA, 25 bp, E. coli
tcagcaatacattaccgagcagtgt

SEQ ID NO: 129909 - DNA, 25 bp, E. coli
ccaacttgaaggtgctcagcaatac

SEQ ID NO: 129910 - DNA, 25 bp, E. coli
ccaacttgaaggagctcagcaatac

SEQ ID NO: 129911 - DNA, 25 bp, E. coli
gaaggtgctcaggaatacataaccg

SEQ ID NO: 129912 - DNA, 25 bp, E. coli
gaaggtgctcagcaatacataaccg

SEQ ID NO: 129913 - DNA, 25 bp, E. coli
gactggtaatgatgcaggcccaact

SEQ ID NO: 129914 - DNA, 25 bp, E. coli
gaacgactggtaatgatgcaggccc

SEQ ID NO: 129915 - DNA, 25 bp, E. coli
gaacgactggtattgatgcaggccc

SEQ ID NO: 129916 - DNA, 25 bp, E. coli
gactggtaatgaagcaggcccaact

SEQ ID NO: 129917 - DNA, 25 bp, E. coli
tcaccctccgggtacgactggtaat

SEQ ID NO: 129918 - DNA, 25 bp, E. coli
tcaccctccgggaacgactggtaat

SEQ ID NO: 129919 - DNA, 25 bp, E. coli
ggtaatgatgcaggcccaacttgaa

SEQ ID NO: 129920 - DNA, 25 bp, E. coli
ggtaatgatgcacgcccaacttgaa

SEQ ID NO: 129921 - DNA, 25 bp, E. coli
caggtgaaattggacgctgactacg

SEQ ID NO: 129922 - DNA, 25 bp, E. coli
caggtgaaattgcacgctgactacg

SEQ ID NO: 129923 - DNA, 25 bp, E. coli
tacgcagttaatcagcgtgactggc

SEQ ID NO: 129924 - DNA, 25 bp, E. coli
tagcgccgatgcaggaagataaccc

SEQ ID NO: 129925 - DNA, 25 bp, E. coli
tacgcagttaatgagcgtgactggc

SEQ ID NO: 129926 - DNA, 25 bp, E. coli
tagcgccgatgctggaagataaccc

SEQ ID NO: 129927 - DNA, 25 bp, E. coli
tgttctacgcgcgtccggaattttg

SEQ ID NO: 129928 - DNA, 25 bp, E. coli
tgttctacgcgcctccggaattttg

SEQ ID NO: 129929 - DNA, 25 bp, E. coli
gcattggtcagttcgagctgctcgg

SEQ ID NO: 129930 - DNA, 25 bp, E. coli
gcattggtcagtacgagctgctcgg

SEQ ID NO: 129931 - DNA, 25 bp, E. coli
gcgtaaaaccgtaccgttgatccag

SEQ ID NO: 129932 - DNA, 25 bp, E. coli
gcgtaaaaccgttccgttgatccag

SEQ ID NO: 129933 - DNA, 25 bp, E. coli
gaaacttcctgccatgaaaccggca

SEQ ID NO: 129934 - DNA, 25 bp, E. coli
gaaacttcctgcgatgaaaccggca

SEQ ID NO: 129935 - DNA, 25 bp, E. coli
cgtttgataaaaccgcgaagctgct

SEQ ID NO: 129936 - DNA, 25 bp, E. coli
cgtttgataaaagcgcgaagctgct

SEQ ID NO: 129937 - DNA, 25 bp, E. coli
cattgatgctgtggcctataccgca

SEQ ID NO: 129938 - DNA, 25 bp, E. coli
cgggctttaagccactggtcatggc

SEQ ID NO: 129939 - DNA, 25 bp, E. coli
cattgatgctgtcgcctataccgca

SEQ ID NO: 129940 - DNA, 25 bp, E. coli
cgggctttaagcgactggtcatggc

SEQ ID NO: 129941 - DNA, 25 bp, E. coli
gatgatcgcctatgccggaatggtg

SEQ ID NO: 129942 - DNA, 25 bp, E. coli
gatgatcgcctaagccggaatggtg

SEQ ID NO: 129943 - DNA, 25 bp, E. coli
cataaattgtgatctattcgtcgga

SEQ ID NO: 129944 - DNA, 25 bp, E. coli
cataaattgtgaactattcgtcgga

SEQ ID NO: 129945 - DNA, 25 bp, E. coli
catttatatctgtgatggcaaccac

SEQ ID NO: 129946 - DNA, 25 bp, E. coli
aaactcacctgctaaactgaacggg

SEQ ID NO: 129947 - DNA, 25 bp, E. coli
aaactcacctgcaaaactgaacggg

SEQ ID NO: 129948 - DNA, 25 bp, E. coli
ttcgtcggaaatttgtgcaatgtcc

SEQ ID NO: 129949 - DNA, 25 bp, E. coli
ttcgtcggaaatatgtgcaatgtcc

SEQ ID NO: 129950 - DNA, 25 bp, E. coli
gcaaccgtgaaaatcaaaatagcat

SEQ ID NO: 129951 - DNA, 25 bp, E. coli
gcaaccgtgaaattcaaaatagcat

SEQ ID NO: 129952 - DNA, 25 bp, E. coli
gactctacgagcatgaacaaacgca

SEQ ID NO: 129953 - DNA, 25 bp, E. coli
gaaatacatttgttcaaaactcacc

SEQ ID NO: 129954 - DNA, 25 bp, E. coli
gaaatacatttgatcaaaactcacc

SEQ ID NO: 129955 - DNA, 25 bp, E. coli
gactctacgagcttgaacaaacgca

SEQ ID NO: 129956 - DNA, 25 bp, E. coli
cgagcatgaacatacgcaaccgtga

SEQ ID NO: 129957 - DNA, 25 bp, E. coli
cgagcatgaacaaacgcaaccgtga

SEQ ID NO: 129958 - DNA, 25 bp, E. coli
catttatatctgagatggcaaccac

SEQ ID NO: 129959 - DNA, 25 bp, E. coli
tgtgcaatgtcctcctaaggttatg

SEQ ID NO: 129960 - DNA, 25 bp, E. coli
tgtgcaatgtccacctaaggttatg

SEQ ID NO: 129961 - DNA, 25 bp, E. coli
ggcaaccacagtatgactctacgag

SEQ ID NO: 129962 - DNA, 25 bp, E. coli
ggcaaccacagtttgactctacgag

SEQ ID NO: 129963 - DNA, 25 bp, E. coli
taatgcaattgttcagttcttgctc

SEQ ID NO: 129964 - DNA, 25 bp, E. coli
taatgcaattgtacagttcttgctc

SEQ ID NO: 129965 - DNA, 25 bp, E. coli
caatactcggtagcattctctcaaa

SEQ ID NO: 129966 - DNA, 25 bp, E. coli
caatactcggtaccattctctcaaa

SEQ ID NO: 129967 - DNA, 25 bp, E. coli
tacacccgctttctctgcgaggtgg

SEQ ID NO: 129968 - DNA, 25 bp, E. coli
tacacccgctttgtctgcgaggtgg

SEQ ID NO: 129969 - DNA, 25 bp, E. coli
gtagtattccctcaatttacacccg

SEQ ID NO: 129970 - DNA, 25 bp, E. coli
gtagtattccctgaatttacacccg

SEQ ID NO: 129971 - DNA, 25 bp, E. coli
tacctgagttattcactgactccga

SEQ ID NO: 129972 - DNA, 25 bp, E. coli
tagctgataaccgaatacctgagtt

SEQ ID NO: 129973 - DNA, 25 bp, E. coli
tacctgagttatacactgactccga

SEQ ID NO: 129974 - DNA, 25 bp, E. coli
tagctgataacccaatacctgagtt

SEQ ID NO: 129975 - DNA, 25 bp, E. coli
gactccgagtctgttacgtttcgta

SEQ ID NO: 129976 - DNA, 25 bp, E. coli
gactccgagtctcttacgtttcgta

SEQ ID NO: 129977 - DNA, 25 bp, E. coli
gaatcctattcatggctcttggctg

SEQ ID NO: 129978 - DNA, 25 bp, E. coli
gaatcctattcaaggctcttggctg

SEQ ID NO: 129979 - DNA, 25 bp, E. coli
ggctcttggctgtataaaaataaat

SEQ ID NO: 129980 - DNA, 25 bp, E. coli
ggctcttggctgaataaaaataaat

SEQ ID NO: 129981 - DNA, 25 bp, E. coli
taacggctgttaattataagtgctc

SEQ ID NO: 129982 - DNA, 25 bp, E. coli
taagagtggttacttcgtcacacag

SEQ ID NO: 129983 - DNA, 25 bp, E. coli
taagagtggttagttcgtcacacag

SEQ ID NO: 129984 - DNA, 25 bp, E. coli
taacggctgttatttataagtgctc

SEQ ID NO: 129985 - DNA, 25 bp, E. coli
gagtctcgatattagctgataaccc

SEQ ID NO: 129986 - DNA, 25 bp, E. coli
gagtctcgatataagctgataaccc

SEQ ID NO: 129987 - DNA, 25 bp, E. coli
aagcggcccgcttgacgatattgat

SEQ ID NO: 129988 - DNA, 25 bp, E. coli
aagcggcccgctagacgatattgat

SEQ ID NO: 129989 - DNA, 25 bp, E. coli
cagtttctgccgtcgctgtttgtcg

SEQ ID NO: 129990 - DNA, 25 bp, E. coli
cagtttctgccgacgctgtttgtcg

SEQ ID NO: 129991 - DNA, 25 bp, E. coli
cagaagatgatgagcttgagcaact

SEQ ID NO: 129992 - DNA, 25 bp, E. coli
cagaagatgatgtgcttgagcaact

SEQ ID NO: 129993 - DNA, 25 bp, E. coli
tatcagcaacgtcaatagcataacc

SEQ ID NO: 129994 - DNA, 25 bp, E. coli
tatcagcaacgtgaatagcataacc

SEQ ID NO: 129995 - DNA, 25 bp, E. coli
tgatgtgcttgaccaactggatgca

SEQ ID NO: 129996 - DNA, 25 bp, E. coli
tgatgtgcttgagcaactggatgca

SEQ ID NO: 129997 - DNA, 25 bp, E. coli
gaatatgcagtgtagccgttactcg

SEQ ID NO: 129998 - DNA, 25 bp, E. coli
gaagccgttactggcccaaagcggc

SEQ ID NO: 129999 - DNA, 25 bp, E. coli
gaatatgcagtgaagccgttactcg

SEQ ID NO: 130000 - DNA, 25 bp, E. coli
gaagccgttactcgcccaaagcggc

SEQ ID NO: 130001 - DNA, 25 bp, E. coli
cgctgtttgtcgataacgatgaaga

SEQ ID NO: 130002 - DNA, 25 bp, E. coli
cgctgtttgtcgttaacgatgaaga

SEQ ID NO: 130003 - DNA, 25 bp, E. coli
cgtctggtcagaggcgcgttttagc

SEQ ID NO: 130004 - DNA, 25 bp, E. coli
cgtctggtcagacgcgcgttttagc

SEQ ID NO: 130005 - DNA, 25 bp, E. coli
gggattttatcagcaacgtcaatag

SEQ ID NO: 130006 - DNA, 25 bp, E. coli
gggattttatcaccaacgtcaatag

SEQ ID NO: 130007 - DNA, 25 bp, E. coli
tggatgcacaggtcaatttattttc

SEQ ID NO: 130008 - DNA, 25 bp, E. coli
tggatgcacaggacaatttattttc

SEQ ID NO: 130009 - DNA, 25 bp, E. coli
caatgcgataaatttgcccttgcga

SEQ ID NO: 130010 - DNA, 25 bp, E. coli
caatgcgataaaattgcccttgcga

SEQ ID NO: 130011 - DNA, 25 bp, E. coli
cacccgcttcagagggaaagattaa

SEQ ID NO: 130012 - DNA, 25 bp, E. coli
cacccgcttcagtgggaaagattaa

SEQ ID NO: 130013 - DNA, 25 bp, E. coli
actggctaaaaaggcggcgattgtc

SEQ ID NO: 130014 - DNA, 25 bp, E. coli
actggctaaaaacgcggcgattgtc

SEQ ID NO: 130015 - DNA, 25 bp, E. coli
aactcccgctttattggttgaagca

SEQ ID NO: 130016 - DNA, 25 bp, E. coli
aactcccgcttttttggttgaagca

SEQ ID NO: 130017 - DNA, 25 bp, E. coli
tagataactggcaaaaaaggcggcg

SEQ ID NO: 130018 - DNA, 25 bp, E. coli
tagataactggctaaaaaggcggcg

SEQ ID NO: 130019 - DNA, 25 bp, E. coli
ttctcagcgaacacatcggttttgc

SEQ ID NO: 130020 - DNA, 25 bp, E. coli
ttagtattcacacccgcttcagtgg

SEQ ID NO: 130021 - DNA, 25 bp, E. coli
ttagtattcacagccgcttcagtgg

SEQ ID NO: 130022 - DNA, 25 bp, E. coli
tttttccgcagttgatacaatgcga

SEQ ID NO: 130023 - DNA, 25 bp, E. coli
ttctcagcgaactcatcggttttgc

SEQ ID NO: 130024 - DNA, 25 bp, E. coli
tttttccgcagtagatacaatgcga

SEQ ID NO: 130025 - DNA, 25 bp, E. coli
tgcccttgcgaacgtcattcgcttt

SEQ ID NO: 130026 - DNA, 25 bp, E. coli
tgcccttgcgaaggtcattcgcttt

SEQ ID NO: 130027 - DNA, 25 bp, E. coli
cgattgtcgccttttttctcagcga

SEQ ID NO: 130028 - DNA, 25 bp, E. coli
cgattgtcgcctattttctcagcga

SEQ ID NO: 130029 - DNA, 25 bp, E. coli
cattcgctttggttagtattcacac

SEQ ID NO: 130030 - DNA, 25 bp, E. coli
cattcgctttggatagtattcacac

SEQ ID NO: 130031 - DNA, 25 bp, E. coli
agtgtatagtcaccctggccacgca

SEQ ID NO: 130032 - DNA, 25 bp, E. coli
agtacggatgctacgcaaactttga

SEQ ID NO: 130033 - DNA, 25 bp, E. coli
agtgtatagtcagcctggccacgca

SEQ ID NO: 130034 - DNA, 25 bp, E. coli
agtacggatgcttcgcaaactttga

SEQ ID NO: 130035 - DNA, 25 bp, E. coli
tatgaatgttgtcgcttctcccgca

SEQ ID NO: 130036 - DNA, 25 bp, E. coli
taccgtcgccgataatcctgctatc

SEQ ID NO: 130037 - DNA, 25 bp, E. coli
taccgtcgccgaaaatcctgctatc

SEQ ID NO: 130038 - DNA, 25 bp, E. coli
tatgaatgttgtggcttctcccgca

SEQ ID NO: 130039 - DNA, 25 bp, E. coli
tccgtttgcgcaaacttaccgtcgc

SEQ ID NO: 130040 - DNA, 25 bp, E. coli
tccgtttgcgcatacttaccgtcgc

SEQ ID NO: 130041 - DNA, 25 bp, E. coli
tgagctatgctatgaatgttgtcgc

SEQ ID NO: 130042 - DNA, 25 bp, E. coli
tgagctatgctaagaatgttgtcgc

SEQ ID NO: 130043 - DNA, 25 bp, E. coli
tgaagtacggatgctacgcaaactt

SEQ ID NO: 130044 - DNA, 25 bp, E. coli
tgaagtacggatcctacgcaaactt

SEQ ID NO: 130045 - DNA, 25 bp, E. coli
tgcgcaaacttagcgtcgccgataa

SEQ ID NO: 130046 - DNA, 25 bp, E. coli
tgcgcaaacttaccgtcgccgataa

SEQ ID NO: 130047 - DNA, 25 bp, E. coli
gcctggccacgcttattgggtggtt

SEQ ID NO: 130048 - DNA, 25 bp, E. coli
gcctggccacgcatattgggtggtt

SEQ ID NO: 130049 - DNA, 25 bp, E. coli
gaatgttgtcgcatctcccgcactc

SEQ ID NO: 130050 - DNA, 25 bp, E. coli
gaatgttgtcgcttctcccgcactc

SEQ ID NO: 130051 - DNA, 25 bp, E. coli
gtcagcctggcctcgcatattgggt

SEQ ID NO: 130052 - DNA, 25 bp, E. coli
gtcagcctggccacgcatattgggt

SEQ ID NO: 130053 - DNA, 25 bp, E. coli
aaccaggcttatcgcacggcagaaa

SEQ ID NO: 130054 - DNA, 25 bp, E. coli
aaccaggcttatggcacggcagaaa

SEQ ID NO: 130055 - DNA, 25 bp, E. coli
aataagctgctgatgcgccacccaa

SEQ ID NO: 130056 - DNA, 25 bp, E. coli
aataagctgctgttgcgccacccaa

SEQ ID NO: 130057 - DNA, 25 bp, E. coli
tatctataagacctttaacactccg

SEQ ID NO: 130058 - DNA, 25 bp, E. coli
tatctataagacgtttaacactccg

SEQ ID NO: 130059 - DNA, 25 bp, E. coli
tttaacactccggtaccggcgctaa

SEQ ID NO: 130060 - DNA, 25 bp, E. coli
tttaacactccgctaccggcgctaa

SEQ ID NO: 130061 - DNA, 25 bp, E. coli
tggttgctggtggtattcggctttc

SEQ ID NO: 130062 - DNA, 25 bp, E. coli
tgatgcgccaccgaaccaggcttat

SEQ ID NO: 130063 - DNA, 25 bp, E. coli
tgatgcgccacccaaccaggcttat

SEQ ID NO: 130064 - DNA, 25 bp, E. coli
tgctttgctgctcatggcactacag

SEQ ID NO: 130065 - DNA, 25 bp, E. coli
tgctttgctgctgatggcactacag

SEQ ID NO: 130066 - DNA, 25 bp, E. coli
tgacgctggcaacttttagtggcga

SEQ ID NO: 130067 - DNA, 25 bp, E. coli
tgacgctggcaagttttagtggcga

SEQ ID NO: 130068 - DNA, 25 bp, E. coli
gcacgatcttgaacagggcgttgcc

SEQ ID NO: 130069 - DNA, 25 bp, E. coli
gcagagagccgtgctttgctgctca

SEQ ID NO: 130070 - DNA, 25 bp, E. coli
gcacgatcttgatcagggcgttgcc

SEQ ID NO: 130071 - DNA, 25 bp, E. coli
gcagagagccgtcctttgctgctca

SEQ ID NO: 130072 - DNA, 25 bp, E. coli
taagacctttaacactccgctaccg

SEQ ID NO: 130073 - DNA, 25 bp, E. coli
tggttgctggtgctattcggctttc

SEQ ID NO: 130074 - DNA, 25 bp, E. coli
taagacctttaagactccgctaccg

SEQ ID NO: 130075 - DNA, 25 bp, E. coli
aattttgatggtaccggtgctcgcg

SEQ ID NO: 130076 - DNA, 25 bp, E. coli
aattttgatggttccggtgctcgcg

SEQ ID NO: 130077 - DNA, 25 bp, E. coli
caattctcctgatgtggcggcgtca

SEQ ID NO: 130078 - DNA, 25 bp, E. coli
caattctcctgaagtggcggcgtca

SEQ ID NO: 130079 - DNA, 25 bp, E. coli
tacagcaagatacgcaaccggtgaa

SEQ ID NO: 130080 - DNA, 25 bp, E. coli
tacagcaagataggcaaccggtgaa

SEQ ID NO: 130081 - DNA, 25 bp, E. coli
aactcctggctgaggatgtaccgca

SEQ ID NO: 130082 - DNA, 25 bp, E. coli
aactcctggctgtggatgtaccgca

SEQ ID NO: 130083 - DNA, 25 bp, E. coli
tattgctcacacctatatggctgcg

SEQ ID NO: 130084 - DNA, 25 bp, E. coli
tattgctcacacgtatatggctgcg

SEQ ID NO: 130085 - DNA, 25 bp, E. coli
tttacttcatgataatggcgcgggc

SEQ ID NO: 130086 - DNA, 25 bp, E. coli
tttacttcatgaaaatggcgcgggc

SEQ ID NO: 130087 - DNA, 25 bp, E. coli
gcttatgcattctgcctgggcgcaa

SEQ ID NO: 130088 - DNA, 25 bp, E. coli
gcttatgcattcagcctgggcgcaa

SEQ ID NO: 130089 - DNA, 25 bp, E. coli
gaatgcgcgcttaaccagccgtgaa

SEQ ID NO: 130090 - DNA, 25 bp, E. coli
gaatatcggcctttcgacacccggt

SEQ ID NO: 130091 - DNA, 25 bp, E. coli
gaatatctggaaaaagccggacgca

SEQ ID NO: 130092 - DNA, 25 bp, E. coli
gaatatctggaataagccggacgca

SEQ ID NO: 130093 - DNA, 25 bp, E. coli
gaatgcgcgctttaccagccgtgaa

SEQ ID NO: 130094 - DNA, 25 bp, E. coli
gaatatcggcctatcgacacccggt

SEQ ID NO: 130095 - DNA, 25 bp, E. coli
taacggcggatctactcaatagtgc

SEQ ID NO: 130096 - DNA, 25 bp, E. coli
taacggcggatcaactcaatagtgc

SEQ ID NO: 130097 - DNA, 25 bp, E. coli
caagctggtttcttctgctggtact

SEQ ID NO: 130098 - DNA, 25 bp, E. coli
caagctggtttcatctgctggtact

SEQ ID NO: 130099 - DNA, 25 bp, E. coli
tacgaagaacaatcgtactaagccg

SEQ ID NO: 130100 - DNA, 25 bp, E. coli
tacgaagaacaaacgtactaagccg

SEQ ID NO: 130101 - DNA, 25 bp, E. coli
tattcgtgagaaaatcaagctggtt

SEQ ID NO: 130102 - DNA, 25 bp, E. coli
tattcgtgagaatatcaagctggtt

SEQ ID NO: 130103 - DNA, 25 bp, E. coli
tctgctggtactggtcacttctata

SEQ ID NO: 130104 - DNA, 25 bp, E. coli
tctgctggtactcgtcacttctata

SEQ ID NO: 130105 - DNA, 25 bp, E. coli
gaaaaaattcgaaccagttgttcgc

SEQ ID NO: 130106 - DNA, 25 bp, E. coli
gaaaaaattcgatccagttgttcgc

SEQ ID NO: 130107 - DNA, 25 bp, E. coli
cgccagcacgtgatctacaaagaag

SEQ ID NO: 130108 - DNA, 25 bp, E. coli
cgccagcacgtgttctacaaagaag

SEQ ID NO: 130109 - DNA, 25 bp, E. coli
cgtgatctacaaagaagcgaaaatc

SEQ ID NO: 130110 - DNA, 25 bp, E. coli
cgtgatctacaatgaagcgaaaatc

SEQ ID NO: 130111 - DNA, 25 bp, E. coli
gatccagttgttggccagcacgtga

SEQ ID NO: 130112 - DNA, 25 bp, E. coli
ggctaaaggtattcgtgagaaaatc

SEQ ID NO: 130113 - DNA, 25 bp, E. coli
ggctaaaggtatacgtgagaaaatc

SEQ ID NO: 130114 - DNA, 25 bp, E. coli
tggtcacttctataccactacgaag

SEQ ID NO: 130115 - DNA, 25 bp, E. coli
tggtcacttctaaaccactacgaag

SEQ ID NO: 130116 - DNA, 25 bp, E. coli
tactaagccggataaactggaactg

SEQ ID NO: 130117 - DNA, 25 bp, E. coli
tactaagccggaaaaactggaactg

SEQ ID NO: 130118 - DNA, 25 bp, E. coli
gatccagttgttcgccagcacgtga

SEQ ID NO: 130119 - DNA, 25 bp, E. coli
aaatgcagatcctgacgctgggtcg

SEQ ID NO: 130120 - DNA, 25 bp, E. coli
aaatgcagatccagacgctgggtcg

SEQ ID NO: 130121 - DNA, 25 bp, E. coli
tatccgcgaactgatggccagcgaa

SEQ ID NO: 130122 - DNA, 25 bp, E. coli
tatgaagcagcgaggaaagcagaca

SEQ ID NO: 130123 - DNA, 25 bp, E. coli
tatccgcgaactcatggccagcgaa

SEQ ID NO: 130124 - DNA, 25 bp, E. coli
tatgaagcagcgtggaaagcagaca

SEQ ID NO: 130125 - DNA, 25 bp, E. coli
tattttgccgagagcgaccgtgaca

SEQ ID NO: 130126 - DNA, 25 bp, E. coli
tattttgccgagtgcgaccgtgaca

SEQ ID NO: 130127 - DNA, 25 bp, E. coli
tttaaccgcgtctaagaagagttcg

SEQ ID NO: 130128 - DNA, 25 bp, E. coli
tttaaccgcgtcaaagaagagttcg

SEQ ID NO: 130129 - DNA, 25 bp, E. coli
tgttgatatgaggaaaccgggcatc

SEQ ID NO: 130130 - DNA, 25 bp, E. coli
tgatccctgaagagcacggtggtct

SEQ ID NO: 130131 - DNA, 25 bp, E. coli
tgttgatatgagcaaaccgggcatc

SEQ ID NO: 130132 - DNA, 25 bp, E. coli
tgatccctgaagtgcacggtggtct

SEQ ID NO: 130133 - DNA, 25 bp, E. coli
tcaggaaaaattcgcccacatggcg

SEQ ID NO: 130134 - DNA, 25 bp, E. coli
tcaggaaaaattggcccacatggcg

SEQ ID NO: 130135 - DNA, 25 bp, E. coli
ccaactacggtagggcgatgtgcgc

SEQ ID NO: 130136 - DNA, 25 bp, E. coli
ccaactacggtacggcgatgtgcgc

SEQ ID NO: 130137 - DNA, 25 bp, E. coli
gctccgacgtgggtagcctgaaaac

SEQ ID NO: 130138 - DNA, 25 bp, E. coli
gctccgacgtggctagcctgaaaac

SEQ ID NO: 130139 - DNA, 25 bp, E. coli
tggaactcagcgtttaccgaaccgg

SEQ ID NO: 130140 - DNA, 25 bp, E. coli
tggaactcagcgattaccgaaccgg

SEQ ID NO: 130141 - DNA, 25 bp, E. coli
catcactgggctttcgcaggcaaaa

SEQ ID NO: 130142 - DNA, 25 bp, E. coli
catcactgggctatcgcaggcaaaa

SEQ ID NO: 130143 - DNA, 25 bp, E. coli
tactcaaaggtgttggcgttctacc

SEQ ID NO: 130144 - DNA, 25 bp, E. coli
tactattcacccagaggcattccgg

SEQ ID NO: 130145 - DNA, 25 bp, E. coli
tactgccagtgactgttacgctgga

SEQ ID NO: 130146 - DNA, 25 bp, E. coli
tactattcaccctgaggcattccgg

SEQ ID NO: 130147 - DNA, 25 bp, E. coli
tactcaaaggtgatggcgttctacc

SEQ ID NO: 130148 - DNA, 25 bp, E. coli
tactgccagtgagtgttacgctgga

SEQ ID NO: 130149 - DNA, 25 bp, E. coli
tgttcaacactgaaccaggtcactg

SEQ ID NO: 130150 - DNA, 25 bp, E. coli
tgttcaacactgtaccaggtcactg

SEQ ID NO: 130151 - DNA, 25 bp, E. coli
tggtttcccatagcgcaaagggtag

SEQ ID NO: 130152 - DNA, 25 bp, E. coli
tcgttaagatgctcaatgatccagc

SEQ ID NO: 130153 - DNA, 25 bp, E. coli
tcgttaagatgcacaatgatccagc

SEQ ID NO: 130154 - DNA, 25 bp, E. coli
gcacttaaccggcacaatattcagg

SEQ ID NO: 130155 - DNA, 25 bp, E. coli
gcacttaaccgggacaatattcagg

SEQ ID NO: 130156 - DNA, 25 bp, E. coli
gaagaaaaggcagtggcaacgcatt

SEQ ID NO: 130157 - DNA, 25 bp, E. coli
gaagaaaaggcactggcaacgcatt

SEQ ID NO: 130158 - DNA, 25 bp, E. coli
gaaatttaccggcacaatatcgctt

SEQ ID NO: 130159 - DNA, 25 bp, E. coli
gaaatttaccgggacaatatcgctt

SEQ ID NO: 130160 - DNA, 25 bp, E. coli
tggtttcccataccgcaaagggtag

SEQ ID NO: 130161 - DNA, 25 bp, E. coli
ggaaagtatcaatcgcagtcagaca

SEQ ID NO: 130162 - DNA, 25 bp, E. coli
ggaaagtatcaaacgcagtcagaca

SEQ ID NO: 130163 - DNA, 25 bp, E. coli
aactgctgagaagattggctttgcc

SEQ ID NO: 130164 - DNA, 25 bp, E. coli
caaaaggctccgtagagtcaaccgt

SEQ ID NO: 130165 - DNA, 25 bp, E. coli
caaaaggctccgaagagtcaaccgt

SEQ ID NO: 130166 - DNA, 25 bp, E. coli
caccgctgaaagataatggctctgg

SEQ ID NO: 130167 - DNA, 25 bp, E. coli
caccgctgaaagttaatggctctgg

SEQ ID NO: 130168 - DNA, 25 bp, E. coli
aactgctgagaacattggctttgcc

SEQ ID NO: 130169 - DNA, 25 bp, E. coli
tacgctgaataatggaactgctgag

SEQ ID NO: 130170 - DNA, 25 bp, E. coli
tacgctgaataaaggaactgctgag

SEQ ID NO: 130171 - DNA, 25 bp, E. coli
tattattcccttggttgcgacaacg

SEQ ID NO: 130172 - DNA, 25 bp, E. coli
tattattcccttcgttgcgacaacg

SEQ ID NO: 130173 - DNA, 25 bp, E. coli
ttcagtgtgacggaaatacagcccc

SEQ ID NO: 130174 - DNA, 25 bp, E. coli
ttcagtgtgacgcaaatacagcccc

SEQ ID NO: 130175 - DNA, 25 bp, E. coli
tcgccaaggatgtcgatcaaggaac

SEQ ID NO: 130176 - DNA, 25 bp, E. coli
tcgccaaggatgacgatcaaggaac

SEQ ID NO: 130177 - DNA, 25 bp, E. coli
gcccgcacaagtcgcaatcctgtta

SEQ ID NO: 130178 - DNA, 25 bp, E. coli
gcccgcacaagtggcaatcctgtta

SEQ ID NO: 130179 - DNA, 25 bp, E. coli
gactttgaccagaatgagaccaggg

SEQ ID NO: 130180 - DNA, 25 bp, E. coli
gactttgaccagtatgagaccaggg

SEQ ID NO: 130181 - DNA, 25 bp, E. coli
gatgtttagcgctacaaccttcgcc

SEQ ID NO: 130182 - DNA, 25 bp, E. coli
gagaccagggtttaaaacaccgctg

SEQ ID NO: 130183 - DNA, 25 bp, E. coli
gatgtttagcgcaacaaccttcgcc

SEQ ID NO: 130184 - DNA, 25 bp, E. coli
gagaccagggttaaaaacaccgctg

SEQ ID NO: 130185 - DNA, 25 bp, E. coli
cagcataaaattgcgttcagaagcg

SEQ ID NO: 130186 - DNA, 25 bp, E. coli
cagcataaaattccgttcagaagcg

SEQ ID NO: 130187 - DNA, 25 bp, E. coli
aacatgcggcttatttatggtgagc

SEQ ID NO: 130188 - DNA, 25 bp, E. coli
aacatgcggcttttttatggtgagc

SEQ ID NO: 130189 - DNA, 25 bp, E. coli
ttcagaagcggattagtggcactct

SEQ ID NO: 130190 - DNA, 25 bp, E. coli
ttcagaagcggaatagtggcactct

SEQ ID NO: 130191 - DNA, 25 bp, E. coli
tgaacgccctttttatccagcataa

SEQ ID NO: 130192 - DNA, 25 bp, E. coli
tgaggtgctccagacagagagcgcc

SEQ ID NO: 130193 - DNA, 25 bp, E. coli
tgagctggctcacatctccctgact

SEQ ID NO: 130194 - DNA, 25 bp, E. coli
tgaggtgctccacacagagagcgcc

SEQ ID NO: 130195 - DNA, 25 bp, E. coli
tgagctggctcagatctccctgact

SEQ ID NO: 130196 - DNA, 25 bp, E. coli
tgaacgccctttatatccagcataa

SEQ ID NO: 130197 - DNA, 25 bp, E. coli
tctatgcttgaattgaggtgctcca

SEQ ID NO: 130198 - DNA, 25 bp, E. coli
tctatgcttgaaatgaggtgctcca

SEQ ID NO: 130199 - DNA, 25 bp, E. coli
tctccctgactcagcggcaatatgg

SEQ ID NO: 130200 - DNA, 25 bp, E. coli
tctccctgactctgcggcaatatgg

SEQ ID NO: 130201 - DNA, 25 bp, E. coli
gccactccgataacggtagatacag

SEQ ID NO: 130202 - DNA, 25 bp, E. coli
gccactccgatatcggtagatacag

SEQ ID NO: 130203 - DNA, 25 bp, E. coli
ggcgtctttagtatctcctgctgaa

SEQ ID NO: 130204 - DNA, 25 bp, E. coli
ggcgtctttagtttctcctgctgaa

SEQ ID NO: 130205 - DNA, 25 bp, E. coli
gagagcgccgactacaatgaggtgc

SEQ ID NO: 130206 - DNA, 25 bp, E. coli
gagagcgccgacaacaatgaggtgc

SEQ ID NO: 130207 - DNA, 25 bp, E. coli
cattgcctgaaacgttaactgaaac

SEQ ID NO: 130208 - DNA, 25 bp, E. coli
catgactttatctctaacaaattga

SEQ ID NO: 130209 - DNA, 25 bp, E. coli
catgactttatcactaacaaattga

SEQ ID NO: 130210 - DNA, 25 bp, E. coli
catatttgcggaatagttcatgact

SEQ ID NO: 130211 - DNA, 25 bp, E. coli
cattgcctgaaaggttaactgaaac

SEQ ID NO: 130212 - DNA, 25 bp, E. coli
catatttgcggattagttcatgact

SEQ ID NO: 130213 - DNA, 25 bp, E. coli
aacaagttgatatcaaaggatgggc

SEQ ID NO: 130214 - DNA, 25 bp, E. coli
aacaagttgataacaaaggatgggc

SEQ ID NO: 130215 - DNA, 25 bp, E. coli
tattaaggcaattgtggcacacccc

SEQ ID NO: 130216 - DNA, 25 bp, E. coli
tattaaggcaatagtggcacacccc

SEQ ID NO: 130217 - DNA, 25 bp, E. coli
tgtctttatcaacgcaaataacaag

SEQ ID NO: 130218 - DNA, 25 bp, E. coli
tgtctttatcaaggcaaataacaag

SEQ ID NO: 130219 - DNA, 25 bp, E. coli
tgaaacgcggtgtaacattgcctga

SEQ ID NO: 130220 - DNA, 25 bp, E. coli
tgaaacgcggtgaaacattgcctga

SEQ ID NO: 130221 - DNA, 25 bp, E. coli
tcataattgttgcaatgaaacgcgg

SEQ ID NO: 130222 - DNA, 25 bp, E. coli
tcataattgttggaatgaaacgcgg

SEQ ID NO: 130223 - DNA, 25 bp, E. coli
gcgcaccgcaaagttaagaaaccga

SEQ ID NO: 130224 - DNA, 25 bp, E. coli
gcgcaccgcaaacttaagaaaccga

SEQ ID NO: 130225 - DNA, 25 bp, E. coli
cgttaactgaaaggcatatttgcgg

SEQ ID NO: 130226 - DNA, 25 bp, E. coli
cgttaactgaaacgcatatttgcgg

SEQ ID NO: 130227 - DNA, 25 bp, E. coli
ggcacaccccttgctttgtctttat

SEQ ID NO: 130228 - DNA, 25 bp, E. coli
ggcacaccccttcctttgtctttat

SEQ ID NO: 130229 - DNA, 25 bp, E. coli
aaacgctggcgcagtaccagggcaa

SEQ ID NO: 130230 - DNA, 25 bp, E. coli
aaacgctggcgctgtaccagggcaa

SEQ ID NO: 130231 - DNA, 25 bp, E. coli
tgataaagagcttcaccccgttgcc

SEQ ID NO: 130232 - DNA, 25 bp, E. coli
tgataaagagctacaccccgttgcc

SEQ ID NO: 130233 - DNA, 25 bp, E. coli
gaatgacatccataaggaccagccg

SEQ ID NO: 130234 - DNA, 25 bp, E. coli
gaatgacatccaaaaggaccagccg

SEQ ID NO: 130235 - DNA, 25 bp, E. coli
gacaccagagctgtaccaggaaacg

SEQ ID NO: 130236 - DNA, 25 bp, E. coli
gacaccagagctctaccaggaaacg

SEQ ID NO: 130237 - DNA, 25 bp, E. coli
cgtggagatacggtgctgaccttca

SEQ ID NO: 130238 - DNA, 25 bp, E. coli
cgtggagatacgctgctgaccttca

SEQ ID NO: 130239 - DNA, 25 bp, E. coli
gattagccagatagccgtattccag

SEQ ID NO: 130240 - DNA, 25 bp, E. coli
gataacagtggcttcaacctggtca

SEQ ID NO: 130241 - DNA, 25 bp, E. coli
gataacagtggcatcaacctggtca

SEQ ID NO: 130242 - DNA, 25 bp, E. coli
gattagccagattgccgtattccag

SEQ ID NO: 130243 - DNA, 25 bp, E. coli
ggcaaacttgatgggtacaccgaac

SEQ ID NO: 130244 - DNA, 25 bp, E. coli
ggcaaacttgatcggtacaccgaac

SEQ ID NO: 130245 - DNA, 25 bp, E. coli
tcaaaagacgatgctgctggaggtg

SEQ ID NO: 130246 - DNA, 25 bp, E. coli
tcaaaagacgatcctgctggaggtg

SEQ ID NO: 130247 - DNA, 25 bp, E. coli
tacaccgaacatgcctgccgggaaa

SEQ ID NO: 130248 - DNA, 25 bp, E. coli
tacaccgaacatccctgccgggaaa

SEQ ID NO: 130249 - DNA, 25 bp, E. coli
gatgcaggtcctcgtatccacggat

SEQ ID NO: 130250 - DNA, 25 bp, E. coli
gatgcaggtcctggtatccacggat

SEQ ID NO: 130251 - DNA, 25 bp, E. coli
caaactgatcaaaaaccgcgtcgca

SEQ ID NO: 130252 - DNA, 25 bp, E. coli
caaactgatcaataaccgcgtcgca

SEQ ID NO: 130253 - DNA, 25 bp, E. coli
tattgaaatcgctcaggctgtctcg

SEQ ID NO: 130254 - DNA, 25 bp, E. coli
tatcaacatgctcgtagcgactggc

SEQ ID NO: 130255 - DNA, 25 bp, E. coli
tattgaaatcgcacaggctgtctcg

SEQ ID NO: 130256 - DNA, 25 bp, E. coli
tatcaacatgctggtagcgactggc

SEQ ID NO: 130257 - DNA, 25 bp, E. coli
ttgaggctgagataacacatccgtt

SEQ ID NO: 130258 - DNA, 25 bp, E. coli
ttgaggctgagaaaacacatccgtt

SEQ ID NO: 130259 - DNA, 25 bp, E. coli
ccagtgcgatctctcaggtagcgaa

SEQ ID NO: 130260 - DNA, 25 bp, E. coli
ccagtgcgatctgtcaggtagcgaa

SEQ ID NO: 130261 - DNA, 25 bp, E. coli
gcagcgctgaaatcgccaggtatcg

SEQ ID NO: 130262 - DNA, 25 bp, E. coli
gaagatctgacctccagcgcggttt

SEQ ID NO: 130263 - DNA, 25 bp, E. coli
gcagcgctgaaaacgccaggtatcg

SEQ ID NO: 130264 - DNA, 25 bp, E. coli
gaagatctgaccaccagcgcggttt

SEQ ID NO: 130265 - DNA, 25 bp, E. coli
cggatatcgaaatagcagcccgcga

SEQ ID NO: 130266 - DNA, 25 bp, E. coli
cggatatcgaaaaagcagcccgcga

SEQ ID NO: 130267 - DNA, 25 bp, E. coli
gtagcttcgacatcaacctgccgtg

SEQ ID NO: 130268 - DNA, 25 bp, E. coli
gtagcttcgacaacaacctgccgtg

SEQ ID NO: 130269 - DNA, 25 bp, E. coli
ggtccagccatcgtgaaaaccgtga

SEQ ID NO: 130270 - DNA, 25 bp, E. coli
ggtccagccatcctgaaaaccgtga

SEQ ID NO: 130271 - DNA, 25 bp, E. coli
tcactgcatgaagaaaagcggtgcc

SEQ ID NO: 130272 - DNA, 25 bp, E. coli
tcactgcatgaacaaaagcggtgcc

SEQ ID NO: 130273 - DNA, 25 bp, E. coli
caaaatacgtgttggcatgacgcaa

SEQ ID NO: 130274 - DNA, 25 bp, E. coli
caaaatacgtgtaggcatgacgcaa

SEQ ID NO: 130275 - DNA, 25 bp, E. coli
caacaacaagttgcgtacgcattgg

SEQ ID NO: 130276 - DNA, 25 bp, E. coli
caacaacaagttccgtacgcattgg

SEQ ID NO: 130277 - DNA, 25 bp, E. coli
tactattgatgttgaccgcaggctg

SEQ ID NO: 130278 - DNA, 25 bp, E. coli
tactattgatgtagaccgcaggctg

SEQ ID NO: 130279 - DNA, 25 bp, E. coli
agtggtttaccgtcctgacatcaac

SEQ ID NO: 130280 - DNA, 25 bp, E. coli
agtggtttaccgacctgacatcaac

SEQ ID NO: 130281 - DNA, 25 bp, E. coli
tgtaaaacgctgactgctgcagcag

SEQ ID NO: 130282 - DNA, 25 bp, E. coli
tgtaaaacgctgtctgctgcagcag

SEQ ID NO: 130283 - DNA, 25 bp, E. coli
tgcgtacgcattcggtacaccgctg

SEQ ID NO: 130284 - DNA, 25 bp, E. coli
tgcgtacgcattgggtacaccgctg

SEQ ID NO: 130285 - DNA, 25 bp, E. coli
tctggagcgagtcgtttaccgtcct

SEQ ID NO: 130286 - DNA, 25 bp, E. coli
tctggagcgagtggtttaccgtcct

SEQ ID NO: 130287 - DNA, 25 bp, E. coli
gctaacgacgtaaccaaaatacgtg

SEQ ID NO: 130288 - DNA, 25 bp, E. coli
gctaacgacgtatccaaaatacgtg

SEQ ID NO: 130289 - DNA, 25 bp, E. coli
gcaggctgttccactctggagcgag

SEQ ID NO: 130290 - DNA, 25 bp, E. coli
gctgcagcagcactactattgatgt

SEQ ID NO: 130291 - DNA, 25 bp, E. coli
gctgcagcagcagtactattgatgt

SEQ ID NO: 130292 - DNA, 25 bp, E. coli
gcaggctgttcctctctggagcgag

SEQ ID NO: 130293 - DNA, 25 bp, E. coli
gggaactatctgaccgctaacgacg

SEQ ID NO: 130294 - DNA, 25 bp, E. coli
gggaactatctgtccgctaacgacg

SEQ ID NO: 130295 - DNA, 25 bp, E. coli
aaggcggagttcgaccgcctctgga

SEQ ID NO: 130296 - DNA, 25 bp, E. coli
aaggcggagttccaccgcctctgga

SEQ ID NO: 130297 - DNA, 25 bp, E. coli
agtaacgatatccttcgccaggctt

SEQ ID NO: 130298 - DNA, 25 bp, E. coli
agtaacgatatcgttcgccaggctt

SEQ ID NO: 130299 - DNA, 25 bp, E. coli
tttgcgaaggcggagttcgaccgcc

SEQ ID NO: 130300 - DNA, 25 bp, E. coli
ttattttgcgaaggcggagttcgac

SEQ ID NO: 130301 - DNA, 25 bp, E. coli
ttattttgcgaacgcggagttcgac

SEQ ID NO: 130302 - DNA, 25 bp, E. coli
tttgcgaaggcgcagttcgaccgcc

SEQ ID NO: 130303 - DNA, 25 bp, E. coli
tgaaagagctggtacgtgaaaatcg

SEQ ID NO: 130304 - DNA, 25 bp, E. coli
tgaaagagctggaacgtgaaaatcg

SEQ ID NO: 130305 - DNA, 25 bp, E. coli
gcagtaacgataaccttcgccaggc

SEQ ID NO: 130306 - DNA, 25 bp, E. coli
gcagtaacgatatccttcgccaggc

SEQ ID NO: 130307 - DNA, 25 bp, E. coli
cgcttattttgccaaggcggagttc

SEQ ID NO: 130308 - DNA, 25 bp, E. coli
cgcttattttgcgaaggcggagttc

SEQ ID NO: 130309 - DNA, 25 bp, E. coli
ctggaacgtgaatatcgtgaactgc

SEQ ID NO: 130310 - DNA, 25 bp, E. coli
cgtctgaaagagctggaacgtgaaa

SEQ ID NO: 130311 - DNA, 25 bp, E. coli
cgtctgaaagaggtggaacgtgaaa

SEQ ID NO: 130312 - DNA, 25 bp, E. coli
ctggaacgtgaaaatcgtgaactgc

SEQ ID NO: 130313 - DNA, 25 bp, E. coli
gagttcgaccgcctctggaaaaaat

SEQ ID NO: 130314 - DNA, 25 bp, E. coli
gagctggaacgtcaaaatcgtgaac

SEQ ID NO: 130315 - DNA, 25 bp, E. coli
gagctggaacgtgaaaatcgtgaac

SEQ ID NO: 130316 - DNA, 25 bp, E. coli
gagttcgaccgcgtctggaaaaaat

SEQ ID NO: 130317 - DNA, 25 bp, E. coli
cagttactttctggacggcgcgaca

SEQ ID NO: 130318 - DNA, 25 bp, E. coli
cagttactttctcgacggcgcgaca

SEQ ID NO: 130319 - DNA, 25 bp, E. coli
aaatcgtcggcgagcgcataaggcg

SEQ ID NO: 130320 - DNA, 25 bp, E. coli
caaacggttggtgcctttctggtga

SEQ ID NO: 130321 - DNA, 25 bp, E. coli
aaatcgtcggcgtgcgcataaggcg

SEQ ID NO: 130322 - DNA, 25 bp, E. coli
caaacggttggtccctttctggtga

SEQ ID NO: 130323 - DNA, 25 bp, E. coli
tatctgatgctataaggctggtcgc

SEQ ID NO: 130324 - DNA, 25 bp, E. coli
tatctgatgctaaaaggctggtcgc

SEQ ID NO: 130325 - DNA, 25 bp, E. coli
tttttcgacgagtatcacgcccgtg

SEQ ID NO: 130326 - DNA, 25 bp, E. coli
tttttcgacgagaatcacgcccgtg

SEQ ID NO: 130327 - DNA, 25 bp, E. coli
tgtaactagtttgctcggcgcgtgg

SEQ ID NO: 130328 - DNA, 25 bp, E. coli
tgatctgtctggtggtgactcccgg

SEQ ID NO: 130329 - DNA, 25 bp, E. coli
tgatctgtctggaggtgactcccgg

SEQ ID NO: 130330 - DNA, 25 bp, E. coli
tgtaactagtttcctcggcgcgtgg

SEQ ID NO: 130331 - DNA, 25 bp, E. coli
tgaacattcagagcatcgtcctggg

SEQ ID NO: 130332 - DNA, 25 bp, E. coli
tgactcccggtgcaacagcatggtt

SEQ ID NO: 130333 - DNA, 25 bp, E. coli
tgaacattcagaccatcgtcctggg

SEQ ID NO: 130334 - DNA, 25 bp, E. coli
tgactcccggtggaacagcatggtt

SEQ ID NO: 130335 - DNA, 25 bp, E. coli
cctgggcaatatactggcaatcgat

SEQ ID NO: 130336 - DNA, 25 bp, E. coli
cctgggcaatattctggcaatcgat

SEQ ID NO: 130337 - DNA, 25 bp, E. coli
gcataaggcgctggaggatcgctca

SEQ ID NO: 130338 - DNA, 25 bp, E. coli
gcataaggcgctcgaggatcgctca

SEQ ID NO: 130339 - DNA, 25 bp, E. coli
cattagacgcagaaggtaaaggcca

SEQ ID NO: 130340 - DNA, 25 bp, E. coli
cattagacgcagtaggtaaaggcca

SEQ ID NO: 130341 - DNA, 25 bp, E. coli
taacatgaaaaagaaagctggcgct

SEQ ID NO: 130342 - DNA, 25 bp, E. coli
taacatgaaaaacaaagctggcgct

SEQ ID NO: 130343 - DNA, 25 bp, E. coli
tatgcatagcgtaaccactgatggc

SEQ ID NO: 130344 - DNA, 25 bp, E. coli
tatgcatagcgttaccactgatggc

SEQ ID NO: 130345 - DNA, 25 bp, E. coli
ttacgttaaagctccgaacagcccg

SEQ ID NO: 130346 - DNA, 25 bp, E. coli
ttacgttaaagcaccgaacagcccg

SEQ ID NO: 130347 - DNA, 25 bp, E. coli
tgatccaggtgctccgaagaatgct

SEQ ID NO: 130348 - DNA, 25 bp, E. coli
tgaaaaaagcacttctcgcagccgc

SEQ ID NO: 130349 - DNA, 25 bp, E. coli
tgcaagttacgcgaacaccagcggt

SEQ ID NO: 130350 - DNA, 25 bp, E. coli
tgcaagttacgccaacaccagcggt

SEQ ID NO: 130351 - DNA, 25 bp, E. coli
tgatccaggtgcaccgaagaatgct

SEQ ID NO: 130352 - DNA, 25 bp, E. coli
tgaaaaaagcacatctcgcagccgc

SEQ ID NO: 130353 - DNA, 25 bp, E. coli
gcaccggctcagaacgtaaacattg

SEQ ID NO: 130354 - DNA, 25 bp, E. coli
gcaccggctcagtacgtaaacattg

SEQ ID NO: 130355 - DNA, 25 bp, E. coli
ccgccctggctgtagatggtggtca

SEQ ID NO: 130356 - DNA, 25 bp, E. coli
ccgccctggctgaagatggtggtca

SEQ ID NO: 130357 - DNA, 25 bp, E. coli
ggtcatgtaaccactaacgcgctgt

SEQ ID NO: 130358 - DNA, 25 bp, E. coli
ggttaccctggaaactgcgaatgtt

SEQ ID NO: 130359 - DNA, 25 bp, E. coli
ggttaccctggatactgcgaatgtt

SEQ ID NO: 130360 - DNA, 25 bp, E. coli
ggtcatgtaacctctaacgcgctgt

SEQ ID NO: 130361 - DNA, 25 bp, E. coli
caaggagtaggaactgctgcattcc

SEQ ID NO: 130362 - DNA, 25 bp, E. coli
caatggtgccttatatgatgaaaac

SEQ ID NO: 130363 - DNA, 25 bp, E. coli
caatggtgccttttatgatgaaaac

SEQ ID NO: 130364 - DNA, 25 bp, E. coli
caaggagtaggatctgctgcattcc

SEQ ID NO: 130365 - DNA, 25 bp, E. coli
caaagcctttggatttataggatca

SEQ ID NO: 130366 - DNA, 25 bp, E. coli
caaagcctttggttttataggatca

SEQ ID NO: 130367 - DNA, 25 bp, E. coli
catgtaaatgtaccgacaataggta

SEQ ID NO: 130368 - DNA, 25 bp, E. coli
catgtaaatgtagcgacaataggta

SEQ ID NO: 130369 - DNA, 25 bp, E. coli
tacaaactgggtaaacactgcatat

SEQ ID NO: 130370 - DNA, 25 bp, E. coli
tacaaactgggttaacactgcatat

SEQ ID NO: 130371 - DNA, 25 bp, E. coli
actactcctggatttacaaactggg

SEQ ID NO: 130372 - DNA, 25 bp, E. coli
actactcctggaattacaaactggg

SEQ ID NO: 130373 - DNA, 25 bp, E. coli
tagtaatattcttgtagccatggct

SEQ ID NO: 130374 - DNA, 25 bp, E. coli
tagctggttttaaatcaatggtgcc

SEQ ID NO: 130375 - DNA, 25 bp, E. coli
tagtaatattctagtagccatggct

SEQ ID NO: 130376 - DNA, 25 bp, E. coli
tagctggttttatatcaatggtgcc

SEQ ID NO: 130377 - DNA, 25 bp, E. coli
tttatcagagggtacaggtatagca

SEQ ID NO: 130378 - DNA, 25 bp, E. coli
tttatcagagggaacaggtatagca

SEQ ID NO: 130379 - DNA, 25 bp, E. coli
taactttttcgataggaacagcagt

SEQ ID NO: 130380 - DNA, 25 bp, E. coli
taactttttcgaaaggaacagcagt

SEQ ID NO: 130381 - DNA, 25 bp, E. coli
gctgcattccctacactgattatgg

SEQ ID NO: 130382 - DNA, 25 bp, E. coli
gctgcattcccttcactgattatgg

SEQ ID NO: 130383 - DNA, 25 bp, E. coli
cacgcgtataatagttattgattct

SEQ ID NO: 130384 - DNA, 25 bp, E. coli
cacgcgtataattgttattgattct

SEQ ID NO: 130385 - DNA, 25 bp, E. coli
catagatttcttgctgttcacgtac

SEQ ID NO: 130386 - DNA, 25 bp, E. coli
catagatttcttcctgttcacgtac

SEQ ID NO: 130387 - DNA, 25 bp, E. coli
gccttacccggccaacatagatttc

SEQ ID NO: 130388 - DNA, 25 bp, E. coli
gccttacccggcgaacatagatttc

SEQ ID NO: 130389 - DNA, 25 bp, E. coli
ttatccgacctgcatccccgtaggc

SEQ ID NO: 130390 - DNA, 25 bp, E. coli
ttatccgacctggatccccgtaggc

SEQ ID NO: 130391 - DNA, 25 bp, E. coli
tattgattctttttgccggagagcg

SEQ ID NO: 130392 - DNA, 25 bp, E. coli
ttttgccggagagcggctccgcctt

SEQ ID NO: 130393 - DNA, 25 bp, E. coli
tattgattctttatgccggagagcg

SEQ ID NO: 130394 - DNA, 25 bp, E. coli
ttttgccggagaccggctccgcctt

SEQ ID NO: 130395 - DNA, 25 bp, E. coli
tcctgttcacgttcagattgtcgga

SEQ ID NO: 130396 - DNA, 25 bp, E. coli
tcccgcgccgggacacgcgtataat

SEQ ID NO: 130397 - DNA, 25 bp, E. coli
tcccgcgccgggtcacgcgtataat

SEQ ID NO: 130398 - DNA, 25 bp, E. coli
tcctgttcacgtacagattgtcgga

SEQ ID NO: 130399 - DNA, 25 bp, E. coli
tcacgtacagattgtcggatgcggc

SEQ ID NO: 130400 - DNA, 25 bp, E. coli
gccgggtcacgcgtataattgttat

SEQ ID NO: 130401 - DNA, 25 bp, E. coli
gccgggtcacgcctataattgttat

SEQ ID NO: 130402 - DNA, 25 bp, E. coli
cgcagcgtcgcctccggcataggag

SEQ ID NO: 130403 - DNA, 25 bp, E. coli
cgcagcgtcgccaccggcataggag

SEQ ID NO: 130404 - DNA, 25 bp, E. coli
tcacgtacagatagtcggatgcggc

SEQ ID NO: 130405 - DNA, 25 bp, E. coli
cattattacgagattgtctgggacg

SEQ ID NO: 130406 - DNA, 25 bp, E. coli
cattattacgagtttgtctgggacg

SEQ ID NO: 130407 - DNA, 25 bp, E. coli
tacaattgcagtttattgacccgga

SEQ ID NO: 130408 - DNA, 25 bp, E. coli
taacagccagcggacatctgaagag

SEQ ID NO: 130409 - DNA, 25 bp, E. coli
tacagtacgcggcatccgaaacatg

SEQ ID NO: 130410 - DNA, 25 bp, E. coli
tacagtacgcgggatccgaaacatg

SEQ ID NO: 130411 - DNA, 25 bp, E. coli
tacaattgcagtatattgacccgga

SEQ ID NO: 130412 - DNA, 25 bp, E. coli
taacagccagcgcacatctgaagag

SEQ ID NO: 130413 - DNA, 25 bp, E. coli
tatgccgatattcccactaagtgtg

SEQ ID NO: 130414 - DNA, 25 bp, E. coli
tatgccgatattgccactaagtgtg

SEQ ID NO: 130415 - DNA, 25 bp, E. coli
tgatcgcccggaagagtatgccgat

SEQ ID NO: 130416 - DNA, 25 bp, E. coli
tgatcgcccggatgagtatgccgat

SEQ ID NO: 130417 - DNA, 25 bp, E. coli
tctgggacgaagtgcagacgcacaa

SEQ ID NO: 130418 - DNA, 25 bp, E. coli
tctgggacgaagagcagacgcacaa

SEQ ID NO: 130419 - DNA, 25 bp, E. coli
gcattaaagcgttcaaaaccctcgg

SEQ ID NO: 130420 - DNA, 25 bp, E. coli
gcattaaagcgtacaaaaccctcgg

SEQ ID NO: 130421 - DNA, 25 bp, E. coli
gactctaacagtccgggtaaccacg

SEQ ID NO: 130422 - DNA, 25 bp, E. coli
gactctaacagtgcgggtaaccacg

SEQ ID NO: 130423 - DNA, 25 bp, E. coli
cgtaatgatgaaccgcttaacagcc

SEQ ID NO: 130424 - DNA, 25 bp, E. coli
cgtaatgatgaagcgcttaacagcc

SEQ ID NO: 130425 - DNA, 25 bp, E. coli
gagaagaatcgccatcgttgcctgg

SEQ ID NO: 130426 - DNA, 25 bp, E. coli
gagaagaatcgcgatcgttgcctgg

SEQ ID NO: 130427 - DNA, 25 bp, E. coli
aacctcttgttacttgtgagactgc

SEQ ID NO: 130428 - DNA, 25 bp, E. coli
aacctcttgttagttgtgagactgc

SEQ ID NO: 130429 - DNA, 25 bp, E. coli
aatctggtctgtgctttggctgtga

SEQ ID NO: 130430 - DNA, 25 bp, E. coli
aatctggtctgtcctttggctgtga

SEQ ID NO: 130431 - DNA, 25 bp, E. coli
caaacgctgttgagggttcagatta

SEQ ID NO: 130432 - DNA, 25 bp, E. coli
caaacgctgttgtgggttcagatta

SEQ ID NO: 130433 - DNA, 25 bp, E. coli
cagattataacaatctgtctaaggg

SEQ ID NO: 130434 - DNA, 25 bp, E. coli
cagattataacattctgtctaaggg

SEQ ID NO: 130435 - DNA, 25 bp, E. coli
tacagagtgtgaaagagggaatatc

SEQ ID NO: 130436 - DNA, 25 bp, E. coli
tacagagtgtgatagagggaatatc

SEQ ID NO: 130437 - DNA, 25 bp, E. coli
tgagactgcgtagtgtgcacgatcg

SEQ ID NO: 130438 - DNA, 25 bp, E. coli
tgagactgcgtactgtgcacgatcg

SEQ ID NO: 130439 - DNA, 25 bp, E. coli
cctttggctgtgttatgtacagagt

SEQ ID NO: 130440 - DNA, 25 bp, E. coli
cctttggctgtgatatgtacagagt

SEQ ID NO: 130441 - DNA, 25 bp, E. coli
gaatatctgaattctcccggtgagc

SEQ ID NO: 130442 - DNA, 25 bp, E. coli
gaatatctgaatactcccggtgagc

SEQ ID NO: 130443 - DNA, 25 bp, E. coli
ggtgagcattttgcaacggaccagc

SEQ ID NO: 130444 - DNA, 25 bp, E. coli
ggaccagctccggtacaaacgctgt

SEQ ID NO: 130445 - DNA, 25 bp, E. coli
ggtgagcattttccaacggaccagc

SEQ ID NO: 130446 - DNA, 25 bp, E. coli
ggaccagctccgctacaaacgctgt

SEQ ID NO: 130447 - DNA, 25 bp, E. coli
gatcggttttacgacttcaatctgg

SEQ ID NO: 130448 - DNA, 25 bp, E. coli
gatcggttttaccacttcaatctgg

SEQ ID NO: 130449 - DNA, 25 bp, E. coli
catggaagccaaagccaatagtcgc

SEQ ID NO: 130450 - DNA, 25 bp, E. coli
catagctctacacgccaggctgcga

SEQ ID NO: 130451 - DNA, 25 bp, E. coli
catagctctacaggccaggctgcga

SEQ ID NO: 130452 - DNA, 25 bp, E. coli
catggaagccaatgccaatagtcgc

SEQ ID NO: 130453 - DNA, 25 bp, E. coli
taaaggtgtcgaagtcatggtgcac

SEQ ID NO: 130454 - DNA, 25 bp, E. coli
taaaggtgtcgatgtcatggtgcac

SEQ ID NO: 130455 - DNA, 25 bp, E. coli
cacttgacctggctaaaggtgtcga

SEQ ID NO: 130456 - DNA, 25 bp, E. coli
atgtcatggtgctcgaagcgacgct

SEQ ID NO: 130457 - DNA, 25 bp, E. coli
cacttgacctgggtaaaggtgtcga

SEQ ID NO: 130458 - DNA, 25 bp, E. coli
atgtcatggtgcacgaagcgacgct

SEQ ID NO: 130459 - DNA, 25 bp, E. coli
tgcacgaagcgacgctggatataac

SEQ ID NO: 130460 - DNA, 25 bp, E. coli
tgcacgaagcgaggctggatataac

SEQ ID NO: 130461 - DNA, 25 bp, E. coli
tgcgatgccgcacttgacctggcta

SEQ ID NO: 130462 - DNA, 25 bp, E. coli
tgcgatgccgcagttgacctggcta

SEQ ID NO: 130463 - DNA, 25 bp, E. coli
gcgaatgatttctccgtgtttaacg

SEQ ID NO: 130464 - DNA, 25 bp, E. coli
gcgaatgatttcaccgtgtttaacg

SEQ ID NO: 130465 - DNA, 25 bp, E. coli
gaaacgtgatgatctcatggaatta

SEQ ID NO: 130466 - DNA, 25 bp, E. coli
gaaacgtgatgaactcatggaatta

SEQ ID NO: 130467 - DNA, 25 bp, E. coli
cgctggatataaccatggaagccaa

SEQ ID NO: 130468 - DNA, 25 bp, E. coli
cgctggatataagcatggaagccaa

SEQ ID NO: 130469 - DNA, 25 bp, E. coli
gattacttagctcctccagtgccag

SEQ ID NO: 130470 - DNA, 25 bp, E. coli
gattacttagctgctccagtgccag

SEQ ID NO: 130471 - DNA, 25 bp, E. coli
aagaaattgctgatgccggtgcgga

SEQ ID NO: 130472 - DNA, 25 bp, E. coli
aagaaattgctgttgccggtgcgga

SEQ ID NO: 130473 - DNA, 25 bp, E. coli
cagacattccggataaaggcgcttt

SEQ ID NO: 130474 - DNA, 25 bp, E. coli
cagacattccggttaaaggcgcttt

SEQ ID NO: 130475 - DNA, 25 bp, E. coli
taaataaggctggtgatgccctgcc

SEQ ID NO: 130476 - DNA, 25 bp, E. coli
taaataaggctgctgatgccctgcc

SEQ ID NO: 130477 - DNA, 25 bp, E. coli
agagctatcattcacccggaggcaa

SEQ ID NO: 130478 - DNA, 25 bp, E. coli
agagctatcattgacccggaggcaa

SEQ ID NO: 130479 - DNA, 25 bp, E. coli
tgataaccgttagctgcgcagggag

SEQ ID NO: 130480 - DNA, 25 bp, E. coli
tgataaccgttacctgcgcagggag

SEQ ID NO: 130481 - DNA, 25 bp, E. coli
tgttgataataaatccggcgtggcg

SEQ ID NO: 130482 - DNA, 25 bp, E. coli
tgttgataataattccggcgtggcg

SEQ ID NO: 130483 - DNA, 25 bp, E. coli
ccggtgacgttattgctctggcgaa

SEQ ID NO: 130484 - DNA, 25 bp, E. coli
ccggtgacgttaatgctctggcgaa

SEQ ID NO: 130485 - DNA, 25 bp, E. coli
gaattaacgtgcaggaaaccggctc

SEQ ID NO: 130486 - DNA, 25 bp, E. coli
gaattaacgtgctggaaaccggctc

SEQ ID NO: 130487 - DNA, 25 bp, E. coli
gaatattctccacgccgaactgctg

SEQ ID NO: 130488 - DNA, 25 bp, E. coli
gaatattctccaggccgaactgctg

SEQ ID NO: 130489 - DNA, 25 bp, E. coli
gatcagaaccttcccgacctggaga

SEQ ID NO: 130490 - DNA, 25 bp, E. coli
gatcagaaccttgccgacctggaga

SEQ ID NO: 130491 - DNA, 25 bp, E. coli
ggaaccgcccgtaataatctggatg

SEQ ID NO: 130492 - DNA, 25 bp, E. coli
ggaaccgcccgttataatctggatg

SEQ ID NO: 130493 - DNA, 25 bp, E. coli
cacggcccggaaaatcctgatgaaa

SEQ ID NO: 130494 - DNA, 25 bp, E. coli
cacggcccggaatatcctgatgaaa

SEQ ID NO: 130495 - DNA, 25 bp, E. coli
catgtaatgcatgaactcgatccgg

SEQ ID NO: 130496 - DNA, 25 bp, E. coli
catgtaatgcatcaactcgatccgg

SEQ ID NO: 130497 - DNA, 25 bp, E. coli
catgaactcgatgcggcgctggatt

SEQ ID NO: 130498 - DNA, 25 bp, E. coli
catgaactcgatccggcgctggatt

SEQ ID NO: 130499 - DNA, 25 bp, E. coli
atgcatgaactcgatccggcgctgg

SEQ ID NO: 130500 - DNA, 25 bp, E. coli
atgcatgaactccatccggcgctgg

SEQ ID NO: 130501 - DNA, 25 bp, E. coli
tgtaatgcatgaactcgatccggcg

SEQ ID NO: 130502 - DNA, 25 bp, E. coli
tgtaatgcatgatctcgatccggcg

SEQ ID NO: 130503 - DNA, 25 bp, E. coli
tccacggcccggtaaatcctgatga

SEQ ID NO: 130504 - DNA, 25 bp, E. coli
tccacggcccggaaaatcctgatga

SEQ ID NO: 130505 - DNA, 25 bp, E. coli
tcatcggcgcggtgtgattgttgaa

SEQ ID NO: 130506 - DNA, 25 bp, E. coli
tcatcggcgcggagtgattgttgaa

SEQ ID NO: 130507 - DNA, 25 bp, E. coli
gaactcgatccggcgctggatttgc

SEQ ID NO: 130508 - DNA, 25 bp, E. coli
gaactcgatccgccgctggatttgc

SEQ ID NO: 130509 - DNA, 25 bp, E. coli
cccggaaaatcctgatgaaacatgg

SEQ ID NO: 130510 - DNA, 25 bp, E. coli
cccggaaaatccagatgaaacatgg

SEQ ID NO: 130511 - DNA, 25 bp, E. coli
taatgcatgaactcgatccggcgct

SEQ ID NO: 130512 - DNA, 25 bp, E. coli
taatgcatgaacacgatccggcgct

SEQ ID NO: 130513 - DNA, 25 bp, E. coli
gaccatgtaatgcatgaactcgatc

SEQ ID NO: 130514 - DNA, 25 bp, E. coli
gaccatgtaatggatgaactcgatc

SEQ ID NO: 130515 - DNA, 25 bp, E. coli
aatcactctcctgatgatggactag

SEQ ID NO: 130516 - DNA, 25 bp, E. coli
aatatcaatattgctgggcgtagcg

SEQ ID NO: 130517 - DNA, 25 bp, E. coli
aatatcaatattcctgggcgtagcg

SEQ ID NO: 130518 - DNA, 25 bp, E. coli
aatcactctcctcatgatggactag

SEQ ID NO: 130519 - DNA, 25 bp, E. coli
tattcctgggcgaagcgctcttctt

SEQ ID NO: 130520 - DNA, 25 bp, E. coli
tattcctgggcgtagcgctcttctt

SEQ ID NO: 130521 - DNA, 25 bp, E. coli
tgaacattaatcactctcctcatga

SEQ ID NO: 130522 - DNA, 25 bp, E. coli
tgaacattaatctctctcctcatga

SEQ ID NO: 130523 - DNA, 25 bp, E. coli
gcgtagcgctctacttttagggaaa

SEQ ID NO: 130524 - DNA, 25 bp, E. coli
gcgtagcgctcttcttttagggaaa

SEQ ID NO: 130525 - DNA, 25 bp, E. coli
cctcatgatggactagttataataa

SEQ ID NO: 130526 - DNA, 25 bp, E. coli
cctcatgatggagtagttataataa

SEQ ID NO: 130527 - DNA, 25 bp, E. coli
gcttagaggcggtactctaaatatc

SEQ ID NO: 130528 - DNA, 25 bp, E. coli
gcttagaggcggaactctaaatatc

SEQ ID NO: 130529 - DNA, 25 bp, E. coli
gctcttcttttacggaaaacaggag

SEQ ID NO: 130530 - DNA, 25 bp, E. coli
gctcttcttttagggaaaacaggag

SEQ ID NO: 130531 - DNA, 25 bp, E. coli
gggagtaatagcgttaacattatta

SEQ ID NO: 130532 - DNA, 25 bp, E. coli
gggagtaatagccttaacattatta

SEQ ID NO: 130533 - DNA, 25 bp, E. coli
tggcctaacaaattgcaacctggaa

SEQ ID NO: 130534 - DNA, 25 bp, E. coli
tggcctaacaaaatgcaacctggaa

SEQ ID NO: 130535 - DNA, 25 bp, E. coli
gaggcggaactcaaaatatcaatat

SEQ ID NO: 130536 - DNA, 25 bp, E. coli
gaggcggaactctaaatatcaatat

SEQ ID NO: 130537 - DNA, 25 bp, E. coli
aacgcaaaagcaggtgttagcgcga

SEQ ID NO: 130538 - DNA, 25 bp, E. coli
caacgcaaaagcaggtgttagcgcg

SEQ ID NO: 130539 - DNA, 25 bp, E. coli
aacgcaaaagcacgtgttagcgcga

SEQ ID NO: 130540 - DNA, 25 bp, E. coli
caacgcaaaagctggtgttagcgcg

SEQ ID NO: 130541 - DNA, 25 bp, E. coli
caaaagcaggtgatagcgcgagcat

SEQ ID NO: 130542 - DNA, 25 bp, E. coli
caaaagcaggtgttagcgcgagcat

SEQ ID NO: 130543 - DNA, 25 bp, E. coli
acaatgcgatgaggctctcggttag

SEQ ID NO: 130544 - DNA, 25 bp, E. coli
acaatgcgatgacgctctcggttag

SEQ ID NO: 130545 - DNA, 25 bp, E. coli
tagcgcgagcattattaacgtgggt

SEQ ID NO: 130546 - DNA, 25 bp, E. coli
tagcgcgagcataattaacgtgggt

SEQ ID NO: 130547 - DNA, 25 bp, E. coli
ttagcgcgagcaatattaacgtggg

SEQ ID NO: 130548 - DNA, 25 bp, E. coli
ttagcgcgagcattattaacgtggg

SEQ ID NO: 130549 - DNA, 25 bp, E. coli
tgacaatgcgatcacgctctcggtt

SEQ ID NO: 130550 - DNA, 25 bp, E. coli
tgacaatgcgatgacgctctcggtt

SEQ ID NO: 130551 - DNA, 25 bp, E. coli
gcaaaagcaggtcttagcgcgagca

SEQ ID NO: 130552 - DNA, 25 bp, E. coli
gcaaaagcaggtgttagcgcgagca

SEQ ID NO: 130553 - DNA, 25 bp, E. coli
gacaatgcgatgtcgctctcggtta

SEQ ID NO: 130554 - DNA, 25 bp, E. coli
gacaatgcgatgacgctctcggtta

SEQ ID NO: 130555 - DNA, 25 bp, E. coli
cgcaaaagcaggagttagcgcgagc

SEQ ID NO: 130556 - DNA, 25 bp, E. coli
cgcaaaagcaggtgttagcgcgagc

SEQ ID NO: 130557 - DNA, 25 bp, E. coli
gttagcgcgagctttattaacgtgg

SEQ ID NO: 130558 - DNA, 25 bp, E. coli
gttagcgcgagcattattaacgtgg

SEQ ID NO: 130559 - DNA, 25 bp, E. coli
tttcggcgctggaagtagtaatgca

SEQ ID NO: 130560 - DNA, 25 bp, E. coli
tttcggcgctggtagtagtaatgca

SEQ ID NO: 130561 - DNA, 25 bp, E. coli
ttcggcgctggaagtagtaatgcag

SEQ ID NO: 130562 - DNA, 25 bp, E. coli
tttctgcgcgttttcccgcgcattt

SEQ ID NO: 130563 - DNA, 25 bp, E. coli
tttctgcgcgttatcccgcgcattt

SEQ ID NO: 130564 - DNA, 25 bp, E. coli
ttcggcgctggatgtagtaatgcag

SEQ ID NO: 130565 - DNA, 25 bp, E. coli
tctgcgcgttatgccgcgcatttcg

SEQ ID NO: 130566 - DNA, 25 bp, E. coli
tctgcgcgttatcccgcgcatttcg

SEQ ID NO: 130567 - DNA, 25 bp, E. coli
tcggcattttccttgacgaagccgt

SEQ ID NO: 130568 - DNA, 25 bp, E. coli
tcggcattttccatgacgaagccgt

SEQ ID NO: 130569 - DNA, 25 bp, E. coli
gcatttcggcgctggaagtagtaat

SEQ ID NO: 130570 - DNA, 25 bp, E. coli
gcatttcggcgcaggaagtagtaat

SEQ ID NO: 130571 - DNA, 25 bp, E. coli
cgcatttcggcggtggaagtagtaa

SEQ ID NO: 130572 - DNA, 25 bp, E. coli
cgcatttcggcgctggaagtagtaa

SEQ ID NO: 130573 - DNA, 25 bp, E. coli
cgctggaagtagtaatgcagccgct

SEQ ID NO: 130574 - DNA, 25 bp, E. coli
cgctggaagtagaaatgcagccgct

SEQ ID NO: 130575 - DNA, 25 bp, E. coli
cggcattttccaagacgaagccgta

SEQ ID NO: 130576 - DNA, 25 bp, E. coli
cgtcggcattttgcatgacgaagcc

SEQ ID NO: 130577 - DNA, 25 bp, E. coli
cgtcggcattttccatgacgaagcc

SEQ ID NO: 130578 - DNA, 25 bp, E. coli
cggcattttccatgacgaagccgta

SEQ ID NO: 130579 - DNA, 25 bp, E. coli
cggcgctggaagaagtaatgcagcc

SEQ ID NO: 130580 - DNA, 25 bp, E. coli
cggcgctggaagtagtaatgcagcc

SEQ ID NO: 130581 - DNA, 25 bp, E. coli
tacttaaggaatatcatcctgtgca

SEQ ID NO: 130582 - DNA, 25 bp, E. coli
tacttaaggaatttcatcctgtgca

SEQ ID NO: 130583 - DNA, 25 bp, E. coli
actgacgtatcaatatctggtagaa

SEQ ID NO: 130584 - DNA, 25 bp, E. coli
atttgcctggcgtccggagccacgc

SEQ ID NO: 130585 - DNA, 25 bp, E. coli
actgacgtatcattatctggtagaa

SEQ ID NO: 130586 - DNA, 25 bp, E. coli
atgccgtgatttgcctggcgaccgg

SEQ ID NO: 130587 - DNA, 25 bp, E. coli
atttgcctggcgaccggagccacgc

SEQ ID NO: 130588 - DNA, 25 bp, E. coli
atgccgtgatttccctggcgaccgg

SEQ ID NO: 130589 - DNA, 25 bp, E. coli
ttaagtgaacgtcccagcgaatatt

SEQ ID NO: 130590 - DNA, 25 bp, E. coli
ttaagtgaacgtgccagcgaatatt

SEQ ID NO: 130591 - DNA, 25 bp, E. coli
tcattatctggttgaaaaaatccac

SEQ ID NO: 130592 - DNA, 25 bp, E. coli
tcattatctggtagaaaaaatccac

SEQ ID NO: 130593 - DNA, 25 bp, E. coli
gccacgccattagtgacgtatcatt

SEQ ID NO: 130594 - DNA, 25 bp, E. coli
gccacgccattactgacgtatcatt

SEQ ID NO: 130595 - DNA, 25 bp, E. coli
gaacgtgccagcgaatatttattgg

SEQ ID NO: 130596 - DNA, 25 bp, E. coli
gaacgtgccagccaatatttattgg

SEQ ID NO: 130597 - DNA, 25 bp, E. coli
ccggagccacgcgattactgacgta

SEQ ID NO: 130598 - DNA, 25 bp, E. coli
cgaatatttattggccgtgatccgt

SEQ ID NO: 130599 - DNA, 25 bp, E. coli
ccggagccacgccattactgacgta

SEQ ID NO: 130600 - DNA, 25 bp, E. coli
cgaatatttattcgccgtgatccgt

SEQ ID NO: 130601 - DNA, 25 bp, E. coli
gtgcctctttacataaggaatttca

SEQ ID NO: 130602 - DNA, 25 bp, E. coli
gtgcctctttacttaaggaatttca

SEQ ID NO: 130603 - DNA, 25 bp, E. coli
caacggctggatgcgaaggttaacc

SEQ ID NO: 130604 - DNA, 25 bp, E. coli
caacggctggatccgaaggttaacc

SEQ ID NO: 130605 - DNA, 25 bp, E. coli
caccgttgtcgactgtgtgcttaac

SEQ ID NO: 130606 - DNA, 25 bp, E. coli
caccgttgtcgagtgtgtgcttaac

SEQ ID NO: 130607 - DNA, 25 bp, E. coli
tgtgcttaacaaactctgcccgtcg

SEQ ID NO: 130608 - DNA, 25 bp, E. coli
tgtgcttaacaatctctgcccgtcg

SEQ ID NO: 130609 - DNA, 25 bp, E. coli
tgaactgataaagcgctgggagcgt

SEQ ID NO: 130610 - DNA, 25 bp, E. coli
tgaactgataaaccgctgggagcgt

SEQ ID NO: 130611 - DNA, 25 bp, E. coli
tgcggtctgccgcatgaatgtattc

SEQ ID NO: 130612 - DNA, 25 bp, E. coli
tgcggtctgccggatgaatgtattc

SEQ ID NO: 130613 - DNA, 25 bp, E. coli
tcggcctgtactgacgcggtgaatg

SEQ ID NO: 130614 - DNA, 25 bp, E. coli
tcggcctgtactcacgcggtgaatg

SEQ ID NO: 130615 - DNA, 25 bp, E. coli
gacatgtggcgaaccctgtgattcc

SEQ ID NO: 130616 - DNA, 25 bp, E. coli
gacatgtggcgatccctgtgattcc

SEQ ID NO: 130617 - DNA, 25 bp, E. coli
cgggcggcatcatcgaggattttta

SEQ ID NO: 130618 - DNA, 25 bp, E. coli
cgggcggcatcaacgaggattttta

SEQ ID NO: 130619 - DNA, 25 bp, E. coli
ggtgcggcaccgacattaacccgtg

SEQ ID NO: 130620 - DNA, 25 bp, E. coli
ggtgcggcaccgtcattaacccgtg

SEQ ID NO: 130621 - DNA, 25 bp, E. coli
tcacgcgatacgacaaaagcacttt

SEQ ID NO: 130622 - DNA, 25 bp, E. coli
taacccgtgttcttcagcgtgcgga

SEQ ID NO: 130623 - DNA, 25 bp, E. coli
taacccgtgttcatcagcgtgcgga

SEQ ID NO: 130624 - DNA, 25 bp, E. coli
tcacgcgatacgtcaaaagcacttt

SEQ ID NO: 130625 - DNA, 25 bp, E. coli
caacgtatgctgcaagtcgtgcgcg

SEQ ID NO: 130626 - DNA, 25 bp, E. coli
caacgtatgctggaagtcgtgcgcg

SEQ ID NO: 130627 - DNA, 25 bp, E. coli
aaatgagctgtgaagagctggcccg

SEQ ID NO: 130628 - DNA, 25 bp, E. coli
aaatgagctgtgtagagctggcccg

SEQ ID NO: 130629 - DNA, 25 bp, E. coli
tgttgcaagggcgattaagcgcacc

SEQ ID NO: 130630 - DNA, 25 bp, E. coli
tgttgcaagggccattaagcgcacc

SEQ ID NO: 130631 - DNA, 25 bp, E. coli
tccgaagaggaaatctggcaacgcg

SEQ ID NO: 130632 - DNA, 25 bp, E. coli
tccgaagaggaattctggcaacgcg

SEQ ID NO: 130633 - DNA, 25 bp, E. coli
tctatttccaaagtgctgagtctcg

SEQ ID NO: 130634 - DNA, 25 bp, E. coli
tctatttccaaactgctgagtctcg

SEQ ID NO: 130635 - DNA, 25 bp, E. coli
gccggagacgcggaagaacgttttt

SEQ ID NO: 130636 - DNA, 25 bp, E. coli
gccggagacgcgcaagaacgttttt

SEQ ID NO: 130637 - DNA, 25 bp, E. coli
gccatgcgtcataactccgaagagg

SEQ ID NO: 130638 - DNA, 25 bp, E. coli
gccatgcgtcattactccgaagagg

SEQ ID NO: 130639 - DNA, 25 bp, E. coli
gaaatgcggctatcgcctggctgat

SEQ ID NO: 130640 - DNA, 25 bp, E. coli
gacggacagcttattcaggccggag

SEQ ID NO: 130641 - DNA, 25 bp, E. coli
gaaatgcggctaacgcctggctgat

SEQ ID NO: 130642 - DNA, 25 bp, E. coli
gacggacagctttttcaggccggag

SEQ ID NO: 130643 - DNA, 25 bp, E. coli
cattggtcagggtaaagtcgcggat

SEQ ID NO: 130644 - DNA, 25 bp, E. coli
cattggtcagggaaaagtcgcggat

SEQ ID NO: 130645 - DNA, 25 bp, E. coli
gattgttccgcatgaaatggccatc

SEQ ID NO: 130646 - DNA, 25 bp, E. coli
gattgttccgcaagaaatggccatc

SEQ ID NO: 130647 - DNA, 25 bp, E. coli
aagcacatgggcactgtgcggcatg

SEQ ID NO: 130648 - DNA, 25 bp, E. coli
aagcacatgggctctgtgcggcatg

SEQ ID NO: 130649 - DNA, 25 bp, E. coli
cagtgccagcatcatcactctgtgc

SEQ ID NO: 130650 - DNA, 25 bp, E. coli
cagtgccagcatgatcactctgtgc

SEQ ID NO: 130651 - DNA, 25 bp, E. coli
tgtgattgaagcacatgggctctgt

SEQ ID NO: 130652 - DNA, 25 bp, E. coli
tgtgattgaagctcatgggctctgt

SEQ ID NO: 130653 - DNA, 25 bp, E. coli
tgccagcatgatgactctgtgcagg

SEQ ID NO: 130654 - DNA, 25 bp, E. coli
tgccagcatgatcactctgtgcagg

SEQ ID NO: 130655 - DNA, 25 bp, E. coli
ccagcatgatcactctgtgcaggtg

SEQ ID NO: 130656 - DNA, 25 bp, E. coli
ccagcatgatcagtctgtgcaggtg

SEQ ID NO: 130657 - DNA, 25 bp, E. coli
gcatgatcactcagtgcaggtgaaa

SEQ ID NO: 130658 - DNA, 25 bp, E. coli
gcatgatcactctgtgcaggtgaaa

SEQ ID NO: 130659 - DNA, 25 bp, E. coli
gaacagtgccagcatgatcactctg

SEQ ID NO: 130660 - DNA, 25 bp, E. coli
gaacagtgccaggatgatcactctg

SEQ ID NO: 130661 - DNA, 25 bp, E. coli
gattgaagcacaagggctctgtgcg

SEQ ID NO: 130662 - DNA, 25 bp, E. coli
gatcactctgtgcaggtgaaaaaga

SEQ ID NO: 130663 - DNA, 25 bp, E. coli
gatcactctgtggaggtgaaaaaga

SEQ ID NO: 130664 - DNA, 25 bp, E. coli
gattgaagcacatgggctctgtgcg

SEQ ID NO: 130665 - DNA, 25 bp, E. coli
taatgtgattgaagcacatgggctc

SEQ ID NO: 130666 - DNA, 25 bp, E. coli
tcactctgtgcacgtgaaaaagaaa

SEQ ID NO: 130667 - DNA, 25 bp, E. coli
taatgtgattgatgcacatgggctc

SEQ ID NO: 130668 - DNA, 25 bp, E. coli
tcactctgtgcaggtgaaaaagaaa

SEQ ID NO: 130669 - DNA, 25 bp, E. coli
cagtggccagtctgaacgtgtttga

SEQ ID NO: 130670 - DNA, 25 bp, E. coli
cagtggccagtcagaacgtgtttga

SEQ ID NO: 130671 - DNA, 25 bp, E. coli
tacgcaacagcgttgtaaaacggtg

SEQ ID NO: 130672 - DNA, 25 bp, E. coli
taaaacaccgcgacaggagtgtcgc

SEQ ID NO: 130673 - DNA, 25 bp, E. coli
taaaacaccgcgtcaggagtgtcgc

SEQ ID NO: 130674 - DNA, 25 bp, E. coli
agatccagggctgtctccaggaaag

SEQ ID NO: 130675 - DNA, 25 bp, E. coli
agatccagggctctctccaggaaag

SEQ ID NO: 130676 - DNA, 25 bp, E. coli
tacgcaacagcgatgtaaaacggtg

SEQ ID NO: 130677 - DNA, 25 bp, E. coli
tataagattggccatcagcagggca

SEQ ID NO: 130678 - DNA, 25 bp, E. coli
tataagattggcgatcagcagggca

SEQ ID NO: 130679 - DNA, 25 bp, E. coli
tctgcaaccccattcaaggaaacgg

SEQ ID NO: 130680 - DNA, 25 bp, E. coli
tctgcaaccccaatcaaggaaacgg

SEQ ID NO: 130681 - DNA, 25 bp, E. coli
gatccgggtacggagatcccgctag

SEQ ID NO: 130682 - DNA, 25 bp, E. coli
gatatgccggtatccagatccaggg

SEQ ID NO: 130683 - DNA, 25 bp, E. coli
gatatgccggtaaccagatccaggg

SEQ ID NO: 130684 - DNA, 25 bp, E. coli
ggagtgtcgcaacgtcacagtgacc

SEQ ID NO: 130685 - DNA, 25 bp, E. coli
ggaaagcgatacatacacgactacg

SEQ ID NO: 130686 - DNA, 25 bp, E. coli
ggaaagcgatacttacacgactacg

SEQ ID NO: 130687 - DNA, 25 bp, E. coli
ggagtgtcgcaaggtcacagtgacc

SEQ ID NO: 130688 - DNA, 25 bp, E. coli
tcagcagggcaaaatccgcatggac

SEQ ID NO: 130689 - DNA, 25 bp, E. coli
tcagcagggcaatatccgcatggac

SEQ ID NO: 130690 - DNA, 25 bp, E. coli
gatccgggtacgcagatcccgctag

SEQ ID NO: 130691 - DNA, 25 bp, E. coli
tatgatgctttttctgcgcggcgtg

SEQ ID NO: 130692 - DNA, 25 bp, E. coli
tatgatgcttttactgcgcggcgtg

SEQ ID NO: 130693 - DNA, 25 bp, E. coli
taccagatgatcctcaaagcggtgg

SEQ ID NO: 130694 - DNA, 25 bp, E. coli
taccagatgatcgtcaaagcggtgg

SEQ ID NO: 130695 - DNA, 25 bp, E. coli
tgaataccggctttactgagaacgc

SEQ ID NO: 130696 - DNA, 25 bp, E. coli
tgaataccggctatactgagaacgc

SEQ ID NO: 130697 - DNA, 25 bp, E. coli
tcgcggcctggtacatgctgcatca

SEQ ID NO: 130698 - DNA, 25 bp, E. coli
tcgcggcctggttcatgctgcatca

SEQ ID NO: 130699 - DNA, 25 bp, E. coli
ccattatggcggacgggatgacgct

SEQ ID NO: 130700 - DNA, 25 bp, E. coli
ccattatggcggtcgggatgacgct

SEQ ID NO: 130701 - DNA, 25 bp, E. coli
gcggcaacgcgtctttctggtatca

SEQ ID NO: 130702 - DNA, 25 bp, E. coli
gcggcaacgcgtgtttctggtatca

SEQ ID NO: 130703 - DNA, 25 bp, E. coli
gcagttgctgcaactatcgtcggca

SEQ ID NO: 130704 - DNA, 25 bp, E. coli
gcagttgctgcatctatcgtcggca

SEQ ID NO: 130705 - DNA, 25 bp, E. coli
gaaatcgcttatcgctctgctggtg

SEQ ID NO: 130706 - DNA, 25 bp, E. coli
gaaatcgcttatggctctgctggtg

SEQ ID NO: 130707 - DNA, 25 bp, E. coli
cgattgtctcgaggttaagcccgaa

SEQ ID NO: 130708 - DNA, 25 bp, E. coli
cgattgtctcgacgttaagcccgaa

SEQ ID NO: 130709 - DNA, 25 bp, E. coli
cattgttgggacgttgatcggcgca

SEQ ID NO: 130710 - DNA, 25 bp, E. coli
cattgttgggaccttgatcggcgca

SEQ ID NO: 130711 - DNA, 25 bp, E. coli
gatcattgaagtcgcgcgtctctcc

SEQ ID NO: 130712 - DNA, 25 bp, E. coli
gatcattgaagtggcgcgtctctcc

SEQ ID NO: 130713 - DNA, 25 bp, E. coli
taaatatggtgcagggttctgaccc

SEQ ID NO: 130714 - DNA, 25 bp, E. coli
taactgatggcaaggagctcttcgc

SEQ ID NO: 130715 - DNA, 25 bp, E. coli
taaatatggtgctgggttctgaccc

SEQ ID NO: 130716 - DNA, 25 bp, E. coli
tatgcgcgcactggatacgtatctg

SEQ ID NO: 130717 - DNA, 25 bp, E. coli
tatgcgcgcactcgatacgtatctg

SEQ ID NO: 130718 - DNA, 25 bp, E. coli
tatggtccgctaagcacaatatcgt

SEQ ID NO: 130719 - DNA, 25 bp, E. coli
tatggtccgctatgcacaatatcgt

SEQ ID NO: 130720 - DNA, 25 bp, E. coli
tatcatccgataactctgggcgagt

SEQ ID NO: 130721 - DNA, 25 bp, E. coli
tatcatccgatatctctgggcgagt

SEQ ID NO: 130722 - DNA, 25 bp, E. coli
ttttatccgagtcgacgccagacgc

SEQ ID NO: 130723 - DNA, 25 bp, E. coli
ttttatccgagtggacgccagacgc

SEQ ID NO: 130724 - DNA, 25 bp, E. coli
tgcaggatacccttgaagttgtcag

SEQ ID NO: 130725 - DNA, 25 bp, E. coli
tgcaggatacccatgaagttgtcag

SEQ ID NO: 130726 - DNA, 25 bp, E. coli
gcaaatttaatgctggccaccagcg

SEQ ID NO: 130727 - DNA, 25 bp, E. coli
gcaaatttaatggtggccaccagcg

SEQ ID NO: 130728 - DNA, 25 bp, E. coli
taatgaagaggccaaccagttgcgc

SEQ ID NO: 130729 - DNA, 25 bp, E. coli
tcaatatgacgattaaaaccgggca

SEQ ID NO: 130730 - DNA, 25 bp, E. coli
tcaatatgacgaataaaaccgggca

SEQ ID NO: 130731 - DNA, 25 bp, E. coli
taatgaagaggcgaaccagttgcgc

SEQ ID NO: 130732 - DNA, 25 bp, E. coli
taactgatggcatggagctcttcgc

SEQ ID NO: 130733 - DNA, 25 bp, E. coli
gagtaatgcgcttatcgcaccaggc

SEQ ID NO: 130734 - DNA, 25 bp, E. coli
gagtaatgcgctaatcgcaccaggc

SEQ ID NO: 130735 - DNA, 25 bp, E. coli
tactgcgtgaacctcaacgggtgcg

SEQ ID NO: 130736 - DNA, 25 bp, E. coli
tactgcgtgaacgtcaacgggtgcg

SEQ ID NO: 130737 - DNA, 25 bp, E. coli
tatttcctccctcgacagcagctgg

SEQ ID NO: 130738 - DNA, 25 bp, E. coli
tatttcctccctggacagcagctgg

SEQ ID NO: 130739 - DNA, 25 bp, E. coli
tttcacggtggtacagggctatgcc

SEQ ID NO: 130740 - DNA, 25 bp, E. coli
tttcacggtggttcagggctatgcc

SEQ ID NO: 130741 - DNA, 25 bp, E. coli
ttctgagcagattaagacgcgggcc

SEQ ID NO: 130742 - DNA, 25 bp, E. coli
ttctgagcagataaagacgcgggcc

SEQ ID NO: 130743 - DNA, 25 bp, E. coli
tgtacaccgatatccgtcagggctg

SEQ ID NO: 130744 - DNA, 25 bp, E. coli
tgtacaccgataaccgtcagggctg

SEQ ID NO: 130745 - DNA, 25 bp, E. coli
tgtatttgagccgaaaccggaccgg

SEQ ID NO: 130746 - DNA, 25 bp, E. coli
tgtatttgagcccaaaccggaccgg

SEQ ID NO: 130747 - DNA, 25 bp, E. coli
tgaagaggccatccgtcgtgaaacg

SEQ ID NO: 130748 - DNA, 25 bp, E. coli
tgaagaggccatgcgtcgtgaaacg

SEQ ID NO: 130749 - DNA, 25 bp, E. coli
gaacgccgcgcacatgaaattgtcc

SEQ ID NO: 130750 - DNA, 25 bp, E. coli
gaaagagacgttaaccctgctggac

SEQ ID NO: 130751 - DNA, 25 bp, E. coli
gaaagagacgtttaccctgctggac

SEQ ID NO: 130752 - DNA, 25 bp, E. coli
gaacgccgcgcagatgaaattgtcc

SEQ ID NO: 130753 - DNA, 25 bp, E. coli
gataattactatctgctgggcagca

SEQ ID NO: 130754 - DNA, 25 bp, E. coli
gataattactatgtgctgggcagca

SEQ ID NO: 130755 - DNA, 25 bp, E. coli
tgggtaagaccagacagttccgggc

SEQ ID NO: 130756 - DNA, 25 bp, E. coli
tgggtaagaccacacagttccgggc

SEQ ID NO: 130757 - DNA, 25 bp, E. coli
aacgcacgcgtcgtcaggtgaacaa

SEQ ID NO: 130758 - DNA, 25 bp, E. coli
aacgcacgcgtcctcaggtgaacaa

SEQ ID NO: 130759 - DNA, 25 bp, E. coli
caaaagagatcaagcgtgagatggg

SEQ ID NO: 130760 - DNA, 25 bp, E. coli
caaaagagatcatgcgtgagatggg

SEQ ID NO: 130761 - DNA, 25 bp, E. coli
cagcgagctgctctgcgaagcgttt

SEQ ID NO: 130762 - DNA, 25 bp, E. coli
cagcgagctgctgtgcgaagcgttt

SEQ ID NO: 130763 - DNA, 25 bp, E. coli
catacgctgagcacggcaagaagag

SEQ ID NO: 130764 - DNA, 25 bp, E. coli
catacgctgagctcggcaagaagag

SEQ ID NO: 130765 - DNA, 25 bp, E. coli
taaaaatcctcaccgatgaacgcac

SEQ ID NO: 130766 - DNA, 25 bp, E. coli
taaaaatcctcagcgatgaacgcac

SEQ ID NO: 130767 - DNA, 25 bp, E. coli
agcgtttctgcaagcctttaccggg

SEQ ID NO: 130768 - DNA, 25 bp, E. coli
agcgtttctgcatgcctttaccggg

SEQ ID NO: 130769 - DNA, 25 bp, E. coli
tatatcagcccatacgctgagcacg

SEQ ID NO: 130770 - DNA, 25 bp, E. coli
tatatcagcccaaacgctgagcacg

SEQ ID NO: 130771 - DNA, 25 bp, E. coli
gaatggagcggcgaatatatcagcc

SEQ ID NO: 130772 - DNA, 25 bp, E. coli
gaatggagcggccaatatatcagcc

SEQ ID NO: 130773 - DNA, 25 bp, E. coli
cggcaagaagagtgaacaagtcaaa

SEQ ID NO: 130774 - DNA, 25 bp, E. coli
cggcaagaagagagaacaagtcaaa

SEQ ID NO: 130775 - DNA, 25 bp, E. coli
gtcaggtgaacaacctgcgtcacgc

SEQ ID NO: 130776 - DNA, 25 bp, E. coli
gtcaggtgaacatcctgcgtcacgc

SEQ ID NO: 130777 - DNA, 25 bp, E. coli
tacggtttccatacctcttaaggtg

SEQ ID NO: 130778 - DNA, 25 bp, E. coli
tacggtttccattcctcttaaggtg

SEQ ID NO: 130779 - DNA, 25 bp, E. coli
aatcaggtttattatcccggacagg

SEQ ID NO: 130780 - DNA, 25 bp, E. coli
aatcaggtttataatcccggacagg

SEQ ID NO: 130781 - DNA, 25 bp, E. coli
agagggatccacactcatggcgcgg

SEQ ID NO: 130782 - DNA, 25 bp, E. coli
agagggatccactctcatggcgcgg

SEQ ID NO: 130783 - DNA, 25 bp, E. coli
aacatcttagcctgaccatgcgcga

SEQ ID NO: 130784 - DNA, 25 bp, E. coli
aacatcttagccagaccatgcgcga

SEQ ID NO: 130785 - DNA, 25 bp, E. coli
tatcagccggatgggtcacagcggc

SEQ ID NO: 130786 - DNA, 25 bp, E. coli
tatcagccggatcggtcacagcggc

SEQ ID NO: 130787 - DNA, 25 bp, E. coli
tttggcggcgcgcaaatttactacg

SEQ ID NO: 130788 - DNA, 25 bp, E. coli
tttggcggcgcggaaatttactacg

SEQ ID NO: 130789 - DNA, 25 bp, E. coli
ttattttgtgcaccaggcagcccgc

SEQ ID NO: 130790 - DNA, 25 bp, E. coli
ttattttgtgcagcaggcagcccgc

SEQ ID NO: 130791 - DNA, 25 bp, E. coli
tgatatggcgactaccgtacaggca

SEQ ID NO: 130792 - DNA, 25 bp, E. coli
tgatatggcgacaaccgtacaggca

SEQ ID NO: 130793 - DNA, 25 bp, E. coli
tgatgattgacgtcctctcaggcgt

SEQ ID NO: 130794 - DNA, 25 bp, E. coli
tgatgattgacgacctctcaggcgt

SEQ ID NO: 130795 - DNA, 25 bp, E. coli
tcaggcgtcttagtcggcttaccgt

SEQ ID NO: 130796 - DNA, 25 bp, E. coli
tcaggcgtcttactcggcttaccgt

SEQ ID NO: 130797 - DNA, 25 bp, E. coli
gatccgttcgcgctacatgctctgc

SEQ ID NO: 130798 - DNA, 25 bp, E. coli
gatccgttcgcggtacatgctctgc

SEQ ID NO: 130799 - DNA, 25 bp, E. coli
gagaataaactcagccaggctgggt

SEQ ID NO: 130800 - DNA, 25 bp, E. coli
gagaataaactctgccaggctgggt

SEQ ID NO: 130801 - DNA, 25 bp, E. coli
cacgacgatatgttcctgtacggta

SEQ ID NO: 130802 - DNA, 25 bp, E. coli
cacgacgatatgatcctgtacggta

SEQ ID NO: 130803 - DNA, 25 bp, E. coli
taaagaagggctcaatggcgcagtt

SEQ ID NO: 130804 - DNA, 25 bp, E. coli
taaaggcggttttgcagatatcggc

SEQ ID NO: 130805 - DNA, 25 bp, E. coli
taaaggcggtttagcagatatcggc

SEQ ID NO: 130806 - DNA, 25 bp, E. coli
taaagaagggctgaatggcgcagtt

SEQ ID NO: 130807 - DNA, 25 bp, E. coli
tatcggcgtgcattatctggactgg

SEQ ID NO: 130808 - DNA, 25 bp, E. coli
tatcggcgtgcaatatctggactgg

SEQ ID NO: 130809 - DNA, 25 bp, E. coli
tattacactggcgacaacggctatg

SEQ ID NO: 130810 - DNA, 25 bp, E. coli
tattacactggccacaacggctatg

SEQ ID NO: 130811 - DNA, 25 bp, E. coli
tcttgaatttgaaggtggcgctaac

SEQ ID NO: 130812 - DNA, 25 bp, E. coli
tcttgaatttgatggtggcgctaac

SEQ ID NO: 130813 - DNA, 25 bp, E. coli
cgagtacgagttagaccgtgacgct

SEQ ID NO: 130814 - DNA, 25 bp, E. coli
gacgctacctatccagcgggtaatg

SEQ ID NO: 130815 - DNA, 25 bp, E. coli
cgagtacgagtttgaccgtgacgct

SEQ ID NO: 130816 - DNA, 25 bp, E. coli
gacgctacctatgcagcgggtaatg

SEQ ID NO: 130817 - DNA, 25 bp, E. coli
ggtcgccataattaaccaggtagcg

SEQ ID NO: 130818 - DNA, 25 bp, E. coli
ggtcgccataataaaccaggtagcg

SEQ ID NO: 130819 - DNA, 25 bp, E. coli
tggaccagccggactaccgaaaaat

SEQ ID NO: 130820 - DNA, 25 bp, E. coli
ggaaaacttctataacggtcgccat

SEQ ID NO: 130821 - DNA, 25 bp, E. coli
ggaaaacttctaaaacggtcgccat

SEQ ID NO: 130822 - DNA, 25 bp, E. coli
tggaccagccggtctaccgaaaaat

SEQ ID NO: 130823 - DNA, 25 bp, E. coli
tatcttaaaaagttcgccgccaatg

SEQ ID NO: 130824 - DNA, 25 bp, E. coli
tatcttaaaaagatcgccgccaatg

SEQ ID NO: 130825 - DNA, 25 bp, E. coli
aacagatcatttaactgaaccagag

SEQ ID NO: 130826 - DNA, 25 bp, E. coli
aacagatcattttactgaaccagag

SEQ ID NO: 130827 - DNA, 25 bp, E. coli
tagagcatcaagcaaaagagtaagt

SEQ ID NO: 130828 - DNA, 25 bp, E. coli
tagagcatcaaggaaaagagtaagt

SEQ ID NO: 130829 - DNA, 25 bp, E. coli
ttcaattcattacgtgcactaggcc

SEQ ID NO: 130830 - DNA, 25 bp, E. coli
ttcaattcattaggtgcactaggcc

SEQ ID NO: 130831 - DNA, 25 bp, E. coli
ttacgtgcactacgccatgaaaaag

SEQ ID NO: 130832 - DNA, 25 bp, E. coli
ttacgtgcactaggccatgaaaaag

SEQ ID NO: 130833 - DNA, 25 bp, E. coli
tccaacagcactaacctggaagtcg

SEQ ID NO: 130834 - DNA, 25 bp, E. coli
tccaacagcacttacctggaagtcg

SEQ ID NO: 130835 - DNA, 25 bp, E. coli
tctcatatcagaaaaacagtcactt

SEQ ID NO: 130836 - DNA, 25 bp, E. coli
tctcatatcagataaacagtcactt

SEQ ID NO: 130837 - DNA, 25 bp, E. coli
gcaattatcggtgaggacattcctc

SEQ ID NO: 130838 - DNA, 25 bp, E. coli
gcaattatcggtcaggacattcctc

SEQ ID NO: 130839 - DNA, 25 bp, E. coli
ccccacgagagatacgccgaataat

SEQ ID NO: 130840 - DNA, 25 bp, E. coli
ccccacgagagaaacgccgaataat

SEQ ID NO: 130841 - DNA, 25 bp, E. coli
tagtttcaattgagaccccacgaga

SEQ ID NO: 130842 - DNA, 25 bp, E. coli
tagtttcaattgtgaccccacgaga

SEQ ID NO: 130843 - DNA, 25 bp, E. coli
taatttggcacaaaccgcaaccaaa

SEQ ID NO: 130844 - DNA, 25 bp, E. coli
taatttggcacataccgcaaccaaa

SEQ ID NO: 130845 - DNA, 25 bp, E. coli
cataacaggcagagcaatcatcagc

SEQ ID NO: 130846 - DNA, 25 bp, E. coli
catccagcatttgagcgaagtcaga

SEQ ID NO: 130847 - DNA, 25 bp, E. coli
catccagcatttcagcgaagtcaga

SEQ ID NO: 130848 - DNA, 25 bp, E. coli
cataacaggcagtgcaatcatcagc

SEQ ID NO: 130849 - DNA, 25 bp, E. coli
taaacgatgttgatctgctgcagct

SEQ ID NO: 130850 - DNA, 25 bp, E. coli
taaacgatgttgttctgctgcagct

SEQ ID NO: 130851 - DNA, 25 bp, E. coli
taccgtaagaaaggatggagatctg

SEQ ID NO: 130852 - DNA, 25 bp, E. coli
taccgtaagaaacgatggagatctg

SEQ ID NO: 130853 - DNA, 25 bp, E. coli
ttagtaaaccagaaccgcacgacgg

SEQ ID NO: 130854 - DNA, 25 bp, E. coli
ttagtaaaccagtaccgcacgacgg

SEQ ID NO: 130855 - DNA, 25 bp, E. coli
tgtattccggagtaccacgttcgtc

SEQ ID NO: 130856 - DNA, 25 bp, E. coli
tgttggaagaacttgccgcaattgc

SEQ ID NO: 130857 - DNA, 25 bp, E. coli
tgtaagacgggttgctacgcaggaa

SEQ ID NO: 130858 - DNA, 25 bp, E. coli
tgtattccggagaaccacgttcgtc

SEQ ID NO: 130859 - DNA, 25 bp, E. coli
tgttggaagaacatgccgcaattgc

SEQ ID NO: 130860 - DNA, 25 bp, E. coli
tgtaagacgggtagctacgcaggaa

SEQ ID NO: 130861 - DNA, 25 bp, E. coli
tcgtcatgacccagtactgcaggtt

SEQ ID NO: 130862 - DNA, 25 bp, E. coli
tcgtcatgaccctgtactgcaggtt

SEQ ID NO: 130863 - DNA, 25 bp, E. coli
gacgagcctgctcttcggaagacat

SEQ ID NO: 130864 - DNA, 25 bp, E. coli
tcacccagggagatgttgtattccg

SEQ ID NO: 130865 - DNA, 25 bp, E. coli
tcacccagggagttgttgtattccg

SEQ ID NO: 130866 - DNA, 25 bp, E. coli
gacgagcctgctgttcggaagacat

SEQ ID NO: 130867 - DNA, 25 bp, E. coli
aatagcctggtttttccctgcccca

SEQ ID NO: 130868 - DNA, 25 bp, E. coli
aatagcctggttattccctgcccca

SEQ ID NO: 130869 - DNA, 25 bp, E. coli
tgcatacgaaaacaccagagggtgc

SEQ ID NO: 130870 - DNA, 25 bp, E. coli
tgcatacgaaaagaccagagggtgc

SEQ ID NO: 130871 - DNA, 25 bp, E. coli
tcctctttcataattggcctgtgca

SEQ ID NO: 130872 - DNA, 25 bp, E. coli
tcctctttcatatttggcctgtgca

SEQ ID NO: 130873 - DNA, 25 bp, E. coli
tcatgtctgagtcatgcgaagtgct

SEQ ID NO: 130874 - DNA, 25 bp, E. coli
tcatgtctgagtgatgcgaagtgct

SEQ ID NO: 130875 - DNA, 25 bp, E. coli
gcctgtgcatggtgaaatagcctgg

SEQ ID NO: 130876 - DNA, 25 bp, E. coli
gcctgtgcatggagaaatagcctgg

SEQ ID NO: 130877 - DNA, 25 bp, E. coli
gcatgacaatcatgaccgccaacga

SEQ ID NO: 130878 - DNA, 25 bp, E. coli
gcatgacaatcaagaccgccaacga

SEQ ID NO: 130879 - DNA, 25 bp, E. coli
cccatgctaagaccgcagtgtctgt

SEQ ID NO: 130880 - DNA, 25 bp, E. coli
cccatgctaagagcgcagtgtctgt

SEQ ID NO: 130881 - DNA, 25 bp, E. coli
cttatttaaggacggatcaagcggg

SEQ ID NO: 130882 - DNA, 25 bp, E. coli
cttatttaaggagggatcaagcggg

SEQ ID NO: 130883 - DNA, 25 bp, E. coli
gtctgtcgcatagacactgcatacg

SEQ ID NO: 130884 - DNA, 25 bp, E. coli
gggttcaagaacttaagcctctcct

SEQ ID NO: 130885 - DNA, 25 bp, E. coli
gggttcaagaacataagcctctcct

SEQ ID NO: 130886 - DNA, 25 bp, E. coli
gtctgtcgcatacacactgcatacg

SEQ ID NO: 130887 - DNA, 25 bp, E. coli
tagtcgttattcgttcagggttcaa

SEQ ID NO: 130888 - DNA, 25 bp, E. coli
tagtcgttattccttcagggttcaa

SEQ ID NO: 130889 - DNA, 25 bp, E. coli
taaatcactttttcagagaactgcg

SEQ ID NO: 130890 - DNA, 25 bp, E. coli
taacgggccattacatgtaacagaa

SEQ ID NO: 130891 - DNA, 25 bp, E. coli
taaatcacttttacagagaactgcg

SEQ ID NO: 130892 - DNA, 25 bp, E. coli
agtattacgcatcttttccctgtca

SEQ ID NO: 130893 - DNA, 25 bp, E. coli
agtattacgcatgttttccctgtca

SEQ ID NO: 130894 - DNA, 25 bp, E. coli
aaattaatgggatactcttcgcgat

SEQ ID NO: 130895 - DNA, 25 bp, E. coli
aaattaatgggaaactcttcgcgat

SEQ ID NO: 130896 - DNA, 25 bp, E. coli
ttttttcaacaaatgctcaaccagc

SEQ ID NO: 130897 - DNA, 25 bp, E. coli
ttttttcaacaattgctcaaccagc

SEQ ID NO: 130898 - DNA, 25 bp, E. coli
tcctggcgcattttagtcaaaacgg

SEQ ID NO: 130899 - DNA, 25 bp, E. coli
tcctggcgcattatagtcaaaacgg

SEQ ID NO: 130900 - DNA, 25 bp, E. coli
gcgatttgtgatctctaacgggcca

SEQ ID NO: 130901 - DNA, 25 bp, E. coli
gcgatttgtgatgtctaacgggcca

SEQ ID NO: 130902 - DNA, 25 bp, E. coli
gggtatatccagaacactccacgct

SEQ ID NO: 130903 - DNA, 25 bp, E. coli
gggtatatccagtacactccacgct

SEQ ID NO: 130904 - DNA, 25 bp, E. coli
taatgattccatgaatcctggcgca

SEQ ID NO: 130905 - DNA, 25 bp, E. coli
tcaaccagcattgggtatatccagt

SEQ ID NO: 130906 - DNA, 25 bp, E. coli
taatgattccatcaatcctggcgca

SEQ ID NO: 130907 - DNA, 25 bp, E. coli
taacagaacgtttccatacaccgct

SEQ ID NO: 130908 - DNA, 25 bp, E. coli
taacagaacgttaccatacaccgct

SEQ ID NO: 130909 - DNA, 25 bp, E. coli
tcaaccagcattcggtatatccagt

SEQ ID NO: 130910 - DNA, 25 bp, E. coli
taacgggccatttcatgtaacagaa

SEQ ID NO: 130911 - DNA, 25 bp, E. coli
cacagaagcgtacaacgttatgtct

SEQ ID NO: 130912 - DNA, 25 bp, E. coli
cacagaagcgtagaacgttatgtct

SEQ ID NO: 130913 - DNA, 25 bp, E. coli
caaaccgttcatttatcacaaaagg

SEQ ID NO: 130914 - DNA, 25 bp, E. coli
caaaccgttcatatatcacaaaagg

SEQ ID NO: 130915 - DNA, 25 bp, E. coli
cataaattaaaaacgcacagaagcg

SEQ ID NO: 130916 - DNA, 25 bp, E. coli
cataaattaaaatcgcacagaagcg

SEQ ID NO: 130917 - DNA, 25 bp, E. coli
taaatatgcaaacataaatgcgcag

SEQ ID NO: 130918 - DNA, 25 bp, E. coli
taaatatgcaaagataaatgcgcag

SEQ ID NO: 130919 - DNA, 25 bp, E. coli
tatgtggaaattctcgaagagagca

SEQ ID NO: 130920 - DNA, 25 bp, E. coli
tatgtggaaattgtcgaagagagca

SEQ ID NO: 130921 - DNA, 25 bp, E. coli
tatatttgcttgtacgattcaccgt

SEQ ID NO: 130922 - DNA, 25 bp, E. coli
tatatttgcttgaacgattcaccgt

SEQ ID NO: 130923 - DNA, 25 bp, E. coli
tgttcttcccgtgatgcagacataa

SEQ ID NO: 130924 - DNA, 25 bp, E. coli
tgttcttcccgtcatgcagacataa

SEQ ID NO: 130925 - DNA, 25 bp, E. coli
gcgcaacgctgggatcagtcttaaa

SEQ ID NO: 130926 - DNA, 25 bp, E. coli
gcgcaacgctggcatcagtcttaaa

SEQ ID NO: 130927 - DNA, 25 bp, E. coli
gcgcagaaatgtctttctcaaaccg

SEQ ID NO: 130928 - DNA, 25 bp, E. coli
gcgcagaaatgtgtttctcaaaccg

SEQ ID NO: 130929 - DNA, 25 bp, E. coli
gaagagagcagaattgcgcaacgct

SEQ ID NO: 130930 - DNA, 25 bp, E. coli
gaagagagcagatttgcgcaacgct

SEQ ID NO: 130931 - DNA, 25 bp, E. coli
cgtttataccgaaggtttatgtgga

SEQ ID NO: 130932 - DNA, 25 bp, E. coli
cgtttataccgatggtttatgtgga

SEQ ID NO: 130933 - DNA, 25 bp, E. coli
tacccgtactatcgccgcgacgttg

SEQ ID NO: 130934 - DNA, 25 bp, E. coli
tacccgtactatggccgcgacgttg

SEQ ID NO: 130935 - DNA, 25 bp, E. coli
aaaaacatcccgatcagtatcgcga

SEQ ID NO: 130936 - DNA, 25 bp, E. coli
aaaaacatcccgttcagtatcgcga

SEQ ID NO: 130937 - DNA, 25 bp, E. coli
tatcgcgatctggtagtgcgtgtcg

SEQ ID NO: 130938 - DNA, 25 bp, E. coli
tatcgcgatctgctagtgcgtgtcg

SEQ ID NO: 130939 - DNA, 25 bp, E. coli
tgcgtacaggtgttccgttgcggct

SEQ ID NO: 130940 - DNA, 25 bp, E. coli
tcccgatcagtaacgcgatctggta

SEQ ID NO: 130941 - DNA, 25 bp, E. coli
tcccgatcagtatcgcgatctggta

SEQ ID NO: 130942 - DNA, 25 bp, E. coli
tgcgtacaggtgatccgttgcggct

SEQ ID NO: 130943 - DNA, 25 bp, E. coli
tcagtatcgcgaactggtagtgcgt

SEQ ID NO: 130944 - DNA, 25 bp, E. coli
tcagtatcgcgatctggtagtgcgt

SEQ ID NO: 130945 - DNA, 25 bp, E. coli
gcgaaaaaacatgccgatcagtatc

SEQ ID NO: 130946 - DNA, 25 bp, E. coli
gcgaaaaaacatcccgatcagtatc

SEQ ID NO: 130947 - DNA, 25 bp, E. coli
gcggcaactatttcgcgggtacgtc

SEQ ID NO: 130948 - DNA, 25 bp, E. coli
gcggcaactattacgcgggtacgtc

SEQ ID NO: 130949 - DNA, 25 bp, E. coli
cgtacaggtgatccgttgcggcttc

SEQ ID NO: 130950 - DNA, 25 bp, E. coli
cgtacaggtgatgcgttgcggcttc

SEQ ID NO: 130951 - DNA, 25 bp, E. coli
tggcggcaactattacgcgggtacg

SEQ ID NO: 130952 - DNA, 25 bp, E. coli
tggcggcaactaatacgcgggtacg

SEQ ID NO: 130953 - DNA, 25 bp, E. coli
gacgcctgcgtagaggtgatccgtt

SEQ ID NO: 130954 - DNA, 25 bp, E. coli
gacgcctgcgtacaggtgatccgtt

SEQ ID NO: 130955 - DNA, 25 bp, E. coli
gaagttccgccctgttttattgccg

SEQ ID NO: 130956 - DNA, 25 bp, E. coli
caacgggaacgattgctgagcaacg

SEQ ID NO: 130957 - DNA, 25 bp, E. coli
gaagttccgcccagttttattgccg

SEQ ID NO: 130958 - DNA, 25 bp, E. coli
caacgggaacgaatgctgagcaacg

SEQ ID NO: 130959 - DNA, 25 bp, E. coli
catggaggcggttttattctcggca

SEQ ID NO: 130960 - DNA, 25 bp, E. coli
catggaggcggtattattctcggca

SEQ ID NO: 130961 - DNA, 25 bp, E. coli
tacgggattccgagactcgtcgtct

SEQ ID NO: 130962 - DNA, 25 bp, E. coli
tacgggattccgtgactcgtcgtct

SEQ ID NO: 130963 - DNA, 25 bp, E. coli
tattcacggatgatgaaaaccgccg

SEQ ID NO: 130964 - DNA, 25 bp, E. coli
tattcacggatgttgaaaaccgccg

SEQ ID NO: 130965 - DNA, 25 bp, E. coli
tgttatttccacgagcaggcggagg

SEQ ID NO: 130966 - DNA, 25 bp, E. coli
tgttatttccaccagcaggcggagg

SEQ ID NO: 130967 - DNA, 25 bp, E. coli
tgagttcaaactctacccaggcacg

SEQ ID NO: 130968 - DNA, 25 bp, E. coli
tgagttcaaactgtacccaggcacg

SEQ ID NO: 130969 - DNA, 25 bp, E. coli
tctgggatggcttaacgcaacagga

SEQ ID NO: 130970 - DNA, 25 bp, E. coli
tctgggatggctaaacgcaacagga

SEQ ID NO: 130971 - DNA, 25 bp, E. coli
ccggtgattccgcaggtgccatgct

SEQ ID NO: 130972 - DNA, 25 bp, E. coli
ccggtgattccggaggtgccatgct

SEQ ID NO: 130973 - DNA, 25 bp, E. coli
gacagtattacacgcttgagcgccg

SEQ ID NO: 130974 - DNA, 25 bp, E. coli
gacagtattacaggcttgagcgccg

SEQ ID NO: 130975 - DNA, 25 bp, E. coli
taatgatctcactcgcgaagttccg

SEQ ID NO: 130976 - DNA, 25 bp, E. coli
taatgatctcacacgcgaagttccg

SEQ ID NO: 130977 - DNA, 25 bp, E. coli
cagcgtaacaccttcaaaacacaaa

SEQ ID NO: 130978 - DNA, 25 bp, E. coli
cagcgtaacaccatcaaaacacaaa

SEQ ID NO: 130979 - DNA, 25 bp, E. coli
catgtacggttatcgggcgaactga

SEQ ID NO: 130980 - DNA, 25 bp, E. coli
catgtacggttaacgggcgaactga

SEQ ID NO: 130981 - DNA, 25 bp, E. coli
taaagtcacgttaaagcatgtacgg

SEQ ID NO: 130982 - DNA, 25 bp, E. coli
taaagtcacgtttaagcatgtacgg

SEQ ID NO: 130983 - DNA, 25 bp, E. coli
taaaattattctcgccgtcggtcag

SEQ ID NO: 130984 - DNA, 25 bp, E. coli
taaaattattctggccgtcggtcag

SEQ ID NO: 130985 - DNA, 25 bp, E. coli
tatgagaaagaaccgcaccccggtg

SEQ ID NO: 130986 - DNA, 25 bp, E. coli
tatgagaaagaagcgcaccccggtg

SEQ ID NO: 130987 - DNA, 25 bp, E. coli
tcgccgtcggtcagcatgccagact

SEQ ID NO: 130988 - DNA, 25 bp, E. coli
tcgccgtcggtctgcatgccagact

SEQ ID NO: 130989 - DNA, 25 bp, E. coli
gcgaactgacgaaggcggcagataa

SEQ ID NO: 130990 - DNA, 25 bp, E. coli
gcgaactgacgatggcggcagataa

SEQ ID NO: 130991 - DNA, 25 bp, E. coli
gatttatgagaaagaagcgcacccc

SEQ ID NO: 130992 - DNA, 25 bp, E. coli
gatttatgagaatgaagcgcacccc

SEQ ID NO: 130993 - DNA, 25 bp, E. coli
gttatcaagcggatccgggctaccg

SEQ ID NO: 130994 - DNA, 25 bp, E. coli
gttatcaagcggttccgggctaccg

SEQ ID NO: 130995 - DNA, 25 bp, E. coli
taagcatgtacggttatcgggcgaa

SEQ ID NO: 130996 - DNA, 25 bp, E. coli
taagcatgtacgcttatcgggcgaa

SEQ ID NO: 130997 - DNA, 25 bp, E. coli
gacgatggcggctgataaaattatt

SEQ ID NO: 130998 - DNA, 25 bp, E. coli
gacgatggcggcagataaaattatt

SEQ ID NO: 130999 - DNA, 25 bp, E. coli
aatattgcggcgaactacggtggac

SEQ ID NO: 131000 - DNA, 25 bp, E. coli
aatattgcggcgtactacggtggac

SEQ ID NO: 131001 - DNA, 25 bp, E. coli
tagtagtgaaaagtggaaccgacca

SEQ ID NO: 131002 - DNA, 25 bp, E. coli
accgagcccggtcatgaaacagcct

SEQ ID NO: 131003 - DNA, 25 bp, E. coli
accgagcccggtgatgaaacagcct

SEQ ID NO: 131004 - DNA, 25 bp, E. coli
tagcgaagtaaaaagtctgcaccga

SEQ ID NO: 131005 - DNA, 25 bp, E. coli
tagcgaaaaattgccagcgcatggc

SEQ ID NO: 131006 - DNA, 25 bp, E. coli
tatagtccagggagtcaggcaactg

SEQ ID NO: 131007 - DNA, 25 bp, E. coli
tagcgaagtaaatagtctgcaccga

SEQ ID NO: 131008 - DNA, 25 bp, E. coli
tagcgaaaaattcccagcgcatggc

SEQ ID NO: 131009 - DNA, 25 bp, E. coli
tatagtccagggtgtcaggcaactg

SEQ ID NO: 131010 - DNA, 25 bp, E. coli
ttttgcggccaagaacggtattgag

SEQ ID NO: 131011 - DNA, 25 bp, E. coli
ttttgcggccaacaacggtattgag

SEQ ID NO: 131012 - DNA, 25 bp, E. coli
tgtatgcatgaagtggcccctgtag

SEQ ID NO: 131013 - DNA, 25 bp, E. coli
tgtatgcatgaactggcccctgtag

SEQ ID NO: 131014 - DNA, 25 bp, E. coli
tctgaagcgctatcagccgggaata

SEQ ID NO: 131015 - DNA, 25 bp, E. coli
tctgaagcgctaacagccgggaata

SEQ ID NO: 131016 - DNA, 25 bp, E. coli
ccgggaataccggtctgacgctgaa

SEQ ID NO: 131017 - DNA, 25 bp, E. coli
ccgggaataccgctctgacgctgaa

SEQ ID NO: 131018 - DNA, 25 bp, E. coli
taatcgagagcgacgtttcggcggc

SEQ ID NO: 131019 - DNA, 25 bp, E. coli
taatcgagagcgtcgtttcggcggc

SEQ ID NO: 131020 - DNA, 25 bp, E. coli
tagtagtgaaaactggaaccgacca

SEQ ID NO: 131021 - DNA, 25 bp, E. coli
aatgctgtacttgtgtacggtggtc

SEQ ID NO: 131022 - DNA, 25 bp, E. coli
aatgctgtacttctgtacggtggtc

SEQ ID NO: 131023 - DNA, 25 bp, E. coli
cagttaatgctgtacttctgtacgg

SEQ ID NO: 131024 - DNA, 25 bp, E. coli
cagttaatgctgaacttctgtacgg

SEQ ID NO: 131025 - DNA, 25 bp, E. coli
tacggtggtctgagtgctgtatctc

SEQ ID NO: 131026 - DNA, 25 bp, E. coli
tacttctgtacggtggtctgtgtgc

SEQ ID NO: 131027 - DNA, 25 bp, E. coli
tacttctgtacgctggtctgtgtgc

SEQ ID NO: 131028 - DNA, 25 bp, E. coli
tacggtggtctgtgtgctgtatctc

SEQ ID NO: 131029 - DNA, 25 bp, E. coli
acggtggtctgtgtgctgtatctcc

SEQ ID NO: 131030 - DNA, 25 bp, E. coli
acggtggtctgtctgctgtatctcc

SEQ ID NO: 131031 - DNA, 25 bp, E. coli
tttctgaaccagttaatgctgtact

SEQ ID NO: 131032 - DNA, 25 bp, E. coli
tttctgaaccagataatgctgtact

SEQ ID NO: 131033 - DNA, 25 bp, E. coli
tgctgtacttctctacggtggtctg

SEQ ID NO: 131034 - DNA, 25 bp, E. coli
tgaaccagttaatgctgtacttctg

SEQ ID NO: 131035 - DNA, 25 bp, E. coli
tgaaccagttaaagctgtacttctg

SEQ ID NO: 131036 - DNA, 25 bp, E. coli
tgctgtacttctgtacggtggtctg

SEQ ID NO: 131037 - DNA, 25 bp, E. coli
tctgtacggtggactgtgtgctgta

SEQ ID NO: 131038 - DNA, 25 bp, E. coli
tctgtacggtggtctgtgtgctgta

SEQ ID NO: 131039 - DNA, 25 bp, E. coli
gacatttctgaagcagttaatgctg

SEQ ID NO: 131040 - DNA, 25 bp, E. coli
gacatttctgaaccagttaatgctg

SEQ ID NO: 131041 - DNA, 25 bp, E. coli
cttctgtacggtggtctgtgtgctg

SEQ ID NO: 131042 - DNA, 25 bp, E. coli
cttctgtacggtcgtctgtgtgctg

SEQ ID NO: 131043 - DNA, 25 bp, E. coli
aatggtttcaccgtgcattcgctaa

SEQ ID NO: 131044 - DNA, 25 bp, E. coli
aatggtttcaccctgcattcgctaa

SEQ ID NO: 131045 - DNA, 25 bp, E. coli
taaaaacgatgaatgtcgggaatgg

SEQ ID NO: 131046 - DNA, 25 bp, E. coli
taaaaacgatgattgtcgggaatgg

SEQ ID NO: 131047 - DNA, 25 bp, E. coli
atcagtggtggtcctctccagagtg

SEQ ID NO: 131048 - DNA, 25 bp, E. coli
atcagtggtggtgctctccagagtg

SEQ ID NO: 131049 - DNA, 25 bp, E. coli
tgtcgggaatggattcaccctgcat

SEQ ID NO: 131050 - DNA, 25 bp, E. coli
tgtcgggaatggtttcaccctgcat

SEQ ID NO: 131051 - DNA, 25 bp, E. coli
tgcattcgctaaacagtggtggtgc

SEQ ID NO: 131052 - DNA, 25 bp, E. coli
tgaatgtcgggaatggtttcaccct

SEQ ID NO: 131053 - DNA, 25 bp, E. coli
tgcattcgctaatcagtggtggtgc

SEQ ID NO: 131054 - DNA, 25 bp, E. coli
tgaatgtcgggattggtttcaccct

SEQ ID NO: 131055 - DNA, 25 bp, E. coli
gcgaagacgatgaaaaaacgatgaa

SEQ ID NO: 131056 - DNA, 25 bp, E. coli
gcgaagacgatgtaaaaacgatgaa

SEQ ID NO: 131057 - DNA, 25 bp, E. coli
cgatgtaaaaacgatgaatgtcggg

SEQ ID NO: 131058 - DNA, 25 bp, E. coli
cgatgtaaaaaccatgaatgtcggg

SEQ ID NO: 131059 - DNA, 25 bp, E. coli
ctctccagagtgaggaaccaagata

SEQ ID NO: 131060 - DNA, 25 bp, E. coli
ctctccagagtgtggaaccaagata

SEQ ID NO: 131061 - DNA, 25 bp, E. coli
ggtgctctccagtgtgtggaaccaa

SEQ ID NO: 131062 - DNA, 25 bp, E. coli
ggtgctctccagagtgtggaaccaa

SEQ ID NO: 131063 - DNA, 25 bp, E. coli
tcaccctgcattggctaatcagtgg

SEQ ID NO: 131064 - DNA, 25 bp, E. coli
tcaccctgcattcgctaatcagtgg

SEQ ID NO: 131065 - DNA, 25 bp, E. coli
caaaatattcgcaggttattatgcc

SEQ ID NO: 131066 - DNA, 25 bp, E. coli
caacagcgacaaaatattcgctggt

SEQ ID NO: 131067 - DNA, 25 bp, E. coli
caaaatattcgctggttattatgcc

SEQ ID NO: 131068 - DNA, 25 bp, E. coli
caacagcgacaatatattcgctggt

SEQ ID NO: 131069 - DNA, 25 bp, E. coli
atgctgacacttgcccgccaacaac

SEQ ID NO: 131070 - DNA, 25 bp, E. coli
atgctgacacttccccgccaacaac

SEQ ID NO: 131071 - DNA, 25 bp, E. coli
tatgcctgtcagatttgatgctgct

SEQ ID NO: 131072 - DNA, 25 bp, E. coli
tatgcctgtcagttttgatgctgct

SEQ ID NO: 131073 - DNA, 25 bp, E. coli
ttattatgcctgacagttttgatgc

SEQ ID NO: 131074 - DNA, 25 bp, E. coli
ttctcttaagcctttgcgccggtga

SEQ ID NO: 131075 - DNA, 25 bp, E. coli
ttctcttaagccattgcgccggtga

SEQ ID NO: 131076 - DNA, 25 bp, E. coli
ttattatgcctgtcagttttgatgc

SEQ ID NO: 131077 - DNA, 25 bp, E. coli
tgctggcgcttctcttaagcctttg

SEQ ID NO: 131078 - DNA, 25 bp, E. coli
tgctgctggcgcttctcttaagcct

SEQ ID NO: 131079 - DNA, 25 bp, E. coli
tgctgctggcgcatctcttaagcct

SEQ ID NO: 131080 - DNA, 25 bp, E. coli
tgctggcgcttcacttaagcctttg

SEQ ID NO: 131081 - DNA, 25 bp, E. coli
cctgtcagttttgatgctgctggcg

SEQ ID NO: 131082 - DNA, 25 bp, E. coli
cctgtcagttttcatgctgctggcg

SEQ ID NO: 131083 - DNA, 25 bp, E. coli
gcgacaaaatatacgctggttatta

SEQ ID NO: 131084 - DNA, 25 bp, E. coli
gcgacaaaatattcgctggttatta

SEQ ID NO: 131085 - DNA, 25 bp, E. coli
tggcgcttctcttaagcctttgcgc

SEQ ID NO: 131086 - DNA, 25 bp, E. coli
tggcgcttctctaaagcctttgcgc

SEQ ID NO: 131087 - DNA, 25 bp, E. coli
caaaaggctccgaaagtcaatggat

SEQ ID NO: 131088 - DNA, 25 bp, E. coli
caaaaggctccgtaagtcaatggat

SEQ ID NO: 131089 - DNA, 25 bp, E. coli
cactggcgcatctaaaggctccgta

SEQ ID NO: 131090 - DNA, 25 bp, E. coli
cactggcgcatcaaaaggctccgta

SEQ ID NO: 131091 - DNA, 25 bp, E. coli
tatctgaacgcataacccaacgtat

SEQ ID NO: 131092 - DNA, 25 bp, E. coli
tatgcatgcgctaaacttgaaaggc

SEQ ID NO: 131093 - DNA, 25 bp, E. coli
tatgcatgcgcttaacttgaaaggc

SEQ ID NO: 131094 - DNA, 25 bp, E. coli
tatctgaacgcaaaacccaacgtat

SEQ ID NO: 131095 - DNA, 25 bp, E. coli
tgaacaagcaaacaatatctgaacg

SEQ ID NO: 131096 - DNA, 25 bp, E. coli
tgaacaagcaaagaatatctgaacg

SEQ ID NO: 131097 - DNA, 25 bp, E. coli
gcaaagaccttgtcaatgccactgg

SEQ ID NO: 131098 - DNA, 25 bp, E. coli
gcaaagaccttgacaatgccactgg

SEQ ID NO: 131099 - DNA, 25 bp, E. coli
cgctaaacttgaaaggcaaagacct

SEQ ID NO: 131100 - DNA, 25 bp, E. coli
cgtaagtcaatggatgaacggtgga

SEQ ID NO: 131101 - DNA, 25 bp, E. coli
cgtaagtcaatgcatgaacggtgga

SEQ ID NO: 131102 - DNA, 25 bp, E. coli
cgctaaacttgataggcaaagacct

SEQ ID NO: 131103 - DNA, 25 bp, E. coli
ggcgcatcaaaacgctccgtaagtc

SEQ ID NO: 131104 - DNA, 25 bp, E. coli
ggcgcatcaaaaggctccgtaagtc

SEQ ID NO: 131105 - DNA, 25 bp, E. coli
taacccaacgtatgcatgcgctaaa

SEQ ID NO: 131106 - DNA, 25 bp, E. coli
taacccaacgtaagcatgcgctaaa

SEQ ID NO: 131107 - DNA, 25 bp, E. coli
gaccttgtcaatcccactggcgcat

SEQ ID NO: 131108 - DNA, 25 bp, E. coli
gaccttgtcaatgccactggcgcat

SEQ ID NO: 131109 - DNA, 25 bp, E. coli
aatatgtggagttcgcgcaaaaccg

SEQ ID NO: 131110 - DNA, 25 bp, E. coli
aatatgtggagtacgcgcaaaaccg

SEQ ID NO: 131111 - DNA, 25 bp, E. coli
taaagcgtcctgtgaaaggtcgtgc

SEQ ID NO: 131112 - DNA, 25 bp, E. coli
taaaggcagactaaacgcttatggc

SEQ ID NO: 131113 - DNA, 25 bp, E. coli
taaagcgtcctgagaaaggtcgtgc

SEQ ID NO: 131114 - DNA, 25 bp, E. coli
taaaggcagacttaacgcttatggc

SEQ ID NO: 131115 - DNA, 25 bp, E. coli
tttgttgaacaaactgacccctggg

SEQ ID NO: 131116 - DNA, 25 bp, E. coli
tttgttgaacaatctgacccctggg

SEQ ID NO: 131117 - DNA, 25 bp, E. coli
tgcagcaagcgttgtccgaatccct

SEQ ID NO: 131118 - DNA, 25 bp, E. coli
tgcagcaagcgtagtccgaatccct

SEQ ID NO: 131119 - DNA, 25 bp, E. coli
tcgtacctgatagcgacgccgcatt

SEQ ID NO: 131120 - DNA, 25 bp, E. coli
tcgtacctgataccgacgccgcatt

SEQ ID NO: 131121 - DNA, 25 bp, E. coli
cgcttatggcgtcgttgttcatgca

SEQ ID NO: 131122 - DNA, 25 bp, E. coli
cgcttatggcgtggttgttcatgca

SEQ ID NO: 131123 - DNA, 25 bp, E. coli
ggtggcagctatacaactggcaaga

SEQ ID NO: 131124 - DNA, 25 bp, E. coli
ggtggcagctattcaactggcaaga

SEQ ID NO: 131125 - DNA, 25 bp, E. coli
ggtaaatactgggactatcgcgact

SEQ ID NO: 131126 - DNA, 25 bp, E. coli
ggtaaatactggcactatcgcgact

SEQ ID NO: 131127 - DNA, 25 bp, E. coli
ggtcgtgcaccgatcccggaatatg

SEQ ID NO: 131128 - DNA, 25 bp, E. coli
ggtcgtgcaccgttcccggaatatg

SEQ ID NO: 131129 - DNA, 25 bp, E. coli
taaccagttcccttgtaatgcacgt

SEQ ID NO: 131130 - DNA, 25 bp, E. coli
taaccagttcccatgtaatgcacgt

SEQ ID NO: 131131 - DNA, 25 bp, E. coli
tacgtgcgggtttttgatttccttt

SEQ ID NO: 131132 - DNA, 25 bp, E. coli
tacgtgcgggttattgatttccttt

SEQ ID NO: 131133 - DNA, 25 bp, E. coli
tatcagcatgttccaaaacaccctg

SEQ ID NO: 131134 - DNA, 25 bp, E. coli
tattgggttatcttagcgtgctaac

SEQ ID NO: 131135 - DNA, 25 bp, E. coli
tattatttgctcaacacgtaacccg

SEQ ID NO: 131136 - DNA, 25 bp, E. coli
tatcagcatgttgcaaaacaccctg

SEQ ID NO: 131137 - DNA, 25 bp, E. coli
tatacacaggattacccgcataacc

SEQ ID NO: 131138 - DNA, 25 bp, E. coli
tatacacaggataacccgcataacc

SEQ ID NO: 131139 - DNA, 25 bp, E. coli
tattatttgctctacacgtaacccg

SEQ ID NO: 131140 - DNA, 25 bp, E. coli
tattgggttatcatagcgtgctaac

SEQ ID NO: 131141 - DNA, 25 bp, E. coli
ttcgcctgcgggatataatcgtgct

SEQ ID NO: 131142 - DNA, 25 bp, E. coli
ttcgcctgcgggttataatcgtgct

SEQ ID NO: 131143 - DNA, 25 bp, E. coli
tgttacttcagtaattcgcctgcgg

SEQ ID NO: 131144 - DNA, 25 bp, E. coli
tgttacttcagttattcgcctgcgg

SEQ ID NO: 131145 - DNA, 25 bp, E. coli
tgcgggttacgcttgactgtccggt

SEQ ID NO: 131146 - DNA, 25 bp, E. coli
tgcgggttacgcatgactgtccggt

SEQ ID NO: 131147 - DNA, 25 bp, E. coli
gcgggttataaaagcccttttgcgg

SEQ ID NO: 131148 - DNA, 25 bp, E. coli
gcgggttataaatgcccttttgcgg

SEQ ID NO: 131149 - DNA, 25 bp, E. coli
gcaaaacgctcaaaataacccgcaa

SEQ ID NO: 131150 - DNA, 25 bp, E. coli
gcaaaacgctcataataacccgcaa

SEQ ID NO: 131151 - DNA, 25 bp, E. coli
taatcgtgctttagcgggttataaa

SEQ ID NO: 131152 - DNA, 25 bp, E. coli
taatcgtgcttttgcgggttataaa

SEQ ID NO: 131153 - DNA, 25 bp, E. coli
cagactgttcctgtggcgtaaacgt

SEQ ID NO: 131154 - DNA, 25 bp, E. coli
cagactgttcctctggcgtaaacgt

SEQ ID NO: 131155 - DNA, 25 bp, E. coli
taaacgaaggctgccagctgtcaca

SEQ ID NO: 131156 - DNA, 25 bp, E. coli
taaacgaaggctcccagctgtcaca

SEQ ID NO: 131157 - DNA, 25 bp, E. coli
tttatattggtcaggaactttgccc

SEQ ID NO: 131158 - DNA, 25 bp, E. coli
tttatattggtctggaactttgccc

SEQ ID NO: 131159 - DNA, 25 bp, E. coli
tatctgtgcgcgttactctaactgg

SEQ ID NO: 131160 - DNA, 25 bp, E. coli
tatctgtgcgcgatactctaactgg

SEQ ID NO: 131161 - DNA, 25 bp, E. coli
tgaacgggcgtaagtacgtcatctg

SEQ ID NO: 131162 - DNA, 25 bp, E. coli
tgaacgggcgtatgtacgtcatctg

SEQ ID NO: 131163 - DNA, 25 bp, E. coli
tcttaatgcgctgtgtgatggacta

SEQ ID NO: 131164 - DNA, 25 bp, E. coli
tcttaatgcgctctgtgatggacta

SEQ ID NO: 131165 - DNA, 25 bp, E. coli
gctgtcacaggaacgatggcctttt

SEQ ID NO: 131166 - DNA, 25 bp, E. coli
gctgtcacaggatcgatggcctttt

SEQ ID NO: 131167 - DNA, 25 bp, E. coli
cccgatgagtgtcaatatgtgaacg

SEQ ID NO: 131168 - DNA, 25 bp, E. coli
cccgatgagtgtgaatatgtgaacg

SEQ ID NO: 131169 - DNA, 25 bp, E. coli
ctaactggcactggaacgtcggcga

SEQ ID NO: 131170 - DNA, 25 bp, E. coli
ctaactggcactcgaacgtcggcga

SEQ ID NO: 131171 - DNA, 25 bp, E. coli
gggttaccggtggatcagactgttc

SEQ ID NO: 131172 - DNA, 25 bp, E. coli
gggttaccggtgcatcagactgttc

SEQ ID NO: 131173 - DNA, 25 bp, E. coli
taagtaatggaatattgaacgggcg

SEQ ID NO: 131174 - DNA, 25 bp, E. coli
taagtaatggaaaattgaacgggcg

SEQ ID NO: 131175 - DNA, 25 bp, E. coli
aataacgtcctgtacaaattgtcca

SEQ ID NO: 131176 - DNA, 25 bp, E. coli
caaagtaaagtgctcaagccccgcg

SEQ ID NO: 131177 - DNA, 25 bp, E. coli
caaagtaaagtggtcaagccccgcg

SEQ ID NO: 131178 - DNA, 25 bp, E. coli
cagtgttgcttctcgtcatcgcgga

SEQ ID NO: 131179 - DNA, 25 bp, E. coli
cagtgttgcttcacgtcatcgcgga

SEQ ID NO: 131180 - DNA, 25 bp, E. coli
actaaagcgcgtagcgccagtgctg

SEQ ID NO: 131181 - DNA, 25 bp, E. coli
actaaagcgcgttgcgccagtgctg

SEQ ID NO: 131182 - DNA, 25 bp, E. coli
aataacgtcctgaacaaattgtcca

SEQ ID NO: 131183 - DNA, 25 bp, E. coli
tatgatgacggagcgaaaaagacat

SEQ ID NO: 131184 - DNA, 25 bp, E. coli
tatgatgacggaccgaaaaagacat

SEQ ID NO: 131185 - DNA, 25 bp, E. coli
tattttcacttctttacctgagcgg

SEQ ID NO: 131186 - DNA, 25 bp, E. coli
tattttcacttcattacctgagcgg

SEQ ID NO: 131187 - DNA, 25 bp, E. coli
ttggcagaagaaaggactaaagcgc

SEQ ID NO: 131188 - DNA, 25 bp, E. coli
ttggcagaagaatggactaaagcgc

SEQ ID NO: 131189 - DNA, 25 bp, E. coli
tgtcctcggtagatgaacacgcctg

SEQ ID NO: 131190 - DNA, 25 bp, E. coli
tgtcctcggtagttgaacacgcctg

SEQ ID NO: 131191 - DNA, 25 bp, E. coli
tcatcgcggatgataattgtcctcg

SEQ ID NO: 131192 - DNA, 25 bp, E. coli
tcatcgcggatgttaattgtcctcg

SEQ ID NO: 131193 - DNA, 25 bp, E. coli
gcgcatagcgcatgctttggcagaa

SEQ ID NO: 131194 - DNA, 25 bp, E. coli
gcgcatagcgcaagctttggcagaa

SEQ ID NO: 131195 - DNA, 25 bp, E. coli
tcacctacgagctagatagtggatg

SEQ ID NO: 131196 - DNA, 25 bp, E. coli
tcacctacgagcaagatagtggatg

SEQ ID NO: 131197 - DNA, 25 bp, E. coli
catcccgtcccgactatagtattta

SEQ ID NO: 131198 - DNA, 25 bp, E. coli
catcccgtcccgtctatagtattta

SEQ ID NO: 131199 - DNA, 25 bp, E. coli
cgcccgtttttaactttcctgattg

SEQ ID NO: 131200 - DNA, 25 bp, E. coli
cgcccgtttttatctttcctgattg

SEQ ID NO: 131201 - DNA, 25 bp, E. coli
tatggtgggccgatatcgctttgag

SEQ ID NO: 131202 - DNA, 25 bp, E. coli
tatggtgggccgttatcgctttgag

SEQ ID NO: 131203 - DNA, 25 bp, E. coli
tccttattttatgcgcactgattac

SEQ ID NO: 131204 - DNA, 25 bp, E. coli
tccttattttatccgcactgattac

SEQ ID NO: 131205 - DNA, 25 bp, E. coli
tctatagtatttttgagggtttgct

SEQ ID NO: 131206 - DNA, 25 bp, E. coli
tctatagtatttatgagggtttgct

SEQ ID NO: 131207 - DNA, 25 bp, E. coli
cctgattgtagttatctgattttac

SEQ ID NO: 131208 - DNA, 25 bp, E. coli
cctgattgtagtaatctgattttac

SEQ ID NO: 131209 - DNA, 25 bp, E. coli
cgctttgagttcattctgatcatcc

SEQ ID NO: 131210 - DNA, 25 bp, E. coli
cgctttgagttctttctgatcatcc

SEQ ID NO: 131211 - DNA, 25 bp, E. coli
gattttactccctctttcatcccgt

SEQ ID NO: 131212 - DNA, 25 bp, E. coli
gattttactcccactttcatcccgt

SEQ ID NO: 131213 - DNA, 25 bp, E. coli
taatcataattagccaccagagtgt

SEQ ID NO: 131214 - DNA, 25 bp, E. coli
taatcataattacccaccagagtgt

SEQ ID NO: 131215 - DNA, 25 bp, E. coli
gatcatccttattttatgcgcactg

SEQ ID NO: 131216 - DNA, 25 bp, E. coli
gagggtttgcttttaataatcataa

SEQ ID NO: 131217 - DNA, 25 bp, E. coli
gatcatccttatattatgcgcactg

SEQ ID NO: 131218 - DNA, 25 bp, E. coli
gagggtttgcttataataatcataa

SEQ ID NO: 131219 - DNA, 25 bp, E. coli
taaagataaagctcttctccaggag

SEQ ID NO: 131220 - DNA, 25 bp, E. coli
taaagataaagcacttctccaggag

SEQ ID NO: 131221 - DNA, 25 bp, E. coli
tagatgcaccttgttcggcaactgg

SEQ ID NO: 131222 - DNA, 25 bp, E. coli
tagatgcaccttcttcggcaactgg

SEQ ID NO: 131223 - DNA, 25 bp, E. coli
tattcttgaggtagctccagaggcg

SEQ ID NO: 131224 - DNA, 25 bp, E. coli
tattcttgaggttgctccagaggcg

SEQ ID NO: 131225 - DNA, 25 bp, E. coli
tgagcaagggcaatcactgagcaac

SEQ ID NO: 131226 - DNA, 25 bp, E. coli
tgagcaagggcattcactgagcaac

SEQ ID NO: 131227 - DNA, 25 bp, E. coli
tgaaggcgcagttgcaattaagcgc

SEQ ID NO: 131228 - DNA, 25 bp, E. coli
tgaaggcgcagtagcaattaagcgc

SEQ ID NO: 131229 - DNA, 25 bp, E. coli
tccgatgacaggcaaacagcgtact

SEQ ID NO: 131230 - DNA, 25 bp, E. coli
tcgatattgatgagcagcgcctctc

SEQ ID NO: 131231 - DNA, 25 bp, E. coli
tccagaggcgcatgttctggcggtc

SEQ ID NO: 131232 - DNA, 25 bp, E. coli
tcgatattgatgtgcagcgcctctc

SEQ ID NO: 131233 - DNA, 25 bp, E. coli
tccagaggcgcaagttctggcggtc

SEQ ID NO: 131234 - DNA, 25 bp, E. coli
tccgatgacagggaaacagcgtact

SEQ ID NO: 131235 - DNA, 25 bp, E. coli
gcgtacgctctcacagtcagactgg

SEQ ID NO: 131236 - DNA, 25 bp, E. coli
gcgtacgctctctcagtcagactgg

SEQ ID NO: 131237 - DNA, 25 bp, E. coli
cggcaactggtgtaattcgtcgcca

SEQ ID NO: 131238 - DNA, 25 bp, E. coli
cggcaactggtgaaattcgtcgcca

SEQ ID NO: 131239 - DNA, 25 bp, E. coli
taagcgcccgcaacttaagggattg

SEQ ID NO: 131240 - DNA, 25 bp, E. coli
taagcgcccgcatcttaagggattg

SEQ ID NO: 131241 - DNA, 25 bp, E. coli
atgcgctgcgcgaagtaccggtaaa

SEQ ID NO: 131242 - DNA, 25 bp, E. coli
gggtgtcccggtgaccgaattgcgt

SEQ ID NO: 131243 - DNA, 25 bp, E. coli
atgcgctgcgcgtagtaccggtaaa

SEQ ID NO: 131244 - DNA, 25 bp, E. coli
gggtgtcccggtcaccgaattgcgt

SEQ ID NO: 131245 - DNA, 25 bp, E. coli
tattcttcgtgatgcgggtgtcccg

SEQ ID NO: 131246 - DNA, 25 bp, E. coli
tattcttcgtgaagcgggtgtcccg

SEQ ID NO: 131247 - DNA, 25 bp, E. coli
gcgaagtaccggtaaagcaattaat

SEQ ID NO: 131248 - DNA, 25 bp, E. coli
gcgaagtaccggaaaagcaattaat

SEQ ID NO: 131249 - DNA, 25 bp, E. coli
gctgcgcgaagttccggtaaagcaa

SEQ ID NO: 131250 - DNA, 25 bp, E. coli
gcgtgaatatttgcagaccggagat

SEQ ID NO: 131251 - DNA, 25 bp, E. coli
gcgtgaatatttccagaccggagat

SEQ ID NO: 131252 - DNA, 25 bp, E. coli
gctgcgcgaagtaccggtaaagcaa

SEQ ID NO: 131253 - DNA, 25 bp, E. coli
gaatatttgcagtccggagatgcgg

SEQ ID NO: 131254 - DNA, 25 bp, E. coli
gcagaccggagaagcggtggatagc

SEQ ID NO: 131255 - DNA, 25 bp, E. coli
gcagaccggagatgcggtggatagc

SEQ ID NO: 131256 - DNA, 25 bp, E. coli
gaatatttgcagaccggagatgcgg

SEQ ID NO: 131257 - DNA, 25 bp, E. coli
cccggagcgtgaatatttgcagacc

SEQ ID NO: 131258 - DNA, 25 bp, E. coli
cccggagcgtgattatttgcagacc

SEQ ID NO: 131259 - DNA, 25 bp, E. coli
cggatattcttcctgaagcgggtgt

SEQ ID NO: 131260 - DNA, 25 bp, E. coli
cggatattcttcgtgaagcgggtgt

SEQ ID NO: 131261 - DNA, 25 bp, E. coli
ggagcgtgaatatttgcagaccgga

SEQ ID NO: 131262 - DNA, 25 bp, E. coli
ggagcgtgaataattgcagaccgga

SEQ ID NO: 131263 - DNA, 25 bp, E. coli
cacgtttcacttacgaattatgagc

SEQ ID NO: 131264 - DNA, 25 bp, E. coli
cacgtttcactttcgaattatgagc

SEQ ID NO: 131265 - DNA, 25 bp, E. coli
taaattaaatgtgaattgccgcaca

SEQ ID NO: 131266 - DNA, 25 bp, E. coli
tactatggctaaatggtaaaaaacg

SEQ ID NO: 131267 - DNA, 25 bp, E. coli
taaattaaatgtcaattgccgcaca

SEQ ID NO: 131268 - DNA, 25 bp, E. coli
tactatggctaattggtaaaaaacg

SEQ ID NO: 131269 - DNA, 25 bp, E. coli
tatgcgcgaaatgaaacaattcatg

SEQ ID NO: 131270 - DNA, 25 bp, E. coli
tatgcgcgaaatcaaacaattcatg

SEQ ID NO: 131271 - DNA, 25 bp, E. coli
ttgccgcacacattattaaataaga

SEQ ID NO: 131272 - DNA, 25 bp, E. coli
ttgccgcacacaatattaaataaga

SEQ ID NO: 131273 - DNA, 25 bp, E. coli
tgagttgccgcgttgttaagaaaac

SEQ ID NO: 131274 - DNA, 25 bp, E. coli
tgagttgccgcgatgttaagaaaac

SEQ ID NO: 131275 - DNA, 25 bp, E. coli
cctgattcagtgtgagaacctgccg

SEQ ID NO: 131276 - DNA, 25 bp, E. coli
cctgattcagtgagagaacctgccg

SEQ ID NO: 131277 - DNA, 25 bp, E. coli
gaacctgccgtttcttgagttgccg

SEQ ID NO: 131278 - DNA, 25 bp, E. coli
gaacctgccgttacttgagttgccg

SEQ ID NO: 131279 - DNA, 25 bp, E. coli
ccgtggcccgtggtcttatttatga

SEQ ID NO: 131280 - DNA, 25 bp, E. coli
cgaattatgagccaatatgcgcgaa

SEQ ID NO: 131281 - DNA, 25 bp, E. coli
cgaattatgagcgaatatgcgcgaa

SEQ ID NO: 131282 - DNA, 25 bp, E. coli
ccgtggcccgtgctcttatttatga

SEQ ID NO: 131283 - DNA, 25 bp, E. coli
tcaaaatgacgcttgaaatcacgtt

SEQ ID NO: 131284 - DNA, 25 bp, E. coli
tcaaaatgacgcatgaaatcacgtt

SEQ ID NO: 131285 - DNA, 25 bp, E. coli
aatcctcgggactgtgaccaaaaag

SEQ ID NO: 131286 - DNA, 25 bp, E. coli
cacgcgcatcatgaacgttagctta

SEQ ID NO: 131287 - DNA, 25 bp, E. coli
cacgcgcatcatcaacgttagctta

SEQ ID NO: 131288 - DNA, 25 bp, E. coli
cagtgaccaaaatgtgcaaagttaa

SEQ ID NO: 131289 - DNA, 25 bp, E. coli
cagtgaccaaaaagtgcaaagttaa

SEQ ID NO: 131290 - DNA, 25 bp, E. coli
aatcctcgggacagtgaccaaaaag

SEQ ID NO: 131291 - DNA, 25 bp, E. coli
tgctggcaatgatcatgagaaagag

SEQ ID NO: 131292 - DNA, 25 bp, E. coli
tgctggcaatgaacatgagaaagag

SEQ ID NO: 131293 - DNA, 25 bp, E. coli
gccaatcctcggcacagtgaccaaa

SEQ ID NO: 131294 - DNA, 25 bp, E. coli
cctgcgtgctggcaatgatcatgag

SEQ ID NO: 131295 - DNA, 25 bp, E. coli
cctgcgtgctgggaatgatcatgag

SEQ ID NO: 131296 - DNA, 25 bp, E. coli
gccaatcctcgggacagtgaccaaa

SEQ ID NO: 131297 - DNA, 25 bp, E. coli
gacagtgaccaaaaagtgcaaagtt

SEQ ID NO: 131298 - DNA, 25 bp, E. coli
gacagtgaccaataagtgcaaagtt

SEQ ID NO: 131299 - DNA, 25 bp, E. coli
ccgattaccgagcagtttattcgcg

SEQ ID NO: 131300 - DNA, 25 bp, E. coli
ccgattaccgaggagtttattcgcg

SEQ ID NO: 131301 - DNA, 25 bp, E. coli
gtgaataagatcctgcgtgctggca

SEQ ID NO: 131302 - DNA, 25 bp, E. coli
gtgaataagatcgtgcgtgctggca

SEQ ID NO: 131303 - DNA, 25 bp, E. coli
ggaacgcacgcggatcatgaacgtt

SEQ ID NO: 131304 - DNA, 25 bp, E. coli
ggaacgcacgcgcatcatgaacgtt

SEQ ID NO: 131305 - DNA, 25 bp, E. coli
taagatcctgcgagctggcaatgat

SEQ ID NO: 131306 - DNA, 25 bp, E. coli
taagatcctgcgtgctggcaatgat

SEQ ID NO: 131307 - DNA, 25 bp, E. coli
caaccgaagtatcggctggataacg

SEQ ID NO: 131308 - DNA, 25 bp, E. coli
aagtatcggctgcataacggcgatc

SEQ ID NO: 131309 - DNA, 25 bp, E. coli
aagtatcggctggataacggcgatc

SEQ ID NO: 131310 - DNA, 25 bp, E. coli
caaccgaagtatgggctggataacg

SEQ ID NO: 131311 - DNA, 25 bp, E. coli
agtatcggctggataacggcgatct

SEQ ID NO: 131312 - DNA, 25 bp, E. coli
agtatcggctggttaacggcgatct

SEQ ID NO: 131313 - DNA, 25 bp, E. coli
tcccagcgtcgtaacgctgttacgg

SEQ ID NO: 131314 - DNA, 25 bp, E. coli
tcccagcgtcgttacgctgttacgg

SEQ ID NO: 131315 - DNA, 25 bp, E. coli
ccaaccgaagtaacggctggataac

SEQ ID NO: 131316 - DNA, 25 bp, E. coli
ccaaccgaagtatcggctggataac

SEQ ID NO: 131317 - DNA, 25 bp, E. coli
gctgttacgggataatacccgcatc

SEQ ID NO: 131318 - DNA, 25 bp, E. coli
gctgttacgggaaaatacccgcatc

SEQ ID NO: 131319 - DNA, 25 bp, E. coli
gaagtatcggctcgataacggcgat

SEQ ID NO: 131320 - DNA, 25 bp, E. coli
gaagtatcggctggataacggcgat

SEQ ID NO: 131321 - DNA, 25 bp, E. coli
ccagcgtcgttacgctgttacggga

SEQ ID NO: 131322 - DNA, 25 bp, E. coli
cgctgttacgggaaaatacccgcat

SEQ ID NO: 131323 - DNA, 25 bp, E. coli
cgctgttacgggtaaatacccgcat

SEQ ID NO: 131324 - DNA, 25 bp, E. coli
ccagcgtcgttaggctgttacggga

SEQ ID NO: 131325 - DNA, 25 bp, E. coli
cgaagtatcggcaggataacggcga

SEQ ID NO: 131326 - DNA, 25 bp, E. coli
cgaagtatcggctggataacggcga

SEQ ID NO: 131327 - DNA, 25 bp, E. coli
gtatcggctggataacggcgatctg

SEQ ID NO: 131328 - DNA, 25 bp, E. coli
gtatcggctggaaaacggcgatctg

SEQ ID NO: 131329 - DNA, 25 bp, E. coli
catggttcttacaggtggtatggcg

SEQ ID NO: 131330 - DNA, 25 bp, E. coli
cattttccccatggttcttactggt

SEQ ID NO: 131331 - DNA, 25 bp, E. coli
catggttcttactggtggtatggcg

SEQ ID NO: 131332 - DNA, 25 bp, E. coli
cattttccccatcgttcttactggt

SEQ ID NO: 131333 - DNA, 25 bp, E. coli
taaacgcctggcgaacgttgccagc

SEQ ID NO: 131334 - DNA, 25 bp, E. coli
taaacgcctggccaacgttgccagc

SEQ ID NO: 131335 - DNA, 25 bp, E. coli
tactggtggtatcgcgattaaacgc

SEQ ID NO: 131336 - DNA, 25 bp, E. coli
tactggtggtatggcgattaaacgc

SEQ ID NO: 131337 - DNA, 25 bp, E. coli
acgttgccagcattgtgtgtggctg

SEQ ID NO: 131338 - DNA, 25 bp, E. coli
acgttgccagcaatgtgtgtggctg

SEQ ID NO: 131339 - DNA, 25 bp, E. coli
tatggcgattaatcgcctggcgaac

SEQ ID NO: 131340 - DNA, 25 bp, E. coli
tatggcgattaaacgcctggcgaac

SEQ ID NO: 131341 - DNA, 25 bp, E. coli
tggtatggcgataaaacgcctggcg

SEQ ID NO: 131342 - DNA, 25 bp, E. coli
gcctggcgaacgttgccagcaatgt

SEQ ID NO: 131343 - DNA, 25 bp, E. coli
gcctggcgaacgatgccagcaatgt

SEQ ID NO: 131344 - DNA, 25 bp, E. coli
cgctgtggcaaaaacctcgacctga

SEQ ID NO: 131345 - DNA, 25 bp, E. coli
cgctgtggcaaatacctcgacctga

SEQ ID NO: 131346 - DNA, 25 bp, E. coli
cgaacgttgccagcaatgtgtgtgg

SEQ ID NO: 131347 - DNA, 25 bp, E. coli
cgaacgttgccaccaatgtgtgtgg

SEQ ID NO: 131348 - DNA, 25 bp, E. coli
gattaaacgcctcgcgaacgttgcc

SEQ ID NO: 131349 - DNA, 25 bp, E. coli
gattaaacgcctggcgaacgttgcc

SEQ ID NO: 131350 - DNA, 25 bp, E. coli
tggtatggcgattaaacgcctggcg

SEQ ID NO: 131351 - DNA, 25 bp, E. coli
tacgtcaacggctgcgaatcgtcgc

SEQ ID NO: 131352 - DNA, 25 bp, E. coli
tacgtcaacggcagcgaatcgtcgc

SEQ ID NO: 131353 - DNA, 25 bp, E. coli
agcgagctggcgtcggataccgata

SEQ ID NO: 131354 - DNA, 25 bp, E. coli
agcgagctggcgacggataccgata

SEQ ID NO: 131355 - DNA, 25 bp, E. coli
ttgccgaaacggtgcgagtagtgtt

SEQ ID NO: 131356 - DNA, 25 bp, E. coli
ttgccgaaacggagcgagtagtgtt

SEQ ID NO: 131357 - DNA, 25 bp, E. coli
tttcgttgcctttgccgaggtcgcg

SEQ ID NO: 131358 - DNA, 25 bp, E. coli
tttcgttgccttagccgaggtcgcg

SEQ ID NO: 131359 - DNA, 25 bp, E. coli
tgttttaccgcataacgctgggctg

SEQ ID NO: 131360 - DNA, 25 bp, E. coli
tgatcgtcatctgcgaccacgacaa

SEQ ID NO: 131361 - DNA, 25 bp, E. coli
tgttttaccgcaaaacgctgggctg

SEQ ID NO: 131362 - DNA, 25 bp, E. coli
tgatcgtcatctccgaccacgacaa

SEQ ID NO: 131363 - DNA, 25 bp, E. coli
gcctgaagatcagcgcgcggaaatg

SEQ ID NO: 131364 - DNA, 25 bp, E. coli
gcctgaagatcaccgcgcggaaatg

SEQ ID NO: 131365 - DNA, 25 bp, E. coli
gcgagatattggcttcgccgcacca

SEQ ID NO: 131366 - DNA, 25 bp, E. coli
gcgagatattgggttcgccgcacca

SEQ ID NO: 131367 - DNA, 25 bp, E. coli
ccgaggtcgcgcagcgctacgatta

SEQ ID NO: 131368 - DNA, 25 bp, E. coli
ccgaggtcgcgctgcgctacgatta

SEQ ID NO: 131369 - DNA, 25 bp, E. coli
gatatcgccaatgtggactcccagc

SEQ ID NO: 131370 - DNA, 25 bp, E. coli
gatatcgccaatctggactcccagc

SEQ ID NO: 131371 - DNA, 25 bp, E. coli
tggaaggaatttataccgccgaacg

SEQ ID NO: 131372 - DNA, 25 bp, E. coli
tggaaggaatttttaccgccgaacg

SEQ ID NO: 131373 - DNA, 25 bp, E. coli
cactgacgaaggagaatttgaccgc

SEQ ID NO: 131374 - DNA, 25 bp, E. coli
cactgacgaaggtgaatttgaccgc

SEQ ID NO: 131375 - DNA, 25 bp, E. coli
caccttgtagcgctctttccgttat

SEQ ID NO: 131376 - DNA, 25 bp, E. coli
caccttgtagcggtctttccgttat

SEQ ID NO: 131377 - DNA, 25 bp, E. coli
atttggtacactcacgcagctggta

SEQ ID NO: 131378 - DNA, 25 bp, E. coli
atttggtacactgacgcagctggta

SEQ ID NO: 131379 - DNA, 25 bp, E. coli
atgggtgttccgctcgccattgccc

SEQ ID NO: 131380 - DNA, 25 bp, E. coli
atgggtgttccggtcgccattgccc

SEQ ID NO: 131381 - DNA, 25 bp, E. coli
tttccgttatctacactgacgaagg

SEQ ID NO: 131382 - DNA, 25 bp, E. coli
tttccgttatcttcactgacgaagg

SEQ ID NO: 131383 - DNA, 25 bp, E. coli
ttaagcggtgttggctttgaaagcg

SEQ ID NO: 131384 - DNA, 25 bp, E. coli
ttgcttcaaccgtcgcaccttgtag

SEQ ID NO: 131385 - DNA, 25 bp, E. coli
ttgcttcaaccgacgcaccttgtag

SEQ ID NO: 131386 - DNA, 25 bp, E. coli
ttaagcggtgttcgctttgaaagcg

SEQ ID NO: 131387 - DNA, 25 bp, E. coli
tgactgccattcgtgatgcccatca

SEQ ID NO: 131388 - DNA, 25 bp, E. coli
tgactgccattcctgatgcccatca

SEQ ID NO: 131389 - DNA, 25 bp, E. coli
gctggtactggataactcgccggtt

SEQ ID NO: 131390 - DNA, 25 bp, E. coli
gctggtactggaaaactcgccggtt

SEQ ID NO: 131391 - DNA, 25 bp, E. coli
gcacgcggtgcataatggcctgact

SEQ ID NO: 131392 - DNA, 25 bp, E. coli
gcacgcggtgcaaaatggcctgact

SEQ ID NO: 131393 - DNA, 25 bp, E. coli
gatactaaaatcctcgcgggcgcac

SEQ ID NO: 131394 - DNA, 25 bp, E. coli
gatactaaaatcgtcgcgggcgcac

SEQ ID NO: 131395 - DNA, 25 bp, E. coli
cacaactacaaatagcgaatccgga

SEQ ID NO: 131396 - DNA, 25 bp, E. coli
cacaactacaaaaagcgaatccgga

SEQ ID NO: 131397 - DNA, 25 bp, E. coli
caaagggatggataagtatgctgac

SEQ ID NO: 131398 - DNA, 25 bp, E. coli
caaagggatggaaaagtatgctgac

SEQ ID NO: 131399 - DNA, 25 bp, E. coli
tacaaaaagcgaatccggaactgct

SEQ ID NO: 131400 - DNA, 25 bp, E. coli
tacaaaaagcgattccggaactgct

SEQ ID NO: 131401 - DNA, 25 bp, E. coli
cgtccacaactacaaaaagcgaatc

SEQ ID NO: 131402 - DNA, 25 bp, E. coli
cgtccacaactagaaaaagcgaatc

SEQ ID NO: 131403 - DNA, 25 bp, E. coli
tattccgcaagtcaaagtgaccgtg

SEQ ID NO: 131404 - DNA, 25 bp, E. coli
tttgaaaattaccacaaactgaccg

SEQ ID NO: 131405 - DNA, 25 bp, E. coli
tattccgcaagtgaaagtgaccgtg

SEQ ID NO: 131406 - DNA, 25 bp, E. coli
tttgaaaattacgacaaactgaccg

SEQ ID NO: 131407 - DNA, 25 bp, E. coli
ttacgacaaactgaccgatgctgac

SEQ ID NO: 131408 - DNA, 25 bp, E. coli
ttacgacaaactcaccgatgctgac

SEQ ID NO: 131409 - DNA, 25 bp, E. coli
gctgatattccggaagtcaaagtga

SEQ ID NO: 131410 - DNA, 25 bp, E. coli
gctgatattccgcaagtcaaagtga

SEQ ID NO: 131411 - DNA, 25 bp, E. coli
gaaaattacgactaactgaccgatg

SEQ ID NO: 131412 - DNA, 25 bp, E. coli
gaaaattacgacaaactgaccgatg

SEQ ID NO: 131413 - DNA, 25 bp, E. coli
gatattccgcaagtcaaagtgaccg

SEQ ID NO: 131414 - DNA, 25 bp, E. coli
gatattccgcaactcaaagtgaccg

SEQ ID NO: 131415 - DNA, 25 bp, E. coli
gatggataagtaagctgaccagctt

SEQ ID NO: 131416 - DNA, 25 bp, E. coli
gatggataagtatgctgaccagctt

SEQ ID NO: 131417 - DNA, 25 bp, E. coli
agctgtccctccagttcagctactg

SEQ ID NO: 131418 - DNA, 25 bp, E. coli
agctgtccctcctgttcagctactg

SEQ ID NO: 131419 - DNA, 25 bp, E. coli
tatcagctgtccctcctgttcagct

SEQ ID NO: 131420 - DNA, 25 bp, E. coli
tatcagctgtccgtcctgttcagct

SEQ ID NO: 131421 - DNA, 25 bp, E. coli
ttctgtttctatcagctgtccctcc

SEQ ID NO: 131422 - DNA, 25 bp, E. coli
ttctgtttctatgagctgtccctcc

SEQ ID NO: 131423 - DNA, 25 bp, E. coli
tgtccctcctgttcagctactgacg

SEQ ID NO: 131424 - DNA, 25 bp, E. coli
tgtttctatcaggtgtccctcctgt

SEQ ID NO: 131425 - DNA, 25 bp, E. coli
tgtttctatcagctgtccctcctgt

SEQ ID NO: 131426 - DNA, 25 bp, E. coli
tgtccctcctgtacagctactgacg

SEQ ID NO: 131427 - DNA, 25 bp, E. coli
tcctgttcagcttctgacggggtgg

SEQ ID NO: 131428 - DNA, 25 bp, E. coli
tcctgttcagctactgacggggtgg

SEQ ID NO: 131429 - DNA, 25 bp, E. coli
tccctcctgttctgctactgacggg

SEQ ID NO: 131430 - DNA, 25 bp, E. coli
tccctcctgttcagctactgacggg

SEQ ID NO: 131431 - DNA, 25 bp, E. coli
tctatcagctgtgcctcctgttcag

SEQ ID NO: 131432 - DNA, 25 bp, E. coli
tctatcagctgtccctcctgttcag

SEQ ID NO: 131433 - DNA, 25 bp, E. coli
gtttctatcagctgtccctcctgtt

SEQ ID NO: 131434 - DNA, 25 bp, E. coli
gtttctatcagcagtccctcctgtt

SEQ ID NO: 131435 - DNA, 25 bp, E. coli
gtggcttctgtttctatcagctgtc

SEQ ID NO: 131436 - DNA, 25 bp, E. coli
gtggcttctgttactatcagctgtc

SEQ ID NO: 131437 - DNA, 25 bp, E. coli
ggcttctgtttctatcagctgtccc

SEQ ID NO: 131438 - DNA, 25 bp, E. coli
ggcttctgtttcaatcagctgtccc

SEQ ID NO: 131439 - DNA, 25 bp, E. coli
caacggttttacctgcgaagccgat

SEQ ID NO: 131440 - DNA, 25 bp, E. coli
caacggttttacgtgcgaagccgat

SEQ ID NO: 131441 - DNA, 25 bp, E. coli
tactcttggtagatgcggctacgta

SEQ ID NO: 131442 - DNA, 25 bp, E. coli
tactcttggtagttgcggctacgta

SEQ ID NO: 131443 - DNA, 25 bp, E. coli
tgcgaagccgatactcttggtagtt

SEQ ID NO: 131444 - DNA, 25 bp, E. coli
tgcgaagccgattctcttggtagtt

SEQ ID NO: 131445 - DNA, 25 bp, E. coli
gccagatagagtggatgctgaccac

SEQ ID NO: 131446 - DNA, 25 bp, E. coli
gccagatagagtcgatgctgaccac

SEQ ID NO: 131447 - DNA, 25 bp, E. coli
gctgaccactggagaactgaatccc

SEQ ID NO: 131448 - DNA, 25 bp, E. coli
gctgaccactggtgaactgaatccc

SEQ ID NO: 131449 - DNA, 25 bp, E. coli
cgccgaatgtccaaagctggatgtg

SEQ ID NO: 131450 - DNA, 25 bp, E. coli
cgccgaatgtcctaagctggatgtg

SEQ ID NO: 131451 - DNA, 25 bp, E. coli
gggccagtatcagcggtaagtttag

SEQ ID NO: 131452 - DNA, 25 bp, E. coli
gggccagtatcaccggtaagtttag

SEQ ID NO: 131453 - DNA, 25 bp, E. coli
ggtatttccacaatttatcagccag

SEQ ID NO: 131454 - DNA, 25 bp, E. coli
gggcctgcagcgtgatatcacgccg

SEQ ID NO: 131455 - DNA, 25 bp, E. coli
gggcctgcagcgagatatcacgccg

SEQ ID NO: 131456 - DNA, 25 bp, E. coli
ggtatttccacattttatcagccag

SEQ ID NO: 131457 - DNA, 25 bp, E. coli
ggagggcaaccagctgcactatctg

SEQ ID NO: 131458 - DNA, 25 bp, E. coli
ggagggcaaccacctgcactatctg

SEQ ID NO: 131459 - DNA, 25 bp, E. coli
taagtttagtgaggccgaatgtcct

SEQ ID NO: 131460 - DNA, 25 bp, E. coli
taagtttagtgacgccgaatgtcct

SEQ ID NO: 131461 - DNA, 25 bp, E. coli
caacccaatgctgccgggtatcgtg

SEQ ID NO: 131462 - DNA, 25 bp, E. coli
caacccaatgctcccgggtatcgtg

SEQ ID NO: 131463 - DNA, 25 bp, E. coli
catgggtgaaagtctctacaaccca

SEQ ID NO: 131464 - DNA, 25 bp, E. coli
catgggtgaaagactctacaaccca

SEQ ID NO: 131465 - DNA, 25 bp, E. coli
agtagaaagtgatggcgcgaccgtt

SEQ ID NO: 131466 - DNA, 25 bp, E. coli
agtagaaagtgaaggcgcgaccgtt

SEQ ID NO: 131467 - DNA, 25 bp, E. coli
tatcgtggcggacctgaaagccaaa

SEQ ID NO: 131468 - DNA, 25 bp, E. coli
tatcgtggcggagctgaaagccaaa

SEQ ID NO: 131469 - DNA, 25 bp, E. coli
cgttgacccgcgatgacgtcatggg

SEQ ID NO: 131470 - DNA, 25 bp, E. coli
cgttgacccgcgttgacgtcatggg

SEQ ID NO: 131471 - DNA, 25 bp, E. coli
gtctgaacgtgacgttgacccgcga

SEQ ID NO: 131472 - DNA, 25 bp, E. coli
gtctgaacgtgaggttgacccgcga

SEQ ID NO: 131473 - DNA, 25 bp, E. coli
gtgaaggcgcgagcgttgtattcct

SEQ ID NO: 131474 - DNA, 25 bp, E. coli
gtgaaggcgcgaccgttgtattcct

SEQ ID NO: 131475 - DNA, 25 bp, E. coli
tggcggtacggtcaaactggccgat

SEQ ID NO: 131476 - DNA, 25 bp, E. coli
tggcggtacggtgaaactggccgat

SEQ ID NO: 131477 - DNA, 25 bp, E. coli
tcaaaacccgcggtggcggtacggt

SEQ ID NO: 131478 - DNA, 25 bp, E. coli
tcaaaacccgcgctggcggtacggt

SEQ ID NO: 131479 - DNA, 25 bp, E. coli
gatgctgggcaatgatggtaaaccg

SEQ ID NO: 131480 - DNA, 25 bp, E. coli
gacgtcatgggtgaaagtctctaca

SEQ ID NO: 131481 - DNA, 25 bp, E. coli
gatgctgggcaaagatggtaaaccg

SEQ ID NO: 131482 - DNA, 25 bp, E. coli
gacgtcatgggtcaaagtctctaca

SEQ ID NO: 131483 - DNA, 25 bp, E. coli
caagaagtgaatgctgcacgcgtgg

SEQ ID NO: 131484 - DNA, 25 bp, E. coli
caagaagtgaatcctgcacgcgtgg

SEQ ID NO: 131485 - DNA, 25 bp, E. coli
catcattctggcagcatgggcagca

SEQ ID NO: 131486 - DNA, 25 bp, E. coli
catcattctggctgcatgggcagca

SEQ ID NO: 131487 - DNA, 25 bp, E. coli
cagtgtgaatttcccggaagaccca

SEQ ID NO: 131488 - DNA, 25 bp, E. coli
cagtgtgaatttgccggaagaccca

SEQ ID NO: 131489 - DNA, 25 bp, E. coli
atcgctgttgcaagacgtccccaga

SEQ ID NO: 131490 - DNA, 25 bp, E. coli
atcgctgttgcatgacgtccccaga

SEQ ID NO: 131491 - DNA, 25 bp, E. coli
tctcacgtcgggacgggtcatttcc

SEQ ID NO: 131492 - DNA, 25 bp, E. coli
tcccgctgcagcaaacaggtgtgcg

SEQ ID NO: 131493 - DNA, 25 bp, E. coli
tctcacgtcgggtcgggtcatttcc

SEQ ID NO: 131494 - DNA, 25 bp, E. coli
tcccgctgcagctaacaggtgtgcg

SEQ ID NO: 131495 - DNA, 25 bp, E. coli
ccgtaccgctgttgaatcaggttaa

SEQ ID NO: 131496 - DNA, 25 bp, E. coli
ccgtaccgctgtagaatcaggttaa

SEQ ID NO: 131497 - DNA, 25 bp, E. coli
gtgcagcctggcaagatctcacgtc

SEQ ID NO: 131498 - DNA, 25 bp, E. coli
gtgcagcctggctagatctcacgtc

SEQ ID NO: 131499 - DNA, 25 bp, E. coli
ggcagccgcgccatttatcatcatt

SEQ ID NO: 131500 - DNA, 25 bp, E. coli
ggaagacccacgacctgactctgta

SEQ ID NO: 131501 - DNA, 25 bp, E. coli
ggcagccgcgccttttatcatcatt

SEQ ID NO: 131502 - DNA, 25 bp, E. coli
ggaagacccacgtcctgactctgta

SEQ ID NO: 131503 - DNA, 25 bp, E. coli
tggcctctgccattgcaagaagtga

SEQ ID NO: 131504 - DNA, 25 bp, E. coli
tggcctctgccaatgcaagaagtga

SEQ ID NO: 131505 - DNA, 25 bp, E. coli
caacatccgacatcccgtctttttc

SEQ ID NO: 131506 - DNA, 25 bp, E. coli
caacatccgacaacccgtctttttc

SEQ ID NO: 131507 - DNA, 25 bp, E. coli
cagtgctgaagcgtataccggtcgt

SEQ ID NO: 131508 - DNA, 25 bp, E. coli
cagtgctgaagcctataccggtcgt

SEQ ID NO: 131509 - DNA, 25 bp, E. coli
aggatattcccgctgtgctggccgt

SEQ ID NO: 131510 - DNA, 25 bp, E. coli
aggatattcccggtgtgctggccgt

SEQ ID NO: 131511 - DNA, 25 bp, E. coli
acaacatccgacttcccgtcttttt

SEQ ID NO: 131512 - DNA, 25 bp, E. coli
acaacatccgacatcccgtcttttt

SEQ ID NO: 131513 - DNA, 25 bp, E. coli
tattcccggtgtcctggccgtgttt

SEQ ID NO: 131514 - DNA, 25 bp, E. coli
tattcccggtgtgctggccgtgttt

SEQ ID NO: 131515 - DNA, 25 bp, E. coli
ttcaccaacaacttccgacatcccg

SEQ ID NO: 131516 - DNA, 25 bp, E. coli
ttcaccaacaacatccgacatcccg

SEQ ID NO: 131517 - DNA, 25 bp, E. coli
tgaacgccgtaaggacagttttggt

SEQ ID NO: 131518 - DNA, 25 bp, E. coli
tgaacgccgtaacgacagttttggt

SEQ ID NO: 131519 - DNA, 25 bp, E. coli
tcccggtgtgctggccgtgtttgct

SEQ ID NO: 131520 - DNA, 25 bp, E. coli
tcccggtgtgctcgccgtgtttgct

SEQ ID NO: 131521 - DNA, 25 bp, E. coli
tcaccaacaacatccgacatcccgt

SEQ ID NO: 131522 - DNA, 25 bp, E. coli
gctggccgtgtttgctgaacgccgt

SEQ ID NO: 131523 - DNA, 25 bp, E. coli
gctggccgtgttagctgaacgccgt

SEQ ID NO: 131524 - DNA, 25 bp, E. coli
gatattcccggtctgctggccgtgt

SEQ ID NO: 131525 - DNA, 25 bp, E. coli
gatattcccggtgtgctggccgtgt

SEQ ID NO: 131526 - DNA, 25 bp, E. coli
tcaccaacaacaaccgacatcccgt

SEQ ID NO: 131527 - DNA, 25 bp, E. coli
taaatatgaagatggtgcgacctgg

SEQ ID NO: 131528 - DNA, 25 bp, E. coli
tacagttctggcagatgtgctcccg

SEQ ID NO: 131529 - DNA, 25 bp, E. coli
tacacagcagtttatgtcctggccg

SEQ ID NO: 131530 - DNA, 25 bp, E. coli
tacagttctggctgatgtgctcccg

SEQ ID NO: 131531 - DNA, 25 bp, E. coli
tacacagcagttaatgtcctggccg

SEQ ID NO: 131532 - DNA, 25 bp, E. coli
taaatatgaagaaggtgcgacctgg

SEQ ID NO: 131533 - DNA, 25 bp, E. coli
accagagggtgttattgcacagcca

SEQ ID NO: 131534 - DNA, 25 bp, E. coli
accagagggtgtaattgcacagcca

SEQ ID NO: 131535 - DNA, 25 bp, E. coli
tatgagtgactgatcaccgcactgg

SEQ ID NO: 131536 - DNA, 25 bp, E. coli
tatgagtgactgttcaccgcactgg

SEQ ID NO: 131537 - DNA, 25 bp, E. coli
tatcacaacgggaaaatagcctgct

SEQ ID NO: 131538 - DNA, 25 bp, E. coli
tatcacaacgggtaaatagcctgct

SEQ ID NO: 131539 - DNA, 25 bp, E. coli
gccttccctgaagatgtggcacagt

SEQ ID NO: 131540 - DNA, 25 bp, E. coli
ccgggcgatcgcaaaagaaaatgct

SEQ ID NO: 131541 - DNA, 25 bp, E. coli
ccgggcgatcgctaaagaaaatgct

SEQ ID NO: 131542 - DNA, 25 bp, E. coli
gccttccctgaacatgtggcacagt

SEQ ID NO: 131543 - DNA, 25 bp, E. coli
cgatcgtgtcgataaaccagagggt

SEQ ID NO: 131544 - DNA, 25 bp, E. coli
cgatcgtgtcgaaaaaccagagggt

SEQ ID NO: 131545 - DNA, 25 bp, E. coli
ggtagatgtcacctatatgccagca

SEQ ID NO: 131546 - DNA, 25 bp, E. coli
ggtagatgtcacgtatatgccagca

SEQ ID NO: 131547 - DNA, 25 bp, E. coli
ggcggctatctcacattcatgggaa

SEQ ID NO: 131548 - DNA, 25 bp, E. coli
ggcggctatctctcattcatgggaa

SEQ ID NO: 131549 - DNA, 25 bp, E. coli
taaaaggttatcagcctgcggttcc

SEQ ID NO: 131550 - DNA, 25 bp, E. coli
taaaaggttatctgcctgcggttcc

SEQ ID NO: 131551 - DNA, 25 bp, E. coli
actatggtgcgctgatgtcctggcg

SEQ ID NO: 131552 - DNA, 25 bp, E. coli
actatggtgcgcagatgtcctggcg

SEQ ID NO: 131553 - DNA, 25 bp, E. coli
ttatcgttctggctttggcgctgct

SEQ ID NO: 131554 - DNA, 25 bp, E. coli
ttatcgttctgggtttggcgctgct

SEQ ID NO: 131555 - DNA, 25 bp, E. coli
tcagtaacgaaaacgccagcggttc

SEQ ID NO: 131556 - DNA, 25 bp, E. coli
tctatggtttgcatatgaccgtggg

SEQ ID NO: 131557 - DNA, 25 bp, E. coli
tcagtaacgaaatcgccagcggttc

SEQ ID NO: 131558 - DNA, 25 bp, E. coli
tctatggtttgcttatgaccgtggg

SEQ ID NO: 131559 - DNA, 25 bp, E. coli
gaatggccgctgatgatcttcacgg

SEQ ID NO: 131560 - DNA, 25 bp, E. coli
gaatggccgctgttgatcttcacgg

SEQ ID NO: 131561 - DNA, 25 bp, E. coli
cgttgccctgtgcttgtggattgca

SEQ ID NO: 131562 - DNA, 25 bp, E. coli
cgttgccctgtggttgtggattgca

SEQ ID NO: 131563 - DNA, 25 bp, E. coli
tggattgcaccagagctaaaaggtt

SEQ ID NO: 131564 - DNA, 25 bp, E. coli
tggattgcaccacagctaaaaggtt

SEQ ID NO: 131565 - DNA, 25 bp, E. coli
tggttgctggcaatgctgaaaaagc

SEQ ID NO: 131566 - DNA, 25 bp, E. coli
tggttgctggcattgctgaaaaagc

SEQ ID NO: 131567 - DNA, 25 bp, E. coli
gatgatggtgcgtgtgtataacagc

SEQ ID NO: 131568 - DNA, 25 bp, E. coli
gagcagaagcccagcagcgtgttat

SEQ ID NO: 131569 - DNA, 25 bp, E. coli
gatgatggtgcgagtgtataacagc

SEQ ID NO: 131570 - DNA, 25 bp, E. coli
gagcagaagccctgcagcgtgttat

SEQ ID NO: 131571 - DNA, 25 bp, E. coli
cagcttgtgtaaaaaataatgccag

SEQ ID NO: 131572 - DNA, 25 bp, E. coli
cagcttgtgtaataaataatgccag

SEQ ID NO: 131573 - DNA, 25 bp, E. coli
tatcccctcgactgttaatacgtta

SEQ ID NO: 131574 - DNA, 25 bp, E. coli
tatcccctcgacagttaatacgtta

SEQ ID NO: 131575 - DNA, 25 bp, E. coli
ttgccgtggagccaattaaagaagc

SEQ ID NO: 131576 - DNA, 25 bp, E. coli
ttgccgtggagcgaattaaagaagc

SEQ ID NO: 131577 - DNA, 25 bp, E. coli
tacctaacaaagaaaccatctccag

SEQ ID NO: 131578 - DNA, 25 bp, E. coli
tacctaacaaagtaaccatctccag

SEQ ID NO: 131579 - DNA, 25 bp, E. coli
tcttgatttgagagagttaccgcct

SEQ ID NO: 131580 - DNA, 25 bp, E. coli
tcttgatttgagtgagttaccgcct

SEQ ID NO: 131581 - DNA, 25 bp, E. coli
ccagcaatttttctgaacgactaga

SEQ ID NO: 131582 - DNA, 25 bp, E. coli
ccagcaatttttgtgaacgactaga

SEQ ID NO: 131583 - DNA, 25 bp, E. coli
gaagcttacaattcgaacatggcat

SEQ ID NO: 131584 - DNA, 25 bp, E. coli
gaagcttacaatacgaacatggcat

SEQ ID NO: 131585 - DNA, 25 bp, E. coli
gacaatgccagtctcgttaatatca

SEQ ID NO: 131586 - DNA, 25 bp, E. coli
gaacatggcatcacttgatttgtca

SEQ ID NO: 131587 - DNA, 25 bp, E. coli
gaacatggcatctcttgatttgtca

SEQ ID NO: 131588 - DNA, 25 bp, E. coli
gacaatgccagtgtcgttaatatca

SEQ ID NO: 131589 - DNA, 25 bp, E. coli
cattcattggttaatctggaagcgc

SEQ ID NO: 131590 - DNA, 25 bp, E. coli
cattcattggtttatctggaagcgc

SEQ ID NO: 131591 - DNA, 25 bp, E. coli
taatggtgaagaaagagcaattgcc

SEQ ID NO: 131592 - DNA, 25 bp, E. coli
taatggtgaagatagagcaattgcc

SEQ ID NO: 131593 - DNA, 25 bp, E. coli
agcgatctgtttggcgtagtcaacg

SEQ ID NO: 131594 - DNA, 25 bp, E. coli
agtcaacgacaatccggacatcatt

SEQ ID NO: 131595 - DNA, 25 bp, E. coli
agtcaacgacaaaccggacatcatt

SEQ ID NO: 131596 - DNA, 25 bp, E. coli
agcgatctgtttcgcgtagtcaacg

SEQ ID NO: 131597 - DNA, 25 bp, E. coli
ttcccatgaacatctgctgccgctg

SEQ ID NO: 131598 - DNA, 25 bp, E. coli
ttcccatgaacaactgctgccgctg

SEQ ID NO: 131599 - DNA, 25 bp, E. coli
tctgtttggcgttgtcaacgacaat

SEQ ID NO: 131600 - DNA, 25 bp, E. coli
tctgtttggcgtagtcaacgacaat

SEQ ID NO: 131601 - DNA, 25 bp, E. coli
ccagcgatctgtatggcgtagtcaa

SEQ ID NO: 131602 - DNA, 25 bp, E. coli
ccagcgatctgtttggcgtagtcaa

SEQ ID NO: 131603 - DNA, 25 bp, E. coli
ccatgaacaactgctgccgctggag

SEQ ID NO: 131604 - DNA, 25 bp, E. coli
ccatgaacaactcctgccgctggag

SEQ ID NO: 131605 - DNA, 25 bp, E. coli
gtagtcaacgactatccggacatca

SEQ ID NO: 131606 - DNA, 25 bp, E. coli
gtagtcaacgacaatccggacatca

SEQ ID NO: 131607 - DNA, 25 bp, E. coli
gcgtagtcaacgacaatccggacat

SEQ ID NO: 131608 - DNA, 25 bp, E. coli
gcgtagtcaacgtcaatccggacat

SEQ ID NO: 131609 - DNA, 25 bp, E. coli
cgattcccatgaacaactgctgccg

SEQ ID NO: 131610 - DNA, 25 bp, E. coli
cgattcccatgatcaactgctgccg

SEQ ID NO: 131611 - DNA, 25 bp, E. coli
cattgccagcgatctgtttggcgta

SEQ ID NO: 131612 - DNA, 25 bp, E. coli
cattgccagcgaactgtttggcgta

SEQ ID NO: 131613 - DNA, 25 bp, E. coli
tggcgtagtcaaggacaatccggac

SEQ ID NO: 131614 - DNA, 25 bp, E. coli
tggcgtagtcaacgacaatccggac

SEQ ID NO: 131615 - DNA, 25 bp, E. coli
taaagctaattgaaagcggcgactg

SEQ ID NO: 131616 - DNA, 25 bp, E. coli
tacgggagtgcatggatgtacgttt

SEQ ID NO: 131617 - DNA, 25 bp, E. coli
taaagctaattgtaagcggcgactg

SEQ ID NO: 131618 - DNA, 25 bp, E. coli
tacgggagtgcaaggatgtacgttt

SEQ ID NO: 131619 - DNA, 25 bp, E. coli
atacgcgcgccacttgattcagacg

SEQ ID NO: 131620 - DNA, 25 bp, E. coli
atacgcgcgccagttgattcagacg

SEQ ID NO: 131621 - DNA, 25 bp, E. coli
taccagttgtattgcctgggccact

SEQ ID NO: 131622 - DNA, 25 bp, E. coli
taccagttgtatagcctgggccact

SEQ ID NO: 131623 - DNA, 25 bp, E. coli
tatcgtattgacaacgccacgctgg

SEQ ID NO: 131624 - DNA, 25 bp, E. coli
tatcgtattgactacgccacgctgg

SEQ ID NO: 131625 - DNA, 25 bp, E. coli
tgtacgtttatcaacgacccgtcga

SEQ ID NO: 131626 - DNA, 25 bp, E. coli
tgtacgtttatctacgacccgtcga

SEQ ID NO: 131627 - DNA, 25 bp, E. coli
gcgactggttagacagggataagta

SEQ ID NO: 131628 - DNA, 25 bp, E. coli
gcgactggttagtcagggataagta

SEQ ID NO: 131629 - DNA, 25 bp, E. coli
cgaacttgatgccttgcgcaccagg

SEQ ID NO: 131630 - DNA, 25 bp, E. coli
cgaacttgatgcgttgcgcaccagg

SEQ ID NO: 131631 - DNA, 25 bp, E. coli
ctgggccactatgcaggcgcagttc

SEQ ID NO: 131632 - DNA, 25 bp, E. coli
ctgggccactatccaggcgcagttc

SEQ ID NO: 131633 - DNA, 25 bp, E. coli
gattcagacgccctacgggagtgca

SEQ ID NO: 131634 - DNA, 25 bp, E. coli
gattcagacgccgtacgggagtgca

SEQ ID NO: 131635 - DNA, 25 bp, E. coli
gacccgtcgatggattaaagctaat

SEQ ID NO: 131636 - DNA, 25 bp, E. coli
gacccgtcgatgcattaaagctaat

SEQ ID NO: 131637 - DNA, 25 bp, E. coli
caagcccattggtgcattcttcagt

SEQ ID NO: 131638 - DNA, 25 bp, E. coli
caagcccattggagcattcttcagt

SEQ ID NO: 131639 - DNA, 25 bp, E. coli
caccggcgtcgataaagtctgtatc

SEQ ID NO: 131640 - DNA, 25 bp, E. coli
caccggcgtcgaaaaagtctgtatc

SEQ ID NO: 131641 - DNA, 25 bp, E. coli
tatccactttggtaaacccgagaag

SEQ ID NO: 131642 - DNA, 25 bp, E. coli
tatccactttggaaaacccgagaag

SEQ ID NO: 131643 - DNA, 25 bp, E. coli
aaacccgagaaggaggcgctggatc

SEQ ID NO: 131644 - DNA, 25 bp, E. coli
aaacccgagaagcaggcgctggatc

SEQ ID NO: 131645 - DNA, 25 bp, E. coli
ttggtaaacccgtgaagcaggcgct

SEQ ID NO: 131646 - DNA, 25 bp, E. coli
ttggtaaacccgagaagcaggcgct

SEQ ID NO: 131647 - DNA, 25 bp, E. coli
tttggtaaacccgagaagcaggcgc

SEQ ID NO: 131648 - DNA, 25 bp, E. coli
tttggtaaaccccagaagcaggcgc

SEQ ID NO: 131649 - DNA, 25 bp, E. coli
tgtatccactttggtaaacccgaga

SEQ ID NO: 131650 - DNA, 25 bp, E. coli
tgtatccactttcgtaaacccgaga

SEQ ID NO: 131651 - DNA, 25 bp, E. coli
gcccattggtgcattcttcagtgaa

SEQ ID NO: 131652 - DNA, 25 bp, E. coli
gcccattggtgctttcttcagtgaa

SEQ ID NO: 131653 - DNA, 25 bp, E. coli
cgaaaaagtctgaatccactttggt

SEQ ID NO: 131654 - DNA, 25 bp, E. coli
cgaaaaagtctgtatccactttggt

SEQ ID NO: 131655 - DNA, 25 bp, E. coli
cggcgtcgaaaatgtctgtatccac

SEQ ID NO: 131656 - DNA, 25 bp, E. coli
cggcgtcgaaaaagtctgtatccac

SEQ ID NO: 131657 - DNA, 25 bp, E. coli
ctgcgcggtgaaacgggcacccaca

SEQ ID NO: 131658 - DNA, 25 bp, E. coli
ctgcgcggtgaatcgggcacccaca

SEQ ID NO: 131659 - DNA, 25 bp, E. coli
cacagtgttctagctcaggacgtta

SEQ ID NO: 131660 - DNA, 25 bp, E. coli
cacagtgttctacctcaggacgtta

SEQ ID NO: 131661 - DNA, 25 bp, E. coli
catcgagatggatttgacgggccgc

SEQ ID NO: 131662 - DNA, 25 bp, E. coli
catcgagatggaattgacgggccgc

SEQ ID NO: 131663 - DNA, 25 bp, E. coli
aaaaacacctgatgccgttgccgga

SEQ ID NO: 131664 - DNA, 25 bp, E. coli
aaaaacacctgaagccgttgccgga

SEQ ID NO: 131665 - DNA, 25 bp, E. coli
tgtgaagacgattccgggaacaacc

SEQ ID NO: 131666 - DNA, 25 bp, E. coli
tgtgaagacgataccgggaacaacc

SEQ ID NO: 131667 - DNA, 25 bp, E. coli
tgtcccggcgcgacaatcaagcttt

SEQ ID NO: 131668 - DNA, 25 bp, E. coli
tgtcccggcgcgtcaatcaagcttt

SEQ ID NO: 131669 - DNA, 25 bp, E. coli
taattaccggtcacgcacatgtcgg

SEQ ID NO: 131670 - DNA, 25 bp, E. coli
taattaccggtctcgcacatgtcgg

SEQ ID NO: 131671 - DNA, 25 bp, E. coli
tctatgatacagtcgcggcaaaagc

SEQ ID NO: 131672 - DNA, 25 bp, E. coli
tctatgatacagacgcggcaaaagc

SEQ ID NO: 131673 - DNA, 25 bp, E. coli
cctaaaggcgatttcacactgggag

SEQ ID NO: 131674 - DNA, 25 bp, E. coli
cctaaaggcgatatcacactgggag

SEQ ID NO: 131675 - DNA, 25 bp, E. coli
taactaaacgagtcatggacgtcgc

SEQ ID NO: 131676 - DNA, 25 bp, E. coli
taactaaacgagacatggacgtcgc

SEQ ID NO: 131677 - DNA, 25 bp, E. coli
gctaattcacgaaggtgtcccggcg

SEQ ID NO: 131678 - DNA, 25 bp, E. coli
gctaattcacgatggtgtcccggcg

SEQ ID NO: 131679 - DNA, 25 bp, E. coli
gacgggccgcgaactcaaatcattg

SEQ ID NO: 131680 - DNA, 25 bp, E. coli
gacgggccgcgatctcaaatcattg

SEQ ID NO: 131681 - DNA, 25 bp, E. coli
caagagagtgacaaagttgcaggct

SEQ ID NO: 131682 - DNA, 25 bp, E. coli
aattgcggctggatacgtttactgc

SEQ ID NO: 131683 - DNA, 25 bp, E. coli
aattgcggctggttacgtttactgc

SEQ ID NO: 131684 - DNA, 25 bp, E. coli
caaagttgcagggtatttataccaa

SEQ ID NO: 131685 - DNA, 25 bp, E. coli
caaagttgcaggctatttataccaa

SEQ ID NO: 131686 - DNA, 25 bp, E. coli
caagagagtgactaagttgcaggct

SEQ ID NO: 131687 - DNA, 25 bp, E. coli
caggaattgcggctggatacgttta

SEQ ID NO: 131688 - DNA, 25 bp, E. coli
caggaattgcgggtggatacgttta

SEQ ID NO: 131689 - DNA, 25 bp, E. coli
agttgcaggctaattataccaaaaa

SEQ ID NO: 131690 - DNA, 25 bp, E. coli
attagccacggcgaagttgatgacc

SEQ ID NO: 131691 - DNA, 25 bp, E. coli
agttgcaggctatttataccaaaaa

SEQ ID NO: 131692 - DNA, 25 bp, E. coli
attagccacggccaagttgatgacc

SEQ ID NO: 131693 - DNA, 25 bp, E. coli
tagccacggcgatgttgatgaccag

SEQ ID NO: 131694 - DNA, 25 bp, E. coli
tagccacggcgaagttgatgaccag

SEQ ID NO: 131695 - DNA, 25 bp, E. coli
ttgtctgagctgtttagccacggcg

SEQ ID NO: 131696 - DNA, 25 bp, E. coli
ttgtctgagctgattagccacggcg

SEQ ID NO: 131697 - DNA, 25 bp, E. coli
cgtgtgttatttatagcattgccag

SEQ ID NO: 131698 - DNA, 25 bp, E. coli
cgtgtgttatttttagcattgccag

SEQ ID NO: 131699 - DNA, 25 bp, E. coli
gattttgtctgacctgattagccac

SEQ ID NO: 131700 - DNA, 25 bp, E. coli
gattttgtctgagctgattagccac

SEQ ID NO: 131701 - DNA, 25 bp, E. coli
ggctggatacgtttactgcccctgt

SEQ ID NO: 131702 - DNA, 25 bp, E. coli
ggctggatacgtatactgcccctgt

SEQ ID NO: 131703 - DNA, 25 bp, E. coli
taaaggccagaaaatggcaccgccg

SEQ ID NO: 131704 - DNA, 25 bp, E. coli
taaaggccagaatatggcaccgccg

SEQ ID NO: 131705 - DNA, 25 bp, E. coli
tatcctcgttggtggtcagactcgt

SEQ ID NO: 131706 - DNA, 25 bp, E. coli
tatcctcgttggaggtcagactcgt

SEQ ID NO: 131707 - DNA, 25 bp, E. coli
tattgctgctgaaaacggcgacgca

SEQ ID NO: 131708 - DNA, 25 bp, E. coli
tattgctgctgataacggcgacgca

SEQ ID NO: 131709 - DNA, 25 bp, E. coli
tgactcgtgcgaaactggaaagcct

SEQ ID NO: 131710 - DNA, 25 bp, E. coli
tgactcgtgcgatactggaaagcct

SEQ ID NO: 131711 - DNA, 25 bp, E. coli
tgcgctggcttagggtctggacaaa

SEQ ID NO: 131712 - DNA, 25 bp, E. coli
tgcgctggcttacggtctggacaaa

SEQ ID NO: 131713 - DNA, 25 bp, E. coli
tctctgggtatcgaaaccatgggcg

SEQ ID NO: 131714 - DNA, 25 bp, E. coli
tctctgggtatccaaaccatgggcg

SEQ ID NO: 131715 - DNA, 25 bp, E. coli
ccatgtgctgcacggtgaacgtaaa

SEQ ID NO: 131716 - DNA, 25 bp, E. coli
gccgtatcgctgctctggaagtaaa

SEQ ID NO: 131717 - DNA, 25 bp, E. coli
ccatgtgctgcagggtgaacgtaaa

SEQ ID NO: 131718 - DNA, 25 bp, E. coli
gccgtatcgctggtctggaagtaaa

SEQ ID NO: 131719 - DNA, 25 bp, E. coli
ggtatcctgcacctttccgcgaaag

SEQ ID NO: 131720 - DNA, 25 bp, E. coli
ggtatcctgcacgtttccgcgaaag

SEQ ID NO: 131721 - DNA, 25 bp, E. coli
taagcaggttgatgaagcaggcgac

SEQ ID NO: 131722 - DNA, 25 bp, E. coli
taagcaggttgaagaagcaggcgac

SEQ ID NO: 131723 - DNA, 25 bp, E. coli
gatgcttctgcatacaacgcgaaag

SEQ ID NO: 131724 - DNA, 25 bp, E. coli
gatgcttctgcaaacaacgcgaaag

SEQ ID NO: 131725 - DNA, 25 bp, E. coli
tactctggcgatggaagacgcctgg

SEQ ID NO: 131726 - DNA, 25 bp, E. coli
tacagaatggtttttccggacctga

SEQ ID NO: 131727 - DNA, 25 bp, E. coli
tacagaatggttattccggacctga

SEQ ID NO: 131728 - DNA, 25 bp, E. coli
tactctggcgatcgaagacgcctgg

SEQ ID NO: 131729 - DNA, 25 bp, E. coli
tgttcatggtgtttttgccggtccg

SEQ ID NO: 131730 - DNA, 25 bp, E. coli
tgtcagacctgcctgtactctggcg

SEQ ID NO: 131731 - DNA, 25 bp, E. coli
tgtcagacctgcgtgtactctggcg

SEQ ID NO: 131732 - DNA, 25 bp, E. coli
tgcccgggcaggcaaagtaatgcct

SEQ ID NO: 131733 - DNA, 25 bp, E. coli
tgttcatggtgtatttgccggtccg

SEQ ID NO: 131734 - DNA, 25 bp, E. coli
gaagaagcgctgcattacaccctca

SEQ ID NO: 131735 - DNA, 25 bp, E. coli
gaagaagcgctggattacaccctca

SEQ ID NO: 131736 - DNA, 25 bp, E. coli
gaaagaaaattcagcctccggctca

SEQ ID NO: 131737 - DNA, 25 bp, E. coli
gaaagaaaattctgcctccggctca

SEQ ID NO: 131738 - DNA, 25 bp, E. coli
tgcccgggcagggaaagtaatgcct

SEQ ID NO: 131739 - DNA, 25 bp, E. coli
taatttatccggtcaggcaaaaggc

SEQ ID NO: 131740 - DNA, 25 bp, E. coli
taatgcctgcaataccattgacggg

SEQ ID NO: 131741 - DNA, 25 bp, E. coli
taatctgcagatagctgatgccagg

SEQ ID NO: 131742 - DNA, 25 bp, E. coli
taatttatccggacaggcaaaaggc

SEQ ID NO: 131743 - DNA, 25 bp, E. coli
taatgcctgcaaaaccattgacggg

SEQ ID NO: 131744 - DNA, 25 bp, E. coli
taatctgcagattgctgatgccagg

SEQ ID NO: 131745 - DNA, 25 bp, E. coli
gacgcctggcagattatcgatatgg

SEQ ID NO: 131746 - DNA, 25 bp, E. coli
gacgcctggcagtttatcgatatgg

SEQ ID NO: 131747 - DNA, 25 bp, E. coli
tacttatcgacaagacagggatccg

SEQ ID NO: 131748 - DNA, 25 bp, E. coli
tacttatcgacatgacagggatccg

SEQ ID NO: 131749 - DNA, 25 bp, E. coli
ttatagaggacgtgcttgccgctgg

SEQ ID NO: 131750 - DNA, 25 bp, E. coli
ttatagaggacgagcttgccgctgg

SEQ ID NO: 131751 - DNA, 25 bp, E. coli
tttatacggcgttactgaagcggcg

SEQ ID NO: 131752 - DNA, 25 bp, E. coli
ttgagatagcgcctcgtaaccctgg

SEQ ID NO: 131753 - DNA, 25 bp, E. coli
ttctggcgaagctatacggcgtgac

SEQ ID NO: 131754 - DNA, 25 bp, E. coli
tttatacggcgtaactgaagcggcg

SEQ ID NO: 131755 - DNA, 25 bp, E. coli
ttcggtttggagaacctgcgcctgc

SEQ ID NO: 131756 - DNA, 25 bp, E. coli
ttctggcgaagcaatacggcgtgac

SEQ ID NO: 131757 - DNA, 25 bp, E. coli
ttgagatagcgcgtcgtaaccctgg

SEQ ID NO: 131758 - DNA, 25 bp, E. coli
ttcggtttggagtacctgcgcctgc

SEQ ID NO: 131759 - DNA, 25 bp, E. coli
gcatcatgctggaacctggtacacg

SEQ ID NO: 131760 - DNA, 25 bp, E. coli
gcatcatgctggtacctggtacacg

SEQ ID NO: 131761 - DNA, 25 bp, E. coli
gaatggacgtcggtacgatccgaaa

SEQ ID NO: 131762 - DNA, 25 bp, E. coli
gaatggacgtcgctacgatccgaaa

SEQ ID NO: 131763 - DNA, 25 bp, E. coli
gatacgatcaacgaatgcattagcg

SEQ ID NO: 131764 - DNA, 25 bp, E. coli
gatacgatcaaccaatgcattagcg

SEQ ID NO: 131765 - DNA, 25 bp, E. coli
ggtacacgggttacgcatgcagctg

SEQ ID NO: 131766 - DNA, 25 bp, E. coli
ggtacacgggtttcgcatgcagctg

SEQ ID NO: 131767 - DNA, 25 bp, E. coli
tcagaggtatagtaggcagtcgcgt

SEQ ID NO: 131768 - DNA, 25 bp, E. coli
tcagaggtatagaaggcagtcgcgt

SEQ ID NO: 131769 - DNA, 25 bp, E. coli
aatccctctcctcggcggtttctgg

SEQ ID NO: 131770 - DNA, 25 bp, E. coli
aatccctctcctgggcggtttctgg

SEQ ID NO: 131771 - DNA, 25 bp, E. coli
aaccgggcttggtcgtcgcatcgct

SEQ ID NO: 131772 - DNA, 25 bp, E. coli
cagccaggttttaagttcaccgcca

SEQ ID NO: 131773 - DNA, 25 bp, E. coli
cagccaggtttttagttcaccgcca

SEQ ID NO: 131774 - DNA, 25 bp, E. coli
catcatcgccatactttcgccgtgg

SEQ ID NO: 131775 - DNA, 25 bp, E. coli
cattctttcgccgtggctgctgttt

SEQ ID NO: 131776 - DNA, 25 bp, E. coli
cattctttcgccctggctgctgttt

SEQ ID NO: 131777 - DNA, 25 bp, E. coli
catcatcgccattctttcgccgtgg

SEQ ID NO: 131778 - DNA, 25 bp, E. coli
gccaaatccctcacctgggcggttt

SEQ ID NO: 131779 - DNA, 25 bp, E. coli
gccaaatccctctcctgggcggttt

SEQ ID NO: 131780 - DNA, 25 bp, E. coli
aaccgggcttggacgtcgcatcgct

SEQ ID NO: 131781 - DNA, 25 bp, E. coli
tcgcatcgctctcattctggtgaaa

SEQ ID NO: 131782 - DNA, 25 bp, E. coli
tcgcatcgctctgattctggtgaaa

SEQ ID NO: 131783 - DNA, 25 bp, E. coli
gcttggacgtcggatcgctctgatt

SEQ ID NO: 131784 - DNA, 25 bp, E. coli
gcttggacgtcgcatcgctctgatt

SEQ ID NO: 131785 - DNA, 25 bp, E. coli
gcggtttctggtatttctaattcag

SEQ ID NO: 131786 - DNA, 25 bp, E. coli
gcagctcgcccacccaggttttaag

SEQ ID NO: 131787 - DNA, 25 bp, E. coli
gcggtttctggtttttctaattcag

SEQ ID NO: 131788 - DNA, 25 bp, E. coli
gcagctcgcccagccaggttttaag

SEQ ID NO: 131789 - DNA, 25 bp, E. coli
cgccgtggctgctgtttagcccgga

SEQ ID NO: 131790 - DNA, 25 bp, E. coli
cgccgtggctgcagtttagcccgga

SEQ ID NO: 131791 - DNA, 25 bp, E. coli
cagcctacggttatgttccggtttg

SEQ ID NO: 131792 - DNA, 25 bp, E. coli
acggctgtcggatgccggcgtaaac

SEQ ID NO: 131793 - DNA, 25 bp, E. coli
acggctgtcggaagccggcgtaaac

SEQ ID NO: 131794 - DNA, 25 bp, E. coli
cagcctacggttttgttccggtttg

SEQ ID NO: 131795 - DNA, 25 bp, E. coli
tagaggatttttaacggctgccgga

SEQ ID NO: 131796 - DNA, 25 bp, E. coli
tatgttctggctcgttggcctttgg

SEQ ID NO: 131797 - DNA, 25 bp, E. coli
tatgttctggctggttggcctttgg

SEQ ID NO: 131798 - DNA, 25 bp, E. coli
tagaggattttttacggctgccgga

SEQ ID NO: 131799 - DNA, 25 bp, E. coli
ttttgctactcgatagttactgcag

SEQ ID NO: 131800 - DNA, 25 bp, E. coli
ttttgctactcgttagttactgcag

SEQ ID NO: 131801 - DNA, 25 bp, E. coli
tccgacctacggttatgttctggct

SEQ ID NO: 131802 - DNA, 25 bp, E. coli
tccgacctacggatatgttctggct

SEQ ID NO: 131803 - DNA, 25 bp, E. coli
gcaacgattatcctatgagattggg

SEQ ID NO: 131804 - DNA, 25 bp, E. coli
gcaacgattatcgtatgagattggg

SEQ ID NO: 131805 - DNA, 25 bp, E. coli
gaacgccctatccagcctacggtta

SEQ ID NO: 131806 - DNA, 25 bp, E. coli
gaacgccctatcgagcctacggtta

SEQ ID NO: 131807 - DNA, 25 bp, E. coli
cgttagttactggagtagaggattt

SEQ ID NO: 131808 - DNA, 25 bp, E. coli
cgttagttactgcagtagaggattt

SEQ ID NO: 131809 - DNA, 25 bp, E. coli
ggttatgttccgattgtaggcctga

SEQ ID NO: 131810 - DNA, 25 bp, E. coli
ggttatgttccgtttgtaggcctga

SEQ ID NO: 131811 - DNA, 25 bp, E. coli
ggcctttggcaaggattatcctatg

SEQ ID NO: 131812 - DNA, 25 bp, E. coli
ggcctttggcaacgattatcctatg

SEQ ID NO: 131813 - DNA, 25 bp, E. coli
acgaacctctggtccctctgtactg

SEQ ID NO: 131814 - DNA, 25 bp, E. coli
acgaacctctggaccctctgtactg

SEQ ID NO: 131815 - DNA, 25 bp, E. coli
tagacgcgtggtagacctttgtgac

SEQ ID NO: 131816 - DNA, 25 bp, E. coli
tagacgcgtggttgacctttgtgac

SEQ ID NO: 131817 - DNA, 25 bp, E. coli
tgtctctgtagacgcgtggttgacc

SEQ ID NO: 131818 - DNA, 25 bp, E. coli
tgtctctgtagaggcgtggttgacc

SEQ ID NO: 131819 - DNA, 25 bp, E. coli
cctctggaccctctgtactgaatgc

SEQ ID NO: 131820 - DNA, 25 bp, E. coli
cctctggaccctgtgtactgaatgc

SEQ ID NO: 131821 - DNA, 25 bp, E. coli
gcagtgcccgggtttccctcaaacg

SEQ ID NO: 131822 - DNA, 25 bp, E. coli
gcagtgcccgggattccctcaaacg

SEQ ID NO: 131823 - DNA, 25 bp, E. coli
ctctgtagacgcctggttgaccttt

SEQ ID NO: 131824 - DNA, 25 bp, E. coli
ctctgtagacgcgtggttgaccttt

SEQ ID NO: 131825 - DNA, 25 bp, E. coli
gggtttccctcaaacgtcgtatctg

SEQ ID NO: 131826 - DNA, 25 bp, E. coli
gggtttccctcatacgtcgtatctg

SEQ ID NO: 131827 - DNA, 25 bp, E. coli
ggacactgttgtctctgtagacgcg

SEQ ID NO: 131828 - DNA, 25 bp, E. coli
ggacactgttgtgtctgtagacgcg

SEQ ID NO: 131829 - DNA, 25 bp, E. coli
tcaaacgtcgtatctggcggaggga

SEQ ID NO: 131830 - DNA, 25 bp, E. coli
tcaaacgtcgtaactggcggaggga

SEQ ID NO: 131831 - DNA, 25 bp, E. coli
gatgccggacactgttgtctctgta

SEQ ID NO: 131832 - DNA, 25 bp, E. coli
gatgccggacacagttgtctctgta

SEQ ID NO: 131833 - DNA, 25 bp, E. coli
gagggatgccggacactgttgtctc

SEQ ID NO: 131834 - DNA, 25 bp, E. coli
gagggatgccggtcactgttgtctc

SEQ ID NO: 131835 - DNA, 25 bp, E. coli
aattatcggcaagggaagccttcac

SEQ ID NO: 131836 - DNA, 25 bp, E. coli
aattatcggcaacggaagccttcac

SEQ ID NO: 131837 - DNA, 25 bp, E. coli
cagcaatggcgagaagacgtaataa

SEQ ID NO: 131838 - DNA, 25 bp, E. coli
cagcaatggcgacaagacgtaataa

SEQ ID NO: 131839 - DNA, 25 bp, E. coli
tactggctgcgtttattattttgcg

SEQ ID NO: 131840 - DNA, 25 bp, E. coli
tactggctgcgtatattattttgcg

SEQ ID NO: 131841 - DNA, 25 bp, E. coli
agtttcttcagtgggcattatccgg

SEQ ID NO: 131842 - DNA, 25 bp, E. coli
agtttcttcagtcggcattatccgg

SEQ ID NO: 131843 - DNA, 25 bp, E. coli
tatgggtacaaactgaagaagcaag

SEQ ID NO: 131844 - DNA, 25 bp, E. coli
tatgggtacaaagtgaagaagcaag

SEQ ID NO: 131845 - DNA, 25 bp, E. coli
ttttgcgccagaaacgctgaattgg

SEQ ID NO: 131846 - DNA, 25 bp, E. coli
ttttgcgccagatacgctgaattgg

SEQ ID NO: 131847 - DNA, 25 bp, E. coli
tgctcttaatggtggcgatcttggg

SEQ ID NO: 131848 - DNA, 25 bp, E. coli
tgctcttaatggaggcgatcttggg

SEQ ID NO: 131849 - DNA, 25 bp, E. coli
gcgggctttacccatcgctgacgat

SEQ ID NO: 131850 - DNA, 25 bp, E. coli
gcgggctttaccgatcgctgacgat

SEQ ID NO: 131851 - DNA, 25 bp, E. coli
gaaaatgtacgaaggcagcaatggc

SEQ ID NO: 131852 - DNA, 25 bp, E. coli
gaaaatgtacgatggcagcaatggc

SEQ ID NO: 131853 - DNA, 25 bp, E. coli
cgctgaattgggtaagtctggaagt

SEQ ID NO: 131854 - DNA, 25 bp, E. coli
cgctgaattgggaaagtctggaagt

SEQ ID NO: 131855 - DNA, 25 bp, E. coli
cgcttactgaacactgggaaatgca

SEQ ID NO: 131856 - DNA, 25 bp, E. coli
cgcttactgaactctgggaaatgca

SEQ ID NO: 131857 - DNA, 25 bp, E. coli
aaacagcttatctgtatggcaccag

SEQ ID NO: 131858 - DNA, 25 bp, E. coli
aaacagcttatcagtatggcaccag

SEQ ID NO: 131859 - DNA, 25 bp, E. coli
tatcaccgtggttggcgaagcgagt

SEQ ID NO: 131860 - DNA, 25 bp, E. coli
tatcaccgtggtaggcgaagcgagt

SEQ ID NO: 131861 - DNA, 25 bp, E. coli
ttagatctcaatttgcccggcatga

SEQ ID NO: 131862 - DNA, 25 bp, E. coli
ttagatctcaatatgcccggcatga

SEQ ID NO: 131863 - DNA, 25 bp, E. coli
tgttaaccagttaaccccacgcgag

SEQ ID NO: 131864 - DNA, 25 bp, E. coli
tgttaaccagtttaccccacgcgag

SEQ ID NO: 131865 - DNA, 25 bp, E. coli
tgaacggtctggtaacgctggataa

SEQ ID NO: 131866 - DNA, 25 bp, E. coli
tgaacggtctggaaacgctggataa

SEQ ID NO: 131867 - DNA, 25 bp, E. coli
tgccgaacaagaagattgcccgccg

SEQ ID NO: 131868 - DNA, 25 bp, E. coli
tgccgaacaagatgattgcccgccg

SEQ ID NO: 131869 - DNA, 25 bp, E. coli
ccatgaagaagatgtggtcaccgca

SEQ ID NO: 131870 - DNA, 25 bp, E. coli
ccatgaagaagaagtggtcaccgca

SEQ ID NO: 131871 - DNA, 25 bp, E. coli
cgcggcgcggatggctatctgttaa

SEQ ID NO: 131872 - DNA, 25 bp, E. coli
cgcggcgcggatcgctatctgttaa

SEQ ID NO: 131873 - DNA, 25 bp, E. coli
gataaactgcgcgaaaagtccctct

SEQ ID NO: 131874 - DNA, 25 bp, E. coli
gataaactgcgccaaaagtccctct

SEQ ID NO: 131875 - DNA, 25 bp, E. coli
tggaaccggaagatctgctgaaagc

SEQ ID NO: 131876 - DNA, 25 bp, E. coli
tggaaccggaagttctgctgaaagc

SEQ ID NO: 131877 - DNA, 25 bp, E. coli
taagcgaagcataaacgcctgttct

SEQ ID NO: 131878 - DNA, 25 bp, E. coli
taagcgaagcattaacgcctgttct

SEQ ID NO: 131879 - DNA, 25 bp, E. coli
ttgaagccggcctgccgacaatatg

SEQ ID NO: 131880 - DNA, 25 bp, E. coli
ttgaggctgcgcagcagtcgccagt

SEQ ID NO: 131881 - DNA, 25 bp, E. coli
ttgaggctgcgctgcagtcgccagt

SEQ ID NO: 131882 - DNA, 25 bp, E. coli
ttgaagccggccagccgacaatatg

SEQ ID NO: 131883 - DNA, 25 bp, E. coli
tgaacgtgcggcaagtaccgagaac

SEQ ID NO: 131884 - DNA, 25 bp, E. coli
tgaacgtgcggctagtaccgagaac

SEQ ID NO: 131885 - DNA, 25 bp, E. coli
tcgttatctggctattgccaactac

SEQ ID NO: 131886 - DNA, 25 bp, E. coli
tcgttatctggcaattgccaactac

SEQ ID NO: 131887 - DNA, 25 bp, E. coli
gacaatatgttcagaaacctgtgtc

SEQ ID NO: 131888 - DNA, 25 bp, E. coli
gacaatatgttctgaaacctgtgtc

SEQ ID NO: 131889 - DNA, 25 bp, E. coli
cgcgattgaacgagcggcaagtacc

SEQ ID NO: 131890 - DNA, 25 bp, E. coli
cgcgattgaacgtgcggcaagtacc

SEQ ID NO: 131891 - DNA, 25 bp, E. coli
cgtgcggcaagtaccgagaacgaga

SEQ ID NO: 131892 - DNA, 25 bp, E. coli
cgtgcggcaagttccgagaacgaga

SEQ ID NO: 131893 - DNA, 25 bp, E. coli
ggcagacgcgggagaactgggcagc

SEQ ID NO: 131894 - DNA, 25 bp, E. coli
ggccagccgacattatgttcagaaa

SEQ ID NO: 131895 - DNA, 25 bp, E. coli
ggccagccgacaatatgttcagaaa

SEQ ID NO: 131896 - DNA, 25 bp, E. coli
ggcagacgcgggtgaactgggcagc

SEQ ID NO: 131897 - DNA, 25 bp, E. coli
ggctgcgcagcactcgccagtttat

SEQ ID NO: 131898 - DNA, 25 bp, E. coli
ggctgcgcagcagtcgccagtttat

SEQ ID NO: 131899 - DNA, 25 bp, E. coli
gatgtatcgttatctggctattgcc

SEQ ID NO: 131900 - DNA, 25 bp, E. coli
gatgtatcgttaactggctattgcc

SEQ ID NO: 131901 - DNA, 25 bp, E. coli
attcgccacggcagggcatgcctgg

SEQ ID NO: 131902 - DNA, 25 bp, E. coli
attcgccacggctgggcatgcctgg

SEQ ID NO: 131903 - DNA, 25 bp, E. coli
aacgccaaaacgattatatgaagaa

SEQ ID NO: 131904 - DNA, 25 bp, E. coli
aacgccaaaacgtttatatgaagaa

SEQ ID NO: 131905 - DNA, 25 bp, E. coli
tatggaaagcgtcacatcgctggca

SEQ ID NO: 131906 - DNA, 25 bp, E. coli
tatggaaagcgtgacatcgctggca

SEQ ID NO: 131907 - DNA, 25 bp, E. coli
tgctgattgaaacaccggaagaacc

SEQ ID NO: 131908 - DNA, 25 bp, E. coli
tgctgattgaaagaccggaagaacc

SEQ ID NO: 131909 - DNA, 25 bp, E. coli
gataccgacgttacaccattcgacc

SEQ ID NO: 131910 - DNA, 25 bp, E. coli
gataccgacgtttcaccattcgacc

SEQ ID NO: 131911 - DNA, 25 bp, E. coli
ggtgaatcatgcatgcgcgtcgatg

SEQ ID NO: 131912 - DNA, 25 bp, E. coli
ggtgagccccccttaattcctgtag

SEQ ID NO: 131913 - DNA, 25 bp, E. coli
ggagttccggtcagcgatgttcacg

SEQ ID NO: 131914 - DNA, 25 bp, E. coli
ggtgagccccccataattcctgtag

SEQ ID NO: 131915 - DNA, 25 bp, E. coli
gtgccctgctaaggcgtcatgttcg

SEQ ID NO: 131916 - DNA, 25 bp, E. coli
gtgccctgctaacgcgtcatgttcg

SEQ ID NO: 131917 - DNA, 25 bp, E. coli
ggtgaatcatgcttgcgcgtcgatg

SEQ ID NO: 131918 - DNA, 25 bp, E. coli
ggagttccggtctgcgatgttcacg

SEQ ID NO: 131919 - DNA, 25 bp, E. coli
gatgttcacgttatttcaacccaag

SEQ ID NO: 131920 - DNA, 25 bp, E. coli
gatgtgccagaaatcccattcgcca

SEQ ID NO: 131921 - DNA, 25 bp, E. coli
gatgtgccagaattcccattcgcca

SEQ ID NO: 131922 - DNA, 25 bp, E. coli
gatgttcacgttttttcaacccaag

SEQ ID NO: 131923 - DNA, 25 bp, E. coli
caaactggccttagacggcagcggt

SEQ ID NO: 131924 - DNA, 25 bp, E. coli
caaactggcctttgacggcagcggt

SEQ ID NO: 131925 - DNA, 25 bp, E. coli
catcaggcgattgtgcgtaagtggc

SEQ ID NO: 131926 - DNA, 25 bp, E. coli
catcaggcgattctgcgtaagtggc

SEQ ID NO: 131927 - DNA, 25 bp, E. coli
aaatgcacatcgacgaattccagga

SEQ ID NO: 131928 - DNA, 25 bp, E. coli
aaatgcacatcgtcgaattccagga

SEQ ID NO: 131929 - DNA, 25 bp, E. coli
tctgcatgcaggtaatcggcaaatg

SEQ ID NO: 131930 - DNA, 25 bp, E. coli
tctgcatgcaggaaatcggcaaatg

SEQ ID NO: 131931 - DNA, 25 bp, E. coli
cctgggaaggtctgatctgcatgca

SEQ ID NO: 131932 - DNA, 25 bp, E. coli
cctgggaaggtcagatctgcatgca

SEQ ID NO: 131933 - DNA, 25 bp, E. coli
gttatcgaaccgaacaaactggcct

SEQ ID NO: 131934 - DNA, 25 bp, E. coli
gattttcggtggcatggcgattccc

SEQ ID NO: 131935 - DNA, 25 bp, E. coli
gttatcgaaccgtacaaactggcct

SEQ ID NO: 131936 - DNA, 25 bp, E. coli
gattcccggaagctacatcggaaga

SEQ ID NO: 131937 - DNA, 25 bp, E. coli
gattttcggtgggatggcgattccc

SEQ ID NO: 131938 - DNA, 25 bp, E. coli
gattcccggaaggtacatcggaaga

SEQ ID NO: 131939 - DNA, 25 bp, E. coli
tggcaaagaaccctagccgtcgtct

SEQ ID NO: 131940 - DNA, 25 bp, E. coli
ggcaaatgcaccgaagaacatcagg

SEQ ID NO: 131941 - DNA, 25 bp, E. coli
ggcaaatgcacccaagaacatcagg

SEQ ID NO: 131942 - DNA, 25 bp, E. coli
tggcaaagaaccgtagccgtcgtct

SEQ ID NO: 131943 - DNA, 25 bp, E. coli
gaggtacgcaccagcgaacttttcg

SEQ ID NO: 131944 - DNA, 25 bp, E. coli
gaggtacgcacctgcgaacttttcg

SEQ ID NO: 131945 - DNA, 25 bp, E. coli
caattataaactcggcggtgcacag

SEQ ID NO: 131946 - DNA, 25 bp, E. coli
caacatgatagcgtacgcctcgatc

SEQ ID NO: 131947 - DNA, 25 bp, E. coli
caattataaactgggcggtgcacag

SEQ ID NO: 131948 - DNA, 25 bp, E. coli
caacatgatagcctacgcctcgatc

SEQ ID NO: 131949 - DNA, 25 bp, E. coli
cacagcaacatgttagcgtacgcct

SEQ ID NO: 131950 - DNA, 25 bp, E. coli
cacagcaacatgatagcgtacgcct

SEQ ID NO: 131951 - DNA, 25 bp, E. coli
catgatagcgtaggcctcgatccgt

SEQ ID NO: 131952 - DNA, 25 bp, E. coli
catgatagcgtacgcctcgatccgt

SEQ ID NO: 131953 - DNA, 25 bp, E. coli
taaactgggcggagcacagcaacat

SEQ ID NO: 131954 - DNA, 25 bp, E. coli
taaactgggcggtgcacagcaacat

SEQ ID NO: 131955 - DNA, 25 bp, E. coli
agcaacatgataccgtacgcctcga

SEQ ID NO: 131956 - DNA, 25 bp, E. coli
agcaacatgatagcgtacgcctcga

SEQ ID NO: 131957 - DNA, 25 bp, E. coli
taccaccgccaaatataaactgggc

SEQ ID NO: 131958 - DNA, 25 bp, E. coli
taccaccgccaattataaactgggc

SEQ ID NO: 131959 - DNA, 25 bp, E. coli
tgcacagcaacatgatagcgtacgc

SEQ ID NO: 131960 - DNA, 25 bp, E. coli
tgcacagcaacaagatagcgtacgc

SEQ ID NO: 131961 - DNA, 25 bp, E. coli
cgccaattataatctgggcggtgca

SEQ ID NO: 131962 - DNA, 25 bp, E. coli
cgccaattataaactgggcggtgca

SEQ ID NO: 131963 - DNA, 25 bp, E. coli
cgtacgcctcgaaccgtgggtgttt

SEQ ID NO: 131964 - DNA, 25 bp, E. coli
cgtacgcctcgatccgtgggtgttt

SEQ ID NO: 131965 - DNA, 25 bp, E. coli
gataccaccgccaattataaactgg

SEQ ID NO: 131966 - DNA, 25 bp, E. coli
gataccaccgcctattataaactgg

SEQ ID NO: 131967 - DNA, 25 bp, E. coli
caatgtctggattgcttcgccggga

SEQ ID NO: 131968 - DNA, 25 bp, E. coli
caatgtctggatagcttcgccggga

SEQ ID NO: 131969 - DNA, 25 bp, E. coli
caaatccgcatttttggcgggcagt

SEQ ID NO: 131970 - DNA, 25 bp, E. coli
caaatccgcattattggcgggcagt

SEQ ID NO: 131971 - DNA, 25 bp, E. coli
tactggaagataacggctggctggc

SEQ ID NO: 131972 - DNA, 25 bp, E. coli
taaaagcaggcattgcacgcgtggt

SEQ ID NO: 131973 - DNA, 25 bp, E. coli
tactggaagatatcggctggctggc

SEQ ID NO: 131974 - DNA, 25 bp, E. coli
taaaagcaggcaatgcacgcgtggt

SEQ ID NO: 131975 - DNA, 25 bp, E. coli
agcgaagtcgaaaacggtctgccca

SEQ ID NO: 131976 - DNA, 25 bp, E. coli
agcgaagtcgaatacggtctgccca

SEQ ID NO: 131977 - DNA, 25 bp, E. coli
aaaaccgaatcaatccggcagcggc

SEQ ID NO: 131978 - DNA, 25 bp, E. coli
aaaaccgaatcattccggcagcggc

SEQ ID NO: 131979 - DNA, 25 bp, E. coli
ggcttatcggctctatcaacgcgaa

SEQ ID NO: 131980 - DNA, 25 bp, E. coli
ggcttatcggctgtatcaacgcgaa

SEQ ID NO: 131981 - DNA, 25 bp, E. coli
taatatcgtgtttgtcgatccaccg

SEQ ID NO: 131982 - DNA, 25 bp, E. coli
taatatcgtgttagtcgatccaccg

SEQ ID NO: 131983 - DNA, 25 bp, E. coli
ttaactggctgggtccggtcattgt

SEQ ID NO: 131984 - DNA, 25 bp, E. coli
tacatcgggaaaaagtggcgggtca

SEQ ID NO: 131985 - DNA, 25 bp, E. coli
tcaacgcgaagcacaaggagaaagt

SEQ ID NO: 131986 - DNA, 25 bp, E. coli
tacatcgggaaatagtggcgggtca

SEQ ID NO: 131987 - DNA, 25 bp, E. coli
ttaactggctggctccggtcattgt

SEQ ID NO: 131988 - DNA, 25 bp, E. coli
tcaacgcgaagctcaaggagaaagt

SEQ ID NO: 131989 - DNA, 25 bp, E. coli
caatcagatgagactaatcatctct

SEQ ID NO: 131990 - DNA, 25 bp, E. coli
caatcagatgagtctaatcatctct

SEQ ID NO: 131991 - DNA, 25 bp, E. coli
tagttcaataaaaacaatcagatga

SEQ ID NO: 131992 - DNA, 25 bp, E. coli
ttgctgtgaccaagaaatttttcga

SEQ ID NO: 131993 - DNA, 25 bp, E. coli
ttgctgtgaccatgaaatttttcga

SEQ ID NO: 131994 - DNA, 25 bp, E. coli
tagttcaataaatacaatcagatga

SEQ ID NO: 131995 - DNA, 25 bp, E. coli
tctgaaatcgatgagacgcgatgca

SEQ ID NO: 131996 - DNA, 25 bp, E. coli
tctgaaatcgatcagacgcgatgca

SEQ ID NO: 131997 - DNA, 25 bp, E. coli
tcagtggtacgtgtgaaatcgatca

SEQ ID NO: 131998 - DNA, 25 bp, E. coli
tcagtggtacgtctgaaatcgatca

SEQ ID NO: 131999 - DNA, 25 bp, E. coli
gaaatttttcgactgaacgaagcgt

SEQ ID NO: 132000 - DNA, 25 bp, E. coli
gaaatcgatcagtcgcgatgcattg

SEQ ID NO: 132001 - DNA, 25 bp, E. coli
gaaatcgatcagacgcgatgcattg

SEQ ID NO: 132002 - DNA, 25 bp, E. coli
gaaatttttcgagtgaacgaagcgt

SEQ ID NO: 132003 - DNA, 25 bp, E. coli
cgactgaacgaagcgtatgaaattt

SEQ ID NO: 132004 - DNA, 25 bp, E. coli
cgaagcgtatgaaatttgtgttagt

SEQ ID NO: 132005 - DNA, 25 bp, E. coli
cgccgctgggatatcgcgtattttc

SEQ ID NO: 132006 - DNA, 25 bp, E. coli
cgactgaacgaaccgtatgaaattt

SEQ ID NO: 132007 - DNA, 25 bp, E. coli
cgaagcgtatgatatttgtgttagt

SEQ ID NO: 132008 - DNA, 25 bp, E. coli
cgccgctgggatttcgcgtattttc

SEQ ID NO: 132009 - DNA, 25 bp, E. coli
taataccgccgcagggatatcgcgt

SEQ ID NO: 132010 - DNA, 25 bp, E. coli
taataccgccgctgggatatcgcgt

SEQ ID NO: 132011 - DNA, 25 bp, E. coli
aggcaacgcaatcattttcaaaccg

SEQ ID NO: 132012 - DNA, 25 bp, E. coli
aggcaacgcaatgattttcaaaccg

SEQ ID NO: 132013 - DNA, 25 bp, E. coli
tgaaacgtcctttgtgtatacccgc

SEQ ID NO: 132014 - DNA, 25 bp, E. coli
tgaaacgtccttagtgtatacccgc

SEQ ID NO: 132015 - DNA, 25 bp, E. coli
tgcgtgaaacgtcctttgtgtatac

SEQ ID NO: 132016 - DNA, 25 bp, E. coli
tcgatgaccgccttggagcgctcgc

SEQ ID NO: 132017 - DNA, 25 bp, E. coli
tgcgtgaaacgtgctttgtgtatac

SEQ ID NO: 132018 - DNA, 25 bp, E. coli
tcgatgaccgccatggagcgctcgc

SEQ ID NO: 132019 - DNA, 25 bp, E. coli
gcaggcaacgcaatgattttcaaac

SEQ ID NO: 132020 - DNA, 25 bp, E. coli
gcaggcaacgcattgattttcaaac

SEQ ID NO: 132021 - DNA, 25 bp, E. coli
gaaaagcgcccaccaggggcaaaaa

SEQ ID NO: 132022 - DNA, 25 bp, E. coli
gaaaagcgcccagcaggggcaaaaa

SEQ ID NO: 132023 - DNA, 25 bp, E. coli
cccgttgcgtgaaacgtcctttgtg

SEQ ID NO: 132024 - DNA, 25 bp, E. coli
cccgttgcgtgatacgtcctttgtg

SEQ ID NO: 132025 - DNA, 25 bp, E. coli
cgcgccgtgaaaagcgcccagcagg

SEQ ID NO: 132026 - DNA, 25 bp, E. coli
cgcgccgtgaaatgcgcccagcagg

SEQ ID NO: 132027 - DNA, 25 bp, E. coli
cggcaggcaacgcaatgattttcaa

SEQ ID NO: 132028 - DNA, 25 bp, E. coli
cggcaggcaacggaatgattttcaa

SEQ ID NO: 132029 - DNA, 25 bp, E. coli
gatcgcgccgtgtaaagcgcccagc

SEQ ID NO: 132030 - DNA, 25 bp, E. coli
tggcggcaggcaacgcaatgatttt

SEQ ID NO: 132031 - DNA, 25 bp, E. coli
tggcggcaggcatcgcaatgatttt

SEQ ID NO: 132032 - DNA, 25 bp, E. coli
gatcgcgccgtgaaaagcgcccagc

SEQ ID NO: 132033 - DNA, 25 bp, E. coli
caaagaatatcaatgcagcaggagt

SEQ ID NO: 132034 - DNA, 25 bp, E. coli
caaagaatatcattgcagcaggagt

SEQ ID NO: 132035 - DNA, 25 bp, E. coli
tacgaaaggcaataaatcgcgtgac

SEQ ID NO: 132036 - DNA, 25 bp, E. coli
agatgccttatctcgttacgctggg

SEQ ID NO: 132037 - DNA, 25 bp, E. coli
agatgccttatcacgttacgctggg

SEQ ID NO: 132038 - DNA, 25 bp, E. coli
tacgaaaggcaaaaaatcgcgtgac

SEQ ID NO: 132039 - DNA, 25 bp, E. coli
tttaacgtgcgagaaataccgccca

SEQ ID NO: 132040 - DNA, 25 bp, E. coli
tttaacgtgcgacaaataccgccca

SEQ ID NO: 132041 - DNA, 25 bp, E. coli
tgtaatatttctctagccaaccgag

SEQ ID NO: 132042 - DNA, 25 bp, E. coli
tgttccgtcaacttttcaggtgggt

SEQ ID NO: 132043 - DNA, 25 bp, E. coli
tgtaatatttctgtagccaaccgag

SEQ ID NO: 132044 - DNA, 25 bp, E. coli
tgttccgtcaacatttcaggtgggt

SEQ ID NO: 132045 - DNA, 25 bp, E. coli
tgtcactgttccaccaatggtgcgt

SEQ ID NO: 132046 - DNA, 25 bp, E. coli
tgtcactgttcctccaatggtgcgt

SEQ ID NO: 132047 - DNA, 25 bp, E. coli
tcctgtatgagctgcattgcctggg

SEQ ID NO: 132048 - DNA, 25 bp, E. coli
tcctgtatgagcagcattgcctggg

SEQ ID NO: 132049 - DNA, 25 bp, E. coli
cattgaaactattctggcggccaaa

SEQ ID NO: 132050 - DNA, 25 bp, E. coli
cattgaaactatactggcggccaaa

SEQ ID NO: 132051 - DNA, 25 bp, E. coli
ggtgcgtttaaaacccagtgagcaa

SEQ ID NO: 132052 - DNA, 25 bp, E. coli
ggtgcgtttaaatcccagtgagcaa

SEQ ID NO: 132053 - DNA, 25 bp, E. coli
gatgttaccacatacgcaaagctta

SEQ ID NO: 132054 - DNA, 25 bp, E. coli
gatgttaccacaaacgcaaagctta

SEQ ID NO: 132055 - DNA, 25 bp, E. coli
agttgctgtgatcccttatgttgcc

SEQ ID NO: 132056 - DNA, 25 bp, E. coli
agttgctgtgatgccttatgttgcc

SEQ ID NO: 132057 - DNA, 25 bp, E. coli
aacaacgcgagatacctattccggg

SEQ ID NO: 132058 - DNA, 25 bp, E. coli
aacaacgcgagaaacctattccggg

SEQ ID NO: 132059 - DNA, 25 bp, E. coli
ttatgttgcctgtcagcaatgcccg

SEQ ID NO: 132060 - DNA, 25 bp, E. coli
ttatgttgcctgacagcaatgcccg

SEQ ID NO: 132061 - DNA, 25 bp, E. coli
tgccagcagccgaaagaattagtct

SEQ ID NO: 132062 - DNA, 25 bp, E. coli
tgccagcagccgtaagaattagtct

SEQ ID NO: 132063 - DNA, 25 bp, E. coli
tcttaaaaatggtcagcaagttgct

SEQ ID NO: 132064 - DNA, 25 bp, E. coli
tcttaaaaatggacagcaagttgct

SEQ ID NO: 132065 - DNA, 25 bp, E. coli
cctattccgggtcacaatgaagcat

SEQ ID NO: 132066 - DNA, 25 bp, E. coli
cctattccgggtgacaatgaagcat

SEQ ID NO: 132067 - DNA, 25 bp, E. coli
gaattagtctggtaacaacgcgaga

SEQ ID NO: 132068 - DNA, 25 bp, E. coli
gaatgttttaatttgccagcagccg

SEQ ID NO: 132069 - DNA, 25 bp, E. coli
gaattagtctggaaacaacgcgaga

SEQ ID NO: 132070 - DNA, 25 bp, E. coli
gaatgttttaatatgccagcagccg

SEQ ID NO: 132071 - DNA, 25 bp, E. coli
ggagagccgaatcatgtctacgatg

SEQ ID NO: 132072 - DNA, 25 bp, E. coli
ggctgggtaaaaatattgctgatct

SEQ ID NO: 132073 - DNA, 25 bp, E. coli
ggagagccgaatgatgtctacgatg

SEQ ID NO: 132074 - DNA, 25 bp, E. coli
ggctgggtaaaattattgctgatct

SEQ ID NO: 132075 - DNA, 25 bp, E. coli
taataaaaattaagtctgtcgggat

SEQ ID NO: 132076 - DNA, 25 bp, E. coli
taataaaaattatgtctgtcgggat

SEQ ID NO: 132077 - DNA, 25 bp, E. coli
atcgcgatttcgctgatcctgccag

SEQ ID NO: 132078 - DNA, 25 bp, E. coli
atcgcgatttcggtgatcctgccag

SEQ ID NO: 132079 - DNA, 25 bp, E. coli
tttcggtgatcctgccagggcttgt

SEQ ID NO: 132080 - DNA, 25 bp, E. coli
tttcggtgatccagccagggcttgt

SEQ ID NO: 132081 - DNA, 25 bp, E. coli
tgatcgcgatttcggtgatcctgcc

SEQ ID NO: 132082 - DNA, 25 bp, E. coli
tgatcgcgatttgggtgatcctgcc

SEQ ID NO: 132083 - DNA, 25 bp, E. coli
tcgcgatttcggtgatcctgccagg

SEQ ID NO: 132084 - DNA, 25 bp, E. coli
tcgcgatttcggagatcctgccagg

SEQ ID NO: 132085 - DNA, 25 bp, E. coli
gcgatttcggtgatcctgccagggc

SEQ ID NO: 132086 - DNA, 25 bp, E. coli
gcgatttcggtgttcctgccagggc

SEQ ID NO: 132087 - DNA, 25 bp, E. coli
gctgatcgcgatttcggtgatcctg

SEQ ID NO: 132088 - DNA, 25 bp, E. coli
gctgatcgcgatatcggtgatcctg

SEQ ID NO: 132089 - DNA, 25 bp, E. coli
cgagctgatcgcgatttcggtgatc

SEQ ID NO: 132090 - DNA, 25 bp, E. coli
cgagctgatcgccatttcggtgatc

SEQ ID NO: 132091 - DNA, 25 bp, E. coli
cgcgatttcggtgatcctgccaggg

SEQ ID NO: 132092 - DNA, 25 bp, E. coli
cgcgatttcggtcatcctgccaggg

SEQ ID NO: 132093 - DNA, 25 bp, E. coli
cgatttcggtgatcctgccagggct

SEQ ID NO: 132094 - DNA, 25 bp, E. coli
cgatttcggtgaacctgccagggct

SEQ ID NO: 132095 - DNA, 25 bp, E. coli
gatttcggtgatgctgccagggctt

SEQ ID NO: 132096 - DNA, 25 bp, E. coli
gatttcggtgatcctgccagggctt

SEQ ID NO: 132097 - DNA, 25 bp, E. coli
gagctgatcgcgatttcggtgatcc

SEQ ID NO: 132098 - DNA, 25 bp, E. coli
gagctgatcgcgttttcggtgatcc

SEQ ID NO: 132099 - DNA, 25 bp, E. coli
caatatgtagcatatggcgcaacca

SEQ ID NO: 132100 - DNA, 25 bp, E. coli
aagatatttactctccatcaggcag

SEQ ID NO: 132101 - DNA, 25 bp, E. coli
caatatgtagcaaatggcgcaacca

SEQ ID NO: 132102 - DNA, 25 bp, E. coli
aagatatttactgtccatcaggcag

SEQ ID NO: 132103 - DNA, 25 bp, E. coli
cacactggtattcaatggaactccc

SEQ ID NO: 132104 - DNA, 25 bp, E. coli
cacactggtattgaatggaactccc

SEQ ID NO: 132105 - DNA, 25 bp, E. coli
aaaaaagtgtcatcgctggcgtctt

SEQ ID NO: 132106 - DNA, 25 bp, E. coli
aacaattgggtaagcacctgtagcc

SEQ ID NO: 132107 - DNA, 25 bp, E. coli
aaaaaagtgtcaacgctggcgtctt

SEQ ID NO: 132108 - DNA, 25 bp, E. coli
aacaattgggtatgcacctgtagcc

SEQ ID NO: 132109 - DNA, 25 bp, E. coli
tttaccacgtgtacagctatcgcga

SEQ ID NO: 132110 - DNA, 25 bp, E. coli
tttaccacgtgttcagctatcgcga

SEQ ID NO: 132111 - DNA, 25 bp, E. coli
gacataggtgttcttggccccgacg

SEQ ID NO: 132112 - DNA, 25 bp, E. coli
gacataggtgttgttggccccgacg

SEQ ID NO: 132113 - DNA, 25 bp, E. coli
cgcaggcggtcagaaagtacaaaat

SEQ ID NO: 132114 - DNA, 25 bp, E. coli
cgcaggcggtcacaaagtacaaaat

SEQ ID NO: 132115 - DNA, 25 bp, E. coli
gggatgctatccttgacaccaagta

SEQ ID NO: 132116 - DNA, 25 bp, E. coli
gggatgctatccatgacaccaagta

SEQ ID NO: 132117 - DNA, 25 bp, E. coli
tggaactcccttccgaatgactgga

SEQ ID NO: 132118 - DNA, 25 bp, E. coli
tggaactcccttgcgaatgactgga

SEQ ID NO: 132119 - DNA, 25 bp, E. coli
taatgcatatgtgcgatacaagcgg

SEQ ID NO: 132120 - DNA, 25 bp, E. coli
taatgcatatgtccgatacaagcgg

SEQ ID NO: 132121 - DNA, 25 bp, E. coli
caattcgctgcgcatccggctctgt

SEQ ID NO: 132122 - DNA, 25 bp, E. coli
caattcgctgcggatccggctctgt

SEQ ID NO: 132123 - DNA, 25 bp, E. coli
catgcagacagccacgaacctggat

SEQ ID NO: 132124 - DNA, 25 bp, E. coli
catgcagacagcgacgaacctggat

SEQ ID NO: 132125 - DNA, 25 bp, E. coli
acattgccgccggatatggcgccgg

SEQ ID NO: 132126 - DNA, 25 bp, E. coli
atatggcgccggacgttctgctgca

SEQ ID NO: 132127 - DNA, 25 bp, E. coli
atatggcgccggtcgttctgctgca

SEQ ID NO: 132128 - DNA, 25 bp, E. coli
acattgccgccgcatatggcgccgg

SEQ ID NO: 132129 - DNA, 25 bp, E. coli
acagcttcgcgaaacattgccgccg

SEQ ID NO: 132130 - DNA, 25 bp, E. coli
acagcttcgcgatacattgccgccg

SEQ ID NO: 132131 - DNA, 25 bp, E. coli
ttgatggtgaagtggacagctcccg

SEQ ID NO: 132132 - DNA, 25 bp, E. coli
ttgatggtgaagaggacagctcccg

SEQ ID NO: 132133 - DNA, 25 bp, E. coli
tgttccagattttaccaacctttgc

SEQ ID NO: 132134 - DNA, 25 bp, E. coli
tgttccagatttaaccaacctttgc

SEQ ID NO: 132135 - DNA, 25 bp, E. coli
tgctgatcgcccaattcgctgcgga

SEQ ID NO: 132136 - DNA, 25 bp, E. coli
tgctgatcgccctattcgctgcgga

SEQ ID NO: 132137 - DNA, 25 bp, E. coli
gacagcgacgaagctggatgaagtc

SEQ ID NO: 132138 - DNA, 25 bp, E. coli
gacagcgacgaacctggatgaagtc

SEQ ID NO: 132139 - DNA, 25 bp, E. coli
ccgcgctttgcccatgttccagatt

SEQ ID NO: 132140 - DNA, 25 bp, E. coli
ccgcgctttgccgatgttccagatt

SEQ ID NO: 132141 - DNA, 25 bp, E. coli
gtgaagaggacacctcccggcgcat

SEQ ID NO: 132142 - DNA, 25 bp, E. coli
gtgaagaggacagctcccggcgcat

SEQ ID NO: 132143 - DNA, 25 bp, E. coli
caacgatgatgtctgctcgtagccg

SEQ ID NO: 132144 - DNA, 25 bp, E. coli
caacgatgatgtgtgctcgtagccg

SEQ ID NO: 132145 - DNA, 25 bp, E. coli
caggcaacaggttttctggcgttta

SEQ ID NO: 132146 - DNA, 25 bp, E. coli
caggcaacaggtattctggcgttta

SEQ ID NO: 132147 - DNA, 25 bp, E. coli
taaaaaatgtctgtgtcaatgagcc

SEQ ID NO: 132148 - DNA, 25 bp, E. coli
taaaaaatgtctctgtcaatgagcc

SEQ ID NO: 132149 - DNA, 25 bp, E. coli
tcccgggtgtgctgattctggaagc

SEQ ID NO: 132150 - DNA, 25 bp, E. coli
tcccgggtgtgcagattctggaagc

SEQ ID NO: 132151 - DNA, 25 bp, E. coli
tctggaagcaatggcacaggcaaca

SEQ ID NO: 132152 - DNA, 25 bp, E. coli
tctggaagcaatcgcacaggcaaca

SEQ ID NO: 132153 - DNA, 25 bp, E. coli
gactactaacacacatactctgcag

SEQ ID NO: 132154 - DNA, 25 bp, E. coli
gactactaacactcatactctgcag

SEQ ID NO: 132155 - DNA, 25 bp, E. coli
ctggaaccgggtcagctgtactact

SEQ ID NO: 132156 - DNA, 25 bp, E. coli
ctggaaccgggtgagctgtactact

SEQ ID NO: 132157 - DNA, 25 bp, E. coli
gattttagaactactgccgcaccgt

SEQ ID NO: 132158 - DNA, 25 bp, E. coli
gattttagaacttctgccgcaccgt

SEQ ID NO: 132159 - DNA, 25 bp, E. coli
gtcactttcgaataaacgcgccgcg

SEQ ID NO: 132160 - DNA, 25 bp, E. coli
gtcgtgcctggccatcaaatgatca

SEQ ID NO: 132161 - DNA, 25 bp, E. coli
gtcactttcgaaaaaacgcgccgcg

SEQ ID NO: 132162 - DNA, 25 bp, E. coli
gtcgtgcctggcgatcaaatgatca

SEQ ID NO: 132163 - DNA, 25 bp, E. coli
tcaatgagccattcttccagggcca

SEQ ID NO: 132164 - DNA, 25 bp, E. coli
tcaatgagccatacttccagggcca

SEQ ID NO: 132165 - DNA, 25 bp, E. coli
atgaccgcgcctaccggcggagcga

SEQ ID NO: 132166 - DNA, 25 bp, E. coli
atgaccgcgccttccggcggagcga

SEQ ID NO: 132167 - DNA, 25 bp, E. coli
aacaaaagcggcctcagagatcagc

SEQ ID NO: 132168 - DNA, 25 bp, E. coli
aacaaaagcggcgtcagagatcagc

SEQ ID NO: 132169 - DNA, 25 bp, E. coli
tatcgtgacagaaatgatagtgctg

SEQ ID NO: 132170 - DNA, 25 bp, E. coli
tatcgtgacagatatgatagtgctg

SEQ ID NO: 132171 - DNA, 25 bp, E. coli
gcggcgtcagagatcagctttaagt

SEQ ID NO: 132172 - DNA, 25 bp, E. coli
gcggcgtcagagttcagctttaagt

SEQ ID NO: 132173 - DNA, 25 bp, E. coli
cgcgttccagtttatcgtgacagaa

SEQ ID NO: 132174 - DNA, 25 bp, E. coli
cgcgttccagttaatcgtgacagaa

SEQ ID NO: 132175 - DNA, 25 bp, E. coli
cgtgacagaaatcatagtgctggga

SEQ ID NO: 132176 - DNA, 25 bp, E. coli
cgtcagagatcacctttaagttcgc

SEQ ID NO: 132177 - DNA, 25 bp, E. coli
cgtgacagaaatgatagtgctggga

SEQ ID NO: 132178 - DNA, 25 bp, E. coli
cgtcagagatcagctttaagttcgc

SEQ ID NO: 132179 - DNA, 25 bp, E. coli
gatacggcgtgacgcaacaaaagcg

SEQ ID NO: 132180 - DNA, 25 bp, E. coli
gatcagctttaacttcgcgttccag

SEQ ID NO: 132181 - DNA, 25 bp, E. coli
gatacggcgtgaggcaacaaaagcg

SEQ ID NO: 132182 - DNA, 25 bp, E. coli
gatcagctttaagttcgcgttccag

SEQ ID NO: 132183 - DNA, 25 bp, E. coli
taagttcgcgttgcagtttatcgtg

SEQ ID NO: 132184 - DNA, 25 bp, E. coli
taagttcgcgttccagtttatcgtg

SEQ ID NO: 132185 - DNA, 25 bp, E. coli
gagcgatacggcgtgaggcaacaaa

SEQ ID NO: 132186 - DNA, 25 bp, E. coli
gagcgatacggcctgaggcaacaaa

SEQ ID NO: 132187 - DNA, 25 bp, E. coli
cactaatcaggtcgaaatatccccg

SEQ ID NO: 132188 - DNA, 25 bp, E. coli
cactaatcaggtggaaatatccccg

SEQ ID NO: 132189 - DNA, 25 bp, E. coli
cagtaaatgcggaatcgcgacgacc

SEQ ID NO: 132190 - DNA, 25 bp, E. coli
cagtaaatgcggtatcgcgacgacc

SEQ ID NO: 132191 - DNA, 25 bp, E. coli
taaacgcgggctcgattgaacaggt

SEQ ID NO: 132192 - DNA, 25 bp, E. coli
taaacgcgggctggattgaacaggt

SEQ ID NO: 132193 - DNA, 25 bp, E. coli
agcgtattactattgcgccgcaagg

SEQ ID NO: 132194 - DNA, 25 bp, E. coli
agcgtattactaatgcgccgcaagg

SEQ ID NO: 132195 - DNA, 25 bp, E. coli
tattgaagagcaactggatctcggc

SEQ ID NO: 132196 - DNA, 25 bp, E. coli
tattgaagagcatctggatctcggc

SEQ ID NO: 132197 - DNA, 25 bp, E. coli
gctactggcgattgatggactggaa

SEQ ID NO: 132198 - DNA, 25 bp, E. coli
gctactggcgatagatggactggaa

SEQ ID NO: 132199 - DNA, 25 bp, E. coli
cgttactgctggatggcacgctcga

SEQ ID NO: 132200 - DNA, 25 bp, E. coli
cgttactgctggttggcacgctcga

SEQ ID NO: 132201 - DNA, 25 bp, E. coli
ctatcagtgcgatgcggcgtttggc

SEQ ID NO: 132202 - DNA, 25 bp, E. coli
ctatcagtgcgaagcggcgtttggc

SEQ ID NO: 132203 - DNA, 25 bp, E. coli
tcacatcattaagagcgccgaacag

SEQ ID NO: 132204 - DNA, 25 bp, E. coli
tcacatcattaacagcgccgaacag

SEQ ID NO: 132205 - DNA, 25 bp, E. coli
gatgattatttccagccgctgcgtg

SEQ ID NO: 132206 - DNA, 25 bp, E. coli
gatgattatttcgagccgctgcgtg

SEQ ID NO: 132207 - DNA, 25 bp, E. coli
gacccgttaatggatgccgatgaag

SEQ ID NO: 132208 - DNA, 25 bp, E. coli
gacccgttaatgcatgccgatgaag

SEQ ID NO: 132209 - DNA, 25 bp, E. coli
catctgcgaaatcctcgccaggcgg

SEQ ID NO: 132210 - DNA, 25 bp, E. coli
catctgcgaaatgctcgccaggcgg

SEQ ID NO: 132211 - DNA, 25 bp, E. coli
aacacgttatgcacgcatctgcgaa

SEQ ID NO: 132212 - DNA, 25 bp, E. coli
aacacgttatgctcgcatctgcgaa

SEQ ID NO: 132213 - DNA, 25 bp, E. coli
tacctgcgtgaatacagcatgttgc

SEQ ID NO: 132214 - DNA, 25 bp, E. coli
tacctgcgtgaaaacagcatgttgc

SEQ ID NO: 132215 - DNA, 25 bp, E. coli
tattcgtaccgctgatgccgttggc

SEQ ID NO: 132216 - DNA, 25 bp, E. coli
tattcgtaccgcagatgccgttggc

SEQ ID NO: 132217 - DNA, 25 bp, E. coli
tgggacaggagaaaacgggcatcac

SEQ ID NO: 132218 - DNA, 25 bp, E. coli
tgggacaggagataacgggcatcac

SEQ ID NO: 132219 - DNA, 25 bp, E. coli
tgatctgaccgtctgcatggagcag

SEQ ID NO: 132220 - DNA, 25 bp, E. coli
tgaatgtttccgttgcctcagccct

SEQ ID NO: 132221 - DNA, 25 bp, E. coli
tgaatgtttccgatgcctcagccct

SEQ ID NO: 132222 - DNA, 25 bp, E. coli
tgatctgaccgtgtgcatggagcag

SEQ ID NO: 132223 - DNA, 25 bp, E. coli
gcatggagcaggtccacaaacctca

SEQ ID NO: 132224 - DNA, 25 bp, E. coli
gcatggagcaggaccacaaacctca

SEQ ID NO: 132225 - DNA, 25 bp, E. coli
gaaattgattactctcgcccgacct

SEQ ID NO: 132226 - DNA, 25 bp, E. coli
gaaattgattacactcgcccgacct

SEQ ID NO: 132227 - DNA, 25 bp, E. coli
tggcgaaagtcggaaaacgcaaagg

SEQ ID NO: 132228 - DNA, 25 bp, E. coli
tggcgaaagtcgcaaaacgcaaagg

SEQ ID NO: 132229 - DNA, 25 bp, E. coli
gatgccgttggcgtacatgaagttc

SEQ ID NO: 132230 - DNA, 25 bp, E. coli
gatgccgttggcctacatgaagttc

SEQ ID NO: 132231 - DNA, 25 bp, E. coli
aacgctgcccttatcgccactggat

SEQ ID NO: 132232 - DNA, 25 bp, E. coli
catgttctttgagtggtggttcgcc

SEQ ID NO: 132233 - DNA, 25 bp, E. coli
catgttctttgactggtggttcgcc

SEQ ID NO: 132234 - DNA, 25 bp, E. coli
atccatccgcgcagggaggcgagtt

SEQ ID NO: 132235 - DNA, 25 bp, E. coli
atccatccgcgctgggaggcgagtt

SEQ ID NO: 132236 - DNA, 25 bp, E. coli
acaccatgaagagcgcgacgcatta

SEQ ID NO: 132237 - DNA, 25 bp, E. coli
acaccatgaagaccgcgacgcatta

SEQ ID NO: 132238 - DNA, 25 bp, E. coli
aacgctgcccttttcgccactggat

SEQ ID NO: 132239 - DNA, 25 bp, E. coli
tttgactggtggttcgccacatcac

SEQ ID NO: 132240 - DNA, 25 bp, E. coli
tttgactggtggatcgccacatcac

SEQ ID NO: 132241 - DNA, 25 bp, E. coli
tgaaaacgctgtgggaagcagtgcc

SEQ ID NO: 132242 - DNA, 25 bp, E. coli
tgaaaacgctgtcggaagcagtgcc

SEQ ID NO: 132243 - DNA, 25 bp, E. coli
tcggcatttacacggctggcagagc

SEQ ID NO: 132244 - DNA, 25 bp, E. coli
tcggcatttacagggctggcagagc

SEQ ID NO: 132245 - DNA, 25 bp, E. coli
gcgacgcattaattcgactacgggc

SEQ ID NO: 132246 - DNA, 25 bp, E. coli
gttagttacgctgatttttctgtca

SEQ ID NO: 132247 - DNA, 25 bp, E. coli
gttagttacgctcatttttctgtca

SEQ ID NO: 132248 - DNA, 25 bp, E. coli
gcgacgcattaaatcgactacgggc

SEQ ID NO: 132249 - DNA, 25 bp, E. coli
gcaacgtcagcgtgagccgtttttc

SEQ ID NO: 132250 - DNA, 25 bp, E. coli
gcaacgtcagcgagagccgtttttc

SEQ ID NO: 132251 - DNA, 25 bp, E. coli
ctggcagagcgcaacgtcagcgtga

SEQ ID NO: 132252 - DNA, 25 bp, E. coli
ctggcagagcgctacgtcagcgtga

SEQ ID NO: 132253 - DNA, 25 bp, E. coli
aatgtcgatgctgaaagggacgcca

SEQ ID NO: 132254 - DNA, 25 bp, E. coli
aatgtcgatgctcaaagggacgcca

SEQ ID NO: 132255 - DNA, 25 bp, E. coli
tactggtactcttcgccaggcgcga

SEQ ID NO: 132256 - DNA, 25 bp, E. coli
tactggtactctacgccaggcgcga

SEQ ID NO: 132257 - DNA, 25 bp, E. coli
agtaacgccccatcaactgcactgg

SEQ ID NO: 132258 - DNA, 25 bp, E. coli
agtaacgccccaacaactgcactgg

SEQ ID NO: 132259 - DNA, 25 bp, E. coli
aaagggacgccaatttcatcgatca

SEQ ID NO: 132260 - DNA, 25 bp, E. coli
aaagggacgccattttcatcgatca

SEQ ID NO: 132261 - DNA, 25 bp, E. coli
ttcgccctggacatcggtttcacgg

SEQ ID NO: 132262 - DNA, 25 bp, E. coli
ttcgccctggacttcggtttcacgg

SEQ ID NO: 132263 - DNA, 25 bp, E. coli
gctcgccccagaatgcgtatggtta

SEQ ID NO: 132264 - DNA, 25 bp, E. coli
gctcgccccagattgcgtatggtta

SEQ ID NO: 132265 - DNA, 25 bp, E. coli
cattggtgatcacccagtaacgccc

SEQ ID NO: 132266 - DNA, 25 bp, E. coli
cattggtgatcagccagtaacgccc

SEQ ID NO: 132267 - DNA, 25 bp, E. coli
gataagtggctgcacgccaaccact

SEQ ID NO: 132268 - DNA, 25 bp, E. coli
gataagtggctggacgccaaccact

SEQ ID NO: 132269 - DNA, 25 bp, E. coli
gtttcaatgattccaccgctggtgt

SEQ ID NO: 132270 - DNA, 25 bp, E. coli
gatcatttcgtactgaccctgcatg

SEQ ID NO: 132271 - DNA, 25 bp, E. coli
gatcatttcgtagtgaccctgcatg

SEQ ID NO: 132272 - DNA, 25 bp, E. coli
gtttcaatgattgcaccgctggtgt

SEQ ID NO: 132273 - DNA, 25 bp, E. coli
ggtttcacggcctttgccattggtg

SEQ ID NO: 132274 - DNA, 25 bp, E. coli
ggtttcacggccattgccattggtg

SEQ ID NO: 132275 - DNA, 25 bp, E. coli
aatagaggcacctacaggctccggt

SEQ ID NO: 132276 - DNA, 25 bp, E. coli
aatagaggcaccaacaggctccggt

SEQ ID NO: 132277 - DNA, 25 bp, E. coli
taaacaactgctggatggccaggtc

SEQ ID NO: 132278 - DNA, 25 bp, E. coli
aaatttaatcatcgtgcagccggtc

SEQ ID NO: 132279 - DNA, 25 bp, E. coli
aaatttaatcatggtgcagccggtc

SEQ ID NO: 132280 - DNA, 25 bp, E. coli
tatgctgcgcaacataaacaggctc

SEQ ID NO: 132281 - DNA, 25 bp, E. coli
tatgaggcgcttgcacttaatcgcg

SEQ ID NO: 132282 - DNA, 25 bp, E. coli
tatgaggcgcttccacttaatcgcg

SEQ ID NO: 132283 - DNA, 25 bp, E. coli
tatgctgcgcaagataaacaggctc

SEQ ID NO: 132284 - DNA, 25 bp, E. coli
tgtggcggacgctgcaacatattga

SEQ ID NO: 132285 - DNA, 25 bp, E. coli
tgtggcggacgcagcaacatattga

SEQ ID NO: 132286 - DNA, 25 bp, E. coli
gaagcattatttataacgccagcgg

SEQ ID NO: 132287 - DNA, 25 bp, E. coli
gaagcattatttttaacgccagcgg

SEQ ID NO: 132288 - DNA, 25 bp, E. coli
gaaaaaaggttctaggctcgcaagg

SEQ ID NO: 132289 - DNA, 25 bp, E. coli
gaaaaaaggttcaaggctcgcaagg

SEQ ID NO: 132290 - DNA, 25 bp, E. coli
gatacttgtcgctacccaggtcgtg

SEQ ID NO: 132291 - DNA, 25 bp, E. coli
gatacttgtcgcaacccaggtcgtg

SEQ ID NO: 132292 - DNA, 25 bp, E. coli
taaacaactgctcgatggccaggtc

SEQ ID NO: 132293 - DNA, 25 bp, E. coli
tcaaaacagaggctgaaggcctggc

SEQ ID NO: 132294 - DNA, 25 bp, E. coli
tcaaaacagagggtgaaggcctggc

SEQ ID NO: 132295 - DNA, 25 bp, E. coli
gagaacgtatttccaggaccgacag

SEQ ID NO: 132296 - DNA, 25 bp, E. coli
gagaacgtatttgcaggaccgacag

SEQ ID NO: 132297 - DNA, 25 bp, E. coli
aattctgtggctttctgatcaaatc

SEQ ID NO: 132298 - DNA, 25 bp, E. coli
aattctgtggctatctgatcaaatc

SEQ ID NO: 132299 - DNA, 25 bp, E. coli
acattgggtgttgcaacaggcgcgc

SEQ ID NO: 132300 - DNA, 25 bp, E. coli
acattgggtgttccaacaggcgcgc

SEQ ID NO: 132301 - DNA, 25 bp, E. coli
tgtcgctcgctcctctggcggcgtt

SEQ ID NO: 132302 - DNA, 25 bp, E. coli
tgattggtgcgtaaattctgtggct

SEQ ID NO: 132303 - DNA, 25 bp, E. coli
tgtcgctcgctcgtctggcggcgtt

SEQ ID NO: 132304 - DNA, 25 bp, E. coli
tgattggtgcgttaattctgtggct

SEQ ID NO: 132305 - DNA, 25 bp, E. coli
tgctgcggcgttcacctggatgaac

SEQ ID NO: 132306 - DNA, 25 bp, E. coli
tgctgcggcgttgacctggatgaac

SEQ ID NO: 132307 - DNA, 25 bp, E. coli
tgccacggttgatgctggcatcgct

SEQ ID NO: 132308 - DNA, 25 bp, E. coli
tgccacggttgaagctggcatcgct

SEQ ID NO: 132309 - DNA, 25 bp, E. coli
gcggcgtgatgctgacgttattgct

SEQ ID NO: 132310 - DNA, 25 bp, E. coli
gctggcatcgctgattggtgcgtta

SEQ ID NO: 132311 - DNA, 25 bp, E. coli
gcgtttgttgccacggttgatgctg

SEQ ID NO: 132312 - DNA, 25 bp, E. coli
gcggcgtgatgcagacgttattgct

SEQ ID NO: 132313 - DNA, 25 bp, E. coli
gctggcatcgctcattggtgcgtta

SEQ ID NO: 132314 - DNA, 25 bp, E. coli
gcgtttgttgcctcggttgatgctg

SEQ ID NO: 132315 - DNA, 25 bp, E. coli
gacgttattgcttcttcgcccgtta

SEQ ID NO: 132316 - DNA, 25 bp, E. coli
gacgttattgctacttcgcccgtta

SEQ ID NO: 132317 - DNA, 25 bp, E. coli
ggaaccgacgactttgggtgttgca

SEQ ID NO: 132318 - DNA, 25 bp, E. coli
ggaaccgacgacattgggtgttgca

SEQ ID NO: 132319 - DNA, 25 bp, E. coli
taaaacgatcatgagtgacagcggg

SEQ ID NO: 132320 - DNA, 25 bp, E. coli
taaaacgatcatcagtgacagcggg

SEQ ID NO: 132321 - DNA, 25 bp, E. coli
agagaaatagctccccttgcccgaa

SEQ ID NO: 132322 - DNA, 25 bp, E. coli
agagaaatagctgcccttgcccgaa

SEQ ID NO: 132323 - DNA, 25 bp, E. coli
aaacacggattattcaacgctcgcg

SEQ ID NO: 132324 - DNA, 25 bp, E. coli
aaacacggattaatcaacgctcgcg

SEQ ID NO: 132325 - DNA, 25 bp, E. coli
tattgtcaaccagtatccaggcatg

SEQ ID NO: 132326 - DNA, 25 bp, E. coli
tattgcacagcgttatcagcgagcc

SEQ ID NO: 132327 - DNA, 25 bp, E. coli
tattgcacagcgatatcagcgagcc

SEQ ID NO: 132328 - DNA, 25 bp, E. coli
tattgtcaaccactatccaggcatg

SEQ ID NO: 132329 - DNA, 25 bp, E. coli
gaacgtgcgtttatctcctgcgatg

SEQ ID NO: 132330 - DNA, 25 bp, E. coli
gaaacgtacattgcaatctgtggcg

SEQ ID NO: 132331 - DNA, 25 bp, E. coli
gaaacgtacattccaatctgtggcg

SEQ ID NO: 132332 - DNA, 25 bp, E. coli
gaacgtgcgtttttctcctgcgatg

SEQ ID NO: 132333 - DNA, 25 bp, E. coli
cgcgggtaaaggacatctgcaacga

SEQ ID NO: 132334 - DNA, 25 bp, E. coli
gcgggttacctgtgactattgcaca

SEQ ID NO: 132335 - DNA, 25 bp, E. coli
cgcgggtaaaggtcatctgcaacga

SEQ ID NO: 132336 - DNA, 25 bp, E. coli
gcgggttacctgagactattgcaca

SEQ ID NO: 132337 - DNA, 25 bp, E. coli
cattatcggaggtctgattcgccca

SEQ ID NO: 132338 - DNA, 25 bp, E. coli
cattatcggaggactgattcgccca

SEQ ID NO: 132339 - DNA, 25 bp, E. coli
tcaaaatttgatcccgttgagccgc

SEQ ID NO: 132340 - DNA, 25 bp, E. coli
tcaaaatttgatgccgttgagccgc

SEQ ID NO: 132341 - DNA, 25 bp, E. coli
aatcactcgtgctttcgtaaacgca

SEQ ID NO: 132342 - DNA, 25 bp, E. coli
aatcactcgtgcattcgtaaacgca

SEQ ID NO: 132343 - DNA, 25 bp, E. coli
cactcgtgcattcgtaaacgcagat

SEQ ID NO: 132344 - DNA, 25 bp, E. coli
cactcgtgcattggtaaacgcagat

SEQ ID NO: 132345 - DNA, 25 bp, E. coli
taaacgcagatttcgacggcttcgc

SEQ ID NO: 132346 - DNA, 25 bp, E. coli
taaacgcagattacgacggcttcgc

SEQ ID NO: 132347 - DNA, 25 bp, E. coli
aaacgcagatttcgacggcttcgcg

SEQ ID NO: 132348 - DNA, 25 bp, E. coli
cattcgtaaacgcagatttcgacgg

SEQ ID NO: 132349 - DNA, 25 bp, E. coli
aaacgcagatttggacggcttcgcg

SEQ ID NO: 132350 - DNA, 25 bp, E. coli
cattcgtaaacggagatttcgacgg

SEQ ID NO: 132351 - DNA, 25 bp, E. coli
tgcattcgtaaaggcagatttcgac

SEQ ID NO: 132352 - DNA, 25 bp, E. coli
tgcattcgtaaacgcagatttcgac

SEQ ID NO: 132353 - DNA, 25 bp, E. coli
tcgtaaacgcagatttcgacggctt

SEQ ID NO: 132354 - DNA, 25 bp, E. coli
tcgtaaacgcagttttcgacggctt

SEQ ID NO: 132355 - DNA, 25 bp, E. coli
tcgtgcattcgtaaacgcagatttc

SEQ ID NO: 132356 - DNA, 25 bp, E. coli
tcgtgcattcgttaacgcagatttc

SEQ ID NO: 132357 - DNA, 25 bp, E. coli
gcgcgaaatcactcgtgcattcgta

SEQ ID NO: 132358 - DNA, 25 bp, E. coli
gcgcgaaatcacacgtgcattcgta

SEQ ID NO: 132359 - DNA, 25 bp, E. coli
gcgaaatcactcgtgcattcgtaaa

SEQ ID NO: 132360 - DNA, 25 bp, E. coli
gcgaaatcactcctgcattcgtaaa

SEQ ID NO: 132361 - DNA, 25 bp, E. coli
tcactcgtgcatacgtaaacgcaga

SEQ ID NO: 132362 - DNA, 25 bp, E. coli
tcactcgtgcattcgtaaacgcaga

SEQ ID NO: 132363 - DNA, 25 bp, E. coli
aaccggcgggttactctcagaagcg

SEQ ID NO: 132364 - DNA, 25 bp, E. coli
aaccggcgggtttctctcagaagcg

SEQ ID NO: 132365 - DNA, 25 bp, E. coli
caaatttggcctgcctgtcgctggg

SEQ ID NO: 132366 - DNA, 25 bp, E. coli
caaatttggcctccctgtcgctggg

SEQ ID NO: 132367 - DNA, 25 bp, E. coli
tacaacacaccagcgacattatggg

SEQ ID NO: 132368 - DNA, 25 bp, E. coli
tactggaacagaagcaactggctcc

SEQ ID NO: 132369 - DNA, 25 bp, E. coli
tacaacacaccaccgacattatggg

SEQ ID NO: 132370 - DNA, 25 bp, E. coli
tactggaacagatgcaactggctcc

SEQ ID NO: 132371 - DNA, 25 bp, E. coli
tagcagacggtcagaaaacctggac

SEQ ID NO: 132372 - DNA, 25 bp, E. coli
tagcagacggtctgaaaacctggac

SEQ ID NO: 132373 - DNA, 25 bp, E. coli
tattattggtctgggcgctatgctg

SEQ ID NO: 132374 - DNA, 25 bp, E. coli
tattggctttacgtcgcggctggag

SEQ ID NO: 132375 - DNA, 25 bp, E. coli
tattggctttacctcgcggctggag

SEQ ID NO: 132376 - DNA, 25 bp, E. coli
tattattggtctcggcgctatgctg

SEQ ID NO: 132377 - DNA, 25 bp, E. coli
gacaaacgaactttcgctgcgctga

SEQ ID NO: 132378 - DNA, 25 bp, E. coli
gacaaacgaactatcgctgcgctga

SEQ ID NO: 132379 - DNA, 25 bp, E. coli
gataaaataaatgcaccgggcgtcg

SEQ ID NO: 132380 - DNA, 25 bp, E. coli
gttactccacgcagacatcggctgg

SEQ ID NO: 132381 - DNA, 25 bp, E. coli
gttactccacgctgacatcggctgg

SEQ ID NO: 132382 - DNA, 25 bp, E. coli
gataaaataaatccaccgggcgtcg

SEQ ID NO: 132383 - DNA, 25 bp, E. coli
ggcgtatgatcgaacactctggtgg

SEQ ID NO: 132384 - DNA, 25 bp, E. coli
ggcgtatgatcgtacactctggtgg

SEQ ID NO: 132385 - DNA, 25 bp, E. coli
aataaccagactcgcaacatcaacg

SEQ ID NO: 132386 - DNA, 25 bp, E. coli
caatagcctggatttattcaataaa

SEQ ID NO: 132387 - DNA, 25 bp, E. coli
caatttcgtgaataaccagactggc

SEQ ID NO: 132388 - DNA, 25 bp, E. coli
aataaccagactggcaacatcaacg

SEQ ID NO: 132389 - DNA, 25 bp, E. coli
caatttcgtgaaaaaccagactggc

SEQ ID NO: 132390 - DNA, 25 bp, E. coli
caatagcctggaattattcaataaa

SEQ ID NO: 132391 - DNA, 25 bp, E. coli
gctaacctgggcctgctaccccgga

SEQ ID NO: 132392 - DNA, 25 bp, E. coli
gctaacctgggcgtgctaccccgga

SEQ ID NO: 132393 - DNA, 25 bp, E. coli
acaatgaaaggttgcaatgatatcc

SEQ ID NO: 132394 - DNA, 25 bp, E. coli
acaatgaaaggtagcaatgatatcc

SEQ ID NO: 132395 - DNA, 25 bp, E. coli
tatcctttatgacagacctgggtgg

SEQ ID NO: 132396 - DNA, 25 bp, E. coli
tatcctttatgagagacctgggtgg

SEQ ID NO: 132397 - DNA, 25 bp, E. coli
tgatatcctttatgagagacctggg

SEQ ID NO: 132398 - DNA, 25 bp, E. coli
tgatatcctttaagagagacctggg

SEQ ID NO: 132399 - DNA, 25 bp, E. coli
cctttatgagagacctgggtggaat

SEQ ID NO: 132400 - DNA, 25 bp, E. coli
cctttatgagagtcctgggtggaat

SEQ ID NO: 132401 - DNA, 25 bp, E. coli
gcaatgatatcctttatgagagacc

SEQ ID NO: 132402 - DNA, 25 bp, E. coli
gcaatgatatccattatgagagacc

SEQ ID NO: 132403 - DNA, 25 bp, E. coli
gagaaaagtttatcaatagcctgga

SEQ ID NO: 132404 - DNA, 25 bp, E. coli
gaaaagaataagttatgtactcaga

SEQ ID NO: 132405 - DNA, 25 bp, E. coli
gaaaagaataagatatgtactcaga

SEQ ID NO: 132406 - DNA, 25 bp, E. coli
gagaaaagtttaacaatagcctgga

SEQ ID NO: 132407 - DNA, 25 bp, E. coli
caaccgccggttcagcaggtgattt

SEQ ID NO: 132408 - DNA, 25 bp, E. coli
caaccgccggttgagcaggtgattt

SEQ ID NO: 132409 - DNA, 25 bp, E. coli
tatcgcgatgccacgaatgaacggg

SEQ ID NO: 132410 - DNA, 25 bp, E. coli
tatcgcgatgcctcgaatgaacggg

SEQ ID NO: 132411 - DNA, 25 bp, E. coli
ttattacaggaagtacaaccgccgg

SEQ ID NO: 132412 - DNA, 25 bp, E. coli
ttattacaggaactacaaccgccgg

SEQ ID NO: 132413 - DNA, 25 bp, E. coli
tcattgggagcgacaacggtactgg

SEQ ID NO: 132414 - DNA, 25 bp, E. coli
tctgaatgcgacgttaaataccggc

SEQ ID NO: 132415 - DNA, 25 bp, E. coli
tcattgggagcgtcaacggtactgg

SEQ ID NO: 132416 - DNA, 25 bp, E. coli
tctgaatgcgaccttaaataccggc

SEQ ID NO: 132417 - DNA, 25 bp, E. coli
cgcgactgggatgcaatggttgata

SEQ ID NO: 132418 - DNA, 25 bp, E. coli
cgcgactgggatccaatggttgata

SEQ ID NO: 132419 - DNA, 25 bp, E. coli
cgcagccattggacggaaaacagat

SEQ ID NO: 132420 - DNA, 25 bp, E. coli
cgcagccattggtcggaaaacagat

SEQ ID NO: 132421 - DNA, 25 bp, E. coli
cccttgagttgctgggaggtttcac

SEQ ID NO: 132422 - DNA, 25 bp, E. coli
cccttgagttgcagggaggtttcac

SEQ ID NO: 132423 - DNA, 25 bp, E. coli
gattattacaggaacagcttgcaca

SEQ ID NO: 132424 - DNA, 25 bp, E. coli
gattattacaggtacagcttgcaca

SEQ ID NO: 132425 - DNA, 25 bp, E. coli
gatattgccaaaccgttacgtctgg

SEQ ID NO: 132426 - DNA, 25 bp, E. coli
gatattgccaaagcgttacgtctgg

SEQ ID NO: 132427 - DNA, 25 bp, E. coli
tcaattgagccaccgatgcgatgcc

SEQ ID NO: 132428 - DNA, 25 bp, E. coli
tcaattgagccagcgatgcgatgcc

SEQ ID NO: 132429 - DNA, 25 bp, E. coli
ttatggcagcgtaacatcctcgccg

SEQ ID NO: 132430 - DNA, 25 bp, E. coli
ttatggcagcgttacatcctcgccg

SEQ ID NO: 132431 - DNA, 25 bp, E. coli
tggtgtttaccctgcaggcgtgtgt

SEQ ID NO: 132432 - DNA, 25 bp, E. coli
tgtactgaaccgttttcactggcgc

SEQ ID NO: 132433 - DNA, 25 bp, E. coli
tgtactgaaccgatttcactggcgc

SEQ ID NO: 132434 - DNA, 25 bp, E. coli
tgaaatcctcttgtcacgcgccaaa

SEQ ID NO: 132435 - DNA, 25 bp, E. coli
tcgactttaaatccgttatggcagc

SEQ ID NO: 132436 - DNA, 25 bp, E. coli
tcgactttaaatgcgttatggcagc

SEQ ID NO: 132437 - DNA, 25 bp, E. coli
tgaaatcctcttctcacgcgccaaa

SEQ ID NO: 132438 - DNA, 25 bp, E. coli
tccggttgaacgagtagaagcctgg

SEQ ID NO: 132439 - DNA, 25 bp, E. coli
tgccgatgccaaagcactgctggcg

SEQ ID NO: 132440 - DNA, 25 bp, E. coli
tccggttgaacgtgtagaagcctgg

SEQ ID NO: 132441 - DNA, 25 bp, E. coli
tgccgatgccaatgcactgctggcg

SEQ ID NO: 132442 - DNA, 25 bp, E. coli
tcggcgggcataccaacattgtgca

SEQ ID NO: 132443 - DNA, 25 bp, E. coli
tcggcgggcatagcaacattgtgca

SEQ ID NO: 132444 - DNA, 25 bp, E. coli
gcgccaaagtctcgaacggtgagaa

SEQ ID NO: 132445 - DNA, 25 bp, E. coli
gcgccaaagtctggaacggtgagaa

SEQ ID NO: 132446 - DNA, 25 bp, E. coli
gaagcctgggttacgccaaatctga

SEQ ID NO: 132447 - DNA, 25 bp, E. coli
gaagcctgggtttcgccaaatctga

SEQ ID NO: 132448 - DNA, 25 bp, E. coli
tggtgtttacccagcaggcgtgtgt

SEQ ID NO: 132449 - DNA, 25 bp, E. coli
gatgaagaacggtctgggcgtcacc

SEQ ID NO: 132450 - DNA, 25 bp, E. coli
gatgaagaacggactgggcgtcacc

SEQ ID NO: 132451 - DNA, 25 bp, E. coli
cattcgtaacgtattgcgggcaaaa

SEQ ID NO: 132452 - DNA, 25 bp, E. coli
cattcgtaacgttttgcgggcaaaa

SEQ ID NO: 132453 - DNA, 25 bp, E. coli
aacggtcaggtgtaagcctttggcg

SEQ ID NO: 132454 - DNA, 25 bp, E. coli
aacggtcaggtgaaagcctttggcg

SEQ ID NO: 132455 - DNA, 25 bp, E. coli
tagttatgacgacaacggccaggtg

SEQ ID NO: 132456 - DNA, 25 bp, E. coli
tagttatgacgagaacggccaggtg

SEQ ID NO: 132457 - DNA, 25 bp, E. coli
ttaaaagtgtgtggataaccgcctg

SEQ ID NO: 132458 - DNA, 25 bp, E. coli
ttaaaagtgtgtcgataaccgcctg

SEQ ID NO: 132459 - DNA, 25 bp, E. coli
tgtccggaggcgtaaaacagcgcgt

SEQ ID NO: 132460 - DNA, 25 bp, E. coli
tgtccggaggcgaaaaacagcgcgt

SEQ ID NO: 132461 - DNA, 25 bp, E. coli
tgaactggcgatgaaacctggcctg

SEQ ID NO: 132462 - DNA, 25 bp, E. coli
tgaactggcgatcaaacctggcctg

SEQ ID NO: 132463 - DNA, 25 bp, E. coli
tcactggatattccgcgtaaacgcg

SEQ ID NO: 132464 - DNA, 25 bp, E. coli
cgccgcagcaaagcagcattcgtaa

SEQ ID NO: 132465 - DNA, 25 bp, E. coli
cgccgcagcaaaccagcattcgtaa

SEQ ID NO: 132466 - DNA, 25 bp, E. coli
ggatgagatcctgcatctggcagac

SEQ ID NO: 132467 - DNA, 25 bp, E. coli
ggatgagatcctccatctggcagac

SEQ ID NO: 132468 - DNA, 25 bp, E. coli
tggatgaaccgcaggcgtcactgga

SEQ ID NO: 132469 - DNA, 25 bp, E. coli
ggcgcttttagggattgaaccgttg

SEQ ID NO: 132470 - DNA, 25 bp, E. coli
ggcgcttttaggcattgaaccgttg

SEQ ID NO: 132471 - DNA, 25 bp, E. coli
tggatgaaccgctggcgtcactgga

SEQ ID NO: 132472 - DNA, 25 bp, E. coli
tcactggatattgcgcgtaaacgcg

SEQ ID NO: 132473 - DNA, 25 bp, E. coli
catcaggccttcaggcatagctggc

SEQ ID NO: 132474 - DNA, 25 bp, E. coli
catcaggccttctggcatagctggc

SEQ ID NO: 132475 - DNA, 25 bp, E. coli
taaagctcgcacagttgcgtgaacg

SEQ ID NO: 132476 - DNA, 25 bp, E. coli
taaagctcgcactgttgcgtgaacg

SEQ ID NO: 132477 - DNA, 25 bp, E. coli
tgtcaccaaagaattaccgctaaag

SEQ ID NO: 132478 - DNA, 25 bp, E. coli
tgtcaccaaagatttaccgctaaag

SEQ ID NO: 132479 - DNA, 25 bp, E. coli
gcgtacatgcatatctgcaagggca

SEQ ID NO: 132480 - DNA, 25 bp, E. coli
gcgtacatgcatttctgcaagggca

SEQ ID NO: 132481 - DNA, 25 bp, E. coli
gactttgaaatagaggaagcctttg

SEQ ID NO: 132482 - DNA, 25 bp, E. coli
gactttgaaatacaggaagcctttg

SEQ ID NO: 132483 - DNA, 25 bp, E. coli
cgaatgacgaaagctgtctgcgcca

SEQ ID NO: 132484 - DNA, 25 bp, E. coli
cgaatgacgaaacctgtctgcgcca

SEQ ID NO: 132485 - DNA, 25 bp, E. coli
cgctgggagcgttacgtggtactca

SEQ ID NO: 132486 - DNA, 25 bp, E. coli
cgctgggagcgtaacgtggtactca

SEQ ID NO: 132487 - DNA, 25 bp, E. coli
ctgactgatgtgttggaaggcgtac

SEQ ID NO: 132488 - DNA, 25 bp, E. coli
cgtggtactcaaagctgaattggca

SEQ ID NO: 132489 - DNA, 25 bp, E. coli
ctgactgatgtgatggaaggcgtac

SEQ ID NO: 132490 - DNA, 25 bp, E. coli
cgtggtactcaatgctgaattggca

SEQ ID NO: 132491 - DNA, 25 bp, E. coli
gatttgaacgtattcgccgtgatga

SEQ ID NO: 132492 - DNA, 25 bp, E. coli
gatttgaacgtaatcgccgtgatga

SEQ ID NO: 132493 - DNA, 25 bp, E. coli
ggatttgtggttgctcgcgaatgac

SEQ ID NO: 132494 - DNA, 25 bp, E. coli
ggatttgtggttcctcgcgaatgac

SEQ ID NO: 132495 - DNA, 25 bp, E. coli
cactggtagcgcagaagtgattcag

SEQ ID NO: 132496 - DNA, 25 bp, E. coli
cactggtagcgctgaagtgattcag

SEQ ID NO: 132497 - DNA, 25 bp, E. coli
atctccgggacgtacactggtagcg

SEQ ID NO: 132498 - DNA, 25 bp, E. coli
atctccgggacgaacactggtagcg

SEQ ID NO: 132499 - DNA, 25 bp, E. coli
tcgctatagtggacgtaccgccatg

SEQ ID NO: 132500 - DNA, 25 bp, E. coli
tcgctatagtggtcgtaccgccatg

SEQ ID NO: 132501 - DNA, 25 bp, E. coli
gcccgtgaaccggatcgctatagtg

SEQ ID NO: 132502 - DNA, 25 bp, E. coli
gcccgtgaaccgcatcgctatagtg

SEQ ID NO: 132503 - DNA, 25 bp, E. coli
gcatcgctatagtggtcgtaccgcc

SEQ ID NO: 132504 - DNA, 25 bp, E. coli
gcatcgctatagaggtcgtaccgcc

SEQ ID NO: 132505 - DNA, 25 bp, E. coli
gaaccgcatcgctatagtggtcgta

SEQ ID NO: 132506 - DNA, 25 bp, E. coli
gaaccgcatcgcaatagtggtcgta

SEQ ID NO: 132507 - DNA, 25 bp, E. coli
cgaacactggtagcgctgaagtgat

SEQ ID NO: 132508 - DNA, 25 bp, E. coli
cgaacactggtaccgctgaagtgat

SEQ ID NO: 132509 - DNA, 25 bp, E. coli
cgggacgaacacaggtagcgctgaa

SEQ ID NO: 132510 - DNA, 25 bp, E. coli
ctggtagcgctgtagtgattcaggc

SEQ ID NO: 132511 - DNA, 25 bp, E. coli
cgggacgaacactggtagcgctgaa

SEQ ID NO: 132512 - DNA, 25 bp, E. coli
ctggtagcgctgaagtgattcaggc

SEQ ID NO: 132513 - DNA, 25 bp, E. coli
cgtgaaccgcatcgctatagtggtc

SEQ ID NO: 132514 - DNA, 25 bp, E. coli
cgtgaaccgcatggctatagtggtc

SEQ ID NO: 132515 - DNA, 25 bp, E. coli
ggacgaacactggtagcgctgaagt

SEQ ID NO: 132516 - DNA, 25 bp, E. coli
ggacgaacactgctagcgctgaagt

SEQ ID NO: 132517 - DNA, 25 bp, E. coli
cagggatatttattttttcattgaa

SEQ ID NO: 132518 - DNA, 25 bp, E. coli
cagggatatttaatttttcattgaa

SEQ ID NO: 132519 - DNA, 25 bp, E. coli
aacgtcagcatcctaacagcaccag

SEQ ID NO: 132520 - DNA, 25 bp, E. coli
aacgtcagcatcgtaacagcaccag

SEQ ID NO: 132521 - DNA, 25 bp, E. coli
tggtgtacccgataaacgtcagcat

SEQ ID NO: 132522 - DNA, 25 bp, E. coli
tgtacccgaaaaacgtcagcatcct

SEQ ID NO: 132523 - DNA, 25 bp, E. coli
tgtacccgaaaatcgtcagcatcct

SEQ ID NO: 132524 - DNA, 25 bp, E. coli
tggtgtacccgaaaaacgtcagcat

SEQ ID NO: 132525 - DNA, 25 bp, E. coli
tgaatctttatttgcataatctgaa

SEQ ID NO: 132526 - DNA, 25 bp, E. coli
tgaatctttattagcataatctgaa

SEQ ID NO: 132527 - DNA, 25 bp, E. coli
tctgaatggtgttcccgaaaaacgt

SEQ ID NO: 132528 - DNA, 25 bp, E. coli
tctgaatggtgtacccgaaaaacgt

SEQ ID NO: 132529 - DNA, 25 bp, E. coli
gcataatctgaatggtgtacccgaa

SEQ ID NO: 132530 - DNA, 25 bp, E. coli
gcatcctaacaggaccaggatttaa

SEQ ID NO: 132531 - DNA, 25 bp, E. coli
gcataatctgaaaggtgtacccgaa

SEQ ID NO: 132532 - DNA, 25 bp, E. coli
gcatcctaacagcaccaggatttaa

SEQ ID NO: 132533 - DNA, 25 bp, E. coli
gaaaaacgtcaggatcctaacagca

SEQ ID NO: 132534 - DNA, 25 bp, E. coli
gaaaaacgtcagcatcctaacagca

SEQ ID NO: 132535 - DNA, 25 bp, E. coli
cgaatatattattttcagggatatt

SEQ ID NO: 132536 - DNA, 25 bp, E. coli
cgaatatattatattcagggatatt

SEQ ID NO: 132537 - DNA, 25 bp, E. coli
gtcagcatcctaacagcaccaggat

SEQ ID NO: 132538 - DNA, 25 bp, E. coli
gtcagcatcctatcagcaccaggat

SEQ ID NO: 132539 - DNA, 25 bp, E. coli
catcaaacggatagccgagcgtggg

SEQ ID NO: 132540 - DNA, 25 bp, E. coli
catcaaacggattgccgagcgtggg

SEQ ID NO: 132541 - DNA, 25 bp, E. coli
taaaggcgctggatgaaaagtacgc

SEQ ID NO: 132542 - DNA, 25 bp, E. coli
taaaggcgctggttgaaaagtacgc

SEQ ID NO: 132543 - DNA, 25 bp, E. coli
acaacaggagacgatgttgcagcag

SEQ ID NO: 132544 - DNA, 25 bp, E. coli
acaacaggagaccatgttgcagcag

SEQ ID NO: 132545 - DNA, 25 bp, E. coli
aaaagtacgcgcagcgggtggcaca

SEQ ID NO: 132546 - DNA, 25 bp, E. coli
aaaagtacgcgctgcgggtggcaca

SEQ ID NO: 132547 - DNA, 25 bp, E. coli
ttattgcggcgcgaaaatccggcac

SEQ ID NO: 132548 - DNA, 25 bp, E. coli
ttattgcggcgccaaaatccggcac

SEQ ID NO: 132549 - DNA, 25 bp, E. coli
gcgaaaatccgggacgacaacgcca

SEQ ID NO: 132550 - DNA, 25 bp, E. coli
gcgaaaatccggcacgacaacgcca

SEQ ID NO: 132551 - DNA, 25 bp, E. coli
gcgcactctgtgctcatcaaacgga

SEQ ID NO: 132552 - DNA, 25 bp, E. coli
gcgcactctgtggtcatcaaacgga

SEQ ID NO: 132553 - DNA, 25 bp, E. coli
cgaacggatagatcaacaggagacg

SEQ ID NO: 132554 - DNA, 25 bp, E. coli
cgaacggatagaacaacaggagacg

SEQ ID NO: 132555 - DNA, 25 bp, E. coli
cgacaacgccaggacaggtatcgcg

SEQ ID NO: 132556 - DNA, 25 bp, E. coli
cgacaacgccagcacaggtatcgcg

SEQ ID NO: 132557 - DNA, 25 bp, E. coli
gagcgccgcgcccaatattattgcg

SEQ ID NO: 132558 - DNA, 25 bp, E. coli
gatgaacgcgcgactgaagagcgcc

SEQ ID NO: 132559 - DNA, 25 bp, E. coli
gatgaacgcgcgtctgaagagcgcc

SEQ ID NO: 132560 - DNA, 25 bp, E. coli
gagcgccgcgccgaatattattgcg

SEQ ID NO: 132561 - DNA, 25 bp, E. coli
catattctggattccttactggcga

SEQ ID NO: 132562 - DNA, 25 bp, E. coli
catattctggataccttactggcga

SEQ ID NO: 132563 - DNA, 25 bp, E. coli
tacgttcgattttcagcatggtgca

SEQ ID NO: 132564 - DNA, 25 bp, E. coli
tacgttcgatttacagcatggtgca

SEQ ID NO: 132565 - DNA, 25 bp, E. coli
tatcgttgtagcgtttgccggaccg

SEQ ID NO: 132566 - DNA, 25 bp, E. coli
taccgcctggcggaaattttatagt

SEQ ID NO: 132567 - DNA, 25 bp, E. coli
tatcgttgtagcctttgccggaccg

SEQ ID NO: 132568 - DNA, 25 bp, E. coli
taccgcctggcgcaaattttatagt

SEQ ID NO: 132569 - DNA, 25 bp, E. coli
tatagtgacgccactgcgatggtcg

SEQ ID NO: 132570 - DNA, 25 bp, E. coli
tatagtgacgcctctgcgatggtcg

SEQ ID NO: 132571 - DNA, 25 bp, E. coli
gcaattctcgatttcgccgcgctgg

SEQ ID NO: 132572 - DNA, 25 bp, E. coli
gcaattctcgatatcgccgcgctgg

SEQ ID NO: 132573 - DNA, 25 bp, E. coli
gatctgtggcctggtactgggcacc

SEQ ID NO: 132574 - DNA, 25 bp, E. coli
gatagcgtatactgcgaaaagcgcc

SEQ ID NO: 132575 - DNA, 25 bp, E. coli
gatagcgtatacagcgaaaagcgcc

SEQ ID NO: 132576 - DNA, 25 bp, E. coli
gatctgtggcctcgtactgggcacc

SEQ ID NO: 132577 - DNA, 25 bp, E. coli
tggaaaaagagttcgttatcgccgc

SEQ ID NO: 132578 - DNA, 25 bp, E. coli
tggaaaaagagtacgttatcgccgc

SEQ ID NO: 132579 - DNA, 25 bp, E. coli
taagccgtttactgagcggagctgc

SEQ ID NO: 132580 - DNA, 25 bp, E. coli
taagccgtttacagagcggagctgc

SEQ ID NO: 132581 - DNA, 25 bp, E. coli
gacctcggacgccatgttttaagcc

SEQ ID NO: 132582 - DNA, 25 bp, E. coli
gacctcggacgcgatgttttaagcc

SEQ ID NO: 132583 - DNA, 25 bp, E. coli
caaggttggagaccagaacagcgtc

SEQ ID NO: 132584 - DNA, 25 bp, E. coli
caaggttggagagcagaacagcgtc

SEQ ID NO: 132585 - DNA, 25 bp, E. coli
acgtaaccaaagtggcgtgcgccag

SEQ ID NO: 132586 - DNA, 25 bp, E. coli
acgtaaccaaagaggcgtgcgccag

SEQ ID NO: 132587 - DNA, 25 bp, E. coli
tatcaacccgaataacaaactgccg

SEQ ID NO: 132588 - DNA, 25 bp, E. coli
tatcaacccgaaaaacaaactgccg

SEQ ID NO: 132589 - DNA, 25 bp, E. coli
tgatcgctacgatgttacccagcag

SEQ ID NO: 132590 - DNA, 25 bp, E. coli
tgttccgttgcttaaggagcagcca

SEQ ID NO: 132591 - DNA, 25 bp, E. coli
tgttccgttgctaaaggagcagcca

SEQ ID NO: 132592 - DNA, 25 bp, E. coli
tgatcgctacgaagttacccagcag

SEQ ID NO: 132593 - DNA, 25 bp, E. coli
tccacagcaagatacgatgcagacg

SEQ ID NO: 132594 - DNA, 25 bp, E. coli
tccacagcaagaaacgatgcagacg

SEQ ID NO: 132595 - DNA, 25 bp, E. coli
cggatgccgcctctctggactgtca

SEQ ID NO: 132596 - DNA, 25 bp, E. coli
cggatgccgcctgtctggactgtca

SEQ ID NO: 132597 - DNA, 25 bp, E. coli
tgtggagcctgatcggaattaccgc

SEQ ID NO: 132598 - DNA, 25 bp, E. coli
tgtggagcctgaacggaattaccgc

SEQ ID NO: 132599 - DNA, 25 bp, E. coli
taacgagccgatctacaaggttgga

SEQ ID NO: 132600 - DNA, 25 bp, E. coli
taagatttgcgtcgattgccacagc

SEQ ID NO: 132601 - DNA, 25 bp, E. coli
taagatttgcgtggattgccacagc

SEQ ID NO: 132602 - DNA, 25 bp, E. coli
taacgagccgatgtacaaggttgga

SEQ ID NO: 132603 - DNA, 25 bp, E. coli
gatgcagacgttaagtgacaaagga

SEQ ID NO: 132604 - DNA, 25 bp, E. coli
gatgcagacgtttagtgacaaagga

SEQ ID NO: 132605 - DNA, 25 bp, E. coli
aattttctggaaatcctatgatgcc

SEQ ID NO: 132606 - DNA, 25 bp, E. coli
aattttctggaattcctatgatgcc

SEQ ID NO: 132607 - DNA, 25 bp, E. coli
caatccgatgaagggcagaacctcg

SEQ ID NO: 132608 - DNA, 25 bp, E. coli
caatccgatgaacggcagaacctcg

SEQ ID NO: 132609 - DNA, 25 bp, E. coli
cacaacgtcctgcatagggaacacg

SEQ ID NO: 132610 - DNA, 25 bp, E. coli
cacaacgtcctggatagggaacacg

SEQ ID NO: 132611 - DNA, 25 bp, E. coli
taaacgaaccagaatagaattcgcc

SEQ ID NO: 132612 - DNA, 25 bp, E. coli
taaacgaaccagtatagaattcgcc

SEQ ID NO: 132613 - DNA, 25 bp, E. coli
tagggaacacgtattcccctgtgca

SEQ ID NO: 132614 - DNA, 25 bp, E. coli
tagaattcgcccttttggcatgata

SEQ ID NO: 132615 - DNA, 25 bp, E. coli
tagaattcgcccatttggcatgata

SEQ ID NO: 132616 - DNA, 25 bp, E. coli
tagggaacacgttttcccctgtgca

SEQ ID NO: 132617 - DNA, 25 bp, E. coli
cctatgatgcctatcccggtaaatg

SEQ ID NO: 132618 - DNA, 25 bp, E. coli
cctatgatgcctttcccggtaaatg

SEQ ID NO: 132619 - DNA, 25 bp, E. coli
gctgtgagttcagaaagattctgca

SEQ ID NO: 132620 - DNA, 25 bp, E. coli
gctgtgagttcacaaagattctgca

SEQ ID NO: 132621 - DNA, 25 bp, E. coli
gaacctcgcggttctgccgtttttg

SEQ ID NO: 132622 - DNA, 25 bp, E. coli
gaacctcgcggtactgccgtttttg

SEQ ID NO: 132623 - DNA, 25 bp, E. coli
cccggtaaatggagctgtgagttca

SEQ ID NO: 132624 - DNA, 25 bp, E. coli
cccggtaaatggtgctgtgagttca

SEQ ID NO: 132625 - DNA, 25 bp, E. coli
gatatcattctcgtgaacaatccga

SEQ ID NO: 132626 - DNA, 25 bp, E. coli
gatatcattctcctgaacaatccga

SEQ ID NO: 132627 - DNA, 25 bp, E. coli
caacaacgtgttacgctgctaaccc

SEQ ID NO: 132628 - DNA, 25 bp, E. coli
caacaacgtgtttcgctgctaaccc

SEQ ID NO: 132629 - DNA, 25 bp, E. coli
tataccggcagtacacaaatacccc

SEQ ID NO: 132630 - DNA, 25 bp, E. coli
tatagaaaaaacagcgcaagactgg

SEQ ID NO: 132631 - DNA, 25 bp, E. coli
tatagaaaaaactgcgcaagactgg

SEQ ID NO: 132632 - DNA, 25 bp, E. coli
tttagtcgaaaaactctcaccggct

SEQ ID NO: 132633 - DNA, 25 bp, E. coli
tttagtcgaaaatctctcaccggct

SEQ ID NO: 132634 - DNA, 25 bp, E. coli
tataccggcagttcacaaatacccc

SEQ ID NO: 132635 - DNA, 25 bp, E. coli
tgaaacggatacacgaaggcattct

SEQ ID NO: 132636 - DNA, 25 bp, E. coli
tgaaacggatactcgaaggcattct

SEQ ID NO: 132637 - DNA, 25 bp, E. coli
gaaggcattcttgcgatcatcatcg

SEQ ID NO: 132638 - DNA, 25 bp, E. coli
gcaagactggaggaacttatcgccc

SEQ ID NO: 132639 - DNA, 25 bp, E. coli
gaaggcattcttccgatcatcatcg

SEQ ID NO: 132640 - DNA, 25 bp, E. coli
gcaagactggagcaacttatcgccc

SEQ ID NO: 132641 - DNA, 25 bp, E. coli
cattggcttaatgtacgccgccgct

SEQ ID NO: 132642 - DNA, 25 bp, E. coli
cattggcttaatctacgccgccgct

SEQ ID NO: 132643 - DNA, 25 bp, E. coli
tggacaacagccatgtgcaggttac

SEQ ID NO: 132644 - DNA, 25 bp, E. coli
tggaattgcgtctcttataccggca

SEQ ID NO: 132645 - DNA, 25 bp, E. coli
tggaattgcgtcacttataccggca

SEQ ID NO: 132646 - DNA, 25 bp, E. coli
tggttaacctttattggcgcaatcg

SEQ ID NO: 132647 - DNA, 25 bp, E. coli
tggttaaccttttttggcgcaatcg

SEQ ID NO: 132648 - DNA, 25 bp, E. coli
tggacaacagccttgtgcaggttac

SEQ ID NO: 132649 - DNA, 25 bp, E. coli
caacaggcgttctatctggtggcag

SEQ ID NO: 132650 - DNA, 25 bp, E. coli
caaaatcccggatagtacgcgcgtg

SEQ ID NO: 132651 - DNA, 25 bp, E. coli
caaattcttgaaactgcacagcagg

SEQ ID NO: 132652 - DNA, 25 bp, E. coli
caaattcttgaatctgcacagcagg

SEQ ID NO: 132653 - DNA, 25 bp, E. coli
caacaggcgttcaatctggtggcag

SEQ ID NO: 132654 - DNA, 25 bp, E. coli
caaaatcccggaaagtacgcgcgtg

SEQ ID NO: 132655 - DNA, 25 bp, E. coli
cagttgttcaaaggcgagccgatgc

SEQ ID NO: 132656 - DNA, 25 bp, E. coli
cagttgttcaaacgcgagccgatgc

SEQ ID NO: 132657 - DNA, 25 bp, E. coli
tatgccaccgacaataccgatatgg

SEQ ID NO: 132658 - DNA, 25 bp, E. coli
tatgccaccgactataccgatatgg

SEQ ID NO: 132659 - DNA, 25 bp, E. coli
ttatcaccgatgagaatacgccgct

SEQ ID NO: 132660 - DNA, 25 bp, E. coli
ttatcaccgatgtgaatacgccgct

SEQ ID NO: 132661 - DNA, 25 bp, E. coli
gaactggcatttgcacgcgtcacgc

SEQ ID NO: 132662 - DNA, 25 bp, E. coli
gaactggcatttccacgcgtcacgc

SEQ ID NO: 132663 - DNA, 25 bp, E. coli
cgtctgtttctctatcaatgggcca

SEQ ID NO: 132664 - DNA, 25 bp, E. coli
cattgctgaagcctgggttacccgt

SEQ ID NO: 132665 - DNA, 25 bp, E. coli
cgtctgtttctcaatcaatgggcca

SEQ ID NO: 132666 - DNA, 25 bp, E. coli
cattgctgaagcgtgggttacccgt

SEQ ID NO: 132667 - DNA, 25 bp, E. coli
gttacccgtaaagcgaccagcgatg

SEQ ID NO: 132668 - DNA, 25 bp, E. coli
gttacccgtaaaccgaccagcgatg

SEQ ID NO: 132669 - DNA, 25 bp, E. coli
gagttaaaagcccttgatgcgccag

SEQ ID NO: 132670 - DNA, 25 bp, E. coli
gagttaaaagccgttgatgcgccag

SEQ ID NO: 132671 - DNA, 25 bp, E. coli
aaggccagggacacttcaggatgaa

SEQ ID NO: 132672 - DNA, 25 bp, E. coli
aaggccagggactcttcaggatgaa

SEQ ID NO: 132673 - DNA, 25 bp, E. coli
caggatgaacgaatggccgcaaggc

SEQ ID NO: 132674 - DNA, 25 bp, E. coli
caggatgatgacacttctgcaggac

SEQ ID NO: 132675 - DNA, 25 bp, E. coli
caggatgaacgattggccgcaaggc

SEQ ID NO: 132676 - DNA, 25 bp, E. coli
caggatgatgactcttctgcaggac

SEQ ID NO: 132677 - DNA, 25 bp, E. coli
aacgaaccgggagcgctgtgaatac

SEQ ID NO: 132678 - DNA, 25 bp, E. coli
aacgaaccgggaccgctgtgaatac

SEQ ID NO: 132679 - DNA, 25 bp, E. coli
tagctggaatgctgcgaaacgaacc

SEQ ID NO: 132680 - DNA, 25 bp, E. coli
tagctggaatgcagcgaaacgaacc

SEQ ID NO: 132681 - DNA, 25 bp, E. coli
ttctgcaggacacaccaggatggtg

SEQ ID NO: 132682 - DNA, 25 bp, E. coli
ttctgcaggacagaccaggatggtg

SEQ ID NO: 132683 - DNA, 25 bp, E. coli
tgtcaaggatgaccagggagcaaca

SEQ ID NO: 132684 - DNA, 25 bp, E. coli
tgtcaaggatgagcagggagcaaca

SEQ ID NO: 132685 - DNA, 25 bp, E. coli
gccgcaaggccagaggaaaagttgt

SEQ ID NO: 132686 - DNA, 25 bp, E. coli
gccgcaaggccacaggaaaagttgt

SEQ ID NO: 132687 - DNA, 25 bp, E. coli
ccaggatggagaatgagaaccggtc

SEQ ID NO: 132688 - DNA, 25 bp, E. coli
ccaggatggagattgagaaccggtc

SEQ ID NO: 132689 - DNA, 25 bp, E. coli
gtcagacaacgaagtgaacatcagg

SEQ ID NO: 132690 - DNA, 25 bp, E. coli
gtcagacaacgatgtgaacatcagg

SEQ ID NO: 132691 - DNA, 25 bp, E. coli
gacgcgttaaagcacacctccagga

SEQ ID NO: 132692 - DNA, 25 bp, E. coli
gacgcgttaaaggacacctccagga

SEQ ID NO: 132693 - DNA, 25 bp, E. coli
cagagaaagatacctgtgctcacgc

SEQ ID NO: 132694 - DNA, 25 bp, E. coli
cagagaaagatagctgtgctcacgc

SEQ ID NO: 132695 - DNA, 25 bp, E. coli
tacggccaacagagaaagatacctg

SEQ ID NO: 132696 - DNA, 25 bp, E. coli
tacggccaacagtgaaagatacctg

SEQ ID NO: 132697 - DNA, 25 bp, E. coli
atgacgtgtctgtatattaataagc

SEQ ID NO: 132698 - DNA, 25 bp, E. coli
atgacgtgtctgaatattaataagc

SEQ ID NO: 132699 - DNA, 25 bp, E. coli
aaagatacctgtcctcacgccattg

SEQ ID NO: 132700 - DNA, 25 bp, E. coli
aaagatacctgtgctcacgccattg

SEQ ID NO: 132701 - DNA, 25 bp, E. coli
tattaataagctaacccgcattgag

SEQ ID NO: 132702 - DNA, 25 bp, E. coli
tattaataagcttacccgcattgag

SEQ ID NO: 132703 - DNA, 25 bp, E. coli
tgtgctcacgcctttgcttatattg

SEQ ID NO: 132704 - DNA, 25 bp, E. coli
tgtgctcacgccattgcttatattg

SEQ ID NO: 132705 - DNA, 25 bp, E. coli
tccatacacaattcggccaacagag

SEQ ID NO: 132706 - DNA, 25 bp, E. coli
tccatacacaatacggccaacagag

SEQ ID NO: 132707 - DNA, 25 bp, E. coli
ccattgcttataatggctggttaca

SEQ ID NO: 132708 - DNA, 25 bp, E. coli
ccattgcttatattggctggttaca

SEQ ID NO: 132709 - DNA, 25 bp, E. coli
gctaacccgcattgagttaaccaat

SEQ ID NO: 132710 - DNA, 25 bp, E. coli
gctaacccgcatagagttaaccaat

SEQ ID NO: 132711 - DNA, 25 bp, E. coli
cattgagttaaccaataacggattc

SEQ ID NO: 132712 - DNA, 25 bp, E. coli
cattgagttaacgaataacggattc

SEQ ID NO: 132713 - DNA, 25 bp, E. coli
taacggattccatacacaatacggc

SEQ ID NO: 132714 - DNA, 25 bp, E. coli
taacggattccaaacacaatacggc

SEQ ID NO: 132715 - DNA, 25 bp, E. coli
taacaaactggctcaatcttcaatg

SEQ ID NO: 132716 - DNA, 25 bp, E. coli
taacaaactggcacaatcttcaatg

SEQ ID NO: 132717 - DNA, 25 bp, E. coli
atattcgcgccactgccggcctgtt

SEQ ID NO: 132718 - DNA, 25 bp, E. coli
atattcgcgccagtgccggcctgtt

SEQ ID NO: 132719 - DNA, 25 bp, E. coli
tgtcatctgactaaaaaggcgccga

SEQ ID NO: 132720 - DNA, 25 bp, E. coli
tgtcatctgacttaaaaggcgccga

SEQ ID NO: 132721 - DNA, 25 bp, E. coli
tgagggtaaatattcgcgccagtgc

SEQ ID NO: 132722 - DNA, 25 bp, E. coli
tgagggtaaataatcgcgccagtgc

SEQ ID NO: 132723 - DNA, 25 bp, E. coli
tccgagaaaaataaattcgttgacg

SEQ ID NO: 132724 - DNA, 25 bp, E. coli
tccgagaaaaattaattcgttgacg

SEQ ID NO: 132725 - DNA, 25 bp, E. coli
tctttgagattggtaacaaactggc

SEQ ID NO: 132726 - DNA, 25 bp, E. coli
tctttgagattgctaacaaactggc

SEQ ID NO: 132727 - DNA, 25 bp, E. coli
cctttagaaaattgtcgaatcagtg

SEQ ID NO: 132728 - DNA, 25 bp, E. coli
cctttagaaaatagtcgaatcagtg

SEQ ID NO: 132729 - DNA, 25 bp, E. coli
gcacttttgtactttgtcatctgac

SEQ ID NO: 132730 - DNA, 25 bp, E. coli
gcacttttgtacattgtcatctgac

SEQ ID NO: 132731 - DNA, 25 bp, E. coli
cgccgaagcgccattagaaaatagt

SEQ ID NO: 132732 - DNA, 25 bp, E. coli
cgccgaagcgcctttagaaaatagt

SEQ ID NO: 132733 - DNA, 25 bp, E. coli
cttcaatgttggcacgcttttcccc

SEQ ID NO: 132734 - DNA, 25 bp, E. coli
cttcaatgttgggacgcttttcccc

SEQ ID NO: 132735 - DNA, 25 bp, E. coli
gggactgtctgaccacttttgtact

SEQ ID NO: 132736 - DNA, 25 bp, E. coli
gggactgtctgagcacttttgtact

SEQ ID NO: 132737 - DNA, 25 bp, E. coli
caatgattgaacatgcgcggcagat

SEQ ID NO: 132738 - DNA, 25 bp, E. coli
caatgattgaacttgcgcggcagat

SEQ ID NO: 132739 - DNA, 25 bp, E. coli
taacagctgggaacttgaaaagggt

SEQ ID NO: 132740 - DNA, 25 bp, E. coli
aaattgctgcaaaatacctggccgg

SEQ ID NO: 132741 - DNA, 25 bp, E. coli
aaattgctgcaatatacctggccgg

SEQ ID NO: 132742 - DNA, 25 bp, E. coli
tacccatgagaaaatgcagcgcagc

SEQ ID NO: 132743 - DNA, 25 bp, E. coli
tagtcagcttgaagggcagacgcgt

SEQ ID NO: 132744 - DNA, 25 bp, E. coli
tagtcagcttgatgggcagacgcgt

SEQ ID NO: 132745 - DNA, 25 bp, E. coli
tacccatgagaatatgcagcgcagc

SEQ ID NO: 132746 - DNA, 25 bp, E. coli
tataaccggttacagcagatcatgg

SEQ ID NO: 132747 - DNA, 25 bp, E. coli
tataaccggttagagcagatcatgg

SEQ ID NO: 132748 - DNA, 25 bp, E. coli
tgttatcagccgaacacatggcggt

SEQ ID NO: 132749 - DNA, 25 bp, E. coli
tgttatcagccgtacacatggcggt

SEQ ID NO: 132750 - DNA, 25 bp, E. coli
cctgcattggcgtacatggtcgtaa

SEQ ID NO: 132751 - DNA, 25 bp, E. coli
cctgcattggcgaacatggtcgtaa

SEQ ID NO: 132752 - DNA, 25 bp, E. coli
gattatcggcggtcgtatcgacgac

SEQ ID NO: 132753 - DNA, 25 bp, E. coli
gattatcggcggacgtatcgacgac

SEQ ID NO: 132754 - DNA, 25 bp, E. coli
ggtattacagcacccacggaagaga

SEQ ID NO: 132755 - DNA, 25 bp, E. coli
ggtattacagcagccacggaagaga

SEQ ID NO: 132756 - DNA, 25 bp, E. coli
tggctgacagctcaaaatacggttc

SEQ ID NO: 132757 - DNA, 25 bp, E. coli
tggctgacagctgaaaatacggttc

SEQ ID NO: 132758 - DNA, 25 bp, E. coli
taacagctgggatcttgaaaagggt

SEQ ID NO: 132759 - DNA, 25 bp, E. coli
catatggcggctggtgttaagcaac

SEQ ID NO: 132760 - DNA, 25 bp, E. coli
catatggcggctcgtgttaagcaac

SEQ ID NO: 132761 - DNA, 25 bp, E. coli
taaagtcctcgcctacgaagtgcgt

SEQ ID NO: 132762 - DNA, 25 bp, E. coli
taaagtcctcgcgtacgaagtgcgt

SEQ ID NO: 132763 - DNA, 25 bp, E. coli
agtttatcgacttcctgcgcaccgg

SEQ ID NO: 132764 - DNA, 25 bp, E. coli
agtttatcgactacctgcgcaccgg

SEQ ID NO: 132765 - DNA, 25 bp, E. coli
aaatgcacccgctgtcgatcaaacg

SEQ ID NO: 132766 - DNA, 25 bp, E. coli
aaaagttcgcctgtcgtctggctga

SEQ ID NO: 132767 - DNA, 25 bp, E. coli
aaaagttcgcctctcgtctggctga

SEQ ID NO: 132768 - DNA, 25 bp, E. coli
aaatgcacccgcagtcgatcaaacg

SEQ ID NO: 132769 - DNA, 25 bp, E. coli
tatctggtggtgctgaacttcgcga

SEQ ID NO: 132770 - DNA, 25 bp, E. coli
tatctggtggtggtgaacttcgcga

SEQ ID NO: 132771 - DNA, 25 bp, E. coli
tgaccgacaaacagcaactggagga

SEQ ID NO: 132772 - DNA, 25 bp, E. coli
tgaccgacaaactgcaactggagga

SEQ ID NO: 132773 - DNA, 25 bp, E. coli
gccgagcctccaccagtttaataaa

SEQ ID NO: 132774 - DNA, 25 bp, E. coli
gccgagcctccagcagtttaataaa

SEQ ID NO: 132775 - DNA, 25 bp, E. coli
cgaagtgcgtatcttgatgaccgac

SEQ ID NO: 132776 - DNA, 25 bp, E. coli
cgaagtgcgtatgttgatgaccgac

SEQ ID NO: 132777 - DNA, 25 bp, E. coli
gtaaagggattattccgccgccgct

SEQ ID NO: 132778 - DNA, 25 bp, E. coli
gtaaagggattaatccgccgccgct

SEQ ID NO: 132779 - DNA, 25 bp, E. coli
taacgggatgctggagcttggcacc

SEQ ID NO: 132780 - DNA, 25 bp, E. coli
taacgggatgctcgagcttggcacc

SEQ ID NO: 132781 - DNA, 25 bp, E. coli
aatgggtaaatctcgcctggctggc

SEQ ID NO: 132782 - DNA, 25 bp, E. coli
aatgggtaaatcacgcctggctggc

SEQ ID NO: 132783 - DNA, 25 bp, E. coli
cagtttcggcggctatcctgacggc

SEQ ID NO: 132784 - DNA, 25 bp, E. coli
caaattcatctgctgtctggagcga

SEQ ID NO: 132785 - DNA, 25 bp, E. coli
cagtttcggcgggtatcctgacggc

SEQ ID NO: 132786 - DNA, 25 bp, E. coli
caaattcatctggtgtctggagcga

SEQ ID NO: 132787 - DNA, 25 bp, E. coli
tggttgttctcagcagaaacactgg

SEQ ID NO: 132788 - DNA, 25 bp, E. coli
tgatggcattagtcaggcgacaccg

SEQ ID NO: 132789 - DNA, 25 bp, E. coli
tgatggcattagacaggcgacaccg

SEQ ID NO: 132790 - DNA, 25 bp, E. coli
tgaaattgcggtgaacatccctggt

SEQ ID NO: 132791 - DNA, 25 bp, E. coli
tgaaattgcggtcaacatccctggt

SEQ ID NO: 132792 - DNA, 25 bp, E. coli
tctgatcgattactacacgcgtccg

SEQ ID NO: 132793 - DNA, 25 bp, E. coli
tctgatcgattagtacacgcgtccg

SEQ ID NO: 132794 - DNA, 25 bp, E. coli
ccgccagtggtgctgatatgaacac

SEQ ID NO: 132795 - DNA, 25 bp, E. coli
ccgccagtggtggtgatatgaacac

SEQ ID NO: 132796 - DNA, 25 bp, E. coli
cgtctacggccaacgcaaagggtaa

SEQ ID NO: 132797 - DNA, 25 bp, E. coli
cgtctacggccatcgcaaagggtaa

SEQ ID NO: 132798 - DNA, 25 bp, E. coli
tggttgttctcaccagaaacactgg

SEQ ID NO: 132799 - DNA, 25 bp, E. coli
tggtattcagaatagctagctcccc

SEQ ID NO: 132800 - DNA, 25 bp, E. coli
tggtattcagaaaagctagctcccc

SEQ ID NO: 132801 - DNA, 25 bp, E. coli
tcaaactacgcatgcagtcggtagc

SEQ ID NO: 132802 - DNA, 25 bp, E. coli
tcaaactacgcaagcagtcggtagc

SEQ ID NO: 132803 - DNA, 25 bp, E. coli
aatgtgactgtaaagttgaagcgcc

SEQ ID NO: 132804 - DNA, 25 bp, E. coli
aaggcaaaaacaggacgcatctgga

SEQ ID NO: 132805 - DNA, 25 bp, E. coli
aaggcaaaaacacgacgcatctgga

SEQ ID NO: 132806 - DNA, 25 bp, E. coli
aatgtgactgtatagttgaagcgcc

SEQ ID NO: 132807 - DNA, 25 bp, E. coli
tgatccgcactgttcgggtaaaaaa

SEQ ID NO: 132808 - DNA, 25 bp, E. coli
tgatccgcactgatcgggtaaaaaa

SEQ ID NO: 132809 - DNA, 25 bp, E. coli
tgtatagttgaaccgccagcgccgt

SEQ ID NO: 132810 - DNA, 25 bp, E. coli
tgtatagttgaagcgccagcgccgt

SEQ ID NO: 132811 - DNA, 25 bp, E. coli
tcagtgctgagcagctggaactggt

SEQ ID NO: 132812 - DNA, 25 bp, E. coli
tcatcagagccagcggcggtctggt

SEQ ID NO: 132813 - DNA, 25 bp, E. coli
tcatcagagccaccggcggtctggt

SEQ ID NO: 132814 - DNA, 25 bp, E. coli
gaatgcgggctcttcagagccaccg

SEQ ID NO: 132815 - DNA, 25 bp, E. coli
gaatgcgggctcatcagagccaccg

SEQ ID NO: 132816 - DNA, 25 bp, E. coli
gaaagtgatccggactgttcgggta

SEQ ID NO: 132817 - DNA, 25 bp, E. coli
gaaagtgatccgcactgttcgggta

SEQ ID NO: 132818 - DNA, 25 bp, E. coli
gttcgcctactctccagacaggcag

SEQ ID NO: 132819 - DNA, 25 bp, E. coli
gttcgcctactcaccagacaggcag

SEQ ID NO: 132820 - DNA, 25 bp, E. coli
ggatgaccggaatgcgggctcatca

SEQ ID NO: 132821 - DNA, 25 bp, E. coli
ggatgaccggaaagcgggctcatca

SEQ ID NO: 132822 - DNA, 25 bp, E. coli
ggaaatacctcaatcgtatcactga

SEQ ID NO: 132823 - DNA, 25 bp, E. coli
ggaaatacctcattcgtatcactga

SEQ ID NO: 132824 - DNA, 25 bp, E. coli
tcagtgctgagctgctggaactggt

SEQ ID NO: 132825 - DNA, 25 bp, E. coli
aacgtgctgtttcccgatgacccaa

SEQ ID NO: 132826 - DNA, 25 bp, E. coli
caacagcatctttattaccgactgg

SEQ ID NO: 132827 - DNA, 25 bp, E. coli
cacgatggcggaagtgaccttcaac

SEQ ID NO: 132828 - DNA, 25 bp, E. coli
cacgatggcggatgtgaccttcaac

SEQ ID NO: 132829 - DNA, 25 bp, E. coli
caacagcatcttaattaccgactgg

SEQ ID NO: 132830 - DNA, 25 bp, E. coli
taccgactggaataattacgccgcg

SEQ ID NO: 132831 - DNA, 25 bp, E. coli
taccgactggaaaaattacgccgcg

SEQ ID NO: 132832 - DNA, 25 bp, E. coli
atggcgtggtgtatgtctccggtac

SEQ ID NO: 132833 - DNA, 25 bp, E. coli
atggcgtggtgtttgtctccggtac

SEQ ID NO: 132834 - DNA, 25 bp, E. coli
aacgtgctgtttgccgatgacccaa

SEQ ID NO: 132835 - DNA, 25 bp, E. coli
aaaccggcgcgaatctgcattcagt

SEQ ID NO: 132836 - DNA, 25 bp, E. coli
aaaccggcgcgattctgcattcagt

SEQ ID NO: 132837 - DNA, 25 bp, E. coli
ttcgttcccggctcgctggctgatg

SEQ ID NO: 132838 - DNA, 25 bp, E. coli
ttcgttcccggcacgctggctgatg

SEQ ID NO: 132839 - DNA, 25 bp, E. coli
tctccggtacgctggcttttgatca

SEQ ID NO: 132840 - DNA, 25 bp, E. coli
tctccggtacgcaggcttttgatca

SEQ ID NO: 132841 - DNA, 25 bp, E. coli
tcagtgcggactggtaaaacctgac

SEQ ID NO: 132842 - DNA, 25 bp, E. coli
tcagtgcggactcgtaaaacctgac

SEQ ID NO: 132843 - DNA, 25 bp, E. coli
gcgcaaacccgccacgttctggaaa

SEQ ID NO: 132844 - DNA, 25 bp, E. coli
gcgcaaacccgcgacgttctggaaa

SEQ ID NO: 132845 - DNA, 25 bp, E. coli
ggtggaaatcgcgacaattgcgcat

SEQ ID NO: 132846 - DNA, 25 bp, E. coli
ggtggaaatcgccacaattgcgcat

SEQ ID NO: 132847 - DNA, 25 bp, E. coli
aatctgtatggcttcctgcgtgata

SEQ ID NO: 132848 - DNA, 25 bp, E. coli
aatctgtatggcatcctgcgtgata

SEQ ID NO: 132849 - DNA, 25 bp, E. coli
cacgctggtccgttttgatccagtg

SEQ ID NO: 132850 - DNA, 25 bp, E. coli
cacgctggtccgatttgatccagtg

SEQ ID NO: 132851 - DNA, 25 bp, E. coli
agcgattaccttaatctgtatggct

SEQ ID NO: 132852 - DNA, 25 bp, E. coli
agcctacgacgatgcggtggagaaa

SEQ ID NO: 132853 - DNA, 25 bp, E. coli
accttaatctgtatggcttcctgcg

SEQ ID NO: 132854 - DNA, 25 bp, E. coli
accttaatctgtttggcttcctgcg

SEQ ID NO: 132855 - DNA, 25 bp, E. coli
agcaagcctacgtcgaagcggtgga

SEQ ID NO: 132856 - DNA, 25 bp, E. coli
agcgattacctttatctgtatggct

SEQ ID NO: 132857 - DNA, 25 bp, E. coli
agcctacgacgaagcggtggagaaa

SEQ ID NO: 132858 - DNA, 25 bp, E. coli
agcaagcctacgacgaagcggtgga

SEQ ID NO: 132859 - DNA, 25 bp, E. coli
gcgactggaacagattttaggtcag

SEQ ID NO: 132860 - DNA, 25 bp, E. coli
gcgactggaacacattttaggtcag

SEQ ID NO: 132861 - DNA, 25 bp, E. coli
cttcctgcgtgaaatctaccagatg

SEQ ID NO: 132862 - DNA, 25 bp, E. coli
cttcctgcgtgatatctaccagatg

SEQ ID NO: 132863 - DNA, 25 bp, E. coli
tggcttcctgcgagatatctaccag

SEQ ID NO: 132864 - DNA, 25 bp, E. coli
ggcgcgactggatcagattttaggt

SEQ ID NO: 132865 - DNA, 25 bp, E. coli
ggcgcgactggaacagattttaggt

SEQ ID NO: 132866 - DNA, 25 bp, E. coli
tggcttcctgcgtgatatctaccag

SEQ ID NO: 132867 - DNA, 25 bp, E. coli
gaccacgctggtccgttttgatcca

SEQ ID NO: 132868 - DNA, 25 bp, E. coli
gaccacgctggtgcgttttgatcca

SEQ ID NO: 132869 - DNA, 25 bp, E. coli
catctggttgttcgaggtacgtgca

SEQ ID NO: 132870 - DNA, 25 bp, E. coli
catctggttgttggaggtacgtgca

SEQ ID NO: 132871 - DNA, 25 bp, E. coli
catgggcaacgaatacggaaacggg

SEQ ID NO: 132872 - DNA, 25 bp, E. coli
catgggcaacgattacggaaacggg

SEQ ID NO: 132873 - DNA, 25 bp, E. coli
aaatgagtatgttggtcgtggtcac

SEQ ID NO: 132874 - DNA, 25 bp, E. coli
aaatgagtatgtaggtcgtggtcac

SEQ ID NO: 132875 - DNA, 25 bp, E. coli
taggtgatgtatccgcaaaaattcg

SEQ ID NO: 132876 - DNA, 25 bp, E. coli
taggtgatgtatgcgcaaaaattcg

SEQ ID NO: 132877 - DNA, 25 bp, E. coli
tggtcactgaaaatgtacctccgcg

SEQ ID NO: 132878 - DNA, 25 bp, E. coli
tggtcactgaaattgtacctccgcg

SEQ ID NO: 132879 - DNA, 25 bp, E. coli
tccgcgcttacgaggcagattagcc

SEQ ID NO: 132880 - DNA, 25 bp, E. coli
tccgcgcttacgtggcagattagcc

SEQ ID NO: 132881 - DNA, 25 bp, E. coli
tctgggaacaaatagctggactggc

SEQ ID NO: 132882 - DNA, 25 bp, E. coli
tctgggaacaaaaagctggactggc

SEQ ID NO: 132883 - DNA, 25 bp, E. coli
ccagacatttgggttaaacaggcgt

SEQ ID NO: 132884 - DNA, 25 bp, E. coli
ccagacatttggcttaaacaggcgt

SEQ ID NO: 132885 - DNA, 25 bp, E. coli
gcaatgtagtgatggcatgggcaac

SEQ ID NO: 132886 - DNA, 25 bp, E. coli
gcaatgtagtgaaggcatgggcaac

SEQ ID NO: 132887 - DNA, 25 bp, E. coli
gaaacgggatttcagttccagacat

SEQ ID NO: 132888 - DNA, 25 bp, E. coli
gaaacgggatttgagttccagacat

SEQ ID NO: 132889 - DNA, 25 bp, E. coli
gcgtaccccggttgatttggatggt

SEQ ID NO: 132890 - DNA, 25 bp, E. coli
gcgtaccccggtagatttggatggt

SEQ ID NO: 132891 - DNA, 25 bp, E. coli
caagcgcgtacctttgcccgcgaaa

SEQ ID NO: 132892 - DNA, 25 bp, E. coli
caagcgcgtaccattgcccgcgaaa

SEQ ID NO: 132893 - DNA, 25 bp, E. coli
actttgccgtagtacagagcgatgg

SEQ ID NO: 132894 - DNA, 25 bp, E. coli
aacgcatattaaggatttcactgtg

SEQ ID NO: 132895 - DNA, 25 bp, E. coli
actttgccgtagaacagagcgatgg

SEQ ID NO: 132896 - DNA, 25 bp, E. coli
aacgcatattaacgatttcactgtg

SEQ ID NO: 132897 - DNA, 25 bp, E. coli
tattaacgatttcactgtgcgtacc

SEQ ID NO: 132898 - DNA, 25 bp, E. coli
tatctggtcggataacacctaacgc

SEQ ID NO: 132899 - DNA, 25 bp, E. coli
tatctggtcggaaaacacctaacgc

SEQ ID NO: 132900 - DNA, 25 bp, E. coli
tattaacgatttgactgtgcgtacc

SEQ ID NO: 132901 - DNA, 25 bp, E. coli
tgcaggaacatcagcgcgactttgc

SEQ ID NO: 132902 - DNA, 25 bp, E. coli
tgcaggaacatctgcgcgactttgc

SEQ ID NO: 132903 - DNA, 25 bp, E. coli
tctgcgcgacttagccgtagaacag

SEQ ID NO: 132904 - DNA, 25 bp, E. coli
tctgcgcgactttgccgtagaacag

SEQ ID NO: 132905 - DNA, 25 bp, E. coli
gcgactttgccgtagaacagagcga

SEQ ID NO: 132906 - DNA, 25 bp, E. coli
gcgactttgccgaagaacagagcga

SEQ ID NO: 132907 - DNA, 25 bp, E. coli
gaacatctgcgccactttgccgtag

SEQ ID NO: 132908 - DNA, 25 bp, E. coli
gaacatctgcgcgactttgccgtag

SEQ ID NO: 132909 - DNA, 25 bp, E. coli
gattctgttgcgcaagcgcgtacct

SEQ ID NO: 132910 - DNA, 25 bp, E. coli
gattctgttgcggaagcgcgtacct

SEQ ID NO: 132911 - DNA, 25 bp, E. coli
ggaaaacacctatcgcatattaacg

SEQ ID NO: 132912 - DNA, 25 bp, E. coli
ggaaaacacctaacgcatattaacg

SEQ ID NO: 132913 - DNA, 25 bp, E. coli
aggctccggcagaggcgactggcgc

SEQ ID NO: 132914 - DNA, 25 bp, E. coli
attgatattgcttatgaaggctccg

SEQ ID NO: 132915 - DNA, 25 bp, E. coli
aggctccggcagtggcgactggcgc

SEQ ID NO: 132916 - DNA, 25 bp, E. coli
attgatattgctaatgaaggctccg

SEQ ID NO: 132917 - DNA, 25 bp, E. coli
tattgcttatgaaggctccggcagt

SEQ ID NO: 132918 - DNA, 25 bp, E. coli
tattgcttatgatggctccggcagt

SEQ ID NO: 132919 - DNA, 25 bp, E. coli
ttgatattgcttttgaaggctccgg

SEQ ID NO: 132920 - DNA, 25 bp, E. coli
ttgatattgcttatgaaggctccgg

SEQ ID NO: 132921 - DNA, 25 bp, E. coli
tgatattgcttatgaaggctccggc

SEQ ID NO: 132922 - DNA, 25 bp, E. coli
tgatattgcttaagaaggctccggc

SEQ ID NO: 132923 - DNA, 25 bp, E. coli
ccattgatattgcttatgaaggctc

SEQ ID NO: 132924 - DNA, 25 bp, E. coli
ccattgatattggttatgaaggctc

SEQ ID NO: 132925 - DNA, 25 bp, E. coli
gcagtggcgactggcgcactgacgg

SEQ ID NO: 132926 - DNA, 25 bp, E. coli
gcagtggcgactcgcgcactgacgg

SEQ ID NO: 132927 - DNA, 25 bp, E. coli
cgaatccgtggcgattgatattgct

SEQ ID NO: 132928 - DNA, 25 bp, E. coli
cgaatccgtggccattgatattgct

SEQ ID NO: 132929 - DNA, 25 bp, E. coli
cattgatattgcatatgaaggctcc

SEQ ID NO: 132930 - DNA, 25 bp, E. coli
cattgatattgcttatgaaggctcc

SEQ ID NO: 132931 - DNA, 25 bp, E. coli
gatattgcttatgaaggctccggca

SEQ ID NO: 132932 - DNA, 25 bp, E. coli
gatattgcttatcaaggctccggca

SEQ ID NO: 132933 - DNA, 25 bp, E. coli
ggctccggcagtcgcgactggcgca

SEQ ID NO: 132934 - DNA, 25 bp, E. coli
ggctccggcagtggcgactggcgca

SEQ ID NO: 132935 - DNA, 25 bp, E. coli
taccaggtgacagggaaattgtaac

SEQ ID NO: 132936 - DNA, 25 bp, E. coli
aactgattgcgcatcctgtaccggg

SEQ ID NO: 132937 - DNA, 25 bp, E. coli
aactgattgcgcttcctgtaccggg

SEQ ID NO: 132938 - DNA, 25 bp, E. coli
tacctccgcgaacgttatgagcatg

SEQ ID NO: 132939 - DNA, 25 bp, E. coli
tatgagcatgaatgcttcagcccgc

SEQ ID NO: 132940 - DNA, 25 bp, E. coli
tacctccgcgaaggttatgagcatg

SEQ ID NO: 132941 - DNA, 25 bp, E. coli
taccaggtgacacggaaattgtaac

SEQ ID NO: 132942 - DNA, 25 bp, E. coli
tatgagcatgaaagcttcagcccgc

SEQ ID NO: 132943 - DNA, 25 bp, E. coli
tgtaacccacagctttgcagagtgg

SEQ ID NO: 132944 - DNA, 25 bp, E. coli
tgtaacccacaggtttgcagagtgg

SEQ ID NO: 132945 - DNA, 25 bp, E. coli
tcctttgcgacatgttaaccgctgg

SEQ ID NO: 132946 - DNA, 25 bp, E. coli
tcctttgcgacaagttaaccgctgg

SEQ ID NO: 132947 - DNA, 25 bp, E. coli
tcattcgttgggtgccggaaacaca

SEQ ID NO: 132948 - DNA, 25 bp, E. coli
tcattcgttgggagccggaaacaca

SEQ ID NO: 132949 - DNA, 25 bp, E. coli
gctatgcagtgattgtaccaggtga

SEQ ID NO: 132950 - DNA, 25 bp, E. coli
gctatgcagtgaatgtaccaggtga

SEQ ID NO: 132951 - DNA, 25 bp, E. coli
cgctggttcaaacatcactacggag

SEQ ID NO: 132952 - DNA, 25 bp, E. coli
cgctggttcaaagatcactacggag

SEQ ID NO: 132953 - DNA, 25 bp, E. coli
tcaaccggcagaaggagacagtcct

SEQ ID NO: 132954 - DNA, 25 bp, E. coli
tcaaccggcagatggagacagtcct

SEQ ID NO: 132955 - DNA, 25 bp, E. coli
gagtgcccgtcagagtcattcgttg

SEQ ID NO: 132956 - DNA, 25 bp, E. coli
gagtgcccgtcacagtcattcgttg

SEQ ID NO: 132957 - DNA, 25 bp, E. coli
caacctcgctgagtgtgaaaaaggc

SEQ ID NO: 132958 - DNA, 25 bp, E. coli
caacctcgctgactgtgaaaaaggc

SEQ ID NO: 132959 - DNA, 25 bp, E. coli
taaaaagtgctgaggcgttaacgcc

SEQ ID NO: 132960 - DNA, 25 bp, E. coli
tacggcattagtcaatccaacctcg

SEQ ID NO: 132961 - DNA, 25 bp, E. coli
taaaaagtgctgtggcgttaacgcc

SEQ ID NO: 132962 - DNA, 25 bp, E. coli
tacggcattagtgaatccaacctcg

SEQ ID NO: 132963 - DNA, 25 bp, E. coli
aaaaatctggaaccctttgaacctg

SEQ ID NO: 132964 - DNA, 25 bp, E. coli
aaaaatctggaagcctttgaacctg

SEQ ID NO: 132965 - DNA, 25 bp, E. coli
tgctacaacaagttacagatcccgg

SEQ ID NO: 132966 - DNA, 25 bp, E. coli
tgctacaacaagatacagatcccgg

SEQ ID NO: 132967 - DNA, 25 bp, E. coli
tgcgaaagggaaaacgctgcaccag

SEQ ID NO: 132968 - DNA, 25 bp, E. coli
tgcgaaagggaatacgctgcaccag

SEQ ID NO: 132969 - DNA, 25 bp, E. coli
gctcctgaagcgtaacctactgaag

SEQ ID NO: 132970 - DNA, 25 bp, E. coli
gctaaacctgaaacacctgcgcaac

SEQ ID NO: 132971 - DNA, 25 bp, E. coli
gctaaacctgaatcacctgcgcaac

SEQ ID NO: 132972 - DNA, 25 bp, E. coli
gctcctgaagcgaaacctactgaag

SEQ ID NO: 132973 - DNA, 25 bp, E. coli
gaatcttatcatgcggcgattcagg

SEQ ID NO: 132974 - DNA, 25 bp, E. coli
gaatcttatcatccggcgattcagg

SEQ ID NO: 132975 - DNA, 25 bp, E. coli
ctgaagctcccgatgcaaaagcaga

SEQ ID NO: 132976 - DNA, 25 bp, E. coli
ctgaagctcccgttgcaaaagcaga

SEQ ID NO: 132977 - DNA, 25 bp, E. coli
ggcgcgttatgctgactggctgaaa

SEQ ID NO: 132978 - DNA, 25 bp, E. coli
ggcgcgttatgcagactggctgaaa

SEQ ID NO: 132979 - DNA, 25 bp, E. coli
cacgatggttcgtatcggcactgca

SEQ ID NO: 132980 - DNA, 25 bp, E. coli
cacgatggttcgaatcggcactgca

SEQ ID NO: 132981 - DNA, 25 bp, E. coli
taaaagccgcctcgtggcagagcat

SEQ ID NO: 132982 - DNA, 25 bp, E. coli
taaaattcgccactttcaggaactg

SEQ ID NO: 132983 - DNA, 25 bp, E. coli
taaaattcgccagtttcaggaactg

SEQ ID NO: 132984 - DNA, 25 bp, E. coli
taaaagccgcctggtggcagagcat

SEQ ID NO: 132985 - DNA, 25 bp, E. coli
tatcgacacgctctctctgggaatg

SEQ ID NO: 132986 - DNA, 25 bp, E. coli
tatcgacacgctgtctctgggaatg

SEQ ID NO: 132987 - DNA, 25 bp, E. coli
tttgaagttgcacgccaaatggctg

SEQ ID NO: 132988 - DNA, 25 bp, E. coli
tttgaagttgcaggccaaatggctg

SEQ ID NO: 132989 - DNA, 25 bp, E. coli
tgatgccgggcagcgtcaatttggt

SEQ ID NO: 132990 - DNA, 25 bp, E. coli
tgatgccgggcaccgtcaatttggt

SEQ ID NO: 132991 - DNA, 25 bp, E. coli
gcccgttgcagtctaataaaagccg

SEQ ID NO: 132992 - DNA, 25 bp, E. coli
gcccgttgcagtgtaataaaagccg

SEQ ID NO: 132993 - DNA, 25 bp, E. coli
gaatgtcggacgatatggaagccgc

SEQ ID NO: 132994 - DNA, 25 bp, E. coli
gaatgtcggacgttatggaagccgc

SEQ ID NO: 132995 - DNA, 25 bp, E. coli
cgttgcggccgtactccagaagaaa

SEQ ID NO: 132996 - DNA, 25 bp, E. coli
cgttgcggccgttctccagaagaaa

SEQ ID NO: 132997 - DNA, 25 bp, E. coli
gtaaaacaaaacctgcgagcgccat

SEQ ID NO: 132998 - DNA, 25 bp, E. coli
gtaaaacaaaacgtgcgagcgccat

SEQ ID NO: 132999 - DNA, 25 bp, E. coli
gagcgccatcgctgaagccattgat

SEQ ID NO: 133000 - DNA, 25 bp, E. coli
gagcgccatcgcagaagccattgat

SEQ ID NO: 133001 - DNA, 25 bp, E. coli
caactcggtggcctggtgtcttaca

SEQ ID NO: 133002 - DNA, 25 bp, E. coli
caactcggtggcgtggtgtcttaca

SEQ ID NO: 133003 - DNA, 25 bp, E. coli
aaatgcttcgttccgacctgtggcg

SEQ ID NO: 133004 - DNA, 25 bp, E. coli
aaatgcttcgttgcgacctgtggcg

SEQ ID NO: 133005 - DNA, 25 bp, E. coli
tgactatgtggcttcgcgtccggta

SEQ ID NO: 133006 - DNA, 25 bp, E. coli
tgactatgtggcatcgcgtccggta

SEQ ID NO: 133007 - DNA, 25 bp, E. coli
tgctggtgcactccgaaaacgcgct

SEQ ID NO: 133008 - DNA, 25 bp, E. coli
tgctggtgcactgcgaaaacgcgct

SEQ ID NO: 133009 - DNA, 25 bp, E. coli
tcgccgggcatgcttgatgcgcaca

SEQ ID NO: 133010 - DNA, 25 bp, E. coli
tcgccgggcatggttgatgcgcaca

SEQ ID NO: 133011 - DNA, 25 bp, E. coli
gaagaaatcggttctctggcgaagt

SEQ ID NO: 133012 - DNA, 25 bp, E. coli
gaagaaatcggtactctggcgaagt

SEQ ID NO: 133013 - DNA, 25 bp, E. coli
gaagctcgcgttctagatatcgccg

SEQ ID NO: 133014 - DNA, 25 bp, E. coli
gaagctcgcgttgtagatatcgccg

SEQ ID NO: 133015 - DNA, 25 bp, E. coli
gaactgaagttccatgccgctaaag

SEQ ID NO: 133016 - DNA, 25 bp, E. coli
gaactgaagttcgatgccgctaaag

SEQ ID NO: 133017 - DNA, 25 bp, E. coli
ctcgtgcacgtctggaaggtcagga

SEQ ID NO: 133018 - DNA, 25 bp, E. coli
ctcgtgcacgtcaggaaggtcagga

SEQ ID NO: 133019 - DNA, 25 bp, E. coli
gttatgaaaccgctactcgcgcagc

SEQ ID NO: 133020 - DNA, 25 bp, E. coli
gttacttgtgaaacctgcccgcatt

SEQ ID NO: 133021 - DNA, 25 bp, E. coli
gttatgaaaccggtactcgcgcagc

SEQ ID NO: 133022 - DNA, 25 bp, E. coli
gttacttgtgaatcctgcccgcatt

SEQ ID NO: 133023 - DNA, 25 bp, E. coli
caggccatcgatccggagttactta

SEQ ID NO: 133024 - DNA, 25 bp, E. coli
caggccatcgatgcggagttactta

SEQ ID NO: 133025 - DNA, 25 bp, E. coli
aaacaagctcttggtggcgaaaaat

SEQ ID NO: 133026 - DNA, 25 bp, E. coli
aaacaagctcttcgtggcgaaaaat

SEQ ID NO: 133027 - DNA, 25 bp, E. coli
tagttgcagcaagcgcacatcaagg

SEQ ID NO: 133028 - DNA, 25 bp, E. coli
tagttgcagcaaccgcacatcaagg

SEQ ID NO: 133029 - DNA, 25 bp, E. coli
taggctatccgggagaacgtcgtga

SEQ ID NO: 133030 - DNA, 25 bp, E. coli
taggctatccggcagaacgtcgtga

SEQ ID NO: 133031 - DNA, 25 bp, E. coli
tattactggctgaggtacaggacag

SEQ ID NO: 133032 - DNA, 25 bp, E. coli
tattactggctgtggtacaggacag

SEQ ID NO: 133033 - DNA, 25 bp, E. coli
tgatggcactgaacacattcccggg

SEQ ID NO: 133034 - DNA, 25 bp, E. coli
tgatggcactgatcacattcccggg

SEQ ID NO: 133035 - DNA, 25 bp, E. coli
gaagcagttagtaagccactcatgg

SEQ ID NO: 133036 - DNA, 25 bp, E. coli
gaagcagttagttagccactcatgg

SEQ ID NO: 133037 - DNA, 25 bp, E. coli
cattgatgaatgaatttagccaggc

SEQ ID NO: 133038 - DNA, 25 bp, E. coli
cattgatgaatgtatttagccaggc

SEQ ID NO: 133039 - DNA, 25 bp, E. coli
cgtgaatcacaaaatgcgaatgcca

SEQ ID NO: 133040 - DNA, 25 bp, E. coli
cgtgaatcacaatatgcgaatgcca

SEQ ID NO: 133041 - DNA, 25 bp, E. coli
ggttattgcatccaaccaacagatg

SEQ ID NO: 133042 - DNA, 25 bp, E. coli
ggttattgcatcgaaccaacagatg

SEQ ID NO: 133043 - DNA, 25 bp, E. coli
taatgggaatgctctgtccttgcca

SEQ ID NO: 133044 - DNA, 25 bp, E. coli
taatgggaatgcactgtccttgcca

SEQ ID NO: 133045 - DNA, 25 bp, E. coli
aaggaggttgctccgctcatggcct

SEQ ID NO: 133046 - DNA, 25 bp, E. coli
aaggaggttgctgcgctcatggcct

SEQ ID NO: 133047 - DNA, 25 bp, E. coli
aggttgctgcgctcatggcctgcac

SEQ ID NO: 133048 - DNA, 25 bp, E. coli
aggttgctgcgcacatggcctgcac

SEQ ID NO: 133049 - DNA, 25 bp, E. coli
ttgctgcgctcatggcctgcacgtc

SEQ ID NO: 133050 - DNA, 25 bp, E. coli
ttgctgcgctcaaggcctgcacgtc

SEQ ID NO: 133051 - DNA, 25 bp, E. coli
tgctgcgctcatcgcctgcacgtcc

SEQ ID NO: 133052 - DNA, 25 bp, E. coli
tgcgctcatggcctgcacgtccagg

SEQ ID NO: 133053 - DNA, 25 bp, E. coli
tgctgcgctcatggcctgcacgtcc

SEQ ID NO: 133054 - DNA, 25 bp, E. coli
tgcgctcatggcgtgcacgtccagg

SEQ ID NO: 133055 - DNA, 25 bp, E. coli
gcgctcatggccagcacgtccaggt

SEQ ID NO: 133056 - DNA, 25 bp, E. coli
gctcatggcctgcacgtccaggtaa

SEQ ID NO: 133057 - DNA, 25 bp, E. coli
gcgctcatggcctgcacgtccaggt

SEQ ID NO: 133058 - DNA, 25 bp, E. coli
gctcatggcctggacgtccaggtaa

SEQ ID NO: 133059 - DNA, 25 bp, E. coli
tgataaggaggttgctgcgctcatg

SEQ ID NO: 133060 - DNA, 25 bp, E. coli
gttgctgcgctcatggcctgcacgt

SEQ ID NO: 133061 - DNA, 25 bp, E. coli
gttgctgcgctcttggcctgcacgt

SEQ ID NO: 133062 - DNA, 25 bp, E. coli
tgataaggaggtagctgcgctcatg

SEQ ID NO: 133063 - DNA, 25 bp, E. coli
gtgataaggaggatgctgcgctcat

SEQ ID NO: 133064 - DNA, 25 bp, E. coli
gtgataaggaggttgctgcgctcat

SEQ ID NO: 133065 - DNA, 25 bp, E. coli
taaggaggttgcagcgctcatggcc

SEQ ID NO: 133066 - DNA, 25 bp, E. coli
taaggaggttgctgcgctcatggcc

SEQ ID NO: 133067 - DNA, 25 bp, E. coli
cacagcaatggagttacgctggcga

SEQ ID NO: 133068 - DNA, 25 bp, E. coli
cacagcaatggacttacgctggcga

SEQ ID NO: 133069 - DNA, 25 bp, E. coli
cattggtttaggtagcgcaggtacg

SEQ ID NO: 133070 - DNA, 25 bp, E. coli
catctttggcataacgggaaatggg

SEQ ID NO: 133071 - DNA, 25 bp, E. coli
catctttggcattacgggaaatggg

SEQ ID NO: 133072 - DNA, 25 bp, E. coli
cattggtttaggaagcgcaggtacg

SEQ ID NO: 133073 - DNA, 25 bp, E. coli
taaaacctggcttattaatggcgaa

SEQ ID NO: 133074 - DNA, 25 bp, E. coli
taaaacctggctaattaatggcgaa

SEQ ID NO: 133075 - DNA, 25 bp, E. coli
gaacggatgccgaatttgaacttga

SEQ ID NO: 133076 - DNA, 25 bp, E. coli
gcaaacgcgtctgtattaccggaaa

SEQ ID NO: 133077 - DNA, 25 bp, E. coli
gaattatcgcaaggtcgggcctacg

SEQ ID NO: 133078 - DNA, 25 bp, E. coli
gcaaacgcgtctctattaccggaaa

SEQ ID NO: 133079 - DNA, 25 bp, E. coli
gaattatcgcaacgtcgggcctacg

SEQ ID NO: 133080 - DNA, 25 bp, E. coli
gaacggatgccgtatttgaacttga

SEQ ID NO: 133081 - DNA, 25 bp, E. coli
gaactatgcgcatgaaggcctgaaa

SEQ ID NO: 133082 - DNA, 25 bp, E. coli
gaactatgcgcaagaaggcctgaaa

SEQ ID NO: 133083 - DNA, 25 bp, E. coli
cggcaaagcggtgacggattcagtt

SEQ ID NO: 133084 - DNA, 25 bp, E. coli
cggcaaagcggtcacggattcagtt

SEQ ID NO: 133085 - DNA, 25 bp, E. coli
cattggcaaaaagagcgagggcttg

SEQ ID NO: 133086 - DNA, 25 bp, E. coli
cattggcaaaaacagcgagggcttg

SEQ ID NO: 133087 - DNA, 25 bp, E. coli
gggccggattcataggttcacgaga

SEQ ID NO: 133088 - DNA, 25 bp, E. coli
gggccggattcaaaggttcacgaga

SEQ ID NO: 133089 - DNA, 25 bp, E. coli
aattattaaccacagaaacggcgct

SEQ ID NO: 133090 - DNA, 25 bp, E. coli
aattattaaccagagaaacggcgct

SEQ ID NO: 133091 - DNA, 25 bp, E. coli
caggctagggagcatatccgtatcc

SEQ ID NO: 133092 - DNA, 25 bp, E. coli
caggctagggaggatatccgtatcc

SEQ ID NO: 133093 - DNA, 25 bp, E. coli
tagggaggatatccgtatcctgcgc

SEQ ID NO: 133094 - DNA, 25 bp, E. coli
tagggaggatatgcgtatcctgcgc

SEQ ID NO: 133095 - DNA, 25 bp, E. coli
tattgaacaggctagggaggatatc

SEQ ID NO: 133096 - DNA, 25 bp, E. coli
tattgaacaggcaagggaggatatc

SEQ ID NO: 133097 - DNA, 25 bp, E. coli
ttgccctgtattgaacaggctaggg

SEQ ID NO: 133098 - DNA, 25 bp, E. coli
ttattaaccacagaaacggcgctgg

SEQ ID NO: 133099 - DNA, 25 bp, E. coli
ttgccctgtattcaacaggctaggg

SEQ ID NO: 133100 - DNA, 25 bp, E. coli
ttgaacaggctagggaggatatccg

SEQ ID NO: 133101 - DNA, 25 bp, E. coli
ttgaacaggctacggaggatatccg

SEQ ID NO: 133102 - DNA, 25 bp, E. coli
ttattaaccacacaaacggcgctgg

SEQ ID NO: 133103 - DNA, 25 bp, E. coli
tgaaattattaaccacagaaacggc

SEQ ID NO: 133104 - DNA, 25 bp, E. coli
tgaaattattaagcacagaaacggc

SEQ ID NO: 133105 - DNA, 25 bp, E. coli
cctgtattgaacaggctagggagga

SEQ ID NO: 133106 - DNA, 25 bp, E. coli
cctgtattgaactggctagggagga

SEQ ID NO: 133107 - DNA, 25 bp, E. coli
gaacaggctaggcaggatatccgta

SEQ ID NO: 133108 - DNA, 25 bp, E. coli
gaacaggctagggaggatatccgta

SEQ ID NO: 133109 - DNA, 25 bp, E. coli
ggatatccgtatcctgcgccaactg

SEQ ID NO: 133110 - DNA, 25 bp, E. coli
ggatatccgtatgctgcgccaactg

SEQ ID NO: 133111 - DNA, 25 bp, E. coli
tacgtatgacaaacacagaattgcc

SEQ ID NO: 133112 - DNA, 25 bp, E. coli
atattgaatttatgcgattttgtag

SEQ ID NO: 133113 - DNA, 25 bp, E. coli
atattgaatttaagcgattttgtag

SEQ ID NO: 133114 - DNA, 25 bp, E. coli
aactgagtagctgaaggaaatccca

SEQ ID NO: 133115 - DNA, 25 bp, E. coli
aaagggcggtcgcaagatcgccctt

SEQ ID NO: 133116 - DNA, 25 bp, E. coli
aaagggcggtcggaagatcgccctt

SEQ ID NO: 133117 - DNA, 25 bp, E. coli
aactgagtagctcaaggaaatccca

SEQ ID NO: 133118 - DNA, 25 bp, E. coli
tacgtatgacaatcacagaattgcc

SEQ ID NO: 133119 - DNA, 25 bp, E. coli
tgtcaacaaactgagtagctcaagg

SEQ ID NO: 133120 - DNA, 25 bp, E. coli
tgtcaacaaactcagtagctcaagg

SEQ ID NO: 133121 - DNA, 25 bp, E. coli
tcaggcctacgacgatggtgcaata

SEQ ID NO: 133122 - DNA, 25 bp, E. coli
tcaggcctacgaggatggtgcaata

SEQ ID NO: 133123 - DNA, 25 bp, E. coli
cctacgaggatgctgcaatatattg

SEQ ID NO: 133124 - DNA, 25 bp, E. coli
cctacgaggatggtgcaatatattg

SEQ ID NO: 133125 - DNA, 25 bp, E. coli
gcggtcgcaagaacgccctttttta

SEQ ID NO: 133126 - DNA, 25 bp, E. coli
gcggtcgcaagatcgccctttttta

SEQ ID NO: 133127 - DNA, 25 bp, E. coli
cgaacactttgtgaacaaactgagt

SEQ ID NO: 133128 - DNA, 25 bp, E. coli
cgaacactttgtcaacaaactgagt

SEQ ID NO: 133129 - DNA, 25 bp, E. coli
ggcaaaaacaacgaacactttgtca

SEQ ID NO: 133130 - DNA, 25 bp, E. coli
ggcaaaaacaaccaacactttgtca

SEQ ID NO: 133131 - DNA, 25 bp, E. coli
gatcgcccttttatacgtatgacaa

SEQ ID NO: 133132 - DNA, 25 bp, E. coli
gatcgcccttttttacgtatgacaa

SEQ ID NO: 133133 - DNA, 25 bp, E. coli
atggaacatattactattatccccg

SEQ ID NO: 133134 - DNA, 25 bp, E. coli
atggaacatatttctattatccccg

SEQ ID NO: 133135 - DNA, 25 bp, E. coli
acttaaaaaattcatggaacatatt

SEQ ID NO: 133136 - DNA, 25 bp, E. coli
acttaaaaaattgatggaacatatt

SEQ ID NO: 133137 - DNA, 25 bp, E. coli
aacttaaaaaatagatggaacatat

SEQ ID NO: 133138 - DNA, 25 bp, E. coli
aacttaaaaaattgatggaacatat

SEQ ID NO: 133139 - DNA, 25 bp, E. coli
tatccccgattagagacaagcctag

SEQ ID NO: 133140 - DNA, 25 bp, E. coli
tatccccgattacagacaagcctag

SEQ ID NO: 133141 - DNA, 25 bp, E. coli
ttatccccgattacagacaagccta

SEQ ID NO: 133142 - DNA, 25 bp, E. coli
ttatccccgatttcagacaagccta

SEQ ID NO: 133143 - DNA, 25 bp, E. coli
gaacttaaaaaaatgatggaacata

SEQ ID NO: 133144 - DNA, 25 bp, E. coli
gaacttaaaaaattgatggaacata

SEQ ID NO: 133145 - DNA, 25 bp, E. coli
ggaacttaaaaatttgatggaacat

SEQ ID NO: 133146 - DNA, 25 bp, E. coli
tggaacatatttgtattatccccga

SEQ ID NO: 133147 - DNA, 25 bp, E. coli
ggaacttaaaaaattgatggaacat

SEQ ID NO: 133148 - DNA, 25 bp, E. coli
tggaacttaaaaaattgatggaaca

SEQ ID NO: 133149 - DNA, 25 bp, E. coli
tggaacttaaaatattgatggaaca

SEQ ID NO: 133150 - DNA, 25 bp, E. coli
ggaacatatttcaattatccccgat

SEQ ID NO: 133151 - DNA, 25 bp, E. coli
ggaacatatttctattatccccgat

SEQ ID NO: 133152 - DNA, 25 bp, E. coli
tggaacatatttctattatccccga

SEQ ID NO: 133153 - DNA, 25 bp, E. coli
gatggaacatatttctattatcccc

SEQ ID NO: 133154 - DNA, 25 bp, E. coli
gatggaacatatatctattatcccc

SEQ ID NO: 133155 - DNA, 25 bp, E. coli
taaatacaccgataacctgagcgtc

SEQ ID NO: 133156 - DNA, 25 bp, E. coli
taaacgttacttgggtgtgacgccg

SEQ ID NO: 133157 - DNA, 25 bp, E. coli
taaacgttacttcggtgtgacgccg

SEQ ID NO: 133158 - DNA, 25 bp, E. coli
taaatacaccgaaaacctgagcgtc

SEQ ID NO: 133159 - DNA, 25 bp, E. coli
aaagcgcatcgcaatttagccgtga

SEQ ID NO: 133160 - DNA, 25 bp, E. coli
acaccggtgatgaacgagcctggca

SEQ ID NO: 133161 - DNA, 25 bp, E. coli
acaccggtgatgtacgagcctggca

SEQ ID NO: 133162 - DNA, 25 bp, E. coli
aaagcgcatcgctatttagccgtga

SEQ ID NO: 133163 - DNA, 25 bp, E. coli
tatgaaacgtgatgagatttgccgc

SEQ ID NO: 133164 - DNA, 25 bp, E. coli
tatgaaacgtgaagagatttgccgc

SEQ ID NO: 133165 - DNA, 25 bp, E. coli
tatcagaagagaatttatgcgcggc

SEQ ID NO: 133166 - DNA, 25 bp, E. coli
tatcagaagagattttatgcgcggc

SEQ ID NO: 133167 - DNA, 25 bp, E. coli
tgcgaaacctatgccacgtcagagg

SEQ ID NO: 133168 - DNA, 25 bp, E. coli
tgcgaaacctatcccacgtcagagg

SEQ ID NO: 133169 - DNA, 25 bp, E. coli
tgtactacgtgcagaccggaccttg

SEQ ID NO: 133170 - DNA, 25 bp, E. coli
tgtactacgtgctgaccggaccttg

SEQ ID NO: 133171 - DNA, 25 bp, E. coli
gaattaccgtctgcataaggcgcgg

SEQ ID NO: 133172 - DNA, 25 bp, E. coli
gaattaccgtctccataaggcgcgg

SEQ ID NO: 133173 - DNA, 25 bp, E. coli
gattagccgcgtgctgaaacggatt

SEQ ID NO: 133174 - DNA, 25 bp, E. coli
gattagccgcgtcctgaaacggatt

SEQ ID NO: 133175 - DNA, 25 bp, E. coli
gagcgtatcggcgttccaccataat

SEQ ID NO: 133176 - DNA, 25 bp, E. coli
gagcgtatcggccttccaccataat

SEQ ID NO: 133177 - DNA, 25 bp, E. coli
aatggcctgccatacaataaagcgg

SEQ ID NO: 133178 - DNA, 25 bp, E. coli
aatggcctgccaaacaataaagcgg

SEQ ID NO: 133179 - DNA, 25 bp, E. coli
tactggcatctataatccgtggtct

SEQ ID NO: 133180 - DNA, 25 bp, E. coli
tactggcatctaaaatccgtggtct

SEQ ID NO: 133181 - DNA, 25 bp, E. coli
tagattcggccaagatcggacggaa

SEQ ID NO: 133182 - DNA, 25 bp, E. coli
tagattcggccatgatcggacggaa

SEQ ID NO: 133183 - DNA, 25 bp, E. coli
tgcaaaattaggtgtcggaccggga

SEQ ID NO: 133184 - DNA, 25 bp, E. coli
tgcaaaattaggagtcggaccggga

SEQ ID NO: 133185 - DNA, 25 bp, E. coli
gaacagaagaatatccccaggcctc

SEQ ID NO: 133186 - DNA, 25 bp, E. coli
gaacagaagaatttccccaggcctc

SEQ ID NO: 133187 - DNA, 25 bp, E. coli
gaaaaattgctatctcccatgacgg

SEQ ID NO: 133188 - DNA, 25 bp, E. coli
gaaaaattgctaactcccatgacgg

SEQ ID NO: 133189 - DNA, 25 bp, E. coli
cgatcgagcgactaccagagaagtt

SEQ ID NO: 133190 - DNA, 25 bp, E. coli
ccgactggaggctgatttgacatta

SEQ ID NO: 133191 - DNA, 25 bp, E. coli
cgatcgagcgacaaccagagaagtt

SEQ ID NO: 133192 - DNA, 25 bp, E. coli
ccgactggaggcagatttgacatta

SEQ ID NO: 133193 - DNA, 25 bp, E. coli
cgtcaattcagtcgtgtccggcata

SEQ ID NO: 133194 - DNA, 25 bp, E. coli
cattagaacagaatggtccggaggt

SEQ ID NO: 133195 - DNA, 25 bp, E. coli
cgtcaattcagtggtgtccggcata

SEQ ID NO: 133196 - DNA, 25 bp, E. coli
cattagaacagattggtccggaggt

SEQ ID NO: 133197 - DNA, 25 bp, E. coli
gatattatcggtcctcagcgacagg

SEQ ID NO: 133198 - DNA, 25 bp, E. coli
gatattatcggtgctcagcgacagg

SEQ ID NO: 133199 - DNA, 25 bp, E. coli
cactgattgacgtgcgagttaatgc

SEQ ID NO: 133200 - DNA, 25 bp, E. coli
cagccaacaggctggagtgatcggc

SEQ ID NO: 133201 - DNA, 25 bp, E. coli
cagccaacaggcaggagtgatcggc

SEQ ID NO: 133202 - DNA, 25 bp, E. coli
cactgattgacgagcgagttaatgc

SEQ ID NO: 133203 - DNA, 25 bp, E. coli
tagtggcgcttagcgcgaaatacgg

SEQ ID NO: 133204 - DNA, 25 bp, E. coli
tagtggcgcttaccgcgaaatacgg

SEQ ID NO: 133205 - DNA, 25 bp, E. coli
tgattgccagcctacaggcaggagt

SEQ ID NO: 133206 - DNA, 25 bp, E. coli
tgattgccagccaacaggcaggagt

SEQ ID NO: 133207 - DNA, 25 bp, E. coli
tgaggcactgattgacgagcgagtt

SEQ ID NO: 133208 - DNA, 25 bp, E. coli
tgagagttacgcaccgctgatggca

SEQ ID NO: 133209 - DNA, 25 bp, E. coli
tgcggcttgatgagctgattgccag

SEQ ID NO: 133210 - DNA, 25 bp, E. coli
tgcggcttgatgtgctgattgccag

SEQ ID NO: 133211 - DNA, 25 bp, E. coli
tgagagttacgctccgctgatggca

SEQ ID NO: 133212 - DNA, 25 bp, E. coli
tgaggcactgatagacgagcgagtt

SEQ ID NO: 133213 - DNA, 25 bp, E. coli
tctctgatgatgtagtggcgcttac

SEQ ID NO: 133214 - DNA, 25 bp, E. coli
tctctgatgatgaagtggcgcttac

SEQ ID NO: 133215 - DNA, 25 bp, E. coli
cgtcgctacggttgagagttacgca

SEQ ID NO: 133216 - DNA, 25 bp, E. coli
cgtcgctacggtagagagttacgca

SEQ ID NO: 133217 - DNA, 25 bp, E. coli
tgtggcgttaattgcccgtcttgcc

SEQ ID NO: 133218 - DNA, 25 bp, E. coli
tgtggcgttaatagcccgtcttgcc

SEQ ID NO: 133219 - DNA, 25 bp, E. coli
gagttaatgcacactgtgtgcggct

SEQ ID NO: 133220 - DNA, 25 bp, E. coli
gagttaatgcactctgtgtgcggct

SEQ ID NO: 133221 - DNA, 25 bp, E. coli
caatcagattatccgcgaagcgctt

SEQ ID NO: 133222 - DNA, 25 bp, E. coli
caatcagattatgcgcgaagcgctt

SEQ ID NO: 133223 - DNA, 25 bp, E. coli
cactaaaattggtgcgcggcgtgga

SEQ ID NO: 133224 - DNA, 25 bp, E. coli
cactaaaattggagcgcggcgtgga

SEQ ID NO: 133225 - DNA, 25 bp, E. coli
aggcgctggcatagggcgtcaatca

SEQ ID NO: 133226 - DNA, 25 bp, E. coli
accgtcttggttttggcgcgatgca

SEQ ID NO: 133227 - DNA, 25 bp, E. coli
aggcgctggcattgggcgtcaatca

SEQ ID NO: 133228 - DNA, 25 bp, E. coli
accgtcttggttatggcgcgatgca

SEQ ID NO: 133229 - DNA, 25 bp, E. coli
acgtcgctataagcgtgctgcgtga

SEQ ID NO: 133230 - DNA, 25 bp, E. coli
acgtcgctataaccgtgctgcgtga

SEQ ID NO: 133231 - DNA, 25 bp, E. coli
tatggtccgcacctcaccaatcaga

SEQ ID NO: 133232 - DNA, 25 bp, E. coli
tatggtccgcacgtcaccaatcaga

SEQ ID NO: 133233 - DNA, 25 bp, E. coli
tctacgttggatcgtatttcgcgag

SEQ ID NO: 133234 - DNA, 25 bp, E. coli
tctccggcagaggtgcaaaaagcgg

SEQ ID NO: 133235 - DNA, 25 bp, E. coli
tctacgttggatggtatttcgcgag

SEQ ID NO: 133236 - DNA, 25 bp, E. coli
tctccggcagagctgcaaaaagcgg

SEQ ID NO: 133237 - DNA, 25 bp, E. coli
catttacgggagaatatggctgctg

SEQ ID NO: 133238 - DNA, 25 bp, E. coli
catttacgggagtatatggctgctg

SEQ ID NO: 133239 - DNA, 25 bp, E. coli
gataccagcgacatttatggtccgc

SEQ ID NO: 133240 - DNA, 25 bp, E. coli
gataccagcgacttttatggtccgc

SEQ ID NO: 133241 - DNA, 25 bp, E. coli
gatgcaacaacaaggcctggtaaaa

SEQ ID NO: 133242 - DNA, 25 bp, E. coli
gatgcaacaacatggcctggtaaaa

SEQ ID NO: 133243 - DNA, 25 bp, E. coli
caggatatcggaacggcgttagcca

SEQ ID NO: 133244 - DNA, 25 bp, E. coli
caggatatcggatcggcgttagcca

SEQ ID NO: 133245 - DNA, 25 bp, E. coli
aggatatcggatcggcgttagccaa

SEQ ID NO: 133246 - DNA, 25 bp, E. coli
atcaccgctgtattcgccctttgtg

SEQ ID NO: 133247 - DNA, 25 bp, E. coli
atcaccgctgtaatcgccctttgtg

SEQ ID NO: 133248 - DNA, 25 bp, E. coli
aggatatcggatgggcgttagccaa

SEQ ID NO: 133249 - DNA, 25 bp, E. coli
tatcggatcggcgttagccaacaaa

SEQ ID NO: 133250 - DNA, 25 bp, E. coli
tatcggatcggccttagccaacaaa

SEQ ID NO: 133251 - DNA, 25 bp, E. coli
ttcgttagtgcaggatatcggatcg

SEQ ID NO: 133252 - DNA, 25 bp, E. coli
ttcgttagtgcacgatatcggatcg

SEQ ID NO: 133253 - DNA, 25 bp, E. coli
tcggatcggcgtaagccaacaaacc

SEQ ID NO: 133254 - DNA, 25 bp, E. coli
tcggatcggcgttagccaacaaacc

SEQ ID NO: 133255 - DNA, 25 bp, E. coli
gcaggatatcggatcggcgttagcc

SEQ ID NO: 133256 - DNA, 25 bp, E. coli
gcaggatatcggttcggcgttagcc

SEQ ID NO: 133257 - DNA, 25 bp, E. coli
gctgtattcgccctttgtgccgtgg

SEQ ID NO: 133258 - DNA, 25 bp, E. coli
gctgtattcgccgtttgtgccgtgg

SEQ ID NO: 133259 - DNA, 25 bp, E. coli
cgttagtgcaggatatcggatcggc

SEQ ID NO: 133260 - DNA, 25 bp, E. coli
cgttagtgcaggttatcggatcggc

SEQ ID NO: 133261 - DNA, 25 bp, E. coli
cggatcggcgtttgccaacaaaccg

SEQ ID NO: 133262 - DNA, 25 bp, E. coli
cggatcggcgttagccaacaaaccg

SEQ ID NO: 133263 - DNA, 25 bp, E. coli
tcaccgctgtatacgccctttgtgc

SEQ ID NO: 133264 - DNA, 25 bp, E. coli
tcaccgctgtattcgccctttgtgc

SEQ ID NO: 133265 - DNA, 25 bp, E. coli
catatgaacagggattcagccagcg

SEQ ID NO: 133266 - DNA, 25 bp, E. coli
catatgaacaggcattcagccagcg

SEQ ID NO: 133267 - DNA, 25 bp, E. coli
tacgggtcgtgttttgcggtatcaa

SEQ ID NO: 133268 - DNA, 25 bp, E. coli
tacgggtcgtgtattgcggtatcaa

SEQ ID NO: 133269 - DNA, 25 bp, E. coli
tatcgttgtggcgtcaccaaactgg

SEQ ID NO: 133270 - DNA, 25 bp, E. coli
tatcgttgtggcctcaccaaactgg

SEQ ID NO: 133271 - DNA, 25 bp, E. coli
tctggaaggtgaaatatcaggccgg

SEQ ID NO: 133272 - DNA, 25 bp, E. coli
tctggaaggtgatatatcaggccgg

SEQ ID NO: 133273 - DNA, 25 bp, E. coli
gaaactggttgaagcgtatcgcgag

SEQ ID NO: 133274 - DNA, 25 bp, E. coli
gaaactggttgatgcgtatcgcgag

SEQ ID NO: 133275 - DNA, 25 bp, E. coli
cgttggcgattctgggcaaacaagc

SEQ ID NO: 133276 - DNA, 25 bp, E. coli
cgttggcgattcagggcaaacaagc

SEQ ID NO: 133277 - DNA, 25 bp, E. coli
gttgaagccgcaggaggcacagcat

SEQ ID NO: 133278 - DNA, 25 bp, E. coli
gttgaagccgcacgaggcacagcat

SEQ ID NO: 133279 - DNA, 25 bp, E. coli
ggatattttggctccagggttacgg

SEQ ID NO: 133280 - DNA, 25 bp, E. coli
gggtgctgccaattcccagcggttt

SEQ ID NO: 133281 - DNA, 25 bp, E. coli
gggtgctgccaaatcccagcggttt

SEQ ID NO: 133282 - DNA, 25 bp, E. coli
ggttttccctttcctcatccggcaa

SEQ ID NO: 133283 - DNA, 25 bp, E. coli
ggttttccctttgctcatccggcaa

SEQ ID NO: 133284 - DNA, 25 bp, E. coli
ggatattttggcaccagggttacgg

SEQ ID NO: 133285 - DNA, 25 bp, E. coli
ggtttaagtcgcctttcactggaga

SEQ ID NO: 133286 - DNA, 25 bp, E. coli
ggtttaagtcgcgtttcactggaga

SEQ ID NO: 133287 - DNA, 25 bp, E. coli
aggctacgccctggcggcaatgtgt

SEQ ID NO: 133288 - DNA, 25 bp, E. coli
acgccctggcgggaatgtgtgaaat

SEQ ID NO: 133289 - DNA, 25 bp, E. coli
acgtaaagatgattttccgctgttg

SEQ ID NO: 133290 - DNA, 25 bp, E. coli
acgccctggcggcaatgtgtgaaat

SEQ ID NO: 133291 - DNA, 25 bp, E. coli
aggctacgccctcgcggcaatgtgt

SEQ ID NO: 133292 - DNA, 25 bp, E. coli
acgtaaagatgaatttccgctgttg

SEQ ID NO: 133293 - DNA, 25 bp, E. coli
aaaggctacgccctggcggcaatgt

SEQ ID NO: 133294 - DNA, 25 bp, E. coli
aaaggctacgccgtggcggcaatgt

SEQ ID NO: 133295 - DNA, 25 bp, E. coli
tcccacgtaaagttgattttccgct

SEQ ID NO: 133296 - DNA, 25 bp, E. coli
tcccacgtaaagatgattttccgct

SEQ ID NO: 133297 - DNA, 25 bp, E. coli
tttcccacgtaatgatgattttccg

SEQ ID NO: 133298 - DNA, 25 bp, E. coli
tttcccacgtaaagatgattttccg

SEQ ID NO: 133299 - DNA, 25 bp, E. coli
cctggcggcaatgtgtgaaattctt

SEQ ID NO: 133300 - DNA, 25 bp, E. coli
ccacgtaaagatgattttccgctgt

SEQ ID NO: 133301 - DNA, 25 bp, E. coli
ccacgtaaagatcattttccgctgt

SEQ ID NO: 133302 - DNA, 25 bp, E. coli
cctggcggcaatctgtgaaattctt

SEQ ID NO: 133303 - DNA, 25 bp, E. coli
gccctggcggcattgtgtgaaattc

SEQ ID NO: 133304 - DNA, 25 bp, E. coli
gccctggcggcaatgtgtgaaattc

SEQ ID NO: 133305 - DNA, 25 bp, E. coli
cgccctggcggctatgtgtgaaatt

SEQ ID NO: 133306 - DNA, 25 bp, E. coli
ccctggcggcaatgtgtgaaattct

SEQ ID NO: 133307 - DNA, 25 bp, E. coli
ccctggcggcaaagtgtgaaattct

SEQ ID NO: 133308 - DNA, 25 bp, E. coli
cgccctggcggcaatgtgtgaaatt

SEQ ID NO: 133309 - DNA, 25 bp, E. coli
cacattctgtggataaatacggcat

SEQ ID NO: 133310 - DNA, 25 bp, E. coli
cacattctgtggttaaatacggcat

SEQ ID NO: 133311 - DNA, 25 bp, E. coli
catttacagcctagacgtgcgacga

SEQ ID NO: 133312 - DNA, 25 bp, E. coli
catttacagccttgacgtgcgacga

SEQ ID NO: 133313 - DNA, 25 bp, E. coli
tatccacagaaagctgggataactg

SEQ ID NO: 133314 - DNA, 25 bp, E. coli
tatccacagaaacctgggataactg

SEQ ID NO: 133315 - DNA, 25 bp, E. coli
tgtggataaatagggcattggttga

SEQ ID NO: 133316 - DNA, 25 bp, E. coli
tgtggataaatacggcattggttga

SEQ ID NO: 133317 - DNA, 25 bp, E. coli
tgacgtgcgacgaaactccagtttt

SEQ ID NO: 133318 - DNA, 25 bp, E. coli
tgacgtgcgacgtaactccagtttt

SEQ ID NO: 133319 - DNA, 25 bp, E. coli
tccactactgtttccatttacagcc

SEQ ID NO: 133320 - DNA, 25 bp, E. coli
tccactactgttaccatttacagcc

SEQ ID NO: 133321 - DNA, 25 bp, E. coli
gctgggataactgtgaaaaacctcc

SEQ ID NO: 133322 - DNA, 25 bp, E. coli
gcttaacttagtcgcacattctgtg

SEQ ID NO: 133323 - DNA, 25 bp, E. coli
gctgggataactctgaaaaacctcc

SEQ ID NO: 133324 - DNA, 25 bp, E. coli
gcttaacttagtggcacattctgtg

SEQ ID NO: 133325 - DNA, 25 bp, E. coli
gaaactccagtttttagtggttcag

SEQ ID NO: 133326 - DNA, 25 bp, E. coli
gaaactccagttattagtggttcag

SEQ ID NO: 133327 - DNA, 25 bp, E. coli
gtggttcagtgcataacttagtggc

SEQ ID NO: 133328 - DNA, 25 bp, E. coli
gtggttcagtgcttaacttagtggc

SEQ ID NO: 133329 - DNA, 25 bp, E. coli
taactgtgaaaaacctccactactg

SEQ ID NO: 133330 - DNA, 25 bp, E. coli
taactgtgaaaatcctccactactg

SEQ ID NO: 133331 - DNA, 25 bp, E. coli
catcgggagtcaccaattcagtagg

SEQ ID NO: 133332 - DNA, 25 bp, E. coli
cagcttaatgaagagaacccgtatt

SEQ ID NO: 133333 - DNA, 25 bp, E. coli
cagcttaatgaacagaacccgtatt

SEQ ID NO: 133334 - DNA, 25 bp, E. coli
catcgggagtcagcaattcagtagg

SEQ ID NO: 133335 - DNA, 25 bp, E. coli
caggacttggcgatgcgtttgctaa

SEQ ID NO: 133336 - DNA, 25 bp, E. coli
caggacttggcgttgcgtttgctaa

SEQ ID NO: 133337 - DNA, 25 bp, E. coli
tactggcagtggagatctaatatca

SEQ ID NO: 133338 - DNA, 25 bp, E. coli
tatattacacaacaccccattgggc

SEQ ID NO: 133339 - DNA, 25 bp, E. coli
tatcattaggtggtcatgcaggact

SEQ ID NO: 133340 - DNA, 25 bp, E. coli
tactggcagtggtgatctaatatca

SEQ ID NO: 133341 - DNA, 25 bp, E. coli
tatattacacaagaccccattgggc

SEQ ID NO: 133342 - DNA, 25 bp, E. coli
tatcggtgcaggagttgacgcttca

SEQ ID NO: 133343 - DNA, 25 bp, E. coli
tatcggtgcaggtgttgacgcttca

SEQ ID NO: 133344 - DNA, 25 bp, E. coli
tatcattaggtgctcatgcaggact

SEQ ID NO: 133345 - DNA, 25 bp, E. coli
ccaagtctttacgtacatcgggagt

SEQ ID NO: 133346 - DNA, 25 bp, E. coli
ccaagtctttacctacatcgggagt

SEQ ID NO: 133347 - DNA, 25 bp, E. coli
gacagaatctgttggtatcggtgca

SEQ ID NO: 133348 - DNA, 25 bp, E. coli
gacagaatctgtaggtatcggtgca

SEQ ID NO: 133349 - DNA, 25 bp, E. coli
gactctggcttgtagaacgtggcaa

SEQ ID NO: 133350 - DNA, 25 bp, E. coli
gactctggcttgaagaacgtggcaa

SEQ ID NO: 133351 - DNA, 25 bp, E. coli
ggaaccggtactatgacccgctaca

SEQ ID NO: 133352 - DNA, 25 bp, E. coli
ggaaccggtactttgacccgctaca

SEQ ID NO: 133353 - DNA, 25 bp, E. coli
aattaatgaaccgacagcagctgcg

SEQ ID NO: 133354 - DNA, 25 bp, E. coli
aattaatgaacccacagcagctgcg

SEQ ID NO: 133355 - DNA, 25 bp, E. coli
taccaactggcggttaggcagcgac

SEQ ID NO: 133356 - DNA, 25 bp, E. coli
taccaactggcgcttaggcagcgac

SEQ ID NO: 133357 - DNA, 25 bp, E. coli
tattgaacgaaacaccactgtgccc

SEQ ID NO: 133358 - DNA, 25 bp, E. coli
tattgaacgaaagaccactgtgccc

SEQ ID NO: 133359 - DNA, 25 bp, E. coli
ttaaaacgcgcgcatgtcgccagga

SEQ ID NO: 133360 - DNA, 25 bp, E. coli
ttaaaacgcgcggatgtcgccagga

SEQ ID NO: 133361 - DNA, 25 bp, E. coli
tgcagtcaaacgttatggcccgcgt

SEQ ID NO: 133362 - DNA, 25 bp, E. coli
tgcagtcaaacgatatggcccgcgt

SEQ ID NO: 133363 - DNA, 25 bp, E. coli
gcccgtgtcgcgagtagaaacttat

SEQ ID NO: 133364 - DNA, 25 bp, E. coli
gcccgtgtcgcgtgtagaaacttat

SEQ ID NO: 133365 - DNA, 25 bp, E. coli
gaaacttattcaaccatgcacccgg

SEQ ID NO: 133366 - DNA, 25 bp, E. coli
gaaacttattcatccatgcacccgg

SEQ ID NO: 133367 - DNA, 25 bp, E. coli
gacggtgccgcgcaattaattccaa

SEQ ID NO: 133368 - DNA, 25 bp, E. coli
cggtaacattgaccgcgcagcagat

SEQ ID NO: 133369 - DNA, 25 bp, E. coli
cggtaacattgagcgcgcagcagat

SEQ ID NO: 133370 - DNA, 25 bp, E. coli
ggaaaaccggctgtatcacggcgta

SEQ ID NO: 133371 - DNA, 25 bp, E. coli
ggaaaaccggctctatcacggcgta

SEQ ID NO: 133372 - DNA, 25 bp, E. coli
taacgagagtgatctggcagccttg

SEQ ID NO: 133373 - DNA, 25 bp, E. coli
taacgagagtgaactggcagccttg

SEQ ID NO: 133374 - DNA, 25 bp, E. coli
gacggtgccgcggaattaattccaa

SEQ ID NO: 133375 - DNA, 25 bp, E. coli
cacggtctgtttagtgcgcgaccat

SEQ ID NO: 133376 - DNA, 25 bp, E. coli
cacggtctgttttgtgcgcgaccat

SEQ ID NO: 133377 - DNA, 25 bp, E. coli
acggtctgttttgtgcgcgaccatg

SEQ ID NO: 133378 - DNA, 25 bp, E. coli
acggtctgttttctgcgcgaccatg

SEQ ID NO: 133379 - DNA, 25 bp, E. coli
tgttttgtgcgccaccatgatcggc

SEQ ID NO: 133380 - DNA, 25 bp, E. coli
tgttttgtgcgcgaccatgatcggc

SEQ ID NO: 133381 - DNA, 25 bp, E. coli
tctgttttgtgcccgaccatgatcg

SEQ ID NO: 133382 - DNA, 25 bp, E. coli
tctgttttgtgcgcgaccatgatcg

SEQ ID NO: 133383 - DNA, 25 bp, E. coli
gcacggtctgttatgtgcgcgacca

SEQ ID NO: 133384 - DNA, 25 bp, E. coli
gcacggtctgttttgtgcgcgacca

SEQ ID NO: 133385 - DNA, 25 bp, E. coli
ctgttttgtgcgggaccatgatcgg

SEQ ID NO: 133386 - DNA, 25 bp, E. coli
cggtctgttttgagcgcgaccatga

SEQ ID NO: 133387 - DNA, 25 bp, E. coli
cggtctgttttgtgcgcgaccatga

SEQ ID NO: 133388 - DNA, 25 bp, E. coli
ctgttttgtgcgcgaccatgatcgg

SEQ ID NO: 133389 - DNA, 25 bp, E. coli
gttttgtgcgcgaccatgatcggca

SEQ ID NO: 133390 - DNA, 25 bp, E. coli
gttttgtgcgcgtccatgatcggca

SEQ ID NO: 133391 - DNA, 25 bp, E. coli
gtctgttttgtgcgcgaccatgatc

SEQ ID NO: 133392 - DNA, 25 bp, E. coli
gtctgttttgtgggcgaccatgatc

SEQ ID NO: 133393 - DNA, 25 bp, E. coli
ggtctgttttgtgcgcgaccatgat

SEQ ID NO: 133394 - DNA, 25 bp, E. coli
ggtctgttttgtccgcgaccatgat

SEQ ID NO: 133395 - DNA, 25 bp, E. coli
ggcacggtctgttttgtgcgcgacc

SEQ ID NO: 133396 - DNA, 25 bp, E. coli
ggcacggtctgtattgtgcgcgacc

SEQ ID NO: 133397 - DNA, 25 bp, E. coli
cacgttgtggagaaacgtggcaatg

SEQ ID NO: 133398 - DNA, 25 bp, E. coli
cacgttgtggagtaacgtggcaatg

SEQ ID NO: 133399 - DNA, 25 bp, E. coli
agattattggtttatgcagataaac

SEQ ID NO: 133400 - DNA, 25 bp, E. coli
agattattggttaatgcagataaac

SEQ ID NO: 133401 - DNA, 25 bp, E. coli
actcttgctctaatgaagcaggaac

SEQ ID NO: 133402 - DNA, 25 bp, E. coli
aaaaaagagacaccaatatgcccca

SEQ ID NO: 133403 - DNA, 25 bp, E. coli
actcttgctctattgaagcaggaac

SEQ ID NO: 133404 - DNA, 25 bp, E. coli
aaaaaagagacagcaatatgcccca

SEQ ID NO: 133405 - DNA, 25 bp, E. coli
tataaccattttacacgttgtggag

SEQ ID NO: 133406 - DNA, 25 bp, E. coli
tataaccatttttcacgttgtggag

SEQ ID NO: 133407 - DNA, 25 bp, E. coli
gccagcaactctagctctaatgaag

SEQ ID NO: 133408 - DNA, 25 bp, E. coli
ccatttttcacgatgtggagtaacg

SEQ ID NO: 133409 - DNA, 25 bp, E. coli
gccagcaactcttgctctaatgaag

SEQ ID NO: 133410 - DNA, 25 bp, E. coli
ccatttttcacgttgtggagtaacg

SEQ ID NO: 133411 - DNA, 25 bp, E. coli
gataacccttgtctgaacattaaaa

SEQ ID NO: 133412 - DNA, 25 bp, E. coli
gatttgttagattacccttgtctga

SEQ ID NO: 133413 - DNA, 25 bp, E. coli
gatttgttagataacccttgtctga

SEQ ID NO: 133414 - DNA, 25 bp, E. coli
gataacccttgtgtgaacattaaaa

SEQ ID NO: 133415 - DNA, 25 bp, E. coli
gagacagcaataagccccaaaatat

SEQ ID NO: 133416 - DNA, 25 bp, E. coli
gagacagcaatatgccccaaaatat

SEQ ID NO: 133417 - DNA, 25 bp, E. coli
gagtttagattattggttaatgcag

SEQ ID NO: 133418 - DNA, 25 bp, E. coli
gagtttagattaatggttaatgcag

SEQ ID NO: 133419 - DNA, 25 bp, E. coli
tacgggtggtgctattctgggtaaa

SEQ ID NO: 133420 - DNA, 25 bp, E. coli
tacgggtggtgcaattctgggtaaa

SEQ ID NO: 133421 - DNA, 25 bp, E. coli
taaaggtgcaaatgtgggtgccgcc

SEQ ID NO: 133422 - DNA, 25 bp, E. coli
taaaggtgcaaaagtgggtgccgcc

SEQ ID NO: 133423 - DNA, 25 bp, E. coli
actgaaaggtgctgctgttggcgct

SEQ ID NO: 133424 - DNA, 25 bp, E. coli
actgaaaggtgcagctgttggcgct

SEQ ID NO: 133425 - DNA, 25 bp, E. coli
ttaaaggtgccgtgattggcggtac

SEQ ID NO: 133426 - DNA, 25 bp, E. coli
ttaaaggtgccgagattggcggtac

SEQ ID NO: 133427 - DNA, 25 bp, E. coli
ttaatggcgtacagaaaggtgcagc

SEQ ID NO: 133428 - DNA, 25 bp, E. coli
ttaatggcgtactgaaaggtgcagc

SEQ ID NO: 133429 - DNA, 25 bp, E. coli
tggtgcagtaacagaaaaaggccgc

SEQ ID NO: 133430 - DNA, 25 bp, E. coli
tggtgcagtaactgaaaaaggccgc

SEQ ID NO: 133431 - DNA, 25 bp, E. coli
tctgaccggcaatggcctcgaaggg

SEQ ID NO: 133432 - DNA, 25 bp, E. coli
tctgaccggcaaaggcctcgaaggg

SEQ ID NO: 133433 - DNA, 25 bp, E. coli
gctgtcactggcgttctgaccggca

SEQ ID NO: 133434 - DNA, 25 bp, E. coli
gctgtcactggccttctgaccggca

SEQ ID NO: 133435 - DNA, 25 bp, E. coli
gcaggcgttggtttacttactggca

SEQ ID NO: 133436 - DNA, 25 bp, E. coli
gcaggcgttggtatacttactggca

SEQ ID NO: 133437 - DNA, 25 bp, E. coli
gcaccacgaaaggtgcattgctagg

SEQ ID NO: 133438 - DNA, 25 bp, E. coli
gcaccacgaaagctgcattgctagg

SEQ ID NO: 133439 - DNA, 25 bp, E. coli
gtaaaaatgcgcgtaaaggtgcaaa

SEQ ID NO: 133440 - DNA, 25 bp, E. coli
gtaaaaatgcgcctaaaggtgcaaa

SEQ ID NO: 133441 - DNA, 25 bp, E. coli
cagaaaaagaggatgatagttggga

SEQ ID NO: 133442 - DNA, 25 bp, E. coli
cagaaaaagaggttgatagttggga

SEQ ID NO: 133443 - DNA, 25 bp, E. coli
aaaacgccatgaataccgctggtaa

SEQ ID NO: 133444 - DNA, 25 bp, E. coli
aaaacgccatgattaccgctggtaa

SEQ ID NO: 133445 - DNA, 25 bp, E. coli
tagttgggaaaatcgccatgattac

SEQ ID NO: 133446 - DNA, 25 bp, E. coli
tagttgggaaaaacgccatgattac

SEQ ID NO: 133447 - DNA, 25 bp, E. coli
tcattgaaggaatacgtgatcagtt

SEQ ID NO: 133448 - DNA, 25 bp, E. coli
tcattgaaggaaaacgtgatcagtt

SEQ ID NO: 133449 - DNA, 25 bp, E. coli
tcagttagtgggtaaaatccaggaa

SEQ ID NO: 133450 - DNA, 25 bp, E. coli
gaaggaaaacgtcatcagttagtgg

SEQ ID NO: 133451 - DNA, 25 bp, E. coli
gaaggaaaacgtgatcagttagtgg

SEQ ID NO: 133452 - DNA, 25 bp, E. coli
gaaaacgtgatctgttagtgggtaa

SEQ ID NO: 133453 - DNA, 25 bp, E. coli
gaaaaacgccatgattaccgctggt

SEQ ID NO: 133454 - DNA, 25 bp, E. coli
gaaaaacgccatcattaccgctggt

SEQ ID NO: 133455 - DNA, 25 bp, E. coli
gaaaacgtgatcagttagtgggtaa

SEQ ID NO: 133456 - DNA, 25 bp, E. coli
cgtgatcagttactgggtaaaatcc

SEQ ID NO: 133457 - DNA, 25 bp, E. coli
cgtgatcagttagtgggtaaaatcc

SEQ ID NO: 133458 - DNA, 25 bp, E. coli
gttgatagttggcaaaaacgccatg

SEQ ID NO: 133459 - DNA, 25 bp, E. coli
gttgatagttgggaaaaacgccatg

SEQ ID NO: 133460 - DNA, 25 bp, E. coli
tgggaaaaacgcgatgattaccgct

SEQ ID NO: 133461 - DNA, 25 bp, E. coli
tgggaaaaacgccatgattaccgct

SEQ ID NO: 133462 - DNA, 25 bp, E. coli
tcagttagtgggaaaaatccaggaa

SEQ ID NO: 133463 - DNA, 25 bp, E. coli
cactatcaggttgcatttggcggca

SEQ ID NO: 133464 - DNA, 25 bp, E. coli
cactcgaaagtgtgatggcagcggc

SEQ ID NO: 133465 - DNA, 25 bp, E. coli
cactatcaggttccatttggcggca

SEQ ID NO: 133466 - DNA, 25 bp, E. coli
cactcgaaagtgagatggcagcggc

SEQ ID NO: 133467 - DNA, 25 bp, E. coli
tattacgccaaacgaaacggaagca

SEQ ID NO: 133468 - DNA, 25 bp, E. coli
tattacgccaaaggaaacggaagca

SEQ ID NO: 133469 - DNA, 25 bp, E. coli
tccggtcagcgtcatcaaaggcgaa

SEQ ID NO: 133470 - DNA, 25 bp, E. coli
tccggtcagcgtgatcaaaggcgaa

SEQ ID NO: 133471 - DNA, 25 bp, E. coli
gctggcgctggtggacattattacg

SEQ ID NO: 133472 - DNA, 25 bp, E. coli
gctggcgctggtcgacattattacg

SEQ ID NO: 133473 - DNA, 25 bp, E. coli
gaatgtcatcggtattcatgccggc

SEQ ID NO: 133474 - DNA, 25 bp, E. coli
gaatgtcatcggaattcatgccggc

SEQ ID NO: 133475 - DNA, 25 bp, E. coli
cgtaccgtggcgtgaagagatcgac

SEQ ID NO: 133476 - DNA, 25 bp, E. coli
cgtaccgtggcgagaagagatcgac

SEQ ID NO: 133477 - DNA, 25 bp, E. coli
gattgccgtaactcgtaaaggcgca

SEQ ID NO: 133478 - DNA, 25 bp, E. coli
gattgccgtaacacgtaaaggcgca

SEQ ID NO: 133479 - DNA, 25 bp, E. coli
ggaagaaaaaccattgccagaggcg

SEQ ID NO: 133480 - DNA, 25 bp, E. coli
ggaagaaaaacctttgccagaggcg

SEQ ID NO: 133481 - DNA, 25 bp, E. coli
tcaaaggcgaatcaacaggtgtggc

SEQ ID NO: 133482 - DNA, 25 bp, E. coli
tcaaaggcgaatgaacaggtgtggc

SEQ ID NO: 133483 - DNA, 25 bp, E. coli
gagatcgacgcaattttagacaggc

SEQ ID NO: 133484 - DNA, 25 bp, E. coli
gagatcgacgcatttttagacaggc

SEQ ID NO: 133485 - DNA, 25 bp, E. coli
caatggctaccgacgatttctggcg

SEQ ID NO: 133486 - DNA, 25 bp, E. coli
caatggctaccgtcgatttctggcg

SEQ ID NO: 133487 - DNA, 25 bp, E. coli
taaagtggtcacagaaccgcttgcg

SEQ ID NO: 133488 - DNA, 25 bp, E. coli
taaagtggtcactgaaccgcttgcg

SEQ ID NO: 133489 - DNA, 25 bp, E. coli
tatgcaaattgacaagacgccgcga

SEQ ID NO: 133490 - DNA, 25 bp, E. coli
tatgcaaattgagaagacgccgcga

SEQ ID NO: 133491 - DNA, 25 bp, E. coli
tataaacaacagcttgcgcgcgccg

SEQ ID NO: 133492 - DNA, 25 bp, E. coli
tatttcaggatacccagcgctgctg

SEQ ID NO: 133493 - DNA, 25 bp, E. coli
tatttcaggatagccagcgctgctg

SEQ ID NO: 133494 - DNA, 25 bp, E. coli
tataaacaacaggttgcgcgcgccg

SEQ ID NO: 133495 - DNA, 25 bp, E. coli
tgtttccgtcgaataccgcctcagg

SEQ ID NO: 133496 - DNA, 25 bp, E. coli
tgtcaaagtgattgtctcgcgcgcc

SEQ ID NO: 133497 - DNA, 25 bp, E. coli
tgtcaaagtgatagtctcgcgcgcc

SEQ ID NO: 133498 - DNA, 25 bp, E. coli
tgtttccgtcgattaccgcctcagg

SEQ ID NO: 133499 - DNA, 25 bp, E. coli
tccgccgtggcgtgtatgtcaaagt

SEQ ID NO: 133500 - DNA, 25 bp, E. coli
tccgccgtggcgagtatgtcaaagt

SEQ ID NO: 133501 - DNA, 25 bp, E. coli
cattaatgccgacggaacgcaggcg

SEQ ID NO: 133502 - DNA, 25 bp, E. coli
cattaatgccgagggaacgcaggcg

SEQ ID NO: 133503 - DNA, 25 bp, E. coli
gatttaatgtcgcttcgccagcgcg

SEQ ID NO: 133504 - DNA, 25 bp, E. coli
gatttaatgtcggttcgccagcgcg

SEQ ID NO: 133505 - DNA, 25 bp, E. coli
gatgcctgggatccgtttaccgtgc

SEQ ID NO: 133506 - DNA, 25 bp, E. coli
gatgcctgggatgcgtttaccgtgc

SEQ ID NO: 133507 - DNA, 25 bp, E. coli
aactggcggtggattctactgctaa

SEQ ID NO: 133508 - DNA, 25 bp, E. coli
cagacaagaaaagcgtactgcgcaa

SEQ ID NO: 133509 - DNA, 25 bp, E. coli
cagacaagaaaaccgtactgcgcaa

SEQ ID NO: 133510 - DNA, 25 bp, E. coli
agcttcccgcttaggttccggctgg

SEQ ID NO: 133511 - DNA, 25 bp, E. coli
agcttcccgctttggttccggctgg

SEQ ID NO: 133512 - DNA, 25 bp, E. coli
aactgggacgaagcagcggcacgtt

SEQ ID NO: 133513 - DNA, 25 bp, E. coli
aactgggacgaaccagcggcacgtt

SEQ ID NO: 133514 - DNA, 25 bp, E. coli
aactggcggtggtttctactgctaa

SEQ ID NO: 133515 - DNA, 25 bp, E. coli
tgatcaccaaactggaccagctgcc

SEQ ID NO: 133516 - DNA, 25 bp, E. coli
tgatcaccaaacaggaccagctgcc

SEQ ID NO: 133517 - DNA, 25 bp, E. coli
tctggaaaggtcagaaaaaaggcac

SEQ ID NO: 133518 - DNA, 25 bp, E. coli
tctggaaaggtctgaaaaaaggcac

SEQ ID NO: 133519 - DNA, 25 bp, E. coli
tctgaaaaaagggaccaccctgcag

SEQ ID NO: 133520 - DNA, 25 bp, E. coli
tctgaaaaaaggcaccaccctgcag

SEQ ID NO: 133521 - DNA, 25 bp, E. coli
cgtatgcttacgatgccctggaacc

SEQ ID NO: 133522 - DNA, 25 bp, E. coli
cgtatgcttacgttgccctggaacc

SEQ ID NO: 133523 - DNA, 25 bp, E. coli
gataagcagaccttggaaatccacc

SEQ ID NO: 133524 - DNA, 25 bp, E. coli
gataagcagaccatggaaatccacc

SEQ ID NO: 133525 - DNA, 25 bp, E. coli
tggaaccgcacttcgataagcagac

SEQ ID NO: 133526 - DNA, 25 bp, E. coli
tggaccagctgcgagcagacaagaa

SEQ ID NO: 133527 - DNA, 25 bp, E. coli
tggaccagctgccagcagacaagaa

SEQ ID NO: 133528 - DNA, 25 bp, E. coli
tggaaccgcactacgataagcagac

SEQ ID NO: 133529 - DNA, 25 bp, E. coli
cattttatttttgaacgcaggccaa

SEQ ID NO: 133530 - DNA, 25 bp, E. coli
cattttatttttcaacgcaggccaa

SEQ ID NO: 133531 - DNA, 25 bp, E. coli
taaatagccttctagaacaaggcca

SEQ ID NO: 133532 - DNA, 25 bp, E. coli
taaaatcgcccgctcgcggcatatc

SEQ ID NO: 133533 - DNA, 25 bp, E. coli
taaatagccttcaagaacaaggcca

SEQ ID NO: 133534 - DNA, 25 bp, E. coli
taaaatcgcccggtcgcggcatatc

SEQ ID NO: 133535 - DNA, 25 bp, E. coli
aaaatgcaattttgcaaccgattgc

SEQ ID NO: 133536 - DNA, 25 bp, E. coli
aaaatgcaatttagcaaccgattgc

SEQ ID NO: 133537 - DNA, 25 bp, E. coli
gcaagtgaagagtttctaaatagcc

SEQ ID NO: 133538 - DNA, 25 bp, E. coli
gcaaccgattgctataaaacattta

SEQ ID NO: 133539 - DNA, 25 bp, E. coli
gcaagtgaagagattctaaatagcc

SEQ ID NO: 133540 - DNA, 25 bp, E. coli
gcaaccgattgcaataaaacattta

SEQ ID NO: 133541 - DNA, 25 bp, E. coli
gaaatatatgtatcctgacgatcac

SEQ ID NO: 133542 - DNA, 25 bp, E. coli
gaacaaggccatccctttacctaat

SEQ ID NO: 133543 - DNA, 25 bp, E. coli
gaaatatatgtaacctgacgatcac

SEQ ID NO: 133544 - DNA, 25 bp, E. coli
gaacaaggccatgcctttacctaat

SEQ ID NO: 133545 - DNA, 25 bp, E. coli
gatcaaaatcacctcttaaaatgca

SEQ ID NO: 133546 - DNA, 25 bp, E. coli
gatcaaaatcacgtcttaaaatgca

SEQ ID NO: 133547 - DNA, 25 bp, E. coli
tcacaaaatcacgtaaaatcgcccg

SEQ ID NO: 133548 - DNA, 25 bp, E. coli
tcacaaaatcacctaaaatcgcccg

SEQ ID NO: 133549 - DNA, 25 bp, E. coli
gagatttccttatcaaacagagcag

SEQ ID NO: 133550 - DNA, 25 bp, E. coli
gagatttccttaacaaacagagcag

SEQ ID NO: 133551 - DNA, 25 bp, E. coli
taccggtcaacacacctggcggttt

SEQ ID NO: 133552 - DNA, 25 bp, E. coli
taccggtcaacagacctggcggttt

SEQ ID NO: 133553 - DNA, 25 bp, E. coli
atataccgacgatcttgggcaaccg

SEQ ID NO: 133554 - DNA, 25 bp, E. coli
atataccgacgaacttgggcaaccg

SEQ ID NO: 133555 - DNA, 25 bp, E. coli
aacaggacatctggtagaagggttg

SEQ ID NO: 133556 - DNA, 25 bp, E. coli
aacaggacatctcgtagaagggttg

SEQ ID NO: 133557 - DNA, 25 bp, E. coli
gagctggaacttcccgctaccggtc

SEQ ID NO: 133558 - DNA, 25 bp, E. coli
gagctggaacttgccgctaccggtc

SEQ ID NO: 133559 - DNA, 25 bp, E. coli
gcttagtcgttatcaaatcaaccag

SEQ ID NO: 133560 - DNA, 25 bp, E. coli
gcttagtcgttaacaaatcaaccag

SEQ ID NO: 133561 - DNA, 25 bp, E. coli
gaaggcgttggtggaatataccgac

SEQ ID NO: 133562 - DNA, 25 bp, E. coli
gaaggcgttggtcgaatataccgac

SEQ ID NO: 133563 - DNA, 25 bp, E. coli
gacaccgaaccttttattcttgaag

SEQ ID NO: 133564 - DNA, 25 bp, E. coli
gacaccgaacctattattcttgaag

SEQ ID NO: 133565 - DNA, 25 bp, E. coli
cgcagtgtcaggtgatgcagcaact

SEQ ID NO: 133566 - DNA, 25 bp, E. coli
cgcagtgtcaggagatgcagcaact

SEQ ID NO: 133567 - DNA, 25 bp, E. coli
cggtttggcctgacgcgcatgttgc

SEQ ID NO: 133568 - DNA, 25 bp, E. coli
cggtttggcctgtcgcgcatgttgc

SEQ ID NO: 133569 - DNA, 25 bp, E. coli
ggtgatttgccgaatggtgcctttg

SEQ ID NO: 133570 - DNA, 25 bp, E. coli
ggtgatttgccgtatggtgcctttg

SEQ ID NO: 133571 - DNA, 25 bp, E. coli
tcaaccagcagtaattaaatgtact

SEQ ID NO: 133572 - DNA, 25 bp, E. coli
tcaaccagcagttattaaatgtact

SEQ ID NO: 133573 - DNA, 25 bp, E. coli
tacaggcgttgcaaacacagcgtct

SEQ ID NO: 133574 - DNA, 25 bp, E. coli
tacaggcgttgctaacacagcgtct

SEQ ID NO: 133575 - DNA, 25 bp, E. coli
aaagcttgaccccattgaaaccgcg

SEQ ID NO: 133576 - DNA, 25 bp, E. coli
aaagcttgacccgattgaaaccgcg

SEQ ID NO: 133577 - DNA, 25 bp, E. coli
tatttggtgctgtgccgtggacaca

SEQ ID NO: 133578 - DNA, 25 bp, E. coli
tatttggtgctgagccgtggacaca

SEQ ID NO: 133579 - DNA, 25 bp, E. coli
ttaccaactggacgtgaaccgccgg

SEQ ID NO: 133580 - DNA, 25 bp, E. coli
ttaccaactggaggtgaaccgccgg

SEQ ID NO: 133581 - DNA, 25 bp, E. coli
tgtaccaccaaacaggatctgcgcg

SEQ ID NO: 133582 - DNA, 25 bp, E. coli
tgtaccaccaaagaggatctgcgcg

SEQ ID NO: 133583 - DNA, 25 bp, E. coli
gcagtatcccgccttcagaaggcaa

SEQ ID NO: 133584 - DNA, 25 bp, E. coli
gcagtatcccgcgttcagaaggcaa

SEQ ID NO: 133585 - DNA, 25 bp, E. coli
gaaattgttaatcctcatgacggca

SEQ ID NO: 133586 - DNA, 25 bp, E. coli
gaaaaacaagcgcaactgatccgtg

SEQ ID NO: 133587 - DNA, 25 bp, E. coli
gaaattgttaatgctcatgacggca

SEQ ID NO: 133588 - DNA, 25 bp, E. coli
gaaagtagcctgtcattgacgcatg

SEQ ID NO: 133589 - DNA, 25 bp, E. coli
gaaaaacaagcggaactgatccgtg

SEQ ID NO: 133590 - DNA, 25 bp, E. coli
gaaagtagcctgacattgacgcatg

SEQ ID NO: 133591 - DNA, 25 bp, E. coli
cgtaaagagattcagcgtcgcctgg

SEQ ID NO: 133592 - DNA, 25 bp, E. coli
cgtaaagagattgagcgtcgcctgg

SEQ ID NO: 133593 - DNA, 25 bp, E. coli
taacctgattgatgagctggagcgg

SEQ ID NO: 133594 - DNA, 25 bp, E. coli
taacctgattgaagagctggagcgg

SEQ ID NO: 133595 - DNA, 25 bp, E. coli
aatgacccggataggcatatggagt

SEQ ID NO: 133596 - DNA, 25 bp, E. coli
aatgacccggattggcatatggagt

SEQ ID NO: 133597 - DNA, 25 bp, E. coli
cagaatatttatgaaaaagcggaaa

SEQ ID NO: 133598 - DNA, 25 bp, E. coli
cagaatatttatcaaaaagcggaaa

SEQ ID NO: 133599 - DNA, 25 bp, E. coli
atgacccggattggcatatggagta

SEQ ID NO: 133600 - DNA, 25 bp, E. coli
atgacccggattcgcatatggagta

SEQ ID NO: 133601 - DNA, 25 bp, E. coli
ttaatgacccggtttggcatatgga

SEQ ID NO: 133602 - DNA, 25 bp, E. coli
ttaatgacccggattggcatatgga

SEQ ID NO: 133603 - DNA, 25 bp, E. coli
tggtgatagtcaacgccgggttgat

SEQ ID NO: 133604 - DNA, 25 bp, E. coli
tggtgatagtcatcgccgggttgat

SEQ ID NO: 133605 - DNA, 25 bp, E. coli
gccgggttgatttcgttatggagaa

SEQ ID NO: 133606 - DNA, 25 bp, E. coli
gccgggttgattacgttatggagaa

SEQ ID NO: 133607 - DNA, 25 bp, E. coli
gaagcgttacgtaattgcgatggtg

SEQ ID NO: 133608 - DNA, 25 bp, E. coli
gaagcgttacgttattgcgatggtg

SEQ ID NO: 133609 - DNA, 25 bp, E. coli
cccggattggcatatggagtattca

SEQ ID NO: 133610 - DNA, 25 bp, E. coli
cccggattggcaaatggagtattca

SEQ ID NO: 133611 - DNA, 25 bp, E. coli
gttaatgacccgcattggcatatgg

SEQ ID NO: 133612 - DNA, 25 bp, E. coli
gttaatgacccggattggcatatgg

SEQ ID NO: 133613 - DNA, 25 bp, E. coli
gattggcatatgcagtattcagaat

SEQ ID NO: 133614 - DNA, 25 bp, E. coli
gattggcatatggagtattcagaat

SEQ ID NO: 133615 - DNA, 25 bp, E. coli
taatgacccggattggcatatggag

SEQ ID NO: 133616 - DNA, 25 bp, E. coli
taatgacccggaatggcatatggag

SEQ ID NO: 133617 - DNA, 25 bp, E. coli
aatacatcgggcgagtcgcgaagtt

SEQ ID NO: 133618 - DNA, 25 bp, E. coli
aatacatcgggccagtcgcgaagtt

SEQ ID NO: 133619 - DNA, 25 bp, E. coli
catcgggcgagtggcgaagttcttt

SEQ ID NO: 133620 - DNA, 25 bp, E. coli
catcgggcgagtcgcgaagttcttt

SEQ ID NO: 133621 - DNA, 25 bp, E. coli
catccggaatacatcgggcgagtcg

SEQ ID NO: 133622 - DNA, 25 bp, E. coli
catccggaatacttcgggcgagtcg

SEQ ID NO: 133623 - DNA, 25 bp, E. coli
tacatcgggcgagtcgcgaagttct

SEQ ID NO: 133624 - DNA, 25 bp, E. coli
tacatcgggcgactcgcgaagttct

SEQ ID NO: 133625 - DNA, 25 bp, E. coli
atacatcgggcgagtcgcgaagttc

SEQ ID NO: 133626 - DNA, 25 bp, E. coli
atccggaatacatcgggcgagtcgc

SEQ ID NO: 133627 - DNA, 25 bp, E. coli
atccggaatacaacgggcgagtcgc

SEQ ID NO: 133628 - DNA, 25 bp, E. coli
atacatcgggcgtgtcgcgaagttc

SEQ ID NO: 133629 - DNA, 25 bp, E. coli
acatcgggcgagacgcgaagttctt

SEQ ID NO: 133630 - DNA, 25 bp, E. coli
acatcgggcgagtcgcgaagttctt

SEQ ID NO: 133631 - DNA, 25 bp, E. coli
tccggaatacatcgggcgagtcgcg

SEQ ID NO: 133632 - DNA, 25 bp, E. coli
tccggaatacatggggcgagtcgcg

SEQ ID NO: 133633 - DNA, 25 bp, E. coli
ccggaatacatccggcgagtcgcga

SEQ ID NO: 133634 - DNA, 25 bp, E. coli
ccggaatacatcgggcgagtcgcga

SEQ ID NO: 133635 - DNA, 25 bp, E. coli
gcatccggaatacatcgggcgagtc

SEQ ID NO: 133636 - DNA, 25 bp, E. coli
gcatccggaatagatcgggcgagtc

SEQ ID NO: 133637 - DNA, 25 bp, E. coli
cggaatacatcgcgcgagtcgcgaa

SEQ ID NO: 133638 - DNA, 25 bp, E. coli
cggaatacatcgggcgagtcgcgaa

SEQ ID NO: 133639 - DNA, 25 bp, E. coli
caatatgcggttaggataccgggcg

SEQ ID NO: 133640 - DNA, 25 bp, E. coli
caatatgcggtttggataccgggcg

SEQ ID NO: 133641 - DNA, 25 bp, E. coli
catggtgcaatttcctgtacggtgg

SEQ ID NO: 133642 - DNA, 25 bp, E. coli
catggtgcaattacctgtacggtgg

SEQ ID NO: 133643 - DNA, 25 bp, E. coli
tacagaaagttgctcatacgctggg

SEQ ID NO: 133644 - DNA, 25 bp, E. coli
tacagaaagttggtcatacgctggg

SEQ ID NO: 133645 - DNA, 25 bp, E. coli
aaaatgctttgtcgatggtgccgcc

SEQ ID NO: 133646 - DNA, 25 bp, E. coli
aaacaggacgacgactcagcgtgct

SEQ ID NO: 133647 - DNA, 25 bp, E. coli
aaacaggacgaccactcagcgtgct

SEQ ID NO: 133648 - DNA, 25 bp, E. coli
aaaatgctttgtggatggtgccgcc

SEQ ID NO: 133649 - DNA, 25 bp, E. coli
tgtttgatgaacaccctcagcagcc

SEQ ID NO: 133650 - DNA, 25 bp, E. coli
tgtttgatgaactccctcagcagcc

SEQ ID NO: 133651 - DNA, 25 bp, E. coli
tctcaatggctatgaacccgaccga

SEQ ID NO: 133652 - DNA, 25 bp, E. coli
tctcaatggctaagaacccgaccga

SEQ ID NO: 133653 - DNA, 25 bp, E. coli
gcattttgtattcacgccggaacgg

SEQ ID NO: 133654 - DNA, 25 bp, E. coli
gctggcttttttccgatgagtgaac

SEQ ID NO: 133655 - DNA, 25 bp, E. coli
gctggcttttttgcgatgagtgaac

SEQ ID NO: 133656 - DNA, 25 bp, E. coli
gcattttgtattgacgccggaacgg

SEQ ID NO: 133657 - DNA, 25 bp, E. coli
cattgaaaatatggcccttatgccg

SEQ ID NO: 133658 - DNA, 25 bp, E. coli
cattgaaaatatcgcccttatgccg

SEQ ID NO: 133659 - DNA, 25 bp, E. coli
gtcctgtacatctgcaccgcaaagg

SEQ ID NO: 133660 - DNA, 25 bp, E. coli
gtcctgtacatcagcaccgcaaagg

SEQ ID NO: 133661 - DNA, 25 bp, E. coli
caaacacgttatggctgacatcaaa

SEQ ID NO: 133662 - DNA, 25 bp, E. coli
caaacacgttatcgctgacatcaaa

SEQ ID NO: 133663 - DNA, 25 bp, E. coli
cagtggaaaactcatcgtacataat

SEQ ID NO: 133664 - DNA, 25 bp, E. coli
cagtggaaaactgatcgtacataat

SEQ ID NO: 133665 - DNA, 25 bp, E. coli
ttcggttggtctggttactcctgtc

SEQ ID NO: 133666 - DNA, 25 bp, E. coli
ttcggttggtctcgttactcctgtc

SEQ ID NO: 133667 - DNA, 25 bp, E. coli
cctgtctggttaatagcaagataat

SEQ ID NO: 133668 - DNA, 25 bp, E. coli
ccatggactcattaacaccctttca

SEQ ID NO: 133669 - DNA, 25 bp, E. coli
ccatggactcataaacaccctttca

SEQ ID NO: 133670 - DNA, 25 bp, E. coli
cctgtctggttattagcaagataat

SEQ ID NO: 133671 - DNA, 25 bp, E. coli
gctataaacagtcgaaaactcatcg

SEQ ID NO: 133672 - DNA, 25 bp, E. coli
gctttattgtcatacacgttatggc

SEQ ID NO: 133673 - DNA, 25 bp, E. coli
gctataaacagtggaaaactcatcg

SEQ ID NO: 133674 - DNA, 25 bp, E. coli
gctttattgtcaaacacgttatggc

SEQ ID NO: 133675 - DNA, 25 bp, E. coli
gcaagataattgctataaacagtgg

SEQ ID NO: 133676 - DNA, 25 bp, E. coli
gaattatcccatggactcattaaca

SEQ ID NO: 133677 - DNA, 25 bp, E. coli
gcaagataattggtataaacagtgg

SEQ ID NO: 133678 - DNA, 25 bp, E. coli
gaattatcccatcgactcattaaca

SEQ ID NO: 133679 - DNA, 25 bp, E. coli
ggttactcctgtgtggttattagca

SEQ ID NO: 133680 - DNA, 25 bp, E. coli
ggttactcctgtctggttattagca

SEQ ID NO: 133681 - DNA, 25 bp, E. coli
ggctgacatcaaaaaaaaccggatt

SEQ ID NO: 133682 - DNA, 25 bp, E. coli
ggctgacatcaataaaaaccggatt

SEQ ID NO: 133683 - DNA, 25 bp, E. coli
ccgttgaagtggtgaaccgtcgcct

SEQ ID NO: 133684 - DNA, 25 bp, E. coli
ccgttgaagtggagaaccgtcgcct

SEQ ID NO: 133685 - DNA, 25 bp, E. coli
ttactcgatgccgagatccttgcgg

SEQ ID NO: 133686 - DNA, 25 bp, E. coli
ttactcgatgcccagatccttgcgg

SEQ ID NO: 133687 - DNA, 25 bp, E. coli
ttgcggtggcgaggaaaatgtttcc

SEQ ID NO: 133688 - DNA, 25 bp, E. coli
ttgcggtggcgacgaaaatgtttcc

SEQ ID NO: 133689 - DNA, 25 bp, E. coli
tgtaaggtcacccatagccttgcgg

SEQ ID NO: 133690 - DNA, 25 bp, E. coli
tgtaaggtcaccgatagccttgcgg

SEQ ID NO: 133691 - DNA, 25 bp, E. coli
tgcggaagtttatctggcgatgacc

SEQ ID NO: 133692 - DNA, 25 bp, E. coli
tgaccggtggtcaaacgtcgatggc

SEQ ID NO: 133693 - DNA, 25 bp, E. coli
tgaccggtggtctaacgtcgatggc

SEQ ID NO: 133694 - DNA, 25 bp, E. coli
tgcgcactatgatggccacaagatc

SEQ ID NO: 133695 - DNA, 25 bp, E. coli
tgcggaagtttaactggcgatgacc

SEQ ID NO: 133696 - DNA, 25 bp, E. coli
tgcgcactatgaaggccacaagatc

SEQ ID NO: 133697 - DNA, 25 bp, E. coli
gaagcccgtctccatctggtgcaga

SEQ ID NO: 133698 - DNA, 25 bp, E. coli
gaagcccgtctcgatctggtgcaga

SEQ ID NO: 133699 - DNA, 25 bp, E. coli
cgatggaaggagtgacacaacagca

SEQ ID NO: 133700 - DNA, 25 bp, E. coli
ccggtatgaaccagattggtgcgca

SEQ ID NO: 133701 - DNA, 25 bp, E. coli
cgatggaaggagagacacaacagca

SEQ ID NO: 133702 - DNA, 25 bp, E. coli
ccggtatgaacctgattggtgcgca

SEQ ID NO: 133703 - DNA, 25 bp, E. coli
gtttatctcaaagccgatcggctgg

SEQ ID NO: 133704 - DNA, 25 bp, E. coli
gtttatctcaaacccgatcggctgg

SEQ ID NO: 133705 - DNA, 25 bp, E. coli
catttgtgggtaatgtgcagcacct

SEQ ID NO: 133706 - DNA, 25 bp, E. coli
catttgtgggtattgtgcagcacct

SEQ ID NO: 133707 - DNA, 25 bp, E. coli
aaagagtctggctaatggcatcccg

SEQ ID NO: 133708 - DNA, 25 bp, E. coli
aaagagtctggcaaatggcatcccg

SEQ ID NO: 133709 - DNA, 25 bp, E. coli
tagttaacgtctttatggcacgccg

SEQ ID NO: 133710 - DNA, 25 bp, E. coli
tagttaacgtctatatggcacgccg

SEQ ID NO: 133711 - DNA, 25 bp, E. coli
tgttctttatgctcggcgcgaagtt

SEQ ID NO: 133712 - DNA, 25 bp, E. coli
tgttctttatgcacggcgcgaagtt

SEQ ID NO: 133713 - DNA, 25 bp, E. coli
tccaattgatggactgtgcggtgct

SEQ ID NO: 133714 - DNA, 25 bp, E. coli
tccaattgatggtctgtgcggtgct

SEQ ID NO: 133715 - DNA, 25 bp, E. coli
ccttcacgtcaaaggcgggcggtaa

SEQ ID NO: 133716 - DNA, 25 bp, E. coli
ccttcacgtcaatggcgggcggtaa

SEQ ID NO: 133717 - DNA, 25 bp, E. coli
gattgcgaaaacagaccagacgtcc

SEQ ID NO: 133718 - DNA, 25 bp, E. coli
gatacaaacgccagaccgaacagtt

SEQ ID NO: 133719 - DNA, 25 bp, E. coli
gattgcgaaaactgaccagacgtcc

SEQ ID NO: 133720 - DNA, 25 bp, E. coli
gatacaaacgcctgaccgaacagtt

SEQ ID NO: 133721 - DNA, 25 bp, E. coli
gggattttcctttcaccattgctgg

SEQ ID NO: 133722 - DNA, 25 bp, E. coli
gggattttccttacaccattgctgg

SEQ ID NO: 133723 - DNA, 25 bp, E. coli
tggcatcccgatggcaaacattctg

SEQ ID NO: 133724 - DNA, 25 bp, E. coli
tggcatcccgatcgcaaacattctg

SEQ ID NO: 133725 - DNA, 25 bp, E. coli
taaccctgatcacggtggtgttgct

SEQ ID NO: 133726 - DNA, 25 bp, E. coli
taaccctgatcagggtggtgttgct

SEQ ID NO: 133727 - DNA, 25 bp, E. coli
agctttgtcggctgtaaagcgcgac

SEQ ID NO: 133728 - DNA, 25 bp, E. coli
agctttgtcggcagtaaagcgcgac

SEQ ID NO: 133729 - DNA, 25 bp, E. coli
aaacctgtcgtgtattgctggcgct

SEQ ID NO: 133730 - DNA, 25 bp, E. coli
aaacctgtcgtgaattgctggcgct

SEQ ID NO: 133731 - DNA, 25 bp, E. coli
tggtggtgttctcgcctacactttt

SEQ ID NO: 133732 - DNA, 25 bp, E. coli
tgcaaacttagtgagcaatggagct

SEQ ID NO: 133733 - DNA, 25 bp, E. coli
tgcaaacttagtcagcaatggagct

SEQ ID NO: 133734 - DNA, 25 bp, E. coli
tcagcaatggagctttgtcggcagt

SEQ ID NO: 133735 - DNA, 25 bp, E. coli
tcagcaatggaggtttgtcggcagt

SEQ ID NO: 133736 - DNA, 25 bp, E. coli
gcttaccctttttccatcggcatgt

SEQ ID NO: 133737 - DNA, 25 bp, E. coli
gcttacccttttaccatcggcatgt

SEQ ID NO: 133738 - DNA, 25 bp, E. coli
gaattgctggcggtgcttacccttt

SEQ ID NO: 133739 - DNA, 25 bp, E. coli
gaattgctggcgctgcttacccttt

SEQ ID NO: 133740 - DNA, 25 bp, E. coli
cccggactgatgaaacctgtcgtga

SEQ ID NO: 133741 - DNA, 25 bp, E. coli
cccggactgatgtaacctgtcgtga

SEQ ID NO: 133742 - DNA, 25 bp, E. coli
cgtgtacaacacgaaaactggtggt

SEQ ID NO: 133743 - DNA, 25 bp, E. coli
cgtgtacaacaccaaaactggtggt

SEQ ID NO: 133744 - DNA, 25 bp, E. coli
gtaaagcgcgacagcactggctctg

SEQ ID NO: 133745 - DNA, 25 bp, E. coli
gtggcactcatcagcaaacttagtc

SEQ ID NO: 133746 - DNA, 25 bp, E. coli
gtggcactcatctgcaaacttagtc

SEQ ID NO: 133747 - DNA, 25 bp, E. coli
gtaaagcgcgactgcactggctctg

SEQ ID NO: 133748 - DNA, 25 bp, E. coli
tggtggtgttctggcctacactttt

SEQ ID NO: 133749 - DNA, 25 bp, E. coli
taaaaacaggctggcaaaaattgcc

SEQ ID NO: 133750 - DNA, 25 bp, E. coli
taaaaacaggctcgcaaaaattgcc

SEQ ID NO: 133751 - DNA, 25 bp, E. coli
aaattgcccgtctgactaacgagcg

SEQ ID NO: 133752 - DNA, 25 bp, E. coli
aaattgcccgtcagactaacgagcg

SEQ ID NO: 133753 - DNA, 25 bp, E. coli
tgtacatagctgtttacctggctga

SEQ ID NO: 133754 - DNA, 25 bp, E. coli
tgatgttgaaccatccttgcaggag

SEQ ID NO: 133755 - DNA, 25 bp, E. coli
tgatgttgaaccttccttgcaggag

SEQ ID NO: 133756 - DNA, 25 bp, E. coli
tgtacatagctgattacctggctga

SEQ ID NO: 133757 - DNA, 25 bp, E. coli
tgttcgacctgacacgttactccga

SEQ ID NO: 133758 - DNA, 25 bp, E. coli
tgttcgacctgagacgttactccga

SEQ ID NO: 133759 - DNA, 25 bp, E. coli
tgcttattctaacccaccgggcagc

SEQ ID NO: 133760 - DNA, 25 bp, E. coli
tgcttattctaagccaccgggcagc

SEQ ID NO: 133761 - DNA, 25 bp, E. coli
tcagccgcaggaaaagcatctgttc

SEQ ID NO: 133762 - DNA, 25 bp, E. coli
ccatgcatttgtcagcagaggagca

SEQ ID NO: 133763 - DNA, 25 bp, E. coli
ccatgcatttgtgagcagaggagca

SEQ ID NO: 133764 - DNA, 25 bp, E. coli
gaagatctggcaacagtcagggaaa

SEQ ID NO: 133765 - DNA, 25 bp, E. coli
gaagatctggcatcagtcagggaaa

SEQ ID NO: 133766 - DNA, 25 bp, E. coli
taacggcgaggattgggtgcatctt

SEQ ID NO: 133767 - DNA, 25 bp, E. coli
tcaattactggcaaacaggaaagcc

SEQ ID NO: 133768 - DNA, 25 bp, E. coli
tcaattactggctaacaggaaagcc

SEQ ID NO: 133769 - DNA, 25 bp, E. coli
tcagccgcaggataagcatctgttc

SEQ ID NO: 133770 - DNA, 25 bp, E. coli
taacggcgaggaatgggtgcatctt

SEQ ID NO: 133771 - DNA, 25 bp, E. coli
caaagattttgaccgccttagtcaa

SEQ ID NO: 133772 - DNA, 25 bp, E. coli
caaagattttgagcgccttagtcaa

SEQ ID NO: 133773 - DNA, 25 bp, E. coli
agttttcttgatgccaacggttctc

SEQ ID NO: 133774 - DNA, 25 bp, E. coli
agttttcttgatcccaacggttctc

SEQ ID NO: 133775 - DNA, 25 bp, E. coli
gtaagcataacgtgttccgaattac

SEQ ID NO: 133776 - DNA, 25 bp, E. coli
gtaagcataacgagttccgaattac

SEQ ID NO: 133777 - DNA, 25 bp, E. coli
tgagcgccttagacaatttgctgac

SEQ ID NO: 133778 - DNA, 25 bp, E. coli
tgaaaatcttttggactatcttgaa

SEQ ID NO: 133779 - DNA, 25 bp, E. coli
tgaaaatcttttcgactatcttgaa

SEQ ID NO: 133780 - DNA, 25 bp, E. coli
tgagcgccttagtcaatttgctgac

SEQ ID NO: 133781 - DNA, 25 bp, E. coli
tctcaataaggatgttgaaaatctt

SEQ ID NO: 133782 - DNA, 25 bp, E. coli
tctcagtaagcataacgtgttccga

SEQ ID NO: 133783 - DNA, 25 bp, E. coli
tctcagtaagcaaaacgtgttccga

SEQ ID NO: 133784 - DNA, 25 bp, E. coli
tctcaataaggaagttgaaaatctt

SEQ ID NO: 133785 - DNA, 25 bp, E. coli
ccttagtcaatttgctgacgatctc

SEQ ID NO: 133786 - DNA, 25 bp, E. coli
ccagttttcttgatgccaacggttc

SEQ ID NO: 133787 - DNA, 25 bp, E. coli
gccaacggttctcttaatattgata

SEQ ID NO: 133788 - DNA, 25 bp, E. coli
ccagttttcttgttgccaacggttc

SEQ ID NO: 133789 - DNA, 25 bp, E. coli
gccaacggttctgttaatattgata

SEQ ID NO: 133790 - DNA, 25 bp, E. coli
ccttagtcaattagctgacgatctc

SEQ ID NO: 133791 - DNA, 25 bp, E. coli
gatgccaacggtactcttaatattg

SEQ ID NO: 133792 - DNA, 25 bp, E. coli
gatgccaacggttctcttaatattg

SEQ ID NO: 133793 - DNA, 25 bp, E. coli
cactcccttttactggctaaaccag

SEQ ID NO: 133794 - DNA, 25 bp, E. coli
caaaaaatcaggacggattgacgcc

SEQ ID NO: 133795 - DNA, 25 bp, E. coli
caaaaaatcaggtcggattgacgcc

SEQ ID NO: 133796 - DNA, 25 bp, E. coli
cactcccttttagtggctaaaccag

SEQ ID NO: 133797 - DNA, 25 bp, E. coli
tactggctaaaccagaaaacttatt

SEQ ID NO: 133798 - DNA, 25 bp, E. coli
tactggctaaacgagaaaacttatt

SEQ ID NO: 133799 - DNA, 25 bp, E. coli
tttatcattcaaaaaatcaggtcgg

SEQ ID NO: 133800 - DNA, 25 bp, E. coli
tttatcattcaataaatcaggtcgg

SEQ ID NO: 133801 - DNA, 25 bp, E. coli
tgtctgcgcaaaaccaggttacgct

SEQ ID NO: 133802 - DNA, 25 bp, E. coli
tgtcttttgtgagttttgtcaccaa

SEQ ID NO: 133803 - DNA, 25 bp, E. coli
tgtcttttgtgacttttgtcaccaa

SEQ ID NO: 133804 - DNA, 25 bp, E. coli
tgtctgcgcaaatccaggttacgct

SEQ ID NO: 133805 - DNA, 25 bp, E. coli
tgacgcctgtctccgcaaatccagg

SEQ ID NO: 133806 - DNA, 25 bp, E. coli
tgacgcctgtctgcgcaaatccagg

SEQ ID NO: 133807 - DNA, 25 bp, E. coli
tcggattgacgcctgtctgcgcaaa

SEQ ID NO: 133808 - DNA, 25 bp, E. coli
tcaggtcggattgacgcctgtctgc

SEQ ID NO: 133809 - DNA, 25 bp, E. coli
tcggattgacgcgtgtctgcgcaaa

SEQ ID NO: 133810 - DNA, 25 bp, E. coli
tcaggtcggattcacgcctgtctgc

SEQ ID NO: 133811 - DNA, 25 bp, E. coli
ctgcgcaaatccaggttacgcttaa

SEQ ID NO: 133812 - DNA, 25 bp, E. coli
ctgcgcaaatcctggttacgcttaa

SEQ ID NO: 133813 - DNA, 25 bp, E. coli
gagttttgtcacgaaatatcgttat

SEQ ID NO: 133814 - DNA, 25 bp, E. coli
gagttttgtcaccaaatatcgttat

SEQ ID NO: 133815 - DNA, 25 bp, E. coli
caacgaaatattaggcgcgcgactc

SEQ ID NO: 133816 - DNA, 25 bp, E. coli
aatttgaactggtcaccaccgacgg

SEQ ID NO: 133817 - DNA, 25 bp, E. coli
aatttgaactggacaccaccgacgg

SEQ ID NO: 133818 - DNA, 25 bp, E. coli
caacgaaatatttggcgcgcgactc

SEQ ID NO: 133819 - DNA, 25 bp, E. coli
tacggcaccgtaaaagggatgacgc

SEQ ID NO: 133820 - DNA, 25 bp, E. coli
tacggcaccgtataagggatgacgc

SEQ ID NO: 133821 - DNA, 25 bp, E. coli
tataagagcgatactggcccactcg

SEQ ID NO: 133822 - DNA, 25 bp, E. coli
tataagagcgattctggcccactcg

SEQ ID NO: 133823 - DNA, 25 bp, E. coli
tgtttgactgcgaaatgccaacccg

SEQ ID NO: 133824 - DNA, 25 bp, E. coli
tgtacgccgtatcctgctgactggg

SEQ ID NO: 133825 - DNA, 25 bp, E. coli
tgtttgactgcgtaatgccaacccg

SEQ ID NO: 133826 - DNA, 25 bp, E. coli
tgtacgccgtatgctgctgactggg

SEQ ID NO: 133827 - DNA, 25 bp, E. coli
tgaccgatggcgtggtgaaaatccg

SEQ ID NO: 133828 - DNA, 25 bp, E. coli
tgaccgatggcgaggtgaaaatccg

SEQ ID NO: 133829 - DNA, 25 bp, E. coli
gcccgggccaggaaatcatgaaact

SEQ ID NO: 133830 - DNA, 25 bp, E. coli
gcccgggccaggtaatcatgaaact

SEQ ID NO: 133831 - DNA, 25 bp, E. coli
gaagaagttgaagccactggcgcgc

SEQ ID NO: 133832 - DNA, 25 bp, E. coli
gaagaagttgaacccactggcgcgc

SEQ ID NO: 133833 - DNA, 25 bp, E. coli
gacaaaccgcgtaacctgatgggcg

SEQ ID NO: 133834 - DNA, 25 bp, E. coli
gacaaaccgcgttacctgatgggcg

SEQ ID NO: 133835 - DNA, 25 bp, E. coli
gattacgcaaaaggctccatggaga

SEQ ID NO: 133836 - DNA, 25 bp, E. coli
gattacgcaaaacgctccatggaga

SEQ ID NO: 133837 - DNA, 25 bp, E. coli
caacgcgggacacgctcgttctgat

SEQ ID NO: 133838 - DNA, 25 bp, E. coli
caacgcgggacaggctcgttctgat

SEQ ID NO: 133839 - DNA, 25 bp, E. coli
tagtcaggatgatggctgtggcaaa

SEQ ID NO: 133840 - DNA, 25 bp, E. coli
tagtcaggatgaaggctgtggcaaa

SEQ ID NO: 133841 - DNA, 25 bp, E. coli
tatggagttactgatcaacgcggga

SEQ ID NO: 133842 - DNA, 25 bp, E. coli
tatggagttactcatcaacgcggga

SEQ ID NO: 133843 - DNA, 25 bp, E. coli
tattatgccaggatttagccaggga

SEQ ID NO: 133844 - DNA, 25 bp, E. coli
tattatgccaggttttagccaggga

SEQ ID NO: 133845 - DNA, 25 bp, E. coli
ttcagaccgcgtaaattagtcagga

SEQ ID NO: 133846 - DNA, 25 bp, E. coli
ttcagaccgcgttaattagtcagga

SEQ ID NO: 133847 - DNA, 25 bp, E. coli
gaagccatacgttgtgccgggcaaa

SEQ ID NO: 133848 - DNA, 25 bp, E. coli
gaagccatacgtagtgccgggcaaa

SEQ ID NO: 133849 - DNA, 25 bp, E. coli
cgttctgatgcgttggaagccatac

SEQ ID NO: 133850 - DNA, 25 bp, E. coli
cgttctgatgcgatggaagccatac

SEQ ID NO: 133851 - DNA, 25 bp, E. coli
cattaagaaaagtgctccatgcctg

SEQ ID NO: 133852 - DNA, 25 bp, E. coli
cttcaggcgcataagattcagaccg

SEQ ID NO: 133853 - DNA, 25 bp, E. coli
cattaagaaaagagctccatgcctg

SEQ ID NO: 133854 - DNA, 25 bp, E. coli
cttcaggcgcattagattcagaccg

SEQ ID NO: 133855 - DNA, 25 bp, E. coli
tggcagggcgcatctaaactaatgg

SEQ ID NO: 133856 - DNA, 25 bp, E. coli
tggcagggcgcaactaaactaatgg

SEQ ID NO: 133857 - DNA, 25 bp, E. coli
taatggccagctctgaatctgcctg

SEQ ID NO: 133858 - DNA, 25 bp, E. coli
taatggccagctgtgaatctgcctg

SEQ ID NO: 133859 - DNA, 25 bp, E. coli
cagttactgctctgtgcctgaagcg

SEQ ID NO: 133860 - DNA, 25 bp, E. coli
cagttactgctcagtgcctgaagcg

SEQ ID NO: 133861 - DNA, 25 bp, E. coli
catgatgatcctgaatcttaagcgg

SEQ ID NO: 133862 - DNA, 25 bp, E. coli
catgatgatcctcaatcttaagcgg

SEQ ID NO: 133863 - DNA, 25 bp, E. coli
tatcgctaaaaaggttctactgcca

SEQ ID NO: 133864 - DNA, 25 bp, E. coli
tatcgctaaaaacgttctactgcca

SEQ ID NO: 133865 - DNA, 25 bp, E. coli
tatacagaacgatgaagagatcgac

SEQ ID NO: 133866 - DNA, 25 bp, E. coli
tatacagaacgaagaagagatcgac

SEQ ID NO: 133867 - DNA, 25 bp, E. coli
ttctggagaaacagaaaatatcgct

SEQ ID NO: 133868 - DNA, 25 bp, E. coli
ttctggagaaactgaaaatatcgct

SEQ ID NO: 133869 - DNA, 25 bp, E. coli
tgtcgcactcatgaatggcagttac

SEQ ID NO: 133870 - DNA, 25 bp, E. coli
tgtcgcactcatcaatggcagttac

SEQ ID NO: 133871 - DNA, 25 bp, E. coli
tgcgaatcaaatcacaacggaagat

SEQ ID NO: 133872 - DNA, 25 bp, E. coli
tgcgaatcaaatgacaacggaagat

SEQ ID NO: 133873 - DNA, 25 bp, E. coli
cctttaatattatacgctgcctggg

SEQ ID NO: 133874 - DNA, 25 bp, E. coli
cctttaatattaaacgctgcctggg

SEQ ID NO: 133875 - DNA, 25 bp, E. coli
cgacgtaatgttccatcagaatgcc

SEQ ID NO: 133876 - DNA, 25 bp, E. coli
cgacgtaatgttgcatcagaatgcc

SEQ ID NO: 133877 - DNA, 25 bp, E. coli
gatcaatgagctcgtacgccatcag

SEQ ID NO: 133878 - DNA, 25 bp, E. coli
gatcaatgagctggtacgccatcag

SEQ ID NO: 133879 - DNA, 25 bp, E. coli
tcaaattgaacgtttaaaacctgtc

SEQ ID NO: 133880 - DNA, 25 bp, E. coli
tcaaattgaacgattaaaacctgtc

SEQ ID NO: 133881 - DNA, 25 bp, E. coli
cagcaatgcgatccagcgatggtgc

SEQ ID NO: 133882 - DNA, 25 bp, E. coli
cagcaatgcgatgcagcgatggtgc

SEQ ID NO: 133883 - DNA, 25 bp, E. coli
aaatcgcctgttggatattgatatc

SEQ ID NO: 133884 - DNA, 25 bp, E. coli
aaatcgcctgttcgatattgatatc

SEQ ID NO: 133885 - DNA, 25 bp, E. coli
tgggcgcggcaaccctcgcattacg

SEQ ID NO: 133886 - DNA, 25 bp, E. coli
tgcgatgcagcgttggtgcgcaatt

SEQ ID NO: 133887 - DNA, 25 bp, E. coli
tgcgatgcagcgatggtgcgcaatt

SEQ ID NO: 133888 - DNA, 25 bp, E. coli
gccgattggtcgtaacgctttgtca

SEQ ID NO: 133889 - DNA, 25 bp, E. coli
gccgattggtcgaaacgctttgtca

SEQ ID NO: 133890 - DNA, 25 bp, E. coli
gcagcttagtcccataactctgctt

SEQ ID NO: 133891 - DNA, 25 bp, E. coli
gcagcttagtccgataactctgctt

SEQ ID NO: 133892 - DNA, 25 bp, E. coli
gcattacgcctcactgcgctacgta

SEQ ID NO: 133893 - DNA, 25 bp, E. coli
gcattacgcctctctgcgctacgta

SEQ ID NO: 133894 - DNA, 25 bp, E. coli
gcaaaactggcagcaatgcgatgca

SEQ ID NO: 133895 - DNA, 25 bp, E. coli
gcaaaactggcaccaatgcgatgca

SEQ ID NO: 133896 - DNA, 25 bp, E. coli
gacgtcgatgatataaatcgcctgt

SEQ ID NO: 133897 - DNA, 25 bp, E. coli
cgctttgtcatggattgagcactgg

SEQ ID NO: 133898 - DNA, 25 bp, E. coli
cgctttgtcatgcattgagcactgg

SEQ ID NO: 133899 - DNA, 25 bp, E. coli
ggagcggcagcttagtccgataact

SEQ ID NO: 133900 - DNA, 25 bp, E. coli
tgggcgcggcaagcctcgcattacg

SEQ ID NO: 133901 - DNA, 25 bp, E. coli
ggagcggcagctaagtccgataact

SEQ ID NO: 133902 - DNA, 25 bp, E. coli
gacgtcgatgatttaaatcgcctgt

SEQ ID NO: 133903 - DNA, 25 bp, E. coli
caaaaattattggttctaatgacag

SEQ ID NO: 133904 - DNA, 25 bp, E. coli
caaaaattattgcttctaatgacag

SEQ ID NO: 133905 - DNA, 25 bp, E. coli
acaatgttgcaggttaaagagaata

SEQ ID NO: 133906 - DNA, 25 bp, E. coli
acaatgttgcagcttaaagagaata

SEQ ID NO: 133907 - DNA, 25 bp, E. coli
ttcgttctggcgttgatttactggg

SEQ ID NO: 133908 - DNA, 25 bp, E. coli
ttcgttctggcgatgatttactggg

SEQ ID NO: 133909 - DNA, 25 bp, E. coli
tcggcactcgatacgtctttaccat

SEQ ID NO: 133910 - DNA, 25 bp, E. coli
tcggcactcgattcgtctttaccat

SEQ ID NO: 133911 - DNA, 25 bp, E. coli
tctaatgacagtttcatcagtgcag

SEQ ID NO: 133912 - DNA, 25 bp, E. coli
tctaatgacagtatcatcagtgcag

SEQ ID NO: 133913 - DNA, 25 bp, E. coli
gacagtatcatcagtgcagtgaaaa

SEQ ID NO: 133914 - DNA, 25 bp, E. coli
gacagtatcatctgtgcagtgaaaa

SEQ ID NO: 133915 - DNA, 25 bp, E. coli
gaaaacaatgttccagcttaaagag

SEQ ID NO: 133916 - DNA, 25 bp, E. coli
gaaaacaatgttgcagcttaaagag

SEQ ID NO: 133917 - DNA, 25 bp, E. coli
cccgcaaggaaatcaatgttgcagc

SEQ ID NO: 133918 - DNA, 25 bp, E. coli
cccgcaaggaaaacaatgttgcagc

SEQ ID NO: 133919 - DNA, 25 bp, E. coli
ggtgattggcgaacggcactcgatt

SEQ ID NO: 133920 - DNA, 25 bp, E. coli
gtcaattggcatcgcgatgcgtgcc

SEQ ID NO: 133921 - DNA, 25 bp, E. coli
ggtgattggcgatcggcactcgatt

SEQ ID NO: 133922 - DNA, 25 bp, E. coli
gtcaattggcatggcgatgcgtgcc

SEQ ID NO: 133923 - DNA, 25 bp, E. coli
tggcatggcgatccgtgccaaaacg

SEQ ID NO: 133924 - DNA, 25 bp, E. coli
tggcatggcgatgcgtgccaaaacg

SEQ ID NO: 133925 - DNA, 25 bp, E. coli
aacggtgaacaaaatcaccctgggt

SEQ ID NO: 133926 - DNA, 25 bp, E. coli
caggcctgatgaccagccacaacta

SEQ ID NO: 133927 - DNA, 25 bp, E. coli
caggcctgatgagcagccacaacta

SEQ ID NO: 133928 - DNA, 25 bp, E. coli
tacagaacggtgaacaatatcaccc

SEQ ID NO: 133929 - DNA, 25 bp, E. coli
tacagaacggtgtacaatatcaccc

SEQ ID NO: 133930 - DNA, 25 bp, E. coli
acaggcctgatgaccagccacaact

SEQ ID NO: 133931 - DNA, 25 bp, E. coli
acaggcctgatgtccagccacaact

SEQ ID NO: 133932 - DNA, 25 bp, E. coli
aacggtgaacaatatcaccctgggt

SEQ ID NO: 133933 - DNA, 25 bp, E. coli
aactacagaacgctgaacaatatca

SEQ ID NO: 133934 - DNA, 25 bp, E. coli
aactacagaacggtgaacaatatca

SEQ ID NO: 133935 - DNA, 25 bp, E. coli
tgaacaatatcagcctgggtaagca

SEQ ID NO: 133936 - DNA, 25 bp, E. coli
tgaacaatatcaccctgggtaagca

SEQ ID NO: 133937 - DNA, 25 bp, E. coli
gcaacaggcctgttgaccagccaca

SEQ ID NO: 133938 - DNA, 25 bp, E. coli
gcaacaggcctgatgaccagccaca

SEQ ID NO: 133939 - DNA, 25 bp, E. coli
gaacggtgaacaatatcaccctggg

SEQ ID NO: 133940 - DNA, 25 bp, E. coli
gaacggtgaacattatcaccctggg

SEQ ID NO: 133941 - DNA, 25 bp, E. coli
gggcaacaggcctgatgaccagcca

SEQ ID NO: 133942 - DNA, 25 bp, E. coli
gggcaacaggccagatgaccagcca

SEQ ID NO: 133943 - DNA, 25 bp, E. coli
gtgaacaatatcaccctgggtaagc

SEQ ID NO: 133944 - DNA, 25 bp, E. coli
ggtgaacaatatcaccctgggtaag

SEQ ID NO: 133945 - DNA, 25 bp, E. coli
gtgaacaatatctccctgggtaagc

SEQ ID NO: 133946 - DNA, 25 bp, E. coli
ggtgaacaatatgaccctgggtaag

SEQ ID NO: 133947 - DNA, 25 bp, E. coli
caaacggctaaatgagattaatcag

SEQ ID NO: 133948 - DNA, 25 bp, E. coli
caaacggctaaaagagattaatcag

SEQ ID NO: 133949 - DNA, 25 bp, E. coli
cacgcgactcaatcggctaaaagag

SEQ ID NO: 133950 - DNA, 25 bp, E. coli
cacgcgactcaaacggctaaaagag

SEQ ID NO: 133951 - DNA, 25 bp, E. coli
tatatcgcacgcgactcaaacggct

SEQ ID NO: 133952 - DNA, 25 bp, E. coli
tatatcgcacgccactcaaacggct

SEQ ID NO: 133953 - DNA, 25 bp, E. coli
tgaatcatcatctgtttctggcgga

SEQ ID NO: 133954 - DNA, 25 bp, E. coli
tgaacgcgccacgttatatcgcacg

SEQ ID NO: 133955 - DNA, 25 bp, E. coli
tgaacgcgccaccttatatcgcacg

SEQ ID NO: 133956 - DNA, 25 bp, E. coli
tgaatcatcatcagtttctggcgga

SEQ ID NO: 133957 - DNA, 25 bp, E. coli
gcggttttggcgtattgatcccgga

SEQ ID NO: 133958 - DNA, 25 bp, E. coli
gcggttttggcgaattgatcccgga

SEQ ID NO: 133959 - DNA, 25 bp, E. coli
gcaccaacgatatctgcctcggcag

SEQ ID NO: 133960 - DNA, 25 bp, E. coli
gcaccaacgataactgcctcggcag

SEQ ID NO: 133961 - DNA, 25 bp, E. coli
gttgctgttaccgagccccttcgat

SEQ ID NO: 133962 - DNA, 25 bp, E. coli
gttgctgttacccagccccttcgat

SEQ ID NO: 133963 - DNA, 25 bp, E. coli
ggtggtggtgaaacatcatctgttt

SEQ ID NO: 133964 - DNA, 25 bp, E. coli
ggtggtggtgaatcatcatctgttt

SEQ ID NO: 133965 - DNA, 25 bp, E. coli
taactgcctcgggagtgactgcccg

SEQ ID NO: 133966 - DNA, 25 bp, E. coli
taactgcctcggcagtgactgcccg

SEQ ID NO: 133967 - DNA, 25 bp, E. coli
gagagcggttttcgcgaattgatcc

SEQ ID NO: 133968 - DNA, 25 bp, E. coli
gagagcggttttggcgaattgatcc

SEQ ID NO: 133969 - DNA, 25 bp, E. coli
caaaggaactgctcattgcgtgtga

SEQ ID NO: 133970 - DNA, 25 bp, E. coli
caaaggaactgcacattgcgtgtga

SEQ ID NO: 133971 - DNA, 25 bp, E. coli
catgaaaaaatgaaacaccctttgg

SEQ ID NO: 133972 - DNA, 25 bp, E. coli
catgaaaaaatgtaacaccctttgg

SEQ ID NO: 133973 - DNA, 25 bp, E. coli
actgctcattgcgtgtgatgcggca

SEQ ID NO: 133974 - DNA, 25 bp, E. coli
aaagaacgaaatccatgaaaaaatg

SEQ ID NO: 133975 - DNA, 25 bp, E. coli
actgctcattgcctgtgatgcggca

SEQ ID NO: 133976 - DNA, 25 bp, E. coli
aaagaacgaaatgcatgaaaaaatg

SEQ ID NO: 133977 - DNA, 25 bp, E. coli
tgataacgataactgagctggaaga

SEQ ID NO: 133978 - DNA, 25 bp, E. coli
tgtgatgcggcatttaggactatag

SEQ ID NO: 133979 - DNA, 25 bp, E. coli
tgtgatgcggcaattaggactatag

SEQ ID NO: 133980 - DNA, 25 bp, E. coli
tgataacgataagtgagctggaaga

SEQ ID NO: 133981 - DNA, 25 bp, E. coli
gcggcaattaggactatagagataa

SEQ ID NO: 133982 - DNA, 25 bp, E. coli
gcgaatcaggataaataataaatag

SEQ ID NO: 133983 - DNA, 25 bp, E. coli
gcggcaattaggtctatagagataa

SEQ ID NO: 133984 - DNA, 25 bp, E. coli
gcgaatcaggattaataataaatag

SEQ ID NO: 133985 - DNA, 25 bp, E. coli
gaagccgcaaatctttttattgaaa

SEQ ID NO: 133986 - DNA, 25 bp, E. coli
gaagccgcaaatgtttttattgaaa

SEQ ID NO: 133987 - DNA, 25 bp, E. coli
gactatagagattatgcgaatcagg

SEQ ID NO: 133988 - DNA, 25 bp, E. coli
gactatagagataatgcgaatcagg

SEQ ID NO: 133989 - DNA, 25 bp, E. coli
ctgagctggaagatgaaataataaa

SEQ ID NO: 133990 - DNA, 25 bp, E. coli
ctgagctggaagttgaaataataaa

SEQ ID NO: 133991 - DNA, 25 bp, E. coli
aatatgctctcatcgcgccagttgg

SEQ ID NO: 133992 - DNA, 25 bp, E. coli
aatatgctctcaacgcgccagttgg

SEQ ID NO: 133993 - DNA, 25 bp, E. coli
caactggtggtattggcaaacggac

SEQ ID NO: 133994 - DNA, 25 bp, E. coli
caactggtggtaatggcaaacggac

SEQ ID NO: 133995 - DNA, 25 bp, E. coli
ttaatgtcgccaagaaccagacccg

SEQ ID NO: 133996 - DNA, 25 bp, E. coli
ttaatgtcgccatgaaccagacccg

SEQ ID NO: 133997 - DNA, 25 bp, E. coli
tgtgctgcacgagcttaatcaggct

SEQ ID NO: 133998 - DNA, 25 bp, E. coli
tgtgctgcacgaccttaatcaggct

SEQ ID NO: 133999 - DNA, 25 bp, E. coli
tcagttacgggagagacaaggtact

SEQ ID NO: 134000 - DNA, 25 bp, E. coli
tcagttacgggacagacaaggtact

SEQ ID NO: 134001 - DNA, 25 bp, E. coli
cctgatcggtcctaacggttgcggg

SEQ ID NO: 134002 - DNA, 25 bp, E. coli
cctgatgcggttgatgggcgaactc

SEQ ID NO: 134003 - DNA, 25 bp, E. coli
cctgatgcggttcatgggcgaactc

SEQ ID NO: 134004 - DNA, 25 bp, E. coli
cctgatcggtccaaacggttgcggg

SEQ ID NO: 134005 - DNA, 25 bp, E. coli
gctagccggtacagcgatcaactgg

SEQ ID NO: 134006 - DNA, 25 bp, E. coli
gctagccggtactgcgatcaactgg

SEQ ID NO: 134007 - DNA, 25 bp, E. coli
gaacagtattcagcgtggaagcgga

SEQ ID NO: 134008 - DNA, 25 bp, E. coli
gaacagtattcaccgtggaagcgga

SEQ ID NO: 134009 - DNA, 25 bp, E. coli
cggacatgttatcgcgcaaggcaca

SEQ ID NO: 134010 - DNA, 25 bp, E. coli
cggacatgttatggcgcaaggcaca

SEQ ID NO: 134011 - DNA, 25 bp, E. coli
gtatggtcgtaaaccctggctgtca

SEQ ID NO: 134012 - DNA, 25 bp, E. coli
gtatggtcgtaatccctggctgtca

SEQ ID NO: 134013 - DNA, 25 bp, E. coli
taaaatcaacatttaccgtgtggca

SEQ ID NO: 134014 - DNA, 25 bp, E. coli
taaaatcaacatataccgtgtggca

SEQ ID NO: 134015 - DNA, 25 bp, E. coli
ggcctcgttcgaaccgagcgtgctg

SEQ ID NO: 134016 - DNA, 25 bp, E. coli
ggcctcgttcgatccgagcgtgctg

SEQ ID NO: 134017 - DNA, 25 bp, E. coli
aaatcaacatttaccgtgtggcaaa

SEQ ID NO: 134018 - DNA, 25 bp, E. coli
caacatttaccgtgtggcaaaagat

SEQ ID NO: 134019 - DNA, 25 bp, E. coli
aaatcaacattttccgtgtggcaaa

SEQ ID NO: 134020 - DNA, 25 bp, E. coli
caacatttaccgagtggcaaaagat

SEQ ID NO: 134021 - DNA, 25 bp, E. coli
ttgagctacaggcacgttttgacga

SEQ ID NO: 134022 - DNA, 25 bp, E. coli
ttgagctacagggacgttttgacga

SEQ ID NO: 134023 - DNA, 25 bp, E. coli
tcaggcctcgttggatccgagcgtg

SEQ ID NO: 134024 - DNA, 25 bp, E. coli
tcaggcctcgttcgatccgagcgtg

SEQ ID NO: 134025 - DNA, 25 bp, E. coli
ctacaggcacgtattgacgaagaag

SEQ ID NO: 134026 - DNA, 25 bp, E. coli
ctcgttcgatcccagcgtgctggcg

SEQ ID NO: 134027 - DNA, 25 bp, E. coli
ctacaggcacgttttgacgaagaag

SEQ ID NO: 134028 - DNA, 25 bp, E. coli
ctcgttcgatccgagcgtgctggcg

SEQ ID NO: 134029 - DNA, 25 bp, E. coli
ggtggttgagcttcaggcacgtttt

SEQ ID NO: 134030 - DNA, 25 bp, E. coli
ggttgagctacacgcacgttttgac

SEQ ID NO: 134031 - DNA, 25 bp, E. coli
ggttgagctacaggcacgttttgac

SEQ ID NO: 134032 - DNA, 25 bp, E. coli
ggtggttgagctacaggcacgtttt

SEQ ID NO: 134033 - DNA, 25 bp, E. coli
gagctacaggcacgttttgacgaag

SEQ ID NO: 134034 - DNA, 25 bp, E. coli
gagctacaggcaggttttgacgaag

SEQ ID NO: 134035 - DNA, 25 bp, E. coli
aatattgcatgggaaaaccaggcgc

SEQ ID NO: 134036 - DNA, 25 bp, E. coli
aatattgcatggcaaaaccaggcgc

SEQ ID NO: 134037 - DNA, 25 bp, E. coli
caaatctattatctggtggatgcgt

SEQ ID NO: 134038 - DNA, 25 bp, E. coli
caaatctattatgtggtggatgcgt

SEQ ID NO: 134039 - DNA, 25 bp, E. coli
caggcgcagaacagagcgtgcataa

SEQ ID NO: 134040 - DNA, 25 bp, E. coli
caggcgcagaactgagcgtgcataa

SEQ ID NO: 134041 - DNA, 25 bp, E. coli
tgccggaagaaaaacgtaaattgct

SEQ ID NO: 134042 - DNA, 25 bp, E. coli
tgaccatttcggagttgctacaata

SEQ ID NO: 134043 - DNA, 25 bp, E. coli
tgaataaagcgctctggagcaccgt

SEQ ID NO: 134044 - DNA, 25 bp, E. coli
tgaataaagcgcactggagcaccgt

SEQ ID NO: 134045 - DNA, 25 bp, E. coli
tgccggaagaaatacgtaaattgct

SEQ ID NO: 134046 - DNA, 25 bp, E. coli
tgaccatttcggtgttgctacaata

SEQ ID NO: 134047 - DNA, 25 bp, E. coli
gcccagctgtttggctgaaaaccag

SEQ ID NO: 134048 - DNA, 25 bp, E. coli
gcccagctgtttcgctgaaaaccag

SEQ ID NO: 134049 - DNA, 25 bp, E. coli
gctacgtcagcaccacagcgatgtg

SEQ ID NO: 134050 - DNA, 25 bp, E. coli
gctacgtcagcagcacagcgatgtg

SEQ ID NO: 134051 - DNA, 25 bp, E. coli
gaaagaagtagataatcgcccagct

SEQ ID NO: 134052 - DNA, 25 bp, E. coli
gaaagaagtagaaaatcgcccagct

SEQ ID NO: 134053 - DNA, 25 bp, E. coli
gtccaagccgccatctgaataaagc

SEQ ID NO: 134054 - DNA, 25 bp, E. coli
gtccaagccgccttctgaataaagc

SEQ ID NO: 134055 - DNA, 25 bp, E. coli
tggatgcgtcttttcagcaggcggt

SEQ ID NO: 134056 - DNA, 25 bp, E. coli
tggatgcgtcttatcagcaggcggt

SEQ ID NO: 134057 - DNA, 25 bp, E. coli
aataatgaactgttcttccccggcg

SEQ ID NO: 134058 - DNA, 25 bp, E. coli
aataatgaactgatcttccccggcg

SEQ ID NO: 134059 - DNA, 25 bp, E. coli
cagtagaacgcctgatgagtcatca

SEQ ID NO: 134060 - DNA, 25 bp, E. coli
cagtagaacgccagatgagtcatca

SEQ ID NO: 134061 - DNA, 25 bp, E. coli
aacacggtcaataaggcactgcggg

SEQ ID NO: 134062 - DNA, 25 bp, E. coli
aacacggtcaattaggcactgcggg

SEQ ID NO: 134063 - DNA, 25 bp, E. coli
aaaggtctgctggaggttgcgtccc

SEQ ID NO: 134064 - DNA, 25 bp, E. coli
aaaggtctgctgcaggttgcgtccc

SEQ ID NO: 134065 - DNA, 25 bp, E. coli
tatcaacccggtacagcagcgggct

SEQ ID NO: 134066 - DNA, 25 bp, E. coli
tatcaacccggttcagcagcgggct

SEQ ID NO: 134067 - DNA, 25 bp, E. coli
tgatttcacaaaccgagtctggacg

SEQ ID NO: 134068 - DNA, 25 bp, E. coli
tgatttcacaaagcgagtctggacg

SEQ ID NO: 134069 - DNA, 25 bp, E. coli
tgagtaacataatgcgccatgcggt

SEQ ID NO: 134070 - DNA, 25 bp, E. coli
tgagtaacataaagcgccatgcggt

SEQ ID NO: 134071 - DNA, 25 bp, E. coli
tcataaggcagaccacctggaagcc

SEQ ID NO: 134072 - DNA, 25 bp, E. coli
tcataaggcagagcacctggaagcc

SEQ ID NO: 134073 - DNA, 25 bp, E. coli
gaaaaaggatatctgcggtcacggc

SEQ ID NO: 134074 - DNA, 25 bp, E. coli
gaaaaaggatatgtgcggtcacggc

SEQ ID NO: 134075 - DNA, 25 bp, E. coli
ggagcggctgcctgaactgcttgaa

SEQ ID NO: 134076 - DNA, 25 bp, E. coli
ggagcggctgccagaactgcttgaa

SEQ ID NO: 134077 - DNA, 25 bp, E. coli
taatcgatacgaaccctgcagcaaa

SEQ ID NO: 134078 - DNA, 25 bp, E. coli
taatcgatacgatccctgcagcaaa

SEQ ID NO: 134079 - DNA, 25 bp, E. coli
cacatactctcgagtttgcaggagg

SEQ ID NO: 134080 - DNA, 25 bp, E. coli
cacatactctcgtgtttgcaggagg

SEQ ID NO: 134081 - DNA, 25 bp, E. coli
cactctgctggatcatccggaaagc

SEQ ID NO: 134082 - DNA, 25 bp, E. coli
cactctgctggaacatccggaaagc

SEQ ID NO: 134083 - DNA, 25 bp, E. coli
tattcccttgtcacggagttaacgg

SEQ ID NO: 134084 - DNA, 25 bp, E. coli
tattcccttgtctcggagttaacgg

SEQ ID NO: 134085 - DNA, 25 bp, E. coli
tatttcctgacgatgccgatgcact

SEQ ID NO: 134086 - DNA, 25 bp, E. coli
tatttcctgacgttgccgatgcact

SEQ ID NO: 134087 - DNA, 25 bp, E. coli
tgatataaagctggtgccaacagag

SEQ ID NO: 134088 - DNA, 25 bp, E. coli
tgatataaagctcgtgccaacagag

SEQ ID NO: 134089 - DNA, 25 bp, E. coli
tctccatgatgccaagaacagcagc

SEQ ID NO: 134090 - DNA, 25 bp, E. coli
tctccatgatgcgaagaacagcagc

SEQ ID NO: 134091 - DNA, 25 bp, E. coli
gaatctgtcgctttcgtcgaaaaag

SEQ ID NO: 134092 - DNA, 25 bp, E. coli
gaatctgtcgctatcgtcgaaaaag

SEQ ID NO: 134093 - DNA, 25 bp, E. coli
gaaaacgcccgtttaacacgtgatg

SEQ ID NO: 134094 - DNA, 25 bp, E. coli
gaaatctcggtaggttatccccaga

SEQ ID NO: 134095 - DNA, 25 bp, E. coli
gaaatctcggtacgttatccccaga

SEQ ID NO: 134096 - DNA, 25 bp, E. coli
gaaaacgcccgtataacacgtgatg

SEQ ID NO: 134097 - DNA, 25 bp, E. coli
ggaggtaccgcattatcaaaagcag

SEQ ID NO: 134098 - DNA, 25 bp, E. coli
ggaggtaccgcaatatcaaaagcag

SEQ ID NO: 134099 - DNA, 25 bp, E. coli
tcagcttggatattgaaaacgcccg

SEQ ID NO: 134100 - DNA, 25 bp, E. coli
tcagcttggataatgaaaacgcccg

SEQ ID NO: 134101 - DNA, 25 bp, E. coli
taaaaccacaatgggcgaatcggcg

SEQ ID NO: 134102 - DNA, 25 bp, E. coli
taaaaccacaatcggcgaatcggcg

SEQ ID NO: 134103 - DNA, 25 bp, E. coli
caacgcgacgaatgtagagtttggc

SEQ ID NO: 134104 - DNA, 25 bp, E. coli
caacgcgacgaaagtagagtttggc

SEQ ID NO: 134105 - DNA, 25 bp, E. coli
taaagacgtcttctactaacgccca

SEQ ID NO: 134106 - DNA, 25 bp, E. coli
tgcgtgtcgctataaccacaatcgg

SEQ ID NO: 134107 - DNA, 25 bp, E. coli
taaagacgtcttgtactaacgccca

SEQ ID NO: 134108 - DNA, 25 bp, E. coli
tgcgtgtcgctaaaaccacaatcgg

SEQ ID NO: 134109 - DNA, 25 bp, E. coli
tcattggcggtaatgaggattcgga

SEQ ID NO: 134110 - DNA, 25 bp, E. coli
tcattggcggtattgaggattcgga

SEQ ID NO: 134111 - DNA, 25 bp, E. coli
ccattttaggatatcaagcgaacag

SEQ ID NO: 134112 - DNA, 25 bp, E. coli
ccattttaggatttcaagcgaacag

SEQ ID NO: 134113 - DNA, 25 bp, E. coli
tacggtacgggctcattaaatatta

SEQ ID NO: 134114 - DNA, 25 bp, E. coli
tacggtacgggcacattaaatatta

SEQ ID NO: 134115 - DNA, 25 bp, E. coli
ctattcgcgagggtgggctgattac

SEQ ID NO: 134116 - DNA, 25 bp, E. coli
ctattcgcgaggctgggctgattac

SEQ ID NO: 134117 - DNA, 25 bp, E. coli
gattaggtactctagctgcaggcgt

SEQ ID NO: 134118 - DNA, 25 bp, E. coli
gattaggtactcaagctgcaggcgt

SEQ ID NO: 134119 - DNA, 25 bp, E. coli
tggctctggcgatggtgtttttgtc

SEQ ID NO: 134120 - DNA, 25 bp, E. coli
tggctctggcgaaggtgtttttgtc

SEQ ID NO: 134121 - DNA, 25 bp, E. coli
ggcggtacgctcattttcgatacgg

SEQ ID NO: 134122 - DNA, 25 bp, E. coli
ggcggtacgctctttttcgatacgg

SEQ ID NO: 134123 - DNA, 25 bp, E. coli
aatgaggagatcaaatccggagaaa

SEQ ID NO: 134124 - DNA, 25 bp, E. coli
aatgaggagatctaatccggagaaa

SEQ ID NO: 134125 - DNA, 25 bp, E. coli
caaatccggagataaaagcgattat

SEQ ID NO: 134126 - DNA, 25 bp, E. coli
caaatccggagaaaaaagcgattat

SEQ ID NO: 134127 - DNA, 25 bp, E. coli
tacgctaaagaaaaatacaagcgga

SEQ ID NO: 134128 - DNA, 25 bp, E. coli
taaaaatgaggacatcaaatccgga

SEQ ID NO: 134129 - DNA, 25 bp, E. coli
taaaaatgaggagatcaaatccgga

SEQ ID NO: 134130 - DNA, 25 bp, E. coli
tacgctaaagaataatacaagcgga

SEQ ID NO: 134131 - DNA, 25 bp, E. coli
aaaatgaggagatcaaatccggaga

SEQ ID NO: 134132 - DNA, 25 bp, E. coli
aaaatgaggagaacaaatccggaga

SEQ ID NO: 134133 - DNA, 25 bp, E. coli
tgtaaaaatgaggagatcaaatccg

SEQ ID NO: 134134 - DNA, 25 bp, E. coli
tgtaaaaatgagcagatcaaatccg

SEQ ID NO: 134135 - DNA, 25 bp, E. coli
tgaggagatcaaatccggagaaaaa

SEQ ID NO: 134136 - DNA, 25 bp, E. coli
tgaggagatcaattccggagaaaaa

SEQ ID NO: 134137 - DNA, 25 bp, E. coli
tcattacgctaaagaaaaatacaag

SEQ ID NO: 134138 - DNA, 25 bp, E. coli
tcattacgctaatgaaaaatacaag

SEQ ID NO: 134139 - DNA, 25 bp, E. coli
gttggaatgtaaaaatgaggagatc

SEQ ID NO: 134140 - DNA, 25 bp, E. coli
gttggaatgtaataatgaggagatc

SEQ ID NO: 134141 - DNA, 25 bp, E. coli
tcaaatccggagaaaaaagcgatta

SEQ ID NO: 134142 - DNA, 25 bp, E. coli
tcaaatccggagtaaaaagcgatta

SEQ ID NO: 134143 - DNA, 25 bp, E. coli
gatcaaatccggtgaaaaaagcgat

SEQ ID NO: 134144 - DNA, 25 bp, E. coli
gatcaaatccggagaaaaaagcgat

SEQ ID NO: 134145 - DNA, 25 bp, E. coli
taaaaatcgatgacgccaggctgtt

SEQ ID NO: 134146 - DNA, 25 bp, E. coli
taccgattcctgtatgacgacttca

SEQ ID NO: 134147 - DNA, 25 bp, E. coli
taccgattcctgaatgacgacttca

SEQ ID NO: 134148 - DNA, 25 bp, E. coli
taaataccgattcctgaatgacgac

SEQ ID NO: 134149 - DNA, 25 bp, E. coli
taaataccgattgctgaatgacgac

SEQ ID NO: 134150 - DNA, 25 bp, E. coli
taaaaatcgatgtcgccaggctgtt

SEQ ID NO: 134151 - DNA, 25 bp, E. coli
accgattcctgattgacgacttcat

SEQ ID NO: 134152 - DNA, 25 bp, E. coli
accgattcctgaatgacgacttcat

SEQ ID NO: 134153 - DNA, 25 bp, E. coli
accacgtaaaaaacgatgtcgccag

SEQ ID NO: 134154 - DNA, 25 bp, E. coli
cacgtaaaaatcgatgtcgccaggc

SEQ ID NO: 134155 - DNA, 25 bp, E. coli
accacgtaaaaatcgatgtcgccag

SEQ ID NO: 134156 - DNA, 25 bp, E. coli
aaaaatcgatgtcgccaggctgttt

SEQ ID NO: 134157 - DNA, 25 bp, E. coli
cacgtaaaaatccatgtcgccaggc

SEQ ID NO: 134158 - DNA, 25 bp, E. coli
aaaaatcgatgtggccaggctgttt

SEQ ID NO: 134159 - DNA, 25 bp, E. coli
gcgaggaatattggccttcggtgtt

SEQ ID NO: 134160 - DNA, 25 bp, E. coli
gcgaggaatattcgccttcggtgtt

SEQ ID NO: 134161 - DNA, 25 bp, E. coli
cgtaaaaatcgaagtcgccaggctg

SEQ ID NO: 134162 - DNA, 25 bp, E. coli
cgtaaaaatcgatgtcgccaggctg

SEQ ID NO: 134163 - DNA, 25 bp, E. coli
gtaaataccgatacctgaatgacga

SEQ ID NO: 134164 - DNA, 25 bp, E. coli
gtaaataccgattcctgaatgacga

SEQ ID NO: 134165 - DNA, 25 bp, E. coli
gaccacgtaaaaatcgatgtcgcca

SEQ ID NO: 134166 - DNA, 25 bp, E. coli
gaccacgtaaaattcgatgtcgcca

SEQ ID NO: 134167 - DNA, 25 bp, E. coli
aagcgtgtcgaactgaagctgaacg

SEQ ID NO: 134168 - DNA, 25 bp, E. coli
aagcgtgtcgaagtgaagctgaacg

SEQ ID NO: 134169 - DNA, 25 bp, E. coli
taaaacgcgacatagtacgtggcct

SEQ ID NO: 134170 - DNA, 25 bp, E. coli
taaaacgcgacaaagtacgtggcct

SEQ ID NO: 134171 - DNA, 25 bp, E. coli
agatgttaatgctgcaactggcggc

SEQ ID NO: 134172 - DNA, 25 bp, E. coli
agatgttaatgcagcaactggcggc

SEQ ID NO: 134173 - DNA, 25 bp, E. coli
aacggaccgtaccacattagatctg

SEQ ID NO: 134174 - DNA, 25 bp, E. coli
aacggaccgtacgacattagatctg

SEQ ID NO: 134175 - DNA, 25 bp, E. coli
actgaagctgaaggcggaagctgtc

SEQ ID NO: 134176 - DNA, 25 bp, E. coli
actgaagctgaacgcggaagctgtc

SEQ ID NO: 134177 - DNA, 25 bp, E. coli
tattatggcgcggtatccatccggg

SEQ ID NO: 134178 - DNA, 25 bp, E. coli
tattatggcgcgctatccatccggg

SEQ ID NO: 134179 - DNA, 25 bp, E. coli
tcatggccaaagaacaaacggaccg

SEQ ID NO: 134180 - DNA, 25 bp, E. coli
tcatggccaaagtacaaacggaccg

SEQ ID NO: 134181 - DNA, 25 bp, E. coli
gctgcgtagtcacggcatcgtttaa

SEQ ID NO: 134182 - DNA, 25 bp, E. coli
gctgcgtagtcagggcatcgtttaa

SEQ ID NO: 134183 - DNA, 25 bp, E. coli
ccgaagtcaccatgatcatggccaa

SEQ ID NO: 134184 - DNA, 25 bp, E. coli
ccgaagtcaccaagatcatggccaa

SEQ ID NO: 134185 - DNA, 25 bp, E. coli
cattagatctgtacgcgcacgagcg

SEQ ID NO: 134186 - DNA, 25 bp, E. coli
cattagatctgttcgcgcacgagcg

SEQ ID NO: 134187 - DNA, 25 bp, E. coli
gatcgaagagatgttaatgcagcaa

SEQ ID NO: 134188 - DNA, 25 bp, E. coli
gatcgaagagatcttaatgcagcaa

SEQ ID NO: 134189 - DNA, 25 bp, E. coli
taaatacgatttgctggactcgcca

SEQ ID NO: 134190 - DNA, 25 bp, E. coli
taaatacgatttcctggactcgcca

SEQ ID NO: 134191 - DNA, 25 bp, E. coli
taaagattcggtacgcggtctgcaa

SEQ ID NO: 134192 - DNA, 25 bp, E. coli
taaagattcggttcgcggtctgcaa

SEQ ID NO: 134193 - DNA, 25 bp, E. coli
agattatcccgaccgttagcggcgg

SEQ ID NO: 134194 - DNA, 25 bp, E. coli
agattatcccgagcgttagcggcgg

SEQ ID NO: 134195 - DNA, 25 bp, E. coli
tatcattacagccatcagggaccgg

SEQ ID NO: 134196 - DNA, 25 bp, E. coli
tatcattacagcgatcagggaccgg

SEQ ID NO: 134197 - DNA, 25 bp, E. coli
ttatatcgaactgcagccaggcgcg

SEQ ID NO: 134198 - DNA, 25 bp, E. coli
ttatatcgaactccagccaggcgcg

SEQ ID NO: 134199 - DNA, 25 bp, E. coli
tgattcgtatcgtgccagagcggct

SEQ ID NO: 134200 - DNA, 25 bp, E. coli
tgattgaacagggaaccagtacgct

SEQ ID NO: 134201 - DNA, 25 bp, E. coli
tgattcgtatcgagccagagcggct

SEQ ID NO: 134202 - DNA, 25 bp, E. coli
tgattgaacaggcaaccagtacgct

SEQ ID NO: 134203 - DNA, 25 bp, E. coli
tccgcagcctacaacaagatggtgg

SEQ ID NO: 134204 - DNA, 25 bp, E. coli
tccgcagcctactacaagatggtgg

SEQ ID NO: 134205 - DNA, 25 bp, E. coli
tctcgatagcaataaagccgggcag

SEQ ID NO: 134206 - DNA, 25 bp, E. coli
tctcgatagcaaaaaagccgggcag

SEQ ID NO: 134207 - DNA, 25 bp, E. coli
gaagaactggtctcccgtgtggata

SEQ ID NO: 134208 - DNA, 25 bp, E. coli
gaagtgaccctgttcaccgcgaatg

SEQ ID NO: 134209 - DNA, 25 bp, E. coli
gaagaactggtcacccgtgtggata

SEQ ID NO: 134210 - DNA, 25 bp, E. coli
gaagtgaccctgatcaccgcgaatg

SEQ ID NO: 134211 - DNA, 25 bp, E. coli
caaaggtcttggtgcgcataccgac

SEQ ID NO: 134212 - DNA, 25 bp, E. coli
caaaggtcttggagcgcataccgac

SEQ ID NO: 134213 - DNA, 25 bp, E. coli
tatccgtcagatgaagcacgcgctg

SEQ ID NO: 134214 - DNA, 25 bp, E. coli
tatgaaacaaactgggaaggacgct

SEQ ID NO: 134215 - DNA, 25 bp, E. coli
tatgaaacaaacagggaaggacgct

SEQ ID NO: 134216 - DNA, 25 bp, E. coli
tatccgtcagatcaagcacgcgctg

SEQ ID NO: 134217 - DNA, 25 bp, E. coli
tttgacgaggtctacaaaggccccg

SEQ ID NO: 134218 - DNA, 25 bp, E. coli
tttgacgaggtcaacaaaggccccg

SEQ ID NO: 134219 - DNA, 25 bp, E. coli
tgatgtacattcctgcggcaccgat

SEQ ID NO: 134220 - DNA, 25 bp, E. coli
tgatgtacattcgtgcggcaccgat

SEQ ID NO: 134221 - DNA, 25 bp, E. coli
tgcaggcccgccagagtgaagaaat

SEQ ID NO: 134222 - DNA, 25 bp, E. coli
tgcaggcccgcctgagtgaagaaat

SEQ ID NO: 134223 - DNA, 25 bp, E. coli
tcgatgctggactatctggaccgca

SEQ ID NO: 134224 - DNA, 25 bp, E. coli
tcgatgctggacaatctggaccgca

SEQ ID NO: 134225 - DNA, 25 bp, E. coli
gcatgcggcacaacgtacggaagtt

SEQ ID NO: 134226 - DNA, 25 bp, E. coli
gcatgcggcacatcgtacggaagtt

SEQ ID NO: 134227 - DNA, 25 bp, E. coli
cattcacggtaaccgagcgttgggc

SEQ ID NO: 134228 - DNA, 25 bp, E. coli
cattcacggtaagcgagcgttgggc

SEQ ID NO: 134229 - DNA, 25 bp, E. coli
taatttcttcggcacgctcagcgct

SEQ ID NO: 134230 - DNA, 25 bp, E. coli
taatttcttcgggacgctcagcgct

SEQ ID NO: 134231 - DNA, 25 bp, E. coli
gagaaaaatcttgcctacgcgcaca

SEQ ID NO: 134232 - DNA, 25 bp, E. coli
gagaaaaatcttccctacgcgcaca

SEQ ID NO: 134233 - DNA, 25 bp, E. coli
aatgcgttttctggccaacgggaca

SEQ ID NO: 134234 - DNA, 25 bp, E. coli
aatgcgttttctcgccaacgggaca

SEQ ID NO: 134235 - DNA, 25 bp, E. coli
cacccggatgatgtggaggttatcc

SEQ ID NO: 134236 - DNA, 25 bp, E. coli
cacccggatgatctggaggttatcc

SEQ ID NO: 134237 - DNA, 25 bp, E. coli
catcatatgatggtggaaaccacgc

SEQ ID NO: 134238 - DNA, 25 bp, E. coli
catcatatgatgctggaaaccacgc

SEQ ID NO: 134239 - DNA, 25 bp, E. coli
aacatattgaagtactccgcgcagc

SEQ ID NO: 134240 - DNA, 25 bp, E. coli
aacatattgaagaactccgcgcagc

SEQ ID NO: 134241 - DNA, 25 bp, E. coli
ttacagggaaaagatcaccgatgcc

SEQ ID NO: 134242 - DNA, 25 bp, E. coli
ttacagggaaaacatcaccgatgcc

SEQ ID NO: 134243 - DNA, 25 bp, E. coli
tggtggcaccatcaaagataacaac

SEQ ID NO: 134244 - DNA, 25 bp, E. coli
tggtggcaccatgaaagataacaac

SEQ ID NO: 134245 - DNA, 25 bp, E. coli
tgaagacattgctgtcactgacgcg

SEQ ID NO: 134246 - DNA, 25 bp, E. coli
tgaagacattgcagtcactgacgcg

SEQ ID NO: 134247 - DNA, 25 bp, E. coli
tccggcacatggttttacactgaag

SEQ ID NO: 134248 - DNA, 25 bp, E. coli
tccggcacatggatttacactgaag

SEQ ID NO: 134249 - DNA, 25 bp, E. coli
cccagaagcctgcaaaatgcgtttt

SEQ ID NO: 134250 - DNA, 25 bp, E. coli
cccagaagcctggaaaatgcgtttt

SEQ ID NO: 134251 - DNA, 25 bp, E. coli
ggaggttatcccactctgccggata

SEQ ID NO: 134252 - DNA, 25 bp, E. coli
ggaggttatccctctctgccggata

SEQ ID NO: 134253 - DNA, 25 bp, E. coli
gatgcccgttgtttccgtgaaatgc

SEQ ID NO: 134254 - DNA, 25 bp, E. coli
gatgcccgttgtatccgtgaaatgc

SEQ ID NO: 134255 - DNA, 25 bp, E. coli
caatgatccgcatcatgtgctgcaa

SEQ ID NO: 134256 - DNA, 25 bp, E. coli
caatgatccgcaacatgtgctgcaa

SEQ ID NO: 134257 - DNA, 25 bp, E. coli
cgaccgggcctgcaaaggctttgct

SEQ ID NO: 134258 - DNA, 25 bp, E. coli
cgaccgggcctggaaaggctttgct

SEQ ID NO: 134259 - DNA, 25 bp, E. coli
aggctttgctgccagcgattgccaa

SEQ ID NO: 134260 - DNA, 25 bp, E. coli
acgccgcgcttctgggttgtcacaa

SEQ ID NO: 134261 - DNA, 25 bp, E. coli
acgccgcgcttcagggttgtcacaa

SEQ ID NO: 134262 - DNA, 25 bp, E. coli
aggctttgctgcgagcgattgccaa

SEQ ID NO: 134263 - DNA, 25 bp, E. coli
aaattattgaaggaacgcgacagcc

SEQ ID NO: 134264 - DNA, 25 bp, E. coli
aaattattgaagcaacgcgacagcc

SEQ ID NO: 134265 - DNA, 25 bp, E. coli
tagacacgttgcctaactgggagca

SEQ ID NO: 134266 - DNA, 25 bp, E. coli
tagacacgttgcgtaactgggagca

SEQ ID NO: 134267 - DNA, 25 bp, E. coli
tgaaaatcaaagaaatacgccgcgc

SEQ ID NO: 134268 - DNA, 25 bp, E. coli
tgaaaatcaaagtaatacgccgcgc

SEQ ID NO: 134269 - DNA, 25 bp, E. coli
tcttatttccgtaagcgtagacacg

SEQ ID NO: 134270 - DNA, 25 bp, E. coli
tcttatttccgttagcgtagacacg

SEQ ID NO: 134271 - DNA, 25 bp, E. coli
taaggcacttttagagcggttgact

SEQ ID NO: 134272 - DNA, 25 bp, E. coli
taaggcactttttgagcggttgact

SEQ ID NO: 134273 - DNA, 25 bp, E. coli
cgcgacagccttgacggacttttga

SEQ ID NO: 134274 - DNA, 25 bp, E. coli
cgcgacagccttcacggacttttga

SEQ ID NO: 134275 - DNA, 25 bp, E. coli
ggttgactcacaccatggcccagat

SEQ ID NO: 134276 - DNA, 25 bp, E. coli
ggttgactcacagcatggcccagat

SEQ ID NO: 134277 - DNA, 25 bp, E. coli
aatctggtggatcggccgttcaaga

SEQ ID NO: 134278 - DNA, 25 bp, E. coli
aatctggtggatgggccgttcaaga

SEQ ID NO: 134279 - DNA, 25 bp, E. coli
tgattggtggatcgaagtttacgcc

SEQ ID NO: 134280 - DNA, 25 bp, E. coli
tgattggtggatggaagtttacgcc

SEQ ID NO: 134281 - DNA, 25 bp, E. coli
tccaggcttttagggttcgtgcgaa

SEQ ID NO: 134282 - DNA, 25 bp, E. coli
tccaggcttttacggttcgtgcgaa

SEQ ID NO: 134283 - DNA, 25 bp, E. coli
tcttatgaatctcgtggatgggccg

SEQ ID NO: 134284 - DNA, 25 bp, E. coli
tcttatgaatctggtggatgggccg

SEQ ID NO: 134285 - DNA, 25 bp, E. coli
ccagtaaccaaactattcttatgaa

SEQ ID NO: 134286 - DNA, 25 bp, E. coli
gccgttcaagaatttgattggtgga

SEQ ID NO: 134287 - DNA, 25 bp, E. coli
gccgttcaagaaattgattggtgga

SEQ ID NO: 134288 - DNA, 25 bp, E. coli
ccaggaggcgtgtcgtatcgagttt

SEQ ID NO: 134289 - DNA, 25 bp, E. coli
ccaggaggcgtgacgtatcgagttt

SEQ ID NO: 134290 - DNA, 25 bp, E. coli
ccagtaaccaaagtattcttatgaa

SEQ ID NO: 134291 - DNA, 25 bp, E. coli
ggtccaggctttaacggttcgtgcg

SEQ ID NO: 134292 - DNA, 25 bp, E. coli
ggtccaggcttttacggttcgtgcg

SEQ ID NO: 134293 - DNA, 25 bp, E. coli
tggatggaagttaacgccgctgagc

SEQ ID NO: 134294 - DNA, 25 bp, E. coli
ggcgtgtcgtatggagtttcatctc

SEQ ID NO: 134295 - DNA, 25 bp, E. coli
tggatgggccgtacaagaaattgat

SEQ ID NO: 134296 - DNA, 25 bp, E. coli
ggcgtgtcgtatcgagtttcatctc

SEQ ID NO: 134297 - DNA, 25 bp, E. coli
tggatgggccgttcaagaaattgat

SEQ ID NO: 134298 - DNA, 25 bp, E. coli
tggatggaagtttacgccgctgagc

SEQ ID NO: 134299 - DNA, 25 bp, E. coli
caatcgaggtcgatctgggcgacgt

SEQ ID NO: 134300 - DNA, 25 bp, E. coli
caatcgaggtcgttctgggcgacgt

SEQ ID NO: 134301 - DNA, 25 bp, E. coli
caacgtttaggcggccagggagcta

SEQ ID NO: 134302 - DNA, 25 bp, E. coli
caacgtttaggccgccagggagcta

SEQ ID NO: 134303 - DNA, 25 bp, E. coli
cagatacccggtggcatatttgtga

SEQ ID NO: 134304 - DNA, 25 bp, E. coli
cagatacccggtcgcatatttgtga

SEQ ID NO: 134305 - DNA, 25 bp, E. coli
gccagggagctaccggtaatagcgg

SEQ ID NO: 134306 - DNA, 25 bp, E. coli
gccggagaaacaatcgaggtcgatc

SEQ ID NO: 134307 - DNA, 25 bp, E. coli
cctggaggaagaagaaaatacgact

SEQ ID NO: 134308 - DNA, 25 bp, E. coli
gccagggagctagcggtaatagcgg

SEQ ID NO: 134309 - DNA, 25 bp, E. coli
gccggagaaacattcgaggtcgatc

SEQ ID NO: 134310 - DNA, 25 bp, E. coli
cctggaggaagatgaaaatacgact

SEQ ID NO: 134311 - DNA, 25 bp, E. coli
cggctaactttcctgttgtagggca

SEQ ID NO: 134312 - DNA, 25 bp, E. coli
cggctaactttcgtgttgtagggca

SEQ ID NO: 134313 - DNA, 25 bp, E. coli
gatctgggcgacctatttgcggcta

SEQ ID NO: 134314 - DNA, 25 bp, E. coli
ggcgacgtatttccggctaactttc

SEQ ID NO: 134315 - DNA, 25 bp, E. coli
gtggcatatttgagaccccggcggt

SEQ ID NO: 134316 - DNA, 25 bp, E. coli
ggcgacgtatttgcggctaactttc

SEQ ID NO: 134317 - DNA, 25 bp, E. coli
gtggcatatttgtgaccccggcggt

SEQ ID NO: 134318 - DNA, 25 bp, E. coli
tcaatgccggagtaacaatcgaggt

SEQ ID NO: 134319 - DNA, 25 bp, E. coli
tcaatgccggagaaacaatcgaggt

SEQ ID NO: 134320 - DNA, 25 bp, E. coli
gatctgggcgacgtatttgcggcta

SEQ ID NO: 134321 - DNA, 25 bp, E. coli
caaacggttgaatacgtgcagcgga

SEQ ID NO: 134322 - DNA, 25 bp, E. coli
caaacggttgaaaacgtgcagcgga

SEQ ID NO: 134323 - DNA, 25 bp, E. coli
tactttccgtcataagaggcgctgt

SEQ ID NO: 134324 - DNA, 25 bp, E. coli
tactttccgtcaaaagaggcgctgt

SEQ ID NO: 134325 - DNA, 25 bp, E. coli
aaagcgattctttgcgcagcactgg

SEQ ID NO: 134326 - DNA, 25 bp, E. coli
aaagcgattcttagcgcagcactgg

SEQ ID NO: 134327 - DNA, 25 bp, E. coli
ttcacaattcggatttcacggcaca

SEQ ID NO: 134328 - DNA, 25 bp, E. coli
ttcacaattcggttttcacggcaca

SEQ ID NO: 134329 - DNA, 25 bp, E. coli
tgttaatggatgtactgacgggcga

SEQ ID NO: 134330 - DNA, 25 bp, E. coli
tgttaatggatgaactgacgggcga

SEQ ID NO: 134331 - DNA, 25 bp, E. coli
tgggcttccactgaacattacgccg

SEQ ID NO: 134332 - DNA, 25 bp, E. coli
gcttcgcgcctgttctgtatggaga

SEQ ID NO: 134333 - DNA, 25 bp, E. coli
gcttcgcgcctgatctgtatggaga

SEQ ID NO: 134334 - DNA, 25 bp, E. coli
gcagcactggacactttttcacaat

SEQ ID NO: 134335 - DNA, 25 bp, E. coli
gcagcactggactctttttcacaat

SEQ ID NO: 134336 - DNA, 25 bp, E. coli
cattaattgatgagaaatcggcgct

SEQ ID NO: 134337 - DNA, 25 bp, E. coli
cattaattgatgtgaaatcggcgct

SEQ ID NO: 134338 - DNA, 25 bp, E. coli
gattctcgatatgtggctggcaccg

SEQ ID NO: 134339 - DNA, 25 bp, E. coli
gattctcgatatctggctggcaccg

SEQ ID NO: 134340 - DNA, 25 bp, E. coli
tgggcttccactcaacattacgccg

SEQ ID NO: 134341 - DNA, 25 bp, E. coli
ggctggcaccgtaaaaagcgtttcg

SEQ ID NO: 134342 - DNA, 25 bp, E. coli
ggctggcaccgttaaaagcgtttcg

SEQ ID NO: 134343 - DNA, 25 bp, E. coli
caaacaatatcaccaagttatcgat

SEQ ID NO: 134344 - DNA, 25 bp, E. coli
caaacaatatcagcaagttatcgat

SEQ ID NO: 134345 - DNA, 25 bp, E. coli
cagcaagttatcgataattatccga

SEQ ID NO: 134346 - DNA, 25 bp, E. coli
cagcaagttatccataattatccga

SEQ ID NO: 134347 - DNA, 25 bp, E. coli
aaacagccaacgtcagcttgaggcg

SEQ ID NO: 134348 - DNA, 25 bp, E. coli
aaacagccaacgacagcttgaggcg

SEQ ID NO: 134349 - DNA, 25 bp, E. coli
taccgaattgctggcagaaaacagc

SEQ ID NO: 134350 - DNA, 25 bp, E. coli
taccgaattgctcgcagaaaacagc

SEQ ID NO: 134351 - DNA, 25 bp, E. coli
ttggcgatggtgaaacggccaccgt

SEQ ID NO: 134352 - DNA, 25 bp, E. coli
ttggcgatggtgtaacggccaccgt

SEQ ID NO: 134353 - DNA, 25 bp, E. coli
gctggcagaaaagagcgccgatttg

SEQ ID NO: 134354 - DNA, 25 bp, E. coli
gctggcagaaaacagcgccgatttg

SEQ ID NO: 134355 - DNA, 25 bp, E. coli
gaattgctggcacaaaacagcgccg

SEQ ID NO: 134356 - DNA, 25 bp, E. coli
gaattgctggcagaaaacagcgccg

SEQ ID NO: 134357 - DNA, 25 bp, E. coli
cgacacgctactattggaactgacc

SEQ ID NO: 134358 - DNA, 25 bp, E. coli
cgattggcgatggtgtaacggccac

SEQ ID NO: 134359 - DNA, 25 bp, E. coli
cgattggcgatgctgtaacggccac

SEQ ID NO: 134360 - DNA, 25 bp, E. coli
cgacacgctacttttggaactgacc

SEQ ID NO: 134361 - DNA, 25 bp, E. coli
tggcgacacgctactattggaactg

SEQ ID NO: 134362 - DNA, 25 bp, E. coli
tggcgacacgcttctattggaactg

SEQ ID NO: 134363 - DNA, 25 bp, E. coli
gagcgcatcaaagaatatcagcaag

SEQ ID NO: 134364 - DNA, 25 bp, E. coli
gagcgcatcaaacaatatcagcaag

SEQ ID NO: 134365 - DNA, 25 bp, E. coli
caaaaagtgacaaaattatgagatt

SEQ ID NO: 134366 - DNA, 25 bp, E. coli
caaaaagtgacataattatgagatt

SEQ ID NO: 134367 - DNA, 25 bp, E. coli
aaagattcgttgacaaaaagtgaca

SEQ ID NO: 134368 - DNA, 25 bp, E. coli
aaagattcgttgtcaaaaagtgaca

SEQ ID NO: 134369 - DNA, 25 bp, E. coli
tatggctcgctttgagatattcctc

SEQ ID NO: 134370 - DNA, 25 bp, E. coli
tatggctcgcttagagatattcctc

SEQ ID NO: 134371 - DNA, 25 bp, E. coli
tatcgatctcatgaaatatggctcg

SEQ ID NO: 134372 - DNA, 25 bp, E. coli
tatcgatctcatcaaatatggctcg

SEQ ID NO: 134373 - DNA, 25 bp, E. coli
ttctgtcagttgtgaaactgaagcg

SEQ ID NO: 134374 - DNA, 25 bp, E. coli
ttctgtcagttgagaaactgaagcg

SEQ ID NO: 134375 - DNA, 25 bp, E. coli
tcttcctgcgatatctcacaaaaaa

SEQ ID NO: 134376 - DNA, 25 bp, E. coli
tcttcctgcgatttctcacaaaaaa

SEQ ID NO: 134377 - DNA, 25 bp, E. coli
gttgtgaaactgaagcgatttagtc

SEQ ID NO: 134378 - DNA, 25 bp, E. coli
gttgtgaaactgtagcgatttagtc

SEQ ID NO: 134379 - DNA, 25 bp, E. coli
cgctttgagatattcctcaagtaaa

SEQ ID NO: 134380 - DNA, 25 bp, E. coli
cgctttgagataatcctcaagtaaa

SEQ ID NO: 134381 - DNA, 25 bp, E. coli
gatttctcacaaaaaagattcgttg

SEQ ID NO: 134382 - DNA, 25 bp, E. coli
gatctcatcaaaaatggctcgcttt

SEQ ID NO: 134383 - DNA, 25 bp, E. coli
gatttctcacaataaagattcgttg

SEQ ID NO: 134384 - DNA, 25 bp, E. coli
gagctgccgtttatttattctgtca

SEQ ID NO: 134385 - DNA, 25 bp, E. coli
gagctgccgtttttttattctgtca

SEQ ID NO: 134386 - DNA, 25 bp, E. coli
gatctcatcaaatatggctcgcttt

SEQ ID NO: 134387 - DNA, 25 bp, E. coli
aagcagcttttgtcgctggagaagc

SEQ ID NO: 134388 - DNA, 25 bp, E. coli
aagcagcttttgacgctggagaagc

SEQ ID NO: 134389 - DNA, 25 bp, E. coli
cagccaggtctgctaaaaagcgcca

SEQ ID NO: 134390 - DNA, 25 bp, E. coli
cagccaggtctggtaaaaagcgcca

SEQ ID NO: 134391 - DNA, 25 bp, E. coli
cagtgccagctatgcgcaaagtgcg

SEQ ID NO: 134392 - DNA, 25 bp, E. coli
catcaaacgatgcaaggcggctggc

SEQ ID NO: 134393 - DNA, 25 bp, E. coli
catcaaacgatggaaggcggctggc

SEQ ID NO: 134394 - DNA, 25 bp, E. coli
cagtgccagctaagcgcaaagtgcg

SEQ ID NO: 134395 - DNA, 25 bp, E. coli
taccgcagaggtggaaaagcagctt

SEQ ID NO: 134396 - DNA, 25 bp, E. coli
taccgcagaggtcgaaaagcagctt

SEQ ID NO: 134397 - DNA, 25 bp, E. coli
ttttgaagtctttgcgctggaaccg

SEQ ID NO: 134398 - DNA, 25 bp, E. coli
ttttgaagtcttagcgctggaaccg

SEQ ID NO: 134399 - DNA, 25 bp, E. coli
cgcgcccggcctttcgtaaaggtga

SEQ ID NO: 134400 - DNA, 25 bp, E. coli
cgcgcccggcctatcgtaaaggtga

SEQ ID NO: 134401 - DNA, 25 bp, E. coli
gattttaacgttcgctggcgcgtca

SEQ ID NO: 134402 - DNA, 25 bp, E. coli
gtttatccgcgatgtactggcgcag

SEQ ID NO: 134403 - DNA, 25 bp, E. coli
gtttatccgcgaagtactggcgcag

SEQ ID NO: 134404 - DNA, 25 bp, E. coli
gattttaacgttggctggcgcgtca

SEQ ID NO: 134405 - DNA, 25 bp, E. coli
ggtacgccggtactggatatcaaac

SEQ ID NO: 134406 - DNA, 25 bp, E. coli
ggtacgccggtagtggatatcaaac

SEQ ID NO: 134407 - DNA, 25 bp, E. coli
gaggaaacgggcaaaacctatgccg

SEQ ID NO: 134408 - DNA, 25 bp, E. coli
gaggaaacgggctaaacctatgccg

SEQ ID NO: 134409 - DNA, 25 bp, E. coli
caggcgaataatccaacagagtatc

SEQ ID NO: 134410 - DNA, 25 bp, E. coli
cagagtatcagtctagatcaccaca

SEQ ID NO: 134411 - DNA, 25 bp, E. coli
caggcgaataatgcaacagagtatc

SEQ ID NO: 134412 - DNA, 25 bp, E. coli
catactgagaatctgaggcaacccc

SEQ ID NO: 134413 - DNA, 25 bp, E. coli
catactgagaatgtgaggcaacccc

SEQ ID NO: 134414 - DNA, 25 bp, E. coli
cagagtatcagtgtagatcaccaca

SEQ ID NO: 134415 - DNA, 25 bp, E. coli
tataagggctgagagcaaatcgaga

SEQ ID NO: 134416 - DNA, 25 bp, E. coli
tataagggctgacagcaaatcgaga

SEQ ID NO: 134417 - DNA, 25 bp, E. coli
tattgatgcgaggaaatcgccggaa

SEQ ID NO: 134418 - DNA, 25 bp, E. coli
tattgatgcgagcaaatcgccggaa

SEQ ID NO: 134419 - DNA, 25 bp, E. coli
tctatgtcgataaattacccaatgg

SEQ ID NO: 134420 - DNA, 25 bp, E. coli
tctatgtcgatatattacccaatgg

SEQ ID NO: 134421 - DNA, 25 bp, E. coli
gcgaaaaaacgcctgaatattgtgg

SEQ ID NO: 134422 - DNA, 25 bp, E. coli
gcgaaaaaacgcgtgaatattgtgg

SEQ ID NO: 134423 - DNA, 25 bp, E. coli
gcaacccctgatggcaaatgtggca

SEQ ID NO: 134424 - DNA, 25 bp, E. coli
gcaacccctgatcgcaaatgtggca

SEQ ID NO: 134425 - DNA, 25 bp, E. coli
cggaatttcccgtgatataagggct

SEQ ID NO: 134426 - DNA, 25 bp, E. coli
cgtgataaaaagctatttggcggga

SEQ ID NO: 134427 - DNA, 25 bp, E. coli
cggaatttcccgagatataagggct

SEQ ID NO: 134428 - DNA, 25 bp, E. coli
cgtgataaaaaggtatttggcggga

SEQ ID NO: 134429 - DNA, 25 bp, E. coli
ggaattatttccgtgctgcgggtag

SEQ ID NO: 134430 - DNA, 25 bp, E. coli
ggaattatttccctgctgcgggtag

SEQ ID NO: 134431 - DNA, 25 bp, E. coli
caataatggcgtgtttgttggcgaa

SEQ ID NO: 134432 - DNA, 25 bp, E. coli
caataatggcgtctttgttggcgaa

SEQ ID NO: 134433 - DNA, 25 bp, E. coli
tttgcgacatactggcggcatgaaa

SEQ ID NO: 134434 - DNA, 25 bp, E. coli
tatatctgacccacgctaagctgag

SEQ ID NO: 134435 - DNA, 25 bp, E. coli
tatatctgaccctcgctaagctgag

SEQ ID NO: 134436 - DNA, 25 bp, E. coli
tttgcgacatacaggcggcatgaaa

SEQ ID NO: 134437 - DNA, 25 bp, E. coli
ttggcgaagtaacgatatatctgac

SEQ ID NO: 134438 - DNA, 25 bp, E. coli
ttggcgaagtaaggatatatctgac

SEQ ID NO: 134439 - DNA, 25 bp, E. coli
gcagcgacgaaatcaccgacgggcg

SEQ ID NO: 134440 - DNA, 25 bp, E. coli
gcagcgacgaaaacaccgacgggcg

SEQ ID NO: 134441 - DNA, 25 bp, E. coli
gtccatttgggctatacgaaagtcg

SEQ ID NO: 134442 - DNA, 25 bp, E. coli
gggcaatacgaaagtcgatgatacg

SEQ ID NO: 134443 - DNA, 25 bp, E. coli
ggtacgcgcgtctatgtccatttgg

SEQ ID NO: 134444 - DNA, 25 bp, E. coli
gtccatttgggcaatacgaaagtcg

SEQ ID NO: 134445 - DNA, 25 bp, E. coli
ggtacgcgcgtcaatgtccatttgg

SEQ ID NO: 134446 - DNA, 25 bp, E. coli
gggcaatacgaatgtcgatgatacg

SEQ ID NO: 134447 - DNA, 25 bp, E. coli
tggcaatttgcgtcatactggcggc

SEQ ID NO: 134448 - DNA, 25 bp, E. coli
tggcaatttgcgacatactggcggc

SEQ ID NO: 134449 - DNA, 25 bp, E. coli
taagctgagcttcgctggcaatttg

SEQ ID NO: 134450 - DNA, 25 bp, E. coli
taagctgagcttggctggcaatttg

SEQ ID NO: 134451 - DNA, 25 bp, E. coli
gacgggcggcgttaatgatttcatc

SEQ ID NO: 134452 - DNA, 25 bp, E. coli
gacgggcggcgtaaatgatttcatc

SEQ ID NO: 134453 - DNA, 25 bp, E. coli
cacagtttagaattgcgcgcgtcca

SEQ ID NO: 134454 - DNA, 25 bp, E. coli
cacagtttagaaatgcgcgcgtcca

SEQ ID NO: 134455 - DNA, 25 bp, E. coli
cagttttgatcagctgcagcggcgg

SEQ ID NO: 134456 - DNA, 25 bp, E. coli
cagttttgatcacctgcagcggcgg

SEQ ID NO: 134457 - DNA, 25 bp, E. coli
tagtcgtagtctcatcgggcgcatc

SEQ ID NO: 134458 - DNA, 25 bp, E. coli
tagtcgtagtctgatcgggcgcatc

SEQ ID NO: 134459 - DNA, 25 bp, E. coli
tttgaaaacgctcagacgaacgcct

SEQ ID NO: 134460 - DNA, 25 bp, E. coli
tttgaaaacgctgagacgaacgcct

SEQ ID NO: 134461 - DNA, 25 bp, E. coli
tgttcaccataattaccggcaggcc

SEQ ID NO: 134462 - DNA, 25 bp, E. coli
tgttcaccataaataccggcaggcc

SEQ ID NO: 134463 - DNA, 25 bp, E. coli
tcagtgccctgagacataacgaaga

SEQ ID NO: 134464 - DNA, 25 bp, E. coli
tcagtgccctgacacataacgaaga

SEQ ID NO: 134465 - DNA, 25 bp, E. coli
gacaggtcgttaaccggcttgcgca

SEQ ID NO: 134466 - DNA, 25 bp, E. coli
gacaggtcgttatccggcttgcgca

SEQ ID NO: 134467 - DNA, 25 bp, E. coli
cattttcagcggttcagcggccgtc

SEQ ID NO: 134468 - DNA, 25 bp, E. coli
cattttcagcggatcagcggccgtc

SEQ ID NO: 134469 - DNA, 25 bp, E. coli
gataccacgttcagcacagatagcg

SEQ ID NO: 134470 - DNA, 25 bp, E. coli
gataccacgttctgcacagatagcg

SEQ ID NO: 134471 - DNA, 25 bp, E. coli
gattcttgcagcatcgccggatcaa

SEQ ID NO: 134472 - DNA, 25 bp, E. coli
gattcttgcagcttcgccggatcaa

SEQ ID NO: 134473 - DNA, 25 bp, E. coli
ggattacccagctgtacgcaagttg

SEQ ID NO: 134474 - DNA, 25 bp, E. coli
ggattacccagcagtacgcaagttg

SEQ ID NO: 134475 - DNA, 25 bp, E. coli
caagcgggcgatattgtctcctggc

SEQ ID NO: 134476 - DNA, 25 bp, E. coli
aagaaccccagtcactatcaagcgg

SEQ ID NO: 134477 - DNA, 25 bp, E. coli
aagaaccccagtgactatcaagcgg

SEQ ID NO: 134478 - DNA, 25 bp, E. coli
caagcgggcgattttgtctcctggc

SEQ ID NO: 134479 - DNA, 25 bp, E. coli
cagaaggtcgatatgcagaaactgg

SEQ ID NO: 134480 - DNA, 25 bp, E. coli
cagaaggtcgatttgcagaaactgg

SEQ ID NO: 134481 - DNA, 25 bp, E. coli
acgatccggcgtttgtgcagcttac

SEQ ID NO: 134482 - DNA, 25 bp, E. coli
acgatccggcgtatgtgcagcttac

SEQ ID NO: 134483 - DNA, 25 bp, E. coli
tggtgatacatatcattggcgcagg

SEQ ID NO: 134484 - DNA, 25 bp, E. coli
tggtgatacataacattggcgcagg

SEQ ID NO: 134485 - DNA, 25 bp, E. coli
gggtgcctaatcaggaaacctggtt

SEQ ID NO: 134486 - DNA, 25 bp, E. coli
gggtgcctaatctggaaacctggtt

SEQ ID NO: 134487 - DNA, 25 bp, E. coli
gcattgcgcagcgagaaggtcgatt

SEQ ID NO: 134488 - DNA, 25 bp, E. coli
gcattgcgcagccagaaggtcgatt

SEQ ID NO: 134489 - DNA, 25 bp, E. coli
gacggtacgccgctggtgatacata

SEQ ID NO: 134490 - DNA, 25 bp, E. coli
ggcagcacgctattttacgatccgg

SEQ ID NO: 134491 - DNA, 25 bp, E. coli
ggacagcaacatcgatcaccgtcgg

SEQ ID NO: 134492 - DNA, 25 bp, E. coli
ggacagcaacatggatcaccgtcgg

SEQ ID NO: 134493 - DNA, 25 bp, E. coli
ggcagcacgctaatttacgatccgg

SEQ ID NO: 134494 - DNA, 25 bp, E. coli
tcaccgtcgggtgcctaatctggaa

SEQ ID NO: 134495 - DNA, 25 bp, E. coli
tcaccgtcgggtccctaatctggaa

SEQ ID NO: 134496 - DNA, 25 bp, E. coli
gacggtacgccggtggtgatacata

SEQ ID NO: 134497 - DNA, 25 bp, E. coli
aactggacgatttgcgtgcggcagc

SEQ ID NO: 134498 - DNA, 25 bp, E. coli
aactggacgattagcgtgcggcagc

SEQ ID NO: 134499 - DNA, 25 bp, E. coli
tgaaaactgaaaacgcgaaagcctc

SEQ ID NO: 134500 - DNA, 25 bp, E. coli
tgaaaactgaaatcgcgaaagcctc

SEQ ID NO: 134501 - DNA, 25 bp, E. coli
tgcgtgtgccgtagacattacagcg

SEQ ID NO: 134502 - DNA, 25 bp, E. coli
tgcgtgtgccgttgacattacagcg

SEQ ID NO: 134503 - DNA, 25 bp, E. coli
tccaatgttgcagctaaggccggtg

SEQ ID NO: 134504 - DNA, 25 bp, E. coli
tccaatgttgcacctaaggccggtg

SEQ ID NO: 134505 - DNA, 25 bp, E. coli
gcctccaaaggtagtaagggcattg

SEQ ID NO: 134506 - DNA, 25 bp, E. coli
ccggctcacaaaagcgcaggcagat

SEQ ID NO: 134507 - DNA, 25 bp, E. coli
gcctccaaaggttgtaagggcattg

SEQ ID NO: 134508 - DNA, 25 bp, E. coli
ccggctcacaaatgcgcaggcagat

SEQ ID NO: 134509 - DNA, 25 bp, E. coli
gaaaagctccgcaaagaactggacg

SEQ ID NO: 134510 - DNA, 25 bp, E. coli
gaactgaaaaatccccgtgaagacg

SEQ ID NO: 134511 - DNA, 25 bp, E. coli
gaactgaaaaatgcccgtgaagacg

SEQ ID NO: 134512 - DNA, 25 bp, E. coli
gaaaagctccgctaagaactggacg

SEQ ID NO: 134513 - DNA, 25 bp, E. coli
cattctgcaacgagtggcacaggag

SEQ ID NO: 134514 - DNA, 25 bp, E. coli
cattgactatgaacgctaccggctc

SEQ ID NO: 134515 - DNA, 25 bp, E. coli
cattgactatgatcgctaccggctc

SEQ ID NO: 134516 - DNA, 25 bp, E. coli
cattctgcaacgtgtggcacaggag

SEQ ID NO: 134517 - DNA, 25 bp, E. coli
ggagtcagatttacaacccggcacc

SEQ ID NO: 134518 - DNA, 25 bp, E. coli
ggagtcagattttcaacccggcacc

SEQ ID NO: 134519 - DNA, 25 bp, E. coli
agctttaatcgcagcagctcaacag

SEQ ID NO: 134520 - DNA, 25 bp, E. coli
agctttaatcgctgcagctcaacag

SEQ ID NO: 134521 - DNA, 25 bp, E. coli
aaagcgtgactggagtgacgtcatg

SEQ ID NO: 134522 - DNA, 25 bp, E. coli
actggagtgacgacatgctgcaggc

SEQ ID NO: 134523 - DNA, 25 bp, E. coli
aaagcgtgactgcagtgacgtcatg

SEQ ID NO: 134524 - DNA, 25 bp, E. coli
actggagtgacgtcatgctgcaggc

SEQ ID NO: 134525 - DNA, 25 bp, E. coli
tatcagcggtcaccagctcgattac

SEQ ID NO: 134526 - DNA, 25 bp, E. coli
tatcagcggtcagcagctcgattac

SEQ ID NO: 134527 - DNA, 25 bp, E. coli
cccagctttaatggctgcagctcaa

SEQ ID NO: 134528 - DNA, 25 bp, E. coli
cccagctttaatcgctgcagctcaa

SEQ ID NO: 134529 - DNA, 25 bp, E. coli
cggatatcagcgctcagcagctcga

SEQ ID NO: 134530 - DNA, 25 bp, E. coli
cgtgactggagtgacgtcatgctgc

SEQ ID NO: 134531 - DNA, 25 bp, E. coli
cggatatcagcggtcagcagctcga

SEQ ID NO: 134532 - DNA, 25 bp, E. coli
cgtgactggagtcacgtcatgctgc

SEQ ID NO: 134533 - DNA, 25 bp, E. coli
gatatcagcggtgagcagctcgatt

SEQ ID NO: 134534 - DNA, 25 bp, E. coli
gatatcagcggtcagcagctcgatt

SEQ ID NO: 134535 - DNA, 25 bp, E. coli
gggtattgccggccagatgcacgga

SEQ ID NO: 134536 - DNA, 25 bp, E. coli
gtcagcagctcgtttaccgtacggg

SEQ ID NO: 134537 - DNA, 25 bp, E. coli
gggtattgccgggcagatgcacgga

SEQ ID NO: 134538 - DNA, 25 bp, E. coli
gtcagcagctcgattaccgtacggg

SEQ ID NO: 134539 - DNA, 25 bp, E. coli
tggagtgacgtcatgctgcaggctt

SEQ ID NO: 134540 - DNA, 25 bp, E. coli
tggagtgacgtcttgctgcaggctt

SEQ ID NO: 134541 - DNA, 25 bp, E. coli
tacaaaatagatgctggactttccg

SEQ ID NO: 134542 - DNA, 25 bp, E. coli
tacaaaatagatcctggactttccg

SEQ ID NO: 134543 - DNA, 25 bp, E. coli
taaatccactcctacttgccgctga

SEQ ID NO: 134544 - DNA, 25 bp, E. coli
taaatccactccaacttgccgctga

SEQ ID NO: 134545 - DNA, 25 bp, E. coli
actaagctatttagcctgtaaggcc

SEQ ID NO: 134546 - DNA, 25 bp, E. coli
actaagctattttgcctgtaaggcc

SEQ ID NO: 134547 - DNA, 25 bp, E. coli
tatcagccagtagtaaagagggacg

SEQ ID NO: 134548 - DNA, 25 bp, E. coli
tatatggctgcgaatgataacaagg

SEQ ID NO: 134549 - DNA, 25 bp, E. coli
tatatggctgcgtatgataacaagg

SEQ ID NO: 134550 - DNA, 25 bp, E. coli
tatcagccagtactaaagagggacg

SEQ ID NO: 134551 - DNA, 25 bp, E. coli
tattatgggcactaatatcagccag

SEQ ID NO: 134552 - DNA, 25 bp, E. coli
tattatgggcacaaatatcagccag

SEQ ID NO: 134553 - DNA, 25 bp, E. coli
tgtaaggccgcagaggctgaactcg

SEQ ID NO: 134554 - DNA, 25 bp, E. coli
tgtaaggccgcacaggctgaactcg

SEQ ID NO: 134555 - DNA, 25 bp, E. coli
tgaactcggactggcatatatggct

SEQ ID NO: 134556 - DNA, 25 bp, E. coli
tgaactcggactcgcatatatggct

SEQ ID NO: 134557 - DNA, 25 bp, E. coli
gccgctgattgctttgaaacagtaa

SEQ ID NO: 134558 - DNA, 25 bp, E. coli
gccgctgattgcattgaaacagtaa

SEQ ID NO: 134559 - DNA, 25 bp, E. coli
gacgaaaagcgtgttcactaagcta

SEQ ID NO: 134560 - DNA, 25 bp, E. coli
gacgaaaagcgtcttcactaagcta

SEQ ID NO: 134561 - DNA, 25 bp, E. coli
taagtaagggaatgatcataagacc

SEQ ID NO: 134562 - DNA, 25 bp, E. coli
taagtaagggaaagatcataagacc

SEQ ID NO: 134563 - DNA, 25 bp, E. coli
caacaactgagtcaatctggcctgg

SEQ ID NO: 134564 - DNA, 25 bp, E. coli
caacaactgagtgaatctggcctgg

SEQ ID NO: 134565 - DNA, 25 bp, E. coli
cagcaccctggtctttgaagtcgaa

SEQ ID NO: 134566 - DNA, 25 bp, E. coli
cagcaccctggtgtttgaagtcgaa

SEQ ID NO: 134567 - DNA, 25 bp, E. coli
taaatgggaactgactatcccgcag

SEQ ID NO: 134568 - DNA, 25 bp, E. coli
taaatgggaactcactatcccgcag

SEQ ID NO: 134569 - DNA, 25 bp, E. coli
tatcccgcaggaactggcatatggc

SEQ ID NO: 134570 - DNA, 25 bp, E. coli
tatcccgcaggatctggcatatggc

SEQ ID NO: 134571 - DNA, 25 bp, E. coli
ttttgacaccatcgaagcgcaagca

SEQ ID NO: 134572 - DNA, 25 bp, E. coli
ttttgacaccatggaagcgcaagca

SEQ ID NO: 134573 - DNA, 25 bp, E. coli
tgcaattccgcgagatcaaccaggg

SEQ ID NO: 134574 - DNA, 25 bp, E. coli
tgcaattccgcgtgatcaaccaggg

SEQ ID NO: 134575 - DNA, 25 bp, E. coli
tgaagtcgaactcctggaaatcctc

SEQ ID NO: 134576 - DNA, 25 bp, E. coli
tgaagtcgaactgctggaaatcctc

SEQ ID NO: 134577 - DNA, 25 bp, E. coli
tgcgctggaaggcaaacatccggct

SEQ ID NO: 134578 - DNA, 25 bp, E. coli
tgcgctggaagggaaacatccggct

SEQ ID NO: 134579 - DNA, 25 bp, E. coli
gctgctgccagaagcactggttgca

SEQ ID NO: 134580 - DNA, 25 bp, E. coli
gctgctgccagatgcactggttgca

SEQ ID NO: 134581 - DNA, 25 bp, E. coli
ccctggctggatagaagcactgact

SEQ ID NO: 134582 - DNA, 25 bp, E. coli
ccctggctggattgaagcactgact

SEQ ID NO: 134583 - DNA, 25 bp, E. coli
ggcaccgtgtttcacagctccgttg

SEQ ID NO: 134584 - DNA, 25 bp, E. coli
ggcaccgtgtttgacagctccgttg

SEQ ID NO: 134585 - DNA, 25 bp, E. coli
caagggttattacccgcactggcag

SEQ ID NO: 134586 - DNA, 25 bp, E. coli
caagggttattagccgcactggcag

SEQ ID NO: 134587 - DNA, 25 bp, E. coli
tagcgccgcacatgggttattagcc

SEQ ID NO: 134588 - DNA, 25 bp, E. coli
tagcgccgcacaagggttattagcc

SEQ ID NO: 134589 - DNA, 25 bp, E. coli
tgaaaaaagagggtattactacact

SEQ ID NO: 134590 - DNA, 25 bp, E. coli
tgaaaaaagaggctattactacact

SEQ ID NO: 134591 - DNA, 25 bp, E. coli
tgaaaatcccggagacttccgaagg

SEQ ID NO: 134592 - DNA, 25 bp, E. coli
tgaaaatcccggtgacttccgaagg

SEQ ID NO: 134593 - DNA, 25 bp, E. coli
gcaattaaaatactgaaaaaagagg

SEQ ID NO: 134594 - DNA, 25 bp, E. coli
gcaattaaaatagtgaaaaaagagg

SEQ ID NO: 134595 - DNA, 25 bp, E. coli
gacggcattcgtacggttcaggagc

SEQ ID NO: 134596 - DNA, 25 bp, E. coli
gacggcattcgttcggttcaggagc

SEQ ID NO: 134597 - DNA, 25 bp, E. coli
cattcgtacggttcaggagctgcaa

SEQ ID NO: 134598 - DNA, 25 bp, E. coli
cattcgtacggtacaggagctgcaa

SEQ ID NO: 134599 - DNA, 25 bp, E. coli
ggtgacttccgatggtctggcagca

SEQ ID NO: 134600 - DNA, 25 bp, E. coli
ggtattactacacttggcactgctg

SEQ ID NO: 134601 - DNA, 25 bp, E. coli
ggtattactacagttggcactgctg

SEQ ID NO: 134602 - DNA, 25 bp, E. coli
ggtgacttccgaaggtctggcagca

SEQ ID NO: 134603 - DNA, 25 bp, E. coli
gggcaaaatacgttgctccgtatgt

SEQ ID NO: 134604 - DNA, 25 bp, E. coli
gggcaaaatacgatgctccgtatgt

SEQ ID NO: 134605 - DNA, 25 bp, E. coli
tggcactgctgtatatagcgccgca

SEQ ID NO: 134606 - DNA, 25 bp, E. coli
tggcactgctgtttatagcgccgca

SEQ ID NO: 134607 - DNA, 25 bp, E. coli
aaggcaaaccgctaacgctacgctc

SEQ ID NO: 134608 - DNA, 25 bp, E. coli
aaggcaaaccgcaaacgctacgctc

SEQ ID NO: 134609 - DNA, 25 bp, E. coli
cagcgcggctgggtacgacctattt

SEQ ID NO: 134610 - DNA, 25 bp, E. coli
cagcgcggctggctacgacctattt

SEQ ID NO: 134611 - DNA, 25 bp, E. coli
tgtttggcctgaagcgtcaacttcg

SEQ ID NO: 134612 - DNA, 25 bp, E. coli
tgggctgtcgggaaacccgcgagct

SEQ ID NO: 134613 - DNA, 25 bp, E. coli
tgggctgtcgggtaacccgcgagct

SEQ ID NO: 134614 - DNA, 25 bp, E. coli
tgtttggcctgatgcgtcaacttcg

SEQ ID NO: 134615 - DNA, 25 bp, E. coli
tgatgcgtcaacttcgcgatcgcgg

SEQ ID NO: 134616 - DNA, 25 bp, E. coli
tgatgcgtcaacatcgcgatcgcgg

SEQ ID NO: 134617 - DNA, 25 bp, E. coli
gcgtgagctggacacccacgcgctt

SEQ ID NO: 134618 - DNA, 25 bp, E. coli
gcgtgagctggagacccacgcgctt

SEQ ID NO: 134619 - DNA, 25 bp, E. coli
gacctatttcccgtaaagaacagca

SEQ ID NO: 134620 - DNA, 25 bp, E. coli
gacctatttcccctaaagaacagca

SEQ ID NO: 134621 - DNA, 25 bp, E. coli
tcataggtcgcgaacccaaacgttt

SEQ ID NO: 134622 - DNA, 25 bp, E. coli
tcataggtcgcgtacccaaacgttt

SEQ ID NO: 134623 - DNA, 25 bp, E. coli
ggctggctacgagctatttcccgta

SEQ ID NO: 134624 - DNA, 25 bp, E. coli
tggcctgatgcgacaacttcgcgat

SEQ ID NO: 134625 - DNA, 25 bp, E. coli
ggctggctacgacctatttcccgta

SEQ ID NO: 134626 - DNA, 25 bp, E. coli
tggcctgatgcgtcaacttcgcgat

SEQ ID NO: 134627 - DNA, 25 bp, E. coli
gacgctcatcaaagcattaaccggt

SEQ ID NO: 134628 - DNA, 25 bp, E. coli
gacgctcatcaatgcattaaccggt

SEQ ID NO: 134629 - DNA, 25 bp, E. coli
cacgggcagtcggttacagtacaac

SEQ ID NO: 134630 - DNA, 25 bp, E. coli
cacgggcagtcgcttacagtacaac

SEQ ID NO: 134631 - DNA, 25 bp, E. coli
atgactgtgaacacgggcagtcgct

SEQ ID NO: 134632 - DNA, 25 bp, E. coli
atgactgtgaactcgggcagtcgct

SEQ ID NO: 134633 - DNA, 25 bp, E. coli
aacacgggcagtggcttacagtaca

SEQ ID NO: 134634 - DNA, 25 bp, E. coli
aacacgggcagtcgcttacagtaca

SEQ ID NO: 134635 - DNA, 25 bp, E. coli
tgatgactgtgatcacgggcagtcg

SEQ ID NO: 134636 - DNA, 25 bp, E. coli
tgaacacgggcagtcgcttacagta

SEQ ID NO: 134637 - DNA, 25 bp, E. coli
tgaacacgggcactcgcttacagta

SEQ ID NO: 134638 - DNA, 25 bp, E. coli
tgatgactgtgaacacgggcagtcg

SEQ ID NO: 134639 - DNA, 25 bp, E. coli
tcgcttacagtagaactgcgactgg

SEQ ID NO: 134640 - DNA, 25 bp, E. coli
tcgcttacagtacaactgcgactgg

SEQ ID NO: 134641 - DNA, 25 bp, E. coli
gcagtcgcttacagtacaactgcga

SEQ ID NO: 134642 - DNA, 25 bp, E. coli
gcagtcgcttactgtacaactgcga

SEQ ID NO: 134643 - DNA, 25 bp, E. coli
gaacacgggcagtcgcttacagtac

SEQ ID NO: 134644 - DNA, 25 bp, E. coli
gaacacgggcagacgcttacagtac

SEQ ID NO: 134645 - DNA, 25 bp, E. coli
cgcttacagtacaactgcgactggg

SEQ ID NO: 134646 - DNA, 25 bp, E. coli
cgcttacagtactactgcgactggg

SEQ ID NO: 134647 - DNA, 25 bp, E. coli
cgggcagtcgctaacagtacaactg

SEQ ID NO: 134648 - DNA, 25 bp, E. coli
cgggcagtcgcttacagtacaactg

SEQ ID NO: 134649 - DNA, 25 bp, E. coli
gtgaacacgggctgtcgcttacagt

SEQ ID NO: 134650 - DNA, 25 bp, E. coli
gtgaacacgggcagtcgcttacagt

SEQ ID NO: 134651 - DNA, 25 bp, E. coli
aagcaggtcagctcgcattatctgg

SEQ ID NO: 134652 - DNA, 25 bp, E. coli
aagcaggtcagcacgcattatctgg

SEQ ID NO: 134653 - DNA, 25 bp, E. coli
tacaacggtaaagcgcgcatctggc

SEQ ID NO: 134654 - DNA, 25 bp, E. coli
tacaacggtaaaccgcgcatctggc

SEQ ID NO: 134655 - DNA, 25 bp, E. coli
aaagtgctggtgttccactacaccg

SEQ ID NO: 134656 - DNA, 25 bp, E. coli
aaagtgctggtgatccactacaccg

SEQ ID NO: 134657 - DNA, 25 bp, E. coli
tattgcccgttaacacatcaagccg

SEQ ID NO: 134658 - DNA, 25 bp, E. coli
tattgcccgttatcacatcaagccg

SEQ ID NO: 134659 - DNA, 25 bp, E. coli
ttgtcgagaaagagggatatcagct

SEQ ID NO: 134660 - DNA, 25 bp, E. coli
tttgaaccggcacagattcaggcgc

SEQ ID NO: 134661 - DNA, 25 bp, E. coli
ttgtcgagaaagtgggatatcagct

SEQ ID NO: 134662 - DNA, 25 bp, E. coli
tttgaaccggcagagattcaggcgc

SEQ ID NO: 134663 - DNA, 25 bp, E. coli
gaagcggatgcacaaactcaggcga

SEQ ID NO: 134664 - DNA, 25 bp, E. coli
gaagcggatgcagaaactcaggcga

SEQ ID NO: 134665 - DNA, 25 bp, E. coli
ctattggcattgtgctggaaaaccg

SEQ ID NO: 134666 - DNA, 25 bp, E. coli
ctattggcattgagctggaaaaccg

SEQ ID NO: 134667 - DNA, 25 bp, E. coli
gatatcagcttgatacccgacgcca

SEQ ID NO: 134668 - DNA, 25 bp, E. coli
gattttgatagcacgctggcgacac

SEQ ID NO: 134669 - DNA, 25 bp, E. coli
gattttgatagctcgctggcgacac

SEQ ID NO: 134670 - DNA, 25 bp, E. coli
gatatcagcttgttacccgacgcca

SEQ ID NO: 134671 - DNA, 25 bp, E. coli
tggcgacactgaccgataagcaggt

SEQ ID NO: 134672 - DNA, 25 bp, E. coli
tggcgacactgagcgataagcaggt

SEQ ID NO: 134673 - DNA, 25 bp, E. coli
caatccagaccaatttcaattgctg

SEQ ID NO: 134674 - DNA, 25 bp, E. coli
caatccagaccattttcaattgctg

SEQ ID NO: 134675 - DNA, 25 bp, E. coli
cacttcatcgcaataacaatccaga

SEQ ID NO: 134676 - DNA, 25 bp, E. coli
cacttcatcgcattaacaatccaga

SEQ ID NO: 134677 - DNA, 25 bp, E. coli
tacgccctcaattttcactcgttga

SEQ ID NO: 134678 - DNA, 25 bp, E. coli
tacactgtcgttgttaattaatcgt

SEQ ID NO: 134679 - DNA, 25 bp, E. coli
tacactgtcgttcttaattaatcgt

SEQ ID NO: 134680 - DNA, 25 bp, E. coli
tacgccctcaatattcactcgttga

SEQ ID NO: 134681 - DNA, 25 bp, E. coli
ttcactcgttgaatgatcgccctca

SEQ ID NO: 134682 - DNA, 25 bp, E. coli
ttcactcgttgattgatcgccctca

SEQ ID NO: 134683 - DNA, 25 bp, E. coli
tgcagaaaagggttagctcaggctg

SEQ ID NO: 134684 - DNA, 25 bp, E. coli
tgcagaaaagggatagctcaggctg

SEQ ID NO: 134685 - DNA, 25 bp, E. coli
ccaatcttctattttgcgcttcctg

SEQ ID NO: 134686 - DNA, 25 bp, E. coli
ccaatcttctatattgcgcttcctg

SEQ ID NO: 134687 - DNA, 25 bp, E. coli
gctgtcatataactttacactgtcg

SEQ ID NO: 134688 - DNA, 25 bp, E. coli
gctgtcatataagtttacactgtcg

SEQ ID NO: 134689 - DNA, 25 bp, E. coli
gatagctcaggctgtccctttttta

SEQ ID NO: 134690 - DNA, 25 bp, E. coli
gatagctcaggcagtccctttttta

SEQ ID NO: 134691 - DNA, 25 bp, E. coli
gattgatcgccctcacacttcatcg

SEQ ID NO: 134692 - DNA, 25 bp, E. coli
gattgatcgcccacacacttcatcg

SEQ ID NO: 134693 - DNA, 25 bp, E. coli
taatcgttactatgacgtgactcct

SEQ ID NO: 134694 - DNA, 25 bp, E. coli
taatcgttactaagacgtgactcct

SEQ ID NO: 134695 - DNA, 25 bp, E. coli
aatgcggtgtcccatctcgggcaaa

SEQ ID NO: 134696 - DNA, 25 bp, E. coli
aatgcggtgtccgatctcgggcaaa

SEQ ID NO: 134697 - DNA, 25 bp, E. coli
cacaaatgcggtctccgatctcggg

SEQ ID NO: 134698 - DNA, 25 bp, E. coli
caaatgcggtgtccgatctcgggca

SEQ ID NO: 134699 - DNA, 25 bp, E. coli
cacaaatgcggtgtccgatctcggg

SEQ ID NO: 134700 - DNA, 25 bp, E. coli
caaatgcggtgtgcgatctcgggca

SEQ ID NO: 134701 - DNA, 25 bp, E. coli
tgtccgatctcgggcaaaaacttgg

SEQ ID NO: 134702 - DNA, 25 bp, E. coli
tgtccgatctcgcgcaaaaacttgg

SEQ ID NO: 134703 - DNA, 25 bp, E. coli
tcggcgctcggcacaaatgcggtgt

SEQ ID NO: 134704 - DNA, 25 bp, E. coli
tcggcgctcggctcaaatgcggtgt

SEQ ID NO: 134705 - DNA, 25 bp, E. coli
gcgctcggcacaaatgcggtgtccg

SEQ ID NO: 134706 - DNA, 25 bp, E. coli
gcgctcggcacatatgcggtgtccg

SEQ ID NO: 134707 - DNA, 25 bp, E. coli
gctcggcacaaaagcggtgtccgat

SEQ ID NO: 134708 - DNA, 25 bp, E. coli
gctcggcacaaatgcggtgtccgat

SEQ ID NO: 134709 - DNA, 25 bp, E. coli
cggtgtccgatctcgggcaaaaact

SEQ ID NO: 134710 - DNA, 25 bp, E. coli
cggtgtccgatcacgggcaaaaact

SEQ ID NO: 134711 - DNA, 25 bp, E. coli
ctggaatcggcggtcggcacaaatg

SEQ ID NO: 134712 - DNA, 25 bp, E. coli
ctggaatcggcgctcggcacaaatg

SEQ ID NO: 134713 - DNA, 25 bp, E. coli
tgcggtgtccgaactcgggcaaaaa

SEQ ID NO: 134714 - DNA, 25 bp, E. coli
ggcacaaatgcgctgtccgatctcg

SEQ ID NO: 134715 - DNA, 25 bp, E. coli
tgcggtgtccgatctcgggcaaaaa

SEQ ID NO: 134716 - DNA, 25 bp, E. coli
ggcacaaatgcggtgtccgatctcg

SEQ ID NO: 134717 - DNA, 25 bp, E. coli
aatcattaaaccagagccagtgagc

SEQ ID NO: 134718 - DNA, 25 bp, E. coli
aacctgagccagtgagctatgagtc

SEQ ID NO: 134719 - DNA, 25 bp, E. coli
aacctgagccagagagctatgagtc

SEQ ID NO: 134720 - DNA, 25 bp, E. coli
aatcattaaacctgagccagtgagc

SEQ ID NO: 134721 - DNA, 25 bp, E. coli
taaacctgagcctgtgagctatgag

SEQ ID NO: 134722 - DNA, 25 bp, E. coli
taaacctgagccagtgagctatgag

SEQ ID NO: 134723 - DNA, 25 bp, E. coli
agccagtgagctatgagtcctcagg

SEQ ID NO: 134724 - DNA, 25 bp, E. coli
agccagtgagctttgagtcctcagg

SEQ ID NO: 134725 - DNA, 25 bp, E. coli
ttaaacctgagcgagtgagctatga

SEQ ID NO: 134726 - DNA, 25 bp, E. coli
ttaaacctgagccagtgagctatga

SEQ ID NO: 134727 - DNA, 25 bp, E. coli
tgagccagtgagctatgagtcctca

SEQ ID NO: 134728 - DNA, 25 bp, E. coli
tcattaaacctgagccagtgagcta

SEQ ID NO: 134729 - DNA, 25 bp, E. coli
tcattaaacctgtgccagtgagcta

SEQ ID NO: 134730 - DNA, 25 bp, E. coli
tgagccagtgaggtatgagtcctca

SEQ ID NO: 134731 - DNA, 25 bp, E. coli
cctgagccagtgtgctatgagtcct

SEQ ID NO: 134732 - DNA, 25 bp, E. coli
cctgagccagtgagctatgagtcct

SEQ ID NO: 134733 - DNA, 25 bp, E. coli
ctgagccagtgagctatgagtcctc

SEQ ID NO: 134734 - DNA, 25 bp, E. coli
cattaaacctgagccagtgagctat

SEQ ID NO: 134735 - DNA, 25 bp, E. coli
ctgagccagtgacctatgagtcctc

SEQ ID NO: 134736 - DNA, 25 bp, E. coli
cattaaacctgacccagtgagctat

SEQ ID NO: 134737 - DNA, 25 bp, E. coli
gagccagtgagcaatgagtcctcag

SEQ ID NO: 134738 - DNA, 25 bp, E. coli
gagccagtgagctatgagtcctcag

SEQ ID NO: 134739 - DNA, 25 bp, E. coli
atactggtgtcggttctggttctgc

SEQ ID NO: 134740 - DNA, 25 bp, E. coli
tgtgccgggaaatcccggaagtccg

SEQ ID NO: 134741 - DNA, 25 bp, E. coli
atactggtgtcgcttctggttctgc

SEQ ID NO: 134742 - DNA, 25 bp, E. coli
tgtgccgggaaaacccggaagtccg

SEQ ID NO: 134743 - DNA, 25 bp, E. coli
tagcgcgtggcgtctgttgaaagat

SEQ ID NO: 134744 - DNA, 25 bp, E. coli
tagcgcgtggcgactgttgaaagat

SEQ ID NO: 134745 - DNA, 25 bp, E. coli
tgcatgtgcaggagatcccgccaca

SEQ ID NO: 134746 - DNA, 25 bp, E. coli
tgcatgtgcaggtgatcccgccaca

SEQ ID NO: 134747 - DNA, 25 bp, E. coli
cgcttctggttctgcgtagcgcgtg

SEQ ID NO: 134748 - DNA, 25 bp, E. coli
cgcttctggttcagcgtagcgcgtg

SEQ ID NO: 134749 - DNA, 25 bp, E. coli
cgccacacgatcacgatgccttgtt

SEQ ID NO: 134750 - DNA, 25 bp, E. coli
cgccacacgatctcgatgccttgtt

SEQ ID NO: 134751 - DNA, 25 bp, E. coli
cggaagtccgcattgtgcaccatgt

SEQ ID NO: 134752 - DNA, 25 bp, E. coli
cggaagtccgcaatgtgcaccatgt

SEQ ID NO: 134753 - DNA, 25 bp, E. coli
gatcagatccaacactacctgatgg

SEQ ID NO: 134754 - DNA, 25 bp, E. coli
gatcagatccaagactacctgatgg

SEQ ID NO: 134755 - DNA, 25 bp, E. coli
gggtgtctggcctttcacatcatca

SEQ ID NO: 134756 - DNA, 25 bp, E. coli
ggtgcaccggtatcgctggatatcg

SEQ ID NO: 134757 - DNA, 25 bp, E. coli
gggtgtctggccattcacatcatca

SEQ ID NO: 134758 - DNA, 25 bp, E. coli
ggtgcaccggtaacgctggatatcg

SEQ ID NO: 134759 - DNA, 25 bp, E. coli
ggaatatcaaccttgtcatgggcca

SEQ ID NO: 134760 - DNA, 25 bp, E. coli
ggaatatcaaccatgtcatgggcca

SEQ ID NO: 134761 - DNA, 25 bp, E. coli
cacctgtataactaatggtcggagt

SEQ ID NO: 134762 - DNA, 25 bp, E. coli
cacctgtataacaaatggtcggagt

SEQ ID NO: 134763 - DNA, 25 bp, E. coli
taacacctgtattacaaatggtcgg

SEQ ID NO: 134764 - DNA, 25 bp, E. coli
accgccaggcaatatgttccgataa

SEQ ID NO: 134765 - DNA, 25 bp, E. coli
accgccaggcaaaatgttccgataa

SEQ ID NO: 134766 - DNA, 25 bp, E. coli
aactattgcaagacgttcaaagacg

SEQ ID NO: 134767 - DNA, 25 bp, E. coli
aactattgcaagtcgttcaaagacg

SEQ ID NO: 134768 - DNA, 25 bp, E. coli
tatgttcaataactattgcaagacg

SEQ ID NO: 134769 - DNA, 25 bp, E. coli
tatgttcaataagtattgcaagacg

SEQ ID NO: 134770 - DNA, 25 bp, E. coli
ttcaaagacgtagcgccaggcaata

SEQ ID NO: 134771 - DNA, 25 bp, E. coli
ttcaaagacgtaccgccaggcaata

SEQ ID NO: 134772 - DNA, 25 bp, E. coli
ttgcaagacgttcaaagacgtaccg

SEQ ID NO: 134773 - DNA, 25 bp, E. coli
ttgcaagacgttgaaagacgtaccg

SEQ ID NO: 134774 - DNA, 25 bp, E. coli
tcctgaaaagtatgttcaataacta

SEQ ID NO: 134775 - DNA, 25 bp, E. coli
tcctgaaaagtaagttcaataacta

SEQ ID NO: 134776 - DNA, 25 bp, E. coli
gacaataacacctgtataacaaatg

SEQ ID NO: 134777 - DNA, 25 bp, E. coli
gacaataacaccagtataacaaatg

SEQ ID NO: 134778 - DNA, 25 bp, E. coli
gtaccgccaggctatatgttccgat

SEQ ID NO: 134779 - DNA, 25 bp, E. coli
gtaccgccaggcaatatgttccgat

SEQ ID NO: 134780 - DNA, 25 bp, E. coli
taacacctgtataacaaatggtcgg

SEQ ID NO: 134781 - DNA, 25 bp, E. coli
gacgttcaaagaggtaccgccaggc

SEQ ID NO: 134782 - DNA, 25 bp, E. coli
gacgttcaaagacgtaccgccaggc

SEQ ID NO: 134783 - DNA, 25 bp, E. coli
caggcgatacaacacgccgggctga

SEQ ID NO: 134784 - DNA, 25 bp, E. coli
caggtcgatagaatcatcggtaatg

SEQ ID NO: 134785 - DNA, 25 bp, E. coli
caggtcgatagattcatcggtaatg

SEQ ID NO: 134786 - DNA, 25 bp, E. coli
caggcgatacaagacgccgggctga

SEQ ID NO: 134787 - DNA, 25 bp, E. coli
acggcacaggcgttacaacacgccg

SEQ ID NO: 134788 - DNA, 25 bp, E. coli
agggcaggtcgaaagaatcatcggt

SEQ ID NO: 134789 - DNA, 25 bp, E. coli
acggcacaggcgatacaacacgccg

SEQ ID NO: 134790 - DNA, 25 bp, E. coli
agggcaggtcgatagaatcatcggt

SEQ ID NO: 134791 - DNA, 25 bp, E. coli
cgatgttgacgggacaggcgataca

SEQ ID NO: 134792 - DNA, 25 bp, E. coli
cgatgttgacggcacaggcgataca

SEQ ID NO: 134793 - DNA, 25 bp, E. coli
gttgacggcacacgcgatacaacac

SEQ ID NO: 134794 - DNA, 25 bp, E. coli
gttgacggcacaggcgatacaacac

SEQ ID NO: 134795 - DNA, 25 bp, E. coli
ggcgatacaacaggccgggctgact

SEQ ID NO: 134796 - DNA, 25 bp, E. coli
ggcgatacaacacgccgggctgact

SEQ ID NO: 134797 - DNA, 25 bp, E. coli
tcacgcgatgttcacggcacaggcg

SEQ ID NO: 134798 - DNA, 25 bp, E. coli
tcacgcgatgttgacggcacaggcg

SEQ ID NO: 134799 - DNA, 25 bp, E. coli
taatactggtggatggcgtgaaact

SEQ ID NO: 134800 - DNA, 25 bp, E. coli
taatactggtggttggcgtgaaact

SEQ ID NO: 134801 - DNA, 25 bp, E. coli
ggttggcgtgaaacttggctgtatt

SEQ ID NO: 134802 - DNA, 25 bp, E. coli
gatgttgacggctcaggcgatacaa

SEQ ID NO: 134803 - DNA, 25 bp, E. coli
gatgttgacggcacaggcgatacaa

SEQ ID NO: 134804 - DNA, 25 bp, E. coli
ggttggcgtgaatcttggctgtatt

SEQ ID NO: 134805 - DNA, 25 bp, E. coli
catgcttggctgacggacgtcctga

SEQ ID NO: 134806 - DNA, 25 bp, E. coli
catgcttggctgtcggacgtcctga

SEQ ID NO: 134807 - DNA, 25 bp, E. coli
tatgggacgaaaggcctggttgttc

SEQ ID NO: 134808 - DNA, 25 bp, E. coli
tatgggacgaaacgcctggttgttc

SEQ ID NO: 134809 - DNA, 25 bp, E. coli
accgcagtctggagccacatgcttg

SEQ ID NO: 134810 - DNA, 25 bp, E. coli
accgcagtctggtgccacatgcttg

SEQ ID NO: 134811 - DNA, 25 bp, E. coli
tttcaccgacggtaagatcgtgcat

SEQ ID NO: 134812 - DNA, 25 bp, E. coli
ttgttcgctggttcactggtggccg

SEQ ID NO: 134813 - DNA, 25 bp, E. coli
ttgttcgctggtacactggtggccg

SEQ ID NO: 134814 - DNA, 25 bp, E. coli
tttcaccgacggaaagatcgtgcat

SEQ ID NO: 134815 - DNA, 25 bp, E. coli
ttcaaggcacacacaacaatatctg

SEQ ID NO: 134816 - DNA, 25 bp, E. coli
ttcaaggcacactcaacaatatctg

SEQ ID NO: 134817 - DNA, 25 bp, E. coli
tgttacctcctggaccgcttcttgt

SEQ ID NO: 134818 - DNA, 25 bp, E. coli
tgttacctcctgcaccgcttcttgt

SEQ ID NO: 134819 - DNA, 25 bp, E. coli
tcttgtccttcctgtcggagcgaga

SEQ ID NO: 134820 - DNA, 25 bp, E. coli
tcttgtccttccagtcggagcgaga

SEQ ID NO: 134821 - DNA, 25 bp, E. coli
gctatccgtccgctcgttatgggac

SEQ ID NO: 134822 - DNA, 25 bp, E. coli
gctatccgtccggtcgttatgggac

SEQ ID NO: 134823 - DNA, 25 bp, E. coli
ggctgagttactgcctcttgagggc

SEQ ID NO: 134824 - DNA, 25 bp, E. coli
ggctgagttactccctcttgagggc

SEQ ID NO: 134825 - DNA, 25 bp, E. coli
taatgagccttcagggaaccgcagt

SEQ ID NO: 134826 - DNA, 25 bp, E. coli
taatgagccttctgggaaccgcagt

SEQ ID NO: 134827 - DNA, 25 bp, E. coli
caattcatgagcttatccgccagga

SEQ ID NO: 134828 - DNA, 25 bp, E. coli
aacgcgatcattaccggctggctga

SEQ ID NO: 134829 - DNA, 25 bp, E. coli
caattcatgagcatatccgccagga

SEQ ID NO: 134830 - DNA, 25 bp, E. coli
aacgcgatcatttccggctggctga

SEQ ID NO: 134831 - DNA, 25 bp, E. coli
cagcgagatgttagccaacgcgatc

SEQ ID NO: 134832 - DNA, 25 bp, E. coli
cagcgagatgtttgccaacgcgatc

SEQ ID NO: 134833 - DNA, 25 bp, E. coli
tgatgacctggcttattgccctggg

SEQ ID NO: 134834 - DNA, 25 bp, E. coli
tgcactggagcgttttcatctggcc

SEQ ID NO: 134835 - DNA, 25 bp, E. coli
tgcactggagcgatttcatctggcc

SEQ ID NO: 134836 - DNA, 25 bp, E. coli
tgaaaaagagctggaacgcgacgca

SEQ ID NO: 134837 - DNA, 25 bp, E. coli
tgaaaaagagctcgaacgcgacgca

SEQ ID NO: 134838 - DNA, 25 bp, E. coli
tgatgacctggcatattgccctggg

SEQ ID NO: 134839 - DNA, 25 bp, E. coli
tcctgcagcgggtgcggcaaagatt

SEQ ID NO: 134840 - DNA, 25 bp, E. coli
tcctgcagcgggagcggcaaagatt

SEQ ID NO: 134841 - DNA, 25 bp, E. coli
tcttcaatgaagtaactcgcgatgc

SEQ ID NO: 134842 - DNA, 25 bp, E. coli
tcttcaatgaagaaactcgcgatgc

SEQ ID NO: 134843 - DNA, 25 bp, E. coli
cctcccgggcgatggcaattcatga

SEQ ID NO: 134844 - DNA, 25 bp, E. coli
cctcccgggcgaaggcaattcatga

SEQ ID NO: 134845 - DNA, 25 bp, E. coli
gcatggatgtgatgaagaacacccc

SEQ ID NO: 134846 - DNA, 25 bp, E. coli
gcatggatgtgaagaagaacacccc

SEQ ID NO: 134847 - DNA, 25 bp, E. coli
gtactacccgtcttgcaaaaaccga

SEQ ID NO: 134848 - DNA, 25 bp, E. coli
gtactacccgtcatgcaaaaaccga

SEQ ID NO: 134849 - DNA, 25 bp, E. coli
tacgccgatcgtgcaacgctgtcta

SEQ ID NO: 134850 - DNA, 25 bp, E. coli
aaaagaaaggcgagcatacccgcta

SEQ ID NO: 134851 - DNA, 25 bp, E. coli
aaaagaaaggcgtgcatacccgcta

SEQ ID NO: 134852 - DNA, 25 bp, E. coli
aaagagattgttggcctctgcggcg

SEQ ID NO: 134853 - DNA, 25 bp, E. coli
aaagagattgttcgcctctgcggcg

SEQ ID NO: 134854 - DNA, 25 bp, E. coli
tacgccgatcgtccaacgctgtcta

SEQ ID NO: 134855 - DNA, 25 bp, E. coli
tgttaccgccgttaactacgccgat

SEQ ID NO: 134856 - DNA, 25 bp, E. coli
tgttaccgccgtaaactacgccgat

SEQ ID NO: 134857 - DNA, 25 bp, E. coli
tcccgacgaaagaacgtggtactgc

SEQ ID NO: 134858 - DNA, 25 bp, E. coli
tcccgacgaaagtacgtggtactgc

SEQ ID NO: 134859 - DNA, 25 bp, E. coli
gatatggaccacaaaaagccgggca

SEQ ID NO: 134860 - DNA, 25 bp, E. coli
gatcacccacgtttgtctgcggaag

SEQ ID NO: 134861 - DNA, 25 bp, E. coli
gatcacccacgtatgtctgcggaag

SEQ ID NO: 134862 - DNA, 25 bp, E. coli
gattctgaaagtcggtctggtcgcc

SEQ ID NO: 134863 - DNA, 25 bp, E. coli
gatatggaccactaaaagccgggca

SEQ ID NO: 134864 - DNA, 25 bp, E. coli
gattctgaaagtgggtctggtcgcc

SEQ ID NO: 134865 - DNA, 25 bp, E. coli
ggctgggagcacctctttaccgtta

SEQ ID NO: 134866 - DNA, 25 bp, E. coli
ggctgggcctacttgctgatgcaaa

SEQ ID NO: 134867 - DNA, 25 bp, E. coli
ggctgggcctacatgctgatgcaaa

SEQ ID NO: 134868 - DNA, 25 bp, E. coli
ggctgggagcacgtctttaccgtta

SEQ ID NO: 134869 - DNA, 25 bp, E. coli
tggctacctggtaagtgaactgcac

SEQ ID NO: 134870 - DNA, 25 bp, E. coli
tggctacctggttagtgaactgcac

SEQ ID NO: 134871 - DNA, 25 bp, E. coli
aatggctggccagaatcagccgtga

SEQ ID NO: 134872 - DNA, 25 bp, E. coli
aatggctggccacaatcagccgtga

SEQ ID NO: 134873 - DNA, 25 bp, E. coli
tactgaccgatccagaatggcaggc

SEQ ID NO: 134874 - DNA, 25 bp, E. coli
tactgaccgatcgagaatggcaggc

SEQ ID NO: 134875 - DNA, 25 bp, E. coli
tgaccttaccgggaattattgttgg

SEQ ID NO: 134876 - DNA, 25 bp, E. coli
tgaccttaccggcaattattgttgg

SEQ ID NO: 134877 - DNA, 25 bp, E. coli
tgcatctaccgcaggtgttaccgcc

SEQ ID NO: 134878 - DNA, 25 bp, E. coli
tgcatctaccgctggtgttaccgcc

SEQ ID NO: 134879 - DNA, 25 bp, E. coli
gcgctggcgatgatctccctgttga

SEQ ID NO: 134880 - DNA, 25 bp, E. coli
gcgctggcgatgttctccctgttga

SEQ ID NO: 134881 - DNA, 25 bp, E. coli
cctgttgatttctgaatggctggcc

SEQ ID NO: 134882 - DNA, 25 bp, E. coli
cctgttgatttcagaatggctggcc

SEQ ID NO: 134883 - DNA, 25 bp, E. coli
gctgtttagcctcccgtttgggatc

SEQ ID NO: 134884 - DNA, 25 bp, E. coli
gctgtttagcctgccgtttgggatc

SEQ ID NO: 134885 - DNA, 25 bp, E. coli
cgctggcgcgttatctttactatca

SEQ ID NO: 134886 - DNA, 25 bp, E. coli
cgctggcgcgttttctttactatca

SEQ ID NO: 134887 - DNA, 25 bp, E. coli
cggcgcggatttttcggtgaacgtc

SEQ ID NO: 134888 - DNA, 25 bp, E. coli
cggcgcggatttatcggtgaacgtc

SEQ ID NO: 134889 - DNA, 25 bp, E. coli
ggtgaaacgcgatccattccttctg

SEQ ID NO: 134890 - DNA, 25 bp, E. coli
gggcaaagctctcctcgacagcgta

SEQ ID NO: 134891 - DNA, 25 bp, E. coli
ggtgaaacgcgaaccattccttctg

SEQ ID NO: 134892 - DNA, 25 bp, E. coli
gggcaaagctctgctcgacagcgta

SEQ ID NO: 134893 - DNA, 25 bp, E. coli
aatgctaataatgtattggctcgga

SEQ ID NO: 134894 - DNA, 25 bp, E. coli
aatgctaataatctattggctcgga

SEQ ID NO: 134895 - DNA, 25 bp, E. coli
cacaaatgaactggccaggtgtcat

SEQ ID NO: 134896 - DNA, 25 bp, E. coli
cacaaatgaactcgccaggtgtcat

SEQ ID NO: 134897 - DNA, 25 bp, E. coli
tatggtcagtatgggcattggtatc

SEQ ID NO: 134898 - DNA, 25 bp, E. coli
tatggtcagtatcggcattggtatc

SEQ ID NO: 134899 - DNA, 25 bp, E. coli
tgtcattttccgaccgctcaaacag

SEQ ID NO: 134900 - DNA, 25 bp, E. coli
tgtcattttccgtccgctcaaacag

SEQ ID NO: 134901 - DNA, 25 bp, E. coli
tgacgcccgcgaaggttaagctgtt

SEQ ID NO: 134902 - DNA, 25 bp, E. coli
tgacgcccgcgatggttaagctgtt

SEQ ID NO: 134903 - DNA, 25 bp, E. coli
gctacgcacaaaagaactggccagg

SEQ ID NO: 134904 - DNA, 25 bp, E. coli
gctacgcacaaatgaactggccagg

SEQ ID NO: 134905 - DNA, 25 bp, E. coli
gctgttggctgctttgacacagtag

SEQ ID NO: 134906 - DNA, 25 bp, E. coli
gctgttggctgcattgacacagtag

SEQ ID NO: 134907 - DNA, 25 bp, E. coli
gcatccctgcagatttatatattgt

SEQ ID NO: 134908 - DNA, 25 bp, E. coli
gcatccctgcagttttatatattgt

SEQ ID NO: 134909 - DNA, 25 bp, E. coli
cgcgatggttaacctgttggctgca

SEQ ID NO: 134910 - DNA, 25 bp, E. coli
cgcgatggttaagctgttggctgca

SEQ ID NO: 134911 - DNA, 25 bp, E. coli
ggtactcgctatcgtcagtatgggc

SEQ ID NO: 134912 - DNA, 25 bp, E. coli
ggtactcgctatggtcagtatgggc

SEQ ID NO: 134913 - DNA, 25 bp, E. coli
tcaaacagcgcatccctgcagattt

SEQ ID NO: 134914 - DNA, 25 bp, E. coli
tcaaacagcgcaaccctgcagattt

SEQ ID NO: 134915 - DNA, 25 bp, E. coli
catgaagagctaactgccttacagg

SEQ ID NO: 134916 - DNA, 25 bp, E. coli
catgaagagctatctgccttacagg

SEQ ID NO: 134917 - DNA, 25 bp, E. coli
acgctggcggtctcttttactacgc

SEQ ID NO: 134918 - DNA, 25 bp, E. coli
aggggcagaccgttccgctggaaat

SEQ ID NO: 134919 - DNA, 25 bp, E. coli
acgctggcggtcacttttactacgc

SEQ ID NO: 134920 - DNA, 25 bp, E. coli
aggggcagaccgatccgctggaaat

SEQ ID NO: 134921 - DNA, 25 bp, E. coli
tatgctgcgggtgcatgaagagcta

SEQ ID NO: 134922 - DNA, 25 bp, E. coli
tacgctgtgcgtggacgcccgcagt

SEQ ID NO: 134923 - DNA, 25 bp, E. coli
tacgctgtgcgtcgacgcccgcagt

SEQ ID NO: 134924 - DNA, 25 bp, E. coli
tatgctgcgggtccatgaagagcta

SEQ ID NO: 134925 - DNA, 25 bp, E. coli
tttactacgctgagcgtcgacgccc

SEQ ID NO: 134926 - DNA, 25 bp, E. coli
tttactacgctgtgcgtcgacgccc

SEQ ID NO: 134927 - DNA, 25 bp, E. coli
tgcgggtgcatgtagagctaactgc

SEQ ID NO: 134928 - DNA, 25 bp, E. coli
tgcgggtgcatgaagagctaactgc

SEQ ID NO: 134929 - DNA, 25 bp, E. coli
ggtctcttttactacgctgtgcgtc

SEQ ID NO: 134930 - DNA, 25 bp, E. coli
ggtctcttttacaacgctgtgcgtc

SEQ ID NO: 134931 - DNA, 25 bp, E. coli
ggtgcatgaagagctaactgcctta

SEQ ID NO: 134932 - DNA, 25 bp, E. coli
ggtgcatgaagacctaactgcctta

SEQ ID NO: 134933 - DNA, 25 bp, E. coli
tggcggtctcttttactacgctgtg

SEQ ID NO: 134934 - DNA, 25 bp, E. coli
tggcggtctcttatactacgctgtg

SEQ ID NO: 134935 - DNA, 25 bp, E. coli
taactgccttacaggggcagaccga

SEQ ID NO: 134936 - DNA, 25 bp, E. coli
taactgccttactggggcagaccga

SEQ ID NO: 134937 - DNA, 25 bp, E. coli
caggtttagaacctgttgccgcaga

SEQ ID NO: 134938 - DNA, 25 bp, E. coli
caggtttagaacgtgttgccgcaga

SEQ ID NO: 134939 - DNA, 25 bp, E. coli
acggtcgcggactgttattatgccc

SEQ ID NO: 134940 - DNA, 25 bp, E. coli
acggtcgcggacagttattatgccc

SEQ ID NO: 134941 - DNA, 25 bp, E. coli
aggtttagaaccagttgccgcagag

SEQ ID NO: 134942 - DNA, 25 bp, E. coli
aggtttagaacctgttgccgcagag

SEQ ID NO: 134943 - DNA, 25 bp, E. coli
aacggtcgcggacagttattatgcc

SEQ ID NO: 134944 - DNA, 25 bp, E. coli
aacggtcgcggagagttattatgcc

SEQ ID NO: 134945 - DNA, 25 bp, E. coli
tcgcggacagtttttatgcccgtag

SEQ ID NO: 134946 - DNA, 25 bp, E. coli
tcgcggacagttattatgcccgtag

SEQ ID NO: 134947 - DNA, 25 bp, E. coli
gaaacggtcgcgcacagttattatg

SEQ ID NO: 134948 - DNA, 25 bp, E. coli
gaaacggtcgcggacagttattatg

SEQ ID NO: 134949 - DNA, 25 bp, E. coli
cggtcgcggacacttattatgcccg

SEQ ID NO: 134950 - DNA, 25 bp, E. coli
cggtcgcggacagttattatgcccg

SEQ ID NO: 134951 - DNA, 25 bp, E. coli
gtttagaacctgttgccgcagagtg

SEQ ID NO: 134952 - DNA, 25 bp, E. coli
gtttagaacctgatgccgcagagtg

SEQ ID NO: 134953 - DNA, 25 bp, E. coli
ggtcgcggacagttattatgcccgt

SEQ ID NO: 134954 - DNA, 25 bp, E. coli
tgcaggtttagatcctgttgccgca

SEQ ID NO: 134955 - DNA, 25 bp, E. coli
ggtttagaacctcttgccgcagagt

SEQ ID NO: 134956 - DNA, 25 bp, E. coli
ggtcgcggacagatattatgcccgt

SEQ ID NO: 134957 - DNA, 25 bp, E. coli
ggtttagaacctgttgccgcagagt

SEQ ID NO: 134958 - DNA, 25 bp, E. coli
tgcaggtttagaacctgttgccgca

SEQ ID NO: 134959 - DNA, 25 bp, E. coli
caaaagatggcctgttcagcagcga

SEQ ID NO: 134960 - DNA, 25 bp, E. coli
caaagcctctggcaactggaaaggg

SEQ ID NO: 134961 - DNA, 25 bp, E. coli
caaaagatggccagttcagcagcga

SEQ ID NO: 134962 - DNA, 25 bp, E. coli
caaagcctctgggaactggaaaggg

SEQ ID NO: 134963 - DNA, 25 bp, E. coli
catcatttgatcgtcgctcaggcgg

SEQ ID NO: 134964 - DNA, 25 bp, E. coli
catcatttgatcctcgctcaggcgg

SEQ ID NO: 134965 - DNA, 25 bp, E. coli
aactactggcaagtgcggcctggga

SEQ ID NO: 134966 - DNA, 25 bp, E. coli
aactactggcaactgcggcctggga

SEQ ID NO: 134967 - DNA, 25 bp, E. coli
tgatcagcgacaccaaactactggc

SEQ ID NO: 134968 - DNA, 25 bp, E. coli
tgatcagcgacagcaaactactggc

SEQ ID NO: 134969 - DNA, 25 bp, E. coli
tgggatgcgcaaacactcaacgaac

SEQ ID NO: 134970 - DNA, 25 bp, E. coli
tgggatgcgcaatcactcaacgaac

SEQ ID NO: 134971 - DNA, 25 bp, E. coli
tgatgttgaaaagcatgcgcgacgc

SEQ ID NO: 134972 - DNA, 25 bp, E. coli
tgatgttgaaaaccatgcgcgacgc

SEQ ID NO: 134973 - DNA, 25 bp, E. coli
ccagcaaagcggagtgccacatcat

SEQ ID NO: 134974 - DNA, 25 bp, E. coli
ccagcaaagcggtgtgccacatcat

SEQ ID NO: 134975 - DNA, 25 bp, E. coli
gtatgtatgacctgcagattgccca

SEQ ID NO: 134976 - DNA, 25 bp, E. coli
gtatgtatgaccagcagattgccca

SEQ ID NO: 134977 - DNA, 25 bp, E. coli
gatgacgccagaacaaccattgcca

SEQ ID NO: 134978 - DNA, 25 bp, E. coli
gagcacactcgcgtgtataccagta

SEQ ID NO: 134979 - DNA, 25 bp, E. coli
gatgacgccagatcaaccattgcca

SEQ ID NO: 134980 - DNA, 25 bp, E. coli
gagcacactcgcctgtataccagta

SEQ ID NO: 134981 - DNA, 25 bp, E. coli
caagattggttaactgccgcaggaa

SEQ ID NO: 134982 - DNA, 25 bp, E. coli
caagattggttatctgccgcaggaa

SEQ ID NO: 134983 - DNA, 25 bp, E. coli
taaagacatcgatggtgaagcgcgt

SEQ ID NO: 134984 - DNA, 25 bp, E. coli
taaagacatcgaaggtgaagcgcgt

SEQ ID NO: 134985 - DNA, 25 bp, E. coli
tgatctctggtctggaacagccgga

SEQ ID NO: 134986 - DNA, 25 bp, E. coli
tgatctctggtcaggaacagccgga

SEQ ID NO: 134987 - DNA, 25 bp, E. coli
tgaacaaggccgactggaagagatc

SEQ ID NO: 134988 - DNA, 25 bp, E. coli
tgaacaaggccgtctggaagagatc

SEQ ID NO: 134989 - DNA, 25 bp, E. coli
gaaggtaactactcctcctggctgg

SEQ ID NO: 134990 - DNA, 25 bp, E. coli
gaagagtacaagtaacgcacgctgg

SEQ ID NO: 134991 - DNA, 25 bp, E. coli
gaaggtaactacacctcctggctgg

SEQ ID NO: 134992 - DNA, 25 bp, E. coli
gaagagatcattcaggctcacgacg

SEQ ID NO: 134993 - DNA, 25 bp, E. coli
gaagagatcattgaggctcacgacg

SEQ ID NO: 134994 - DNA, 25 bp, E. coli
gaagagtacaagaaacgcacgctgg

SEQ ID NO: 134995 - DNA, 25 bp, E. coli
gttaacgccctgtaacgcctggatg

SEQ ID NO: 134996 - DNA, 25 bp, E. coli
gatatcatgaagttcggcaacaccg

SEQ ID NO: 134997 - DNA, 25 bp, E. coli
gatatcatgaagatcggcaacaccg

SEQ ID NO: 134998 - DNA, 25 bp, E. coli
gttaacgccctgaaacgcctggatg

SEQ ID NO: 134999 - DNA, 25 bp, E. coli
gatcctcgaactagaccgcggtgaa

SEQ ID NO: 135000 - DNA, 25 bp, E. coli
gagcttctcgatgccgaaaggagcg

SEQ ID NO: 135001 - DNA, 25 bp, E. coli
gatcctcgaacttgaccgcggtgaa

SEQ ID NO: 135002 - DNA, 25 bp, E. coli
gagcttctcgatcccgaaaggagcg

SEQ ID NO: 135003 - DNA, 25 bp, E. coli
caacagaagatgagaagaacgcgct

SEQ ID NO: 135004 - DNA, 25 bp, E. coli
caacagaagatgtgaagaacgcgct

SEQ ID NO: 135005 - DNA, 25 bp, E. coli
taaaagcagctattgatccagttgg

SEQ ID NO: 135006 - DNA, 25 bp, E. coli
taaaagcagctaatgatccagttgg

SEQ ID NO: 135007 - DNA, 25 bp, E. coli
aaaatacaggaatcacggcgagagc

SEQ ID NO: 135008 - DNA, 25 bp, E. coli
aaaatacaggaaacacggcgagagc

SEQ ID NO: 135009 - DNA, 25 bp, E. coli
tgaaaccacagacgaattgagcggg

SEQ ID NO: 135010 - DNA, 25 bp, E. coli
tgaaaccacagaggaattgagcggg

SEQ ID NO: 135011 - DNA, 25 bp, E. coli
gaatgctggacaagatcgaccctct

SEQ ID NO: 135012 - DNA, 25 bp, E. coli
gaatgctggacatgatcgaccctct

SEQ ID NO: 135013 - DNA, 25 bp, E. coli
gaaaacttcgtggtatgcggagtga

SEQ ID NO: 135014 - DNA, 25 bp, E. coli
gaaaacttcgtgctatgcggagtga

SEQ ID NO: 135015 - DNA, 25 bp, E. coli
ccgagaaggccggaaaacttgctgc

SEQ ID NO: 135016 - DNA, 25 bp, E. coli
ccgagaaggccgcaaaacttgctgc

SEQ ID NO: 135017 - DNA, 25 bp, E. coli
cgcaattgatactgtcggtcgacgc

SEQ ID NO: 135018 - DNA, 25 bp, E. coli
cgcaattgatacagtcggtcgacgc

SEQ ID NO: 135019 - DNA, 25 bp, E. coli
cggaatgtcggctaaacaaacggct

SEQ ID NO: 135020 - DNA, 25 bp, E. coli
cggaatgtcggcaaaacaaacggct

SEQ ID NO: 135021 - DNA, 25 bp, E. coli
tggctgcggcgctaagaaatcttga

SEQ ID NO: 135022 - DNA, 25 bp, E. coli
tggctgcggcgcaaagaaatcttga

SEQ ID NO: 135023 - DNA, 25 bp, E. coli
taatgctgcgtttgcatccgggaaa

SEQ ID NO: 135024 - DNA, 25 bp, E. coli
taatgctgcgttagcatccgggaaa

SEQ ID NO: 135025 - DNA, 25 bp, E. coli
tatccttatcattgcctggttttca

SEQ ID NO: 135026 - DNA, 25 bp, E. coli
tatccttatcatagcctggttttca

SEQ ID NO: 135027 - DNA, 25 bp, E. coli
tgggcggtcattattcccgcagtgc

SEQ ID NO: 135028 - DNA, 25 bp, E. coli
tgggcggtcatttttcccgcagtgc

SEQ ID NO: 135029 - DNA, 25 bp, E. coli
tccgggttattgatattagaagcaa

SEQ ID NO: 135030 - DNA, 25 bp, E. coli
tccgggttattgttattagaagcaa

SEQ ID NO: 135031 - DNA, 25 bp, E. coli
gccaccagctccactgcgggaacgt

SEQ ID NO: 135032 - DNA, 25 bp, E. coli
cctttgtgatcgtgtttggttcttt

SEQ ID NO: 135033 - DNA, 25 bp, E. coli
gccaccagctcctctgcgggaacgt

SEQ ID NO: 135034 - DNA, 25 bp, E. coli
cctttgtgatcgagtttggttcttt

SEQ ID NO: 135035 - DNA, 25 bp, E. coli
ctggttttcaatccttcattccggg

SEQ ID NO: 135036 - DNA, 25 bp, E. coli
ctggttttcaatgcttcattccggg

SEQ ID NO: 135037 - DNA, 25 bp, E. coli
gattatctccttagtgatcgtgttt

SEQ ID NO: 135038 - DNA, 25 bp, E. coli
gatcaagctgaaaaaaagcactctg

SEQ ID NO: 135039 - DNA, 25 bp, E. coli
gatcaagctgaataaaagcactctg

SEQ ID NO: 135040 - DNA, 25 bp, E. coli
gattatctcctttgtgatcgtgttt

SEQ ID NO: 135041 - DNA, 25 bp, E. coli
gggtgcctttatgcttatcattgcc

SEQ ID NO: 135042 - DNA, 25 bp, E. coli
gggtgcctttatccttatcattgcc

SEQ ID NO: 135043 - DNA, 25 bp, E. coli
tcaatgcttcataccgggttattgt

SEQ ID NO: 135044 - DNA, 25 bp, E. coli
tcaatgcttcattccgggttattgt

SEQ ID NO: 135045 - DNA, 25 bp, E. coli
gatcttgccggtgcctggtttttct

SEQ ID NO: 135046 - DNA, 25 bp, E. coli
gatcttgccggtccctggtttttct

SEQ ID NO: 135047 - DNA, 25 bp, E. coli
aattatttcaagattctctgctgcg

SEQ ID NO: 135048 - DNA, 25 bp, E. coli
aattatttcaagtttctctgctgcg

SEQ ID NO: 135049 - DNA, 25 bp, E. coli
cactatgaacggattaatcctggaa

SEQ ID NO: 135050 - DNA, 25 bp, E. coli
cactatgaacggtttaatcctggaa

SEQ ID NO: 135051 - DNA, 25 bp, E. coli
tatcttccgtcagaatgtgtaaacg

SEQ ID NO: 135052 - DNA, 25 bp, E. coli
tattcacctgcatatgcactgttgg

SEQ ID NO: 135053 - DNA, 25 bp, E. coli
tatcttccgtcacaatgtgtaaacg

SEQ ID NO: 135054 - DNA, 25 bp, E. coli
tattcacctgcaaatgcactgttgg

SEQ ID NO: 135055 - DNA, 25 bp, E. coli
tgtcgcgaaaaacgagatctctcct

SEQ ID NO: 135056 - DNA, 25 bp, E. coli
tgtcgcgaaaaaggagatctctcct

SEQ ID NO: 135057 - DNA, 25 bp, E. coli
tgctgcgtttcaaaacctggctgaa

SEQ ID NO: 135058 - DNA, 25 bp, E. coli
tcctggaattagcaagaaaaacgcc

SEQ ID NO: 135059 - DNA, 25 bp, E. coli
tgctgcgtttcataacctggctgaa

SEQ ID NO: 135060 - DNA, 25 bp, E. coli
tcctggaattaggaagaaaaacgcc

SEQ ID NO: 135061 - DNA, 25 bp, E. coli
cctggctgaaatgttaaaccaatgc

SEQ ID NO: 135062 - DNA, 25 bp, E. coli
gcactgttggaagaggttatccgac

SEQ ID NO: 135063 - DNA, 25 bp, E. coli
gcactgttggaacaggttatccgac

SEQ ID NO: 135064 - DNA, 25 bp, E. coli
gaaaaacgccagtttgtcgcgaaaa

SEQ ID NO: 135065 - DNA, 25 bp, E. coli
gaaaaacgccagattgtcgcgaaaa

SEQ ID NO: 135066 - DNA, 25 bp, E. coli
cctggctgaaatcttaaaccaatgc

SEQ ID NO: 135067 - DNA, 25 bp, E. coli
gtctgttccagtgttgccatactta

SEQ ID NO: 135068 - DNA, 25 bp, E. coli
gtctgttccagtcttgccatactta

SEQ ID NO: 135069 - DNA, 25 bp, E. coli
cagactaaattctctatcgccactt

SEQ ID NO: 135070 - DNA, 25 bp, E. coli
cagactaaattcactatcgccactt

SEQ ID NO: 135071 - DNA, 25 bp, E. coli
ttcactatcgcctcttttattggcg

SEQ ID NO: 135072 - DNA, 25 bp, E. coli
tatccagactaatttcactatcgcc

SEQ ID NO: 135073 - DNA, 25 bp, E. coli
ttcactatcgccacttttattggcg

SEQ ID NO: 135074 - DNA, 25 bp, E. coli
tatccagactaaattcactatcgcc

SEQ ID NO: 135075 - DNA, 25 bp, E. coli
tattggcgatgaaaagatgtttcgt

SEQ ID NO: 135076 - DNA, 25 bp, E. coli
tattggcgatgataagatgtttcgt

SEQ ID NO: 135077 - DNA, 25 bp, E. coli
ttggcgatgaaaagatgtttcgtga

SEQ ID NO: 135078 - DNA, 25 bp, E. coli
ttggcgatgaaatgatgtttcgtga

SEQ ID NO: 135079 - DNA, 25 bp, E. coli
tcgccacttttaatggcgatgaaaa

SEQ ID NO: 135080 - DNA, 25 bp, E. coli
tcgccacttttattggcgatgaaaa

SEQ ID NO: 135081 - DNA, 25 bp, E. coli
tccagactaaatacactatcgccac

SEQ ID NO: 135082 - DNA, 25 bp, E. coli
tccagactaaattcactatcgccac

SEQ ID NO: 135083 - DNA, 25 bp, E. coli
gccacttttattcgcgatgaaaaga

SEQ ID NO: 135084 - DNA, 25 bp, E. coli
gccacttttattggcgatgaaaaga

SEQ ID NO: 135085 - DNA, 25 bp, E. coli
gctatccagactaaattcactatcg

SEQ ID NO: 135086 - DNA, 25 bp, E. coli
gctatccagacttaattcactatcg

SEQ ID NO: 135087 - DNA, 25 bp, E. coli
gactaaattcacaatcgccactttt

SEQ ID NO: 135088 - DNA, 25 bp, E. coli
gactaaattcactatcgccactttt

SEQ ID NO: 135089 - DNA, 25 bp, E. coli
ggctatccagacaaaattcactatc

SEQ ID NO: 135090 - DNA, 25 bp, E. coli
ggctatccagactaaattcactatc

SEQ ID NO: 135091 - DNA, 25 bp, E. coli
atctactttggcacggtgttctcat

SEQ ID NO: 135092 - DNA, 25 bp, E. coli
ataacgttggcactaccgcgcgctg

SEQ ID NO: 135093 - DNA, 25 bp, E. coli
ataacgttggcagtaccgcgcgctg

SEQ ID NO: 135094 - DNA, 25 bp, E. coli
atctactttggctcggtgttctcat

SEQ ID NO: 135095 - DNA, 25 bp, E. coli
aaagtgggcgcactttcctgaaagg

SEQ ID NO: 135096 - DNA, 25 bp, E. coli
aaaaagaggcggtttctgcacctgc

SEQ ID NO: 135097 - DNA, 25 bp, E. coli
aaagtgggcgcagtttcctgaaagg

SEQ ID NO: 135098 - DNA, 25 bp, E. coli
aaaaagaggcggattctgcacctgc

SEQ ID NO: 135099 - DNA, 25 bp, E. coli
tgtcggtgataacgttggcactacc

SEQ ID NO: 135100 - DNA, 25 bp, E. coli
tgtcggtgataaggttggcactacc

SEQ ID NO: 135101 - DNA, 25 bp, E. coli
tgaccaatctcggtaatccgaaagc

SEQ ID NO: 135102 - DNA, 25 bp, E. coli
tgaccaatctcgctaatccgaaagc

SEQ ID NO: 135103 - DNA, 25 bp, E. coli
tcctgaaaggtttactgaccaatct

SEQ ID NO: 135104 - DNA, 25 bp, E. coli
tcctgaaaggttaactgaccaatct

SEQ ID NO: 135105 - DNA, 25 bp, E. coli
gccacaggtcgacctggcgaaaagt

SEQ ID NO: 135106 - DNA, 25 bp, E. coli
gccacaggtcgagctggcgaaaagt

SEQ ID NO: 135107 - DNA, 25 bp, E. coli
cgctaatccgaatgcgattatctac

SEQ ID NO: 135108 - DNA, 25 bp, E. coli
cgctaatccgaaagcgattatctac

SEQ ID NO: 135109 - DNA, 25 bp, E. coli
ggtttctgcaccagcgccacaggtc

SEQ ID NO: 135110 - DNA, 25 bp, E. coli
ggtttctgcacctgcgccacaggtc

SEQ ID NO: 135111 - DNA, 25 bp, E. coli
ggctcggtgttctcattgtttgtcg

SEQ ID NO: 135112 - DNA, 25 bp, E. coli
ggctcggtgttcacattgtttgtcg

SEQ ID NO: 135113 - DNA, 25 bp, E. coli
cagttttgcgtttgttcatcagcct

SEQ ID NO: 135114 - DNA, 25 bp, E. coli
cagttttgcgttagttcatcagcct

SEQ ID NO: 135115 - DNA, 25 bp, E. coli
tatgggcggtaaaacagataaattt

SEQ ID NO: 135116 - DNA, 25 bp, E. coli
tatgggcggtaatacagataaattt

SEQ ID NO: 135117 - DNA, 25 bp, E. coli
tttttcccgtgttctcaaattgctg

SEQ ID NO: 135118 - DNA, 25 bp, E. coli
tttttcccgtgtactcaaattgctg

SEQ ID NO: 135119 - DNA, 25 bp, E. coli
ttctcaaattgcagacaagtgcttg

SEQ ID NO: 135120 - DNA, 25 bp, E. coli
ttctcaaattgctgacaagtgcttg

SEQ ID NO: 135121 - DNA, 25 bp, E. coli
tgttctcaaattgctgacaagtgct

SEQ ID NO: 135122 - DNA, 25 bp, E. coli
tgttctcaaattcctgacaagtgct

SEQ ID NO: 135123 - DNA, 25 bp, E. coli
tgcgtttgttcatcagcctgatgcc

SEQ ID NO: 135124 - DNA, 25 bp, E. coli
tgcgtttgttcaacagcctgatgcc

SEQ ID NO: 135125 - DNA, 25 bp, E. coli
tcatcagcctgaagccgggcatagc

SEQ ID NO: 135126 - DNA, 25 bp, E. coli
tcatcagcctgatgccgggcatagc

SEQ ID NO: 135127 - DNA, 25 bp, E. coli
cccgtgttctcatattgctgacaag

SEQ ID NO: 135128 - DNA, 25 bp, E. coli
cccgtgttctcaaattgctgacaag

SEQ ID NO: 135129 - DNA, 25 bp, E. coli
cgtctcggtggcttatgggcggtaa

SEQ ID NO: 135130 - DNA, 25 bp, E. coli
cgtctcggtggcatatgggcggtaa

SEQ ID NO: 135131 - DNA, 25 bp, E. coli
ggcttatgggcgctaaaacagataa

SEQ ID NO: 135132 - DNA, 25 bp, E. coli
ggcttatgggcggtaaaacagataa

SEQ ID NO: 135133 - DNA, 25 bp, E. coli
gatgccgggcattgcccggcataaa

SEQ ID NO: 135134 - DNA, 25 bp, E. coli
gatgccgggcatagcccggcataaa

SEQ ID NO: 135135 - DNA, 25 bp, E. coli
accgcgccgtaaatgaccagacctt

SEQ ID NO: 135136 - DNA, 25 bp, E. coli
accgcgccgtaattgaccagacctt

SEQ ID NO: 135137 - DNA, 25 bp, E. coli
aaattgacgcggacatcgctttcgc

SEQ ID NO: 135138 - DNA, 25 bp, E. coli
aaattgacgcggtcatcgctttcgc

SEQ ID NO: 135139 - DNA, 25 bp, E. coli
taccgtgattatttgtccgccaaac

SEQ ID NO: 135140 - DNA, 25 bp, E. coli
taccgtgattatatgtccgccaaac

SEQ ID NO: 135141 - DNA, 25 bp, E. coli
tcttgatagatgacacaaagctcgg

SEQ ID NO: 135142 - DNA, 25 bp, E. coli
tcttgatagatgtcacaaagctcgg

SEQ ID NO: 135143 - DNA, 25 bp, E. coli
gccaaagttggagaacagcggttcc

SEQ ID NO: 135144 - DNA, 25 bp, E. coli
gccaaagttggacaacagcggttcc

SEQ ID NO: 135145 - DNA, 25 bp, E. coli
gcagatcgtacagcaacccgttgtc

SEQ ID NO: 135146 - DNA, 25 bp, E. coli
gcagatcgtacaccaacccgttgtc

SEQ ID NO: 135147 - DNA, 25 bp, E. coli
gaacagcggttcgacgacgttaaca

SEQ ID NO: 135148 - DNA, 25 bp, E. coli
gaacagcggttccacgacgttaaca

SEQ ID NO: 135149 - DNA, 25 bp, E. coli
cattcattttgtactgccagacgcg

SEQ ID NO: 135150 - DNA, 25 bp, E. coli
cattcattttgttctgccagacgcg

SEQ ID NO: 135151 - DNA, 25 bp, E. coli
ggaattgccgccatcgcctggatgc

SEQ ID NO: 135152 - DNA, 25 bp, E. coli
ggaattgccgccttcgcctggatgc

SEQ ID NO: 135153 - DNA, 25 bp, E. coli
gatgccgatatccaactcttccagg

SEQ ID NO: 135154 - DNA, 25 bp, E. coli
gaccacggccattctgttcgagcag

SEQ ID NO: 135155 - DNA, 25 bp, E. coli
gatgccgatatcgaactcttccagg

SEQ ID NO: 135156 - DNA, 25 bp, E. coli
gaccacggccatactgttcgagcag

SEQ ID NO: 135157 - DNA, 25 bp, E. coli
caatccaattgcgagcttaagtcga

SEQ ID NO: 135158 - DNA, 25 bp, E. coli
caatccaattgccagcttaagtcga

SEQ ID NO: 135159 - DNA, 25 bp, E. coli
caaagagttccgtaagcgttgatgc

SEQ ID NO: 135160 - DNA, 25 bp, E. coli
caaagagttccgaaagcgttgatgc

SEQ ID NO: 135161 - DNA, 25 bp, E. coli
cataaatatccgtgtctccagacgc

SEQ ID NO: 135162 - DNA, 25 bp, E. coli
cataaatatccgagtctccagacgc

SEQ ID NO: 135163 - DNA, 25 bp, E. coli
tacaagctgatatcaaccaggaatc

SEQ ID NO: 135164 - DNA, 25 bp, E. coli
tacaagctgataacaaccaggaatc

SEQ ID NO: 135165 - DNA, 25 bp, E. coli
taaaaacctgaacacatgaatgcgt

SEQ ID NO: 135166 - DNA, 25 bp, E. coli
taaaaacctgaagacatgaatgcgt

SEQ ID NO: 135167 - DNA, 25 bp, E. coli
tattcttgggcagtaatccgcaaac

SEQ ID NO: 135168 - DNA, 25 bp, E. coli
tattcttgggcactaatccgcaaac

SEQ ID NO: 135169 - DNA, 25 bp, E. coli
ttgtcacccggatcatagtcacttg

SEQ ID NO: 135170 - DNA, 25 bp, E. coli
ttcaatgcgttaaaagaaagctggc

SEQ ID NO: 135171 - DNA, 25 bp, E. coli
ttgtcacccggaacatagtcacttg

SEQ ID NO: 135172 - DNA, 25 bp, E. coli
ttcaatgcgttataagaaagctggc

SEQ ID NO: 135173 - DNA, 25 bp, E. coli
gcttaagtcgaaacaaggagactcg

SEQ ID NO: 135174 - DNA, 25 bp, E. coli
gcttaagtcgaatcaaggagactcg

SEQ ID NO: 135175 - DNA, 25 bp, E. coli
gcagtgttgtagttcaattgcgcac

SEQ ID NO: 135176 - DNA, 25 bp, E. coli
gcagtgttgtagatcaattgcgcac

SEQ ID NO: 135177 - DNA, 25 bp, E. coli
gattaatactctgtccgctacgcag

SEQ ID NO: 135178 - DNA, 25 bp, E. coli
gattaatactctctccgctacgcag

SEQ ID NO: 135179 - DNA, 25 bp, E. coli
aatgcatacatcatcaccgaaaccg

SEQ ID NO: 135180 - DNA, 25 bp, E. coli
aatgcatacatcttcaccgaaaccg

SEQ ID NO: 135181 - DNA, 25 bp, E. coli
atcttcaccgaatccggtcagcgcg

SEQ ID NO: 135182 - DNA, 25 bp, E. coli
atcttcaccgaaaccggtcagcgcg

SEQ ID NO: 135183 - DNA, 25 bp, E. coli
acatcttcaccgtaaccggtcagcg

SEQ ID NO: 135184 - DNA, 25 bp, E. coli
acatcttcaccgaaaccggtcagcg

SEQ ID NO: 135185 - DNA, 25 bp, E. coli
tgcatacatcttcaccgaaaccggt

SEQ ID NO: 135186 - DNA, 25 bp, E. coli
tgcatacatcttgaccgaaaccggt

SEQ ID NO: 135187 - DNA, 25 bp, E. coli
tcacccgggaaaggagtacgaccag

SEQ ID NO: 135188 - DNA, 25 bp, E. coli
tctcatcaatgcatacatcttcacc

SEQ ID NO: 135189 - DNA, 25 bp, E. coli
tcacccgggaaacgagtacgaccag

SEQ ID NO: 135190 - DNA, 25 bp, E. coli
tctcatcaatgcttacatcttcacc

SEQ ID NO: 135191 - DNA, 25 bp, E. coli
gccattctcatcaatgcatacatct

SEQ ID NO: 135192 - DNA, 25 bp, E. coli
gccattctcatctatgcatacatct

SEQ ID NO: 135193 - DNA, 25 bp, E. coli
gcatacatcttctccgaaaccggtc

SEQ ID NO: 135194 - DNA, 25 bp, E. coli
gcatacatcttcaccgaaaccggtc

SEQ ID NO: 135195 - DNA, 25 bp, E. coli
cccgggaaacgactacgaccagatg

SEQ ID NO: 135196 - DNA, 25 bp, E. coli
cccgggaaacgagtacgaccagatg

SEQ ID NO: 135197 - DNA, 25 bp, E. coli
cgggaaacgagtacgaccagatgac

SEQ ID NO: 135198 - DNA, 25 bp, E. coli
cgggaaacgagttcgaccagatgac

SEQ ID NO: 135199 - DNA, 25 bp, E. coli
gggaaacgagtacgaccagatgacc

SEQ ID NO: 135200 - DNA, 25 bp, E. coli
gggaaacgagtaggaccagatgacc

SEQ ID NO: 135201 - DNA, 25 bp, E. coli
caacattccgactctggttggtgta

SEQ ID NO: 135202 - DNA, 25 bp, E. coli
caacattccgacactggttggtgta

SEQ ID NO: 135203 - DNA, 25 bp, E. coli
cattccgacactggttggtgtagat

SEQ ID NO: 135204 - DNA, 25 bp, E. coli
cattccgacactcgttggtgtagat

SEQ ID NO: 135205 - DNA, 25 bp, E. coli
accacctcacataccgtaattcttg

SEQ ID NO: 135206 - DNA, 25 bp, E. coli
accacctcacattccgtaattcttg

SEQ ID NO: 135207 - DNA, 25 bp, E. coli
cataccgtaattgttgcccgttcgt

SEQ ID NO: 135208 - DNA, 25 bp, E. coli
cataccgtaattcttgcccgttcgt

SEQ ID NO: 135209 - DNA, 25 bp, E. coli
ttatgaagaataggcctcgctgttc

SEQ ID NO: 135210 - DNA, 25 bp, E. coli
ttatgaagaatacgcctcgctgttc

SEQ ID NO: 135211 - DNA, 25 bp, E. coli
ccagctgcttcaccaaatctacggt

SEQ ID NO: 135212 - DNA, 25 bp, E. coli
ccagctgcttcagcaaatctacggt

SEQ ID NO: 135213 - DNA, 25 bp, E. coli
gaagaatacgccacgctgttcacca

SEQ ID NO: 135214 - DNA, 25 bp, E. coli
gaagaatacgcctcgctgttcacca

SEQ ID NO: 135215 - DNA, 25 bp, E. coli
cgacactggttggtgtagatattga

SEQ ID NO: 135216 - DNA, 25 bp, E. coli
cgacactggttgctgtagatattga

SEQ ID NO: 135217 - DNA, 25 bp, E. coli
ctcgctgttcacgacacaactacgg

SEQ ID NO: 135218 - DNA, 25 bp, E. coli
ctcgctgttcaccacacaactacgg

SEQ ID NO: 135219 - DNA, 25 bp, E. coli
tcacataccgtatttcttgcccgtt

SEQ ID NO: 135220 - DNA, 25 bp, E. coli
tcacataccgtaattcttgcccgtt

SEQ ID NO: 135221 - DNA, 25 bp, E. coli
gatgtctgcttccagctgcttcagc

SEQ ID NO: 135222 - DNA, 25 bp, E. coli
gatgtctgcttcgagctgcttcagc

SEQ ID NO: 135223 - DNA, 25 bp, E. coli
catggacacggacgtacttaacgac

SEQ ID NO: 135224 - DNA, 25 bp, E. coli
catgaccatacgcagaccatcggga

SEQ ID NO: 135225 - DNA, 25 bp, E. coli
catgaccatacggagaccatcggga

SEQ ID NO: 135226 - DNA, 25 bp, E. coli
catggacacggaggtacttaacgac

SEQ ID NO: 135227 - DNA, 25 bp, E. coli
cagacgctgaagctgacgaacgacc

SEQ ID NO: 135228 - DNA, 25 bp, E. coli
cagacgctgaaggtgacgaacgacc

SEQ ID NO: 135229 - DNA, 25 bp, E. coli
tatcacggtggccaatgaccggcgc

SEQ ID NO: 135230 - DNA, 25 bp, E. coli
tatcacggtggcgaatgaccggcgc

SEQ ID NO: 135231 - DNA, 25 bp, E. coli
ttttacagacgaagacgggataccg

SEQ ID NO: 135232 - DNA, 25 bp, E. coli
ttttacagacgatgacgggataccg

SEQ ID NO: 135233 - DNA, 25 bp, E. coli
tccggagaagaaaatgaagaccctg

SEQ ID NO: 135234 - DNA, 25 bp, E. coli
tccggagaagaatatgaagaccctg

SEQ ID NO: 135235 - DNA, 25 bp, E. coli
gccttctttgagcacggtgcgcaga

SEQ ID NO: 135236 - DNA, 25 bp, E. coli
gccttctttgaggacggtgcgcaga

SEQ ID NO: 135237 - DNA, 25 bp, E. coli
gaaaatcaatctcaatagcggcggt

SEQ ID NO: 135238 - DNA, 25 bp, E. coli
gaaaatcaatctgaatagcggcggt

SEQ ID NO: 135239 - DNA, 25 bp, E. coli
gattcgcggtgaaacggacaaggac

SEQ ID NO: 135240 - DNA, 25 bp, E. coli
gattcgcggtgatacggacaaggac

SEQ ID NO: 135241 - DNA, 25 bp, E. coli
taaggaacaggtctatatccacgcg

SEQ ID NO: 135242 - DNA, 25 bp, E. coli
taaggaacaggtgtatatccacgcg

SEQ ID NO: 135243 - DNA, 25 bp, E. coli
gacgatatcggcgatgctgctgaac

SEQ ID NO: 135244 - DNA, 25 bp, E. coli
gacgatatcggccatgctgctgaac

SEQ ID NO: 135245 - DNA, 25 bp, E. coli
cagtatgagtttagccgcgccatgc

SEQ ID NO: 135246 - DNA, 25 bp, E. coli
cagtatgagttttgccgcgccatgc

SEQ ID NO: 135247 - DNA, 25 bp, E. coli
actgggtagatctggtgctgtgcac

SEQ ID NO: 135248 - DNA, 25 bp, E. coli
actgggtagatcaggtgctgtgcac

SEQ ID NO: 135249 - DNA, 25 bp, E. coli
tataacgtaccgctggtgctgacgc

SEQ ID NO: 135250 - DNA, 25 bp, E. coli
tataacgtaccggtggtgctgacgc

SEQ ID NO: 135251 - DNA, 25 bp, E. coli
tgggcgggccggtaaaaatcatgaa

SEQ ID NO: 135252 - DNA, 25 bp, E. coli
tgggcgggccggaaaaaatcatgaa

SEQ ID NO: 135253 - DNA, 25 bp, E. coli
tgttggcatctgtcaaggcgctgga

SEQ ID NO: 135254 - DNA, 25 bp, E. coli
tgttggcatctgacaaggcgctgga

SEQ ID NO: 135255 - DNA, 25 bp, E. coli
tgaagccgaagccttgaccggagaa

SEQ ID NO: 135256 - DNA, 25 bp, E. coli
tgaagccgaagcgttgaccggagaa

SEQ ID NO: 135257 - DNA, 25 bp, E. coli
tgccggaagcaaccatgaaagccat

SEQ ID NO: 135258 - DNA, 25 bp, E. coli
tgccggaagcaagcatgaaagccat

SEQ ID NO: 135259 - DNA, 25 bp, E. coli
cctgggtagtggctatcgatcaaac

SEQ ID NO: 135260 - DNA, 25 bp, E. coli
gccgaagcgctttatcaggaactaa

SEQ ID NO: 135261 - DNA, 25 bp, E. coli
cctgggtagtgggtatcgatcaaac

SEQ ID NO: 135262 - DNA, 25 bp, E. coli
ccttgcgatgaacgaagatgaagcc

SEQ ID NO: 135263 - DNA, 25 bp, E. coli
gccgaagcgcttaatcaggaactaa

SEQ ID NO: 135264 - DNA, 25 bp, E. coli
ccttgcgatgaaggaagatgaagcc

SEQ ID NO: 135265 - DNA, 25 bp, E. coli
cgttatggattatgcgccgggcatt

SEQ ID NO: 135266 - DNA, 25 bp, E. coli
cgttatggattaagcgccgggcatt

SEQ ID NO: 135267 - DNA, 25 bp, E. coli
caattattatcaactctggcagcac

SEQ ID NO: 135268 - DNA, 25 bp, E. coli
caattattatcatctctggcagcac

SEQ ID NO: 135269 - DNA, 25 bp, E. coli
cagtctgttactgatgagtgtcttt

SEQ ID NO: 135270 - DNA, 25 bp, E. coli
cagtctgttactcatgagtgtcttt

SEQ ID NO: 135271 - DNA, 25 bp, E. coli
acagccttccgcgagagtatggtca

SEQ ID NO: 135272 - DNA, 25 bp, E. coli
acagccttccgccagagtatggtca

SEQ ID NO: 135273 - DNA, 25 bp, E. coli
ttattatcaactctggcagcacaac

SEQ ID NO: 135274 - DNA, 25 bp, E. coli
ttattatcaactgtggcagcacaac

SEQ ID NO: 135275 - DNA, 25 bp, E. coli
tctttcatggcaacagacagaacaa

SEQ ID NO: 135276 - DNA, 25 bp, E. coli
tctttcatggcatcagacagaacaa

SEQ ID NO: 135277 - DNA, 25 bp, E. coli
ccttccgcgagagtatggtcagtct

SEQ ID NO: 135278 - DNA, 25 bp, E. coli
ccttccgcgagactatggtcagtct

SEQ ID NO: 135279 - DNA, 25 bp, E. coli
gaaaacaatcagtcagccttccgcg

SEQ ID NO: 135280 - DNA, 25 bp, E. coli
gaaaacaatcagacagccttccgcg

SEQ ID NO: 135281 - DNA, 25 bp, E. coli
cgcgagagtatgctcagtctgttac

SEQ ID NO: 135282 - DNA, 25 bp, E. coli
cgcgagagtatggtcagtctgttac

SEQ ID NO: 135283 - DNA, 25 bp, E. coli
tggcaacagacagaacaattattat

SEQ ID NO: 135284 - DNA, 25 bp, E. coli
tggcaacagacacaacaattattat

SEQ ID NO: 135285 - DNA, 25 bp, E. coli
tcagacagccttccgcgagagtatg

SEQ ID NO: 135286 - DNA, 25 bp, E. coli
tcagacagccttgcgcgagagtatg

SEQ ID NO: 135287 - DNA, 25 bp, E. coli
gatgagtgtctttcatggcaacaga

SEQ ID NO: 135288 - DNA, 25 bp, E. coli
gatgagtgtcttacatggcaacaga

SEQ ID NO: 135289 - DNA, 25 bp, E. coli
tgacaccctgttctcggcgtttaag

SEQ ID NO: 135290 - DNA, 25 bp, E. coli
tgtcgaggtgcccaatggaaaagac

SEQ ID NO: 135291 - DNA, 25 bp, E. coli
tgacaccctgttgtcggcgtttaag

SEQ ID NO: 135292 - DNA, 25 bp, E. coli
tgtcgaggtgccgaatggaaaagac

SEQ ID NO: 135293 - DNA, 25 bp, E. coli
tgaagcacatggattatgttcagca

SEQ ID NO: 135294 - DNA, 25 bp, E. coli
tgaagcacatggtttatgttcagca

SEQ ID NO: 135295 - DNA, 25 bp, E. coli
tcagcatgtgtagaagtagaagcgt

SEQ ID NO: 135296 - DNA, 25 bp, E. coli
gcatggcgactttttaagcatctgg

SEQ ID NO: 135297 - DNA, 25 bp, E. coli
gcatggcgacttattaagcatctgg

SEQ ID NO: 135298 - DNA, 25 bp, E. coli
gaacagtgccatcatgaccactcta

SEQ ID NO: 135299 - DNA, 25 bp, E. coli
gaacagtgccatgatgaccactcta

SEQ ID NO: 135300 - DNA, 25 bp, E. coli
cgaatatgcgatcaggcaatgtgac

SEQ ID NO: 135301 - DNA, 25 bp, E. coli
cgaatatgcgatgaggcaatgtgac

SEQ ID NO: 135302 - DNA, 25 bp, E. coli
cattcttaaccccactgtcgaggtg

SEQ ID NO: 135303 - DNA, 25 bp, E. coli
cattcttaacccgactgtcgaggtg

SEQ ID NO: 135304 - DNA, 25 bp, E. coli
gggcgctactatagcataacgaata

SEQ ID NO: 135305 - DNA, 25 bp, E. coli
gggcgctactattgcataacgaata

SEQ ID NO: 135306 - DNA, 25 bp, E. coli
ggcaatgtgacacccatgacaccct

SEQ ID NO: 135307 - DNA, 25 bp, E. coli
ggcaatgtgacagccatgacaccct

SEQ ID NO: 135308 - DNA, 25 bp, E. coli
tgaccactctattcaggtgaaaaag

SEQ ID NO: 135309 - DNA, 25 bp, E. coli
tgaccactctatacaggtgaaaaag

SEQ ID NO: 135310 - DNA, 25 bp, E. coli
tcagcatgtgtacaagtagaagcgt

SEQ ID NO: 135311 - DNA, 25 bp, E. coli
aattccggcgatatgctcgcatcaa

SEQ ID NO: 135312 - DNA, 25 bp, E. coli
aattccggcgatttgctcgcatcaa

SEQ ID NO: 135313 - DNA, 25 bp, E. coli
cattgggtaatatatcgacatagac

SEQ ID NO: 135314 - DNA, 25 bp, E. coli
aactttctcgatatgctctcagccc

SEQ ID NO: 135315 - DNA, 25 bp, E. coli
aaaaatatcacttcccgcagcaggg

SEQ ID NO: 135316 - DNA, 25 bp, E. coli
aaaaatatcactacccgcagcaggg

SEQ ID NO: 135317 - DNA, 25 bp, E. coli
aactttctcgatttgctctcagccc

SEQ ID NO: 135318 - DNA, 25 bp, E. coli
tattcatgccacatttgccatcagg

SEQ ID NO: 135319 - DNA, 25 bp, E. coli
tattcatgccacttttgccatcagg

SEQ ID NO: 135320 - DNA, 25 bp, E. coli
tgtggtgatctagactgatactctg

SEQ ID NO: 135321 - DNA, 25 bp, E. coli
tgtggtgatctacactgatactctg

SEQ ID NO: 135322 - DNA, 25 bp, E. coli
gccaaatagctttttatcacgcaaa

SEQ ID NO: 135323 - DNA, 25 bp, E. coli
gccaaatagcttattatcacgcaaa

SEQ ID NO: 135324 - DNA, 25 bp, E. coli
ccacaatattcacgcgttttttcgc

SEQ ID NO: 135325 - DNA, 25 bp, E. coli
ccacaatattcaggcgttttttcgc

SEQ ID NO: 135326 - DNA, 25 bp, E. coli
cttatatcacggcaaattccggcga

SEQ ID NO: 135327 - DNA, 25 bp, E. coli
cttatatcacgggaaattccggcga

SEQ ID NO: 135328 - DNA, 25 bp, E. coli
cattgggtaataaatcgacatagac

SEQ ID NO: 135329 - DNA, 25 bp, E. coli
gatactctgttggattattcgcctg

SEQ ID NO: 135330 - DNA, 25 bp, E. coli
gatactctgttgcattattcgcctg

SEQ ID NO: 135331 - DNA, 25 bp, E. coli
gggttgcctcagtttctcagtatgt

SEQ ID NO: 135332 - DNA, 25 bp, E. coli
gggttgcctcagattctcagtatgt

SEQ ID NO: 135333 - DNA, 25 bp, E. coli
caggctggaagcactgatgcgccga

SEQ ID NO: 135334 - DNA, 25 bp, E. coli
caggctggaagctctgatgcgccga

SEQ ID NO: 135335 - DNA, 25 bp, E. coli
tacacaaggtcgacagggaaaagag

SEQ ID NO: 135336 - DNA, 25 bp, E. coli
tacacaaggtcgtcagggaaaagag

SEQ ID NO: 135337 - DNA, 25 bp, E. coli
tgcatgtgcatcatctgcgacgcaa

SEQ ID NO: 135338 - DNA, 25 bp, E. coli
tgcatgtgcatcttctgcgacgcaa

SEQ ID NO: 135339 - DNA, 25 bp, E. coli
gccctgctggaaatactgatgcgta

SEQ ID NO: 135340 - DNA, 25 bp, E. coli
gcgttgatagaagtcgccgccaggc

SEQ ID NO: 135341 - DNA, 25 bp, E. coli
gcgttgatagaactcgccgccaggc

SEQ ID NO: 135342 - DNA, 25 bp, E. coli
gccctgctggaattactgatgcgta

SEQ ID NO: 135343 - DNA, 25 bp, E. coli
gaagaggtcacctgtaatgccgttg

SEQ ID NO: 135344 - DNA, 25 bp, E. coli
gaagaggtcaccagtaatgccgttg

SEQ ID NO: 135345 - DNA, 25 bp, E. coli
gaaaccaaaagattttgccctgctg

SEQ ID NO: 135346 - DNA, 25 bp, E. coli
gaaactgtatacgtgggacgaagag

SEQ ID NO: 135347 - DNA, 25 bp, E. coli
gaaactgtatacctgggacgaagag

SEQ ID NO: 135348 - DNA, 25 bp, E. coli
gaaaccaaaagaatttgccctgctg

SEQ ID NO: 135349 - DNA, 25 bp, E. coli
cgaatggcgagaaaaaggtcagcgt

SEQ ID NO: 135350 - DNA, 25 bp, E. coli
cgaatggcgagataaaggtcagcgt

SEQ ID NO: 135351 - DNA, 25 bp, E. coli
tggcgacggcatcaaaacgggcctt

SEQ ID NO: 135352 - DNA, 25 bp, E. coli
tggcgacggcatgaaaacgggcctt

SEQ ID NO: 135353 - DNA, 25 bp, E. coli
gatgacatgctgtttggcgacggca

SEQ ID NO: 135354 - DNA, 25 bp, E. coli
gatgacatgctgattggcgacggca

SEQ ID NO: 135355 - DNA, 25 bp, E. coli
caatgtgacaagttatggcagtgct

SEQ ID NO: 135356 - DNA, 25 bp, E. coli
caatgtgacaagatatggcagtgct

SEQ ID NO: 135357 - DNA, 25 bp, E. coli
cagctattttgttgaggaagggtaa

SEQ ID NO: 135358 - DNA, 25 bp, E. coli
cagctattttgtagaggaagggtaa

SEQ ID NO: 135359 - DNA, 25 bp, E. coli
cagtgctgactgctggcgaagaatt

SEQ ID NO: 135360 - DNA, 25 bp, E. coli
cagtgctgactggtggcgaagaatt

SEQ ID NO: 135361 - DNA, 25 bp, E. coli
aaaaacgggttcagcttcagttgat

SEQ ID NO: 135362 - DNA, 25 bp, E. coli
aaaaacgggttctgcttcagttgat

SEQ ID NO: 135363 - DNA, 25 bp, E. coli
tattcagtatagaagtcggagcggc

SEQ ID NO: 135364 - DNA, 25 bp, E. coli
tattcagtatagtagtcggagcggc

SEQ ID NO: 135365 - DNA, 25 bp, E. coli
tggtgaactgatcgtgcctgaagca

SEQ ID NO: 135366 - DNA, 25 bp, E. coli
tggtgaactgatggtgcctgaagca

SEQ ID NO: 135367 - DNA, 25 bp, E. coli
gcctgaagcaatttggctacttttg

SEQ ID NO: 135368 - DNA, 25 bp, E. coli
gcctgaagcaatatggctacttttg

SEQ ID NO: 135369 - DNA, 25 bp, E. coli
gaattttgacgaatgagtcatgcag

SEQ ID NO: 135370 - DNA, 25 bp, E. coli
gaagtccgaaactggactcactgta

SEQ ID NO: 135371 - DNA, 25 bp, E. coli
gaagtccgaaacaggactcactgta

SEQ ID NO: 135372 - DNA, 25 bp, E. coli
gaattttgacgattgagtcatgcag

SEQ ID NO: 135373 - DNA, 25 bp, E. coli
gattaaatgaggagtgagaagtccg

SEQ ID NO: 135374 - DNA, 25 bp, E. coli
gattaaatgaggtgtgagaagtccg

SEQ ID NO: 135375 - DNA, 25 bp, E. coli
gataacggcgggtgcctgaagcttt

SEQ ID NO: 135376 - DNA, 25 bp, E. coli
gataacggcgggagcctgaagcttt

SEQ ID NO: 135377 - DNA, 25 bp, E. coli
aatgtctgaccggtgacgccctgtt

SEQ ID NO: 135378 - DNA, 25 bp, E. coli
aatgtctgaccgctgacgccctgtt

SEQ ID NO: 135379 - DNA, 25 bp, E. coli
caaattgccgagcaaggccgtggta

SEQ ID NO: 135380 - DNA, 25 bp, E. coli
caaattgccgaggaaggccgtggta

SEQ ID NO: 135381 - DNA, 25 bp, E. coli
tacgcactgcaggatcaaggttacg

SEQ ID NO: 135382 - DNA, 25 bp, E. coli
aactccttggcgacaatgaagtccg

SEQ ID NO: 135383 - DNA, 25 bp, E. coli
aactccttggcgtcaatgaagtccg

SEQ ID NO: 135384 - DNA, 25 bp, E. coli
tagtctatggcgatatttccgggca

SEQ ID NO: 135385 - DNA, 25 bp, E. coli
tacgcactgcagcatcaaggttacg

SEQ ID NO: 135386 - DNA, 25 bp, E. coli
tagtctatggcgttatttccgggca

SEQ ID NO: 135387 - DNA, 25 bp, E. coli
ttgaagaactgggaaccggacacga

SEQ ID NO: 135388 - DNA, 25 bp, E. coli
ttgaagaactggcaaccggacacga

SEQ ID NO: 135389 - DNA, 25 bp, E. coli
ttggtctgctgaataaaatccgcgc

SEQ ID NO: 135390 - DNA, 25 bp, E. coli
ttggtctgctgattaaaatccgcgc

SEQ ID NO: 135391 - DNA, 25 bp, E. coli
tgctgtatcaccgtcaggaaggtcg

SEQ ID NO: 135392 - DNA, 25 bp, E. coli
tgctgtatcaccctcaggaaggtcg

SEQ ID NO: 135393 - DNA, 25 bp, E. coli
gcttgcgctgcgattgtggcttcca

SEQ ID NO: 135394 - DNA, 25 bp, E. coli
gcttgcgctgcgtttgtggcttcca

SEQ ID NO: 135395 - DNA, 25 bp, E. coli
gtacttgcgcgcgtccattccgaat

SEQ ID NO: 135396 - DNA, 25 bp, E. coli
gtacttgcgcgcctccattccgaat

SEQ ID NO: 135397 - DNA, 25 bp, E. coli
gatgagcgcgacatcactctttgcg

SEQ ID NO: 135398 - DNA, 25 bp, E. coli
gatgagcgcgacttcactctttgcg

SEQ ID NO: 135399 - DNA, 25 bp, E. coli
catttgccgaggtagcgatggtcca

SEQ ID NO: 135400 - DNA, 25 bp, E. coli
catttgccgaggaagcgatggtcca

SEQ ID NO: 135401 - DNA, 25 bp, E. coli
tacagcaaagagcaggtgatcaccg

SEQ ID NO: 135402 - DNA, 25 bp, E. coli
tacagcaaagaggaggtgatcaccg

SEQ ID NO: 135403 - DNA, 25 bp, E. coli
ttttatgtgacctcggcggactccg

SEQ ID NO: 135404 - DNA, 25 bp, E. coli
ttttatgtgaccacggcggactccg

SEQ ID NO: 135405 - DNA, 25 bp, E. coli
ttaaagatatcaacagcgacgcccc

SEQ ID NO: 135406 - DNA, 25 bp, E. coli
ttaaagatatcatcagcgacgcccc

SEQ ID NO: 135407 - DNA, 25 bp, E. coli
tgtatgaaatcatccacggcggcgc

SEQ ID NO: 135408 - DNA, 25 bp, E. coli
tgtatgaaatcaaccacggcggcgc

SEQ ID NO: 135409 - DNA, 25 bp, E. coli
gaaaaaacgtctgtcgcgcctgatg

SEQ ID NO: 135410 - DNA, 25 bp, E. coli
gaaaaaacgtctctcgcgcctgatg

SEQ ID NO: 135411 - DNA, 25 bp, E. coli
cgcacgctggacagggtttctaaaa

SEQ ID NO: 135412 - DNA, 25 bp, E. coli
cgcacgctggactgggtttctaaaa

SEQ ID NO: 135413 - DNA, 25 bp, E. coli
gattaccgccgtcaaagtgccaacc

SEQ ID NO: 135414 - DNA, 25 bp, E. coli
taactggacgctgttcttctgggca

SEQ ID NO: 135415 - DNA, 25 bp, E. coli
taaccggctggtggatgtatgcgct

SEQ ID NO: 135416 - DNA, 25 bp, E. coli
taactggacgctcttcttctgggca

SEQ ID NO: 135417 - DNA, 25 bp, E. coli
taaccggctggtcgatgtatgcgct

SEQ ID NO: 135418 - DNA, 25 bp, E. coli
taacgggccgataggtcactcagtg

SEQ ID NO: 135419 - DNA, 25 bp, E. coli
taacgggccgattggtcactcagtg

SEQ ID NO: 135420 - DNA, 25 bp, E. coli
gattaccgccgtgaaagtgccaacc

SEQ ID NO: 135421 - DNA, 25 bp, E. coli
aaatcaaaggcggaggtcgcacgcc

SEQ ID NO: 135422 - DNA, 25 bp, E. coli
aaagtgggtaagtatctgaaagctc

SEQ ID NO: 135423 - DNA, 25 bp, E. coli
aaatcaaaggcgcaggtcgcacgcc

SEQ ID NO: 135424 - DNA, 25 bp, E. coli
aaagtgggtaagaatctgaaagctc

SEQ ID NO: 135425 - DNA, 25 bp, E. coli
tcgcatcgggatgcgtcaaatcaaa

SEQ ID NO: 135426 - DNA, 25 bp, E. coli
tcgcatcgggatccgtcaaatcaaa

SEQ ID NO: 135427 - DNA, 25 bp, E. coli
gcctacatagcagcgatggaaatga

SEQ ID NO: 135428 - DNA, 25 bp, E. coli
gcctacatagcaccgatggaaatga

SEQ ID NO: 135429 - DNA, 25 bp, E. coli
gcagcctctgatgaaataagagcga

SEQ ID NO: 135430 - DNA, 25 bp, E. coli
gcagcctctgatcaaataagagcga

SEQ ID NO: 135431 - DNA, 25 bp, E. coli
gaaccagattggcttgaccacgatg

SEQ ID NO: 135432 - DNA, 25 bp, E. coli
gaaagctcttgattctgaacggaaa

SEQ ID NO: 135433 - DNA, 25 bp, E. coli
gaaagctcttgaatctgaacggaaa

SEQ ID NO: 135434 - DNA, 25 bp, E. coli
gaaccagattgggttgaccacgatg

SEQ ID NO: 135435 - DNA, 25 bp, E. coli
gattgtagctttgctgttatctgga

SEQ ID NO: 135436 - DNA, 25 bp, E. coli
gattgtagctttcctgttatctgga

SEQ ID NO: 135437 - DNA, 25 bp, E. coli
tggaaatgctactgaaccagattgg

SEQ ID NO: 135438 - DNA, 25 bp, E. coli
tggaaatgctacagaaccagattgg

SEQ ID NO: 135439 - DNA, 25 bp, E. coli
gaggtcgcacgcgactttaaagtcc

SEQ ID NO: 135440 - DNA, 25 bp, E. coli
gaccacgatgttggcgcctacatag

SEQ ID NO: 135441 - DNA, 25 bp, E. coli
gaggtcgcacgccactttaaagtcc

SEQ ID NO: 135442 - DNA, 25 bp, E. coli
gaccacgatgttcgcgcctacatag

SEQ ID NO: 135443 - DNA, 25 bp, E. coli
caggttgatctcgttcaggccggca

SEQ ID NO: 135444 - DNA, 25 bp, E. coli
caggttgatctccttcaggccggca

SEQ ID NO: 135445 - DNA, 25 bp, E. coli
taaactgcgatagggaaaccggtcg

SEQ ID NO: 135446 - DNA, 25 bp, E. coli
taaactgcgatacggaaaccggtcg

SEQ ID NO: 135447 - DNA, 25 bp, E. coli
ttttggacatcttcacagccaggcg

SEQ ID NO: 135448 - DNA, 25 bp, E. coli
ttttggacatctacacagccaggcg

SEQ ID NO: 135449 - DNA, 25 bp, E. coli
tgtaagccgggtccatcagattctg

SEQ ID NO: 135450 - DNA, 25 bp, E. coli
tgtaagccgggtgcatcagattctg

SEQ ID NO: 135451 - DNA, 25 bp, E. coli
tgttcaggacttcatcacatgcggc

SEQ ID NO: 135452 - DNA, 25 bp, E. coli
tgttcaggacttgatcacatgcggc

SEQ ID NO: 135453 - DNA, 25 bp, E. coli
tgaaccataacaaaagcgccgcagt

SEQ ID NO: 135454 - DNA, 25 bp, E. coli
tgaaccataacataagcgccgcagt

SEQ ID NO: 135455 - DNA, 25 bp, E. coli
tagtaggcatcacctggaacttccc

SEQ ID NO: 135456 - DNA, 25 bp, E. coli
tagtaggcatcagctggaacttccc

SEQ ID NO: 135457 - DNA, 25 bp, E. coli
ccagcagcagttgagcggtacgttg

SEQ ID NO: 135458 - DNA, 25 bp, E. coli
ccagcagcagttcagcggtacgttg

SEQ ID NO: 135459 - DNA, 25 bp, E. coli
gaagttttcaatcgctctcagagtg

SEQ ID NO: 135460 - DNA, 25 bp, E. coli
gaagttttcaatggctctcagagtg

SEQ ID NO: 135461 - DNA, 25 bp, E. coli
cgtgttcagacctgtaccgattgct

SEQ ID NO: 135462 - DNA, 25 bp, E. coli
cgtgttcagaccagtaccgattgct

SEQ ID NO: 135463 - DNA, 25 bp, E. coli
ggtcttcagccgctacgcatgggaa

SEQ ID NO: 135464 - DNA, 25 bp, E. coli
ggtcttcagccggtacgcatgggaa

SEQ ID NO: 135465 - DNA, 25 bp, E. coli
aatttcggccaagggcgatcagggc

SEQ ID NO: 135466 - DNA, 25 bp, E. coli
aatttcggccaacggcgatcagggc

SEQ ID NO: 135467 - DNA, 25 bp, E. coli
caccaaaagggagtgaggctgccat

SEQ ID NO: 135468 - DNA, 25 bp, E. coli
caaatattggcgctgagtcatcgtc

SEQ ID NO: 135469 - DNA, 25 bp, E. coli
caaatattggcggtgagtcatcgtc

SEQ ID NO: 135470 - DNA, 25 bp, E. coli
caccaaaagggactgaggctgccat

SEQ ID NO: 135471 - DNA, 25 bp, E. coli
cagggcgcggcgacatcattatgga

SEQ ID NO: 135472 - DNA, 25 bp, E. coli
cagggcgcggcgtcatcattatgga

SEQ ID NO: 135473 - DNA, 25 bp, E. coli
tacctgggctgggtgtcgtactact

SEQ ID NO: 135474 - DNA, 25 bp, E. coli
tacctgggctggctgtcgtactact

SEQ ID NO: 135475 - DNA, 25 bp, E. coli
ttgggaaatccagcaatgcgcaggc

SEQ ID NO: 135476 - DNA, 25 bp, E. coli
ttgggaaatccaccaatgcgcaggc

SEQ ID NO: 135477 - DNA, 25 bp, E. coli
tcagggaaagattgcggcgaacagt

SEQ ID NO: 135478 - DNA, 25 bp, E. coli
tcagggaaagatagcggcgaacagt

SEQ ID NO: 135479 - DNA, 25 bp, E. coli
gatatcgccttgatccagctcagaa

SEQ ID NO: 135480 - DNA, 25 bp, E. coli
gatatcgccttgttccagctcagaa

SEQ ID NO: 135481 - DNA, 25 bp, E. coli
ggatatcttgtgatacgagcacgga

SEQ ID NO: 135482 - DNA, 25 bp, E. coli
ggatatcttgtgttacgagcacgga

SEQ ID NO: 135483 - DNA, 25 bp, E. coli
gagtctttaggttaaaccagcgaca

SEQ ID NO: 135484 - DNA, 25 bp, E. coli
gaggcacacctgattttactggaga

SEQ ID NO: 135485 - DNA, 25 bp, E. coli
gagtctttaggtaaaaccagcgaca

SEQ ID NO: 135486 - DNA, 25 bp, E. coli
gaggcacacctgtttttactggaga

SEQ ID NO: 135487 - DNA, 25 bp, E. coli
aactgtgttctgtctcttgggtgca

SEQ ID NO: 135488 - DNA, 25 bp, E. coli
caaagtgcgtaagtggatgactccc

SEQ ID NO: 135489 - DNA, 25 bp, E. coli
cagtttgggcagcaacatttaacga

SEQ ID NO: 135490 - DNA, 25 bp, E. coli
cagtttgggcaggaacatttaacga

SEQ ID NO: 135491 - DNA, 25 bp, E. coli
caaagtgcgtaactggatgactccc

SEQ ID NO: 135492 - DNA, 25 bp, E. coli
catgaatagtttaacagcagaagct

SEQ ID NO: 135493 - DNA, 25 bp, E. coli
catgaatagttttacagcagaagct

SEQ ID NO: 135494 - DNA, 25 bp, E. coli
tacgataacgaacaaggctgatgcc

SEQ ID NO: 135495 - DNA, 25 bp, E. coli
tacgataacgaagaaggctgatgcc

SEQ ID NO: 135496 - DNA, 25 bp, E. coli
aactgtgttctgactcttgggtgca

SEQ ID NO: 135497 - DNA, 25 bp, E. coli
tataaatggccgaatacagtacact

SEQ ID NO: 135498 - DNA, 25 bp, E. coli
tataaatggccgtatacagtacact

SEQ ID NO: 135499 - DNA, 25 bp, E. coli
tgatgcctgagttgagatacggaca

SEQ ID NO: 135500 - DNA, 25 bp, E. coli
tgatgcctgagtagagatacggaca

SEQ ID NO: 135501 - DNA, 25 bp, E. coli
tgctggcatggcaaaacaaagtgcg

SEQ ID NO: 135502 - DNA, 25 bp, E. coli
tgagggcagatctaaagggcacctt

SEQ ID NO: 135503 - DNA, 25 bp, E. coli
tgagggcagatcaaaagggcacctt

SEQ ID NO: 135504 - DNA, 25 bp, E. coli
tgctggcatggctaaacaaagtgcg

SEQ ID NO: 135505 - DNA, 25 bp, E. coli
ccattgtggtgaagtgcaggtttgc

SEQ ID NO: 135506 - DNA, 25 bp, E. coli
ccattgtggtgatgtgcaggtttgc

SEQ ID NO: 135507 - DNA, 25 bp, E. coli
gaatactttgttccaatgagggcag

SEQ ID NO: 135508 - DNA, 25 bp, E. coli
gaatactttgttgcaatgagggcag

SEQ ID NO: 135509 - DNA, 25 bp, E. coli
aactgtattgcatgcactgaaagcg

SEQ ID NO: 135510 - DNA, 25 bp, E. coli
aactgtattgcaagcactgaaagcg

SEQ ID NO: 135511 - DNA, 25 bp, E. coli
tatcagccgtgaagaagttcttaac

SEQ ID NO: 135512 - DNA, 25 bp, E. coli
tatcagccgtgatgaagttcttaac

SEQ ID NO: 135513 - DNA, 25 bp, E. coli
tgatatcagccgagaagaagttctt

SEQ ID NO: 135514 - DNA, 25 bp, E. coli
tgtattgcatgcactgaaagcgatg

SEQ ID NO: 135515 - DNA, 25 bp, E. coli
tgatatcagccgtgaagaagttctt

SEQ ID NO: 135516 - DNA, 25 bp, E. coli
tgtattgcatgctctgaaagcgatg

SEQ ID NO: 135517 - DNA, 25 bp, E. coli
tgaactggcggcgcggcttgatatc

SEQ ID NO: 135518 - DNA, 25 bp, E. coli
tgaactggcggcccggcttgatatc

SEQ ID NO: 135519 - DNA, 25 bp, E. coli
gaagaagttctttacgaactgtggg

SEQ ID NO: 135520 - DNA, 25 bp, E. coli
gaagaagttcttaacgaactgtggg

SEQ ID NO: 135521 - DNA, 25 bp, E. coli
tcttaacgaactgtgggaactcaaa

SEQ ID NO: 135522 - DNA, 25 bp, E. coli
tcttaacgaactctgggaactcaaa

SEQ ID NO: 135523 - DNA, 25 bp, E. coli
ggaaaagccaattctgttgaactgg

SEQ ID NO: 135524 - DNA, 25 bp, E. coli
tggaaactgtatagcatgcactgaa

SEQ ID NO: 135525 - DNA, 25 bp, E. coli
ggcgcggcttgatatcagccgtgaa

SEQ ID NO: 135526 - DNA, 25 bp, E. coli
ggaaaagccaatactgttgaactgg

SEQ ID NO: 135527 - DNA, 25 bp, E. coli
tggaaactgtattgcatgcactgaa

SEQ ID NO: 135528 - DNA, 25 bp, E. coli
ggcgcggcttgaaatcagccgtgaa

SEQ ID NO: 135529 - DNA, 25 bp, E. coli
gatgggaaaagcgaattctgttgaa

SEQ ID NO: 135530 - DNA, 25 bp, E. coli
gatgggaaaagccaattctgttgaa

SEQ ID NO: 135531 - DNA, 25 bp, E. coli
attgccgatctccacgcggtacgcg

SEQ ID NO: 135532 - DNA, 25 bp, E. coli
attgccgatctcgacgcggtacgcg

SEQ ID NO: 135533 - DNA, 25 bp, E. coli
tttcggcgcggagtggcgaaggcgt

SEQ ID NO: 135534 - DNA, 25 bp, E. coli
tttcggcgcggactggcgaaggcgt

SEQ ID NO: 135535 - DNA, 25 bp, E. coli
tcatgcgttaattcgtctttcggcg

SEQ ID NO: 135536 - DNA, 25 bp, E. coli
tcatgcgttaatacgtctttcggcg

SEQ ID NO: 135537 - DNA, 25 bp, E. coli
cgccgaagctcgacagggtagtttg

SEQ ID NO: 135538 - DNA, 25 bp, E. coli
cgccgaagctcgtcagggtagtttg

SEQ ID NO: 135539 - DNA, 25 bp, E. coli
gcgttaattcgtgtttcggcgcgga

SEQ ID NO: 135540 - DNA, 25 bp, E. coli
cgtaattgccgaactcgacgcggta

SEQ ID NO: 135541 - DNA, 25 bp, E. coli
cgtaattgccgatctcgacgcggta

SEQ ID NO: 135542 - DNA, 25 bp, E. coli
gcgttaattcgtctttcggcgcgga

SEQ ID NO: 135543 - DNA, 25 bp, E. coli
gattgcggacctaatcgacgccagc

SEQ ID NO: 135544 - DNA, 25 bp, E. coli
gtacgcgccgaacctcgtcagggta

SEQ ID NO: 135545 - DNA, 25 bp, E. coli
gtacgcgccgaagctcgtcagggta

SEQ ID NO: 135546 - DNA, 25 bp, E. coli
gatctcgacgcgctacgcgccgaag

SEQ ID NO: 135547 - DNA, 25 bp, E. coli
gattgcggaccttatcgacgccagc

SEQ ID NO: 135548 - DNA, 25 bp, E. coli
ggaccttatcgaggccagctcggaa

SEQ ID NO: 135549 - DNA, 25 bp, E. coli
ggaccttatcgacgccagctcggaa

SEQ ID NO: 135550 - DNA, 25 bp, E. coli
taattcgtctttcggcgcggactgg

SEQ ID NO: 135551 - DNA, 25 bp, E. coli
taattcgtctttgggcgcggactgg

SEQ ID NO: 135552 - DNA, 25 bp, E. coli
gatctcgacgcggtacgcgccgaag

SEQ ID NO: 135553 - DNA, 25 bp, E. coli
aagccgtcgttgacgttgcatcagc

SEQ ID NO: 135554 - DNA, 25 bp, E. coli
aagccgtcgttgtcgttgcatcagc

SEQ ID NO: 135555 - DNA, 25 bp, E. coli
agccgtcgttgaggttgcatcagcg

SEQ ID NO: 135556 - DNA, 25 bp, E. coli
agccgtcgttgacgttgcatcagcg

SEQ ID NO: 135557 - DNA, 25 bp, E. coli
tgataagcccgtcgtcgcaaagcac

SEQ ID NO: 135558 - DNA, 25 bp, E. coli
tgataagcccgtggtcgcaaagcac

SEQ ID NO: 135559 - DNA, 25 bp, E. coli
tgccgagaagccctcgttgacgttg

SEQ ID NO: 135560 - DNA, 25 bp, E. coli
tgccgagaagccgtcgttgacgttg

SEQ ID NO: 135561 - DNA, 25 bp, E. coli
gaagccgtcgttgacgttgcatcag

SEQ ID NO: 135562 - DNA, 25 bp, E. coli
gaagccgtcgttcacgttgcatcag

SEQ ID NO: 135563 - DNA, 25 bp, E. coli
gagaagccgtcgatgacgttgcatc

SEQ ID NO: 135564 - DNA, 25 bp, E. coli
gagaagccgtcgttgacgttgcatc

SEQ ID NO: 135565 - DNA, 25 bp, E. coli
ccgtcgttgacgttgcatcagcgga

SEQ ID NO: 135566 - DNA, 25 bp, E. coli
cgagaagccgtccttgacgttgcat

SEQ ID NO: 135567 - DNA, 25 bp, E. coli
ccgagaagccgtcgttgacgttgca

SEQ ID NO: 135568 - DNA, 25 bp, E. coli
cgagaagccgtcgttgacgttgcat

SEQ ID NO: 135569 - DNA, 25 bp, E. coli
ccgtcgttgacgatgcatcagcgga

SEQ ID NO: 135570 - DNA, 25 bp, E. coli
ccgagaagccgtggttgacgttgca

SEQ ID NO: 135571 - DNA, 25 bp, E. coli
cgtcgttgacgtagcatcagcggat

SEQ ID NO: 135572 - DNA, 25 bp, E. coli
cgtcgttgacgttgcatcagcggat

SEQ ID NO: 135573 - DNA, 25 bp, E. coli
gataagcccgtgctcgcaaagcaca

SEQ ID NO: 135574 - DNA, 25 bp, E. coli
gataagcccgtggtcgcaaagcaca

SEQ ID NO: 135575 - DNA, 25 bp, E. coli
aagacagccagagcgcataacacgg

SEQ ID NO: 135576 - DNA, 25 bp, E. coli
aagacagccagaccgcataacacgg

SEQ ID NO: 135577 - DNA, 25 bp, E. coli
cacaagagatatccaggacactggt

SEQ ID NO: 135578 - DNA, 25 bp, E. coli
cacaagagatatgcaggacactggt

SEQ ID NO: 135579 - DNA, 25 bp, E. coli
caaaaaatccctagatgcctgtccc

SEQ ID NO: 135580 - DNA, 25 bp, E. coli
caaaaaatcccttgatgcctgtccc

SEQ ID NO: 135581 - DNA, 25 bp, E. coli
tacactccgttatcacgcacaagag

SEQ ID NO: 135582 - DNA, 25 bp, E. coli
tacactccgttaacacgcacaagag

SEQ ID NO: 135583 - DNA, 25 bp, E. coli
tatgttgttgctacgttgggcagca

SEQ ID NO: 135584 - DNA, 25 bp, E. coli
tatgttgttgcttcgttgggcagca

SEQ ID NO: 135585 - DNA, 25 bp, E. coli
tgctactggcaaactgtggcgctat

SEQ ID NO: 135586 - DNA, 25 bp, E. coli
tgagcagtgacaaacgaagacagcc

SEQ ID NO: 135587 - DNA, 25 bp, E. coli
tgagcagtgacatacgaagacagcc

SEQ ID NO: 135588 - DNA, 25 bp, E. coli
tgctactggcaatctgtggcgctat

SEQ ID NO: 135589 - DNA, 25 bp, E. coli
gccacccgacggctgtaataacaaa

SEQ ID NO: 135590 - DNA, 25 bp, E. coli
gccacccgacgggtgtaataacaaa

SEQ ID NO: 135591 - DNA, 25 bp, E. coli
gcataacacggtccggcagataatt

SEQ ID NO: 135592 - DNA, 25 bp, E. coli
gcataacacggtgcggcagataatt

SEQ ID NO: 135593 - DNA, 25 bp, E. coli
gaaacagtgaccatgtgcacaacgc

SEQ ID NO: 135594 - DNA, 25 bp, E. coli
gaaacagtgaccttgtgcacaacgc

SEQ ID NO: 135595 - DNA, 25 bp, E. coli
ggacactggtatgccgactaaacgc

SEQ ID NO: 135596 - DNA, 25 bp, E. coli
ggacactggtatcccgactaaacgc

SEQ ID NO: 135597 - DNA, 25 bp, E. coli
cactaatggttctaaatactggcgc

SEQ ID NO: 135598 - DNA, 25 bp, E. coli
cactaatggttcaaaatactggcgc

SEQ ID NO: 135599 - DNA, 25 bp, E. coli
tacattgattcagtctccagccggg

SEQ ID NO: 135600 - DNA, 25 bp, E. coli
taaaatggaaaatcgtggagctctg

SEQ ID NO: 135601 - DNA, 25 bp, E. coli
taaaatggaaaaacgtggagctctg

SEQ ID NO: 135602 - DNA, 25 bp, E. coli
tacattgattcactctccagccggg

SEQ ID NO: 135603 - DNA, 25 bp, E. coli
tgatccccgcaatccaattagtaag

SEQ ID NO: 135604 - DNA, 25 bp, E. coli
tgatccccgcaaaccaattagtaag

SEQ ID NO: 135605 - DNA, 25 bp, E. coli
tgcaattgttactggccgggcagac

SEQ ID NO: 135606 - DNA, 25 bp, E. coli
tgagtctgcaaattacgttcgaggc

SEQ ID NO: 135607 - DNA, 25 bp, E. coli
tgcaattgttacaggccgggcagac

SEQ ID NO: 135608 - DNA, 25 bp, E. coli
tgagtctgcaaaatacgttcgaggc

SEQ ID NO: 135609 - DNA, 25 bp, E. coli
tctttatcggtacaaatgatccccg

SEQ ID NO: 135610 - DNA, 25 bp, E. coli
tctttatcggtagaaatgatccccg

SEQ ID NO: 135611 - DNA, 25 bp, E. coli
gctattgctcgccaatggcaccagt

SEQ ID NO: 135612 - DNA, 25 bp, E. coli
gctattgctcgcgaatggcaccagt

SEQ ID NO: 135613 - DNA, 25 bp, E. coli
tggcaccagtcataagccgatcggt

SEQ ID NO: 135614 - DNA, 25 bp, E. coli
tggcaccagtcaaaagccgatcggt

SEQ ID NO: 135615 - DNA, 25 bp, E. coli
taaccggcgtaccaacacaagaact

SEQ ID NO: 135616 - DNA, 25 bp, E. coli
taaccggcgtacgaacacaagaact

SEQ ID NO: 135617 - DNA, 25 bp, E. coli
gatgtaacgctacccgatgctcgcg

SEQ ID NO: 135618 - DNA, 25 bp, E. coli
gatgtaacgctagccgatgctcgcg

SEQ ID NO: 135619 - DNA, 25 bp, E. coli
catcgtcacagaggaaaaggtcaac

SEQ ID NO: 135620 - DNA, 25 bp, E. coli
catcgtcacagacgaaaaggtcaac

SEQ ID NO: 135621 - DNA, 25 bp, E. coli
taaaggccaggttctacatcagcag

SEQ ID NO: 135622 - DNA, 25 bp, E. coli
taacattgccgtgagattgccggag

SEQ ID NO: 135623 - DNA, 25 bp, E. coli
taaaaagacgatgccctgcagttca

SEQ ID NO: 135624 - DNA, 25 bp, E. coli
taaaggccaggtactacatcagcag

SEQ ID NO: 135625 - DNA, 25 bp, E. coli
taaaaagacgatcccctgcagttca

SEQ ID NO: 135626 - DNA, 25 bp, E. coli
aaattcgcggctcacctcatcgagg

SEQ ID NO: 135627 - DNA, 25 bp, E. coli
aaattcgcggctgacctcatcgagg

SEQ ID NO: 135628 - DNA, 25 bp, E. coli
tagggatcaagatcatacggctggc

SEQ ID NO: 135629 - DNA, 25 bp, E. coli
tagggatcaagaacatacggctggc

SEQ ID NO: 135630 - DNA, 25 bp, E. coli
ttcgttcaggtataaagcaccggca

SEQ ID NO: 135631 - DNA, 25 bp, E. coli
ttcgttcaggtaaaaagcaccggca

SEQ ID NO: 135632 - DNA, 25 bp, E. coli
gaagtgttttcaaccctgcgcgaac

SEQ ID NO: 135633 - DNA, 25 bp, E. coli
gaagtgttttcatccctgcgcgaac

SEQ ID NO: 135634 - DNA, 25 bp, E. coli
gacgaaattcttcatggcagccaac

SEQ ID NO: 135635 - DNA, 25 bp, E. coli
gacgaaattcttgatggcagccaac

SEQ ID NO: 135636 - DNA, 25 bp, E. coli
cgttcgccgcgaaccagaaggtgat

SEQ ID NO: 135637 - DNA, 25 bp, E. coli
cgttcgccgcgatccagaaggtgat

SEQ ID NO: 135638 - DNA, 25 bp, E. coli
gataagccaggtggacaggaactca

SEQ ID NO: 135639 - DNA, 25 bp, E. coli
gataagccaggtcgacaggaactca

SEQ ID NO: 135640 - DNA, 25 bp, E. coli
taacattgccgtcagattgccggag

SEQ ID NO: 135641 - DNA, 25 bp, E. coli
aatgatttcggcattctaaatgcaa

SEQ ID NO: 135642 - DNA, 25 bp, E. coli
aatgatttcggctttctaaatgcaa

SEQ ID NO: 135643 - DNA, 25 bp, E. coli
taaatgcaattataatcaggttgcc

SEQ ID NO: 135644 - DNA, 25 bp, E. coli
taaatgcaattaaaatcaggttgcc

SEQ ID NO: 135645 - DNA, 25 bp, E. coli
aaagttgccgcaatgtaaacacatt

SEQ ID NO: 135646 - DNA, 25 bp, E. coli
aaagttgccgcattgtaaacacatt

SEQ ID NO: 135647 - DNA, 25 bp, E. coli
tatctcttggaaacaaatttctcac

SEQ ID NO: 135648 - DNA, 25 bp, E. coli
tatctcttggaatcaaatttctcac

SEQ ID NO: 135649 - DNA, 25 bp, E. coli
tttctcacatcataaaagttgccgc

SEQ ID NO: 135650 - DNA, 25 bp, E. coli
tatttttggttgttaagagtctgta

SEQ ID NO: 135651 - DNA, 25 bp, E. coli
tatcaataaaaatgccgaaatcatt

SEQ ID NO: 135652 - DNA, 25 bp, E. coli
tatcaataaaaaagccgaaatcatt

SEQ ID NO: 135653 - DNA, 25 bp, E. coli
tatttttggttgataagagtctgta

SEQ ID NO: 135654 - DNA, 25 bp, E. coli
tatcgcatctatgaattaatgtaga

SEQ ID NO: 135655 - DNA, 25 bp, E. coli
tatcgcatctatcaattaatgtaga

SEQ ID NO: 135656 - DNA, 25 bp, E. coli
tttctcacatcaaaaaagttgccgc

SEQ ID NO: 135657 - DNA, 25 bp, E. coli
gatttaaaacaaattaaccattgca

SEQ ID NO: 135658 - DNA, 25 bp, E. coli
gatttaaaacaatttaaccattgca

SEQ ID NO: 135659 - DNA, 25 bp, E. coli
taagagtctgtatctcttggaaaca

SEQ ID NO: 135660 - DNA, 25 bp, E. coli
taagagtctgtaactcttggaaaca

SEQ ID NO: 135661 - DNA, 25 bp, E. coli
gagtattaactatttatcgcatcta

SEQ ID NO: 135662 - DNA, 25 bp, E. coli
gagtattaactaattatcgcatcta

SEQ ID NO: 135663 - DNA, 25 bp, E. coli
aatgtggaccatccctcttgattgg

SEQ ID NO: 135664 - DNA, 25 bp, E. coli
aatgtggaccatgcctcttgattgg

SEQ ID NO: 135665 - DNA, 25 bp, E. coli
attgcagtaagcagagggttggact

SEQ ID NO: 135666 - DNA, 25 bp, E. coli
attgcagtaagctgagggttggact

SEQ ID NO: 135667 - DNA, 25 bp, E. coli
agaccgctaaccgactgtacgacag

SEQ ID NO: 135668 - DNA, 25 bp, E. coli
agaccgctaacccactgtacgacag

SEQ ID NO: 135669 - DNA, 25 bp, E. coli
aaaatagacagcaacaccggcagac

SEQ ID NO: 135670 - DNA, 25 bp, E. coli
aaaatagacagctacaccggcagac

SEQ ID NO: 135671 - DNA, 25 bp, E. coli
ttcccgacaattggtactcgcaaca

SEQ ID NO: 135672 - DNA, 25 bp, E. coli
ttcccgacaattcgtactcgcaaca

SEQ ID NO: 135673 - DNA, 25 bp, E. coli
tgtacgacagaagtcactctgctta

SEQ ID NO: 135674 - DNA, 25 bp, E. coli
tgtacgacagaactcactctgctta

SEQ ID NO: 135675 - DNA, 25 bp, E. coli
gcgtatccctgacttgcttgacaaa

SEQ ID NO: 135676 - DNA, 25 bp, E. coli
gcgtatccctgagttgcttgacaaa

SEQ ID NO: 135677 - DNA, 25 bp, E. coli
cccggatgtttctctggcggatgcg

SEQ ID NO: 135678 - DNA, 25 bp, E. coli
cccggatgtttcactggcggatgcg

SEQ ID NO: 135679 - DNA, 25 bp, E. coli
cattgctgaacttggcacccgtgat

SEQ ID NO: 135680 - DNA, 25 bp, E. coli
cattgctgaactaggcacccgtgat

SEQ ID NO: 135681 - DNA, 25 bp, E. coli
gtccagtaagctccattttgctcgc

SEQ ID NO: 135682 - DNA, 25 bp, E. coli
gtccagtaagctgcattttgctcgc

SEQ ID NO: 135683 - DNA, 25 bp, E. coli
tcactggcggatgcgcggaagaaaa

SEQ ID NO: 135684 - DNA, 25 bp, E. coli
tcactggcggatccgcggaagaaaa

SEQ ID NO: 135685 - DNA, 25 bp, E. coli
aagaagctacagatctgttgctgaa

SEQ ID NO: 135686 - DNA, 25 bp, E. coli
cagccctggtttatctccgttaaag

SEQ ID NO: 135687 - DNA, 25 bp, E. coli
cagccctggtttttctccgttaaag

SEQ ID NO: 135688 - DNA, 25 bp, E. coli
aagaagctacagttctgttgctgaa

SEQ ID NO: 135689 - DNA, 25 bp, E. coli
cagagcaaaaagaagctacagatct

SEQ ID NO: 135690 - DNA, 25 bp, E. coli
caaaaagaagctacagatctgttgc

SEQ ID NO: 135691 - DNA, 25 bp, E. coli
caaaaagaagcttcagatctgttgc

SEQ ID NO: 135692 - DNA, 25 bp, E. coli
cagagcaaaaagtagctacagatct

SEQ ID NO: 135693 - DNA, 25 bp, E. coli
agagcaaaaagaagctacagatctg

SEQ ID NO: 135694 - DNA, 25 bp, E. coli
agagcaaaaagatgctacagatctg

SEQ ID NO: 135695 - DNA, 25 bp, E. coli
aaaagaagctacagatctgttgctg

SEQ ID NO: 135696 - DNA, 25 bp, E. coli
aaagaagctacagatctgttgctga

SEQ ID NO: 135697 - DNA, 25 bp, E. coli
aaagaagctacacatctgttgctga

SEQ ID NO: 135698 - DNA, 25 bp, E. coli
aaaagaagctactgatctgttgctg

SEQ ID NO: 135699 - DNA, 25 bp, E. coli
gcaaaaagaagctacagatctgttg

SEQ ID NO: 135700 - DNA, 25 bp, E. coli
gcaaaaagaagcaacagatctgttg

SEQ ID NO: 135701 - DNA, 25 bp, E. coli
cgttcgcgaccgccgatggcaatat

SEQ ID NO: 135702 - DNA, 25 bp, E. coli
cgttcgcgaccggcgatggcaatat

SEQ ID NO: 135703 - DNA, 25 bp, E. coli
ggatgcgttcgcgaccggcgatggc

SEQ ID NO: 135704 - DNA, 25 bp, E. coli
ggatgcgttcgccaccggcgatggc

SEQ ID NO: 135705 - DNA, 25 bp, E. coli
gagcaaaaagaagctacagatctgt

SEQ ID NO: 135706 - DNA, 25 bp, E. coli
gagcaaaaagaacctacagatctgt

SEQ ID NO: 135707 - DNA, 25 bp, E. coli
taacttgcgcgatacaatggacgat

SEQ ID NO: 135708 - DNA, 25 bp, E. coli
gatccccatggcagtcggtttcgtg

SEQ ID NO: 135709 - DNA, 25 bp, E. coli
gatccccatggctgtcggtttcgtg

SEQ ID NO: 135710 - DNA, 25 bp, E. coli
aaaagctctcgaaaatgtcccgccg

SEQ ID NO: 135711 - DNA, 25 bp, E. coli
aaaagctctcgataatgtcccgccg

SEQ ID NO: 135712 - DNA, 25 bp, E. coli
aaagcagcggctacttgatcgtcga

SEQ ID NO: 135713 - DNA, 25 bp, E. coli
aaagcagcggcttcttgatcgtcga

SEQ ID NO: 135714 - DNA, 25 bp, E. coli
tatcgcagccggtctacatgtacca

SEQ ID NO: 135715 - DNA, 25 bp, E. coli
tatcgcagccggactacatgtacca

SEQ ID NO: 135716 - DNA, 25 bp, E. coli
tgcgaaaggctttacgacgattggc

SEQ ID NO: 135717 - DNA, 25 bp, E. coli
tgcgaaaggcttaacgacgattggc

SEQ ID NO: 135718 - DNA, 25 bp, E. coli
tcttgcgtcattttctcggtggcga

SEQ ID NO: 135719 - DNA, 25 bp, E. coli
tactgcggtggtcgtcgttacgtca

SEQ ID NO: 135720 - DNA, 25 bp, E. coli
tactgcggtggtggtcgttacgtca

SEQ ID NO: 135721 - DNA, 25 bp, E. coli
tcttgcgtcattatctcggtggcga

SEQ ID NO: 135722 - DNA, 25 bp, E. coli
gcatgggtacgcagtttgccaacgt

SEQ ID NO: 135723 - DNA, 25 bp, E. coli
gcatgggtacgctgtttgccaacgt

SEQ ID NO: 135724 - DNA, 25 bp, E. coli
taatgaaatcctgcgcatgctgtcc

SEQ ID NO: 135725 - DNA, 25 bp, E. coli
taacttgcgcgaaacaatggacgat

SEQ ID NO: 135726 - DNA, 25 bp, E. coli
taatgaaatcctccgcatgctgtcc

SEQ ID NO: 135727 - DNA, 25 bp, E. coli
gatgcattttgcgacgacgctagcg

SEQ ID NO: 135728 - DNA, 25 bp, E. coli
gatgcattttgccacgacgctagcg

SEQ ID NO: 135729 - DNA, 25 bp, E. coli
cattcggaaagtattcttctgcgcg

SEQ ID NO: 135730 - DNA, 25 bp, E. coli
cattcggaaagttttcttctgcgcg

SEQ ID NO: 135731 - DNA, 25 bp, E. coli
caggcaggacgtaattgaaacttga

SEQ ID NO: 135732 - DNA, 25 bp, E. coli
caggcaggacgttattgaaacttga

SEQ ID NO: 135733 - DNA, 25 bp, E. coli
taaacattggcttttgactgaatca

SEQ ID NO: 135734 - DNA, 25 bp, E. coli
taaacattggctattgactgaatca

SEQ ID NO: 135735 - DNA, 25 bp, E. coli
tagagttgaataatcaggcaggacg

SEQ ID NO: 135736 - DNA, 25 bp, E. coli
tagagttgaatattcaggcaggacg

SEQ ID NO: 135737 - DNA, 25 bp, E. coli
tatatcgacaaatgcgggttaatgc

SEQ ID NO: 135738 - DNA, 25 bp, E. coli
tatatcgacaaaagcgggttaatgc

SEQ ID NO: 135739 - DNA, 25 bp, E. coli
gcgcgtatcttgattttgcccaaag

SEQ ID NO: 135740 - DNA, 25 bp, E. coli
gcgcgtatcttgtttttgcccaaag

SEQ ID NO: 135741 - DNA, 25 bp, E. coli
gcataattgctcatcaggcagcgga

SEQ ID NO: 135742 - DNA, 25 bp, E. coli
gcataattgctcttcaggcagcgga

SEQ ID NO: 135743 - DNA, 25 bp, E. coli
gcagcggatatcagtcaacctcact

SEQ ID NO: 135744 - DNA, 25 bp, E. coli
gcagcggatatctgtcaacctcact

SEQ ID NO: 135745 - DNA, 25 bp, E. coli
gatcgcatgccgaattcaatggctg

SEQ ID NO: 135746 - DNA, 25 bp, E. coli
tcaatggctgggtataaacattggc

SEQ ID NO: 135747 - DNA, 25 bp, E. coli
tcaatggctgggaataaacattggc

SEQ ID NO: 135748 - DNA, 25 bp, E. coli
gaccccacaccatcgaatacatttt

SEQ ID NO: 135749 - DNA, 25 bp, E. coli
gatcgcatgccgtattcaatggctg

SEQ ID NO: 135750 - DNA, 25 bp, E. coli
gaccccacaccaacgaatacatttt

SEQ ID NO: 135751 - DNA, 25 bp, E. coli
caaccgcgacgctgaatttctgttt

SEQ ID NO: 135752 - DNA, 25 bp, E. coli
caaccgcgacgcagaatttctgttt

SEQ ID NO: 135753 - DNA, 25 bp, E. coli
caccgtctgagcagtatggcgtgca

SEQ ID NO: 135754 - DNA, 25 bp, E. coli
caccgtctgagctgtatggcgtgca

SEQ ID NO: 135755 - DNA, 25 bp, E. coli
aaaaccatacgcgatggtgtgcatc

SEQ ID NO: 135756 - DNA, 25 bp, E. coli
aaaaccatacgccatggtgtgcatc

SEQ ID NO: 135757 - DNA, 25 bp, E. coli
tggtcaccgtctcagcagtatggcg

SEQ ID NO: 135758 - DNA, 25 bp, E. coli
ccagtgctgccacgtcggtattgat

SEQ ID NO: 135759 - DNA, 25 bp, E. coli
ccagtgctgccaggtcggtattgat

SEQ ID NO: 135760 - DNA, 25 bp, E. coli
gacagcaaccgccacgctgaatttc

SEQ ID NO: 135761 - DNA, 25 bp, E. coli
gacagcaaccgcgacgctgaatttc

SEQ ID NO: 135762 - DNA, 25 bp, E. coli
cgatggatgttaaggaagagttgtt

SEQ ID NO: 135763 - DNA, 25 bp, E. coli
cgctgaatttctgtttacctcaatg

SEQ ID NO: 135764 - DNA, 25 bp, E. coli
cgctgaatttctctttacctcaatg

SEQ ID NO: 135765 - DNA, 25 bp, E. coli
cgatggatgttatggaagagttgtt

SEQ ID NO: 135766 - DNA, 25 bp, E. coli
ctggaaaaaccaaacgcgatggtgt

SEQ ID NO: 135767 - DNA, 25 bp, E. coli
cattgccagtgcagccacgtcggta

SEQ ID NO: 135768 - DNA, 25 bp, E. coli
ctggaaaaaccatacgcgatggtgt

SEQ ID NO: 135769 - DNA, 25 bp, E. coli
cattgccagtgctgccacgtcggta

SEQ ID NO: 135770 - DNA, 25 bp, E. coli
ggatcagttctggtcaccgtctgag

SEQ ID NO: 135771 - DNA, 25 bp, E. coli
ggatcagttctgctcaccgtctgag

SEQ ID NO: 135772 - DNA, 25 bp, E. coli
tggtcaccgtctgagcagtatggcg

SEQ ID NO: 135773 - DNA, 25 bp, E. coli
cacgttctttgggatcaatatgacc

SEQ ID NO: 135774 - DNA, 25 bp, E. coli
caaactgcggttcgtcctgatgcgc

SEQ ID NO: 135775 - DNA, 25 bp, E. coli
caaactgcggttggtcctgatgcgc

SEQ ID NO: 135776 - DNA, 25 bp, E. coli
cacgttctttggcatcaatatgacc

SEQ ID NO: 135777 - DNA, 25 bp, E. coli
ggtcgattgccggacgttctttggc

SEQ ID NO: 135778 - DNA, 25 bp, E. coli
ggtcgattgccgcacgttctttggc

SEQ ID NO: 135779 - DNA, 25 bp, E. coli
agtgcattcaggaaactgcgttcca

SEQ ID NO: 135780 - DNA, 25 bp, E. coli
agtgcattcaggtaactgcgttcca

SEQ ID NO: 135781 - DNA, 25 bp, E. coli
tatgaccatcacatttagcggcaaa

SEQ ID NO: 135782 - DNA, 25 bp, E. coli
tacgctcatccaccggcgtactttg

SEQ ID NO: 135783 - DNA, 25 bp, E. coli
tatgaccatcacttttagcggcaaa

SEQ ID NO: 135784 - DNA, 25 bp, E. coli
tacgctcatccagcggcgtactttg

SEQ ID NO: 135785 - DNA, 25 bp, E. coli
tgtatttattccacagcaccgtacc

SEQ ID NO: 135786 - DNA, 25 bp, E. coli
tgtatttattcctcagcaccgtacc

SEQ ID NO: 135787 - DNA, 25 bp, E. coli
gcgccgcgcgaattttatctttgta

SEQ ID NO: 135788 - DNA, 25 bp, E. coli
gctgttcgagatcgcgttcaatgcc

SEQ ID NO: 135789 - DNA, 25 bp, E. coli
gcgccgcgcgaaatttatctttgta

SEQ ID NO: 135790 - DNA, 25 bp, E. coli
gctgttcgagatggcgttcaatgcc

SEQ ID NO: 135791 - DNA, 25 bp, E. coli
gaaatagatttccagcgcctcttct

SEQ ID NO: 135792 - DNA, 25 bp, E. coli
gaaatagatttcgagcgcctcttct

SEQ ID NO: 135793 - DNA, 25 bp, E. coli
gatccagcggttgttcgattgcctg

SEQ ID NO: 135794 - DNA, 25 bp, E. coli
gatccagcggttcttcgattgcctg

SEQ ID NO: 135795 - DNA, 25 bp, E. coli
catgggcgcacgtaatgtcatccgg

SEQ ID NO: 135796 - DNA, 25 bp, E. coli
catgggcgcacgaaatgtcatccgg

SEQ ID NO: 135797 - DNA, 25 bp, E. coli
ggtaactgccacacttccggtacgg

SEQ ID NO: 135798 - DNA, 25 bp, E. coli
ggtaactgccactcttccggtacgg

SEQ ID NO: 135799 - DNA, 25 bp, E. coli
tgtgccaaaggccaagctgataacg

SEQ ID NO: 135800 - DNA, 25 bp, E. coli
tgtgccaaaggcgaagctgataacg

SEQ ID NO: 135801 - DNA, 25 bp, E. coli
tcggcgctacagaagatgcagaacg

SEQ ID NO: 135802 - DNA, 25 bp, E. coli
tcggcgctacagtagatgcagaacg

SEQ ID NO: 135803 - DNA, 25 bp, E. coli
gaagagcacatgaaaaccggcaagc

SEQ ID NO: 135804 - DNA, 25 bp, E. coli
gaagagcacatgtaaaccggcaagc

SEQ ID NO: 135805 - DNA, 25 bp, E. coli
gaaagcacacgaaggttctaccggt

SEQ ID NO: 135806 - DNA, 25 bp, E. coli
gacaccctgggtcatatcgcagaag

SEQ ID NO: 135807 - DNA, 25 bp, E. coli
gaaagcacacgatggttctaccggt

SEQ ID NO: 135808 - DNA, 25 bp, E. coli
gacaccctgggtgatatcgcagaag

SEQ ID NO: 135809 - DNA, 25 bp, E. coli
gataccccgtctggtcactgggaaa

SEQ ID NO: 135810 - DNA, 25 bp, E. coli
gataacggtcgttaaggcccgctca

SEQ ID NO: 135811 - DNA, 25 bp, E. coli
gataccccgtctcgtcactgggaaa

SEQ ID NO: 135812 - DNA, 25 bp, E. coli
ggttgatgaaaatcacggccaggtg

SEQ ID NO: 135813 - DNA, 25 bp, E. coli
ggttgatgaaaaacacggccaggtg

SEQ ID NO: 135814 - DNA, 25 bp, E. coli
taaccgtcacgacctggctgttgag

SEQ ID NO: 135815 - DNA, 25 bp, E. coli
taaccgtcacgagctggctgttgag

SEQ ID NO: 135816 - DNA, 25 bp, E. coli
gataacggtcgtaaaggcccgctca

SEQ ID NO: 135817 - DNA, 25 bp, E. coli
aagcaggcgatttattcagacaaga

SEQ ID NO: 135818 - DNA, 25 bp, E. coli
aagcaggcgattaattcagacaaga

SEQ ID NO: 135819 - DNA, 25 bp, E. coli
aattaatttagatgttgagggcagc

SEQ ID NO: 135820 - DNA, 25 bp, E. coli
aattaatttagaagttgagggcagc

SEQ ID NO: 135821 - DNA, 25 bp, E. coli
aatttccggcaaagcttactatcgt

SEQ ID NO: 135822 - DNA, 25 bp, E. coli
aatttccggcaatgcttactatcgt

SEQ ID NO: 135823 - DNA, 25 bp, E. coli
tagagcttttcttacaatgccggat

SEQ ID NO: 135824 - DNA, 25 bp, E. coli
tagagcttttctaacaatgccggat

SEQ ID NO: 135825 - DNA, 25 bp, E. coli
tataaaatcagccagaaatggtctt

SEQ ID NO: 135826 - DNA, 25 bp, E. coli
tatatgctcaaataagtgtctctgt

SEQ ID NO: 135827 - DNA, 25 bp, E. coli
tatatgctcaaaaaagtgtctctgt

SEQ ID NO: 135828 - DNA, 25 bp, E. coli
tataaaatcagcgagaaatggtctt

SEQ ID NO: 135829 - DNA, 25 bp, E. coli
tgataactattttgcgggatccgta

SEQ ID NO: 135830 - DNA, 25 bp, E. coli
tgataactatttagcgggatccgta

SEQ ID NO: 135831 - DNA, 25 bp, E. coli
gcattgttactgtaaaagcaggcga

SEQ ID NO: 135832 - DNA, 25 bp, E. coli
gcattgttactgaaaaagcaggcga

SEQ ID NO: 135833 - DNA, 25 bp, E. coli
gaagatgaactggttgaggtcaacc

SEQ ID NO: 135834 - DNA, 25 bp, E. coli
gaagatgaactgcttgaggtcaacc

SEQ ID NO: 135835 - DNA, 25 bp, E. coli
tgggtaaaacacaaaaatattcgct

SEQ ID NO: 135836 - DNA, 25 bp, E. coli
tgggtaaaacactaaaatattcgct

SEQ ID NO: 135837 - DNA, 25 bp, E. coli
gatccgtatctgatttggaccatcg

SEQ ID NO: 135838 - DNA, 25 bp, E. coli
gatccgtatctgttttggaccatcg

SEQ ID NO: 135839 - DNA, 25 bp, E. coli
aaggcggcctgcataccgttgtcga

SEQ ID NO: 135840 - DNA, 25 bp, E. coli
aaggcggcctgcttaccgttgtcga

SEQ ID NO: 135841 - DNA, 25 bp, E. coli
cagattttcaactgcatgaggcagg

SEQ ID NO: 135842 - DNA, 25 bp, E. coli
cagattttcaacagcatgaggcagg

SEQ ID NO: 135843 - DNA, 25 bp, E. coli
caggtttgatcggtgctgacgaagt

SEQ ID NO: 135844 - DNA, 25 bp, E. coli
caggtttgatcgctgctgacgaagt

SEQ ID NO: 135845 - DNA, 25 bp, E. coli
atggttgcacctggctacccgtcag

SEQ ID NO: 135846 - DNA, 25 bp, E. coli
atggttgcacctcgctacccgtcag

SEQ ID NO: 135847 - DNA, 25 bp, E. coli
tttagcgctttataccagtgcccct

SEQ ID NO: 135848 - DNA, 25 bp, E. coli
tttagcgctttaaaccagtgcccct

SEQ ID NO: 135849 - DNA, 25 bp, E. coli
tgaactggcacaccaacagattgcg

SEQ ID NO: 135850 - DNA, 25 bp, E. coli
tgaactggcacagcaacagattgcg

SEQ ID NO: 135851 - DNA, 25 bp, E. coli
ccattctgacaaccagttctgctga

SEQ ID NO: 135852 - DNA, 25 bp, E. coli
ccattctgacaagcagttctgctga

SEQ ID NO: 135853 - DNA, 25 bp, E. coli
gattgcgatgcttaatggttgcacc

SEQ ID NO: 135854 - DNA, 25 bp, E. coli
gatagcacaacactttcacggccgc

SEQ ID NO: 135855 - DNA, 25 bp, E. coli
gattgcgatgctaaatggttgcacc

SEQ ID NO: 135856 - DNA, 25 bp, E. coli
gatagcacaacagtttcacggccgc

SEQ ID NO: 135857 - DNA, 25 bp, E. coli
tcacggccgctttatgccatatggc

SEQ ID NO: 135858 - DNA, 25 bp, E. coli
taacgtgctggatgaagtgtattaa

SEQ ID NO: 135859 - DNA, 25 bp, E. coli
tcacggccgcttaatgccatatggc

SEQ ID NO: 135860 - DNA, 25 bp, E. coli
taacgtgctggaagaagtgtattaa

SEQ ID NO: 135861 - DNA, 25 bp, E. coli
catagcgtcgcactagatgcagcag

SEQ ID NO: 135862 - DNA, 25 bp, E. coli
catagcgtcgcagtagatgcagcag

SEQ ID NO: 135863 - DNA, 25 bp, E. coli
aaattacaggctcggcggaagctga

SEQ ID NO: 135864 - DNA, 25 bp, E. coli
aaatgggtgacgcataccgaggcac

SEQ ID NO: 135865 - DNA, 25 bp, E. coli
aaattacaggctgggcggaagctga

SEQ ID NO: 135866 - DNA, 25 bp, E. coli
aaatgggtgacggataccgaggcac

SEQ ID NO: 135867 - DNA, 25 bp, E. coli
tatcgccccattaacgccatacgat

SEQ ID NO: 135868 - DNA, 25 bp, E. coli
tatcgccccatttacgccatacgat

SEQ ID NO: 135869 - DNA, 25 bp, E. coli
tcgcagtagatggagcagaagcaca

SEQ ID NO: 135870 - DNA, 25 bp, E. coli
tcgcagtagatgcagcagaagcaca

SEQ ID NO: 135871 - DNA, 25 bp, E. coli
tctcgatagacagataacatccagg

SEQ ID NO: 135872 - DNA, 25 bp, E. coli
tctcgatagacacataacatccagg

SEQ ID NO: 135873 - DNA, 25 bp, E. coli
gataccgaggcagagcatagcgtcg

SEQ ID NO: 135874 - DNA, 25 bp, E. coli
gattcaactgaatttacaggctggg

SEQ ID NO: 135875 - DNA, 25 bp, E. coli
gttatgtttgtatgcgtcccgcgac

SEQ ID NO: 135876 - DNA, 25 bp, E. coli
gttatgtttgtaagcgtcccgcgac

SEQ ID NO: 135877 - DNA, 25 bp, E. coli
gattcaactgaaattacaggctggg

SEQ ID NO: 135878 - DNA, 25 bp, E. coli
gataccgaggcacagcatagcgtcg

SEQ ID NO: 135879 - DNA, 25 bp, E. coli
ggaagctgatgcaggcagagacctc

SEQ ID NO: 135880 - DNA, 25 bp, E. coli
ggaagctgatgctggcagagacctc

SEQ ID NO: 135881 - DNA, 25 bp, E. coli
gagacctcccgagttaacactgtgc

SEQ ID NO: 135882 - DNA, 25 bp, E. coli
gagacctcccgacttaacactgtgc

SEQ ID NO: 135883 - DNA, 25 bp, E. coli
attgccctggtcgacttacgtccgt

SEQ ID NO: 135884 - DNA, 25 bp, E. coli
attttatgagcgaacactgctgtca

SEQ ID NO: 135885 - DNA, 25 bp, E. coli
attgccctggtccacttacgtccgt

SEQ ID NO: 135886 - DNA, 25 bp, E. coli
attttatgagcgtacactgctgtca

SEQ ID NO: 135887 - DNA, 25 bp, E. coli
tgaccgcgacattctgggaaattgg

SEQ ID NO: 135888 - DNA, 25 bp, E. coli
tgaccgcgacatactgggaaattgg

SEQ ID NO: 135889 - DNA, 25 bp, E. coli
tctcagagagaacctcaacaggcta

SEQ ID NO: 135890 - DNA, 25 bp, E. coli
tctcagagagaagctcaacaggcta

SEQ ID NO: 135891 - DNA, 25 bp, E. coli
gctgatgaccgccacatactgggaa

SEQ ID NO: 135892 - DNA, 25 bp, E. coli
gctgatgaccgcgacatactgggaa

SEQ ID NO: 135893 - DNA, 25 bp, E. coli
gaattaacaccaatgccctggtcca

SEQ ID NO: 135894 - DNA, 25 bp, E. coli
gaattaacaccattgccctggtcca

SEQ ID NO: 135895 - DNA, 25 bp, E. coli
cgacatactgggaaattggccgacg

SEQ ID NO: 135896 - DNA, 25 bp, E. coli
cgttaacgcgctgatgaccgcgaca

SEQ ID NO: 135897 - DNA, 25 bp, E. coli
cgttaacgcgctcatgaccgcgaca

SEQ ID NO: 135898 - DNA, 25 bp, E. coli
cgacatactgggtaattggccgacg

SEQ ID NO: 135899 - DNA, 25 bp, E. coli
ggaatcgctctcagagagaacctca

SEQ ID NO: 135900 - DNA, 25 bp, E. coli
ggaatcgctctctgagagaacctca

SEQ ID NO: 135901 - DNA, 25 bp, E. coli
gagaacctcaactggctaccagcaa

SEQ ID NO: 135902 - DNA, 25 bp, E. coli
gacccaattttatgagcgaacactg

SEQ ID NO: 135903 - DNA, 25 bp, E. coli
gagaacctcaacaggctaccagcaa

SEQ ID NO: 135904 - DNA, 25 bp, E. coli
gacccaattttaagagcgaacactg

SEQ ID NO: 135905 - DNA, 25 bp, E. coli
cacattctttctgtgcgtcacgacg

SEQ ID NO: 135906 - DNA, 25 bp, E. coli
cacattctttctctgcgtcacgacg

SEQ ID NO: 135907 - DNA, 25 bp, E. coli
tttgaagcgaaattcccggacgcgc

SEQ ID NO: 135908 - DNA, 25 bp, E. coli
tttgaagcgaaaatcccggacgcgc

SEQ ID NO: 135909 - DNA, 25 bp, E. coli
tgaaagaagagatccacggcttccg

SEQ ID NO: 135910 - DNA, 25 bp, E. coli
tgaaagaagagaaccacggcttccg

SEQ ID NO: 135911 - DNA, 25 bp, E. coli
tgcgcgcgtctgcataacattgagc

SEQ ID NO: 135912 - DNA, 25 bp, E. coli
tgcgcgcgtctggataacattgagc

SEQ ID NO: 135913 - DNA, 25 bp, E. coli
tgcgtgcggccactaaaacatttgc

SEQ ID NO: 135914 - DNA, 25 bp, E. coli
tgcgtgcggccagtaaaacatttgc

SEQ ID NO: 135915 - DNA, 25 bp, E. coli
tctgaaagaagaaggcaaagggctg

SEQ ID NO: 135916 - DNA, 25 bp, E. coli
tctgaaagaagatggcaaagggctg

SEQ ID NO: 135917 - DNA, 25 bp, E. coli
gcgatgttgcgtatcaccaaaccgg

SEQ ID NO: 135918 - DNA, 25 bp, E. coli
gcgatgttgcgtttcaccaaaccgg

SEQ ID NO: 135919 - DNA, 25 bp, E. coli
gaagcctttggtcactgcattgaag

SEQ ID NO: 135920 - DNA, 25 bp, E. coli
gaagcctttggtgactgcattgaag

SEQ ID NO: 135921 - DNA, 25 bp, E. coli
gcgatttggatcgaagccaacgtga

SEQ ID NO: 135922 - DNA, 25 bp, E. coli
gcgatttggatccaagccaacgtga

SEQ ID NO: 135923 - DNA, 25 bp, E. coli
cattttgccagaacattgccgcgcg

SEQ ID NO: 135924 - DNA, 25 bp, E. coli
cattttgccagatcattgccgcgcg

SEQ ID NO: 135925 - DNA, 25 bp, E. coli
gtggcactcacgctctgtacttctg

SEQ ID NO: 135926 - DNA, 25 bp, E. coli
gtggcactcacggtctgtacttctg

SEQ ID NO: 135927 - DNA, 25 bp, E. coli
taggctctcaggtcaccacaggccc

SEQ ID NO: 135928 - DNA, 25 bp, E. coli
taggctctcaggacaccacaggccc

SEQ ID NO: 135929 - DNA, 25 bp, E. coli
ttctgtaggctctcaggacaccaca

SEQ ID NO: 135930 - DNA, 25 bp, E. coli
ttctgtaggctcacaggacaccaca

SEQ ID NO: 135931 - DNA, 25 bp, E. coli
tgtaggctctcaggacaccacaggc

SEQ ID NO: 135932 - DNA, 25 bp, E. coli
tgtaggctctcacgacaccacaggc

SEQ ID NO: 135933 - DNA, 25 bp, E. coli
tgcgctgccaatggaagtggatgtc

SEQ ID NO: 135934 - DNA, 25 bp, E. coli
tgcgctgccaatcgaagtggatgtc

SEQ ID NO: 135935 - DNA, 25 bp, E. coli
tctgtaggctctgaggacaccacag

SEQ ID NO: 135936 - DNA, 25 bp, E. coli
tctgtaggctctcaggacaccacag

SEQ ID NO: 135937 - DNA, 25 bp, E. coli
gctgccaatcgaagtggatgtctct

SEQ ID NO: 135938 - DNA, 25 bp, E. coli
gctgccaatcgatgtggatgtctct

SEQ ID NO: 135939 - DNA, 25 bp, E. coli
gcgctgccaatccaagtggatgtct

SEQ ID NO: 135940 - DNA, 25 bp, E. coli
gcgctgccaatcgaagtggatgtct

SEQ ID NO: 135941 - DNA, 25 bp, E. coli
cgctgccaatcgaagtggatgtctc

SEQ ID NO: 135942 - DNA, 25 bp, E. coli
cgctgccaatcgtagtggatgtctc

SEQ ID NO: 135943 - DNA, 25 bp, E. coli
ctgtaggctctcaggacaccacagg

SEQ ID NO: 135944 - DNA, 25 bp, E. coli
ctctcaggacacgacaggcccgatg

SEQ ID NO: 135945 - DNA, 25 bp, E. coli
ctctcaggacaccacaggcccgatg

SEQ ID NO: 135946 - DNA, 25 bp, E. coli
ctgtaggctctctggacaccacagg

SEQ ID NO: 135947 - DNA, 25 bp, E. coli
gtgcgctgccaatcgaagtggatgt

SEQ ID NO: 135948 - DNA, 25 bp, E. coli
gtgcgctgccaaacgaagtggatgt

SEQ ID NO: 135949 - DNA, 25 bp, E. coli
aattcttactcagcagggaatctga

SEQ ID NO: 135950 - DNA, 25 bp, E. coli
aattcttactcaccagggaatctga

SEQ ID NO: 135951 - DNA, 25 bp, E. coli
caccatggcgtcttaaggatatatc

SEQ ID NO: 135952 - DNA, 25 bp, E. coli
caccatggcgtcataaggatatatc

SEQ ID NO: 135953 - DNA, 25 bp, E. coli
tagctaaggtctgtggttatgccag

SEQ ID NO: 135954 - DNA, 25 bp, E. coli
tacttgatgagaggatgcaaatggc

SEQ ID NO: 135955 - DNA, 25 bp, E. coli
tagctaaggtctctggttatgccag

SEQ ID NO: 135956 - DNA, 25 bp, E. coli
tacttgatgagacgatgcaaatggc

SEQ ID NO: 135957 - DNA, 25 bp, E. coli
atacggatttatctgcaccatggcg

SEQ ID NO: 135958 - DNA, 25 bp, E. coli
atacggatttatgtgcaccatggcg

SEQ ID NO: 135959 - DNA, 25 bp, E. coli
tagttgggctaaacactgtgctgaa

SEQ ID NO: 135960 - DNA, 25 bp, E. coli
tagttgggctaatcactgtgctgaa

SEQ ID NO: 135961 - DNA, 25 bp, E. coli
tgtacttgtcgactctagctctaga

SEQ ID NO: 135962 - DNA, 25 bp, E. coli
tgtacttgtcgagtctagctctaga

SEQ ID NO: 135963 - DNA, 25 bp, E. coli
tccaagtcaatactctcagaggagt

SEQ ID NO: 135964 - DNA, 25 bp, E. coli
tccaagtcaatagtctcagaggagt

SEQ ID NO: 135965 - DNA, 25 bp, E. coli
cctgaaagagtgttagtggcggatt

SEQ ID NO: 135966 - DNA, 25 bp, E. coli
cctgaaagagtgatagtggcggatt

SEQ ID NO: 135967 - DNA, 25 bp, E. coli
gaatatttactcagcactcgttgtt

SEQ ID NO: 135968 - DNA, 25 bp, E. coli
gaatatttactctgcactcgttgtt

SEQ ID NO: 135969 - DNA, 25 bp, E. coli
gagaggttcatctgtacttgtcgac

SEQ ID NO: 135970 - DNA, 25 bp, E. coli
gagaggttcatcagtacttgtcgac

SEQ ID NO: 135971 - DNA, 25 bp, E. coli
tagcggttgggaactggcgctactt

SEQ ID NO: 135972 - DNA, 25 bp, E. coli
tacacctcgacgttaaactgggacg

SEQ ID NO: 135973 - DNA, 25 bp, E. coli
tacacctcgacgataaactgggacg

SEQ ID NO: 135974 - DNA, 25 bp, E. coli
tagcggttgggatctggcgctactt

SEQ ID NO: 135975 - DNA, 25 bp, E. coli
ctcgacgttaaagtgggacgatccg

SEQ ID NO: 135976 - DNA, 25 bp, E. coli
ctcgacgttaaactgggacgatccg

SEQ ID NO: 135977 - DNA, 25 bp, E. coli
tatttccaggtcctatggcctctga

SEQ ID NO: 135978 - DNA, 25 bp, E. coli
tattgctgtcgaaacggtaaccgaa

SEQ ID NO: 135979 - DNA, 25 bp, E. coli
tattgctgtcgatacggtaaccgaa

SEQ ID NO: 135980 - DNA, 25 bp, E. coli
tatttccaggtcgtatggcctctga

SEQ ID NO: 135981 - DNA, 25 bp, E. coli
ttctcggcggcgcagtcgcagtatc

SEQ ID NO: 135982 - DNA, 25 bp, E. coli
ttctcggcggcggagtcgcagtatc

SEQ ID NO: 135983 - DNA, 25 bp, E. coli
gaaacggtaacccaagatgcgcaca

SEQ ID NO: 135984 - DNA, 25 bp, E. coli
gaaacggtaaccgaagatgcgcaca

SEQ ID NO: 135985 - DNA, 25 bp, E. coli
cggcaatgatatgtgggatgccact

SEQ ID NO: 135986 - DNA, 25 bp, E. coli
cggcaatgatatctgggatgccact

SEQ ID NO: 135987 - DNA, 25 bp, E. coli
ggtaaccgaagatgcgcacacttct

SEQ ID NO: 135988 - DNA, 25 bp, E. coli
ggtaaccgaagaagcgcacacttct

SEQ ID NO: 135989 - DNA, 25 bp, E. coli
tggcgttacacctcgacgttaaact

SEQ ID NO: 135990 - DNA, 25 bp, E. coli
tggcgttacaccacgacgttaaact

SEQ ID NO: 135991 - DNA, 25 bp, E. coli
tggcggtattgcagtcgaaacggta

SEQ ID NO: 135992 - DNA, 25 bp, E. coli
tggcggtattgctgtcgaaacggta

SEQ ID NO: 135993 - DNA, 25 bp, E. coli
caaggtttgcaagtcaggcttagcc

SEQ ID NO: 135994 - DNA, 25 bp, E. coli
caaggtttgcaactcaggcttagcc

SEQ ID NO: 135995 - DNA, 25 bp, E. coli
caagagtctggatagccgtaacgat

SEQ ID NO: 135996 - DNA, 25 bp, E. coli
caagagtctggaaagccgtaacgat

SEQ ID NO: 135997 - DNA, 25 bp, E. coli
cactgttgcgaagtaccgagagtct

SEQ ID NO: 135998 - DNA, 25 bp, E. coli
cactgttgcgaactaccgagagtct

SEQ ID NO: 135999 - DNA, 25 bp, E. coli
acttcagcaggagctacagcaggcg

SEQ ID NO: 136000 - DNA, 25 bp, E. coli
acttcagcaggacctacagcaggcg

SEQ ID NO: 136001 - DNA, 25 bp, E. coli
tatatgaaaccgttggtactggccg

SEQ ID NO: 136002 - DNA, 25 bp, E. coli
tatatgaaaccgatggtactggccg

SEQ ID NO: 136003 - DNA, 25 bp, E. coli
tatcgttgaacagcagcaagccttc

SEQ ID NO: 136004 - DNA, 25 bp, E. coli
tatcgttgaacaccagcaagccttc

SEQ ID NO: 136005 - DNA, 25 bp, E. coli
tgactacattgaggacgagctgccg

SEQ ID NO: 136006 - DNA, 25 bp, E. coli
tgactacattgacgacgagctgccg

SEQ ID NO: 136007 - DNA, 25 bp, E. coli
tccagtcacgtctataccgagggcg

SEQ ID NO: 136008 - DNA, 25 bp, E. coli
tccagtcacgtcaataccgagggcg

SEQ ID NO: 136009 - DNA, 25 bp, E. coli
gaatcgacgatatctcgcgtgacca

SEQ ID NO: 136010 - DNA, 25 bp, E. coli
gaatcgacgataactcgcgtgacca

SEQ ID NO: 136011 - DNA, 25 bp, E. coli
gaaaacccagcgaaaccgttgagcg

SEQ ID NO: 136012 - DNA, 25 bp, E. coli
gaaaacccagcgtaaccgttgagcg

SEQ ID NO: 136013 - DNA, 25 bp, E. coli
ggtcactggacgctagaactcaaca

SEQ ID NO: 136014 - DNA, 25 bp, E. coli
ggtcactggacggtagaactcaaca

SEQ ID NO: 136015 - DNA, 25 bp, E. coli
aattcctcgacgtacgtgggatcgt

SEQ ID NO: 136016 - DNA, 25 bp, E. coli
aattcctcgacgaacgtgggatcgt

SEQ ID NO: 136017 - DNA, 25 bp, E. coli
caaaattcctcgtcgaacgtgggat

SEQ ID NO: 136018 - DNA, 25 bp, E. coli
caaaattcctcgacgaacgtgggat

SEQ ID NO: 136019 - DNA, 25 bp, E. coli
ctcgacgaacgtgggatcgtagtag

SEQ ID NO: 136020 - DNA, 25 bp, E. coli
ctcgacgaacgtcggatcgtagtag

SEQ ID NO: 136021 - DNA, 25 bp, E. coli
attcctcgacgatcgtgggatcgta

SEQ ID NO: 136022 - DNA, 25 bp, E. coli
acgaacgtgggaacgtagtagagaa

SEQ ID NO: 136023 - DNA, 25 bp, E. coli
acgaacgtgggatcgtagtagagaa

SEQ ID NO: 136024 - DNA, 25 bp, E. coli
attcctcgacgaacgtgggatcgta

SEQ ID NO: 136025 - DNA, 25 bp, E. coli
aaattcctcgaccaacgtgggatcg

SEQ ID NO: 136026 - DNA, 25 bp, E. coli
aaattcctcgacgaacgtgggatcg

SEQ ID NO: 136027 - DNA, 25 bp, E. coli
tcctcgacgaacgtgggatcgtagt

SEQ ID NO: 136028 - DNA, 25 bp, E. coli
tcctcgacgaacctgggatcgtagt

SEQ ID NO: 136029 - DNA, 25 bp, E. coli
gcaaaattcctcgacgaacgtggga

SEQ ID NO: 136030 - DNA, 25 bp, E. coli
ccgatctctatggagaagatcccga

SEQ ID NO: 136031 - DNA, 25 bp, E. coli
cgatctctatgcagaagatcccgat

SEQ ID NO: 136032 - DNA, 25 bp, E. coli
cctcgacgaacgtgggatcgtagta

SEQ ID NO: 136033 - DNA, 25 bp, E. coli
gcaaaattcctccacgaacgtggga

SEQ ID NO: 136034 - DNA, 25 bp, E. coli
cctcgacgaacgagggatcgtagta

SEQ ID NO: 136035 - DNA, 25 bp, E. coli
cgatctctatgctgaagatcccgat

SEQ ID NO: 136036 - DNA, 25 bp, E. coli
ccgatctctatgcagaagatcccga

SEQ ID NO: 136037 - DNA, 25 bp, E. coli
catcggaatcacaggagctgcttgc

SEQ ID NO: 136038 - DNA, 25 bp, E. coli
catcggaatcactggagctgcttgc

SEQ ID NO: 136039 - DNA, 25 bp, E. coli
tagacctgttctcgtgcctgagctt

SEQ ID NO: 136040 - DNA, 25 bp, E. coli
tagacctgttctggtgcctgagctt

SEQ ID NO: 136041 - DNA, 25 bp, E. coli
tgcttgctgcggtatgccagccgac

SEQ ID NO: 136042 - DNA, 25 bp, E. coli
tgcttgctgcggaatgccagccgac

SEQ ID NO: 136043 - DNA, 25 bp, E. coli
tcatgaagctgcctaaacgtcgccg

SEQ ID NO: 136044 - DNA, 25 bp, E. coli
tcatgaagctgcgtaaacgtcgccg

SEQ ID NO: 136045 - DNA, 25 bp, E. coli
gaaaaaatctgcacggtgtaccgcg

SEQ ID NO: 136046 - DNA, 25 bp, E. coli
gaaaaaatctgctcggtgtaccgcg

SEQ ID NO: 136047 - DNA, 25 bp, E. coli
cattgtccgactggctattacgtca

SEQ ID NO: 136048 - DNA, 25 bp, E. coli
cattgtccgactcgctattacgtca

SEQ ID NO: 136049 - DNA, 25 bp, E. coli
ggtgtaccgcgaaagcgacatcgta

SEQ ID NO: 136050 - DNA, 25 bp, E. coli
ggtgtaccgcgatagcgacatcgta

SEQ ID NO: 136051 - DNA, 25 bp, E. coli
taaggagaaatagacacgttgggtt

SEQ ID NO: 136052 - DNA, 25 bp, E. coli
tcacaacgagctccatacggataca

SEQ ID NO: 136053 - DNA, 25 bp, E. coli
taagcatcaccgttgatccagagtc

SEQ ID NO: 136054 - DNA, 25 bp, E. coli
tcacaacgagctgcatacggataca

SEQ ID NO: 136055 - DNA, 25 bp, E. coli
taagcatcaccgatgatccagagtc

SEQ ID NO: 136056 - DNA, 25 bp, E. coli
taaggagaaatacacacgttgggtt

SEQ ID NO: 136057 - DNA, 25 bp, E. coli
taatcctcgagtcctggtggaaccg

SEQ ID NO: 136058 - DNA, 25 bp, E. coli
taatcctcgagtgctggtggaaccg

SEQ ID NO: 136059 - DNA, 25 bp, E. coli
cattcggaatatttaacggtgcgga

SEQ ID NO: 136060 - DNA, 25 bp, E. coli
cattcggaatatataacggtgcgga

SEQ ID NO: 136061 - DNA, 25 bp, E. coli
tattctttgacccatattgacggtg

SEQ ID NO: 136062 - DNA, 25 bp, E. coli
tattctttgaccgatattgacggtg

SEQ ID NO: 136063 - DNA, 25 bp, E. coli
tattatcgtattctcggtccgctgg

SEQ ID NO: 136064 - DNA, 25 bp, E. coli
tattatcgtattgtcggtccgctgg

SEQ ID NO: 136065 - DNA, 25 bp, E. coli
ttggctcagcatcaaacagtttggt

SEQ ID NO: 136066 - DNA, 25 bp, E. coli
ttggctcagcatgaaacagtttggt

SEQ ID NO: 136067 - DNA, 25 bp, E. coli
gaaccggcatttttcgctctggcat

SEQ ID NO: 136068 - DNA, 25 bp, E. coli
gacggtgtagtctgatttggctcac

SEQ ID NO: 136069 - DNA, 25 bp, E. coli
gaaagtttccccatcaccatcgtca

SEQ ID NO: 136070 - DNA, 25 bp, E. coli
gaaccggcatttatcgctctggcat

SEQ ID NO: 136071 - DNA, 25 bp, E. coli
gaaagtttccccttcaccatcgtca

SEQ ID NO: 136072 - DNA, 25 bp, E. coli
gacggtgtagtcagatttggctcac

SEQ ID NO: 136073 - DNA, 25 bp, E. coli
gacagcactttatttcgaaccggca

SEQ ID NO: 136074 - DNA, 25 bp, E. coli
gacagcactttaattcgaaccggca

SEQ ID NO: 136075 - DNA, 25 bp, E. coli
cggtgcggatgtgggaaaaaccata

SEQ ID NO: 136076 - DNA, 25 bp, E. coli
cggtgcggatgtcggaaaaaccata

SEQ ID NO: 136077 - DNA, 25 bp, E. coli
tcaacgcttttggtgataaccgcaa

SEQ ID NO: 136078 - DNA, 25 bp, E. coli
tcaacgcttttgctgataaccgcaa

SEQ ID NO: 136079 - DNA, 25 bp, E. coli
gatgctatgattctcgcagggataa

SEQ ID NO: 136080 - DNA, 25 bp, E. coli
gatgctatgattgtcgcagggataa

SEQ ID NO: 136081 - DNA, 25 bp, E. coli
caaaaacgtagagcgcatatcgcct

SEQ ID NO: 136082 - DNA, 25 bp, E. coli
caaaaacgtagaccgcatatcgcct

SEQ ID NO: 136083 - DNA, 25 bp, E. coli
catatcgccttgttgcggctcggaa

SEQ ID NO: 136084 - DNA, 25 bp, E. coli
catatcgccttgatgcggctcggaa

SEQ ID NO: 136085 - DNA, 25 bp, E. coli
tgtgatctgccgcaaatagagaatg

SEQ ID NO: 136086 - DNA, 25 bp, E. coli
tgtgatctgccggaaatagagaatg

SEQ ID NO: 136087 - DNA, 25 bp, E. coli
tgctgtcagcttacatccttgggtg

SEQ ID NO: 136088 - DNA, 25 bp, E. coli
tgctgtcagctttcatccttgggtg

SEQ ID NO: 136089 - DNA, 25 bp, E. coli
tgaagattttctctgacctcgcgcg

SEQ ID NO: 136090 - DNA, 25 bp, E. coli
tgaagattttctgtgacctcgcgcg

SEQ ID NO: 136091 - DNA, 25 bp, E. coli
tcatccttgggtgcacaaatgtgca

SEQ ID NO: 136092 - DNA, 25 bp, E. coli
tcatccttgggtccacaaatgtgca

SEQ ID NO: 136093 - DNA, 25 bp, E. coli
gaatgaatattcacctgcgattaat

SEQ ID NO: 136094 - DNA, 25 bp, E. coli
gaatgaatattctcctgcgattaat

SEQ ID NO: 136095 - DNA, 25 bp, E. coli
gaaaattcttatccatctccgttat

SEQ ID NO: 136096 - DNA, 25 bp, E. coli
gaaaattcttatgcatctccgttat

SEQ ID NO: 136097 - DNA, 25 bp, E. coli
taagccctacaaaatattgagcgag

SEQ ID NO: 136098 - DNA, 25 bp, E. coli
taagccctacaatatattgagcgag

SEQ ID NO: 136099 - DNA, 25 bp, E. coli
taataactcgcctgcaaaaacgtag

SEQ ID NO: 136100 - DNA, 25 bp, E. coli
taataactcgccagcaaaaacgtag

SEQ ID NO: 136101 - DNA, 25 bp, E. coli
gacctcgcgcgtatcatttctttat

SEQ ID NO: 136102 - DNA, 25 bp, E. coli
gacctcgcgcgtttcatttctttat

SEQ ID NO: 136103 - DNA, 25 bp, E. coli
catttagcgtgaaaaattgaatgag

SEQ ID NO: 136104 - DNA, 25 bp, E. coli
catttagcgtgataaattgaatgag

SEQ ID NO: 136105 - DNA, 25 bp, E. coli
tacagcactcaccagacatctctga

SEQ ID NO: 136106 - DNA, 25 bp, E. coli
tacagcactcacgagacatctctga

SEQ ID NO: 136107 - DNA, 25 bp, E. coli
aaaaattgaatgagattattcctgc

SEQ ID NO: 136108 - DNA, 25 bp, E. coli
aaaaattgaatgtgattattcctgc

SEQ ID NO: 136109 - DNA, 25 bp, E. coli
ttaatctcccttacatttagcgtga

SEQ ID NO: 136110 - DNA, 25 bp, E. coli
ttaatctccctttcatttagcgtga

SEQ ID NO: 136111 - DNA, 25 bp, E. coli
tgcttctacagcactcaccagacat

SEQ ID NO: 136112 - DNA, 25 bp, E. coli
tgcttctacagctctcaccagacat

SEQ ID NO: 136113 - DNA, 25 bp, E. coli
taaactgacaaatatttaatctccc

SEQ ID NO: 136114 - DNA, 25 bp, E. coli
taaactgacaaaaatttaatctccc

SEQ ID NO: 136115 - DNA, 25 bp, E. coli
gacatctctgatgctgaacccacta

SEQ ID NO: 136116 - DNA, 25 bp, E. coli
gacatctctgatcctgaacccacta

SEQ ID NO: 136117 - DNA, 25 bp, E. coli
ccgcactgacattaactgacaaata

SEQ ID NO: 136118 - DNA, 25 bp, E. coli
cccactaaacttatgaagattcttt

SEQ ID NO: 136119 - DNA, 25 bp, E. coli
ccgcactgacataaactgacaaata

SEQ ID NO: 136120 - DNA, 25 bp, E. coli
cccactaaacttttgaagattcttt

SEQ ID NO: 136121 - DNA, 25 bp, E. coli
gagattattcctgcttctacagcac

SEQ ID NO: 136122 - DNA, 25 bp, E. coli
gatgctgaaccctctaaacttatga

SEQ ID NO: 136123 - DNA, 25 bp, E. coli
gatgctgaacccactaaacttatga

SEQ ID NO: 136124 - DNA, 25 bp, E. coli
gagattattcctccttctacagcac

SEQ ID NO: 136125 - DNA, 25 bp, E. coli
caatatcaaaaatccgtgcgcccga

SEQ ID NO: 136126 - DNA, 25 bp, E. coli
caatatcaaaaaaccgtgcgcccga

SEQ ID NO: 136127 - DNA, 25 bp, E. coli
catccaggttaatcaggtcgctaaa

SEQ ID NO: 136128 - DNA, 25 bp, E. coli
catccaggttaaacaggtcgctaaa

SEQ ID NO: 136129 - DNA, 25 bp, E. coli
catctgtcgatggaagaacgcgtta

SEQ ID NO: 136130 - DNA, 25 bp, E. coli
catcaagcgtgaggttaacgagcgt

SEQ ID NO: 136131 - DNA, 25 bp, E. coli
catctgtcgatgcaagaacgcgtta

SEQ ID NO: 136132 - DNA, 25 bp, E. coli
catcaagcgtgacgttaacgagcgt

SEQ ID NO: 136133 - DNA, 25 bp, E. coli
ttgaaacgcggctcggcaattgacc

SEQ ID NO: 136134 - DNA, 25 bp, E. coli
ttgaaacgcggcacggcaattgacc

SEQ ID NO: 136135 - DNA, 25 bp, E. coli
tgagccttctaaacaatatgcggac

SEQ ID NO: 136136 - DNA, 25 bp, E. coli
tgagcaagtcggtgatgaacacatc

SEQ ID NO: 136137 - DNA, 25 bp, E. coli
tgagccttctaatcaatatgcggac

SEQ ID NO: 136138 - DNA, 25 bp, E. coli
tgagcaagtcggagatgaacacatc

SEQ ID NO: 136139 - DNA, 25 bp, E. coli
tcggcttccggcaagagtcttattg

SEQ ID NO: 136140 - DNA, 25 bp, E. coli
tcggcttccggctagagtcttattg

SEQ ID NO: 136141 - DNA, 25 bp, E. coli
gacggttgagcccaagaaggtcatc

SEQ ID NO: 136142 - DNA, 25 bp, E. coli
gacggttgagccgaagaaggtcatc

SEQ ID NO: 136143 - DNA, 25 bp, E. coli
cattttcgttgataccccgctggat

SEQ ID NO: 136144 - DNA, 25 bp, E. coli
cattttcgttgaaaccccgctggat

SEQ ID NO: 136145 - DNA, 25 bp, E. coli
tggatatctgcctgatgcgccgcat

SEQ ID NO: 136146 - DNA, 25 bp, E. coli
tggatatctgccagatgcgccgcat

SEQ ID NO: 136147 - DNA, 25 bp, E. coli
cagtttgcgctgatgtgggcagtac

SEQ ID NO: 136148 - DNA, 25 bp, E. coli
cagtttgcgctgttgtgggcagtac

SEQ ID NO: 136149 - DNA, 25 bp, E. coli
tacgaatgtattctggtcggcgcat

SEQ ID NO: 136150 - DNA, 25 bp, E. coli
tacgaatgtattgtggtcggcgcat

SEQ ID NO: 136151 - DNA, 25 bp, E. coli
tatgctgtttgatgtgcgccacgtc

SEQ ID NO: 136152 - DNA, 25 bp, E. coli
tagtggtccatatggtcatcggcaa

SEQ ID NO: 136153 - DNA, 25 bp, E. coli
tatgctgtttgaagtgcgccacgtc

SEQ ID NO: 136154 - DNA, 25 bp, E. coli
tagtggtccataaggtcatcggcaa

SEQ ID NO: 136155 - DNA, 25 bp, E. coli
tattttagaacctcggatgatgggc

SEQ ID NO: 136156 - DNA, 25 bp, E. coli
tattttagaaccacggatgatgggc

SEQ ID NO: 136157 - DNA, 25 bp, E. coli
tttcggtgccataaaccagcgtgtg

SEQ ID NO: 136158 - DNA, 25 bp, E. coli
tttcggtgccattaaccagcgtgtg

SEQ ID NO: 136159 - DNA, 25 bp, E. coli
tggtagtgatccacgcgggcattca

SEQ ID NO: 136160 - DNA, 25 bp, E. coli
gataaaacgggcatgcacattctgc

SEQ ID NO: 136161 - DNA, 25 bp, E. coli
gataaaacgggcttgcacattctgc

SEQ ID NO: 136162 - DNA, 25 bp, E. coli
ggagctgacgcggaaactttttaaa

SEQ ID NO: 136163 - DNA, 25 bp, E. coli
ggagctgacgcgcaaactttttaaa

SEQ ID NO: 136164 - DNA, 25 bp, E. coli
tggtagtgatcctcgcgggcattca

SEQ ID NO: 136165 - DNA, 25 bp, E. coli
taatttgcatatgtcgccggagcga

SEQ ID NO: 136166 - DNA, 25 bp, E. coli
taacgaatttatgtctatgctgccg

SEQ ID NO: 136167 - DNA, 25 bp, E. coli
taacgaatttatctctatgctgccg

SEQ ID NO: 136168 - DNA, 25 bp, E. coli
taatttgcatatctcgccggagcga

SEQ ID NO: 136169 - DNA, 25 bp, E. coli
caaactggccgagttcttacgggcg

SEQ ID NO: 136170 - DNA, 25 bp, E. coli
caaactggccgacttcttacgggcg

SEQ ID NO: 136171 - DNA, 25 bp, E. coli
cagtttaacgtggtgaacgccgaca

SEQ ID NO: 136172 - DNA, 25 bp, E. coli
cagtttaacgtgctgaacgccgaca

SEQ ID NO: 136173 - DNA, 25 bp, E. coli
tgaagaactgattgccggtaaccgc

SEQ ID NO: 136174 - DNA, 25 bp, E. coli
tgaagaactgatagccggtaaccgc

SEQ ID NO: 136175 - DNA, 25 bp, E. coli
gaagatgcgcgccactattccgtag

SEQ ID NO: 136176 - DNA, 25 bp, E. coli
gcaatgctgcgcagacttatgaagg

SEQ ID NO: 136177 - DNA, 25 bp, E. coli
gaagatgcgcgcgactattccgtag

SEQ ID NO: 136178 - DNA, 25 bp, E. coli
gcaatgctgcgctgacttatgaagg

SEQ ID NO: 136179 - DNA, 25 bp, E. coli
gaacctacggctagcatgacatcgc

SEQ ID NO: 136180 - DNA, 25 bp, E. coli
gaaatggaccctaactggctgctga

SEQ ID NO: 136181 - DNA, 25 bp, E. coli
gaacctacggcttgcatgacatcgc

SEQ ID NO: 136182 - DNA, 25 bp, E. coli
gaaatggacccttactggctgctga

SEQ ID NO: 136183 - DNA, 25 bp, E. coli
gttataacttctgcggcgtacaggg

SEQ ID NO: 136184 - DNA, 25 bp, E. coli
gttataacttctccggcgtacaggg

SEQ ID NO: 136185 - DNA, 25 bp, E. coli
ggtttactggagcagatccgcgcca

SEQ ID NO: 136186 - DNA, 25 bp, E. coli
gtggaaaaataccagaacccgcgcg

SEQ ID NO: 136187 - DNA, 25 bp, E. coli
gtggaaaaatacgagaacccgcgcg

SEQ ID NO: 136188 - DNA, 25 bp, E. coli
ggtttactggaggagatccgcgcca

SEQ ID NO: 136189 - DNA, 25 bp, E. coli
tcaaccagacggttaaaggccaggg

SEQ ID NO: 136190 - DNA, 25 bp, E. coli
tcaaccagacggataaaggccaggg

SEQ ID NO: 136191 - DNA, 25 bp, E. coli
tatggtgatcattcaggcggaactg

SEQ ID NO: 136192 - DNA, 25 bp, E. coli
tatggtgatcatacaggcggaactg

SEQ ID NO: 136193 - DNA, 25 bp, E. coli
tctcagcaaatgaaagcgcatcgga

SEQ ID NO: 136194 - DNA, 25 bp, E. coli
tctcagcaaatgtaagcgcatcgga

SEQ ID NO: 136195 - DNA, 25 bp, E. coli
gcggtcgttatgactcagcaaatga

SEQ ID NO: 136196 - DNA, 25 bp, E. coli
gcggtcgttatgtctcagcaaatga

SEQ ID NO: 136197 - DNA, 25 bp, E. coli
gcgtaccgatgctgccgcaggtgta

SEQ ID NO: 136198 - DNA, 25 bp, E. coli
gcgtaccgatgcagccgcaggtgta

SEQ ID NO: 136199 - DNA, 25 bp, E. coli
gcaataaatataatgaatctggtta

SEQ ID NO: 136200 - DNA, 25 bp, E. coli
gcaataaatatattgaatctggtta

SEQ ID NO: 136201 - DNA, 25 bp, E. coli
gaactgcagttcgtctgacttcgca

SEQ ID NO: 136202 - DNA, 25 bp, E. coli
gaaaacgcagcgtaccgatgctgcc

SEQ ID NO: 136203 - DNA, 25 bp, E. coli
gaaaacgcagcgaaccgatgctgcc

SEQ ID NO: 136204 - DNA, 25 bp, E. coli
gaactgcagttcctctgacttcgca

SEQ ID NO: 136205 - DNA, 25 bp, E. coli
cgaagcttatatcggcgatcatttt

SEQ ID NO: 136206 - DNA, 25 bp, E. coli
cgaagcttatatgggcgatcatttt

SEQ ID NO: 136207 - DNA, 25 bp, E. coli
cggcgatcattttattgtggctaac

SEQ ID NO: 136208 - DNA, 25 bp, E. coli
cggcgatcatttaattgtggctaac

SEQ ID NO: 136209 - DNA, 25 bp, E. coli
ggtgagaactttttgcagttctctg

SEQ ID NO: 136210 - DNA, 25 bp, E. coli
ggtgagaactttatgcagttctctg

SEQ ID NO: 136211 - DNA, 25 bp, E. coli
taatggtgagcgctcgttatgtctc

SEQ ID NO: 136212 - DNA, 25 bp, E. coli
taatggtgagcggtcgttatgtctc

SEQ ID NO: 136213 - DNA, 25 bp, E. coli
acccgtgaaacggagactaactacg

SEQ ID NO: 136214 - DNA, 25 bp, E. coli
acccgtgaaacgcagactaactacg

SEQ ID NO: 136215 - DNA, 25 bp, E. coli
tatcactcccgcctggcaggtgatt

SEQ ID NO: 136216 - DNA, 25 bp, E. coli
tatcactcccgcgtggcaggtgatt

SEQ ID NO: 136217 - DNA, 25 bp, E. coli
ttgtattggcatgacgcctgtggct

SEQ ID NO: 136218 - DNA, 25 bp, E. coli
ttactcgcaatacggtaagaaacgc

SEQ ID NO: 136219 - DNA, 25 bp, E. coli
ttactcgcaatagggtaagaaacgc

SEQ ID NO: 136220 - DNA, 25 bp, E. coli
ttgtattggcatcacgcctgtggct

SEQ ID NO: 136221 - DNA, 25 bp, E. coli
tgaaacgcagactaactacggcgtt

SEQ ID NO: 136222 - DNA, 25 bp, E. coli
tgaaacgcagacaaactacggcgtt

SEQ ID NO: 136223 - DNA, 25 bp, E. coli
tcactcccgcgtcgcaggtgattgg

SEQ ID NO: 136224 - DNA, 25 bp, E. coli
tcactcccgcgtggcaggtgattgg

SEQ ID NO: 136225 - DNA, 25 bp, E. coli
gcatcacgcctgaggctcaggcact

SEQ ID NO: 136226 - DNA, 25 bp, E. coli
gcatcacgcctgtggctcaggcact

SEQ ID NO: 136227 - DNA, 25 bp, E. coli
cggtaagaaacgcgtcgaaggctat

SEQ ID NO: 136228 - DNA, 25 bp, E. coli
ctctgttggcgcgggcgcacgctat

SEQ ID NO: 136229 - DNA, 25 bp, E. coli
cgtgaaacgcagtctaactacggcg

SEQ ID NO: 136230 - DNA, 25 bp, E. coli
ctctgttggcgccggcgcacgctat

SEQ ID NO: 136231 - DNA, 25 bp, E. coli
cgtgaaacgcagactaactacggcg

SEQ ID NO: 136232 - DNA, 25 bp, E. coli
cggtaagaaacgggtcgaaggctat

SEQ ID NO: 136233 - DNA, 25 bp, E. coli
ctcgcaatacggaaagaaacgcgtc

SEQ ID NO: 136234 - DNA, 25 bp, E. coli
ctcgcaatacggtaagaaacgcgtc

SEQ ID NO: 136235 - DNA, 25 bp, E. coli
caggaaatttatgaacgcccttaca

SEQ ID NO: 136236 - DNA, 25 bp, E. coli
cagttgaaagagtacctgtcattca

SEQ ID NO: 136237 - DNA, 25 bp, E. coli
catggcagggttaaacgaacagttg

SEQ ID NO: 136238 - DNA, 25 bp, E. coli
caggaaatttatcaacgcccttaca

SEQ ID NO: 136239 - DNA, 25 bp, E. coli
cagttgaaagagaacctgtcattca

SEQ ID NO: 136240 - DNA, 25 bp, E. coli
catggcagggtttaacgaacagttg

SEQ ID NO: 136241 - DNA, 25 bp, E. coli
taacgaacagttcaaagagaacctg

SEQ ID NO: 136242 - DNA, 25 bp, E. coli
acctgtcattcacacctgatgaact

SEQ ID NO: 136243 - DNA, 25 bp, E. coli
acctgtcattcagacctgatgaact

SEQ ID NO: 136244 - DNA, 25 bp, E. coli
tatgaacgccctaacaacagcttta

SEQ ID NO: 136245 - DNA, 25 bp, E. coli
tatgaacgcccttacaacagcttta

SEQ ID NO: 136246 - DNA, 25 bp, E. coli
ttacaacagctttatttccgatgca

SEQ ID NO: 136247 - DNA, 25 bp, E. coli
ttacaacagcttaatttccgatgca

SEQ ID NO: 136248 - DNA, 25 bp, E. coli
tgtcaggaaatttatgaacgccctt

SEQ ID NO: 136249 - DNA, 25 bp, E. coli
tgtcaggaaattaatgaacgccctt

SEQ ID NO: 136250 - DNA, 25 bp, E. coli
tgaaagaaacatggcagggtttaac

SEQ ID NO: 136251 - DNA, 25 bp, E. coli
tgaaagaaacatcgcagggtttaac

SEQ ID NO: 136252 - DNA, 25 bp, E. coli
cgcgaaggtaaagtagaggagagat

SEQ ID NO: 136253 - DNA, 25 bp, E. coli
cgcgaaggtaaactagaggagagat

SEQ ID NO: 136254 - DNA, 25 bp, E. coli
taacgaacagttgaaagagaacctg

SEQ ID NO: 136255 - DNA, 25 bp, E. coli
gagaacctgtcattcacacctgatg

SEQ ID NO: 136256 - DNA, 25 bp, E. coli
gagaacctgtcaatcacacctgatg

SEQ ID NO: 136257 - DNA, 25 bp, E. coli
caagggattcgcctcgggcgtttca

SEQ ID NO: 136258 - DNA, 25 bp, E. coli
caagggattcgcgtcgggcgtttca

SEQ ID NO: 136259 - DNA, 25 bp, E. coli
catgctctgagtagcccgaaacgta

SEQ ID NO: 136260 - DNA, 25 bp, E. coli
cagttatttacgttatgccgcgcaa

SEQ ID NO: 136261 - DNA, 25 bp, E. coli
catgctctgagttgcccgaaacgta

SEQ ID NO: 136262 - DNA, 25 bp, E. coli
cagttatttacgatatgccgcgcaa

SEQ ID NO: 136263 - DNA, 25 bp, E. coli
agtcatgatgacacgctgagcggaa

SEQ ID NO: 136264 - DNA, 25 bp, E. coli
agtcatgatgactcgctgagcggaa

SEQ ID NO: 136265 - DNA, 25 bp, E. coli
tatgcggcaatgtacgaccacaggt

SEQ ID NO: 136266 - DNA, 25 bp, E. coli
tatgcggcaatgaacgaccacaggt

SEQ ID NO: 136267 - DNA, 25 bp, E. coli
tttcacggttaaacagccacagcgt

SEQ ID NO: 136268 - DNA, 25 bp, E. coli
tttcacggttaatcagccacagcgt

SEQ ID NO: 136269 - DNA, 25 bp, E. coli
ttaacctgatgagggaaagcggcga

SEQ ID NO: 136270 - DNA, 25 bp, E. coli
ttaacctgatgacggaaagcggcga

SEQ ID NO: 136271 - DNA, 25 bp, E. coli
tctggcttggcctacaattattaca

SEQ ID NO: 136272 - DNA, 25 bp, E. coli
tctggcttggccaacaattattaca

SEQ ID NO: 136273 - DNA, 25 bp, E. coli
gcaattcgatgccttatgcggtgga

SEQ ID NO: 136274 - DNA, 25 bp, E. coli
gcaattcgatgcgttatgcggtgga

SEQ ID NO: 136275 - DNA, 25 bp, E. coli
gtcactgttttctggccgcgctcaa

SEQ ID NO: 136276 - DNA, 25 bp, E. coli
gtcactgttttcaggccgcgctcaa

SEQ ID NO: 136277 - DNA, 25 bp, E. coli
tcaatggcgttaagaccgactggcg

SEQ ID NO: 136278 - DNA, 25 bp, E. coli
tcaatggcgttatgaccgactggcg

SEQ ID NO: 136279 - DNA, 25 bp, E. coli
cagttgctcaaacaaatcggccagg

SEQ ID NO: 136280 - DNA, 25 bp, E. coli
cagttgctcaaagaaatcggccagg

SEQ ID NO: 136281 - DNA, 25 bp, E. coli
aaaaaatttgaaggcagcgtcgcgc

SEQ ID NO: 136282 - DNA, 25 bp, E. coli
aacatgctcgttctcggcgataccg

SEQ ID NO: 136283 - DNA, 25 bp, E. coli
aaaaaatttgaacgcagcgtcgcgc

SEQ ID NO: 136284 - DNA, 25 bp, E. coli
aacatgctcgttgtcggcgataccg

SEQ ID NO: 136285 - DNA, 25 bp, E. coli
ttttcaccagatagcgtggcccggc

SEQ ID NO: 136286 - DNA, 25 bp, E. coli
ttttcaccagattgcgtggcccggc

SEQ ID NO: 136287 - DNA, 25 bp, E. coli
tcctcactggatcaacgtcaggcag

SEQ ID NO: 136288 - DNA, 25 bp, E. coli
tcctcactggatgaacgtcaggcag

SEQ ID NO: 136289 - DNA, 25 bp, E. coli
ctgaagggaagctcaacggacgatg

SEQ ID NO: 136290 - DNA, 25 bp, E. coli
cgtatgtcccaataacagatggcca

SEQ ID NO: 136291 - DNA, 25 bp, E. coli
cgtatgtcccaaaaacagatggcca

SEQ ID NO: 136292 - DNA, 25 bp, E. coli
ctgaagggaagcacaacggacgatg

SEQ ID NO: 136293 - DNA, 25 bp, E. coli
gtggaacttccgcttaacatgctcg

SEQ ID NO: 136294 - DNA, 25 bp, E. coli
gtggaacttccggttaacatgctcg

SEQ ID NO: 136295 - DNA, 25 bp, E. coli
ggaactgcgtgaagcactgactgca

SEQ ID NO: 136296 - DNA, 25 bp, E. coli
tggaaaatgaagtgtcccgcgagca

SEQ ID NO: 136297 - DNA, 25 bp, E. coli
tggaaaatgaagagtcccgcgagca

SEQ ID NO: 136298 - DNA, 25 bp, E. coli
ggaactgcgtgatgcactgactgca

SEQ ID NO: 136299 - DNA, 25 bp, E. coli
gatgggtaaccttccggcattccgt

SEQ ID NO: 136300 - DNA, 25 bp, E. coli
gatgggtaacctaccggcattccgt

SEQ ID NO: 136301 - DNA, 25 bp, E. coli
cagtactccggcgaaataaagggat

SEQ ID NO: 136302 - DNA, 25 bp, E. coli
cagtactccggccaaataaagggat

SEQ ID NO: 136303 - DNA, 25 bp, E. coli
tgagtatctctaatgaaggcgctga

SEQ ID NO: 136304 - DNA, 25 bp, E. coli
tgcttctggcaaatatgagctgcga

SEQ ID NO: 136305 - DNA, 25 bp, E. coli
tgcttctggcaattatgagctgcga

SEQ ID NO: 136306 - DNA, 25 bp, E. coli
tgagtatctctattgaaggcgctga

SEQ ID NO: 136307 - DNA, 25 bp, E. coli
tcttcgggccagcaatcgatgattc

SEQ ID NO: 136308 - DNA, 25 bp, E. coli
tcttcgggccaggaatcgatgattc

SEQ ID NO: 136309 - DNA, 25 bp, E. coli
ccttctatgccataaaaggtcagaa

SEQ ID NO: 136310 - DNA, 25 bp, E. coli
ccttctatgccaaaaaaggtcagaa

SEQ ID NO: 136311 - DNA, 25 bp, E. coli
gaaaaggccataccagcgctcagta

SEQ ID NO: 136312 - DNA, 25 bp, E. coli
gacaatactcactccctgcttctgg

SEQ ID NO: 136313 - DNA, 25 bp, E. coli
gaactcgatagtgacggacaatact

SEQ ID NO: 136314 - DNA, 25 bp, E. coli
gaaaaggccatagcagcgctcagta

SEQ ID NO: 136315 - DNA, 25 bp, E. coli
gaactcgatagtcacggacaatact

SEQ ID NO: 136316 - DNA, 25 bp, E. coli
gacaatactcacaccctgcttctgg

SEQ ID NO: 136317 - DNA, 25 bp, E. coli
ggcgctgatactaacctcttcgggc

SEQ ID NO: 136318 - DNA, 25 bp, E. coli
ggcgctgatacttacctcttcgggc

SEQ ID NO: 136319 - DNA, 25 bp, E. coli
taacctccacgacctttgctgcggg

SEQ ID NO: 136320 - DNA, 25 bp, E. coli
taacctccacgagctttgctgcggg

SEQ ID NO: 136321 - DNA, 25 bp, E. coli
tcaatgttgagtacagaaaaggcca

SEQ ID NO: 136322 - DNA, 25 bp, E. coli
tcaatgttgagttcagaaaaggcca

SEQ ID NO: 136323 - DNA, 25 bp, E. coli
aaagcgccggactcattcataaacg

SEQ ID NO: 136324 - DNA, 25 bp, E. coli
aaagcgtggctgattttcctcgtca

SEQ ID NO: 136325 - DNA, 25 bp, E. coli
aaaatcatcgctccggacgcaggtt

SEQ ID NO: 136326 - DNA, 25 bp, E. coli
aaagcgccggacacattcataaacg

SEQ ID NO: 136327 - DNA, 25 bp, E. coli
aaaatcatcgctgcggacgcaggtt

SEQ ID NO: 136328 - DNA, 25 bp, E. coli
aaagcgtggctgtttttcctcgtca

SEQ ID NO: 136329 - DNA, 25 bp, E. coli
tttatcccttccaggctgtggccgg

SEQ ID NO: 136330 - DNA, 25 bp, E. coli
tatcgtggtcttcggcgcatgtctg

SEQ ID NO: 136331 - DNA, 25 bp, E. coli
tatcgtggtcttgggcgcatgtctg

SEQ ID NO: 136332 - DNA, 25 bp, E. coli
tttatcccttcctggctgtggccgg

SEQ ID NO: 136333 - DNA, 25 bp, E. coli
tattgccacgctcacctggtttgag

SEQ ID NO: 136334 - DNA, 25 bp, E. coli
tattgccacgctgacctggtttgag

SEQ ID NO: 136335 - DNA, 25 bp, E. coli
tcttcaatatgaacgtgctggcgcg

SEQ ID NO: 136336 - DNA, 25 bp, E. coli
tcttcaatatgatcgtgctggcgcg

SEQ ID NO: 136337 - DNA, 25 bp, E. coli
gctttgatgttgctgtcgcgccgcc

SEQ ID NO: 136338 - DNA, 25 bp, E. coli
gctttgatgttggtgtcgcgccgcc

SEQ ID NO: 136339 - DNA, 25 bp, E. coli
gactggctgtatgagctgggcaacc

SEQ ID NO: 136340 - DNA, 25 bp, E. coli
cgctgtttaccaagaaccgcgtgga

SEQ ID NO: 136341 - DNA, 25 bp, E. coli
cgctgtttaccatgaaccgcgtgga

SEQ ID NO: 136342 - DNA, 25 bp, E. coli
gactggctgtatcagctgggcaacc

SEQ ID NO: 136343 - DNA, 25 bp, E. coli
gagtctgctgcaattcagtggcctg

SEQ ID NO: 136344 - DNA, 25 bp, E. coli
gagtctgctgcatttcagtggcctg

SEQ ID NO: 136345 - DNA, 25 bp, E. coli
agttcatctggcaccctgtgtcgcg

SEQ ID NO: 136346 - DNA, 25 bp, E. coli
agacattggtggtaaagaagcctca

SEQ ID NO: 136347 - DNA, 25 bp, E. coli
agttcatctggctccctgtgtcgcg

SEQ ID NO: 136348 - DNA, 25 bp, E. coli
agacattggtggaaaagaagcctca

SEQ ID NO: 136349 - DNA, 25 bp, E. coli
aaaccagttcatgtggcaccctgtg

SEQ ID NO: 136350 - DNA, 25 bp, E. coli
aaatcgctaccagaagctgtgtgcc

SEQ ID NO: 136351 - DNA, 25 bp, E. coli
aaatcgctaccacaagctgtgtgcc

SEQ ID NO: 136352 - DNA, 25 bp, E. coli
acatggtcgggtaatatgctttgcc

SEQ ID NO: 136353 - DNA, 25 bp, E. coli
aaaccagttcatctggcaccctgtg

SEQ ID NO: 136354 - DNA, 25 bp, E. coli
acatggtcgggttatatgctttgcc

SEQ ID NO: 136355 - DNA, 25 bp, E. coli
taccagaagctgagtgccagcaaac

SEQ ID NO: 136356 - DNA, 25 bp, E. coli
taccagaagctgtgtgccagcaaac

SEQ ID NO: 136357 - DNA, 25 bp, E. coli
tgtgtgccagcataccagttcatct

SEQ ID NO: 136358 - DNA, 25 bp, E. coli
tgtgtgccagcaaaccagttcatct

SEQ ID NO: 136359 - DNA, 25 bp, E. coli
tgcggcaagacattggtggtaaaga

SEQ ID NO: 136360 - DNA, 25 bp, E. coli
tgcggcaagacaatggtggtaaaga

SEQ ID NO: 136361 - DNA, 25 bp, E. coli
tctggcaccctgagtcgcgcgcggt

SEQ ID NO: 136362 - DNA, 25 bp, E. coli
tctggcaccctgtgtcgcgcgcggt

SEQ ID NO: 136363 - DNA, 25 bp, E. coli
cctcagaaatcggtaccagaagctg

SEQ ID NO: 136364 - DNA, 25 bp, E. coli
cctcagaaatcgctaccagaagctg

SEQ ID NO: 136365 - DNA, 25 bp, E. coli
ggtaatatgcttagccgatggctgg

SEQ ID NO: 136366 - DNA, 25 bp, E. coli
ggtaatatgctttgccgatggctgg

SEQ ID NO: 136367 - DNA, 25 bp, E. coli
caaagaacaaacacaggctgcggta

SEQ ID NO: 136368 - DNA, 25 bp, E. coli
caaagaacaaactcaggctgcggta

SEQ ID NO: 136369 - DNA, 25 bp, E. coli
aaaactgcgttaactggccgatgcg

SEQ ID NO: 136370 - DNA, 25 bp, E. coli
aaaactgcgttatctggccgatgcg

SEQ ID NO: 136371 - DNA, 25 bp, E. coli
ttgatcgtgttattgcccagcaggc

SEQ ID NO: 136372 - DNA, 25 bp, E. coli
ttgatcgtgttaatgcccagcaggc

SEQ ID NO: 136373 - DNA, 25 bp, E. coli
tggtaataaccctacctgcgacggt

SEQ ID NO: 136374 - DNA, 25 bp, E. coli
tggtaataacccaacctgcgacggt

SEQ ID NO: 136375 - DNA, 25 bp, E. coli
tgctggaacgtgtagacaaaccgac

SEQ ID NO: 136376 - DNA, 25 bp, E. coli
tgctggaacgtgaagacaaaccgac

SEQ ID NO: 136377 - DNA, 25 bp, E. coli
tcgtctctgaacagaaacaactggc

SEQ ID NO: 136378 - DNA, 25 bp, E. coli
tcgtctctgaactgaaacaactggc

SEQ ID NO: 136379 - DNA, 25 bp, E. coli
cctggtgccggataacgaagtgctg

SEQ ID NO: 136380 - DNA, 25 bp, E. coli
cctggtgccggaaaacgaagtgctg

SEQ ID NO: 136381 - DNA, 25 bp, E. coli
cctaaaaaggatgaacgtggcgctc

SEQ ID NO: 136382 - DNA, 25 bp, E. coli
cctaaaaaggatcaacgtggcgctc

SEQ ID NO: 136383 - DNA, 25 bp, E. coli
gaaagtccgaatgagtacgccagca

SEQ ID NO: 136384 - DNA, 25 bp, E. coli
gaaagtccgaatcagtacgccagca

SEQ ID NO: 136385 - DNA, 25 bp, E. coli
cattaaaggttatgacggcccgatc

SEQ ID NO: 136386 - DNA, 25 bp, E. coli
cattaaaggttaagacggcccgatc

SEQ ID NO: 136387 - DNA, 25 bp, E. coli
taagaaatatctgccggaaagtccg

SEQ ID NO: 136388 - DNA, 25 bp, E. coli
taagaaatatctcccggaaagtccg

SEQ ID NO: 136389 - DNA, 25 bp, E. coli
cagactgcctgatggttaaacctgc

SEQ ID NO: 136390 - DNA, 25 bp, E. coli
cagactgcctgaaggttaaacctgc

SEQ ID NO: 136391 - DNA, 25 bp, E. coli
catctggcacgccaaattgaacgca

SEQ ID NO: 136392 - DNA, 25 bp, E. coli
catctggcacgcgaaattgaacgca

SEQ ID NO: 136393 - DNA, 25 bp, E. coli
gcgtgatgcgcaatccagagaaaca

SEQ ID NO: 136394 - DNA, 25 bp, E. coli
gcgtgatgcgcattccagagaaaca

SEQ ID NO: 136395 - DNA, 25 bp, E. coli
gaacgtactgaattgccgattggcg

SEQ ID NO: 136396 - DNA, 25 bp, E. coli
gacgcgactctggaaaatttaggca

SEQ ID NO: 136397 - DNA, 25 bp, E. coli
gaacgtactgaaatgccgattggcg

SEQ ID NO: 136398 - DNA, 25 bp, E. coli
cgctgcgcgctatgtttgaagagac

SEQ ID NO: 136399 - DNA, 25 bp, E. coli
cgctgcgcgctaagtttgaagagac

SEQ ID NO: 136400 - DNA, 25 bp, E. coli
cgacatcgtgcgagagctgcgtgaa

SEQ ID NO: 136401 - DNA, 25 bp, E. coli
cgacatcgtgcgtgagctgcgtgaa

SEQ ID NO: 136402 - DNA, 25 bp, E. coli
cgtatgtcgcgcatctgcaagcaga

SEQ ID NO: 136403 - DNA, 25 bp, E. coli
cgtatgtcgcgcttctgcaagcaga

SEQ ID NO: 136404 - DNA, 25 bp, E. coli
ggcgaccgcaaatgctatcagatga

SEQ ID NO: 136405 - DNA, 25 bp, E. coli
ggcgaccgcaaaagctatcagatga

SEQ ID NO: 136406 - DNA, 25 bp, E. coli
gatgaaaccggcagcgatgcctggc

SEQ ID NO: 136407 - DNA, 25 bp, E. coli
gatgaacccaatcaaccgtcgtgag

SEQ ID NO: 136408 - DNA, 25 bp, E. coli
gatgaaaccggctgcgatgcctggc

SEQ ID NO: 136409 - DNA, 25 bp, E. coli
gatgaacccaatgaaccgtcgtgag

SEQ ID NO: 136410 - DNA, 25 bp, E. coli
gacgcgactctgcaaaatttaggca

SEQ ID NO: 136411 - DNA, 25 bp, E. coli
caccttcggcatggcaagaatataa

SEQ ID NO: 136412 - DNA, 25 bp, E. coli
caccttcggcatcgcaagaatataa

SEQ ID NO: 136413 - DNA, 25 bp, E. coli
taaaacgtactttttatctggagaa

SEQ ID NO: 136414 - DNA, 25 bp, E. coli
taaaacgtacttattatctggagaa

SEQ ID NO: 136415 - DNA, 25 bp, E. coli
aaaatgatggatccgggtgcgttac

SEQ ID NO: 136416 - DNA, 25 bp, E. coli
aaaatgatggatgcgggtgcgttac

SEQ ID NO: 136417 - DNA, 25 bp, E. coli
tatctggagaaattgatggatgcgg

SEQ ID NO: 136418 - DNA, 25 bp, E. coli
tatctggagaaaatgatggatgcgg

SEQ ID NO: 136419 - DNA, 25 bp, E. coli
tgtaccctccaggaactattatgtt

SEQ ID NO: 136420 - DNA, 25 bp, E. coli
tgtaccctccagcaactattatgtt

SEQ ID NO: 136421 - DNA, 25 bp, E. coli
tgcgggtgcgttacctgccggtctc

SEQ ID NO: 136422 - DNA, 25 bp, E. coli
tgctggttcaccatcggcatcgcaa

SEQ ID NO: 136423 - DNA, 25 bp, E. coli
tgcgggtgcgtttcctgccggtctc

SEQ ID NO: 136424 - DNA, 25 bp, E. coli
tgctggttcaccttcggcatcgcaa

SEQ ID NO: 136425 - DNA, 25 bp, E. coli
gttacctgccggtctcctttctgta

SEQ ID NO: 136426 - DNA, 25 bp, E. coli
gttacctgccggactcctttctgta

SEQ ID NO: 136427 - DNA, 25 bp, E. coli
gtctcctttctgtaccctccaggaa

SEQ ID NO: 136428 - DNA, 25 bp, E. coli
ggaactattatgtttcaccaattta

SEQ ID NO: 136429 - DNA, 25 bp, E. coli
gtctcctttctgaaccctccaggaa

SEQ ID NO: 136430 - DNA, 25 bp, E. coli
ggcatcgcaagattataaaacgtac

SEQ ID NO: 136431 - DNA, 25 bp, E. coli
ggaactattatgattcaccaattta

SEQ ID NO: 136432 - DNA, 25 bp, E. coli
ggcatcgcaagaatataaaacgtac

SEQ ID NO: 136433 - DNA, 25 bp, E. coli
cacctggcgggtgactaatacgatt

SEQ ID NO: 136434 - DNA, 25 bp, E. coli
cacctggcgggtcactaatacgatt

SEQ ID NO: 136435 - DNA, 25 bp, E. coli
tagacgccatcacaacatcgttttt

SEQ ID NO: 136436 - DNA, 25 bp, E. coli
taggtgtgaagataaaataatatgc

SEQ ID NO: 136437 - DNA, 25 bp, E. coli
tagacgccatcagaacatcgttttt

SEQ ID NO: 136438 - DNA, 25 bp, E. coli
tagccttagtgtataggtgtgaaga

SEQ ID NO: 136439 - DNA, 25 bp, E. coli
tagccttagtgtttaggtgtgaaga

SEQ ID NO: 136440 - DNA, 25 bp, E. coli
taggtgtgaagaaaaaataatatgc

SEQ ID NO: 136441 - DNA, 25 bp, E. coli
tgtttataaaaagctgacagaatta

SEQ ID NO: 136442 - DNA, 25 bp, E. coli
tgtttataaaaacctgacagaatta

SEQ ID NO: 136443 - DNA, 25 bp, E. coli
tcgttttttcgtcacacctggcggg

SEQ ID NO: 136444 - DNA, 25 bp, E. coli
tcgttttttcgtgacacctggcggg

SEQ ID NO: 136445 - DNA, 25 bp, E. coli
gccgctttcgcgtccctttgtttat

SEQ ID NO: 136446 - DNA, 25 bp, E. coli
gccgctttcgcgaccctttgtttat

SEQ ID NO: 136447 - DNA, 25 bp, E. coli
gcgggtgactaatacgatttaataa

SEQ ID NO: 136448 - DNA, 25 bp, E. coli
gcgggtgactaaaacgatttaataa

SEQ ID NO: 136449 - DNA, 25 bp, E. coli
gttaaaccatcctcttagacgccat

SEQ ID NO: 136450 - DNA, 25 bp, E. coli
gttaaaccatccacttagacgccat

SEQ ID NO: 136451 - DNA, 25 bp, E. coli
ggtgctaactataaccactatatca

SEQ ID NO: 136452 - DNA, 25 bp, E. coli
ggtgctaactattaccactatatca

SEQ ID NO: 136453 - DNA, 25 bp, E. coli
taatatgcaataaaaaagggccgct

SEQ ID NO: 136454 - DNA, 25 bp, E. coli
taatatgcaatataaaagggccgct

SEQ ID NO: 136455 - DNA, 25 bp, E. coli
cagtaaccgcctccgtaagcggcgt

SEQ ID NO: 136456 - DNA, 25 bp, E. coli
cagtaaccgcctgcgtaagcggcgt

SEQ ID NO: 136457 - DNA, 25 bp, E. coli
ttacggatatcgagcttgccggtgc

SEQ ID NO: 136458 - DNA, 25 bp, E. coli
ttacggatatcgtgcttgccggtgc

SEQ ID NO: 136459 - DNA, 25 bp, E. coli
attacggatatccagcttgccggtg

SEQ ID NO: 136460 - DNA, 25 bp, E. coli
attacggatatcgagcttgccggtg

SEQ ID NO: 136461 - DNA, 25 bp, E. coli
tatatggcggcgcaacggctggaaa

SEQ ID NO: 136462 - DNA, 25 bp, E. coli
tatatggcggcggaacggctggaaa

SEQ ID NO: 136463 - DNA, 25 bp, E. coli
tgggaacggagaatcgtttagcgga

SEQ ID NO: 136464 - DNA, 25 bp, E. coli
tgggaacggagattcgtttagcgga

SEQ ID NO: 136465 - DNA, 25 bp, E. coli
tgcgcaaagtgcattctgcgccgca

SEQ ID NO: 136466 - DNA, 25 bp, E. coli
tgcgccgcagcaaacccatcttatt

SEQ ID NO: 136467 - DNA, 25 bp, E. coli
tgcgcaaagtgctttctgcgccgca

SEQ ID NO: 136468 - DNA, 25 bp, E. coli
tgcgccgcagcatacccatcttatt

SEQ ID NO: 136469 - DNA, 25 bp, E. coli
gcagtaaccgcctgcgtaagcggcg

SEQ ID NO: 136470 - DNA, 25 bp, E. coli
gcagtaaccgccagcgtaagcggcg

SEQ ID NO: 136471 - DNA, 25 bp, E. coli
gcaaacccatctaattctggagtag

SEQ ID NO: 136472 - DNA, 25 bp, E. coli
gcaaacccatcttattctggagtag

SEQ ID NO: 136473 - DNA, 25 bp, E. coli
gcagcaaacccaacttattctggag

SEQ ID NO: 136474 - DNA, 25 bp, E. coli
gcagcaaacccatcttattctggag

SEQ ID NO: 136475 - DNA, 25 bp, E. coli
ctggtggcagtaaccgcctgcgtaa

SEQ ID NO: 136476 - DNA, 25 bp, E. coli
ctggtggcagtatccgcctgcgtaa

SEQ ID NO: 136477 - DNA, 25 bp, E. coli
aaggttagcaattactgctgggaaa

SEQ ID NO: 136478 - DNA, 25 bp, E. coli
aaggttagcaataactgctgggaaa

SEQ ID NO: 136479 - DNA, 25 bp, E. coli
cacaaaggttaggaataactgctgg

SEQ ID NO: 136480 - DNA, 25 bp, E. coli
caaaggttagcaataactgctggga

SEQ ID NO: 136481 - DNA, 25 bp, E. coli
cacaaaggttagcaataactgctgg

SEQ ID NO: 136482 - DNA, 25 bp, E. coli
caaaggttagcattaactgctggga

SEQ ID NO: 136483 - DNA, 25 bp, E. coli
tagtcgggcattttctttttctcaa

SEQ ID NO: 136484 - DNA, 25 bp, E. coli
tagtcgggcattatctttttctcaa

SEQ ID NO: 136485 - DNA, 25 bp, E. coli
tagcaataactgctgggaaaattcc

SEQ ID NO: 136486 - DNA, 25 bp, E. coli
tagcaataactggtgggaaaattcc

SEQ ID NO: 136487 - DNA, 25 bp, E. coli
tctacctcacaatggttagcaataa

SEQ ID NO: 136488 - DNA, 25 bp, E. coli
tctacctcacaaaggttagcaataa

SEQ ID NO: 136489 - DNA, 25 bp, E. coli
cctcacaaaggttagcaataactgc

SEQ ID NO: 136490 - DNA, 25 bp, E. coli
cctcacaaaggtaagcaataactgc

SEQ ID NO: 136491 - DNA, 25 bp, E. coli
cctgaatgcccggttagtcgggcat

SEQ ID NO: 136492 - DNA, 25 bp, E. coli
cctgaatgcccgcttagtcgggcat

SEQ ID NO: 136493 - DNA, 25 bp, E. coli
gcttagtcgggcattttctttttct

SEQ ID NO: 136494 - DNA, 25 bp, E. coli
gcttagtcgggctttttctttttct

SEQ ID NO: 136495 - DNA, 25 bp, E. coli
gcattttcttttactcaacttcctg

SEQ ID NO: 136496 - DNA, 25 bp, E. coli
gcattttctttttctcaacttcctg

SEQ ID NO: 136497 - DNA, 25 bp, E. coli
gcaataactgctcggaaaattccga

SEQ ID NO: 136498 - DNA, 25 bp, E. coli
gcaataactgctgggaaaattccga

SEQ ID NO: 136499 - DNA, 25 bp, E. coli
atgtgatttgtatatctaatccacg

SEQ ID NO: 136500 - DNA, 25 bp, E. coli
atgtgatttgtaaatctaatccacg

SEQ ID NO: 136501 - DNA, 25 bp, E. coli
agattgtgaagccaaaaggacggct

SEQ ID NO: 136502 - DNA, 25 bp, E. coli
agattgtgaagcgaaaaggacggct

SEQ ID NO: 136503 - DNA, 25 bp, E. coli
aaagaacgccatgcagactgtcaga

SEQ ID NO: 136504 - DNA, 25 bp, E. coli
aaagaacgccatccagactgtcaga

SEQ ID NO: 136505 - DNA, 25 bp, E. coli
ttaactctctgcgtaccgcaaaaga

SEQ ID NO: 136506 - DNA, 25 bp, E. coli
ttaactctctgcctaccgcaaaaga

SEQ ID NO: 136507 - DNA, 25 bp, E. coli
tctgcgtaccgctaaagaacgccat

SEQ ID NO: 136508 - DNA, 25 bp, E. coli
tcagattgtgaagcgaaaaggacgg

SEQ ID NO: 136509 - DNA, 25 bp, E. coli
tctgcgtaccgcaaaagaacgccat

SEQ ID NO: 136510 - DNA, 25 bp, E. coli
ccagactgtcagtttgtgaagcgaa

SEQ ID NO: 136511 - DNA, 25 bp, E. coli
gccatccagactctcagattgtgaa

SEQ ID NO: 136512 - DNA, 25 bp, E. coli
ccagactgtcagattgtgaagcgaa

SEQ ID NO: 136513 - DNA, 25 bp, E. coli
gccatccagactgtcagattgtgaa

SEQ ID NO: 136514 - DNA, 25 bp, E. coli
gaacgccatccagactgtcagattg

SEQ ID NO: 136515 - DNA, 25 bp, E. coli
gaacgccatccacactgtcagattg

SEQ ID NO: 136516 - DNA, 25 bp, E. coli
gcaaaagaacgccatccagactgtc

SEQ ID NO: 136517 - DNA, 25 bp, E. coli
gcaaaagaacgcgatccagactgtc

SEQ ID NO: 136518 - DNA, 25 bp, E. coli
gtaccgcaaaagaacgccatccaga

SEQ ID NO: 136519 - DNA, 25 bp, E. coli
gtaccgcaaaagtacgccatccaga

SEQ ID NO: 136520 - DNA, 25 bp, E. coli
tcagattgtgaaccgaaaaggacgg

SEQ ID NO: 136521 - DNA, 25 bp, E. coli
caactggagcatatggacttcaggg

SEQ ID NO: 136522 - DNA, 25 bp, E. coli
caactggagcatttggacttcaggg

SEQ ID NO: 136523 - DNA, 25 bp, E. coli
caaaggcaaaggcactactggcagc

SEQ ID NO: 136524 - DNA, 25 bp, E. coli
cagcatgatgcctgggatgccgagc

SEQ ID NO: 136525 - DNA, 25 bp, E. coli
cagcatgatgccagggatgccgagc

SEQ ID NO: 136526 - DNA, 25 bp, E. coli
caaaggcaaagggactactggcagc

SEQ ID NO: 136527 - DNA, 25 bp, E. coli
cagatgatgcgctggcaactggagc

SEQ ID NO: 136528 - DNA, 25 bp, E. coli
cagatgatgcgcaggcaactggagc

SEQ ID NO: 136529 - DNA, 25 bp, E. coli
tttatgacaccaccgaaacaccgaa

SEQ ID NO: 136530 - DNA, 25 bp, E. coli
tttatgacaccagcgaaacaccgaa

SEQ ID NO: 136531 - DNA, 25 bp, E. coli
tgatataaacgctgaggatgggccg

SEQ ID NO: 136532 - DNA, 25 bp, E. coli
tgatataaacgcagaggatgggccg

SEQ ID NO: 136533 - DNA, 25 bp, E. coli
gccgaagcagttgcgcaaagcagaa

SEQ ID NO: 136534 - DNA, 25 bp, E. coli
gccgaagcagttccgcaaagcagaa

SEQ ID NO: 136535 - DNA, 25 bp, E. coli
gcaaatcgtcctattggtaagcgaa

SEQ ID NO: 136536 - DNA, 25 bp, E. coli
gcaaatcgtccttttggtaagcgaa

SEQ ID NO: 136537 - DNA, 25 bp, E. coli
cgaaggttatagattgcgcaagatc

SEQ ID NO: 136538 - DNA, 25 bp, E. coli
cgcggtcggccagctaaatataatg

SEQ ID NO: 136539 - DNA, 25 bp, E. coli
cgaaggttatagtttgcgcaagatc

SEQ ID NO: 136540 - DNA, 25 bp, E. coli
cgcggtcggccacctaaatataatg

SEQ ID NO: 136541 - DNA, 25 bp, E. coli
ctatggtgcgctgaagctggccgac

SEQ ID NO: 136542 - DNA, 25 bp, E. coli
ctatggtgcgctcaagctggccgac

SEQ ID NO: 136543 - DNA, 25 bp, E. coli
caaaccggaacaaaaccgtaggctg

SEQ ID NO: 136544 - DNA, 25 bp, E. coli
caaaccggaacataaccgtaggctg

SEQ ID NO: 136545 - DNA, 25 bp, E. coli
cataggataatcgttgccaaaggcc

SEQ ID NO: 136546 - DNA, 25 bp, E. coli
cataggataatccttgccaaaggcc

SEQ ID NO: 136547 - DNA, 25 bp, E. coli
tactgcagtaactaacgagtagcaa

SEQ ID NO: 136548 - DNA, 25 bp, E. coli
tactgcagtaacaaacgagtagcaa

SEQ ID NO: 136549 - DNA, 25 bp, E. coli
tgacgagggcgcgtaattgccccaa

SEQ ID NO: 136550 - DNA, 25 bp, E. coli
tgacgagggcgcctaattgccccaa

SEQ ID NO: 136551 - DNA, 25 bp, E. coli
tccggcagccgttaaaaatcctcta

SEQ ID NO: 136552 - DNA, 25 bp, E. coli
tccggcagccgtaaaaaatcctcta

SEQ ID NO: 136553 - DNA, 25 bp, E. coli
tcaggcctacaatcggaacataacc

SEQ ID NO: 136554 - DNA, 25 bp, E. coli
tcaggcctacaaacggaacataacc

SEQ ID NO: 136555 - DNA, 25 bp, E. coli
gtttacgccggcatccgacagccgt

SEQ ID NO: 136556 - DNA, 25 bp, E. coli
gtttacgccggcttccgacagccgt

SEQ ID NO: 136557 - DNA, 25 bp, E. coli
gttgccaaaggccaacgagccagaa

SEQ ID NO: 136558 - DNA, 25 bp, E. coli
gttgccaaaggcgaacgagccagaa

SEQ ID NO: 136559 - DNA, 25 bp, E. coli
taaccgtaggctggatagggcgttc

SEQ ID NO: 136560 - DNA, 25 bp, E. coli
taattgccccaaactcataggataa

SEQ ID NO: 136561 - DNA, 25 bp, E. coli
taaccgtaggctcgatagggcgttc

SEQ ID NO: 136562 - DNA, 25 bp, E. coli
taattgccccaatctcataggataa

SEQ ID NO: 136563 - DNA, 25 bp, E. coli
gagccagaacataaccgtaggtcgg

SEQ ID NO: 136564 - DNA, 25 bp, E. coli
gagccagaacattaccgtaggtcgg

SEQ ID NO: 136565 - DNA, 25 bp, E. coli
aatcgtgcgcttccctattcctgta

SEQ ID NO: 136566 - DNA, 25 bp, E. coli
aatcgtgcgcttgcctattcctgta

SEQ ID NO: 136567 - DNA, 25 bp, E. coli
tacgatgtatttattatatggagca

SEQ ID NO: 136568 - DNA, 25 bp, E. coli
tatgccatgataatttaatacgatg

SEQ ID NO: 136569 - DNA, 25 bp, E. coli
tatgccatgatattttaatacgatg

SEQ ID NO: 136570 - DNA, 25 bp, E. coli
tacgatgtattttttatatggagca

SEQ ID NO: 136571 - DNA, 25 bp, E. coli
tgataaaggttaattagtgaaagat

SEQ ID NO: 136572 - DNA, 25 bp, E. coli
tgataaaggttatttagtgaaagat

SEQ ID NO: 136573 - DNA, 25 bp, E. coli
tgtatttattatttggagcacttaa

SEQ ID NO: 136574 - DNA, 25 bp, E. coli
tgtatttattatatggagcacttaa

SEQ ID NO: 136575 - DNA, 25 bp, E. coli
tcagagctgcttatatgataaaggt

SEQ ID NO: 136576 - DNA, 25 bp, E. coli
tcagagctgcttttatgataaaggt

SEQ ID NO: 136577 - DNA, 25 bp, E. coli
gcctattcctgttccaaatgtatta

SEQ ID NO: 136578 - DNA, 25 bp, E. coli
gcctattcctgtaccaaatgtatta

SEQ ID NO: 136579 - DNA, 25 bp, E. coli
gcgcttgcctattcctgtaccaaat

SEQ ID NO: 136580 - DNA, 25 bp, E. coli
gcgcttgcctatacctgtaccaaat

SEQ ID NO: 136581 - DNA, 25 bp, E. coli
gctcttcagagcagcttttatgata

SEQ ID NO: 136582 - DNA, 25 bp, E. coli
gctcttcagagctgcttttatgata

SEQ ID NO: 136583 - DNA, 25 bp, E. coli
cgtgcgcttgccaattcctgtacca

SEQ ID NO: 136584 - DNA, 25 bp, E. coli
cggctctgctcttcagagctgcttt

SEQ ID NO: 136585 - DNA, 25 bp, E. coli
cgtgcgcttgcctattcctgtacca

SEQ ID NO: 136586 - DNA, 25 bp, E. coli
cggctctgctctacagagctgcttt

SEQ ID NO: 136587 - DNA, 25 bp, E. coli
aatagcagtgtttgctacgcttgcc

SEQ ID NO: 136588 - DNA, 25 bp, E. coli
caattatgtgtgcaaacgttctgga

SEQ ID NO: 136589 - DNA, 25 bp, E. coli
catagcggcctctgttatcggtatt

SEQ ID NO: 136590 - DNA, 25 bp, E. coli
aatagcagtgttagctacgcttgcc

SEQ ID NO: 136591 - DNA, 25 bp, E. coli
caattatgtgtggaaacgttctgga

SEQ ID NO: 136592 - DNA, 25 bp, E. coli
catagcggcctcagttatcggtatt

SEQ ID NO: 136593 - DNA, 25 bp, E. coli
tacgcttgccctgacttatcactgg

SEQ ID NO: 136594 - DNA, 25 bp, E. coli
tacgcttgccctcacttatcactgg

SEQ ID NO: 136595 - DNA, 25 bp, E. coli
tattattattagtctggtccaggct

SEQ ID NO: 136596 - DNA, 25 bp, E. coli
tattattattagactggtccaggct

SEQ ID NO: 136597 - DNA, 25 bp, E. coli
tggtccaggctataacgcagttaca

SEQ ID NO: 136598 - DNA, 25 bp, E. coli
tggtccaggctaaaacgcagttaca

SEQ ID NO: 136599 - DNA, 25 bp, E. coli
tcattgcctacactcatagcggcct

SEQ ID NO: 136600 - DNA, 25 bp, E. coli
tcattgcctacagtcatagcggcct

SEQ ID NO: 136601 - DNA, 25 bp, E. coli
gaaatgattccgaaggtgaacggct

SEQ ID NO: 136602 - DNA, 25 bp, E. coli
gacttatcactggatgggaacaaca

SEQ ID NO: 136603 - DNA, 25 bp, E. coli
gaaatgattccgtaggtgaacggct

SEQ ID NO: 136604 - DNA, 25 bp, E. coli
gacttatcactgcatgggaacaaca

SEQ ID NO: 136605 - DNA, 25 bp, E. coli
cgcagttacaggatcaaacattgcc

SEQ ID NO: 136606 - DNA, 25 bp, E. coli
cgcagttacaggttcaaacattgcc

SEQ ID NO: 136607 - DNA, 25 bp, E. coli
gggaacaacaatgatcaacttctcg

SEQ ID NO: 136608 - DNA, 25 bp, E. coli
gggaacaacaatcatcaacttctcg

SEQ ID NO: 136609 - DNA, 25 bp, E. coli
caacggtatttccattgatggagaa

SEQ ID NO: 136610 - DNA, 25 bp, E. coli
cacaacggtattacgattgatggag

SEQ ID NO: 136611 - DNA, 25 bp, E. coli
cacaacggtatttcgattgatggag

SEQ ID NO: 136612 - DNA, 25 bp, E. coli
caacggtatttcgattgatggagaa

SEQ ID NO: 136613 - DNA, 25 bp, E. coli
tatttatcacgcatgggatgcccgc

SEQ ID NO: 136614 - DNA, 25 bp, E. coli
ttacgggccgatgctaccggagctg

SEQ ID NO: 136615 - DNA, 25 bp, E. coli
tatttcgattgaaggagaaaccgaa

SEQ ID NO: 136616 - DNA, 25 bp, E. coli
tttcgtcaactgcattcgaaaaccc

SEQ ID NO: 136617 - DNA, 25 bp, E. coli
tatttcgattgatggagaaaccgaa

SEQ ID NO: 136618 - DNA, 25 bp, E. coli
tttcgtcaactggattcgaaaaccc

SEQ ID NO: 136619 - DNA, 25 bp, E. coli
tatttatcacgcttgggatgcccgc

SEQ ID NO: 136620 - DNA, 25 bp, E. coli
ttacgggccgatcctaccggagctg

SEQ ID NO: 136621 - DNA, 25 bp, E. coli
tgctaccggagcagctcggcggttc

SEQ ID NO: 136622 - DNA, 25 bp, E. coli
tgctaccggagctgctcggcggttc

SEQ ID NO: 136623 - DNA, 25 bp, E. coli
gaagaactttcgtcaactgcattcg

SEQ ID NO: 136624 - DNA, 25 bp, E. coli
gaagaactttcgacaactgcattcg

SEQ ID NO: 136625 - DNA, 25 bp, E. coli
cgattgatggagtaaccgaaggctg

SEQ ID NO: 136626 - DNA, 25 bp, E. coli
cgattgatggagaaaccgaaggctg

SEQ ID NO: 136627 - DNA, 25 bp, E. coli
ggaagagctgaagaactttcgtcaa

SEQ ID NO: 136628 - DNA, 25 bp, E. coli
ggaagagctgaacaactttcgtcaa

SEQ ID NO: 136629 - DNA, 25 bp, E. coli
gagctgaagaactttcgtcaactgc

SEQ ID NO: 136630 - DNA, 25 bp, E. coli
gagctgaagaacattcgtcaactgc

SEQ ID NO: 136631 - DNA, 25 bp, E. coli
caaaacaggtgatcagtgaggagcg

SEQ ID NO: 136632 - DNA, 25 bp, E. coli
caaaacaggtgaacagtgaggagcg

SEQ ID NO: 136633 - DNA, 25 bp, E. coli
cagtgtcacaaaacaggtgaacagt

SEQ ID NO: 136634 - DNA, 25 bp, E. coli
cagtgtcacaaatcaggtgaacagt

SEQ ID NO: 136635 - DNA, 25 bp, E. coli
tacgcgttatttgacaccctgttgc

SEQ ID NO: 136636 - DNA, 25 bp, E. coli
agtgtttgaccgaggacgtaccaca

SEQ ID NO: 136637 - DNA, 25 bp, E. coli
agtgtttgaccgtggacgtaccaca

SEQ ID NO: 136638 - DNA, 25 bp, E. coli
tacgcgttatttcacaccctgttgc

SEQ ID NO: 136639 - DNA, 25 bp, E. coli
tatttgacaccctgttgcaactggc

SEQ ID NO: 136640 - DNA, 25 bp, E. coli
tatttgacacccagttgcaactggc

SEQ ID NO: 136641 - DNA, 25 bp, E. coli
tgaccgtggacgaaccacatcgctg

SEQ ID NO: 136642 - DNA, 25 bp, E. coli
tgaacagtgaggagcgcgatgacac

SEQ ID NO: 136643 - DNA, 25 bp, E. coli
tgaacagtgaggtgcgcgatgacac

SEQ ID NO: 136644 - DNA, 25 bp, E. coli
tgaccgtggacgtaccacatcgctg

SEQ ID NO: 136645 - DNA, 25 bp, E. coli
gacgtaccacatcgctgctgctgtt

SEQ ID NO: 136646 - DNA, 25 bp, E. coli
gacgtaccacatggctgctgctgtt

SEQ ID NO: 136647 - DNA, 25 bp, E. coli
cgcgttatttgacaccctgttgcaa

SEQ ID NO: 136648 - DNA, 25 bp, E. coli
cgcgttatttgagaccctgttgcaa

SEQ ID NO: 136649 - DNA, 25 bp, E. coli
cgtggtacgcgttatttgacaccct

SEQ ID NO: 136650 - DNA, 25 bp, E. coli
cgtggtacgcgtaatttgacaccct

SEQ ID NO: 136651 - DNA, 25 bp, E. coli
gtggacgtaccagatcgctgctgct

SEQ ID NO: 136652 - DNA, 25 bp, E. coli
gtggacgtaccacatcgctgctgct

SEQ ID NO: 136653 - DNA, 25 bp, E. coli
caagtaaaacgagaggttgccgccg

SEQ ID NO: 136654 - DNA, 25 bp, E. coli
caagtaaaacgacaggttgccgccg

SEQ ID NO: 136655 - DNA, 25 bp, E. coli
tacaaatcggcggagatggctcagt

SEQ ID NO: 136656 - DNA, 25 bp, E. coli
tacaaatcggcgcagatggctcagt

SEQ ID NO: 136657 - DNA, 25 bp, E. coli
tactggcaaaagagatcgctggctc

SEQ ID NO: 136658 - DNA, 25 bp, E. coli
tactggcaaaagtgatcgctggctc

SEQ ID NO: 136659 - DNA, 25 bp, E. coli
taaaaggcatcgatcatctggcgca

SEQ ID NO: 136660 - DNA, 25 bp, E. coli
taaaaggcatcgttcatctggcgca

SEQ ID NO: 136661 - DNA, 25 bp, E. coli
tatttgatatgcaccgggaagcggc

SEQ ID NO: 136662 - DNA, 25 bp, E. coli
tatttgatatgctccgggaagcggc

SEQ ID NO: 136663 - DNA, 25 bp, E. coli
tctactggaacaaggtcgccacggt

SEQ ID NO: 136664 - DNA, 25 bp, E. coli
tcgttatatggatcatggcccggcg

SEQ ID NO: 136665 - DNA, 25 bp, E. coli
tcgttatatggaacatggcccggcg

SEQ ID NO: 136666 - DNA, 25 bp, E. coli
tctactggaacatggtcgccacggt

SEQ ID NO: 136667 - DNA, 25 bp, E. coli
gcaatgaatgaaaaagcggcgcaac

SEQ ID NO: 136668 - DNA, 25 bp, E. coli
gcaatgaatgaataagcggcgcaac

SEQ ID NO: 136669 - DNA, 25 bp, E. coli
gactactggtcagggaaattgcccc

SEQ ID NO: 136670 - DNA, 25 bp, E. coli
gactactggtcacggaaattgcccc

SEQ ID NO: 136671 - DNA, 25 bp, E. coli
gtttttccccagaatcgtgccgcag

SEQ ID NO: 136672 - DNA, 25 bp, E. coli
gatatcacctcacatgcgaagcgca

SEQ ID NO: 136673 - DNA, 25 bp, E. coli
gatatcacctcagatgcgaagcgca

SEQ ID NO: 136674 - DNA, 25 bp, E. coli
gtttttccccagtatcgtgccgcag

SEQ ID NO: 136675 - DNA, 25 bp, E. coli
cacagttaagtttattctgagagca

SEQ ID NO: 136676 - DNA, 25 bp, E. coli
caacaataaaattgaggcccggcgt

SEQ ID NO: 136677 - DNA, 25 bp, E. coli
cacagttaagttaattctgagagca

SEQ ID NO: 136678 - DNA, 25 bp, E. coli
caacaataaaatagaggcccggcgt

SEQ ID NO: 136679 - DNA, 25 bp, E. coli
catcgaacaacgtagcgttaaaact

SEQ ID NO: 136680 - DNA, 25 bp, E. coli
catcgaacaacgaagcgttaaaact

SEQ ID NO: 136681 - DNA, 25 bp, E. coli
aaacttttagctgttatcaggatgc

SEQ ID NO: 136682 - DNA, 25 bp, E. coli
aaacttttagctcttatcaggatgc

SEQ ID NO: 136683 - DNA, 25 bp, E. coli
tatcttatagactaaatttcactgc

SEQ ID NO: 136684 - DNA, 25 bp, E. coli
tatcttatagacaaaatttcactgc

SEQ ID NO: 136685 - DNA, 25 bp, E. coli
ttgaggcccggcctatattgcaccg

SEQ ID NO: 136686 - DNA, 25 bp, E. coli
ttgaggcccggcgtatattgcaccg

SEQ ID NO: 136687 - DNA, 25 bp, E. coli
tgcgttgaccatcgaacaacgtagc

SEQ ID NO: 136688 - DNA, 25 bp, E. coli
tgcgttgaccatggaacaacgtagc

SEQ ID NO: 136689 - DNA, 25 bp, E. coli
gctcttatcaggttgctaaaaacat

SEQ ID NO: 136690 - DNA, 25 bp, E. coli
gctaaaaacatcatgattcacagtt

SEQ ID NO: 136691 - DNA, 25 bp, E. coli
gctaaaaacatcttgattcacagtt

SEQ ID NO: 136692 - DNA, 25 bp, E. coli
gctcttatcaggatgctaaaaacat

SEQ ID NO: 136693 - DNA, 25 bp, E. coli
gaattgtttttccttgcgttgacca

SEQ ID NO: 136694 - DNA, 25 bp, E. coli
gaattgtttttcgttgcgttgacca

SEQ ID NO: 136695 - DNA, 25 bp, E. coli
ggcgtatattgcaccgggctttttt

SEQ ID NO: 136696 - DNA, 25 bp, E. coli
ggcgtatattgctccgggctttttt

SEQ ID NO: 136697 - DNA, 25 bp, E. coli
aagacaatttcgcagtcttgcgccg

SEQ ID NO: 136698 - DNA, 25 bp, E. coli
aagacaatttcggagtcttgcgccg

SEQ ID NO: 136699 - DNA, 25 bp, E. coli
ccaggtaaatttttgggattgtagc

SEQ ID NO: 136700 - DNA, 25 bp, E. coli
ccaggtaaatttatgggattgtagc

SEQ ID NO: 136701 - DNA, 25 bp, E. coli
tatagccattaagcccaggaatccg

SEQ ID NO: 136702 - DNA, 25 bp, E. coli
tatagccattaaccccaggaatccg

SEQ ID NO: 136703 - DNA, 25 bp, E. coli
tattcccgggaaatcatcatgatta

SEQ ID NO: 136704 - DNA, 25 bp, E. coli
tattcccgggaattcatcatgatta

SEQ ID NO: 136705 - DNA, 25 bp, E. coli
tgattagtgcgtttgatagcgtcac

SEQ ID NO: 136706 - DNA, 25 bp, E. coli
tgattagtgcgtatgatagcgtcac

SEQ ID NO: 136707 - DNA, 25 bp, E. coli
tgagtgcacgaaagcgaaattgatg

SEQ ID NO: 136708 - DNA, 25 bp, E. coli
tgagtgcacgaatgcgaaattgatg

SEQ ID NO: 136709 - DNA, 25 bp, E. coli
tcttgcgccgcaatgattagtgcgt

SEQ ID NO: 136710 - DNA, 25 bp, E. coli
tcttgcgccgcattgattagtgcgt

SEQ ID NO: 136711 - DNA, 25 bp, E. coli
gaaattgatgaaacgttcgctcact

SEQ ID NO: 136712 - DNA, 25 bp, E. coli
gaaattgatgaatcgttcgctcact

SEQ ID NO: 136713 - DNA, 25 bp, E. coli
cgttcgctcactttttaccaggtaa

SEQ ID NO: 136714 - DNA, 25 bp, E. coli
cgttcgctcactatttaccaggtaa

SEQ ID NO: 136715 - DNA, 25 bp, E. coli
ggagttgcgctcttacccttatagc

SEQ ID NO: 136716 - DNA, 25 bp, E. coli
ggagttgcgctcatacccttatagc

SEQ ID NO: 136717 - DNA, 25 bp, E. coli
tcaaaacgttaaaaatgagtgcacg

SEQ ID NO: 136718 - DNA, 25 bp, E. coli
tcaaaacgttaataatgagtgcacg

SEQ ID NO: 136719 - DNA, 25 bp, E. coli
catcggcggcgcaactgatgtaggc

SEQ ID NO: 136720 - DNA, 25 bp, E. coli
catcggcggcgctactgatgtaggc

SEQ ID NO: 136721 - DNA, 25 bp, E. coli
taaaaagcggtcagaaatcactgcc

SEQ ID NO: 136722 - DNA, 25 bp, E. coli
taaaaagcggtctgaaatcactgcc

SEQ ID NO: 136723 - DNA, 25 bp, E. coli
taaacctcggtgtagttgctgatac

SEQ ID NO: 136724 - DNA, 25 bp, E. coli
taaacctcggtgaagttgctgatac

SEQ ID NO: 136725 - DNA, 25 bp, E. coli
aaaacactctggtaggtaacatcgg

SEQ ID NO: 136726 - DNA, 25 bp, E. coli
aaaacactctggaaggtaacatcgg

SEQ ID NO: 136727 - DNA, 25 bp, E. coli
tatctgacggcagtaacactgttga

SEQ ID NO: 136728 - DNA, 25 bp, E. coli
tatctgacggcactaacactgttga

SEQ ID NO: 136729 - DNA, 25 bp, E. coli
tttaaagcccgtttggagtctctgg

SEQ ID NO: 136730 - DNA, 25 bp, E. coli
tttaaagcccgtatggagtctctgg

SEQ ID NO: 136731 - DNA, 25 bp, E. coli
tgttcgcaaccggattgttatcagg

SEQ ID NO: 136732 - DNA, 25 bp, E. coli
tgttcgcaaccgcattgttatcagg

SEQ ID NO: 136733 - DNA, 25 bp, E. coli
gcttttaacgctgttgctgacgatg

SEQ ID NO: 136734 - DNA, 25 bp, E. coli
gcttttaacgctcttgctgacgatg

SEQ ID NO: 136735 - DNA, 25 bp, E. coli
cgatgctaatcagggttcaggtaaa

SEQ ID NO: 136736 - DNA, 25 bp, E. coli
cgatgctaatcacggttcaggtaaa

SEQ ID NO: 136737 - DNA, 25 bp, E. coli
gttctgccagtgttgacgctaccga

SEQ ID NO: 136738 - DNA, 25 bp, E. coli
gttctgccagtgatgacgctaccga

SEQ ID NO: 136739 - DNA, 25 bp, E. coli
ggcacaggctaaatacgtactcgac

SEQ ID NO: 136740 - DNA, 25 bp, E. coli
ggcacaggctaattacgtactcgac

SEQ ID NO: 136741 - DNA, 25 bp, E. coli
aaggaaattattcacgccacaggaa

SEQ ID NO: 136742 - DNA, 25 bp, E. coli
aattattcacgcgacaggaaaaagg

SEQ ID NO: 136743 - DNA, 25 bp, E. coli
aattattcacgccacaggaaaaagg

SEQ ID NO: 136744 - DNA, 25 bp, E. coli
aaggaaattattgacgccacaggaa

SEQ ID NO: 136745 - DNA, 25 bp, E. coli
attcacgccacaggaaaaaggcgca

SEQ ID NO: 136746 - DNA, 25 bp, E. coli
attcacgccacacgaaaaaggcgca

SEQ ID NO: 136747 - DNA, 25 bp, E. coli
tattcacgccacaggaaaaaggcgc

SEQ ID NO: 136748 - DNA, 25 bp, E. coli
tataaggaaatttttcacgccacag

SEQ ID NO: 136749 - DNA, 25 bp, E. coli
tataaggaaattattcacgccacag

SEQ ID NO: 136750 - DNA, 25 bp, E. coli
tattcacgccactggaaaaaggcgc

SEQ ID NO: 136751 - DNA, 25 bp, E. coli
tcaccggcctataaggaaattattc

SEQ ID NO: 136752 - DNA, 25 bp, E. coli
tcaccggcctattaggaaattattc

SEQ ID NO: 136753 - DNA, 25 bp, E. coli
ccggcctataagcaaattattcacg

SEQ ID NO: 136754 - DNA, 25 bp, E. coli
gcctataaggaaattattcacgcca

SEQ ID NO: 136755 - DNA, 25 bp, E. coli
ccggcctataaggaaattattcacg

SEQ ID NO: 136756 - DNA, 25 bp, E. coli
gcctataaggaatttattcacgcca

SEQ ID NO: 136757 - DNA, 25 bp, E. coli
ggaaattattcacgccacaggaaaa

SEQ ID NO: 136758 - DNA, 25 bp, E. coli
ggaaattattcaggccacaggaaaa

SEQ ID NO: 136759 - DNA, 25 bp, E. coli
taaggaaattattcacgccacagga

SEQ ID NO: 136760 - DNA, 25 bp, E. coli
taaggaaattatacacgccacagga

SEQ ID NO: 136761 - DNA, 25 bp, E. coli
gatggggataaacagagaaaaaaca

SEQ ID NO: 136762 - DNA, 25 bp, E. coli
gatggggataaagagagaaaaaaca

SEQ ID NO: 136763 - DNA, 25 bp, E. coli
catggatgaagaacatagaacctgg

SEQ ID NO: 136764 - DNA, 25 bp, E. coli
catggatgaagatcatagaacctgg

SEQ ID NO: 136765 - DNA, 25 bp, E. coli
aacatagaacctcgttttgcgcacg

SEQ ID NO: 136766 - DNA, 25 bp, E. coli
aacatagaacctggttttgcgcacg

SEQ ID NO: 136767 - DNA, 25 bp, E. coli
tagttttgccagtatgcacgcagaa

SEQ ID NO: 136768 - DNA, 25 bp, E. coli
tagttttgccagaatgcacgcagaa

SEQ ID NO: 136769 - DNA, 25 bp, E. coli
tttgcgcacgttatgcctggtattg

SEQ ID NO: 136770 - DNA, 25 bp, E. coli
tttgcgcacgttttgcctggtattg

SEQ ID NO: 136771 - DNA, 25 bp, E. coli
tgccagaatgcacgcagaaggtcgc

SEQ ID NO: 136772 - DNA, 25 bp, E. coli
tgccagaatgcaggcagaaggtcgc

SEQ ID NO: 136773 - DNA, 25 bp, E. coli
gcgcgtagttttgccagaatgcacg

SEQ ID NO: 136774 - DNA, 25 bp, E. coli
ccgttactggtatcatggatgaaga

SEQ ID NO: 136775 - DNA, 25 bp, E. coli
gcgcgtagttttcccagaatgcacg

SEQ ID NO: 136776 - DNA, 25 bp, E. coli
gaacctggttttccgcacgttatgc

SEQ ID NO: 136777 - DNA, 25 bp, E. coli
gaaggtcgcccgctcgatattctgg

SEQ ID NO: 136778 - DNA, 25 bp, E. coli
gaacctggttttgcgcacgttatgc

SEQ ID NO: 136779 - DNA, 25 bp, E. coli
gaaggtcgcccggtcgatattctgg

SEQ ID NO: 136780 - DNA, 25 bp, E. coli
ccgttactggtaacatggatgaaga

SEQ ID NO: 136781 - DNA, 25 bp, E. coli
gatattctggcccttactggtaaca

SEQ ID NO: 136782 - DNA, 25 bp, E. coli
gatattctggccgttactggtaaca

SEQ ID NO: 136783 - DNA, 25 bp, E. coli
tggatcatagtcataattctttaaa

SEQ ID NO: 136784 - DNA, 25 bp, E. coli
tggatcatagtcttaattctttaaa

SEQ ID NO: 136785 - DNA, 25 bp, E. coli
catcacctcggccatcgtggactgg

SEQ ID NO: 136786 - DNA, 25 bp, E. coli
catcacctcggcgatcgtggactgg

SEQ ID NO: 136787 - DNA, 25 bp, E. coli
atggtcacgcagctggagttcgccc

SEQ ID NO: 136788 - DNA, 25 bp, E. coli
atggtcacgcaggtggagttcgccc

SEQ ID NO: 136789 - DNA, 25 bp, E. coli
tggtcgagctgtccttcaccggcgt

SEQ ID NO: 136790 - DNA, 25 bp, E. coli
tcaggtgacgtcgtacgagatcgac

SEQ ID NO: 136791 - DNA, 25 bp, E. coli
tcaggtgacgtcctacgagatcgac

SEQ ID NO: 136792 - DNA, 25 bp, E. coli
gctggatcagaacaacgaaccgagg

SEQ ID NO: 136793 - DNA, 25 bp, E. coli
gctggatcagaagaacgaaccgagg

SEQ ID NO: 136794 - DNA, 25 bp, E. coli
gaacgctacgagtcgatggtcgagc

SEQ ID NO: 136795 - DNA, 25 bp, E. coli
gaacgctacgagacgatggtcgagc

SEQ ID NO: 136796 - DNA, 25 bp, E. coli
gagaaggtcgactcggcgatcatgc

SEQ ID NO: 136797 - DNA, 25 bp, E. coli
gagaaggtcgacacggcgatcatgc

SEQ ID NO: 136798 - DNA, 25 bp, E. coli
cgaacatcgaagacgtcaacgccga

SEQ ID NO: 136799 - DNA, 25 bp, E. coli
cgttgcgggagaagctttccggcca

SEQ ID NO: 136800 - DNA, 25 bp, E. coli
cgttgcgggagatgctttccggcca

SEQ ID NO: 136801 - DNA, 25 bp, E. coli
cgaacatcgaagtcgtcaacgccga

SEQ ID NO: 136802 - DNA, 25 bp, E. coli
gtcgcttctgcggaagtacccgagg

SEQ ID NO: 136803 - DNA, 25 bp, E. coli
gtcgcttctgcgcaagtacccgagg

SEQ ID NO: 136804 - DNA, 25 bp, E. coli
tggtcgagctgtgcttcaccggcgt

SEQ ID NO: 136805 - DNA, 25 bp, E. coli
tcacggtgatgacctggccgctgtt

SEQ ID NO: 136806 - DNA, 25 bp, E. coli
tcacggtgatgagctggccgctgtt

SEQ ID NO: 136807 - DNA, 25 bp, E. coli
caaaacgcacgcctttgacaagtgc

SEQ ID NO: 136808 - DNA, 25 bp, E. coli
caaaacgcacgcgtttgacaagtgc

SEQ ID NO: 136809 - DNA, 25 bp, E. coli
gccattttttcagtacaatcaccct

SEQ ID NO: 136810 - DNA, 25 bp, E. coli
gccattttttcactacaatcaccct

SEQ ID NO: 136811 - DNA, 25 bp, E. coli
caatcaccctattttcctaaccata

SEQ ID NO: 136812 - DNA, 25 bp, E. coli
caatcaccctatattcctaaccata

SEQ ID NO: 136813 - DNA, 25 bp, E. coli
tataaatattcacaatagggcgcga

SEQ ID NO: 136814 - DNA, 25 bp, E. coli
tataaatattcagaatagggcgcga

SEQ ID NO: 136815 - DNA, 25 bp, E. coli
tgacaagtgctagagtcaatacacg

SEQ ID NO: 136816 - DNA, 25 bp, E. coli
tgacaagtgctacagtcaatacacg

SEQ ID NO: 136817 - DNA, 25 bp, E. coli
tcagagtgcgctataaatattcaca

SEQ ID NO: 136818 - DNA, 25 bp, E. coli
ccttttcaatgaatcagagtgcgct

SEQ ID NO: 136819 - DNA, 25 bp, E. coli
ccttttcaatgattcagagtgcgct

SEQ ID NO: 136820 - DNA, 25 bp, E. coli
gctacagtcaattcacgaagaaaaa

SEQ ID NO: 136821 - DNA, 25 bp, E. coli
gcttccgcgcacaccttttcaatga

SEQ ID NO: 136822 - DNA, 25 bp, E. coli
gcttccgcgcactccttttcaatga

SEQ ID NO: 136823 - DNA, 25 bp, E. coli
gctacagtcaatacacgaagaaaaa

SEQ ID NO: 136824 - DNA, 25 bp, E. coli
gtacggtaacgtatatctgtgccat

SEQ ID NO: 136825 - DNA, 25 bp, E. coli
gtacggtaacgtttatctgtgccat

SEQ ID NO: 136826 - DNA, 25 bp, E. coli
tagggcgcgaatattacgcaaaacg

SEQ ID NO: 136827 - DNA, 25 bp, E. coli
tagggcgcgaattttacgcaaaacg

SEQ ID NO: 136828 - DNA, 25 bp, E. coli
tcagagtgcgctttaaatattcaca

SEQ ID NO: 136829 - DNA, 25 bp, E. coli
atttggagcaaaaatggaccgcgtc

SEQ ID NO: 136830 - DNA, 25 bp, E. coli
atttggagcaaatatggaccgcgtc

SEQ ID NO: 136831 - DNA, 25 bp, E. coli
tttggagcaaatttggaccgcgtcc

SEQ ID NO: 136832 - DNA, 25 bp, E. coli
tatttggagcaaatatggaccgcgt

SEQ ID NO: 136833 - DNA, 25 bp, E. coli
tatttggagcaattatggaccgcgt

SEQ ID NO: 136834 - DNA, 25 bp, E. coli
tttggagcaaatatggaccgcgtcc

SEQ ID NO: 136835 - DNA, 25 bp, E. coli
ttggagcaaataaggaccgcgtcct

SEQ ID NO: 136836 - DNA, 25 bp, E. coli
ttggagcaaatatggaccgcgtcct

SEQ ID NO: 136837 - DNA, 25 bp, E. coli
tgatcgctgcactgaacgctctgtt

SEQ ID NO: 136838 - DNA, 25 bp, E. coli
tgatcgctgcacagaacgctctgtt

SEQ ID NO: 136839 - DNA, 25 bp, E. coli
tcgctgcactgaacgctctgtttgc

SEQ ID NO: 136840 - DNA, 25 bp, E. coli
tcgctgcactgatcgctctgtttgc

SEQ ID NO: 136841 - DNA, 25 bp, E. coli
cctgatcgctgcactgaacgctctg

SEQ ID NO: 136842 - DNA, 25 bp, E. coli
cctgatcgctgctctgaacgctctg

SEQ ID NO: 136843 - DNA, 25 bp, E. coli
cgctgcactgaaggctctgtttgct

SEQ ID NO: 136844 - DNA, 25 bp, E. coli
cgctgcactgaacgctctgtttgct

SEQ ID NO: 136845 - DNA, 25 bp, E. coli
ctgcactgaacggtctgtttgctac

SEQ ID NO: 136846 - DNA, 25 bp, E. coli
ctgcactgaacgctctgtttgctac

SEQ ID NO: 136847 - DNA, 25 bp, E. coli
gatcgctgcactcaacgctctgttt

SEQ ID NO: 136848 - DNA, 25 bp, E. coli
tggagcaaatatggaccgcgtcctt

SEQ ID NO: 136849 - DNA, 25 bp, E. coli
tggagcaaatatcgaccgcgtcctt

SEQ ID NO: 136850 - DNA, 25 bp, E. coli
gatcgctgcactgaacgctctgttt

SEQ ID NO: 136851 - DNA, 25 bp, E. coli
aaaaagcaggtcttggctggacagg

SEQ ID NO: 136852 - DNA, 25 bp, E. coli
aaagcaggtcttggctggacaggta

SEQ ID NO: 136853 - DNA, 25 bp, E. coli
aaagcaggtcttcgctggacaggta

SEQ ID NO: 136854 - DNA, 25 bp, E. coli
aaaaagcaggtcatggctggacagg

SEQ ID NO: 136855 - DNA, 25 bp, E. coli
tcgtcctcacgatttattgcccggt

SEQ ID NO: 136856 - DNA, 25 bp, E. coli
tcgtcctcacgaattattgcccggt

SEQ ID NO: 136857 - DNA, 25 bp, E. coli
tcctcacgaattattgcccggtacg

SEQ ID NO: 136858 - DNA, 25 bp, E. coli
tcctcacgaatttttgcccggtacg

SEQ ID NO: 136859 - DNA, 25 bp, E. coli
gcgtgctcgtcctcacgaattattg

SEQ ID NO: 136860 - DNA, 25 bp, E. coli
gctgcgtgctcgacctcacgaatta

SEQ ID NO: 136861 - DNA, 25 bp, E. coli
gctgcgtgctcgtcctcacgaatta

SEQ ID NO: 136862 - DNA, 25 bp, E. coli
gcgtggtcgaagtgcaattaccgaa

SEQ ID NO: 136863 - DNA, 25 bp, E. coli
gcgtggtcgaagagcaattaccgaa

SEQ ID NO: 136864 - DNA, 25 bp, E. coli
gcgtgctcgtccacacgaattattg

SEQ ID NO: 136865 - DNA, 25 bp, E. coli
ctgaaaaagcagctcttggctggac

SEQ ID NO: 136866 - DNA, 25 bp, E. coli
cgtgcgtggtcgaagtgcaattacc

SEQ ID NO: 136867 - DNA, 25 bp, E. coli
cgtgcgtggtcgtagtgcaattacc

SEQ ID NO: 136868 - DNA, 25 bp, E. coli
ctgaaaaagcaggtcttggctggac

SEQ ID NO: 136869 - DNA, 25 bp, E. coli
gttagctgaaaaagcaggtcttggc

SEQ ID NO: 136870 - DNA, 25 bp, E. coli
gttagctgaaaatgcaggtcttggc

SEQ ID NO: 136871 - DNA, 25 bp, E. coli
gtggtcgaagtggaattaccgaaaa

SEQ ID NO: 136872 - DNA, 25 bp, E. coli
gtggtcgaagtgcaattaccgaaaa

SEQ ID NO: 136873 - DNA, 25 bp, E. coli
aatgacgggactaatggccagatag

SEQ ID NO: 136874 - DNA, 25 bp, E. coli
aatgacgggacttatggccagatag

SEQ ID NO: 136875 - DNA, 25 bp, E. coli
tgtgcgcgcggtcggcagtatgaac

SEQ ID NO: 136876 - DNA, 25 bp, E. coli
tgtgcgcgcggtgggcagtatgaac

SEQ ID NO: 136877 - DNA, 25 bp, E. coli
tgaacgccttaaagaccaggaaact

SEQ ID NO: 136878 - DNA, 25 bp, E. coli
tgaacgccttaatgaccaggaaact

SEQ ID NO: 136879 - DNA, 25 bp, E. coli
tgcgcagggcgatctgaaaaccctg

SEQ ID NO: 136880 - DNA, 25 bp, E. coli
tgcgcagggcgaactgaaaaccctg

SEQ ID NO: 136881 - DNA, 25 bp, E. coli
tcagaatgacgggactaatggccag

SEQ ID NO: 136882 - DNA, 25 bp, E. coli
gcgtaataacgacgcgaacaaacct

SEQ ID NO: 136883 - DNA, 25 bp, E. coli
gcgtaataacgaggcgaacaaacct

SEQ ID NO: 136884 - DNA, 25 bp, E. coli
gctgaagtaccacactgcgcagggc

SEQ ID NO: 136885 - DNA, 25 bp, E. coli
gctgaagtaccagactgcgcagggc

SEQ ID NO: 136886 - DNA, 25 bp, E. coli
gactaatggccacatagggccggag

SEQ ID NO: 136887 - DNA, 25 bp, E. coli
gactaatggccagatagggccggag

SEQ ID NO: 136888 - DNA, 25 bp, E. coli
ccaggaaactttatatgccgaatcg

SEQ ID NO: 136889 - DNA, 25 bp, E. coli
ccaggaaactttttatgccgaatcg

SEQ ID NO: 136890 - DNA, 25 bp, E. coli
ggatggctcgctgggtgtgcgcgcg

SEQ ID NO: 136891 - DNA, 25 bp, E. coli
ggatggctcgctcggtgtgcgcgcg

SEQ ID NO: 136892 - DNA, 25 bp, E. coli
tcagaatgacggcactaatggccag

SEQ ID NO: 136893 - DNA, 25 bp, E. coli
gagtgaacgccttaaagaccaggaa

SEQ ID NO: 136894 - DNA, 25 bp, E. coli
gagtgaacgcctaaaagaccaggaa

SEQ ID NO: 136895 - DNA, 25 bp, E. coli
catccgaaagtgtttaccgtggcgg

SEQ ID NO: 136896 - DNA, 25 bp, E. coli
catccgaaagtgattaccgtggcgg

SEQ ID NO: 136897 - DNA, 25 bp, E. coli
tacagcgaaccgatgatgattaccc

SEQ ID NO: 136898 - DNA, 25 bp, E. coli
tacagcttcatccattgttggtgcg

SEQ ID NO: 136899 - DNA, 25 bp, E. coli
tacagcgaaccgttgatgattaccc

SEQ ID NO: 136900 - DNA, 25 bp, E. coli
tacagcttcatcgattgttggtgcg

SEQ ID NO: 136901 - DNA, 25 bp, E. coli
gatgattaccctgttaaccaacttt

SEQ ID NO: 136902 - DNA, 25 bp, E. coli
gatgattaccctcttaaccaacttt

SEQ ID NO: 136903 - DNA, 25 bp, E. coli
gcttataccgcattgatttcggcgg

SEQ ID NO: 136904 - DNA, 25 bp, E. coli
gcttataccgcaatgatttcggcgg

SEQ ID NO: 136905 - DNA, 25 bp, E. coli
cggtctttccatacctggattatgg

SEQ ID NO: 136906 - DNA, 25 bp, E. coli
cggtctttccattcctggattatgg

SEQ ID NO: 136907 - DNA, 25 bp, E. coli
gattatggttgttccgcaagcgccc

SEQ ID NO: 136908 - DNA, 25 bp, E. coli
gattatggttgtaccgcaagcgccc

SEQ ID NO: 136909 - DNA, 25 bp, E. coli
gatttcggcggttaaaatcagccag

SEQ ID NO: 136910 - DNA, 25 bp, E. coli
gatttcggcggtaaaaatcagccag

SEQ ID NO: 136911 - DNA, 25 bp, E. coli
ggtgcgttatccatcggtctttcca

SEQ ID NO: 136912 - DNA, 25 bp, E. coli
ggtattcaatggacgcgctggtatc

SEQ ID NO: 136913 - DNA, 25 bp, E. coli
ggtatctggcgcatccgaaagtgtt

SEQ ID NO: 136914 - DNA, 25 bp, E. coli
ggtgcgttatccttcggtctttcca

SEQ ID NO: 136915 - DNA, 25 bp, E. coli
ggtatctggcgcttccgaaagtgtt

SEQ ID NO: 136916 - DNA, 25 bp, E. coli
ggtattcaatggtcgcgctggtatc

SEQ ID NO: 136917 - DNA, 25 bp, E. coli
aattctttgtccgtccgctgcgtga

SEQ ID NO: 136918 - DNA, 25 bp, E. coli
aattctttgtccctccgctgcgtga

SEQ ID NO: 136919 - DNA, 25 bp, E. coli
cagccgctggcagtatctaccgaaa

SEQ ID NO: 136920 - DNA, 25 bp, E. coli
cagccgctggcactatctaccgaaa

SEQ ID NO: 136921 - DNA, 25 bp, E. coli
agaacgtgccgaatctgtttgcccg

SEQ ID NO: 136922 - DNA, 25 bp, E. coli
agaacgtgccgattctgtttgcccg

SEQ ID NO: 136923 - DNA, 25 bp, E. coli
actacaaggtcgtcatgaaagaggc

SEQ ID NO: 136924 - DNA, 25 bp, E. coli
actacaaggtcgacatgaaagaggc

SEQ ID NO: 136925 - DNA, 25 bp, E. coli
tgtttgcccgtatcgaacgcgtgat

SEQ ID NO: 136926 - DNA, 25 bp, E. coli
tgtttgcccgtaacgaacgcgtgat

SEQ ID NO: 136927 - DNA, 25 bp, E. coli
tgtcacgaaaataggccagccgctg

SEQ ID NO: 136928 - DNA, 25 bp, E. coli
tggttgagcaacaggaaagcctgtc

SEQ ID NO: 136929 - DNA, 25 bp, E. coli
tgtcacgaaaattggccagccgctg

SEQ ID NO: 136930 - DNA, 25 bp, E. coli
tgaaagaggcgctaaagccggacac

SEQ ID NO: 136931 - DNA, 25 bp, E. coli
tgaaagaggcgcaaaagccggacac

SEQ ID NO: 136932 - DNA, 25 bp, E. coli
gaaacctttgtttcgccagacgctg

SEQ ID NO: 136933 - DNA, 25 bp, E. coli
gaaacctttgttacgccagacgctg

SEQ ID NO: 136934 - DNA, 25 bp, E. coli
ctgaaaggccagcaaatgggtcgct

SEQ ID NO: 136935 - DNA, 25 bp, E. coli
ctgaaaggccaggaaatgggtcgct

SEQ ID NO: 136936 - DNA, 25 bp, E. coli
gataaaatcctggaagccaaaggcc

SEQ ID NO: 136937 - DNA, 25 bp, E. coli
gataaaatcctgcaagccaaaggcc

SEQ ID NO: 136938 - DNA, 25 bp, E. coli
tggttgagcaactggaaagcctgtc

SEQ ID NO: 136939 - DNA, 25 bp, E. coli
catagcatgaaagatagcaaaggct

SEQ ID NO: 136940 - DNA, 25 bp, E. coli
caggcttcaaaattagtgatctgtc

SEQ ID NO: 136941 - DNA, 25 bp, E. coli
caggcttcaaaaatagtgatctgtc

SEQ ID NO: 136942 - DNA, 25 bp, E. coli
catggttaaggataacgagatctga

SEQ ID NO: 136943 - DNA, 25 bp, E. coli
catagcatgaaacatagcaaaggct

SEQ ID NO: 136944 - DNA, 25 bp, E. coli
catggttaaggaaaacgagatctga

SEQ ID NO: 136945 - DNA, 25 bp, E. coli
tcctggtctatctgagaaatcacca

SEQ ID NO: 136946 - DNA, 25 bp, E. coli
tccgtgcacattgtatgtaacatgg

SEQ ID NO: 136947 - DNA, 25 bp, E. coli
tccgtgcacattctatgtaacatgg

SEQ ID NO: 136948 - DNA, 25 bp, E. coli
tcctggtctatcagagaaatcacca

SEQ ID NO: 136949 - DNA, 25 bp, E. coli
tcttttcgtagtcataatcctggtc

SEQ ID NO: 136950 - DNA, 25 bp, E. coli
tcttttcgtagtgataatcctggtc

SEQ ID NO: 136951 - DNA, 25 bp, E. coli
tctgctatgttgagtatggaagctg

SEQ ID NO: 136952 - DNA, 25 bp, E. coli
tctgctatgttgtgtatggaagctg

SEQ ID NO: 136953 - DNA, 25 bp, E. coli
gcaaaggctatgttttagaggcaca

SEQ ID NO: 136954 - DNA, 25 bp, E. coli
gcaaaggctatgatttagaggcaca

SEQ ID NO: 136955 - DNA, 25 bp, E. coli
ctataatgacgtgctgtgacaggct

SEQ ID NO: 136956 - DNA, 25 bp, E. coli
ctataatgacgtcctgtgacaggct

SEQ ID NO: 136957 - DNA, 25 bp, E. coli
taatcattctcgtttggcatagcat

SEQ ID NO: 136958 - DNA, 25 bp, E. coli
taatcattctcgattggcatagcat

SEQ ID NO: 136959 - DNA, 25 bp, E. coli
gagatctgacactcactataatgac

SEQ ID NO: 136960 - DNA, 25 bp, E. coli
gagatctgacacacactataatgac

SEQ ID NO: 136961 - DNA, 25 bp, E. coli
caatgtgaatgtcttggcacgctgc

SEQ ID NO: 136962 - DNA, 25 bp, E. coli
caatgtgaatgtgttggcacgctgc

SEQ ID NO: 136963 - DNA, 25 bp, E. coli
atccagttaacccagtttcgccagg

SEQ ID NO: 136964 - DNA, 25 bp, E. coli
atccagttaaccgagtttcgccagg

SEQ ID NO: 136965 - DNA, 25 bp, E. coli
ttagcgccaacggagaaggtcaggc

SEQ ID NO: 136966 - DNA, 25 bp, E. coli
ttagcgccaacgcagaaggtcaggc

SEQ ID NO: 136967 - DNA, 25 bp, E. coli
tgtcaaactgaatcgcggacggctg

SEQ ID NO: 136968 - DNA, 25 bp, E. coli
tgtcaaactgaaacgcggacggctg

SEQ ID NO: 136969 - DNA, 25 bp, E. coli
gctgcggtaacgacaaacgatattt

SEQ ID NO: 136970 - DNA, 25 bp, E. coli
gctttcgatgaggaataattcccgc

SEQ ID NO: 136971 - DNA, 25 bp, E. coli
gctgcggtaacgtcaaacgatattt

SEQ ID NO: 136972 - DNA, 25 bp, E. coli
gctttcgatgagcaataattcccgc

SEQ ID NO: 136973 - DNA, 25 bp, E. coli
ccacaggaaattatgtggttgccgc

SEQ ID NO: 136974 - DNA, 25 bp, E. coli
cgcgtacggtgctggatatcaatca

SEQ ID NO: 136975 - DNA, 25 bp, E. coli
cgcgtacggtgcaggatatcaatca

SEQ ID NO: 136976 - DNA, 25 bp, E. coli
ccacaggaaattttgtggttgccgc

SEQ ID NO: 136977 - DNA, 25 bp, E. coli
gatcatcgcgattctgttcagtccg

SEQ ID NO: 136978 - DNA, 25 bp, E. coli
gatcatcgcgatactgttcagtccg

SEQ ID NO: 136979 - DNA, 25 bp, E. coli
gtgtttctattcctacagcgcccaa

SEQ ID NO: 136980 - DNA, 25 bp, E. coli
gtgtttctattcgtacagcgcccaa

SEQ ID NO: 136981 - DNA, 25 bp, E. coli
ggcgagcaatctcacatcgcaattg

SEQ ID NO: 136982 - DNA, 25 bp, E. coli
ggcgagcaatctgacatcgcaattg

SEQ ID NO: 136983 - DNA, 25 bp, E. coli
tacagcaatatctggccgtgggtgg

SEQ ID NO: 136984 - DNA, 25 bp, E. coli
tacagcaatatcaggccgtgggtgg

SEQ ID NO: 136985 - DNA, 25 bp, E. coli
acacgacaaggagtgctggcaaacg

SEQ ID NO: 136986 - DNA, 25 bp, E. coli
acacgacaaggactgctggcaaacg

SEQ ID NO: 136987 - DNA, 25 bp, E. coli
tatcgaaccatcgacagggctggag

SEQ ID NO: 136988 - DNA, 25 bp, E. coli
tatcgaaccatccacagggctggag

SEQ ID NO: 136989 - DNA, 25 bp, E. coli
tccaaagcggcattgatggcgatcg

SEQ ID NO: 136990 - DNA, 25 bp, E. coli
tccaaagcggcaatgatggcgatcg

SEQ ID NO: 136991 - DNA, 25 bp, E. coli
tcggatggttcagcaaggctctgga

SEQ ID NO: 136992 - DNA, 25 bp, E. coli
tcggatggttcaccaaggctctgga

SEQ ID NO: 136993 - DNA, 25 bp, E. coli
gctctggagagtcttgacgaagttc

SEQ ID NO: 136994 - DNA, 25 bp, E. coli
gctctggagagtgttgacgaagttc

SEQ ID NO: 136995 - DNA, 25 bp, E. coli
cgctttggctttttgatgcactgga

SEQ ID NO: 136996 - DNA, 25 bp, E. coli
cgctttggctttatgatgcactgga

SEQ ID NO: 136997 - DNA, 25 bp, E. coli
gatattgagtttcgattctggctgg

SEQ ID NO: 136998 - DNA, 25 bp, E. coli
gatttggcgacccttcatcagtcct

SEQ ID NO: 136999 - DNA, 25 bp, E. coli
gatttggcgaccgttcatcagtcct

SEQ ID NO: 137000 - DNA, 25 bp, E. coli
gatattgagtttggattctggctgg

SEQ ID NO: 137001 - DNA, 25 bp, E. coli
tggaataacccaccgtacagcaata

SEQ ID NO: 137002 - DNA, 25 bp, E. coli
tggaataacccagcgtacagcaata

SEQ ID NO: 137003 - DNA, 25 bp, E. coli
taagccacggtggaatctggaataa

SEQ ID NO: 137004 - DNA, 25 bp, E. coli
taagccacggtgcaatctggaataa

SEQ ID NO: 137005 - DNA, 25 bp, E. coli
caatgtatgcttctcgctggctgct

SEQ ID NO: 137006 - DNA, 25 bp, E. coli
caatgtatgcttgtcgctggctgct

SEQ ID NO: 137007 - DNA, 25 bp, E. coli
cacttactgcgcgtctttatggatg

SEQ ID NO: 137008 - DNA, 25 bp, E. coli
cacttactgcgcctctttatggatg

SEQ ID NO: 137009 - DNA, 25 bp, E. coli
caggagattattgacgtactgccga

SEQ ID NO: 137010 - DNA, 25 bp, E. coli
caggagattattcacgtactgccga

SEQ ID NO: 137011 - DNA, 25 bp, E. coli
aaagtagcagcgtcgattgtggcaa

SEQ ID NO: 137012 - DNA, 25 bp, E. coli
aaagtagcagcgacgattgtggcaa

SEQ ID NO: 137013 - DNA, 25 bp, E. coli
ttgccctggcgctgaagttcttcca

SEQ ID NO: 137014 - DNA, 25 bp, E. coli
ttgccctggcgcagaagttcttcca

SEQ ID NO: 137015 - DNA, 25 bp, E. coli
gccgaatatcttgtcgatggcggaa

SEQ ID NO: 137016 - DNA, 25 bp, E. coli
gccgaatatcttctcgatggcggaa

SEQ ID NO: 137017 - DNA, 25 bp, E. coli
gcaacgtcgctgaaaaacaaagtag

SEQ ID NO: 137018 - DNA, 25 bp, E. coli
gcaacgtcgctgtaaaacaaagtag

SEQ ID NO: 137019 - DNA, 25 bp, E. coli
gaacaaagagaacctgaactggctg

SEQ ID NO: 137020 - DNA, 25 bp, E. coli
gaacaaagagaagctgaactggctg

SEQ ID NO: 137021 - DNA, 25 bp, E. coli
cccgtgtactttggcctttcgctgg

SEQ ID NO: 137022 - DNA, 25 bp, E. coli
cccgtgtactttcgcctttcgctgg

SEQ ID NO: 137023 - DNA, 25 bp, E. coli
gataacaaactgttgtggtacgtca

SEQ ID NO: 137024 - DNA, 25 bp, E. coli
gataacaaactgatgtggtacgtca

SEQ ID NO: 137025 - DNA, 25 bp, E. coli
gatcctcgtgttgctgtcgctggtg

SEQ ID NO: 137026 - DNA, 25 bp, E. coli
gatcctcgtgttcctgtcgctggtg

SEQ ID NO: 137027 - DNA, 25 bp, E. coli
cagtggttagcgagttttcgtcagc

SEQ ID NO: 137028 - DNA, 25 bp, E. coli
cagtggttagcgtgttttcgtcagc

SEQ ID NO: 137029 - DNA, 25 bp, E. coli
caggaacaaagtgaagatgatcaag

SEQ ID NO: 137030 - DNA, 25 bp, E. coli
caggaacaaagtcaagatgatcaag

SEQ ID NO: 137031 - DNA, 25 bp, E. coli
taaaaaatgtgtatgttttcccgct

SEQ ID NO: 137032 - DNA, 25 bp, E. coli
taaaaaatgtgtttgttttcccgct

SEQ ID NO: 137033 - DNA, 25 bp, E. coli
aaatgtgtatgtattcccgctctcg

SEQ ID NO: 137034 - DNA, 25 bp, E. coli
aaatgtgtatgttttcccgctctcg

SEQ ID NO: 137035 - DNA, 25 bp, E. coli
tatgttttcccggtctcgtgaatgg

SEQ ID NO: 137036 - DNA, 25 bp, E. coli
tatgttttcccgctctcgtgaatgg

SEQ ID NO: 137037 - DNA, 25 bp, E. coli
tgtgtatgttttcccgctctcgtga

SEQ ID NO: 137038 - DNA, 25 bp, E. coli
tgtgtatgttttgccgctctcgtga

SEQ ID NO: 137039 - DNA, 25 bp, E. coli
tgaatcaggccaaccagtttccgga

SEQ ID NO: 137040 - DNA, 25 bp, E. coli
tgaatcaggccatccagtttccgga

SEQ ID NO: 137041 - DNA, 25 bp, E. coli
gaaaacttaattgaggaacaaagtg

SEQ ID NO: 137042 - DNA, 25 bp, E. coli
gaagaagcggaatacttaattcagg

SEQ ID NO: 137043 - DNA, 25 bp, E. coli
gaagaagcggaaaacttaattcagg

SEQ ID NO: 137044 - DNA, 25 bp, E. coli
gaaaacttaattcaggaacaaagtg

SEQ ID NO: 137045 - DNA, 25 bp, E. coli
gttagcgagttttcgtcagcatcgc

SEQ ID NO: 137046 - DNA, 25 bp, E. coli
gttagcgagtttacgtcagcatcgc

SEQ ID NO: 137047 - DNA, 25 bp, E. coli
gtgaatcaggccttccagtttccgg

SEQ ID NO: 137048 - DNA, 25 bp, E. coli
gtgaatcaggccatccagtttccgg

SEQ ID NO: 137049 - DNA, 25 bp, E. coli
caaccgtctcagcaggagcttcgag

SEQ ID NO: 137050 - DNA, 25 bp, E. coli
caaccgtctcaggaggagcttcgag

SEQ ID NO: 137051 - DNA, 25 bp, E. coli
cataagctgtgggatgcaatgccga

SEQ ID NO: 137052 - DNA, 25 bp, E. coli
catcgccaaagtttattcgggagga

SEQ ID NO: 137053 - DNA, 25 bp, E. coli
catcgccaaagtatattcgggagga

SEQ ID NO: 137054 - DNA, 25 bp, E. coli
cataagctgtggcatgcaatgccga

SEQ ID NO: 137055 - DNA, 25 bp, E. coli
taaacaacgtcgtctctcgactacg

SEQ ID NO: 137056 - DNA, 25 bp, E. coli
taaacaacgtcgactctcgactacg

SEQ ID NO: 137057 - DNA, 25 bp, E. coli
agatcacccaacgacataagctgtg

SEQ ID NO: 137058 - DNA, 25 bp, E. coli
agatcacccaaccacataagctgtg

SEQ ID NO: 137059 - DNA, 25 bp, E. coli
tattcgggaggaatctatgtccaga

SEQ ID NO: 137060 - DNA, 25 bp, E. coli
tattcgggaggattctatgtccaga

SEQ ID NO: 137061 - DNA, 25 bp, E. coli
gactctcgactaggtggctgaaaag

SEQ ID NO: 137062 - DNA, 25 bp, E. coli
gactctcgactacgtggctgaaaag

SEQ ID NO: 137063 - DNA, 25 bp, E. coli
gactggcaggctgtttaaacaacgt

SEQ ID NO: 137064 - DNA, 25 bp, E. coli
gactggcaggctctttaaacaacgt

SEQ ID NO: 137065 - DNA, 25 bp, E. coli
cgtggctgaaaagccagatcaccca

SEQ ID NO: 137066 - DNA, 25 bp, E. coli
cgtggctgaaaacccagatcaccca

SEQ ID NO: 137067 - DNA, 25 bp, E. coli
ggagcttcgagattgcatcgccaaa

SEQ ID NO: 137068 - DNA, 25 bp, E. coli
ggagcttcgagaatgcatcgccaaa

SEQ ID NO: 137069 - DNA, 25 bp, E. coli
gatgcaatgccgtagcaaccgtctc

SEQ ID NO: 137070 - DNA, 25 bp, E. coli
gatgcaatgccgaagcaaccgtctc

SEQ ID NO: 137071 - DNA, 25 bp, E. coli
aagagctgggcagcgtaaaacgcaa

SEQ ID NO: 137072 - DNA, 25 bp, E. coli
caagcagttacccttgaaaatcgtc

SEQ ID NO: 137073 - DNA, 25 bp, E. coli
caagcagttaccgttgaaaatcgtc

SEQ ID NO: 137074 - DNA, 25 bp, E. coli
aactgtcggatcgtaaacctgcgga

SEQ ID NO: 137075 - DNA, 25 bp, E. coli
aactgtcggatcctaaacctgcgga

SEQ ID NO: 137076 - DNA, 25 bp, E. coli
aagagctgggcaccgtaaaacgcaa

SEQ ID NO: 137077 - DNA, 25 bp, E. coli
tacctgcttcatctctcaatcgacg

SEQ ID NO: 137078 - DNA, 25 bp, E. coli
tagggatggttccacaatggcagca

SEQ ID NO: 137079 - DNA, 25 bp, E. coli
tacctgcttcatgtctcaatcgacg

SEQ ID NO: 137080 - DNA, 25 bp, E. coli
tagggatggttcgacaatggcagca

SEQ ID NO: 137081 - DNA, 25 bp, E. coli
tgctgaacagtgttgggccatacct

SEQ ID NO: 137082 - DNA, 25 bp, E. coli
tgctgaacagtgatgggccatacct

SEQ ID NO: 137083 - DNA, 25 bp, E. coli
tcgacgaacttgtgaacgtctggcc

SEQ ID NO: 137084 - DNA, 25 bp, E. coli
tctacgcgccgttgttgttaaaaca

SEQ ID NO: 137085 - DNA, 25 bp, E. coli
tctacgcgccgtagttgttaaaaca

SEQ ID NO: 137086 - DNA, 25 bp, E. coli
tcgacgaacttgagaacgtctggcc

SEQ ID NO: 137087 - DNA, 25 bp, E. coli
tcttactcgataaccaacggttagg

SEQ ID NO: 137088 - DNA, 25 bp, E. coli
tcttactcgatatccaacggttagg

SEQ ID NO: 137089 - DNA, 25 bp, E. coli
ccggtgacggctgtttcatgatgaa

SEQ ID NO: 137090 - DNA, 25 bp, E. coli
ccggtgacggctctttcatgatgaa

SEQ ID NO: 137091 - DNA, 25 bp, E. coli
ggcactcgacacgatgctgaacagt

SEQ ID NO: 137092 - DNA, 25 bp, E. coli
ggcactcgacaccatgctgaacagt

SEQ ID NO: 137093 - DNA, 25 bp, E. coli
catagccaaaaactgagtaaagaag

SEQ ID NO: 137094 - DNA, 25 bp, E. coli
catagccaaaaagtgagtaaagaag

SEQ ID NO: 137095 - DNA, 25 bp, E. coli
aaactgagtaaagaagcacagaagc

SEQ ID NO: 137096 - DNA, 25 bp, E. coli
aaactgagtaaacaagcacagaagc

SEQ ID NO: 137097 - DNA, 25 bp, E. coli
tgcgtgaagttcttagccaaaaact

SEQ ID NO: 137098 - DNA, 25 bp, E. coli
tgcgtgaagttcatagccaaaaact

SEQ ID NO: 137099 - DNA, 25 bp, E. coli
tcgcctgcgtgatgttcatagccaa

SEQ ID NO: 137100 - DNA, 25 bp, E. coli
tcgcctgcgtgaagttcatagccaa

SEQ ID NO: 137101 - DNA, 25 bp, E. coli
ccaaaaactgagtaaagaagcacag

SEQ ID NO: 137102 - DNA, 25 bp, E. coli
ccaaaaactgagaaaagaagcacag

SEQ ID NO: 137103 - DNA, 25 bp, E. coli
gcctgcgtgaagttcatagccaaaa

SEQ ID NO: 137104 - DNA, 25 bp, E. coli
gcctgcgtgaagatcatagccaaaa

SEQ ID NO: 137105 - DNA, 25 bp, E. coli
gaagttcatagccaaaaactgagta

SEQ ID NO: 137106 - DNA, 25 bp, E. coli
gaagttcatagcgaaaaactgagta

SEQ ID NO: 137107 - DNA, 25 bp, E. coli
ctgagtaaagaaccacagaagctga

SEQ ID NO: 137108 - DNA, 25 bp, E. coli
ctgagtaaagaagcacagaagctga

SEQ ID NO: 137109 - DNA, 25 bp, E. coli
cgtgaagttcatagccaaaaactga

SEQ ID NO: 137110 - DNA, 25 bp, E. coli
cgtgaagttcattgccaaaaactga

SEQ ID NO: 137111 - DNA, 25 bp, E. coli
gtaaagaagcacagaagctgatgaa

SEQ ID NO: 137112 - DNA, 25 bp, E. coli
gttcatagccaataactgagtaaag

SEQ ID NO: 137113 - DNA, 25 bp, E. coli
gttcatagccaaaaactgagtaaag

SEQ ID NO: 137114 - DNA, 25 bp, E. coli
gtaaagaagcactgaagctgatgaa

SEQ ID NO: 137115 - DNA, 25 bp, E. coli
caagcaaaaaaggtcccgaaggagc

SEQ ID NO: 137116 - DNA, 25 bp, E. coli
aagatgatgttcaatactgggaacc

SEQ ID NO: 137117 - DNA, 25 bp, E. coli
caagcaaaaaagctcccgaaggagc

SEQ ID NO: 137118 - DNA, 25 bp, E. coli
aagatgatgttctatactgggaacc

SEQ ID NO: 137119 - DNA, 25 bp, E. coli
caaaagatacattttgccccgaaag

SEQ ID NO: 137120 - DNA, 25 bp, E. coli
caaaagatacatattgccccgaaag

SEQ ID NO: 137121 - DNA, 25 bp, E. coli
cgaaggagccttgattttcactttt

SEQ ID NO: 137122 - DNA, 25 bp, E. coli
cgaaggagccttcattttcactttt

SEQ ID NO: 137123 - DNA, 25 bp, E. coli
taccgtagtatgagagtatccatcg

SEQ ID NO: 137124 - DNA, 25 bp, E. coli
taccgtagtatgtgagtatccatcg

SEQ ID NO: 137125 - DNA, 25 bp, E. coli
tatactgggaacgatgacaacacgg

SEQ ID NO: 137126 - DNA, 25 bp, E. coli
tatactgggaaccatgacaacacgg

SEQ ID NO: 137127 - DNA, 25 bp, E. coli
ttttaaatccaaggacagacggctg

SEQ ID NO: 137128 - DNA, 25 bp, E. coli
ttttaaatccaacgacagacggctg

SEQ ID NO: 137129 - DNA, 25 bp, E. coli
gccccgaaaggattcatgtcagaaa

SEQ ID NO: 137130 - DNA, 25 bp, E. coli
gccccgaaaggaatcatgtcagaaa

SEQ ID NO: 137131 - DNA, 25 bp, E. coli
gacaacacgggcttctaaagtgaat

SEQ ID NO: 137132 - DNA, 25 bp, E. coli
gacaacacgggcatctaaagtgaat

SEQ ID NO: 137133 - DNA, 25 bp, E. coli
gtatccatcgaatagacaccaagca

SEQ ID NO: 137134 - DNA, 25 bp, E. coli
gtatccatcgaaaagacaccaagca

SEQ ID NO: 137135 - DNA, 25 bp, E. coli
gacggctggcatttaagtattgtga

SEQ ID NO: 137136 - DNA, 25 bp, E. coli
gacggctggcatataagtattgtga

SEQ ID NO: 137137 - DNA, 25 bp, E. coli
aagagaaggggcaggtgacgccgcc

SEQ ID NO: 137138 - DNA, 25 bp, E. coli
aagagaaggggctggtgacgccgcc

SEQ ID NO: 137139 - DNA, 25 bp, E. coli
caaagccattcggttctatgaagag

SEQ ID NO: 137140 - DNA, 25 bp, E. coli
caaagccattcgcttctatgaagag

SEQ ID NO: 137141 - DNA, 25 bp, E. coli
attaccggcctgaccagcaaagcca

SEQ ID NO: 137142 - DNA, 25 bp, E. coli
attaccggcctgtccagcaaagcca

SEQ ID NO: 137143 - DNA, 25 bp, E. coli
agcgatgtagcataaattaccggcc

SEQ ID NO: 137144 - DNA, 25 bp, E. coli
agcgatgtagcaaaaattaccggcc

SEQ ID NO: 137145 - DNA, 25 bp, E. coli
aaaattaccggcgtgaccagcaaag

SEQ ID NO: 137146 - DNA, 25 bp, E. coli
aaaattaccggcctgaccagcaaag

SEQ ID NO: 137147 - DNA, 25 bp, E. coli
tagcaaaaattaccggcctgaccag

SEQ ID NO: 137148 - DNA, 25 bp, E. coli
tagcaaaaattagcggcctgaccag

SEQ ID NO: 137149 - DNA, 25 bp, E. coli
tgtagcaaaaattaccggcctgacc

SEQ ID NO: 137150 - DNA, 25 bp, E. coli
tgtagcaaaaataaccggcctgacc

SEQ ID NO: 137151 - DNA, 25 bp, E. coli
ccattcgcttctatgaagagaaggg

SEQ ID NO: 137152 - DNA, 25 bp, E. coli
ccattcgcttctttgaagagaaggg

SEQ ID NO: 137153 - DNA, 25 bp, E. coli
ggcctgaccagctaagccattcgct

SEQ ID NO: 137154 - DNA, 25 bp, E. coli
ggcctgaccagcaaagccattcgct

SEQ ID NO: 137155 - DNA, 25 bp, E. coli
gatgtagcaaaaattaccggcctga

SEQ ID NO: 137156 - DNA, 25 bp, E. coli
gaccagcaaagccattcgcttctat

SEQ ID NO: 137157 - DNA, 25 bp, E. coli
gatgtagcaaaatttaccggcctga

SEQ ID NO: 137158 - DNA, 25 bp, E. coli
gaccagcaaagcgattcgcttctat

SEQ ID NO: 137159 - DNA, 25 bp, E. coli
cagctaagttgaatgcttacaaaag

SEQ ID NO: 137160 - DNA, 25 bp, E. coli
cagctaagttgattgcttacaaaag

SEQ ID NO: 137161 - DNA, 25 bp, E. coli
agcgacttatttccgcattaatgcc

SEQ ID NO: 137162 - DNA, 25 bp, E. coli
agcgacttatttgcgcattaatgcc

SEQ ID NO: 137163 - DNA, 25 bp, E. coli
tagagatgtaaacaaatagcatggc

SEQ ID NO: 137164 - DNA, 25 bp, E. coli
tagagatgtaaagaaatagcatggc

SEQ ID NO: 137165 - DNA, 25 bp, E. coli
ttgtctgtccggcagtgcgtttcgt

SEQ ID NO: 137166 - DNA, 25 bp, E. coli
ttgtctgtccgggagtgcgtttcgt

SEQ ID NO: 137167 - DNA, 25 bp, E. coli
ccggcagtgcgtttcgttatgtttt

SEQ ID NO: 137168 - DNA, 25 bp, E. coli
ccggcagtgcgtatcgttatgtttt

SEQ ID NO: 137169 - DNA, 25 bp, E. coli
gcttacaaaagaagaaattcagagg

SEQ ID NO: 137170 - DNA, 25 bp, E. coli
gcattaatgccgtcgtaaccggcga

SEQ ID NO: 137171 - DNA, 25 bp, E. coli
gcttacaaaagatgaaattcagagg

SEQ ID NO: 137172 - DNA, 25 bp, E. coli
gcattaatgccgacgtaaccggcga

SEQ ID NO: 137173 - DNA, 25 bp, E. coli
gaaatagcatggcaaaaatccgaag

SEQ ID NO: 137174 - DNA, 25 bp, E. coli
gaaatagcatgggaaaaatccgaag

SEQ ID NO: 137175 - DNA, 25 bp, E. coli
ctgttaaagaaaagtaaattcagct

SEQ ID NO: 137176 - DNA, 25 bp, E. coli
ctgttaaagaaatgtaaattcagct

SEQ ID NO: 137177 - DNA, 25 bp, E. coli
ggcaaaaatccgtagtatagcgact

SEQ ID NO: 137178 - DNA, 25 bp, E. coli
ggcaaaaatccgaagtatagcgact

SEQ ID NO: 137179 - DNA, 25 bp, E. coli
taaccggcgacttacgaatcaactg

SEQ ID NO: 137180 - DNA, 25 bp, E. coli
taaccggcgactaacgaatcaactg

SEQ ID NO: 137181 - DNA, 25 bp, E. coli
caatacatcaagatccatgcgctgg

SEQ ID NO: 137182 - DNA, 25 bp, E. coli
caatacatcaagttccatgcgctgg

SEQ ID NO: 137183 - DNA, 25 bp, E. coli
tactaccgtactgaccgaagtgccg

SEQ ID NO: 137184 - DNA, 25 bp, E. coli
tactaccgtactcaccgaagtgccg

SEQ ID NO: 137185 - DNA, 25 bp, E. coli
aaaacactggatcgactttgacgcg

SEQ ID NO: 137186 - DNA, 25 bp, E. coli
aaaacactggatggactttgacgcg

SEQ ID NO: 137187 - DNA, 25 bp, E. coli
tgatgcgcaacgataaacgcgagcc

SEQ ID NO: 137188 - DNA, 25 bp, E. coli
tgatgcgcaacgttaaacgcgagcc

SEQ ID NO: 137189 - DNA, 25 bp, E. coli
ccaaccgtgggcagtgtcaacggca

SEQ ID NO: 137190 - DNA, 25 bp, E. coli
ccaaccgtgggctgtgtcaacggca

SEQ ID NO: 137191 - DNA, 25 bp, E. coli
gaagtgcagatctatcgtcgcgcta

SEQ ID NO: 137192 - DNA, 25 bp, E. coli
gaagtgcagatcaatcgtcgcgcta

SEQ ID NO: 137193 - DNA, 25 bp, E. coli
gactacgtgattcctaacggcggta

SEQ ID NO: 137194 - DNA, 25 bp, E. coli
gactacgtgattgctaacggcggta

SEQ ID NO: 137195 - DNA, 25 bp, E. coli
gtattactgctaacccgatgctggg

SEQ ID NO: 137196 - DNA, 25 bp, E. coli
gtattactgctatcccgatgctggg

SEQ ID NO: 137197 - DNA, 25 bp, E. coli
tggcgatcttcaaaagcggcgtaac

SEQ ID NO: 137198 - DNA, 25 bp, E. coli
tggcgatcttcataagcggcgtaac

SEQ ID NO: 137199 - DNA, 25 bp, E. coli
taagtgcgccggctaacgatgccgt

SEQ ID NO: 137200 - DNA, 25 bp, E. coli
taagtgcgccgggtaacgatgccgt

SEQ ID NO: 137201 - DNA, 25 bp, E. coli
gatccacggtaatgcgatgccgcag

SEQ ID NO: 137202 - DNA, 25 bp, E. coli
gatccacggtaaagcgatgccgcag

SEQ ID NO: 137203 - DNA, 25 bp, E. coli
caacaggtggagtagtcgaatacgc

SEQ ID NO: 137204 - DNA, 25 bp, E. coli
caacaggtggagaagtcgaatacgc

SEQ ID NO: 137205 - DNA, 25 bp, E. coli
taaaaagcaatcgtagaatcagcgg

SEQ ID NO: 137206 - DNA, 25 bp, E. coli
taaaaagcaatcctagaatcagcgg

SEQ ID NO: 137207 - DNA, 25 bp, E. coli
aggtcgcgaggacgcgcaattctac

SEQ ID NO: 137208 - DNA, 25 bp, E. coli
aggtcgcgaggaggcgcaattctac

SEQ ID NO: 137209 - DNA, 25 bp, E. coli
aaaatgaggcaagagattcactggg

SEQ ID NO: 137210 - DNA, 25 bp, E. coli
aaaatgaggcaacagattcactggg

SEQ ID NO: 137211 - DNA, 25 bp, E. coli
ttctacaaaattgcgcatttcacta

SEQ ID NO: 137212 - DNA, 25 bp, E. coli
ttgccgggtgctgacagtaaaaagc

SEQ ID NO: 137213 - DNA, 25 bp, E. coli
ttgccgggtgctcacagtaaaaagc

SEQ ID NO: 137214 - DNA, 25 bp, E. coli
ttctacaaaattccgcatttcacta

SEQ ID NO: 137215 - DNA, 25 bp, E. coli
gccggaaaggttccggtgaggcgca

SEQ ID NO: 137216 - DNA, 25 bp, E. coli
gccggaaaggttgcggtgaggcgca

SEQ ID NO: 137217 - DNA, 25 bp, E. coli
gcgaggaggcgctattctacaaaat

SEQ ID NO: 137218 - DNA, 25 bp, E. coli
gcgaggaggcgcaattctacaaaat

SEQ ID NO: 137219 - DNA, 25 bp, E. coli
cgcagtatgtaaaaaatgaggcaac

SEQ ID NO: 137220 - DNA, 25 bp, E. coli
cgcagtatgtaataaatgaggcaac

SEQ ID NO: 137221 - DNA, 25 bp, E. coli
gtttctcttgcgcaacaggtggaga

SEQ ID NO: 137222 - DNA, 25 bp, E. coli
gtttctcttgcggaacaggtggaga

SEQ ID NO: 137223 - DNA, 25 bp, E. coli
tggagaagtcgaatacgcagtatgt

SEQ ID NO: 137224 - DNA, 25 bp, E. coli
tggagaagtcgattacgcagtatgt

SEQ ID NO: 137225 - DNA, 25 bp, E. coli
caggcattgcgtcaggacttgaaca

SEQ ID NO: 137226 - DNA, 25 bp, E. coli
caggcattgcgtgaggacttgaaca

SEQ ID NO: 137227 - DNA, 25 bp, E. coli
actttaccaggcattgcgtcaggac

SEQ ID NO: 137228 - DNA, 25 bp, E. coli
aacaatctggcccaacttcagtgca

SEQ ID NO: 137229 - DNA, 25 bp, E. coli
actttaccaggctttgcgtcaggac

SEQ ID NO: 137230 - DNA, 25 bp, E. coli
aacaatctggccgaacttcagtgca

SEQ ID NO: 137231 - DNA, 25 bp, E. coli
ttgaacggatgaacaatcggttggg

SEQ ID NO: 137232 - DNA, 25 bp, E. coli
ttgaacggatgatcaatcggttggg

SEQ ID NO: 137233 - DNA, 25 bp, E. coli
tgcgtcaggacttgaacaatctggc

SEQ ID NO: 137234 - DNA, 25 bp, E. coli
tgcgtcaggactagaacaatctggc

SEQ ID NO: 137235 - DNA, 25 bp, E. coli
ccaacttcagtgcaacaacagtggt

SEQ ID NO: 137236 - DNA, 25 bp, E. coli
ccaacttcagtggaacaacagtggt

SEQ ID NO: 137237 - DNA, 25 bp, E. coli
cggtgaaaaatattgaacggatgat

SEQ ID NO: 137238 - DNA, 25 bp, E. coli
cggtgaaaaataatgaacggatgat

SEQ ID NO: 137239 - DNA, 25 bp, E. coli
gtcaaccgcaccacgcttatcgatg

SEQ ID NO: 137240 - DNA, 25 bp, E. coli
gtcaaccgcacctcgcttatcgatg

SEQ ID NO: 137241 - DNA, 25 bp, E. coli
ggacttgaacaatctggcccaactt

SEQ ID NO: 137242 - DNA, 25 bp, E. coli
ggacttgaacaaactggcccaactt

SEQ ID NO: 137243 - DNA, 25 bp, E. coli
ggcgtactgccacacgataaacttt

SEQ ID NO: 137244 - DNA, 25 bp, E. coli
ggcgtactgccagacgataaacttt

SEQ ID NO: 137245 - DNA, 25 bp, E. coli
tactgccagacgttaaactttacca

SEQ ID NO: 137246 - DNA, 25 bp, E. coli
tactgccagacgataaactttacca

SEQ ID NO: 137247 - DNA, 25 bp, E. coli
actgctacgtcacctggtgagaacg

SEQ ID NO: 137248 - DNA, 25 bp, E. coli
actgctacgtcagctggtgagaacg

SEQ ID NO: 137249 - DNA, 25 bp, E. coli
aactgctacgtcagctggtgagaac

SEQ ID NO: 137250 - DNA, 25 bp, E. coli
aactgctacgtctgctggtgagaac

SEQ ID NO: 137251 - DNA, 25 bp, E. coli
tgctacgtcagctggtgagaacgga

SEQ ID NO: 137252 - DNA, 25 bp, E. coli
tgctacgtcagcaggtgagaacgga

SEQ ID NO: 137253 - DNA, 25 bp, E. coli
tcggcggtgaacagctacgtcagct

SEQ ID NO: 137254 - DNA, 25 bp, E. coli
tcggcggtgaactgctacgtcagct

SEQ ID NO: 137255 - DNA, 25 bp, E. coli
gcctcggcggtgtactgctacgtca

SEQ ID NO: 137256 - DNA, 25 bp, E. coli
gcctcggcggtgaactgctacgtca

SEQ ID NO: 137257 - DNA, 25 bp, E. coli
gcggtgaactgcaacgtcagctggt

SEQ ID NO: 137258 - DNA, 25 bp, E. coli
gcggtgaactgctacgtcagctggt

SEQ ID NO: 137259 - DNA, 25 bp, E. coli
gaactgctacgtcagctggtgagaa

SEQ ID NO: 137260 - DNA, 25 bp, E. coli
gaactgctacgtgagctggtgagaa

SEQ ID NO: 137261 - DNA, 25 bp, E. coli
cggcggtgaactgctacgtcagctg

SEQ ID NO: 137262 - DNA, 25 bp, E. coli
cggtgaactgcttcgtcagctggtg

SEQ ID NO: 137263 - DNA, 25 bp, E. coli
cggtgaactgctacgtcagctggtg

SEQ ID NO: 137264 - DNA, 25 bp, E. coli
ctacgtcagctgctgagaacggacc

SEQ ID NO: 137265 - DNA, 25 bp, E. coli
ctacgtcagctggtgagaacggacc

SEQ ID NO: 137266 - DNA, 25 bp, E. coli
cggcggtgaactcctacgtcagctg

SEQ ID NO: 137267 - DNA, 25 bp, E. coli
gtgaactgctacctcagctggtgag

SEQ ID NO: 137268 - DNA, 25 bp, E. coli
gtgaactgctacgtcagctggtgag

SEQ ID NO: 137269 - DNA, 25 bp, E. coli
aatttcagggcgacattattgcgga

SEQ ID NO: 137270 - DNA, 25 bp, E. coli
caatgtttgctcaggccggaaataa

SEQ ID NO: 137271 - DNA, 25 bp, E. coli
aatttcagggcgtcattattgcgga

SEQ ID NO: 137272 - DNA, 25 bp, E. coli
caatgtttgctctggccggaaataa

SEQ ID NO: 137273 - DNA, 25 bp, E. coli
cacggtgtcgcgcatggtaaaaatc

SEQ ID NO: 137274 - DNA, 25 bp, E. coli
cacggtgtcgcggatggtaaaaatc

SEQ ID NO: 137275 - DNA, 25 bp, E. coli
catcgccaaatatcgtgctaccggg

SEQ ID NO: 137276 - DNA, 25 bp, E. coli
cagggatagccagcaatattggcgt

SEQ ID NO: 137277 - DNA, 25 bp, E. coli
catcgccaaataacgtgctaccggg

SEQ ID NO: 137278 - DNA, 25 bp, E. coli
cagggatagccaccaatattggcgt

SEQ ID NO: 137279 - DNA, 25 bp, E. coli
aaaatccggatgagctttccgtggg

SEQ ID NO: 137280 - DNA, 25 bp, E. coli
aaaatccggatgtgctttccgtggg

SEQ ID NO: 137281 - DNA, 25 bp, E. coli
tagcgtcgttgctgccaatgtttgc

SEQ ID NO: 137282 - DNA, 25 bp, E. coli
tagcgtcgttgcagccaatgtttgc

SEQ ID NO: 137283 - DNA, 25 bp, E. coli
tgaagccggtgataaacaaatgacg

SEQ ID NO: 137284 - DNA, 25 bp, E. coli
tgaagccggtgaaaaacaaatgacg

SEQ ID NO: 137285 - DNA, 25 bp, E. coli
tgatgatgaaggaaacctcgtaccg

SEQ ID NO: 137286 - DNA, 25 bp, E. coli
tgatgatgaaggtaacctcgtaccg

SEQ ID NO: 137287 - DNA, 25 bp, E. coli
gattaatcgtccaccagcaaactgg

SEQ ID NO: 137288 - DNA, 25 bp, E. coli
gattaatcgtcctccagcaaactgg

SEQ ID NO: 137289 - DNA, 25 bp, E. coli
ggcaaatcagcactaaccggtttca

SEQ ID NO: 137290 - DNA, 25 bp, E. coli
ggcaaatcagcagtaaccggtttca

SEQ ID NO: 137291 - DNA, 25 bp, E. coli
caatgaagtccattgacggtatcaa

SEQ ID NO: 137292 - DNA, 25 bp, E. coli
caatgaagtccaatgacggtatcaa

SEQ ID NO: 137293 - DNA, 25 bp, E. coli
agcatttgtccgaaccggcttaggg

SEQ ID NO: 137294 - DNA, 25 bp, E. coli
agagcaagcattagtccgtaccggc

SEQ ID NO: 137295 - DNA, 25 bp, E. coli
agagcaagcatttgtccgtaccggc

SEQ ID NO: 137296 - DNA, 25 bp, E. coli
agcatttgtccgtaccggcttaggg

SEQ ID NO: 137297 - DNA, 25 bp, E. coli
tgccaagcaggtggcgctgattgcc

SEQ ID NO: 137298 - DNA, 25 bp, E. coli
tgccaagcaggtcgcgctgattgcc

SEQ ID NO: 137299 - DNA, 25 bp, E. coli
gctgcattgactacactcttaaccc

SEQ ID NO: 137300 - DNA, 25 bp, E. coli
gctacgcgtaaaaaaggcctggcgg

SEQ ID NO: 137301 - DNA, 25 bp, E. coli
gctacgcgtaaataaggcctggcgg

SEQ ID NO: 137302 - DNA, 25 bp, E. coli
gctgcattgacttcactcttaaccc

SEQ ID NO: 137303 - DNA, 25 bp, E. coli
gaagctacgcgttaaaaaggcctgg

SEQ ID NO: 137304 - DNA, 25 bp, E. coli
gaagctacgcgtaaaaaaggcctgg

SEQ ID NO: 137305 - DNA, 25 bp, E. coli
gaaatccgtggaaccaatgaagtcc

SEQ ID NO: 137306 - DNA, 25 bp, E. coli
gaaatccgtggatccaatgaagtcc

SEQ ID NO: 137307 - DNA, 25 bp, E. coli
cgaagccgatcgagccaagcaggtg

SEQ ID NO: 137308 - DNA, 25 bp, E. coli
cgaagccgatcgtgccaagcaggtg

SEQ ID NO: 137309 - DNA, 25 bp, E. coli
tggtctgaatcgtggtggtactgcg

SEQ ID NO: 137310 - DNA, 25 bp, E. coli
tggtctgaatcgaggtggtactgcg

SEQ ID NO: 137311 - DNA, 25 bp, E. coli
tagagaaatccgtggaaccaatgaa

SEQ ID NO: 137312 - DNA, 25 bp, E. coli
tagagaaatccgaggaaccaatgaa

SEQ ID NO: 137313 - DNA, 25 bp, E. coli
aaggtgcgctgaaaaccgggcgtct

SEQ ID NO: 137314 - DNA, 25 bp, E. coli
aaggtgcgctgataaccgggcgtct

SEQ ID NO: 137315 - DNA, 25 bp, E. coli
tactgctggcaacctcggaataccg

SEQ ID NO: 137316 - DNA, 25 bp, E. coli
tactgctggcaagctcggaataccg

SEQ ID NO: 137317 - DNA, 25 bp, E. coli
tgatcgccggctgcattattggccc

SEQ ID NO: 137318 - DNA, 25 bp, E. coli
tgatcgccggctccattattggccc

SEQ ID NO: 137319 - DNA, 25 bp, E. coli
tcgaactcgatccacaaaggctgtg

SEQ ID NO: 137320 - DNA, 25 bp, E. coli
tcgaactcgatcgacaaaggctgtg

SEQ ID NO: 137321 - DNA, 25 bp, E. coli
tctacggcgattcccatgcaggcga

SEQ ID NO: 137322 - DNA, 25 bp, E. coli
tctacggcgattgccatgcaggcga

SEQ ID NO: 137323 - DNA, 25 bp, E. coli
gactggtgaccgttgccgaatctat

SEQ ID NO: 137324 - DNA, 25 bp, E. coli
gactggtgaccgatgccgaatctat

SEQ ID NO: 137325 - DNA, 25 bp, E. coli
cgtatgaagcgccagaacgtgccga

SEQ ID NO: 137326 - DNA, 25 bp, E. coli
cgtatgaagcgcgagaacgtgccga

SEQ ID NO: 137327 - DNA, 25 bp, E. coli
cgccgattctgctggtgatcctcaa

SEQ ID NO: 137328 - DNA, 25 bp, E. coli
cgccgattctgcaggtgatcctcaa

SEQ ID NO: 137329 - DNA, 25 bp, E. coli
ggtctataaacgcaccagcgcgatg

SEQ ID NO: 137330 - DNA, 25 bp, E. coli
ggtctataaacggaccagcgcgatg

SEQ ID NO: 137331 - DNA, 25 bp, E. coli
taattcaacgacatggctggcaggg

SEQ ID NO: 137332 - DNA, 25 bp, E. coli
taattcaacgacttggctggcaggg

SEQ ID NO: 137333 - DNA, 25 bp, E. coli
gatgagatcgacgaagaacagccgc

SEQ ID NO: 137334 - DNA, 25 bp, E. coli
gatgagatcgaccaagaacagccgc

SEQ ID NO: 137335 - DNA, 25 bp, E. coli
caaactcgtgcggaacgtgacaatc

SEQ ID NO: 137336 - DNA, 25 bp, E. coli
caaactcgtgcgcaacgtgacaatc

SEQ ID NO: 137337 - DNA, 25 bp, E. coli
agttattgtcctacatgcgccgcca

SEQ ID NO: 137338 - DNA, 25 bp, E. coli
agttattgtccttcatgcgccgcca

SEQ ID NO: 137339 - DNA, 25 bp, E. coli
ttgtgacagttacggcactcctgcg

SEQ ID NO: 137340 - DNA, 25 bp, E. coli
ttgtgacagttagggcactcctgcg

SEQ ID NO: 137341 - DNA, 25 bp, E. coli
tgacaatccggagaggtcgcacgga

SEQ ID NO: 137342 - DNA, 25 bp, E. coli
tgacaatccggacaggtcgcacgga

SEQ ID NO: 137343 - DNA, 25 bp, E. coli
tccacaggcgctaaatcagaccagg

SEQ ID NO: 137344 - DNA, 25 bp, E. coli
tccacaggcgcttaatcagaccagg

SEQ ID NO: 137345 - DNA, 25 bp, E. coli
ccaggcttacggacagaatttccca

SEQ ID NO: 137346 - DNA, 25 bp, E. coli
ccaggcttacggtcagaatttccca

SEQ ID NO: 137347 - DNA, 25 bp, E. coli
cggttgttgtagtgcacggaatcca

SEQ ID NO: 137348 - DNA, 25 bp, E. coli
cggttgttgtagagcacggaatcca

SEQ ID NO: 137349 - DNA, 25 bp, E. coli
tggcagctaatggagaactcttcgg

SEQ ID NO: 137350 - DNA, 25 bp, E. coli
tggtcatgcatcatcgcggcaaccg

SEQ ID NO: 137351 - DNA, 25 bp, E. coli
tggtcatgcatcttcgcggcaaccg

SEQ ID NO: 137352 - DNA, 25 bp, E. coli
tggcagctaatgcagaactcttcgg

SEQ ID NO: 137353 - DNA, 25 bp, E. coli
gagcttgcgtatcatcttcggcaca

SEQ ID NO: 137354 - DNA, 25 bp, E. coli
gagcttgcgtatgatcttcggcaca

SEQ ID NO: 137355 - DNA, 25 bp, E. coli
gatgagcttcaaatttctgcggcgt

SEQ ID NO: 137356 - DNA, 25 bp, E. coli
gatgagcttcaattttctgcggcgt

SEQ ID NO: 137357 - DNA, 25 bp, E. coli
cataaggaagtagaggtcaggaaca

SEQ ID NO: 137358 - DNA, 25 bp, E. coli
caacggcctcaaggatggaaatagt

SEQ ID NO: 137359 - DNA, 25 bp, E. coli
aattcatcatgactagtggagagcg

SEQ ID NO: 137360 - DNA, 25 bp, E. coli
cataaggaagtacaggtcaggaaca

SEQ ID NO: 137361 - DNA, 25 bp, E. coli
aattcatcatgagtagtggagagcg

SEQ ID NO: 137362 - DNA, 25 bp, E. coli
caacggcctcaacgatggaaatagt

SEQ ID NO: 137363 - DNA, 25 bp, E. coli
cataagaaatagaggcgcaacggcc

SEQ ID NO: 137364 - DNA, 25 bp, E. coli
cataagaaatagtggcgcaacggcc

SEQ ID NO: 137365 - DNA, 25 bp, E. coli
tatcaacactgatacgagcaagtcc

SEQ ID NO: 137366 - DNA, 25 bp, E. coli
tatcaacactgaaacgagcaagtcc

SEQ ID NO: 137367 - DNA, 25 bp, E. coli
tctttcaggccataggttaaggcac

SEQ ID NO: 137368 - DNA, 25 bp, E. coli
tcattgcaccggtaaaaacgcagga

SEQ ID NO: 137369 - DNA, 25 bp, E. coli
tcattgcaccggaaaaaacgcagga

SEQ ID NO: 137370 - DNA, 25 bp, E. coli
tctttcaggccaaaggttaaggcac

SEQ ID NO: 137371 - DNA, 25 bp, E. coli
gcaggagaacccttaagcatttcag

SEQ ID NO: 137372 - DNA, 25 bp, E. coli
gcaggagaacccataagcatttcag

SEQ ID NO: 137373 - DNA, 25 bp, E. coli
cgttatctgatgtgttagcccgtga

SEQ ID NO: 137374 - DNA, 25 bp, E. coli
cgttatctgatgagttagcccgtga

SEQ ID NO: 137375 - DNA, 25 bp, E. coli
gatctcagagactacactttaagtg

SEQ ID NO: 137376 - DNA, 25 bp, E. coli
gatctcagagacaacactttaagtg

SEQ ID NO: 137377 - DNA, 25 bp, E. coli
taagggctggagtgttgctcaatct

SEQ ID NO: 137378 - DNA, 25 bp, E. coli
taagggctggagagttgctcaatct

SEQ ID NO: 137379 - DNA, 25 bp, E. coli
tacacgttaatttgttttgaattga

SEQ ID NO: 137380 - DNA, 25 bp, E. coli
tacacgttaattagttttgaattga

SEQ ID NO: 137381 - DNA, 25 bp, E. coli
catattgaagggttctcgtaaaacg

SEQ ID NO: 137382 - DNA, 25 bp, E. coli
catattgaagggatctcgtaaaacg

SEQ ID NO: 137383 - DNA, 25 bp, E. coli
tttgaattgaaaagggcgcttcggc

SEQ ID NO: 137384 - DNA, 25 bp, E. coli
tttttgcatttgttgacggcatatc

SEQ ID NO: 137385 - DNA, 25 bp, E. coli
tttgaattgaaatgggcgcttcggc

SEQ ID NO: 137386 - DNA, 25 bp, E. coli
tttttgcatttgatgacggcatatc

SEQ ID NO: 137387 - DNA, 25 bp, E. coli
tgttttgcagttattacgtcacaag

SEQ ID NO: 137388 - DNA, 25 bp, E. coli
tgttttgcagtttttacgtcacaag

SEQ ID NO: 137389 - DNA, 25 bp, E. coli
tcctgcgtaggacttttgttttgca

SEQ ID NO: 137390 - DNA, 25 bp, E. coli
tcctgcgtaggagttttgttttgca

SEQ ID NO: 137391 - DNA, 25 bp, E. coli
gccgtaatttaattcatattgaagg

SEQ ID NO: 137392 - DNA, 25 bp, E. coli
gccgtaatttaaatcatattgaagg

SEQ ID NO: 137393 - DNA, 25 bp, E. coli
gcgccctttttggatttgttgacgg

SEQ ID NO: 137394 - DNA, 25 bp, E. coli
gcgccctttttgcatttgttgacgg

SEQ ID NO: 137395 - DNA, 25 bp, E. coli
gcagtttttacgtcacaagggatta

SEQ ID NO: 137396 - DNA, 25 bp, E. coli
gcagtttttacgacacaagggatta

SEQ ID NO: 137397 - DNA, 25 bp, E. coli
cgcttcggcgccctttttgcatttg

SEQ ID NO: 137398 - DNA, 25 bp, E. coli
cgcttcggcgccgtttttgcatttg

SEQ ID NO: 137399 - DNA, 25 bp, E. coli
tcgtaaaacgtatataattcctgcg

SEQ ID NO: 137400 - DNA, 25 bp, E. coli
tcgtaaaacgtaaataattcctgcg

SEQ ID NO: 137401 - DNA, 25 bp, E. coli
aattaacccgcagacactctgaagt

SEQ ID NO: 137402 - DNA, 25 bp, E. coli
aatgccatgagtatcgccaacgtcg

SEQ ID NO: 137403 - DNA, 25 bp, E. coli
aattaacccgcacacactctgaagt

SEQ ID NO: 137404 - DNA, 25 bp, E. coli
aatgccatgagtttcgccaacgtcg

SEQ ID NO: 137405 - DNA, 25 bp, E. coli
cagccaatggttttgatgttgacgc

SEQ ID NO: 137406 - DNA, 25 bp, E. coli
cagccaatggttatgatgttgacgc

SEQ ID NO: 137407 - DNA, 25 bp, E. coli
taaaacgctggatctgggctgtggc

SEQ ID NO: 137408 - DNA, 25 bp, E. coli
tacaatgaagacctcggcgagctgc

SEQ ID NO: 137409 - DNA, 25 bp, E. coli
taaaacgctggaactgggctgtggc

SEQ ID NO: 137410 - DNA, 25 bp, E. coli
tacaatgaagacgtcggcgagctgc

SEQ ID NO: 137411 - DNA, 25 bp, E. coli
gtcggcttcccgattgccttcaaag

SEQ ID NO: 137412 - DNA, 25 bp, E. coli
gtcggcttcccgtttgccttcaaag

SEQ ID NO: 137413 - DNA, 25 bp, E. coli
tattaaactgcgtttcgccacgatg

SEQ ID NO: 137414 - DNA, 25 bp, E. coli
tattaaactgcgattcgccacgatg

SEQ ID NO: 137415 - DNA, 25 bp, E. coli
ccacgatgctggcacgtaaaaaatg

SEQ ID NO: 137416 - DNA, 25 bp, E. coli
ccacgatgctgggacgtaaaaaatg

SEQ ID NO: 137417 - DNA, 25 bp, E. coli
gctgattatccaagtaccgtcggct

SEQ ID NO: 137418 - DNA, 25 bp, E. coli
gctgattatccatgtaccgtcggct

SEQ ID NO: 137419 - DNA, 25 bp, E. coli
cgtcgatattaccaaggctgggaga

SEQ ID NO: 137420 - DNA, 25 bp, E. coli
cgtcgatattacgaaggctgggaga

SEQ ID NO: 137421 - DNA, 25 bp, E. coli
gtaacagtctttacctggcagccaa

SEQ ID NO: 137422 - DNA, 25 bp, E. coli
gtaacagtcttttcctggcagccaa

SEQ ID NO: 137423 - DNA, 25 bp, E. coli
aatggctggcagtggagacgttacc

SEQ ID NO: 137424 - DNA, 25 bp, E. coli
aatggctggcagaggagacgttacc

SEQ ID NO: 137425 - DNA, 25 bp, E. coli
cagccggagcatggcgctctggcat

SEQ ID NO: 137426 - DNA, 25 bp, E. coli
cagccggagcatcgcgctctggcat

SEQ ID NO: 137427 - DNA, 25 bp, E. coli
agcatcgcgctcaggcatacgctta

SEQ ID NO: 137428 - DNA, 25 bp, E. coli
agcatcgcgctctggcatacgctta

SEQ ID NO: 137429 - DNA, 25 bp, E. coli
acacccaggactggcactggacggt

SEQ ID NO: 137430 - DNA, 25 bp, E. coli
acacccaggactcgcactggacggt

SEQ ID NO: 137431 - DNA, 25 bp, E. coli
tcatcttttgatcccaccagagggc

SEQ ID NO: 137432 - DNA, 25 bp, E. coli
tcatcttttgatgccaccagagggc

SEQ ID NO: 137433 - DNA, 25 bp, E. coli
tcttttgatccctccagagggcctt

SEQ ID NO: 137434 - DNA, 25 bp, E. coli
tcttttgatcccaccagagggcctt

SEQ ID NO: 137435 - DNA, 25 bp, E. coli
gcagaggagacgatacccgacaaca

SEQ ID NO: 137436 - DNA, 25 bp, E. coli
gcagaggagacgttacccgacaaca

SEQ ID NO: 137437 - DNA, 25 bp, E. coli
gctttgttatggtgtagtacctcac

SEQ ID NO: 137438 - DNA, 25 bp, E. coli
gctttgttatggagtagtacctcac

SEQ ID NO: 137439 - DNA, 25 bp, E. coli
gttacccgacaagacccaggactgg

SEQ ID NO: 137440 - DNA, 25 bp, E. coli
gttacccgacaacacccaggactgg

SEQ ID NO: 137441 - DNA, 25 bp, E. coli
gacaacacccaggactggcactgga

SEQ ID NO: 137442 - DNA, 25 bp, E. coli
gacaacacccagcactggcactgga

SEQ ID NO: 137443 - DNA, 25 bp, E. coli
cgcacaaacatttcaatggctggca

SEQ ID NO: 137444 - DNA, 25 bp, E. coli
cgcacaaacattacaatggctggca

SEQ ID NO: 137445 - DNA, 25 bp, E. coli
cactgacatattttccgcatcccgg

SEQ ID NO: 137446 - DNA, 25 bp, E. coli
cactgacatattatccgcatcccgg

SEQ ID NO: 137447 - DNA, 25 bp, E. coli
tactgatgttccagcctctgacggc

SEQ ID NO: 137448 - DNA, 25 bp, E. coli
tactgatgttcctgcctctgacggc

SEQ ID NO: 137449 - DNA, 25 bp, E. coli
acccggcagtaccacgacattaggc

SEQ ID NO: 137450 - DNA, 25 bp, E. coli
acccggcagtacgacgacattaggc

SEQ ID NO: 137451 - DNA, 25 bp, E. coli
ttattgccgcgttactatggacgag

SEQ ID NO: 137452 - DNA, 25 bp, E. coli
ttattgccgcgtaactatggacgag

SEQ ID NO: 137453 - DNA, 25 bp, E. coli
tgcctgggcagtagcattcatcgtc

SEQ ID NO: 137454 - DNA, 25 bp, E. coli
tgcctgggcagttgcattcatcgtc

SEQ ID NO: 137455 - DNA, 25 bp, E. coli
ccaggtcgaaaggagtatggacgat

SEQ ID NO: 137456 - DNA, 25 bp, E. coli
ccaggtcgaaagcagtatggacgat

SEQ ID NO: 137457 - DNA, 25 bp, E. coli
gcattttttaacaacacaacgcgcc

SEQ ID NO: 137458 - DNA, 25 bp, E. coli
gcattttttaactacacaacgcgcc

SEQ ID NO: 137459 - DNA, 25 bp, E. coli
gcgcatgcggcaacttcaatgagta

SEQ ID NO: 137460 - DNA, 25 bp, E. coli
gcgcatgcggcatcttcaatgagta

SEQ ID NO: 137461 - DNA, 25 bp, E. coli
gcatgaaaatgatccacccggcagt

SEQ ID NO: 137462 - DNA, 25 bp, E. coli
gcatgaaaatgaaccacccggcagt

SEQ ID NO: 137463 - DNA, 25 bp, E. coli
gacggcaatcagaaagcccttaatt

SEQ ID NO: 137464 - DNA, 25 bp, E. coli
gacattaggcctttttgcctgggca

SEQ ID NO: 137465 - DNA, 25 bp, E. coli
gacggcaatcagtaagcccttaatt

SEQ ID NO: 137466 - DNA, 25 bp, E. coli
gacattaggcctatttgcctgggca

SEQ ID NO: 137467 - DNA, 25 bp, E. coli
aatgctgctctcaatgttgtgcgat

SEQ ID NO: 137468 - DNA, 25 bp, E. coli
aatgctgctctctatgttgtgcgat

SEQ ID NO: 137469 - DNA, 25 bp, E. coli
tatgttgtgcgatatggtcaacaac

SEQ ID NO: 137470 - DNA, 25 bp, E. coli
tatgttgtgcgaaatggtcaacaac

SEQ ID NO: 137471 - DNA, 25 bp, E. coli
ttaatgctgctctctatgttgtgcg

SEQ ID NO: 137472 - DNA, 25 bp, E. coli
ttaatgctgctcactatgttgtgcg

SEQ ID NO: 137473 - DNA, 25 bp, E. coli
tgtgcgatatggtcaacaacaaacc

SEQ ID NO: 137474 - DNA, 25 bp, E. coli
tgtgcgatatggacaacaacaaacc

SEQ ID NO: 137475 - DNA, 25 bp, E. coli
tgctgctctctatgttgtgcgatat

SEQ ID NO: 137476 - DNA, 25 bp, E. coli
tgctgctctctaagttgtgcgatat

SEQ ID NO: 137477 - DNA, 25 bp, E. coli
tctatgttgtgccatatggtcaaca

SEQ ID NO: 137478 - DNA, 25 bp, E. coli
tctctatgttgtccgatatggtcaa

SEQ ID NO: 137479 - DNA, 25 bp, E. coli
tctatgttgtgcgatatggtcaaca

SEQ ID NO: 137480 - DNA, 25 bp, E. coli
tctctatgttgtgcgatatggtcaa

SEQ ID NO: 137481 - DNA, 25 bp, E. coli
gctgctctctatcttgtgcgatatg

SEQ ID NO: 137482 - DNA, 25 bp, E. coli
gctctctatgttctgcgatatggtc

SEQ ID NO: 137483 - DNA, 25 bp, E. coli
gctctctatgttgtgcgatatggtc

SEQ ID NO: 137484 - DNA, 25 bp, E. coli
gctgctctctatgttgtgcgatatg

SEQ ID NO: 137485 - DNA, 25 bp, E. coli
ctgctctctatgatgtgcgatatgg

SEQ ID NO: 137486 - DNA, 25 bp, E. coli
ctgctctctatgttgtgcgatatgg

SEQ ID NO: 137487 - DNA, 25 bp, E. coli
taatgctgctctgtatgttgtgcga

SEQ ID NO: 137488 - DNA, 25 bp, E. coli
taatgctgctctctatgttgtgcga

SEQ ID NO: 137489 - DNA, 25 bp, E. coli
tacgctcttcgtaccctgtctcttg

SEQ ID NO: 137490 - DNA, 25 bp, E. coli
tacgctcttcgttccctgtctcttg

SEQ ID NO: 137491 - DNA, 25 bp, E. coli
tattcggtacgctcttcgtaccctg

SEQ ID NO: 137492 - DNA, 25 bp, E. coli
tattcggtacgcacttcgtaccctg

SEQ ID NO: 137493 - DNA, 25 bp, E. coli
ttggtgagattaatcggtacgctct

SEQ ID NO: 137494 - DNA, 25 bp, E. coli
ttggtgagattattcggtacgctct

SEQ ID NO: 137495 - DNA, 25 bp, E. coli
tgattggtgagattattcggtacgc

SEQ ID NO: 137496 - DNA, 25 bp, E. coli
tgattggtgagaatattcggtacgc

SEQ ID NO: 137497 - DNA, 25 bp, E. coli
tgcaccaacctgcgcggatgcgcag

SEQ ID NO: 137498 - DNA, 25 bp, E. coli
tgcaccaacctgggcggatgcgcag

SEQ ID NO: 137499 - DNA, 25 bp, E. coli
tcttgcaccaacctgcgcggatgcg

SEQ ID NO: 137500 - DNA, 25 bp, E. coli
tcttgcaccaacgtgcgcggatgcg

SEQ ID NO: 137501 - DNA, 25 bp, E. coli
cccagaggtattgattggtgagatt

SEQ ID NO: 137502 - DNA, 25 bp, E. coli
cccagaggtattcattggtgagatt

SEQ ID NO: 137503 - DNA, 25 bp, E. coli
gattattcggtacgctcttcgtacc

SEQ ID NO: 137504 - DNA, 25 bp, E. coli
gattattcggtaggctcttcgtacc

SEQ ID NO: 137505 - DNA, 25 bp, E. coli
gtctcttgcaccaacctgcgcggat

SEQ ID NO: 137506 - DNA, 25 bp, E. coli
ggtgagattattcggtacgctcttc

SEQ ID NO: 137507 - DNA, 25 bp, E. coli
gtctcttgcacctacctgcgcggat

SEQ ID NO: 137508 - DNA, 25 bp, E. coli
ggtgagattattgggtacgctcttc

SEQ ID NO: 137509 - DNA, 25 bp, E. coli
gagattattcggtacgctcttcgta

SEQ ID NO: 137510 - DNA, 25 bp, E. coli
gagattattcggaacgctcttcgta

SEQ ID NO: 137511 - DNA, 25 bp, E. coli
aagcgacggcttctgcatggaagac

SEQ ID NO: 137512 - DNA, 25 bp, E. coli
aagcgacggcttgtgcatggaagac

SEQ ID NO: 137513 - DNA, 25 bp, E. coli
cacagcgatcaggtgtttgcgatca

SEQ ID NO: 137514 - DNA, 25 bp, E. coli
cagcgttttcgcttaagcgacggct

SEQ ID NO: 137515 - DNA, 25 bp, E. coli
cagcgttttcgcataagcgacggct

SEQ ID NO: 137516 - DNA, 25 bp, E. coli
cacagcgatcagctgtttgcgatca

SEQ ID NO: 137517 - DNA, 25 bp, E. coli
catggaagacgatcagttttccgtc

SEQ ID NO: 137518 - DNA, 25 bp, E. coli
catggaagacgaacagttttccgtc

SEQ ID NO: 137519 - DNA, 25 bp, E. coli
aaaccggcgtctgcgcgctgttagg

SEQ ID NO: 137520 - DNA, 25 bp, E. coli
aaaccggcgtctccgcgctgttagg

SEQ ID NO: 137521 - DNA, 25 bp, E. coli
tttgcgatcagcaacatcgacccgt

SEQ ID NO: 137522 - DNA, 25 bp, E. coli
tttccgcccgtatcacagcgatcag

SEQ ID NO: 137523 - DNA, 25 bp, E. coli
tttccgcccgtaacacagcgatcag

SEQ ID NO: 137524 - DNA, 25 bp, E. coli
tttgcgatcagctacatcgacccgt

SEQ ID NO: 137525 - DNA, 25 bp, E. coli
tgattgcggaactccagggcgagct

SEQ ID NO: 137526 - DNA, 25 bp, E. coli
tgattgcggaacaccagggcgagct

SEQ ID NO: 137527 - DNA, 25 bp, E. coli
tgagccagtggatagacatctgcaa

SEQ ID NO: 137528 - DNA, 25 bp, E. coli
tgagccagtggaaagacatctgcaa

SEQ ID NO: 137529 - DNA, 25 bp, E. coli
tcgatgacatccagcctgaaaccgg

SEQ ID NO: 137530 - DNA, 25 bp, E. coli
tcgatgacatcctgcctgaaaccgg

SEQ ID NO: 137531 - DNA, 25 bp, E. coli
cgttcttcgagtgcagcgtgctgtc

SEQ ID NO: 137532 - DNA, 25 bp, E. coli
cgttcttcgagtccagcgtgctgtc

SEQ ID NO: 137533 - DNA, 25 bp, E. coli
accgtttgtcgatggtttggcacca

SEQ ID NO: 137534 - DNA, 25 bp, E. coli
accgtttgtcgaaggtttggcacca

SEQ ID NO: 137535 - DNA, 25 bp, E. coli
aaactatgacgaggatgtgagtcgc

SEQ ID NO: 137536 - DNA, 25 bp, E. coli
aaactatgacgacgatgtgagtcgc

SEQ ID NO: 137537 - DNA, 25 bp, E. coli
tttgtcgatggtttggcaccagtga

SEQ ID NO: 137538 - DNA, 25 bp, E. coli
tttgtcgatggtatggcaccagtga

SEQ ID NO: 137539 - DNA, 25 bp, E. coli
tgagtcgcagcgagatcaatatcaa

SEQ ID NO: 137540 - DNA, 25 bp, E. coli
tgagtcgcagcgtgatcaatatcaa

SEQ ID NO: 137541 - DNA, 25 bp, E. coli
cctgggctgggataactatgacgag

SEQ ID NO: 137542 - DNA, 25 bp, E. coli
cctgggctgggaaaactatgacgag

SEQ ID NO: 137543 - DNA, 25 bp, E. coli
gctgggaaaactatgacgaggatgt

SEQ ID NO: 137544 - DNA, 25 bp, E. coli
gctgggaaaactttgacgaggatgt

SEQ ID NO: 137545 - DNA, 25 bp, E. coli
gcaccagtgaccagggctgggaaaa

SEQ ID NO: 137546 - DNA, 25 bp, E. coli
gcaccagtgacctgggctgggaaaa

SEQ ID NO: 137547 - DNA, 25 bp, E. coli
cgcagcgtgatctatatcaacaagg

SEQ ID NO: 137548 - DNA, 25 bp, E. coli
cgcagcgtgatcaatatcaacaagg

SEQ ID NO: 137549 - DNA, 25 bp, E. coli
ctatgacgaggaagtgagtcgcagc

SEQ ID NO: 137550 - DNA, 25 bp, E. coli
ctatgacgaggatgtgagtcgcagc

SEQ ID NO: 137551 - DNA, 25 bp, E. coli
gacctgggctgggaaaactatgacg

SEQ ID NO: 137552 - DNA, 25 bp, E. coli
gacctgggctggcaaaactatgacg

SEQ ID NO: 137553 - DNA, 25 bp, E. coli
gatgtgagtcgctgcgtgatcaata

SEQ ID NO: 137554 - DNA, 25 bp, E. coli
gatgtgagtcgcagcgtgatcaata

SEQ ID NO: 137555 - DNA, 25 bp, E. coli
atttctctgagatgttcgcaagcgg

SEQ ID NO: 137556 - DNA, 25 bp, E. coli
agatgttcgcaagcgggccagtccc

SEQ ID NO: 137557 - DNA, 25 bp, E. coli
agatgttcgcaaccgggccagtccc

SEQ ID NO: 137558 - DNA, 25 bp, E. coli
atttctctgagaagttcgcaagcgg

SEQ ID NO: 137559 - DNA, 25 bp, E. coli
taccacaagaatgtggcgctccgcg

SEQ ID NO: 137560 - DNA, 25 bp, E. coli
taccacaagaatctggcgctccgcg

SEQ ID NO: 137561 - DNA, 25 bp, E. coli
tatttcataccagaagaatgtggcg

SEQ ID NO: 137562 - DNA, 25 bp, E. coli
tatttcataccacaagaatgtggcg

SEQ ID NO: 137563 - DNA, 25 bp, E. coli
tgagatgttcgcaagcgggccagtc

SEQ ID NO: 137564 - DNA, 25 bp, E. coli
tgagatgttcgctagcgggccagtc

SEQ ID NO: 137565 - DNA, 25 bp, E. coli
tcccctgagccgatatttcatacca

SEQ ID NO: 137566 - DNA, 25 bp, E. coli
tcccctgagccgttatttcatacca

SEQ ID NO: 137567 - DNA, 25 bp, E. coli
tctctgagatgtacgcaagcgggcc

SEQ ID NO: 137568 - DNA, 25 bp, E. coli
tctctgagatgttcgcaagcgggcc

SEQ ID NO: 137569 - DNA, 25 bp, E. coli
tcataccacaagtatgtggcgctcc

SEQ ID NO: 137570 - DNA, 25 bp, E. coli
tcataccacaagaatgtggcgctcc

SEQ ID NO: 137571 - DNA, 25 bp, E. coli
gccagtcccctgtgccgatatttca

SEQ ID NO: 137572 - DNA, 25 bp, E. coli
gccagtcccctgagccgatatttca

SEQ ID NO: 137573 - DNA, 25 bp, E. coli
gggccagtcccctgagccgatattt

SEQ ID NO: 137574 - DNA, 25 bp, E. coli
gggccagtccccagagccgatattt

SEQ ID NO: 137575 - DNA, 25 bp, E. coli
gagccgatatttgataccacaagaa

SEQ ID NO: 137576 - DNA, 25 bp, E. coli
gagccgatatttcataccacaagaa

SEQ ID NO: 137577 - DNA, 25 bp, E. coli
aatggactgtatagcgctcttcgtg

SEQ ID NO: 137578 - DNA, 25 bp, E. coli
aatggactgtattgcgctcttcgtg

SEQ ID NO: 137579 - DNA, 25 bp, E. coli
tacaggctaaagacgaaccgccagg

SEQ ID NO: 137580 - DNA, 25 bp, E. coli
tacaggctaaagtcgaaccgccagg

SEQ ID NO: 137581 - DNA, 25 bp, E. coli
taaaaactggcgctaacaatacagg

SEQ ID NO: 137582 - DNA, 25 bp, E. coli
taaaaactggcggtaacaatacagg

SEQ ID NO: 137583 - DNA, 25 bp, E. coli
aaactttcgcccgtcctggcattga

SEQ ID NO: 137584 - DNA, 25 bp, E. coli
aaactttcgcccctcctggcattga

SEQ ID NO: 137585 - DNA, 25 bp, E. coli
tgccagcttgtttaaaatgcgtaaa

SEQ ID NO: 137586 - DNA, 25 bp, E. coli
tgccagcttgttaaaaatgcgtaaa

SEQ ID NO: 137587 - DNA, 25 bp, E. coli
tcgtgcgtcgcgactgttaaaaact

SEQ ID NO: 137588 - DNA, 25 bp, E. coli
tcgtgcgtcgcgtctgttaaaaact

SEQ ID NO: 137589 - DNA, 25 bp, E. coli
gcctgtcggaactggtatttaacca

SEQ ID NO: 137590 - DNA, 25 bp, E. coli
gcctgtcggaacaggtatttaacca

SEQ ID NO: 137591 - DNA, 25 bp, E. coli
gccaggctagactttagttccacaa

SEQ ID NO: 137592 - DNA, 25 bp, E. coli
gccaggctagacattagttccacaa

SEQ ID NO: 137593 - DNA, 25 bp, E. coli
ctggcattgattcagcctgtcggaa

SEQ ID NO: 137594 - DNA, 25 bp, E. coli
ctggcattgattgagcctgtcggaa

SEQ ID NO: 137595 - DNA, 25 bp, E. coli
ggtgcttttttgaggcctgcttcaa

SEQ ID NO: 137596 - DNA, 25 bp, E. coli
ggtgcttttttgtggcctgcttcaa

SEQ ID NO: 137597 - DNA, 25 bp, E. coli
tcaacacccgcctgcaatggactgt

SEQ ID NO: 137598 - DNA, 25 bp, E. coli
tcaacacccgccagcaatggactgt

SEQ ID NO: 137599 - DNA, 25 bp, E. coli
aaggcggctcgctgaagatgtacaa

SEQ ID NO: 137600 - DNA, 25 bp, E. coli
caattatgttggaccggaagaccgc

SEQ ID NO: 137601 - DNA, 25 bp, E. coli
aaggcggctcgcagaagatgtacaa

SEQ ID NO: 137602 - DNA, 25 bp, E. coli
caattatgttggtccggaagaccgc

SEQ ID NO: 137603 - DNA, 25 bp, E. coli
cacccgatggatcttatgcgcaccg

SEQ ID NO: 137604 - DNA, 25 bp, E. coli
caaagctgggaataggcgatgcata

SEQ ID NO: 137605 - DNA, 25 bp, E. coli
cacccgatggatgttatgcgcaccg

SEQ ID NO: 137606 - DNA, 25 bp, E. coli
caaagctgggaaaaggcgatgcata

SEQ ID NO: 137607 - DNA, 25 bp, E. coli
tacaaaacgaaactgaaagccctgc

SEQ ID NO: 137608 - DNA, 25 bp, E. coli
tacaaaacgaaagtgaaagccctgc

SEQ ID NO: 137609 - DNA, 25 bp, E. coli
tgggcggcgcactttatcgaacaac

SEQ ID NO: 137610 - DNA, 25 bp, E. coli
tgggcggcgcacattatcgaacaac

SEQ ID NO: 137611 - DNA, 25 bp, E. coli
tggtatcactactgccacaacggcg

SEQ ID NO: 137612 - DNA, 25 bp, E. coli
tggtatcactacagccacaacggcg

SEQ ID NO: 137613 - DNA, 25 bp, E. coli
ccactgtttgttttcgcccgcgtca

SEQ ID NO: 137614 - DNA, 25 bp, E. coli
ccactgtttgttatcgcccgcgtca

SEQ ID NO: 137615 - DNA, 25 bp, E. coli
gatattgccgacaaactgctggcgt

SEQ ID NO: 137616 - DNA, 25 bp, E. coli
gatattgccgactaactgctggcgt

SEQ ID NO: 137617 - DNA, 25 bp, E. coli
tgtacgccgaacacgagtttaacgc

SEQ ID NO: 137618 - DNA, 25 bp, E. coli
ggctaacgtgcgaaccgtgctggaa

SEQ ID NO: 137619 - DNA, 25 bp, E. coli
ggctaacgtgcgtaccgtgctggaa

SEQ ID NO: 137620 - DNA, 25 bp, E. coli
tgtacgccgaactcgagtttaacgc

SEQ ID NO: 137621 - DNA, 25 bp, E. coli
caccggacagcgtcatgatgatgta

SEQ ID NO: 137622 - DNA, 25 bp, E. coli
caccggacagcgacatgatgatgta

SEQ ID NO: 137623 - DNA, 25 bp, E. coli
agccggaaggcatcgcgggtgaggg

SEQ ID NO: 137624 - DNA, 25 bp, E. coli
accggacagcgacatgatgatgtaa

SEQ ID NO: 137625 - DNA, 25 bp, E. coli
agtgcttcagattgcggtgacccca

SEQ ID NO: 137626 - DNA, 25 bp, E. coli
accggacagcgagatgatgatgtaa

SEQ ID NO: 137627 - DNA, 25 bp, E. coli
agatagcggtgagcccacaccggac

SEQ ID NO: 137628 - DNA, 25 bp, E. coli
agatagcggtgaccccacaccggac

SEQ ID NO: 137629 - DNA, 25 bp, E. coli
agccggaaggcaacgcgggtgaggg

SEQ ID NO: 137630 - DNA, 25 bp, E. coli
agtgcttcagatagcggtgacccca

SEQ ID NO: 137631 - DNA, 25 bp, E. coli
ttcagatagcggagaccccacaccg

SEQ ID NO: 137632 - DNA, 25 bp, E. coli
ttcagatagcggtgaccccacaccg

SEQ ID NO: 137633 - DNA, 25 bp, E. coli
ccacaccggacaccgacatgatgat

SEQ ID NO: 137634 - DNA, 25 bp, E. coli
ccacaccggacagcgacatgatgat

SEQ ID NO: 137635 - DNA, 25 bp, E. coli
cggcagctccggtgccggaaggcat

SEQ ID NO: 137636 - DNA, 25 bp, E. coli
cggcagctccggagccggaaggcat

SEQ ID NO: 137637 - DNA, 25 bp, E. coli
gtgcttcagataccggtgaccccac

SEQ ID NO: 137638 - DNA, 25 bp, E. coli
ggagtgcttcagttagcggtgaccc

SEQ ID NO: 137639 - DNA, 25 bp, E. coli
ggatgagctgctgggcgcaccggca

SEQ ID NO: 137640 - DNA, 25 bp, E. coli
ggagtgcttcagatagcggtgaccc

SEQ ID NO: 137641 - DNA, 25 bp, E. coli
ggatgagctgctcggcgcaccggca

SEQ ID NO: 137642 - DNA, 25 bp, E. coli
gtgcttcagatagcggtgaccccac

SEQ ID NO: 137643 - DNA, 25 bp, E. coli
cagccaggttctcctcgccagttag

SEQ ID NO: 137644 - DNA, 25 bp, E. coli
cagccaggttctgctcgccagttag

SEQ ID NO: 137645 - DNA, 25 bp, E. coli
agatgccgtcataactctcaaacag

SEQ ID NO: 137646 - DNA, 25 bp, E. coli
agatgccgtcattactctcaaacag

SEQ ID NO: 137647 - DNA, 25 bp, E. coli
aaaccaaccagccaggttctgctcg

SEQ ID NO: 137648 - DNA, 25 bp, E. coli
aaaccaaccagcgaggttctgctcg

SEQ ID NO: 137649 - DNA, 25 bp, E. coli
gctcgccagttaccggcaatgctgc

SEQ ID NO: 137650 - DNA, 25 bp, E. coli
gctgcgcaatctgccgcaaaccaac

SEQ ID NO: 137651 - DNA, 25 bp, E. coli
gctcgccagttagcggcaatgctgc

SEQ ID NO: 137652 - DNA, 25 bp, E. coli
gctgcgcaatctcccgcaaaccaac

SEQ ID NO: 137653 - DNA, 25 bp, E. coli
gaagtgcaactaccagatgccgtca

SEQ ID NO: 137654 - DNA, 25 bp, E. coli
gcaactaccagaagccgtcattact

SEQ ID NO: 137655 - DNA, 25 bp, E. coli
gcaactaccagatgccgtcattact

SEQ ID NO: 137656 - DNA, 25 bp, E. coli
gaagtgcaactagcagatgccgtca

SEQ ID NO: 137657 - DNA, 25 bp, E. coli
cgttgctgttgcgcagcccatttga

SEQ ID NO: 137658 - DNA, 25 bp, E. coli
cccgttcgatgaagtgcaactacca

SEQ ID NO: 137659 - DNA, 25 bp, E. coli
cccgttcgatgatgtgcaactacca

SEQ ID NO: 137660 - DNA, 25 bp, E. coli
cgttgctgttgcccagcccatttga

SEQ ID NO: 137661 - DNA, 25 bp, E. coli
ggttctgctcgccagttagcggcaa

SEQ ID NO: 137662 - DNA, 25 bp, E. coli
ggttctgctcgcgagttagcggcaa

SEQ ID NO: 137663 - DNA, 25 bp, E. coli
gatgaagtgcaactaccagatgccg

SEQ ID NO: 137664 - DNA, 25 bp, E. coli
gatgaagtgcaagtaccagatgccg

SEQ ID NO: 137665 - DNA, 25 bp, E. coli
caaaatattctcctggcaggtggac

SEQ ID NO: 137666 - DNA, 25 bp, E. coli
cagacctgggatcccgtaatacttg

SEQ ID NO: 137667 - DNA, 25 bp, E. coli
caaaatattctcgtggcaggtggac

SEQ ID NO: 137668 - DNA, 25 bp, E. coli
cagacctgggatgccgtaatacttg

SEQ ID NO: 137669 - DNA, 25 bp, E. coli
taaacaggttgaacttaccccacgc

SEQ ID NO: 137670 - DNA, 25 bp, E. coli
taaacaggttgatcttaccccacgc

SEQ ID NO: 137671 - DNA, 25 bp, E. coli
taccccacgcgagtttgatctgctg

SEQ ID NO: 137672 - DNA, 25 bp, E. coli
taccccacgcgactttgatctgctg

SEQ ID NO: 137673 - DNA, 25 bp, E. coli
ttattactagactagcagacctggg

SEQ ID NO: 137674 - DNA, 25 bp, E. coli
ttattactagacaagcagacctggg

SEQ ID NO: 137675 - DNA, 25 bp, E. coli
tgattatcatcactgcccgtaccag

SEQ ID NO: 137676 - DNA, 25 bp, E. coli
tgattatcatcagtgcccgtaccag

SEQ ID NO: 137677 - DNA, 25 bp, E. coli
tgcagcagagcctaagatgatccag

SEQ ID NO: 137678 - DNA, 25 bp, E. coli
tgcagcagagccaaagatgatccag

SEQ ID NO: 137679 - DNA, 25 bp, E. coli
tctggtttgcacgtcatcctggcga

SEQ ID NO: 137680 - DNA, 25 bp, E. coli
tctggtttgcacctcatcctggcga

SEQ ID NO: 137681 - DNA, 25 bp, E. coli
gatagttcatgatgcggatggcgcc

SEQ ID NO: 137682 - DNA, 25 bp, E. coli
gatagttcatgaagcggatggcgcc

SEQ ID NO: 137683 - DNA, 25 bp, E. coli
ggcgccagagctggtttattactag

SEQ ID NO: 137684 - DNA, 25 bp, E. coli
ggcgccagagctcgtttattactag

SEQ ID NO: 137685 - DNA, 25 bp, E. coli
tcaaagcgttgtttcgtcgtcagga

SEQ ID NO: 137686 - DNA, 25 bp, E. coli
tcaaagcgttgtatcgtcgtcagga

SEQ ID NO: 137687 - DNA, 25 bp, E. coli
taaaaccccatgtgcgtaagcgggc

SEQ ID NO: 137688 - DNA, 25 bp, E. coli
taaaaccccatgagcgtaagcgggc

SEQ ID NO: 137689 - DNA, 25 bp, E. coli
tagcgaatatccagggttcaaaacc

SEQ ID NO: 137690 - DNA, 25 bp, E. coli
tagcgaatatcctgggttcaaaacc

SEQ ID NO: 137691 - DNA, 25 bp, E. coli
gcgctgaatcgctgtccttcgacga

SEQ ID NO: 137692 - DNA, 25 bp, E. coli
gcgctgaatcgcagtccttcgacga

SEQ ID NO: 137693 - DNA, 25 bp, E. coli
gacgatctcacgtgaagttcagcgt

SEQ ID NO: 137694 - DNA, 25 bp, E. coli
gaactatggaagaacggaacaggct

SEQ ID NO: 137695 - DNA, 25 bp, E. coli
gacactgtctgaccgcgaggagata

SEQ ID NO: 137696 - DNA, 25 bp, E. coli
gaactatggaagtacggaacaggct

SEQ ID NO: 137697 - DNA, 25 bp, E. coli
gacgatctcacgagaagttcagcgt

SEQ ID NO: 137698 - DNA, 25 bp, E. coli
gacactgtctgagcgcgaggagata

SEQ ID NO: 137699 - DNA, 25 bp, E. coli
cgtaagcgggctgtagctcacctga

SEQ ID NO: 137700 - DNA, 25 bp, E. coli
cgtaagcgggctctagctcacctga

SEQ ID NO: 137701 - DNA, 25 bp, E. coli
gatacgagctggattgtcagccaaa

SEQ ID NO: 137702 - DNA, 25 bp, E. coli
gatacgagctggtttgtcagccaaa

SEQ ID NO: 137703 - DNA, 25 bp, E. coli
tcactatgttaagggatactggcgg

SEQ ID NO: 137704 - DNA, 25 bp, E. coli
tcactatgttaacggatactggcgg

SEQ ID NO: 137705 - DNA, 25 bp, E. coli
gatactggcggcttaaaaccccatg

SEQ ID NO: 137706 - DNA, 25 bp, E. coli
gatactggcggcataaaaccccatg

SEQ ID NO: 137707 - DNA, 25 bp, E. coli
gagcattcgtgccatagctactgcg

SEQ ID NO: 137708 - DNA, 25 bp, E. coli
gagcattcgtgcgatagctactgcg

SEQ ID NO: 137709 - DNA, 25 bp, E. coli
cagcgggcgattcacttgttgaatc

SEQ ID NO: 137710 - DNA, 25 bp, E. coli
cagcgggcgattgacttgttgaatc

SEQ ID NO: 137711 - DNA, 25 bp, E. coli
cagggcggtaataagagcactcgtc

SEQ ID NO: 137712 - DNA, 25 bp, E. coli
cagggcggtaattagagcactcgtc

SEQ ID NO: 137713 - DNA, 25 bp, E. coli
gcctggcgttgttcccggcaagtac

SEQ ID NO: 137714 - DNA, 25 bp, E. coli
gcctggcgttgtacccggcaagtac

SEQ ID NO: 137715 - DNA, 25 bp, E. coli
gcatcgttgcctggcgttgttcccg

SEQ ID NO: 137716 - DNA, 25 bp, E. coli
gcatcgttgcctcgcgttgttcccg

SEQ ID NO: 137717 - DNA, 25 bp, E. coli
gcactcgtcgtctgcgggcgattga

SEQ ID NO: 137718 - DNA, 25 bp, E. coli
gcatcagggcggtaataagagcact

SEQ ID NO: 137719 - DNA, 25 bp, E. coli
gcatcagggcggaaataagagcact

SEQ ID NO: 137720 - DNA, 25 bp, E. coli
gaacgtctggcaacgttgcctggcg

SEQ ID NO: 137721 - DNA, 25 bp, E. coli
gcactcgtcgtcagcgggcgattga

SEQ ID NO: 137722 - DNA, 25 bp, E. coli
gaacgtctggcatcgttgcctggcg

SEQ ID NO: 137723 - DNA, 25 bp, E. coli
cggtcaggtggtggaaacgggcgat

SEQ ID NO: 137724 - DNA, 25 bp, E. coli
cggtcaggtggtcgaaacgggcgat

SEQ ID NO: 137725 - DNA, 25 bp, E. coli
gattgcgatggcgattgcctgtcgg

SEQ ID NO: 137726 - DNA, 25 bp, E. coli
gattgcgatggccattgcctgtcgg

SEQ ID NO: 137727 - DNA, 25 bp, E. coli
ggcgattgacttcttgaatcaggtc

SEQ ID NO: 137728 - DNA, 25 bp, E. coli
ggcgattgacttgttgaatcaggtc

SEQ ID NO: 137729 - DNA, 25 bp, E. coli
taataagagcacacgtcgtcagcgg

SEQ ID NO: 137730 - DNA, 25 bp, E. coli
taataagagcactcgtcgtcagcgg

SEQ ID NO: 137731 - DNA, 25 bp, E. coli
cactgaaaactattgatccggcgga

SEQ ID NO: 137732 - DNA, 25 bp, E. coli
cactgaaaactaatgatccggcgga

SEQ ID NO: 137733 - DNA, 25 bp, E. coli
aaaattcgcgggttactggcagcca

SEQ ID NO: 137734 - DNA, 25 bp, E. coli
aaaattcgcgggatactggcagcca

SEQ ID NO: 137735 - DNA, 25 bp, E. coli
tatctcaggccgaagcgaaatcgtt

SEQ ID NO: 137736 - DNA, 25 bp, E. coli
tatctcaggccgtagcgaaatcgtt

SEQ ID NO: 137737 - DNA, 25 bp, E. coli
tattaatattctagcccatccggcg

SEQ ID NO: 137738 - DNA, 25 bp, E. coli
tattaatattcttgcccatccggcg

SEQ ID NO: 137739 - DNA, 25 bp, E. coli
ttacgatccagtcaaagcgcgcgaa

SEQ ID NO: 137740 - DNA, 25 bp, E. coli
ttacgatccagtgaaagcgcgcgaa

SEQ ID NO: 137741 - DNA, 25 bp, E. coli
tttacccagcaggagttagcgcagg

SEQ ID NO: 137742 - DNA, 25 bp, E. coli
tttacccagcagcagttagcgcagg

SEQ ID NO: 137743 - DNA, 25 bp, E. coli
tcccgctggtggaagaaaaactggt

SEQ ID NO: 137744 - DNA, 25 bp, E. coli
tcccgctggtggtagaaaaactggt

SEQ ID NO: 137745 - DNA, 25 bp, E. coli
ccggcagcgctgcaaaaatatggca

SEQ ID NO: 137746 - DNA, 25 bp, E. coli
ccggcagcgctggaaaaatatggca

SEQ ID NO: 137747 - DNA, 25 bp, E. coli
taaggcggcgcaggatatcatctgg

SEQ ID NO: 137748 - DNA, 25 bp, E. coli
taaggcggcgcacgatatcatctgg

SEQ ID NO: 137749 - DNA, 25 bp, E. coli
gatggccagtccctcaattatgcag

SEQ ID NO: 137750 - DNA, 25 bp, E. coli
gatgttctacactggctggtcggct

SEQ ID NO: 137751 - DNA, 25 bp, E. coli
gatgttctacacaggctggtcggct

SEQ ID NO: 137752 - DNA, 25 bp, E. coli
gatggccagtccgtcaattatgcag

SEQ ID NO: 137753 - DNA, 25 bp, E. coli
taaattagaattccatacaggaagt

SEQ ID NO: 137754 - DNA, 25 bp, E. coli
tacaggaagtttagaagatagattg

SEQ ID NO: 137755 - DNA, 25 bp, E. coli
taaattagaattgcatacaggaagt

SEQ ID NO: 137756 - DNA, 25 bp, E. coli
tacaggaagttttgaagatagattg

SEQ ID NO: 137757 - DNA, 25 bp, E. coli
tatggttggctttgaacgaagaaaa

SEQ ID NO: 137758 - DNA, 25 bp, E. coli
tatggttggcttagaacgaagaaaa

SEQ ID NO: 137759 - DNA, 25 bp, E. coli
tattcttgaaggaagagatagagat

SEQ ID NO: 137760 - DNA, 25 bp, E. coli
tattcttgaaggtagagatagagat

SEQ ID NO: 137761 - DNA, 25 bp, E. coli
tttagttgaaggtgagacctcggcc

SEQ ID NO: 137762 - DNA, 25 bp, E. coli
tttagttgaaggagagacctcggcc

SEQ ID NO: 137763 - DNA, 25 bp, E. coli
tgagttattataaagaggctaaacc

SEQ ID NO: 137764 - DNA, 25 bp, E. coli
tgagttattatatagaggctaaacc

SEQ ID NO: 137765 - DNA, 25 bp, E. coli
gattggtatatcaggttgaaagaaa

SEQ ID NO: 137766 - DNA, 25 bp, E. coli
tcctagaagcgatattaaatattcg

SEQ ID NO: 137767 - DNA, 25 bp, E. coli
tcctagaagcgaaattaaatattcg

SEQ ID NO: 137768 - DNA, 25 bp, E. coli
taatttaggtggtatatggttggct

SEQ ID NO: 137769 - DNA, 25 bp, E. coli
taatttaggtggaatatggttggct

SEQ ID NO: 137770 - DNA, 25 bp, E. coli
gagacctcggccaattttaatttag

SEQ ID NO: 137771 - DNA, 25 bp, E. coli
gagacctcggcctattttaatttag

SEQ ID NO: 137772 - DNA, 25 bp, E. coli
gattggtatatctggttgaaagaaa

SEQ ID NO: 137773 - DNA, 25 bp, E. coli
gaggctaaacctcatatgaattttt

SEQ ID NO: 137774 - DNA, 25 bp, E. coli
gaggctaaacctgatatgaattttt

SEQ ID NO: 137775 - DNA, 25 bp, E. coli
catcttcatgtctttcgccgggcag

SEQ ID NO: 137776 - DNA, 25 bp, E. coli
catcttcatgtcattcgccgggcag

SEQ ID NO: 137777 - DNA, 25 bp, E. coli
tactggctgtgactgcgttggtact

SEQ ID NO: 137778 - DNA, 25 bp, E. coli
tactggctgtgagtgcgttggtact

SEQ ID NO: 137779 - DNA, 25 bp, E. coli
aaatcattgcctacactgccaggcg

SEQ ID NO: 137780 - DNA, 25 bp, E. coli
aaatcattgccttcactgccaggcg

SEQ ID NO: 137781 - DNA, 25 bp, E. coli
tatcgccagctttattggtacgtcg

SEQ ID NO: 137782 - DNA, 25 bp, E. coli
tatcgccagcttaattggtacgtcg

SEQ ID NO: 137783 - DNA, 25 bp, E. coli
tcaggcagaaaaagccgggtctatt

SEQ ID NO: 137784 - DNA, 25 bp, E. coli
tcaggcagaaaatgccgggtctatt

SEQ ID NO: 137785 - DNA, 25 bp, E. coli
gctttcttcacgaatattcgcccgg

SEQ ID NO: 137786 - DNA, 25 bp, E. coli
gcttgctaatacctgtggcgcggca

SEQ ID NO: 137787 - DNA, 25 bp, E. coli
gctttcttcacgtatattcgcccgg

SEQ ID NO: 137788 - DNA, 25 bp, E. coli
gcttgctaatacgtgtggcgcggca

SEQ ID NO: 137789 - DNA, 25 bp, E. coli
gtaaaactggccttagcaggcgcgc

SEQ ID NO: 137790 - DNA, 25 bp, E. coli
gataaaatcgttcctaccggcgtgg

SEQ ID NO: 137791 - DNA, 25 bp, E. coli
gataaaatcgttgctaccggcgtgg

SEQ ID NO: 137792 - DNA, 25 bp, E. coli
gtaaaactggccatagcaggcgcgc

SEQ ID NO: 137793 - DNA, 25 bp, E. coli
taacttttgcataggttcccgtcgg

SEQ ID NO: 137794 - DNA, 25 bp, E. coli
taacttttgcattggttcccgtcgg

SEQ ID NO: 137795 - DNA, 25 bp, E. coli
gttcccgtcggcaggtcaacgtgga

SEQ ID NO: 137796 - DNA, 25 bp, E. coli
gttcccgtcggctggtcaacgtgga

SEQ ID NO: 137797 - DNA, 25 bp, E. coli
tagccaacgtcagttatttacactg

SEQ ID NO: 137798 - DNA, 25 bp, E. coli
taaatgtaatcacccaaagcctgag

SEQ ID NO: 137799 - DNA, 25 bp, E. coli
tagccaacgtcacttatttacactg

SEQ ID NO: 137800 - DNA, 25 bp, E. coli
taaatgtaatcagccaaagcctgag

SEQ ID NO: 137801 - DNA, 25 bp, E. coli
atattcttttaggcaacgtcagtta

SEQ ID NO: 137802 - DNA, 25 bp, E. coli
agcctgagttttagtgctgatgaac

SEQ ID NO: 137803 - DNA, 25 bp, E. coli
agcctgagtttttgtgctgatgaac

SEQ ID NO: 137804 - DNA, 25 bp, E. coli
atattcttttagccaacgtcagtta

SEQ ID NO: 137805 - DNA, 25 bp, E. coli
aaatattctttttgccaacgtcagt

SEQ ID NO: 137806 - DNA, 25 bp, E. coli
aatattcttttacccaacgtcagtt

SEQ ID NO: 137807 - DNA, 25 bp, E. coli
aatattcttttagccaacgtcagtt

SEQ ID NO: 137808 - DNA, 25 bp, E. coli
aaaatattctttaagccaacgtcag

SEQ ID NO: 137809 - DNA, 25 bp, E. coli
aaatattcttttagccaacgtcagt

SEQ ID NO: 137810 - DNA, 25 bp, E. coli
aaaatattcttttagccaacgtcag

SEQ ID NO: 137811 - DNA, 25 bp, E. coli
tgttggccgctaaaaatcatgacaa

SEQ ID NO: 137812 - DNA, 25 bp, E. coli
tgttggccgctataaatcatgacaa

SEQ ID NO: 137813 - DNA, 25 bp, E. coli
tattcttttagccaacgtcagttat

SEQ ID NO: 137814 - DNA, 25 bp, E. coli
tattcttttagcgaacgtcagttat

SEQ ID NO: 137815 - DNA, 25 bp, E. coli
ccaacgtcagttttttacactgttg

SEQ ID NO: 137816 - DNA, 25 bp, E. coli
ccaacgtcagttatttacactgttg

SEQ ID NO: 137817 - DNA, 25 bp, E. coli
gtgctgatgaactaaagacgtattt

SEQ ID NO: 137818 - DNA, 25 bp, E. coli
gtgctgatgaacaaaagacgtattt

SEQ ID NO: 137819 - DNA, 25 bp, E. coli
cttttgattcctgggcgacgttcaa

SEQ ID NO: 137820 - DNA, 25 bp, E. coli
cttttgattcctcggcgacgttcaa

SEQ ID NO: 137821 - DNA, 25 bp, E. coli
taaaactgtcgttgaaattggtcgc

SEQ ID NO: 137822 - DNA, 25 bp, E. coli
taaaactgtcgtagaaattggtcgc

SEQ ID NO: 137823 - DNA, 25 bp, E. coli
acccggcggtacagcgaatctgcaa

SEQ ID NO: 137824 - DNA, 25 bp, E. coli
acccggcggtactgcgaatctgcaa

SEQ ID NO: 137825 - DNA, 25 bp, E. coli
taccatgctatttttgctgagcgga

SEQ ID NO: 137826 - DNA, 25 bp, E. coli
taccatgctattattgctgagcgga

SEQ ID NO: 137827 - DNA, 25 bp, E. coli
gcaggaaggcctgttctccgtgaga

SEQ ID NO: 137828 - DNA, 25 bp, E. coli
gctttttagtcctgcggtgcgttaa

SEQ ID NO: 137829 - DNA, 25 bp, E. coli
gctttttagtccagcggtgcgttaa

SEQ ID NO: 137830 - DNA, 25 bp, E. coli
gaatccacccacgaaatgctgctgg

SEQ ID NO: 137831 - DNA, 25 bp, E. coli
gaatccacccaccaaatgctgctgg

SEQ ID NO: 137832 - DNA, 25 bp, E. coli
gcaggaaggcctcttctccgtgaga

SEQ ID NO: 137833 - DNA, 25 bp, E. coli
cgacgttcaatgatagggcgcaaat

SEQ ID NO: 137834 - DNA, 25 bp, E. coli
cgacgttcaatgttagggcgcaaat

SEQ ID NO: 137835 - DNA, 25 bp, E. coli
ctccgtgagaattggcgaatgtggc

SEQ ID NO: 137836 - DNA, 25 bp, E. coli
ctccgtgagaataggcgaatgtggc

SEQ ID NO: 137837 - DNA, 25 bp, E. coli
ggcgtgagtttctggtgtacaaatc

SEQ ID NO: 137838 - DNA, 25 bp, E. coli
ggcgtgagtttcaggtgtacaaatc

SEQ ID NO: 137839 - DNA, 25 bp, E. coli
gatgaaagctttaggtgcgatgcac

SEQ ID NO: 137840 - DNA, 25 bp, E. coli
gatgaaagcttttggtgcgatgcac

SEQ ID NO: 137841 - DNA, 25 bp, E. coli
cataaaacgggtcccgggattctca

SEQ ID NO: 137842 - DNA, 25 bp, E. coli
cataaaacgggtgccgggattctca

SEQ ID NO: 137843 - DNA, 25 bp, E. coli
catctgtaacaacaggattgccgca

SEQ ID NO: 137844 - DNA, 25 bp, E. coli
catctgtaacaagaggattgccgca

SEQ ID NO: 137845 - DNA, 25 bp, E. coli
aaaaaaccgcttcccatgccgcaat

SEQ ID NO: 137846 - DNA, 25 bp, E. coli
aaaaaaccgcttgccatgccgcaat

SEQ ID NO: 137847 - DNA, 25 bp, E. coli
tttccgctgcacctcataaaacggg

SEQ ID NO: 137848 - DNA, 25 bp, E. coli
tttccgctgcacgtcataaaacggg

SEQ ID NO: 137849 - DNA, 25 bp, E. coli
tgctctccggtgatgagaaccctgt

SEQ ID NO: 137850 - DNA, 25 bp, E. coli
tgctctccggtgttgagaaccctgt

SEQ ID NO: 137851 - DNA, 25 bp, E. coli
tcggtcgggccggattctttgctct

SEQ ID NO: 137852 - DNA, 25 bp, E. coli
tcggtcgggccgcattctttgctct

SEQ ID NO: 137853 - DNA, 25 bp, E. coli
tctatcaccgaggaaagaggccaca

SEQ ID NO: 137854 - DNA, 25 bp, E. coli
tctatcaccgagcaaagaggccaca

SEQ ID NO: 137855 - DNA, 25 bp, E. coli
gccgcaatcggtgaggttacatttc

SEQ ID NO: 137856 - DNA, 25 bp, E. coli
gcccgagattctgaactctggatgg

SEQ ID NO: 137857 - DNA, 25 bp, E. coli
gcccgagattctcaactctggatgg

SEQ ID NO: 137858 - DNA, 25 bp, E. coli
gccgcaatcggtcaggttacatttc

SEQ ID NO: 137859 - DNA, 25 bp, E. coli
gatacagagcaaagcgcataaccgc

SEQ ID NO: 137860 - DNA, 25 bp, E. coli
gatacagagcaatgcgcataaccgc

SEQ ID NO: 137861 - DNA, 25 bp, E. coli
gggaggccttcgcacatctgtaaca

SEQ ID NO: 137862 - DNA, 25 bp, E. coli
gggaggccttcggacatctgtaaca

SEQ ID NO: 137863 - DNA, 25 bp, E. coli
cacaagcgagttatgtacggctgta

SEQ ID NO: 137864 - DNA, 25 bp, E. coli
cacaagcgagttttgtacggctgta

SEQ ID NO: 137865 - DNA, 25 bp, E. coli
taacgataggtcttaacaaagaggt

SEQ ID NO: 137866 - DNA, 25 bp, E. coli
tatgagcaaaatcgtgtatgtcacg

SEQ ID NO: 137867 - DNA, 25 bp, E. coli
tatgagcaaaatggtgtatgtcacg

SEQ ID NO: 137868 - DNA, 25 bp, E. coli
gctatggtgatatagtgcaagacag

SEQ ID NO: 137869 - DNA, 25 bp, E. coli
gctatggtgataaagtgcaagacag

SEQ ID NO: 137870 - DNA, 25 bp, E. coli
cattgcgcctttatgcataatgaga

SEQ ID NO: 137871 - DNA, 25 bp, E. coli
cattgcgcctttttgcataatgaga

SEQ ID NO: 137872 - DNA, 25 bp, E. coli
gattcaaatactgaaaatacgtgac

SEQ ID NO: 137873 - DNA, 25 bp, E. coli
gattcaaatactcaaaatacgtgac

SEQ ID NO: 137874 - DNA, 25 bp, E. coli
tctttgacgaaacttaatgggtaat

SEQ ID NO: 137875 - DNA, 25 bp, E. coli
tctttgacgaaagttaatgggtaat

SEQ ID NO: 137876 - DNA, 25 bp, E. coli
gattgcttttgcatgaacattgcgc

SEQ ID NO: 137877 - DNA, 25 bp, E. coli
gattgcttttgcttgaacattgcgc

SEQ ID NO: 137878 - DNA, 25 bp, E. coli
ggtaattactttctttgctcccaca

SEQ ID NO: 137879 - DNA, 25 bp, E. coli
ggtaattactttgtttgctcccaca

SEQ ID NO: 137880 - DNA, 25 bp, E. coli
taacgataggtcataacaaagaggt

SEQ ID NO: 137881 - DNA, 25 bp, E. coli
taatcatttgtttggtgagaactct

SEQ ID NO: 137882 - DNA, 25 bp, E. coli
taatcatttgttaggtgagaactct

SEQ ID NO: 137883 - DNA, 25 bp, E. coli
gagaactcttggtcgcagattcaaa

SEQ ID NO: 137884 - DNA, 25 bp, E. coli
gagaactcttggacgcagattcaaa

SEQ ID NO: 137885 - DNA, 25 bp, E. coli
aattgaccagcccaaaattgccgtc

SEQ ID NO: 137886 - DNA, 25 bp, E. coli
aattgaccagccgaaaattgccgtc

SEQ ID NO: 137887 - DNA, 25 bp, E. coli
aacgcacgttgaaggtctgccctaa

SEQ ID NO: 137888 - DNA, 25 bp, E. coli
cactcggcgcggaaaaagcggtacg

SEQ ID NO: 137889 - DNA, 25 bp, E. coli
caaattgtcgctaatcaggaaggga

SEQ ID NO: 137890 - DNA, 25 bp, E. coli
cactcggcgcggtaaaagcggtacg

SEQ ID NO: 137891 - DNA, 25 bp, E. coli
caaattgtcgcttatcaggaaggga

SEQ ID NO: 137892 - DNA, 25 bp, E. coli
taaacagtggctcgcaacgcacgtt

SEQ ID NO: 137893 - DNA, 25 bp, E. coli
taaacagtggctggcaacgcacgtt

SEQ ID NO: 137894 - DNA, 25 bp, E. coli
aacgcacgttgatggtctgccctaa

SEQ ID NO: 137895 - DNA, 25 bp, E. coli
tacctttgttgataccctcgtggcg

SEQ ID NO: 137896 - DNA, 25 bp, E. coli
tacctttgttgaaaccctcgtggcg

SEQ ID NO: 137897 - DNA, 25 bp, E. coli
tccggtaagaaattgggcaatgctg

SEQ ID NO: 137898 - DNA, 25 bp, E. coli
tccggtaagaaaatgggcaatgctg

SEQ ID NO: 137899 - DNA, 25 bp, E. coli
tgccgtcatcaaatgcgaagccttt

SEQ ID NO: 137900 - DNA, 25 bp, E. coli
tgccgtcatcaattgcgaagccttt

SEQ ID NO: 137901 - DNA, 25 bp, E. coli
tctctataccaaaacggaagacggt

SEQ ID NO: 137902 - DNA, 25 bp, E. coli
tctctataccaatacggaagacggt

SEQ ID NO: 137903 - DNA, 25 bp, E. coli
gttatcaataaagaagccgacggtg

SEQ ID NO: 137904 - DNA, 25 bp, E. coli
gttatcaataaacaagccgacggtg

SEQ ID NO: 137905 - DNA, 25 bp, E. coli
ggtacgtaatcaaaatcaggccgga

SEQ ID NO: 137906 - DNA, 25 bp, E. coli
ggtacgtaatcataatcaggccgga

SEQ ID NO: 137907 - DNA, 25 bp, E. coli
caggcacagcttcatgaacatggca

SEQ ID NO: 137908 - DNA, 25 bp, E. coli
caggcgcggcagttgtatcacgatc

SEQ ID NO: 137909 - DNA, 25 bp, E. coli
caggcacagcttgatgaacatggca

SEQ ID NO: 137910 - DNA, 25 bp, E. coli
caggcgcggcagatgtatcacgatc

SEQ ID NO: 137911 - DNA, 25 bp, E. coli
taaatgctcagattcaggcgcggca

SEQ ID NO: 137912 - DNA, 25 bp, E. coli
taaatgctcagaatcaggcgcggca

SEQ ID NO: 137913 - DNA, 25 bp, E. coli
taccaactggtgtagcgcaacatgt

SEQ ID NO: 137914 - DNA, 25 bp, E. coli
taccaactggtgaagcgcaacatgt

SEQ ID NO: 137915 - DNA, 25 bp, E. coli
tatcacgatcgccaagaagtgacgg

SEQ ID NO: 137916 - DNA, 25 bp, E. coli
tatcacgatcgcgaagaagtgacgg

SEQ ID NO: 137917 - DNA, 25 bp, E. coli
ttttgcccgcgtgaaagagaatgcg

SEQ ID NO: 137918 - DNA, 25 bp, E. coli
ttttgcccgcgtcaaagagaatgcg

SEQ ID NO: 137919 - DNA, 25 bp, E. coli
gcccgatggcgctaagtctgatgga

SEQ ID NO: 137920 - DNA, 25 bp, E. coli
gcccgatggcgcaaagtctgatgga

SEQ ID NO: 137921 - DNA, 25 bp, E. coli
gctttgaaaaagagtgcgccgcaga

SEQ ID NO: 137922 - DNA, 25 bp, E. coli
gctttgaaaaagtgtgcgccgcaga

SEQ ID NO: 137923 - DNA, 25 bp, E. coli
taaggttgtattcctgtgccgtccg

SEQ ID NO: 137924 - DNA, 25 bp, E. coli
taaggttgtattgctgtgccgtccg

SEQ ID NO: 137925 - DNA, 25 bp, E. coli
tatgaaacgccgaagcgtccggttg

SEQ ID NO: 137926 - DNA, 25 bp, E. coli
taagttaatccgagagctgccgttc

SEQ ID NO: 137927 - DNA, 25 bp, E. coli
taagttaatccgtgagctgccgttc

SEQ ID NO: 137928 - DNA, 25 bp, E. coli
tatgaaacgccgtagcgtccggttg

SEQ ID NO: 137929 - DNA, 25 bp, E. coli
cagcccaggcggtgctctgggaaat

SEQ ID NO: 137930 - DNA, 25 bp, E. coli
cagcccaggcggagctctgggaaat

SEQ ID NO: 137931 - DNA, 25 bp, E. coli
actgaacggcaagggcagttctgcc

SEQ ID NO: 137932 - DNA, 25 bp, E. coli
agttctgcccgtgcgacactgacgg

SEQ ID NO: 137933 - DNA, 25 bp, E. coli
agttctgcccgtccgacactgacgg

SEQ ID NO: 137934 - DNA, 25 bp, E. coli
agtatcaggcattccccattcaggg

SEQ ID NO: 137935 - DNA, 25 bp, E. coli
agtatcaggcataccccattcaggg

SEQ ID NO: 137936 - DNA, 25 bp, E. coli
aaacacatcatgtgacgacacgcct

SEQ ID NO: 137937 - DNA, 25 bp, E. coli
actgaacggcaacggcagttctgcc

SEQ ID NO: 137938 - DNA, 25 bp, E. coli
aaacacatcatgagacgacacgcct

SEQ ID NO: 137939 - DNA, 25 bp, E. coli
ttctaacctgcagggcatggtcacg

SEQ ID NO: 137940 - DNA, 25 bp, E. coli
ttctaacctgcacggcatggtcacg

SEQ ID NO: 137941 - DNA, 25 bp, E. coli
tgcaggatattcgacaggaaacaca

SEQ ID NO: 137942 - DNA, 25 bp, E. coli
tgcaggatattccacaggaaacaca

SEQ ID NO: 137943 - DNA, 25 bp, E. coli
tccacaggaaacacatcatgagacg

SEQ ID NO: 137944 - DNA, 25 bp, E. coli
tccacaggaaactcatcatgagacg

SEQ ID NO: 137945 - DNA, 25 bp, E. coli
tcagtcagcccaggcggtgctctgg

SEQ ID NO: 137946 - DNA, 25 bp, E. coli
tcagtcagcccacgcggtgctctgg

SEQ ID NO: 137947 - DNA, 25 bp, E. coli
gcccgtccgacactgacggtttcta

SEQ ID NO: 137948 - DNA, 25 bp, E. coli
gcccgtccgacagtgacggtttcta

SEQ ID NO: 137949 - DNA, 25 bp, E. coli
ggacgggatttgaactgaacggcaa

SEQ ID NO: 137950 - DNA, 25 bp, E. coli
ggacgggatttgtactgaacggcaa

SEQ ID NO: 137951 - DNA, 25 bp, E. coli
aattatggagttcggttcgttgtgc

SEQ ID NO: 137952 - DNA, 25 bp, E. coli
aattatggagttgggttcgttgtgc

SEQ ID NO: 137953 - DNA, 25 bp, E. coli
cacgaagccaggttattaaacagca

SEQ ID NO: 137954 - DNA, 25 bp, E. coli
caccgcaaatgtatgttgctatagg

SEQ ID NO: 137955 - DNA, 25 bp, E. coli
cacgaagccaggatattaaacagca

SEQ ID NO: 137956 - DNA, 25 bp, E. coli
caccgcaaatgtttgttgctatagg

SEQ ID NO: 137957 - DNA, 25 bp, E. coli
caggaaaaagccttagtgaagaatt

SEQ ID NO: 137958 - DNA, 25 bp, E. coli
caggaaaaagccatagtgaagaatt

SEQ ID NO: 137959 - DNA, 25 bp, E. coli
tatgctggcaggactattgtttaaa

SEQ ID NO: 137960 - DNA, 25 bp, E. coli
tatgctggcaggtctattgtttaaa

SEQ ID NO: 137961 - DNA, 25 bp, E. coli
tattgtttaaatatgatcctggttc

SEQ ID NO: 137962 - DNA, 25 bp, E. coli
tattgtttaaatttgatcctggttc

SEQ ID NO: 137963 - DNA, 25 bp, E. coli
ttagcgcctgtatctgccattatcg

SEQ ID NO: 137964 - DNA, 25 bp, E. coli
ttagcgcctgtaactgccattatcg

SEQ ID NO: 137965 - DNA, 25 bp, E. coli
taagctccttgaactgacaggaaaa

SEQ ID NO: 137966 - DNA, 25 bp, E. coli
taagctccttgatctgacaggaaaa

SEQ ID NO: 137967 - DNA, 25 bp, E. coli
gacaactaaaagtatggaatcatac

SEQ ID NO: 137968 - DNA, 25 bp, E. coli
gacaactaaaagaatggaatcatac

SEQ ID NO: 137969 - DNA, 25 bp, E. coli
gattgtcgttgcgagtttagcgcct

SEQ ID NO: 137970 - DNA, 25 bp, E. coli
gattgtcgttgccagtttagcgcct

SEQ ID NO: 137971 - DNA, 25 bp, E. coli
ggcaacaaaataagattcaccgcaa

SEQ ID NO: 137972 - DNA, 25 bp, E. coli
ggcaacaaaatatgattcaccgcaa

SEQ ID NO: 137973 - DNA, 25 bp, E. coli
caagcaatgcgtgtggctattccgg

SEQ ID NO: 137974 - DNA, 25 bp, E. coli
aatgcgattccgcaagtggtgacca

SEQ ID NO: 137975 - DNA, 25 bp, E. coli
aatgcgattccggaagtggtgacca

SEQ ID NO: 137976 - DNA, 25 bp, E. coli
caagcaatgcgtctggctattccgg

SEQ ID NO: 137977 - DNA, 25 bp, E. coli
cacgctgcggataaggctgctgata

SEQ ID NO: 137978 - DNA, 25 bp, E. coli
cacgctgcggattaggctgctgata

SEQ ID NO: 137979 - DNA, 25 bp, E. coli
aaatacaaccgcgtagccggtgcgc

SEQ ID NO: 137980 - DNA, 25 bp, E. coli
aaatacaaccgcctagccggtgcgc

SEQ ID NO: 137981 - DNA, 25 bp, E. coli
tacgctggaaatcatcgcgctgggc

SEQ ID NO: 137982 - DNA, 25 bp, E. coli
tacgctggaaatgatcgcgctgggc

SEQ ID NO: 137983 - DNA, 25 bp, E. coli
ttatcgcaggtcttcagagcattgg

SEQ ID NO: 137984 - DNA, 25 bp, E. coli
ttatcgcaggtcatcagagcattgg

SEQ ID NO: 137985 - DNA, 25 bp, E. coli
tgataacggcaacctgacagcgatt

SEQ ID NO: 137986 - DNA, 25 bp, E. coli
tgcgggccaggttctgaccatcatc

SEQ ID NO: 137987 - DNA, 25 bp, E. coli
tgaacatcggtgctgcagttgcgcc

SEQ ID NO: 137988 - DNA, 25 bp, E. coli
tgcgggccaggtactgaccatcatc

SEQ ID NO: 137989 - DNA, 25 bp, E. coli
tgataacggcaagctgacagcgatt

SEQ ID NO: 137990 - DNA, 25 bp, E. coli
tgaacatcggtggtgcagttgcgcc

SEQ ID NO: 137991 - DNA, 25 bp, E. coli
tcaggcagctggaaacaacgatctc

SEQ ID NO: 137992 - DNA, 25 bp, E. coli
tcaacatgatgcctgctggctacct

SEQ ID NO: 137993 - DNA, 25 bp, E. coli
tcaacatgatgcgtgctggctacct

SEQ ID NO: 137994 - DNA, 25 bp, E. coli
tcaggcagctggtaacaacgatctc

SEQ ID NO: 137995 - DNA, 25 bp, E. coli
aattgccgtgcaaagactaatcgcg

SEQ ID NO: 137996 - DNA, 25 bp, E. coli
aattgccgtgcatagactaatcgcg

SEQ ID NO: 137997 - DNA, 25 bp, E. coli
tgggcgtggcaatcattctcgtcag

SEQ ID NO: 137998 - DNA, 25 bp, E. coli
tgggcgtggcaaacattctcgtcag

SEQ ID NO: 137999 - DNA, 25 bp, E. coli
tgtttatcgccggactggtacctgg

SEQ ID NO: 138000 - DNA, 25 bp, E. coli
tgtttatcgccgcactggtacctgg

SEQ ID NO: 138001 - DNA, 25 bp, E. coli
tctcatgtcgtcaaagcattgggcg

SEQ ID NO: 138002 - DNA, 25 bp, E. coli
tctcaatggaacttgctggtgtcgc

SEQ ID NO: 138003 - DNA, 25 bp, E. coli
tctcaatggaacatgctggtgtcgc

SEQ ID NO: 138004 - DNA, 25 bp, E. coli
tctcatgtcgtctaagcattgggcg

SEQ ID NO: 138005 - DNA, 25 bp, E. coli
gatcttcaacctgtcgattggcgca

SEQ ID NO: 138006 - DNA, 25 bp, E. coli
gatcataccgccaggaatagccctg

SEQ ID NO: 138007 - DNA, 25 bp, E. coli
gatcttcaacctctcgattggcgca

SEQ ID NO: 138008 - DNA, 25 bp, E. coli
tcaacatattgcagctgacgctggg

SEQ ID NO: 138009 - DNA, 25 bp, E. coli
taatgctggtgacatatatcccggc

SEQ ID NO: 138010 - DNA, 25 bp, E. coli
tcaacatattgctgctgacgctggg

SEQ ID NO: 138011 - DNA, 25 bp, E. coli
taaccttgctgaggcggcgatgctg

SEQ ID NO: 138012 - DNA, 25 bp, E. coli
taaccttgctgacgcggcgatgctg

SEQ ID NO: 138013 - DNA, 25 bp, E. coli
taatgctggtgagatatatcccggc

SEQ ID NO: 138014 - DNA, 25 bp, E. coli
taatgagctacagcggcattgccga

SEQ ID NO: 138015 - DNA, 25 bp, E. coli
taatgagctacaccggcattgccga

SEQ ID NO: 138016 - DNA, 25 bp, E. coli
gatcataccgcctggaatagccctg

SEQ ID NO: 138017 - DNA, 25 bp, E. coli
caaagaaccatttacattgcagggc

SEQ ID NO: 138018 - DNA, 25 bp, E. coli
caaagaaccattaacattgcagggc

SEQ ID NO: 138019 - DNA, 25 bp, E. coli
caggtcttgacaaaggaatttacgc

SEQ ID NO: 138020 - DNA, 25 bp, E. coli
cagtataaccgattcattgtgcgat

SEQ ID NO: 138021 - DNA, 25 bp, E. coli
caggtcttgacataggaatttacgc

SEQ ID NO: 138022 - DNA, 25 bp, E. coli
cagtataaccgaatcattgtgcgat

SEQ ID NO: 138023 - DNA, 25 bp, E. coli
tataggcggtcctgttggacaacgg

SEQ ID NO: 138024 - DNA, 25 bp, E. coli
tataggcggtccagttggacaacgg

SEQ ID NO: 138025 - DNA, 25 bp, E. coli
ttggacaacggcgaacagtataacc

SEQ ID NO: 138026 - DNA, 25 bp, E. coli
tttggagaataaagagcttgcaacc

SEQ ID NO: 138027 - DNA, 25 bp, E. coli
tttggagaataatgagcttgcaacc

SEQ ID NO: 138028 - DNA, 25 bp, E. coli
tttacgcaaacgattaccttcaggc

SEQ ID NO: 138029 - DNA, 25 bp, E. coli
ttggacaacggccaacagtataacc

SEQ ID NO: 138030 - DNA, 25 bp, E. coli
tttacgcaaacgtttaccttcaggc

SEQ ID NO: 138031 - DNA, 25 bp, E. coli
tcattgtgcgataacaggtcttgac

SEQ ID NO: 138032 - DNA, 25 bp, E. coli
tcattgtgcgattacaggtcttgac

SEQ ID NO: 138033 - DNA, 25 bp, E. coli
gcttgcaaccggaaacggatttctt

SEQ ID NO: 138034 - DNA, 25 bp, E. coli
gcatctcctgacacagctaacaata

SEQ ID NO: 138035 - DNA, 25 bp, E. coli
gcatctcctgactcagctaacaata

SEQ ID NO: 138036 - DNA, 25 bp, E. coli
gcttgcaaccggtaacggatttctt

SEQ ID NO: 138037 - DNA, 25 bp, E. coli
cttcaggctacgcaaggctttggag

SEQ ID NO: 138038 - DNA, 25 bp, E. coli
cttcaggctacggaaggctttggag

SEQ ID NO: 138039 - DNA, 25 bp, E. coli
taacacttttggtcttatcagtacc

SEQ ID NO: 138040 - DNA, 25 bp, E. coli
tacccaaagtgaagaagaaattaga

SEQ ID NO: 138041 - DNA, 25 bp, E. coli
tacccaaagtgatgaagaaattaga

SEQ ID NO: 138042 - DNA, 25 bp, E. coli
tgaaatcaccatgacgacctgggag

SEQ ID NO: 138043 - DNA, 25 bp, E. coli
tgcaaccggcaatgatcctgaaatc

SEQ ID NO: 138044 - DNA, 25 bp, E. coli
tgcaaccggcaaagatcctgaaatc

SEQ ID NO: 138045 - DNA, 25 bp, E. coli
tgaaatcaccatcacgacctgggag

SEQ ID NO: 138046 - DNA, 25 bp, E. coli
gaagaaattagacaactggtttcgg

SEQ ID NO: 138047 - DNA, 25 bp, E. coli
gaagaaattagagaactggtttcgg

SEQ ID NO: 138048 - DNA, 25 bp, E. coli
ggatacattgactgaaattaacgag

SEQ ID NO: 138049 - DNA, 25 bp, E. coli
ggacttatcagttcccaaagtgaag

SEQ ID NO: 138050 - DNA, 25 bp, E. coli
ggatacattgacagaaattaacgag

SEQ ID NO: 138051 - DNA, 25 bp, E. coli
ggacttatcagtacccaaagtgaag

SEQ ID NO: 138052 - DNA, 25 bp, E. coli
ggccagtggcgaacttgtccgttat

SEQ ID NO: 138053 - DNA, 25 bp, E. coli
ggccagtggcgatcttgtccgttat

SEQ ID NO: 138054 - DNA, 25 bp, E. coli
taaccgtcatgtagcatgaggatac

SEQ ID NO: 138055 - DNA, 25 bp, E. coli
taacacttttggacttatcagtacc

SEQ ID NO: 138056 - DNA, 25 bp, E. coli
taaccgtcatgttgcatgaggatac

SEQ ID NO: 138057 - DNA, 25 bp, E. coli
gagttgaataattacctgactcgcg

SEQ ID NO: 138058 - DNA, 25 bp, E. coli
gacctgggaggattggaatagcaac

SEQ ID NO: 138059 - DNA, 25 bp, E. coli
gagttgaataataacctgactcgcg

SEQ ID NO: 138060 - DNA, 25 bp, E. coli
gacctgggaggaatggaatagcaac

SEQ ID NO: 138061 - DNA, 25 bp, E. coli
aatcctcaagaaaggctgttgccgc

SEQ ID NO: 138062 - DNA, 25 bp, E. coli
aatcctcaagaatggctgttgccgc

SEQ ID NO: 138063 - DNA, 25 bp, E. coli
cacgcgcggcaaaaatgacagcaga

SEQ ID NO: 138064 - DNA, 25 bp, E. coli
cacgcgcggcaataatgacagcaga

SEQ ID NO: 138065 - DNA, 25 bp, E. coli
aaatacaagacgtttactggctccg

SEQ ID NO: 138066 - DNA, 25 bp, E. coli
aaatacaagacgattactggctccg

SEQ ID NO: 138067 - DNA, 25 bp, E. coli
tatcaccaggccaaaccagttagag

SEQ ID NO: 138068 - DNA, 25 bp, E. coli
tatcaccaggcctaaccagttagag

SEQ ID NO: 138069 - DNA, 25 bp, E. coli
tttaaaggcaagagaggcaggcgct

SEQ ID NO: 138070 - DNA, 25 bp, E. coli
tttaaaggcaagtgaggcaggcgct

SEQ ID NO: 138071 - DNA, 25 bp, E. coli
gcagaacgtaaacgcctcaaaaggt

SEQ ID NO: 138072 - DNA, 25 bp, E. coli
gcagaacgtaaaggcctcaaaaggt

SEQ ID NO: 138073 - DNA, 25 bp, E. coli
gaatcgcctgcaaccaaggtttgag

SEQ ID NO: 138074 - DNA, 25 bp, E. coli
gaatcgcctgcatccaaggtttgag

SEQ ID NO: 138075 - DNA, 25 bp, E. coli
gatagagaaaaacatgcgctcgcca

SEQ ID NO: 138076 - DNA, 25 bp, E. coli
gatagagaaaaagatgcgctcgcca

SEQ ID NO: 138077 - DNA, 25 bp, E. coli
gattggcaccaatcatccttgagga

SEQ ID NO: 138078 - DNA, 25 bp, E. coli
gattggcaccaaacatccttgagga

SEQ ID NO: 138079 - DNA, 25 bp, E. coli
ggttctcgaaaaaggacggcgtatc

SEQ ID NO: 138080 - DNA, 25 bp, E. coli
ggttctcgaaaatggacggcgtatc

SEQ ID NO: 138081 - DNA, 25 bp, E. coli
gagcatctgtcatcaaccgttacga

SEQ ID NO: 138082 - DNA, 25 bp, E. coli
gagcatctgtcaacaaccgttacga

SEQ ID NO: 138083 - DNA, 25 bp, E. coli
caacgggcaaaatagctggctggca

SEQ ID NO: 138084 - DNA, 25 bp, E. coli
cagtgccaattttacaacgcgaagg

SEQ ID NO: 138085 - DNA, 25 bp, E. coli
caacgggcaaaaaagctggctggca

SEQ ID NO: 138086 - DNA, 25 bp, E. coli
cagtgccaatttaacaacgcgaagg

SEQ ID NO: 138087 - DNA, 25 bp, E. coli
tagcagtgcatttcccgagttagcc

SEQ ID NO: 138088 - DNA, 25 bp, E. coli
tagcagtgcattacccgagttagcc

SEQ ID NO: 138089 - DNA, 25 bp, E. coli
ttcaaatggcgatctggacgtcacc

SEQ ID NO: 138090 - DNA, 25 bp, E. coli
ttcaaatggcgaactggacgtcacc

SEQ ID NO: 138091 - DNA, 25 bp, E. coli
tcctgatagccagcaagggtttgcc

SEQ ID NO: 138092 - DNA, 25 bp, E. coli
tcaaatttgacctgacggcgggcga

SEQ ID NO: 138093 - DNA, 25 bp, E. coli
tcctgatagccaccaagggtttgcc

SEQ ID NO: 138094 - DNA, 25 bp, E. coli
tcaaatttgaccagacggcgggcga

SEQ ID NO: 138095 - DNA, 25 bp, E. coli
gcattttaaccgtctggcgcggcta

SEQ ID NO: 138096 - DNA, 25 bp, E. coli
gcattttaaccgactggcgcggcta

SEQ ID NO: 138097 - DNA, 25 bp, E. coli
gaatgaatctgttgggatccccgat

SEQ ID NO: 138098 - DNA, 25 bp, E. coli
gaatgaatctgtagggatccccgat

SEQ ID NO: 138099 - DNA, 25 bp, E. coli
gaatttactgcctacggcgggacgc

SEQ ID NO: 138100 - DNA, 25 bp, E. coli
gaatttactgccaacggcgggacgc

SEQ ID NO: 138101 - DNA, 25 bp, E. coli
ggtaatcatcaacctgcgggcgtgt

SEQ ID NO: 138102 - DNA, 25 bp, E. coli
ggtaatcatcaagctgcgggcgtgt

SEQ ID NO: 138103 - DNA, 25 bp, E. coli
taatattggcacgtgggtacagcgc

SEQ ID NO: 138104 - DNA, 25 bp, E. coli
taatattggcacctgggtacagcgc

SEQ ID NO: 138105 - DNA, 25 bp, E. coli
caccgtttcgcgccgatgtgttcat

SEQ ID NO: 138106 - DNA, 25 bp, E. coli
caccgtttcgcggcgatgtgttcat

SEQ ID NO: 138107 - DNA, 25 bp, E. coli
attggctccggtcgtcaaacgcgcg

SEQ ID NO: 138108 - DNA, 25 bp, E. coli
attggctccggtggtcaaacgcgcg

SEQ ID NO: 138109 - DNA, 25 bp, E. coli
ccggtcgtcaaaggcgcgcgcgaaa

SEQ ID NO: 138110 - DNA, 25 bp, E. coli
gcctgagaacgaagctcgcgcactg

SEQ ID NO: 138111 - DNA, 25 bp, E. coli
gcctgagaacgatgctcgcgcactg

SEQ ID NO: 138112 - DNA, 25 bp, E. coli
ccggtcgtcaaacgcgcgcgcgaaa

SEQ ID NO: 138113 - DNA, 25 bp, E. coli
gacaccgacgaattggctccggtcg

SEQ ID NO: 138114 - DNA, 25 bp, E. coli
gacaccgacgaaatggctccggtcg

SEQ ID NO: 138115 - DNA, 25 bp, E. coli
cgatgctcgcgctctggcgcaacga

SEQ ID NO: 138116 - DNA, 25 bp, E. coli
cgatgctcgcgcactggcgcaacga

SEQ ID NO: 138117 - DNA, 25 bp, E. coli
ctggtggaggctgacaaatccggct

SEQ ID NO: 138118 - DNA, 25 bp, E. coli
ctggtggaggctcacaaatccggct

SEQ ID NO: 138119 - DNA, 25 bp, E. coli
ctgacaaatccggctggctggtgcc

SEQ ID NO: 138120 - DNA, 25 bp, E. coli
ctgacaaatccgcctggctggtgcc

SEQ ID NO: 138121 - DNA, 25 bp, E. coli
tggaggctgacaaatccggctggct

SEQ ID NO: 138122 - DNA, 25 bp, E. coli
tggacaccgacgaattggctccggt

SEQ ID NO: 138123 - DNA, 25 bp, E. coli
tggacaccgacgtattggctccggt

SEQ ID NO: 138124 - DNA, 25 bp, E. coli
tggaggctgacatatccggctggct

SEQ ID NO: 138125 - DNA, 25 bp, E. coli
gacgaattggctgcggtcgtcaaac

SEQ ID NO: 138126 - DNA, 25 bp, E. coli
gacgaattggctccggtcgtcaaac

SEQ ID NO: 138127 - DNA, 25 bp, E. coli
aacgggatttctccgtgatcaacgt

SEQ ID NO: 138128 - DNA, 25 bp, E. coli
caaaataattcgcaggaacgggatt

SEQ ID NO: 138129 - DNA, 25 bp, E. coli
caaaataattcggaggaacgggatt

SEQ ID NO: 138130 - DNA, 25 bp, E. coli
caggaacgggatatctgcgtgatca

SEQ ID NO: 138131 - DNA, 25 bp, E. coli
caggaacgggatttctgcgtgatca

SEQ ID NO: 138132 - DNA, 25 bp, E. coli
aacgggatttctgcgtgatcaacgt

SEQ ID NO: 138133 - DNA, 25 bp, E. coli
tattgagtgtcacgttgctaatgct

SEQ ID NO: 138134 - DNA, 25 bp, E. coli
tattgagtgtcaggttgctaatgct

SEQ ID NO: 138135 - DNA, 25 bp, E. coli
tgatcgctctgcgaatgccattggt

SEQ ID NO: 138136 - DNA, 25 bp, E. coli
tgggttgatcgctctgccaatgcca

SEQ ID NO: 138137 - DNA, 25 bp, E. coli
tgggttgatcgcactgccaatgcca

SEQ ID NO: 138138 - DNA, 25 bp, E. coli
tgatcgctctgccaatgccattggt

SEQ ID NO: 138139 - DNA, 25 bp, E. coli
tgctaatgcttgattaagtccgaaa

SEQ ID NO: 138140 - DNA, 25 bp, E. coli
tgctaatgcttgtttaagtccgaaa

SEQ ID NO: 138141 - DNA, 25 bp, E. coli
tcgctctgccaaagccattggtttg

SEQ ID NO: 138142 - DNA, 25 bp, E. coli
tcgctctgccaatgccattggtttg

SEQ ID NO: 138143 - DNA, 25 bp, E. coli
ccagctgggttgatcgctctgccaa

SEQ ID NO: 138144 - DNA, 25 bp, E. coli
ccagctgggttgttcgctctgccaa

SEQ ID NO: 138145 - DNA, 25 bp, E. coli
tggatcaccagcagggttgatcgct

SEQ ID NO: 138146 - DNA, 25 bp, E. coli
tggatcaccagctgggttgatcgct

SEQ ID NO: 138147 - DNA, 25 bp, E. coli
taattcgcaggatcgggatttctgc

SEQ ID NO: 138148 - DNA, 25 bp, E. coli
taattcgcaggaacgggatttctgc

SEQ ID NO: 138149 - DNA, 25 bp, E. coli
caacgccctggctggtatcgagtgt

SEQ ID NO: 138150 - DNA, 25 bp, E. coli
caacgccctggcaggtatcgagtgt

SEQ ID NO: 138151 - DNA, 25 bp, E. coli
tttctctgttaaggccagatggcgc

SEQ ID NO: 138152 - DNA, 25 bp, E. coli
ttttgcaacgccgtggctggtatcg

SEQ ID NO: 138153 - DNA, 25 bp, E. coli
tttctctgttaacgccagatggcgc

SEQ ID NO: 138154 - DNA, 25 bp, E. coli
ttttgcaacgccctggctggtatcg

SEQ ID NO: 138155 - DNA, 25 bp, E. coli
tgttactggaacgagcggagattcc

SEQ ID NO: 138156 - DNA, 25 bp, E. coli
tgttactggaaccagcggagattcc

SEQ ID NO: 138157 - DNA, 25 bp, E. coli
tctgttaacgccagatggcgcaacg

SEQ ID NO: 138158 - DNA, 25 bp, E. coli
tctgttaacgcctgatggcgcaacg

SEQ ID NO: 138159 - DNA, 25 bp, E. coli
gctatacacccatgcgctcgcggaa

SEQ ID NO: 138160 - DNA, 25 bp, E. coli
gctatacacccaagcgctcgcggaa

SEQ ID NO: 138161 - DNA, 25 bp, E. coli
cgagcggagattgccggcagcaaaa

SEQ ID NO: 138162 - DNA, 25 bp, E. coli
cgaaagtctttcactgttaacgcca

SEQ ID NO: 138163 - DNA, 25 bp, E. coli
ccctggctggtaacgagtgtggcct

SEQ ID NO: 138164 - DNA, 25 bp, E. coli
cgctggcgctggtaccatccgctat

SEQ ID NO: 138165 - DNA, 25 bp, E. coli
cgctggcgctggaaccatccgctat

SEQ ID NO: 138166 - DNA, 25 bp, E. coli
cgaaagtctttctctgttaacgcca

SEQ ID NO: 138167 - DNA, 25 bp, E. coli
ccctggctggtatcgagtgtggcct

SEQ ID NO: 138168 - DNA, 25 bp, E. coli
cgagcggagattcccggcagcaaaa

SEQ ID NO: 138169 - DNA, 25 bp, E. coli
cggcgggcggctatacacccatgcg

SEQ ID NO: 138170 - DNA, 25 bp, E. coli
cggcgggcggctttacacccatgcg

SEQ ID NO: 138171 - DNA, 25 bp, E. coli
tgttcaacaacaccgtctatggcct

SEQ ID NO: 138172 - DNA, 25 bp, E. coli
tgttcaacaacagcgtctatggcct

SEQ ID NO: 138173 - DNA, 25 bp, E. coli
tgaaacccacttaacggctcaggcc

SEQ ID NO: 138174 - DNA, 25 bp, E. coli
tgaaacccactttacggctcaggcc

SEQ ID NO: 138175 - DNA, 25 bp, E. coli
tgaacaaaagccgtcgacgctatgg

SEQ ID NO: 138176 - DNA, 25 bp, E. coli
tgaacaaaagccctcgacgctatgg

SEQ ID NO: 138177 - DNA, 25 bp, E. coli
tcgggaaacctggaaacgatggcaa

SEQ ID NO: 138178 - DNA, 25 bp, E. coli
tcgggaaacctgcaaacgatggcaa

SEQ ID NO: 138179 - DNA, 25 bp, E. coli
gctacacgacgatctgggcaggatt

SEQ ID NO: 138180 - DNA, 25 bp, E. coli
gctacacgacgaactgggcaggatt

SEQ ID NO: 138181 - DNA, 25 bp, E. coli
gaataagatcgagtcccactgctgt

SEQ ID NO: 138182 - DNA, 25 bp, E. coli
gaataagatcgactcccactgctgt

SEQ ID NO: 138183 - DNA, 25 bp, E. coli
cgctttgcgattgagggactccggc

SEQ ID NO: 138184 - DNA, 25 bp, E. coli
cgctttgcgattcagggactccggc

SEQ ID NO: 138185 - DNA, 25 bp, E. coli
gattaacttctcgtgcatcctggaa

SEQ ID NO: 138186 - DNA, 25 bp, E. coli
gattaacttctcctgcatcctggaa

SEQ ID NO: 138187 - DNA, 25 bp, E. coli
tggagtcaccgcaaacgcaatctga

SEQ ID NO: 138188 - DNA, 25 bp, E. coli
tggagtcaccgctaacgcaatctga

SEQ ID NO: 138189 - DNA, 25 bp, E. coli
gaggcttccgcgttctgttcaacaa

SEQ ID NO: 138190 - DNA, 25 bp, E. coli
gatggaacgccacaaactgctgcgg

SEQ ID NO: 138191 - DNA, 25 bp, E. coli
gatggaacgccagaaactgctgcgg

SEQ ID NO: 138192 - DNA, 25 bp, E. coli
gaggcttccgcgatctgttcaacaa

SEQ ID NO: 138193 - DNA, 25 bp, E. coli
atgatttagcggctccggtcattgc

SEQ ID NO: 138194 - DNA, 25 bp, E. coli
atgatttagcgggtccggtcattgc

SEQ ID NO: 138195 - DNA, 25 bp, E. coli
tagcggctccggtcattgctggcat

SEQ ID NO: 138196 - DNA, 25 bp, E. coli
tagcggctccggacattgctggcat

SEQ ID NO: 138197 - DNA, 25 bp, E. coli
ttagcggctccggtcattgctggca

SEQ ID NO: 138198 - DNA, 25 bp, E. coli
ttagcggctccgctcattgctggca

SEQ ID NO: 138199 - DNA, 25 bp, E. coli
tctggcatgatttagcggctccggt

SEQ ID NO: 138200 - DNA, 25 bp, E. coli
tctggcatgattaagcggctccggt

SEQ ID NO: 138201 - DNA, 25 bp, E. coli
ccttctggcatgttttagcggctcc

SEQ ID NO: 138202 - DNA, 25 bp, E. coli
ccttctggcatgatttagcggctcc

SEQ ID NO: 138203 - DNA, 25 bp, E. coli
gcggctccggtcattgctggcattc

SEQ ID NO: 138204 - DNA, 25 bp, E. coli
gcggctccggtctttgctggcattc

SEQ ID NO: 138205 - DNA, 25 bp, E. coli
ctgggcatggccttctggcatgatt

SEQ ID NO: 138206 - DNA, 25 bp, E. coli
ctgggcatggccatctggcatgatt

SEQ ID NO: 138207 - DNA, 25 bp, E. coli
gatttagcggctccggtcattgctg

SEQ ID NO: 138208 - DNA, 25 bp, E. coli
gatttagcggctgcggtcattgctg

SEQ ID NO: 138209 - DNA, 25 bp, E. coli
tggcatgatttaccggctccggtca

SEQ ID NO: 138210 - DNA, 25 bp, E. coli
ggcatggccttctggcatgatttag

SEQ ID NO: 138211 - DNA, 25 bp, E. coli
tggcatgatttagcggctccggtca

SEQ ID NO: 138212 - DNA, 25 bp, E. coli
ggcatggccttcaggcatgatttag

SEQ ID NO: 138213 - DNA, 25 bp, E. coli
tggccttctggcatgatttagcggc

SEQ ID NO: 138214 - DNA, 25 bp, E. coli
tggccttctggcttgatttagcggc

SEQ ID NO: 138215 - DNA, 25 bp, E. coli
cagcgggatgcacattgcagattgc

SEQ ID NO: 138216 - DNA, 25 bp, E. coli
cagcgggatgcagattgcagattgc

SEQ ID NO: 138217 - DNA, 25 bp, E. coli
cagcgaaagggcacatgaccagatg

SEQ ID NO: 138218 - DNA, 25 bp, E. coli
cagcgaaagggctcatgaccagatg

SEQ ID NO: 138219 - DNA, 25 bp, E. coli
cagtattgccgttccgggcgggcca

SEQ ID NO: 138220 - DNA, 25 bp, E. coli
cagtattgccgtaccgggcgggcca

SEQ ID NO: 138221 - DNA, 25 bp, E. coli
acattgcagattgcgtcacagcgcc

SEQ ID NO: 138222 - DNA, 25 bp, E. coli
acattgcagattccgtcacagcgcc

SEQ ID NO: 138223 - DNA, 25 bp, E. coli
acatgaccagatccgcagtattgcc

SEQ ID NO: 138224 - DNA, 25 bp, E. coli
acatgaccagatgcgcagtattgcc

SEQ ID NO: 138225 - DNA, 25 bp, E. coli
gccacagcgggatgcacattgcaga

SEQ ID NO: 138226 - DNA, 25 bp, E. coli
gccacagcgggaagcacattgcaga

SEQ ID NO: 138227 - DNA, 25 bp, E. coli
gcagattgcgtctcagcgcctcctt

SEQ ID NO: 138228 - DNA, 25 bp, E. coli
gcagattgcgtcacagcgcctcctt

SEQ ID NO: 138229 - DNA, 25 bp, E. coli
gaaagggcacatcaccagatgcgca

SEQ ID NO: 138230 - DNA, 25 bp, E. coli
gaaagggcacatgaccagatgcgca

SEQ ID NO: 138231 - DNA, 25 bp, E. coli
ctgccgccagcgtaagggcacatga

SEQ ID NO: 138232 - DNA, 25 bp, E. coli
ctgccgccagcgaaagggcacatga

SEQ ID NO: 138233 - DNA, 25 bp, E. coli
tggcgaaacgcggtactgctgccgc

SEQ ID NO: 138234 - DNA, 25 bp, E. coli
tggcgaaacgcgctactgctgccgc

SEQ ID NO: 138235 - DNA, 25 bp, E. coli
gatgcacattgcagattgcgtcaca

SEQ ID NO: 138236 - DNA, 25 bp, E. coli
gatgcacattgctgattgcgtcaca

SEQ ID NO: 138237 - DNA, 25 bp, E. coli
taaatcatctctcgcaatgcgggct

SEQ ID NO: 138238 - DNA, 25 bp, E. coli
taaatcatctctggcaatgcgggct

SEQ ID NO: 138239 - DNA, 25 bp, E. coli
agataacctgatggttcgcgcagcg

SEQ ID NO: 138240 - DNA, 25 bp, E. coli
agataacctgatcgttcgcgcagcg

SEQ ID NO: 138241 - DNA, 25 bp, E. coli
tatcagcattgacaagcgtttgccg

SEQ ID NO: 138242 - DNA, 25 bp, E. coli
tatacattaccggtcagcgtgcgga

SEQ ID NO: 138243 - DNA, 25 bp, E. coli
tatcagcattgagaagcgtttgccg

SEQ ID NO: 138244 - DNA, 25 bp, E. coli
tatacattaccgctcagcgtgcgga

SEQ ID NO: 138245 - DNA, 25 bp, E. coli
ttacggcgacacgatcagcattgag

SEQ ID NO: 138246 - DNA, 25 bp, E. coli
ttacggcgacaccatcagcattgag

SEQ ID NO: 138247 - DNA, 25 bp, E. coli
tgatacagagtcagaagcccgccag

SEQ ID NO: 138248 - DNA, 25 bp, E. coli
tgatacagagtctgaagcccgccag

SEQ ID NO: 138249 - DNA, 25 bp, E. coli
gccgaaggcgttggtgaaatactaa

SEQ ID NO: 138250 - DNA, 25 bp, E. coli
gccgaaggcgttcgtgaaatactaa

SEQ ID NO: 138251 - DNA, 25 bp, E. coli
gaagtggtatctggtggcgcaccct

SEQ ID NO: 138252 - DNA, 25 bp, E. coli
gaagtggtatctcgtggcgcaccct

SEQ ID NO: 138253 - DNA, 25 bp, E. coli
ggatggttaccacacgctgcaaacg

SEQ ID NO: 138254 - DNA, 25 bp, E. coli
ggtggttcatcctatgccgcgacgg

SEQ ID NO: 138255 - DNA, 25 bp, E. coli
ggtggttcatccaatgccgcgacgg

SEQ ID NO: 138256 - DNA, 25 bp, E. coli
ggatggttaccagacgctgcaaacg

SEQ ID NO: 138257 - DNA, 25 bp, E. coli
tggctgttagaatacgccccgtcgc

SEQ ID NO: 138258 - DNA, 25 bp, E. coli
tggctgttagaaaacgccccgtcgc

SEQ ID NO: 138259 - DNA, 25 bp, E. coli
caaaacggacggtgataaaggctca

SEQ ID NO: 138260 - DNA, 25 bp, E. coli
caaaacggacggagataaaggctca

SEQ ID NO: 138261 - DNA, 25 bp, E. coli
tacacgctggcgtatgacggtgcat

SEQ ID NO: 138262 - DNA, 25 bp, E. coli
tacacgctggcgaatgacggtgcat

SEQ ID NO: 138263 - DNA, 25 bp, E. coli
tatgctggtgattggtaaggccgcc

SEQ ID NO: 138264 - DNA, 25 bp, E. coli
tatgctggtgataggtaaggccgcc

SEQ ID NO: 138265 - DNA, 25 bp, E. coli
taccagcaggcagagaaaatcgtca

SEQ ID NO: 138266 - DNA, 25 bp, E. coli
taccaactggcgttgaacaaagagg

SEQ ID NO: 138267 - DNA, 25 bp, E. coli
taccaactggcgatgaacaaagagg

SEQ ID NO: 138268 - DNA, 25 bp, E. coli
taccagcaggcacagaaaatcgtca

SEQ ID NO: 138269 - DNA, 25 bp, E. coli
tatcagggcatggttaacggcattc

SEQ ID NO: 138270 - DNA, 25 bp, E. coli
tatcagggcatgcttaacggcattc

SEQ ID NO: 138271 - DNA, 25 bp, E. coli
cgacccggcggtaacaatagataat

SEQ ID NO: 138272 - DNA, 25 bp, E. coli
cgacccggcggttacaatagataat

SEQ ID NO: 138273 - DNA, 25 bp, E. coli
gatttaaagattgatgctcccgacg

SEQ ID NO: 138274 - DNA, 25 bp, E. coli
gatttaaagattcatgctcccgacg

SEQ ID NO: 138275 - DNA, 25 bp, E. coli
ggtgcatccattttcaatccggcgg

SEQ ID NO: 138276 - DNA, 25 bp, E. coli
ggtgcatccattatcaatccggcgg

SEQ ID NO: 138277 - DNA, 25 bp, E. coli
ggtggatcaactgaacgccctgaag

SEQ ID NO: 138278 - DNA, 25 bp, E. coli
ggtggatcaactcaacgccctgaag

SEQ ID NO: 138279 - DNA, 25 bp, E. coli
tactccgataacgatccgaactggg

SEQ ID NO: 138280 - DNA, 25 bp, E. coli
tactccgataaccatccgaactggg

SEQ ID NO: 138281 - DNA, 25 bp, E. coli
tacgggctttgatgacgaactggtt

SEQ ID NO: 138282 - DNA, 25 bp, E. coli
tacgggctttgaagacgaactggtt

SEQ ID NO: 138283 - DNA, 25 bp, E. coli
tcctctctggttagcctgatccgcg

SEQ ID NO: 138284 - DNA, 25 bp, E. coli
tcctctctggtttgcctgatccgcg

SEQ ID NO: 138285 - DNA, 25 bp, E. coli
cctgtcagtctggtttacgggcttt

SEQ ID NO: 138286 - DNA, 25 bp, E. coli
cctgtcagtctgctttacgggcttt

SEQ ID NO: 138287 - DNA, 25 bp, E. coli
gctatcgtgaacatcgtgataggcc

SEQ ID NO: 138288 - DNA, 25 bp, E. coli
gctatcgtgaacttcgtgataggcc

SEQ ID NO: 138289 - DNA, 25 bp, E. coli
cgaactggttcgaaatgggattgcc

SEQ ID NO: 138290 - DNA, 25 bp, E. coli
cgaactggttcgtaatgggattgcc

SEQ ID NO: 138291 - DNA, 25 bp, E. coli
gattatctgcaaagctcgtcaagtt

SEQ ID NO: 138292 - DNA, 25 bp, E. coli
gattatctgcaatgctcgtcaagtt

SEQ ID NO: 138293 - DNA, 25 bp, E. coli
gattgattacgcgataatcgcggtg

SEQ ID NO: 138294 - DNA, 25 bp, E. coli
gattgattacgccataatcgcggtg

SEQ ID NO: 138295 - DNA, 25 bp, E. coli
gttgtgctttctttgttgccagtca

SEQ ID NO: 138296 - DNA, 25 bp, E. coli
gttgtgctttctatgttgccagtca

SEQ ID NO: 138297 - DNA, 25 bp, E. coli
gtcaagtttcttccccagagcgtaa

SEQ ID NO: 138298 - DNA, 25 bp, E. coli
gtcaagtttcttgcccagagcgtaa

SEQ ID NO: 138299 - DNA, 25 bp, E. coli
taatcgcggtgattgctttttcctc

SEQ ID NO: 138300 - DNA, 25 bp, E. coli
taatcgcggtgaatgctttttcctc

SEQ ID NO: 138301 - DNA, 25 bp, E. coli
gatccgcggctttgttcgtgaagcg

SEQ ID NO: 138302 - DNA, 25 bp, E. coli
gatccgcggcttagttcgtgaagcg

SEQ ID NO: 138303 - DNA, 25 bp, E. coli
taaatccattgaccagcgtccgctg

SEQ ID NO: 138304 - DNA, 25 bp, E. coli
taaagcattgatgcacgatgtgccg

SEQ ID NO: 138305 - DNA, 25 bp, E. coli
taaagcattgatccacgatgtgccg

SEQ ID NO: 138306 - DNA, 25 bp, E. coli
taaatccattgagcagcgtccgctg

SEQ ID NO: 138307 - DNA, 25 bp, E. coli
tatccagtccggtaatgacgcctgt

SEQ ID NO: 138308 - DNA, 25 bp, E. coli
tatccagtccggaaatgacgcctgt

SEQ ID NO: 138309 - DNA, 25 bp, E. coli
tgccgggagccacgagtcatttatt

SEQ ID NO: 138310 - DNA, 25 bp, E. coli
tgccgggagccaggagtcatttatt

SEQ ID NO: 138311 - DNA, 25 bp, E. coli
tataatctggttgcttcggctaccc

SEQ ID NO: 138312 - DNA, 25 bp, E. coli
tataatctggttccttcggctaccc

SEQ ID NO: 138313 - DNA, 25 bp, E. coli
gaaattccatcactggttcggcagc

SEQ ID NO: 138314 - DNA, 25 bp, E. coli
gaaattccatcagtggttcggcagc

SEQ ID NO: 138315 - DNA, 25 bp, E. coli
ccgcgtgggcagctgaaaaacctga

SEQ ID NO: 138316 - DNA, 25 bp, E. coli
cgatgtgccggatgagtacgccatt

SEQ ID NO: 138317 - DNA, 25 bp, E. coli
ccgcgtgggcaggtgaaaaacctga

SEQ ID NO: 138318 - DNA, 25 bp, E. coli
cgatgtgccggaagagtacgccatt

SEQ ID NO: 138319 - DNA, 25 bp, E. coli
tggatcccgcgagcctgactaaaat

SEQ ID NO: 138320 - DNA, 25 bp, E. coli
tggcatgaagacaggaaccacggca

SEQ ID NO: 138321 - DNA, 25 bp, E. coli
tggcatgaagactggaaccacggca

SEQ ID NO: 138322 - DNA, 25 bp, E. coli
tggatcccgcgaccctgactaaaat

SEQ ID NO: 138323 - DNA, 25 bp, E. coli
tacccagggcgaaatgcgtttaatc

SEQ ID NO: 138324 - DNA, 25 bp, E. coli
tacccagggcgatatgcgtttaatc

SEQ ID NO: 138325 - DNA, 25 bp, E. coli
aatgcgggtgatacagcttcagtac

SEQ ID NO: 138326 - DNA, 25 bp, E. coli
aatgcgggtgattcagcttcagtac

SEQ ID NO: 138327 - DNA, 25 bp, E. coli
taaaatggccgcgtttggacaatcc

SEQ ID NO: 138328 - DNA, 25 bp, E. coli
taaaatggccgcctttggacaatcc

SEQ ID NO: 138329 - DNA, 25 bp, E. coli
aaaatgcttgagactatggccagcc

SEQ ID NO: 138330 - DNA, 25 bp, E. coli
aaaatgcttgagtctatggccagcc

SEQ ID NO: 138331 - DNA, 25 bp, E. coli
tatggccagccgcatagaaaactat

SEQ ID NO: 138332 - DNA, 25 bp, E. coli
tatggccagccggatagaaaactat

SEQ ID NO: 138333 - DNA, 25 bp, E. coli
taccatgactggcttcgtgatgcac

SEQ ID NO: 138334 - DNA, 25 bp, E. coli
taccatgactgggttcgtgatgcac

SEQ ID NO: 138335 - DNA, 25 bp, E. coli
tgttacacatctgttctcgcagcag

SEQ ID NO: 138336 - DNA, 25 bp, E. coli
tgtcaaaggttcgatcagtggctat

SEQ ID NO: 138337 - DNA, 25 bp, E. coli
tgttacacatctcttctcgcagcag

SEQ ID NO: 138338 - DNA, 25 bp, E. coli
tgtcaaaggttccatcagtggctat

SEQ ID NO: 138339 - DNA, 25 bp, E. coli
tgcacatgcgatcgaaaaacaagct

SEQ ID NO: 138340 - DNA, 25 bp, E. coli
tgcacatgcgatggaaaaacaagct

SEQ ID NO: 138341 - DNA, 25 bp, E. coli
gcacattagcgatacaaagaaccag

SEQ ID NO: 138342 - DNA, 25 bp, E. coli
gcacattagcgaaacaaagaaccag

SEQ ID NO: 138343 - DNA, 25 bp, E. coli
gactctatgagtaaaatggccgcgt

SEQ ID NO: 138344 - DNA, 25 bp, E. coli
gactctatgagttaaatggccgcgt

SEQ ID NO: 138345 - DNA, 25 bp, E. coli
gagttacgttccagaattgagcagc

SEQ ID NO: 138346 - DNA, 25 bp, E. coli
gagttacgttcctgaattgagcagc

SEQ ID NO: 138347 - DNA, 25 bp, E. coli
cactcttttagtcctaccgctggat

SEQ ID NO: 138348 - DNA, 25 bp, E. coli
cactcttttagtgctaccgctggat

SEQ ID NO: 138349 - DNA, 25 bp, E. coli
cagggtttgccttgtataacaaagc

SEQ ID NO: 138350 - DNA, 25 bp, E. coli
cagggtttgcctagtataacaaagc

SEQ ID NO: 138351 - DNA, 25 bp, E. coli
taacaaagcaattgatgtgccaaag

SEQ ID NO: 138352 - DNA, 25 bp, E. coli
tatccggataatccactgatgccgc

SEQ ID NO: 138353 - DNA, 25 bp, E. coli
tatccggataatgcactgatgccgc

SEQ ID NO: 138354 - DNA, 25 bp, E. coli
tgccaaagttggataggagaatatt

SEQ ID NO: 138355 - DNA, 25 bp, E. coli
tgtattccggcacgataagaaggga

SEQ ID NO: 138356 - DNA, 25 bp, E. coli
tgccaaagttggttaggagaatatt

SEQ ID NO: 138357 - DNA, 25 bp, E. coli
tgtattccggcaggataagaaggga

SEQ ID NO: 138358 - DNA, 25 bp, E. coli
gcaccttccttacgtaacatttagt

SEQ ID NO: 138359 - DNA, 25 bp, E. coli
gcaccttccttaggtaacatttagt

SEQ ID NO: 138360 - DNA, 25 bp, E. coli
gcaactaggttgtactgatgctgtt

SEQ ID NO: 138361 - DNA, 25 bp, E. coli
gcaactaggttgaactgatgctgtt

SEQ ID NO: 138362 - DNA, 25 bp, E. coli
cgaaatatgggatgtattccggcac

SEQ ID NO: 138363 - DNA, 25 bp, E. coli
ccgctggattactgtggtgcaacta

SEQ ID NO: 138364 - DNA, 25 bp, E. coli
cgaaatatgggaagtattccggcac

SEQ ID NO: 138365 - DNA, 25 bp, E. coli
ccgctggattacagtggtgcaacta

SEQ ID NO: 138366 - DNA, 25 bp, E. coli
cgcatccggtgagcgtgccgaaata

SEQ ID NO: 138367 - DNA, 25 bp, E. coli
cgcatccggtgaccgtgccgaaata

SEQ ID NO: 138368 - DNA, 25 bp, E. coli
taacaaagcaatagatgtgccaaag

SEQ ID NO: 138369 - DNA, 25 bp, E. coli
aatgatgacaaagcgcaggatagcg

SEQ ID NO: 138370 - DNA, 25 bp, E. coli
aatgatgacaaaccgcaggatagcg

SEQ ID NO: 138371 - DNA, 25 bp, E. coli
tatgatcgcacctgtattccagcag

SEQ ID NO: 138372 - DNA, 25 bp, E. coli
tatgatcgcaccagtattccagcag

SEQ ID NO: 138373 - DNA, 25 bp, E. coli
ttaagtttgcttactgccatcgggc

SEQ ID NO: 138374 - DNA, 25 bp, E. coli
ttaagtttgctttctgccatcgggc

SEQ ID NO: 138375 - DNA, 25 bp, E. coli
tgtttttgaataatctgacgctggc

SEQ ID NO: 138376 - DNA, 25 bp, E. coli
tgtggtctggctaatccctggctga

SEQ ID NO: 138377 - DNA, 25 bp, E. coli
tgtttttgaatattctgacgctggc

SEQ ID NO: 138378 - DNA, 25 bp, E. coli
tgtggtctggcttatccctggctga

SEQ ID NO: 138379 - DNA, 25 bp, E. coli
tgacgctggcaaatgggacaattcg

SEQ ID NO: 138380 - DNA, 25 bp, E. coli
tgacgctggcaattgggacaattcg

SEQ ID NO: 138381 - DNA, 25 bp, E. coli
tcgttaatgtggttatctcgcggta

SEQ ID NO: 138382 - DNA, 25 bp, E. coli
tcgttaatgtggatatctcgcggta

SEQ ID NO: 138383 - DNA, 25 bp, E. coli
gccatcgggctacgtgttgtccatg

SEQ ID NO: 138384 - DNA, 25 bp, E. coli
gccatcgggctaggtgttgtccatg

SEQ ID NO: 138385 - DNA, 25 bp, E. coli
gggtcctcaattacctgtggtctgg

SEQ ID NO: 138386 - DNA, 25 bp, E. coli
gggtcctcaatttcctgtggtctgg

SEQ ID NO: 138387 - DNA, 25 bp, E. coli
taacaatacccatgtccagggcgac

SEQ ID NO: 138388 - DNA, 25 bp, E. coli
taacaatacccaagtccagggcgac

SEQ ID NO: 138389 - DNA, 25 bp, E. coli
gaccttgattcggtggagttaacca

SEQ ID NO: 138390 - DNA, 25 bp, E. coli
gaccttgattcgctggagttaacca

SEQ ID NO: 138391 - DNA, 25 bp, E. coli
cgagttgttaaagctacgataaata

SEQ ID NO: 138392 - DNA, 25 bp, E. coli
cgagttgttaaacctacgataaata

SEQ ID NO: 138393 - DNA, 25 bp, E. coli
tagtcatttcgggaagggttcctcc

SEQ ID NO: 138394 - DNA, 25 bp, E. coli
tagtcatttcggcaagggttcctcc

SEQ ID NO: 138395 - DNA, 25 bp, E. coli
tagcggcctatactaatttcgagtt

SEQ ID NO: 138396 - DNA, 25 bp, E. coli
tagcggcctatagtaatttcgagtt

SEQ ID NO: 138397 - DNA, 25 bp, E. coli
tgttgtatgattgaaattagcggcc

SEQ ID NO: 138398 - DNA, 25 bp, E. coli
tgttgtatgattcaaattagcggcc

SEQ ID NO: 138399 - DNA, 25 bp, E. coli
tctacgtcggattatagactcgcgg

SEQ ID NO: 138400 - DNA, 25 bp, E. coli
tctacgtcggataatagactcgcgg

SEQ ID NO: 138401 - DNA, 25 bp, E. coli
gcgtctacgctgttttaaggttctg

SEQ ID NO: 138402 - DNA, 25 bp, E. coli
gcgtctacgctgatttaaggttctg

SEQ ID NO: 138403 - DNA, 25 bp, E. coli
gcggttttttctgcgagatttctca

SEQ ID NO: 138404 - DNA, 25 bp, E. coli
gcggttttttctccgagatttctca

SEQ ID NO: 138405 - DNA, 25 bp, E. coli
cgatatacttatacttaggctgcta

SEQ ID NO: 138406 - DNA, 25 bp, E. coli
cgatatacttattcttaggctgcta

SEQ ID NO: 138407 - DNA, 25 bp, E. coli
ggacaggatcgtacccgactcacta

SEQ ID NO: 138408 - DNA, 25 bp, E. coli
ggacaggatcgttcccgactcacta

SEQ ID NO: 138409 - DNA, 25 bp, E. coli
taaggttctgatcaccgaccagtga

SEQ ID NO: 138410 - DNA, 25 bp, E. coli
tcacaaagcccaaaaagcgtctacg

SEQ ID NO: 138411 - DNA, 25 bp, E. coli
tcacaaagcccataaagcgtctacg

SEQ ID NO: 138412 - DNA, 25 bp, E. coli
taaggttctgatgaccgaccagtga

SEQ ID NO: 138413 - DNA, 25 bp, E. coli
catggatatcacaccggagcgtgaa

SEQ ID NO: 138414 - DNA, 25 bp, E. coli
catggatatcactccggagcgtgaa

SEQ ID NO: 138415 - DNA, 25 bp, E. coli
aggcaaatacaccagtgttgatcag

SEQ ID NO: 138416 - DNA, 25 bp, E. coli
aggcaaatacacgagtgttgatcag

SEQ ID NO: 138417 - DNA, 25 bp, E. coli
agcaaggcaaattcaccagtgttga

SEQ ID NO: 138418 - DNA, 25 bp, E. coli
agcaaggcaaatacaccagtgttga

SEQ ID NO: 138419 - DNA, 25 bp, E. coli
tatcactccggaccgtgaaaagcag

SEQ ID NO: 138420 - DNA, 25 bp, E. coli
tatcactccggagcgtgaaaagcag

SEQ ID NO: 138421 - DNA, 25 bp, E. coli
tgatggcgggcaaggatatcactcc

SEQ ID NO: 138422 - DNA, 25 bp, E. coli
tgatggcgggcatggatatcactcc

SEQ ID NO: 138423 - DNA, 25 bp, E. coli
tcagcaaggcaaatacaccagtgtt

SEQ ID NO: 138424 - DNA, 25 bp, E. coli
tcagcaaggcaattacaccagtgtt

SEQ ID NO: 138425 - DNA, 25 bp, E. coli
ctccggagcgtgaaaagcaggtgct

SEQ ID NO: 138426 - DNA, 25 bp, E. coli
ctccggagcgtgtaaagcaggtgct

SEQ ID NO: 138427 - DNA, 25 bp, E. coli
gggtcagcaagggaaatacaccagt

SEQ ID NO: 138428 - DNA, 25 bp, E. coli
gggtcagcaaggcaaatacaccagt

SEQ ID NO: 138429 - DNA, 25 bp, E. coli
tggcgggcatggatatcactccgga

SEQ ID NO: 138430 - DNA, 25 bp, E. coli
tggcgggcatggttatcactccgga

SEQ ID NO: 138431 - DNA, 25 bp, E. coli
ggcatggatatcactccggagcgtg

SEQ ID NO: 138432 - DNA, 25 bp, E. coli
ggcatggatatctctccggagcgtg

SEQ ID NO: 138433 - DNA, 25 bp, E. coli
tcactccggagcctgaaaagcaggt

SEQ ID NO: 138434 - DNA, 25 bp, E. coli
tcactccggagcgtgaaaagcaggt

SEQ ID NO: 138435 - DNA, 25 bp, E. coli
caagcgccccgttaaacttgatgaa

SEQ ID NO: 138436 - DNA, 25 bp, E. coli
caagcgccccgtaaaacttgatgaa

SEQ ID NO: 138437 - DNA, 25 bp, E. coli
catggcatgattcggcgaactacgc

SEQ ID NO: 138438 - DNA, 25 bp, E. coli
catggcatgattgggcgaactacgc

SEQ ID NO: 138439 - DNA, 25 bp, E. coli
tacacccggtttattaatgatgaca

SEQ ID NO: 138440 - DNA, 25 bp, E. coli
tacacccggttttttaatgatgaca

SEQ ID NO: 138441 - DNA, 25 bp, E. coli
tatgcaaagtaatagcgctgagcgt

SEQ ID NO: 138442 - DNA, 25 bp, E. coli
tatcgtctgtaagggttcattgaac

SEQ ID NO: 138443 - DNA, 25 bp, E. coli
tatactggtatatctaagccatggc

SEQ ID NO: 138444 - DNA, 25 bp, E. coli
tatactggtataactaagccatggc

SEQ ID NO: 138445 - DNA, 25 bp, E. coli
tatgcaaagtaaaagcgctgagcgt

SEQ ID NO: 138446 - DNA, 25 bp, E. coli
tatcgtctgtaacggttcattgaac

SEQ ID NO: 138447 - DNA, 25 bp, E. coli
tattgatgagaagtaccaggttggg

SEQ ID NO: 138448 - DNA, 25 bp, E. coli
tattgatgagaactaccaggttggg

SEQ ID NO: 138449 - DNA, 25 bp, E. coli
tataattgaactcgacaagcgcccc

SEQ ID NO: 138450 - DNA, 25 bp, E. coli
tataattgaactggacaagcgcccc

SEQ ID NO: 138451 - DNA, 25 bp, E. coli
cgggaaacgtttaatgtctcatggg

SEQ ID NO: 138452 - DNA, 25 bp, E. coli
cgggaaacgttttatgtctcatggg

SEQ ID NO: 138453 - DNA, 25 bp, E. coli
gattctgagccaatgaaggcgctac

SEQ ID NO: 138454 - DNA, 25 bp, E. coli
gattctgagccattgaaggcgctac

SEQ ID NO: 138455 - DNA, 25 bp, E. coli
ggcgctacctcattcaaatatctgg

SEQ ID NO: 138456 - DNA, 25 bp, E. coli
ggcgctacctcaatcaaatatctgg

SEQ ID NO: 138457 - DNA, 25 bp, E. coli
caacagcgagctggtggtacgcaac

SEQ ID NO: 138458 - DNA, 25 bp, E. coli
caacagcgagctcgtggtacgcaac

SEQ ID NO: 138459 - DNA, 25 bp, E. coli
tactactggtgcctttcccggctga

SEQ ID NO: 138460 - DNA, 25 bp, E. coli
tactggtgataagggccacgacagg

SEQ ID NO: 138461 - DNA, 25 bp, E. coli
tactactggtgcgtttcccggctga

SEQ ID NO: 138462 - DNA, 25 bp, E. coli
tactggtgataacggccacgacagg

SEQ ID NO: 138463 - DNA, 25 bp, E. coli
tgttcaacacaacagcaggcgttta

SEQ ID NO: 138464 - DNA, 25 bp, E. coli
tgttcaacacaagagcaggcgttta

SEQ ID NO: 138465 - DNA, 25 bp, E. coli
tgacttctcgcgcaaactggatacc

SEQ ID NO: 138466 - DNA, 25 bp, E. coli
tgacttctcgcggaaactggatacc

SEQ ID NO: 138467 - DNA, 25 bp, E. coli
tcgcccgcgaacctgaacaaggtac

SEQ ID NO: 138468 - DNA, 25 bp, E. coli
tcgcccgcgaacgtgaacaaggtac

SEQ ID NO: 138469 - DNA, 25 bp, E. coli
tctacgatgaagttaacggcgagca

SEQ ID NO: 138470 - DNA, 25 bp, E. coli
tctacgatgaagataacggcgagca

SEQ ID NO: 138471 - DNA, 25 bp, E. coli
cgggcgtaactccaacagtgcgcaa

SEQ ID NO: 138472 - DNA, 25 bp, E. coli
cgtcaaaaattatcagcaggagctg

SEQ ID NO: 138473 - DNA, 25 bp, E. coli
cgggcgtaactcgaacagtgcgcaa

SEQ ID NO: 138474 - DNA, 25 bp, E. coli
cgtcaaaaattaacagcaggagctg

SEQ ID NO: 138475 - DNA, 25 bp, E. coli
gtgtttgtctttttgatgcccgcca

SEQ ID NO: 138476 - DNA, 25 bp, E. coli
ggtacgcaactgctataacccgaat

SEQ ID NO: 138477 - DNA, 25 bp, E. coli
gtgtttgtctttatgatgcccgcca

SEQ ID NO: 138478 - DNA, 25 bp, E. coli
ggtacgcaactggtataacccgaat

SEQ ID NO: 138479 - DNA, 25 bp, E. coli
caaccgcagttgatgctcgatatgg

SEQ ID NO: 138480 - DNA, 25 bp, E. coli
ctcgatatggaagaggcccgtggac

SEQ ID NO: 138481 - DNA, 25 bp, E. coli
ctcgatatggaacaggcccgtggac

SEQ ID NO: 138482 - DNA, 25 bp, E. coli
caaccgcagttgttgctcgatatgg

SEQ ID NO: 138483 - DNA, 25 bp, E. coli
tttgagcagctgctttatccgcaat

SEQ ID NO: 138484 - DNA, 25 bp, E. coli
tttgagcagctggtttatccgcaat

SEQ ID NO: 138485 - DNA, 25 bp, E. coli
tggtttatccgctatggctgcacga

SEQ ID NO: 138486 - DNA, 25 bp, E. coli
tgatgctcgatatggaacaggcccg

SEQ ID NO: 138487 - DNA, 25 bp, E. coli
tgatgctcgataaggaacaggcccg

SEQ ID NO: 138488 - DNA, 25 bp, E. coli
gctcctaagctttaccttatcagcc

SEQ ID NO: 138489 - DNA, 25 bp, E. coli
gctcctaagcttaaccttatcagcc

SEQ ID NO: 138490 - DNA, 25 bp, E. coli
cgatatggaacacgcccgtggactg

SEQ ID NO: 138491 - DNA, 25 bp, E. coli
cgcagttgatgctcgatatggaaca

SEQ ID NO: 138492 - DNA, 25 bp, E. coli
cgatatggaacaggcccgtggactg

SEQ ID NO: 138493 - DNA, 25 bp, E. coli
cgcagttgatgcacgatatggaaca

SEQ ID NO: 138494 - DNA, 25 bp, E. coli
gggcgctcctaacctttaccttatc

SEQ ID NO: 138495 - DNA, 25 bp, E. coli
gggcgctcctaagctttaccttatc

SEQ ID NO: 138496 - DNA, 25 bp, E. coli
ggcacaaccgcagttgatgctcgat

SEQ ID NO: 138497 - DNA, 25 bp, E. coli
ggcacaaccgcacttgatgctcgat

SEQ ID NO: 138498 - DNA, 25 bp, E. coli
tggtttatccgcaatggctgcacga

SEQ ID NO: 138499 - DNA, 25 bp, E. coli
gagcagctggtttatccgcaatggc

SEQ ID NO: 138500 - DNA, 25 bp, E. coli
gagcagctggttaatccgcaatggc

SEQ ID NO: 138501 - DNA, 25 bp, E. coli
caagcgtgagctattttctgaagag

SEQ ID NO: 138502 - DNA, 25 bp, E. coli
caagcgtgagcttttttctgaagag

SEQ ID NO: 138503 - DNA, 25 bp, E. coli
caaactatttattgcaagcgtgagc

SEQ ID NO: 138504 - DNA, 25 bp, E. coli
caaactatttatagcaagcgtgagc

SEQ ID NO: 138505 - DNA, 25 bp, E. coli
tatgagctggttactattgaagcgc

SEQ ID NO: 138506 - DNA, 25 bp, E. coli
tatcgccgcgtataatggttcagga

SEQ ID NO: 138507 - DNA, 25 bp, E. coli
tatgagctggtttctattgaagcgc

SEQ ID NO: 138508 - DNA, 25 bp, E. coli
tatcgccgcgtaaaatggttcagga

SEQ ID NO: 138509 - DNA, 25 bp, E. coli
tttctatgagcgttgggctggagca

SEQ ID NO: 138510 - DNA, 25 bp, E. coli
tttctatgagcgatgggctggagca

SEQ ID NO: 138511 - DNA, 25 bp, E. coli
cctaatcggttgactggcagtggtc

SEQ ID NO: 138512 - DNA, 25 bp, E. coli
gctgtcccctatgcgaaaatgccag

SEQ ID NO: 138513 - DNA, 25 bp, E. coli
gctgtcccctatccgaaaatgccag

SEQ ID NO: 138514 - DNA, 25 bp, E. coli
gaagcgctatgcagtggttgccctg

SEQ ID NO: 138515 - DNA, 25 bp, E. coli
gaagcgctatgctgtggttgccctg

SEQ ID NO: 138516 - DNA, 25 bp, E. coli
gaagatttagcacaagtagcctaca

SEQ ID NO: 138517 - DNA, 25 bp, E. coli
gaagatttagcagaagtagcctaca

SEQ ID NO: 138518 - DNA, 25 bp, E. coli
cctaatcggttgtctggcagtggtc

SEQ ID NO: 138519 - DNA, 25 bp, E. coli
cttacaaaaatttcgtggcgtgacg

SEQ ID NO: 138520 - DNA, 25 bp, E. coli
cttacaaaaattacgtggcgtgacg

SEQ ID NO: 138521 - DNA, 25 bp, E. coli
gatatgcggaaattttaacggcggc

SEQ ID NO: 138522 - DNA, 25 bp, E. coli
gatatgcggaaaatttaacggcggc

SEQ ID NO: 138523 - DNA, 25 bp, E. coli
caatggatgttgtgaccgggcagat

SEQ ID NO: 138524 - DNA, 25 bp, E. coli
caatggatgttgagaccgggcagat

SEQ ID NO: 138525 - DNA, 25 bp, E. coli
tgacgtagcccgaaaggcggcaatg

SEQ ID NO: 138526 - DNA, 25 bp, E. coli
tgacgtagcccgtaaggcggcaatg

SEQ ID NO: 138527 - DNA, 25 bp, E. coli
tcagatagggccacaggcactgaag

SEQ ID NO: 138528 - DNA, 25 bp, E. coli
tcagatagggcctcaggcactgaag

SEQ ID NO: 138529 - DNA, 25 bp, E. coli
gccacaggcactcaaggcggtttat

SEQ ID NO: 138530 - DNA, 25 bp, E. coli
gccacaggcactgaaggcggtttat

SEQ ID NO: 138531 - DNA, 25 bp, E. coli
gctgtacttggccacaaggtcacct

SEQ ID NO: 138532 - DNA, 25 bp, E. coli
gctgtacttggcgacaaggtcacct

SEQ ID NO: 138533 - DNA, 25 bp, E. coli
gcacgaacggtcagatagggccaca

SEQ ID NO: 138534 - DNA, 25 bp, E. coli
gcacgaacggtctgatagggccaca

SEQ ID NO: 138535 - DNA, 25 bp, E. coli
gacaaggtcaccaatcaggagcacc

SEQ ID NO: 138536 - DNA, 25 bp, E. coli
gaaattccattttgcggccggaggg

SEQ ID NO: 138537 - DNA, 25 bp, E. coli
gaaattccatttagcggccggaggg

SEQ ID NO: 138538 - DNA, 25 bp, E. coli
gacaaggtcacctatcaggagcacc

SEQ ID NO: 138539 - DNA, 25 bp, E. coli
ggtttatgacgttgcccgtaaggcg

SEQ ID NO: 138540 - DNA, 25 bp, E. coli
ggtttatgacgtagcccgtaaggcg

SEQ ID NO: 138541 - DNA, 25 bp, E. coli
tcacctatcaggtgcacctgaacgc

SEQ ID NO: 138542 - DNA, 25 bp, E. coli
taaggcggcaatcgatgttgtgacc

SEQ ID NO: 138543 - DNA, 25 bp, E. coli
taaggcggcaatggatgttgtgacc

SEQ ID NO: 138544 - DNA, 25 bp, E. coli
tcacctatcaggagcacctgaacgc

SEQ ID NO: 138545 - DNA, 25 bp, E. coli
aaaccgtggaagagcacgcggcaaa

SEQ ID NO: 138546 - DNA, 25 bp, E. coli
aaaccgtggaagtgcacgcggcaaa

SEQ ID NO: 138547 - DNA, 25 bp, E. coli
aacgtagaccacgaagagatcgcta

SEQ ID NO: 138548 - DNA, 25 bp, E. coli
aacgtagaccaccaagagatcgcta

SEQ ID NO: 138549 - DNA, 25 bp, E. coli
tgaccggtctggatatgggctttga

SEQ ID NO: 138550 - DNA, 25 bp, E. coli
tgaccggtctggttatgggctttga

SEQ ID NO: 138551 - DNA, 25 bp, E. coli
tcgctaaatttgaagccgtcgcctc

SEQ ID NO: 138552 - DNA, 25 bp, E. coli
tcgctaaatttgtagccgtcgcctc

SEQ ID NO: 138553 - DNA, 25 bp, E. coli
gaaggtgagttcaaaccgctgcacc

SEQ ID NO: 138554 - DNA, 25 bp, E. coli
gaaggtgagttctaaccgctgcacc

SEQ ID NO: 138555 - DNA, 25 bp, E. coli
cattcaggtggaatacgtgcaggaa

SEQ ID NO: 138556 - DNA, 25 bp, E. coli
cggaatatatttagcgcatggtgcc

SEQ ID NO: 138557 - DNA, 25 bp, E. coli
cggaatatattttgcgcatggtgcc

SEQ ID NO: 138558 - DNA, 25 bp, E. coli
cattcaggtggattacgtgcaggaa

SEQ ID NO: 138559 - DNA, 25 bp, E. coli
ggccccggcgtgcatgtgaactata

SEQ ID NO: 138560 - DNA, 25 bp, E. coli
tggcaaaaaggtgctcgatgtcggt

SEQ ID NO: 138561 - DNA, 25 bp, E. coli
tggcaaaaaggtcctcgatgtcggt

SEQ ID NO: 138562 - DNA, 25 bp, E. coli
ggccccggcgtggatgtgaactata

SEQ ID NO: 138563 - DNA, 25 bp, E. coli
taaccgcaacgggaagtcatggctg

SEQ ID NO: 138564 - DNA, 25 bp, E. coli
taaccgcaacggcaagtcatggctg

SEQ ID NO: 138565 - DNA, 25 bp, E. coli
gagcctgtgcgcaactggtgaaacc

SEQ ID NO: 138566 - DNA, 25 bp, E. coli
gagcctgtgcgctactggtgaaacc

SEQ ID NO: 138567 - DNA, 25 bp, E. coli
caatctcgatgaaggcgacggctac

SEQ ID NO: 138568 - DNA, 25 bp, E. coli
caatctcgatgatggcgacggctac

SEQ ID NO: 138569 - DNA, 25 bp, E. coli
tacatatcgctttcacctggtggcg

SEQ ID NO: 138570 - DNA, 25 bp, E. coli
tacatatcgcttacacctggtggcg

SEQ ID NO: 138571 - DNA, 25 bp, E. coli
tatatcagccataccgcggacaacg

SEQ ID NO: 138572 - DNA, 25 bp, E. coli
tatatcagccattccgcggacaacg

SEQ ID NO: 138573 - DNA, 25 bp, E. coli
ttcaggtaacgacacttgccagcgg

SEQ ID NO: 138574 - DNA, 25 bp, E. coli
ttcaggtaacgagacttgccagcgg

SEQ ID NO: 138575 - DNA, 25 bp, E. coli
gcttgataacgggaactggctgctg

SEQ ID NO: 138576 - DNA, 25 bp, E. coli
gcttgataacggcaactggctgctg

SEQ ID NO: 138577 - DNA, 25 bp, E. coli
gaactggcgctggtgtacaacgcga

SEQ ID NO: 138578 - DNA, 25 bp, E. coli
gaaaatttccgcagacggtggtcac

SEQ ID NO: 138579 - DNA, 25 bp, E. coli
gaactggcgctgctgtacaacgcga

SEQ ID NO: 138580 - DNA, 25 bp, E. coli
gaaaatttccgctgacggtggtcac

SEQ ID NO: 138581 - DNA, 25 bp, E. coli
gataacgtgctgtggctcctatgga

SEQ ID NO: 138582 - DNA, 25 bp, E. coli
gataacgtgctgaggctcctatgga

SEQ ID NO: 138583 - DNA, 25 bp, E. coli
gttcattcgacacccaatcacggtg

SEQ ID NO: 138584 - DNA, 25 bp, E. coli
gttcattcgacagccaatcacggtg

SEQ ID NO: 138585 - DNA, 25 bp, E. coli
taatgtgcgtctggtttgcgggaac

SEQ ID NO: 138586 - DNA, 25 bp, E. coli
taatgtgcgtctcgtttgcgggaac

SEQ ID NO: 138587 - DNA, 25 bp, E. coli
gatgacacgcgtacagagcaaaacc

SEQ ID NO: 138588 - DNA, 25 bp, E. coli
gatgacacgcgttcagagcaaaacc

SEQ ID NO: 138589 - DNA, 25 bp, E. coli
aacatagcgttacctcgccagttcg

SEQ ID NO: 138590 - DNA, 25 bp, E. coli
aacatagcgttagctcgccagttcg

SEQ ID NO: 138591 - DNA, 25 bp, E. coli
tttaaggaaacacaagcacgccgcg

SEQ ID NO: 138592 - DNA, 25 bp, E. coli
tttaaggaaacagaagcacgccgcg

SEQ ID NO: 138593 - DNA, 25 bp, E. coli
tgtatatttatggaatcagacagca

SEQ ID NO: 138594 - DNA, 25 bp, E. coli
tgtttatatcatgacgcttcagcta

SEQ ID NO: 138595 - DNA, 25 bp, E. coli
tgtttatatcatcacgcttcagcta

SEQ ID NO: 138596 - DNA, 25 bp, E. coli
tgtatatttatgcaatcagacagca

SEQ ID NO: 138597 - DNA, 25 bp, E. coli
gccagttcgtcgatagccaatcttt

SEQ ID NO: 138598 - DNA, 25 bp, E. coli
gccagttcgtcgttagccaatcttt

SEQ ID NO: 138599 - DNA, 25 bp, E. coli
gacatattaagaaacaaacccgacg

SEQ ID NO: 138600 - DNA, 25 bp, E. coli
gacatattaagatacaaacccgacg

SEQ ID NO: 138601 - DNA, 25 bp, E. coli
ccgacgccaaaacacgcaaattgtt

SEQ ID NO: 138602 - DNA, 25 bp, E. coli
cgcgccttccgtattctgatagcta

SEQ ID NO: 138603 - DNA, 25 bp, E. coli
cgccgcgcaactattacgtgacgtt

SEQ ID NO: 138604 - DNA, 25 bp, E. coli
cgccgcgcaacttttacgtgacgtt

SEQ ID NO: 138605 - DNA, 25 bp, E. coli
ccgacgccaaaagacgcaaattgtt

SEQ ID NO: 138606 - DNA, 25 bp, E. coli
cgcgccttccgttttctgatagcta

SEQ ID NO: 138607 - DNA, 25 bp, E. coli
gatagctacaccgttaacatagcgt

SEQ ID NO: 138608 - DNA, 25 bp, E. coli
gatagctacacccttaacatagcgt

SEQ ID NO: 138609 - DNA, 25 bp, E. coli
gacgttgccgtcaattgtggaatta

SEQ ID NO: 138610 - DNA, 25 bp, E. coli
gacgttgccgtctattgtggaatta

SEQ ID NO: 138611 - DNA, 25 bp, E. coli
cacgttagccgcaggttggatcttg

SEQ ID NO: 138612 - DNA, 25 bp, E. coli
cacgttagccgctggttggatcttg

SEQ ID NO: 138613 - DNA, 25 bp, E. coli
aaaggctggattcgcctggtcttgc

SEQ ID NO: 138614 - DNA, 25 bp, E. coli
aaaggctggattggcctggtcttgc

SEQ ID NO: 138615 - DNA, 25 bp, E. coli
ttgtctgtcgctaatgcattgtggg

SEQ ID NO: 138616 - DNA, 25 bp, E. coli
ttgtctgtcgcttatgcattgtggg

SEQ ID NO: 138617 - DNA, 25 bp, E. coli
tcttgctgttggctggaatgatcat

SEQ ID NO: 138618 - DNA, 25 bp, E. coli
tcttgctgttgggtggaatgatcat

SEQ ID NO: 138619 - DNA, 25 bp, E. coli
gctggcattggcaatcgtgctggaa

SEQ ID NO: 138620 - DNA, 25 bp, E. coli
gctggcattggctatcgtgctggaa

SEQ ID NO: 138621 - DNA, 25 bp, E. coli
gaatgatcatggtgaaacttgcctg

SEQ ID NO: 138622 - DNA, 25 bp, E. coli
gaatgatcatggagaaacttgcctg

SEQ ID NO: 138623 - DNA, 25 bp, E. coli
cgttaaagggatggacttgtctgtc

SEQ ID NO: 138624 - DNA, 25 bp, E. coli
cgttaaagggatcgacttgtctgtc

SEQ ID NO: 138625 - DNA, 25 bp, E. coli
gtttgaatgggtacacgccgcctgg

SEQ ID NO: 138626 - DNA, 25 bp, E. coli
gtttgaatgggttcacgccgcctgg

SEQ ID NO: 138627 - DNA, 25 bp, E. coli
gggtttggtattgccgccacgttag

SEQ ID NO: 138628 - DNA, 25 bp, E. coli
gggtttggtattcccgccacgttag

SEQ ID NO: 138629 - DNA, 25 bp, E. coli
tcaacggttaaatcgtaaaggctgg

SEQ ID NO: 138630 - DNA, 25 bp, E. coli
tcaacggttaaaacgtaaaggctgg

SEQ ID NO: 138631 - DNA, 25 bp, E. coli
gacggctttcgtggcaaaatatttg

SEQ ID NO: 138632 - DNA, 25 bp, E. coli
gacggctttcgtcgcaaaatatttg

SEQ ID NO: 138633 - DNA, 25 bp, E. coli
caatacattgatttccagctgttat

SEQ ID NO: 138634 - DNA, 25 bp, E. coli
caatacattgatatccagctgttat

SEQ ID NO: 138635 - DNA, 25 bp, E. coli
accgggaatgttggccgtgtttatg

SEQ ID NO: 138636 - DNA, 25 bp, E. coli
accgggaatgttcgccgtgtttatg

SEQ ID NO: 138637 - DNA, 25 bp, E. coli
acattgatatcctgctgttattaaa

SEQ ID NO: 138638 - DNA, 25 bp, E. coli
acattgatatccagctgttattaaa

SEQ ID NO: 138639 - DNA, 25 bp, E. coli
ttagctgccagaccgcaagaaaaag

SEQ ID NO: 138640 - DNA, 25 bp, E. coli
ttacatcctgcgttacaggacgcgt

SEQ ID NO: 138641 - DNA, 25 bp, E. coli
ttacatcctgcgatacaggacgcgt

SEQ ID NO: 138642 - DNA, 25 bp, E. coli
ttagctgccagagcgcaagaaaaag

SEQ ID NO: 138643 - DNA, 25 bp, E. coli
tcctgcgttacaggacgcgttaacg

SEQ ID NO: 138644 - DNA, 25 bp, E. coli
tcctgcgttacacgacgcgttaacg

SEQ ID NO: 138645 - DNA, 25 bp, E. coli
ctgccagaccgcaagaaaaagcgcc

SEQ ID NO: 138646 - DNA, 25 bp, E. coli
ctgccagaccgctagaaaaagcgcc

SEQ ID NO: 138647 - DNA, 25 bp, E. coli
ggtgaggaacggtttctgtttggca

SEQ ID NO: 138648 - DNA, 25 bp, E. coli
gtgaagtacagtcattaccgtctgc

SEQ ID NO: 138649 - DNA, 25 bp, E. coli
gtgaagtacagtgattaccgtctgc

SEQ ID NO: 138650 - DNA, 25 bp, E. coli
ggcattagctgcgagaccgcaagaa

SEQ ID NO: 138651 - DNA, 25 bp, E. coli
ggcattagctgccagaccgcaagaa

SEQ ID NO: 138652 - DNA, 25 bp, E. coli
gatgggtgaagtacagtcattaccg

SEQ ID NO: 138653 - DNA, 25 bp, E. coli
ggtgaggaacggattctgtttggca

SEQ ID NO: 138654 - DNA, 25 bp, E. coli
gatgggtgaagttcagtcattaccg

SEQ ID NO: 138655 - DNA, 25 bp, E. coli
atatatcgcctaaaaacaacgcggg

SEQ ID NO: 138656 - DNA, 25 bp, E. coli
atatatcgcctataaacaacgcggg

SEQ ID NO: 138657 - DNA, 25 bp, E. coli
tacgcagcgtgtgtggttgactact

SEQ ID NO: 138658 - DNA, 25 bp, E. coli
tacgcagcgtgtctggttgactact

SEQ ID NO: 138659 - DNA, 25 bp, E. coli
tagtcacataaagagatagcagatt

SEQ ID NO: 138660 - DNA, 25 bp, E. coli
tagtcacataaacagatagcagatt

SEQ ID NO: 138661 - DNA, 25 bp, E. coli
tggttgactactggttagcaaataa

SEQ ID NO: 138662 - DNA, 25 bp, E. coli
tcatgcaacaggttatgcaagtgca

SEQ ID NO: 138663 - DNA, 25 bp, E. coli
tcatgcaacaggatatgcaagtgca

SEQ ID NO: 138664 - DNA, 25 bp, E. coli
gccccatttaattcttacgcagcgt

SEQ ID NO: 138665 - DNA, 25 bp, E. coli
gccccatttaatacttacgcagcgt

SEQ ID NO: 138666 - DNA, 25 bp, E. coli
gcataaatatgtcatggatgtcact

SEQ ID NO: 138667 - DNA, 25 bp, E. coli
gcataaatatgtgatggatgtcact

SEQ ID NO: 138668 - DNA, 25 bp, E. coli
gcagggaatggctgccccatttaat

SEQ ID NO: 138669 - DNA, 25 bp, E. coli
ctgacaaaatgctgaattgagatca

SEQ ID NO: 138670 - DNA, 25 bp, E. coli
gcagggaatggcagccccatttaat

SEQ ID NO: 138671 - DNA, 25 bp, E. coli
ctgacaaaatgcagaattgagatca

SEQ ID NO: 138672 - DNA, 25 bp, E. coli
gttctattaagtaatttctcgccga

SEQ ID NO: 138673 - DNA, 25 bp, E. coli
gttctattaagttatttctcgccga

SEQ ID NO: 138674 - DNA, 25 bp, E. coli
ggaaaaaacagtccataaagcgttg

SEQ ID NO: 138675 - DNA, 25 bp, E. coli
ggaaaaaacagtgcataaagcgttg

SEQ ID NO: 138676 - DNA, 25 bp, E. coli
tggttgactactcgttagcaaataa

SEQ ID NO: 138677 - DNA, 25 bp, E. coli
aagcacaactttgaggagaactggc

SEQ ID NO: 138678 - DNA, 25 bp, E. coli
agtgctactcggaactcagttcccc

SEQ ID NO: 138679 - DNA, 25 bp, E. coli
gttagtgctactcggtactcagttc

SEQ ID NO: 138680 - DNA, 25 bp, E. coli
agtgctactcggtactcagttcccc

SEQ ID NO: 138681 - DNA, 25 bp, E. coli
gttagtgctactgggtactcagttc

SEQ ID NO: 138682 - DNA, 25 bp, E. coli
acaactttcaggagaactggcggtc

SEQ ID NO: 138683 - DNA, 25 bp, E. coli
acaactttcaggtgaactggcggtc

SEQ ID NO: 138684 - DNA, 25 bp, E. coli
aagcacaactttcaggagaactggc

SEQ ID NO: 138685 - DNA, 25 bp, E. coli
tagtgctactcgctactcagttccc

SEQ ID NO: 138686 - DNA, 25 bp, E. coli
tagtgctactcggtactcagttccc

SEQ ID NO: 138687 - DNA, 25 bp, E. coli
tgctactcggtactcagttccccta

SEQ ID NO: 138688 - DNA, 25 bp, E. coli
tgctactcggtagtcagttccccta

SEQ ID NO: 138689 - DNA, 25 bp, E. coli
tcagttcccctaccgtgcgttctac

SEQ ID NO: 138690 - DNA, 25 bp, E. coli
tcagttcccctagcgtgcgttctac

SEQ ID NO: 138691 - DNA, 25 bp, E. coli
gctgaagcacaagtttcaggagaac

SEQ ID NO: 138692 - DNA, 25 bp, E. coli
gctgaagcacaactttcaggagaac

SEQ ID NO: 138693 - DNA, 25 bp, E. coli
gtgctactcggtactcagttcccct

SEQ ID NO: 138694 - DNA, 25 bp, E. coli
ggtactcagttcccctaccgtgcgt

SEQ ID NO: 138695 - DNA, 25 bp, E. coli
gtgctactcggttctcagttcccct

SEQ ID NO: 138696 - DNA, 25 bp, E. coli
ggtactcagttcgcctaccgtgcgt

SEQ ID NO: 138697 - DNA, 25 bp, E. coli
gtactcagttcccctaccgtgcgtt

SEQ ID NO: 138698 - DNA, 25 bp, E. coli
gtactcagttccgctaccgtgcgtt

SEQ ID NO: 138699 - DNA, 25 bp, E. coli
aagatacggtgcatttgtatcgtac

SEQ ID NO: 138700 - DNA, 25 bp, E. coli
aagatacggtgcttttgtatcgtac

SEQ ID NO: 138701 - DNA, 25 bp, E. coli
tatcgtacttattgtttctggtgcg

SEQ ID NO: 138702 - DNA, 25 bp, E. coli
tattgtttctggagcgctgttaacc

SEQ ID NO: 138703 - DNA, 25 bp, E. coli
tttctggtgcgctgttaaccgaggt

SEQ ID NO: 138704 - DNA, 25 bp, E. coli
tatcgtacttatagtttctggtgcg

SEQ ID NO: 138705 - DNA, 25 bp, E. coli
tattgtttctggtgcgctgttaacc

SEQ ID NO: 138706 - DNA, 25 bp, E. coli
tttctggtgcgcagttaaccgaggt

SEQ ID NO: 138707 - DNA, 25 bp, E. coli
tctggtgcgctgttaaccgaggtaa

SEQ ID NO: 138708 - DNA, 25 bp, E. coli
tctggtgcgctgataaccgaggtaa

SEQ ID NO: 138709 - DNA, 25 bp, E. coli
gcgctgttaacccaggtaaataata

SEQ ID NO: 138710 - DNA, 25 bp, E. coli
gcgctgttaaccgaggtaaataata

SEQ ID NO: 138711 - DNA, 25 bp, E. coli
cgcacaatgaagatacggtgctttt

SEQ ID NO: 138712 - DNA, 25 bp, E. coli
cgtacttattgtatctggtgcgctg

SEQ ID NO: 138713 - DNA, 25 bp, E. coli
cgtacttattgtttctggtgcgctg

SEQ ID NO: 138714 - DNA, 25 bp, E. coli
cgcacaatgaagttacggtgctttt

SEQ ID NO: 138715 - DNA, 25 bp, E. coli
cggtgcttttgtttcgtacttattg

SEQ ID NO: 138716 - DNA, 25 bp, E. coli
cggtgcttttgtatcgtacttattg

SEQ ID NO: 138717 - DNA, 25 bp, E. coli
ggtgcgctgttaaccgaggtaaata

SEQ ID NO: 138718 - DNA, 25 bp, E. coli
ggtgcgctgttatccgaggtaaata

SEQ ID NO: 138719 - DNA, 25 bp, E. coli
tggaccgcacaatgaagatacggtg

SEQ ID NO: 138720 - DNA, 25 bp, E. coli
tggaccgcacaaagaagatacggtg

SEQ ID NO: 138721 - DNA, 25 bp, E. coli
aaccgccagcgaggcatcgcgcagg

SEQ ID NO: 138722 - DNA, 25 bp, E. coli
aaccgccagcgacgcatcgcgcagg

SEQ ID NO: 138723 - DNA, 25 bp, E. coli
cagcgacgcatcgcgcaggctggaa

SEQ ID NO: 138724 - DNA, 25 bp, E. coli
cagcgacgcatcccgcaggctggaa

SEQ ID NO: 138725 - DNA, 25 bp, E. coli
taaaaaatttaaggctgacgggcag

SEQ ID NO: 138726 - DNA, 25 bp, E. coli
taaaaaatttaacgctgacgggcag

SEQ ID NO: 138727 - DNA, 25 bp, E. coli
aaaaatttaacgctgacgggcagat

SEQ ID NO: 138728 - DNA, 25 bp, E. coli
aaaatttaacgcagacgggcagatt

SEQ ID NO: 138729 - DNA, 25 bp, E. coli
aaaatttaacgctgacgggcagatt

SEQ ID NO: 138730 - DNA, 25 bp, E. coli
aaaaatttaacggtgacgggcagat

SEQ ID NO: 138731 - DNA, 25 bp, E. coli
tattgatgatgtgccggtgattgtt

SEQ ID NO: 138732 - DNA, 25 bp, E. coli
tattgatgatgtcccggtgattgtt

SEQ ID NO: 138733 - DNA, 25 bp, E. coli
tgtcccggtgatagttcaggataaa

SEQ ID NO: 138734 - DNA, 25 bp, E. coli
tgttcaggataaaaaatttaacgct

SEQ ID NO: 138735 - DNA, 25 bp, E. coli
tgtcccggtgattgttcaggataaa

SEQ ID NO: 138736 - DNA, 25 bp, E. coli
tgttcaggataataaatttaacgct

SEQ ID NO: 138737 - DNA, 25 bp, E. coli
tcccggtgattgttcaggataaaaa

SEQ ID NO: 138738 - DNA, 25 bp, E. coli
tcccggtgattgatcaggataaaaa

SEQ ID NO: 138739 - DNA, 25 bp, E. coli
gtcccggtgattcttcaggataaaa

SEQ ID NO: 138740 - DNA, 25 bp, E. coli
gtcccggtgattgttcaggataaaa

SEQ ID NO: 138741 - DNA, 25 bp, E. coli
ggtattgatgatgtcccggtgattg

SEQ ID NO: 138742 - DNA, 25 bp, E. coli
ggtattgatgatctcccggtgattg

SEQ ID NO: 138743 - DNA, 25 bp, E. coli
taaacgacagcggactggttcgcgg

SEQ ID NO: 138744 - DNA, 25 bp, E. coli
taaacgacagcgcactggttcgcgg

SEQ ID NO: 138745 - DNA, 25 bp, E. coli
tgatatctgccactgtgaagccctg

SEQ ID NO: 138746 - DNA, 25 bp, E. coli
tgtacgacaaagacagccaggcgtt

SEQ ID NO: 138747 - DNA, 25 bp, E. coli
tgtacgacaaagtcagccaggcgtt

SEQ ID NO: 138748 - DNA, 25 bp, E. coli
tgatatctgccagtgtgaagccctg

SEQ ID NO: 138749 - DNA, 25 bp, E. coli
tgagccacggcgataaagttaccgc

SEQ ID NO: 138750 - DNA, 25 bp, E. coli
tgagccacggcgttaaagttaccgc

SEQ ID NO: 138751 - DNA, 25 bp, E. coli
tgaagatgggcctggttgaaccgct

SEQ ID NO: 138752 - DNA, 25 bp, E. coli
tgaagatgggccaggttgaaccgct

SEQ ID NO: 138753 - DNA, 25 bp, E. coli
tctctgcgtgctctcgaaaccatcg

SEQ ID NO: 138754 - DNA, 25 bp, E. coli
tctctgcgtgctgtcgaaaccatcg

SEQ ID NO: 138755 - DNA, 25 bp, E. coli
gcgtgcgccgcactatgtctttgaa

SEQ ID NO: 138756 - DNA, 25 bp, E. coli
gcattattctttgcggcggcccgga

SEQ ID NO: 138757 - DNA, 25 bp, E. coli
gcattattctttccggcggcccgga

SEQ ID NO: 138758 - DNA, 25 bp, E. coli
gcgtgcgccgcagtatgtctttgaa

SEQ ID NO: 138759 - DNA, 25 bp, E. coli
gataaagtcatcctcggcctctctg

SEQ ID NO: 138760 - DNA, 25 bp, E. coli
gataaagtcatcgtcggcctctctg

SEQ ID NO: 138761 - DNA, 25 bp, E. coli
tgtctttgaagcaggcgtaccggta

SEQ ID NO: 138762 - DNA, 25 bp, E. coli
tgtctttgaagctggcgtaccggta

SEQ ID NO: 138763 - DNA, 25 bp, E. coli
tcacgtaccggctgaagatcgcttc

SEQ ID NO: 138764 - DNA, 25 bp, E. coli
tcacgtaccggcagaagatcgcttc

SEQ ID NO: 138765 - DNA, 25 bp, E. coli
aagattgattttagtgatggttgtc

SEQ ID NO: 138766 - DNA, 25 bp, E. coli
aagattgatttttgtgatggttgtc

SEQ ID NO: 138767 - DNA, 25 bp, E. coli
aggcgctatttcttgccatctgtag

SEQ ID NO: 138768 - DNA, 25 bp, E. coli
aggcgctatttcatgccatctgtag

SEQ ID NO: 138769 - DNA, 25 bp, E. coli
tattttacgcgttacagtgctgcga

SEQ ID NO: 138770 - DNA, 25 bp, E. coli
tattttacgcgtaacagtgctgcga

SEQ ID NO: 138771 - DNA, 25 bp, E. coli
ttacagtgctgcgacaatggccgga

SEQ ID NO: 138772 - DNA, 25 bp, E. coli
ttacagtgctgccacaatggccgga

SEQ ID NO: 138773 - DNA, 25 bp, E. coli
gccagaagagtatgagaaagcacta

SEQ ID NO: 138774 - DNA, 25 bp, E. coli
ccatctgtaggtgtcagaaataggg

SEQ ID NO: 138775 - DNA, 25 bp, E. coli
ccatctgtaggtctcagaaataggg

SEQ ID NO: 138776 - DNA, 25 bp, E. coli
gccagaagagtaagagaaagcacta

SEQ ID NO: 138777 - DNA, 25 bp, E. coli
gaaaagacgcctggcaggcgctatt

SEQ ID NO: 138778 - DNA, 25 bp, E. coli
gacaatggccggaaaagacgcctgg

SEQ ID NO: 138779 - DNA, 25 bp, E. coli
gaaagcactattttacgcgttacag

SEQ ID NO: 138780 - DNA, 25 bp, E. coli
gaaaagacgcctcgcaggcgctatt

SEQ ID NO: 138781 - DNA, 25 bp, E. coli
gacaatggccggtaaagacgcctgg

SEQ ID NO: 138782 - DNA, 25 bp, E. coli
gaaagcactattatacgcgttacag

SEQ ID NO: 138783 - DNA, 25 bp, E. coli
gatttgtatcacttaaagattgatt

SEQ ID NO: 138784 - DNA, 25 bp, E. coli
gatttgtatcacataaagattgatt

SEQ ID NO: 138785 - DNA, 25 bp, E. coli
gatggttgtcatattataagcgcaa

SEQ ID NO: 138786 - DNA, 25 bp, E. coli
gatggttgtcattttataagcgcaa

SEQ ID NO: 138787 - DNA, 25 bp, E. coli
aatcattgtttcacccctgacaagg

SEQ ID NO: 138788 - DNA, 25 bp, E. coli
aatcattgtttctcccctgacaagg

SEQ ID NO: 138789 - DNA, 25 bp, E. coli
caaagataagtctcttgaagtagag

SEQ ID NO: 138790 - DNA, 25 bp, E. coli
caaagataagtcacttgaagtagag

SEQ ID NO: 138791 - DNA, 25 bp, E. coli
caaaattaccatcaatatcaggtcc

SEQ ID NO: 138792 - DNA, 25 bp, E. coli
caaaattaccatgaatatcaggtcc

SEQ ID NO: 138793 - DNA, 25 bp, E. coli
tatcaggtcctgtaaatctccatat

SEQ ID NO: 138794 - DNA, 25 bp, E. coli
tatcaggtcctgaaaatctccatat

SEQ ID NO: 138795 - DNA, 25 bp, E. coli
tattgctgaatttagtccgcaggaa

SEQ ID NO: 138796 - DNA, 25 bp, E. coli
tattgctgaattaagtccgcaggaa

SEQ ID NO: 138797 - DNA, 25 bp, E. coli
ttaacgaaatctccgaacaagccag

SEQ ID NO: 138798 - DNA, 25 bp, E. coli
ttaacgaaatctgcgaacaagccag

SEQ ID NO: 138799 - DNA, 25 bp, E. coli
tccgcaggaatttgtggataattgt

SEQ ID NO: 138800 - DNA, 25 bp, E. coli
tccgcaggaattagtggataattgt

SEQ ID NO: 138801 - DNA, 25 bp, E. coli
cctgacaaggttaacgaaatctgcg

SEQ ID NO: 138802 - DNA, 25 bp, E. coli
cctgacaaggtttacgaaatctgcg

SEQ ID NO: 138803 - DNA, 25 bp, E. coli
gaagtagagtcatattttgtcgaca

SEQ ID NO: 138804 - DNA, 25 bp, E. coli
gaagtagagtcaaattttgtcgaca

SEQ ID NO: 138805 - DNA, 25 bp, E. coli
cgatctgaagagtatattgttaaaa

SEQ ID NO: 138806 - DNA, 25 bp, E. coli
cgatctgaagagaatattgttaaaa

SEQ ID NO: 138807 - DNA, 25 bp, E. coli
tatacctaccagattcaaagataag

SEQ ID NO: 138808 - DNA, 25 bp, E. coli
tatacctaccagtttcaaagataag

SEQ ID NO: 138809 - DNA, 25 bp, E. coli
taccgcccggaagagatagaatcca

SEQ ID NO: 138810 - DNA, 25 bp, E. coli
taaactgactgccatgggcgttggc

SEQ ID NO: 138811 - DNA, 25 bp, E. coli
taaactgactgcgatgggcgttggc

SEQ ID NO: 138812 - DNA, 25 bp, E. coli
aaaggcgtgctgatcaactctggcg

SEQ ID NO: 138813 - DNA, 25 bp, E. coli
aaaggcgtgctgttcaactctggcg

SEQ ID NO: 138814 - DNA, 25 bp, E. coli
tatgactctcgaatggcaggaatcc

SEQ ID NO: 138815 - DNA, 25 bp, E. coli
taccgcccggaacagatagaatcca

SEQ ID NO: 138816 - DNA, 25 bp, E. coli
tatgactctcgattggcaggaatcc

SEQ ID NO: 138817 - DNA, 25 bp, E. coli
tgatgaacaaactggcgaaagcacc

SEQ ID NO: 138818 - DNA, 25 bp, E. coli
tgatgaacaaacaggcgaaagcacc

SEQ ID NO: 138819 - DNA, 25 bp, E. coli
gaagcgcacatttgaagtaaccgaa

SEQ ID NO: 138820 - DNA, 25 bp, E. coli
gaagcgcacattagaagtaaccgaa

SEQ ID NO: 138821 - DNA, 25 bp, E. coli
gaacaagttatcgacggctgctgct

SEQ ID NO: 138822 - DNA, 25 bp, E. coli
gaacaagttatccacggctgctgct

SEQ ID NO: 138823 - DNA, 25 bp, E. coli
ggatcactggccagacaccgttaaa

SEQ ID NO: 138824 - DNA, 25 bp, E. coli
ggatcactggcctgacaccgttaaa

SEQ ID NO: 138825 - DNA, 25 bp, E. coli
ggtcttgaccatgaagcggccttca

SEQ ID NO: 138826 - DNA, 25 bp, E. coli
ggtcttgaccatcaagcggccttca

SEQ ID NO: 138827 - DNA, 25 bp, E. coli
ggtgaactctgacgaaccagcgaaa

SEQ ID NO: 138828 - DNA, 25 bp, E. coli
ggtgaactctgaggaaccagcgaaa

SEQ ID NO: 138829 - DNA, 25 bp, E. coli
taagaagacttcagcggtcaactgg

SEQ ID NO: 138830 - DNA, 25 bp, E. coli
taagaagacttctgcggtcaactgg

SEQ ID NO: 138831 - DNA, 25 bp, E. coli
caatgcgcgattatcttgccggact

SEQ ID NO: 138832 - DNA, 25 bp, E. coli
aagacggcgttcaggcaatgcgcga

SEQ ID NO: 138833 - DNA, 25 bp, E. coli
caatgcgcgattttcttgccggact

SEQ ID NO: 138834 - DNA, 25 bp, E. coli
aagacggcgttctggcaatgcgcga

SEQ ID NO: 138835 - DNA, 25 bp, E. coli
tacacttaactcttacggtgaaatg

SEQ ID NO: 138836 - DNA, 25 bp, E. coli
tacacttaactcatacggtgaaatg

SEQ ID NO: 138837 - DNA, 25 bp, E. coli
tatcgcttcgccagagcatcaggtt

SEQ ID NO: 138838 - DNA, 25 bp, E. coli
tatcgcttcgcctgagcatcaggtt

SEQ ID NO: 138839 - DNA, 25 bp, E. coli
tcttgccggactcgatatcgcttcg

SEQ ID NO: 138840 - DNA, 25 bp, E. coli
tcttgccggactggatatcgcttcg

SEQ ID NO: 138841 - DNA, 25 bp, E. coli
tcaggttctgatcaacgtaacagca

SEQ ID NO: 138842 - DNA, 25 bp, E. coli
tcaggttctgatgaacgtaacagca

SEQ ID NO: 138843 - DNA, 25 bp, E. coli
gcgtggatcagcaacgagttatgca

SEQ ID NO: 138844 - DNA, 25 bp, E. coli
gcgtggatcagctacgagttatgca

SEQ ID NO: 138845 - DNA, 25 bp, E. coli
cgtaacagcaaatagcgaggtcgct

SEQ ID NO: 138846 - DNA, 25 bp, E. coli
cgtaacagcaaaaagcgaggtcgct

SEQ ID NO: 138847 - DNA, 25 bp, E. coli
cgatacatttctcaatatgccaacc

SEQ ID NO: 138848 - DNA, 25 bp, E. coli
cgatacatttctgaatatgccaacc

SEQ ID NO: 138849 - DNA, 25 bp, E. coli
cggtgaaatggagtgaatctctcga

SEQ ID NO: 138850 - DNA, 25 bp, E. coli
cggtgaaatggactgaatctctcga

SEQ ID NO: 138851 - DNA, 25 bp, E. coli
gaggtcgctccgacaattatcaaag

SEQ ID NO: 138852 - DNA, 25 bp, E. coli
gaggtcgctccgtcaattatcaaag

SEQ ID NO: 138853 - DNA, 25 bp, E. coli
acgatgggacgttgcaatgactgtg

SEQ ID NO: 138854 - DNA, 25 bp, E. coli
acgatgggacgtagcaatgactgtg

SEQ ID NO: 138855 - DNA, 25 bp, E. coli
aaagcagtgctgattatcgaaggga

SEQ ID NO: 138856 - DNA, 25 bp, E. coli
aaattgctcccggtgtgcgacggcg

SEQ ID NO: 138857 - DNA, 25 bp, E. coli
aaagcagtgctgtttatcgaaggga

SEQ ID NO: 138858 - DNA, 25 bp, E. coli
aaattgctcccgctgtgcgacggcg

SEQ ID NO: 138859 - DNA, 25 bp, E. coli
tttatcgaagggataacggtgagtg

SEQ ID NO: 138860 - DNA, 25 bp, E. coli
tttatcgaagggttaacggtgagtg

SEQ ID NO: 138861 - DNA, 25 bp, E. coli
tgacggcaaagtggtgtggaacgct

SEQ ID NO: 138862 - DNA, 25 bp, E. coli
tgacggcaaagtcgtgtggaacgct

SEQ ID NO: 138863 - DNA, 25 bp, E. coli
tccgtggacgatcggacgttgcaat

SEQ ID NO: 138864 - DNA, 25 bp, E. coli
tccgtggacgatgggacgttgcaat

SEQ ID NO: 138865 - DNA, 25 bp, E. coli
tcccggtgtgcgacggcgcaatgct

SEQ ID NO: 138866 - DNA, 25 bp, E. coli
tcccggtgtgcgtcggcgcaatgct

SEQ ID NO: 138867 - DNA, 25 bp, E. coli
gccatgtccgcatagcagtgctgtt

SEQ ID NO: 138868 - DNA, 25 bp, E. coli
gccatgtccgcaaagcagtgctgtt

SEQ ID NO: 138869 - DNA, 25 bp, E. coli
ccacgccggaagacgttgagccgtt

SEQ ID NO: 138870 - DNA, 25 bp, E. coli
ccacgccggaagtcgttgagccgtt

SEQ ID NO: 138871 - DNA, 25 bp, E. coli
gcttagccatgtccgcaaagcagtg

SEQ ID NO: 138872 - DNA, 25 bp, E. coli
gcttagccatgtgcgcaaagcagtg

SEQ ID NO: 138873 - DNA, 25 bp, E. coli
ggaaaaattgctgccggtgtgcgac

SEQ ID NO: 138874 - DNA, 25 bp, E. coli
ggaaaaattgctcccggtgtgcgac

SEQ ID NO: 138875 - DNA, 25 bp, E. coli
attaagctattctggcgacccgccg

SEQ ID NO: 138876 - DNA, 25 bp, E. coli
attaagctattcaggcgacccgccg

SEQ ID NO: 138877 - DNA, 25 bp, E. coli
tagcaaagataatgcaaccagcctg

SEQ ID NO: 138878 - DNA, 25 bp, E. coli
tatcttggctacttggacgactacg

SEQ ID NO: 138879 - DNA, 25 bp, E. coli
tagcaaagataaagcaaccagcctg

SEQ ID NO: 138880 - DNA, 25 bp, E. coli
tatcttggctacatggacgactacg

SEQ ID NO: 138881 - DNA, 25 bp, E. coli
tataacctgcgtgaaattccgcctg

SEQ ID NO: 138882 - DNA, 25 bp, E. coli
tttaaaagcacgttggtcgcaccgt

SEQ ID NO: 138883 - DNA, 25 bp, E. coli
tataacctgcgtcaaattccgcctg

SEQ ID NO: 138884 - DNA, 25 bp, E. coli
tttaaaagcacgatggtcgcaccgt

SEQ ID NO: 138885 - DNA, 25 bp, E. coli
tgactattgcctatcttgggcggga

SEQ ID NO: 138886 - DNA, 25 bp, E. coli
tgactattgcctttcttgggcggga

SEQ ID NO: 138887 - DNA, 25 bp, E. coli
tctggttgccagtatgtgcagccac

SEQ ID NO: 138888 - DNA, 25 bp, E. coli
tctggttgccagaatgtgcagccac

SEQ ID NO: 138889 - DNA, 25 bp, E. coli
gcaagtcgccgtccaaagtcgcatt

SEQ ID NO: 138890 - DNA, 25 bp, E. coli
gcaagtcgccgtgcaaagtcgcatt

SEQ ID NO: 138891 - DNA, 25 bp, E. coli
gactggagccaaaagcgacttcgca

SEQ ID NO: 138892 - DNA, 25 bp, E. coli
gactggagccaatagcgacttcgca

SEQ ID NO: 138893 - DNA, 25 bp, E. coli
cgacttcgcaggttcggatcatgaa

SEQ ID NO: 138894 - DNA, 25 bp, E. coli
cgcctgcagccggtggagaataaaa

SEQ ID NO: 138895 - DNA, 25 bp, E. coli
cgacttcgcaggatcggatcatgaa

SEQ ID NO: 138896 - DNA, 25 bp, E. coli
cgcctgcagccgctggagaataaaa

SEQ ID NO: 138897 - DNA, 25 bp, E. coli
caacgggtcattagcgaacagcaac

SEQ ID NO: 138898 - DNA, 25 bp, E. coli
caacgggtcatttgcgaacagcaac

SEQ ID NO: 138899 - DNA, 25 bp, E. coli
tacaacaatttagggcaacgggtca

SEQ ID NO: 138900 - DNA, 25 bp, E. coli
tacaacaatttacggcaacgggtca

SEQ ID NO: 138901 - DNA, 25 bp, E. coli
aaagatattctctggagcgtcgggc

SEQ ID NO: 138902 - DNA, 25 bp, E. coli
aaagatattctcaggagcgtcgggc

SEQ ID NO: 138903 - DNA, 25 bp, E. coli
taccctggcggtgctgattctctca

SEQ ID NO: 138904 - DNA, 25 bp, E. coli
taccctggcggtcctgattctctca

SEQ ID NO: 138905 - DNA, 25 bp, E. coli
tatctgctttaaagcggcgtggaac

SEQ ID NO: 138906 - DNA, 25 bp, E. coli
tatctgctttaatgcggcgtggaac

SEQ ID NO: 138907 - DNA, 25 bp, E. coli
tattcgcgcggcattaattccgacg

SEQ ID NO: 138908 - DNA, 25 bp, E. coli
tattcgcgcggctttaattccgacg

SEQ ID NO: 138909 - DNA, 25 bp, E. coli
tattttcagcgtggatgatgccagc

SEQ ID NO: 138910 - DNA, 25 bp, E. coli
tattttcagcgtcgatgatgccagc

SEQ ID NO: 138911 - DNA, 25 bp, E. coli
tccgacggtcgattcagcaaaaacg

SEQ ID NO: 138912 - DNA, 25 bp, E. coli
tccgacggtcgaatcagcaaaaacg

SEQ ID NO: 138913 - DNA, 25 bp, E. coli
gaatttatcccgttgcaggtgatcc

SEQ ID NO: 138914 - DNA, 25 bp, E. coli
gaatttatcccgatgcaggtgatcc

SEQ ID NO: 138915 - DNA, 25 bp, E. coli
gatgccagcctgtcattattgatgg

SEQ ID NO: 138916 - DNA, 25 bp, E. coli
taagttttataattcgcgccaccag

SEQ ID NO: 138917 - DNA, 25 bp, E. coli
taagttttataaatcgcgccaccag

SEQ ID NO: 138918 - DNA, 25 bp, E. coli
gatgccagcctgacattattgatgg

SEQ ID NO: 138919 - DNA, 25 bp, E. coli
caattatgggaatagcgggcgctgc

SEQ ID NO: 138920 - DNA, 25 bp, E. coli
caattatgggaaaagcgggcgctgc

SEQ ID NO: 138921 - DNA, 25 bp, E. coli
caaaatcggctcgttacggaaggcg

SEQ ID NO: 138922 - DNA, 25 bp, E. coli
cactgttgtatggtacccggcaaac

SEQ ID NO: 138923 - DNA, 25 bp, E. coli
cactgttgtatgctacccggcaaac

SEQ ID NO: 138924 - DNA, 25 bp, E. coli
caaaatcggctccttacggaaggcg

SEQ ID NO: 138925 - DNA, 25 bp, E. coli
caaaagcctgggtgatgaatcgcac

SEQ ID NO: 138926 - DNA, 25 bp, E. coli
caaaagcctgggagatgaatcgcac

SEQ ID NO: 138927 - DNA, 25 bp, E. coli
acagcttgcttcaggtgcgggcaca

SEQ ID NO: 138928 - DNA, 25 bp, E. coli
acagcttgcttctggtgcgggcaca

SEQ ID NO: 138929 - DNA, 25 bp, E. coli
tagataacgcttgccacattggcgg

SEQ ID NO: 138930 - DNA, 25 bp, E. coli
tagataacgcttcccacattggcgg

SEQ ID NO: 138931 - DNA, 25 bp, E. coli
tatcggtcattatcgtggcgacggg

SEQ ID NO: 138932 - DNA, 25 bp, E. coli
tatcggtcattaacgtggcgacggg

SEQ ID NO: 138933 - DNA, 25 bp, E. coli
ttattcagtcgaataccaccggcgc

SEQ ID NO: 138934 - DNA, 25 bp, E. coli
ttattcagtcgattaccaccggcgc

SEQ ID NO: 138935 - DNA, 25 bp, E. coli
gaatatgtttgctctcctggcggtg

SEQ ID NO: 138936 - DNA, 25 bp, E. coli
gaatatgtttgcactcctggcggtg

SEQ ID NO: 138937 - DNA, 25 bp, E. coli
gaaagttcacttgatccgcaggcaa

SEQ ID NO: 138938 - DNA, 25 bp, E. coli
gaaagttcacttcatccgcaggcaa

SEQ ID NO: 138939 - DNA, 25 bp, E. coli
gatatcccgctgcagaaatacgacg

SEQ ID NO: 138940 - DNA, 25 bp, E. coli
gatatcccgctggagaaatacgacg

SEQ ID NO: 138941 - DNA, 25 bp, E. coli
atgaaagccgtatcctcgacgcggg

SEQ ID NO: 138942 - DNA, 25 bp, E. coli
atgaaagccgtaacctcgacgcggg

SEQ ID NO: 138943 - DNA, 25 bp, E. coli
aaaacggaccgcacggctatctgcg

SEQ ID NO: 138944 - DNA, 25 bp, E. coli
aaaacggaccgctcggctatctgcg

SEQ ID NO: 138945 - DNA, 25 bp, E. coli
aaattccggctggatcgggcagtga

SEQ ID NO: 138946 - DNA, 25 bp, E. coli
aaattccggctgcatcgggcagtga

SEQ ID NO: 138947 - DNA, 25 bp, E. coli
tagtcaaaaccagcagcgacagcgt

SEQ ID NO: 138948 - DNA, 25 bp, E. coli
tagtcaaaaccaccagcgacagcgt

SEQ ID NO: 138949 - DNA, 25 bp, E. coli
tatgacgaacaaggcgatcttatcg

SEQ ID NO: 138950 - DNA, 25 bp, E. coli
tatgacgaacaacgcgatcttatcg

SEQ ID NO: 138951 - DNA, 25 bp, E. coli
tgttgctgctctgactggcaatcgg

SEQ ID NO: 138952 - DNA, 25 bp, E. coli
tgttgctgctctcactggcaatcgg

SEQ ID NO: 138953 - DNA, 25 bp, E. coli
tcgatcagttaacggatgaaagccg

SEQ ID NO: 138954 - DNA, 25 bp, E. coli
tcgatcagttaagggatgaaagccg

SEQ ID NO: 138955 - DNA, 25 bp, E. coli
gctgaacgttgctccgctgatgcgt

SEQ ID NO: 138956 - DNA, 25 bp, E. coli
gctgaacgttgcaccgctgatgcgt

SEQ ID NO: 138957 - DNA, 25 bp, E. coli
gaaaaacgcattgaggcgatcctcg

SEQ ID NO: 138958 - DNA, 25 bp, E. coli
gaaaaacgcattcaggcgatcctcg

SEQ ID NO: 138959 - DNA, 25 bp, E. coli
gtaatccacagcaggaagaactggc

SEQ ID NO: 138960 - DNA, 25 bp, E. coli
gtaatccacagctggaagaactggc

SEQ ID NO: 138961 - DNA, 25 bp, E. coli
gatgcgtaccgagtcaccggatgaa

SEQ ID NO: 138962 - DNA, 25 bp, E. coli
gatgcgtaccgactcaccggatgaa

SEQ ID NO: 138963 - DNA, 25 bp, E. coli
cagggttattggcaaaagaccatca

SEQ ID NO: 138964 - DNA, 25 bp, E. coli
cagggttattgggaaaagaccatca

SEQ ID NO: 138965 - DNA, 25 bp, E. coli
aactaacctggattgctttgtgcga

SEQ ID NO: 138966 - DNA, 25 bp, E. coli
aactaacctggaatgctttgtgcga

SEQ ID NO: 138967 - DNA, 25 bp, E. coli
tagtcatgtaagcattgcggaaagc

SEQ ID NO: 138968 - DNA, 25 bp, E. coli
tagtcatgtaaggattgcggaaagc

SEQ ID NO: 138969 - DNA, 25 bp, E. coli
tgcggaaagcttgaatgtgaaaaaa

SEQ ID NO: 138970 - DNA, 25 bp, E. coli
tgcggaaagcttcaatgtgaaaaaa

SEQ ID NO: 138971 - DNA, 25 bp, E. coli
gctaagcatatatatggttatcatg

SEQ ID NO: 138972 - DNA, 25 bp, E. coli
gctaagcatataaatggttatcatg

SEQ ID NO: 138973 - DNA, 25 bp, E. coli
gacaatccttaagtagtcatgtaag

SEQ ID NO: 138974 - DNA, 25 bp, E. coli
gacaatccttaactagtcatgtaag

SEQ ID NO: 138975 - DNA, 25 bp, E. coli
ctttgtgcgataggttagtcagggt

SEQ ID NO: 138976 - DNA, 25 bp, E. coli
ctttgtgcgatacgttagtcagggt

SEQ ID NO: 138977 - DNA, 25 bp, E. coli
gtctatagatgaaaaactaacctgg

SEQ ID NO: 138978 - DNA, 25 bp, E. coli
gtctatagatgataaactaacctgg

SEQ ID NO: 138979 - DNA, 25 bp, E. coli
ggttatcatgagtagaagattgtag

SEQ ID NO: 138980 - DNA, 25 bp, E. coli
ggaaaagaccatgaagacaatcctt

SEQ ID NO: 138981 - DNA, 25 bp, E. coli
ggttatcatgagaagaagattgtag

SEQ ID NO: 138982 - DNA, 25 bp, E. coli
ggaaaagaccatcaagacaatcctt

SEQ ID NO: 138983 - DNA, 25 bp, E. coli
gatgttattaacacatggtctatag

SEQ ID NO: 138984 - DNA, 25 bp, E. coli
gatgttattaactcatggtctatag

SEQ ID NO: 138985 - DNA, 25 bp, E. coli
tacgcttaatgtgcttgatgacaaa

SEQ ID NO: 138986 - DNA, 25 bp, E. coli
atcaccgctgtatttgccctctgtt

SEQ ID NO: 138987 - DNA, 25 bp, E. coli
atcaccgctgtaattgccctctgtt

SEQ ID NO: 138988 - DNA, 25 bp, E. coli
tacgcttaatgtccttgatgacaaa

SEQ ID NO: 138989 - DNA, 25 bp, E. coli
tgtatttgccctctgttccgtggtt

SEQ ID NO: 138990 - DNA, 25 bp, E. coli
tgtatttgccctgtgttccgtggtt

SEQ ID NO: 138991 - DNA, 25 bp, E. coli
tgtgcttgatgagaaaaactacacc

SEQ ID NO: 138992 - DNA, 25 bp, E. coli
tgtgcttgatgacaaaaactacacc

SEQ ID NO: 138993 - DNA, 25 bp, E. coli
gctgtatttgccctctgttccgtgg

SEQ ID NO: 138994 - DNA, 25 bp, E. coli
gctgtatttgccgtctgttccgtgg

SEQ ID NO: 138995 - DNA, 25 bp, E. coli
cgcttaatgtgcttgatgacaaaaa

SEQ ID NO: 138996 - DNA, 25 bp, E. coli
cgcttaatgtgcatgatgacaaaaa

SEQ ID NO: 138997 - DNA, 25 bp, E. coli
ctgtatttgcccactgttccgtggt

SEQ ID NO: 138998 - DNA, 25 bp, E. coli
ctgtatttgccctctgttccgtggt

SEQ ID NO: 138999 - DNA, 25 bp, E. coli
cttaatgtgcttgatgacaaaaact

SEQ ID NO: 139000 - DNA, 25 bp, E. coli
cttaatgtgcttcatgacaaaaact

SEQ ID NO: 139001 - DNA, 25 bp, E. coli
gtgcttgatgacaaaaactacaccc

SEQ ID NO: 139002 - DNA, 25 bp, E. coli
gtgcttgatgactaaaactacaccc

SEQ ID NO: 139003 - DNA, 25 bp, E. coli
tcaccgctgtatttgccctctgttc

SEQ ID NO: 139004 - DNA, 25 bp, E. coli
taatgtgcttgaagacaaaaactac

SEQ ID NO: 139005 - DNA, 25 bp, E. coli
tcaccgctgtatatgccctctgttc

SEQ ID NO: 139006 - DNA, 25 bp, E. coli
taatgtgcttgatgacaaaaactac

SEQ ID NO: 139007 - DNA, 25 bp, E. coli
caaagccgtgggatatctgcgtgcg

SEQ ID NO: 139008 - DNA, 25 bp, E. coli
caaagccgtgggttatctgcgtgcg

SEQ ID NO: 139009 - DNA, 25 bp, E. coli
taaatggttccggtcgacgtgagcg

SEQ ID NO: 139010 - DNA, 25 bp, E. coli
taaatggttccgctcgacgtgagcg

SEQ ID NO: 139011 - DNA, 25 bp, E. coli
tatattctggcactgaccgatctgg

SEQ ID NO: 139012 - DNA, 25 bp, E. coli
tatattctggcagtgaccgatctgg

SEQ ID NO: 139013 - DNA, 25 bp, E. coli
ttcacggtttcagtgcgggagcaaa

SEQ ID NO: 139014 - DNA, 25 bp, E. coli
ttatcgtctgggacagggctcaacg

SEQ ID NO: 139015 - DNA, 25 bp, E. coli
ttatcgtctgggtcagggctcaacg

SEQ ID NO: 139016 - DNA, 25 bp, E. coli
ttcacggtttcactgcgggagcaaa

SEQ ID NO: 139017 - DNA, 25 bp, E. coli
tctggcaaaaacgaagccgggtatg

SEQ ID NO: 139018 - DNA, 25 bp, E. coli
tctttggtcacgcactgctgctggc

SEQ ID NO: 139019 - DNA, 25 bp, E. coli
tctttggtcacggactgctgctggc

SEQ ID NO: 139020 - DNA, 25 bp, E. coli
tctggcaaaaaccaagccgggtatg

SEQ ID NO: 139021 - DNA, 25 bp, E. coli
gcggcggtcgctatcggtacttcta

SEQ ID NO: 139022 - DNA, 25 bp, E. coli
gcggcggtcgctttcggtacttcta

SEQ ID NO: 139023 - DNA, 25 bp, E. coli
gcaatcccggtgattctcgcgcaaa

SEQ ID NO: 139024 - DNA, 25 bp, E. coli
gcaatcccggtgtttctcgcgcaaa

SEQ ID NO: 139025 - DNA, 25 bp, E. coli
gacaatcccgagcttgtaacgctgg

SEQ ID NO: 139026 - DNA, 25 bp, E. coli
gacaatcccgaggttgtaacgctgg

SEQ ID NO: 139027 - DNA, 25 bp, E. coli
ggtacttctatctggcttccggcga

SEQ ID NO: 139028 - DNA, 25 bp, E. coli
ggtacttctatcaggcttccggcga

SEQ ID NO: 139029 - DNA, 25 bp, E. coli
caacgattatctggtgtaaacgaca

SEQ ID NO: 139030 - DNA, 25 bp, E. coli
cacatatctgttctactcgcttggt

SEQ ID NO: 139031 - DNA, 25 bp, E. coli
cacatatctgttgtactcgcttggt

SEQ ID NO: 139032 - DNA, 25 bp, E. coli
caacgattatctcgtgtaaacgaca

SEQ ID NO: 139033 - DNA, 25 bp, E. coli
catggatgttatcgcgatagccaca

SEQ ID NO: 139034 - DNA, 25 bp, E. coli
catggatgttatggcgatagccaca

SEQ ID NO: 139035 - DNA, 25 bp, E. coli
ctcgcttggtaaaggtcgtatccct

SEQ ID NO: 139036 - DNA, 25 bp, E. coli
acttaaggatatcggtgttgaaggc

SEQ ID NO: 139037 - DNA, 25 bp, E. coli
ctcgcttggtaatggtcgtatccct

SEQ ID NO: 139038 - DNA, 25 bp, E. coli
acttaaggatatgggtgttgaaggc

SEQ ID NO: 139039 - DNA, 25 bp, E. coli
tatgcgttttgcaaccgtaagctgc

SEQ ID NO: 139040 - DNA, 25 bp, E. coli
tatgcgttttgctaccgtaagctgc

SEQ ID NO: 139041 - DNA, 25 bp, E. coli
tatcttctcagaggtcacaaaagtg

SEQ ID NO: 139042 - DNA, 25 bp, E. coli
tatcttctcagacgtcacaaaagtg

SEQ ID NO: 139043 - DNA, 25 bp, E. coli
ttttacgcttatccagtcgccactg

SEQ ID NO: 139044 - DNA, 25 bp, E. coli
ttttacgcttatgcagtcgccactg

SEQ ID NO: 139045 - DNA, 25 bp, E. coli
cgattcaggaagttatgcgttttgc

SEQ ID NO: 139046 - DNA, 25 bp, E. coli
cgattcaggaagatatgcgttttgc

SEQ ID NO: 139047 - DNA, 25 bp, E. coli
cgtaagctgctcaatctccgtaata

SEQ ID NO: 139048 - DNA, 25 bp, E. coli
cgtaagctgctctatctccgtaata

SEQ ID NO: 139049 - DNA, 25 bp, E. coli
gtcgccactgtttcgctacaaatag

SEQ ID NO: 139050 - DNA, 25 bp, E. coli
gtcgccactgttacgctacaaatag

SEQ ID NO: 139051 - DNA, 25 bp, E. coli
caaccaataaactgcaagcctgcgg

SEQ ID NO: 139052 - DNA, 25 bp, E. coli
caaccaataaacagcaagcctgcgg

SEQ ID NO: 139053 - DNA, 25 bp, E. coli
cggtggcggtgggttactcaccatt

SEQ ID NO: 139054 - DNA, 25 bp, E. coli
cggtggcggtggcttactcaccatt

SEQ ID NO: 139055 - DNA, 25 bp, E. coli
tatcgactcgattgccggtggcggt

SEQ ID NO: 139056 - DNA, 25 bp, E. coli
tatcgactcgatagccggtggcggt

SEQ ID NO: 139057 - DNA, 25 bp, E. coli
taatagcctgtttatggtttccccg

SEQ ID NO: 139058 - DNA, 25 bp, E. coli
taatagcctgttaatggtttccccg

SEQ ID NO: 139059 - DNA, 25 bp, E. coli
tcggcggtgatgagtgccaaattac

SEQ ID NO: 139060 - DNA, 25 bp, E. coli
tcggcggtgatgtgtgccaaattac

SEQ ID NO: 139061 - DNA, 25 bp, E. coli
gccatgacctttgtcggctcaatga

SEQ ID NO: 139062 - DNA, 25 bp, E. coli
gccatgacctttctcggctcaatga

SEQ ID NO: 139063 - DNA, 25 bp, E. coli
cctttgtcggctcaatgagcggcgc

SEQ ID NO: 139064 - DNA, 25 bp, E. coli
cctttgtcggctgaatgagcggcgc

SEQ ID NO: 139065 - DNA, 25 bp, E. coli
gacaggagatcctccactggttggg

SEQ ID NO: 139066 - DNA, 25 bp, E. coli
gacaggagatccaccactggttggg

SEQ ID NO: 139067 - DNA, 25 bp, E. coli
gactggtgttgaccaaaggacaaaa

SEQ ID NO: 139068 - DNA, 25 bp, E. coli
gactggtgttgagcaaaggacaaaa

SEQ ID NO: 139069 - DNA, 25 bp, E. coli
gggttactcaccattccggcattga

SEQ ID NO: 139070 - DNA, 25 bp, E. coli
gggttactcacctttccggcattga

SEQ ID NO: 139071 - DNA, 25 bp, E. coli
ggagttctctttattgtcgccatgc

SEQ ID NO: 139072 - DNA, 25 bp, E. coli
ggagttctcttttttgtcgccatgc

SEQ ID NO: 139073 - DNA, 25 bp, E. coli
caactttaaggacttctgggagcaa

SEQ ID NO: 139074 - DNA, 25 bp, E. coli
caactttaaggagttctgggagcaa

SEQ ID NO: 139075 - DNA, 25 bp, E. coli
tacgtggtcagcaagccgttaagcc

SEQ ID NO: 139076 - DNA, 25 bp, E. coli
tacgtggtcagctagccgttaagcc

SEQ ID NO: 139077 - DNA, 25 bp, E. coli
tagggccaaaacagcgtcagggcga

SEQ ID NO: 139078 - DNA, 25 bp, E. coli
tagggccaaaactgcgtcagggcga

SEQ ID NO: 139079 - DNA, 25 bp, E. coli
tataagcagcagttgatgggatccc

SEQ ID NO: 139080 - DNA, 25 bp, E. coli
tataagcagcagatgatgggatccc

SEQ ID NO: 139081 - DNA, 25 bp, E. coli
tcttcaaggaagtacgtacgctcga

SEQ ID NO: 139082 - DNA, 25 bp, E. coli
tcttcaaggaagaacgtacgctcga

SEQ ID NO: 139083 - DNA, 25 bp, E. coli
gaagggttttattgcgtccagcgta

SEQ ID NO: 139084 - DNA, 25 bp, E. coli
gaagggttttatagcgtccagcgta

SEQ ID NO: 139085 - DNA, 25 bp, E. coli
gacagccgttacaacaaagcgatta

SEQ ID NO: 139086 - DNA, 25 bp, E. coli
gacagccgttactacaaagcgatta

SEQ ID NO: 139087 - DNA, 25 bp, E. coli
gattgtgtttccatcggctgctacg

SEQ ID NO: 139088 - DNA, 25 bp, E. coli
gatctctacgtctaaatgggcgagc

SEQ ID NO: 139089 - DNA, 25 bp, E. coli
gattgtgtttccttcggctgctacg

SEQ ID NO: 139090 - DNA, 25 bp, E. coli
tactttgagcaatcccgtaagccac

SEQ ID NO: 139091 - DNA, 25 bp, E. coli
taatcagttaaaaccagacagccgt

SEQ ID NO: 139092 - DNA, 25 bp, E. coli
tactttgagcaaacccgtaagccac

SEQ ID NO: 139093 - DNA, 25 bp, E. coli
taatcagttaaatccagacagccgt

SEQ ID NO: 139094 - DNA, 25 bp, E. coli
gatctctacgtcaaaatgggcgagc

SEQ ID NO: 139095 - DNA, 25 bp, E. coli
tgattcagtactactcccgccgtga

SEQ ID NO: 139096 - DNA, 25 bp, E. coli
tggtgcacttcacgctaaaactcga

SEQ ID NO: 139097 - DNA, 25 bp, E. coli
tgattcagtacttctcccgccgtga

SEQ ID NO: 139098 - DNA, 25 bp, E. coli
tggtgcacttcaggctaaaactcga

SEQ ID NO: 139099 - DNA, 25 bp, E. coli
tgcaggcgagcctgaaattggcgca

SEQ ID NO: 139100 - DNA, 25 bp, E. coli
tgcaggcgagccagaaattggcgca

SEQ ID NO: 139101 - DNA, 25 bp, E. coli
tgcctggcgtgatccgcgaaattaa

SEQ ID NO: 139102 - DNA, 25 bp, E. coli
tgccgtcaccggtcctgattcagta

SEQ ID NO: 139103 - DNA, 25 bp, E. coli
tgccgtcaccggacctgattcagta

SEQ ID NO: 139104 - DNA, 25 bp, E. coli
tgcctggcgtgaaccgcgaaattaa

SEQ ID NO: 139105 - DNA, 25 bp, E. coli
ccgggcagaccgttcattttgatat

SEQ ID NO: 139106 - DNA, 25 bp, E. coli
ccgggcagaccgatcattttgatat

SEQ ID NO: 139107 - DNA, 25 bp, E. coli
gctaaaactcgaggatggcaccacc

SEQ ID NO: 139108 - DNA, 25 bp, E. coli
gctttttaccgctatggatggcagt

SEQ ID NO: 139109 - DNA, 25 bp, E. coli
gctttttaccgcaatggatggcagt

SEQ ID NO: 139110 - DNA, 25 bp, E. coli
gctaaaactcgacgatggcaccacc

SEQ ID NO: 139111 - DNA, 25 bp, E. coli
gcaatagcgccgacctggtgcactt

SEQ ID NO: 139112 - DNA, 25 bp, E. coli
gaatctgtacagtgcaatagcgccg

SEQ ID NO: 139113 - DNA, 25 bp, E. coli
gaatctgtacagagcaatagcgccg

SEQ ID NO: 139114 - DNA, 25 bp, E. coli
gcaatagcgccgtcctggtgcactt

SEQ ID NO: 139115 - DNA, 25 bp, E. coli
gatttcaaccatccgctggccgggc

SEQ ID NO: 139116 - DNA, 25 bp, E. coli
gatttcaaccatgcgctggccgggc

SEQ ID NO: 139117 - DNA, 25 bp, E. coli
caaaaagcaacattaggtggagtga

SEQ ID NO: 139118 - DNA, 25 bp, E. coli
caaaaagcaacaataggtggagtga

SEQ ID NO: 139119 - DNA, 25 bp, E. coli
tacctgtatttggagaagaagatct

SEQ ID NO: 139120 - DNA, 25 bp, E. coli
tacctgtatttgcagaagaagatct

SEQ ID NO: 139121 - DNA, 25 bp, E. coli
tgtcaaaatccggaacagttctcga

SEQ ID NO: 139122 - DNA, 25 bp, E. coli
tgtcaaaatccgcaacagttctcga

SEQ ID NO: 139123 - DNA, 25 bp, E. coli
tcatcgttcaaatgccaaatggaga

SEQ ID NO: 139124 - DNA, 25 bp, E. coli
tcatcgttcaaaagccaaatggaga

SEQ ID NO: 139125 - DNA, 25 bp, E. coli
gacattaggattaccagcctggata

SEQ ID NO: 139126 - DNA, 25 bp, E. coli
gacattaggatttccagcctggata

SEQ ID NO: 139127 - DNA, 25 bp, E. coli
cttctataagatccgaaactgcgag

SEQ ID NO: 139128 - DNA, 25 bp, E. coli
cttctataagatgcgaaactgcgag

SEQ ID NO: 139129 - DNA, 25 bp, E. coli
gatcaattgtacactccagatctgg

SEQ ID NO: 139130 - DNA, 25 bp, E. coli
gatcaattgtactctccagatctgg

SEQ ID NO: 139131 - DNA, 25 bp, E. coli
ggataccgctacacaaattctgtca

SEQ ID NO: 139132 - DNA, 25 bp, E. coli
ggataccgctactcaaattctgtca

SEQ ID NO: 139133 - DNA, 25 bp, E. coli
taagaatctcatgctcgcatttgca

SEQ ID NO: 139134 - DNA, 25 bp, E. coli
taagaatctcatcctcgcatttgca

SEQ ID NO: 139135 - DNA, 25 bp, E. coli
gatcgcttcatcctggaagatggaa

SEQ ID NO: 139136 - DNA, 25 bp, E. coli
gagtgacatttattcgtcgtccaac

SEQ ID NO: 139137 - DNA, 25 bp, E. coli
gatcgcttcatcgtggaagatggaa

SEQ ID NO: 139138 - DNA, 25 bp, E. coli
gagtgacatttaatcgtcgtccaac

SEQ ID NO: 139139 - DNA, 25 bp, E. coli
aaaatcggcaaatggtgacgcggcg

SEQ ID NO: 139140 - DNA, 25 bp, E. coli
aaaacgaaaattagcgctggcgctc

SEQ ID NO: 139141 - DNA, 25 bp, E. coli
aaaatcggcaaaaggtgacgcggcg

SEQ ID NO: 139142 - DNA, 25 bp, E. coli
aacattaataccgaccccaggctgg

SEQ ID NO: 139143 - DNA, 25 bp, E. coli
aacattaatacccaccccaggctgg

SEQ ID NO: 139144 - DNA, 25 bp, E. coli
aaaacgaaaatttgcgctggcgctc

SEQ ID NO: 139145 - DNA, 25 bp, E. coli
ttcccgatccggagaaagcgatggg

SEQ ID NO: 139146 - DNA, 25 bp, E. coli
ttcccgatccggtgaaagcgatggg

SEQ ID NO: 139147 - DNA, 25 bp, E. coli
tgacgcggcgaaaaaagcggctaac

SEQ ID NO: 139148 - DNA, 25 bp, E. coli
tgacgcggcgaataaagcggctaac

SEQ ID NO: 139149 - DNA, 25 bp, E. coli
tcgcagctggcaaaagatccggagg

SEQ ID NO: 139150 - DNA, 25 bp, E. coli
tcgcagctggcataagatccggagg

SEQ ID NO: 139151 - DNA, 25 bp, E. coli
gctgcaataccacagccggacgaaa

SEQ ID NO: 139152 - DNA, 25 bp, E. coli
gctggcgctcatctccgggaaaaac

SEQ ID NO: 139153 - DNA, 25 bp, E. coli
gctgcaataccagagccggacgaaa

SEQ ID NO: 139154 - DNA, 25 bp, E. coli
gctggcgctcatgtccgggaaaaac

SEQ ID NO: 139155 - DNA, 25 bp, E. coli
ccccgcctggtgctgaataatgata

SEQ ID NO: 139156 - DNA, 25 bp, E. coli
ccggaggtgcttccgtttatagccc

SEQ ID NO: 139157 - DNA, 25 bp, E. coli
ccccgcctggtggtgaataatgata

SEQ ID NO: 139158 - DNA, 25 bp, E. coli
ccggaggtgcttgcgtttatagccc

SEQ ID NO: 139159 - DNA, 25 bp, E. coli
ggcgtcttctggtggagaacattaa

SEQ ID NO: 139160 - DNA, 25 bp, E. coli
ggcgtcttctggaggagaacattaa

SEQ ID NO: 139161 - DNA, 25 bp, E. coli
attgagctggatcgcgtaacgtatc

SEQ ID NO: 139162 - DNA, 25 bp, E. coli
attgagctggatggcgtaacgtatc

SEQ ID NO: 139163 - DNA, 25 bp, E. coli
aaatcgcacccgatctatacaggga

SEQ ID NO: 139164 - DNA, 25 bp, E. coli
aaaacagaccgtcagattgagctgg

SEQ ID NO: 139165 - DNA, 25 bp, E. coli
aaaacagaccgtgagattgagctgg

SEQ ID NO: 139166 - DNA, 25 bp, E. coli
aaatcgcacccgttctatacaggga

SEQ ID NO: 139167 - DNA, 25 bp, E. coli
tggtcgttttgtaagcacgaaaaag

SEQ ID NO: 139168 - DNA, 25 bp, E. coli
tggtcgttttgttagcacgaaaaag

SEQ ID NO: 139169 - DNA, 25 bp, E. coli
tgagaacagtgggatcagaaggaaa

SEQ ID NO: 139170 - DNA, 25 bp, E. coli
tgagaacagtggcatcagaaggaaa

SEQ ID NO: 139171 - DNA, 25 bp, E. coli
tctatacagggatgctgagaacagt

SEQ ID NO: 139172 - DNA, 25 bp, E. coli
tctatacagggaagctgagaacagt

SEQ ID NO: 139173 - DNA, 25 bp, E. coli
cccaatatccatcctgagtatcgta

SEQ ID NO: 139174 - DNA, 25 bp, E. coli
cccaatatccatgctgagtatcgta

SEQ ID NO: 139175 - DNA, 25 bp, E. coli
ggctcgactatctaaacagaccgtg

SEQ ID NO: 139176 - DNA, 25 bp, E. coli
tggcatcagaagcaaatgttgcacg

SEQ ID NO: 139177 - DNA, 25 bp, E. coli
tggcatcagaaggaaatgttgcacg

SEQ ID NO: 139178 - DNA, 25 bp, E. coli
ggctcgactatcaaaacagaccgtg

SEQ ID NO: 139179 - DNA, 25 bp, E. coli
gagtatcgtactctggtgttccacg

SEQ ID NO: 139180 - DNA, 25 bp, E. coli
gatgagtactttaaaatcggctcga

SEQ ID NO: 139181 - DNA, 25 bp, E. coli
gatgagtacttttaaatcggctcga

SEQ ID NO: 139182 - DNA, 25 bp, E. coli
gagtatcgtactgtggtgttccacg

SEQ ID NO: 139183 - DNA, 25 bp, E. coli
cagcgctggaaagtcgtaaaggtga

SEQ ID NO: 139184 - DNA, 25 bp, E. coli
cagcgctggaaactcgtaaaggtga

SEQ ID NO: 139185 - DNA, 25 bp, E. coli
ctggaaagtcgtaaaggtgagcacc

SEQ ID NO: 139186 - DNA, 25 bp, E. coli
ctggaaagtcgttaaggtgagcacc

SEQ ID NO: 139187 - DNA, 25 bp, E. coli
acgattttgacaccgctggaaagtc

SEQ ID NO: 139188 - DNA, 25 bp, E. coli
acagcgctggaaagtcgtaaaggtg

SEQ ID NO: 139189 - DNA, 25 bp, E. coli
acgattttgacagcgctggaaagtc

SEQ ID NO: 139190 - DNA, 25 bp, E. coli
acagcgctggaatgtcgtaaaggtg

SEQ ID NO: 139191 - DNA, 25 bp, E. coli
aacgattttgactgcgctggaaagt

SEQ ID NO: 139192 - DNA, 25 bp, E. coli
aacgattttgacagcgctggaaagt

SEQ ID NO: 139193 - DNA, 25 bp, E. coli
ttttgacagcgctggaaagtcgtaa

SEQ ID NO: 139194 - DNA, 25 bp, E. coli
ttgacagcgctggaaagtcgtaaag

SEQ ID NO: 139195 - DNA, 25 bp, E. coli
ttgacagcgctgcaaagtcgtaaag

SEQ ID NO: 139196 - DNA, 25 bp, E. coli
ttttgacagcgcaggaaagtcgtaa

SEQ ID NO: 139197 - DNA, 25 bp, E. coli
tgacagcgctggaaagtcgtaaagg

SEQ ID NO: 139198 - DNA, 25 bp, E. coli
tgacagcgctggtaagtcgtaaagg

SEQ ID NO: 139199 - DNA, 25 bp, E. coli
cgctggaaagtcgtaaaggtgagca

SEQ ID NO: 139200 - DNA, 25 bp, E. coli
cgctggaaagtcctaaaggtgagca

SEQ ID NO: 139201 - DNA, 25 bp, E. coli
ggaaagtcgtaaaggtgagcaccca

SEQ ID NO: 139202 - DNA, 25 bp, E. coli
tggaaagtcgtataggtgagcaccc

SEQ ID NO: 139203 - DNA, 25 bp, E. coli
tggaaagtcgtaaaggtgagcaccc

SEQ ID NO: 139204 - DNA, 25 bp, E. coli
ggaaagtcgtaatggtgagcaccca

SEQ ID NO: 139205 - DNA, 25 bp, E. coli
aagatcacctaaggccgcttttttg

SEQ ID NO: 139206 - DNA, 25 bp, E. coli
cataagtttcttgtttttgtccatg

SEQ ID NO: 139207 - DNA, 25 bp, E. coli
cataagtttcttctttttgtccatg

SEQ ID NO: 139208 - DNA, 25 bp, E. coli
aagatcacctaacgccgcttttttg

SEQ ID NO: 139209 - DNA, 25 bp, E. coli
tatttaaaatatacaatcaacatgc

SEQ ID NO: 139210 - DNA, 25 bp, E. coli
tatttcttctgtgataagtttcttg

SEQ ID NO: 139211 - DNA, 25 bp, E. coli
tttgtccatgtttatatctcctcac

SEQ ID NO: 139212 - DNA, 25 bp, E. coli
tattgctggcttgttcgataaccat

SEQ ID NO: 139213 - DNA, 25 bp, E. coli
tatttaaaatattcaatcaacatgc

SEQ ID NO: 139214 - DNA, 25 bp, E. coli
tttgtccatgttaatatctcctcac

SEQ ID NO: 139215 - DNA, 25 bp, E. coli
tatttcttctgtcataagtttcttg

SEQ ID NO: 139216 - DNA, 25 bp, E. coli
tattgctggcttcttcgataaccat

SEQ ID NO: 139217 - DNA, 25 bp, E. coli
tcagggaaagatcacctaacgccgc

SEQ ID NO: 139218 - DNA, 25 bp, E. coli
taatagcttgtataataattcctta

SEQ ID NO: 139219 - DNA, 25 bp, E. coli
tcagggaaagatgacctaacgccgc

SEQ ID NO: 139220 - DNA, 25 bp, E. coli
taatagcttgtaaaataattcctta

SEQ ID NO: 139221 - DNA, 25 bp, E. coli
ggcttgttcgattaccattcatttt

SEQ ID NO: 139222 - DNA, 25 bp, E. coli
ggcttgttcgataaccattcatttt

SEQ ID NO: 139223 - DNA, 25 bp, E. coli
taataaggttattattgctggcttg

SEQ ID NO: 139224 - DNA, 25 bp, E. coli
taatatctcctcacctcagggaaag

SEQ ID NO: 139225 - DNA, 25 bp, E. coli
taataaggttataattgctggcttg

SEQ ID NO: 139226 - DNA, 25 bp, E. coli
taatatctcctctcctcagggaaag

SEQ ID NO: 139227 - DNA, 25 bp, E. coli
aataggcgtattgggtagcttggtg

SEQ ID NO: 139228 - DNA, 25 bp, E. coli
caataggcgtatagggtagcttggt

SEQ ID NO: 139229 - DNA, 25 bp, E. coli
caataggcgtattgggtagcttggt

SEQ ID NO: 139230 - DNA, 25 bp, E. coli
aataggcgtattcggtagcttggtg

SEQ ID NO: 139231 - DNA, 25 bp, E. coli
cttggtgtttggcttgctgacgtat

SEQ ID NO: 139232 - DNA, 25 bp, E. coli
cttggtgtttgggttgctgacgtat

SEQ ID NO: 139233 - DNA, 25 bp, E. coli
agcttggtgtttggcttgctgacgt

SEQ ID NO: 139234 - DNA, 25 bp, E. coli
agcttggtgtttcgcttgctgacgt

SEQ ID NO: 139235 - DNA, 25 bp, E. coli
tagcttggtgtttggcttgctgacg

SEQ ID NO: 139236 - DNA, 25 bp, E. coli
tagcttggtgttaggcttgctgacg

SEQ ID NO: 139237 - DNA, 25 bp, E. coli
taggcgtattggctagcttggtgtt

SEQ ID NO: 139238 - DNA, 25 bp, E. coli
taggcgtattgggtagcttggtgtt

SEQ ID NO: 139239 - DNA, 25 bp, E. coli
tattgggtagctaggtgtttggctt

SEQ ID NO: 139240 - DNA, 25 bp, E. coli
tattgggtagcttggtgtttggctt

SEQ ID NO: 139241 - DNA, 25 bp, E. coli
cgtattgggtagcttggtgtttggc

SEQ ID NO: 139242 - DNA, 25 bp, E. coli
cgtattgggtaggttggtgtttggc

SEQ ID NO: 139243 - DNA, 25 bp, E. coli
gtagcttggtgtttggcttgctgac

SEQ ID NO: 139244 - DNA, 25 bp, E. coli
ggcgtattgggtagcttggtgtttg

SEQ ID NO: 139245 - DNA, 25 bp, E. coli
gtagcttggtgtatggcttgctgac

SEQ ID NO: 139246 - DNA, 25 bp, E. coli
ggcgtattgggttgcttggtgtttg

SEQ ID NO: 139247 - DNA, 25 bp, E. coli
tggcaataggcgtattgggtagctt

SEQ ID NO: 139248 - DNA, 25 bp, E. coli
tggcaataggcgaattgggtagctt

SEQ ID NO: 139249 - DNA, 25 bp, E. coli
catgcgtccagataagtcattgtaa

SEQ ID NO: 139250 - DNA, 25 bp, E. coli
catgcgtccagaaaagtcattgtaa

SEQ ID NO: 139251 - DNA, 25 bp, E. coli
tatcgcctttggcattattatcgac

SEQ ID NO: 139252 - DNA, 25 bp, E. coli
tatcgcctttgggattattatcgac

SEQ ID NO: 139253 - DNA, 25 bp, E. coli
tattatcgacaatacaggcaactgg

SEQ ID NO: 139254 - DNA, 25 bp, E. coli
tattatcgacaaaacaggcaactgg

SEQ ID NO: 139255 - DNA, 25 bp, E. coli
tgttattggtattttcctgacgttc

SEQ ID NO: 139256 - DNA, 25 bp, E. coli
tgttattggtatattcctgacgttc

SEQ ID NO: 139257 - DNA, 25 bp, E. coli
tctacggttccgacgcattgcttgt

SEQ ID NO: 139258 - DNA, 25 bp, E. coli
tctacggttccgtcgcattgcttgt

SEQ ID NO: 139259 - DNA, 25 bp, E. coli
ccgtcgcattgcatgttattggtat

SEQ ID NO: 139260 - DNA, 25 bp, E. coli
ccgtcgcattgcttgttattggtat

SEQ ID NO: 139261 - DNA, 25 bp, E. coli
gcaactggagtttaccattctacgg

SEQ ID NO: 139262 - DNA, 25 bp, E. coli
gcaactggagttaaccattctacgg

SEQ ID NO: 139263 - DNA, 25 bp, E. coli
cgacaaaacaggcaactggagttta

SEQ ID NO: 139264 - DNA, 25 bp, E. coli
cgacaaaacagggaactggagttta

SEQ ID NO: 139265 - DNA, 25 bp, E. coli
ggtatattcctgtcgttcttcatgc

SEQ ID NO: 139266 - DNA, 25 bp, E. coli
ggtatattcctgacgttcttcatgc

SEQ ID NO: 139267 - DNA, 25 bp, E. coli
tggagtttaccattctacggttccg

SEQ ID NO: 139268 - DNA, 25 bp, E. coli
tggagtttaccaatctacggttccg

SEQ ID NO: 139269 - DNA, 25 bp, E. coli
gacgttcttcatccgtccagataag

SEQ ID NO: 139270 - DNA, 25 bp, E. coli
gacgttcttcatgcgtccagataag

SEQ ID NO: 139271 - DNA, 25 bp, E. coli
aatttaggcccatggagattgcgca

SEQ ID NO: 139272 - DNA, 25 bp, E. coli
aatttaggcccaaggagattgcgca

SEQ ID NO: 139273 - DNA, 25 bp, E. coli
tagctacagcgttccgttctccagt

SEQ ID NO: 139274 - DNA, 25 bp, E. coli
tagctacagcgtaccgttctccagt

SEQ ID NO: 139275 - DNA, 25 bp, E. coli
aacagtggcgttaatttaggcccat

SEQ ID NO: 139276 - DNA, 25 bp, E. coli
aacagtggcgtttatttaggcccat

SEQ ID NO: 139277 - DNA, 25 bp, E. coli
tattttctgaatttaaacagtggcg

SEQ ID NO: 139278 - DNA, 25 bp, E. coli
tattttctgaatataaacagtggcg

SEQ ID NO: 139279 - DNA, 25 bp, E. coli
tgttaatactgatgcgtttccggct

SEQ ID NO: 139280 - DNA, 25 bp, E. coli
tgttaatactgaagcgtttccggct

SEQ ID NO: 139281 - DNA, 25 bp, E. coli
tgcaatgggtgtaaatactgatgcg

SEQ ID NO: 139282 - DNA, 25 bp, E. coli
tgcaatgggtgttaatactgatgcg

SEQ ID NO: 139283 - DNA, 25 bp, E. coli
tctggcgacagcaattttctgaatt

SEQ ID NO: 139284 - DNA, 25 bp, E. coli
tctggcgacagctattttctgaatt

SEQ ID NO: 139285 - DNA, 25 bp, E. coli
gctctaaattttaccctgccgctca

SEQ ID NO: 139286 - DNA, 25 bp, E. coli
gctctaaatttttccctgccgctca

SEQ ID NO: 139287 - DNA, 25 bp, E. coli
gcgtaccgttctccagtgtgccatt

SEQ ID NO: 139288 - DNA, 25 bp, E. coli
gcgtaccgttctgcagtgtgccatt

SEQ ID NO: 139289 - DNA, 25 bp, E. coli
cccatggagattgcgcaacaattca

SEQ ID NO: 139290 - DNA, 25 bp, E. coli
cccatggagattccgcaacaattca

SEQ ID NO: 139291 - DNA, 25 bp, E. coli
gttctccagtgtcccattactccag

SEQ ID NO: 139292 - DNA, 25 bp, E. coli
gttctccagtgtgccattactccag

SEQ ID NO: 139293 - DNA, 25 bp, E. coli
acagtctccggccgcaggcttcaat

SEQ ID NO: 139294 - DNA, 25 bp, E. coli
acagtctccggcggcaggcttcaat

SEQ ID NO: 139295 - DNA, 25 bp, E. coli
ttttctgagcacagtctccggcggc

SEQ ID NO: 139296 - DNA, 25 bp, E. coli
ttttctgagcactgtctccggcggc

SEQ ID NO: 139297 - DNA, 25 bp, E. coli
tcactcttttctttgtttgcttcag

SEQ ID NO: 139298 - DNA, 25 bp, E. coli
tctgagcaattcagtaatgtcactc

SEQ ID NO: 139299 - DNA, 25 bp, E. coli
tcttttttctgagcacagtctccgg

SEQ ID NO: 139300 - DNA, 25 bp, E. coli
tctggtctgaccagttttctgagca

SEQ ID NO: 139301 - DNA, 25 bp, E. coli
tcttttttctgaccacagtctccgg

SEQ ID NO: 139302 - DNA, 25 bp, E. coli
tctgagcaattctgtaatgtcactc

SEQ ID NO: 139303 - DNA, 25 bp, E. coli
tctggtctgacctgttttctgagca

SEQ ID NO: 139304 - DNA, 25 bp, E. coli
gcaattcagtaatgtcactcttttc

SEQ ID NO: 139305 - DNA, 25 bp, E. coli
gcaattcagtaaagtcactcttttc

SEQ ID NO: 139306 - DNA, 25 bp, E. coli
gaaactcttttttctgagcacagtc

SEQ ID NO: 139307 - DNA, 25 bp, E. coli
gaaactctttttactgagcacagtc

SEQ ID NO: 139308 - DNA, 25 bp, E. coli
ctgagcacagtcaccggcggcaggc

SEQ ID NO: 139309 - DNA, 25 bp, E. coli
ctgagcacagtctccggcggcaggc

SEQ ID NO: 139310 - DNA, 25 bp, E. coli
ggtctgacctgttttctgagcaatt

SEQ ID NO: 139311 - DNA, 25 bp, E. coli
ggtctgacctgtattctgagcaatt

SEQ ID NO: 139312 - DNA, 25 bp, E. coli
tcactcttttctatgtttgcttcag

SEQ ID NO: 139313 - DNA, 25 bp, E. coli
gacctgttttctgagcaattcagta

SEQ ID NO: 139314 - DNA, 25 bp, E. coli
gacctgttttctcagcaattcagta

SEQ ID NO: 139315 - DNA, 25 bp, E. coli
catctctgatgtgaacgcttccgac

SEQ ID NO: 139316 - DNA, 25 bp, E. coli
catctctgatgtcaacgcttccgac

SEQ ID NO: 139317 - DNA, 25 bp, E. coli
ttaaggtccgtgtagccgctatgcg

SEQ ID NO: 139318 - DNA, 25 bp, E. coli
ttaaggtccgtgaagccgctatgcg

SEQ ID NO: 139319 - DNA, 25 bp, E. coli
tgataaatacttcgcgaaacgcgct

SEQ ID NO: 139320 - DNA, 25 bp, E. coli
tgataaatacttggcgaaacgcgct

SEQ ID NO: 139321 - DNA, 25 bp, E. coli
tccgacgaagatcgttggaacgctg

SEQ ID NO: 139322 - DNA, 25 bp, E. coli
tccgacgaagatggttggaacgctg

SEQ ID NO: 139323 - DNA, 25 bp, E. coli
tcccgggtctgataaaggctagctg

SEQ ID NO: 139324 - DNA, 25 bp, E. coli
tcccgggtctgaaaaaggctagctg

SEQ ID NO: 139325 - DNA, 25 bp, E. coli
ttcctgcggaagatcgggttgagcc

SEQ ID NO: 139326 - DNA, 25 bp, E. coli
ttcctgcggaagttcgggttgagcc

SEQ ID NO: 139327 - DNA, 25 bp, E. coli
gctgaactgaaaccgatcatctctg

SEQ ID NO: 139328 - DNA, 25 bp, E. coli
gctgaactgaaagcgatcatctctg

SEQ ID NO: 139329 - DNA, 25 bp, E. coli
gcaatcaatgaaagcacgcgaagta

SEQ ID NO: 139330 - DNA, 25 bp, E. coli
gcaatcaatgaatgcacgcgaagta

SEQ ID NO: 139331 - DNA, 25 bp, E. coli
cgctatgcgcggtgaaatcccgggt

SEQ ID NO: 139332 - DNA, 25 bp, E. coli
ccgtcaaacaggacgtccgcatggt

SEQ ID NO: 139333 - DNA, 25 bp, E. coli
cgctatgcgcggagaaatcccgggt

SEQ ID NO: 139334 - DNA, 25 bp, E. coli
ccgtcaaacaggtcgtccgcatggt

SEQ ID NO: 139335 - DNA, 25 bp, E. coli
ggaacgctgttctcaagctgcagac

SEQ ID NO: 139336 - DNA, 25 bp, E. coli
ggaacgctgttcacaagctgcagac

SEQ ID NO: 139337 - DNA, 25 bp, E. coli
cagggctgtatattgcgccggatgc

SEQ ID NO: 139338 - DNA, 25 bp, E. coli
cagggctgtataatgcgccggatgc

SEQ ID NO: 139339 - DNA, 25 bp, E. coli
agggctgtatattgcgccggatgca

SEQ ID NO: 139340 - DNA, 25 bp, E. coli
attgcgccggatccagaagtgccag

SEQ ID NO: 139341 - DNA, 25 bp, E. coli
gacgcgggttgtgaatacaaaggtt

SEQ ID NO: 139342 - DNA, 25 bp, E. coli
attgcgccggatgcagaagtgccag

SEQ ID NO: 139343 - DNA, 25 bp, E. coli
agggctgtatatagcgccggatgca

SEQ ID NO: 139344 - DNA, 25 bp, E. coli
gacgcgggttgtcaatacaaaggtt

SEQ ID NO: 139345 - DNA, 25 bp, E. coli
tatattgcgccggatgcagaagtgc

SEQ ID NO: 139346 - DNA, 25 bp, E. coli
tattgcgccggaagcagaagtgcca

SEQ ID NO: 139347 - DNA, 25 bp, E. coli
tatattgcgccgcatgcagaagtgc

SEQ ID NO: 139348 - DNA, 25 bp, E. coli
tattgcgccggatgcagaagtgcca

SEQ ID NO: 139349 - DNA, 25 bp, E. coli
ttgacgcgggttgtgaatacaaagg

SEQ ID NO: 139350 - DNA, 25 bp, E. coli
ttgacgcgggttctgaatacaaagg

SEQ ID NO: 139351 - DNA, 25 bp, E. coli
tgattgacgcgggttgtgaatacaa

SEQ ID NO: 139352 - DNA, 25 bp, E. coli
tgattgacgcggcttgtgaatacaa

SEQ ID NO: 139353 - DNA, 25 bp, E. coli
tgcgccggatgctgaagtgccagaa

SEQ ID NO: 139354 - DNA, 25 bp, E. coli
tgcgccggatgcagaagtgccagaa

SEQ ID NO: 139355 - DNA, 25 bp, E. coli
ccagggctgtatattgcgccggatg

SEQ ID NO: 139356 - DNA, 25 bp, E. coli
ccagggctgtattttgcgccggatg

SEQ ID NO: 139357 - DNA, 25 bp, E. coli
gattgacgcgggatgtgaatacaaa

SEQ ID NO: 139358 - DNA, 25 bp, E. coli
gattgacgcgggttgtgaatacaaa

SEQ ID NO: 139359 - DNA, 25 bp, E. coli
caattttctcgttactcccggcata

SEQ ID NO: 139360 - DNA, 25 bp, E. coli
caattttctcgtaactcccggcata

SEQ ID NO: 139361 - DNA, 25 bp, E. coli
cattcaataatgtagcgtcggttgt

SEQ ID NO: 139362 - DNA, 25 bp, E. coli
cattcaataatgaagcgtcggttgt

SEQ ID NO: 139363 - DNA, 25 bp, E. coli
tatgatgatgatgagtccggtaacc

SEQ ID NO: 139364 - DNA, 25 bp, E. coli
tatgatgatgatcagtccggtaacc

SEQ ID NO: 139365 - DNA, 25 bp, E. coli
tgttattgtccgaaacgcattggga

SEQ ID NO: 139366 - DNA, 25 bp, E. coli
tgtttgtaatgatgccggttgggaa

SEQ ID NO: 139367 - DNA, 25 bp, E. coli
tgtttgtaatgaagccggttgggaa

SEQ ID NO: 139368 - DNA, 25 bp, E. coli
tgttattgtccgtaacgcattggga

SEQ ID NO: 139369 - DNA, 25 bp, E. coli
cgtttataataggatccgggacatg

SEQ ID NO: 139370 - DNA, 25 bp, E. coli
cgcattgggactacagcaagtgcca

SEQ ID NO: 139371 - DNA, 25 bp, E. coli
cccggcatatgccttaagtgagata

SEQ ID NO: 139372 - DNA, 25 bp, E. coli
cccggcatatgcgttaagtgagata

SEQ ID NO: 139373 - DNA, 25 bp, E. coli
cgtttataatagcatccgggacatg

SEQ ID NO: 139374 - DNA, 25 bp, E. coli
cgcattgggacttcagcaagtgcca

SEQ ID NO: 139375 - DNA, 25 bp, E. coli
gataaaatattcagaaccggagttg

SEQ ID NO: 139376 - DNA, 25 bp, E. coli
gataaaatattctgaaccggagttg

SEQ ID NO: 139377 - DNA, 25 bp, E. coli
tcaaatagcattacgctgatagcga

SEQ ID NO: 139378 - DNA, 25 bp, E. coli
taattctgtttgtcgcgatggacgg

SEQ ID NO: 139379 - DNA, 25 bp, E. coli
taattctgtttgacgcgatggacgg

SEQ ID NO: 139380 - DNA, 25 bp, E. coli
tcaaatagcatttcgctgatagcga

SEQ ID NO: 139381 - DNA, 25 bp, E. coli
caatgggtatcagagcggcttctgc

SEQ ID NO: 139382 - DNA, 25 bp, E. coli
caatgggtatcacagcggcttctgc

SEQ ID NO: 139383 - DNA, 25 bp, E. coli
taaaaccggtgttgggaagagcagt

SEQ ID NO: 139384 - DNA, 25 bp, E. coli
taaaaccggtgtagggaagagcagt

SEQ ID NO: 139385 - DNA, 25 bp, E. coli
ataaggccgaacctaccagcggtgg

SEQ ID NO: 139386 - DNA, 25 bp, E. coli
agtcggcgaccggtatataacgctg

SEQ ID NO: 139387 - DNA, 25 bp, E. coli
agtcggcgaccgctatataacgctg

SEQ ID NO: 139388 - DNA, 25 bp, E. coli
ataaggccgaacgtaccagcggtgg

SEQ ID NO: 139389 - DNA, 25 bp, E. coli
tataacgctgatggatctgcccggc

SEQ ID NO: 139390 - DNA, 25 bp, E. coli
tatatcaccggtcagcgatgtggcg

SEQ ID NO: 139391 - DNA, 25 bp, E. coli
tataacgctgatcgatctgcccggc

SEQ ID NO: 139392 - DNA, 25 bp, E. coli
tatatcaccggtgagcgatgtggcg

SEQ ID NO: 139393 - DNA, 25 bp, E. coli
tcctttcgcacgacggtagtccggg

SEQ ID NO: 139394 - DNA, 25 bp, E. coli
tcctttcgcacgtcggtagtccggg

SEQ ID NO: 139395 - DNA, 25 bp, E. coli
gctcgtagcgatattggtgaaaccg

SEQ ID NO: 139396 - DNA, 25 bp, E. coli
gctcgtagcgattttggtgaaaccg

SEQ ID NO: 139397 - DNA, 25 bp, E. coli
gcgctgacggtgcatgaacattttt

SEQ ID NO: 139398 - DNA, 25 bp, E. coli
gcgctgacggtggatgaacattttt

SEQ ID NO: 139399 - DNA, 25 bp, E. coli
gaagagcagtctgtgcaatgccctg

SEQ ID NO: 139400 - DNA, 25 bp, E. coli
gaagagcagtctctgcaatgccctg

SEQ ID NO: 139401 - DNA, 25 bp, E. coli
gattaagtgcctcccacgtgaggcc

SEQ ID NO: 139402 - DNA, 25 bp, E. coli
gattaagtgcctgccacgtgaggcc

SEQ ID NO: 139403 - DNA, 25 bp, E. coli
tacatctatctcagggcacgcgaag

SEQ ID NO: 139404 - DNA, 25 bp, E. coli
tacatctatctctgggcacgcgaag

SEQ ID NO: 139405 - DNA, 25 bp, E. coli
tgaagcggctcgtcagagaaatgcg

SEQ ID NO: 139406 - DNA, 25 bp, E. coli
tgaagcggctcgacagagaaatgcg

SEQ ID NO: 139407 - DNA, 25 bp, E. coli
tcctgacgacgatacctttgcaagt

SEQ ID NO: 139408 - DNA, 25 bp, E. coli
tccaccgcggcagttgaatctggga

SEQ ID NO: 139409 - DNA, 25 bp, E. coli
tcctgacgacgaaacctttgcaagt

SEQ ID NO: 139410 - DNA, 25 bp, E. coli
tccaccgcggcacttgaatctggga

SEQ ID NO: 139411 - DNA, 25 bp, E. coli
gctgcaaaacgtgctgcgtcaggaa

SEQ ID NO: 139412 - DNA, 25 bp, E. coli
gctgcaaaacgtcctgcgtcaggaa

SEQ ID NO: 139413 - DNA, 25 bp, E. coli
gcgtcaggaacaaagcggttacatc

SEQ ID NO: 139414 - DNA, 25 bp, E. coli
gcgtcaggaacatagcggttacatc

SEQ ID NO: 139415 - DNA, 25 bp, E. coli
gaatctgggattaccggatctcgcg

SEQ ID NO: 139416 - DNA, 25 bp, E. coli
gaatctgggatttccggatctcgcg

SEQ ID NO: 139417 - DNA, 25 bp, E. coli
ggataactcctctttactggccgcg

SEQ ID NO: 139418 - DNA, 25 bp, E. coli
ggataactcctcattactggccgcg

SEQ ID NO: 139419 - DNA, 25 bp, E. coli
tggaatcgggcataacacggttgtt

SEQ ID NO: 139420 - DNA, 25 bp, E. coli
tggtttgttccgcaagtgctcgacg

SEQ ID NO: 139421 - DNA, 25 bp, E. coli
tggtttgttccggaagtgctcgacg

SEQ ID NO: 139422 - DNA, 25 bp, E. coli
tggaatcgggcaaaacacggttgtt

SEQ ID NO: 139423 - DNA, 25 bp, E. coli
gatgaagataagttgcaggcgctac

SEQ ID NO: 139424 - DNA, 25 bp, E. coli
gatgaagataagatgcaggcgctac

SEQ ID NO: 139425 - DNA, 25 bp, E. coli
catctgcgtttgtgggcgtttgtca

SEQ ID NO: 139426 - DNA, 25 bp, E. coli
catctgcgtttgagggcgtttgtca

SEQ ID NO: 139427 - DNA, 25 bp, E. coli
catacgctggcgatcttaggtctgg

SEQ ID NO: 139428 - DNA, 25 bp, E. coli
catacgctggcgttcttaggtctgg

SEQ ID NO: 139429 - DNA, 25 bp, E. coli
tatccgtttaaagcgcaagggcgta

SEQ ID NO: 139430 - DNA, 25 bp, E. coli
agatgggctggatccagaccggcct

SEQ ID NO: 139431 - DNA, 25 bp, E. coli
agatgggctggaaccagaccggcct

SEQ ID NO: 139432 - DNA, 25 bp, E. coli
tagcgttttcctggcgttaggcacg

SEQ ID NO: 139433 - DNA, 25 bp, E. coli
tatccgtttaaaccgcaagggcgta

SEQ ID NO: 139434 - DNA, 25 bp, E. coli
tagcgttttcctcgcgttaggcacg

SEQ ID NO: 139435 - DNA, 25 bp, E. coli
tgcagcgtcgcaacagtatctggtt

SEQ ID NO: 139436 - DNA, 25 bp, E. coli
tgcagcgtcgcatcagtatctggtt

SEQ ID NO: 139437 - DNA, 25 bp, E. coli
tcagcggcagcctttattgcctggc

SEQ ID NO: 139438 - DNA, 25 bp, E. coli
gcgcaagggcgtaagtcatgaataa

SEQ ID NO: 139439 - DNA, 25 bp, E. coli
gcgcaagggcgttagtcatgaataa

SEQ ID NO: 139440 - DNA, 25 bp, E. coli
gaataccaggcgattcatacgctgg

SEQ ID NO: 139441 - DNA, 25 bp, E. coli
gaataccaggcgtttcatacgctgg

SEQ ID NO: 139442 - DNA, 25 bp, E. coli
cgatcttaggtctggcggtggcaat

SEQ ID NO: 139443 - DNA, 25 bp, E. coli
cgttaatgttagatggtgctatccg

SEQ ID NO: 139444 - DNA, 25 bp, E. coli
cgttaatgttagttggtgctatccg

SEQ ID NO: 139445 - DNA, 25 bp, E. coli
cgatcttaggtcaggcggtggcaat

SEQ ID NO: 139446 - DNA, 25 bp, E. coli
tcagcggcagccattattgcctggc

SEQ ID NO: 139447 - DNA, 25 bp, E. coli
cagtacgctgctatcgggtgtttcc

SEQ ID NO: 139448 - DNA, 25 bp, E. coli
cagtacgctgctttcgggtgtttcc

SEQ ID NO: 139449 - DNA, 25 bp, E. coli
ttaaactggctgacccacaaacgcg

SEQ ID NO: 139450 - DNA, 25 bp, E. coli
ttaaactggctgtcccacaaacgcg

SEQ ID NO: 139451 - DNA, 25 bp, E. coli
tgcgcggtgcggtcagcattgaact

SEQ ID NO: 139452 - DNA, 25 bp, E. coli
tgcgcggtgcggacagcattgaact

SEQ ID NO: 139453 - DNA, 25 bp, E. coli
ccacgatgatggcagatgacagtac

SEQ ID NO: 139454 - DNA, 25 bp, E. coli
cctggagaatgagcgggaagctaac

SEQ ID NO: 139455 - DNA, 25 bp, E. coli
cctggagaatgaccgggaagctaac

SEQ ID NO: 139456 - DNA, 25 bp, E. coli
ccacgatgatgggagatgacagtac

SEQ ID NO: 139457 - DNA, 25 bp, E. coli
gctataacaaatccgcgaaacgcgc

SEQ ID NO: 139458 - DNA, 25 bp, E. coli
gctataacaaatgcgcgaaacgcgc

SEQ ID NO: 139459 - DNA, 25 bp, E. coli
gaagctaaccatattgatgccgcgc

SEQ ID NO: 139460 - DNA, 25 bp, E. coli
gaagctaaccattttgatgccgcgc

SEQ ID NO: 139461 - DNA, 25 bp, E. coli
ccgcgccgcgccatgaattgttgga

SEQ ID NO: 139462 - DNA, 25 bp, E. coli
ccgcgccgcgccttgaattgttgga

SEQ ID NO: 139463 - DNA, 25 bp, E. coli
ggtgctcacagatcaacggctgaag

SEQ ID NO: 139464 - DNA, 25 bp, E. coli
ggtgctcacagaacaacggctgaag

SEQ ID NO: 139465 - DNA, 25 bp, E. coli
tggaccgcatcagttagtgtttcgc

SEQ ID NO: 139466 - DNA, 25 bp, E. coli
tggaccgcatcacttagtgtttcgc

SEQ ID NO: 139467 - DNA, 25 bp, E. coli
gatgcgacgccgtttccggtaaagc

SEQ ID NO: 139468 - DNA, 25 bp, E. coli
gatgcgacgccgattccggtaaagc

SEQ ID NO: 139469 - DNA, 25 bp, E. coli
caagggcgaaacgatgaaatacatc

SEQ ID NO: 139470 - DNA, 25 bp, E. coli
caagggcgaaaccatgaaatacatc

SEQ ID NO: 139471 - DNA, 25 bp, E. coli
taactcaggccgagacgaactgacc

SEQ ID NO: 139472 - DNA, 25 bp, E. coli
aacaaaaaattcatgcagggcaccg

SEQ ID NO: 139473 - DNA, 25 bp, E. coli
aacaaaaaattcttgcagggcaccg

SEQ ID NO: 139474 - DNA, 25 bp, E. coli
tatgtgcccgtaatgccgtatcgag

SEQ ID NO: 139475 - DNA, 25 bp, E. coli
tatgtgcccgtattgccgtatcgag

SEQ ID NO: 139476 - DNA, 25 bp, E. coli
ttaaaggtgccaataactcaggccg

SEQ ID NO: 139477 - DNA, 25 bp, E. coli
ttcgatcaggaccagaaactggcct

SEQ ID NO: 139478 - DNA, 25 bp, E. coli
ttaaaggtgccattaactcaggccg

SEQ ID NO: 139479 - DNA, 25 bp, E. coli
ttcgatcaggacgagaaactggcct

SEQ ID NO: 139480 - DNA, 25 bp, E. coli
tggtattgccgtagcgaaaagtgac

SEQ ID NO: 139481 - DNA, 25 bp, E. coli
tgaaatacatccaggcgctgaaaga

SEQ ID NO: 139482 - DNA, 25 bp, E. coli
tgaaatacatcctggcgctgaaaga

SEQ ID NO: 139483 - DNA, 25 bp, E. coli
gaaggtcttcgaaaccaatgaggtg

SEQ ID NO: 139484 - DNA, 25 bp, E. coli
gaaggtcttcgataccaatgaggtg

SEQ ID NO: 139485 - DNA, 25 bp, E. coli
gaaagatcagccagaggccgctcag

SEQ ID NO: 139486 - DNA, 25 bp, E. coli
gaaagatcagcctgaggccgctcag

SEQ ID NO: 139487 - DNA, 25 bp, E. coli
tggtattgccgttgcgaaaagtgac

SEQ ID NO: 139488 - DNA, 25 bp, E. coli
taactcaggccgtgacgaactgacc

SEQ ID NO: 139489 - DNA, 25 bp, E. coli
gatcgctatcgccttgggcttcgac

SEQ ID NO: 139490 - DNA, 25 bp, E. coli
gatcgctatcgcgttgggcttcgac

SEQ ID NO: 139491 - DNA, 25 bp, E. coli
agattaccggacattcggcagagca

SEQ ID NO: 139492 - DNA, 25 bp, E. coli
agattaccggactttcggcagagca

SEQ ID NO: 139493 - DNA, 25 bp, E. coli
aaagattaccggactttcggcagag

SEQ ID NO: 139494 - DNA, 25 bp, E. coli
aaagattaccggtctttcggcagag

SEQ ID NO: 139495 - DNA, 25 bp, E. coli
tcctgaatggattcaaaagattacc

SEQ ID NO: 139496 - DNA, 25 bp, E. coli
tcctgaatggatacaaaagattacc

SEQ ID NO: 139497 - DNA, 25 bp, E. coli
tcataatgatggatatataaaaggg

SEQ ID NO: 139498 - DNA, 25 bp, E. coli
tcataatgatggttatataaaaggg

SEQ ID NO: 139499 - DNA, 25 bp, E. coli
cctggtccctgtgctggctggacga

SEQ ID NO: 139500 - DNA, 25 bp, E. coli
cctggtccctgtcctggctggacga

SEQ ID NO: 139501 - DNA, 25 bp, E. coli
gcgaattcataatgatggatatata

SEQ ID NO: 139502 - DNA, 25 bp, E. coli
gcgaattcataaagatggatatata

SEQ ID NO: 139503 - DNA, 25 bp, E. coli
gaatggatacaaaagattaccggac

SEQ ID NO: 139504 - DNA, 25 bp, E. coli
gaatggatacaatagattaccggac

SEQ ID NO: 139505 - DNA, 25 bp, E. coli
ctgaatggatacaaaagattaccgg

SEQ ID NO: 139506 - DNA, 25 bp, E. coli
ctgaatggatactaaagattaccgg

SEQ ID NO: 139507 - DNA, 25 bp, E. coli
gatacaaaagattaccggactttcg

SEQ ID NO: 139508 - DNA, 25 bp, E. coli
gatacaaaagataaccggactttcg

SEQ ID NO: 139509 - DNA, 25 bp, E. coli
ggtccctgtgctggctggacgaatt

SEQ ID NO: 139510 - DNA, 25 bp, E. coli
ggtccctgtgctcgctggacgaatt

SEQ ID NO: 139511 - DNA, 25 bp, E. coli
tggatacaaaagattaccggacttt

SEQ ID NO: 139512 - DNA, 25 bp, E. coli
tggatacaaaagtttaccggacttt

SEQ ID NO: 139513 - DNA, 25 bp, E. coli
catgggtaccaaacatactcctgac

SEQ ID NO: 139514 - DNA, 25 bp, E. coli
cagacgttggcgcagcattgctttg

SEQ ID NO: 139515 - DNA, 25 bp, E. coli
cagacgttggcggagcattgctttg

SEQ ID NO: 139516 - DNA, 25 bp, E. coli
catgggtaccaatcatactcctgac

SEQ ID NO: 139517 - DNA, 25 bp, E. coli
tacccataacaaatgaaaggccagg

SEQ ID NO: 139518 - DNA, 25 bp, E. coli
tacccataacaattgaaaggccagg

SEQ ID NO: 139519 - DNA, 25 bp, E. coli
gcctacgttgaacatgtgccagacg

SEQ ID NO: 139520 - DNA, 25 bp, E. coli
gcctacgttgaagatgtgccagacg

SEQ ID NO: 139521 - DNA, 25 bp, E. coli
gctaaagcgtcatttcgggcctacg

SEQ ID NO: 139522 - DNA, 25 bp, E. coli
gctaaagcgtcaattcgggcctacg

SEQ ID NO: 139523 - DNA, 25 bp, E. coli
gcaatatctctgttcccgattggga

SEQ ID NO: 139524 - DNA, 25 bp, E. coli
gcaatatctctgatcccgattggga

SEQ ID NO: 139525 - DNA, 25 bp, E. coli
ctcttttgtagaatgcccgatgcga

SEQ ID NO: 139526 - DNA, 25 bp, E. coli
cgtttccccgcgataatatgaccaa

SEQ ID NO: 139527 - DNA, 25 bp, E. coli
ctcttttgtagattgcccgatgcga

SEQ ID NO: 139528 - DNA, 25 bp, E. coli
cgtttccccgcgttaatatgaccaa

SEQ ID NO: 139529 - DNA, 25 bp, E. coli
ggtgattctcaatcgccagatgtta

SEQ ID NO: 139530 - DNA, 25 bp, E. coli
gggtatcagtcgtggtgccgcaata

SEQ ID NO: 139531 - DNA, 25 bp, E. coli
ggtgattctcaaacgccagatgtta

SEQ ID NO: 139532 - DNA, 25 bp, E. coli
gggtatcagtcgaggtgccgcaata

SEQ ID NO: 139533 - DNA, 25 bp, E. coli
gatgttacccgtatcattcacatgg

SEQ ID NO: 139534 - DNA, 25 bp, E. coli
gatgttacccgtttcattcacatgg

SEQ ID NO: 139535 - DNA, 25 bp, E. coli
cagtgacagaggatacgctggcgaa

SEQ ID NO: 139536 - DNA, 25 bp, E. coli
cagtgacagaggttacgctggcgaa

SEQ ID NO: 139537 - DNA, 25 bp, E. coli
tagatggcttagtaaccgtgttggc

SEQ ID NO: 139538 - DNA, 25 bp, E. coli
tatgaggtcaacttaatcggcggcg

SEQ ID NO: 139539 - DNA, 25 bp, E. coli
tagatggcttagaaaccgtgttggc

SEQ ID NO: 139540 - DNA, 25 bp, E. coli
tatgaggtcaacataatcggcggcg

SEQ ID NO: 139541 - DNA, 25 bp, E. coli
tgtgtgaaccgctaatcgcgattgt

SEQ ID NO: 139542 - DNA, 25 bp, E. coli
tgtgtgaaccgcaaatcgcgattgt

SEQ ID NO: 139543 - DNA, 25 bp, E. coli
gccagaaattgcgacagcggatgtt

SEQ ID NO: 139544 - DNA, 25 bp, E. coli
gccagaaattgccacagcggatgtt

SEQ ID NO: 139545 - DNA, 25 bp, E. coli
gataactttgttcccggacgtccgg

SEQ ID NO: 139546 - DNA, 25 bp, E. coli
gtgcatttcaccctgcgcatcaggg

SEQ ID NO: 139547 - DNA, 25 bp, E. coli
gtgcatttcaccgtgcgcatcaggg

SEQ ID NO: 139548 - DNA, 25 bp, E. coli
tggcgcatgacagcaagttcgatct

SEQ ID NO: 139549 - DNA, 25 bp, E. coli
tggcgcatgacaccaagttcgatct

SEQ ID NO: 139550 - DNA, 25 bp, E. coli
ggaccgtattgtccccgcagtgaca

SEQ ID NO: 139551 - DNA, 25 bp, E. coli
ggaccgtattgtgcccgcagtgaca

SEQ ID NO: 139552 - DNA, 25 bp, E. coli
tctctgacaatctccgaaaaagggt

SEQ ID NO: 139553 - DNA, 25 bp, E. coli
tctctgacaatcaccgaaaaagggt

SEQ ID NO: 139554 - DNA, 25 bp, E. coli
taatcggcggcgtacagcaaattgc

SEQ ID NO: 139555 - DNA, 25 bp, E. coli
taatcggcggcgaacagcaaattgc

SEQ ID NO: 139556 - DNA, 25 bp, E. coli
gataactttgttgccggacgtccgg

SEQ ID NO: 139557 - DNA, 25 bp, E. coli
taccgcgaggaaaacatagttaaca

SEQ ID NO: 139558 - DNA, 25 bp, E. coli
taccgcgaggaatacatagttaaca

SEQ ID NO: 139559 - DNA, 25 bp, E. coli
tacctcatattaattaccgcgagga

SEQ ID NO: 139560 - DNA, 25 bp, E. coli
tacctcatattatttaccgcgagga

SEQ ID NO: 139561 - DNA, 25 bp, E. coli
tatctcatagcagagaaagtcccta

SEQ ID NO: 139562 - DNA, 25 bp, E. coli
tatctcatagcacagaaagtcccta

SEQ ID NO: 139563 - DNA, 25 bp, E. coli
ttgtagaggcgtgatcagaacatgc

SEQ ID NO: 139564 - DNA, 25 bp, E. coli
ttgtagaggcgtcatcagaacatgc

SEQ ID NO: 139565 - DNA, 25 bp, E. coli
tgcacaaatcattcagcctcaaagc

SEQ ID NO: 139566 - DNA, 25 bp, E. coli
tgcacaaatcatacagcctcaaagc

SEQ ID NO: 139567 - DNA, 25 bp, E. coli
gcaggattaaaaagacataccaccg

SEQ ID NO: 139568 - DNA, 25 bp, E. coli
gcaggattaaaatgacataccaccg

SEQ ID NO: 139569 - DNA, 25 bp, E. coli
gacatacacctcttgttcgatggga

SEQ ID NO: 139570 - DNA, 25 bp, E. coli
gacataccaccgaattcatggagtt

SEQ ID NO: 139571 - DNA, 25 bp, E. coli
gacataccaccgtattcatggagtt

SEQ ID NO: 139572 - DNA, 25 bp, E. coli
gaaaacctatgaaatactggcagga

SEQ ID NO: 139573 - DNA, 25 bp, E. coli
gaaagtccctaatgattgtagaggc

SEQ ID NO: 139574 - DNA, 25 bp, E. coli
gaacatgcctcttcaatcgattaag

SEQ ID NO: 139575 - DNA, 25 bp, E. coli
gaacatgcctctacaatcgattaag

SEQ ID NO: 139576 - DNA, 25 bp, E. coli
gacatacacctcatgttcgatggga

SEQ ID NO: 139577 - DNA, 25 bp, E. coli
gaaagtccctaaagattgtagaggc

SEQ ID NO: 139578 - DNA, 25 bp, E. coli
gaaaacctatgatatactggcagga

SEQ ID NO: 139579 - DNA, 25 bp, E. coli
caataaggttatacggcaggccagc

SEQ ID NO: 139580 - DNA, 25 bp, E. coli
caataaggttattcggcaggccagc

SEQ ID NO: 139581 - DNA, 25 bp, E. coli
caaatcggacggcacggtgaaaacg

SEQ ID NO: 139582 - DNA, 25 bp, E. coli
caaatcggacgggacggtgaaaacg

SEQ ID NO: 139583 - DNA, 25 bp, E. coli
catccagtgcgcaagtcaataaggt

SEQ ID NO: 139584 - DNA, 25 bp, E. coli
catccagtgcgctagtcaataaggt

SEQ ID NO: 139585 - DNA, 25 bp, E. coli
ttacagcagggaaagcatccagtgc

SEQ ID NO: 139586 - DNA, 25 bp, E. coli
ttacagcagggatagcatccagtgc

SEQ ID NO: 139587 - DNA, 25 bp, E. coli
tgttgaatacctgagccgcaagaat

SEQ ID NO: 139588 - DNA, 25 bp, E. coli
tgttgaatacctcagccgcaagaat

SEQ ID NO: 139589 - DNA, 25 bp, E. coli
tgcttgataatggtgatctgcccgg

SEQ ID NO: 139590 - DNA, 25 bp, E. coli
tgaaaacggctcatcaaaaccttgg

SEQ ID NO: 139591 - DNA, 25 bp, E. coli
tgcttgataatgctgatctgcccgg

SEQ ID NO: 139592 - DNA, 25 bp, E. coli
tgaaaacggctcttcaaaaccttgg

SEQ ID NO: 139593 - DNA, 25 bp, E. coli
gccaatgttatgacgcaggaggaat

SEQ ID NO: 139594 - DNA, 25 bp, E. coli
gccaatgttatgtcgcaggaggaat

SEQ ID NO: 139595 - DNA, 25 bp, E. coli
gctctggcccagattgtaagtgata

SEQ ID NO: 139596 - DNA, 25 bp, E. coli
gctttattgctgcagctctggccca

SEQ ID NO: 139597 - DNA, 25 bp, E. coli
gctctggcccagtttgtaagtgata

SEQ ID NO: 139598 - DNA, 25 bp, E. coli
gctttattgctggagctctggccca

SEQ ID NO: 139599 - DNA, 25 bp, E. coli
cgttgcctgcgcatatatccggatt

SEQ ID NO: 139600 - DNA, 25 bp, E. coli
cgttgcctgcgcttatatccggatt

SEQ ID NO: 139601 - DNA, 25 bp, E. coli
aactgggcggcatctactacagcga

SEQ ID NO: 139602 - DNA, 25 bp, E. coli
caggattcccgcatgaaggctacgc

SEQ ID NO: 139603 - DNA, 25 bp, E. coli
caggattcccgcttgaaggctacgc

SEQ ID NO: 139604 - DNA, 25 bp, E. coli
aactgggcggcaactactacagcga

SEQ ID NO: 139605 - DNA, 25 bp, E. coli
tcttgaacgtcagtggcagaaacgc

SEQ ID NO: 139606 - DNA, 25 bp, E. coli
tcatcgatgaagtgctggagcctgg

SEQ ID NO: 139607 - DNA, 25 bp, E. coli
tcttgaacgtcactggcagaaacgc

SEQ ID NO: 139608 - DNA, 25 bp, E. coli
tctgccgcaagacatggataaactg

SEQ ID NO: 139609 - DNA, 25 bp, E. coli
tctgccgcaagagatggataaactg

SEQ ID NO: 139610 - DNA, 25 bp, E. coli
tctacgatgcgctgaaacaaggtga

SEQ ID NO: 139611 - DNA, 25 bp, E. coli
tcacgtcatgaactggatatcgcgc

SEQ ID NO: 139612 - DNA, 25 bp, E. coli
tcatcgatgaagagctggagcctgg

SEQ ID NO: 139613 - DNA, 25 bp, E. coli
tctacgatgcgcagaaacaaggtga

SEQ ID NO: 139614 - DNA, 25 bp, E. coli
gaattgatcaacgagccggaacact

SEQ ID NO: 139615 - DNA, 25 bp, E. coli
gaagatccgtcaatcctcgcgatgc

SEQ ID NO: 139616 - DNA, 25 bp, E. coli
gaattgatcaaccagccggaacact

SEQ ID NO: 139617 - DNA, 25 bp, E. coli
gaagatccgtcattcctcgcgatgc

SEQ ID NO: 139618 - DNA, 25 bp, E. coli
gacgtgtttatcattcagggtaccg

SEQ ID NO: 139619 - DNA, 25 bp, E. coli
gacgtgtttatctttcagggtaccg

SEQ ID NO: 139620 - DNA, 25 bp, E. coli
ggcgagtttatatcccagtcacgtc

SEQ ID NO: 139621 - DNA, 25 bp, E. coli
ggcgagtttataacccagtcacgtc

SEQ ID NO: 139622 - DNA, 25 bp, E. coli
tcacgtcatgaagtggatatcgcgc

SEQ ID NO: 139623 - DNA, 25 bp, E. coli
aacaaccgtgtggtgatcctctccg

SEQ ID NO: 139624 - DNA, 25 bp, E. coli
aacaaccgtgtgctgatcctctccg

SEQ ID NO: 139625 - DNA, 25 bp, E. coli
tatgtgaacgctcgtctgatgtccg

SEQ ID NO: 139626 - DNA, 25 bp, E. coli
tatgtgaacgctggtctgatgtccg

SEQ ID NO: 139627 - DNA, 25 bp, E. coli
tgaaagtcatggacctggcggcctt

SEQ ID NO: 139628 - DNA, 25 bp, E. coli
tgaaagtcatggtcctggcggcctt

SEQ ID NO: 139629 - DNA, 25 bp, E. coli
tctgcagggcactgaaggcttcggt

SEQ ID NO: 139630 - DNA, 25 bp, E. coli
tctgcagggcacagaaggcttcggt

SEQ ID NO: 139631 - DNA, 25 bp, E. coli
gcaaccaaagttgacggcgtgttta

SEQ ID NO: 139632 - DNA, 25 bp, E. coli
cctgcgtggtatggaaattgaagcc

SEQ ID NO: 139633 - DNA, 25 bp, E. coli
cctgcgtggtatcgaaattgaagcc

SEQ ID NO: 139634 - DNA, 25 bp, E. coli
gcaaccaaagttcacggcgtgttta

SEQ ID NO: 139635 - DNA, 25 bp, E. coli
gaagctatcagcctgttgcgcaaca

SEQ ID NO: 139636 - DNA, 25 bp, E. coli
gaagctatcagcgtgttgcgcaaca

SEQ ID NO: 139637 - DNA, 25 bp, E. coli
cattgaatggcgtgtgcgacagcta

SEQ ID NO: 139638 - DNA, 25 bp, E. coli
cattgaatggcgagtgcgacagcta

SEQ ID NO: 139639 - DNA, 25 bp, E. coli
gtatgaaccgcgttgtgggcgacca

SEQ ID NO: 139640 - DNA, 25 bp, E. coli
gtatgaaccgcgatgtgggcgacca

SEQ ID NO: 139641 - DNA, 25 bp, E. coli
ggctaccaatgctaaacccgtctat

SEQ ID NO: 139642 - DNA, 25 bp, E. coli
ggctaccaatgcaaaacccgtctat

SEQ ID NO: 139643 - DNA, 25 bp, E. coli
taatgaacggcctggcaatgcgtga

SEQ ID NO: 139644 - DNA, 25 bp, E. coli
taatgaacggccaggcaatgcgtga

SEQ ID NO: 139645 - DNA, 25 bp, E. coli
tactggagtcagtagccgcgtctta

SEQ ID NO: 139646 - DNA, 25 bp, E. coli
taaagccctgcatgaagcgaatgcg

SEQ ID NO: 139647 - DNA, 25 bp, E. coli
tactggagtcagaagccgcgtctta

SEQ ID NO: 139648 - DNA, 25 bp, E. coli
taaagccctgcaagaagcgaatgcg

SEQ ID NO: 139649 - DNA, 25 bp, E. coli
tagttaccgatgcacgactctccgg

SEQ ID NO: 139650 - DNA, 25 bp, E. coli
tagttaccgatggacgactctccgg

SEQ ID NO: 139651 - DNA, 25 bp, E. coli
tctgatgttgtaccgctgatggcac

SEQ ID NO: 139652 - DNA, 25 bp, E. coli
tctgatgttgtagcgctgatggcac

SEQ ID NO: 139653 - DNA, 25 bp, E. coli
gcgtgaaaaactgtccggtgccgaa

SEQ ID NO: 139654 - DNA, 25 bp, E. coli
gcgtgaaaaactctccggtgccgaa

SEQ ID NO: 139655 - DNA, 25 bp, E. coli
gaacggtatcgttgcactgctggcg

SEQ ID NO: 139656 - DNA, 25 bp, E. coli
gaatcattgaaccttcgcgcgagac

SEQ ID NO: 139657 - DNA, 25 bp, E. coli
gaatcattgaacgttcgcgcgagac

SEQ ID NO: 139658 - DNA, 25 bp, E. coli
gaacggtatcgtagcactgctggcg

SEQ ID NO: 139659 - DNA, 25 bp, E. coli
gaccgttcatcgttcgcagttggca

SEQ ID NO: 139660 - DNA, 25 bp, E. coli
gttatgaaaacctctgccgtgccgg

SEQ ID NO: 139661 - DNA, 25 bp, E. coli
gttatgaaaaccactgccgtgccgg

SEQ ID NO: 139662 - DNA, 25 bp, E. coli
ggtactgccaacaccaaccagatgg

SEQ ID NO: 139663 - DNA, 25 bp, E. coli
ggtactgccaactccaaccagatgg

SEQ ID NO: 139664 - DNA, 25 bp, E. coli
gaccgttcatcgatcgcagttggca

SEQ ID NO: 139665 - DNA, 25 bp, E. coli
gagaaccaggtgtttgaagcgccag

SEQ ID NO: 139666 - DNA, 25 bp, E. coli
gagaaccaggtgattgaagcgccag

SEQ ID NO: 139667 - DNA, 25 bp, E. coli
aatagccgcgcaggcacaaacgttt

SEQ ID NO: 139668 - DNA, 25 bp, E. coli
aatagccgcgcacgcacaaacgttt

SEQ ID NO: 139669 - DNA, 25 bp, E. coli
cacatttgaggacaaaatagccgcg

SEQ ID NO: 139670 - DNA, 25 bp, E. coli
cacatttgaggagaaaatagccgcg

SEQ ID NO: 139671 - DNA, 25 bp, E. coli
catgcggtgtttccatgtatttcgc

SEQ ID NO: 139672 - DNA, 25 bp, E. coli
catgcggtgtttgcatgtatttcgc

SEQ ID NO: 139673 - DNA, 25 bp, E. coli
tacaagattggcctgggacaaccgc

SEQ ID NO: 139674 - DNA, 25 bp, E. coli
tacaagattggcgtgggacaaccgc

SEQ ID NO: 139675 - DNA, 25 bp, E. coli
gcgtgaaagccgatcctgaagccgt

SEQ ID NO: 139676 - DNA, 25 bp, E. coli
gcgtgaaagccgttcctgaagccgt

SEQ ID NO: 139677 - DNA, 25 bp, E. coli
gaagccgtcctctcctttcatgcgg

SEQ ID NO: 139678 - DNA, 25 bp, E. coli
gaagccgtcctcacctttcatgcgg

SEQ ID NO: 139679 - DNA, 25 bp, E. coli
gaaaaactggctactcagtctgtgg

SEQ ID NO: 139680 - DNA, 25 bp, E. coli
gaaaaactggcttctcagtctgtgg

SEQ ID NO: 139681 - DNA, 25 bp, E. coli
ctgtggtattactgaagtgcgtgac

SEQ ID NO: 139682 - DNA, 25 bp, E. coli
gctggaccagccagtttcaggcggt

SEQ ID NO: 139683 - DNA, 25 bp, E. coli
gctggaccagcctgtttcaggcggt

SEQ ID NO: 139684 - DNA, 25 bp, E. coli
ctgtggtattacagaagtgcgtgac

SEQ ID NO: 139685 - DNA, 25 bp, E. coli
gtggctgagcccatttccggcgcct

SEQ ID NO: 139686 - DNA, 25 bp, E. coli
ggatatcgccaaaatgcggctgcgt

SEQ ID NO: 139687 - DNA, 25 bp, E. coli
ggatatcgccaatatgcggctgcgt

SEQ ID NO: 139688 - DNA, 25 bp, E. coli
gtggctgagcccttttccggcgcct

SEQ ID NO: 139689 - DNA, 25 bp, E. coli
caacgcattgattagttagggaagg

SEQ ID NO: 139690 - DNA, 25 bp, E. coli
cacctcttagctggatttacaatca

SEQ ID NO: 139691 - DNA, 25 bp, E. coli
caacgcattgataagttagggaagg

SEQ ID NO: 139692 - DNA, 25 bp, E. coli
cacctcttagctcgatttacaatca

SEQ ID NO: 139693 - DNA, 25 bp, E. coli
tacctaaacgtaacaataccatgac

SEQ ID NO: 139694 - DNA, 25 bp, E. coli
acatttcaccgtagtctgctctgaa

SEQ ID NO: 139695 - DNA, 25 bp, E. coli
acatttcaccgttgtctgctctgaa

SEQ ID NO: 139696 - DNA, 25 bp, E. coli
tacctaaacgtatcaataccatgac

SEQ ID NO: 139697 - DNA, 25 bp, E. coli
tgaaaacctcacctcttagctggat

SEQ ID NO: 139698 - DNA, 25 bp, E. coli
tgaaaacctcacgtcttagctggat

SEQ ID NO: 139699 - DNA, 25 bp, E. coli
gctggatttacaatcaacgcattga

SEQ ID NO: 139700 - DNA, 25 bp, E. coli
gctggatttacattcaacgcattga

SEQ ID NO: 139701 - DNA, 25 bp, E. coli
gcagacaaatttcttgttacctaaa

SEQ ID NO: 139702 - DNA, 25 bp, E. coli
gcagacaaatttgttgttacctaaa

SEQ ID NO: 139703 - DNA, 25 bp, E. coli
cgttgtctgctcagaaaacctcacc

SEQ ID NO: 139704 - DNA, 25 bp, E. coli
cgcattgattagttagggaaggtgc

SEQ ID NO: 139705 - DNA, 25 bp, E. coli
cgttgtctgctctgaaaacctcacc

SEQ ID NO: 139706 - DNA, 25 bp, E. coli
cgcattgattagatagggaaggtgc

SEQ ID NO: 139707 - DNA, 25 bp, E. coli
gtaacaataccatgacatttcaccg

SEQ ID NO: 139708 - DNA, 25 bp, E. coli
gtaacaataccaagacatttcaccg

SEQ ID NO: 139709 - DNA, 25 bp, E. coli
gatgtaatccttctgcagacaaatt

SEQ ID NO: 139710 - DNA, 25 bp, E. coli
gatgtaatccttgtgcagacaaatt

SEQ ID NO: 139711 - DNA, 25 bp, E. coli
aattgctggagcaggactacaacac

SEQ ID NO: 139712 - DNA, 25 bp, E. coli
aattgctggagctggactacaacac

SEQ ID NO: 139713 - DNA, 25 bp, E. coli
caggaagacgaaccggcgattttgc

SEQ ID NO: 139714 - DNA, 25 bp, E. coli
caggaagacgaagcggcgattttgc

SEQ ID NO: 139715 - DNA, 25 bp, E. coli
agtatgttgcagaggcgcctggaga

SEQ ID NO: 139716 - DNA, 25 bp, E. coli
attggcgagtttcgcgcggtgtcgg

SEQ ID NO: 139717 - DNA, 25 bp, E. coli
attggcgagtttggcgcggtgtcgg

SEQ ID NO: 139718 - DNA, 25 bp, E. coli
agtatgttgcagtggcgcctggaga

SEQ ID NO: 139719 - DNA, 25 bp, E. coli
tgaattgctggaccaggactacaac

SEQ ID NO: 139720 - DNA, 25 bp, E. coli
tgaattgctggagcaggactacaac

SEQ ID NO: 139721 - DNA, 25 bp, E. coli
tcgctgccgttagagattgaattgc

SEQ ID NO: 139722 - DNA, 25 bp, E. coli
tcgctgccgttacagattgaattgc

SEQ ID NO: 139723 - DNA, 25 bp, E. coli
tcttcgtgacgtgtccgtttgtggt

SEQ ID NO: 139724 - DNA, 25 bp, E. coli
tcttcgtgacgtctccgtttgtggt

SEQ ID NO: 139725 - DNA, 25 bp, E. coli
gccgttacagattgaattgctggag

SEQ ID NO: 139726 - DNA, 25 bp, E. coli
gccgttacagatagaattgctggag

SEQ ID NO: 139727 - DNA, 25 bp, E. coli
gagtttggcgcgctgtcggtggttt

SEQ ID NO: 139728 - DNA, 25 bp, E. coli
gagtttggcgcggtgtcggtggttt

SEQ ID NO: 139729 - DNA, 25 bp, E. coli
cgaacatccgctcggcgctgcttta

SEQ ID NO: 139730 - DNA, 25 bp, E. coli
cgaacatccgctgggcgctgcttta

SEQ ID NO: 139731 - DNA, 25 bp, E. coli
tggcgattatcagcctgtttttaaa

SEQ ID NO: 139732 - DNA, 25 bp, E. coli
tggcgattatcaccctgtttttaaa

SEQ ID NO: 139733 - DNA, 25 bp, E. coli
cagtttcactggctttggcattcgt

SEQ ID NO: 139734 - DNA, 25 bp, E. coli
cagtttcactgggtttggcattcgt

SEQ ID NO: 139735 - DNA, 25 bp, E. coli
tgctgaagtcgcagaaccggctgcc

SEQ ID NO: 139736 - DNA, 25 bp, E. coli
tgctgaagtcgctgaaccggctgcc

SEQ ID NO: 139737 - DNA, 25 bp, E. coli
tcgctttgggctcctgcaacctggc

SEQ ID NO: 139738 - DNA, 25 bp, E. coli
tcgctttgggctgctgcaacctggc

SEQ ID NO: 139739 - DNA, 25 bp, E. coli
tctgatgcagtctgtgaggtcgctg

SEQ ID NO: 139740 - DNA, 25 bp, E. coli
tctgatgcagtcagtgaggtcgctg

SEQ ID NO: 139741 - DNA, 25 bp, E. coli
gcaacctggctgatttttgccgcag

SEQ ID NO: 139742 - DNA, 25 bp, E. coli
gcagttgctgatccagttgctgaag

SEQ ID NO: 139743 - DNA, 25 bp, E. coli
gcaacctggctgttttttgccgcag

SEQ ID NO: 139744 - DNA, 25 bp, E. coli
gcagttgctgatgcagttgctgaag

SEQ ID NO: 139745 - DNA, 25 bp, E. coli
gcagctttctgggtgttagccgcag

SEQ ID NO: 139746 - DNA, 25 bp, E. coli
gcagctttctggctgttagccgcag

SEQ ID NO: 139747 - DNA, 25 bp, E. coli
cgatgatgccgcagcagtttcggat

SEQ ID NO: 139748 - DNA, 25 bp, E. coli
cgttagtttcactcgtcttcgcagc

SEQ ID NO: 139749 - DNA, 25 bp, E. coli
cgttagtttcacacgtcttcgcagc

SEQ ID NO: 139750 - DNA, 25 bp, E. coli
cgatgatgccgctgcagtttcggat

SEQ ID NO: 139751 - DNA, 25 bp, E. coli
cattcgtttcgctggtcttcgctgc

SEQ ID NO: 139752 - DNA, 25 bp, E. coli
cattcgtttcgcaggtcttcgctgc

SEQ ID NO: 139753 - DNA, 25 bp, E. coli
ggtcgctgccgcctgtgcactatta

SEQ ID NO: 139754 - DNA, 25 bp, E. coli
ggtcgctgccgcgtgtgcactatta

SEQ ID NO: 139755 - DNA, 25 bp, E. coli
acggtggactctatcgctatgtgct

SEQ ID NO: 139756 - DNA, 25 bp, E. coli
acggtggactctttcgctatgtgct

SEQ ID NO: 139757 - DNA, 25 bp, E. coli
gccggacggtggactctatcgctat

SEQ ID NO: 139758 - DNA, 25 bp, E. coli
gccggacggtggtctctatcgctat

SEQ ID NO: 139759 - DNA, 25 bp, E. coli
gactctatcgctttgtgctgacaaa

SEQ ID NO: 139760 - DNA, 25 bp, E. coli
gactctatcgctatgtgctgacaaa

SEQ ID NO: 139761 - DNA, 25 bp, E. coli
cgctatgtgctgacaaaaatatatt

SEQ ID NO: 139762 - DNA, 25 bp, E. coli
cgctatgtgctgtcaaaaatatatt

SEQ ID NO: 139763 - DNA, 25 bp, E. coli
ctctatcgctatgtgctgacaaaaa

SEQ ID NO: 139764 - DNA, 25 bp, E. coli
ctatgtgctgactaaaatatattga

SEQ ID NO: 139765 - DNA, 25 bp, E. coli
cggacggtggactctatcgctatgt

SEQ ID NO: 139766 - DNA, 25 bp, E. coli
ctatgtgctgacaaaaatatattga

SEQ ID NO: 139767 - DNA, 25 bp, E. coli
cggacggtggacactatcgctatgt

SEQ ID NO: 139768 - DNA, 25 bp, E. coli
ctctatcgctatctgctgacaaaaa

SEQ ID NO: 139769 - DNA, 25 bp, E. coli
ggtggactctatggctatgtgctga

SEQ ID NO: 139770 - DNA, 25 bp, E. coli
ggtggactctatcgctatgtgctga

SEQ ID NO: 139771 - DNA, 25 bp, E. coli
tggactctatcggtatgtgctgaca

SEQ ID NO: 139772 - DNA, 25 bp, E. coli
tggactctatcgctatgtgctgaca

SEQ ID NO: 139773 - DNA, 25 bp, E. coli
gacggtggactctatcgctatgtgc

SEQ ID NO: 139774 - DNA, 25 bp, E. coli
gtgccggacggtggactctatcgct

SEQ ID NO: 139775 - DNA, 25 bp, E. coli
gacggtggactcaatcgctatgtgc

SEQ ID NO: 139776 - DNA, 25 bp, E. coli
gtgccggacggtcgactctatcgct

SEQ ID NO: 139777 - DNA, 25 bp, E. coli
catatgcggataacgtgcgcgaacg

SEQ ID NO: 139778 - DNA, 25 bp, E. coli
catatgcggatatcgtgcgcgaacg

SEQ ID NO: 139779 - DNA, 25 bp, E. coli
acagactgataaccgcgaacgcgat

SEQ ID NO: 139780 - DNA, 25 bp, E. coli
acagactgataagcgcgaacgcgat

SEQ ID NO: 139781 - DNA, 25 bp, E. coli
atctgctcgaccatgctgaatcccg

SEQ ID NO: 139782 - DNA, 25 bp, E. coli
atctgctcgaccttgctgaatcccg

SEQ ID NO: 139783 - DNA, 25 bp, E. coli
ttcaacagcaggaaacaccattcgt

SEQ ID NO: 139784 - DNA, 25 bp, E. coli
ttttgatccacaagggcgtaccagt

SEQ ID NO: 139785 - DNA, 25 bp, E. coli
ttttgatccacatgggcgtaccagt

SEQ ID NO: 139786 - DNA, 25 bp, E. coli
ttcaacagcaggtaacaccattcgt

SEQ ID NO: 139787 - DNA, 25 bp, E. coli
gcgtaccagtgaagatctgctcgac

SEQ ID NO: 139788 - DNA, 25 bp, E. coli
gcgtaccagtgatgatctgctcgac

SEQ ID NO: 139789 - DNA, 25 bp, E. coli
cgaacatcagtggatatgcggatat

SEQ ID NO: 139790 - DNA, 25 bp, E. coli
cgttgctaacgagattgccgaagct

SEQ ID NO: 139791 - DNA, 25 bp, E. coli
cgttgctaacgacattgccgaagct

SEQ ID NO: 139792 - DNA, 25 bp, E. coli
cgaacatcagtgcatatgcggatat

SEQ ID NO: 139793 - DNA, 25 bp, E. coli
cattcgttatgggaggcaatagacc

SEQ ID NO: 139794 - DNA, 25 bp, E. coli
cattcgttatggcaggcaatagacc

SEQ ID NO: 139795 - DNA, 25 bp, E. coli
gtgagatgatctccgttgctaacga

SEQ ID NO: 139796 - DNA, 25 bp, E. coli
gtgagatgatctgcgttgctaacga

SEQ ID NO: 139797 - DNA, 25 bp, E. coli
gacctttcaacaaacaacagactga

SEQ ID NO: 139798 - DNA, 25 bp, E. coli
gacctttcaacatacaacagactga

SEQ ID NO: 139799 - DNA, 25 bp, E. coli
aacgcgaccagttccaggagcgcat

SEQ ID NO: 139800 - DNA, 25 bp, E. coli
aacgcgaccagtaccaggagcgcat

SEQ ID NO: 139801 - DNA, 25 bp, E. coli
acccgcgtttgctactgcttgatga

SEQ ID NO: 139802 - DNA, 25 bp, E. coli
acgcgaccagttccaggagcgcata

SEQ ID NO: 139803 - DNA, 25 bp, E. coli
acccgcgtttgcaactgcttgatga

SEQ ID NO: 139804 - DNA, 25 bp, E. coli
acgcgaccagttgcaggagcgcata

SEQ ID NO: 139805 - DNA, 25 bp, E. coli
aacccgcgtttgctactgcttgatg

SEQ ID NO: 139806 - DNA, 25 bp, E. coli
aacccgcgtttggtactgcttgatg

SEQ ID NO: 139807 - DNA, 25 bp, E. coli
gcgaccagttccaggagcgcataaa

SEQ ID NO: 139808 - DNA, 25 bp, E. coli
gctaaagctggccgatcgcggctac

SEQ ID NO: 139809 - DNA, 25 bp, E. coli
gcgaccagttcctggagcgcataaa

SEQ ID NO: 139810 - DNA, 25 bp, E. coli
gcgtttgctactgcttgatgagcca

SEQ ID NO: 139811 - DNA, 25 bp, E. coli
gcgtttgctactccttgatgagcca

SEQ ID NO: 139812 - DNA, 25 bp, E. coli
gctaaagctggcggatcgcggctac

SEQ ID NO: 139813 - DNA, 25 bp, E. coli
cgcgaccagttcgaggagcgcataa

SEQ ID NO: 139814 - DNA, 25 bp, E. coli
cgaccagttccacgagcgcataaag

SEQ ID NO: 139815 - DNA, 25 bp, E. coli
cgtttgctactggttgatgagccat

SEQ ID NO: 139816 - DNA, 25 bp, E. coli
cgcgaccagttccaggagcgcataa

SEQ ID NO: 139817 - DNA, 25 bp, E. coli
cgtttgctactgcttgatgagccat

SEQ ID NO: 139818 - DNA, 25 bp, E. coli
cccgcgtttgcttctgcttgatgag

SEQ ID NO: 139819 - DNA, 25 bp, E. coli
cccgcgtttgctactgcttgatgag

SEQ ID NO: 139820 - DNA, 25 bp, E. coli
cgaccagttccaggagcgcataaag

SEQ ID NO: 139821 - DNA, 25 bp, E. coli
caacgtcaggttcgccagtgccaga

SEQ ID NO: 139822 - DNA, 25 bp, E. coli
caacgtcaggttggccagtgccaga

SEQ ID NO: 139823 - DNA, 25 bp, E. coli
catcgacggcgtattgcggacaatt

SEQ ID NO: 139824 - DNA, 25 bp, E. coli
cagaataccggtgagtcgcaacaga

SEQ ID NO: 139825 - DNA, 25 bp, E. coli
cagaataccggtcagtcgcaacaga

SEQ ID NO: 139826 - DNA, 25 bp, E. coli
catcgacggcgttttgcggacaatt

SEQ ID NO: 139827 - DNA, 25 bp, E. coli
tatcgggcgacgaaacatagatgtc

SEQ ID NO: 139828 - DNA, 25 bp, E. coli
tatcgggcgacgtaacatagatgtc

SEQ ID NO: 139829 - DNA, 25 bp, E. coli
ttatctcccgaattaaggtcatggc

SEQ ID NO: 139830 - DNA, 25 bp, E. coli
ttatctcccgaaataaggtcatggc

SEQ ID NO: 139831 - DNA, 25 bp, E. coli
tgagtgaggccaacaaagaaaccgc

SEQ ID NO: 139832 - DNA, 25 bp, E. coli
tgagtgaggccatcaaagaaaccgc

SEQ ID NO: 139833 - DNA, 25 bp, E. coli
tcgctttcggaagagatgcccgcaa

SEQ ID NO: 139834 - DNA, 25 bp, E. coli
tcgctttcggaacagatgcccgcaa

SEQ ID NO: 139835 - DNA, 25 bp, E. coli
tcagctcgcggtgacaacaattggc

SEQ ID NO: 139836 - DNA, 25 bp, E. coli
tcagctcgcggtcacaacaattggc

SEQ ID NO: 139837 - DNA, 25 bp, E. coli
gaaattcgtgattcagaaaccgcgc

SEQ ID NO: 139838 - DNA, 25 bp, E. coli
gaaattcgtgatacagaaaccgcgc

SEQ ID NO: 139839 - DNA, 25 bp, E. coli
tggatgaacaagcactggagcgact

SEQ ID NO: 139840 - DNA, 25 bp, E. coli
tggatgaacaaggactggagcgact

SEQ ID NO: 139841 - DNA, 25 bp, E. coli
tggatatgtctttcgctcgcggcct

SEQ ID NO: 139842 - DNA, 25 bp, E. coli
tggatatgtcttacgctcgcggcct

SEQ ID NO: 139843 - DNA, 25 bp, E. coli
aatcaccttcacgtccaggtctggg

SEQ ID NO: 139844 - DNA, 25 bp, E. coli
aatgttgccgatctgggcgagctac

SEQ ID NO: 139845 - DNA, 25 bp, E. coli
aatacgctgtcatcttccgggctgg

SEQ ID NO: 139846 - DNA, 25 bp, E. coli
aatcaccttcacctccaggtctggg

SEQ ID NO: 139847 - DNA, 25 bp, E. coli
aatacgctgtcaacttccgggctgg

SEQ ID NO: 139848 - DNA, 25 bp, E. coli
aatgttgccgatgtgggcgagctac

SEQ ID NO: 139849 - DNA, 25 bp, E. coli
catcttgggctggaaccactgctga

SEQ ID NO: 139850 - DNA, 25 bp, E. coli
catcttgggctgcaaccactgctga

SEQ ID NO: 139851 - DNA, 25 bp, E. coli
tacctggcgttcctgaaacgtctgg

SEQ ID NO: 139852 - DNA, 25 bp, E. coli
tacctggcgttcgtgaaacgtctgg

SEQ ID NO: 139853 - DNA, 25 bp, E. coli
tccgtgcgctgtataatccggcgaa

SEQ ID NO: 139854 - DNA, 25 bp, E. coli
tccaatggcgtggtatatggcgcgc

SEQ ID NO: 139855 - DNA, 25 bp, E. coli
tccaatggcgtgctatatggcgcgc

SEQ ID NO: 139856 - DNA, 25 bp, E. coli
tccgtgcgctgtttaatccggcgaa

SEQ ID NO: 139857 - DNA, 25 bp, E. coli
gcaatatggttttttcccagcaggg

SEQ ID NO: 139858 - DNA, 25 bp, E. coli
gcaatatggtttattcccagcaggg

SEQ ID NO: 139859 - DNA, 25 bp, E. coli
cattgttaaagcctatgcctggacg

SEQ ID NO: 139860 - DNA, 25 bp, E. coli
cattgttaaagcgtatgcctggacg

SEQ ID NO: 139861 - DNA, 25 bp, E. coli
gatttcaccatgacggtaacgccgg

SEQ ID NO: 139862 - DNA, 25 bp, E. coli
gatttcaccatgtcggtaacgccgg

SEQ ID NO: 139863 - DNA, 25 bp, E. coli
tggcattgtctaattcggctcgctg

SEQ ID NO: 139864 - DNA, 25 bp, E. coli
tggcattgtctatttcggctcgctg

SEQ ID NO: 139865 - DNA, 25 bp, E. coli
caaatgaatcaagataacggctggt

SEQ ID NO: 139866 - DNA, 25 bp, E. coli
caaaacggtaatcgatcaagagcag

SEQ ID NO: 139867 - DNA, 25 bp, E. coli
caaaacggtaatggatcaagagcag

SEQ ID NO: 139868 - DNA, 25 bp, E. coli
caaatgaatcaacataacggctggt

SEQ ID NO: 139869 - DNA, 25 bp, E. coli
caggcgctggaaatgttgaaaccgc

SEQ ID NO: 139870 - DNA, 25 bp, E. coli
caggcgctggaattgttgaaaccgc

SEQ ID NO: 139871 - DNA, 25 bp, E. coli
gaacagttacgctggaaagaaccca

SEQ ID NO: 139872 - DNA, 25 bp, E. coli
gaacagttacgcaggaaagaaccca

SEQ ID NO: 139873 - DNA, 25 bp, E. coli
tgatattagtcaacgctggcaggaa

SEQ ID NO: 139874 - DNA, 25 bp, E. coli
tgtccgctgtgcataacgatctcaa

SEQ ID NO: 139875 - DNA, 25 bp, E. coli
tgatattagtcatcgctggcaggaa

SEQ ID NO: 139876 - DNA, 25 bp, E. coli
tgtccgctgtgcttaacgatctcaa

SEQ ID NO: 139877 - DNA, 25 bp, E. coli
cggcagccagttgcaatggattaca

SEQ ID NO: 139878 - DNA, 25 bp, E. coli
cggcagccagttccaatggattaca

SEQ ID NO: 139879 - DNA, 25 bp, E. coli
gttgaaaccgcaacaggaaccgacg

SEQ ID NO: 139880 - DNA, 25 bp, E. coli
gttgaaaccgcatcaggaaccgacg

SEQ ID NO: 139881 - DNA, 25 bp, E. coli
tgtgaaaacgcaccaactacgccaa

SEQ ID NO: 139882 - DNA, 25 bp, E. coli
tgtgaaaacgcagcaactacgccaa

SEQ ID NO: 139883 - DNA, 25 bp, E. coli
taacggctggttactggaaggacag

SEQ ID NO: 139884 - DNA, 25 bp, E. coli
taacggctggtttctggaaggacag

SEQ ID NO: 139885 - DNA, 25 bp, E. coli
gagatcctcgacgagatgtccgctg

SEQ ID NO: 139886 - DNA, 25 bp, E. coli
gagatcctcgaccagatgtccgctg

SEQ ID NO: 139887 - DNA, 25 bp, E. coli
caagcagcctgatgtttgacgagta

SEQ ID NO: 139888 - DNA, 25 bp, E. coli
caagcagcctgaagtttgacgagta

SEQ ID NO: 139889 - DNA, 25 bp, E. coli
caatgatcactttttggtcatacaa

SEQ ID NO: 139890 - DNA, 25 bp, E. coli
caatgatcacttattggtcatacaa

SEQ ID NO: 139891 - DNA, 25 bp, E. coli
caaagcgtaatgattcaaatgcaca

SEQ ID NO: 139892 - DNA, 25 bp, E. coli
caaagcgtaatgtttcaaatgcaca

SEQ ID NO: 139893 - DNA, 25 bp, E. coli
tactcgcacgttccatgaaaatcct

SEQ ID NO: 139894 - DNA, 25 bp, E. coli
tactctaagaaatcaggattgcacc

SEQ ID NO: 139895 - DNA, 25 bp, E. coli
tactcgcacgttgcatgaaaatcct

SEQ ID NO: 139896 - DNA, 25 bp, E. coli
tactctaagaaaacaggattgcacc

SEQ ID NO: 139897 - DNA, 25 bp, E. coli
tatgaataacattgaatagcagcca

SEQ ID NO: 139898 - DNA, 25 bp, E. coli
tatgaataacatagaatagcagcca

SEQ ID NO: 139899 - DNA, 25 bp, E. coli
tgaaaatcctttgcaaagcgtaatg

SEQ ID NO: 139900 - DNA, 25 bp, E. coli
tgaaaatcctttccaaagcgtaatg

SEQ ID NO: 139901 - DNA, 25 bp, E. coli
gattgcaccagttcaagcagcctga

SEQ ID NO: 139902 - DNA, 25 bp, E. coli
gattgcaccagtacaagcagcctga

SEQ ID NO: 139903 - DNA, 25 bp, E. coli
taagatgacggcattttactcgcac

SEQ ID NO: 139904 - DNA, 25 bp, E. coli
tcactttttctaggaatcaggaacc

SEQ ID NO: 139905 - DNA, 25 bp, E. coli
tagcagccattctctttttctacga

SEQ ID NO: 139906 - DNA, 25 bp, E. coli
taagatgacggctttttactcgcac

SEQ ID NO: 139907 - DNA, 25 bp, E. coli
tagcagccattcactttttctacga

SEQ ID NO: 139908 - DNA, 25 bp, E. coli
tcactttttctacgaatcaggaacc

SEQ ID NO: 139909 - DNA, 25 bp, E. coli
tacttgtaatttacttacggtgcac

SEQ ID NO: 139910 - DNA, 25 bp, E. coli
tacttgtaattttcttacggtgcac

SEQ ID NO: 139911 - DNA, 25 bp, E. coli
tacggtgcactgtactgcttttacg

SEQ ID NO: 139912 - DNA, 25 bp, E. coli
tacggtgcactgaactgcttttacg

SEQ ID NO: 139913 - DNA, 25 bp, E. coli
attacgggaaaaccgcgcaaagtgc

SEQ ID NO: 139914 - DNA, 25 bp, E. coli
attacgggaaaagcgcgcaaagtgc

SEQ ID NO: 139915 - DNA, 25 bp, E. coli
aaacgcttatcctcccgtgcgatta

SEQ ID NO: 139916 - DNA, 25 bp, E. coli
aaacgcttatccacccgtgcgatta

SEQ ID NO: 139917 - DNA, 25 bp, E. coli
ttcagtgcggaaatcgtcattaccc

SEQ ID NO: 139918 - DNA, 25 bp, E. coli
ttcagtgcggaattcgtcattaccc

SEQ ID NO: 139919 - DNA, 25 bp, E. coli
tccacccgtgcgattacgggaaaag

SEQ ID NO: 139920 - DNA, 25 bp, E. coli
tccacccgtgcgtttacgggaaaag

SEQ ID NO: 139921 - DNA, 25 bp, E. coli
tcgtcattacccgtgagtctcttta

SEQ ID NO: 139922 - DNA, 25 bp, E. coli
tcgtcattacccctgagtctcttta

SEQ ID NO: 139923 - DNA, 25 bp, E. coli
gcttgcgaaaacagtaaacgcttat

SEQ ID NO: 139924 - DNA, 25 bp, E. coli
gcttgcgaaaactgtaaacgcttat

SEQ ID NO: 139925 - DNA, 25 bp, E. coli
cgcaaagtgcggcaaaactgataaa

SEQ ID NO: 139926 - DNA, 25 bp, E. coli
cgcaaagtgcgggaaaactgataaa

SEQ ID NO: 139927 - DNA, 25 bp, E. coli
gtactgcttttacgagcttgcgaaa

SEQ ID NO: 139928 - DNA, 25 bp, E. coli
ggtacttaagccagggtatacttgt

SEQ ID NO: 139929 - DNA, 25 bp, E. coli
ggtacttaagcctgggtatacttgt

SEQ ID NO: 139930 - DNA, 25 bp, E. coli
gtactgcttttaggagcttgcgaaa

SEQ ID NO: 139931 - DNA, 25 bp, E. coli
tatccgtcaagggttatcaaccaag

SEQ ID NO: 139932 - DNA, 25 bp, E. coli
tatccgtcaaggcttatcaaccaag

SEQ ID NO: 139933 - DNA, 25 bp, E. coli
tttatcagaaacttatcgccccggg

SEQ ID NO: 139934 - DNA, 25 bp, E. coli
tttatcagaaacatatcgccccggg

SEQ ID NO: 139935 - DNA, 25 bp, E. coli
tgtatactggagtcggtaagcaggc

SEQ ID NO: 139936 - DNA, 25 bp, E. coli
tgtatactggagacggtaagcaggc

SEQ ID NO: 139937 - DNA, 25 bp, E. coli
tcgccccgggtgatgatattgtaaa

SEQ ID NO: 139938 - DNA, 25 bp, E. coli
tcgccccgggtgttgatattgtaaa

SEQ ID NO: 139939 - DNA, 25 bp, E. coli
tcttctgaagagtggaaaatggtct

SEQ ID NO: 139940 - DNA, 25 bp, E. coli
tcttctgaagagaggaaaatggtct

SEQ ID NO: 139941 - DNA, 25 bp, E. coli
gccagtaaatgcgacaggtgtgtcc

SEQ ID NO: 139942 - DNA, 25 bp, E. coli
gccagtaaatgccacaggtgtgtcc

SEQ ID NO: 139943 - DNA, 25 bp, E. coli
gcgatggtatgagccgagctgtaaa

SEQ ID NO: 139944 - DNA, 25 bp, E. coli
gcgatggtatgacccgagctgtaaa

SEQ ID NO: 139945 - DNA, 25 bp, E. coli
gaagtgttcaatgggagagcgctct

SEQ ID NO: 139946 - DNA, 25 bp, E. coli
gaagtgttcaatcggagagcgctct

SEQ ID NO: 139947 - DNA, 25 bp, E. coli
gaaatcccaggttatatgagtcgtg

SEQ ID NO: 139948 - DNA, 25 bp, E. coli
gaaatcccaggtaatatgagtcgtg

SEQ ID NO: 139949 - DNA, 25 bp, E. coli
gggcaccatccgtgggaagaatgat

SEQ ID NO: 139950 - DNA, 25 bp, E. coli
gggcaccatccgagggaagaatgat

SEQ ID NO: 139951 - DNA, 25 bp, E. coli
taactcttgatgttaaagcggcaca

SEQ ID NO: 139952 - DNA, 25 bp, E. coli
taactcttgatgataaagcggcaca

SEQ ID NO: 139953 - DNA, 25 bp, E. coli
catggtctgcagcatcaggaagtcc

SEQ ID NO: 139954 - DNA, 25 bp, E. coli
catggtctgcaggatcaggaagtcc

SEQ ID NO: 139955 - DNA, 25 bp, E. coli
aacattgaagtcacggttgctggcc

SEQ ID NO: 139956 - DNA, 25 bp, E. coli
aaaactggcggcactacgtcagcaa

SEQ ID NO: 139957 - DNA, 25 bp, E. coli
aacattgaagtctcggttgctggcc

SEQ ID NO: 139958 - DNA, 25 bp, E. coli
aaaactggcggctctacgtcagcaa

SEQ ID NO: 139959 - DNA, 25 bp, E. coli
ttgaaaaactcaccatgcgcgaagc

SEQ ID NO: 139960 - DNA, 25 bp, E. coli
ttgaaaaactcagcatgcgcgaagc

SEQ ID NO: 139961 - DNA, 25 bp, E. coli
tcgcgccggagctgtatctgaaacg

SEQ ID NO: 139962 - DNA, 25 bp, E. coli
tcgcgccggagcagtatctgaaacg

SEQ ID NO: 139963 - DNA, 25 bp, E. coli
tcagcaaggtgtggcgtttcccaat

SEQ ID NO: 139964 - DNA, 25 bp, E. coli
tcagcaaggtgtcgcgtttcccaat

SEQ ID NO: 139965 - DNA, 25 bp, E. coli
gaaagcctcctttgtaacgttgcag

SEQ ID NO: 139966 - DNA, 25 bp, E. coli
gaaagcctccttagtaacgttgcag

SEQ ID NO: 139967 - DNA, 25 bp, E. coli
cgaagattacgtcactgcgctggaa

SEQ ID NO: 139968 - DNA, 25 bp, E. coli
cgaagattacgtgactgcgctggaa

SEQ ID NO: 139969 - DNA, 25 bp, E. coli
gttcaaaaattctggccgctatccg

SEQ ID NO: 139970 - DNA, 25 bp, E. coli
gttcaaaaattcaggccgctatccg

SEQ ID NO: 139971 - DNA, 25 bp, E. coli
tgacattatcggtgcccgcggtacg

SEQ ID NO: 139972 - DNA, 25 bp, E. coli
tgacattatcggagcccgcggtacg

SEQ ID NO: 139973 - DNA, 25 bp, E. coli
gatgaactgagaaatcgccgcgaaa

SEQ ID NO: 139974 - DNA, 25 bp, E. coli
gatgaactgagatatcgccgcgaaa

SEQ ID NO: 139975 - DNA, 25 bp, E. coli
aacgcactgcaatacgccggtgaaa

SEQ ID NO: 139976 - DNA, 25 bp, E. coli
aacgcactgcaaaacgccggtgaaa

SEQ ID NO: 139977 - DNA, 25 bp, E. coli
caacattgagaaaagcgacgataac

SEQ ID NO: 139978 - DNA, 25 bp, E. coli
caacattgagaatagcgacgataac

SEQ ID NO: 139979 - DNA, 25 bp, E. coli
tacgctggctgaaaatatggaagtc

SEQ ID NO: 139980 - DNA, 25 bp, E. coli
tacgctggctgataatatggaagtc

SEQ ID NO: 139981 - DNA, 25 bp, E. coli
ttttgacaaactggccaacgcactg

SEQ ID NO: 139982 - DNA, 25 bp, E. coli
ttttgacaaactcgccaacgcactg

SEQ ID NO: 139983 - DNA, 25 bp, E. coli
ttatccccactgttgcgtcaatgga

SEQ ID NO: 139984 - DNA, 25 bp, E. coli
ttatccccactgatgcgtcaatgga

SEQ ID NO: 139985 - DNA, 25 bp, E. coli
tctctggcgcaaccttcgtaaacgg

SEQ ID NO: 139986 - DNA, 25 bp, E. coli
tctctggcgcaagcttcgtaaacgg

SEQ ID NO: 139987 - DNA, 25 bp, E. coli
gctatcagcgaacgtcccgcgttaa

SEQ ID NO: 139988 - DNA, 25 bp, E. coli
gctatcagcgaaggtcccgcgttaa

SEQ ID NO: 139989 - DNA, 25 bp, E. coli
gaaaaaatggctgcatcaagggctt

SEQ ID NO: 139990 - DNA, 25 bp, E. coli
gaaaaaatggctccatcaagggctt

SEQ ID NO: 139991 - DNA, 25 bp, E. coli
cgtaatgagcctgaacccatcgcag

SEQ ID NO: 139992 - DNA, 25 bp, E. coli
cgtaatgagcctcaacccatcgcag

SEQ ID NO: 139993 - DNA, 25 bp, E. coli
gattcaactggaaggtacgcgcctg

SEQ ID NO: 139994 - DNA, 25 bp, E. coli
gattcaactggatggtacgcgcctg

SEQ ID NO: 139995 - DNA, 25 bp, E. coli
gagcttcccgccctacaacattgag

SEQ ID NO: 139996 - DNA, 25 bp, E. coli
gagcttcccgccgtacaacattgag

SEQ ID NO: 139997 - DNA, 25 bp, E. coli
cagttgttacaaggagttgaaacca

SEQ ID NO: 139998 - DNA, 25 bp, E. coli
cagttgttacaacgagttgaaacca

SEQ ID NO: 139999 - DNA, 25 bp, E. coli
acccgcgttctcttctgatactaca

SEQ ID NO: 140000 - DNA, 25 bp, E. coli
acccgcgttctcatctgatactaca

SEQ ID NO: 140001 - DNA, 25 bp, E. coli
tagctgtgggtattaacgacaaacg

SEQ ID NO: 140002 - DNA, 25 bp, E. coli
tagctgtgggtaataacgacaaacg

SEQ ID NO: 140003 - DNA, 25 bp, E. coli
ttagttcccctacatgcagtatgga

SEQ ID NO: 140004 - DNA, 25 bp, E. coli
ttagttcccctagatgcagtatgga

SEQ ID NO: 140005 - DNA, 25 bp, E. coli
tcttctactgcaaaaggcgttacga

SEQ ID NO: 140006 - DNA, 25 bp, E. coli
tcttctactgcataaggcgttacga

SEQ ID NO: 140007 - DNA, 25 bp, E. coli
ccatcaatggcacaattagttcccc

SEQ ID NO: 140008 - DNA, 25 bp, E. coli
ccatcaatggcagaattagttcccc

SEQ ID NO: 140009 - DNA, 25 bp, E. coli
gcttatggactaccatcacccgcgt

SEQ ID NO: 140010 - DNA, 25 bp, E. coli
gcttatggactagcatcacccgcgt

SEQ ID NO: 140011 - DNA, 25 bp, E. coli
gaaaccaactatcgtgcttcttcta

SEQ ID NO: 140012 - DNA, 25 bp, E. coli
gaaaccaactatggtgcttcttcta

SEQ ID NO: 140013 - DNA, 25 bp, E. coli
cgttacgacagaagtggtagctgtg

SEQ ID NO: 140014 - DNA, 25 bp, E. coli
cgttacgacagatgtggtagctgtg

SEQ ID NO: 140015 - DNA, 25 bp, E. coli
taatcatcttcagcaacgttgtggg

SEQ ID NO: 140016 - DNA, 25 bp, E. coli
taatcatcttcaccaacgttgtggg

SEQ ID NO: 140017 - DNA, 25 bp, E. coli
taagtattggttgtcaggagctgtt

SEQ ID NO: 140018 - DNA, 25 bp, E. coli
taagtattggttctcaggagctgtt

SEQ ID NO: 140019 - DNA, 25 bp, E. coli
taaagatgttgataccactcggcgt

SEQ ID NO: 140020 - DNA, 25 bp, E. coli
tatttgtaaccaccgtagttgggca

SEQ ID NO: 140021 - DNA, 25 bp, E. coli
taaagatgttgaaaccactcggcgt

SEQ ID NO: 140022 - DNA, 25 bp, E. coli
tatttgtaaccagcgtagttgggca

SEQ ID NO: 140023 - DNA, 25 bp, E. coli
aaacttgttgcctccaaaggcggca

SEQ ID NO: 140024 - DNA, 25 bp, E. coli
aactcattgtgggaggaaaaagacc

SEQ ID NO: 140025 - DNA, 25 bp, E. coli
aaacttgttgccaccaaaggcggca

SEQ ID NO: 140026 - DNA, 25 bp, E. coli
aactcattgtggcaggaaaaagacc

SEQ ID NO: 140027 - DNA, 25 bp, E. coli
tatttattacgtgatccggagcgac

SEQ ID NO: 140028 - DNA, 25 bp, E. coli
tatttattacgtcatccggagcgac

SEQ ID NO: 140029 - DNA, 25 bp, E. coli
ttatccggacaataaccgtcagccg

SEQ ID NO: 140030 - DNA, 25 bp, E. coli
ttatccggacaaaaaccgtcagccg

SEQ ID NO: 140031 - DNA, 25 bp, E. coli
tgtgaaaagtttggcctgcatccca

SEQ ID NO: 140032 - DNA, 25 bp, E. coli
gccgatgagttacatggcgactaca

SEQ ID NO: 140033 - DNA, 25 bp, E. coli
gccgatgagttagatggcgactaca

SEQ ID NO: 140034 - DNA, 25 bp, E. coli
gaaggctcccgtttcacgcaagaaa

SEQ ID NO: 140035 - DNA, 25 bp, E. coli
gaaggctcccgtatcacgcaagaaa

SEQ ID NO: 140036 - DNA, 25 bp, E. coli
gtaaaactattgctacctgtgccag

SEQ ID NO: 140037 - DNA, 25 bp, E. coli
ggatttacagccaattgccgatgag

SEQ ID NO: 140038 - DNA, 25 bp, E. coli
gtaaaactattggtacctgtgccag

SEQ ID NO: 140039 - DNA, 25 bp, E. coli
ggatttacagcctattgccgatgag

SEQ ID NO: 140040 - DNA, 25 bp, E. coli
tgtgaaaagtttcgcctgcatccca

SEQ ID NO: 140041 - DNA, 25 bp, E. coli
cacgacgtggtgtcaatgaacagcc

SEQ ID NO: 140042 - DNA, 25 bp, E. coli
cacgacgtggtgacaatgaacagcc

SEQ ID NO: 140043 - DNA, 25 bp, E. coli
taaacgcagagtaggatcgcgccca

SEQ ID NO: 140044 - DNA, 25 bp, E. coli
taaacgcagagttggatcgcgccca

SEQ ID NO: 140045 - DNA, 25 bp, E. coli
aaattccgcaatgttagcgatggcg

SEQ ID NO: 140046 - DNA, 25 bp, E. coli
aaattccgcaatcttagcgatggcg

SEQ ID NO: 140047 - DNA, 25 bp, E. coli
ttatggctccggtaggtgccgcact

SEQ ID NO: 140048 - DNA, 25 bp, E. coli
ttatggctccggaaggtgccgcact

SEQ ID NO: 140049 - DNA, 25 bp, E. coli
tgttcgccagaagagatgccacacg

SEQ ID NO: 140050 - DNA, 25 bp, E. coli
tgttcgccagaacagatgccacacg

SEQ ID NO: 140051 - DNA, 25 bp, E. coli
tgaacagccgggttaaattccgcaa

SEQ ID NO: 140052 - DNA, 25 bp, E. coli
tgaacagccgggataaattccgcaa

SEQ ID NO: 140053 - DNA, 25 bp, E. coli
gcgttggcgattgcattcactggga

SEQ ID NO: 140054 - DNA, 25 bp, E. coli
gcgttggcgattccattcactggga

SEQ ID NO: 140055 - DNA, 25 bp, E. coli
cgcacgctggtgaatccggcaaaaa

SEQ ID NO: 140056 - DNA, 25 bp, E. coli
cgcacgctggtgtatccggcaaaaa

SEQ ID NO: 140057 - DNA, 25 bp, E. coli
gttgcaacccaccttgaagtgctgg

SEQ ID NO: 140058 - DNA, 25 bp, E. coli
gttgcaacccacgttgaagtgctgg

SEQ ID NO: 140059 - DNA, 25 bp, E. coli
ggaactcgaataccagccagaagct

SEQ ID NO: 140060 - DNA, 25 bp, E. coli
ggaactcgaatagcagccagaagct

SEQ ID NO: 140061 - DNA, 25 bp, E. coli
gatcgcgcccaaatgtgttcgccag

SEQ ID NO: 140062 - DNA, 25 bp, E. coli
gatcgcgcccaattgtgttcgccag

SEQ ID NO: 140063 - DNA, 25 bp, E. coli
aatccactaaatcttccgggaatgg

SEQ ID NO: 140064 - DNA, 25 bp, E. coli
aatccactaaatgttccgggaatgg

SEQ ID NO: 140065 - DNA, 25 bp, E. coli
caggagcgccagcacttagttttga

SEQ ID NO: 140066 - DNA, 25 bp, E. coli
caggagcgccaggacttagttttga

SEQ ID NO: 140067 - DNA, 25 bp, E. coli
tacaggcacattgattgagccagga

SEQ ID NO: 140068 - DNA, 25 bp, E. coli
tacaggcacattcattgagccagga

SEQ ID NO: 140069 - DNA, 25 bp, E. coli
gagagtctcctatagtttccttcga

SEQ ID NO: 140070 - DNA, 25 bp, E. coli
gagagtctcctaaagtttccttcga

SEQ ID NO: 140071 - DNA, 25 bp, E. coli
tagttcacttagtaaacgtctcggg

SEQ ID NO: 140072 - DNA, 25 bp, E. coli
tagttcacttagaaaacgtctcggg

SEQ ID NO: 140073 - DNA, 25 bp, E. coli
tatgatgcctcatagccaggagcgc

SEQ ID NO: 140074 - DNA, 25 bp, E. coli
tatgatgcctcaaagccaggagcgc

SEQ ID NO: 140075 - DNA, 25 bp, E. coli
tatgagtcagtatgcatcgccgcga

SEQ ID NO: 140076 - DNA, 25 bp, E. coli
tatgagtcagtaagcatcgccgcga

SEQ ID NO: 140077 - DNA, 25 bp, E. coli
tatcaacgggtctatgtgactgcga

SEQ ID NO: 140078 - DNA, 25 bp, E. coli
tatcaacgggtcaatgtgactgcga

SEQ ID NO: 140079 - DNA, 25 bp, E. coli
gaaaggctgcagtctactatgacag

SEQ ID NO: 140080 - DNA, 25 bp, E. coli
gaaaggctgcagactactatgacag

SEQ ID NO: 140081 - DNA, 25 bp, E. coli
ggttttaagcttgtcgctacaggca

SEQ ID NO: 140082 - DNA, 25 bp, E. coli
ggatgtcacttcagtatttcgccca

SEQ ID NO: 140083 - DNA, 25 bp, E. coli
ggttttaagcttctcgctacaggca

SEQ ID NO: 140084 - DNA, 25 bp, E. coli
ggatgtcacttctgtatttcgccca

SEQ ID NO: 140085 - DNA, 25 bp, E. coli
caataatggcgtacccgaaagcagc

SEQ ID NO: 140086 - DNA, 25 bp, E. coli
caataatggcgttcccgaaagcagc

SEQ ID NO: 140087 - DNA, 25 bp, E. coli
accagcggtaacgtctctgctcccg

SEQ ID NO: 140088 - DNA, 25 bp, E. coli
gcttcacgttaactattgtacccaa

SEQ ID NO: 140089 - DNA, 25 bp, E. coli
atcagcctgattcccaggtcgtcgg

SEQ ID NO: 140090 - DNA, 25 bp, E. coli
cgttaagtattgaacccaatgacca

SEQ ID NO: 140091 - DNA, 25 bp, E. coli
gcttcacgttaagtattgtacccaa

SEQ ID NO: 140092 - DNA, 25 bp, E. coli
atcagcctgattgccaggtcgtcgg

SEQ ID NO: 140093 - DNA, 25 bp, E. coli
accagcggtaacctctctgctcccg

SEQ ID NO: 140094 - DNA, 25 bp, E. coli
cgttaagtattgtacccaatgacca

SEQ ID NO: 140095 - DNA, 25 bp, E. coli
gcgctaatgataggcataaaattct

SEQ ID NO: 140096 - DNA, 25 bp, E. coli
gcgctaatgatacgcataaaattct

SEQ ID NO: 140097 - DNA, 25 bp, E. coli
gcattatcaataatggcgtacccga

SEQ ID NO: 140098 - DNA, 25 bp, E. coli
gcattatcaatattggcgtacccga

SEQ ID NO: 140099 - DNA, 25 bp, E. coli
ccgaaagcagctacacgttaagtat

SEQ ID NO: 140100 - DNA, 25 bp, E. coli
cgccgggatcctctgagcgcataca

SEQ ID NO: 140101 - DNA, 25 bp, E. coli
ccgaaagcagcttcacgttaagtat

SEQ ID NO: 140102 - DNA, 25 bp, E. coli
cgccgggatcctgtgagcgcataca

SEQ ID NO: 140103 - DNA, 25 bp, E. coli
gttgatcagcctcattcccaggtcg

SEQ ID NO: 140104 - DNA, 25 bp, E. coli
gttgatcagcctgattcccaggtcg

SEQ ID NO: 140105 - DNA, 25 bp, E. coli
tggcgtacccgaaagcagcttcacg

SEQ ID NO: 140106 - DNA, 25 bp, E. coli
tggcgtacccgatagcagcttcacg

SEQ ID NO: 140107 - DNA, 25 bp, E. coli
taaatacgctgtaatctacgcaaaa

SEQ ID NO: 140108 - DNA, 25 bp, E. coli
taaatacgctgttatctacgcaaaa

SEQ ID NO: 140109 - DNA, 25 bp, E. coli
aacccacgtaaaaacgctgttatct

SEQ ID NO: 140110 - DNA, 25 bp, E. coli
aacccacgtaaatacgctgttatct

SEQ ID NO: 140111 - DNA, 25 bp, E. coli
aaatacgctgttttctacgcaaaaa

SEQ ID NO: 140112 - DNA, 25 bp, E. coli
aaatacgctgttatctacgcaaaaa

SEQ ID NO: 140113 - DNA, 25 bp, E. coli
cacgtaaatacggtgttatctacgc

SEQ ID NO: 140114 - DNA, 25 bp, E. coli
cacgtaaatacgctgttatctacgc

SEQ ID NO: 140115 - DNA, 25 bp, E. coli
tattaaaacccacgtaaatacgctg

SEQ ID NO: 140116 - DNA, 25 bp, E. coli
tattaaaacccaggtaaatacgctg

SEQ ID NO: 140117 - DNA, 25 bp, E. coli
tcataccaaagtattaaaacccacg

SEQ ID NO: 140118 - DNA, 25 bp, E. coli
tgcggaaatatttttaataactcac

SEQ ID NO: 140119 - DNA, 25 bp, E. coli
tcataccaaagttttaaaacccacg

SEQ ID NO: 140120 - DNA, 25 bp, E. coli
tgcggaaatattattaataactcac

SEQ ID NO: 140121 - DNA, 25 bp, E. coli
cccacgtaaataggctgttatctac

SEQ ID NO: 140122 - DNA, 25 bp, E. coli
cccacgtaaatacgctgttatctac

SEQ ID NO: 140123 - DNA, 25 bp, E. coli
cgtaaatacgctcttatctacgcaa

SEQ ID NO: 140124 - DNA, 25 bp, E. coli
cgtaaatacgctgttatctacgcaa

SEQ ID NO: 140125 - DNA, 25 bp, E. coli
tgtctgcggaaaaatttttaataac

SEQ ID NO: 140126 - DNA, 25 bp, E. coli
gtaaatacgctgatatctacgcaaa

SEQ ID NO: 140127 - DNA, 25 bp, E. coli
gtaaatacgctgttatctacgcaaa

SEQ ID NO: 140128 - DNA, 25 bp, E. coli
tgtctgcggaaatatttttaataac

SEQ ID NO: 140129 - DNA, 25 bp, E. coli
cactgcgggactcgcgtatggcaat

SEQ ID NO: 140130 - DNA, 25 bp, E. coli
cactgcgggactggcgtatggcaat

SEQ ID NO: 140131 - DNA, 25 bp, E. coli
agaaatggacgatgccactgcggga

SEQ ID NO: 140132 - DNA, 25 bp, E. coli
agaaatggacgaagccactgcggga

SEQ ID NO: 140133 - DNA, 25 bp, E. coli
tatcgagttcggtgaccgcctggac

SEQ ID NO: 140134 - DNA, 25 bp, E. coli
tatcgagttcggagaccgcctggac

SEQ ID NO: 140135 - DNA, 25 bp, E. coli
tgttcccgacggttgactcagtgaa

SEQ ID NO: 140136 - DNA, 25 bp, E. coli
tgttcccgacggatgactcagtgaa

SEQ ID NO: 140137 - DNA, 25 bp, E. coli
tgaccgcctggagggtcacttctga

SEQ ID NO: 140138 - DNA, 25 bp, E. coli
tgaccgcctggacggtcacttctga

SEQ ID NO: 140139 - DNA, 25 bp, E. coli
ccaggcggcttctcagaaatggacg

SEQ ID NO: 140140 - DNA, 25 bp, E. coli
ccaggcggcttcacagaaatggacg

SEQ ID NO: 140141 - DNA, 25 bp, E. coli
gcggcttcacagaaatggacgatgc

SEQ ID NO: 140142 - DNA, 25 bp, E. coli
gcggcttcacagtaatggacgatgc

SEQ ID NO: 140143 - DNA, 25 bp, E. coli
gactcagtgaaaaaggtcgtgtggc

SEQ ID NO: 140144 - DNA, 25 bp, E. coli
gactcagtgaaataggtcgtgtggc

SEQ ID NO: 140145 - DNA, 25 bp, E. coli
gaaaaaggtcgtgtggctggcaatc

SEQ ID NO: 140146 - DNA, 25 bp, E. coli
gaaaaaggtcgtctggctggcaatc

SEQ ID NO: 140147 - DNA, 25 bp, E. coli
cgacggatgactgagtgaaaaaggt

SEQ ID NO: 140148 - DNA, 25 bp, E. coli
cgacggatgactcagtgaaaaaggt

SEQ ID NO: 140149 - DNA, 25 bp, E. coli
tcacagaaatggtcgatgccactgc

SEQ ID NO: 140150 - DNA, 25 bp, E. coli
tcacagaaatggacgatgccactgc

SEQ ID NO: 140151 - DNA, 25 bp, E. coli
cagccttcgatcatacatattcaga

SEQ ID NO: 140152 - DNA, 25 bp, E. coli
cagccttcgatcttacatattcaga

SEQ ID NO: 140153 - DNA, 25 bp, E. coli
aggaataagatgagggaaccgcgcc

SEQ ID NO: 140154 - DNA, 25 bp, E. coli
aggaataagatgtgggaaccgcgcc

SEQ ID NO: 140155 - DNA, 25 bp, E. coli
tagtagcgaggaacatcaagtgaac

SEQ ID NO: 140156 - DNA, 25 bp, E. coli
tagtagcgaggatcatcaagtgaac

SEQ ID NO: 140157 - DNA, 25 bp, E. coli
gcctacaggactggtcacctggtaa

SEQ ID NO: 140158 - DNA, 25 bp, E. coli
gcctacaggactcgtcacctggtaa

SEQ ID NO: 140159 - DNA, 25 bp, E. coli
gaaccgcgccatcggcgatttaccg

SEQ ID NO: 140160 - DNA, 25 bp, E. coli
gaatataatgatcccgccacgaacg

SEQ ID NO: 140161 - DNA, 25 bp, E. coli
gaaccgcgccatgggcgatttaccg

SEQ ID NO: 140162 - DNA, 25 bp, E. coli
gaatataatgatgccgccacgaacg

SEQ ID NO: 140163 - DNA, 25 bp, E. coli
cttgagcgttccttagtagcgagga

SEQ ID NO: 140164 - DNA, 25 bp, E. coli
ctggcacgttcaccggcttgagcgt

SEQ ID NO: 140165 - DNA, 25 bp, E. coli
cttgagcgttccatagtagcgagga

SEQ ID NO: 140166 - DNA, 25 bp, E. coli
ctggcacgttcagcggcttgagcgt

SEQ ID NO: 140167 - DNA, 25 bp, E. coli
ggtcattttaccgaatagccgaaag

SEQ ID NO: 140168 - DNA, 25 bp, E. coli
ggtcattttacccaatagccgaaag

SEQ ID NO: 140169 - DNA, 25 bp, E. coli
tggagattgagcgaccctggcacgt

SEQ ID NO: 140170 - DNA, 25 bp, E. coli
tggagattgagccaccctggcacgt

SEQ ID NO: 140171 - DNA, 25 bp, E. coli
tcaagtgaacggaacagccttcgat

SEQ ID NO: 140172 - DNA, 25 bp, E. coli
tcaagtgaacggtacagccttcgat

SEQ ID NO: 140173 - DNA, 25 bp, E. coli
aacggtctgaccctgctgccgcaaa

SEQ ID NO: 140174 - DNA, 25 bp, E. coli
cagctcatgccgtgcataacggtct

SEQ ID NO: 140175 - DNA, 25 bp, E. coli
cagctcatgccgagcataacggtct

SEQ ID NO: 140176 - DNA, 25 bp, E. coli
cataacggtctgaccgtgctgccgc

SEQ ID NO: 140177 - DNA, 25 bp, E. coli
cataacggtctgtccgtgctgccgc

SEQ ID NO: 140178 - DNA, 25 bp, E. coli
aacggtctgaccgtgctgccgcaaa

SEQ ID NO: 140179 - DNA, 25 bp, E. coli
ttttacgcgtgtggcggcagctcat

SEQ ID NO: 140180 - DNA, 25 bp, E. coli
ttttacgcgtgtcgcggcagctcat

SEQ ID NO: 140181 - DNA, 25 bp, E. coli
tgcataacggtcagaccgtgctgcc

SEQ ID NO: 140182 - DNA, 25 bp, E. coli
tgcataacggtctgaccgtgctgcc

SEQ ID NO: 140183 - DNA, 25 bp, E. coli
tgccgtgcataagggtctgaccgtg

SEQ ID NO: 140184 - DNA, 25 bp, E. coli
tcgttttacgcgtgtggcggcagct

SEQ ID NO: 140185 - DNA, 25 bp, E. coli
tgccgtgcataacggtctgaccgtg

SEQ ID NO: 140186 - DNA, 25 bp, E. coli
tcgttttacgcgagtggcggcagct

SEQ ID NO: 140187 - DNA, 25 bp, E. coli
ccgtgctgccgcaaaccgagaagtt

SEQ ID NO: 140188 - DNA, 25 bp, E. coli
ccgtgctgccgctaaccgagaagtt

SEQ ID NO: 140189 - DNA, 25 bp, E. coli
gcagctcatgccctgcataacggtc

SEQ ID NO: 140190 - DNA, 25 bp, E. coli
gcagctcatgccgtgcataacggtc

SEQ ID NO: 140191 - DNA, 25 bp, E. coli
cgtgctgccgcaaaccgagaagttt

SEQ ID NO: 140192 - DNA, 25 bp, E. coli
cgtgctgccgcataccgagaagttt

SEQ ID NO: 140193 - DNA, 25 bp, E. coli
gtctgaccgtgcagccgcaaaccga

SEQ ID NO: 140194 - DNA, 25 bp, E. coli
gtctgaccgtgctgccgcaaaccga

SEQ ID NO: 140195 - DNA, 25 bp, E. coli
caatatggttccgtcgaagcggcgc

SEQ ID NO: 140196 - DNA, 25 bp, E. coli
caatatggttccctcgaagcggcgc

SEQ ID NO: 140197 - DNA, 25 bp, E. coli
caatattgcaccctggaccatgcca

SEQ ID NO: 140198 - DNA, 25 bp, E. coli
caatattgcaccgtggaccatgcca

SEQ ID NO: 140199 - DNA, 25 bp, E. coli
tgggagccttctataacaccaacgg

SEQ ID NO: 140200 - DNA, 25 bp, E. coli
tgtactggtacatccgattctggcg

SEQ ID NO: 140201 - DNA, 25 bp, E. coli
tgtactggtacaaccgattctggcg

SEQ ID NO: 140202 - DNA, 25 bp, E. coli
tctgaaaggtataggcggcaacgta

SEQ ID NO: 140203 - DNA, 25 bp, E. coli
tcttcggtattcttggcgcgctggc

SEQ ID NO: 140204 - DNA, 25 bp, E. coli
tctgaaaggtattggcggcaacgta

SEQ ID NO: 140205 - DNA, 25 bp, E. coli
tctgccaattatgatgaacccggtg

SEQ ID NO: 140206 - DNA, 25 bp, E. coli
tctttattggcatggcgctggcaga

SEQ ID NO: 140207 - DNA, 25 bp, E. coli
tctgccaattatcatgaacccggtg

SEQ ID NO: 140208 - DNA, 25 bp, E. coli
tcttcggtattcatggcgcgctggc

SEQ ID NO: 140209 - DNA, 25 bp, E. coli
tctttattggcaaggcgctggcaga

SEQ ID NO: 140210 - DNA, 25 bp, E. coli
gcttaatgccgttaacccttgcggg

SEQ ID NO: 140211 - DNA, 25 bp, E. coli
gcttaatgccgtaaacccttgcggg

SEQ ID NO: 140212 - DNA, 25 bp, E. coli
ccccatatagtgtcggtgaggccta

SEQ ID NO: 140213 - DNA, 25 bp, E. coli
ccccatatagtgacggtgaggccta

SEQ ID NO: 140214 - DNA, 25 bp, E. coli
ggtaagaccttccatatctgggcca

SEQ ID NO: 140215 - DNA, 25 bp, E. coli
ggtaagaccttcgatatctgggcca

SEQ ID NO: 140216 - DNA, 25 bp, E. coli
tgggagccttctttaacaccaacgg

SEQ ID NO: 140217 - DNA, 25 bp, E. coli
aaccgctgaatggatccgcctgcag

SEQ ID NO: 140218 - DNA, 25 bp, E. coli
cagccgatcgtatccgctgaatgca

SEQ ID NO: 140219 - DNA, 25 bp, E. coli
cagccgatcgtaaccgctgaatgca

SEQ ID NO: 140220 - DNA, 25 bp, E. coli
aacttctgtctgagcaccaccttca

SEQ ID NO: 140221 - DNA, 25 bp, E. coli
aaccgctgaatgcatccgcctgcag

SEQ ID NO: 140222 - DNA, 25 bp, E. coli
aacttctgtctgtgcaccaccttca

SEQ ID NO: 140223 - DNA, 25 bp, E. coli
ttttcgccgggcttggacccagcac

SEQ ID NO: 140224 - DNA, 25 bp, E. coli
ttttcgccgggcatggacccagcac

SEQ ID NO: 140225 - DNA, 25 bp, E. coli
gatcgtaaccgcagaatgcatccgc

SEQ ID NO: 140226 - DNA, 25 bp, E. coli
gtttggcactgatcagccgatcgta

SEQ ID NO: 140227 - DNA, 25 bp, E. coli
gtttggcactgaacagccgatcgta

SEQ ID NO: 140228 - DNA, 25 bp, E. coli
gggcatggacccagcacgcaacttc

SEQ ID NO: 140229 - DNA, 25 bp, E. coli
gtctgtgcaccagcttcacgtttgg

SEQ ID NO: 140230 - DNA, 25 bp, E. coli
gggcatggaccctgcacgcaacttc

SEQ ID NO: 140231 - DNA, 25 bp, E. coli
gtctgtgcaccaccttcacgtttgg

SEQ ID NO: 140232 - DNA, 25 bp, E. coli
tgttgtaccggatgttttccctgcc

SEQ ID NO: 140233 - DNA, 25 bp, E. coli
tgttgtaccggaagttttccctgcc

SEQ ID NO: 140234 - DNA, 25 bp, E. coli
tcacgtttggcactgaacagccgat

SEQ ID NO: 140235 - DNA, 25 bp, E. coli
tcacgtttggcagtgaacagccgat

SEQ ID NO: 140236 - DNA, 25 bp, E. coli
gatgttttccctgcctgtctggtga

SEQ ID NO: 140237 - DNA, 25 bp, E. coli
gatgttttccctccctgtctggtga

SEQ ID NO: 140238 - DNA, 25 bp, E. coli
gatcgtaaccgctgaatgcatccgc

SEQ ID NO: 140239 - DNA, 25 bp, E. coli
aagattggcgttgcaggcttacagc

SEQ ID NO: 140240 - DNA, 25 bp, E. coli
aagattggcgttccaggcttacagc

SEQ ID NO: 140241 - DNA, 25 bp, E. coli
cacgcgattccgttgctgattaacc

SEQ ID NO: 140242 - DNA, 25 bp, E. coli
cacgcgattccgatgctgattaacc

SEQ ID NO: 140243 - DNA, 25 bp, E. coli
caggcttacagcgtgagcagattaa

SEQ ID NO: 140244 - DNA, 25 bp, E. coli
caggcttacagcctgagcagattaa

SEQ ID NO: 140245 - DNA, 25 bp, E. coli
tacatcggcgcgagtaataccggtg

SEQ ID NO: 140246 - DNA, 25 bp, E. coli
tacatcggcgcgtgtaataccggtg

SEQ ID NO: 140247 - DNA, 25 bp, E. coli
tataacaaaagttgcaccattgcca

SEQ ID NO: 140248 - DNA, 25 bp, E. coli
tataacaaaagtagcaccattgcca

SEQ ID NO: 140249 - DNA, 25 bp, E. coli
tatcgccaaaatgatcgctgaagga

SEQ ID NO: 140250 - DNA, 25 bp, E. coli
tatcgccaaaatcatcgctgaagga

SEQ ID NO: 140251 - DNA, 25 bp, E. coli
gcgacggctcctggctgttttgaag

SEQ ID NO: 140252 - DNA, 25 bp, E. coli
gcgacggctcctcgctgttttgaag

SEQ ID NO: 140253 - DNA, 25 bp, E. coli
gaagttttcattgacaacgacatgg

SEQ ID NO: 140254 - DNA, 25 bp, E. coli
gaagttttcattcacaacgacatgg

SEQ ID NO: 140255 - DNA, 25 bp, E. coli
gacagactcatgaaaaagattggcg

SEQ ID NO: 140256 - DNA, 25 bp, E. coli
gacagactcatgtaaaagattggcg

SEQ ID NO: 140257 - DNA, 25 bp, E. coli
ggcgtttggcctatccgttgagcac

SEQ ID NO: 140258 - DNA, 25 bp, E. coli
ggcgtttggcctttccgttgagcac

SEQ ID NO: 140259 - DNA, 25 bp, E. coli
gatcgctgaaggtaaagtggcgttt

SEQ ID NO: 140260 - DNA, 25 bp, E. coli
gatcgctgaaggaaaagtggcgttt

SEQ ID NO: 140261 - DNA, 25 bp, E. coli
aatggcgcagtgttccagcttgctg

SEQ ID NO: 140262 - DNA, 25 bp, E. coli
aatggcgcagtgatccagcttgctg

SEQ ID NO: 140263 - DNA, 25 bp, E. coli
catctcaggtattagccatggcgaa

SEQ ID NO: 140264 - DNA, 25 bp, E. coli
catctcaggtataagccatggcgaa

SEQ ID NO: 140265 - DNA, 25 bp, E. coli
atctgcatgatgaggatccggcccg

SEQ ID NO: 140266 - DNA, 25 bp, E. coli
atctgcatgatgtggatccggcccg

SEQ ID NO: 140267 - DNA, 25 bp, E. coli
tttagcgatcttcatggcaccctgc

SEQ ID NO: 140268 - DNA, 25 bp, E. coli
tttagcgatcttgatggcaccctgc

SEQ ID NO: 140269 - DNA, 25 bp, E. coli
tgccggaaaagatcaggctgccaac

SEQ ID NO: 140270 - DNA, 25 bp, E. coli
tgccggaaaagaacaggctgccaac

SEQ ID NO: 140271 - DNA, 25 bp, E. coli
tcatagttatgactggcaaccggca

SEQ ID NO: 140272 - DNA, 25 bp, E. coli
tcatagttatgagtggcaaccggca

SEQ ID NO: 140273 - DNA, 25 bp, E. coli
gctgccaactggtttatcgcgacct

SEQ ID NO: 140274 - DNA, 25 bp, E. coli
gctgccaactggattatcgcgacct

SEQ ID NO: 140275 - DNA, 25 bp, E. coli
gaagggctggaccattttttctccg

SEQ ID NO: 140276 - DNA, 25 bp, E. coli
gaagggctggacgattttttctccg

SEQ ID NO: 140277 - DNA, 25 bp, E. coli
gattaagccgtacccaggcggcgct

SEQ ID NO: 140278 - DNA, 25 bp, E. coli
gattaagccgtagccaggcggcgct

SEQ ID NO: 140279 - DNA, 25 bp, E. coli
ggcaccctgctgcacagtcatagtt

SEQ ID NO: 140280 - DNA, 25 bp, E. coli
ggcaccctgctggacagtcatagtt

SEQ ID NO: 140281 - DNA, 25 bp, E. coli
taacgctaatctggcgcgacagtga

SEQ ID NO: 140282 - DNA, 25 bp, E. coli
taacgctaatctcgcgcgacagtga

SEQ ID NO: 140283 - DNA, 25 bp, E. coli
taaagttggtatgccgctgcgtgtc

SEQ ID NO: 140284 - DNA, 25 bp, E. coli
taaagttggtatcccgctgcgtgtc

SEQ ID NO: 140285 - DNA, 25 bp, E. coli
tacgttttgctaacccgcaggaagg

SEQ ID NO: 140286 - DNA, 25 bp, E. coli
aacaggctatctgcacgttggcggc

SEQ ID NO: 140287 - DNA, 25 bp, E. coli
aacaggctatctccacgttggcggc

SEQ ID NO: 140288 - DNA, 25 bp, E. coli
tatggatggcatcaactggctgagc

SEQ ID NO: 140289 - DNA, 25 bp, E. coli
tacgttttgctatcccgcaggaagg

SEQ ID NO: 140290 - DNA, 25 bp, E. coli
tatggatggcatgaactggctgagc

SEQ ID NO: 140291 - DNA, 25 bp, E. coli
tttgctgagttcgatgccgacgccg

SEQ ID NO: 140292 - DNA, 25 bp, E. coli
tttgctgagttccatgccgacgccg

SEQ ID NO: 140293 - DNA, 25 bp, E. coli
tccgtggtccgatcgagttcagcaa

SEQ ID NO: 140294 - DNA, 25 bp, E. coli
tccgtggtccgaacgagttcagcaa

SEQ ID NO: 140295 - DNA, 25 bp, E. coli
tcatcacgctatacaggcgacggcg

SEQ ID NO: 140296 - DNA, 25 bp, E. coli
tcatcacgctattcaggcgacggcg

SEQ ID NO: 140297 - DNA, 25 bp, E. coli
gaaaaaacatctgcgtccggtagcg

SEQ ID NO: 140298 - DNA, 25 bp, E. coli
gaaaaaacatctccgtccggtagcg

SEQ ID NO: 140299 - DNA, 25 bp, E. coli
gacaagctgctgtggctgaaccatc

SEQ ID NO: 140300 - DNA, 25 bp, E. coli
gacaagctgctgaggctgaaccatc

SEQ ID NO: 140301 - DNA, 25 bp, E. coli
gaaaatcaaaacacgcttcgcgcca

SEQ ID NO: 140302 - DNA, 25 bp, E. coli
gaaaatcaaaactcgcttcgcgcca

SEQ ID NO: 140303 - DNA, 25 bp, E. coli
cgctacaacgcggtgatcgatcaga

SEQ ID NO: 140304 - DNA, 25 bp, E. coli
cgctacaacgcgctgatcgatcaga

SEQ ID NO: 140305 - DNA, 25 bp, E. coli
aatttacatgcggttgatcctgcgg

SEQ ID NO: 140306 - DNA, 25 bp, E. coli
aatttacatgcgcttgatcctgcgg

SEQ ID NO: 140307 - DNA, 25 bp, E. coli
caggcggcaagattgatgataaaac

SEQ ID NO: 140308 - DNA, 25 bp, E. coli
caggcggcaagaatgatgataaaac

SEQ ID NO: 140309 - DNA, 25 bp, E. coli
cacttacagttcagacgtttaccca

SEQ ID NO: 140310 - DNA, 25 bp, E. coli
cacttacagttctgacgtttaccca

SEQ ID NO: 140311 - DNA, 25 bp, E. coli
tatatactcgtgtctttgctacagc

SEQ ID NO: 140312 - DNA, 25 bp, E. coli
tatatactcgtgactttgctacagc

SEQ ID NO: 140313 - DNA, 25 bp, E. coli
tttttcagattaagatcaggcggca

SEQ ID NO: 140314 - DNA, 25 bp, E. coli
tttttcagattatgatcaggcggca

SEQ ID NO: 140315 - DNA, 25 bp, E. coli
ttgctacagcaagcagacggatttc

SEQ ID NO: 140316 - DNA, 25 bp, E. coli
ttgctacagcaaccagacggatttc

SEQ ID NO: 140317 - DNA, 25 bp, E. coli
tgatcctgcgggttatgacccgagg

SEQ ID NO: 140318 - DNA, 25 bp, E. coli
tgatcctgcgggatatgacccgagg

SEQ ID NO: 140319 - DNA, 25 bp, E. coli
gcaatttagccgattgatttacggg

SEQ ID NO: 140320 - DNA, 25 bp, E. coli
gcaatttagccgtttgatttacggg

SEQ ID NO: 140321 - DNA, 25 bp, E. coli
gacgtttacccaacttgctttcgct

SEQ ID NO: 140322 - DNA, 25 bp, E. coli
gacgtttacccatcttgctttcgct

SEQ ID NO: 140323 - DNA, 25 bp, E. coli
cccgaggtgtaaagggtatctgtct

SEQ ID NO: 140324 - DNA, 25 bp, E. coli
cccgaggtgtaatgggtatctgtct

SEQ ID NO: 140325 - DNA, 25 bp, E. coli
gattagccctgacgatcacttacag

SEQ ID NO: 140326 - DNA, 25 bp, E. coli
gattagccctgaggatcacttacag

SEQ ID NO: 140327 - DNA, 25 bp, E. coli
caccaacggtttaatgctggaagaa

SEQ ID NO: 140328 - DNA, 25 bp, E. coli
caccaacggttttatgctggaagaa

SEQ ID NO: 140329 - DNA, 25 bp, E. coli
aaaacgctgaccaacggctgcatct

SEQ ID NO: 140330 - DNA, 25 bp, E. coli
aaaacgctgacctacggctgcatct

SEQ ID NO: 140331 - DNA, 25 bp, E. coli
tgggcctgctgtacaacaccaacgg

SEQ ID NO: 140332 - DNA, 25 bp, E. coli
tgggcctgctgttcaacaccaacgg

SEQ ID NO: 140333 - DNA, 25 bp, E. coli
tgccgatgagcacatgaaccagttc

SEQ ID NO: 140334 - DNA, 25 bp, E. coli
tgccgatgagcagatgaaccagttc

SEQ ID NO: 140335 - DNA, 25 bp, E. coli
tcattgaatgcaccggcatggccga

SEQ ID NO: 140336 - DNA, 25 bp, E. coli
tcattgaatgcagcggcatggccga

SEQ ID NO: 140337 - DNA, 25 bp, E. coli
cgtcgcaggcgaagcagaaaaactg

SEQ ID NO: 140338 - DNA, 25 bp, E. coli
cgtcgcaggcgatgcagaaaaactg

SEQ ID NO: 140339 - DNA, 25 bp, E. coli
gattacccggtagatatcagcgaag

SEQ ID NO: 140340 - DNA, 25 bp, E. coli
gattacccggtacatatcagcgaag

SEQ ID NO: 140341 - DNA, 25 bp, E. coli
tggatgcggtacttgccgatgagca

SEQ ID NO: 140342 - DNA, 25 bp, E. coli
tggatgcggtacatgccgatgagca

SEQ ID NO: 140343 - DNA, 25 bp, E. coli
tggaagaaaacgacgtcagcaccaa

SEQ ID NO: 140344 - DNA, 25 bp, E. coli
tggaagaaaacgtcgtcagcaccaa

SEQ ID NO: 140345 - DNA, 25 bp, E. coli
gatcccggcccgattattcagacct

SEQ ID NO: 140346 - DNA, 25 bp, E. coli
gatgaaccagttcaccatcgcccag

SEQ ID NO: 140347 - DNA, 25 bp, E. coli
gatgaaccagttgaccatcgcccag

SEQ ID NO: 140348 - DNA, 25 bp, E. coli
gatcccggcccgtttattcagacct

SEQ ID NO: 140349 - DNA, 25 bp, E. coli
cagtttagcttcgagttcagcgcga

SEQ ID NO: 140350 - DNA, 25 bp, E. coli
cagtttagcttccagttcagcgcga

SEQ ID NO: 140351 - DNA, 25 bp, E. coli
agtggtacgcagaacgccgttcggc

SEQ ID NO: 140352 - DNA, 25 bp, E. coli
agtggtacgcagtacgccgttcggc

SEQ ID NO: 140353 - DNA, 25 bp, E. coli
taccaggaagtttcgagcatagccc

SEQ ID NO: 140354 - DNA, 25 bp, E. coli
taccaggaagttacgagcatagccc

SEQ ID NO: 140355 - DNA, 25 bp, E. coli
tttagacgcgatggtaacagtttcc

SEQ ID NO: 140356 - DNA, 25 bp, E. coli
tttagacgcgatcgtaacagtttcc

SEQ ID NO: 140357 - DNA, 25 bp, E. coli
tgatcacccagggtacccaggtttg

SEQ ID NO: 140358 - DNA, 25 bp, E. coli
tgatcacccaggctacccaggtttg

SEQ ID NO: 140359 - DNA, 25 bp, E. coli
gcattgattttctcagcgcgagcat

SEQ ID NO: 140360 - DNA, 25 bp, E. coli
gcattgattttcacagcgcgagcat

SEQ ID NO: 140361 - DNA, 25 bp, E. coli
gaacagtttaccatcgtcgccagct

SEQ ID NO: 140362 - DNA, 25 bp, E. coli
gaacagtttaccttcgtcgccagct

SEQ ID NO: 140363 - DNA, 25 bp, E. coli
cgaatacttcgcagtgaacctggaa

SEQ ID NO: 140364 - DNA, 25 bp, E. coli
cgagtaccgatgcaaccgaacagtt

SEQ ID NO: 140365 - DNA, 25 bp, E. coli
cgaatacttcgctgtgaacctggaa

SEQ ID NO: 140366 - DNA, 25 bp, E. coli
cgagtaccgatggaaccgaacagtt

SEQ ID NO: 140367 - DNA, 25 bp, E. coli
gttacagcgtcagcgatgtcgcgag

SEQ ID NO: 140368 - DNA, 25 bp, E. coli
gttacagcgtcaccgatgtcgcgag

SEQ ID NO: 140369 - DNA, 25 bp, E. coli
tcaacgccagctccagttacagcgt

SEQ ID NO: 140370 - DNA, 25 bp, E. coli
tcaacgccagctgcagttacagcgt

SEQ ID NO: 140371 - DNA, 25 bp, E. coli
cacggtggctgaactggaatctgaa

SEQ ID NO: 140372 - DNA, 25 bp, E. coli
cagaaaagggctcggtactcctggt

SEQ ID NO: 140373 - DNA, 25 bp, E. coli
cacggtggctgatctggaatctgaa

SEQ ID NO: 140374 - DNA, 25 bp, E. coli
cagaaaagggctgggtactcctggt

SEQ ID NO: 140375 - DNA, 25 bp, E. coli
tactctaaagagatcaaagccgaag

SEQ ID NO: 140376 - DNA, 25 bp, E. coli
tactctaaagagttcaaagccgaag

SEQ ID NO: 140377 - DNA, 25 bp, E. coli
tgcgtaaggcgtaaaatgaagctcg

SEQ ID NO: 140378 - DNA, 25 bp, E. coli
tgcgtaaggcgttaaatgaagctcg

SEQ ID NO: 140379 - DNA, 25 bp, E. coli
tcccgattatctcttcctgaaggca

SEQ ID NO: 140380 - DNA, 25 bp, E. coli
tcccgattatctgttcctgaaggca

SEQ ID NO: 140381 - DNA, 25 bp, E. coli
tctgaaattctggaactgcgtaagg

SEQ ID NO: 140382 - DNA, 25 bp, E. coli
tctgaaattctgcaactgcgtaagg

SEQ ID NO: 140383 - DNA, 25 bp, E. coli
gcactttaggactatgggttaccgc

SEQ ID NO: 140384 - DNA, 25 bp, E. coli
gcactttaggacaatgggttaccgc

SEQ ID NO: 140385 - DNA, 25 bp, E. coli
cgccttgagcgagatatattaaaaa

SEQ ID NO: 140386 - DNA, 25 bp, E. coli
cgccttgagcgacatatattaaaaa

SEQ ID NO: 140387 - DNA, 25 bp, E. coli
gttaccgccgccagaaaagggctcg

SEQ ID NO: 140388 - DNA, 25 bp, E. coli
gttaccgccgcctgaaaagggctcg

SEQ ID NO: 140389 - DNA, 25 bp, E. coli
tcaaagccgaagctgtcagaacggt

SEQ ID NO: 140390 - DNA, 25 bp, E. coli
tcaaagccgaaggtgtcagaacggt

SEQ ID NO: 140391 - DNA, 25 bp, E. coli
tcagaacggttcatgaaaatcaact

SEQ ID NO: 140392 - DNA, 25 bp, E. coli
tcagaacggttcttgaaaatcaact

SEQ ID NO: 140393 - DNA, 25 bp, E. coli
caccgtgcagcgcattgtctgttat

SEQ ID NO: 140394 - DNA, 25 bp, E. coli
caccgatgagggtgagtttgaccgc

SEQ ID NO: 140395 - DNA, 25 bp, E. coli
caccgtgcagcggattgtctgttat

SEQ ID NO: 140396 - DNA, 25 bp, E. coli
caccgatgagggagagtttgaccgc

SEQ ID NO: 140397 - DNA, 25 bp, E. coli
atgggtgttccggtagcgatcgcac

SEQ ID NO: 140398 - DNA, 25 bp, E. coli
atgggtgttccgctagcgatcgcac

SEQ ID NO: 140399 - DNA, 25 bp, E. coli
ataacggcctgaccgctatcccgga

SEQ ID NO: 140400 - DNA, 25 bp, E. coli
ataacggcctgagcgctatcccgga

SEQ ID NO: 140401 - DNA, 25 bp, E. coli
ttgtcgacaccaaaatcgtcgctgg

SEQ ID NO: 140402 - DNA, 25 bp, E. coli
ttgtcgacaccataatcgtcgctgg

SEQ ID NO: 140403 - DNA, 25 bp, E. coli
tgtctgttatctacaccgatgaggg

SEQ ID NO: 140404 - DNA, 25 bp, E. coli
tgtctgttatcttcaccgatgaggg

SEQ ID NO: 140405 - DNA, 25 bp, E. coli
tgagggtgagtttgaccgctatctg

SEQ ID NO: 140406 - DNA, 25 bp, E. coli
tgagggtgagttagaccgctatctg

SEQ ID NO: 140407 - DNA, 25 bp, E. coli
tcccggacgcgcatcactattatca

SEQ ID NO: 140408 - DNA, 25 bp, E. coli
tcccggacgcgcttcactattatca

SEQ ID NO: 140409 - DNA, 25 bp, E. coli
gcgcattgtctgatatctacaccga

SEQ ID NO: 140410 - DNA, 25 bp, E. coli
gcgcattgtctgttatctacaccga

SEQ ID NO: 140411 - DNA, 25 bp, E. coli
ccgaatatggtctttgtcgacacca

SEQ ID NO: 140412 - DNA, 25 bp, E. coli
ccgaatatggtcattgtcgacacca

SEQ ID NO: 140413 - DNA, 25 bp, E. coli
cggtagcgatcggaccgactatcgc

SEQ ID NO: 140414 - DNA, 25 bp, E. coli
cggtagcgatcgcaccgactatcgc

SEQ ID NO: 140415 - DNA, 25 bp, E. coli
caactgcacaggatattgaatggcc

SEQ ID NO: 140416 - DNA, 25 bp, E. coli
caactgcacaggttattgaatggcc

SEQ ID NO: 140417 - DNA, 25 bp, E. coli
gaaggatacggaagcagaaaaactg

SEQ ID NO: 140418 - DNA, 25 bp, E. coli
cacagcctgggtgaaggatacggaa

SEQ ID NO: 140419 - DNA, 25 bp, E. coli
cacagcctgggtcaaggatacggaa

SEQ ID NO: 140420 - DNA, 25 bp, E. coli
gaaggatacggatgcagaaaaactg

SEQ ID NO: 140421 - DNA, 25 bp, E. coli
caggatattgaaaggccagcactgc

SEQ ID NO: 140422 - DNA, 25 bp, E. coli
caggatattgaatggccagcactgc

SEQ ID NO: 140423 - DNA, 25 bp, E. coli
agaaatctcgttgctggaagcatgg

SEQ ID NO: 140424 - DNA, 25 bp, E. coli
agaaatctcgttcctggaagcatgg

SEQ ID NO: 140425 - DNA, 25 bp, E. coli
tattgaatggccagcactgccgtag

SEQ ID NO: 140426 - DNA, 25 bp, E. coli
tattgaatggcctgcactgccgtag

SEQ ID NO: 140427 - DNA, 25 bp, E. coli
tgttgatacgtcaactgcacaggat

SEQ ID NO: 140428 - DNA, 25 bp, E. coli
tgttgatacgtctactgcacaggat

SEQ ID NO: 140429 - DNA, 25 bp, E. coli
tctcgttgctggaagcatggaaaaa

SEQ ID NO: 140430 - DNA, 25 bp, E. coli
tctcgttgctggtagcatggaaaaa

SEQ ID NO: 140431 - DNA, 25 bp, E. coli
gcacaggatattgaatggccagcac

SEQ ID NO: 140432 - DNA, 25 bp, E. coli
gcacaggatattcaatggccagcac

SEQ ID NO: 140433 - DNA, 25 bp, E. coli
cgtgttgatacgacaactgcacagg

SEQ ID NO: 140434 - DNA, 25 bp, E. coli
cgtgttgatacgtcaactgcacagg

SEQ ID NO: 140435 - DNA, 25 bp, E. coli
gatacgtcaactccacaggatattg

SEQ ID NO: 140436 - DNA, 25 bp, E. coli
gatacgtcaactgcacaggatattg

SEQ ID NO: 140437 - DNA, 25 bp, E. coli
cagtgaacccggacgatataatcag

SEQ ID NO: 140438 - DNA, 25 bp, E. coli
cagtgaacccggtcgatataatcag

SEQ ID NO: 140439 - DNA, 25 bp, E. coli
ttaaccagcgcattcctcgccagtg

SEQ ID NO: 140440 - DNA, 25 bp, E. coli
ttaaccagcgcaatcctcgccagtg

SEQ ID NO: 140441 - DNA, 25 bp, E. coli
tgagcggatacaatcgggacgcgaa

SEQ ID NO: 140442 - DNA, 25 bp, E. coli
tgagcggatacattcgggacgcgaa

SEQ ID NO: 140443 - DNA, 25 bp, E. coli
gcctatcattactgtggtttcaccg

SEQ ID NO: 140444 - DNA, 25 bp, E. coli
gcctatcattacagtggtttcaccg

SEQ ID NO: 140445 - DNA, 25 bp, E. coli
gcttctccaaaagcaagtgagcgga

SEQ ID NO: 140446 - DNA, 25 bp, E. coli
gcgtctctgctgacggttagctcaa

SEQ ID NO: 140447 - DNA, 25 bp, E. coli
gcttctccaaaaccaagtgagcgga

SEQ ID NO: 140448 - DNA, 25 bp, E. coli
gcattccttctgcagttaaccagcg

SEQ ID NO: 140449 - DNA, 25 bp, E. coli
gcgtctctgctgtcggttagctcaa

SEQ ID NO: 140450 - DNA, 25 bp, E. coli
gcattccttctggagttaaccagcg

SEQ ID NO: 140451 - DNA, 25 bp, E. coli
gaaaacccatcatgtcaaagcgcat

SEQ ID NO: 140452 - DNA, 25 bp, E. coli
gaaaacccatcaagtcaaagcgcat

SEQ ID NO: 140453 - DNA, 25 bp, E. coli
cgtttgcgcaaaacggtccagccgt

SEQ ID NO: 140454 - DNA, 25 bp, E. coli
cgaatccccggtcagcaatgcgtat

SEQ ID NO: 140455 - DNA, 25 bp, E. coli
cgtttgcgcaaatcggtccagccgt

SEQ ID NO: 140456 - DNA, 25 bp, E. coli
cgaatccccggtgagcaatgcgtat

SEQ ID NO: 140457 - DNA, 25 bp, E. coli
cgtatctcgtctcccgtttgcgcaa

SEQ ID NO: 140458 - DNA, 25 bp, E. coli
cgtatctcgtctgccgtttgcgcaa

SEQ ID NO: 140459 - DNA, 25 bp, E. coli
tactccctcagacgagaacatggtc

SEQ ID NO: 140460 - DNA, 25 bp, E. coli
tactccctcagaggagaacatggtc

SEQ ID NO: 140461 - DNA, 25 bp, E. coli
agaacatggtctcgcaaaagtgtag

SEQ ID NO: 140462 - DNA, 25 bp, E. coli
agaacatggtctggcaaaagtgtag

SEQ ID NO: 140463 - DNA, 25 bp, E. coli
aaagtacggcatactatgaaaaacg

SEQ ID NO: 140464 - DNA, 25 bp, E. coli
aaaacgccagtttctccctcagagg

SEQ ID NO: 140465 - DNA, 25 bp, E. coli
aaaacgccagttactccctcagagg

SEQ ID NO: 140466 - DNA, 25 bp, E. coli
aaagtacggcattctatgaaaaacg

SEQ ID NO: 140467 - DNA, 25 bp, E. coli
ttcacgccaccaaaaatgccgttcg

SEQ ID NO: 140468 - DNA, 25 bp, E. coli
ttcacgccaccataaatgccgttcg

SEQ ID NO: 140469 - DNA, 25 bp, E. coli
cctcagaggagatcatggtctggca

SEQ ID NO: 140470 - DNA, 25 bp, E. coli
ccataaatgccgatcgatgtggcag

SEQ ID NO: 140471 - DNA, 25 bp, E. coli
gccgttcgatgtggcagttgttgaa

SEQ ID NO: 140472 - DNA, 25 bp, E. coli
gccgttcgatgtcgcagttgttgaa

SEQ ID NO: 140473 - DNA, 25 bp, E. coli
cctcagaggagaacatggtctggca

SEQ ID NO: 140474 - DNA, 25 bp, E. coli
ccataaatgccgttcgatgtggcag

SEQ ID NO: 140475 - DNA, 25 bp, E. coli
gcattctatgaataacgccagttac

SEQ ID NO: 140476 - DNA, 25 bp, E. coli
gcattctatgaaaaacgccagttac

SEQ ID NO: 140477 - DNA, 25 bp, E. coli
gcaggcacttcacgccaccataaat

SEQ ID NO: 140478 - DNA, 25 bp, E. coli
gcaggcacttcaggccaccataaat

SEQ ID NO: 140479 - DNA, 25 bp, E. coli
tggcagttgttgaaaaaagtacggc

SEQ ID NO: 140480 - DNA, 25 bp, E. coli
tggcagttgttgtaaaaagtacggc

SEQ ID NO: 140481 - DNA, 25 bp, E. coli
taaaccgttttaggatcgcagcggc

SEQ ID NO: 140482 - DNA, 25 bp, E. coli
taaaccgttttacgatcgcagcggc

SEQ ID NO: 140483 - DNA, 25 bp, E. coli
tatgcctgccagtaagggttaaccg

SEQ ID NO: 140484 - DNA, 25 bp, E. coli
tatgcctgccagaaagggttaaccg

SEQ ID NO: 140485 - DNA, 25 bp, E. coli
tgacgccccggataaaccgcttgat

SEQ ID NO: 140486 - DNA, 25 bp, E. coli
tgacgccccggaaaaaccgcttgat

SEQ ID NO: 140487 - DNA, 25 bp, E. coli
tcgactttgccctgcagtatgcctg

SEQ ID NO: 140488 - DNA, 25 bp, E. coli
tgccgtggaaatatatcgccccttc

SEQ ID NO: 140489 - DNA, 25 bp, E. coli
tgccgtggaaatttatcgccccttc

SEQ ID NO: 140490 - DNA, 25 bp, E. coli
tcgactttgcccagcagtatgcctg

SEQ ID NO: 140491 - DNA, 25 bp, E. coli
tcttaaaggctgttcgctgggctgc

SEQ ID NO: 140492 - DNA, 25 bp, E. coli
tcttaaaggctgatcgctgggctgc

SEQ ID NO: 140493 - DNA, 25 bp, E. coli
gccgacgcgccgtttaaacagtgga

SEQ ID NO: 140494 - DNA, 25 bp, E. coli
gccgacgcgccgattaaacagtgga

SEQ ID NO: 140495 - DNA, 25 bp, E. coli
cgcttgatgcgcgagaactgctcga

SEQ ID NO: 140496 - DNA, 25 bp, E. coli
ccgctggtgtcagaacccggaaagc

SEQ ID NO: 140497 - DNA, 25 bp, E. coli
ccgctggtgtcacaacccggaaagc

SEQ ID NO: 140498 - DNA, 25 bp, E. coli
cgcttgatgcgccagaactgctcga

SEQ ID NO: 140499 - DNA, 25 bp, E. coli
gatttaaaacaccttgccgacgcgc

SEQ ID NO: 140500 - DNA, 25 bp, E. coli
gatttaaaacacgttgccgacgcgc

SEQ ID NO: 140501 - DNA, 25 bp, E. coli
tggataacctgataaaactcgccgc

SEQ ID NO: 140502 - DNA, 25 bp, E. coli
tggataacctgaaaaaactcgccgc

SEQ ID NO: 140503 - DNA, 25 bp, E. coli
aaaacggacgctgattaaattcaga

SEQ ID NO: 140504 - DNA, 25 bp, E. coli
aaaacggacgctcattaaattcaga

SEQ ID NO: 140505 - DNA, 25 bp, E. coli
aaatagttatgatcttgcaagctgc

SEQ ID NO: 140506 - DNA, 25 bp, E. coli
aaatagttatgaacttgcaagctgc

SEQ ID NO: 140507 - DNA, 25 bp, E. coli
tagggaggctctacttaagactctc

SEQ ID NO: 140508 - DNA, 25 bp, E. coli
tagggaggctcttcttaagactctc

SEQ ID NO: 140509 - DNA, 25 bp, E. coli
tgcaagctgctattgatgaagaaaa

SEQ ID NO: 140510 - DNA, 25 bp, E. coli
tgcaagctgctaatgatgaagaaaa

SEQ ID NO: 140511 - DNA, 25 bp, E. coli
tctgaaaaatttagggaggctcttc

SEQ ID NO: 140512 - DNA, 25 bp, E. coli
tctgaaaaattttgggaggctcttc

SEQ ID NO: 140513 - DNA, 25 bp, E. coli
ccaagatcaatacaaggttttgctc

SEQ ID NO: 140514 - DNA, 25 bp, E. coli
ccaagatcaatagaaggttttgctc

SEQ ID NO: 140515 - DNA, 25 bp, E. coli
gcatgtacggcgtagataaaaaacc

SEQ ID NO: 140516 - DNA, 25 bp, E. coli
gcatgtacggcgaagataaaaaacc

SEQ ID NO: 140517 - DNA, 25 bp, E. coli
ggacgctcattaaattcagaaatag

SEQ ID NO: 140518 - DNA, 25 bp, E. coli
ggttttgctcaagaagaatctgaaa

SEQ ID NO: 140519 - DNA, 25 bp, E. coli
ggttttgctcaacaagaatctgaaa

SEQ ID NO: 140520 - DNA, 25 bp, E. coli
ggacgctcattatattcagaaatag

SEQ ID NO: 140521 - DNA, 25 bp, E. coli
taagactctcaggagcatgtacggc

SEQ ID NO: 140522 - DNA, 25 bp, E. coli
taagactctcagcagcatgtacggc

SEQ ID NO: 140523 - DNA, 25 bp, E. coli
gatgaagaaaaaacaccaagatcaa

SEQ ID NO: 140524 - DNA, 25 bp, E. coli
gatgaagaaaaatcaccaagatcaa

SEQ ID NO: 140525 - DNA, 25 bp, E. coli
caaatatctacgctccctcttacga

SEQ ID NO: 140526 - DNA, 25 bp, E. coli
caaatatctacggtccctcttacga

SEQ ID NO: 140527 - DNA, 25 bp, E. coli
catacatgctaaaagagaagctcca

SEQ ID NO: 140528 - DNA, 25 bp, E. coli
catcaagtgcttaaggtagagaaca

SEQ ID NO: 140529 - DNA, 25 bp, E. coli
catacatgctaatagagaagctcca

SEQ ID NO: 140530 - DNA, 25 bp, E. coli
catcaagtgctttaggtagagaaca

SEQ ID NO: 140531 - DNA, 25 bp, E. coli
tacttctggcatgattgattggcaa

SEQ ID NO: 140532 - DNA, 25 bp, E. coli
tacttctggcatcattgattggcaa

SEQ ID NO: 140533 - DNA, 25 bp, E. coli
agtcggcaaatttgtggtgggctca

SEQ ID NO: 140534 - DNA, 25 bp, E. coli
agtcggcaaattagtggtgggctca

SEQ ID NO: 140535 - DNA, 25 bp, E. coli
taccagtcttggagctgctctgaca

SEQ ID NO: 140536 - DNA, 25 bp, E. coli
taccagtcttggtgctgctctgaca

SEQ ID NO: 140537 - DNA, 25 bp, E. coli
tattttacagtttggcactctggca

SEQ ID NO: 140538 - DNA, 25 bp, E. coli
tattttacagttaggcactctggca

SEQ ID NO: 140539 - DNA, 25 bp, E. coli
tctggcaacatgcagtggtgataac

SEQ ID NO: 140540 - DNA, 25 bp, E. coli
tctggcaacatggagtggtgataac

SEQ ID NO: 140541 - DNA, 25 bp, E. coli
gcagatgctcatgcacgcaatgata

SEQ ID NO: 140542 - DNA, 25 bp, E. coli
gcagatgctcatccacgcaatgata

SEQ ID NO: 140543 - DNA, 25 bp, E. coli
gaaatgcattaagaaacaggatcgc

SEQ ID NO: 140544 - DNA, 25 bp, E. coli
gaaatgcattaacaaacaggatcgc

SEQ ID NO: 140545 - DNA, 25 bp, E. coli
taatatcgtcgaaactacatgcggg

SEQ ID NO: 140546 - DNA, 25 bp, E. coli
taatatcgtcgatactacatgcggg

SEQ ID NO: 140547 - DNA, 25 bp, E. coli
aaatcacgtactcaaatcgttctca

SEQ ID NO: 140548 - DNA, 25 bp, E. coli
aacgtcatttgttcattttgtgcgc

SEQ ID NO: 140549 - DNA, 25 bp, E. coli
aaatcacgtactgaaatcgttctca

SEQ ID NO: 140550 - DNA, 25 bp, E. coli
aacgtcatttgtacattttgtgcgc

SEQ ID NO: 140551 - DNA, 25 bp, E. coli
tgtgcgcttttctctttcagaagaa

SEQ ID NO: 140552 - DNA, 25 bp, E. coli
tgtgcgcttttcactttcagaagaa

SEQ ID NO: 140553 - DNA, 25 bp, E. coli
tcatcactttgagatacaactccct

SEQ ID NO: 140554 - DNA, 25 bp, E. coli
taagaaaaccttaagaggcattgtt

SEQ ID NO: 140555 - DNA, 25 bp, E. coli
taagaaaacctttagaggcattgtt

SEQ ID NO: 140556 - DNA, 25 bp, E. coli
tcatcactttgacatacaactccct

SEQ ID NO: 140557 - DNA, 25 bp, E. coli
gaaatcgttctcaatcaacgtcatt

SEQ ID NO: 140558 - DNA, 25 bp, E. coli
gaaatcgttctctatcaacgtcatt

SEQ ID NO: 140559 - DNA, 25 bp, E. coli
cccgacaataagtaaatcacgtact

SEQ ID NO: 140560 - DNA, 25 bp, E. coli
cccgacaataagaaaatcacgtact

SEQ ID NO: 140561 - DNA, 25 bp, E. coli
tgtttaagttaaacgaccatactgg

SEQ ID NO: 140562 - DNA, 25 bp, E. coli
tgtttaagttaatcgaccatactgg

SEQ ID NO: 140563 - DNA, 25 bp, E. coli
tcactttcagaagaaccttaagaaa

SEQ ID NO: 140564 - DNA, 25 bp, E. coli
tcagaaaatatttccaggagatggc

SEQ ID NO: 140565 - DNA, 25 bp, E. coli
tcactttcagaacaaccttaagaaa

SEQ ID NO: 140566 - DNA, 25 bp, E. coli
tcagaaaatattaccaggagatggc

SEQ ID NO: 140567 - DNA, 25 bp, E. coli
gaccatactggacatcgtcagaaaa

SEQ ID NO: 140568 - DNA, 25 bp, E. coli
gaccatactggagatcgtcagaaaa

SEQ ID NO: 140569 - DNA, 25 bp, E. coli
cagttccagggaagctatgaaatgc

SEQ ID NO: 140570 - DNA, 25 bp, E. coli
cagttccagggatgctatgaaatgc

SEQ ID NO: 140571 - DNA, 25 bp, E. coli
cagggaagctatcaaatgcgcggtt

SEQ ID NO: 140572 - DNA, 25 bp, E. coli
cagggaagctatgaaatgcgcggtt

SEQ ID NO: 140573 - DNA, 25 bp, E. coli
atgaaatgcgcgcttataccttccg

SEQ ID NO: 140574 - DNA, 25 bp, E. coli
atgaaatgcgcggttataccttccg

SEQ ID NO: 140575 - DNA, 25 bp, E. coli
ttttttgcatctatccatgcgttaa

SEQ ID NO: 140576 - DNA, 25 bp, E. coli
ttttttgcatctttccatgcgttaa

SEQ ID NO: 140577 - DNA, 25 bp, E. coli
tcgttgaatatggaagcgttatgca

SEQ ID NO: 140578 - DNA, 25 bp, E. coli
tcgttgaatatgcaagcgttatgca

SEQ ID NO: 140579 - DNA, 25 bp, E. coli
cgtgcagaaagcacaacgggtaaag

SEQ ID NO: 140580 - DNA, 25 bp, E. coli
cgtgcagaaagctcaacgggtaaag

SEQ ID NO: 140581 - DNA, 25 bp, E. coli
gatcctctgcgtacgttgaatatgg

SEQ ID NO: 140582 - DNA, 25 bp, E. coli
gttataacaccgccgagcaaaaaat

SEQ ID NO: 140583 - DNA, 25 bp, E. coli
gttataacaccggcgagcaaaaaat

SEQ ID NO: 140584 - DNA, 25 bp, E. coli
tggaagcgttatgcaaggatcaggc

SEQ ID NO: 140585 - DNA, 25 bp, E. coli
tggaagcgttatccaaggatcaggc

SEQ ID NO: 140586 - DNA, 25 bp, E. coli
gagcagtttgtctgttcttttgacg

SEQ ID NO: 140587 - DNA, 25 bp, E. coli
gagcagtttgtcagttcttttgacg

SEQ ID NO: 140588 - DNA, 25 bp, E. coli
gatcctctgcgttcgttgaatatgg

SEQ ID NO: 140589 - DNA, 25 bp, E. coli
gatggccattttatgcatctttcca

SEQ ID NO: 140590 - DNA, 25 bp, E. coli
gatggccattttttgcatctttcca

SEQ ID NO: 140591 - DNA, 25 bp, E. coli
aattcaaattttgaggtaatgcttg

SEQ ID NO: 140592 - DNA, 25 bp, E. coli
caatctcaccgatgttaccacatcg

SEQ ID NO: 140593 - DNA, 25 bp, E. coli
aaggttctcaccgttccccgatgag

SEQ ID NO: 140594 - DNA, 25 bp, E. coli
aaggttctcacccttccccgatgag

SEQ ID NO: 140595 - DNA, 25 bp, E. coli
caatctcaccgaagttaccacatcg

SEQ ID NO: 140596 - DNA, 25 bp, E. coli
aattcaaattttcaggtaatgcttg

SEQ ID NO: 140597 - DNA, 25 bp, E. coli
acccttccccgatgagtgcaaactt

SEQ ID NO: 140598 - DNA, 25 bp, E. coli
acccttccccgaagagtgcaaactt

SEQ ID NO: 140599 - DNA, 25 bp, E. coli
tcgctcctcaccgttcgggccgttg

SEQ ID NO: 140600 - DNA, 25 bp, E. coli
tcgctcctcacccttcgggccgttg

SEQ ID NO: 140601 - DNA, 25 bp, E. coli
gaagttaccacaacgctgtggtgaa

SEQ ID NO: 140602 - DNA, 25 bp, E. coli
gaagttaccacatcgctgtggtgaa

SEQ ID NO: 140603 - DNA, 25 bp, E. coli
gcaaactttcacaatctcaccgaag

SEQ ID NO: 140604 - DNA, 25 bp, E. coli
gcaaactttcactatctcaccgaag

SEQ ID NO: 140605 - DNA, 25 bp, E. coli
ccccgatgagtggaaactttcacaa

SEQ ID NO: 140606 - DNA, 25 bp, E. coli
ccccgatgagtgcaaactttcacaa

SEQ ID NO: 140607 - DNA, 25 bp, E. coli
gattattcgtcggttcgctcctcac

SEQ ID NO: 140608 - DNA, 25 bp, E. coli
gattattcgtcgcttcgctcctcac

SEQ ID NO: 140609 - DNA, 25 bp, E. coli
tcgaaccttagtcgaaggttctcac

SEQ ID NO: 140610 - DNA, 25 bp, E. coli
tcgaaccttagtggaaggttctcac

SEQ ID NO: 140611 - DNA, 25 bp, E. coli
tcaccgaagttagcacatcgctgtg

SEQ ID NO: 140612 - DNA, 25 bp, E. coli
tcaccgaagttaccacatcgctgtg

SEQ ID NO: 140613 - DNA, 25 bp, E. coli
aataatccgcctacgcaaattgacc

SEQ ID NO: 140614 - DNA, 25 bp, E. coli
caatagcggtagaaaaacgcaccac

SEQ ID NO: 140615 - DNA, 25 bp, E. coli
aataatccgccttcgcaaattgacc

SEQ ID NO: 140616 - DNA, 25 bp, E. coli
caatagcggtagtaaaacgcaccac

SEQ ID NO: 140617 - DNA, 25 bp, E. coli
caaattgacctagctcaatagcggt

SEQ ID NO: 140618 - DNA, 25 bp, E. coli
cagcttaattttaaacggcaagaga

SEQ ID NO: 140619 - DNA, 25 bp, E. coli
cagcttaatttttaacggcaagaga

SEQ ID NO: 140620 - DNA, 25 bp, E. coli
cactgcctgacacgccagttaaaaa

SEQ ID NO: 140621 - DNA, 25 bp, E. coli
caaattgacctacctcaatagcggt

SEQ ID NO: 140622 - DNA, 25 bp, E. coli
cactgcctgacaggccagttaaaaa

SEQ ID NO: 140623 - DNA, 25 bp, E. coli
aaaattctgaatctttttgcgcgaa

SEQ ID NO: 140624 - DNA, 25 bp, E. coli
aaaattctgaatgtttttgcgcgaa

SEQ ID NO: 140625 - DNA, 25 bp, E. coli
tattactgcgcgaggaaactaacag

SEQ ID NO: 140626 - DNA, 25 bp, E. coli
tattactgcgcgtggaaactaacag

SEQ ID NO: 140627 - DNA, 25 bp, E. coli
tgtttgccacaaaataatccgcctt

SEQ ID NO: 140628 - DNA, 25 bp, E. coli
tgtttgccacaatataatccgcctt

SEQ ID NO: 140629 - DNA, 25 bp, E. coli
tgcgcgaaatcataaagaacatctg

SEQ ID NO: 140630 - DNA, 25 bp, E. coli
tgcgcgaaatcaaaaagaacatctg

SEQ ID NO: 140631 - DNA, 25 bp, E. coli
cggcaagagagacaaaacagcgagc

SEQ ID NO: 140632 - DNA, 25 bp, E. coli
cggcaagagagagaaaacagcgagc

SEQ ID NO: 140633 - DNA, 25 bp, E. coli
ggtagaaaaacgcaccactgcctga

SEQ ID NO: 140634 - DNA, 25 bp, E. coli
ggtagaaaaacggaccactgcctga

SEQ ID NO: 140635 - DNA, 25 bp, E. coli
aacatttacgcctctttacgcctga

SEQ ID NO: 140636 - DNA, 25 bp, E. coli
aacatttacgccactttacgcctga

SEQ ID NO: 140637 - DNA, 25 bp, E. coli
tatccgtcaccggaaatcactgttt

SEQ ID NO: 140638 - DNA, 25 bp, E. coli
tatccgtcaccgcaaatcactgttt

SEQ ID NO: 140639 - DNA, 25 bp, E. coli
tatctttctcgtcaagacgcactgg

SEQ ID NO: 140640 - DNA, 25 bp, E. coli
tatctttctcgtgaagacgcactgg

SEQ ID NO: 140641 - DNA, 25 bp, E. coli
tgaataagcgcgatgcaatcaatca

SEQ ID NO: 140642 - DNA, 25 bp, E. coli
tgaataagcgcgttgcaatcaatca

SEQ ID NO: 140643 - DNA, 25 bp, E. coli
tccacggcgcatagcaggatctgaa

SEQ ID NO: 140644 - DNA, 25 bp, E. coli
tccacggcgcattgcaggatctgaa

SEQ ID NO: 140645 - DNA, 25 bp, E. coli
gaagtggcacaggttttcggaacga

SEQ ID NO: 140646 - DNA, 25 bp, E. coli
gaagtggcacagcttttcggaacga

SEQ ID NO: 140647 - DNA, 25 bp, E. coli
cccagcgtctgtaatatggtgtaca

SEQ ID NO: 140648 - DNA, 25 bp, E. coli
cccagcgtctgttatatggtgtaca

SEQ ID NO: 140649 - DNA, 25 bp, E. coli
gatcgtatcacggagattaacggca

SEQ ID NO: 140650 - DNA, 25 bp, E. coli
ggcttgccacggaacaacatttacg

SEQ ID NO: 140651 - DNA, 25 bp, E. coli
ggcttgccacggtacaacatttacg

SEQ ID NO: 140652 - DNA, 25 bp, E. coli
gatcgtatcacgcagattaacggca

SEQ ID NO: 140653 - DNA, 25 bp, E. coli
gatcgcttccgttaatcggtcggcg

SEQ ID NO: 140654 - DNA, 25 bp, E. coli
gatctgaaaagcaaaccgttcgcca

SEQ ID NO: 140655 - DNA, 25 bp, E. coli
gatctgaaaagctaaccgttcgcca

SEQ ID NO: 140656 - DNA, 25 bp, E. coli
gatcgcttccgtaaatcggtcggcg

SEQ ID NO: 140657 - DNA, 25 bp, E. coli
caccagaaacggatgcggaacgagc

SEQ ID NO: 140658 - DNA, 25 bp, E. coli
caccagaaacggttgcggaacgagc

SEQ ID NO: 140659 - DNA, 25 bp, E. coli
cattctaccgataaccagacccgga

SEQ ID NO: 140660 - DNA, 25 bp, E. coli
cattctaccgattaccagacccgga

SEQ ID NO: 140661 - DNA, 25 bp, E. coli
taccagacccggacggcttattggg

SEQ ID NO: 140662 - DNA, 25 bp, E. coli
taccagacccggtcggcttattggg

SEQ ID NO: 140663 - DNA, 25 bp, E. coli
acccgaatggttaatgaagcacatt

SEQ ID NO: 140664 - DNA, 25 bp, E. coli
acccgaatggtttatgaagcacatt

SEQ ID NO: 140665 - DNA, 25 bp, E. coli
tatccattatcacccgcaggaagcg

SEQ ID NO: 140666 - DNA, 25 bp, E. coli
tatccattatcagccgcaggaagcg

SEQ ID NO: 140667 - DNA, 25 bp, E. coli
tattgggaattagtccgcgatcact

SEQ ID NO: 140668 - DNA, 25 bp, E. coli
tattgggaattactccgcgatcact

SEQ ID NO: 140669 - DNA, 25 bp, E. coli
tgcggaacgagcagctgtgctttgc

SEQ ID NO: 140670 - DNA, 25 bp, E. coli
tgcggaacgagctgctgtgctttgc

SEQ ID NO: 140671 - DNA, 25 bp, E. coli
gctgtgctttgctttgctgcggaaa

SEQ ID NO: 140672 - DNA, 25 bp, E. coli
gctgtgctttgcattgctgcggaaa

SEQ ID NO: 140673 - DNA, 25 bp, E. coli
gaatttgatcacagcaatattatcc

SEQ ID NO: 140674 - DNA, 25 bp, E. coli
gaatttgatcactgcaatattatcc

SEQ ID NO: 140675 - DNA, 25 bp, E. coli
ccgcgatcacttagcaatattgaaa

SEQ ID NO: 140676 - DNA, 25 bp, E. coli
ccgcgatcactttgcaatattgaaa

SEQ ID NO: 140677 - DNA, 25 bp, E. coli
ggatcccatacccttagcaccagaa

SEQ ID NO: 140678 - DNA, 25 bp, E. coli
ggatcccataccgttagcaccagaa

SEQ ID NO: 140679 - DNA, 25 bp, E. coli
caatctctgtatcatgatgaacaaa

SEQ ID NO: 140680 - DNA, 25 bp, E. coli
caatctctgtatgatgatgaacaaa

SEQ ID NO: 140681 - DNA, 25 bp, E. coli
caaaaatattttatgagcccgatgc

SEQ ID NO: 140682 - DNA, 25 bp, E. coli
caaacagtatatgaatgacatggca

SEQ ID NO: 140683 - DNA, 25 bp, E. coli
caaaaatattttttgagcccgatgc

SEQ ID NO: 140684 - DNA, 25 bp, E. coli
caaacagtatatcaatgacatggca

SEQ ID NO: 140685 - DNA, 25 bp, E. coli
tatgagcccgatgcaagactggttg

SEQ ID NO: 140686 - DNA, 25 bp, E. coli
tatgagcccgatccaagactggttg

SEQ ID NO: 140687 - DNA, 25 bp, E. coli
tgatgatgaacaaaagagagcttta

SEQ ID NO: 140688 - DNA, 25 bp, E. coli
tgatgaagcaagcaatggcaaacag

SEQ ID NO: 140689 - DNA, 25 bp, E. coli
tgatgaagcaaggaatggcaaacag

SEQ ID NO: 140690 - DNA, 25 bp, E. coli
tgatgatgaacataagagagcttta

SEQ ID NO: 140691 - DNA, 25 bp, E. coli
tccggattcaatgtctgtatgatga

SEQ ID NO: 140692 - DNA, 25 bp, E. coli
tccggattcaatctctgtatgatga

SEQ ID NO: 140693 - DNA, 25 bp, E. coli
gcaaggaatggcaaacagtatatca

SEQ ID NO: 140694 - DNA, 25 bp, E. coli
gagctttaagtgtactggtaaatga

SEQ ID NO: 140695 - DNA, 25 bp, E. coli
gcaagactggttccagaagagatta

SEQ ID NO: 140696 - DNA, 25 bp, E. coli
gcaaggaatggctaacagtatatca

SEQ ID NO: 140697 - DNA, 25 bp, E. coli
gcaagactggttgcagaagagatta

SEQ ID NO: 140698 - DNA, 25 bp, E. coli
gagctttaagtgaactggtaaatga

SEQ ID NO: 140699 - DNA, 25 bp, E. coli
tggtaaatgattatacttcaaaaga

SEQ ID NO: 140700 - DNA, 25 bp, E. coli
tggtaaatgattttacttcaaaaga

SEQ ID NO: 140701 - DNA, 25 bp, E. coli
aaatgcttacggtcagaaggcgggc

SEQ ID NO: 140702 - DNA, 25 bp, E. coli
aaatgcttacggacagaaggcgggc

SEQ ID NO: 140703 - DNA, 25 bp, E. coli
tagcaatcagctggatcaacggtct

SEQ ID NO: 140704 - DNA, 25 bp, E. coli
tagcaatcagctcgatcaacggtct

SEQ ID NO: 140705 - DNA, 25 bp, E. coli
tatgagtcagcagcgcacgaagttt

SEQ ID NO: 140706 - DNA, 25 bp, E. coli
tatgagtcagcaccgcacgaagttt

SEQ ID NO: 140707 - DNA, 25 bp, E. coli
tattggcctggtggacaatctctcc

SEQ ID NO: 140708 - DNA, 25 bp, E. coli
tattggcctggtcgacaatctctcc

SEQ ID NO: 140709 - DNA, 25 bp, E. coli
tgacgacactatactgccgacagcg

SEQ ID NO: 140710 - DNA, 25 bp, E. coli
tgacgacactattctgccgacagcg

SEQ ID NO: 140711 - DNA, 25 bp, E. coli
gactgtaacatcagcccaggcgaat

SEQ ID NO: 140712 - DNA, 25 bp, E. coli
gactgtaacatctgcccaggcgaat

SEQ ID NO: 140713 - DNA, 25 bp, E. coli
gaaagaggtcgcagctgcaaccaat

SEQ ID NO: 140714 - DNA, 25 bp, E. coli
gaaatggcgcatccgttacagccgg

SEQ ID NO: 140715 - DNA, 25 bp, E. coli
gaaatggcgcatgcgttacagccgg

SEQ ID NO: 140716 - DNA, 25 bp, E. coli
gaaagaggtcgctgctgcaaccaat

SEQ ID NO: 140717 - DNA, 25 bp, E. coli
tggtacacctcgtcgtccggtaagg

SEQ ID NO: 140718 - DNA, 25 bp, E. coli
tggtacacctcgacgtccggtaagg

SEQ ID NO: 140719 - DNA, 25 bp, E. coli
taatgacctgcaggaccagtgtgcg

SEQ ID NO: 140720 - DNA, 25 bp, E. coli
taatgacctgcacgaccagtgtgcg

SEQ ID NO: 140721 - DNA, 25 bp, E. coli
gaccttaacaaacaggccggtgatg

SEQ ID NO: 140722 - DNA, 25 bp, E. coli
gaccttaacaaagaggccggtgatg

SEQ ID NO: 140723 - DNA, 25 bp, E. coli
cagccttagcgcctgtgtgcagcaa

SEQ ID NO: 140724 - DNA, 25 bp, E. coli
cagccttagcgcgtgtgtgcagcaa

SEQ ID NO: 140725 - DNA, 25 bp, E. coli
cagttaggctttctacgtatccacg

SEQ ID NO: 140726 - DNA, 25 bp, E. coli
cagatgaaacacagcgtcagcacgc

SEQ ID NO: 140727 - DNA, 25 bp, E. coli
cagttaggctttgtacgtatccacg

SEQ ID NO: 140728 - DNA, 25 bp, E. coli
cagatgaaacactgcgtcagcacgc

SEQ ID NO: 140729 - DNA, 25 bp, E. coli
tgggcaaattcacggaacaatagac

SEQ ID NO: 140730 - DNA, 25 bp, E. coli
tgtcgctggtgaatattacgcctga

SEQ ID NO: 140731 - DNA, 25 bp, E. coli
tgtcgctggtgattattacgcctga

SEQ ID NO: 140732 - DNA, 25 bp, E. coli
tgggcaaattcagggaacaatagac

SEQ ID NO: 140733 - DNA, 25 bp, E. coli
tgcagcaaagtgtagtgcgacagat

SEQ ID NO: 140734 - DNA, 25 bp, E. coli
tgcagcaaagtgaagtgcgacagat

SEQ ID NO: 140735 - DNA, 25 bp, E. coli
tcagcacgctgaaccaggagatgac

SEQ ID NO: 140736 - DNA, 25 bp, E. coli
gctgaatgcaaattccagcagtggg

SEQ ID NO: 140737 - DNA, 25 bp, E. coli
gctgaatgcaaaatccagcagtggg

SEQ ID NO: 140738 - DNA, 25 bp, E. coli
ccccagcgatgttgatattccgtta

SEQ ID NO: 140739 - DNA, 25 bp, E. coli
ccccagcgatgtagatattccgtta

SEQ ID NO: 140740 - DNA, 25 bp, E. coli
gatcggtacttttcgtatgtcgctg

SEQ ID NO: 140741 - DNA, 25 bp, E. coli
gtcaaaatcactcagcaaaacaggc

SEQ ID NO: 140742 - DNA, 25 bp, E. coli
gtcaaaatcactgagcaaaacaggc

SEQ ID NO: 140743 - DNA, 25 bp, E. coli
tcagcacgctgatccaggagatgac

SEQ ID NO: 140744 - DNA, 25 bp, E. coli
gatcggtactttacgtatgtcgctg

SEQ ID NO: 140745 - DNA, 25 bp, E. coli
aagcagtggtcctacgcggtggaat

SEQ ID NO: 140746 - DNA, 25 bp, E. coli
aagcagtggtccaacgcggtggaat

SEQ ID NO: 140747 - DNA, 25 bp, E. coli
aacgcggtggaaattctgcctgaaa

SEQ ID NO: 140748 - DNA, 25 bp, E. coli
aacgcggtggaatttctgcctgaaa

SEQ ID NO: 140749 - DNA, 25 bp, E. coli
actgctgggtaacgatcagcgcgca

SEQ ID NO: 140750 - DNA, 25 bp, E. coli
actgctgggtaaggatcagcgcgca

SEQ ID NO: 140751 - DNA, 25 bp, E. coli
ttgcatagcgtaaccgccgaaagcg

SEQ ID NO: 140752 - DNA, 25 bp, E. coli
ttgcatagcgtatccgccgaaagcg

SEQ ID NO: 140753 - DNA, 25 bp, E. coli
tgatattcgcatagcagatgtgagc

SEQ ID NO: 140754 - DNA, 25 bp, E. coli
tgatattcgcattgcagatgtgagc

SEQ ID NO: 140755 - DNA, 25 bp, E. coli
tcctctgccagtttgaagcagtgcg

SEQ ID NO: 140756 - DNA, 25 bp, E. coli
tcctctgccagtatgaagcagtgcg

SEQ ID NO: 140757 - DNA, 25 bp, E. coli
tctggccgatttactcgacccgcat

SEQ ID NO: 140758 - DNA, 25 bp, E. coli
tctggccgattttctcgacccgcat

SEQ ID NO: 140759 - DNA, 25 bp, E. coli
ccaactggtgaaagaaggcgaactg

SEQ ID NO: 140760 - DNA, 25 bp, E. coli
ccaactggtgaatgaaggcgaactg

SEQ ID NO: 140761 - DNA, 25 bp, E. coli
gcgcaccattcttgatgtcggctgt

SEQ ID NO: 140762 - DNA, 25 bp, E. coli
gcgcaccattctagatgtcggctgt

SEQ ID NO: 140763 - DNA, 25 bp, E. coli
cgcatctggcggagggtatcgatcc

SEQ ID NO: 140764 - DNA, 25 bp, E. coli
cgcatctggcggtgggtatcgatcc

SEQ ID NO: 140765 - DNA, 25 bp, E. coli
ctggcagttaaaagaccaactggtg

SEQ ID NO: 140766 - DNA, 25 bp, E. coli
ctggcagttaaatgaccaactggtg

SEQ ID NO: 140767 - DNA, 25 bp, E. coli
tacactgatcacgtggcgtagccac

SEQ ID NO: 140768 - DNA, 25 bp, E. coli
tacactgatcacctggcgtagccac

SEQ ID NO: 140769 - DNA, 25 bp, E. coli
tctcgtcagcagcaaggtatcattc

SEQ ID NO: 140770 - DNA, 25 bp, E. coli
tctttcatgcggttggcaggccagg

SEQ ID NO: 140771 - DNA, 25 bp, E. coli
tctcgtcagcaggaaggtatcattc

SEQ ID NO: 140772 - DNA, 25 bp, E. coli
tctttcatgcggatggcaggccagg

SEQ ID NO: 140773 - DNA, 25 bp, E. coli
gctgtacatcacagccgcactatcg

SEQ ID NO: 140774 - DNA, 25 bp, E. coli
gctgtacatcactgccgcactatcg

SEQ ID NO: 140775 - DNA, 25 bp, E. coli
gcactatcgctcgtcatctcaaagt

SEQ ID NO: 140776 - DNA, 25 bp, E. coli
gcactatcgctcctcatctcaaagt

SEQ ID NO: 140777 - DNA, 25 bp, E. coli
cgttccagggcaacaactctttcat

SEQ ID NO: 140778 - DNA, 25 bp, E. coli
cgttccagggcatcaactctttcat

SEQ ID NO: 140779 - DNA, 25 bp, E. coli
gatcaggctgtacatcactgccgca

SEQ ID NO: 140780 - DNA, 25 bp, E. coli
gatcaggctgtagatcactgccgca

SEQ ID NO: 140781 - DNA, 25 bp, E. coli
ggcgtagccacgattccggctcgat

SEQ ID NO: 140782 - DNA, 25 bp, E. coli
ggcgtagccacgtttccggctcgat

SEQ ID NO: 140783 - DNA, 25 bp, E. coli
ggctcgattccgataagttttgcag

SEQ ID NO: 140784 - DNA, 25 bp, E. coli
ggccaggtgttgattacactgatca

SEQ ID NO: 140785 - DNA, 25 bp, E. coli
ggccaggtgttgtttacactgatca

SEQ ID NO: 140786 - DNA, 25 bp, E. coli
ggctcgattccgttaagttttgcag

SEQ ID NO: 140787 - DNA, 25 bp, E. coli
taagttttgcaggtaccgatcaggc

SEQ ID NO: 140788 - DNA, 25 bp, E. coli
taagttttgcagctaccgatcaggc

SEQ ID NO: 140789 - DNA, 25 bp, E. coli
aggacacgccgcagcgcttgatcgc

SEQ ID NO: 140790 - DNA, 25 bp, E. coli
aggacacgccgctgcgcttgatcgc

SEQ ID NO: 140791 - DNA, 25 bp, E. coli
ttgacatcctgcacgccgggcacgt

SEQ ID NO: 140792 - DNA, 25 bp, E. coli
ttgaagaggacaggccgcagcgctt

SEQ ID NO: 140793 - DNA, 25 bp, E. coli
ttgacatcctgctcgccgggcacgt

SEQ ID NO: 140794 - DNA, 25 bp, E. coli
ttgaagaggacacgccgcagcgctt

SEQ ID NO: 140795 - DNA, 25 bp, E. coli
tgctcgacgaccaacatcatcaaga

SEQ ID NO: 140796 - DNA, 25 bp, E. coli
tgctcgacgacctacatcatcaaga

SEQ ID NO: 140797 - DNA, 25 bp, E. coli
gcgactataaacgagaagagattgc

SEQ ID NO: 140798 - DNA, 25 bp, E. coli
gcgactataaaccagaagagattgc

SEQ ID NO: 140799 - DNA, 25 bp, E. coli
gaaaggcggcgagtataaaccagaa

SEQ ID NO: 140800 - DNA, 25 bp, E. coli
gaaaggcggcgactataaaccagaa

SEQ ID NO: 140801 - DNA, 25 bp, E. coli
gacggttgctcgacgaccaacatca

SEQ ID NO: 140802 - DNA, 25 bp, E. coli
cttgatcgccgggatcttgccagat

SEQ ID NO: 140803 - DNA, 25 bp, E. coli
cttgatcgccggcatcttgccagat

SEQ ID NO: 140804 - DNA, 25 bp, E. coli
gtgtctttgacatcctgcacgccgg

SEQ ID NO: 140805 - DNA, 25 bp, E. coli
gtgtctttgacaacctgcacgccgg

SEQ ID NO: 140806 - DNA, 25 bp, E. coli
gaccaacatcatgaagaagatccaa

SEQ ID NO: 140807 - DNA, 25 bp, E. coli
gaccaacatcatcaagaagatccaa

SEQ ID NO: 140808 - DNA, 25 bp, E. coli
gacggttgctcgtcgaccaacatca

SEQ ID NO: 140809 - DNA, 25 bp, E. coli
gaccaacggtgtgtttgacatcctg

SEQ ID NO: 140810 - DNA, 25 bp, E. coli
gaccaacggtgtctttgacatcctg

SEQ ID NO: 140811 - DNA, 25 bp, E. coli
aatgatcggtccaaaagcctatgcc

SEQ ID NO: 140812 - DNA, 25 bp, E. coli
aatgatcggtcctaaagcctatgcc

SEQ ID NO: 140813 - DNA, 25 bp, E. coli
cagatgtcaggattgaacgccgggc

SEQ ID NO: 140814 - DNA, 25 bp, E. coli
cagatgtcaggaatgaacgccgggc

SEQ ID NO: 140815 - DNA, 25 bp, E. coli
tacgtaccgcactggctgaagtcac

SEQ ID NO: 140816 - DNA, 25 bp, E. coli
tacgtaccgcacaggctgaagtcac

SEQ ID NO: 140817 - DNA, 25 bp, E. coli
tgtaaagtggcacagacaagtcacc

SEQ ID NO: 140818 - DNA, 25 bp, E. coli
tgttagagaacacccttgaaccgta

SEQ ID NO: 140819 - DNA, 25 bp, E. coli
tgtaaagtggcagagacaagtcacc

SEQ ID NO: 140820 - DNA, 25 bp, E. coli
tgttagagaacagccttgaaccgta

SEQ ID NO: 140821 - DNA, 25 bp, E. coli
tgcactggctccaagtttcagcgcg

SEQ ID NO: 140822 - DNA, 25 bp, E. coli
tgcactggctcctagtttcagcgcg

SEQ ID NO: 140823 - DNA, 25 bp, E. coli
tctggcgtgaaaccaaagtacgtac

SEQ ID NO: 140824 - DNA, 25 bp, E. coli
tctggcgtgaaagcaaagtacgtac

SEQ ID NO: 140825 - DNA, 25 bp, E. coli
cctttatgtgggaatgcaggtcgca

SEQ ID NO: 140826 - DNA, 25 bp, E. coli
cctttatgtgggtatgcaggtcgca

SEQ ID NO: 140827 - DNA, 25 bp, E. coli
gctatctggctagaaatccgcgctt

SEQ ID NO: 140828 - DNA, 25 bp, E. coli
gcgacgatctatgcaggaacactgg

SEQ ID NO: 140829 - DNA, 25 bp, E. coli
gctatctggctacaaatccgcgctt

SEQ ID NO: 140830 - DNA, 25 bp, E. coli
gcgacgatctatccaggaacactgg

SEQ ID NO: 140831 - DNA, 25 bp, E. coli
gcaaatatctggttttctccgaggg

SEQ ID NO: 140832 - DNA, 25 bp, E. coli
gcaaatatctggatttctccgaggg

SEQ ID NO: 140833 - DNA, 25 bp, E. coli
taaaaacattggcttactatgcgtc

SEQ ID NO: 140834 - DNA, 25 bp, E. coli
taaaaacattgggttactatgcgtc

SEQ ID NO: 140835 - DNA, 25 bp, E. coli
tgacatcgataagagactaagtgcg

SEQ ID NO: 140836 - DNA, 25 bp, E. coli
tgacatcgataacagactaagtgcg

SEQ ID NO: 140837 - DNA, 25 bp, E. coli
tgctggcaataagaggaagaaggcc

SEQ ID NO: 140838 - DNA, 25 bp, E. coli
tcgactggctaatgaaggagcctca

SEQ ID NO: 140839 - DNA, 25 bp, E. coli
tgctggcaataacaggaagaaggcc

SEQ ID NO: 140840 - DNA, 25 bp, E. coli
tccaaaccaaacaggagatgcagtt

SEQ ID NO: 140841 - DNA, 25 bp, E. coli
tcgactggctaaagaaggagcctca

SEQ ID NO: 140842 - DNA, 25 bp, E. coli
tccaaaccaaactggagatgcagtt

SEQ ID NO: 140843 - DNA, 25 bp, E. coli
gaagcgactgcctttagaatgctgg

SEQ ID NO: 140844 - DNA, 25 bp, E. coli
gaagcgactgccattagaatgctgg

SEQ ID NO: 140845 - DNA, 25 bp, E. coli
gaaaactgcgtaaaccctcataaag

SEQ ID NO: 140846 - DNA, 25 bp, E. coli
gaaaactgcgtataccctcataaag

SEQ ID NO: 140847 - DNA, 25 bp, E. coli
ccgtcaaaattcgatgttaggtcag

SEQ ID NO: 140848 - DNA, 25 bp, E. coli
ccgtcaaaattccatgttaggtcag

SEQ ID NO: 140849 - DNA, 25 bp, E. coli
cgtgtaaaaaattcaatccctggag

SEQ ID NO: 140850 - DNA, 25 bp, E. coli
cgtgtaaaaaatacaatccctggag

SEQ ID NO: 140851 - DNA, 25 bp, E. coli
gatatacgttaggaagtcgactggc

SEQ ID NO: 140852 - DNA, 25 bp, E. coli
gatagagccgttgttatatgacagc

SEQ ID NO: 140853 - DNA, 25 bp, E. coli
gatatacgttagcaagtcgactggc

SEQ ID NO: 140854 - DNA, 25 bp, E. coli
gatagagccgttcttatatgacagc

SEQ ID NO: 140855 - DNA, 25 bp, E. coli
caatcgcgatcggatagagctctat

SEQ ID NO: 140856 - DNA, 25 bp, E. coli
caatcgcgatcgcatagagctctat

SEQ ID NO: 140857 - DNA, 25 bp, E. coli
tatcccttctgtaaaactggtagga

SEQ ID NO: 140858 - DNA, 25 bp, E. coli
tatatgaatggttttgttgcccctg

SEQ ID NO: 140859 - DNA, 25 bp, E. coli
tatatgaatggtattgttgcccctg

SEQ ID NO: 140860 - DNA, 25 bp, E. coli
tattatcaggaactccagattctgg

SEQ ID NO: 140861 - DNA, 25 bp, E. coli
tatcccttctgttaaactggtagga

SEQ ID NO: 140862 - DNA, 25 bp, E. coli
tattatcaggaagtccagattctgg

SEQ ID NO: 140863 - DNA, 25 bp, E. coli
tttttaaaacacaacaagagtcgag

SEQ ID NO: 140864 - DNA, 25 bp, E. coli
tttttaaaacactacaagagtcgag

SEQ ID NO: 140865 - DNA, 25 bp, E. coli
tccttccgcaggtttccgttatgag

SEQ ID NO: 140866 - DNA, 25 bp, E. coli
tccttccgcaggattccgttatgag

SEQ ID NO: 140867 - DNA, 25 bp, E. coli
tcctcaaaatatgatcgctggcaat

SEQ ID NO: 140868 - DNA, 25 bp, E. coli
tcctcaaaatatcatcgctggcaat

SEQ ID NO: 140869 - DNA, 25 bp, E. coli
gcattctgaagacaaaaaccgcatg

SEQ ID NO: 140870 - DNA, 25 bp, E. coli
gcattctgaagagaaaaaccgcatg

SEQ ID NO: 140871 - DNA, 25 bp, E. coli
gaactggagccagcttttcctataa

SEQ ID NO: 140872 - DNA, 25 bp, E. coli
gaactggagccaccttttcctataa

SEQ ID NO: 140873 - DNA, 25 bp, E. coli
gataagtggaaactggaactacgct

SEQ ID NO: 140874 - DNA, 25 bp, E. coli
gataagtggaaagtggaactacgct

SEQ ID NO: 140875 - DNA, 25 bp, E. coli
taataatgataaaacgctctgggca

SEQ ID NO: 140876 - DNA, 25 bp, E. coli
taataatgataatacgctctgggca

SEQ ID NO: 140877 - DNA, 25 bp, E. coli
caaggatggtatctgcaaaaatgca

SEQ ID NO: 140878 - DNA, 25 bp, E. coli
caaggatggtatgtgcaaaaatgca

SEQ ID NO: 140879 - DNA, 25 bp, E. coli
caggctgcagactcaatggataaaa

SEQ ID NO: 140880 - DNA, 25 bp, E. coli
caggctgcagacacaatggataaaa

SEQ ID NO: 140881 - DNA, 25 bp, E. coli
catgttcaatgctcaggctgcagac

SEQ ID NO: 140882 - DNA, 25 bp, E. coli
catgttcaatgcacaggctgcagac

SEQ ID NO: 140883 - DNA, 25 bp, E. coli
taaaacacatgaagtaaaaggcagc

SEQ ID NO: 140884 - DNA, 25 bp, E. coli
tactatccgcgcagttcatgttcaa

SEQ ID NO: 140885 - DNA, 25 bp, E. coli
tactatccgcgctgttcatgttcaa

SEQ ID NO: 140886 - DNA, 25 bp, E. coli
taaaacacatgatgtaaaaggcagc

SEQ ID NO: 140887 - DNA, 25 bp, E. coli
agtaaaaggcaggatgtccagcgcg

SEQ ID NO: 140888 - DNA, 25 bp, E. coli
agtaaaaggcagcatgtccagcgcg

SEQ ID NO: 140889 - DNA, 25 bp, E. coli
acggatgggatgaaaaatgaccaca

SEQ ID NO: 140890 - DNA, 25 bp, E. coli
acggatgggatgtaaaatgaccaca

SEQ ID NO: 140891 - DNA, 25 bp, E. coli
tatttctgtaactgtactatccgcg

SEQ ID NO: 140892 - DNA, 25 bp, E. coli
tatttctgtaacagtactatccgcg

SEQ ID NO: 140893 - DNA, 25 bp, E. coli
tgtccagcgcgcttgataaaatgtg

SEQ ID NO: 140894 - DNA, 25 bp, E. coli
tgtccagcgcgcatgataaaatgtg

SEQ ID NO: 140895 - DNA, 25 bp, E. coli
gaacacatgagcaaaacggatggga

SEQ ID NO: 140896 - DNA, 25 bp, E. coli
gaacacatgagctaaacggatggga

SEQ ID NO: 140897 - DNA, 25 bp, E. coli
gaccacatgggttaaaaagacaata

SEQ ID NO: 140898 - DNA, 25 bp, E. coli
gaccacatgggtaaaaaagacaata

SEQ ID NO: 140899 - DNA, 25 bp, E. coli
aaccgcttctatgccggtgacggca

SEQ ID NO: 140900 - DNA, 25 bp, E. coli
aaggcgcggagatcgtcgtccatat

SEQ ID NO: 140901 - DNA, 25 bp, E. coli
aaggcgcggagaacgtcgtccatat

SEQ ID NO: 140902 - DNA, 25 bp, E. coli
aaccgcttctatcccggtgacggca

SEQ ID NO: 140903 - DNA, 25 bp, E. coli
aaaaggcgcggacatcgtcgtccat

SEQ ID NO: 140904 - DNA, 25 bp, E. coli
aaaaggcgcggagatcgtcgtccat

SEQ ID NO: 140905 - DNA, 25 bp, E. coli
tcgtccatatgggtatcgacaccgt

SEQ ID NO: 140906 - DNA, 25 bp, E. coli
tcgtccatatggctatcgacaccgt

SEQ ID NO: 140907 - DNA, 25 bp, E. coli
gtccatatgggtttcgacaccgtag

SEQ ID NO: 140908 - DNA, 25 bp, E. coli
ccatatgggtatggacaccgtagcg

SEQ ID NO: 140909 - DNA, 25 bp, E. coli
ccgtggtccggtagccgctgcgtca

SEQ ID NO: 140910 - DNA, 25 bp, E. coli
ccgtggtccggttgccgctgcgtca

SEQ ID NO: 140911 - DNA, 25 bp, E. coli
ccatatgggtatcgacaccgtagcg

SEQ ID NO: 140912 - DNA, 25 bp, E. coli
gcggagatcgtcgtccatatgggta

SEQ ID NO: 140913 - DNA, 25 bp, E. coli
gcggagatcgtcctccatatgggta

SEQ ID NO: 140914 - DNA, 25 bp, E. coli
cgctgcgtcagctgaagcaactccg

SEQ ID NO: 140915 - DNA, 25 bp, E. coli
cgctgcgtcagcagaagcaactccg

SEQ ID NO: 140916 - DNA, 25 bp, E. coli
gtccatatgggtatcgacaccgtag

SEQ ID NO: 140917 - DNA, 25 bp, E. coli
cttctatgccggagacggcaccgcg

SEQ ID NO: 140918 - DNA, 25 bp, E. coli
cttctatgccggtgacggcaccgcg

SEQ ID NO: 140919 - DNA, 25 bp, E. coli
gagatcgtcgtcgatatgggtatcg

SEQ ID NO: 140920 - DNA, 25 bp, E. coli
gagatcgtcgtccatatgggtatcg

SEQ ID NO: 140921 - DNA, 25 bp, E. coli
aatcgaatctctcctctgcgccgtg

SEQ ID NO: 140922 - DNA, 25 bp, E. coli
aatcgaatctctgctctgcgccgtg

SEQ ID NO: 140923 - DNA, 25 bp, E. coli
agcgttttgtgaagcgtctgcccga

SEQ ID NO: 140924 - DNA, 25 bp, E. coli
agcgttttgtgatgcgtctgcccga

SEQ ID NO: 140925 - DNA, 25 bp, E. coli
ttttctcggtctgcaaatggcccat

SEQ ID NO: 140926 - DNA, 25 bp, E. coli
ttttctcggtctccaaatggcccat

SEQ ID NO: 140927 - DNA, 25 bp, E. coli
gctgccgtgggaactgcctaattca

SEQ ID NO: 140928 - DNA, 25 bp, E. coli
gctgccgtgggatctgcctaattca

SEQ ID NO: 140929 - DNA, 25 bp, E. coli
gaaagaaaaatatactgccgcacgg

SEQ ID NO: 140930 - DNA, 25 bp, E. coli
gacatgttgctaccatcggttcgca

SEQ ID NO: 140931 - DNA, 25 bp, E. coli
gaaagaaaaataaactgccgcacgg

SEQ ID NO: 140932 - DNA, 25 bp, E. coli
gacatgttgctagcatcggttcgca

SEQ ID NO: 140933 - DNA, 25 bp, E. coli
cgtatcgcacgtatgactcgcctgg

SEQ ID NO: 140934 - DNA, 25 bp, E. coli
cgtatcgcacgtttgactcgcctgg

SEQ ID NO: 140935 - DNA, 25 bp, E. coli
gattattgctatcccgctggcgatg

SEQ ID NO: 140936 - DNA, 25 bp, E. coli
gattattgctatgccgctggcgatg

SEQ ID NO: 140937 - DNA, 25 bp, E. coli
ggattgttaacctgctcggcggaca

SEQ ID NO: 140938 - DNA, 25 bp, E. coli
ggattgttaaccagctcggcggaca

SEQ ID NO: 140939 - DNA, 25 bp, E. coli
tggagtcacgtcttgaaggcaaacg

SEQ ID NO: 140940 - DNA, 25 bp, E. coli
tggagtcacgtcatgaaggcaaacg

SEQ ID NO: 140941 - DNA, 25 bp, E. coli
tcaatggcaatggtcggcgcaatcg

SEQ ID NO: 140942 - DNA, 25 bp, E. coli
tcaatggcaatgctcggcgcaatcg

SEQ ID NO: 140943 - DNA, 25 bp, E. coli
cacgatggtcgtaatagatttgtaa

SEQ ID NO: 140944 - DNA, 25 bp, E. coli
caaatataatgcttggagatggaaa

SEQ ID NO: 140945 - DNA, 25 bp, E. coli
cacgatggtcgttatagatttgtaa

SEQ ID NO: 140946 - DNA, 25 bp, E. coli
caaatataatgcatggagatggaaa

SEQ ID NO: 140947 - DNA, 25 bp, E. coli
catgcaaaataaaagatgctgctga

SEQ ID NO: 140948 - DNA, 25 bp, E. coli
catgcaaaataatagatgctgctga

SEQ ID NO: 140949 - DNA, 25 bp, E. coli
tactcgatctttgtagccagtctgg

SEQ ID NO: 140950 - DNA, 25 bp, E. coli
tactaaaaacatatcacgatggtcg

SEQ ID NO: 140951 - DNA, 25 bp, E. coli
tactaaaaacatttcacgatggtcg

SEQ ID NO: 140952 - DNA, 25 bp, E. coli
tactcgatctttctagccagtctgg

SEQ ID NO: 140953 - DNA, 25 bp, E. coli
aaaagcaacttggactatcagggtg

SEQ ID NO: 140954 - DNA, 25 bp, E. coli
aaaagcaacttgcactatcagggtg

SEQ ID NO: 140955 - DNA, 25 bp, E. coli
tgtagatggtaatcaaaaagcaact

SEQ ID NO: 140956 - DNA, 25 bp, E. coli
tgtagatggtaaacaaaaagcaact

SEQ ID NO: 140957 - DNA, 25 bp, E. coli
tccccgtgacaatcaaatataatgc

SEQ ID NO: 140958 - DNA, 25 bp, E. coli
tccccgtgacaaacaaatataatgc

SEQ ID NO: 140959 - DNA, 25 bp, E. coli
taattaaaccttacctactcgatct

SEQ ID NO: 140960 - DNA, 25 bp, E. coli
taattaaacctttcctactcgatct

SEQ ID NO: 140961 - DNA, 25 bp, E. coli
gcactatcagggagttaatactaaa

SEQ ID NO: 140962 - DNA, 25 bp, E. coli
gcactatcagggtgttaatactaaa

SEQ ID NO: 140963 - DNA, 25 bp, E. coli
ggttttggccatgaattattccccg

SEQ ID NO: 140964 - DNA, 25 bp, E. coli
ggttttggccatcaattattccccg

SEQ ID NO: 140965 - DNA, 25 bp, E. coli
tagaagttaagtgtcgccgcgttgg

SEQ ID NO: 140966 - DNA, 25 bp, E. coli
tagaagttaagtctcgccgcgttgg

SEQ ID NO: 140967 - DNA, 25 bp, E. coli
caggtaccagttgaagtccgtccgg

SEQ ID NO: 140968 - DNA, 25 bp, E. coli
caggtaccagttcaagtccgtccgg

SEQ ID NO: 140969 - DNA, 25 bp, E. coli
aaggcgttcgcagactaccgttggt

SEQ ID NO: 140970 - DNA, 25 bp, E. coli
aaggcgttcgcacactaccgttggt

SEQ ID NO: 140971 - DNA, 25 bp, E. coli
tatggccgaagccaacaaggcgttc

SEQ ID NO: 140972 - DNA, 25 bp, E. coli
tatggccgaagcgaacaaggcgttc

SEQ ID NO: 140973 - DNA, 25 bp, E. coli
ttgaagctgctcgtaaacgcggtga

SEQ ID NO: 140974 - DNA, 25 bp, E. coli
ttgaagctgctcctaaacgcggtga

SEQ ID NO: 140975 - DNA, 25 bp, E. coli
tgataaatccatcgctctgcgcctg

SEQ ID NO: 140976 - DNA, 25 bp, E. coli
tgataaatccatggctctgcgcctg

SEQ ID NO: 140977 - DNA, 25 bp, E. coli
tgcgcctggcgatcgaactttctga

SEQ ID NO: 140978 - DNA, 25 bp, E. coli
tgcgcctggcgaacgaactttctga

SEQ ID NO: 140979 - DNA, 25 bp, E. coli
ccggttcgtcgttatgctctggcaa

SEQ ID NO: 140980 - DNA, 25 bp, E. coli
ccggttcgtcgtaatgctctggcaa

SEQ ID NO: 140981 - DNA, 25 bp, E. coli
gcgctctggtaattctgaactggaa

SEQ ID NO: 140982 - DNA, 25 bp, E. coli
gcgctctggtaaatctgaactggaa

SEQ ID NO: 140983 - DNA, 25 bp, E. coli
gaatctatcgtatacagcgcgctgg

SEQ ID NO: 140984 - DNA, 25 bp, E. coli
gaagtagctctccaaaacgtgcgcc

SEQ ID NO: 140985 - DNA, 25 bp, E. coli
gaagtagctctcgaaaacgtgcgcc

SEQ ID NO: 140986 - DNA, 25 bp, E. coli
gaatctatcgtaaacagcgcgctgg

SEQ ID NO: 140987 - DNA, 25 bp, E. coli
aaggtcctgcaggagcaaatgtcat

SEQ ID NO: 140988 - DNA, 25 bp, E. coli
aaggtcctgcagcagcaaatgtcat

SEQ ID NO: 140989 - DNA, 25 bp, E. coli
catttttctgcgtttcagaatgata

SEQ ID NO: 140990 - DNA, 25 bp, E. coli
catttttctgcgattcagaatgata

SEQ ID NO: 140991 - DNA, 25 bp, E. coli
taaaggtcctgcagcagcaaatgtc

SEQ ID NO: 140992 - DNA, 25 bp, E. coli
taaaggtcctgctgcagcaaatgtc

SEQ ID NO: 140993 - DNA, 25 bp, E. coli
agagagtggtgcaaaaggtcctgca

SEQ ID NO: 140994 - DNA, 25 bp, E. coli
agagagtggtgctaaaggtcctgca

SEQ ID NO: 140995 - DNA, 25 bp, E. coli
tgaaggtcaaaacgttaccttctct

SEQ ID NO: 140996 - DNA, 25 bp, E. coli
tgaaggtcaaaaggttaccttctct

SEQ ID NO: 140997 - DNA, 25 bp, E. coli
ctcctgttgatgctagtaaagatgt

SEQ ID NO: 140998 - DNA, 25 bp, E. coli
ctcctgttgatggtagtaaagatgt

SEQ ID NO: 140999 - DNA, 25 bp, E. coli
gtttgtgcatttttctgcgattcag

SEQ ID NO: 141000 - DNA, 25 bp, E. coli
gtttgtgcatttatctgcgattcag

SEQ ID NO: 141001 - DNA, 25 bp, E. coli
tcgaaccttatttgaaggtcaaaag

SEQ ID NO: 141002 - DNA, 25 bp, E. coli
tcgaaccttattagaaggtcaaaag

SEQ ID NO: 141003 - DNA, 25 bp, E. coli
ggtgctaaaggtcctgcagcagcaa

SEQ ID NO: 141004 - DNA, 25 bp, E. coli
ggtgctaaaggtgctgcagcagcaa

SEQ ID NO: 141005 - DNA, 25 bp, E. coli
ggctttatttctcctgttgatggta

SEQ ID NO: 141006 - DNA, 25 bp, E. coli
ggctttatttctgctgttgatggta

SEQ ID NO: 141007 - DNA, 25 bp, E. coli
gagtggtgctaaaggtcctgcagca

SEQ ID NO: 141008 - DNA, 25 bp, E. coli
gagtggtgctaatggtcctgcagca

SEQ ID NO: 141009 - DNA, 25 bp, E. coli
caattctctgaggattaccgggcgt

SEQ ID NO: 141010 - DNA, 25 bp, E. coli
caattctctgagcattaccgggcgt

SEQ ID NO: 141011 - DNA, 25 bp, E. coli
tatgcctgcatgatcaatcgcggga

SEQ ID NO: 141012 - DNA, 25 bp, E. coli
tatgcctgcatgttcaatcgcggga

SEQ ID NO: 141013 - DNA, 25 bp, E. coli
tatcttccacgattgatgggcgctc

SEQ ID NO: 141014 - DNA, 25 bp, E. coli
tatagtcaggattaccacggacagg

SEQ ID NO: 141015 - DNA, 25 bp, E. coli
tatcttccacgaatgatgggcgctc

SEQ ID NO: 141016 - DNA, 25 bp, E. coli
tatagtcaggataaccacggacagg

SEQ ID NO: 141017 - DNA, 25 bp, E. coli
tttatcaaacctttatgccgccggg

SEQ ID NO: 141018 - DNA, 25 bp, E. coli
tttatcaaacctatatgccgccggg

SEQ ID NO: 141019 - DNA, 25 bp, E. coli
tgttttgataaaagcgcctggagcg

SEQ ID NO: 141020 - DNA, 25 bp, E. coli
tgttttgataaatgcgcctggagcg

SEQ ID NO: 141021 - DNA, 25 bp, E. coli
gaatctgacgaatatatgttgcccg

SEQ ID NO: 141022 - DNA, 25 bp, E. coli
gaatctgacgaaaatatgttgcccg

SEQ ID NO: 141023 - DNA, 25 bp, E. coli
gataataaaacgtgacgctcgcgga

SEQ ID NO: 141024 - DNA, 25 bp, E. coli
gaaaagtcgcgcacaggtaacaatc

SEQ ID NO: 141025 - DNA, 25 bp, E. coli
gataataaaacgagacgctcgcgga

SEQ ID NO: 141026 - DNA, 25 bp, E. coli
gaaaagtcgcgctcaggtaacaatc

SEQ ID NO: 141027 - DNA, 25 bp, E. coli
gattattcaaccaggagtcgtggga

SEQ ID NO: 141028 - DNA, 25 bp, E. coli
gattattcaacctggagtcgtggga

SEQ ID NO: 141029 - DNA, 25 bp, E. coli
tgtccccatcctccaacgagaaggt

SEQ ID NO: 141030 - DNA, 25 bp, E. coli
tgtccccatcctgcaacgagaaggt

SEQ ID NO: 141031 - DNA, 25 bp, E. coli
aaagagtactttgtcaacccacaag

SEQ ID NO: 141032 - DNA, 25 bp, E. coli
aaagagtactttctcaacccacaag

SEQ ID NO: 141033 - DNA, 25 bp, E. coli
tatgattaaacgtggcggcgagaat

SEQ ID NO: 141034 - DNA, 25 bp, E. coli
tatgattaaacgaggcggcgagaat

SEQ ID NO: 141035 - DNA, 25 bp, E. coli
gcattaaaggcatacctgggaaaac

SEQ ID NO: 141036 - DNA, 25 bp, E. coli
gcattaaaggcaaacctgggaaaac

SEQ ID NO: 141037 - DNA, 25 bp, E. coli
gaaatctgcatttaaggcatacctg

SEQ ID NO: 141038 - DNA, 25 bp, E. coli
gaaatctgcattaaaggcatacctg

SEQ ID NO: 141039 - DNA, 25 bp, E. coli
cccgcctgttgtgcgaggaaagcgc

SEQ ID NO: 141040 - DNA, 25 bp, E. coli
ccgcgcacccgaaaattcaggacat

SEQ ID NO: 141041 - DNA, 25 bp, E. coli
cccgcctgttgtccgaggaaagcgc

SEQ ID NO: 141042 - DNA, 25 bp, E. coli
cccgaaaattcaggacatcgtggtt

SEQ ID NO: 141043 - DNA, 25 bp, E. coli
ccgctgcaatatcattaaacgtggc

SEQ ID NO: 141044 - DNA, 25 bp, E. coli
cccgaaaattcacgacatcgtggtt

SEQ ID NO: 141045 - DNA, 25 bp, E. coli
ccgctgcaatatgattaaacgtggc

SEQ ID NO: 141046 - DNA, 25 bp, E. coli
ccgcgcacccgataattcaggacat

SEQ ID NO: 141047 - DNA, 25 bp, E. coli
ggagctggaaaatattatcgccgcg

SEQ ID NO: 141048 - DNA, 25 bp, E. coli
ggagctggaaaaaattatcgccgcg

SEQ ID NO: 141049 - DNA, 25 bp, E. coli
ggaaaatattatcgccgcgcacccg

SEQ ID NO: 141050 - DNA, 25 bp, E. coli
ggaaaatattatggccgcgcacccg

SEQ ID NO: 141051 - DNA, 25 bp, E. coli
gagtactttctctacccacaagcca

SEQ ID NO: 141052 - DNA, 25 bp, E. coli
gagtactttctcaacccacaagcca

SEQ ID NO: 141053 - DNA, 25 bp, E. coli
catgaaactggtttgcgttggaccg

SEQ ID NO: 141054 - DNA, 25 bp, E. coli
catgaaactggtatgcgttggaccg

SEQ ID NO: 141055 - DNA, 25 bp, E. coli
aaagacttcgactacacggttgcca

SEQ ID NO: 141056 - DNA, 25 bp, E. coli
aacacggttgcctttcacccgacag

SEQ ID NO: 141057 - DNA, 25 bp, E. coli
aactggtatgcgttggaccggaaga

SEQ ID NO: 141058 - DNA, 25 bp, E. coli
aacacggttgccattcacccgacag

SEQ ID NO: 141059 - DNA, 25 bp, E. coli
aaagacttcgacaacacggttgcca

SEQ ID NO: 141060 - DNA, 25 bp, E. coli
aactggtatgcgatggaccggaaga

SEQ ID NO: 141061 - DNA, 25 bp, E. coli
gccgtgtcgcatgaaactggtatgc

SEQ ID NO: 141062 - DNA, 25 bp, E. coli
gccgtgtcgcatcaaactggtatgc

SEQ ID NO: 141063 - DNA, 25 bp, E. coli
gccaaaaccattcaagtcaacggcg

SEQ ID NO: 141064 - DNA, 25 bp, E. coli
gccaaaaccattgaagtcaacggcg

SEQ ID NO: 141065 - DNA, 25 bp, E. coli
ccagccgtgtcggatgaaactggta

SEQ ID NO: 141066 - DNA, 25 bp, E. coli
ccagccgtgtcgcatgaaactggta

SEQ ID NO: 141067 - DNA, 25 bp, E. coli
gacttcgacaactcggttgccattc

SEQ ID NO: 141068 - DNA, 25 bp, E. coli
gacttcgacaacacggttgccattc

SEQ ID NO: 141069 - DNA, 25 bp, E. coli
cgttgatgccaaaaccattgaagtc

SEQ ID NO: 141070 - DNA, 25 bp, E. coli
cgttgatgccaataccattgaagtc

SEQ ID NO: 141071 - DNA, 25 bp, E. coli
cattgaagtcaacggcgaaaccatc

SEQ ID NO: 141072 - DNA, 25 bp, E. coli
cattgaagtcaagggcgaaaccatc

SEQ ID NO: 141073 - DNA, 25 bp, E. coli
ggttgccattcacccgacagcggca

SEQ ID NO: 141074 - DNA, 25 bp, E. coli
ggttgccattcagccgacagcggca

SEQ ID NO: 141075 - DNA, 25 bp, E. coli
caaacctcgcgaactgggtagtgcc

SEQ ID NO: 141076 - DNA, 25 bp, E. coli
caaacctcgcgatctgggtagtgcc

SEQ ID NO: 141077 - DNA, 25 bp, E. coli
catattgatgccagcgtgctcggcg

SEQ ID NO: 141078 - DNA, 25 bp, E. coli
catattgatgcctgcgtgctcggcg

SEQ ID NO: 141079 - DNA, 25 bp, E. coli
catttgcgctaatccgtggcggtca

SEQ ID NO: 141080 - DNA, 25 bp, E. coli
catttgcgctaaaccgtggcggtca

SEQ ID NO: 141081 - DNA, 25 bp, E. coli
accgggtcgcgctaagtgatcatcg

SEQ ID NO: 141082 - DNA, 25 bp, E. coli
accgggtcgcgcaaagtgatcatcg

SEQ ID NO: 141083 - DNA, 25 bp, E. coli
tattgacggcaatatgtggctcacc

SEQ ID NO: 141084 - DNA, 25 bp, E. coli
tatcactctgcattcggaaaacggc

SEQ ID NO: 141085 - DNA, 25 bp, E. coli
tattgacggcaaaatgtggctcacc

SEQ ID NO: 141086 - DNA, 25 bp, E. coli
tatcactctgcaatcggaaaacggc

SEQ ID NO: 141087 - DNA, 25 bp, E. coli
tgcgtgccaaaagagaagctcggtt

SEQ ID NO: 141088 - DNA, 25 bp, E. coli
tgcgtgccaaaacagaagctcggtt

SEQ ID NO: 141089 - DNA, 25 bp, E. coli
cgcaagagcttcctgatggtgacat

SEQ ID NO: 141090 - DNA, 25 bp, E. coli
cgaaacaacgtattgcgcgccgtgt

SEQ ID NO: 141091 - DNA, 25 bp, E. coli
cgcaagagcttcgtgatggtgacat

SEQ ID NO: 141092 - DNA, 25 bp, E. coli
cgaaacaacgtaatgcgcgccgtgt

SEQ ID NO: 141093 - DNA, 25 bp, E. coli
ggtgcagccatgattgatagcgcca

SEQ ID NO: 141094 - DNA, 25 bp, E. coli
gtgatttagccagcgtgcgtgccaa

SEQ ID NO: 141095 - DNA, 25 bp, E. coli
ggtgcagccatgtttgatagcgcca

SEQ ID NO: 141096 - DNA, 25 bp, E. coli
gtgatttagccaccgtgcgtgccaa

SEQ ID NO: 141097 - DNA, 25 bp, E. coli
aacgcgccctatctgcaagttagtg

SEQ ID NO: 141098 - DNA, 25 bp, E. coli
aatggctacacacttccccttggag

SEQ ID NO: 141099 - DNA, 25 bp, E. coli
aatggctacacagttccccttggag

SEQ ID NO: 141100 - DNA, 25 bp, E. coli
caacaggtgcaactctgacggcaac

SEQ ID NO: 141101 - DNA, 25 bp, E. coli
caacaggtgcaagtctgacggcaac

SEQ ID NO: 141102 - DNA, 25 bp, E. coli
taaaccatagtccttcccgaggcat

SEQ ID NO: 141103 - DNA, 25 bp, E. coli
taaaccatagtcgttcccgaggcat

SEQ ID NO: 141104 - DNA, 25 bp, E. coli
aacgcgccctatgtgcaagttagtg

SEQ ID NO: 141105 - DNA, 25 bp, E. coli
acaggcggcccttgctatatatacg

SEQ ID NO: 141106 - DNA, 25 bp, E. coli
acaggcggccctagctatatatacg

SEQ ID NO: 141107 - DNA, 25 bp, E. coli
tacgcatggtatagccgaggtcact

SEQ ID NO: 141108 - DNA, 25 bp, E. coli
tacgcatggtattgccgaggtcact

SEQ ID NO: 141109 - DNA, 25 bp, E. coli
tttgtgcagtcacgtaccaacgcgc

SEQ ID NO: 141110 - DNA, 25 bp, E. coli
tttgtgcagtcaggtaccaacgcgc

SEQ ID NO: 141111 - DNA, 25 bp, E. coli
tcggtgtcaattccccaacaggtgc

SEQ ID NO: 141112 - DNA, 25 bp, E. coli
tcggcagcaaatcggagaggattac

SEQ ID NO: 141113 - DNA, 25 bp, E. coli
tctcaggcgagttcaaagccactgt

SEQ ID NO: 141114 - DNA, 25 bp, E. coli
tctcaggcgagtacaaagccactgt

SEQ ID NO: 141115 - DNA, 25 bp, E. coli
tcggcagcaaatgggagaggattac

SEQ ID NO: 141116 - DNA, 25 bp, E. coli
tcggtgtcaattgcccaacaggtgc

SEQ ID NO: 141117 - DNA, 25 bp, E. coli
gtaacattcagtgcagaaccaccag

SEQ ID NO: 141118 - DNA, 25 bp, E. coli
gtaacattcagtccagaaccaccag

SEQ ID NO: 141119 - DNA, 25 bp, E. coli
aagcgtcttttaattgcagccagaa

SEQ ID NO: 141120 - DNA, 25 bp, E. coli
taaacagccgcttgatgcagatcga

SEQ ID NO: 141121 - DNA, 25 bp, E. coli
taaactcaaagcgagtaaacagccg

SEQ ID NO: 141122 - DNA, 25 bp, E. coli
taaactcaaagccagtaaacagccg

SEQ ID NO: 141123 - DNA, 25 bp, E. coli
taaacagccgctagatgcagatcga

SEQ ID NO: 141124 - DNA, 25 bp, E. coli
aagcgtcttttatttgcagccagaa

SEQ ID NO: 141125 - DNA, 25 bp, E. coli
tatcacaccaggcaaaacgaggcga

SEQ ID NO: 141126 - DNA, 25 bp, E. coli
tagtcagtggtttaaaatagcggct

SEQ ID NO: 141127 - DNA, 25 bp, E. coli
tatcacaccagggaaaacgaggcga

SEQ ID NO: 141128 - DNA, 25 bp, E. coli
tagtcagtggttaaaaatagcggct

SEQ ID NO: 141129 - DNA, 25 bp, E. coli
tataactttggagtgagggctgcta

SEQ ID NO: 141130 - DNA, 25 bp, E. coli
tattggcggagctttctgctagaaa

SEQ ID NO: 141131 - DNA, 25 bp, E. coli
tataactttggactgagggctgcta

SEQ ID NO: 141132 - DNA, 25 bp, E. coli
tattggcggagcattctgctagaaa

SEQ ID NO: 141133 - DNA, 25 bp, E. coli
gacagttcagcaatatggttcttgg

SEQ ID NO: 141134 - DNA, 25 bp, E. coli
gacagttcagcattatggttcttgg

SEQ ID NO: 141135 - DNA, 25 bp, E. coli
ggtgaaccaaaatcaacagtaagcg

SEQ ID NO: 141136 - DNA, 25 bp, E. coli
ggtgaaccaaaaacaacagtaagcg

SEQ ID NO: 141137 - DNA, 25 bp, E. coli
tcaaaacattctgatgaggcggaaa

SEQ ID NO: 141138 - DNA, 25 bp, E. coli
taataatggtcaagcgacagctcag

SEQ ID NO: 141139 - DNA, 25 bp, E. coli
tcaaaacattctcatgaggcggaaa

SEQ ID NO: 141140 - DNA, 25 bp, E. coli
taataatggtcatgcgacagctcag

SEQ ID NO: 141141 - DNA, 25 bp, E. coli
cactggcgtggagaagatgccgcat

SEQ ID NO: 141142 - DNA, 25 bp, E. coli
cactggcgtggacaagatgccgcat

SEQ ID NO: 141143 - DNA, 25 bp, E. coli
agaagatgccgcttggctggctgcc

SEQ ID NO: 141144 - DNA, 25 bp, E. coli
agaagatgccgcatggctggctgcc

SEQ ID NO: 141145 - DNA, 25 bp, E. coli
aaagccatcatcccggcgcaacgag

SEQ ID NO: 141146 - DNA, 25 bp, E. coli
aacgtattgcgctctggcgtggaga

SEQ ID NO: 141147 - DNA, 25 bp, E. coli
aacgtattgcgcactggcgtggaga

SEQ ID NO: 141148 - DNA, 25 bp, E. coli
aacactgtttgggattgcgttttag

SEQ ID NO: 141149 - DNA, 25 bp, E. coli
aaagccatcatcgcggcgcaacgag

SEQ ID NO: 141150 - DNA, 25 bp, E. coli
aacactgtttggcattgcgttttag

SEQ ID NO: 141151 - DNA, 25 bp, E. coli
tattttgcaacgaattgcgcactgg

SEQ ID NO: 141152 - DNA, 25 bp, E. coli
tattttgcaacgtattgcgcactgg

SEQ ID NO: 141153 - DNA, 25 bp, E. coli
tgtcaaaacactgtttgggattgcg

SEQ ID NO: 141154 - DNA, 25 bp, E. coli
tgtcaaaacactctttgggattgcg

SEQ ID NO: 141155 - DNA, 25 bp, E. coli
gcatggctggctgccaccacggatg

SEQ ID NO: 141156 - DNA, 25 bp, E. coli
gcatggctggctcccaccacggatg

SEQ ID NO: 141157 - DNA, 25 bp, E. coli
gtatctgctccctcgcgatctcacg

SEQ ID NO: 141158 - DNA, 25 bp, E. coli
gtatctgctcccacgcgatctcacg

SEQ ID NO: 141159 - DNA, 25 bp, E. coli
gagccagcccatctgccccatattt

SEQ ID NO: 141160 - DNA, 25 bp, E. coli
gagccagcccatgtgccccatattt

SEQ ID NO: 141161 - DNA, 25 bp, E. coli
gatcgaaactgatgcgccgtatctg

SEQ ID NO: 141162 - DNA, 25 bp, E. coli
gatcgaaactgaagcgccgtatctg

SEQ ID NO: 141163 - DNA, 25 bp, E. coli
aaatcaatgcatactgggccacgcg

SEQ ID NO: 141164 - DNA, 25 bp, E. coli
aaatcaatgcattctgggccacgcg

SEQ ID NO: 141165 - DNA, 25 bp, E. coli
taggtcttatcggtctgcaactgga

SEQ ID NO: 141166 - DNA, 25 bp, E. coli
taggtcttatcgctctgcaactgga

SEQ ID NO: 141167 - DNA, 25 bp, E. coli
tattgaacgcgcaaaaacttcgtga

SEQ ID NO: 141168 - DNA, 25 bp, E. coli
tattgaacgcgctaaaacttcgtga

SEQ ID NO: 141169 - DNA, 25 bp, E. coli
ttccccgacaggagaaattgatacg

SEQ ID NO: 141170 - DNA, 25 bp, E. coli
ttccccgacaggtgaaattgatacg

SEQ ID NO: 141171 - DNA, 25 bp, E. coli
tgtttaccggtatctggccacaacg

SEQ ID NO: 141172 - DNA, 25 bp, E. coli
tgtacgaaggtattccgcagccggt

SEQ ID NO: 141173 - DNA, 25 bp, E. coli
tgtttaccggtaactggccacaacg

SEQ ID NO: 141174 - DNA, 25 bp, E. coli
tgtacgaaggtaatccgcagccggt

SEQ ID NO: 141175 - DNA, 25 bp, E. coli
cattgtgcatggaactcgggtcgcg

SEQ ID NO: 141176 - DNA, 25 bp, E. coli
cattgtgcatggtactcgggtcgcg

SEQ ID NO: 141177 - DNA, 25 bp, E. coli
gatcctcggctcattactggcaatg

SEQ ID NO: 141178 - DNA, 25 bp, E. coli
tggcaattgttgtgggttccccgac

SEQ ID NO: 141179 - DNA, 25 bp, E. coli
ggcgctgggcaacaaaccgtatcaa

SEQ ID NO: 141180 - DNA, 25 bp, E. coli
tggcaattgttgagggttccccgac

SEQ ID NO: 141181 - DNA, 25 bp, E. coli
ggcgctgggcaagaaaccgtatcaa

SEQ ID NO: 141182 - DNA, 25 bp, E. coli
tcaactggcgaatagtctgaccgag

SEQ ID NO: 141183 - DNA, 25 bp, E. coli
tcaactggcgaaaagtctgaccgag

SEQ ID NO: 141184 - DNA, 25 bp, E. coli
gatcctcggctctttactggcaatg

SEQ ID NO: 141185 - DNA, 25 bp, E. coli
caatgaatatccgtggtgggtggct

SEQ ID NO: 141186 - DNA, 25 bp, E. coli
caatgaatatccctggtgggtggct

SEQ ID NO: 141187 - DNA, 25 bp, E. coli
caaacggtggatatctcacaaggcg

SEQ ID NO: 141188 - DNA, 25 bp, E. coli
caaacggtggatttctcacaaggcg

SEQ ID NO: 141189 - DNA, 25 bp, E. coli
catcgttgcaatttatccgcgtcag

SEQ ID NO: 141190 - DNA, 25 bp, E. coli
catcgttgcaatatatccgcgtcag

SEQ ID NO: 141191 - DNA, 25 bp, E. coli
tacgcaagcgggtaagtcagtggct

SEQ ID NO: 141192 - DNA, 25 bp, E. coli
tacgcaagcgggaaagtcagtggct

SEQ ID NO: 141193 - DNA, 25 bp, E. coli
aggcgaaaagctggtggacccctat

SEQ ID NO: 141194 - DNA, 25 bp, E. coli
aggcgaaaagctcgtggacccctat

SEQ ID NO: 141195 - DNA, 25 bp, E. coli
tatcggcaaaagaattacgcaagcg

SEQ ID NO: 141196 - DNA, 25 bp, E. coli
tatcggcaaaagtattacgcaagcg

SEQ ID NO: 141197 - DNA, 25 bp, E. coli
gcgtaactggcatctaagccgcgaa

SEQ ID NO: 141198 - DNA, 25 bp, E. coli
gcgtaactggcaactaagccgcgaa

SEQ ID NO: 141199 - DNA, 25 bp, E. coli
cattcacggaatagatgtttcgcgc

SEQ ID NO: 141200 - DNA, 25 bp, E. coli
cattcacggaattgatgtttcgcgc

SEQ ID NO: 141201 - DNA, 25 bp, E. coli
tggacccctattattcgcgtaactg

SEQ ID NO: 141202 - DNA, 25 bp, E. coli
tggacccctatttttcgcgtaactg

SEQ ID NO: 141203 - DNA, 25 bp, E. coli
gggtggctcacttctatcaacgtcg

SEQ ID NO: 141204 - DNA, 25 bp, E. coli
gggtggctcactactatcaacgtcg

SEQ ID NO: 141205 - DNA, 25 bp, E. coli
taagccgcgaaaatggcctgctgcg

SEQ ID NO: 141206 - DNA, 25 bp, E. coli
taagccgcgaaattggcctgctgcg

SEQ ID NO: 141207 - DNA, 25 bp, E. coli
caaagacatggaagcgctaatggca

SEQ ID NO: 141208 - DNA, 25 bp, E. coli
caaagacatggatgcgctaatggca

SEQ ID NO: 141209 - DNA, 25 bp, E. coli
tatggcagatgattaccgcccacgc

SEQ ID NO: 141210 - DNA, 25 bp, E. coli
tatgaagactttttccgcagcatga

SEQ ID NO: 141211 - DNA, 25 bp, E. coli
tatggcagatgaataccgcccacgc

SEQ ID NO: 141212 - DNA, 25 bp, E. coli
tatgaagactttatccgcagcatga

SEQ ID NO: 141213 - DNA, 25 bp, E. coli
tattgctgacgacgcttatcgatcc

SEQ ID NO: 141214 - DNA, 25 bp, E. coli
tattgctgacgaggcttatcgatcc

SEQ ID NO: 141215 - DNA, 25 bp, E. coli
tgttaacggcgatggcgctttctcc

SEQ ID NO: 141216 - DNA, 25 bp, E. coli
tgttaacggcgaaggcgctttctcc

SEQ ID NO: 141217 - DNA, 25 bp, E. coli
tgagtacggcatcccaaatgcctgg

SEQ ID NO: 141218 - DNA, 25 bp, E. coli
tgagtacggcatgccaaatgcctgg

SEQ ID NO: 141219 - DNA, 25 bp, E. coli
gcgctttctccgttgttatggcaga

SEQ ID NO: 141220 - DNA, 25 bp, E. coli
gcgctttctccgatgttatggcaga

SEQ ID NO: 141221 - DNA, 25 bp, E. coli
gatcacgacaacagcaaagacatgg

SEQ ID NO: 141222 - DNA, 25 bp, E. coli
gatttacttaacgtgcaaagcgcag

SEQ ID NO: 141223 - DNA, 25 bp, E. coli
gatttacttaacctgcaaagcgcag

SEQ ID NO: 141224 - DNA, 25 bp, E. coli
gatcacgacaactgcaaagacatgg

SEQ ID NO: 141225 - DNA, 25 bp, E. coli
ggtcttcggtcctaacagcttgttc

SEQ ID NO: 141226 - DNA, 25 bp, E. coli
ggtcttcggtccaaacagcttgttc

SEQ ID NO: 141227 - DNA, 25 bp, E. coli
gatgtgctctgtattgatcacgaca

SEQ ID NO: 141228 - DNA, 25 bp, E. coli
gatgtgctctgttttgatcacgaca

SEQ ID NO: 141229 - DNA, 25 bp, E. coli
acgtctgaggcaccgttctctggca

SEQ ID NO: 141230 - DNA, 25 bp, E. coli
acgtctgaggcagcgttctctggca

SEQ ID NO: 141231 - DNA, 25 bp, E. coli
tatggctctgactaacgggccacgc

SEQ ID NO: 141232 - DNA, 25 bp, E. coli
tatccactacttccagaatctgacg

SEQ ID NO: 141233 - DNA, 25 bp, E. coli
tatggctctgacaaacgggccacgc

SEQ ID NO: 141234 - DNA, 25 bp, E. coli
tatccactacttgcagaatctgacg

SEQ ID NO: 141235 - DNA, 25 bp, E. coli
tgaaacggaaatcagaaaaagagct

SEQ ID NO: 141236 - DNA, 25 bp, E. coli
tgaaacggaaatgagaaaaagagct

SEQ ID NO: 141237 - DNA, 25 bp, E. coli
ccggctgatttaaggctctgacaaa

SEQ ID NO: 141238 - DNA, 25 bp, E. coli
ccggctgatttatggctctgacaaa

SEQ ID NO: 141239 - DNA, 25 bp, E. coli
gctgtctgaatgtgaacgtctgagg

SEQ ID NO: 141240 - DNA, 25 bp, E. coli
gctgtctgaatgagaacgtctgagg

SEQ ID NO: 141241 - DNA, 25 bp, E. coli
gcagcgttctctcgcaaataaactg

SEQ ID NO: 141242 - DNA, 25 bp, E. coli
gcagcgttctctggcaaataaactg

SEQ ID NO: 141243 - DNA, 25 bp, E. coli
gaagattgccatggtaccccggagt

SEQ ID NO: 141244 - DNA, 25 bp, E. coli
gaagattgccatcgtaccccggagt

SEQ ID NO: 141245 - DNA, 25 bp, E. coli
gactggacggagaacctgaaacgga

SEQ ID NO: 141246 - DNA, 25 bp, E. coli
tggcacggagttccgcctcaaactg

SEQ ID NO: 141247 - DNA, 25 bp, E. coli
tggcacggagttgcgcctcaaactg

SEQ ID NO: 141248 - DNA, 25 bp, E. coli
gatgatctggtggtgaacttatgca

SEQ ID NO: 141249 - DNA, 25 bp, E. coli
gactggacggagtacctgaaacgga

SEQ ID NO: 141250 - DNA, 25 bp, E. coli
gatgatctggtgctgaacttatgca

SEQ ID NO: 141251 - DNA, 25 bp, E. coli
cacccagccggttaccagtagcgga

SEQ ID NO: 141252 - DNA, 25 bp, E. coli
cacccagccggtaaccagtagcgga

SEQ ID NO: 141253 - DNA, 25 bp, E. coli
caggcgttatatgcgggttccacgg

SEQ ID NO: 141254 - DNA, 25 bp, E. coli
caggcgttatatccgggttccacgg

SEQ ID NO: 141255 - DNA, 25 bp, E. coli
catcaggcgttatatgcgggttcca

SEQ ID NO: 141256 - DNA, 25 bp, E. coli
catcaggcgttaaatgcgggttcca

SEQ ID NO: 141257 - DNA, 25 bp, E. coli
ttaccagtagcgcaagccatcaggc

SEQ ID NO: 141258 - DNA, 25 bp, E. coli
ttaccagtagcggaagccatcaggc

SEQ ID NO: 141259 - DNA, 25 bp, E. coli
gccatagccgcgcatccgatatctg

SEQ ID NO: 141260 - DNA, 25 bp, E. coli
ccagtagcggaacccatcaggcgtt

SEQ ID NO: 141261 - DNA, 25 bp, E. coli
ccagtagcggaagccatcaggcgtt

SEQ ID NO: 141262 - DNA, 25 bp, E. coli
gccatagccgcggatccgatatctg

SEQ ID NO: 141263 - DNA, 25 bp, E. coli
gaagtggcctcggtgtttcgcccac

SEQ ID NO: 141264 - DNA, 25 bp, E. coli
gaatcaggtgaacgagagccatagc

SEQ ID NO: 141265 - DNA, 25 bp, E. coli
gaatcaggtgaaggagagccatagc

SEQ ID NO: 141266 - DNA, 25 bp, E. coli
gaagtggcctcgctgtttcgcccac

SEQ ID NO: 141267 - DNA, 25 bp, E. coli
cggttaccagtaccggaagccatca

SEQ ID NO: 141268 - DNA, 25 bp, E. coli
cggttaccagtagcggaagccatca

SEQ ID NO: 141269 - DNA, 25 bp, E. coli
gatatctggcgccaagtggcctcgc

SEQ ID NO: 141270 - DNA, 25 bp, E. coli
gatatctggcgcgaagtggcctcgc

SEQ ID NO: 141271 - DNA, 25 bp, E. coli
gtgaacgagagccatagccgcgcat

SEQ ID NO: 141272 - DNA, 25 bp, E. coli
gtgaacgagagcgatagccgcgcat

SEQ ID NO: 141273 - DNA, 25 bp, E. coli
tacggaggtcagttctcgcgtcatt

SEQ ID NO: 141274 - DNA, 25 bp, E. coli
aaagtagccattcgcggtattctcg

SEQ ID NO: 141275 - DNA, 25 bp, E. coli
aaagtagccattggcggtattctcg

SEQ ID NO: 141276 - DNA, 25 bp, E. coli
tacggaggtcagatctcgcgtcatt

SEQ ID NO: 141277 - DNA, 25 bp, E. coli
ttccgtgcaggatgagaaccttgag

SEQ ID NO: 141278 - DNA, 25 bp, E. coli
ttccgtgcaggaagagaaccttgag

SEQ ID NO: 141279 - DNA, 25 bp, E. coli
tgaaagttccgtccaggaagagaac

SEQ ID NO: 141280 - DNA, 25 bp, E. coli
tgaaagttccgtgcaggaagagaac

SEQ ID NO: 141281 - DNA, 25 bp, E. coli
gctgcttacggacgtcagttctcgc

SEQ ID NO: 141282 - DNA, 25 bp, E. coli
gctgcttacggaggtcagttctcgc

SEQ ID NO: 141283 - DNA, 25 bp, E. coli
cgaatttatgaaagtagccattggc

SEQ ID NO: 141284 - DNA, 25 bp, E. coli
cgccgatggacgaaacgacgttgaa

SEQ ID NO: 141285 - DNA, 25 bp, E. coli
cgataaccagctgcttacggaggtc

SEQ ID NO: 141286 - DNA, 25 bp, E. coli
cgataaccagctccttacggaggtc

SEQ ID NO: 141287 - DNA, 25 bp, E. coli
cgaatttatgaatgtagccattggc

SEQ ID NO: 141288 - DNA, 25 bp, E. coli
cgccgatggacgtaacgacgttgaa

SEQ ID NO: 141289 - DNA, 25 bp, E. coli
gtgcaggaagagaaccttgagcgtc

SEQ ID NO: 141290 - DNA, 25 bp, E. coli
gtgcaggaagagtaccttgagcgtc

SEQ ID NO: 141291 - DNA, 25 bp, E. coli
taaccagctgctaacggaggtcagt

SEQ ID NO: 141292 - DNA, 25 bp, E. coli
taacgacgttgaaagttccgtgcag

SEQ ID NO: 141293 - DNA, 25 bp, E. coli
taaccagctgcttacggaggtcagt

SEQ ID NO: 141294 - DNA, 25 bp, E. coli
taacgacgttgatagttccgtgcag

SEQ ID NO: 141295 - DNA, 25 bp, E. coli
catgctatgccatacgagaatgatt

SEQ ID NO: 141296 - DNA, 25 bp, E. coli
catgctatgccaaacgagaatgatt

SEQ ID NO: 141297 - DNA, 25 bp, E. coli
tagcagaaatgtttgacagatcact

SEQ ID NO: 141298 - DNA, 25 bp, E. coli
tagcagaaatgtatgacagatcact

SEQ ID NO: 141299 - DNA, 25 bp, E. coli
tcattatagtgtctgtcagatctcg

SEQ ID NO: 141300 - DNA, 25 bp, E. coli
tcagatctcgttttccttaaccatg

SEQ ID NO: 141301 - DNA, 25 bp, E. coli
tcattatagtgtgtgtcagatctcg

SEQ ID NO: 141302 - DNA, 25 bp, E. coli
tcagcttccatagacaacatagcag

SEQ ID NO: 141303 - DNA, 25 bp, E. coli
tcagatctcgttatccttaaccatg

SEQ ID NO: 141304 - DNA, 25 bp, E. coli
tcagcttccatacacaacatagcag

SEQ ID NO: 141305 - DNA, 25 bp, E. coli
ccatgttacatacaatgtgcacgga

SEQ ID NO: 141306 - DNA, 25 bp, E. coli
gcctgtcacaggtcgtcattatagt

SEQ ID NO: 141307 - DNA, 25 bp, E. coli
gcctgtcacaggacgtcattatagt

SEQ ID NO: 141308 - DNA, 25 bp, E. coli
ccatgttacatagaatgtgcacgga

SEQ ID NO: 141309 - DNA, 25 bp, E. coli
gatcactattttagaagcctgtcac

SEQ ID NO: 141310 - DNA, 25 bp, E. coli
gatcactatttttgaagcctgtcac

SEQ ID NO: 141311 - DNA, 25 bp, E. coli
ggtgatttctctgatagaccaggat

SEQ ID NO: 141312 - DNA, 25 bp, E. coli
ggtgatttctctcatagaccaggat

SEQ ID NO: 141313 - DNA, 25 bp, E. coli
tgtgcctctaaatcatagcctttgc

SEQ ID NO: 141314 - DNA, 25 bp, E. coli
tgtgcctctaaaacatagcctttgc

SEQ ID NO: 141315 - DNA, 25 bp, E. coli
gaccaggattatgactacgaaaaga

SEQ ID NO: 141316 - DNA, 25 bp, E. coli
gaccaggattatcactacgaaaaga

SEQ ID NO: 141317 - DNA, 25 bp, E. coli
cagcaggtcaggatttccacggcga

SEQ ID NO: 141318 - DNA, 25 bp, E. coli
cagcaggtcaggttttccacggcga

SEQ ID NO: 141319 - DNA, 25 bp, E. coli
taaagcactggaactgaaaacgccg

SEQ ID NO: 141320 - DNA, 25 bp, E. coli
taaatcgctgatcctgccggtatcc

SEQ ID NO: 141321 - DNA, 25 bp, E. coli
taaatcgctgatgctgccggtatcc

SEQ ID NO: 141322 - DNA, 25 bp, E. coli
taaaccagaaaaccgcgcgaaagtg

SEQ ID NO: 141323 - DNA, 25 bp, E. coli
taaagcactggatctgaaaacgccg

SEQ ID NO: 141324 - DNA, 25 bp, E. coli
taaaccagaaaagcgcgcgaaagtg

SEQ ID NO: 141325 - DNA, 25 bp, E. coli
aaacacctggcgcatactggcgtac

SEQ ID NO: 141326 - DNA, 25 bp, E. coli
aaacacctggcggatactggcgtac

SEQ ID NO: 141327 - DNA, 25 bp, E. coli
aaaatgtacggtctgccagctgccg

SEQ ID NO: 141328 - DNA, 25 bp, E. coli
aaaatgtacggtgtgccagctgccg

SEQ ID NO: 141329 - DNA, 25 bp, E. coli
tgttatggcagatgcaggcggttcc

SEQ ID NO: 141330 - DNA, 25 bp, E. coli
tgttatggcagaagcaggcggttcc

SEQ ID NO: 141331 - DNA, 25 bp, E. coli
cctgcaaaaggtgggtaaatcgctg

SEQ ID NO: 141332 - DNA, 25 bp, E. coli
cctgcaaaaggtcggtaaatcgctg

SEQ ID NO: 141333 - DNA, 25 bp, E. coli
ggtgaatacaccaacgcagcaggtc

SEQ ID NO: 141334 - DNA, 25 bp, E. coli
ggtgaatacacctacgcagcaggtc

SEQ ID NO: 141335 - DNA, 25 bp, E. coli
ggtattatgatctccgcggcgctga

SEQ ID NO: 141336 - DNA, 25 bp, E. coli
ggtattatgatcaccgcggcgctga

SEQ ID NO: 141337 - DNA, 25 bp, E. coli
gatgcaaaagcgtcaggtaccagcg

SEQ ID NO: 141338 - DNA, 25 bp, E. coli
gatgcaaaagcgacaggtaccagcg

SEQ ID NO: 141339 - DNA, 25 bp, E. coli
catttctgtcaatctagcggccggt

SEQ ID NO: 141340 - DNA, 25 bp, E. coli
tactgccggacattcgggaaccttg

SEQ ID NO: 141341 - DNA, 25 bp, E. coli
tactggtgtaactaatgccggacag

SEQ ID NO: 141342 - DNA, 25 bp, E. coli
tacagcagtgtaagtggcgcaaatg

SEQ ID NO: 141343 - DNA, 25 bp, E. coli
tacagcagtgtatgtggcgcaaatg

SEQ ID NO: 141344 - DNA, 25 bp, E. coli
tactgccggacaatcgggaaccttg

SEQ ID NO: 141345 - DNA, 25 bp, E. coli
tactggtgtaacaaatgccggacag

SEQ ID NO: 141346 - DNA, 25 bp, E. coli
tgggtacatttacggcaacggcaac

SEQ ID NO: 141347 - DNA, 25 bp, E. coli
tgggtacatttagggcaacggcaac

SEQ ID NO: 141348 - DNA, 25 bp, E. coli
tgacaatgcggaaaccttaacggcc

SEQ ID NO: 141349 - DNA, 25 bp, E. coli
tgacaatgcggataccttaacggcc

SEQ ID NO: 141350 - DNA, 25 bp, E. coli
tcatacagttaatgcacagcccggg

SEQ ID NO: 141351 - DNA, 25 bp, E. coli
tcatacagttaaagcacagcccggg

SEQ ID NO: 141352 - DNA, 25 bp, E. coli
gactgatcgatgaggtgaccggcct

SEQ ID NO: 141353 - DNA, 25 bp, E. coli
gactttgggtataccattggcgcga

SEQ ID NO: 141354 - DNA, 25 bp, E. coli
gactttgggtattccattggcgcga

SEQ ID NO: 141355 - DNA, 25 bp, E. coli
gactgatcgatgtggtgaccggcct

SEQ ID NO: 141356 - DNA, 25 bp, E. coli
catttctgtcaaactagcggccggt

SEQ ID NO: 141357 - DNA, 25 bp, E. coli
gattctgggaagaatgccagcccgg

SEQ ID NO: 141358 - DNA, 25 bp, E. coli
gattctgggaagtatgccagcccgg

SEQ ID NO: 141359 - DNA, 25 bp, E. coli
taactcacaggataatgggccagac

SEQ ID NO: 141360 - DNA, 25 bp, E. coli
taactcacaggaaaatgggccagac

SEQ ID NO: 141361 - DNA, 25 bp, E. coli
caattcgcgacatggcgctggatca

SEQ ID NO: 141362 - DNA, 25 bp, E. coli
caattcgcgacaaggcgctggatca

SEQ ID NO: 141363 - DNA, 25 bp, E. coli
taaagcctttaaagcggaagccggt

SEQ ID NO: 141364 - DNA, 25 bp, E. coli
taaagcctttaatgcggaagccggt

SEQ ID NO: 141365 - DNA, 25 bp, E. coli
aaaatggatgttcccggtgctggac

SEQ ID NO: 141366 - DNA, 25 bp, E. coli
aaaatggatgttgccggtgctggac

SEQ ID NO: 141367 - DNA, 25 bp, E. coli
tatgggcgtcataactggcgttggc

SEQ ID NO: 141368 - DNA, 25 bp, E. coli
tatgatgggcatcgtcgtgacgcta

SEQ ID NO: 141369 - DNA, 25 bp, E. coli
tatgatgggcatggtcgtgacgcta

SEQ ID NO: 141370 - DNA, 25 bp, E. coli
tatgggcgtcattactggcgttggc

SEQ ID NO: 141371 - DNA, 25 bp, E. coli
tagccggaaaatagcgtatggaccc

SEQ ID NO: 141372 - DNA, 25 bp, E. coli
tagccggaaaattgcgtatggaccc

SEQ ID NO: 141373 - DNA, 25 bp, E. coli
tatcggcggtattgtccacgctacg

SEQ ID NO: 141374 - DNA, 25 bp, E. coli
tatagtcggcacagcggtatttgcc

SEQ ID NO: 141375 - DNA, 25 bp, E. coli
tatcggcggtatagtccacgctacg

SEQ ID NO: 141376 - DNA, 25 bp, E. coli
tattgattcggctggcggctattcg

SEQ ID NO: 141377 - DNA, 25 bp, E. coli
tattttgggtgaaagatcccaccga

SEQ ID NO: 141378 - DNA, 25 bp, E. coli
tatagtcggcactgcggtatttgcc

SEQ ID NO: 141379 - DNA, 25 bp, E. coli
tattgattcggcaggcggctattcg

SEQ ID NO: 141380 - DNA, 25 bp, E. coli
tattttgggtgatagatcccaccga

SEQ ID NO: 141381 - DNA, 25 bp, E. coli
taagctaccgacctttgcgctggat

SEQ ID NO: 141382 - DNA, 25 bp, E. coli
taagctaccgacgtttgcgctggat

SEQ ID NO: 141383 - DNA, 25 bp, E. coli
caactggcagttggtatcgtctacc

SEQ ID NO: 141384 - DNA, 25 bp, E. coli
caactggcagttcgtatcgtctacc

SEQ ID NO: 141385 - DNA, 25 bp, E. coli
agcgcattctgagcgaccgtgaaaa

SEQ ID NO: 141386 - DNA, 25 bp, E. coli
agcgcattctgaccgaccgtgaaaa

SEQ ID NO: 141387 - DNA, 25 bp, E. coli
tgttcatgaccatccgtaccaacgg

SEQ ID NO: 141388 - DNA, 25 bp, E. coli
tgttcatgaccaaccgtaccaacgg

SEQ ID NO: 141389 - DNA, 25 bp, E. coli
tgactcatgggcaggtactgacctg

SEQ ID NO: 141390 - DNA, 25 bp, E. coli
tgactcatgggctggtactgacctg

SEQ ID NO: 141391 - DNA, 25 bp, E. coli
tcagtttgaactagacctggaagca

SEQ ID NO: 141392 - DNA, 25 bp, E. coli
tcagtttgaacttgacctggaagca

SEQ ID NO: 141393 - DNA, 25 bp, E. coli
ccgacgacggtgatgttgtgaacaa

SEQ ID NO: 141394 - DNA, 25 bp, E. coli
ccgacgacggtgttgttgtgaacaa

SEQ ID NO: 141395 - DNA, 25 bp, E. coli
cgtgtaggcgtgtaaggtgaaactc

SEQ ID NO: 141396 - DNA, 25 bp, E. coli
cgtgtaggcgtgaaaggtgaaactc

SEQ ID NO: 141397 - DNA, 25 bp, E. coli
gatacctcttatccccgtgtaggcg

SEQ ID NO: 141398 - DNA, 25 bp, E. coli
gatacctcttatgcccgtgtaggcg

SEQ ID NO: 141399 - DNA, 25 bp, E. coli
ggttactcctattctaaagcactgg

SEQ ID NO: 141400 - DNA, 25 bp, E. coli
ggttactcctatactaaagcactgg

SEQ ID NO: 141401 - DNA, 25 bp, E. coli
taatgtcggtgtcgcgtatgatgca

SEQ ID NO: 141402 - DNA, 25 bp, E. coli
tcacaacatgaaatccgacgacggt

SEQ ID NO: 141403 - DNA, 25 bp, E. coli
tcacaacatgaattccgacgacggt

SEQ ID NO: 141404 - DNA, 25 bp, E. coli
taatgtcggtgtggcgtatgatgca

SEQ ID NO: 141405 - DNA, 25 bp, E. coli
catttcgtccagacttaagttcaca

SEQ ID NO: 141406 - DNA, 25 bp, E. coli
catttcgtccagtcttaagttcaca

SEQ ID NO: 141407 - DNA, 25 bp, E. coli
taaaggaggaacctatggctaatcc

SEQ ID NO: 141408 - DNA, 25 bp, E. coli
taaaggaggaacgtatggctaatcc

SEQ ID NO: 141409 - DNA, 25 bp, E. coli
ttaagttcacaagacctcaccggag

SEQ ID NO: 141410 - DNA, 25 bp, E. coli
ttaagttcacaacacctcaccggag

SEQ ID NO: 141411 - DNA, 25 bp, E. coli
tcgttttcgggcatttcgtccagac

SEQ ID NO: 141412 - DNA, 25 bp, E. coli
tcgggcatttcgaccagacttaagt

SEQ ID NO: 141413 - DNA, 25 bp, E. coli
tcgggcatttcgtccagacttaagt

SEQ ID NO: 141414 - DNA, 25 bp, E. coli
tcgttttcgggcttttcgtccagac

SEQ ID NO: 141415 - DNA, 25 bp, E. coli
tcatataaaggaggaacgtatggct

SEQ ID NO: 141416 - DNA, 25 bp, E. coli
tcatataaaggacgaacgtatggct

SEQ ID NO: 141417 - DNA, 25 bp, E. coli
cctgctccggtgagttcatataaag

SEQ ID NO: 141418 - DNA, 25 bp, E. coli
gcctcaaactttggttttcgggcat

SEQ ID NO: 141419 - DNA, 25 bp, E. coli
gcctcaaactttcgttttcgggcat

SEQ ID NO: 141420 - DNA, 25 bp, E. coli
cctgctccggtgtgttcatataaag

SEQ ID NO: 141421 - DNA, 25 bp, E. coli
ccggtgagttcatataaaggaggaa

SEQ ID NO: 141422 - DNA, 25 bp, E. coli
ccggtgagttcaaataaaggaggaa

SEQ ID NO: 141423 - DNA, 25 bp, E. coli
ggaggaacgtatcgctaatccaacc

SEQ ID NO: 141424 - DNA, 25 bp, E. coli
ggaggaacgtatggctaatccaacc

SEQ ID NO: 141425 - DNA, 25 bp, E. coli
gagcctgctccgctgagttcatata

SEQ ID NO: 141426 - DNA, 25 bp, E. coli
gagcctgctccggtgagttcatata

SEQ ID NO: 141427 - DNA, 25 bp, E. coli
caatcgtaatggctctgaggagtaa

SEQ ID NO: 141428 - DNA, 25 bp, E. coli
caatcgtaatgggtctgaggagtaa

SEQ ID NO: 141429 - DNA, 25 bp, E. coli
tacgcttgcgttgggtggttaagta

SEQ ID NO: 141430 - DNA, 25 bp, E. coli
tacgcttgcgttcggtggttaagta

SEQ ID NO: 141431 - DNA, 25 bp, E. coli
aacggttacactctcccatcaatcg

SEQ ID NO: 141432 - DNA, 25 bp, E. coli
aacggttacactgtcccatcaatcg

SEQ ID NO: 141433 - DNA, 25 bp, E. coli
tataaaataattggagctctggtct

SEQ ID NO: 141434 - DNA, 25 bp, E. coli
tttactagcaatacgcttgcgttcg

SEQ ID NO: 141435 - DNA, 25 bp, E. coli
tataaaataattcgagctctggtct

SEQ ID NO: 141436 - DNA, 25 bp, E. coli
tttactagcaattcgcttgcgttcg

SEQ ID NO: 141437 - DNA, 25 bp, E. coli
tgaacctcagtttgccgaatttggc

SEQ ID NO: 141438 - DNA, 25 bp, E. coli
tgaacctcagttagccgaatttggc

SEQ ID NO: 141439 - DNA, 25 bp, E. coli
gctacctaacaatgctcccaatcgg

SEQ ID NO: 141440 - DNA, 25 bp, E. coli
gctacctaacaaagctcccaatcgg

SEQ ID NO: 141441 - DNA, 25 bp, E. coli
gacagcaggttctatctgaacctca

SEQ ID NO: 141442 - DNA, 25 bp, E. coli
gacagcaggttcaatctgaacctca

SEQ ID NO: 141443 - DNA, 25 bp, E. coli
ccgaaggctgtttactttactagca

SEQ ID NO: 141444 - DNA, 25 bp, E. coli
ccgaaggctgttaactttactagca

SEQ ID NO: 141445 - DNA, 25 bp, E. coli
ggagctacgtaacaacggttacact

SEQ ID NO: 141446 - DNA, 25 bp, E. coli
ggttaagtatgtttaatgcgcgggc

SEQ ID NO: 141447 - DNA, 25 bp, E. coli
ggagctacgtaagaacggttacact

SEQ ID NO: 141448 - DNA, 25 bp, E. coli
ggttaagtatgtataatgcgcgggc

SEQ ID NO: 141449 - DNA, 25 bp, E. coli
caactaacgtaaggtaggcacagcc

SEQ ID NO: 141450 - DNA, 25 bp, E. coli
caactaacgtaacgtaggcacagcc

SEQ ID NO: 141451 - DNA, 25 bp, E. coli
caaatagttcagagctgagaccgcc

SEQ ID NO: 141452 - DNA, 25 bp, E. coli
caaatattgtaaccctgacgtctaa

SEQ ID NO: 141453 - DNA, 25 bp, E. coli
caaatagttcagtgctgagaccgcc

SEQ ID NO: 141454 - DNA, 25 bp, E. coli
caaatattgtaagcctgacgtctaa

SEQ ID NO: 141455 - DNA, 25 bp, E. coli
actatggcactaaggcactatggca

SEQ ID NO: 141456 - DNA, 25 bp, E. coli
actatggcactatggcactatggca

SEQ ID NO: 141457 - DNA, 25 bp, E. coli
tatggcaccgccagcgattgtaatc

SEQ ID NO: 141458 - DNA, 25 bp, E. coli
tagacatccgtgacaattttgcgaa

SEQ ID NO: 141459 - DNA, 25 bp, E. coli
tatggcaccgcctgcgattgtaatc

SEQ ID NO: 141460 - DNA, 25 bp, E. coli
tagacatccgtgtcaattttgcgaa

SEQ ID NO: 141461 - DNA, 25 bp, E. coli
tcacagccattcacggtcgcaggta

SEQ ID NO: 141462 - DNA, 25 bp, E. coli
tcacagccattctcggtcgcaggta

SEQ ID NO: 141463 - DNA, 25 bp, E. coli
cgcactatggcactatggcactatg

SEQ ID NO: 141464 - DNA, 25 bp, E. coli
cgcactatggcagtatggcactatg

SEQ ID NO: 141465 - DNA, 25 bp, E. coli
gatattataaaagacagttgcacgc

SEQ ID NO: 141466 - DNA, 25 bp, E. coli
gatattataaaacacagttgcacgc

SEQ ID NO: 141467 - DNA, 25 bp, E. coli
ggtcgcaggtatcaagcttttcagg

SEQ ID NO: 141468 - DNA, 25 bp, E. coli
ggtcgcaggtatgaagcttttcagg

SEQ ID NO: 141469 - DNA, 25 bp, E. coli
gatgttatgacagagtccaatcgga

SEQ ID NO: 141470 - DNA, 25 bp, E. coli
gatgttatgacacagtccaatcgga

SEQ ID NO: 141471 - DNA, 25 bp, E. coli
cagtgagtccatccccggtttcgct

SEQ ID NO: 141472 - DNA, 25 bp, E. coli
cagtgagtccatgcccggtttcgct

SEQ ID NO: 141473 - DNA, 25 bp, E. coli
catccccggtttggcttcgctggaa

SEQ ID NO: 141474 - DNA, 25 bp, E. coli
catccccggtttcgcttcgctggaa

SEQ ID NO: 141475 - DNA, 25 bp, E. coli
aggtgccagtgagtccatccccggt

SEQ ID NO: 141476 - DNA, 25 bp, E. coli
aggtgccagtgactccatccccggt

SEQ ID NO: 141477 - DNA, 25 bp, E. coli
ttggttcagccggtggacgatgaga

SEQ ID NO: 141478 - DNA, 25 bp, E. coli
ttggttcagccgctggacgatgaga

SEQ ID NO: 141479 - DNA, 25 bp, E. coli
tggtgctgatgtcggttcttttcgt

SEQ ID NO: 141480 - DNA, 25 bp, E. coli
tgactggtgctgatgtgggttcttt

SEQ ID NO: 141481 - DNA, 25 bp, E. coli
tgactggtgctgttgtgggttcttt

SEQ ID NO: 141482 - DNA, 25 bp, E. coli
tcgcttcgctggtatcgtgtagtgg

SEQ ID NO: 141483 - DNA, 25 bp, E. coli
tcgcttcgctggaatcgtgtagtgg

SEQ ID NO: 141484 - DNA, 25 bp, E. coli
tcgctggaatcgagtagtggtgact

SEQ ID NO: 141485 - DNA, 25 bp, E. coli
tcgctggaatcgtgtagtggtgact

SEQ ID NO: 141486 - DNA, 25 bp, E. coli
cccggtttcgctacgctggaatcgt

SEQ ID NO: 141487 - DNA, 25 bp, E. coli
cccggtttcgcttcgctggaatcgt

SEQ ID NO: 141488 - DNA, 25 bp, E. coli
cggtgttggttctgccgctggacga

SEQ ID NO: 141489 - DNA, 25 bp, E. coli
cggtgttggttcagccgctggacga

SEQ ID NO: 141490 - DNA, 25 bp, E. coli
ggtttcgcttcgctggaatcgtgta

SEQ ID NO: 141491 - DNA, 25 bp, E. coli
ggtttcgcttcggtggaatcgtgta

SEQ ID NO: 141492 - DNA, 25 bp, E. coli
tggtgctgatgtgggttcttttcgt

SEQ ID NO: 141493 - DNA, 25 bp, E. coli
acctgcgtgaacgtcggctgcgtac

SEQ ID NO: 141494 - DNA, 25 bp, E. coli
acctgcgtgaacctcggctgcgtac

SEQ ID NO: 141495 - DNA, 25 bp, E. coli
tgtgcgttgggcgagaagagaagat

SEQ ID NO: 141496 - DNA, 25 bp, E. coli
tgtgcgttgggccagaagagaagat

SEQ ID NO: 141497 - DNA, 25 bp, E. coli
tgaacgtcggctgcgtaccgaagaa

SEQ ID NO: 141498 - DNA, 25 bp, E. coli
tgaacgtcggctccgtaccgaagaa

SEQ ID NO: 141499 - DNA, 25 bp, E. coli
tgccaaaacgctggaagttaacggt

SEQ ID NO: 141500 - DNA, 25 bp, E. coli
tgccaaaacgctcgaagttaacggt

SEQ ID NO: 141501 - DNA, 25 bp, E. coli
gctgcgtaccgatgaaagtgatgtg

SEQ ID NO: 141502 - DNA, 25 bp, E. coli
gctgcgtaccgaagaaagtgatgtg

SEQ ID NO: 141503 - DNA, 25 bp, E. coli
gaagttaacggtcaaaccatcacag

SEQ ID NO: 141504 - DNA, 25 bp, E. coli
gcacctgcgtgaacgtcggctgcgt

SEQ ID NO: 141505 - DNA, 25 bp, E. coli
gaagttaacggtgaaaccatcacag

SEQ ID NO: 141506 - DNA, 25 bp, E. coli
gcacctgcgtgatcgtcggctgcgt

SEQ ID NO: 141507 - DNA, 25 bp, E. coli
cgctggaagttatcggtgaaaccat

SEQ ID NO: 141508 - DNA, 25 bp, E. coli
cgctggaagttaacggtgaaaccat

SEQ ID NO: 141509 - DNA, 25 bp, E. coli
cgtaccgaagaaagtgatgtggcac

SEQ ID NO: 141510 - DNA, 25 bp, E. coli
cgtcggctgcgttccgaagaaagtg

SEQ ID NO: 141511 - DNA, 25 bp, E. coli
cgtcggctgcgtaccgaagaaagtg

SEQ ID NO: 141512 - DNA, 25 bp, E. coli
cgtaccgaagaatgtgatgtggcac

SEQ ID NO: 141513 - DNA, 25 bp, E. coli
taacggtgaaaccatcacagccgat

SEQ ID NO: 141514 - DNA, 25 bp, E. coli
taacggtgaaacgatcacagccgat

SEQ ID NO: 141515 - DNA, 25 bp, E. coli
caattgccgcaggtaaaagttatca

SEQ ID NO: 141516 - DNA, 25 bp, E. coli
caaactagcacaactgcgtaaggca

SEQ ID NO: 141517 - DNA, 25 bp, E. coli
caattgccgcagctaaaagttatca

SEQ ID NO: 141518 - DNA, 25 bp, E. coli
caaactagcacatctgcgtaaggca

SEQ ID NO: 141519 - DNA, 25 bp, E. coli
tagagcgttttaacgatgtgccgct

SEQ ID NO: 141520 - DNA, 25 bp, E. coli
tagagcgttttatcgatgtgccgct

SEQ ID NO: 141521 - DNA, 25 bp, E. coli
ttttaacgatgtgccgctgtggatc

SEQ ID NO: 141522 - DNA, 25 bp, E. coli
ttttaacgatgtcccgctgtggatc

SEQ ID NO: 141523 - DNA, 25 bp, E. coli
tgaaaccaaacttgcacaactgcgt

SEQ ID NO: 141524 - DNA, 25 bp, E. coli
tgaaaccaaactagcacaactgcgt

SEQ ID NO: 141525 - DNA, 25 bp, E. coli
tgcgttctgaaagcaaactagcaca

SEQ ID NO: 141526 - DNA, 25 bp, E. coli
tgcgttctgaaaccaaactagcaca

SEQ ID NO: 141527 - DNA, 25 bp, E. coli
gccgcagctaaatgttatcaccgtc

SEQ ID NO: 141528 - DNA, 25 bp, E. coli
gccgcagctaaaagttatcaccgtc

SEQ ID NO: 141529 - DNA, 25 bp, E. coli
gcacaactgcgttaggcattgccgt

SEQ ID NO: 141530 - DNA, 25 bp, E. coli
gcacaactgcgtaaggcattgccgt

SEQ ID NO: 141531 - DNA, 25 bp, E. coli
cgctggtagagcgttttaacgatgt

SEQ ID NO: 141532 - DNA, 25 bp, E. coli
cgctggtagagccttttaacgatgt

SEQ ID NO: 141533 - DNA, 25 bp, E. coli
gttacaggcacaattgccgcagcta

SEQ ID NO: 141534 - DNA, 25 bp, E. coli
gttacaggcacatttgccgcagcta

SEQ ID NO: 141535 - DNA, 25 bp, E. coli
taaggcattgccgtggttacaggca

SEQ ID NO: 141536 - DNA, 25 bp, E. coli
taaggcattgccctggttacaggca

SEQ ID NO: 141537 - DNA, 25 bp, E. coli
caaaccctttatcgatcgtctgaat

SEQ ID NO: 141538 - DNA, 25 bp, E. coli
caaaccctttatggatcgtctgaat

SEQ ID NO: 141539 - DNA, 25 bp, E. coli
cattttaggttagctgctggctcca

SEQ ID NO: 141540 - DNA, 25 bp, E. coli
cattttaggttacctgctggctcca

SEQ ID NO: 141541 - DNA, 25 bp, E. coli
aacagtggtgatggcatttgttgca

SEQ ID NO: 141542 - DNA, 25 bp, E. coli
aacagtggtgatcgcatttgttgca

SEQ ID NO: 141543 - DNA, 25 bp, E. coli
ttccggcaatcgacaaaccctttat

SEQ ID NO: 141544 - DNA, 25 bp, E. coli
ttaggttacctgctggctccactgg

SEQ ID NO: 141545 - DNA, 25 bp, E. coli
ttaggttacctggtggctccactgg

SEQ ID NO: 141546 - DNA, 25 bp, E. coli
ttccggcaatcgtcaaaccctttat

SEQ ID NO: 141547 - DNA, 25 bp, E. coli
tgtggcaacagtcgtgatggcattt

SEQ ID NO: 141548 - DNA, 25 bp, E. coli
tgtggcaacagtggtgatggcattt

SEQ ID NO: 141549 - DNA, 25 bp, E. coli
gcatttgttgcattaattgcgttga

SEQ ID NO: 141550 - DNA, 25 bp, E. coli
gcatttgttgcaataattgcgttga

SEQ ID NO: 141551 - DNA, 25 bp, E. coli
cggcaatcgtcataccctttatcga

SEQ ID NO: 141552 - DNA, 25 bp, E. coli
cgtcaaacccttaatcgatcgtctg

SEQ ID NO: 141553 - DNA, 25 bp, E. coli
cggcaatcgtcaaaccctttatcga

SEQ ID NO: 141554 - DNA, 25 bp, E. coli
cgtcaaaccctttatcgatcgtctg

SEQ ID NO: 141555 - DNA, 25 bp, E. coli
ggcatcattaatcgcgatccctggc

SEQ ID NO: 141556 - DNA, 25 bp, E. coli
ggcatcattaatggcgatccctggc

SEQ ID NO: 141557 - DNA, 25 bp, E. coli
gatggcatttgtagcaataattgcg

SEQ ID NO: 141558 - DNA, 25 bp, E. coli
gatggcatttgttgcaataattgcg

SEQ ID NO: 141559 - DNA, 25 bp, E. coli
catcattaaccccggaagcagcact

SEQ ID NO: 141560 - DNA, 25 bp, E. coli
catcattaacccgggaagcagcact

SEQ ID NO: 141561 - DNA, 25 bp, E. coli
atcgaacaggtcagggaagatgtcc

SEQ ID NO: 141562 - DNA, 25 bp, E. coli
acagcgaatccggaattatcttcga

SEQ ID NO: 141563 - DNA, 25 bp, E. coli
atcgaacaggtctgggaagatgtcc

SEQ ID NO: 141564 - DNA, 25 bp, E. coli
agcgaatccggatttatcttcgaca

SEQ ID NO: 141565 - DNA, 25 bp, E. coli
atgacatcattaaccccggaagcag

SEQ ID NO: 141566 - DNA, 25 bp, E. coli
acagcgaatccgcaattatcttcga

SEQ ID NO: 141567 - DNA, 25 bp, E. coli
agcgaatccggaattatcttcgaca

SEQ ID NO: 141568 - DNA, 25 bp, E. coli
atgacatcattatccccggaagcag

SEQ ID NO: 141569 - DNA, 25 bp, E. coli
tatcgaacaggtcagggaagatgtc

SEQ ID NO: 141570 - DNA, 25 bp, E. coli
tatcgaacaggtgagggaagatgtc

SEQ ID NO: 141571 - DNA, 25 bp, E. coli
tgtatcgaacaggtcagggaagatg

SEQ ID NO: 141572 - DNA, 25 bp, E. coli
tgtatcgaacagctcagggaagatg

SEQ ID NO: 141573 - DNA, 25 bp, E. coli
tgacatcattaagcccggaagcagc

SEQ ID NO: 141574 - DNA, 25 bp, E. coli
tgacatcattaaccccggaagcagc

SEQ ID NO: 141575 - DNA, 25 bp, E. coli
tcgaacaggtcagggaagatgtccg

SEQ ID NO: 141576 - DNA, 25 bp, E. coli
tcgaacaggtcacggaagatgtccg

SEQ ID NO: 141577 - DNA, 25 bp, E. coli
cctgtatcgaactggtcagggaaga

SEQ ID NO: 141578 - DNA, 25 bp, E. coli
cctgtatcgaacaggtcagggaaga

SEQ ID NO: 141579 - DNA, 25 bp, E. coli
gaacaggtcaggcaagatgtccgta

SEQ ID NO: 141580 - DNA, 25 bp, E. coli
gaacaggtcagggaagatgtccgta

SEQ ID NO: 141581 - DNA, 25 bp, E. coli
tacagttcagaagaaataaaaaatt

SEQ ID NO: 141582 - DNA, 25 bp, E. coli
tacagttcagaacaaataaaaaatt

SEQ ID NO: 141583 - DNA, 25 bp, E. coli
cttttttccttaaatgtgcgtttca

SEQ ID NO: 141584 - DNA, 25 bp, E. coli
cttttttccttatatgtgcgtttca

SEQ ID NO: 141585 - DNA, 25 bp, E. coli
aaaatttcttttaattgcgatatgc

SEQ ID NO: 141586 - DNA, 25 bp, E. coli
aaaatttctttttattgcgatatgc

SEQ ID NO: 141587 - DNA, 25 bp, E. coli
tatgtgcgtttcatatacagttcag

SEQ ID NO: 141588 - DNA, 25 bp, E. coli
tatgtgcgtttcttatacagttcag

SEQ ID NO: 141589 - DNA, 25 bp, E. coli
ttttattgcgatatgcattgctgca

SEQ ID NO: 141590 - DNA, 25 bp, E. coli
ttttattgcgatttgcattgctgca

SEQ ID NO: 141591 - DNA, 25 bp, E. coli
tgttcttttttccttatatgtgcgt

SEQ ID NO: 141592 - DNA, 25 bp, E. coli
tgttcttttttcgttatatgtgcgt

SEQ ID NO: 141593 - DNA, 25 bp, E. coli
tgcattgctgcatttagcaccttga

SEQ ID NO: 141594 - DNA, 25 bp, E. coli
tgcattgctgcaattagcaccttga

SEQ ID NO: 141595 - DNA, 25 bp, E. coli
tgcgatatgcattgctgcatttagc

SEQ ID NO: 141596 - DNA, 25 bp, E. coli
tgcgatatgcatagctgcatttagc

SEQ ID NO: 141597 - DNA, 25 bp, E. coli
cgtttcatatacagttcagaacaaa

SEQ ID NO: 141598 - DNA, 25 bp, E. coli
cgtttcatatactgttcagaacaaa

SEQ ID NO: 141599 - DNA, 25 bp, E. coli
gatatgcattgcagcatttagcacc

SEQ ID NO: 141600 - DNA, 25 bp, E. coli
gatatgcattgctgcatttagcacc

SEQ ID NO: 141601 - DNA, 25 bp, E. coli
gtgcgtttcataaacagttcagaac

SEQ ID NO: 141602 - DNA, 25 bp, E. coli
gtgcgtttcatatacagttcagaac

SEQ ID NO: 141603 - DNA, 25 bp, E. coli
aaactgctggaaggtctgcgtctca

SEQ ID NO: 141604 - DNA, 25 bp, E. coli
aaactgctggaacgtctgcgtctca

SEQ ID NO: 141605 - DNA, 25 bp, E. coli
tgagtaaagatctggcgctggcccg

SEQ ID NO: 141606 - DNA, 25 bp, E. coli
tgagtaaagatcaggcgctggcccg

SEQ ID NO: 141607 - DNA, 25 bp, E. coli
tcatatcgtagatcaaggcgacgcg

SEQ ID NO: 141608 - DNA, 25 bp, E. coli
tcatatcgtagaacaaggcgacgcg

SEQ ID NO: 141609 - DNA, 25 bp, E. coli
gcattaattgctactacggcgcgca

SEQ ID NO: 141610 - DNA, 25 bp, E. coli
gcattaattgcttctacggcgcgca

SEQ ID NO: 141611 - DNA, 25 bp, E. coli
gaaattacggcagaaatcgtcagca

SEQ ID NO: 141612 - DNA, 25 bp, E. coli
gaaattacggcacaaatcgtcagca

SEQ ID NO: 141613 - DNA, 25 bp, E. coli
gaaacgctggtgttacttggcccca

SEQ ID NO: 141614 - DNA, 25 bp, E. coli
gaaacgctggtgatacttggcccca

SEQ ID NO: 141615 - DNA, 25 bp, E. coli
cgtaaaaccgccagccgagtggtgt

SEQ ID NO: 141616 - DNA, 25 bp, E. coli
cgtaaaaccgcctgccgagtggtgt

SEQ ID NO: 141617 - DNA, 25 bp, E. coli
gtttcagcaatacaacctgtggccg

SEQ ID NO: 141618 - DNA, 25 bp, E. coli
gatatcacgctgcattgcccacagg

SEQ ID NO: 141619 - DNA, 25 bp, E. coli
gtttcagcaatagaacctgtggccg

SEQ ID NO: 141620 - DNA, 25 bp, E. coli
gatatcacgctggattgcccacagg

SEQ ID NO: 141621 - DNA, 25 bp, E. coli
ggcagaaacgaatattacccaggtg

SEQ ID NO: 141622 - DNA, 25 bp, E. coli
ggcagaaacgaaaattacccaggtg

SEQ ID NO: 141623 - DNA, 25 bp, E. coli
tcaatctgcttgtgatgccgcgctc

SEQ ID NO: 141624 - DNA, 25 bp, E. coli
tcaatctgcttgagatgccgcgctc

SEQ ID NO: 141625 - DNA, 25 bp, E. coli
catcatcgctaattatcaatgccgg

SEQ ID NO: 141626 - DNA, 25 bp, E. coli
catcgctaaataacaatgccggatt

SEQ ID NO: 141627 - DNA, 25 bp, E. coli
catcatcgctaaatatcaatgccgg

SEQ ID NO: 141628 - DNA, 25 bp, E. coli
ctaaatatcaatcccggattgccat

SEQ ID NO: 141629 - DNA, 25 bp, E. coli
catcgctaaatatcaatgccggatt

SEQ ID NO: 141630 - DNA, 25 bp, E. coli
ctaaatatcaatgccggattgccat

SEQ ID NO: 141631 - DNA, 25 bp, E. coli
atcatcgctaaaaatcaatgccgga

SEQ ID NO: 141632 - DNA, 25 bp, E. coli
atcatcgctaaatatcaatgccgga

SEQ ID NO: 141633 - DNA, 25 bp, E. coli
atatcaatgccggattgccatccgg

SEQ ID NO: 141634 - DNA, 25 bp, E. coli
atatcaatgccgcattgccatccgg

SEQ ID NO: 141635 - DNA, 25 bp, E. coli
atcgctaaatatcaatgccggattg

SEQ ID NO: 141636 - DNA, 25 bp, E. coli
atcgctaaatatgaatgccggattg

SEQ ID NO: 141637 - DNA, 25 bp, E. coli
tatcaatgccggattgccatccggc

SEQ ID NO: 141638 - DNA, 25 bp, E. coli
tatcaatgccggtttgccatccggc

SEQ ID NO: 141639 - DNA, 25 bp, E. coli
tcgctaaatatcaatgccggattgc

SEQ ID NO: 141640 - DNA, 25 bp, E. coli
tcgctaaatatctatgccggattgc

SEQ ID NO: 141641 - DNA, 25 bp, E. coli
tcatcgctaaatttcaatgccggat

SEQ ID NO: 141642 - DNA, 25 bp, E. coli
tcatcgctaaatatcaatgccggat

SEQ ID NO: 141643 - DNA, 25 bp, E. coli
gctaaatatcaatgccggattgcca

SEQ ID NO: 141644 - DNA, 25 bp, E. coli
gctaaatatcaaagccggattgcca

SEQ ID NO: 141645 - DNA, 25 bp, E. coli
cgctaaatatcaatgccggattgcc

SEQ ID NO: 141646 - DNA, 25 bp, E. coli
cgctaaatatcattgccggattgcc

SEQ ID NO: 141647 - DNA, 25 bp, E. coli
cagctttctgagatgagctgggcgc

SEQ ID NO: 141648 - DNA, 25 bp, E. coli
cagctttctgagttgagctgggcgc

SEQ ID NO: 141649 - DNA, 25 bp, E. coli
agtttcatcaagtcgcgtcctgccg

SEQ ID NO: 141650 - DNA, 25 bp, E. coli
agtttcatcaagacgcgtcctgccg

SEQ ID NO: 141651 - DNA, 25 bp, E. coli
atttatcgccgggaacatcgcttgg

SEQ ID NO: 141652 - DNA, 25 bp, E. coli
atttatcgccggcaacatcgcttgg

SEQ ID NO: 141653 - DNA, 25 bp, E. coli
tatcgccgggaacatcgcttggaag

SEQ ID NO: 141654 - DNA, 25 bp, E. coli
tatcgccgggaagatcgcttggaag

SEQ ID NO: 141655 - DNA, 25 bp, E. coli
tgcagtttcatcaagacgcgtcctg

SEQ ID NO: 141656 - DNA, 25 bp, E. coli
tgcagtttcatctagacgcgtcctg

SEQ ID NO: 141657 - DNA, 25 bp, E. coli
tcgccgggaacaacgcttggaagac

SEQ ID NO: 141658 - DNA, 25 bp, E. coli
tcgccgggaacatcgcttggaagac

SEQ ID NO: 141659 - DNA, 25 bp, E. coli
gaacatcgcttggaagacggaagtg

SEQ ID NO: 141660 - DNA, 25 bp, E. coli
gaacatcgcttgcaagacggaagtg

SEQ ID NO: 141661 - DNA, 25 bp, E. coli
cgcgctggtgatccagctttctgag

SEQ ID NO: 141662 - DNA, 25 bp, E. coli
cgcgctggtgatgcagctttctgag

SEQ ID NO: 141663 - DNA, 25 bp, E. coli
cgggaacatcgcatggaagacggaa

SEQ ID NO: 141664 - DNA, 25 bp, E. coli
cgggaacatcgcttggaagacggaa

SEQ ID NO: 141665 - DNA, 25 bp, E. coli
gtttgcagtttcatcaagacgcgtc

SEQ ID NO: 141666 - DNA, 25 bp, E. coli
gtttgcagtttcttcaagacgcgtc

SEQ ID NO: 141667 - DNA, 25 bp, E. coli
ggtgatgcagctttctgagatgagc

SEQ ID NO: 141668 - DNA, 25 bp, E. coli
ggtgatgcagctatctgagatgagc

SEQ ID NO: 141669 - DNA, 25 bp, E. coli
caagcgaagacattcggcgcgagtt

SEQ ID NO: 141670 - DNA, 25 bp, E. coli
caagcgaagacaatcggcgcgagtt

SEQ ID NO: 141671 - DNA, 25 bp, E. coli
atggattttcctcctctgtataccg

SEQ ID NO: 141672 - DNA, 25 bp, E. coli
atggattttcctgctctgtataccg

SEQ ID NO: 141673 - DNA, 25 bp, E. coli
aaaacaagcgaagacattcggcgcg

SEQ ID NO: 141674 - DNA, 25 bp, E. coli
aaaacaagcgaacacattcggcgcg

SEQ ID NO: 141675 - DNA, 25 bp, E. coli
tataatactcgggacttgtttgcca

SEQ ID NO: 141676 - DNA, 25 bp, E. coli
tataatactcggcacttgtttgcca

SEQ ID NO: 141677 - DNA, 25 bp, E. coli
tgtataccgtctaaaaactggcgaa

SEQ ID NO: 141678 - DNA, 25 bp, E. coli
tgtataccgtcttaaaactggcgaa

SEQ ID NO: 141679 - DNA, 25 bp, E. coli
tgaagacgaaaagaagcgaagacat

SEQ ID NO: 141680 - DNA, 25 bp, E. coli
tgaagacgaaaacaagcgaagacat

SEQ ID NO: 141681 - DNA, 25 bp, E. coli
tcggcgcgagttggctataatactc

SEQ ID NO: 141682 - DNA, 25 bp, E. coli
tcggcgcgagttcgctataatactc

SEQ ID NO: 141683 - DNA, 25 bp, E. coli
gctctgtataccgtcttaaaactgg

SEQ ID NO: 141684 - DNA, 25 bp, E. coli
gctctgtataccctcttaaaactgg

SEQ ID NO: 141685 - DNA, 25 bp, E. coli
gacattcggcgcgagttggctataa

SEQ ID NO: 141686 - DNA, 25 bp, E. coli
gacattcggcgccagttggctataa

SEQ ID NO: 141687 - DNA, 25 bp, E. coli
gattttcctgctgtgtataccgtct

SEQ ID NO: 141688 - DNA, 25 bp, E. coli
gattttcctgctctgtataccgtct

SEQ ID NO: 141689 - DNA, 25 bp, E. coli
ggaaaatgaagaggaaaacaagcga

SEQ ID NO: 141690 - DNA, 25 bp, E. coli
ggaaaatgaagacgaaaacaagcga

SEQ ID NO: 141691 - DNA, 25 bp, E. coli
cagaatggtactatcgactatggtc

SEQ ID NO: 141692 - DNA, 25 bp, E. coli
cagaatggtactttcgactatggtc

SEQ ID NO: 141693 - DNA, 25 bp, E. coli
tatatgacgtagaagcatggaccga

SEQ ID NO: 141694 - DNA, 25 bp, E. coli
tatatgacgtagtagcatggaccga

SEQ ID NO: 141695 - DNA, 25 bp, E. coli
tcctgaaagcgagaagggtaatacc

SEQ ID NO: 141696 - DNA, 25 bp, E. coli
tcctgaaagcgacaagggtaatacc

SEQ ID NO: 141697 - DNA, 25 bp, E. coli
tgcccgtatcggtttcaaaggtgaa

SEQ ID NO: 141698 - DNA, 25 bp, E. coli
tgcccgtatcggattcaaaggtgaa

SEQ ID NO: 141699 - DNA, 25 bp, E. coli
tcagtgggaatttaacattggcgca

SEQ ID NO: 141700 - DNA, 25 bp, E. coli
tcagtgggaattaaacattggcgca

SEQ ID NO: 141701 - DNA, 25 bp, E. coli
gctgacaacttcttgaacggtcgtg

SEQ ID NO: 141702 - DNA, 25 bp, E. coli
gctgacaacttcatgaacggtcgtg

SEQ ID NO: 141703 - DNA, 25 bp, E. coli
cattggcgcaaacggtcctgaaagc

SEQ ID NO: 141704 - DNA, 25 bp, E. coli
cattggcgcaaagggtcctgaaagc

SEQ ID NO: 141705 - DNA, 25 bp, E. coli
gatacctatgctcgcgctgacaact

SEQ ID NO: 141706 - DNA, 25 bp, E. coli
gatacctatgctggcgctgacaact

SEQ ID NO: 141707 - DNA, 25 bp, E. coli
gggtaataccgctacgcgtctggca

SEQ ID NO: 141708 - DNA, 25 bp, E. coli
gggtaataccgcaacgcgtctggca

SEQ ID NO: 141709 - DNA, 25 bp, E. coli
taactacggtgtcgtatatgacgta

SEQ ID NO: 141710 - DNA, 25 bp, E. coli
taactacggtgtggtatatgacgta

SEQ ID NO: 141711 - DNA, 25 bp, E. coli
gatggcgacatgtcatatgcccgta

SEQ ID NO: 141712 - DNA, 25 bp, E. coli
gatggcgacatgacatatgcccgta

SEQ ID NO: 141713 - DNA, 25 bp, E. coli
tactgtttgccgctacctggtggaa

SEQ ID NO: 141714 - DNA, 25 bp, E. coli
tactgtttgccggtacctggtggaa

SEQ ID NO: 141715 - DNA, 25 bp, E. coli
aaaaagcactcggagaattagggcc

SEQ ID NO: 141716 - DNA, 25 bp, E. coli
aaaaagcactcgcagaattagggcc

SEQ ID NO: 141717 - DNA, 25 bp, E. coli
tacccgtgtgggactgtacctgacg

SEQ ID NO: 141718 - DNA, 25 bp, E. coli
tacccgtgtgggtctgtacctgacg

SEQ ID NO: 141719 - DNA, 25 bp, E. coli
ttaccgggctggttaaacgcattgc

SEQ ID NO: 141720 - DNA, 25 bp, E. coli
ttaccgggctggataaacgcattgc

SEQ ID NO: 141721 - DNA, 25 bp, E. coli
tggtattcaaacatcggcggcgcaa

SEQ ID NO: 141722 - DNA, 25 bp, E. coli
tgtggtgaccatggtcctgagcctg

SEQ ID NO: 141723 - DNA, 25 bp, E. coli
tgtggtgaccatcgtcctgagcctg

SEQ ID NO: 141724 - DNA, 25 bp, E. coli
tgtcgaaaataggtgccagcagccg

SEQ ID NO: 141725 - DNA, 25 bp, E. coli
tgtcgaaaatagctgccagcagccg

SEQ ID NO: 141726 - DNA, 25 bp, E. coli
gcagcaatgtttttcgcggcggcaa

SEQ ID NO: 141727 - DNA, 25 bp, E. coli
gaattatccctattcccggcctgtg

SEQ ID NO: 141728 - DNA, 25 bp, E. coli
gaattatccctaatcccggcctgtg

SEQ ID NO: 141729 - DNA, 25 bp, E. coli
gcagcaatgtttatcgcggcggcaa

SEQ ID NO: 141730 - DNA, 25 bp, E. coli
ccgcgaaagcgctgaaaatgactct

SEQ ID NO: 141731 - DNA, 25 bp, E. coli
ccgcgaaagcgcagaaaatgactct

SEQ ID NO: 141732 - DNA, 25 bp, E. coli
gattaacgcgccacaaaatatggtg

SEQ ID NO: 141733 - DNA, 25 bp, E. coli
gattaacgcgcctcaaaatatggtg

SEQ ID NO: 141734 - DNA, 25 bp, E. coli
tggtattcaaacttcggcggcgcaa

SEQ ID NO: 141735 - DNA, 25 bp, E. coli
cagctggtagcactattgctggtgc

SEQ ID NO: 141736 - DNA, 25 bp, E. coli
cagctggtagcagtattgctggtgc

SEQ ID NO: 141737 - DNA, 25 bp, E. coli
agctcccgttgcgttactggcgatt

SEQ ID NO: 141738 - DNA, 25 bp, E. coli
agctcccgttgccttactggcgatt

SEQ ID NO: 141739 - DNA, 25 bp, E. coli
ttaaccgtgcaggtcccgttgcgtt

SEQ ID NO: 141740 - DNA, 25 bp, E. coli
ttaaccgtgcagctcccgttgcgtt

SEQ ID NO: 141741 - DNA, 25 bp, E. coli
tgcagctcccgtagcgttactggcg

SEQ ID NO: 141742 - DNA, 25 bp, E. coli
tgcagctcccgttgcgttactggcg

SEQ ID NO: 141743 - DNA, 25 bp, E. coli
tgccgcagctggtagcactattgct

SEQ ID NO: 141744 - DNA, 25 bp, E. coli
tgccgcagctggaagcactattgct

SEQ ID NO: 141745 - DNA, 25 bp, E. coli
gccgggcagatcctcacgtttaact

SEQ ID NO: 141746 - DNA, 25 bp, E. coli
gccgggcagatcgtcacgtttaact

SEQ ID NO: 141747 - DNA, 25 bp, E. coli
gctcacttatgtgttgagcgggctg

SEQ ID NO: 141748 - DNA, 25 bp, E. coli
gctcacttatgtcttgagcgggctg

SEQ ID NO: 141749 - DNA, 25 bp, E. coli
ccgccgggcagatcgtcacgtttaa

SEQ ID NO: 141750 - DNA, 25 bp, E. coli
ccgccgggcagaacgtcacgtttaa

SEQ ID NO: 141751 - DNA, 25 bp, E. coli
cggacaccactaggccaaaaaggcg

SEQ ID NO: 141752 - DNA, 25 bp, E. coli
cggacaccactacgccaaaaaggcg

SEQ ID NO: 141753 - DNA, 25 bp, E. coli
ggatgccgcagctggtagcactatt

SEQ ID NO: 141754 - DNA, 25 bp, E. coli
ggatgccgcagcaggtagcactatt

SEQ ID NO: 141755 - DNA, 25 bp, E. coli
ggtagcactattcctggtgctgctg

SEQ ID NO: 141756 - DNA, 25 bp, E. coli
ggtagcactattgctggtgctgctg

SEQ ID NO: 141757 - DNA, 25 bp, E. coli
gaggccaaagcctgccatttttagc

SEQ ID NO: 141758 - DNA, 25 bp, E. coli
gaggccaaagccagccatttttagc

SEQ ID NO: 141759 - DNA, 25 bp, E. coli
tatttatgcagttattgagatcccc

SEQ ID NO: 141760 - DNA, 25 bp, E. coli
tatttatgcagtaattgagatcccc

SEQ ID NO: 141761 - DNA, 25 bp, E. coli
tttttagctcaattcggcgatgacc

SEQ ID NO: 141762 - DNA, 25 bp, E. coli
tttttagctcaaatcggcgatgacc

SEQ ID NO: 141763 - DNA, 25 bp, E. coli
tgtcgtcagttctaggcaggataag

SEQ ID NO: 141764 - DNA, 25 bp, E. coli
tgtcgtcagttcaaggcaggataag

SEQ ID NO: 141765 - DNA, 25 bp, E. coli
tcccgataagttggaaatccgctgg

SEQ ID NO: 141766 - DNA, 25 bp, E. coli
tcccgataagttcgaaatccgctgg

SEQ ID NO: 141767 - DNA, 25 bp, E. coli
gaaacgtcattaccaattaaggcag

SEQ ID NO: 141768 - DNA, 25 bp, E. coli
gaaacgtcattagcaattaaggcag

SEQ ID NO: 141769 - DNA, 25 bp, E. coli
ccgctggaagctttctggatgagca

SEQ ID NO: 141770 - DNA, 25 bp, E. coli
ccgctggaagctatctggatgagca

SEQ ID NO: 141771 - DNA, 25 bp, E. coli
gatagaccgcgccttgaaaagaggc

SEQ ID NO: 141772 - DNA, 25 bp, E. coli
gatagaccgcgcgttgaaaagaggc

SEQ ID NO: 141773 - DNA, 25 bp, E. coli
taaccgatgcgataaggacaacaag

SEQ ID NO: 141774 - DNA, 25 bp, E. coli
taaccgatgcgaaaaggacaacaag

SEQ ID NO: 141775 - DNA, 25 bp, E. coli
taagcttgccatatgacctgtatca

SEQ ID NO: 141776 - DNA, 25 bp, E. coli
taagcttgccatttgacctgtatca

SEQ ID NO: 141777 - DNA, 25 bp, E. coli
gatgacctggatcaatcgtcccggc

SEQ ID NO: 141778 - DNA, 25 bp, E. coli
gatgacctggatgaatcgtcccggc

SEQ ID NO: 141779 - DNA, 25 bp, E. coli
caaggtcaacgaatggaatgcaata

SEQ ID NO: 141780 - DNA, 25 bp, E. coli
caacggtaaccggatattatcgacc

SEQ ID NO: 141781 - DNA, 25 bp, E. coli
caacggtaaccgcatattatcgacc

SEQ ID NO: 141782 - DNA, 25 bp, E. coli
caaggtcaacgattggaatgcaata

SEQ ID NO: 141783 - DNA, 25 bp, E. coli
cagtttctgatagatggttcgtgga

SEQ ID NO: 141784 - DNA, 25 bp, E. coli
cagtttctgatacatggttcgtgga

SEQ ID NO: 141785 - DNA, 25 bp, E. coli
tacttacagggcatgatgtcgctgg

SEQ ID NO: 141786 - DNA, 25 bp, E. coli
tacttacagggcttgatgtcgctgg

SEQ ID NO: 141787 - DNA, 25 bp, E. coli
tatttttgaggtacctgacggatgc

SEQ ID NO: 141788 - DNA, 25 bp, E. coli
tattatcgacctcttcagtttctga

SEQ ID NO: 141789 - DNA, 25 bp, E. coli
tattatcgacctgttcagtttctga

SEQ ID NO: 141790 - DNA, 25 bp, E. coli
tatttttgaggttcctgacggatgc

SEQ ID NO: 141791 - DNA, 25 bp, E. coli
tgacggatgcgtacttacagggctt

SEQ ID NO: 141792 - DNA, 25 bp, E. coli
tgacggatgcgttcttacagggctt

SEQ ID NO: 141793 - DNA, 25 bp, E. coli
cattcgaagaggatcaaggtcaacg

SEQ ID NO: 141794 - DNA, 25 bp, E. coli
ctggtgatggtattgcaacggtaac

SEQ ID NO: 141795 - DNA, 25 bp, E. coli
ctggtgatggtaatgcaacggtaac

SEQ ID NO: 141796 - DNA, 25 bp, E. coli
cattcgaagaggttcaaggtcaacg

SEQ ID NO: 141797 - DNA, 25 bp, E. coli
ggttcgtggaaaacagcttccagcg

SEQ ID NO: 141798 - DNA, 25 bp, E. coli
ggttcgtggaaatcagcttccagcg

SEQ ID NO: 141799 - DNA, 25 bp, E. coli
ggctgactcacgttatgttcaaagc

SEQ ID NO: 141800 - DNA, 25 bp, E. coli
ggctgactcacgatatgttcaaagc

SEQ ID NO: 141801 - DNA, 25 bp, E. coli
aataacgagctgaatgagatccgca

SEQ ID NO: 141802 - DNA, 25 bp, E. coli
aataacgagctgtatgagatccgca

SEQ ID NO: 141803 - DNA, 25 bp, E. coli
caaaacgcgggatgggcttggtaca

SEQ ID NO: 141804 - DNA, 25 bp, E. coli
caaaacgcgggaagggcttggtaca

SEQ ID NO: 141805 - DNA, 25 bp, E. coli
cagtgactttgctgcgttagcccaa

SEQ ID NO: 141806 - DNA, 25 bp, E. coli
cagtgactttgcagcgttagcccaa

SEQ ID NO: 141807 - DNA, 25 bp, E. coli
tacagttagcgatcatgcttgcgga

SEQ ID NO: 141808 - DNA, 25 bp, E. coli
tacagttagcgaacatgcttgcgga

SEQ ID NO: 141809 - DNA, 25 bp, E. coli
aacaagaaactctagcaggcgcagc

SEQ ID NO: 141810 - DNA, 25 bp, E. coli
aacaagaaactcaagcaggcgcagc

SEQ ID NO: 141811 - DNA, 25 bp, E. coli
tacccggcaagcagttatgtgaaac

SEQ ID NO: 141812 - DNA, 25 bp, E. coli
tacccggcaagctgttatgtgaaac

SEQ ID NO: 141813 - DNA, 25 bp, E. coli
tatcaaaatgctggcagctgacccg

SEQ ID NO: 141814 - DNA, 25 bp, E. coli
tatcaaaatgctcgcagctgacccg

SEQ ID NO: 141815 - DNA, 25 bp, E. coli
tctgaaagcacacgatatgcgccgc

SEQ ID NO: 141816 - DNA, 25 bp, E. coli
tctgaaagcacaggatatgcgccgc

SEQ ID NO: 141817 - DNA, 25 bp, E. coli
gccgtgacctcatcgcaattgggaa

SEQ ID NO: 141818 - DNA, 25 bp, E. coli
gccgtgacctcaacgcaattgggaa

SEQ ID NO: 141819 - DNA, 25 bp, E. coli
gaaattcggaatattgtcactcgcc

SEQ ID NO: 141820 - DNA, 25 bp, E. coli
gaaattcggaattttgtcactcgcc

SEQ ID NO: 141821 - DNA, 25 bp, E. coli
gattaatgatttgatcccaccgggt

SEQ ID NO: 141822 - DNA, 25 bp, E. coli
gattaatgatttcatcccaccgggt

SEQ ID NO: 141823 - DNA, 25 bp, E. coli
tactgcctgcgtcgaagaatatcgc

SEQ ID NO: 141824 - DNA, 25 bp, E. coli
tactgcctgcgtggaagaatatcgc

SEQ ID NO: 141825 - DNA, 25 bp, E. coli
taccggcagagcgaaactgtgctgg

SEQ ID NO: 141826 - DNA, 25 bp, E. coli
taccggcagagccaaactgtgctgg

SEQ ID NO: 141827 - DNA, 25 bp, E. coli
tgctgctgacgcagaaccagaaggg

SEQ ID NO: 141828 - DNA, 25 bp, E. coli
tgctgctgacgctgaaccagaaggg

SEQ ID NO: 141829 - DNA, 25 bp, E. coli
tcctgtgaaacatagtgccgctcct

SEQ ID NO: 141830 - DNA, 25 bp, E. coli
tcctgtgaaacaaagtgccgctcct

SEQ ID NO: 141831 - DNA, 25 bp, E. coli
gccttaatgaacctgggaagtcaca

SEQ ID NO: 141832 - DNA, 25 bp, E. coli
gccttaatgaacgtgggaagtcaca

SEQ ID NO: 141833 - DNA, 25 bp, E. coli
gaagggttgtaaccgccactggcta

SEQ ID NO: 141834 - DNA, 25 bp, E. coli
gaagggttgtaagcgccactggcta

SEQ ID NO: 141835 - DNA, 25 bp, E. coli
ccggttatgcgtctggtggccttaa

SEQ ID NO: 141836 - DNA, 25 bp, E. coli
ccggttatgcgtgtggtggccttaa

SEQ ID NO: 141837 - DNA, 25 bp, E. coli
cattctgctgaatgccgtgaccgca

SEQ ID NO: 141838 - DNA, 25 bp, E. coli
cattctgctgaaagccgtgaccgca

SEQ ID NO: 141839 - DNA, 25 bp, E. coli
ggccgaggtcggttaagatatcaaa

SEQ ID NO: 141840 - DNA, 25 bp, E. coli
ggcagaacgcctacccggttatgcg

SEQ ID NO: 141841 - DNA, 25 bp, E. coli
ggcagaacgccttcccggttatgcg

SEQ ID NO: 141842 - DNA, 25 bp, E. coli
ggccgaggtcggataagatatcaaa

SEQ ID NO: 141843 - DNA, 25 bp, E. coli
taaacttttttagagcgaagacctg

SEQ ID NO: 141844 - DNA, 25 bp, E. coli
taaacttttttacagcgaagacctg

SEQ ID NO: 141845 - DNA, 25 bp, E. coli
catttgatgagctaaagcagcgatt

SEQ ID NO: 141846 - DNA, 25 bp, E. coli
catttgatgagcaaaagcagcgatt

SEQ ID NO: 141847 - DNA, 25 bp, E. coli
aaagagtcgattccctctaagcagg

SEQ ID NO: 141848 - DNA, 25 bp, E. coli
aaagagtcgattgcctctaagcagg

SEQ ID NO: 141849 - DNA, 25 bp, E. coli
tgactgcgagcattccattaaagag

SEQ ID NO: 141850 - DNA, 25 bp, E. coli
tgactgcgagcaatccattaaagag

SEQ ID NO: 141851 - DNA, 25 bp, E. coli
tctattcgtaaatgcagagcgaacc

SEQ ID NO: 141852 - DNA, 25 bp, E. coli
tctattcgtaaaagcagagcgaacc

SEQ ID NO: 141853 - DNA, 25 bp, E. coli
tcttcactttcgtaggaaaagcgtt

SEQ ID NO: 141854 - DNA, 25 bp, E. coli
tcttcactttcgaaggaaaagcgtt

SEQ ID NO: 141855 - DNA, 25 bp, E. coli
tctaagcaggcaaattgtgcatcgc

SEQ ID NO: 141856 - DNA, 25 bp, E. coli
tctaagcaggcatattgtgcatcgc

SEQ ID NO: 141857 - DNA, 25 bp, E. coli
gcagagcgaaccgattgagagaatc

SEQ ID NO: 141858 - DNA, 25 bp, E. coli
gcagagcgaacccattgagagaatc

SEQ ID NO: 141859 - DNA, 25 bp, E. coli
gaaaagcgttcaatgctagattcac

SEQ ID NO: 141860 - DNA, 25 bp, E. coli
gaaaagcgttcattgctagattcac

SEQ ID NO: 141861 - DNA, 25 bp, E. coli
cgctggtgaatttggataaagtgtc

SEQ ID NO: 141862 - DNA, 25 bp, E. coli
cgctggtgaattaggataaagtgtc

SEQ ID NO: 141863 - DNA, 25 bp, E. coli
tcaatggctaagtttaactctcaga

SEQ ID NO: 141864 - DNA, 25 bp, E. coli
tcaatggctaagattaactctcaga

SEQ ID NO: 141865 - DNA, 25 bp, E. coli
gatggtaaactcgatgactgcgagc

SEQ ID NO: 141866 - DNA, 25 bp, E. coli
gatggtaaactccatgactgcgagc

SEQ ID NO: 141867 - DNA, 25 bp, E. coli
caatagcgggacaattgtcacggat

SEQ ID NO: 141868 - DNA, 25 bp, E. coli
caatagcgggactattgtcacggat

SEQ ID NO: 141869 - DNA, 25 bp, E. coli
caacagtagcgcaggcaaaagaact

SEQ ID NO: 141870 - DNA, 25 bp, E. coli
caaaagaactgatggatgatgcatg

SEQ ID NO: 141871 - DNA, 25 bp, E. coli
caaaagaactgaaggatgatgcatg

SEQ ID NO: 141872 - DNA, 25 bp, E. coli
caacagtagcgctggcaaaagaact

SEQ ID NO: 141873 - DNA, 25 bp, E. coli
tatgagtttcgtgacaatagcggga

SEQ ID NO: 141874 - DNA, 25 bp, E. coli
tatgagtttcgtcacaatagcggga

SEQ ID NO: 141875 - DNA, 25 bp, E. coli
tgtttctccgaatgacaaagtaaga

SEQ ID NO: 141876 - DNA, 25 bp, E. coli
tgtcttttggcgcttttgcacagca

SEQ ID NO: 141877 - DNA, 25 bp, E. coli
tgtttctccgaaagacaaagtaaga

SEQ ID NO: 141878 - DNA, 25 bp, E. coli
tgtcttttggcggttttgcacagca

SEQ ID NO: 141879 - DNA, 25 bp, E. coli
tgaaaaaggtatagattgcagcact

SEQ ID NO: 141880 - DNA, 25 bp, E. coli
tgaaaaaggtattgattgcagcact

SEQ ID NO: 141881 - DNA, 25 bp, E. coli
tccttgaagggaccatcgttaaaaa

SEQ ID NO: 141882 - DNA, 25 bp, E. coli
tccttgaagggagcatcgttaaaaa

SEQ ID NO: 141883 - DNA, 25 bp, E. coli
gaagcagagcgttcaacagtagcgc

SEQ ID NO: 141884 - DNA, 25 bp, E. coli
gaagcagagcgtacaacagtagcgc

SEQ ID NO: 141885 - DNA, 25 bp, E. coli
gaaattgataaagacctgagcagtg

SEQ ID NO: 141886 - DNA, 25 bp, E. coli
gaaattgataaacacctgagcagtg

SEQ ID NO: 141887 - DNA, 25 bp, E. coli
gatgcatgggttatccttgaaggga

SEQ ID NO: 141888 - DNA, 25 bp, E. coli
gatgcatgggttttccttgaaggga

SEQ ID NO: 141889 - DNA, 25 bp, E. coli
caattcttggctcgatcttcggtga

SEQ ID NO: 141890 - DNA, 25 bp, E. coli
caattcttggctggatcttcggtga

SEQ ID NO: 141891 - DNA, 25 bp, E. coli
taccatgctcaatcgcttgctgcgg

SEQ ID NO: 141892 - DNA, 25 bp, E. coli
taccatgctcaaacgcttgctgcgg

SEQ ID NO: 141893 - DNA, 25 bp, E. coli
actggtaatggcagcacctgcggtg

SEQ ID NO: 141894 - DNA, 25 bp, E. coli
aaaacgtgctgtggatgctgacgca

SEQ ID NO: 141895 - DNA, 25 bp, E. coli
aaaacgtgctgtcgatgctgacgca

SEQ ID NO: 141896 - DNA, 25 bp, E. coli
actggtaatggctgcacctgcggtg

SEQ ID NO: 141897 - DNA, 25 bp, E. coli
tttaaaccgcactacctgccgatgg

SEQ ID NO: 141898 - DNA, 25 bp, E. coli
tttaaaccgcacaacctgccgatgg

SEQ ID NO: 141899 - DNA, 25 bp, E. coli
tgggcgctgcgtggtaagccttcac

SEQ ID NO: 141900 - DNA, 25 bp, E. coli
tgggcgctgcgtcgtaagccttcac

SEQ ID NO: 141901 - DNA, 25 bp, E. coli
tgccgatggtcttcaccgggactgc

SEQ ID NO: 141902 - DNA, 25 bp, E. coli
tgcggtggccgataaagccgacaat

SEQ ID NO: 141903 - DNA, 25 bp, E. coli
tgccgatggtctacaccgggactgc

SEQ ID NO: 141904 - DNA, 25 bp, E. coli
tgcggtggccgaaaaagccgacaat

SEQ ID NO: 141905 - DNA, 25 bp, E. coli
cgatgggccatctgttgctggtaca

SEQ ID NO: 141906 - DNA, 25 bp, E. coli
cgatgggccatcagttgctggtaca

SEQ ID NO: 141907 - DNA, 25 bp, E. coli
ggaacgaatccgcttctcagctgtg

SEQ ID NO: 141908 - DNA, 25 bp, E. coli
ggaacgaatccggttctcagctgtg

SEQ ID NO: 141909 - DNA, 25 bp, E. coli
tggatgatccctgcgatgtcttcgg

SEQ ID NO: 141910 - DNA, 25 bp, E. coli
tggatgatccctccgatgtcttcgg

SEQ ID NO: 141911 - DNA, 25 bp, E. coli
caaccgcggtacgttcttacatacg

SEQ ID NO: 141912 - DNA, 25 bp, E. coli
caaccgcggtaccttcttacatacg

SEQ ID NO: 141913 - DNA, 25 bp, E. coli
cacaccatagtgatcaggagacacg

SEQ ID NO: 141914 - DNA, 25 bp, E. coli
cacaccatagtgttcaggagacacg

SEQ ID NO: 141915 - DNA, 25 bp, E. coli
taaatgatgtggtagcgatcgtcaa

SEQ ID NO: 141916 - DNA, 25 bp, E. coli
tacatacgatgttccgctgttctct

SEQ ID NO: 141917 - DNA, 25 bp, E. coli
taaatgatgtggaagcgatcgtcaa

SEQ ID NO: 141918 - DNA, 25 bp, E. coli
tacatacgatgtaccgctgttctct

SEQ ID NO: 141919 - DNA, 25 bp, E. coli
tcagagccccaaaaatcgtttaaat

SEQ ID NO: 141920 - DNA, 25 bp, E. coli
tcagagccccaataatcgtttaaat

SEQ ID NO: 141921 - DNA, 25 bp, E. coli
gacacggaaaggaatcaggcagcct

SEQ ID NO: 141922 - DNA, 25 bp, E. coli
gacacggaaaggtatcaggcagcct

SEQ ID NO: 141923 - DNA, 25 bp, E. coli
ggcagcctgctaacgagtggtttaa

SEQ ID NO: 141924 - DNA, 25 bp, E. coli
tccatcggtcgagggaagaattcca

SEQ ID NO: 141925 - DNA, 25 bp, E. coli
ggcagcctgctatcgagtggtttaa

SEQ ID NO: 141926 - DNA, 25 bp, E. coli
tccatcggtcgacggaagaattcca

SEQ ID NO: 141927 - DNA, 25 bp, E. coli
taaaatcggtaacggctggaaatca

SEQ ID NO: 141928 - DNA, 25 bp, E. coli
tcaatatcacctgtaacgatgggct

SEQ ID NO: 141929 - DNA, 25 bp, E. coli
tcaatatcacctctaacgatgggct

SEQ ID NO: 141930 - DNA, 25 bp, E. coli
taaaatcggtaagggctggaaatca

SEQ ID NO: 141931 - DNA, 25 bp, E. coli
gatgggctttctgatatgcacacca

SEQ ID NO: 141932 - DNA, 25 bp, E. coli
gatgggctttctcatatgcacacca

SEQ ID NO: 141933 - DNA, 25 bp, E. coli
tttcaaactcatgccgaaatgggcc

SEQ ID NO: 141934 - DNA, 25 bp, E. coli
tttcaaactcatcccgaaatgggcc

SEQ ID NO: 141935 - DNA, 25 bp, E. coli
ttcaaatcctgaccctgtaaagcgg

SEQ ID NO: 141936 - DNA, 25 bp, E. coli
ttcaaatcctgagcctgtaaagcgg

SEQ ID NO: 141937 - DNA, 25 bp, E. coli
tgagcgtgaatatcaatgatgtcag

SEQ ID NO: 141938 - DNA, 25 bp, E. coli
tgagcgtgaataacaatgatgtcag

SEQ ID NO: 141939 - DNA, 25 bp, E. coli
tcaggaaataagtaatacccttggt

SEQ ID NO: 141940 - DNA, 25 bp, E. coli
tcatcactatcgtatgcgtcaagag

SEQ ID NO: 141941 - DNA, 25 bp, E. coli
tcatcactatcgaatgcgtcaagag

SEQ ID NO: 141942 - DNA, 25 bp, E. coli
tcaggaaataagaaatacccttggt

SEQ ID NO: 141943 - DNA, 25 bp, E. coli
tcaggagcatgtgaggcaagacgcc

SEQ ID NO: 141944 - DNA, 25 bp, E. coli
tcaggagcatgtcaggcaagacgcc

SEQ ID NO: 141945 - DNA, 25 bp, E. coli
gaaatgggccaaccctggtttcagg

SEQ ID NO: 141946 - DNA, 25 bp, E. coli
gaaatgggccaagcctggtttcagg

SEQ ID NO: 141947 - DNA, 25 bp, E. coli
gcctgagtttgtagacggtaatttg

SEQ ID NO: 141948 - DNA, 25 bp, E. coli
gcctgagtttgttgacggtaatttg

SEQ ID NO: 141949 - DNA, 25 bp, E. coli
ctgaagagaataaaagtcgtgatgc

SEQ ID NO: 141950 - DNA, 25 bp, E. coli
ctgaagagaatataagtcgtgatgc

SEQ ID NO: 141951 - DNA, 25 bp, E. coli
gggagtaacataatctattctgaag

SEQ ID NO: 141952 - DNA, 25 bp, E. coli
gggagtaacatattctattctgaag

SEQ ID NO: 141953 - DNA, 25 bp, E. coli
gatgcgatgtatgaagcccggattg

SEQ ID NO: 141954 - DNA, 25 bp, E. coli
gatgcgatgtatcaagcccggattg

SEQ ID NO: 141955 - DNA, 25 bp, E. coli
aagcactagtaccttggcagtcacc

SEQ ID NO: 141956 - DNA, 25 bp, E. coli
agcctgatgatgagtctgaccgtcg

SEQ ID NO: 141957 - DNA, 25 bp, E. coli
agcctgatgatgtgtctgaccgtcg

SEQ ID NO: 141958 - DNA, 25 bp, E. coli
aaatcacctggcctggcgaagtgcg

SEQ ID NO: 141959 - DNA, 25 bp, E. coli
aaaaggtcaacgtcgcctatgggca

SEQ ID NO: 141960 - DNA, 25 bp, E. coli
aaatcacctggcgtggcgaagtgcg

SEQ ID NO: 141961 - DNA, 25 bp, E. coli
aagcactagtacgttggcagtcacc

SEQ ID NO: 141962 - DNA, 25 bp, E. coli
aaaaggtcaacgacgcctatgggca

SEQ ID NO: 141963 - DNA, 25 bp, E. coli
tggtgaccagtttttacgcgacgtg

SEQ ID NO: 141964 - DNA, 25 bp, E. coli
tccatactggcggttgacggaaagc

SEQ ID NO: 141965 - DNA, 25 bp, E. coli
tccatactggcgcttgacggaaagc

SEQ ID NO: 141966 - DNA, 25 bp, E. coli
gaacaggctgctggcatcagggaaa

SEQ ID NO: 141967 - DNA, 25 bp, E. coli
gaacaggctgctcgcatcagggaaa

SEQ ID NO: 141968 - DNA, 25 bp, E. coli
gcaatagtgattgtcgacagccggg

SEQ ID NO: 141969 - DNA, 25 bp, E. coli
gcaataaatttgaccacagcggcag

SEQ ID NO: 141970 - DNA, 25 bp, E. coli
gcaatagtgattctcgacagccggg

SEQ ID NO: 141971 - DNA, 25 bp, E. coli
gcaataaatttgtccacagcggcag

SEQ ID NO: 141972 - DNA, 25 bp, E. coli
cattgaatcttctggtgatcgccga

SEQ ID NO: 141973 - DNA, 25 bp, E. coli
cattgaatcttcaggtgatcgccga

SEQ ID NO: 141974 - DNA, 25 bp, E. coli
ggcatccaggcggaataaccgtgta

SEQ ID NO: 141975 - DNA, 25 bp, E. coli
tggtgaccagttattacgcgacgtg

SEQ ID NO: 141976 - DNA, 25 bp, E. coli
ggcatccaggcgcaataaccgtgta

SEQ ID NO: 141977 - DNA, 25 bp, E. coli
aaccgttgccactggtgaccgcgta

SEQ ID NO: 141978 - DNA, 25 bp, E. coli
cacagcggcttatggaagccggatt

SEQ ID NO: 141979 - DNA, 25 bp, E. coli
cacagcggcttaaggaagccggatt

SEQ ID NO: 141980 - DNA, 25 bp, E. coli
cagtatgtatcggtggcctacacac

SEQ ID NO: 141981 - DNA, 25 bp, E. coli
cagtatgtatcgctggcctacacac

SEQ ID NO: 141982 - DNA, 25 bp, E. coli
tacacacagcggcttaaggaagccg

SEQ ID NO: 141983 - DNA, 25 bp, E. coli
tacacacagcgggttaaggaagccg

SEQ ID NO: 141984 - DNA, 25 bp, E. coli
accgttgccacaggtgaccgcgtaa

SEQ ID NO: 141985 - DNA, 25 bp, E. coli
accgttgccacacgtgaccgcgtaa

SEQ ID NO: 141986 - DNA, 25 bp, E. coli
agccggaaaaccgttgccacaggtg

SEQ ID NO: 141987 - DNA, 25 bp, E. coli
agccggaaaacccttgccacaggtg

SEQ ID NO: 141988 - DNA, 25 bp, E. coli
aaaccgttgccacaggtgaccgcgt

SEQ ID NO: 141989 - DNA, 25 bp, E. coli
aaaccgttgccagaggtgaccgcgt

SEQ ID NO: 141990 - DNA, 25 bp, E. coli
aaccgttgccacaggtgaccgcgta

SEQ ID NO: 141991 - DNA, 25 bp, E. coli
tgtatcgctggcgtacacacagcgg

SEQ ID NO: 141992 - DNA, 25 bp, E. coli
tgtatcgctggcctacacacagcgg

SEQ ID NO: 141993 - DNA, 25 bp, E. coli
gccggaaaaccgttgccacaggtga

SEQ ID NO: 141994 - DNA, 25 bp, E. coli
gccggaaaaccgatgccacaggtga

SEQ ID NO: 141995 - DNA, 25 bp, E. coli
gctggcctacactcagcggcttaag

SEQ ID NO: 141996 - DNA, 25 bp, E. coli
gctggcctacacacagcggcttaag

SEQ ID NO: 141997 - DNA, 25 bp, E. coli
ggcctacacacaccggcttaaggaa

SEQ ID NO: 141998 - DNA, 25 bp, E. coli
ggcctacacacagcggcttaaggaa

SEQ ID NO: 141999 - DNA, 25 bp, E. coli
aagtatcaggatttgggcgtcacca

SEQ ID NO: 142000 - DNA, 25 bp, E. coli
aagtatcaggatatgggcgtcacca

SEQ ID NO: 142001 - DNA, 25 bp, E. coli
caaagatcccgcaaaaacctggcaa

SEQ ID NO: 142002 - DNA, 25 bp, E. coli
caaagatcccgctaaaacctggcaa

SEQ ID NO: 142003 - DNA, 25 bp, E. coli
tactcgacttttccactgactgaaa

SEQ ID NO: 142004 - DNA, 25 bp, E. coli
tactggctctgcttcctgcaatcgc

SEQ ID NO: 142005 - DNA, 25 bp, E. coli
tacctgactccacatggtaagcacg

SEQ ID NO: 142006 - DNA, 25 bp, E. coli
tactggctctgcatcctgcaatcgc

SEQ ID NO: 142007 - DNA, 25 bp, E. coli
tacctgactccagatggtaagcacg

SEQ ID NO: 142008 - DNA, 25 bp, E. coli
tactcgacttttgcactgactgaaa

SEQ ID NO: 142009 - DNA, 25 bp, E. coli
tgtggcaacggaaggaacaatccca

SEQ ID NO: 142010 - DNA, 25 bp, E. coli
tgtggcaacggatggaacaatccca

SEQ ID NO: 142011 - DNA, 25 bp, E. coli
tgcaatcgccttcgcagaggaactt

SEQ ID NO: 142012 - DNA, 25 bp, E. coli
tgcaatcgccttggcagaggaactt

SEQ ID NO: 142013 - DNA, 25 bp, E. coli
gcctctggtggcaagcttaagctaa

SEQ ID NO: 142014 - DNA, 25 bp, E. coli
gccgatccgttcagcccatattgta

SEQ ID NO: 142015 - DNA, 25 bp, E. coli
gcctctggtggctagcttaagctaa

SEQ ID NO: 142016 - DNA, 25 bp, E. coli
gccgatccgttctgcccatattgta

SEQ ID NO: 142017 - DNA, 25 bp, E. coli
ggtcattgtctacgtcttcgccgat

SEQ ID NO: 142018 - DNA, 25 bp, E. coli
ggtcattgtctaggtcttcgccgat

SEQ ID NO: 142019 - DNA, 25 bp, E. coli
taagcacgctatgtctggttacatg

SEQ ID NO: 142020 - DNA, 25 bp, E. coli
taagcacgctatctctggttacatg

SEQ ID NO: 142021 - DNA, 25 bp, E. coli
catggcgtatcacgcattacggatc

SEQ ID NO: 142022 - DNA, 25 bp, E. coli
catggcgtatcaggcattacggatc

SEQ ID NO: 142023 - DNA, 25 bp, E. coli
taaacatggcgtttcaggcattacg

SEQ ID NO: 142024 - DNA, 25 bp, E. coli
taaacatggcgtatcaggcattacg

SEQ ID NO: 142025 - DNA, 25 bp, E. coli
caggcattacggatcttttctttcg

SEQ ID NO: 142026 - DNA, 25 bp, E. coli
caggcattacggttcttttctttcg

SEQ ID NO: 142027 - DNA, 25 bp, E. coli
tacggatcttttctttcgcccaata

SEQ ID NO: 142028 - DNA, 25 bp, E. coli
tacggatcttttgtttcgcccaata

SEQ ID NO: 142029 - DNA, 25 bp, E. coli
tctaccgttggcctgataaacatgg

SEQ ID NO: 142030 - DNA, 25 bp, E. coli
tctaccgttggcgtgataaacatgg

SEQ ID NO: 142031 - DNA, 25 bp, E. coli
ccgttggcctgataaacatggcgta

SEQ ID NO: 142032 - DNA, 25 bp, E. coli
ccgttggcctgaaaaacatggcgta

SEQ ID NO: 142033 - DNA, 25 bp, E. coli
cggatgtggcgtatccggcccgtaa

SEQ ID NO: 142034 - DNA, 25 bp, E. coli
cggatgtggcgtttccggcccgtaa

SEQ ID NO: 142035 - DNA, 25 bp, E. coli
gattacaattcttccgttggcctga

SEQ ID NO: 142036 - DNA, 25 bp, E. coli
gtatccggcccgtaaattcaataga

SEQ ID NO: 142037 - DNA, 25 bp, E. coli
gattacaattctaccgttggcctga

SEQ ID NO: 142038 - DNA, 25 bp, E. coli
gtatccggcccgaaaattcaataga

SEQ ID NO: 142039 - DNA, 25 bp, E. coli
ggcccgtaaattgaatagattacaa

SEQ ID NO: 142040 - DNA, 25 bp, E. coli
ggcccgtaaattcaatagattacaa

SEQ ID NO: 142041 - DNA, 25 bp, E. coli
gatgtggcgtatccggcccgtaaat

SEQ ID NO: 142042 - DNA, 25 bp, E. coli
gatgtggcgtatgcggcccgtaaat

SEQ ID NO: 142043 - DNA, 25 bp, E. coli
caccacccgaagttttgctgaagca

SEQ ID NO: 142044 - DNA, 25 bp, E. coli
caccacccgaagatttgctgaagca

SEQ ID NO: 142045 - DNA, 25 bp, E. coli
tactatttgcagataccgccaccac

SEQ ID NO: 142046 - DNA, 25 bp, E. coli
taaacaggcattaaccgagcaaggt

SEQ ID NO: 142047 - DNA, 25 bp, E. coli
tactatttgcagttaccgccaccac

SEQ ID NO: 142048 - DNA, 25 bp, E. coli
taaacaggcatttaccgagcaaggt

SEQ ID NO: 142049 - DNA, 25 bp, E. coli
tgatttatcgaaccagcaagcgtga

SEQ ID NO: 142050 - DNA, 25 bp, E. coli
tgatttatcgaagcagcaagcgtga

SEQ ID NO: 142051 - DNA, 25 bp, E. coli
tgaagcaacatcattccgtcatggg

SEQ ID NO: 142052 - DNA, 25 bp, E. coli
tgaagcaacatctttccgtcatggg

SEQ ID NO: 142053 - DNA, 25 bp, E. coli
tcctgaggaactgatgaaaggtttt

SEQ ID NO: 142054 - DNA, 25 bp, E. coli
tcctgaggaactcatgaaaggtttt

SEQ ID NO: 142055 - DNA, 25 bp, E. coli
gcaagcgtgaccagacctatttata

SEQ ID NO: 142056 - DNA, 25 bp, E. coli
gcaagcgtgacctgacctatttata

SEQ ID NO: 142057 - DNA, 25 bp, E. coli
gaaaggttttggtcagcctcagtta

SEQ ID NO: 142058 - DNA, 25 bp, E. coli
gaaaggttttggacagcctcagtta

SEQ ID NO: 142059 - DNA, 25 bp, E. coli
cgatttttcgcgagttcctgaggaa

SEQ ID NO: 142060 - DNA, 25 bp, E. coli
cgatttttcgcgtgttcctgaggaa

SEQ ID NO: 142061 - DNA, 25 bp, E. coli
cgatattgaaaaggttaaacaggca

SEQ ID NO: 142062 - DNA, 25 bp, E. coli
cgatattgaaaacgttaaacaggca

SEQ ID NO: 142063 - DNA, 25 bp, E. coli
ggaagaaactggtcaatgccgatat

SEQ ID NO: 142064 - DNA, 25 bp, E. coli
ggaagaaactggacaatgccgatat

SEQ ID NO: 142065 - DNA, 25 bp, E. coli
catgctggcaagtagtgggactgtc

SEQ ID NO: 142066 - DNA, 25 bp, E. coli
catgctggcaagaagtgggactgtc

SEQ ID NO: 142067 - DNA, 25 bp, E. coli
aaatttctggccgtcatggtaccgg

SEQ ID NO: 142068 - DNA, 25 bp, E. coli
aaatttctggccctcatggtaccgg

SEQ ID NO: 142069 - DNA, 25 bp, E. coli
tagtcggcgcaacttcgatctggca

SEQ ID NO: 142070 - DNA, 25 bp, E. coli
tagtcggcgcaagttcgatctggca

SEQ ID NO: 142071 - DNA, 25 bp, E. coli
tgttgaagtgctttggaccacgctc

SEQ ID NO: 142072 - DNA, 25 bp, E. coli
tgttgaagtgctatggaccacgctc

SEQ ID NO: 142073 - DNA, 25 bp, E. coli
tgaagccttactggcctggcaccgt

SEQ ID NO: 142074 - DNA, 25 bp, E. coli
tgaagccttactcgcctggcaccgt

SEQ ID NO: 142075 - DNA, 25 bp, E. coli
taataccggacgatttagtcggcgc

SEQ ID NO: 142076 - DNA, 25 bp, E. coli
taataccggacgttttagtcggcgc

SEQ ID NO: 142077 - DNA, 25 bp, E. coli
gactaatgctttgggcaccgcgaga

SEQ ID NO: 142078 - DNA, 25 bp, E. coli
gactaatgctttcggcaccgcgaga

SEQ ID NO: 142079 - DNA, 25 bp, E. coli
gaacagctgcgtgccgaattaagcc

SEQ ID NO: 142080 - DNA, 25 bp, E. coli
gaaaagcccgactactggcatggaa

SEQ ID NO: 142081 - DNA, 25 bp, E. coli
gaaaagcccgacaactggcatggaa

SEQ ID NO: 142082 - DNA, 25 bp, E. coli
gaacagctgcgtcccgaattaagcc

SEQ ID NO: 142083 - DNA, 25 bp, E. coli
ctttgtatgacagccagggaaaccc

SEQ ID NO: 142084 - DNA, 25 bp, E. coli
ctttgtatgacacccagggaaaccc

SEQ ID NO: 142085 - DNA, 25 bp, E. coli
ggcgcggtcgacaatactcaggaaa

SEQ ID NO: 142086 - DNA, 25 bp, E. coli
ggcgcggtcgactatactcaggaaa

SEQ ID NO: 142087 - DNA, 25 bp, E. coli
ccgtcgtttcggtgatggtcgcgcc

SEQ ID NO: 142088 - DNA, 25 bp, E. coli
ccgtcgtttcggagatggtcgcgcc

SEQ ID NO: 142089 - DNA, 25 bp, E. coli
caacagcctgtttcatgtgggtgag

SEQ ID NO: 142090 - DNA, 25 bp, E. coli
caacagcctgttacatgtgggtgag

SEQ ID NO: 142091 - DNA, 25 bp, E. coli
ctttccgatggtccggctatctggt

SEQ ID NO: 142092 - DNA, 25 bp, E. coli
ctttccgatggtgcggctatctggt

SEQ ID NO: 142093 - DNA, 25 bp, E. coli
agcctgtttcatctgggtgagtcgc

SEQ ID NO: 142094 - DNA, 25 bp, E. coli
agcctgtttcatgtgggtgagtcgc

SEQ ID NO: 142095 - DNA, 25 bp, E. coli
tatcgccgtcgtttcggtgatggtc

SEQ ID NO: 142096 - DNA, 25 bp, E. coli
tatcgccgtcgtatcggtgatggtc

SEQ ID NO: 142097 - DNA, 25 bp, E. coli
ttctttatcgccctcgtttcggtga

SEQ ID NO: 142098 - DNA, 25 bp, E. coli
ttctttatcgccgtcgtttcggtga

SEQ ID NO: 142099 - DNA, 25 bp, E. coli
tgggctgggaagacacctctgcagt

SEQ ID NO: 142100 - DNA, 25 bp, E. coli
tgggctgggaagtcacctctgcagt

SEQ ID NO: 142101 - DNA, 25 bp, E. coli
tcacctctgcagtgacgctgatctt

SEQ ID NO: 142102 - DNA, 25 bp, E. coli
gaagtcacctctgcagtgacgctga

SEQ ID NO: 142103 - DNA, 25 bp, E. coli
gaagtcacctctccagtgacgctga

SEQ ID NO: 142104 - DNA, 25 bp, E. coli
cgatggtgcggctatctggttactg

SEQ ID NO: 142105 - DNA, 25 bp, E. coli
cgatggtgcggcaatctggttactg

SEQ ID NO: 142106 - DNA, 25 bp, E. coli
ggctgggaagtcacctctgcagtga

SEQ ID NO: 142107 - DNA, 25 bp, E. coli
ggctgggaagtctcctctgcagtga

SEQ ID NO: 142108 - DNA, 25 bp, E. coli
tcacctctgcagagacgctgatctt

SEQ ID NO: 142109 - DNA, 25 bp, E. coli
caatttagcctggtgtttggcctta

SEQ ID NO: 142110 - DNA, 25 bp, E. coli
caatttagcctgctgtttggcctta

SEQ ID NO: 142111 - DNA, 25 bp, E. coli
caggaatctggatcggcgtctgcgt

SEQ ID NO: 142112 - DNA, 25 bp, E. coli
caggaatctggaacggcgtctgcgt

SEQ ID NO: 142113 - DNA, 25 bp, E. coli
tttgtagcggcatcggcactgttgg

SEQ ID NO: 142114 - DNA, 25 bp, E. coli
tttgtagcggcaacggcactgttgg

SEQ ID NO: 142115 - DNA, 25 bp, E. coli
tgagtctggcaattacggtgtgtta

SEQ ID NO: 142116 - DNA, 25 bp, E. coli
tgagtctggcaaatacggtgtgtta

SEQ ID NO: 142117 - DNA, 25 bp, E. coli
tccggcactggtggcattatttttc

SEQ ID NO: 142118 - DNA, 25 bp, E. coli
tccggcactggtcgcattatttttc

SEQ ID NO: 142119 - DNA, 25 bp, E. coli
gaaacactgttaaaaatgagtctgg

SEQ ID NO: 142120 - DNA, 25 bp, E. coli
gaaacactgttataaatgagtctgg

SEQ ID NO: 142121 - DNA, 25 bp, E. coli
cgaggtggcctgatagcggcaattt

SEQ ID NO: 142122 - DNA, 25 bp, E. coli
cgaggtggcctgttagcggcaattt

SEQ ID NO: 142123 - DNA, 25 bp, E. coli
cattgctcacggacttatgcgcatg

SEQ ID NO: 142124 - DNA, 25 bp, E. coli
cattgctcacggtcttatgcgcatg

SEQ ID NO: 142125 - DNA, 25 bp, E. coli
ggttgctctcacgagaatcgacaat

SEQ ID NO: 142126 - DNA, 25 bp, E. coli
ggttgctctcaccagaatcgacaat

SEQ ID NO: 142127 - DNA, 25 bp, E. coli
tggccttaacgggatcggacttatc

SEQ ID NO: 142128 - DNA, 25 bp, E. coli
tggccttaacggcatcggacttatc

SEQ ID NO: 142129 - DNA, 25 bp, E. coli
gagcatgtttgtgttcggcggtata

SEQ ID NO: 142130 - DNA, 25 bp, E. coli
gagcatgtttgtcttcggcggtata

SEQ ID NO: 142131 - DNA, 25 bp, E. coli
tagcgagatgatcaaactggttggc

SEQ ID NO: 142132 - DNA, 25 bp, E. coli
tatgaagcctgggtgccgattgaag

SEQ ID NO: 142133 - DNA, 25 bp, E. coli
tatgaagcctggctgccgattgaag

SEQ ID NO: 142134 - DNA, 25 bp, E. coli
tagcgagatgatgaaactggttggc

SEQ ID NO: 142135 - DNA, 25 bp, E. coli
tagctggctgcgttatgactacggg

SEQ ID NO: 142136 - DNA, 25 bp, E. coli
tagctggctgcgatatgactacggg

SEQ ID NO: 142137 - DNA, 25 bp, E. coli
tcgttatccagtgcgcgctgggcct

SEQ ID NO: 142138 - DNA, 25 bp, E. coli
tctgttcagccctcgcgtgcgtgca

SEQ ID NO: 142139 - DNA, 25 bp, E. coli
tctgttcagcccacgcgtgcgtgca

SEQ ID NO: 142140 - DNA, 25 bp, E. coli
tcgttatccagtccgcgctgggcct

SEQ ID NO: 142141 - DNA, 25 bp, E. coli
gccgcactggatgtatgaagcctgg

SEQ ID NO: 142142 - DNA, 25 bp, E. coli
gccagatgctggttcgcaaagggat

SEQ ID NO: 142143 - DNA, 25 bp, E. coli
gccgcactggatctatgaagcctgg

SEQ ID NO: 142144 - DNA, 25 bp, E. coli
gccagatgctggatcgcaaagggat

SEQ ID NO: 142145 - DNA, 25 bp, E. coli
gaccttccacggtggcgcttctcaa

SEQ ID NO: 142146 - DNA, 25 bp, E. coli
gaccttccacggaggcgcttctcaa

SEQ ID NO: 142147 - DNA, 25 bp, E. coli
gatttttgtcggtcacttcttcggt

SEQ ID NO: 142148 - DNA, 25 bp, E. coli
gatttttgtcggacacttcttcggt

SEQ ID NO: 142149 - DNA, 25 bp, E. coli
tggcgtcgaaccagttccatatcgg

SEQ ID NO: 142150 - DNA, 25 bp, E. coli
tggcgtcgaacctgttccatatcgg

SEQ ID NO: 142151 - DNA, 25 bp, E. coli
gatgacgttattgctgctgttcccg

SEQ ID NO: 142152 - DNA, 25 bp, E. coli
gatgacgttattcctgctgttcccg

SEQ ID NO: 142153 - DNA, 25 bp, E. coli
taccccgtagacaccgatcttttca

SEQ ID NO: 142154 - DNA, 25 bp, E. coli
taccccgtagactccgatcttttca

SEQ ID NO: 142155 - DNA, 25 bp, E. coli
ccgtagactccgttcttttcaaaca

SEQ ID NO: 142156 - DNA, 25 bp, E. coli
atattgcaccatccgtgtacatcgg

SEQ ID NO: 142157 - DNA, 25 bp, E. coli
ccgtagactccgatcttttcaaaca

SEQ ID NO: 142158 - DNA, 25 bp, E. coli
atattgcaccatgcgtgtacatcgg

SEQ ID NO: 142159 - DNA, 25 bp, E. coli
aaacatattgcaccatccgtgtaca

SEQ ID NO: 142160 - DNA, 25 bp, E. coli
aaacatattgcagcatccgtgtaca

SEQ ID NO: 142161 - DNA, 25 bp, E. coli
tttcaaacatattgcaccatccgtg

SEQ ID NO: 142162 - DNA, 25 bp, E. coli
tttcaaacatatagcaccatccgtg

SEQ ID NO: 142163 - DNA, 25 bp, E. coli
ccatccgtgtacatcggggtgagga

SEQ ID NO: 142164 - DNA, 25 bp, E. coli
ccatccgtgtacttcggggtgagga

SEQ ID NO: 142165 - DNA, 25 bp, E. coli
gctgtcaaaacttccccgtagactc

SEQ ID NO: 142166 - DNA, 25 bp, E. coli
gctgtcaaaactaccccgtagactc

SEQ ID NO: 142167 - DNA, 25 bp, E. coli
gactccgatcttatcaaacatattg

SEQ ID NO: 142168 - DNA, 25 bp, E. coli
gactccgatcttttcaaacatattg

SEQ ID NO: 142169 - DNA, 25 bp, E. coli
gggtgaggatatgaaatcaatggat

SEQ ID NO: 142170 - DNA, 25 bp, E. coli
gggtgaggatatcaaatcaatggat

SEQ ID NO: 142171 - DNA, 25 bp, E. coli
gtgctgtcaaaagtaccccgtagac

SEQ ID NO: 142172 - DNA, 25 bp, E. coli
gtgctgtcaaaactaccccgtagac

SEQ ID NO: 142173 - DNA, 25 bp, E. coli
tcaaacatattgcaccatccgtgta

SEQ ID NO: 142174 - DNA, 25 bp, E. coli
tcaaacatattggaccatccgtgta

SEQ ID NO: 142175 - DNA, 25 bp, E. coli
cacaaacggcctatgtgtggcgttt

SEQ ID NO: 142176 - DNA, 25 bp, E. coli
cactgagtgccggagaatctcaaat

SEQ ID NO: 142177 - DNA, 25 bp, E. coli
cactgagtgccgcagaatctcaaat

SEQ ID NO: 142178 - DNA, 25 bp, E. coli
cacaaacggcctttgtgtggcgttt

SEQ ID NO: 142179 - DNA, 25 bp, E. coli
acgcgaagcgcgtagccgttgcccg

SEQ ID NO: 142180 - DNA, 25 bp, E. coli
acgcgaagcgcgaagccgttgcccg

SEQ ID NO: 142181 - DNA, 25 bp, E. coli
tgtggcgttttctggcactgagtgc

SEQ ID NO: 142182 - DNA, 25 bp, E. coli
tgtgttgctgtatttgccgcccgta

SEQ ID NO: 142183 - DNA, 25 bp, E. coli
tgtggcgttttcaggcactgagtgc

SEQ ID NO: 142184 - DNA, 25 bp, E. coli
tgtgttgctgtaattgccgcccgta

SEQ ID NO: 142185 - DNA, 25 bp, E. coli
gctgtaaatcatataccacaccttg

SEQ ID NO: 142186 - DNA, 25 bp, E. coli
gctgtaaatcatttaccacaccttg

SEQ ID NO: 142187 - DNA, 25 bp, E. coli
gaatctcaaatcttccacgtaaccg

SEQ ID NO: 142188 - DNA, 25 bp, E. coli
gaatctcaaatcatccacgtaaccg

SEQ ID NO: 142189 - DNA, 25 bp, E. coli
ccgttgcccgtctggttgtgttgct

SEQ ID NO: 142190 - DNA, 25 bp, E. coli
ccgttgcccgtcaggttgtgttgct

SEQ ID NO: 142191 - DNA, 25 bp, E. coli
cttgtacacacacaaacggcctttg

SEQ ID NO: 142192 - DNA, 25 bp, E. coli
cttgtacacacagaaacggcctttg

SEQ ID NO: 142193 - DNA, 25 bp, E. coli
gtaaccgcctggacggaacgcgaag

SEQ ID NO: 142194 - DNA, 25 bp, E. coli
gtaaccgcctggtcggaacgcgaag

SEQ ID NO: 142195 - DNA, 25 bp, E. coli
tcaaatcatccaggtaaccgcctgg

SEQ ID NO: 142196 - DNA, 25 bp, E. coli
tcaaatcatccacgtaaccgcctgg

SEQ ID NO: 142197 - DNA, 25 bp, E. coli
cacagacgtggataggcaaaagcgc

SEQ ID NO: 142198 - DNA, 25 bp, E. coli
cacagacgtggaaaggcaaaagcgc

SEQ ID NO: 142199 - DNA, 25 bp, E. coli
tattaagcgtgctgccatgggtagc

SEQ ID NO: 142200 - DNA, 25 bp, E. coli
tattaagcgtgcagccatgggtagc

SEQ ID NO: 142201 - DNA, 25 bp, E. coli
tttactgctgggaatcacctgcggc

SEQ ID NO: 142202 - DNA, 25 bp, E. coli
ttgttgagctggacgataatgccgc

SEQ ID NO: 142203 - DNA, 25 bp, E. coli
ttgttgagctggtcgataatgccgc

SEQ ID NO: 142204 - DNA, 25 bp, E. coli
tttactgctgggtatcacctgcggc

SEQ ID NO: 142205 - DNA, 25 bp, E. coli
gcttatggcgcgataaacgtctggc

SEQ ID NO: 142206 - DNA, 25 bp, E. coli
gcttctggctggcaatgcaggcaca

SEQ ID NO: 142207 - DNA, 25 bp, E. coli
gcttctggctgggaatgcaggcaca

SEQ ID NO: 142208 - DNA, 25 bp, E. coli
gcttatggcgcgttaaacgtctggc

SEQ ID NO: 142209 - DNA, 25 bp, E. coli
gaaaaacccattgccggatactgga

SEQ ID NO: 142210 - DNA, 25 bp, E. coli
gaaaaacccattcccggatactgga

SEQ ID NO: 142211 - DNA, 25 bp, E. coli
ggctggtacaccataacaaacgtcg

SEQ ID NO: 142212 - DNA, 25 bp, E. coli
ggcttaatcaacatcgtcaggaggg

SEQ ID NO: 142213 - DNA, 25 bp, E. coli
ggctggtacaccttaacaaacgtcg

SEQ ID NO: 142214 - DNA, 25 bp, E. coli
ggcttaatcaacttcgtcaggaggg

SEQ ID NO: 142215 - DNA, 25 bp, E. coli
tcaacgctttgctctggatgatgcc

SEQ ID NO: 142216 - DNA, 25 bp, E. coli
tcaacgctttgcactggatgatgcc

SEQ ID NO: 142217 - DNA, 25 bp, E. coli
gatgatgcccaacatagagctccgt

SEQ ID NO: 142218 - DNA, 25 bp, E. coli
gatgatgcccaagatagagctccgt

SEQ ID NO: 142219 - DNA, 25 bp, E. coli
ttttcggccagtcgtcgtcatcgtc

SEQ ID NO: 142220 - DNA, 25 bp, E. coli
ttttcggccagtggtcgtcatcgtc

SEQ ID NO: 142221 - DNA, 25 bp, E. coli
tcttcggttgatgctttttcggcca

SEQ ID NO: 142222 - DNA, 25 bp, E. coli
tcttcggttgatcctttttcggcca

SEQ ID NO: 142223 - DNA, 25 bp, E. coli
tcgtcccacttatcgttgaaatcac

SEQ ID NO: 142224 - DNA, 25 bp, E. coli
tcgtcgtcatcgacccacttatcgt

SEQ ID NO: 142225 - DNA, 25 bp, E. coli
tcgtcccacttaacgttgaaatcac

SEQ ID NO: 142226 - DNA, 25 bp, E. coli
tcgtcgtcatcgtcccacttatcgt

SEQ ID NO: 142227 - DNA, 25 bp, E. coli
tcttatggtcgacgcgcttgagatc

SEQ ID NO: 142228 - DNA, 25 bp, E. coli
tcttatggtcgaggcgcttgagatc

SEQ ID NO: 142229 - DNA, 25 bp, E. coli
gcctaccaaaaacacaatcaccaga

SEQ ID NO: 142230 - DNA, 25 bp, E. coli
gcctaccaaaaagacaatcaccaga

SEQ ID NO: 142231 - DNA, 25 bp, E. coli
gcaggacgcctaccaaaaagacaat

SEQ ID NO: 142232 - DNA, 25 bp, E. coli
gaagctccggcttgttggcgagaaa

SEQ ID NO: 142233 - DNA, 25 bp, E. coli
gaagctccggctagttggcgagaaa

SEQ ID NO: 142234 - DNA, 25 bp, E. coli
gcaggacgcctagcaaaaagacaat

SEQ ID NO: 142235 - DNA, 25 bp, E. coli
cgcgcttgagatctttaatcacgtt

SEQ ID NO: 142236 - DNA, 25 bp, E. coli
cgcgcttgagatgtttaatcacgtt

SEQ ID NO: 142237 - DNA, 25 bp, E. coli
taatcacgttcaccaggacgcctac

SEQ ID NO: 142238 - DNA, 25 bp, E. coli
taatcacgttcagcaggacgcctac

SEQ ID NO: 142239 - DNA, 25 bp, E. coli
gagaaatttcttatggtcgacgcgc

SEQ ID NO: 142240 - DNA, 25 bp, E. coli
gagaaatttcttttggtcgacgcgc

SEQ ID NO: 142241 - DNA, 25 bp, E. coli
catcaaaaaatgaactcagaggcct

SEQ ID NO: 142242 - DNA, 25 bp, E. coli
catcaaaaaatgtactcagaggcct

SEQ ID NO: 142243 - DNA, 25 bp, E. coli
taaacttgtacggtgcactcatgga

SEQ ID NO: 142244 - DNA, 25 bp, E. coli
taaacttgtacgctgcactcatgga

SEQ ID NO: 142245 - DNA, 25 bp, E. coli
tatccggtcagcattgttcaagaca

SEQ ID NO: 142246 - DNA, 25 bp, E. coli
tatccggtcagctttgttcaagaca

SEQ ID NO: 142247 - DNA, 25 bp, E. coli
tcagggttaatcgtttcgccaaaag

SEQ ID NO: 142248 - DNA, 25 bp, E. coli
tcagggttaatcctttcgccaaaag

SEQ ID NO: 142249 - DNA, 25 bp, E. coli
tcagaggccttcactttcaacgcgg

SEQ ID NO: 142250 - DNA, 25 bp, E. coli
tcagaggccttctctttcaacgcgg

SEQ ID NO: 142251 - DNA, 25 bp, E. coli
gaacatattctacgctatccggtca

SEQ ID NO: 142252 - DNA, 25 bp, E. coli
gaacatattctaggctatccggtca

SEQ ID NO: 142253 - DNA, 25 bp, E. coli
gaacgcattgcaattgattggcccc

SEQ ID NO: 142254 - DNA, 25 bp, E. coli
gaacgcattgcatttgattggcccc

SEQ ID NO: 142255 - DNA, 25 bp, E. coli
gattggccccaatcatcagggttaa

SEQ ID NO: 142256 - DNA, 25 bp, E. coli
gattggccccaaacatcagggttaa

SEQ ID NO: 142257 - DNA, 25 bp, E. coli
taataagcagcacttgtggatacca

SEQ ID NO: 142258 - DNA, 25 bp, E. coli
tcaacgcggcgagtacgcacaagat

SEQ ID NO: 142259 - DNA, 25 bp, E. coli
tcaacgcggcgactacgcacaagat

SEQ ID NO: 142260 - DNA, 25 bp, E. coli
taataagcagcagttgtggatacca

SEQ ID NO: 142261 - DNA, 25 bp, E. coli
gatgttgctgttcatattcgaccca

SEQ ID NO: 142262 - DNA, 25 bp, E. coli
gatgttgctgttgatattcgaccca

SEQ ID NO: 142263 - DNA, 25 bp, E. coli
aaatcaatatcgtcaatgagcatga

SEQ ID NO: 142264 - DNA, 25 bp, E. coli
aaatcaatatcgacaatgagcatga

SEQ ID NO: 142265 - DNA, 25 bp, E. coli
tatcgtcaatgaccatgatttttcc

SEQ ID NO: 142266 - DNA, 25 bp, E. coli
tatcgtcaatgagcatgatttttcc

SEQ ID NO: 142267 - DNA, 25 bp, E. coli
tgatttttcctttgtgcttaattgc

SEQ ID NO: 142268 - DNA, 25 bp, E. coli
tgatttttccttagtgcttaattgc

SEQ ID NO: 142269 - DNA, 25 bp, E. coli
cctgagttgctgtaggtaaaggtct

SEQ ID NO: 142270 - DNA, 25 bp, E. coli
ccagcctgagttgctgaaggtaaag

SEQ ID NO: 142271 - DNA, 25 bp, E. coli
ccagcctgagttcctgaaggtaaag

SEQ ID NO: 142272 - DNA, 25 bp, E. coli
gcctgagttgctgaaggtaaaggtc

SEQ ID NO: 142273 - DNA, 25 bp, E. coli
cctgagttgctgaaggtaaaggtct

SEQ ID NO: 142274 - DNA, 25 bp, E. coli
gccagcctgagtagctgaaggtaaa

SEQ ID NO: 142275 - DNA, 25 bp, E. coli
gcctgagttgctcaaggtaaaggtc

SEQ ID NO: 142276 - DNA, 25 bp, E. coli
gccagcctgagttgctgaaggtaaa

SEQ ID NO: 142277 - DNA, 25 bp, E. coli
gcatgatttttccttagtgcttaat

SEQ ID NO: 142278 - DNA, 25 bp, E. coli
gcatgatttttcgttagtgcttaat

SEQ ID NO: 142279 - DNA, 25 bp, E. coli
ctgagttgctgaaggtaaaggtctg

SEQ ID NO: 142280 - DNA, 25 bp, E. coli
ctgagttgctgatggtaaaggtctg

SEQ ID NO: 142281 - DNA, 25 bp, E. coli
ggccagcctgagttgctgaaggtaa

SEQ ID NO: 142282 - DNA, 25 bp, E. coli
ggccagcctgagatgctgaaggtaa

SEQ ID NO: 142283 - DNA, 25 bp, E. coli
tcaatatcgtcaatgagcatgattt

SEQ ID NO: 142284 - DNA, 25 bp, E. coli
tcaatatcgtcattgagcatgattt

SEQ ID NO: 142285 - DNA, 25 bp, E. coli
aatggaagccttcactgcagagtgg

SEQ ID NO: 142286 - DNA, 25 bp, E. coli
aatggaagccttgactgcagagtgg

SEQ ID NO: 142287 - DNA, 25 bp, E. coli
cagaagctgggcgagtattacaaca

SEQ ID NO: 142288 - DNA, 25 bp, E. coli
cagaagctgggccagtattacaaca

SEQ ID NO: 142289 - DNA, 25 bp, E. coli
agtggaccttcctgttggcgctgaa

SEQ ID NO: 142290 - DNA, 25 bp, E. coli
agtggaccttccagttggcgctgaa

SEQ ID NO: 142291 - DNA, 25 bp, E. coli
aaaatcgtcggtactgtggcaggga

SEQ ID NO: 142292 - DNA, 25 bp, E. coli
aaaatcgtcggttctgtggcaggga

SEQ ID NO: 142293 - DNA, 25 bp, E. coli
taggactgatatacccgctgctggc

SEQ ID NO: 142294 - DNA, 25 bp, E. coli
taggctcgaccttcaaagatgggaa

SEQ ID NO: 142295 - DNA, 25 bp, E. coli
taggctcgacctacaaagatgggaa

SEQ ID NO: 142296 - DNA, 25 bp, E. coli
taggactgatattcccgctgctggc

SEQ ID NO: 142297 - DNA, 25 bp, E. coli
tattgcgaccactaacattacctgg

SEQ ID NO: 142298 - DNA, 25 bp, E. coli
tattgcgaccacaaacattacctgg

SEQ ID NO: 142299 - DNA, 25 bp, E. coli
tccaaaagggatgttatgcctggcg

SEQ ID NO: 142300 - DNA, 25 bp, E. coli
tccaaaagggatcttatgcctggcg

SEQ ID NO: 142301 - DNA, 25 bp, E. coli
gccattgcgaattccctgggacaag

SEQ ID NO: 142302 - DNA, 25 bp, E. coli
gccattgcgaataccctgggacaag

SEQ ID NO: 142303 - DNA, 25 bp, E. coli
gattaaacacaccatgggacccgga

SEQ ID NO: 142304 - DNA, 25 bp, E. coli
gattaaacacacgatgggacccgga

SEQ ID NO: 142305 - DNA, 25 bp, E. coli
tggtattctcgattgatgccccgct

SEQ ID NO: 142306 - DNA, 25 bp, E. coli
tggtattctcgaatgatgccccgct

SEQ ID NO: 142307 - DNA, 25 bp, E. coli
cagggtactgacactttcgcgatgc

SEQ ID NO: 142308 - DNA, 25 bp, E. coli
cagggtactgactctttcgcgatgc

SEQ ID NO: 142309 - DNA, 25 bp, E. coli
tatgtgcgctgaacgcaaactgccg

SEQ ID NO: 142310 - DNA, 25 bp, E. coli
tatgtgcgctgatcgcaaactgccg

SEQ ID NO: 142311 - DNA, 25 bp, E. coli
tattgctcaaactgggcatgatgcg

SEQ ID NO: 142312 - DNA, 25 bp, E. coli
tattgctcaaacagggcatgatgcg

SEQ ID NO: 142313 - DNA, 25 bp, E. coli
tgattgaagccagcgatctcggcgt

SEQ ID NO: 142314 - DNA, 25 bp, E. coli
tgtggtactggccaaaagagacgct

SEQ ID NO: 142315 - DNA, 25 bp, E. coli
tgattgaagccaccgatctcggcgt

SEQ ID NO: 142316 - DNA, 25 bp, E. coli
tgtggtactggcgaaaagagacgct

SEQ ID NO: 142317 - DNA, 25 bp, E. coli
tcggtaacgagctggcatccatgca

SEQ ID NO: 142318 - DNA, 25 bp, E. coli
tcggtaacgagcaggcatccatgca

SEQ ID NO: 142319 - DNA, 25 bp, E. coli
gctgcattaagtatccgaacgggcg

SEQ ID NO: 142320 - DNA, 25 bp, E. coli
gctgcattaagtttccgaacgggcg

SEQ ID NO: 142321 - DNA, 25 bp, E. coli
gaaatattccttagggccagtgctg

SEQ ID NO: 142322 - DNA, 25 bp, E. coli
gaaatattcctttgggccagtgctg

SEQ ID NO: 142323 - DNA, 25 bp, E. coli
cccgaaagatgagtgtgaaacctgc

SEQ ID NO: 142324 - DNA, 25 bp, E. coli
cccgaaagatgactgtgaaacctgc

SEQ ID NO: 142325 - DNA, 25 bp, E. coli
cttaatcagtgccatgagctgggca

SEQ ID NO: 142326 - DNA, 25 bp, E. coli
cttaatcagtgcgatgagctgggca

SEQ ID NO: 142327 - DNA, 25 bp, E. coli
ggcattcagaccatgagcggctacg

SEQ ID NO: 142328 - DNA, 25 bp, E. coli
ggcattcagaccttgagcggctacg

SEQ ID NO: 142329 - DNA, 25 bp, E. coli
catgcagcaccgttctcaaagtggg

SEQ ID NO: 142330 - DNA, 25 bp, E. coli
catgcagcaccgatctcaaagtggg

SEQ ID NO: 142331 - DNA, 25 bp, E. coli
accgcatgggctttcgcttacaggg

SEQ ID NO: 142332 - DNA, 25 bp, E. coli
accgcatgggctatcgcttacaggg

SEQ ID NO: 142333 - DNA, 25 bp, E. coli
tatgtaccatctcgcgcaaattccg

SEQ ID NO: 142334 - DNA, 25 bp, E. coli
tatgtaccatctggcgcaaattccg

SEQ ID NO: 142335 - DNA, 25 bp, E. coli
tatcatgagttcgatcgcgcctcgc

SEQ ID NO: 142336 - DNA, 25 bp, E. coli
tatcatgagttccatcgcgcctcgc

SEQ ID NO: 142337 - DNA, 25 bp, E. coli
ttagctcgcaaagtaaccgcatggg

SEQ ID NO: 142338 - DNA, 25 bp, E. coli
ttttaaaacgcaccaccgatcgcga

SEQ ID NO: 142339 - DNA, 25 bp, E. coli
ttagctcgcaaactaaccgcatggg

SEQ ID NO: 142340 - DNA, 25 bp, E. coli
ttttaaaacgcagcaccgatcgcga

SEQ ID NO: 142341 - DNA, 25 bp, E. coli
tggtgaccgactgccgattggcaaa

SEQ ID NO: 142342 - DNA, 25 bp, E. coli
tggtgaccgactcccgattggcaaa

SEQ ID NO: 142343 - DNA, 25 bp, E. coli
gcaggatgcattgtggcgttcgccc

SEQ ID NO: 142344 - DNA, 25 bp, E. coli
gcaggatgcattctggcgttcgccc

SEQ ID NO: 142345 - DNA, 25 bp, E. coli
cccgcgtattgcctgtatcattgag

SEQ ID NO: 142346 - DNA, 25 bp, E. coli
cccgcgtattgcgtgtatcattgag

SEQ ID NO: 142347 - DNA, 25 bp, E. coli
ggtggtattgatgttccgccggtaa

SEQ ID NO: 142348 - DNA, 25 bp, E. coli
ggtggtattgatcttccgccggtaa

SEQ ID NO: 142349 - DNA, 25 bp, E. coli
tggagatcacgcacggtcagttaac

SEQ ID NO: 142350 - DNA, 25 bp, E. coli
tggagatcacgctcggtcagttaac

SEQ ID NO: 142351 - DNA, 25 bp, E. coli
tacaagccagcgctgaaatgtgcgg

SEQ ID NO: 142352 - DNA, 25 bp, E. coli
tacaagccagcggtgaaatgtgcgg

SEQ ID NO: 142353 - DNA, 25 bp, E. coli
atgacctggcttatcgatctggaaa

SEQ ID NO: 142354 - DNA, 25 bp, E. coli
acctggcttatcgatctggaaatgc

SEQ ID NO: 142355 - DNA, 25 bp, E. coli
acctggcttatccatctggaaatgc

SEQ ID NO: 142356 - DNA, 25 bp, E. coli
atgacctggcttttcgatctggaaa

SEQ ID NO: 142357 - DNA, 25 bp, E. coli
aaaattttcacctcgccactgcgac

SEQ ID NO: 142358 - DNA, 25 bp, E. coli
aaaattttcaccacgccactgcgac

SEQ ID NO: 142359 - DNA, 25 bp, E. coli
tgcaggcttacatgccagcgctgaa

SEQ ID NO: 142360 - DNA, 25 bp, E. coli
tgcaggcttacaagccagcgctgaa

SEQ ID NO: 142361 - DNA, 25 bp, E. coli
tctgtgcaggctaacaagccagcgc

SEQ ID NO: 142362 - DNA, 25 bp, E. coli
tcagcttgatgaacagcaacgctgt

SEQ ID NO: 142363 - DNA, 25 bp, E. coli
tctgtgcaggcttacaagccagcgc

SEQ ID NO: 142364 - DNA, 25 bp, E. coli
gcaacgctgtaaaattttcacctcg

SEQ ID NO: 142365 - DNA, 25 bp, E. coli
gcaacgctgtaatattttcacctcg

SEQ ID NO: 142366 - DNA, 25 bp, E. coli
gaaagtctgtgcaggcttacaagcc

SEQ ID NO: 142367 - DNA, 25 bp, E. coli
gaaagtctgtgctggcttacaagcc

SEQ ID NO: 142368 - DNA, 25 bp, E. coli
cgaccgaaagtctgtgcaggcttac

SEQ ID NO: 142369 - DNA, 25 bp, E. coli
cgaccgaaagtcagtgcaggcttac

SEQ ID NO: 142370 - DNA, 25 bp, E. coli
gtaaaattttcacctcgccactgcg

SEQ ID NO: 142371 - DNA, 25 bp, E. coli
gtaaaattttcagctcgccactgcg

SEQ ID NO: 142372 - DNA, 25 bp, E. coli
tcagcttgatgatcagcaacgctgt

SEQ ID NO: 142373 - DNA, 25 bp, E. coli
tatgctttttatcagcgactaaccc

SEQ ID NO: 142374 - DNA, 25 bp, E. coli
tatgctttttatgagcgactaaccc

SEQ ID NO: 142375 - DNA, 25 bp, E. coli
tatcagcgactaacccgctaatgca

SEQ ID NO: 142376 - DNA, 25 bp, E. coli
tatcagcgactatcccgctaatgca

SEQ ID NO: 142377 - DNA, 25 bp, E. coli
tttatcagcgacaaacccgctaatg

SEQ ID NO: 142378 - DNA, 25 bp, E. coli
tttatcagcgactaacccgctaatg

SEQ ID NO: 142379 - DNA, 25 bp, E. coli
tgctttttatcagcgactaacccgc

SEQ ID NO: 142380 - DNA, 25 bp, E. coli
tgtgctatgctttttatcagcgact

SEQ ID NO: 142381 - DNA, 25 bp, E. coli
tgtgctatgcttattatcagcgact

SEQ ID NO: 142382 - DNA, 25 bp, E. coli
tgctttttatcaccgactaacccgc

SEQ ID NO: 142383 - DNA, 25 bp, E. coli
tcccgatgttgtcctatgcttttta

SEQ ID NO: 142384 - DNA, 25 bp, E. coli
tcccgatgttgtgctatgcttttta

SEQ ID NO: 142385 - DNA, 25 bp, E. coli
cctccgtgatgcacgtcacaaatct

SEQ ID NO: 142386 - DNA, 25 bp, E. coli
cctccgtgatgctcgtcacaaatct

SEQ ID NO: 142387 - DNA, 25 bp, E. coli
gactaacccgctaatgcaaaacaga

SEQ ID NO: 142388 - DNA, 25 bp, E. coli
gactaacccgcttatgcaaaacaga

SEQ ID NO: 142389 - DNA, 25 bp, E. coli
ccctcccgatgttgtgctatgcttt

SEQ ID NO: 142390 - DNA, 25 bp, E. coli
ccctcccgatgtagtgctatgcttt

SEQ ID NO: 142391 - DNA, 25 bp, E. coli
ggcgcaatttctgcgccatcgcaaa

SEQ ID NO: 142392 - DNA, 25 bp, E. coli
ggcgcaatttctccgccatcgcaaa

SEQ ID NO: 142393 - DNA, 25 bp, E. coli
taacccgctaatccaaaacagataa

SEQ ID NO: 142394 - DNA, 25 bp, E. coli
taacccgctaatgcaaaacagataa

SEQ ID NO: 142395 - DNA, 25 bp, E. coli
ctggacaccgacgaacttactacgg

SEQ ID NO: 142396 - DNA, 25 bp, E. coli
ctggacaccgaccaacttactacgg

SEQ ID NO: 142397 - DNA, 25 bp, E. coli
tacggttgtcaaacgtgcgcgcgaa

SEQ ID NO: 142398 - DNA, 25 bp, E. coli
tacggttgtcaatcgtgcgcgcgaa

SEQ ID NO: 142399 - DNA, 25 bp, E. coli
gtcgtcggaaacgttcgtcctcaat

SEQ ID NO: 142400 - DNA, 25 bp, E. coli
gtcgtcggaaaccttcgtcctcaat

SEQ ID NO: 142401 - DNA, 25 bp, E. coli
acgatgcctgtgcactggcgcaacg

SEQ ID NO: 142402 - DNA, 25 bp, E. coli
acgatgcctgtggactggcgcaacg

SEQ ID NO: 142403 - DNA, 25 bp, E. coli
ttccgccgtggccatctgatgctac

SEQ ID NO: 142404 - DNA, 25 bp, E. coli
ttccgccgtggcgatctgatgctac

SEQ ID NO: 142405 - DNA, 25 bp, E. coli
ttcatgccgatgtgtttatcgctca

SEQ ID NO: 142406 - DNA, 25 bp, E. coli
ttcatgccgatgagtttatcgctca

SEQ ID NO: 142407 - DNA, 25 bp, E. coli
cctgcaacgccggtggaaatcattt

SEQ ID NO: 142408 - DNA, 25 bp, E. coli
gcctgagaacgatgcctgtgcactg

SEQ ID NO: 142409 - DNA, 25 bp, E. coli
cctgcaacgccgctggaaatcattt

SEQ ID NO: 142410 - DNA, 25 bp, E. coli
gcctgagaacgaagcctgtgcactg

SEQ ID NO: 142411 - DNA, 25 bp, E. coli
cgcgtccggtgatagcacctgcaac

SEQ ID NO: 142412 - DNA, 25 bp, E. coli
ccgataaatccgcttggctggtgcc

SEQ ID NO: 142413 - DNA, 25 bp, E. coli
cgcgtccggtgaaagcacctgcaac

SEQ ID NO: 142414 - DNA, 25 bp, E. coli
ccgataaatccggttggctggtgcc

SEQ ID NO: 142415 - DNA, 25 bp, E. coli
ctggtggaggccgataaatccggtt

SEQ ID NO: 142416 - DNA, 25 bp, E. coli
ctggtggaggcccataaatccggtt

SEQ ID NO: 142417 - DNA, 25 bp, E. coli
cataaaccgaatcctttccgcgttt

SEQ ID NO: 142418 - DNA, 25 bp, E. coli
cataaaccgaatgctttccgcgttt

SEQ ID NO: 142419 - DNA, 25 bp, E. coli
agcataaaccgattgctttccgcgt

SEQ ID NO: 142420 - DNA, 25 bp, E. coli
agcataaaccgaatgctttccgcgt

SEQ ID NO: 142421 - DNA, 25 bp, E. coli
aaacgcaaccataactgatatgcag

SEQ ID NO: 142422 - DNA, 25 bp, E. coli
aaacgcaaccattactgatatgcag

SEQ ID NO: 142423 - DNA, 25 bp, E. coli
ttattctgctggtggtctgtggtgc

SEQ ID NO: 142424 - DNA, 25 bp, E. coli
ttattctgctggaggtctgtggtgc

SEQ ID NO: 142425 - DNA, 25 bp, E. coli
tgagcataaaccgaatgctttccgc

SEQ ID NO: 142426 - DNA, 25 bp, E. coli
tgagcataaacccaatgctttccgc

SEQ ID NO: 142427 - DNA, 25 bp, E. coli
tccgcgtttaccgttattctgctgg

SEQ ID NO: 142428 - DNA, 25 bp, E. coli
tccgcgtttacccttattctgctgg

SEQ ID NO: 142429 - DNA, 25 bp, E. coli
gcataaaccgaaagctttccgcgtt

SEQ ID NO: 142430 - DNA, 25 bp, E. coli
gctggcaaacgcaaccattactgat

SEQ ID NO: 142431 - DNA, 25 bp, E. coli
gctggcaaacgctaccattactgat

SEQ ID NO: 142432 - DNA, 25 bp, E. coli
gcataaaccgaatgctttccgcgtt

SEQ ID NO: 142433 - DNA, 25 bp, E. coli
gataacgtcatctcctacaaagcgc

SEQ ID NO: 142434 - DNA, 25 bp, E. coli
gataacgtcatcacctacaaagcgc

SEQ ID NO: 142435 - DNA, 25 bp, E. coli
tggagctggcaatcgcaaccattac

SEQ ID NO: 142436 - DNA, 25 bp, E. coli
tggagctggcaaacgcaaccattac

SEQ ID NO: 142437 - DNA, 25 bp, E. coli
gagcataaaccgtatgctttccgcg

SEQ ID NO: 142438 - DNA, 25 bp, E. coli
gagcataaaccgaatgctttccgcg

SEQ ID NO: 142439 - DNA, 25 bp, E. coli
caattattggtgtattcgcgctacg

SEQ ID NO: 142440 - DNA, 25 bp, E. coli
caattattggtgaattcgcgctacg

SEQ ID NO: 142441 - DNA, 25 bp, E. coli
tatgggcgtatggaacgcgttgcca

SEQ ID NO: 142442 - DNA, 25 bp, E. coli
tatgggcgtatgcaacgcgttgcca

SEQ ID NO: 142443 - DNA, 25 bp, E. coli
ttagtcaggcgtattctttgcccgc

SEQ ID NO: 142444 - DNA, 25 bp, E. coli
ttgtgctcgcatcaattatctggcg

SEQ ID NO: 142445 - DNA, 25 bp, E. coli
ttagtcaggcgttttctttgcccgc

SEQ ID NO: 142446 - DNA, 25 bp, E. coli
ttgtgctcgcatgaattatctggcg

SEQ ID NO: 142447 - DNA, 25 bp, E. coli
tgtggtagtacataccagcctggct

SEQ ID NO: 142448 - DNA, 25 bp, E. coli
tgtggtagtacaaaccagcctggct

SEQ ID NO: 142449 - DNA, 25 bp, E. coli
tcgcgctacgccagatttacgaagg

SEQ ID NO: 142450 - DNA, 25 bp, E. coli
tcgcgctacgcctgatttacgaagg

SEQ ID NO: 142451 - DNA, 25 bp, E. coli
tcggcggcgcttttctcttatggtt

SEQ ID NO: 142452 - DNA, 25 bp, E. coli
tcggcggcgcttatctcttatggtt

SEQ ID NO: 142453 - DNA, 25 bp, E. coli
gcttatcagaatcgtcggcggcgct

SEQ ID NO: 142454 - DNA, 25 bp, E. coli
gcttatcagaatggtcggcggcgct

SEQ ID NO: 142455 - DNA, 25 bp, E. coli
gcaaatgagcacactacaacaaccg

SEQ ID NO: 142456 - DNA, 25 bp, E. coli
gcaaatgagcactctacaacaaccg

SEQ ID NO: 142457 - DNA, 25 bp, E. coli
ggtcttgcaacggtaattacgcagt

SEQ ID NO: 142458 - DNA, 25 bp, E. coli
ggtcttgcaacgctaattacgcagt

SEQ ID NO: 142459 - DNA, 25 bp, E. coli
ggcgctgggcgaagcattttattcc

SEQ ID NO: 142460 - DNA, 25 bp, E. coli
ggcgctgggcgatgcattttattcc

SEQ ID NO: 142461 - DNA, 25 bp, E. coli
aatttgctgcgggaatctgccaacg

SEQ ID NO: 142462 - DNA, 25 bp, E. coli
aatttgctgcggcaatctgccaacg

SEQ ID NO: 142463 - DNA, 25 bp, E. coli
taaatctgtttattacggcgcgtcg

SEQ ID NO: 142464 - DNA, 25 bp, E. coli
taaatctgtttaatacggcgcgtcg

SEQ ID NO: 142465 - DNA, 25 bp, E. coli
tacgactggcccagcaagaactggg

SEQ ID NO: 142466 - DNA, 25 bp, E. coli
tacgactggccctgcaagaactggg

SEQ ID NO: 142467 - DNA, 25 bp, E. coli
agtgttgataagtttgcccgcgagc

SEQ ID NO: 142468 - DNA, 25 bp, E. coli
agtgttgataagattgcccgcgagc

SEQ ID NO: 142469 - DNA, 25 bp, E. coli
aacatgaaattggtggcggaacgcg

SEQ ID NO: 142470 - DNA, 25 bp, E. coli
aacatgaaattgctggcggaacgcg

SEQ ID NO: 142471 - DNA, 25 bp, E. coli
tatctttgagaaaccgctggccgaa

SEQ ID NO: 142472 - DNA, 25 bp, E. coli
tatctttgagaatccgctggccgaa

SEQ ID NO: 142473 - DNA, 25 bp, E. coli
ttcaatatggaagtgcagccgcaac

SEQ ID NO: 142474 - DNA, 25 bp, E. coli
ttcaatatggaactgcagccgcaac

SEQ ID NO: 142475 - DNA, 25 bp, E. coli
tgggtgccaccacataccaacgttg

SEQ ID NO: 142476 - DNA, 25 bp, E. coli
tcatgtacgtcagggacaatcgcgt

SEQ ID NO: 142477 - DNA, 25 bp, E. coli
tcatgtacgtcacggacaatcgcgt

SEQ ID NO: 142478 - DNA, 25 bp, E. coli
cgatttatggaaaacggcgaagcct

SEQ ID NO: 142479 - DNA, 25 bp, E. coli
cgatttatggaatacggcgaagcct

SEQ ID NO: 142480 - DNA, 25 bp, E. coli
gtttacgacagtttgcgccagggca

SEQ ID NO: 142481 - DNA, 25 bp, E. coli
gtttacgacagtatgcgccagggca

SEQ ID NO: 142482 - DNA, 25 bp, E. coli
tgggtgccaccagataccaacgttg

SEQ ID NO: 142483 - DNA, 25 bp, E. coli
taccgcgtggttctgaaagctgact

SEQ ID NO: 142484 - DNA, 25 bp, E. coli
taccgcgtggttgtgaaagctgact

SEQ ID NO: 142485 - DNA, 25 bp, E. coli
ttaccgcgtggttctgaaagctgac

SEQ ID NO: 142486 - DNA, 25 bp, E. coli
ttaccgcgtggtactgaaagctgac

SEQ ID NO: 142487 - DNA, 25 bp, E. coli
tccgatctatcgatgatcgacaatg

SEQ ID NO: 142488 - DNA, 25 bp, E. coli
tccgatctatcgttgatcgacaatg

SEQ ID NO: 142489 - DNA, 25 bp, E. coli
gcgttaccgcgtggttctgaaagct

SEQ ID NO: 142490 - DNA, 25 bp, E. coli
gcgttaccgcgtcgttctgaaagct

SEQ ID NO: 142491 - DNA, 25 bp, E. coli
gcgtggttctgaaagctgacttctg

SEQ ID NO: 142492 - DNA, 25 bp, E. coli
gcgtggttctgatagctgacttctg

SEQ ID NO: 142493 - DNA, 25 bp, E. coli
cgttaccgcgtggttctgaaagctg

SEQ ID NO: 142494 - DNA, 25 bp, E. coli
cgatctatcgatgatcgacaatgaa

SEQ ID NO: 142495 - DNA, 25 bp, E. coli
ccgcgtggttctgaaagctgacttc

SEQ ID NO: 142496 - DNA, 25 bp, E. coli
cgttaccgcgtgcttctgaaagctg

SEQ ID NO: 142497 - DNA, 25 bp, E. coli
ccgcgtggttctcaaagctgacttc

SEQ ID NO: 142498 - DNA, 25 bp, E. coli
cgcgtggttctgaaagctgacttct

SEQ ID NO: 142499 - DNA, 25 bp, E. coli
cgcgtggttctgtaagctgacttct

SEQ ID NO: 142500 - DNA, 25 bp, E. coli
cgatctatcgatcatcgacaatgaa

SEQ ID NO: 142501 - DNA, 25 bp, E. coli
cgtggttctgaaagctgacttctga

SEQ ID NO: 142502 - DNA, 25 bp, E. coli
cgtggttctgaatgctgacttctga

SEQ ID NO: 142503 - DNA, 25 bp, E. coli
ctatcgatgatccacaatgaatggg

SEQ ID NO: 142504 - DNA, 25 bp, E. coli
ctatcgatgatcgacaatgaatggg

SEQ ID NO: 142505 - DNA, 25 bp, E. coli
aagaattcagagcacaaatggcgcg

SEQ ID NO: 142506 - DNA, 25 bp, E. coli
aagaattcagaggacaaatggcgcg

SEQ ID NO: 142507 - DNA, 25 bp, E. coli
taaacacgacgaagcatatgactgg

SEQ ID NO: 142508 - DNA, 25 bp, E. coli
taaacacgacgatgcatatgactgg

SEQ ID NO: 142509 - DNA, 25 bp, E. coli
tatgaaaagatccacgatgcgcgca

SEQ ID NO: 142510 - DNA, 25 bp, E. coli
tatgaaaagatcgacgatgcgcgca

SEQ ID NO: 142511 - DNA, 25 bp, E. coli
tattagctatatgaaaccggcagcg

SEQ ID NO: 142512 - DNA, 25 bp, E. coli
tattagctatatcaaaccggcagcg

SEQ ID NO: 142513 - DNA, 25 bp, E. coli
tattcaacgggccaaaatctggcca

SEQ ID NO: 142514 - DNA, 25 bp, E. coli
tatacgacagcgatgaagggcgacg

SEQ ID NO: 142515 - DNA, 25 bp, E. coli
tatacgacagcgttgaagggcgacg

SEQ ID NO: 142516 - DNA, 25 bp, E. coli
tattcaacgggcgaaaatctggcca

SEQ ID NO: 142517 - DNA, 25 bp, E. coli
tatcggaccacacaagagacgcgtc

SEQ ID NO: 142518 - DNA, 25 bp, E. coli
tatcggaccacagaagagacgcgtc

SEQ ID NO: 142519 - DNA, 25 bp, E. coli
tgaagctcaagaaatcggtgccccg

SEQ ID NO: 142520 - DNA, 25 bp, E. coli
tgaagctcaagatatcggtgccccg

SEQ ID NO: 142521 - DNA, 25 bp, E. coli
cgaaaattggtgcagtcgcccgcta

SEQ ID NO: 142522 - DNA, 25 bp, E. coli
cgaaaattggtggagtcgcccgcta

SEQ ID NO: 142523 - DNA, 25 bp, E. coli
tcagcactgaatcacgccggaattg

SEQ ID NO: 142524 - DNA, 25 bp, E. coli
tcagcactgaatgacgccggaattg

SEQ ID NO: 142525 - DNA, 25 bp, E. coli
gaggaatacctcaaagtcagccggg

SEQ ID NO: 142526 - DNA, 25 bp, E. coli
gaggaatacctctaagtcagccggg

SEQ ID NO: 142527 - DNA, 25 bp, E. coli
catatcattattcatcagggtaagg

SEQ ID NO: 142528 - DNA, 25 bp, E. coli
catatcattattgatcagggtaagg

SEQ ID NO: 142529 - DNA, 25 bp, E. coli
tgtatcagcgccttatcattattca

SEQ ID NO: 142530 - DNA, 25 bp, E. coli
tgtatcagcgccatatcattattca

SEQ ID NO: 142531 - DNA, 25 bp, E. coli
tgctttcgtcaccaaagagacttaa

SEQ ID NO: 142532 - DNA, 25 bp, E. coli
tgcagctgtatctgcgccatatcat

SEQ ID NO: 142533 - DNA, 25 bp, E. coli
tgcagctgtatcagcgccatatcat

SEQ ID NO: 142534 - DNA, 25 bp, E. coli
tgctttcgtcacgaaagagacttaa

SEQ ID NO: 142535 - DNA, 25 bp, E. coli
tcatcagggtaaggatgttcaggcc

SEQ ID NO: 142536 - DNA, 25 bp, E. coli
tcattattcatcagggtaaggatgt

SEQ ID NO: 142537 - DNA, 25 bp, E. coli
tcattattcatctgggtaaggatgt

SEQ ID NO: 142538 - DNA, 25 bp, E. coli
tcatcagggtaacgatgttcaggcc

SEQ ID NO: 142539 - DNA, 25 bp, E. coli
gccgtgctttcgacaccaaagagac

SEQ ID NO: 142540 - DNA, 25 bp, E. coli
gccgtgctttcgtcaccaaagagac

SEQ ID NO: 142541 - DNA, 25 bp, E. coli
gcgccatatcattattcatcagggt

SEQ ID NO: 142542 - DNA, 25 bp, E. coli
gcgccatatcataattcatcagggt

SEQ ID NO: 142543 - DNA, 25 bp, E. coli
cgtgctttcgtctccaaagagactt

SEQ ID NO: 142544 - DNA, 25 bp, E. coli
ctgacagcacgggcagatttgcctt

SEQ ID NO: 142545 - DNA, 25 bp, E. coli
ctgacagcacggccagatttgcctt

SEQ ID NO: 142546 - DNA, 25 bp, E. coli
cgtgctttcgtcaccaaagagactt

SEQ ID NO: 142547 - DNA, 25 bp, E. coli
tcagcgccatatcattattcatcag

SEQ ID NO: 142548 - DNA, 25 bp, E. coli
tcagcgccatatgattattcatcag

SEQ ID NO: 142549 - DNA, 25 bp, E. coli
caacatgcggcggattttgtcgcta

SEQ ID NO: 142550 - DNA, 25 bp, E. coli
caacatgcggcgcattttgtcgcta

SEQ ID NO: 142551 - DNA, 25 bp, E. coli
catgcggcggatattgtcgctaaac

SEQ ID NO: 142552 - DNA, 25 bp, E. coli
catgcggcggattttgtcgctaaac

SEQ ID NO: 142553 - DNA, 25 bp, E. coli
tgtcgctaaacgtcttgctccggca

SEQ ID NO: 142554 - DNA, 25 bp, E. coli
tgtcgctaaacgacttgctccggca

SEQ ID NO: 142555 - DNA, 25 bp, E. coli
taaacgtcttgcaccggcattaccg

SEQ ID NO: 142556 - DNA, 25 bp, E. coli
taaacgtcttgctccggcattaccg

SEQ ID NO: 142557 - DNA, 25 bp, E. coli
tcgcggttgtctggctaagtggcat

SEQ ID NO: 142558 - DNA, 25 bp, E. coli
tcgcggttgtctcgctaagtggcat

SEQ ID NO: 142559 - DNA, 25 bp, E. coli
tcgcgcgtttatcccgttcaaaatt

SEQ ID NO: 142560 - DNA, 25 bp, E. coli
tcgcgcgtttatgccgttcaaaatt

SEQ ID NO: 142561 - DNA, 25 bp, E. coli
tctcgatccactcttcgcgcgttta

SEQ ID NO: 142562 - DNA, 25 bp, E. coli
tctcgatccactgttcgcgcgttta

SEQ ID NO: 142563 - DNA, 25 bp, E. coli
cggattttgtcgctaaacgtcttgc

SEQ ID NO: 142564 - DNA, 25 bp, E. coli
cggattttgtcggtaaacgtcttgc

SEQ ID NO: 142565 - DNA, 25 bp, E. coli
gtcttgctccggcattaccggctaa

SEQ ID NO: 142566 - DNA, 25 bp, E. coli
gttgtctggctaagtggcataacat

SEQ ID NO: 142567 - DNA, 25 bp, E. coli
gttgtctggctatgtggcataacat

SEQ ID NO: 142568 - DNA, 25 bp, E. coli
gtcttgctccgggattaccggctaa

SEQ ID NO: 142569 - DNA, 25 bp, E. coli
taagcaaacccccatgcgcgggcat

SEQ ID NO: 142570 - DNA, 25 bp, E. coli
taagcaaaccccgatgcgcgggcat

SEQ ID NO: 142571 - DNA, 25 bp, E. coli
caaatgtgatggatgctatgaccgc

SEQ ID NO: 142572 - DNA, 25 bp, E. coli
caaatgtgatggttgctatgaccgc

SEQ ID NO: 142573 - DNA, 25 bp, E. coli
tatggcgcaccgcagtacaacgcaa

SEQ ID NO: 142574 - DNA, 25 bp, E. coli
tatggcgcaccggagtacaacgcaa

SEQ ID NO: 142575 - DNA, 25 bp, E. coli
tgtgtgtattgggtgtcgttactgc

SEQ ID NO: 142576 - DNA, 25 bp, E. coli
tgtgtgtattggctgtcgttactgc

SEQ ID NO: 142577 - DNA, 25 bp, E. coli
tcgttactgccatatggcctgcccg

SEQ ID NO: 142578 - DNA, 25 bp, E. coli
tcgttactgccaaatggcctgcccg

SEQ ID NO: 142579 - DNA, 25 bp, E. coli
gaaggtaaaaaaccgatctgcgtcg

SEQ ID NO: 142580 - DNA, 25 bp, E. coli
ccaaaggtcatatgaccaaatgtga

SEQ ID NO: 142581 - DNA, 25 bp, E. coli
gaaggtaaaaaagcgatctgcgtcg

SEQ ID NO: 142582 - DNA, 25 bp, E. coli
ccaaaggtcataagaccaaatgtga

SEQ ID NO: 142583 - DNA, 25 bp, E. coli
gcgtgcgcacttcaccaaaccgaat

SEQ ID NO: 142584 - DNA, 25 bp, E. coli
gctatgaccgcgacgcagaaggtaa

SEQ ID NO: 142585 - DNA, 25 bp, E. coli
gctatgaccgcgtcgcagaaggtaa

SEQ ID NO: 142586 - DNA, 25 bp, E. coli
gcgtgcgcacttgaccaaaccgaat

SEQ ID NO: 142587 - DNA, 25 bp, E. coli
gcagtacaacgcaaccaaaggtcat

SEQ ID NO: 142588 - DNA, 25 bp, E. coli
gcagtacaacgctaccaaaggtcat

SEQ ID NO: 142589 - DNA, 25 bp, E. coli
gatctgcgtcgattcttgcccgcta

SEQ ID NO: 142590 - DNA, 25 bp, E. coli
gatggttgctatcaccgcgtcgcag

SEQ ID NO: 142591 - DNA, 25 bp, E. coli
gatggttgctatgaccgcgtcgcag

SEQ ID NO: 142592 - DNA, 25 bp, E. coli
gatctgcgtcgaatcttgcccgcta

SEQ ID NO: 142593 - DNA, 25 bp, E. coli
caataacgatctgacgacactaaca

SEQ ID NO: 142594 - DNA, 25 bp, E. coli
caataacgatctcacgacactaaca

SEQ ID NO: 142595 - DNA, 25 bp, E. coli
aataacgatctctcgacactaacag

SEQ ID NO: 142596 - DNA, 25 bp, E. coli
aataacgatctcacgacactaacag

SEQ ID NO: 142597 - DNA, 25 bp, E. coli
ataacgatctcaggacactaacagc

SEQ ID NO: 142598 - DNA, 25 bp, E. coli
ataacgatctcacgacactaacagc

SEQ ID NO: 142599 - DNA, 25 bp, E. coli
acaataacgatctcacgacactaac

SEQ ID NO: 142600 - DNA, 25 bp, E. coli
acaataacgatcacacgacactaac

SEQ ID NO: 142601 - DNA, 25 bp, E. coli
tcgctgatacagtgggcaatgcgat

SEQ ID NO: 142602 - DNA, 25 bp, E. coli
tcgctgatacagagggcaatgcgat

SEQ ID NO: 142603 - DNA, 25 bp, E. coli
gctgatacagagggcaatgcgatag

SEQ ID NO: 142604 - DNA, 25 bp, E. coli
gctgatacagagcgcaatgcgatag

SEQ ID NO: 142605 - DNA, 25 bp, E. coli
cgctggcagcctcgaaggatccggt

SEQ ID NO: 142606 - DNA, 25 bp, E. coli
cgctgatacagagggcaatgcgata

SEQ ID NO: 142607 - DNA, 25 bp, E. coli
cgctgatacagacggcaatgcgata

SEQ ID NO: 142608 - DNA, 25 bp, E. coli
cgctggcagcctggaaggatccggt

SEQ ID NO: 142609 - DNA, 25 bp, E. coli
gtcgctgatacacagggcaatgcga

SEQ ID NO: 142610 - DNA, 25 bp, E. coli
gtcgctgatacagagggcaatgcga

SEQ ID NO: 142611 - DNA, 25 bp, E. coli
taacgatctcaccacactaacagca

SEQ ID NO: 142612 - DNA, 25 bp, E. coli
taacgatctcacgacactaacagca

SEQ ID NO: 142613 - DNA, 25 bp, E. coli
catgagctggtggttcccggataca

SEQ ID NO: 142614 - DNA, 25 bp, E. coli
catgagctggtgcttcccggataca

SEQ ID NO: 142615 - DNA, 25 bp, E. coli
cactttgggccagaactacgaagcg

SEQ ID NO: 142616 - DNA, 25 bp, E. coli
aacgatttctcaggcaggtccgggc

SEQ ID NO: 142617 - DNA, 25 bp, E. coli
aacgatttctcacgcaggtccgggc

SEQ ID NO: 142618 - DNA, 25 bp, E. coli
cactttgggccacaactacgaagcg

SEQ ID NO: 142619 - DNA, 25 bp, E. coli
tacgctacagcgtaatgaagttccc

SEQ ID NO: 142620 - DNA, 25 bp, E. coli
tacgctacagcgaaatgaagttccc

SEQ ID NO: 142621 - DNA, 25 bp, E. coli
ttgctgcaggcgagtccgaagatcc

SEQ ID NO: 142622 - DNA, 25 bp, E. coli
ttgctgcaggcgtgtccgaagatcc

SEQ ID NO: 142623 - DNA, 25 bp, E. coli
gctggagcaactggacaatcggcga

SEQ ID NO: 142624 - DNA, 25 bp, E. coli
gctggagcaactcgacaatcggcga

SEQ ID NO: 142625 - DNA, 25 bp, E. coli
gaaaaacattccacgcgcggtacgt

SEQ ID NO: 142626 - DNA, 25 bp, E. coli
gaaaaacattcctcgcgcggtacgt

SEQ ID NO: 142627 - DNA, 25 bp, E. coli
cattggcggttcgatcggtacaggt

SEQ ID NO: 142628 - DNA, 25 bp, E. coli
cattggcggttccatcggtacaggt

SEQ ID NO: 142629 - DNA, 25 bp, E. coli
gattgtcggcttctctttccaggga

SEQ ID NO: 142630 - DNA, 25 bp, E. coli
gattgtcggcttgtctttccaggga

SEQ ID NO: 142631 - DNA, 25 bp, E. coli
gattatcggtatgttcaaaggcgcg

SEQ ID NO: 142632 - DNA, 25 bp, E. coli
gattatcggtatcttcaaaggcgcg

SEQ ID NO: 142633 - DNA, 25 bp, E. coli
tggaactactggtacaactgggcgg

SEQ ID NO: 142634 - DNA, 25 bp, E. coli
tggaactactggaacaactgggcgg

SEQ ID NO: 142635 - DNA, 25 bp, E. coli
cagcaaagcggtgagattatggcac

SEQ ID NO: 142636 - DNA, 25 bp, E. coli
cagcaaagcggtcagattatggcac

SEQ ID NO: 142637 - DNA, 25 bp, E. coli
tatggcactggtcgaatgcgttact

SEQ ID NO: 142638 - DNA, 25 bp, E. coli
tatggcactggtggaatgcgttact

SEQ ID NO: 142639 - DNA, 25 bp, E. coli
tttgttactggcttgctggctcggc

SEQ ID NO: 142640 - DNA, 25 bp, E. coli
tttgttactggcatgctggctcggc

SEQ ID NO: 142641 - DNA, 25 bp, E. coli
tgtctctatccggaagccgtgggag

SEQ ID NO: 142642 - DNA, 25 bp, E. coli
tgtctctatccgcaagccgtgggag

SEQ ID NO: 142643 - DNA, 25 bp, E. coli
tgtttcctggcgaaagatactggtt

SEQ ID NO: 142644 - DNA, 25 bp, E. coli
tgtttcctggcgtaagatactggtt

SEQ ID NO: 142645 - DNA, 25 bp, E. coli
ccttgcttcgtggtcgtggcgtgaa

SEQ ID NO: 142646 - DNA, 25 bp, E. coli
ccttgcttcgtgctcgtggcgtgaa

SEQ ID NO: 142647 - DNA, 25 bp, E. coli
gaacccgtcgcaacatgctgaacag

SEQ ID NO: 142648 - DNA, 25 bp, E. coli
gaacccgtcgcatcatgctgaacag

SEQ ID NO: 142649 - DNA, 25 bp, E. coli
gaagaacatcctatcccggcaacaa

SEQ ID NO: 142650 - DNA, 25 bp, E. coli
gaagaacatcctttcccggcaacaa

SEQ ID NO: 142651 - DNA, 25 bp, E. coli
gaagaaatcagcgaccgatcatggt

SEQ ID NO: 142652 - DNA, 25 bp, E. coli
gaagaaatcagccaccgatcatggt

SEQ ID NO: 142653 - DNA, 25 bp, E. coli
cggttaaaagtcaggttgcggtgca

SEQ ID NO: 142654 - DNA, 25 bp, E. coli
cggttaaaagtctggttgcggtgca

SEQ ID NO: 142655 - DNA, 25 bp, E. coli
gattgctgccgttgttactattgac

SEQ ID NO: 142656 - DNA, 25 bp, E. coli
gattgctgccgtagttactattgac

SEQ ID NO: 142657 - DNA, 25 bp, E. coli
aaggcggagccgctctccggcaaaa

SEQ ID NO: 142658 - DNA, 25 bp, E. coli
aataacaattatacgcgtgacccgg

SEQ ID NO: 142659 - DNA, 25 bp, E. coli
aataacaattattcgcgtgacccgg

SEQ ID NO: 142660 - DNA, 25 bp, E. coli
aaggcggagccggtctccggcaaaa

SEQ ID NO: 142661 - DNA, 25 bp, E. coli
caggaagaaatctatgttggccggg

SEQ ID NO: 142662 - DNA, 25 bp, E. coli
caggaagaaatcaatgttggccggg

SEQ ID NO: 142663 - DNA, 25 bp, E. coli
attatacgcgtgtcccggcgcggga

SEQ ID NO: 142664 - DNA, 25 bp, E. coli
attatacgcgtgacccggcgcggga

SEQ ID NO: 142665 - DNA, 25 bp, E. coli
tgtacgtgaacaggaagaaatctat

SEQ ID NO: 142666 - DNA, 25 bp, E. coli
tgtacgtgaacacgaagaaatctat

SEQ ID NO: 142667 - DNA, 25 bp, E. coli
tccggcaaaaagaatcaataacaat

SEQ ID NO: 142668 - DNA, 25 bp, E. coli
tccggcaaaaagtatcaataacaat

SEQ ID NO: 142669 - DNA, 25 bp, E. coli
gccgctctccgggaaaaagaatcaa

SEQ ID NO: 142670 - DNA, 25 bp, E. coli
gccgctctccggcaaaaagaatcaa

SEQ ID NO: 142671 - DNA, 25 bp, E. coli
ccgacaatctgttcgtgaacaggaa

SEQ ID NO: 142672 - DNA, 25 bp, E. coli
gccgcatccgacaatctgtacgtga

SEQ ID NO: 142673 - DNA, 25 bp, E. coli
gccgcatccgactatctgtacgtga

SEQ ID NO: 142674 - DNA, 25 bp, E. coli
gaaatctatgttcgccgggtaaggc

SEQ ID NO: 142675 - DNA, 25 bp, E. coli
gaaatctatgttggccgggtaaggc

SEQ ID NO: 142676 - DNA, 25 bp, E. coli
ccgacaatctgtacgtgaacaggaa

SEQ ID NO: 142677 - DNA, 25 bp, E. coli
ctcctatgccggaggcgacgctgcg

SEQ ID NO: 142678 - DNA, 25 bp, E. coli
ctcctatgccggtggcgacgctgcg

SEQ ID NO: 142679 - DNA, 25 bp, E. coli
aatttttggccgttcactgcgtgtg

SEQ ID NO: 142680 - DNA, 25 bp, E. coli
aatttttggccgatcactgcgtgtg

SEQ ID NO: 142681 - DNA, 25 bp, E. coli
tacttgaacaagctcgcatcaccga

SEQ ID NO: 142682 - DNA, 25 bp, E. coli
tacttgaacaaggtcgcatcaccga

SEQ ID NO: 142683 - DNA, 25 bp, E. coli
aactgcccgcctgaccaaagggatg

SEQ ID NO: 142684 - DNA, 25 bp, E. coli
aactgcccgcctcaccaaagggatg

SEQ ID NO: 142685 - DNA, 25 bp, E. coli
tctgaaagaacggactagagtcaca

SEQ ID NO: 142686 - DNA, 25 bp, E. coli
tctgaaagaacgcactagagtcaca

SEQ ID NO: 142687 - DNA, 25 bp, E. coli
ccaaagggatgcgttgaatcaggca

SEQ ID NO: 142688 - DNA, 25 bp, E. coli
ccaaagggatgccttgaatcaggca

SEQ ID NO: 142689 - DNA, 25 bp, E. coli
gcaagtatggaacagcgtattcgga

SEQ ID NO: 142690 - DNA, 25 bp, E. coli
gaaccaacggttccaagatctgaaa

SEQ ID NO: 142691 - DNA, 25 bp, E. coli
gcagcggacgatctgaaccaacggt

SEQ ID NO: 142692 - DNA, 25 bp, E. coli
gcagcagaccatagaacaagcgtta

SEQ ID NO: 142693 - DNA, 25 bp, E. coli
gaaccaacggttgcaagatctgaaa

SEQ ID NO: 142694 - DNA, 25 bp, E. coli
gcagcagaccattgaacaagcgtta

SEQ ID NO: 142695 - DNA, 25 bp, E. coli
gcagcggacgatgtgaaccaacggt

SEQ ID NO: 142696 - DNA, 25 bp, E. coli
gcaagtatggaagagcgtattcgga

SEQ ID NO: 142697 - DNA, 25 bp, E. coli
gaacagttggtcatcattgccgcat

SEQ ID NO: 142698 - DNA, 25 bp, E. coli
gaacagttggtcttcattgccgcat

SEQ ID NO: 142699 - DNA, 25 bp, E. coli
cgtattcggatggtgcagcagacca

SEQ ID NO: 142700 - DNA, 25 bp, E. coli
cgtattcggatgctgcagcagacca

SEQ ID NO: 142701 - DNA, 25 bp, E. coli
aatggatggtaaacaaaccttccgg

SEQ ID NO: 142702 - DNA, 25 bp, E. coli
aagccgacgtgcaggcggcgaatct

SEQ ID NO: 142703 - DNA, 25 bp, E. coli
aatggatggtaatcaaaccttccgg

SEQ ID NO: 142704 - DNA, 25 bp, E. coli
aagccgacgtgctggcggcgaatct

SEQ ID NO: 142705 - DNA, 25 bp, E. coli
cagatgaccgcacaggagattaacg

SEQ ID NO: 142706 - DNA, 25 bp, E. coli
catctggtcacaggccgggctggat

SEQ ID NO: 142707 - DNA, 25 bp, E. coli
cagatgaccgcagaggagattaacg

SEQ ID NO: 142708 - DNA, 25 bp, E. coli
catctggtcacacgccgggctggat

SEQ ID NO: 142709 - DNA, 25 bp, E. coli
tgccgtgcataaggccgtagtactc

SEQ ID NO: 142710 - DNA, 25 bp, E. coli
tcgagtacgacgagatgaccgccga

SEQ ID NO: 142711 - DNA, 25 bp, E. coli
tcgagtacgacgtgatgaccgccga

SEQ ID NO: 142712 - DNA, 25 bp, E. coli
tgccgtgcataacgccgtagtactc

SEQ ID NO: 142713 - DNA, 25 bp, E. coli
tctaccgtcgctatgccgaaattgg

SEQ ID NO: 142714 - DNA, 25 bp, E. coli
tctaccgtcgctttgccgaaattgg

SEQ ID NO: 142715 - DNA, 25 bp, E. coli
gaaaccttcgaagaacgtggcagga

SEQ ID NO: 142716 - DNA, 25 bp, E. coli
gaaaccttcgaacaacgtggcagga

SEQ ID NO: 142717 - DNA, 25 bp, E. coli
cgtagtactcgaagaatgcgcctat

SEQ ID NO: 142718 - DNA, 25 bp, E. coli
ccgaaattggcggtattgtgcatac

SEQ ID NO: 142719 - DNA, 25 bp, E. coli
ccgaaattggcgctattgtgcatac

SEQ ID NO: 142720 - DNA, 25 bp, E. coli
cgtagtactcgatgaatgcgcctat

SEQ ID NO: 142721 - DNA, 25 bp, E. coli
cgtggcaggagtccggcacaaatcc

SEQ ID NO: 142722 - DNA, 25 bp, E. coli
cgtggcaggagtgcggcacaaatcc

SEQ ID NO: 142723 - DNA, 25 bp, E. coli
aatccggcttatcgtcaagagatgc

SEQ ID NO: 142724 - DNA, 25 bp, E. coli
aatccggcttatggtcaagagatgc

SEQ ID NO: 142725 - DNA, 25 bp, E. coli
caagagatgcggatgaacgtcagat

SEQ ID NO: 142726 - DNA, 25 bp, E. coli
caagagatgcggttgaacgtcagat

SEQ ID NO: 142727 - DNA, 25 bp, E. coli
cacgtctgcctgtacttctgtcgcg

SEQ ID NO: 142728 - DNA, 25 bp, E. coli
caaacagggaggagtgtatcagtcc

SEQ ID NO: 142729 - DNA, 25 bp, E. coli
cacgtctgcctgaacttctgtcgcg

SEQ ID NO: 142730 - DNA, 25 bp, E. coli
caaacagggaggtgtgtatcagtcc

SEQ ID NO: 142731 - DNA, 25 bp, E. coli
catctggaagaacgtcggcttatgc

SEQ ID NO: 142732 - DNA, 25 bp, E. coli
catctggaagaaggtcggcttatgc

SEQ ID NO: 142733 - DNA, 25 bp, E. coli
agttaacaatcctctgaaaaggtga

SEQ ID NO: 142734 - DNA, 25 bp, E. coli
agttaacaatccactgaaaaggtga

SEQ ID NO: 142735 - DNA, 25 bp, E. coli
taccgtaaataaggccctcagagtg

SEQ ID NO: 142736 - DNA, 25 bp, E. coli
taccgtaaataacgccctcagagtg

SEQ ID NO: 142737 - DNA, 25 bp, E. coli
ttataaaggtcaccctgtcacccgg

SEQ ID NO: 142738 - DNA, 25 bp, E. coli
ttataaaggtcagcctgtcacccgg

SEQ ID NO: 142739 - DNA, 25 bp, E. coli
tcggcttatgctccaatggtgggca

SEQ ID NO: 142740 - DNA, 25 bp, E. coli
tcggcttatgctgcaatggtgggca

SEQ ID NO: 142741 - DNA, 25 bp, E. coli
tcatcaggagcgcaacggagtacgt

SEQ ID NO: 142742 - DNA, 25 bp, E. coli
tcatcaggagcggaacggagtacgt

SEQ ID NO: 142743 - DNA, 25 bp, E. coli
gcaacggagtacgtgccgcgtatat

SEQ ID NO: 142744 - DNA, 25 bp, E. coli
gcaacggagtacctgccgcgtatat

SEQ ID NO: 142745 - DNA, 25 bp, E. coli
ttacggcgaggtgctaagccccatt

SEQ ID NO: 142746 - DNA, 25 bp, E. coli
ttacggcgaggtcctaagccccatt

SEQ ID NO: 142747 - DNA, 25 bp, E. coli
aaacgctcaccggtcgatccggtag

SEQ ID NO: 142748 - DNA, 25 bp, E. coli
aaacgctcaccgctcgatccggtag

SEQ ID NO: 142749 - DNA, 25 bp, E. coli
tttagcgatgaagaacggctggcgc

SEQ ID NO: 142750 - DNA, 25 bp, E. coli
tttagcgatgaacaacggctggcgc

SEQ ID NO: 142751 - DNA, 25 bp, E. coli
tccggtagtacgatcgcttgtcagc

SEQ ID NO: 142752 - DNA, 25 bp, E. coli
tccggtagtacgttcgcttgtcagc

SEQ ID NO: 142753 - DNA, 25 bp, E. coli
gactggcggcaatgcccgctcttta

SEQ ID NO: 142754 - DNA, 25 bp, E. coli
gactggcggcaaagcccgctcttta

SEQ ID NO: 142755 - DNA, 25 bp, E. coli
cattgcgcaaatctgcctgtgtgag

SEQ ID NO: 142756 - DNA, 25 bp, E. coli
cattgcgcaaatgtgcctgtgtgag

SEQ ID NO: 142757 - DNA, 25 bp, E. coli
ggcctgcaaaatctgtcagcccgtt

SEQ ID NO: 142758 - DNA, 25 bp, E. coli
ggcctgcaaaatgtgtcagcccgtt

SEQ ID NO: 142759 - DNA, 25 bp, E. coli
tcaccagtatgatagtcgccgagcg

SEQ ID NO: 142760 - DNA, 25 bp, E. coli
taacgccgccaacggtcgatgatgc

SEQ ID NO: 142761 - DNA, 25 bp, E. coli
taattctgccatggacattcccgct

SEQ ID NO: 142762 - DNA, 25 bp, E. coli
taattctgccatcgacattcccgct

SEQ ID NO: 142763 - DNA, 25 bp, E. coli
taacgccgccaagggtcgatgatgc

SEQ ID NO: 142764 - DNA, 25 bp, E. coli
tcaccagtatgaaagtcgccgagcg

SEQ ID NO: 142765 - DNA, 25 bp, E. coli
gagtacgccgaacccgcaagcgtaa

SEQ ID NO: 142766 - DNA, 25 bp, E. coli
gagtacgccgaagccgcaagcgtaa

SEQ ID NO: 142767 - DNA, 25 bp, E. coli
caatgacccgcgacatgattctgca

SEQ ID NO: 142768 - DNA, 25 bp, E. coli
caatgacccgcgtcatgattctgca

SEQ ID NO: 142769 - DNA, 25 bp, E. coli
caccattatggcgtgcgtgatcgcg

SEQ ID NO: 142770 - DNA, 25 bp, E. coli
caccattatggcctgcgtgatcgcg

SEQ ID NO: 142771 - DNA, 25 bp, E. coli
cagatgtttgcatagctgcgcacca

SEQ ID NO: 142772 - DNA, 25 bp, E. coli
cagatgtttgcaaagctgcgcacca

SEQ ID NO: 142773 - DNA, 25 bp, E. coli
cagagcgtcgccatctgggtgtaaa

SEQ ID NO: 142774 - DNA, 25 bp, E. coli
cagagcgtcgccttctgggtgtaaa

SEQ ID NO: 142775 - DNA, 25 bp, E. coli
taaaaaagggcgcatcaaacgtcag

SEQ ID NO: 142776 - DNA, 25 bp, E. coli
taaaaaagggcggatcaaacgtcag

SEQ ID NO: 142777 - DNA, 25 bp, E. coli
tgatgatgttgacgcaatgacccgc

SEQ ID NO: 142778 - DNA, 25 bp, E. coli
tgatgatgttgaggcaatgacccgc

SEQ ID NO: 142779 - DNA, 25 bp, E. coli
tgcgccggacactgcagcagaatat

SEQ ID NO: 142780 - DNA, 25 bp, E. coli
tgcgccggacacagcagcagaatat

SEQ ID NO: 142781 - DNA, 25 bp, E. coli
gctgaactgcagtaggtggacgact

SEQ ID NO: 142782 - DNA, 25 bp, E. coli
gctgaactgcagaaggtggacgact

SEQ ID NO: 142783 - DNA, 25 bp, E. coli
gaatatcaggatgcagcgcaaccct

SEQ ID NO: 142784 - DNA, 25 bp, E. coli
gaatatcaggatccagcgcaaccct

SEQ ID NO: 142785 - DNA, 25 bp, E. coli
cgcgacgggtaagagcacgaagtaa

SEQ ID NO: 142786 - DNA, 25 bp, E. coli
cgcgacgggtaacagcacgaagtaa

SEQ ID NO: 142787 - DNA, 25 bp, E. coli
taaggtgcagaggattgcccgcgtt

SEQ ID NO: 142788 - DNA, 25 bp, E. coli
taaggtgcagagcattgcccgcgtt

SEQ ID NO: 142789 - DNA, 25 bp, E. coli
taaaacatgccgtgctcttgttgcg

SEQ ID NO: 142790 - DNA, 25 bp, E. coli
taaaacatgccgagctcttgttgcg

SEQ ID NO: 142791 - DNA, 25 bp, E. coli
atgagcaacctacgaaaatatcgag

SEQ ID NO: 142792 - DNA, 25 bp, E. coli
agtcttgatgacctgttcccgccgg

SEQ ID NO: 142793 - DNA, 25 bp, E. coli
agtcttgatgacgtgttcccgccgg

SEQ ID NO: 142794 - DNA, 25 bp, E. coli
atgagcaacctaggaaaatatcgag

SEQ ID NO: 142795 - DNA, 25 bp, E. coli
tgcacacagggagctatcggacatt

SEQ ID NO: 142796 - DNA, 25 bp, E. coli
tgcacacagggacctatcggacatt

SEQ ID NO: 142797 - DNA, 25 bp, E. coli
tctcaaacaacagttgctaaggcag

SEQ ID NO: 142798 - DNA, 25 bp, E. coli
tctcaaacaacacttgctaaggcag

SEQ ID NO: 142799 - DNA, 25 bp, E. coli
cctacgaaaataacgagagtcactg

SEQ ID NO: 142800 - DNA, 25 bp, E. coli
cctacgaaaatatcgagagtcactg

SEQ ID NO: 142801 - DNA, 25 bp, E. coli
gcttcccagaccataaaacatgccg

SEQ ID NO: 142802 - DNA, 25 bp, E. coli
gcttcccagaccttaaaacatgccg

SEQ ID NO: 142803 - DNA, 25 bp, E. coli
gctaaggcagttcgatgcacacagg

SEQ ID NO: 142804 - DNA, 25 bp, E. coli
gctaaggcagttggatgcacacagg

SEQ ID NO: 142805 - DNA, 25 bp, E. coli
gggaatctggtcctcgcttcccaga

SEQ ID NO: 142806 - DNA, 25 bp, E. coli
gggaatctggtcgtcgcttcccaga

SEQ ID NO: 142807 - DNA, 25 bp, E. coli
gagtcactgaatttctctcaaacaa

SEQ ID NO: 142808 - DNA, 25 bp, E. coli
gagtcactgaatatctctcaaacaa

SEQ ID NO: 142809 - DNA, 25 bp, E. coli
gagctatcggactttgggaatctgg

SEQ ID NO: 142810 - DNA, 25 bp, E. coli
gagctatcggacattgggaatctgg

SEQ ID NO: 142811 - DNA, 25 bp, E. coli
caacaggcgctttcgatcgtcgctg

SEQ ID NO: 142812 - DNA, 25 bp, E. coli
caacaggcgcttacgatcgtcgctg

SEQ ID NO: 142813 - DNA, 25 bp, E. coli
catcctaatatgctggtccgctggg

SEQ ID NO: 142814 - DNA, 25 bp, E. coli
catcctaatatggtggtccgctggg

SEQ ID NO: 142815 - DNA, 25 bp, E. coli
tgagcagtaaagacgaacgtgaacg

SEQ ID NO: 142816 - DNA, 25 bp, E. coli
tgagcagtaaagtcgaacgtgaacg

SEQ ID NO: 142817 - DNA, 25 bp, E. coli
tgaacgacgtaaggcgcaactgctt

SEQ ID NO: 142818 - DNA, 25 bp, E. coli
tgaacgacgtaacgcgcaactgctt

SEQ ID NO: 142819 - DNA, 25 bp, E. coli
tcgaacgtgaaccacgtaaggcgca

SEQ ID NO: 142820 - DNA, 25 bp, E. coli
tcgaacgtgaacgacgtaaggcgca

SEQ ID NO: 142821 - DNA, 25 bp, E. coli
gcttagccagatccagcaacaacgg

SEQ ID NO: 142822 - DNA, 25 bp, E. coli
gcttagccagatgcagcaacaacgg

SEQ ID NO: 142823 - DNA, 25 bp, E. coli
gcttacgatcgtcgctggaatatgc

SEQ ID NO: 142824 - DNA, 25 bp, E. coli
gcttacgatcgtggctggaatatgc

SEQ ID NO: 142825 - DNA, 25 bp, E. coli
cgctcctgggcggtggttggcagta

SEQ ID NO: 142826 - DNA, 25 bp, E. coli
cgctcctgggcgctggttggcagta

SEQ ID NO: 142827 - DNA, 25 bp, E. coli
tggacgattcgccatcctaatatgc

SEQ ID NO: 142828 - DNA, 25 bp, E. coli
tggacgattcgcgatcctaatatgc

SEQ ID NO: 142829 - DNA, 25 bp, E. coli
taaggcgcaactccttagccagatc

SEQ ID NO: 142830 - DNA, 25 bp, E. coli
taatatgctggtgcgctgggccaga

SEQ ID NO: 142831 - DNA, 25 bp, E. coli
taatatgctggtccgctgggccaga

SEQ ID NO: 142832 - DNA, 25 bp, E. coli
taaggcgcaactgcttagccagatc

SEQ ID NO: 142833 - DNA, 25 bp, E. coli
cagtgagcgtcctggttttaaccgg

SEQ ID NO: 142834 - DNA, 25 bp, E. coli
cagtgagcgtccaggttttaaccgg

SEQ ID NO: 142835 - DNA, 25 bp, E. coli
ttgtgacaaaactggatcgccttgg

SEQ ID NO: 142836 - DNA, 25 bp, E. coli
ttagcggctcagcagcaaccagtga

SEQ ID NO: 142837 - DNA, 25 bp, E. coli
ttgtgacaaaacaggatcgccttgg

SEQ ID NO: 142838 - DNA, 25 bp, E. coli
ttagcggctcaggagcaaccagtga

SEQ ID NO: 142839 - DNA, 25 bp, E. coli
tgaacgcactcaatccgggatagta

SEQ ID NO: 142840 - DNA, 25 bp, E. coli
tgaacgcactcattccgggatagta

SEQ ID NO: 142841 - DNA, 25 bp, E. coli
gaacgagaccttatacttgaacgca

SEQ ID NO: 142842 - DNA, 25 bp, E. coli
gaacgagaccttttacttgaacgca

SEQ ID NO: 142843 - DNA, 25 bp, E. coli
cgaaacaggtatgagagtgcattgc

SEQ ID NO: 142844 - DNA, 25 bp, E. coli
cgaaacaggtatcagagtgcattgc

SEQ ID NO: 142845 - DNA, 25 bp, E. coli
cattgcccgggaattcaaaacctcg

SEQ ID NO: 142846 - DNA, 25 bp, E. coli
cattgcccgggatttcaaaacctcg

SEQ ID NO: 142847 - DNA, 25 bp, E. coli
tgtaagtataagtgccattgcccgg

SEQ ID NO: 142848 - DNA, 25 bp, E. coli
tgtaagtataagagccattgcccgg

SEQ ID NO: 142849 - DNA, 25 bp, E. coli
taaccggttgcttgctcgcctgaaa

SEQ ID NO: 142850 - DNA, 25 bp, E. coli
taatcgaagaactcattagcggctc

SEQ ID NO: 142851 - DNA, 25 bp, E. coli
taatcgaagaacacattagcggctc

SEQ ID NO: 142852 - DNA, 25 bp, E. coli
tcaacgccgggaaatcgaaagtgca

SEQ ID NO: 142853 - DNA, 25 bp, E. coli
tcaacgccgggatatcgaaagtgca

SEQ ID NO: 142854 - DNA, 25 bp, E. coli
taaccggttgctagctcgcctgaaa

SEQ ID NO: 142855 - DNA, 25 bp, E. coli
tacgtggtgcaagtgtactgccgca

SEQ ID NO: 142856 - DNA, 25 bp, E. coli
taaatctgaccagaacgtacgtggt

SEQ ID NO: 142857 - DNA, 25 bp, E. coli
taaatctgaccacaacgtacgtggt

SEQ ID NO: 142858 - DNA, 25 bp, E. coli
tacgtggtgcaactgtactgccgca

SEQ ID NO: 142859 - DNA, 25 bp, E. coli
cgtggacgtagcagttaacctcggc

SEQ ID NO: 142860 - DNA, 25 bp, E. coli
cgtggacgtagctgttaacctcggc

SEQ ID NO: 142861 - DNA, 25 bp, E. coli
tatccgcgagaaagttgatgcaacc

SEQ ID NO: 142862 - DNA, 25 bp, E. coli
tatccgcgagaatgttgatgcaacc

SEQ ID NO: 142863 - DNA, 25 bp, E. coli
ttaaaaacgctatagctggccaggt

SEQ ID NO: 142864 - DNA, 25 bp, E. coli
ttaaaaacgctaaagctggccaggt

SEQ ID NO: 142865 - DNA, 25 bp, E. coli
gcctgatgccaatcccgaaagtggg

SEQ ID NO: 142866 - DNA, 25 bp, E. coli
gcctgatgccaaacccgaaagtggg

SEQ ID NO: 142867 - DNA, 25 bp, E. coli
gctaaattcgtacaaagcgtggacg

SEQ ID NO: 142868 - DNA, 25 bp, E. coli
gctaaattcgtagaaagcgtggacg

SEQ ID NO: 142869 - DNA, 25 bp, E. coli
tggctaaactgaccaagcgcatgcg

SEQ ID NO: 142870 - DNA, 25 bp, E. coli
tggctgaccagatcaagaaaggcga

SEQ ID NO: 142871 - DNA, 25 bp, E. coli
tggctgaccagaacaagaaaggcga

SEQ ID NO: 142872 - DNA, 25 bp, E. coli
tggctaaactgagcaagcgcatgcg

SEQ ID NO: 142873 - DNA, 25 bp, E. coli
taacctcggcatggacgctcgtaaa

SEQ ID NO: 142874 - DNA, 25 bp, E. coli
taacctcggcatcgacgctcgtaaa

SEQ ID NO: 142875 - DNA, 25 bp, E. coli
gatgcaatgcgccttgttggccagc

SEQ ID NO: 142876 - DNA, 25 bp, E. coli
gatgcaatgcgcgttgttggccagc

SEQ ID NO: 142877 - DNA, 25 bp, E. coli
aagaattaataagcagcaagcagtg

SEQ ID NO: 142878 - DNA, 25 bp, E. coli
aagaattaataaccagcaagcagtg

SEQ ID NO: 142879 - DNA, 25 bp, E. coli
taaagaaggattcgcgcaagagaaa

SEQ ID NO: 142880 - DNA, 25 bp, E. coli
taaagaaggattggcgcaagagaaa

SEQ ID NO: 142881 - DNA, 25 bp, E. coli
atcaaatcacctgccggacttattc

SEQ ID NO: 142882 - DNA, 25 bp, E. coli
atcaaatcacctcccggacttattc

SEQ ID NO: 142883 - DNA, 25 bp, E. coli
tgagcgtctcggttaatacggcgcg

SEQ ID NO: 142884 - DNA, 25 bp, E. coli
tgagcgtctcggataatacggcgcg

SEQ ID NO: 142885 - DNA, 25 bp, E. coli
tcccggacttatacctttatcacac

SEQ ID NO: 142886 - DNA, 25 bp, E. coli
tcccggacttattcctttatcacac

SEQ ID NO: 142887 - DNA, 25 bp, E. coli
gaaattagtgtgtgtctgagcgtct

SEQ ID NO: 142888 - DNA, 25 bp, E. coli
gaaattagtgtgagtctgagcgtct

SEQ ID NO: 142889 - DNA, 25 bp, E. coli
cgcgcaagagaatagaattaataac

SEQ ID NO: 142890 - DNA, 25 bp, E. coli
cgcgcaagagaaaagaattaataac

SEQ ID NO: 142891 - DNA, 25 bp, E. coli
gtgtacgtcgcacactacccgctgt

SEQ ID NO: 142892 - DNA, 25 bp, E. coli
gtgtacgtcgcagactacccgctgt

SEQ ID NO: 142893 - DNA, 25 bp, E. coli
ggcgcggaccgatttacggacaatt

SEQ ID NO: 142894 - DNA, 25 bp, E. coli
ggcgcggaccgaattacggacaatt

SEQ ID NO: 142895 - DNA, 25 bp, E. coli
taaccagcaagctgtgtacgtcgca

SEQ ID NO: 142896 - DNA, 25 bp, E. coli
taatacggcgcggaccgatttacgg

SEQ ID NO: 142897 - DNA, 25 bp, E. coli
taatacggcgcgcaccgatttacgg

SEQ ID NO: 142898 - DNA, 25 bp, E. coli
taaccagcaagcagtgtacgtcgca

SEQ ID NO: 142899 - DNA, 25 bp, E. coli
caacttagtgggatgtccgtcttca

SEQ ID NO: 142900 - DNA, 25 bp, E. coli
caacttagtgggttgtccgtcttca

SEQ ID NO: 142901 - DNA, 25 bp, E. coli
caccgtgctgatgtctgatgcgacg

SEQ ID NO: 142902 - DNA, 25 bp, E. coli
caccgtgctgatctctgatgcgacg

SEQ ID NO: 142903 - DNA, 25 bp, E. coli
caggcaccgtgcagatgtctgatgc

SEQ ID NO: 142904 - DNA, 25 bp, E. coli
caggcaccgtgctgatgtctgatgc

SEQ ID NO: 142905 - DNA, 25 bp, E. coli
tttatgcactatctaggccggataa

SEQ ID NO: 142906 - DNA, 25 bp, E. coli
tgggataacaatgccatcaagtgaa

SEQ ID NO: 142907 - DNA, 25 bp, E. coli
tgtctgcggcatgggataacaatgc

SEQ ID NO: 142908 - DNA, 25 bp, E. coli
tgggataacaatcccatcaagtgaa

SEQ ID NO: 142909 - DNA, 25 bp, E. coli
tgtctgcggcatcggataacaatgc

SEQ ID NO: 142910 - DNA, 25 bp, E. coli
tccggcacaggctccgtgctgatgt

SEQ ID NO: 142911 - DNA, 25 bp, E. coli
tccggcacaggcaccgtgctgatgt

SEQ ID NO: 142912 - DNA, 25 bp, E. coli
gccatcaagtgattttatatgcaat

SEQ ID NO: 142913 - DNA, 25 bp, E. coli
gccatcaagtgaatttatatgcaat

SEQ ID NO: 142914 - DNA, 25 bp, E. coli
gaatttatgcactatgtaggccgga

SEQ ID NO: 142915 - DNA, 25 bp, E. coli
gaatttatgcacaatgtaggccgga

SEQ ID NO: 142916 - DNA, 25 bp, E. coli
ccgtcttcattataagaatttatgc

SEQ ID NO: 142917 - DNA, 25 bp, E. coli
ccgtcttcattaaaagaatttatgc

SEQ ID NO: 142918 - DNA, 25 bp, E. coli
gtgggttgtccgtcttcattataag

SEQ ID NO: 142919 - DNA, 25 bp, E. coli
gtgggttgtccgacttcattataag

SEQ ID NO: 142920 - DNA, 25 bp, E. coli
tttatgcactatgtaggccggataa

SEQ ID NO: 142921 - DNA, 25 bp, E. coli
cacatggagagattacatgttttcg

SEQ ID NO: 142922 - DNA, 25 bp, E. coli
cacatggagagaatacatgttttcg

SEQ ID NO: 142923 - DNA, 25 bp, E. coli
catttgcagaagttaagatcagaga

SEQ ID NO: 142924 - DNA, 25 bp, E. coli
taaaaatagcagataacatttgcag

SEQ ID NO: 142925 - DNA, 25 bp, E. coli
taaaaatagcagttaacatttgcag

SEQ ID NO: 142926 - DNA, 25 bp, E. coli
tatggcgcagcattagttagatgac

SEQ ID NO: 142927 - DNA, 25 bp, E. coli
tatggcgcagcaatagttagatgac

SEQ ID NO: 142928 - DNA, 25 bp, E. coli
tcagagaaaattattaccctgtagg

SEQ ID NO: 142929 - DNA, 25 bp, E. coli
tcagagaaaatttttaccctgtagg

SEQ ID NO: 142930 - DNA, 25 bp, E. coli
tccacataaataaaacaacgggcgt

SEQ ID NO: 142931 - DNA, 25 bp, E. coli
tccacataaatataacaacgggcgt

SEQ ID NO: 142932 - DNA, 25 bp, E. coli
gcatataactcaatagcccttagca

SEQ ID NO: 142933 - DNA, 25 bp, E. coli
gcatataactcattagcccttagca

SEQ ID NO: 142934 - DNA, 25 bp, E. coli
cgtttcaatattaaacacatggaga

SEQ ID NO: 142935 - DNA, 25 bp, E. coli
cgtttcaatatttaacacatggaga

SEQ ID NO: 142936 - DNA, 25 bp, E. coli
catttgcagaagataagatcagaga

SEQ ID NO: 142937 - DNA, 25 bp, E. coli
tagggtattacgacttaaatgtgac

SEQ ID NO: 142938 - DNA, 25 bp, E. coli
tagggtattacgtcttaaatgtgac

SEQ ID NO: 142939 - DNA, 25 bp, E. coli
gatgactaaatcctaactatctgac

SEQ ID NO: 142940 - DNA, 25 bp, E. coli
gggcgtgttataggcccgtttcaat

SEQ ID NO: 142941 - DNA, 25 bp, E. coli
gggcgtgttatacgcccgtttcaat

SEQ ID NO: 142942 - DNA, 25 bp, E. coli
gatgactaaatcgtaactatctgac

SEQ ID NO: 142943 - DNA, 25 bp, E. coli
caaagtgctggttgaaaacccggag

SEQ ID NO: 142944 - DNA, 25 bp, E. coli
caaaagcgtggagctggcgcgtaaa

SEQ ID NO: 142945 - DNA, 25 bp, E. coli
caaaagcgtggacctggcgcgtaaa

SEQ ID NO: 142946 - DNA, 25 bp, E. coli
caaagtgctggtagaaaacccggag

SEQ ID NO: 142947 - DNA, 25 bp, E. coli
tacgatgccgtgagcaaaacctggc

SEQ ID NO: 142948 - DNA, 25 bp, E. coli
taaagcccgtgatgcgtatctggca

SEQ ID NO: 142949 - DNA, 25 bp, E. coli
taaagcccgtgaagcgtatctggca

SEQ ID NO: 142950 - DNA, 25 bp, E. coli
tacgatgccgtgtgcaaaacctggc

SEQ ID NO: 142951 - DNA, 25 bp, E. coli
tttttccgagattgaggcgttggcc

SEQ ID NO: 142952 - DNA, 25 bp, E. coli
tttttccgagatagaggcgttggcc

SEQ ID NO: 142953 - DNA, 25 bp, E. coli
tgtattgcgctgcaaaacaccaccg

SEQ ID NO: 142954 - DNA, 25 bp, E. coli
tgtattgcgctggaaaacaccaccg

SEQ ID NO: 142955 - DNA, 25 bp, E. coli
tgtaacttagccgacagcctgtggt

SEQ ID NO: 142956 - DNA, 25 bp, E. coli
tgtaacttagcccacagcctgtggt

SEQ ID NO: 142957 - DNA, 25 bp, E. coli
tgcatcttgatttctaccgggcggg

SEQ ID NO: 142958 - DNA, 25 bp, E. coli
tgcatcttgattactaccgggcggg

SEQ ID NO: 142959 - DNA, 25 bp, E. coli
tcatcacggtgaacattgcgcgcag

SEQ ID NO: 142960 - DNA, 25 bp, E. coli
tcatcacggtgatcattgcgcgcag

SEQ ID NO: 142961 - DNA, 25 bp, E. coli
gatcactgccaggtatcaggcgacg

SEQ ID NO: 142962 - DNA, 25 bp, E. coli
gatcactgccagctatcaggcgacg

SEQ ID NO: 142963 - DNA, 25 bp, E. coli
ggatggctctgaataccgtggcgat

SEQ ID NO: 142964 - DNA, 25 bp, E. coli
ggatggctctgattaccgtggcgat

SEQ ID NO: 142965 - DNA, 25 bp, E. coli
caactaaaattcaggagcacttagc

SEQ ID NO: 142966 - DNA, 25 bp, E. coli
caaacaaggttgctcgatatctcta

SEQ ID NO: 142967 - DNA, 25 bp, E. coli
caactaaaattctggagcacttagc

SEQ ID NO: 142968 - DNA, 25 bp, E. coli
caaacaaggttggtcgatatctcta

SEQ ID NO: 142969 - DNA, 25 bp, E. coli
gcagaaatgctttacttacccattg

SEQ ID NO: 142970 - DNA, 25 bp, E. coli
gcagaaatgcttaacttacccattg

SEQ ID NO: 142971 - DNA, 25 bp, E. coli
ataacctgctgcaatccgaacccgg

SEQ ID NO: 142972 - DNA, 25 bp, E. coli
ataacctgctgctatccgaacccgg

SEQ ID NO: 142973 - DNA, 25 bp, E. coli
tattgagaattatcctgaagcaggg

SEQ ID NO: 142974 - DNA, 25 bp, E. coli
tattgagaattaacctgaagcaggg

SEQ ID NO: 142975 - DNA, 25 bp, E. coli
tgctggcaagaggtaagactaactt

SEQ ID NO: 142976 - DNA, 25 bp, E. coli
tgctggcaagagctaagactaactt

SEQ ID NO: 142977 - DNA, 25 bp, E. coli
tgtttcccgaggcttctcaactaaa

SEQ ID NO: 142978 - DNA, 25 bp, E. coli
cctataagcgagtttgccagagaaa

SEQ ID NO: 142979 - DNA, 25 bp, E. coli
cctataagcgagattgccagagaaa

SEQ ID NO: 142980 - DNA, 25 bp, E. coli
ccaaagtatactggacgatgtgagg

SEQ ID NO: 142981 - DNA, 25 bp, E. coli
ccaaagtatactcgacgatgtgagg

SEQ ID NO: 142982 - DNA, 25 bp, E. coli
tgtttcccgagggttctcaactaaa

SEQ ID NO: 142983 - DNA, 25 bp, E. coli
gtttctacattagatcgccgtctag

SEQ ID NO: 142984 - DNA, 25 bp, E. coli
gtttctacattacatcgccgtctag

SEQ ID NO: 142985 - DNA, 25 bp, E. coli
ggcgttctactttcgttaggagtga

SEQ ID NO: 142986 - DNA, 25 bp, E. coli
ggcgttctacttacgttaggagtga

SEQ ID NO: 142987 - DNA, 25 bp, E. coli
aagtggctgaactgctgcccgtcga

SEQ ID NO: 142988 - DNA, 25 bp, E. coli
aagtggctgaacagctgcccgtcga

SEQ ID NO: 142989 - DNA, 25 bp, E. coli
aaagcagatcaggagtcagcgggct

SEQ ID NO: 142990 - DNA, 25 bp, E. coli
aaagcagatcagcagtcagcgggct

SEQ ID NO: 142991 - DNA, 25 bp, E. coli
tatgacacctattccggaaagcaga

SEQ ID NO: 142992 - DNA, 25 bp, E. coli
tatgacacctataccggaaagcaga

SEQ ID NO: 142993 - DNA, 25 bp, E. coli
tttttcctgcgtgagagtgctggca

SEQ ID NO: 142994 - DNA, 25 bp, E. coli
tttcaacgaaaaagtgacgcaccgg

SEQ ID NO: 142995 - DNA, 25 bp, E. coli
tttcaacgaaaatgtgacgcaccgg

SEQ ID NO: 142996 - DNA, 25 bp, E. coli
tttttcctgcgtcagagtgctggca

SEQ ID NO: 142997 - DNA, 25 bp, E. coli
tcccaatggctatatgacgccgcag

SEQ ID NO: 142998 - DNA, 25 bp, E. coli
tcccaatggctaaatgacgccgcag

SEQ ID NO: 142999 - DNA, 25 bp, E. coli
tctgtatcacctcaacggcagcctg

SEQ ID NO: 143000 - DNA, 25 bp, E. coli
tctgtatcacctgaacggcagcctg

SEQ ID NO: 143001 - DNA, 25 bp, E. coli
gccatcgggctgtcgtatgacacct

SEQ ID NO: 143002 - DNA, 25 bp, E. coli
gccatcgggctgacgtatgacacct

SEQ ID NO: 143003 - DNA, 25 bp, E. coli
ggctatgcgactgacggcggttttt

SEQ ID NO: 143004 - DNA, 25 bp, E. coli
ggcgaacgtctggataaactgatct

SEQ ID NO: 143005 - DNA, 25 bp, E. coli
ggctatgcgactcacggcggttttt

SEQ ID NO: 143006 - DNA, 25 bp, E. coli
ggcgaacgtctgcataaactgatct

SEQ ID NO: 143007 - DNA, 25 bp, E. coli
gatcccggctgtctggtatatgcgc

SEQ ID NO: 143008 - DNA, 25 bp, E. coli
gatcccggctgtgtggtatatgcgc

SEQ ID NO: 143009 - DNA, 25 bp, E. coli
aattatcttgcccaaaaatcaggca

SEQ ID NO: 143010 - DNA, 25 bp, E. coli
aattatcttgccgaaaaatcaggca

SEQ ID NO: 143011 - DNA, 25 bp, E. coli
caacaaatgttaacagatagcatta

SEQ ID NO: 143012 - DNA, 25 bp, E. coli
caacaaatgttatcagatagcatta

SEQ ID NO: 143013 - DNA, 25 bp, E. coli
atttgatttagatcgcaatttgcga

SEQ ID NO: 143014 - DNA, 25 bp, E. coli
atttgatttagaacgcaatttgcga

SEQ ID NO: 143015 - DNA, 25 bp, E. coli
ttcgcgtcctgtccaggttatatgg

SEQ ID NO: 143016 - DNA, 25 bp, E. coli
ttcgcgtcctgtgcaggttatatgg

SEQ ID NO: 143017 - DNA, 25 bp, E. coli
tatggttgttaagttcttgtcagag

SEQ ID NO: 143018 - DNA, 25 bp, E. coli
tatggttgttaacttcttgtcagag

SEQ ID NO: 143019 - DNA, 25 bp, E. coli
tatacgaaaacgataattatcttgc

SEQ ID NO: 143020 - DNA, 25 bp, E. coli
tatacgaaaacgttaattatcttgc

SEQ ID NO: 143021 - DNA, 25 bp, E. coli
ttcactctgttagtatacgaaaacg

SEQ ID NO: 143022 - DNA, 25 bp, E. coli
ttcactctgttactatacgaaaacg

SEQ ID NO: 143023 - DNA, 25 bp, E. coli
tcgcaatttgcgttttaaacacaaa

SEQ ID NO: 143024 - DNA, 25 bp, E. coli
tcgcaatttgcgatttaaacacaaa

SEQ ID NO: 143025 - DNA, 25 bp, E. coli
gctgcggttatcattaaccgattaa

SEQ ID NO: 143026 - DNA, 25 bp, E. coli
gctgcggttatctttaaccgattaa

SEQ ID NO: 143027 - DNA, 25 bp, E. coli
cttcttgtcagactttatgtcggcc

SEQ ID NO: 143028 - DNA, 25 bp, E. coli
cttcttgtcagagtttatgtcggcc

SEQ ID NO: 143029 - DNA, 25 bp, E. coli
tgtcggccccgctgcggttatcttt

SEQ ID NO: 143030 - DNA, 25 bp, E. coli
tgtcggccccgcagcggttatcttt

SEQ ID NO: 143031 - DNA, 25 bp, E. coli
ttggctctggctgtggctctggctc

SEQ ID NO: 143032 - DNA, 25 bp, E. coli
ttggctctggctctggctctggctc

SEQ ID NO: 143033 - DNA, 25 bp, E. coli
tctggctctggcactggctctggca

SEQ ID NO: 143034 - DNA, 25 bp, E. coli
tctggctctggcactggctctggct

SEQ ID NO: 143035 - DNA, 25 bp, E. coli
tctggctctggcactggcaaaggag

SEQ ID NO: 143036 - DNA, 25 bp, E. coli
tctggctctggctctggctctggca

SEQ ID NO: 143037 - DNA, 25 bp, E. coli
tctggctctggcaaaggagaactaa

SEQ ID NO: 143038 - DNA, 25 bp, E. coli
tctggctctggctctggcaaaggag

SEQ ID NO: 143039 - DNA, 25 bp, E. coli
tctggctctggctctggctctggct

SEQ ID NO: 143040 - DNA, 25 bp, E. coli
tctggctctggctaaggagaactaa

SEQ ID NO: 143041 - DNA, 25 bp, E. coli
ctctggctctggcaaaggagaacta

SEQ ID NO: 143042 - DNA, 25 bp, E. coli
ctctggctctgggtctggcaaagga

SEQ ID NO: 143043 - DNA, 25 bp, E. coli
ctctggctctggctctggcaaagga

SEQ ID NO: 143044 - DNA, 25 bp, E. coli
ctctggctctgggaaaggagaacta

SEQ ID NO: 143045 - DNA, 25 bp, E. coli
tggctctggctctggctctggcaaa

SEQ ID NO: 143046 - DNA, 25 bp, E. coli
tggctctggctctggcaaaggagaa

SEQ ID NO: 143047 - DNA, 25 bp, E. coli
ggctctggctctcgcaaaggagaac

SEQ ID NO: 143048 - DNA, 25 bp, E. coli
ggctctggctctggcaaaggagaac

SEQ ID NO: 143049 - DNA, 25 bp, E. coli
ggctctggctctcgctctggctctg

SEQ ID NO: 143050 - DNA, 25 bp, E. coli
tggctctggctcaggcaaaggagaa

SEQ ID NO: 143051 - DNA, 25 bp, E. coli
ggctctggctctggctctggctctg

SEQ ID NO: 143052 - DNA, 25 bp, E. coli
tggctctggctcaggctctggcaaa

SEQ ID NO: 143053 - DNA, 25 bp, E. coli
caaagctgccgttgcgggtatcgca

SEQ ID NO: 143054 - DNA, 25 bp, E. coli
caaagctgccgtagcgggtatcgca

SEQ ID NO: 143055 - DNA, 25 bp, E. coli
tatggttagcatggatgacaccgcg

SEQ ID NO: 143056 - DNA, 25 bp, E. coli
tatggttagcatcgatgacaccgcg

SEQ ID NO: 143057 - DNA, 25 bp, E. coli
ttttgggcgacgtagatcacctggg

SEQ ID NO: 143058 - DNA, 25 bp, E. coli
ttttgggcgacgaagatcacctggg

SEQ ID NO: 143059 - DNA, 25 bp, E. coli
tgactctggaaagcggcatgatggc

SEQ ID NO: 143060 - DNA, 25 bp, E. coli
tgactctggaaaccggcatgatggc

SEQ ID NO: 143061 - DNA, 25 bp, E. coli
tgaaccaggctaaaggtgcgcgtct

SEQ ID NO: 143062 - DNA, 25 bp, E. coli
tgaaccaggctataggtgcgcgtct

SEQ ID NO: 143063 - DNA, 25 bp, E. coli
tccgtaggcgaatccggcatggtcg

SEQ ID NO: 143064 - DNA, 25 bp, E. coli
tccgtaggcgaaaccggcatggtcg

SEQ ID NO: 143065 - DNA, 25 bp, E. coli
tcacctgggcgaaatggacttcaaa

SEQ ID NO: 143066 - DNA, 25 bp, E. coli
tcacctgggcgatatggacttcaaa

SEQ ID NO: 143067 - DNA, 25 bp, E. coli
gcttgctgaagaggaaaccctggac

SEQ ID NO: 143068 - DNA, 25 bp, E. coli
gcttgctgaagacgaaaccctggac

SEQ ID NO: 143069 - DNA, 25 bp, E. coli
gaagttcaggttatcgccaccgtgg

SEQ ID NO: 143070 - DNA, 25 bp, E. coli
gaagttcaggttttcgccaccgtgg

SEQ ID NO: 143071 - DNA, 25 bp, E. coli
gaactgatgggccaacgtaccgata

SEQ ID NO: 143072 - DNA, 25 bp, E. coli
gaaagtgaccgaatacctgcagatg

SEQ ID NO: 143073 - DNA, 25 bp, E. coli
gaaagtgaccgattacctgcagatg

SEQ ID NO: 143074 - DNA, 25 bp, E. coli
gaactgatgggcgaacgtaccgata

SEQ ID NO: 143075 - DNA, 25 bp, E. coli
cagcagggcggtattttctccatcg

SEQ ID NO: 143076 - DNA, 25 bp, E. coli
catgaactatttgcagcagcaggct

SEQ ID NO: 143077 - DNA, 25 bp, E. coli
cagcagggcggttttttctccatcg

SEQ ID NO: 143078 - DNA, 25 bp, E. coli
catgaactatttccagcagcaggct

SEQ ID NO: 143079 - DNA, 25 bp, E. coli
tacgaagtggtactgcgtgttaccg

SEQ ID NO: 143080 - DNA, 25 bp, E. coli
taaacttgatctggatacggcatct

SEQ ID NO: 143081 - DNA, 25 bp, E. coli
taaacttgatctcgatacggcatct

SEQ ID NO: 143082 - DNA, 25 bp, E. coli
accagcatggtatcccgcggtacat

SEQ ID NO: 143083 - DNA, 25 bp, E. coli
accagcatggtaacccgcggtacat

SEQ ID NO: 143084 - DNA, 25 bp, E. coli
tacgaagtggtagtgcgtgttaccg

SEQ ID NO: 143085 - DNA, 25 bp, E. coli
tctccatcgcggctatcgaaggcac

SEQ ID NO: 143086 - DNA, 25 bp, E. coli
tctccatcgcgggtatcgaaggcac

SEQ ID NO: 143087 - DNA, 25 bp, E. coli
gctggcgaaggtactgaagaacatc

SEQ ID NO: 143088 - DNA, 25 bp, E. coli
gctggcgaaggttctgaagaacatc

SEQ ID NO: 143089 - DNA, 25 bp, E. coli
gaagaaaccgcgttcctgtgtgaag

SEQ ID NO: 143090 - DNA, 25 bp, E. coli
gaagaaaccgcgatcctgtgtgaag

SEQ ID NO: 143091 - DNA, 25 bp, E. coli
gaaatgactttccagatccaacgta

SEQ ID NO: 143092 - DNA, 25 bp, E. coli
gaaatgactttcgagatccaacgta

SEQ ID NO: 143093 - DNA, 25 bp, E. coli
cgcgccgcacgttttccagaaagat

SEQ ID NO: 143094 - DNA, 25 bp, E. coli
cgcgccgcacgtattccagaaagat

SEQ ID NO: 143095 - DNA, 25 bp, E. coli
ccggttaacttcgatgcgctgttca

SEQ ID NO: 143096 - DNA, 25 bp, E. coli
ccggttaacttccatgcgctgttca

SEQ ID NO: 143097 - DNA, 25 bp, E. coli
catatgtccatataggaatcgttaa

SEQ ID NO: 143098 - DNA, 25 bp, E. coli
catatgtccataaaggaatcgttaa

SEQ ID NO: 143099 - DNA, 25 bp, E. coli
tttgaagttgcatatgtccataaag

SEQ ID NO: 143100 - DNA, 25 bp, E. coli
tattttgaagttccatatgtccata

SEQ ID NO: 143101 - DNA, 25 bp, E. coli
tattttgaagttgcatatgtccata

SEQ ID NO: 143102 - DNA, 25 bp, E. coli
tttgaagttgcaaatgtccataaag

SEQ ID NO: 143103 - DNA, 25 bp, E. coli
tgaagttgcataagtccataaagga

SEQ ID NO: 143104 - DNA, 25 bp, E. coli
tgcatatgtccaaaaaggaatcgtt

SEQ ID NO: 143105 - DNA, 25 bp, E. coli
tgcatatgtccataaaggaatcgtt

SEQ ID NO: 143106 - DNA, 25 bp, E. coli
tgaagttgcatatgtccataaagga

SEQ ID NO: 143107 - DNA, 25 bp, E. coli
gcatatgtccataaaggaatcgtta

SEQ ID NO: 143108 - DNA, 25 bp, E. coli
gcatatgtccattaaggaatcgtta

SEQ ID NO: 143109 - DNA, 25 bp, E. coli
gaagttgcatatctccataaaggaa

SEQ ID NO: 143110 - DNA, 25 bp, E. coli
gaagttgcatatgtccataaaggaa

SEQ ID NO: 143111 - DNA, 25 bp, E. coli
gactattttgaacttgcatatgtcc

SEQ ID NO: 143112 - DNA, 25 bp, E. coli
gactattttgaagttgcatatgtcc

SEQ ID NO: 143113 - DNA, 25 bp, E. coli
gttgcatatgtccataaaggaatcg

SEQ ID NO: 143114 - DNA, 25 bp, E. coli
gttgcatatgtcgataaaggaatcg

SEQ ID NO: 143115 - DNA, 25 bp, E. coli
taacatgttttggacaggaccatag

SEQ ID NO: 143116 - DNA, 25 bp, E. coli
taacatgttttgcacaggaccatag

SEQ ID NO: 143117 - DNA, 25 bp, E. coli
gatcttactcttctgactattttga

SEQ ID NO: 143118 - DNA, 25 bp, E. coli
gatcttactcttgtgactattttga

SEQ ID NO: 143119 - DNA, 25 bp, E. coli
aaaggcgtgccggttgtcatgaaag

SEQ ID NO: 143120 - DNA, 25 bp, E. coli
aaaggcgtgccgcttgtcatgaaag

SEQ ID NO: 143121 - DNA, 25 bp, E. coli
tgtcatggcagctggcttcccgcag

SEQ ID NO: 143122 - DNA, 25 bp, E. coli
tgtcatggcagcaggcttcccgcag

SEQ ID NO: 143123 - DNA, 25 bp, E. coli
tgccggttgtcaagaaagatatcaa

SEQ ID NO: 143124 - DNA, 25 bp, E. coli
tgccggttgtcatgaaagatatcaa

SEQ ID NO: 143125 - DNA, 25 bp, E. coli
gcgtgccggttgacatgaaagatat

SEQ ID NO: 143126 - DNA, 25 bp, E. coli
gcgtgccggttgtcatgaaagatat

SEQ ID NO: 143127 - DNA, 25 bp, E. coli
ccggttgtcatgtaagatatcaacg

SEQ ID NO: 143128 - DNA, 25 bp, E. coli
ccggttgtcatgaaagatatcaacg

SEQ ID NO: 143129 - DNA, 25 bp, E. coli
cgtgccggttgtgatgaaagatatc

SEQ ID NO: 143130 - DNA, 25 bp, E. coli
cgtgccggttgtcatgaaagatatc

SEQ ID NO: 143131 - DNA, 25 bp, E. coli
gtgccggttgtcttgaaagatatca

SEQ ID NO: 143132 - DNA, 25 bp, E. coli
ggttgtcatgaaagatatcaacgac

SEQ ID NO: 143133 - DNA, 25 bp, E. coli
gtcatgaaagatttcaacgacaagt

SEQ ID NO: 143134 - DNA, 25 bp, E. coli
ggttgtcatgaatgatatcaacgac

SEQ ID NO: 143135 - DNA, 25 bp, E. coli
gtcatgaaagatatcaacgacaagt

SEQ ID NO: 143136 - DNA, 25 bp, E. coli
ggctgtcatggcagcaggcttcccg

SEQ ID NO: 143137 - DNA, 25 bp, E. coli
ggctgtcatggctgcaggcttcccg

SEQ ID NO: 143138 - DNA, 25 bp, E. coli
ggcgtgccggttctcatgaaagata

SEQ ID NO: 143139 - DNA, 25 bp, E. coli
ggcgtgccggttgtcatgaaagata

SEQ ID NO: 143140 - DNA, 25 bp, E. coli
gtgccggttgtcatgaaagatatca

SEQ ID NO: 143141 - DNA, 25 bp, E. coli
caaggtgttccaggcaagtttcgcg

SEQ ID NO: 143142 - DNA, 25 bp, E. coli
caaggtgttccacgcaagtttcgcg

SEQ ID NO: 143143 - DNA, 25 bp, E. coli
cactacaagctatatcggaatggga

SEQ ID NO: 143144 - DNA, 25 bp, E. coli
cactacaagctaaatcggaatggga

SEQ ID NO: 143145 - DNA, 25 bp, E. coli
tacatacgctggagtgcatcagaaa

SEQ ID NO: 143146 - DNA, 25 bp, E. coli
tacatacgctggtgtgcatcagaaa

SEQ ID NO: 143147 - DNA, 25 bp, E. coli
tttaaaaggaaaccgacctcaggcg

SEQ ID NO: 143148 - DNA, 25 bp, E. coli
tttaaaaggaaagcgacctcaggcg

SEQ ID NO: 143149 - DNA, 25 bp, E. coli
aaatcaatcaggtagttcacccgcg

SEQ ID NO: 143150 - DNA, 25 bp, E. coli
aaatcaatcaggaagttcacccgcg

SEQ ID NO: 143151 - DNA, 25 bp, E. coli
gctaccgtgaaaccaacaacctgta

SEQ ID NO: 143152 - DNA, 25 bp, E. coli
gctggattgatacaaccctgacagg

SEQ ID NO: 143153 - DNA, 25 bp, E. coli
gctaccgtgaaagcaacaacctgta

SEQ ID NO: 143154 - DNA, 25 bp, E. coli
gctggattgatagaaccctgacagg

SEQ ID NO: 143155 - DNA, 25 bp, E. coli
gacttgagatgactgtcgcactgcg

SEQ ID NO: 143156 - DNA, 25 bp, E. coli
gacttgagatgagtgtcgcactgcg

SEQ ID NO: 143157 - DNA, 25 bp, E. coli
gggactattgttatcgccttcggta

SEQ ID NO: 143158 - DNA, 25 bp, E. coli
gggactattgttttcgccttcggta

SEQ ID NO: 143159 - DNA, 25 bp, E. coli
taatgtcgatttaaccgctaccgtg

SEQ ID NO: 143160 - DNA, 25 bp, E. coli
taatgtcgattttaccgctaccgtg

SEQ ID NO: 143161 - DNA, 25 bp, E. coli
tcagaaattagctccgatggacttg

SEQ ID NO: 143162 - DNA, 25 bp, E. coli
tcagaaattagcaccgatggacttg

SEQ ID NO: 143163 - DNA, 25 bp, E. coli
caatcagtcgtcatttgagcgagca

SEQ ID NO: 143164 - DNA, 25 bp, E. coli
caatcagtcgtcttttgagcgagca

SEQ ID NO: 143165 - DNA, 25 bp, E. coli
agagtgcgacctggcgatgttaccg

SEQ ID NO: 143166 - DNA, 25 bp, E. coli
agagtgcgacctcgcgatgttaccg

SEQ ID NO: 143167 - DNA, 25 bp, E. coli
aactgcctggcgcagaagtccatgc

SEQ ID NO: 143168 - DNA, 25 bp, E. coli
aacacctggcaacgtcgctggtcaa

SEQ ID NO: 143169 - DNA, 25 bp, E. coli
aacacctggcaaggtcgctggtcaa

SEQ ID NO: 143170 - DNA, 25 bp, E. coli
aactgcctggcggagaagtccatgc

SEQ ID NO: 143171 - DNA, 25 bp, E. coli
taggtgaaggcgtaatcgaactgcg

SEQ ID NO: 143172 - DNA, 25 bp, E. coli
taggtgaaggcgaaatcgaactgcg

SEQ ID NO: 143173 - DNA, 25 bp, E. coli
tcgtcgagcataatcagcagcgtct

SEQ ID NO: 143174 - DNA, 25 bp, E. coli
tcgtcgagcatattcagcagcgtct

SEQ ID NO: 143175 - DNA, 25 bp, E. coli
gcgtttacatcaatggagcgaccaa

SEQ ID NO: 143176 - DNA, 25 bp, E. coli
gcgatttatggtccggcaactgtgc

SEQ ID NO: 143177 - DNA, 25 bp, E. coli
gcgatttatggtgcggcaactgtgc

SEQ ID NO: 143178 - DNA, 25 bp, E. coli
gcgtttacatcattggagcgaccaa

SEQ ID NO: 143179 - DNA, 25 bp, E. coli
gaacagccgccacaaatctatgacg

SEQ ID NO: 143180 - DNA, 25 bp, E. coli
gaacagccgccagaaatctatgacg

SEQ ID NO: 143181 - DNA, 25 bp, E. coli
ggatggcccgtacattttcgacccg

SEQ ID NO: 143182 - DNA, 25 bp, E. coli
ggatggcccgtagattttcgacccg

SEQ ID NO: 143183 - DNA, 25 bp, E. coli
tgtcgcgtagtataaccgtcaccgt

SEQ ID NO: 143184 - DNA, 25 bp, E. coli
tgtcgcgtagtaaaaccgtcaccgt

SEQ ID NO: 143185 - DNA, 25 bp, E. coli
catttgtgatccagcgcgtgttaat

SEQ ID NO: 143186 - DNA, 25 bp, E. coli
catttgtgatcctgcgcgtgttaat

SEQ ID NO: 143187 - DNA, 25 bp, E. coli
tacacagcagttcttaaaacgataa

SEQ ID NO: 143188 - DNA, 25 bp, E. coli
tacacagcagttgttaaaacgataa

SEQ ID NO: 143189 - DNA, 25 bp, E. coli
tatggtcaggctcgcgaactaagcg

SEQ ID NO: 143190 - DNA, 25 bp, E. coli
tatggtcaggctggcgaactaagcg

SEQ ID NO: 143191 - DNA, 25 bp, E. coli
tccgcttatgtatacaatctttggt

SEQ ID NO: 143192 - DNA, 25 bp, E. coli
tccgcttatgtaaacaatctttggt

SEQ ID NO: 143193 - DNA, 25 bp, E. coli
tcatttggctgaggctttgtagcgg

SEQ ID NO: 143194 - DNA, 25 bp, E. coli
tcatttggctgacgctttgtagcgg

SEQ ID NO: 143195 - DNA, 25 bp, E. coli
gcgccttgctatcggtcacaatggg

SEQ ID NO: 143196 - DNA, 25 bp, E. coli
gcgccttgctatgggtcacaatggg

SEQ ID NO: 143197 - DNA, 25 bp, E. coli
gctttgtagcggtcatgcggttaat

SEQ ID NO: 143198 - DNA, 25 bp, E. coli
gctttgtagcggacatgcggttaat

SEQ ID NO: 143199 - DNA, 25 bp, E. coli
gaaacaattcttatggtcaggctgg

SEQ ID NO: 143200 - DNA, 25 bp, E. coli
gaactaagcgccttgctatgggtca

SEQ ID NO: 143201 - DNA, 25 bp, E. coli
gaactaagcgccatgctatgggtca

SEQ ID NO: 143202 - DNA, 25 bp, E. coli
gaaacaattcttttggtcaggctgg

SEQ ID NO: 143203 - DNA, 25 bp, E. coli
cggtcatgcggttaatacacagcag

SEQ ID NO: 143204 - DNA, 25 bp, E. coli
cggtcatgcggtaaatacacagcag

SEQ ID NO: 143205 - DNA, 25 bp, E. coli
gatcctgcgcgtcttaatccgctta

SEQ ID NO: 143206 - DNA, 25 bp, E. coli
gatcctgcgcgtgttaatccgctta

SEQ ID NO: 143207 - DNA, 25 bp, E. coli
caactccgaagtggtgctggtggca

SEQ ID NO: 143208 - DNA, 25 bp, E. coli
caactccgaagtcgtgctggtggca

SEQ ID NO: 143209 - DNA, 25 bp, E. coli
tacgctatgttgcagttgcagcagc

SEQ ID NO: 143210 - DNA, 25 bp, E. coli
tacgctatgttggagttgcagcagc

SEQ ID NO: 143211 - DNA, 25 bp, E. coli
tattattaagctggatgcccgtggt

SEQ ID NO: 143212 - DNA, 25 bp, E. coli
tattattaagctcgatgcccgtggt

SEQ ID NO: 143213 - DNA, 25 bp, E. coli
tgtttgccagtacttttctcagcgc

SEQ ID NO: 143214 - DNA, 25 bp, E. coli
tgtgccttggtatagcgttacgcta

SEQ ID NO: 143215 - DNA, 25 bp, E. coli
tgtgccttggtaaagcgttacgcta

SEQ ID NO: 143216 - DNA, 25 bp, E. coli
tgtttgccagtagttttctcagcgc

SEQ ID NO: 143217 - DNA, 25 bp, E. coli
gctaccggctgggtgaaacgctatg

SEQ ID NO: 143218 - DNA, 25 bp, E. coli
gctaccggctggctgaaacgctatg

SEQ ID NO: 143219 - DNA, 25 bp, E. coli
gaaacgctatggagcagtcacgcta

SEQ ID NO: 143220 - DNA, 25 bp, E. coli
gaaacgctatggtgcagtcacgcta

SEQ ID NO: 143221 - DNA, 25 bp, E. coli
cgctggcaagagtaagctaccggct

SEQ ID NO: 143222 - DNA, 25 bp, E. coli
cgatttactgtgactgttagcggga

SEQ ID NO: 143223 - DNA, 25 bp, E. coli
cgatttactgtgtctgttagcggga

SEQ ID NO: 143224 - DNA, 25 bp, E. coli
cgctggcaagagaaagctaccggct

SEQ ID NO: 143225 - DNA, 25 bp, E. coli
cattgcgtaaaagatcgcgctggca

SEQ ID NO: 143226 - DNA, 25 bp, E. coli
cattgcgtaaaacatcgcgctggca

SEQ ID NO: 143227 - DNA, 25 bp, E. coli
tcagcgctacactattacccggcaa

SEQ ID NO: 143228 - DNA, 25 bp, E. coli
tcagcgctacacaattacccggcaa

SEQ ID NO: 143229 - DNA, 25 bp, E. coli
caggctcatcccatcgacataaaaa

SEQ ID NO: 143230 - DNA, 25 bp, E. coli
caggctcatcccttcgacataaaaa

SEQ ID NO: 143231 - DNA, 25 bp, E. coli
taaatattgtcttgagtgagcggtc

SEQ ID NO: 143232 - DNA, 25 bp, E. coli
taaatattgtctagagtgagcggtc

SEQ ID NO: 143233 - DNA, 25 bp, E. coli
aacaccagaaggtctcactttcagg

SEQ ID NO: 143234 - DNA, 25 bp, E. coli
aacaccagaaggactcactttcagg

SEQ ID NO: 143235 - DNA, 25 bp, E. coli
tattctctcagttcaacaattggat

SEQ ID NO: 143236 - DNA, 25 bp, E. coli
tattctctcagtacaacaattggat

SEQ ID NO: 143237 - DNA, 25 bp, E. coli
ttttacaaacgattcaggctcatcc

SEQ ID NO: 143238 - DNA, 25 bp, E. coli
ttttacaaacgaatcaggctcatcc

SEQ ID NO: 143239 - DNA, 25 bp, E. coli
tgagcggtcatatataagcactttc

SEQ ID NO: 143240 - DNA, 25 bp, E. coli
tgagcggtcataaataagcactttc

SEQ ID NO: 143241 - DNA, 25 bp, E. coli
gccgatttatgcatattctctcagt

SEQ ID NO: 143242 - DNA, 25 bp, E. coli
gccgatttatgcttattctctcagt

SEQ ID NO: 143243 - DNA, 25 bp, E. coli
gcgggaccattctcaacaccagaag

SEQ ID NO: 143244 - DNA, 25 bp, E. coli
gcgggaccattcacaacaccagaag

SEQ ID NO: 143245 - DNA, 25 bp, E. coli
gaccatccgcctttgcaaaaatttg

SEQ ID NO: 143246 - DNA, 25 bp, E. coli
gaccatccgcctatgcaaaaatttg

SEQ ID NO: 143247 - DNA, 25 bp, E. coli
cgctgaaaacgaccagcgcgggacc

SEQ ID NO: 143248 - DNA, 25 bp, E. coli
cgctgaaaacgagcagcgcgggacc

SEQ ID NO: 143249 - DNA, 25 bp, E. coli
taagcactttctagccgctgaaaac

SEQ ID NO: 143250 - DNA, 25 bp, E. coli
taagcactttcttgccgctgaaaac

SEQ ID NO: 143251 - DNA, 25 bp, E. coli
cacagcccggttatgacgagcaggt

SEQ ID NO: 143252 - DNA, 25 bp, E. coli
cacagcccggttttgacgagcaggt

SEQ ID NO: 143253 - DNA, 25 bp, E. coli
taaagttgcgctcgtgaacgccgaa

SEQ ID NO: 143254 - DNA, 25 bp, E. coli
taaagttgcgctggtgaacgccgaa

SEQ ID NO: 143255 - DNA, 25 bp, E. coli
ttacacgggcgtatggctgcgactc

SEQ ID NO: 143256 - DNA, 25 bp, E. coli
tttacggtggtaaaagatcgcgcgc

SEQ ID NO: 143257 - DNA, 25 bp, E. coli
ttacacgggcgtttggctgcgactc

SEQ ID NO: 143258 - DNA, 25 bp, E. coli
ttgcatgggccacctacaaggacac

SEQ ID NO: 143259 - DNA, 25 bp, E. coli
ttgcatgggccagctacaaggacac

SEQ ID NO: 143260 - DNA, 25 bp, E. coli
tttacggtggtataagatcgcgcgc

SEQ ID NO: 143261 - DNA, 25 bp, E. coli
gcagagcaaaggctacagaagcgtt

SEQ ID NO: 143262 - DNA, 25 bp, E. coli
gcagagcaaagggtacagaagcgtt

SEQ ID NO: 143263 - DNA, 25 bp, E. coli
gacttagctacattggcacgccctg

SEQ ID NO: 143264 - DNA, 25 bp, E. coli
gacttagctacaatggcacgccctg

SEQ ID NO: 143265 - DNA, 25 bp, E. coli
gactaatcatggattcacccgccag

SEQ ID NO: 143266 - DNA, 25 bp, E. coli
gactaatcatggtttcacccgccag

SEQ ID NO: 143267 - DNA, 25 bp, E. coli
gaaaatctgacggtggaaaggacca

SEQ ID NO: 143268 - DNA, 25 bp, E. coli
gaaaatctgacgctggaaaggacca

SEQ ID NO: 143269 - DNA, 25 bp, E. coli
tcacgttgaatagcgacagtcaggg

SEQ ID NO: 143270 - DNA, 25 bp, E. coli
tcaatggcaaagtacgggaaacacg

SEQ ID NO: 143271 - DNA, 25 bp, E. coli
tcacgttgaataccgacagtcaggg

SEQ ID NO: 143272 - DNA, 25 bp, E. coli
tcaatggcaaagaacgggaaacacg

SEQ ID NO: 143273 - DNA, 25 bp, E. coli
caaaaagttcggttcagggcgatgc

SEQ ID NO: 143274 - DNA, 25 bp, E. coli
caaaaagttcggatcagggcgatgc

SEQ ID NO: 143275 - DNA, 25 bp, E. coli
tatcaaaaagttgggttcagggcga

SEQ ID NO: 143276 - DNA, 25 bp, E. coli
tatcaaaaagttcggttcagggcga

SEQ ID NO: 143277 - DNA, 25 bp, E. coli
agtggctatcaataagttcggttca

SEQ ID NO: 143278 - DNA, 25 bp, E. coli
agtggctatcaaaaagttcggttca

SEQ ID NO: 143279 - DNA, 25 bp, E. coli
aaaagttcggttcagggcgatgcac

SEQ ID NO: 143280 - DNA, 25 bp, E. coli
aaaagttcggttgagggcgatgcac

SEQ ID NO: 143281 - DNA, 25 bp, E. coli
aaaaagttcggtacagggcgatgca

SEQ ID NO: 143282 - DNA, 25 bp, E. coli
aaaaagttcggttcagggcgatgca

SEQ ID NO: 143283 - DNA, 25 bp, E. coli
tgaagtggctatgaaaaagttcggt

SEQ ID NO: 143284 - DNA, 25 bp, E. coli
tgaagtggctatcaaaaagttcggt

SEQ ID NO: 143285 - DNA, 25 bp, E. coli
gctatcaaaaagatcggttcagggc

SEQ ID NO: 143286 - DNA, 25 bp, E. coli
gctatcaaaaagttcggttcagggc

SEQ ID NO: 143287 - DNA, 25 bp, E. coli
gaagtggctatctaaaagttcggtt

SEQ ID NO: 143288 - DNA, 25 bp, E. coli
gaagtggctatcaaaaagttcggtt

SEQ ID NO: 143289 - DNA, 25 bp, E. coli
ctatcaaaaagttcggttcagggcg

SEQ ID NO: 143290 - DNA, 25 bp, E. coli
ctatcaaaaagtacggttcagggcg

SEQ ID NO: 143291 - DNA, 25 bp, E. coli
tggctatcaaaatgttcggttcagg

SEQ ID NO: 143292 - DNA, 25 bp, E. coli
tggctatcaaaaagttcggttcagg

SEQ ID NO: 143293 - DNA, 25 bp, E. coli
tcaaaaagttcgcttcagggcgatg

SEQ ID NO: 143294 - DNA, 25 bp, E. coli
tcaaaaagttcggttcagggcgatg

SEQ ID NO: 143295 - DNA, 25 bp, E. coli
aagtggtcacgggagaagcggatct

SEQ ID NO: 143296 - DNA, 25 bp, E. coli
caaccgggtaatcattttagatcgc

SEQ ID NO: 143297 - DNA, 25 bp, E. coli
caaccgggtaatgattttagatcgc

SEQ ID NO: 143298 - DNA, 25 bp, E. coli
aagtggtcacggcagaagcggatct

SEQ ID NO: 143299 - DNA, 25 bp, E. coli
caatggaaaaagaggtcacgggaga

SEQ ID NO: 143300 - DNA, 25 bp, E. coli
caatggaaaaagtggtcacgggaga

SEQ ID NO: 143301 - DNA, 25 bp, E. coli
aaaccggagacggtacccggcgctg

SEQ ID NO: 143302 - DNA, 25 bp, E. coli
aaaccggagacgctacccggcgctg

SEQ ID NO: 143303 - DNA, 25 bp, E. coli
tacccggcgctgaagcgttttcgat

SEQ ID NO: 143304 - DNA, 25 bp, E. coli
tacccggcgctgtagcgttttcgat

SEQ ID NO: 143305 - DNA, 25 bp, E. coli
gaaaacagcccggagcctgtacgca

SEQ ID NO: 143306 - DNA, 25 bp, E. coli
gaaaacagcccgcagcctgtacgca

SEQ ID NO: 143307 - DNA, 25 bp, E. coli
cgctcggctgtgctgtggcgctgtt

SEQ ID NO: 143308 - DNA, 25 bp, E. coli
cgctcggctgtggtgtggcgctgtt

SEQ ID NO: 143309 - DNA, 25 bp, E. coli
gtgtgtgcacaaaaaaagcggctgc

SEQ ID NO: 143310 - DNA, 25 bp, E. coli
gtgtgtgcacaataaaagcggctgc

SEQ ID NO: 143311 - DNA, 25 bp, E. coli
ggtaatgatttttgatcgcagcgat

SEQ ID NO: 143312 - DNA, 25 bp, E. coli
ggtaatgattttagatcgcagcgat

SEQ ID NO: 143313 - DNA, 25 bp, E. coli
gatgcaatggaataagtggtcacgg

SEQ ID NO: 143314 - DNA, 25 bp, E. coli
gagcctgtacgcaaccgggtaatga

SEQ ID NO: 143315 - DNA, 25 bp, E. coli
gagcctgtacgctaccgggtaatga

SEQ ID NO: 143316 - DNA, 25 bp, E. coli
gatgcaatggaaaaagtggtcacgg

SEQ ID NO: 143317 - DNA, 25 bp, E. coli
aatttctggacgctacgcagctgga

SEQ ID NO: 143318 - DNA, 25 bp, E. coli
aatttctggacggtacgcagctgga

SEQ ID NO: 143319 - DNA, 25 bp, E. coli
caaaggcgtgaatgtcgtggtcgat

SEQ ID NO: 143320 - DNA, 25 bp, E. coli
caaaggcgtgaaagtcgtggtcgat

SEQ ID NO: 143321 - DNA, 25 bp, E. coli
agcctgcaatttgtggacggtacgc

SEQ ID NO: 143322 - DNA, 25 bp, E. coli
agcctgcaatttctggacggtacgc

SEQ ID NO: 143323 - DNA, 25 bp, E. coli
ttgcggcgaaagcttccacgtttga

SEQ ID NO: 143324 - DNA, 25 bp, E. coli
ttgcggcgaaaggttccacgtttga

SEQ ID NO: 143325 - DNA, 25 bp, E. coli
tgtactggaatttgttgacgaaccg

SEQ ID NO: 143326 - DNA, 25 bp, E. coli
tgtggttgcggcgaaagcttccacg

SEQ ID NO: 143327 - DNA, 25 bp, E. coli
tgtggttgcggccaaagcttccacg

SEQ ID NO: 143328 - DNA, 25 bp, E. coli
tgtactggaattagttgacgaaccg

SEQ ID NO: 143329 - DNA, 25 bp, E. coli
tcaggtatggctaatgtactggaat

SEQ ID NO: 143330 - DNA, 25 bp, E. coli
tcgtgtttgaagtcaaaggcgtgaa

SEQ ID NO: 143331 - DNA, 25 bp, E. coli
tcgtgtttgaagacaaaggcgtgaa

SEQ ID NO: 143332 - DNA, 25 bp, E. coli
tcaggtatggcttatgtactggaat

SEQ ID NO: 143333 - DNA, 25 bp, E. coli
gaatttgttgaccaaccgacgccgg

SEQ ID NO: 143334 - DNA, 25 bp, E. coli
gaatttgttgacgaaccgacgccgg

SEQ ID NO: 143335 - DNA, 25 bp, E. coli
cgccggaagacatcgtgtttgaaga

SEQ ID NO: 143336 - DNA, 25 bp, E. coli
cgccggaagacaacgtgtttgaaga

SEQ ID NO: 143337 - DNA, 25 bp, E. coli
tggacggtacgctgctggacttcgt

SEQ ID NO: 143338 - DNA, 25 bp, E. coli
tggacggtacgcagctggacttcgt

SEQ ID NO: 143339 - DNA, 25 bp, E. coli
catacctccgagttgctgaaacaca

SEQ ID NO: 143340 - DNA, 25 bp, E. coli
catacctccgagatgctgaaacaca

SEQ ID NO: 143341 - DNA, 25 bp, E. coli
agattcccgcgtagacgatctccag

SEQ ID NO: 143342 - DNA, 25 bp, E. coli
agcgctgcgcaacaaaagggcctga

SEQ ID NO: 143343 - DNA, 25 bp, E. coli
agattcccgcgttgacgatctccag

SEQ ID NO: 143344 - DNA, 25 bp, E. coli
agcgctgcgcaagaaaagggcctga

SEQ ID NO: 143345 - DNA, 25 bp, E. coli
aaagcgtccgctatgtttcgtctcg

SEQ ID NO: 143346 - DNA, 25 bp, E. coli
aaagcgtccgctttgtttcgtctcg

SEQ ID NO: 143347 - DNA, 25 bp, E. coli
ttttgacagccagcagacgattact

SEQ ID NO: 143348 - DNA, 25 bp, E. coli
ttttgacagccaccagacgattact

SEQ ID NO: 143349 - DNA, 25 bp, E. coli
tgattgttcaggtcaaagcgtccgc

SEQ ID NO: 143350 - DNA, 25 bp, E. coli
tgattgttcaggacaaagcgtccgc

SEQ ID NO: 143351 - DNA, 25 bp, E. coli
tcgtctcggcattaatgaagaaatg

SEQ ID NO: 143352 - DNA, 25 bp, E. coli
tcgtctcggcataaatgaagaaatg

SEQ ID NO: 143353 - DNA, 25 bp, E. coli
ccgcaaatggtttagctggcagaaa

SEQ ID NO: 143354 - DNA, 25 bp, E. coli
ccgcaaatggttaagctggcagaaa

SEQ ID NO: 143355 - DNA, 25 bp, E. coli
ggcactgactcttccgcaaatggtt

SEQ ID NO: 143356 - DNA, 25 bp, E. coli
ggcactgactctaccgcaaatggtt

SEQ ID NO: 143357 - DNA, 25 bp, E. coli
taatcagcctgatgaagcgctgcgc

SEQ ID NO: 143358 - DNA, 25 bp, E. coli
taatcagcctgaagaagcgctgcgc

SEQ ID NO: 143359 - DNA, 25 bp, E. coli
gatctccagcaaattcataccggca

SEQ ID NO: 143360 - DNA, 25 bp, E. coli
gatctccagcaatttcataccggca

SEQ ID NO: 143361 - DNA, 25 bp, E. coli
cactgtgtttgcgaagaggatgcga

SEQ ID NO: 143362 - DNA, 25 bp, E. coli
cactgtgtttgccaagaggatgcga

SEQ ID NO: 143363 - DNA, 25 bp, E. coli
taacaactgctgtaattatacgaat

SEQ ID NO: 143364 - DNA, 25 bp, E. coli
taacaactgctgaaattatacgaat

SEQ ID NO: 143365 - DNA, 25 bp, E. coli
cactatcgggtttgggaaaatatct

SEQ ID NO: 143366 - DNA, 25 bp, E. coli
cactatcgggttagggaaaatatct

SEQ ID NO: 143367 - DNA, 25 bp, E. coli
gaatgcttaatatcaggctgctgaa

SEQ ID NO: 143368 - DNA, 25 bp, E. coli
gaatgcttaataacaggctgctgaa

SEQ ID NO: 143369 - DNA, 25 bp, E. coli
gacagagtcagctgcgtattagttg

SEQ ID NO: 143370 - DNA, 25 bp, E. coli
gacagagtcagcagcgtattagttg

SEQ ID NO: 143371 - DNA, 25 bp, E. coli
cattcaggatgacgcggtaagcttc

SEQ ID NO: 143372 - DNA, 25 bp, E. coli
cattcaggatgaggcggtaagcttc

SEQ ID NO: 143373 - DNA, 25 bp, E. coli
gatattcttgcttcagttgcggtcc

SEQ ID NO: 143374 - DNA, 25 bp, E. coli
gttgcggtccagttaatcattctaa

SEQ ID NO: 143375 - DNA, 25 bp, E. coli
gttgcggtccagataatcattctaa

SEQ ID NO: 143376 - DNA, 25 bp, E. coli
gatattcttgctacagttgcggtcc

SEQ ID NO: 143377 - DNA, 25 bp, E. coli
ggcggtaagcttcatcctgatattc

SEQ ID NO: 143378 - DNA, 25 bp, E. coli
ggcggtaagcttgatcctgatattc

SEQ ID NO: 143379 - DNA, 25 bp, E. coli
taacgatcaatgataagggctcaga

SEQ ID NO: 143380 - DNA, 25 bp, E. coli
taacgatcaatgttaagggctcaga

SEQ ID NO: 143381 - DNA, 25 bp, E. coli
taatcttttctcttacactatcggg

SEQ ID NO: 143382 - DNA, 25 bp, E. coli
taatcttttctcatacactatcggg

SEQ ID NO: 143383 - DNA, 25 bp, E. coli
caacgttggtattatttcccgcaga

SEQ ID NO: 143384 - DNA, 25 bp, E. coli
caacgttggtataatttcccgcaga

SEQ ID NO: 143385 - DNA, 25 bp, E. coli
tacgcatcctgtttgatgcaagcag

SEQ ID NO: 143386 - DNA, 25 bp, E. coli
tacgcatcctgtatgatgcaagcag

SEQ ID NO: 143387 - DNA, 25 bp, E. coli
cagactaaccctttcaacgttggta

SEQ ID NO: 143388 - DNA, 25 bp, E. coli
cagactaaccctatcaacgttggta

SEQ ID NO: 143389 - DNA, 25 bp, E. coli
ttattgatcttaggcatcctgtatg

SEQ ID NO: 143390 - DNA, 25 bp, E. coli
ttattgatcttacgcatcctgtatg

SEQ ID NO: 143391 - DNA, 25 bp, E. coli
tgtcttaattgccagaatctaacgg

SEQ ID NO: 143392 - DNA, 25 bp, E. coli
tgtatgatgcaagcagactaaccct

SEQ ID NO: 143393 - DNA, 25 bp, E. coli
tgtcttaattgcgagaatctaacgg

SEQ ID NO: 143394 - DNA, 25 bp, E. coli
tgtatgatgcaaccagactaaccct

SEQ ID NO: 143395 - DNA, 25 bp, E. coli
tctaacggctttcggcaattactcc

SEQ ID NO: 143396 - DNA, 25 bp, E. coli
tctaacggctttgggcaattactcc

SEQ ID NO: 143397 - DNA, 25 bp, E. coli
gccagaatctaacggctttcggcaa

SEQ ID NO: 143398 - DNA, 25 bp, E. coli
gccagaatctaagggctttcggcaa

SEQ ID NO: 143399 - DNA, 25 bp, E. coli
gctttcggcaattactccaaaaggg

SEQ ID NO: 143400 - DNA, 25 bp, E. coli
gctttcggcaataactccaaaaggg

SEQ ID NO: 143401 - DNA, 25 bp, E. coli
gcaagcagactatccctatcaacgt

SEQ ID NO: 143402 - DNA, 25 bp, E. coli
gcaagcagactaaccctatcaacgt

SEQ ID NO: 143403 - DNA, 25 bp, E. coli
gggcgctctcttttattgatcttac

SEQ ID NO: 143404 - DNA, 25 bp, E. coli
gggcgctctcttatattgatcttac

SEQ ID NO: 143405 - DNA, 25 bp, E. coli
caaagcctgttcgtcgccgggaata

SEQ ID NO: 143406 - DNA, 25 bp, E. coli
caaagcctgttcctcgccgggaata

SEQ ID NO: 143407 - DNA, 25 bp, E. coli
tactttctcgggttgctggcgatgt

SEQ ID NO: 143408 - DNA, 25 bp, E. coli
tactttctcgggatgctggcgatgt

SEQ ID NO: 143409 - DNA, 25 bp, E. coli
tattgatgtacaaacccgctactgg

SEQ ID NO: 143410 - DNA, 25 bp, E. coli
tattgatgtacatacccgctactgg

SEQ ID NO: 143411 - DNA, 25 bp, E. coli
ttacccgcacggtactgctgctgtg

SEQ ID NO: 143412 - DNA, 25 bp, E. coli
ttttactggaacagcgtagcgaagc

SEQ ID NO: 143413 - DNA, 25 bp, E. coli
ttttactggaactgcgtagcgaagc

SEQ ID NO: 143414 - DNA, 25 bp, E. coli
ttacccgcacggaactgctgctgtg

SEQ ID NO: 143415 - DNA, 25 bp, E. coli
tctggcagatctcgcaaatgcagcg

SEQ ID NO: 143416 - DNA, 25 bp, E. coli
tctggcagatctggcaaatgcagcg

SEQ ID NO: 143417 - DNA, 25 bp, E. coli
gataaccgtcaggaactgatcgcca

SEQ ID NO: 143418 - DNA, 25 bp, E. coli
gataaccgtcagcaactgatcgcca

SEQ ID NO: 143419 - DNA, 25 bp, E. coli
ggatttcacccagaccatgaccggt

SEQ ID NO: 143420 - DNA, 25 bp, E. coli
ggatttcacccacaccatgaccggt

SEQ ID NO: 143421 - DNA, 25 bp, E. coli
tggctgaaaaccaaacgtcggctgg

SEQ ID NO: 143422 - DNA, 25 bp, E. coli
ggctgctgatttgcacgattacccg

SEQ ID NO: 143423 - DNA, 25 bp, E. coli
ggctgctgatttccacgattacccg

SEQ ID NO: 143424 - DNA, 25 bp, E. coli
tggctgaaaacctaacgtcggctgg

SEQ ID NO: 143425 - DNA, 25 bp, E. coli
gatccgcgcggtcacgtacattatt

SEQ ID NO: 143426 - DNA, 25 bp, E. coli
gatccgcgcggtgacgtacattatt

SEQ ID NO: 143427 - DNA, 25 bp, E. coli
cacgatttgactcactggaagctgt

SEQ ID NO: 143428 - DNA, 25 bp, E. coli
cacgatttgactgactggaagctgt

SEQ ID NO: 143429 - DNA, 25 bp, E. coli
cagttgcggcgttggcacggcctat

SEQ ID NO: 143430 - DNA, 25 bp, E. coli
cagttgcggcgtaggcacggcctat

SEQ ID NO: 143431 - DNA, 25 bp, E. coli
acgatttgactgactggaagctgtg

SEQ ID NO: 143432 - DNA, 25 bp, E. coli
acgatttgactgtctggaagctgtg

SEQ ID NO: 143433 - DNA, 25 bp, E. coli
agttgcggcgttcgcacggcctatg

SEQ ID NO: 143434 - DNA, 25 bp, E. coli
agttgcggcgttggcacggcctatg

SEQ ID NO: 143435 - DNA, 25 bp, E. coli
ttgcggcgttgggacggcctatgaa

SEQ ID NO: 143436 - DNA, 25 bp, E. coli
ttgcggcgttggcacggcctatgaa

SEQ ID NO: 143437 - DNA, 25 bp, E. coli
gcccacgatttgactgactggaagc

SEQ ID NO: 143438 - DNA, 25 bp, E. coli
ccacgatttgacagactggaagctg

SEQ ID NO: 143439 - DNA, 25 bp, E. coli
gcggcgttggcagggcctatgaagg

SEQ ID NO: 143440 - DNA, 25 bp, E. coli
gcggcgttggcacggcctatgaagg

SEQ ID NO: 143441 - DNA, 25 bp, E. coli
gcccacgatttgtctgactggaagc

SEQ ID NO: 143442 - DNA, 25 bp, E. coli
ccacgatttgactgactggaagctg

SEQ ID NO: 143443 - DNA, 25 bp, E. coli
cccacgatttgagtgactggaagct

SEQ ID NO: 143444 - DNA, 25 bp, E. coli
cgttggcacggcgtatgaagggatt

SEQ ID NO: 143445 - DNA, 25 bp, E. coli
cgatttgactgagtggaagctgtgg

SEQ ID NO: 143446 - DNA, 25 bp, E. coli
cccacgatttgactgactggaagct

SEQ ID NO: 143447 - DNA, 25 bp, E. coli
cgttggcacggcctatgaagggatt

SEQ ID NO: 143448 - DNA, 25 bp, E. coli
cgatttgactgactggaagctgtgg

SEQ ID NO: 143449 - DNA, 25 bp, E. coli
aagggcgacatatttttcagcgtgc

SEQ ID NO: 143450 - DNA, 25 bp, E. coli
aagggcgacataattttcagcgtgc

SEQ ID NO: 143451 - DNA, 25 bp, E. coli
cactgatggaacagggcctgatcct

SEQ ID NO: 143452 - DNA, 25 bp, E. coli
cactgatggaactgggcctgatcct

SEQ ID NO: 143453 - DNA, 25 bp, E. coli
acggtattggctccaccacctggga

SEQ ID NO: 143454 - DNA, 25 bp, E. coli
acggtattggctgcaccacctggga

SEQ ID NO: 143455 - DNA, 25 bp, E. coli
tttggtatcggtatcctcgcggcag

SEQ ID NO: 143456 - DNA, 25 bp, E. coli
tttggtatcggtttcctcgcggcag

SEQ ID NO: 143457 - DNA, 25 bp, E. coli
ttcagcgtgctggtaaaactggcgg

SEQ ID NO: 143458 - DNA, 25 bp, E. coli
ttcagcgtgctgctaaaactggcgg

SEQ ID NO: 143459 - DNA, 25 bp, E. coli
tgatgatgaaagagtcggcctacgg

SEQ ID NO: 143460 - DNA, 25 bp, E. coli
tgatgatgaaagtgtcggcctacgg

SEQ ID NO: 143461 - DNA, 25 bp, E. coli
tgctgatcgccgtcccggtgagttt

SEQ ID NO: 143462 - DNA, 25 bp, E. coli
tgctgatcgccgacccggtgagttt

SEQ ID NO: 143463 - DNA, 25 bp, E. coli
gagccggtcggctatatcatgtcga

SEQ ID NO: 143464 - DNA, 25 bp, E. coli
gagccggtcggcaatatcatgtcga

SEQ ID NO: 143465 - DNA, 25 bp, E. coli
cgaagtttatgattatgcgcctggc

SEQ ID NO: 143466 - DNA, 25 bp, E. coli
cgaagtttatgaatatgcgcctggc

SEQ ID NO: 143467 - DNA, 25 bp, E. coli
ggcaacagtatctcctctgcgctgg

SEQ ID NO: 143468 - DNA, 25 bp, E. coli
ggcaacagtatcacctctgcgctgg

SEQ ID NO: 143469 - DNA, 25 bp, E. coli
ggcgtatcgttcttccgttcaccaa

SEQ ID NO: 143470 - DNA, 25 bp, E. coli
ggcgtatcgttcatccgttcaccaa

SEQ ID NO: 143471 - DNA, 25 bp, E. coli
aatgcttagactaaccggatattga

SEQ ID NO: 143472 - DNA, 25 bp, E. coli
aatgcttagacttaccggatattga

SEQ ID NO: 143473 - DNA, 25 bp, E. coli
aacgacatcgttagccgcaagtgaa

SEQ ID NO: 143474 - DNA, 25 bp, E. coli
aacgacatcgtttgccgcaagtgaa

SEQ ID NO: 143475 - DNA, 25 bp, E. coli
tagccgcaagtgaaatcgaagattt

SEQ ID NO: 143476 - DNA, 25 bp, E. coli
tagccgcaagtgtaatcgaagattt

SEQ ID NO: 143477 - DNA, 25 bp, E. coli
tatgggataccacgacaattgaatg

SEQ ID NO: 143478 - DNA, 25 bp, E. coli
tatgggataccaggacaattgaatg

SEQ ID NO: 143479 - DNA, 25 bp, E. coli
tttgacctcaactttatgacagttg

SEQ ID NO: 143480 - DNA, 25 bp, E. coli
tttgacctcaacattatgacagttg

SEQ ID NO: 143481 - DNA, 25 bp, E. coli
ttatccatcatcatattcctcagtg

SEQ ID NO: 143482 - DNA, 25 bp, E. coli
ttatccatcatcttattcctcagtg

SEQ ID NO: 143483 - DNA, 25 bp, E. coli
tccttcgcaataacgacatcgttag

SEQ ID NO: 143484 - DNA, 25 bp, E. coli
tccttcgcaatatcgacatcgttag

SEQ ID NO: 143485 - DNA, 25 bp, E. coli
tcgtggctgatgtatatgggatacc

SEQ ID NO: 143486 - DNA, 25 bp, E. coli
tcgtggctgatgaatatgggatacc

SEQ ID NO: 143487 - DNA, 25 bp, E. coli
gacagttgatgagtatttccgtcag

SEQ ID NO: 143488 - DNA, 25 bp, E. coli
gacagttgatgactatttccgtcag

SEQ ID NO: 143489 - DNA, 25 bp, E. coli
cattgatgtatgttatgaatttctc

SEQ ID NO: 143490 - DNA, 25 bp, E. coli
cattgatgtatgatatgaatttctc

SEQ ID NO: 143491 - DNA, 25 bp, E. coli
ggtaaaaacaagttcaatacttatg

SEQ ID NO: 143492 - DNA, 25 bp, E. coli
ggtaaaaacaagatcaatacttatg

SEQ ID NO: 143493 - DNA, 25 bp, E. coli
catggcttgctgttaatttccctga

SEQ ID NO: 143494 - DNA, 25 bp, E. coli
catggcttgctgataatttccctga

SEQ ID NO: 143495 - DNA, 25 bp, E. coli
tagctacggagataaccgattcgag

SEQ ID NO: 143496 - DNA, 25 bp, E. coli
aaatcaaccaggaaagccagtacgg

SEQ ID NO: 143497 - DNA, 25 bp, E. coli
aaatcaaccaggtaagccagtacgg

SEQ ID NO: 143498 - DNA, 25 bp, E. coli
tagtttggatgatgcagtctgggtc

SEQ ID NO: 143499 - DNA, 25 bp, E. coli
tagtttggatgaagcagtctgggtc

SEQ ID NO: 143500 - DNA, 25 bp, E. coli
tagctacggagaaaaccgattcgag

SEQ ID NO: 143501 - DNA, 25 bp, E. coli
tattagatgccagtaatcccagact

SEQ ID NO: 143502 - DNA, 25 bp, E. coli
tattagatgccactaatcccagact

SEQ ID NO: 143503 - DNA, 25 bp, E. coli
tccgcagctgagtcatatcgataag

SEQ ID NO: 143504 - DNA, 25 bp, E. coli
tccgcagctgagacatatcgataag

SEQ ID NO: 143505 - DNA, 25 bp, E. coli
gccagtacgggtcataaatcctgat

SEQ ID NO: 143506 - DNA, 25 bp, E. coli
gccagtacgggtgataaatcctgat

SEQ ID NO: 143507 - DNA, 25 bp, E. coli
cccagactgaccgtgagtaagcaac

SEQ ID NO: 143508 - DNA, 25 bp, E. coli
cccagactgaccctgagtaagcaac

SEQ ID NO: 143509 - DNA, 25 bp, E. coli
gtctgggtcaaacaagcactggaaa

SEQ ID NO: 143510 - DNA, 25 bp, E. coli
gtctgggtcaaagaagcactggaaa

SEQ ID NO: 143511 - DNA, 25 bp, E. coli
taagcaacggaaagctatcacacag

SEQ ID NO: 143512 - DNA, 25 bp, E. coli
taagcaacggaatgctatcacacag

SEQ ID NO: 143513 - DNA, 25 bp, E. coli
taatgccagtaatgatccgcagctg

SEQ ID NO: 143514 - DNA, 25 bp, E. coli
taatgccagtaaagatccgcagctg

SEQ ID NO: 143515 - DNA, 25 bp, E. coli
caatttaatgtcagcgaccgctgcg

SEQ ID NO: 143516 - DNA, 25 bp, E. coli
aattgtgaatccctgcagcgtcccg

SEQ ID NO: 143517 - DNA, 25 bp, E. coli
aattaccggcgctggttcagtcgca

SEQ ID NO: 143518 - DNA, 25 bp, E. coli
aattgtgaatccgtgcagcgtcccg

SEQ ID NO: 143519 - DNA, 25 bp, E. coli
caatttaatgtctgcgaccgctgcg

SEQ ID NO: 143520 - DNA, 25 bp, E. coli
aattaccggcgcaggttcagtcgca

SEQ ID NO: 143521 - DNA, 25 bp, E. coli
ttccggattaacctgcaatgacgag

SEQ ID NO: 143522 - DNA, 25 bp, E. coli
ttaggtgaggacaaaaatgcatggc

SEQ ID NO: 143523 - DNA, 25 bp, E. coli
ttaggtgaggactaaaatgcatggc

SEQ ID NO: 143524 - DNA, 25 bp, E. coli
ttccggattaacgtgcaatgacgag

SEQ ID NO: 143525 - DNA, 25 bp, E. coli
tgatgtatgccagtaacgcgcagga

SEQ ID NO: 143526 - DNA, 25 bp, E. coli
tgatgtatgccactaacgcgcagga

SEQ ID NO: 143527 - DNA, 25 bp, E. coli
gcaccgctgtttagaaggctggcag

SEQ ID NO: 143528 - DNA, 25 bp, E. coli
gcaccgctgttttgaaggctggcag

SEQ ID NO: 143529 - DNA, 25 bp, E. coli
cgtgggcgacgcattaccggatgta

SEQ ID NO: 143530 - DNA, 25 bp, E. coli
cgtgggcgacgctttaccggatgta

SEQ ID NO: 143531 - DNA, 25 bp, E. coli
tcagccgggatatgatcacagttac

SEQ ID NO: 143532 - DNA, 25 bp, E. coli
tcagccgggataagatcacagttac

SEQ ID NO: 143533 - DNA, 25 bp, E. coli
gagaacttcaccaccaaggcgggtg

SEQ ID NO: 143534 - DNA, 25 bp, E. coli
gatgacgctgcgaattcagccggga

SEQ ID NO: 143535 - DNA, 25 bp, E. coli
gagaacttcacctccaaggcgggtg

SEQ ID NO: 143536 - DNA, 25 bp, E. coli
gatgacgctgcgtattcagccggga

SEQ ID NO: 143537 - DNA, 25 bp, E. coli
cagcatcaggcagccgagctagtgg

SEQ ID NO: 143538 - DNA, 25 bp, E. coli
cagcttaacaacttcgcagttcgcc

SEQ ID NO: 143539 - DNA, 25 bp, E. coli
cagcttaacaacatcgcagttcgcc

SEQ ID NO: 143540 - DNA, 25 bp, E. coli
cagccgagctagtggaggagcagtg

SEQ ID NO: 143541 - DNA, 25 bp, E. coli
cagcatcaggcacccgagctagtgg

SEQ ID NO: 143542 - DNA, 25 bp, E. coli
cagccgagctagaggaggagcagtg

SEQ ID NO: 143543 - DNA, 25 bp, E. coli
tttgtatgacttagctgcgtatctg

SEQ ID NO: 143544 - DNA, 25 bp, E. coli
tttgtatgactttgctgcgtatctg

SEQ ID NO: 143545 - DNA, 25 bp, E. coli
ttccgacagaattggccgcaggccg

SEQ ID NO: 143546 - DNA, 25 bp, E. coli
ttccgacagaataggccgcaggccg

SEQ ID NO: 143547 - DNA, 25 bp, E. coli
tcgccggtgatcgttatcgatgcag

SEQ ID NO: 143548 - DNA, 25 bp, E. coli
tcgccggtgatccttatcgatgcag

SEQ ID NO: 143549 - DNA, 25 bp, E. coli
tcttgctggcggaatggcgttacag

SEQ ID NO: 143550 - DNA, 25 bp, E. coli
tcttgctggcggtatggcgttacag

SEQ ID NO: 143551 - DNA, 25 bp, E. coli
gactttgctgcgaatctgtcgacgg

SEQ ID NO: 143552 - DNA, 25 bp, E. coli
gactttgctgcgtatctgtcgacgg

SEQ ID NO: 143553 - DNA, 25 bp, E. coli
cgtatctgtcgagggatctgatcca

SEQ ID NO: 143554 - DNA, 25 bp, E. coli
cgtatctgtcgacggatctgatcca

SEQ ID NO: 143555 - DNA, 25 bp, E. coli
gatccttatcgaagcaggcagctta

SEQ ID NO: 143556 - DNA, 25 bp, E. coli
gatgcaggcagcataacaacttcgc

SEQ ID NO: 143557 - DNA, 25 bp, E. coli
gatccttatcgatgcaggcagctta

SEQ ID NO: 143558 - DNA, 25 bp, E. coli
gatgcaggcagcttaacaacttcgc

SEQ ID NO: 143559 - DNA, 25 bp, E. coli
taccgggtgggctgaaaaatgccat

SEQ ID NO: 143560 - DNA, 25 bp, E. coli
tatgggcggcgtcattcagaacaaa

SEQ ID NO: 143561 - DNA, 25 bp, E. coli
taccgggtgggcagaaaaatgccat

SEQ ID NO: 143562 - DNA, 25 bp, E. coli
tatgggcggcgtgattcagaacaaa

SEQ ID NO: 143563 - DNA, 25 bp, E. coli
ttaatggcatggttgcacgtaccct

SEQ ID NO: 143564 - DNA, 25 bp, E. coli
ttaatggcatggatgcacgtaccct

SEQ ID NO: 143565 - DNA, 25 bp, E. coli
tgtatgacgctgtcgtacagcagga

SEQ ID NO: 143566 - DNA, 25 bp, E. coli
tgtatgacgctgacgtacagcagga

SEQ ID NO: 143567 - DNA, 25 bp, E. coli
tgaccgggcaattgaccgcatttgg

SEQ ID NO: 143568 - DNA, 25 bp, E. coli
tgaccgggcaatagaccgcatttgg

SEQ ID NO: 143569 - DNA, 25 bp, E. coli
tcgatgcaatggagatgaacaagcc

SEQ ID NO: 143570 - DNA, 25 bp, E. coli
tcgatgcaatggtgatgaacaagcc

SEQ ID NO: 143571 - DNA, 25 bp, E. coli
cctgcgcaaagggtcatttaatggc

SEQ ID NO: 143572 - DNA, 25 bp, E. coli
cctgcgcaaaggctcatttaatggc

SEQ ID NO: 143573 - DNA, 25 bp, E. coli
gctgtcagtatcacctgcgccagat

SEQ ID NO: 143574 - DNA, 25 bp, E. coli
gctccggcgagcatggaagtcaatg

SEQ ID NO: 143575 - DNA, 25 bp, E. coli
gctgtcagtatctcctgcgccagat

SEQ ID NO: 143576 - DNA, 25 bp, E. coli
gctccggcgagcttggaagtcaatg

SEQ ID NO: 143577 - DNA, 25 bp, E. coli
gaagctctggcggaacagatccgtc

SEQ ID NO: 143578 - DNA, 25 bp, E. coli
gaagctctggcgcaacagatccgtc

SEQ ID NO: 143579 - DNA, 25 bp, E. coli
gattcagaccaggtcaatgggcgtg

SEQ ID NO: 143580 - DNA, 25 bp, E. coli
gattcagaccagctcaatgggcgtg

SEQ ID NO: 143581 - DNA, 25 bp, E. coli
tgatcgccccgaatctggatgaaat

SEQ ID NO: 143582 - DNA, 25 bp, E. coli
tggtgcggtccgagcaaaatgatcg

SEQ ID NO: 143583 - DNA, 25 bp, E. coli
tgatcgccccgattctggatgaaat

SEQ ID NO: 143584 - DNA, 25 bp, E. coli
tggtgcggtccgtgcaaaatgatcg

SEQ ID NO: 143585 - DNA, 25 bp, E. coli
gaatatcagggcaaactgaccgttg

SEQ ID NO: 143586 - DNA, 25 bp, E. coli
gaatatcagggctaactgaccgttg

SEQ ID NO: 143587 - DNA, 25 bp, E. coli
gaacatcgatcataaccctggcact

SEQ ID NO: 143588 - DNA, 25 bp, E. coli
gacacggatgtagtcaaagcggacg

SEQ ID NO: 143589 - DNA, 25 bp, E. coli
gactgacgacagatttgacacggat

SEQ ID NO: 143590 - DNA, 25 bp, E. coli
gaaagagttcctcgacgctaacctg

SEQ ID NO: 143591 - DNA, 25 bp, E. coli
gacacggatgtactcaaagcggacg

SEQ ID NO: 143592 - DNA, 25 bp, E. coli
gaaatatggcatgcgtggtatcccg

SEQ ID NO: 143593 - DNA, 25 bp, E. coli
gaacatcgatcaaaaccctggcact

SEQ ID NO: 143594 - DNA, 25 bp, E. coli
gaaagagttcctggacgctaacctg

SEQ ID NO: 143595 - DNA, 25 bp, E. coli
gactgacgacagttttgacacggat

SEQ ID NO: 143596 - DNA, 25 bp, E. coli
gaaatatggcatccgtggtatcccg

SEQ ID NO: 143597 - DNA, 25 bp, E. coli
cgactctgctgcagttcaaaaacgg

SEQ ID NO: 143598 - DNA, 25 bp, E. coli
cgactctgctgctgttcaaaaacgg

SEQ ID NO: 143599 - DNA, 25 bp, E. coli
tcaaaaacggtgaagtggcggcaac

SEQ ID NO: 143600 - DNA, 25 bp, E. coli
tcaaaaacggtgtagtggcggcaac

SEQ ID NO: 143601 - DNA, 25 bp, E. coli
gatcctcgtcgatttctgggcagag

SEQ ID NO: 143602 - DNA, 25 bp, E. coli
gatcctcgtcgaattctgggcagag

SEQ ID NO: 143603 - DNA, 25 bp, E. coli
cacggcataagccaggatgacgcta

SEQ ID NO: 143604 - DNA, 25 bp, E. coli
cacggcataagcgaggatgacgcta

SEQ ID NO: 143605 - DNA, 25 bp, E. coli
cataagcgaggaagacgctatcgcc

SEQ ID NO: 143606 - DNA, 25 bp, E. coli
cataagcgaggatgacgctatcgcc

SEQ ID NO: 143607 - DNA, 25 bp, E. coli
tgatgccgggtcatgtttatcgcgc

SEQ ID NO: 143608 - DNA, 25 bp, E. coli
tgatgccgggtcttgtttatcgcgc

SEQ ID NO: 143609 - DNA, 25 bp, E. coli
tgcacggcataagcgaggatgacgc

SEQ ID NO: 143610 - DNA, 25 bp, E. coli
tgcacggcataaccgaggatgacgc

SEQ ID NO: 143611 - DNA, 25 bp, E. coli
tccttgcccgctgcacggcataagc

SEQ ID NO: 143612 - DNA, 25 bp, E. coli
tccttgcccgctccacggcataagc

SEQ ID NO: 143613 - DNA, 25 bp, E. coli
gccgggtcatgtttatcgcgcgctt

SEQ ID NO: 143614 - DNA, 25 bp, E. coli
gccgggtcatgtatatcgcgcgctt

SEQ ID NO: 143615 - DNA, 25 bp, E. coli
gcgaggatgacgctatcgccagcat

SEQ ID NO: 143616 - DNA, 25 bp, E. coli
gcatccaccggatcttcaaaaatga

SEQ ID NO: 143617 - DNA, 25 bp, E. coli
gcgaggatgacggtatcgccagcat

SEQ ID NO: 143618 - DNA, 25 bp, E. coli
gcatccaccggaacttcaaaaatga

SEQ ID NO: 143619 - DNA, 25 bp, E. coli
ggctgatgccggctcatgtttatcg

SEQ ID NO: 143620 - DNA, 25 bp, E. coli
ggctgatgccgggtcatgtttatcg

SEQ ID NO: 143621 - DNA, 25 bp, E. coli
taagcgaggatgacgctatcgccag

SEQ ID NO: 143622 - DNA, 25 bp, E. coli
taagcgaggatgtcgctatcgccag

SEQ ID NO: 143623 - DNA, 25 bp, E. coli
gatgccgggtcatgtttatcgcgcg

SEQ ID NO: 143624 - DNA, 25 bp, E. coli
gatgccgggtcaagtttatcgcgcg

SEQ ID NO: 143625 - DNA, 25 bp, E. coli
cagaaactattagggtgaattgccc

SEQ ID NO: 143626 - DNA, 25 bp, E. coli
cagaaactattacggtgaattgccc

SEQ ID NO: 143627 - DNA, 25 bp, E. coli
aacgttgtcagcagatcgacctcgg

SEQ ID NO: 143628 - DNA, 25 bp, E. coli
aacgttgtcagctgatcgacctcgg

SEQ ID NO: 143629 - DNA, 25 bp, E. coli
ttacggtgaattgcccaacctgcgg

SEQ ID NO: 143630 - DNA, 25 bp, E. coli
ttacggtgaattccccaacctgcgg

SEQ ID NO: 143631 - DNA, 25 bp, E. coli
tgggctgctgaagaaaaacgaatcc

SEQ ID NO: 143632 - DNA, 25 bp, E. coli
tgggctgctgaacaaaaacgaatcc

SEQ ID NO: 143633 - DNA, 25 bp, E. coli
tgaagaaaaacgtatccccagcagt

SEQ ID NO: 143634 - DNA, 25 bp, E. coli
tgaagaaaaacgaatccccagcagt

SEQ ID NO: 143635 - DNA, 25 bp, E. coli
tcgacctcggagtatgggctgctga

SEQ ID NO: 143636 - DNA, 25 bp, E. coli
tcgacctcggagaatgggctgctga

SEQ ID NO: 143637 - DNA, 25 bp, E. coli
tcagctgatcgacctcggagaatgg

SEQ ID NO: 143638 - DNA, 25 bp, E. coli
gccattttgctcgaaacgttgtcag

SEQ ID NO: 143639 - DNA, 25 bp, E. coli
gcccgtttcggcgattttgctccaa

SEQ ID NO: 143640 - DNA, 25 bp, E. coli
gccattttgctccaaacgttgtcag

SEQ ID NO: 143641 - DNA, 25 bp, E. coli
gcccgtttcggccattttgctccaa

SEQ ID NO: 143642 - DNA, 25 bp, E. coli
gaattgcccaacctgcgggaaaacg

SEQ ID NO: 143643 - DNA, 25 bp, E. coli
gaattgcccaacgtgcgggaaaacg

SEQ ID NO: 143644 - DNA, 25 bp, E. coli
tgaaatcagcccgtttcggccattt

SEQ ID NO: 143645 - DNA, 25 bp, E. coli
tgaaatcagcccctttcggccattt

SEQ ID NO: 143646 - DNA, 25 bp, E. coli
tcagctgatcgagctcggagaatgg

SEQ ID NO: 143647 - DNA, 25 bp, E. coli
caacctgcgccatgttcgtgctggg

SEQ ID NO: 143648 - DNA, 25 bp, E. coli
caacctgcgccaagttcgtgctggg

SEQ ID NO: 143649 - DNA, 25 bp, E. coli
tacagatgctgaacaacgcctacgc

SEQ ID NO: 143650 - DNA, 25 bp, E. coli
tacagatgctgatcaacgcctacgc

SEQ ID NO: 143651 - DNA, 25 bp, E. coli
taactgtatcgtagtgggccgcgct

SEQ ID NO: 143652 - DNA, 25 bp, E. coli
tattggcctgggactgatgctggca

SEQ ID NO: 143653 - DNA, 25 bp, E. coli
tattggcctgggtctgatgctggca

SEQ ID NO: 143654 - DNA, 25 bp, E. coli
tgcattgccaaagggtgaaacaggg

SEQ ID NO: 143655 - DNA, 25 bp, E. coli
tgcattgccaaacggtgaaacaggg

SEQ ID NO: 143656 - DNA, 25 bp, E. coli
gctttcggcactggacggcttttca

SEQ ID NO: 143657 - DNA, 25 bp, E. coli
gctttcggcactcgacggcttttca

SEQ ID NO: 143658 - DNA, 25 bp, E. coli
gcttttcaattggtatgggcgcaac

SEQ ID NO: 143659 - DNA, 25 bp, E. coli
gcttttcaattgctatgggcgcaac

SEQ ID NO: 143660 - DNA, 25 bp, E. coli
gaaaaacaactctgcgctggtccag

SEQ ID NO: 143661 - DNA, 25 bp, E. coli
gagatccgcattcccatttacgtga

SEQ ID NO: 143662 - DNA, 25 bp, E. coli
gagatccgcattgccatttacgtga

SEQ ID NO: 143663 - DNA, 25 bp, E. coli
gaaaaacaactcagcgctggtccag

SEQ ID NO: 143664 - DNA, 25 bp, E. coli
cgtgatgatcatcgcctcggtggtc

SEQ ID NO: 143665 - DNA, 25 bp, E. coli
cgtgatgatcatggcctcggtggtc

SEQ ID NO: 143666 - DNA, 25 bp, E. coli
ggttcactacgccaaattatcggca

SEQ ID NO: 143667 - DNA, 25 bp, E. coli
ggttcactacgcgaaattatcggca

SEQ ID NO: 143668 - DNA, 25 bp, E. coli
taactgtatcgttgtgggccgcgct

SEQ ID NO: 143669 - DNA, 25 bp, E. coli
cataaactacaggtggcagacagcc

SEQ ID NO: 143670 - DNA, 25 bp, E. coli
cataaactacagctggcagacagcc

SEQ ID NO: 143671 - DNA, 25 bp, E. coli
acgagttcagtggtctacgtaggcc

SEQ ID NO: 143672 - DNA, 25 bp, E. coli
acgagttcagtgctctacgtaggcc

SEQ ID NO: 143673 - DNA, 25 bp, E. coli
tatcaggcctacgagttcagtgctc

SEQ ID NO: 143674 - DNA, 25 bp, E. coli
tatcaggcctaccagttcagtgctc

SEQ ID NO: 143675 - DNA, 25 bp, E. coli
ttggcgggaatgaatcacggtagcc

SEQ ID NO: 143676 - DNA, 25 bp, E. coli
ttggcgggaatgtatcacggtagcc

SEQ ID NO: 143677 - DNA, 25 bp, E. coli
tgaatcacggtacccgctgacacag

SEQ ID NO: 143678 - DNA, 25 bp, E. coli
tgaatcacggtagccgctgacacag

SEQ ID NO: 143679 - DNA, 25 bp, E. coli
tccggcataaacaacagctggcaga

SEQ ID NO: 143680 - DNA, 25 bp, E. coli
tccggcataaactacagctggcaga

SEQ ID NO: 143681 - DNA, 25 bp, E. coli
tctgcggctggatttgcctgatgcg

SEQ ID NO: 143682 - DNA, 25 bp, E. coli
tcagtgctctacctaggccggataa

SEQ ID NO: 143683 - DNA, 25 bp, E. coli
tcagtgctctacgtaggccggataa

SEQ ID NO: 143684 - DNA, 25 bp, E. coli
tctgcggctggaattgcctgatgcg

SEQ ID NO: 143685 - DNA, 25 bp, E. coli
gctgacacagatgagcggctggaat

SEQ ID NO: 143686 - DNA, 25 bp, E. coli
gctgacacagatcagcggctggaat

SEQ ID NO: 143687 - DNA, 25 bp, E. coli
cgctgacacaggtctgcggctggaa

SEQ ID NO: 143688 - DNA, 25 bp, E. coli
cgctgacacaggactgcggctggaa

SEQ ID NO: 143689 - DNA, 25 bp, E. coli
tcagcggctggatttgcctgatgcg

SEQ ID NO: 143690 - DNA, 25 bp, E. coli
tcagcggctggaattgcctgatgcg

SEQ ID NO: 143691 - DNA, 25 bp, E. coli
caacaagctcgctatcgttatacct

SEQ ID NO: 143692 - DNA, 25 bp, E. coli
caacaagctcgcaatcgttatacct

SEQ ID NO: 143693 - DNA, 25 bp, E. coli
agcaggcctggcctgctcgccgatt

SEQ ID NO: 143694 - DNA, 25 bp, E. coli
agcaggcctggcgtgctcgccgatt

SEQ ID NO: 143695 - DNA, 25 bp, E. coli
aacagctggcgaagagtccgttcca

SEQ ID NO: 143696 - DNA, 25 bp, E. coli
aacagctggcgatgagtccgttcca

SEQ ID NO: 143697 - DNA, 25 bp, E. coli
tttgcatagattgtttaaagcgact

SEQ ID NO: 143698 - DNA, 25 bp, E. coli
tttgcatagattctttaaagcgact

SEQ ID NO: 143699 - DNA, 25 bp, E. coli
tgactcaggcgaatctcagtgccgg

SEQ ID NO: 143700 - DNA, 25 bp, E. coli
tgactcaggcgattctcagtgccgg

SEQ ID NO: 143701 - DNA, 25 bp, E. coli
tcagtgccggattccccgacggcag

SEQ ID NO: 143702 - DNA, 25 bp, E. coli
tcagtgccggataccccgacggcag

SEQ ID NO: 143703 - DNA, 25 bp, E. coli
gccgattgcgggagtctctggcaaa

SEQ ID NO: 143704 - DNA, 25 bp, E. coli
gccgattgcgggtgtctctggcaaa

SEQ ID NO: 143705 - DNA, 25 bp, E. coli
gaatccttagccgaacagctggcga

SEQ ID NO: 143706 - DNA, 25 bp, E. coli
gaatccttagcccaacagctggcga

SEQ ID NO: 143707 - DNA, 25 bp, E. coli
cgttataccttgtcatcgggtggtc

SEQ ID NO: 143708 - DNA, 25 bp, E. coli
cgttataccttgacatcgggtggtc

SEQ ID NO: 143709 - DNA, 25 bp, E. coli
ggcagcagttactaccgtaaagccg

SEQ ID NO: 143710 - DNA, 25 bp, E. coli
ggcagcagttacaaccgtaaagccg

SEQ ID NO: 143711 - DNA, 25 bp, E. coli
gatgagtccgttccatttgcataga

SEQ ID NO: 143712 - DNA, 25 bp, E. coli
gatgagtccgttgcatttgcataga

SEQ ID NO: 143713 - DNA, 25 bp, E. coli
cacgcaaagtgtgattcttgaggcg

SEQ ID NO: 143714 - DNA, 25 bp, E. coli
cacgcaaagtgtcattcttgaggcg

SEQ ID NO: 143715 - DNA, 25 bp, E. coli
caggcgcgggcgttattacaacaac

SEQ ID NO: 143716 - DNA, 25 bp, E. coli
caggcgcgggcgatattacaacaac

SEQ ID NO: 143717 - DNA, 25 bp, E. coli
taaaaaccgtcctgagcgtggacag

SEQ ID NO: 143718 - DNA, 25 bp, E. coli
taaaaaccgtccagagcgtggacag

SEQ ID NO: 143719 - DNA, 25 bp, E. coli
ttcgttaattgtgcgcatgggccca

SEQ ID NO: 143720 - DNA, 25 bp, E. coli
ttcgttaattgtccgcatgggccca

SEQ ID NO: 143721 - DNA, 25 bp, E. coli
ttacaacaacgtccggcgaagggct

SEQ ID NO: 143722 - DNA, 25 bp, E. coli
ttacaacaacgtgcggcgaagggct

SEQ ID NO: 143723 - DNA, 25 bp, E. coli
tgaaaccgttggactgtgcgctgcc

SEQ ID NO: 143724 - DNA, 25 bp, E. coli
tgaaaccgttggtctgtgcgctgcc

SEQ ID NO: 143725 - DNA, 25 bp, E. coli
tcgatcagtttcttgcacagccgct

SEQ ID NO: 143726 - DNA, 25 bp, E. coli
tcgatcagtttcatgcacagccgct

SEQ ID NO: 143727 - DNA, 25 bp, E. coli
tcttgaggcgctctttgacccgtgg

SEQ ID NO: 143728 - DNA, 25 bp, E. coli
tcttgaggcgctgtttgacccgtgg

SEQ ID NO: 143729 - DNA, 25 bp, E. coli
gccgctacttgcagacgtcgatgag

SEQ ID NO: 143730 - DNA, 25 bp, E. coli
gccgctacttgctgacgtcgatgag

SEQ ID NO: 143731 - DNA, 25 bp, E. coli
ggacgccgggctttatcaaaaactg

SEQ ID NO: 143732 - DNA, 25 bp, E. coli
ggacgccgggctatatcaaaaactg

SEQ ID NO: 143733 - DNA, 25 bp, E. coli
gacccgtggttatgccctgttcagg

SEQ ID NO: 143734 - DNA, 25 bp, E. coli
gacccgtggttaagccctgttcagg

SEQ ID NO: 143735 - DNA, 25 bp, E. coli
caaatggatgattattccacgcgcc

SEQ ID NO: 143736 - DNA, 25 bp, E. coli
caaatggatgataattccacgcgcc

SEQ ID NO: 143737 - DNA, 25 bp, E. coli
aacagaacgtcgtggcgctgtgcca

SEQ ID NO: 143738 - DNA, 25 bp, E. coli
aacagaacgtcgaggcgctgtgcca

SEQ ID NO: 143739 - DNA, 25 bp, E. coli
tattgatgacatggcgccaggtacg

SEQ ID NO: 143740 - DNA, 25 bp, E. coli
tattgatgacatcgcgccaggtacg

SEQ ID NO: 143741 - DNA, 25 bp, E. coli
tattcaaagaagaaacgcagagggt

SEQ ID NO: 143742 - DNA, 25 bp, E. coli
tattcaaagaagtaacgcagagggt

SEQ ID NO: 143743 - DNA, 25 bp, E. coli
ttattactgagacgaatgttccgca

SEQ ID NO: 143744 - DNA, 25 bp, E. coli
ttattactgagaggaatgttccgca

SEQ ID NO: 143745 - DNA, 25 bp, E. coli
tgagcttgccctccggtaaaacgac

SEQ ID NO: 143746 - DNA, 25 bp, E. coli
tgagcttgccctgcggtaaaacgac

SEQ ID NO: 143747 - DNA, 25 bp, E. coli
tcgcgccaggtagggtgattattac

SEQ ID NO: 143748 - DNA, 25 bp, E. coli
tcgcgccaggtacggtgattattac

SEQ ID NO: 143749 - DNA, 25 bp, E. coli
ccagtgggcgcatagtctgagcttg

SEQ ID NO: 143750 - DNA, 25 bp, E. coli
ccagtgggcgcaaagtctgagcttg

SEQ ID NO: 143751 - DNA, 25 bp, E. coli
gctgccgccgctggtgttacatgcg

SEQ ID NO: 143752 - DNA, 25 bp, E. coli
gctgccgccgctcgtgttacatgcg

SEQ ID NO: 143753 - DNA, 25 bp, E. coli
cgcagagggtaaatgtctgaccgga

SEQ ID NO: 143754 - DNA, 25 bp, E. coli
cgcagagggtaattgtctgaccgga

SEQ ID NO: 143755 - DNA, 25 bp, E. coli
cgtgcattaccggtattaacgccgt

SEQ ID NO: 143756 - DNA, 25 bp, E. coli
cgtgcattaccgctattaacgccgt

SEQ ID NO: 143757 - DNA, 25 bp, E. coli
cagtaaagaggtagcacgccggatt

SEQ ID NO: 143758 - DNA, 25 bp, E. coli
cagtaaagaggttgcacgccggatt

SEQ ID NO: 143759 - DNA, 25 bp, E. coli
taaagaggttgctcgccggattggt

SEQ ID NO: 143760 - DNA, 25 bp, E. coli
tacgccagtaaacaggttgcacgcc

SEQ ID NO: 143761 - DNA, 25 bp, E. coli
tacgccagtaaagaggttgcacgcc

SEQ ID NO: 143762 - DNA, 25 bp, E. coli
taaagaggttgcacgccggattggt

SEQ ID NO: 143763 - DNA, 25 bp, E. coli
agtaaagaggttgcacgccggattg

SEQ ID NO: 143764 - DNA, 25 bp, E. coli
agtaaagaggttccacgccggattg

SEQ ID NO: 143765 - DNA, 25 bp, E. coli
ttctggcggacatcgccagcgagcg

SEQ ID NO: 143766 - DNA, 25 bp, E. coli
ttacgccagtaatgaggttgcacgc

SEQ ID NO: 143767 - DNA, 25 bp, E. coli
ttctggcggacaacgccagcgagcg

SEQ ID NO: 143768 - DNA, 25 bp, E. coli
ttacgccagtaaagaggttgcacgc

SEQ ID NO: 143769 - DNA, 25 bp, E. coli
cctttctggcggacaacgccagcga

SEQ ID NO: 143770 - DNA, 25 bp, E. coli
gccagtaaagagcttgcacgccgga

SEQ ID NO: 143771 - DNA, 25 bp, E. coli
ccagtaaagaggttgcacgccggat

SEQ ID NO: 143772 - DNA, 25 bp, E. coli
gccagtaaagaggttgcacgccgga

SEQ ID NO: 143773 - DNA, 25 bp, E. coli
ccagtaaagaggatgcacgccggat

SEQ ID NO: 143774 - DNA, 25 bp, E. coli
cctttctggcggtcaacgccagcga

SEQ ID NO: 143775 - DNA, 25 bp, E. coli
cgccagtaaagaggttgcacgccgg

SEQ ID NO: 143776 - DNA, 25 bp, E. coli
cgccagtaaagacgttgcacgccgg

SEQ ID NO: 143777 - DNA, 25 bp, E. coli
ggttgcacgccgcattggtctgttg

SEQ ID NO: 143778 - DNA, 25 bp, E. coli
ggttgcacgccggattggtctgttg

SEQ ID NO: 143779 - DNA, 25 bp, E. coli
ttcgtcagttgtattaatccccttc

SEQ ID NO: 143780 - DNA, 25 bp, E. coli
ttcgtcagttgttttaatccccttc

SEQ ID NO: 143781 - DNA, 25 bp, E. coli
ttttgcatcgtttatcgataacggg

SEQ ID NO: 143782 - DNA, 25 bp, E. coli
ttttgcatcgttaatcgataacggg

SEQ ID NO: 143783 - DNA, 25 bp, E. coli
taggacagtacacaggttaaccagc

SEQ ID NO: 143784 - DNA, 25 bp, E. coli
taggacagtacagaggttaaccagc

SEQ ID NO: 143785 - DNA, 25 bp, E. coli
tcgataacgggtaggatgctgcgcc

SEQ ID NO: 143786 - DNA, 25 bp, E. coli
tcgataacgggttggatgctgcgcc

SEQ ID NO: 143787 - DNA, 25 bp, E. coli
gccgatagttttatacccataaaga

SEQ ID NO: 143788 - DNA, 25 bp, E. coli
gccgatagttttttacccataaaga

SEQ ID NO: 143789 - DNA, 25 bp, E. coli
cccataaagaataatggtgataact

SEQ ID NO: 143790 - DNA, 25 bp, E. coli
cccataaagaattatggtgataact

SEQ ID NO: 143791 - DNA, 25 bp, E. coli
ttaaagattaagagtaggacagtac

SEQ ID NO: 143792 - DNA, 25 bp, E. coli
ttaaagattaagtgtaggacagtac

SEQ ID NO: 143793 - DNA, 25 bp, E. coli
ggttaaccagcataaggatttgtca

SEQ ID NO: 143794 - DNA, 25 bp, E. coli
ggtgataactatcatcgccaggatg

SEQ ID NO: 143795 - DNA, 25 bp, E. coli
ggtgataactatgatcgccaggatg

SEQ ID NO: 143796 - DNA, 25 bp, E. coli
ggatttgtcattttttcgtcagttg

SEQ ID NO: 143797 - DNA, 25 bp, E. coli
ggatttgtcattatttcgtcagttg

SEQ ID NO: 143798 - DNA, 25 bp, E. coli
ggttaaccagcaaaaggatttgtca

SEQ ID NO: 143799 - DNA, 25 bp, E. coli
gatgctgcgccgttagttttatacc

SEQ ID NO: 143800 - DNA, 25 bp, E. coli
gatgctgcgccgatagttttatacc

SEQ ID NO: 143801 - DNA, 25 bp, E. coli
aaggcgctgcgatgggcctggttaa

SEQ ID NO: 143802 - DNA, 25 bp, E. coli
aaggcgctgcgaagggcctggttaa

SEQ ID NO: 143803 - DNA, 25 bp, E. coli
tacgatgccatagtaataggttccg

SEQ ID NO: 143804 - DNA, 25 bp, E. coli
gccatagtaatacgttccggccccg

SEQ ID NO: 143805 - DNA, 25 bp, E. coli
gccatagtaataggttccggccccg

SEQ ID NO: 143806 - DNA, 25 bp, E. coli
tagctgcgctaaatggcttaaaccg

SEQ ID NO: 143807 - DNA, 25 bp, E. coli
tacgatgccatactaataggttccg

SEQ ID NO: 143808 - DNA, 25 bp, E. coli
tagctgcgctaattggcttaaaccg

SEQ ID NO: 143809 - DNA, 25 bp, E. coli
tatcgggtagctgcgctaaatggct

SEQ ID NO: 143810 - DNA, 25 bp, E. coli
tatcgggtagctccgctaaatggct

SEQ ID NO: 143811 - DNA, 25 bp, E. coli
tgcgctaaatgggttaaaccgcctg

SEQ ID NO: 143812 - DNA, 25 bp, E. coli
tgcgctaaatggcttaaaccgcctg

SEQ ID NO: 143813 - DNA, 25 bp, E. coli
tgccacattcctacgattacgatgc

SEQ ID NO: 143814 - DNA, 25 bp, E. coli
tgccacattccttcgattacgatgc

SEQ ID NO: 143815 - DNA, 25 bp, E. coli
gctaaatggcttaaaccgcctgttt

SEQ ID NO: 143816 - DNA, 25 bp, E. coli
gctaaatggctttaaccgcctgttt

SEQ ID NO: 143817 - DNA, 25 bp, E. coli
gaaaggtgaagcgaacgcacatctg

SEQ ID NO: 143818 - DNA, 25 bp, E. coli
gaaaggtgaagccaacgcacatctg

SEQ ID NO: 143819 - DNA, 25 bp, E. coli
cgctggtgaaaggtgaagccaacgc

SEQ ID NO: 143820 - DNA, 25 bp, E. coli
cgctggtgaaagctgaagccaacgc

SEQ ID NO: 143821 - DNA, 25 bp, E. coli
cattcctacgattacgatgccatag

SEQ ID NO: 143822 - DNA, 25 bp, E. coli
cattcctacgataacgatgccatag

SEQ ID NO: 143823 - DNA, 25 bp, E. coli
cagtatgagcaatcaataattatca

SEQ ID NO: 143824 - DNA, 25 bp, E. coli
cagtatgagcaaacaataattatca

SEQ ID NO: 143825 - DNA, 25 bp, E. coli
aactccctatagaagcgccccgttg

SEQ ID NO: 143826 - DNA, 25 bp, E. coli
aactccctatagtagcgccccgttg

SEQ ID NO: 143827 - DNA, 25 bp, E. coli
tataagtccgtatcttgtctcgatg

SEQ ID NO: 143828 - DNA, 25 bp, E. coli
tataagtccgtaacttgtctcgatg

SEQ ID NO: 143829 - DNA, 25 bp, E. coli
ttgttttaccgcgtgatgggcgaag

SEQ ID NO: 143830 - DNA, 25 bp, E. coli
ttgttttaccgcctgatgggcgaag

SEQ ID NO: 143831 - DNA, 25 bp, E. coli
tgtctcgatgtagatatactgcaca

SEQ ID NO: 143832 - DNA, 25 bp, E. coli
tgaccgttttacaccaactccctat

SEQ ID NO: 143833 - DNA, 25 bp, E. coli
tgaccgttttactccaactccctat

SEQ ID NO: 143834 - DNA, 25 bp, E. coli
tgtctcgatgtacatatactgcaca

SEQ ID NO: 143835 - DNA, 25 bp, E. coli
tgcacaacttgtttacagtatgagc

SEQ ID NO: 143836 - DNA, 25 bp, E. coli
tgcacaacttgtatacagtatgagc

SEQ ID NO: 143837 - DNA, 25 bp, E. coli
gccccgttgccacccatgaggtttg

SEQ ID NO: 143838 - DNA, 25 bp, E. coli
cctgatgggcgaagagaaagaacga

SEQ ID NO: 143839 - DNA, 25 bp, E. coli
cctgatgggcgatgagaaagaacga

SEQ ID NO: 143840 - DNA, 25 bp, E. coli
gccccgttgccagccatgaggtttg

SEQ ID NO: 143841 - DNA, 25 bp, E. coli
gaagtactttggtagtataagtccg

SEQ ID NO: 143842 - DNA, 25 bp, E. coli
gaagtactttggaagtataagtccg

SEQ ID NO: 143843 - DNA, 25 bp, E. coli
cccatgaggtttggtagcaaaacaa

SEQ ID NO: 143844 - DNA, 25 bp, E. coli
cccatgaggtttcgtagcaaaacaa

SEQ ID NO: 143845 - DNA, 25 bp, E. coli
caatgcttggctcgtttcccgctca

SEQ ID NO: 143846 - DNA, 25 bp, E. coli
caatgcttggctggtttcccgctca

SEQ ID NO: 143847 - DNA, 25 bp, E. coli
tacaacatggtcctatgatgccctg

SEQ ID NO: 143848 - DNA, 25 bp, E. coli
tacaacatggtcgtatgatgccctg

SEQ ID NO: 143849 - DNA, 25 bp, E. coli
agcatgaggtgcagacgccggaaaa

SEQ ID NO: 143850 - DNA, 25 bp, E. coli
agaactgccggaggctgaacgacag

SEQ ID NO: 143851 - DNA, 25 bp, E. coli
agcatgaggtgctgacgccggaaaa

SEQ ID NO: 143852 - DNA, 25 bp, E. coli
agaactgccggacgctgaacgacag

SEQ ID NO: 143853 - DNA, 25 bp, E. coli
ttgatgccgaagagggagaactgcc

SEQ ID NO: 143854 - DNA, 25 bp, E. coli
ttgatgccgaagtgggagaactgcc

SEQ ID NO: 143855 - DNA, 25 bp, E. coli
tgtggaatgcggtacagtctcagga

SEQ ID NO: 143856 - DNA, 25 bp, E. coli
tgtggaatgcggaacagtctcagga

SEQ ID NO: 143857 - DNA, 25 bp, E. coli
tccgggctgcagtgaattgaatatc

SEQ ID NO: 143858 - DNA, 25 bp, E. coli
tccgggctgcagagaattgaatatc

SEQ ID NO: 143859 - DNA, 25 bp, E. coli
tcaggatgttgagacgctttgcgca

SEQ ID NO: 143860 - DNA, 25 bp, E. coli
tctggcgtttgtacagcagcgaacg

SEQ ID NO: 143861 - DNA, 25 bp, E. coli
tcaggatgttgacacgctttgcgca

SEQ ID NO: 143862 - DNA, 25 bp, E. coli
tctggcgtttgttcagcagcgaacg

SEQ ID NO: 143863 - DNA, 25 bp, E. coli
gacagattgcttttctgcggatggg

SEQ ID NO: 143864 - DNA, 25 bp, E. coli
gacagattgcttatctgcggatggg

SEQ ID NO: 143865 - DNA, 25 bp, E. coli
taattatgaaaaccagtccgtggtg

SEQ ID NO: 143866 - DNA, 25 bp, E. coli
taattatgaaaagcagtccgtggtg

SEQ ID NO: 143867 - DNA, 25 bp, E. coli
aatgccacgaatcaagagctaaccg

SEQ ID NO: 143868 - DNA, 25 bp, E. coli
aatgccacgaatgaagagctaaccg

SEQ ID NO: 143869 - DNA, 25 bp, E. coli
taaatgccgcatcgtatccgctgca

SEQ ID NO: 143870 - DNA, 25 bp, E. coli
taaatgccgcatggtatccgctgca

SEQ ID NO: 143871 - DNA, 25 bp, E. coli
tatccgctgcattacagccagtgtg

SEQ ID NO: 143872 - DNA, 25 bp, E. coli
tatccgctgcataacagccagtgtg

SEQ ID NO: 143873 - DNA, 25 bp, E. coli
ttcagggaacaattccgttccgtat

SEQ ID NO: 143874 - DNA, 25 bp, E. coli
ttcagggaacaaatccgttccgtat

SEQ ID NO: 143875 - DNA, 25 bp, E. coli
tgtacgatgaatgccgctaaatgcc

SEQ ID NO: 143876 - DNA, 25 bp, E. coli
tgtacgcaattacactccaggacct

SEQ ID NO: 143877 - DNA, 25 bp, E. coli
tgtacgcaattagactccaggacct

SEQ ID NO: 143878 - DNA, 25 bp, E. coli
tgtacgatgaatcccgctaaatgcc

SEQ ID NO: 143879 - DNA, 25 bp, E. coli
tcgtgttcttgttgaaggttcgttc

SEQ ID NO: 143880 - DNA, 25 bp, E. coli
tcgtgttcttgtagaaggttcgttc

SEQ ID NO: 143881 - DNA, 25 bp, E. coli
gagctaaccgttcagtgtacgatga

SEQ ID NO: 143882 - DNA, 25 bp, E. coli
gagctaaccgttgagtgtacgatga

SEQ ID NO: 143883 - DNA, 25 bp, E. coli
ccgttccgtattttgcagcgtggtc

SEQ ID NO: 143884 - DNA, 25 bp, E. coli
ccgttccgtattatgcagcgtggtc

SEQ ID NO: 143885 - DNA, 25 bp, E. coli
gttcgttcagtggtaaatgtacgca

SEQ ID NO: 143886 - DNA, 25 bp, E. coli
gttcgttcagtgctaaatgtacgca

SEQ ID NO: 143887 - DNA, 25 bp, E. coli
ggacctttcaggtgaatgccacgaa

SEQ ID NO: 143888 - DNA, 25 bp, E. coli
ggacctttcaggagaatgccacgaa

SEQ ID NO: 143889 - DNA, 25 bp, E. coli
aattgctggcattaggctacagcgg

SEQ ID NO: 143890 - DNA, 25 bp, E. coli
caagcagtttggacgtaatccgtgg

SEQ ID NO: 143891 - DNA, 25 bp, E. coli
caagcagtttggtcgtaatccgtgg

SEQ ID NO: 143892 - DNA, 25 bp, E. coli
aattgctggcataaggctacagcgg

SEQ ID NO: 143893 - DNA, 25 bp, E. coli
cagatactggaaaacggtaagcggc

SEQ ID NO: 143894 - DNA, 25 bp, E. coli
cagatactggaatacggtaagcggc

SEQ ID NO: 143895 - DNA, 25 bp, E. coli
tatgacagtcttggaaactctctgg

SEQ ID NO: 143896 - DNA, 25 bp, E. coli
tatgacagtcttcgaaactctctgg

SEQ ID NO: 143897 - DNA, 25 bp, E. coli
tcatcgtggcgaaccggaaatcgtc

SEQ ID NO: 143898 - DNA, 25 bp, E. coli
tcatcgtggcgatccggaaatcgtc

SEQ ID NO: 143899 - DNA, 25 bp, E. coli
tctgccagggctccatttagccgga

SEQ ID NO: 143900 - DNA, 25 bp, E. coli
tctgccagggctgcatttagccgga

SEQ ID NO: 143901 - DNA, 25 bp, E. coli
cctcaaggtgttgccggagattgtc

SEQ ID NO: 143902 - DNA, 25 bp, E. coli
cctcaaggtgttcccggagattgtc

SEQ ID NO: 143903 - DNA, 25 bp, E. coli
gaaatcgtcggtggttatgacagtc

SEQ ID NO: 143904 - DNA, 25 bp, E. coli
gaaatcgtcggtcgttatgacagtc

SEQ ID NO: 143905 - DNA, 25 bp, E. coli
gattgtcgccgaaatccagaatctg

SEQ ID NO: 143906 - DNA, 25 bp, E. coli
gattgtcgccgatatccagaatctg

SEQ ID NO: 143907 - DNA, 25 bp, E. coli
ggcgaatccagtctgtgctgcttaa

SEQ ID NO: 143908 - DNA, 25 bp, E. coli
ggcgaatccagtgtgtgctgcttaa

SEQ ID NO: 143909 - DNA, 25 bp, E. coli
gagagcggttttcccctcaaggtgt

SEQ ID NO: 143910 - DNA, 25 bp, E. coli
gagagcggttttgccctcaaggtgt

SEQ ID NO: 143911 - DNA, 25 bp, E. coli
tactgaccagcaatggtacgttaga

SEQ ID NO: 143912 - DNA, 25 bp, E. coli
tactgaccagcattggtacgttaga

SEQ ID NO: 143913 - DNA, 25 bp, E. coli
accaacccgttactcggcgacagtg

SEQ ID NO: 143914 - DNA, 25 bp, E. coli
agacgaagcactgcgcggagcttat

SEQ ID NO: 143915 - DNA, 25 bp, E. coli
agacgaagcactccgcggagcttat

SEQ ID NO: 143916 - DNA, 25 bp, E. coli
accaacccgttagtcggcgacagtg

SEQ ID NO: 143917 - DNA, 25 bp, E. coli
acagtggtgcttcgcgcatctttgg

SEQ ID NO: 143918 - DNA, 25 bp, E. coli
acagtggtgcttggcgcatctttgg

SEQ ID NO: 143919 - DNA, 25 bp, E. coli
ttagacgaagcagtccgcggagctt

SEQ ID NO: 143920 - DNA, 25 bp, E. coli
ttagacgaagcactccgcggagctt

SEQ ID NO: 143921 - DNA, 25 bp, E. coli
tgatgtcaccaacccgttagtcggc

SEQ ID NO: 143922 - DNA, 25 bp, E. coli
tgtgatgtcacctacccgttagtcg

SEQ ID NO: 143923 - DNA, 25 bp, E. coli
tggtacgttagaggaagcactccgc

SEQ ID NO: 143924 - DNA, 25 bp, E. coli
tggtacgttagacgaagcactccgc

SEQ ID NO: 143925 - DNA, 25 bp, E. coli
tgtgatgtcaccaacccgttagtcg

SEQ ID NO: 143926 - DNA, 25 bp, E. coli
tgatgtcaccaagccgttagtcggc

SEQ ID NO: 143927 - DNA, 25 bp, E. coli
tcggcgacagtgctgcttcgcgcat

SEQ ID NO: 143928 - DNA, 25 bp, E. coli
tcggcgacagtggtgcttcgcgcat

SEQ ID NO: 143929 - DNA, 25 bp, E. coli
cgttagtcggcgtcagtggtgcttc

SEQ ID NO: 143930 - DNA, 25 bp, E. coli
cgttagtcggcgacagtggtgcttc

SEQ ID NO: 143931 - DNA, 25 bp, E. coli
cattggtacgttagacgaagcactc

SEQ ID NO: 143932 - DNA, 25 bp, E. coli
cattggtacgtttgacgaagcactc

SEQ ID NO: 143933 - DNA, 25 bp, E. coli
aatgcttggtgataactggtgccac

SEQ ID NO: 143934 - DNA, 25 bp, E. coli
aatgcttggtgaaaactggtgccac

SEQ ID NO: 143935 - DNA, 25 bp, E. coli
catgccgccgtggatattgagaaga

SEQ ID NO: 143936 - DNA, 25 bp, E. coli
catgccgccgtgcatattgagaaga

SEQ ID NO: 143937 - DNA, 25 bp, E. coli
taaacctgtgatcccttcgcactgg

SEQ ID NO: 143938 - DNA, 25 bp, E. coli
taaacctgtgatgccttcgcactgg

SEQ ID NO: 143939 - DNA, 25 bp, E. coli
acgtttctctggacgcgctacggga

SEQ ID NO: 143940 - DNA, 25 bp, E. coli
acgtttctctggtcgcgctacggga

SEQ ID NO: 143941 - DNA, 25 bp, E. coli
tattgttgatacctatggcggcgcg

SEQ ID NO: 143942 - DNA, 25 bp, E. coli
tttggtcgcgacagctttccgtggg

SEQ ID NO: 143943 - DNA, 25 bp, E. coli
tttggtcgcgactgctttccgtggg

SEQ ID NO: 143944 - DNA, 25 bp, E. coli
tattgttgatacgtatggcggcgcg

SEQ ID NO: 143945 - DNA, 25 bp, E. coli
tgtttacctccgaatccgttgccga

SEQ ID NO: 143946 - DNA, 25 bp, E. coli
tgtttacctccgtatccgttgccga

SEQ ID NO: 143947 - DNA, 25 bp, E. coli
tgaaacgtcggatctgatgcccgcc

SEQ ID NO: 143948 - DNA, 25 bp, E. coli
tgaaacgtcggaactgatgcccgcc

SEQ ID NO: 143949 - DNA, 25 bp, E. coli
gctttctggtgatccctgcaggcag

SEQ ID NO: 143950 - DNA, 25 bp, E. coli
gctttctggtgaaccctgcaggcag

SEQ ID NO: 143951 - DNA, 25 bp, E. coli
cggcggcgcgttttcaggcaaagat

SEQ ID NO: 143952 - DNA, 25 bp, E. coli
cggcggcgcgttatcaggcaaagat

SEQ ID NO: 143953 - DNA, 25 bp, E. coli
cattcgcggccactcgatggaagaa

SEQ ID NO: 143954 - DNA, 25 bp, E. coli
cattcgcggccagtcgatggaagaa

SEQ ID NO: 143955 - DNA, 25 bp, E. coli
cacagcatgctctgaagtaatatgg

SEQ ID NO: 143956 - DNA, 25 bp, E. coli
cacagcatgctcagaagtaatatgg

SEQ ID NO: 143957 - DNA, 25 bp, E. coli
catcataggcatccatgcagtgctc

SEQ ID NO: 143958 - DNA, 25 bp, E. coli
catcataggcatgcatgcagtgctc

SEQ ID NO: 143959 - DNA, 25 bp, E. coli
tataacggcagtcaaaattcgcagc

SEQ ID NO: 143960 - DNA, 25 bp, E. coli
tataacggcagtgaaaattcgcagc

SEQ ID NO: 143961 - DNA, 25 bp, E. coli
tctattaatcaaactgagagccgct

SEQ ID NO: 143962 - DNA, 25 bp, E. coli
tctattaatcaatctgagagccgct

SEQ ID NO: 143963 - DNA, 25 bp, E. coli
ccagagcggattggtaagacaatta

SEQ ID NO: 143964 - DNA, 25 bp, E. coli
ccagagcggattcgtaagacaatta

SEQ ID NO: 143965 - DNA, 25 bp, E. coli
gcagtgctctggaagctgtaaagcc

SEQ ID NO: 143966 - DNA, 25 bp, E. coli
gcagtgctctggtagctgtaaagcc

SEQ ID NO: 143967 - DNA, 25 bp, E. coli
ggattttccttgtttccagagcgga

SEQ ID NO: 143968 - DNA, 25 bp, E. coli
ggtaacgctcgtcacatcataggca

SEQ ID NO: 143969 - DNA, 25 bp, E. coli
ggattttccttgattccagagcgga

SEQ ID NO: 143970 - DNA, 25 bp, E. coli
ggtaacgctcgtgacatcataggca

SEQ ID NO: 143971 - DNA, 25 bp, E. coli
ggcggtagcgtggattaatacctct

SEQ ID NO: 143972 - DNA, 25 bp, E. coli
ggcggtagcgtgcattaatacctct

SEQ ID NO: 143973 - DNA, 25 bp, E. coli
taatttgttgcgtatcttcctgccg

SEQ ID NO: 143974 - DNA, 25 bp, E. coli
taatttgttgcgaatcttcctgccg

SEQ ID NO: 143975 - DNA, 25 bp, E. coli
gagagccgcttaattcacagcatgc

SEQ ID NO: 143976 - DNA, 25 bp, E. coli
gagagccgcttatttcacagcatgc

SEQ ID NO: 143977 - DNA, 25 bp, E. coli
taacgacatggtcgcatttagcggc

SEQ ID NO: 143978 - DNA, 25 bp, E. coli
taaaaagatcaatcagggcgcggtg

SEQ ID NO: 143979 - DNA, 25 bp, E. coli
taaaaagatcaaacagggcgcggtg

SEQ ID NO: 143980 - DNA, 25 bp, E. coli
aactcagtggacaaggatgaccgcc

SEQ ID NO: 143981 - DNA, 25 bp, E. coli
aactcagtggactaggatgaccgcc

SEQ ID NO: 143982 - DNA, 25 bp, E. coli
tgacctgcatttgagcgaagtggcg

SEQ ID NO: 143983 - DNA, 25 bp, E. coli
tgacctgcatttcagcgaagtggcg

SEQ ID NO: 143984 - DNA, 25 bp, E. coli
gaaatcatccgtcgtctgggcgtca

SEQ ID NO: 143985 - DNA, 25 bp, E. coli
gaaatcatccgtggtctgggcgtca

SEQ ID NO: 143986 - DNA, 25 bp, E. coli
gacgatgtactttctgacgccgatg

SEQ ID NO: 143987 - DNA, 25 bp, E. coli
gaaaaagattgtcgccgtcgtggaa

SEQ ID NO: 143988 - DNA, 25 bp, E. coli
gaaaaagattgtggccgtcgtggaa

SEQ ID NO: 143989 - DNA, 25 bp, E. coli
cgtcattgaagcatcggcactggca

SEQ ID NO: 143990 - DNA, 25 bp, E. coli
cgtcattgaagcttcggcactggca

SEQ ID NO: 143991 - DNA, 25 bp, E. coli
gattccctgcgcaagatttacgaca

SEQ ID NO: 143992 - DNA, 25 bp, E. coli
gattccctgcgctagatttacgaca

SEQ ID NO: 143993 - DNA, 25 bp, E. coli
gatattgtgattgctggcgcgccac

SEQ ID NO: 143994 - DNA, 25 bp, E. coli
gatattgtgattcctggcgcgccac

SEQ ID NO: 143995 - DNA, 25 bp, E. coli
taaccagcgggaacggtaatgcgcc

SEQ ID NO: 143996 - DNA, 25 bp, E. coli
taacgacatggtggcatttagcggc

SEQ ID NO: 143997 - DNA, 25 bp, E. coli
taaccagcgggatcggtaatgcgcc

SEQ ID NO: 143998 - DNA, 25 bp, E. coli
gacgatgtacttactgacgccgatg

SEQ ID NO: 143999 - DNA, 25 bp, E. coli
caactgcaaaaaatgatcgtccgta

SEQ ID NO: 144000 - DNA, 25 bp, E. coli
caactgcaaaaattgatcgtccgta

SEQ ID NO: 144001 - DNA, 25 bp, E. coli
caccctggcggtcatgttgcagtcc

SEQ ID NO: 144002 - DNA, 25 bp, E. coli
caccctggcggtgatgttgcagtcc

SEQ ID NO: 144003 - DNA, 25 bp, E. coli
tacgatattttttccctcgctcgcg

SEQ ID NO: 144004 - DNA, 25 bp, E. coli
tacgatatttttaccctcgctcgcg

SEQ ID NO: 144005 - DNA, 25 bp, E. coli
taacggcgaatgctacaacacgcgc

SEQ ID NO: 144006 - DNA, 25 bp, E. coli
tgaagccatcttgaactctccgcgt

SEQ ID NO: 144007 - DNA, 25 bp, E. coli
tgaagccatcttcaactctccgcgt

SEQ ID NO: 144008 - DNA, 25 bp, E. coli
tgaccgaaatactacgcctgctgac

SEQ ID NO: 144009 - DNA, 25 bp, E. coli
tgaccgaaatacaacgcctgctgac

SEQ ID NO: 144010 - DNA, 25 bp, E. coli
gctaccgctatgtagatatcgacgt

SEQ ID NO: 144011 - DNA, 25 bp, E. coli
gctaccgctatgaagatatcgacgt

SEQ ID NO: 144012 - DNA, 25 bp, E. coli
cgctcgcgccgaatcaacatcttaa

SEQ ID NO: 144013 - DNA, 25 bp, E. coli
cgcctgctgacccaaacgattgagt

SEQ ID NO: 144014 - DNA, 25 bp, E. coli
cgcctgctgaccgaaacgattgagt

SEQ ID NO: 144015 - DNA, 25 bp, E. coli
cgctcgcgccgattcaacatcttaa

SEQ ID NO: 144016 - DNA, 25 bp, E. coli
gatttccgcgtttgctataacggcg

SEQ ID NO: 144017 - DNA, 25 bp, E. coli
gattgagtctctgaatacccgcgaa

SEQ ID NO: 144018 - DNA, 25 bp, E. coli
gattgagtctctcaatacccgcgaa

SEQ ID NO: 144019 - DNA, 25 bp, E. coli
gatttccgcgttagctataacggcg

SEQ ID NO: 144020 - DNA, 25 bp, E. coli
taacggcgaatggtacaacacgcgc

SEQ ID NO: 144021 - DNA, 25 bp, E. coli
aaagaaactgcttcgtgactcatag

SEQ ID NO: 144022 - DNA, 25 bp, E. coli
aaagaaactgctacgtgactcatag

SEQ ID NO: 144023 - DNA, 25 bp, E. coli
tattctggagacacaaaagaaactg

SEQ ID NO: 144024 - DNA, 25 bp, E. coli
tattctggagactcaaaagaaactg

SEQ ID NO: 144025 - DNA, 25 bp, E. coli
tttgagggatttgctgaacaagtcc

SEQ ID NO: 144026 - DNA, 25 bp, E. coli
tttgagggatttcctgaacaagtcc

SEQ ID NO: 144027 - DNA, 25 bp, E. coli
tgtaccaattgcatcgacatcggct

SEQ ID NO: 144028 - DNA, 25 bp, E. coli
tgtaccaattgcttcgacatcggct

SEQ ID NO: 144029 - DNA, 25 bp, E. coli
tgttttccaatcctaaaaagcgaat

SEQ ID NO: 144030 - DNA, 25 bp, E. coli
tgttttccaatcgtaaaaagcgaat

SEQ ID NO: 144031 - DNA, 25 bp, E. coli
gcttccagtaaacgtaatgtaccaa

SEQ ID NO: 144032 - DNA, 25 bp, E. coli
gcttccagtaaaggtaatgtaccaa

SEQ ID NO: 144033 - DNA, 25 bp, E. coli
gacatcggctgtatattctggagac

SEQ ID NO: 144034 - DNA, 25 bp, E. coli
gaacaagtccatttaattctgaggt

SEQ ID NO: 144035 - DNA, 25 bp, E. coli
gaacaagtccatataattctgaggt

SEQ ID NO: 144036 - DNA, 25 bp, E. coli
gacatcggctgtttattctggagac

SEQ ID NO: 144037 - DNA, 25 bp, E. coli
cgtaaagttttggaactgcataagg

SEQ ID NO: 144038 - DNA, 25 bp, E. coli
cgtaaagttttgcaactgcataagg

SEQ ID NO: 144039 - DNA, 25 bp, E. coli
tcctaaaaagcgtattgcttccagt

SEQ ID NO: 144040 - DNA, 25 bp, E. coli
tcctaaaaagcgaattgcttccagt

SEQ ID NO: 144041 - DNA, 25 bp, E. coli
gaggttgaagcttgatagaaacgcg

SEQ ID NO: 144042 - DNA, 25 bp, E. coli
gaggttgaagctagatagaaacgcg

SEQ ID NO: 144043 - DNA, 25 bp, E. coli
caacttcgaagggacgccggatatg

SEQ ID NO: 144044 - DNA, 25 bp, E. coli
caacttcgaaggcacgccggatatg

SEQ ID NO: 144045 - DNA, 25 bp, E. coli
aggtacatcgcgaaagagcatcatg

SEQ ID NO: 144046 - DNA, 25 bp, E. coli
aggtacatcgcgtaagagcatcatg

SEQ ID NO: 144047 - DNA, 25 bp, E. coli
tagaaggtacatcgcgtaagagcat

SEQ ID NO: 144048 - DNA, 25 bp, E. coli
tagaaggtacatggcgtaagagcat

SEQ ID NO: 144049 - DNA, 25 bp, E. coli
tattctggtagatggtacatcgcgt

SEQ ID NO: 144050 - DNA, 25 bp, E. coli
tattctggtagaaggtacatcgcgt

SEQ ID NO: 144051 - DNA, 25 bp, E. coli
tctggtagaaggaacatcgcgtaag

SEQ ID NO: 144052 - DNA, 25 bp, E. coli
tctggtagaaggtacatcgcgtaag

SEQ ID NO: 144053 - DNA, 25 bp, E. coli
ccagcgtattctggtagaaggtaca

SEQ ID NO: 144054 - DNA, 25 bp, E. coli
ccagcgtattctcgtagaaggtaca

SEQ ID NO: 144055 - DNA, 25 bp, E. coli
ccgcgtggtcaagttcgaaggcacg

SEQ ID NO: 144056 - DNA, 25 bp, E. coli
ccgcgtggtcaacttcgaaggcacg

SEQ ID NO: 144057 - DNA, 25 bp, E. coli
cgtccagatattgagatcagttctg

SEQ ID NO: 144058 - DNA, 25 bp, E. coli
cgtccagatattcagatcagttctg

SEQ ID NO: 144059 - DNA, 25 bp, E. coli
gtcaacttcgaaggcacgccggata

SEQ ID NO: 144060 - DNA, 25 bp, E. coli
gtggtcaacttcgaaggcacgccgg

SEQ ID NO: 144061 - DNA, 25 bp, E. coli
gtggtcaacttccaaggcacgccgg

SEQ ID NO: 144062 - DNA, 25 bp, E. coli
gtcaacttcgaacgcacgccggata

SEQ ID NO: 144063 - DNA, 25 bp, E. coli
ggcgcgtccagaaattcagatcagt

SEQ ID NO: 144064 - DNA, 25 bp, E. coli
ggcgcgtccagatattcagatcagt

SEQ ID NO: 144065 - DNA, 25 bp, E. coli
caacgctaccgtgggcgcaggtttg

SEQ ID NO: 144066 - DNA, 25 bp, E. coli
caacgctaccgtcggcgcaggtttg

SEQ ID NO: 144067 - DNA, 25 bp, E. coli
cattacgtcgttatcagtgcgatct

SEQ ID NO: 144068 - DNA, 25 bp, E. coli
tacgtgttgaatcactggtacctgc

SEQ ID NO: 144069 - DNA, 25 bp, E. coli
acctggctgcgttgctcgacagcgg

SEQ ID NO: 144070 - DNA, 25 bp, E. coli
agcgatcttgagcacctggctgcgt

SEQ ID NO: 144071 - DNA, 25 bp, E. coli
agcgatcttgaggacctggctgcgt

SEQ ID NO: 144072 - DNA, 25 bp, E. coli
acctggctgcgtagctcgacagcgg

SEQ ID NO: 144073 - DNA, 25 bp, E. coli
tacgtgttgaatgactggtacctgc

SEQ ID NO: 144074 - DNA, 25 bp, E. coli
tcaggttcaacaaacattacgtcgt

SEQ ID NO: 144075 - DNA, 25 bp, E. coli
tcaggttcaacatacattacgtcgt

SEQ ID NO: 144076 - DNA, 25 bp, E. coli
gctggcatcactactgccatgcgat

SEQ ID NO: 144077 - DNA, 25 bp, E. coli
gctggcatcacttctgccatgcgat

SEQ ID NO: 144078 - DNA, 25 bp, E. coli
cccgcgtgatgagctttccggcaaa

SEQ ID NO: 144079 - DNA, 25 bp, E. coli
cccgcgtgatgacctttccggcaaa

SEQ ID NO: 144080 - DNA, 25 bp, E. coli
cattacgtcgttttcagtgcgatct

SEQ ID NO: 144081 - DNA, 25 bp, E. coli
ggatattaaccgactggcgcagttg

SEQ ID NO: 144082 - DNA, 25 bp, E. coli
ggatattaaccgtctggcgcagttg

SEQ ID NO: 144083 - DNA, 25 bp, E. coli
ggctgtacaacggtaccgtcggcgc

SEQ ID NO: 144084 - DNA, 25 bp, E. coli
ggctgtacaacgctaccgtcggcgc

SEQ ID NO: 144085 - DNA, 25 bp, E. coli
tcactggtacctccccattgcgaag

SEQ ID NO: 144086 - DNA, 25 bp, E. coli
tcactggtacctgcccattgcgaag

SEQ ID NO: 144087 - DNA, 25 bp, E. coli
caaatgcgtctgctgtcaccacggt

SEQ ID NO: 144088 - DNA, 25 bp, E. coli
caaatgcgtctggtgtcaccacggt

SEQ ID NO: 144089 - DNA, 25 bp, E. coli
cagattactgacgataccggcaagg

SEQ ID NO: 144090 - DNA, 25 bp, E. coli
cagattactgaccataccggcaagg

SEQ ID NO: 144091 - DNA, 25 bp, E. coli
ctttacaaagttgtgcagcgggttc

SEQ ID NO: 144092 - DNA, 25 bp, E. coli
ctttacaaagttctgcagcgggttc

SEQ ID NO: 144093 - DNA, 25 bp, E. coli
taaatgattgtgtctcgcaggtgtc

SEQ ID NO: 144094 - DNA, 25 bp, E. coli
taaatgattgtgactcgcaggtgtc

SEQ ID NO: 144095 - DNA, 25 bp, E. coli
tttagatggaactgcaagctcaacg

SEQ ID NO: 144096 - DNA, 25 bp, E. coli
tttagatggaacagcaagctcaacg

SEQ ID NO: 144097 - DNA, 25 bp, E. coli
gacaggccactgctggtattgccaa

SEQ ID NO: 144098 - DNA, 25 bp, E. coli
gacaggccactggtggtattgccaa

SEQ ID NO: 144099 - DNA, 25 bp, E. coli
gtttactacgcatctggacaggcca

SEQ ID NO: 144100 - DNA, 25 bp, E. coli
gatcagacggtttatcttggacagg

SEQ ID NO: 144101 - DNA, 25 bp, E. coli
gtttactacgcaactggacaggcca

SEQ ID NO: 144102 - DNA, 25 bp, E. coli
gatcagacggttaatcttggacagg

SEQ ID NO: 144103 - DNA, 25 bp, E. coli
ggttctgcaacatacgtcggcgttc

SEQ ID NO: 144104 - DNA, 25 bp, E. coli
ggttctgcaacaaacgtcggcgttc

SEQ ID NO: 144105 - DNA, 25 bp, E. coli
ggaattgtctttacaggcccagcag

SEQ ID NO: 144106 - DNA, 25 bp, E. coli
ggaattgtcttttcaggcccagcag

SEQ ID NO: 144107 - DNA, 25 bp, E. coli
gaccctgggtgtagcgacaaatgcg

SEQ ID NO: 144108 - DNA, 25 bp, E. coli
gaccctgggtgttgcgacaaatgcg

SEQ ID NO: 144109 - DNA, 25 bp, E. coli
tattctgtttggtaagtcgttagcc

SEQ ID NO: 144110 - DNA, 25 bp, E. coli
tattctgtttggaaagtcgttagcc

SEQ ID NO: 144111 - DNA, 25 bp, E. coli
ttctgtttggtaagtcgttagccgc

SEQ ID NO: 144112 - DNA, 25 bp, E. coli
ttctgtttggtatgtcgttagccgc

SEQ ID NO: 144113 - DNA, 25 bp, E. coli
ttttcctggtgcgactgtttggtca

SEQ ID NO: 144114 - DNA, 25 bp, E. coli
ttttcctggtgccactgtttggtca

SEQ ID NO: 144115 - DNA, 25 bp, E. coli
tgttgctgcccgcagtggcaggaat

SEQ ID NO: 144116 - DNA, 25 bp, E. coli
tgttgctgcccggagtggcaggaat

SEQ ID NO: 144117 - DNA, 25 bp, E. coli
cctggtaatggttctgacgctggtg

SEQ ID NO: 144118 - DNA, 25 bp, E. coli
cctggtaatggtactgacgctggtg

SEQ ID NO: 144119 - DNA, 25 bp, E. coli
gcgtcattctgtagatgtttggcgt

SEQ ID NO: 144120 - DNA, 25 bp, E. coli
gctgaactgggcgtcattctgttga

SEQ ID NO: 144121 - DNA, 25 bp, E. coli
gctgaactgggcctcattctgttga

SEQ ID NO: 144122 - DNA, 25 bp, E. coli
gcgtcattctgttgatgtttggcgt

SEQ ID NO: 144123 - DNA, 25 bp, E. coli
gaactgggcgtctttctgttgatgt

SEQ ID NO: 144124 - DNA, 25 bp, E. coli
gaactgggcgtcattctgttgatgt

SEQ ID NO: 144125 - DNA, 25 bp, E. coli
ctggtgcgactgattggtcactccc

SEQ ID NO: 144126 - DNA, 25 bp, E. coli
ctggtgcgactgtttggtcactccc

SEQ ID NO: 144127 - DNA, 25 bp, E. coli
ggtcactcccaaggtacggcattaa

SEQ ID NO: 144128 - DNA, 25 bp, E. coli
ggtcactcccaacgtacggcattaa

SEQ ID NO: 144129 - DNA, 25 bp, E. coli
taatggttctgacgctggtgttgct

SEQ ID NO: 144130 - DNA, 25 bp, E. coli
taatggttctgaggctggtgttgct

SEQ ID NO: 144131 - DNA, 25 bp, E. coli
aatgcaaatggcagggacaaaccgg

SEQ ID NO: 144132 - DNA, 25 bp, E. coli
aatcgcggtagctgcggtagaccaa

SEQ ID NO: 144133 - DNA, 25 bp, E. coli
aatcgcggtagcagcggtagaccaa

SEQ ID NO: 144134 - DNA, 25 bp, E. coli
aatgcaaatggctgggacaaaccgg

SEQ ID NO: 144135 - DNA, 25 bp, E. coli
cattagttgtagaaagctcccgacg

SEQ ID NO: 144136 - DNA, 25 bp, E. coli
tacggtatcacaggttgggaattgc

SEQ ID NO: 144137 - DNA, 25 bp, E. coli
tacggtatcacacgttgggaattgc

SEQ ID NO: 144138 - DNA, 25 bp, E. coli
tagcttccagaggaggaatcacgat

SEQ ID NO: 144139 - DNA, 25 bp, E. coli
tagcttccagagcaggaatcacgat

SEQ ID NO: 144140 - DNA, 25 bp, E. coli
tgatgaatccagtacgaatcgcggt

SEQ ID NO: 144141 - DNA, 25 bp, E. coli
tgatgaatccagaacgaatcgcggt

SEQ ID NO: 144142 - DNA, 25 bp, E. coli
gccggaagaataaggagacagctcg

SEQ ID NO: 144143 - DNA, 25 bp, E. coli
gccggaagaatatggagacagctcg

SEQ ID NO: 144144 - DNA, 25 bp, E. coli
gaaccttcgtgaacatccgtatgaa

SEQ ID NO: 144145 - DNA, 25 bp, E. coli
gaaccttcgtgatcatccgtatgaa

SEQ ID NO: 144146 - DNA, 25 bp, E. coli
gctcccgacgaatgaaccaaatagg

SEQ ID NO: 144147 - DNA, 25 bp, E. coli
gctcccgacgaaagaaccaaatagg

SEQ ID NO: 144148 - DNA, 25 bp, E. coli
cattagttgtagtaagctcccgacg

SEQ ID NO: 144149 - DNA, 25 bp, E. coli
gatttactgagactgacttggccgg

SEQ ID NO: 144150 - DNA, 25 bp, E. coli
gatttactgagagtgacttggccgg

SEQ ID NO: 144151 - DNA, 25 bp, E. coli
gataaagtggctaccatccagaacc

SEQ ID NO: 144152 - DNA, 25 bp, E. coli
gataaagtggcttccatccagaacc

SEQ ID NO: 144153 - DNA, 25 bp, E. coli
aagagtgcttgcagcgctggcagaa

SEQ ID NO: 144154 - DNA, 25 bp, E. coli
aagagtgcttgctgcgctggcagaa

SEQ ID NO: 144155 - DNA, 25 bp, E. coli
cacagcaggcgcaggaaagagtgct

SEQ ID NO: 144156 - DNA, 25 bp, E. coli
cacagcaggcgctggaaagagtgct

SEQ ID NO: 144157 - DNA, 25 bp, E. coli
cagaatgagcagttgcggcaggcac

SEQ ID NO: 144158 - DNA, 25 bp, E. coli
cagaatgagcagatgcggcaggcac

SEQ ID NO: 144159 - DNA, 25 bp, E. coli
tatccgggtgcgagaggcatttcgc

SEQ ID NO: 144160 - DNA, 25 bp, E. coli
tatccgggtgcgtgaggcatttcgc

SEQ ID NO: 144161 - DNA, 25 bp, E. coli
tgcatgttgacagcgcgatggcctg

SEQ ID NO: 144162 - DNA, 25 bp, E. coli
tgcatgttgacaccgcgatggcctg

SEQ ID NO: 144163 - DNA, 25 bp, E. coli
tcgccgtcgtgttgcggagactgaa

SEQ ID NO: 144164 - DNA, 25 bp, E. coli
tcgccgtcgtgtagcggagactgaa

SEQ ID NO: 144165 - DNA, 25 bp, E. coli
gctgttcccacgacttgagccggtg

SEQ ID NO: 144166 - DNA, 25 bp, E. coli
gctgttcccacgtcttgagccggtg

SEQ ID NO: 144167 - DNA, 25 bp, E. coli
gactgaacagcaaggcggaactgag

SEQ ID NO: 144168 - DNA, 25 bp, E. coli
gactgaacagcatggcggaactgag

SEQ ID NO: 144169 - DNA, 25 bp, E. coli
cattaccggaagacgcacgctgttc

SEQ ID NO: 144170 - DNA, 25 bp, E. coli
cattaccggaagtcgcacgctgttc

SEQ ID NO: 144171 - DNA, 25 bp, E. coli
taagtaagctcacctcagcacggct

SEQ ID NO: 144172 - DNA, 25 bp, E. coli
taagtaagctcagctcagcacggct

SEQ ID NO: 144173 - DNA, 25 bp, E. coli
gagctggatattgacaaagacccga

SEQ ID NO: 144174 - DNA, 25 bp, E. coli
gagctggatattcacaaagacccga

SEQ ID NO: 144175 - DNA, 25 bp, E. coli
caaatgcagccacgaaggtgcggct

SEQ ID NO: 144176 - DNA, 25 bp, E. coli
caaatgcagccaggaaggtgcggct

SEQ ID NO: 144177 - DNA, 25 bp, E. coli
caggccatgaaacaaggcgtgcccc

SEQ ID NO: 144178 - DNA, 25 bp, E. coli
catgatattccgacgatggcgtggg

SEQ ID NO: 144179 - DNA, 25 bp, E. coli
catgatattccgtcgatggcgtggg

SEQ ID NO: 144180 - DNA, 25 bp, E. coli
caggccatgaaagaaggcgtgcccc

SEQ ID NO: 144181 - DNA, 25 bp, E. coli
tacctgattgttgaccggacggctg

SEQ ID NO: 144182 - DNA, 25 bp, E. coli
tacctgattgttcaccggacggctg

SEQ ID NO: 144183 - DNA, 25 bp, E. coli
tttttatgatataccgcgtccccgc

SEQ ID NO: 144184 - DNA, 25 bp, E. coli
tttttatgatattccgcgtccccgc

SEQ ID NO: 144185 - DNA, 25 bp, E. coli
tgcacctgccggcatatctgcggag

SEQ ID NO: 144186 - DNA, 25 bp, E. coli
tgcacctgccgggatatctgcggag

SEQ ID NO: 144187 - DNA, 25 bp, E. coli
tcagtggtgcaggttcagaaaatcc

SEQ ID NO: 144188 - DNA, 25 bp, E. coli
tcagtggtgcagcttcagaaaatcc

SEQ ID NO: 144189 - DNA, 25 bp, E. coli
cattatctgcggtttaagcggctgg

SEQ ID NO: 144190 - DNA, 25 bp, E. coli
cattatctgcggattaagcggctgg

SEQ ID NO: 144191 - DNA, 25 bp, E. coli
gtatttacgggcctctgacctgcgg

SEQ ID NO: 144192 - DNA, 25 bp, E. coli
gtatttacgggcgtctgacctgcgg

SEQ ID NO: 144193 - DNA, 25 bp, E. coli
ggcgtactgacctgcgaaaccgttt

SEQ ID NO: 144194 - DNA, 25 bp, E. coli
ggcgtactgaccagcgaaaccgttt

SEQ ID NO: 144195 - DNA, 25 bp, E. coli
gacctgcggcattctggctgaaaaa

SEQ ID NO: 144196 - DNA, 25 bp, E. coli
gacctgcggcatactggctgaaaaa

SEQ ID NO: 144197 - DNA, 25 bp, E. coli
atctggtcccgcctgaagggatgca

SEQ ID NO: 144198 - DNA, 25 bp, E. coli
atctggtcccgcgtgaagggatgca

SEQ ID NO: 144199 - DNA, 25 bp, E. coli
aaacgctgcatcaggtcccgcgtga

SEQ ID NO: 144200 - DNA, 25 bp, E. coli
aaacgctgcatctggtcccgcgtga

SEQ ID NO: 144201 - DNA, 25 bp, E. coli
tttggtgacggtaatgaacagcgcc

SEQ ID NO: 144202 - DNA, 25 bp, E. coli
tttggtgacggttatgaacagcgcc

SEQ ID NO: 144203 - DNA, 25 bp, E. coli
tgaagacgtttctggcggtgttccg

SEQ ID NO: 144204 - DNA, 25 bp, E. coli
tgaagacgtttcaggcggtgttccg

SEQ ID NO: 144205 - DNA, 25 bp, E. coli
gcatggtggttagcgtgcctttttg

SEQ ID NO: 144206 - DNA, 25 bp, E. coli
gcatggtggttaccgtgcctttttg

SEQ ID NO: 144207 - DNA, 25 bp, E. coli
cgccgaaacataaccggacggtgag

SEQ ID NO: 144208 - DNA, 25 bp, E. coli
cccacagggctgaatcctcaactga

SEQ ID NO: 144209 - DNA, 25 bp, E. coli
cgccgaaacatatccggacggtgag

SEQ ID NO: 144210 - DNA, 25 bp, E. coli
cccacagggctgtatcctcaactga

SEQ ID NO: 144211 - DNA, 25 bp, E. coli
gtgcctttttgtcgcgaccgccgaa

SEQ ID NO: 144212 - DNA, 25 bp, E. coli
gtggctgagatataaacgctgcatc

SEQ ID NO: 144213 - DNA, 25 bp, E. coli
gtggctgagataaaaacgctgcatc

SEQ ID NO: 144214 - DNA, 25 bp, E. coli
gtgacggatgagtcaacccggcgct

SEQ ID NO: 144215 - DNA, 25 bp, E. coli
gtgacggatgagacaacccggcgct

SEQ ID NO: 144216 - DNA, 25 bp, E. coli
gtgcctttttgtggcgaccgccgaa

SEQ ID NO: 144217 - DNA, 25 bp, E. coli
ggctgaatcctcaactgaagacgtt

SEQ ID NO: 144218 - DNA, 25 bp, E. coli
ggctgaatcctctactgaagacgtt

SEQ ID NO: 144219 - DNA, 25 bp, E. coli
aatctattctcgtggtcatcgacgc

SEQ ID NO: 144220 - DNA, 25 bp, E. coli
aatctattctcgaggtcatcgacgc

SEQ ID NO: 144221 - DNA, 25 bp, E. coli
caggatcgccaggaatcggttcagg

SEQ ID NO: 144222 - DNA, 25 bp, E. coli
caggatcgccagcaatcggttcagg

SEQ ID NO: 144223 - DNA, 25 bp, E. coli
tattgacttcgcacaaactttgcgg

SEQ ID NO: 144224 - DNA, 25 bp, E. coli
tattgacttcgctcaaactttgcgg

SEQ ID NO: 144225 - DNA, 25 bp, E. coli
tcggttcagggacaggaatttgcaa

SEQ ID NO: 144226 - DNA, 25 bp, E. coli
tcggttcagggagaggaatttgcaa

SEQ ID NO: 144227 - DNA, 25 bp, E. coli
tcatcgacgcaatgttagcaggcgc

SEQ ID NO: 144228 - DNA, 25 bp, E. coli
tcatcgacgcaaagttagcaggcgc

SEQ ID NO: 144229 - DNA, 25 bp, E. coli
gcgtttttgtatacagacagccgga

SEQ ID NO: 144230 - DNA, 25 bp, E. coli
gcgtttttgtattcagacagccgga

SEQ ID NO: 144231 - DNA, 25 bp, E. coli
gcaggcgcgtatgctcgcagatcta

SEQ ID NO: 144232 - DNA, 25 bp, E. coli
gcaggcgcgtatcctcgcagatcta

SEQ ID NO: 144233 - DNA, 25 bp, E. coli
gatcgggcactggaacaggatcgcc

SEQ ID NO: 144234 - DNA, 25 bp, E. coli
gatcgggcactgcaacaggatcgcc

SEQ ID NO: 144235 - DNA, 25 bp, E. coli
tcaaagtcggcgtcgtacgaatcaa

SEQ ID NO: 144236 - DNA, 25 bp, E. coli
tcacctgcaagacagatattgccct

SEQ ID NO: 144237 - DNA, 25 bp, E. coli
taagacaatatgcagcgcaacgccc

SEQ ID NO: 144238 - DNA, 25 bp, E. coli
tcacctgcaagagagatattgccct

SEQ ID NO: 144239 - DNA, 25 bp, E. coli
tcaaagtcggcgacgtacgaatcaa

SEQ ID NO: 144240 - DNA, 25 bp, E. coli
taagacaatatggagcgcaacgccc

SEQ ID NO: 144241 - DNA, 25 bp, E. coli
caaggaagcggtagtcactgcccga

SEQ ID NO: 144242 - DNA, 25 bp, E. coli
caaggaagcggttgtcactgcccga

SEQ ID NO: 144243 - DNA, 25 bp, E. coli
tagtcactgcccgatacggacttta

SEQ ID NO: 144244 - DNA, 25 bp, E. coli
tagtcactgccccatacggacttta

SEQ ID NO: 144245 - DNA, 25 bp, E. coli
tgcccgatacggtctttacataact

SEQ ID NO: 144246 - DNA, 25 bp, E. coli
tgcccgatacggactttacataact

SEQ ID NO: 144247 - DNA, 25 bp, E. coli
ccaggggcaagtatggtaaagcatc

SEQ ID NO: 144248 - DNA, 25 bp, E. coli
ccaggggcaagtttggtaaagcatc

SEQ ID NO: 144249 - DNA, 25 bp, E. coli
gcggtagtcactgcccgatacggac

SEQ ID NO: 144250 - DNA, 25 bp, E. coli
gcggtagtcactccccgatacggac

SEQ ID NO: 144251 - DNA, 25 bp, E. coli
gccccgcacaaggaagcggtagtca

SEQ ID NO: 144252 - DNA, 25 bp, E. coli
cccgcacaaggatgcggtagtcact

SEQ ID NO: 144253 - DNA, 25 bp, E. coli
ccgatacggactttacataactcaa

SEQ ID NO: 144254 - DNA, 25 bp, E. coli
gccccgcacaagcaagcggtagtca

SEQ ID NO: 144255 - DNA, 25 bp, E. coli
ccgatacggactatacataactcaa

SEQ ID NO: 144256 - DNA, 25 bp, E. coli
cccgcacaaggaagcggtagtcact

SEQ ID NO: 144257 - DNA, 25 bp, E. coli
gtccatttaacacattcaaccaggg

SEQ ID NO: 144258 - DNA, 25 bp, E. coli
gtccatttaacagattcaaccaggg

SEQ ID NO: 144259 - DNA, 25 bp, E. coli
gggtccatttaagagattcaaccag

SEQ ID NO: 144260 - DNA, 25 bp, E. coli
gggtccatttaacagattcaaccag

SEQ ID NO: 144261 - DNA, 25 bp, E. coli
ggaagcggtagtcactgcccgatac

SEQ ID NO: 144262 - DNA, 25 bp, E. coli
ggaagcggtagtgactgcccgatac

SEQ ID NO: 144263 - DNA, 25 bp, E. coli
acagcgtgccggtcgatccgaatat

SEQ ID NO: 144264 - DNA, 25 bp, E. coli
acagcgtgccggacgatccgaatat

SEQ ID NO: 144265 - DNA, 25 bp, E. coli
tcgctacccatgaaaataagattgt

SEQ ID NO: 144266 - DNA, 25 bp, E. coli
tcgctacccatgtaaataagattgt

SEQ ID NO: 144267 - DNA, 25 bp, E. coli
gcgccagcgtgatcgctacccatgt

SEQ ID NO: 144268 - DNA, 25 bp, E. coli
gcggcaggtgatatctgacggcaac

SEQ ID NO: 144269 - DNA, 25 bp, E. coli
gcggcaggtgatttctgacggcaac

SEQ ID NO: 144270 - DNA, 25 bp, E. coli
gcgccagcgtgaacgctacccatgt

SEQ ID NO: 144271 - DNA, 25 bp, E. coli
gcagttgcataaccgtttatcgtcg

SEQ ID NO: 144272 - DNA, 25 bp, E. coli
gcagttgcataagcgtttatcgtcg

SEQ ID NO: 144273 - DNA, 25 bp, E. coli
cgctggtggacaaagcacagggtaa

SEQ ID NO: 144274 - DNA, 25 bp, E. coli
cgctggtggacatagcacagggtaa

SEQ ID NO: 144275 - DNA, 25 bp, E. coli
cggtcacctggatccaggcggcgca

SEQ ID NO: 144276 - DNA, 25 bp, E. coli
cggtcacctggaaccaggcggcgca

SEQ ID NO: 144277 - DNA, 25 bp, E. coli
gtttatcgtcgacggcaccgcgtct

SEQ ID NO: 144278 - DNA, 25 bp, E. coli
gtttatcgtcgagggcaccgcgtct

SEQ ID NO: 144279 - DNA, 25 bp, E. coli
tggacaaagcactgggtaacccgct

SEQ ID NO: 144280 - DNA, 25 bp, E. coli
tggacaaagcacagggtaacccgct

SEQ ID NO: 144281 - DNA, 25 bp, E. coli
gatgctgccttcgagcagtatgtgc

SEQ ID NO: 144282 - DNA, 25 bp, E. coli
gatgatattacggagttgcataacc

SEQ ID NO: 144283 - DNA, 25 bp, E. coli
gatgctgccttccagcagtatgtgc

SEQ ID NO: 144284 - DNA, 25 bp, E. coli
gatgatattacgcagttgcataacc

SEQ ID NO: 144285 - DNA, 25 bp, E. coli
aatacggtaacggtattcgccagct

SEQ ID NO: 144286 - DNA, 25 bp, E. coli
aatacggtaacgctattcgccagct

SEQ ID NO: 144287 - DNA, 25 bp, E. coli
ctgccgggctttcatcgggtattca

SEQ ID NO: 144288 - DNA, 25 bp, E. coli
ctgccgggctttgatcgggtattca

SEQ ID NO: 144289 - DNA, 25 bp, E. coli
atacggtaacgctattcgccagctt

SEQ ID NO: 144290 - DNA, 25 bp, E. coli
atacggtaacgcaattcgccagctt

SEQ ID NO: 144291 - DNA, 25 bp, E. coli
taccgctgcgccagcgctggcagaa

SEQ ID NO: 144292 - DNA, 25 bp, E. coli
taccgctgcgcctgcgctggcagaa

SEQ ID NO: 144293 - DNA, 25 bp, E. coli
ccattgaagaatacggtaacgctat

SEQ ID NO: 144294 - DNA, 25 bp, E. coli
ccattgaagaattcggtaacgctat

SEQ ID NO: 144295 - DNA, 25 bp, E. coli
gctgccgggcttagatcgggtattc

SEQ ID NO: 144296 - DNA, 25 bp, E. coli
gctgccgggctttgatcgggtattc

SEQ ID NO: 144297 - DNA, 25 bp, E. coli
gaagaatacggttacgctattcgcc

SEQ ID NO: 144298 - DNA, 25 bp, E. coli
gaagaatacggtaacgctattcgcc

SEQ ID NO: 144299 - DNA, 25 bp, E. coli
gacgccattgaacaatacggtaacg

SEQ ID NO: 144300 - DNA, 25 bp, E. coli
gacgccattgaagaatacggtaacg

SEQ ID NO: 144301 - DNA, 25 bp, E. coli
cgacgccattgaagaatacggtaac

SEQ ID NO: 144302 - DNA, 25 bp, E. coli
cgacgccattgatgaatacggtaac

SEQ ID NO: 144303 - DNA, 25 bp, E. coli
cgccattgaagaatacggtaacgct

SEQ ID NO: 144304 - DNA, 25 bp, E. coli
cgccattgaagattacggtaacgct

SEQ ID NO: 144305 - DNA, 25 bp, E. coli
gttatcagcgacgtaccgctgcgcc

SEQ ID NO: 144306 - DNA, 25 bp, E. coli
gttatcagcgacctaccgctgcgcc

SEQ ID NO: 144307 - DNA, 25 bp, E. coli
aacgcgcctggctggctttgctgcg

SEQ ID NO: 144308 - DNA, 25 bp, E. coli
aacgcgcctggcaggctttgctgcg

SEQ ID NO: 144309 - DNA, 25 bp, E. coli
aacgccgcagaataaagtgcggctg

SEQ ID NO: 144310 - DNA, 25 bp, E. coli
caggagaattaagcctggtggcact

SEQ ID NO: 144311 - DNA, 25 bp, E. coli
caggagaattaaccctggtggcact

SEQ ID NO: 144312 - DNA, 25 bp, E. coli
tactcgccgatacgatgctcatctt

SEQ ID NO: 144313 - DNA, 25 bp, E. coli
tactcgccgataggatgctcatctt

SEQ ID NO: 144314 - DNA, 25 bp, E. coli
agtatcgcgcgaccgcaatcgggtt

SEQ ID NO: 144315 - DNA, 25 bp, E. coli
agtatcgcgcgagcgcaatcgggtt

SEQ ID NO: 144316 - DNA, 25 bp, E. coli
aacgccgcagaaaaaagtgcggctg

SEQ ID NO: 144317 - DNA, 25 bp, E. coli
aaagtgcggctggtagcgttgctca

SEQ ID NO: 144318 - DNA, 25 bp, E. coli
aaagtgcggctgctagcgttgctca

SEQ ID NO: 144319 - DNA, 25 bp, E. coli
tacctttctactggccgatacgatg

SEQ ID NO: 144320 - DNA, 25 bp, E. coli
tagatgcaggagaattaagcctggt

SEQ ID NO: 144321 - DNA, 25 bp, E. coli
tacctttctactcgccgatacgatg

SEQ ID NO: 144322 - DNA, 25 bp, E. coli
tagatgcaggagtattaagcctggt

SEQ ID NO: 144323 - DNA, 25 bp, E. coli
gcggctggtagcgttgctcaatcag

SEQ ID NO: 144324 - DNA, 25 bp, E. coli
gcggctggtagccttgctcaatcag

SEQ ID NO: 144325 - DNA, 25 bp, E. coli
cgcctggcaggctttgctgcgttat

SEQ ID NO: 144326 - DNA, 25 bp, E. coli
cgcctggcaggcattgctgcgttat

SEQ ID NO: 144327 - DNA, 25 bp, E. coli
gggatatagtatggcgcgaccgcaa

SEQ ID NO: 144328 - DNA, 25 bp, E. coli
gggatatagtatcgcgcgaccgcaa

SEQ ID NO: 144329 - DNA, 25 bp, E. coli
catgcagacattaacccgaatgagg

SEQ ID NO: 144330 - DNA, 25 bp, E. coli
catgcagacatttacccgaatgagg

SEQ ID NO: 144331 - DNA, 25 bp, E. coli
taaatcagcagttggccgctgcggc

SEQ ID NO: 144332 - DNA, 25 bp, E. coli
taaatcagcagtaggccgctgcggc

SEQ ID NO: 144333 - DNA, 25 bp, E. coli
tatggcggcgattaagaccctgatg

SEQ ID NO: 144334 - DNA, 25 bp, E. coli
tatggcggcgataaagaccctgatg

SEQ ID NO: 144335 - DNA, 25 bp, E. coli
tccttgatgatgagatggctgcacg

SEQ ID NO: 144336 - DNA, 25 bp, E. coli
tccttgatgatgtgatggctgcacg

SEQ ID NO: 144337 - DNA, 25 bp, E. coli
tcagtcgttgatagctgcctgccaa

SEQ ID NO: 144338 - DNA, 25 bp, E. coli
tcagtcgttgattgctgcctgccaa

SEQ ID NO: 144339 - DNA, 25 bp, E. coli
ccgctgcggcaaatgaagtatggct

SEQ ID NO: 144340 - DNA, 25 bp, E. coli
ccgctgcggcaattgaagtatggct

SEQ ID NO: 144341 - DNA, 25 bp, E. coli
cgttgccccgcataggttgtattag

SEQ ID NO: 144342 - DNA, 25 bp, E. coli
cattttcgtgatattgccgggcggg

SEQ ID NO: 144343 - DNA, 25 bp, E. coli
cgttgccccgcaaaggttgtattag

SEQ ID NO: 144344 - DNA, 25 bp, E. coli
cattttcgtgattttgccgggcggg

SEQ ID NO: 144345 - DNA, 25 bp, E. coli
gattatcaggcgatggaacaggcga

SEQ ID NO: 144346 - DNA, 25 bp, E. coli
gattatcaggcgttggaacaggcga

SEQ ID NO: 144347 - DNA, 25 bp, E. coli
ggagcgctggcaacatcttgatgaa

SEQ ID NO: 144348 - DNA, 25 bp, E. coli
ggagcgctggcatcatcttgatgaa

SEQ ID NO: 144349 - DNA, 25 bp, E. coli
ggttctgtatatcgctacctcgcaa

SEQ ID NO: 144350 - DNA, 25 bp, E. coli
ggttctgtatatggctacctcgcaa

SEQ ID NO: 144351 - DNA, 25 bp, E. coli
acgccaactggcagaactgccgcgt

SEQ ID NO: 144352 - DNA, 25 bp, E. coli
acgccaactggctgaactgccgcgt

SEQ ID NO: 144353 - DNA, 25 bp, E. coli
ttgccgaggccgtcgaacgccaact

SEQ ID NO: 144354 - DNA, 25 bp, E. coli
ttgccgaggccgacgaacgccaact

SEQ ID NO: 144355 - DNA, 25 bp, E. coli
tggtgattgctgacagcggcgctac

SEQ ID NO: 144356 - DNA, 25 bp, E. coli
tgattgctgacaccggcgctacgcc

SEQ ID NO: 144357 - DNA, 25 bp, E. coli
tgattgctgacagcggcgctacgcc

SEQ ID NO: 144358 - DNA, 25 bp, E. coli
tggtgattgctgtcagcggcgctac

SEQ ID NO: 144359 - DNA, 25 bp, E. coli
tcgaacgccaactggcagaactgcc

SEQ ID NO: 144360 - DNA, 25 bp, E. coli
tcgaacgccaacaggcagaactgcc

SEQ ID NO: 144361 - DNA, 25 bp, E. coli
tcggaagtgctggtgattgctgaca

SEQ ID NO: 144362 - DNA, 25 bp, E. coli
tcggaagtgctgctgattgctgaca

SEQ ID NO: 144363 - DNA, 25 bp, E. coli
gccgtcgaacgcgaactggcagaac

SEQ ID NO: 144364 - DNA, 25 bp, E. coli
gccgtcgaacgccaactggcagaac

SEQ ID NO: 144365 - DNA, 25 bp, E. coli
gctggcagatttccagaagcgcatg

SEQ ID NO: 144366 - DNA, 25 bp, E. coli
gctggcagatttgcagaagcgcatg

SEQ ID NO: 144367 - DNA, 25 bp, E. coli
cccgtcggaagtgctggtgattgct

SEQ ID NO: 144368 - DNA, 25 bp, E. coli
cccgtcggaagtcctggtgattgct

SEQ ID NO: 144369 - DNA, 25 bp, E. coli
cgggctggcagaattccagaagcgc

SEQ ID NO: 144370 - DNA, 25 bp, E. coli
cgggctggcagatttccagaagcgc

SEQ ID NO: 144371 - DNA, 25 bp, E. coli
gatatggcgcgtcgcgttgccgagg

SEQ ID NO: 144372 - DNA, 25 bp, E. coli
gatatggcgcgtggcgttgccgagg

SEQ ID NO: 144373 - DNA, 25 bp, E. coli
attatggcgggcgttaaccagacgc

SEQ ID NO: 144374 - DNA, 25 bp, E. coli
agcaattgctgctgggtatgcccgc

SEQ ID NO: 144375 - DNA, 25 bp, E. coli
agcaattgctgcagggtatgcccgc

SEQ ID NO: 144376 - DNA, 25 bp, E. coli
attatggcgggccttaaccagacgc

SEQ ID NO: 144377 - DNA, 25 bp, E. coli
tattcgtccactgcttgatgccatg

SEQ ID NO: 144378 - DNA, 25 bp, E. coli
tattcgtccactccttgatgccatg

SEQ ID NO: 144379 - DNA, 25 bp, E. coli
tccgcgagcggcgaaaattattcgt

SEQ ID NO: 144380 - DNA, 25 bp, E. coli
tccgcgagcggccaaaattattcgt

SEQ ID NO: 144381 - DNA, 25 bp, E. coli
gcgccaaacgtcgagcattttaata

SEQ ID NO: 144382 - DNA, 25 bp, E. coli
gcgccaaacgtccagcattttaata

SEQ ID NO: 144383 - DNA, 25 bp, E. coli
cgcgccagatgctgttcaaagttca

SEQ ID NO: 144384 - DNA, 25 bp, E. coli
cgcgccagatgcagttcaaagttca

SEQ ID NO: 144385 - DNA, 25 bp, E. coli
gttttcgctctcttcgcctggcaga

SEQ ID NO: 144386 - DNA, 25 bp, E. coli
gttttcgctctcatcgcctggcaga

SEQ ID NO: 144387 - DNA, 25 bp, E. coli
ggatctgattgatgcctcgcgctca

SEQ ID NO: 144388 - DNA, 25 bp, E. coli
ggatctgattgaagcctcgcgctca

SEQ ID NO: 144389 - DNA, 25 bp, E. coli
tcactgaagggatcgactgggtcgt

SEQ ID NO: 144390 - DNA, 25 bp, E. coli
tcactgaagggaacgactgggtcgt

SEQ ID NO: 144391 - DNA, 25 bp, E. coli
taatccgtgggaaaccacgccagcg

SEQ ID NO: 144392 - DNA, 25 bp, E. coli
taatccgtgggataccacgccagcg

SEQ ID NO: 144393 - DNA, 25 bp, E. coli
gacgctgatgctcgccctttctatg

SEQ ID NO: 144394 - DNA, 25 bp, E. coli
gacgctgatgctggccctttctatg

SEQ ID NO: 144395 - DNA, 25 bp, E. coli
caacatcaggctgccgagctggcag

SEQ ID NO: 144396 - DNA, 25 bp, E. coli
caacatcaggctcccgagctggcag

SEQ ID NO: 144397 - DNA, 25 bp, E. coli
caggcggcttaaggacctcgcagtt

SEQ ID NO: 144398 - DNA, 25 bp, E. coli
caggcggcttaacgacctcgcagtt

SEQ ID NO: 144399 - DNA, 25 bp, E. coli
tttgtatgactttgccgcctatctt

SEQ ID NO: 144400 - DNA, 25 bp, E. coli
tttgtatgacttagccgcctatctt

SEQ ID NO: 144401 - DNA, 25 bp, E. coli
ttccgacaggataggccgcaagcca

SEQ ID NO: 144402 - DNA, 25 bp, E. coli
ttccgacaggattggccgcaagcca

SEQ ID NO: 144403 - DNA, 25 bp, E. coli
cctatctttcgagggacctgatcca

SEQ ID NO: 144404 - DNA, 25 bp, E. coli
cctatctttcgacggacctgatcca

SEQ ID NO: 144405 - DNA, 25 bp, E. coli
gactttgccgcctatctttcgacgg

SEQ ID NO: 144406 - DNA, 25 bp, E. coli
gactttgccgccaatctttcgacgg

SEQ ID NO: 144407 - DNA, 25 bp, E. coli
ctatctcgctggtggcatggcgttg

SEQ ID NO: 144408 - DNA, 25 bp, E. coli
ctatctcgctggaggcatggcgttg

SEQ ID NO: 144409 - DNA, 25 bp, E. coli
cgtcagtctctaactcgctggaggc

SEQ ID NO: 144410 - DNA, 25 bp, E. coli
cgtcagtctctatctcgctggaggc

SEQ ID NO: 144411 - DNA, 25 bp, E. coli
gattggccgcaacccagtgctgatt

SEQ ID NO: 144412 - DNA, 25 bp, E. coli
gattggccgcaagccagtgctgatt

SEQ ID NO: 144413 - DNA, 25 bp, E. coli
ggcttaacgacctcgcagttcgcct

SEQ ID NO: 144414 - DNA, 25 bp, E. coli
ggcttaacgaccacgcagttcgcct

SEQ ID NO: 144415 - DNA, 25 bp, E. coli
gatcctgattgacgcaggcggctta

SEQ ID NO: 144416 - DNA, 25 bp, E. coli
gatcctgattgaggcaggcggctta

SEQ ID NO: 144417 - DNA, 25 bp, E. coli
aatcagatggttagtagggctccgg

SEQ ID NO: 144418 - DNA, 25 bp, E. coli
aatcagatggtttgtagggctccgg

SEQ ID NO: 144419 - DNA, 25 bp, E. coli
aacaacccgagatgataaacactgg

SEQ ID NO: 144420 - DNA, 25 bp, E. coli
aacaacccgagaagataaacactgg

SEQ ID NO: 144421 - DNA, 25 bp, E. coli
tgtctcaattgacagcaaatgctgt

SEQ ID NO: 144422 - DNA, 25 bp, E. coli
tgtctcaattgagagcaaatgctgt

SEQ ID NO: 144423 - DNA, 25 bp, E. coli
tcttcatgcaacaacccgagatgat

SEQ ID NO: 144424 - DNA, 25 bp, E. coli
tcttcatgcaactacccgagatgat

SEQ ID NO: 144425 - DNA, 25 bp, E. coli
gctgttaagcaattcattgaagaaa

SEQ ID NO: 144426 - DNA, 25 bp, E. coli
gctgttaagcaaatcattgaagaaa

SEQ ID NO: 144427 - DNA, 25 bp, E. coli
gaatgagttgtctcaattgacagca

SEQ ID NO: 144428 - DNA, 25 bp, E. coli
gcaattcattgatgaaaacgctgaa

SEQ ID NO: 144429 - DNA, 25 bp, E. coli
gcaattcattgaagaaaacgctgaa

SEQ ID NO: 144430 - DNA, 25 bp, E. coli
gaatgagttgtcacaattgacagca

SEQ ID NO: 144431 - DNA, 25 bp, E. coli
gaaaacgctgaataagctgccatga

SEQ ID NO: 144432 - DNA, 25 bp, E. coli
gaaaacgctgaaaaagctgccatga

SEQ ID NO: 144433 - DNA, 25 bp, E. coli
gacagcaaatgcagttaagcaattc

SEQ ID NO: 144434 - DNA, 25 bp, E. coli
gacagcaaatgctgttaagcaattc

SEQ ID NO: 144435 - DNA, 25 bp, E. coli
cgctgaaaaagctgccatgatttaa

SEQ ID NO: 144436 - DNA, 25 bp, E. coli
cgctgaaaaagcagccatgatttaa

SEQ ID NO: 144437 - DNA, 25 bp, E. coli
gtatttcttcatgcaacaacccgag

SEQ ID NO: 144438 - DNA, 25 bp, E. coli
gtatttcttcatccaacaacccgag

SEQ ID NO: 144439 - DNA, 25 bp, E. coli
aactgtggcaggctcgtttaccagc

SEQ ID NO: 144440 - DNA, 25 bp, E. coli
caggcggtcacgcttcatttggtac

SEQ ID NO: 144441 - DNA, 25 bp, E. coli
caggcggtcacggttcatttggtac

SEQ ID NO: 144442 - DNA, 25 bp, E. coli
cagtatgtggtgttctccgcaggcg

SEQ ID NO: 144443 - DNA, 25 bp, E. coli
cagtatgtggtgatctccgcaggcg

SEQ ID NO: 144444 - DNA, 25 bp, E. coli
taaaggcgtgctcaatctgcaaagc

SEQ ID NO: 144445 - DNA, 25 bp, E. coli
taaaggcgtgctgaatctgcaaagc

SEQ ID NO: 144446 - DNA, 25 bp, E. coli
aactgtggcagggtcgtttaccagc

SEQ ID NO: 144447 - DNA, 25 bp, E. coli
tatcgctggccttgtgatgctcggc

SEQ ID NO: 144448 - DNA, 25 bp, E. coli
tatcgctggcctagtgatgctcggc

SEQ ID NO: 144449 - DNA, 25 bp, E. coli
tgatgttccaccagatgcgctatga

SEQ ID NO: 144450 - DNA, 25 bp, E. coli
tgaaagaagcctcggtgttccgtac

SEQ ID NO: 144451 - DNA, 25 bp, E. coli
tgaaagaagcctgggtgttccgtac

SEQ ID NO: 144452 - DNA, 25 bp, E. coli
tgatgttccacctgatgcgctatga

SEQ ID NO: 144453 - DNA, 25 bp, E. coli
tccgtactggcgttgtgaagcagcc

SEQ ID NO: 144454 - DNA, 25 bp, E. coli
tgcgcgcttacaacatgagcaacgg

SEQ ID NO: 144455 - DNA, 25 bp, E. coli
tccgtactggcgatgtgaagcagcc

SEQ ID NO: 144456 - DNA, 25 bp, E. coli
tgcgcgcttacatcatgagcaacgg

SEQ ID NO: 144457 - DNA, 25 bp, E. coli
gaacaggaacgttatgccagctcga

SEQ ID NO: 144458 - DNA, 25 bp, E. coli
gaaacgtattggaacgccgcaggac

SEQ ID NO: 144459 - DNA, 25 bp, E. coli
gaaacgtattggtacgccgcaggac

SEQ ID NO: 144460 - DNA, 25 bp, E. coli
gaacaggaacgtaatgccagctcga

SEQ ID NO: 144461 - DNA, 25 bp, E. coli
catacgtggcagtgctatgtaggca

SEQ ID NO: 144462 - DNA, 25 bp, E. coli
catacgtggcagagctatgtaggca

SEQ ID NO: 144463 - DNA, 25 bp, E. coli
atagggaagccgtagcaaagtgcgc

SEQ ID NO: 144464 - DNA, 25 bp, E. coli
atagggaagccgaagcaaagtgcgc

SEQ ID NO: 144465 - DNA, 25 bp, E. coli
tattcgaggagtcaaaggcaaaaaa

SEQ ID NO: 144466 - DNA, 25 bp, E. coli
tattcgaggagtgaaaggcaaaaaa

SEQ ID NO: 144467 - DNA, 25 bp, E. coli
ttttaaatatcgagataacgatcac

SEQ ID NO: 144468 - DNA, 25 bp, E. coli
ttttaaatatcgtgataacgatcac

SEQ ID NO: 144469 - DNA, 25 bp, E. coli
tcctgtcgtttgttttcgatttcaa

SEQ ID NO: 144470 - DNA, 25 bp, E. coli
tcctgtcgtttgatttcgatttcaa

SEQ ID NO: 144471 - DNA, 25 bp, E. coli
ccgtagcaaagtccgcgtgttttta

SEQ ID NO: 144472 - DNA, 25 bp, E. coli
cgacaatatgaaaattattcgagga

SEQ ID NO: 144473 - DNA, 25 bp, E. coli
ccgtagcaaagtgcgcgtgttttta

SEQ ID NO: 144474 - DNA, 25 bp, E. coli
cgacaatatgaatattattcgagga

SEQ ID NO: 144475 - DNA, 25 bp, E. coli
cgtggcagtgctatgtaggcatgat

SEQ ID NO: 144476 - DNA, 25 bp, E. coli
cgtggcagtgctttgtaggcatgat

SEQ ID NO: 144477 - DNA, 25 bp, E. coli
ggcctcccgatagggaagccgtagc

SEQ ID NO: 144478 - DNA, 25 bp, E. coli
ggcctcccgatacggaagccgtagc

SEQ ID NO: 144479 - DNA, 25 bp, E. coli
taacgatcacaataacgacaatatg

SEQ ID NO: 144480 - DNA, 25 bp, E. coli
taacgatcacaaaaacgacaatatg

SEQ ID NO: 144481 - DNA, 25 bp, E. coli
gatgcggtgtaatcatacgtggcag

SEQ ID NO: 144482 - DNA, 25 bp, E. coli
gatgcggtgtaaacatacgtggcag

SEQ ID NO: 144483 - DNA, 25 bp, E. coli
cacctatcagtacagggaaactaca

SEQ ID NO: 144484 - DNA, 25 bp, E. coli
cacctatcagtagagggaaactaca

SEQ ID NO: 144485 - DNA, 25 bp, E. coli
tacagggaaacttcaatgattgacc

SEQ ID NO: 144486 - DNA, 25 bp, E. coli
tacagggaaactacaatgattgacc

SEQ ID NO: 144487 - DNA, 25 bp, E. coli
aaaccctacaagcgcagctgacgcg

SEQ ID NO: 144488 - DNA, 25 bp, E. coli
aaaattgagcaattcgctcgccagg

SEQ ID NO: 144489 - DNA, 25 bp, E. coli
aaaattgagcaaatcgctcgccagg

SEQ ID NO: 144490 - DNA, 25 bp, E. coli
aaaccctacaagggcagctgacgcg

SEQ ID NO: 144491 - DNA, 25 bp, E. coli
tgcctaaaggaaacagggagttcgg

SEQ ID NO: 144492 - DNA, 25 bp, E. coli
tgcctaaaggaatcagggagttcgg

SEQ ID NO: 144493 - DNA, 25 bp, E. coli
gaaactacaatgattgacccgaaaa

SEQ ID NO: 144494 - DNA, 25 bp, E. coli
gaatcaatgccttaaggaatcaggg

SEQ ID NO: 144495 - DNA, 25 bp, E. coli
gaaactacaatgtttgacccgaaaa

SEQ ID NO: 144496 - DNA, 25 bp, E. coli
gaatcaatgcctaaaggaatcaggg

SEQ ID NO: 144497 - DNA, 25 bp, E. coli
cgctcgccaggtacacgaatcaatg

SEQ ID NO: 144498 - DNA, 25 bp, E. coli
cgctcgccaggttcacgaatcaatg

SEQ ID NO: 144499 - DNA, 25 bp, E. coli
ggttcacgaatcaatgcctaaagga

SEQ ID NO: 144500 - DNA, 25 bp, E. coli
ggttcacgaatctatgcctaaagga

SEQ ID NO: 144501 - DNA, 25 bp, E. coli
ggcactcaacacgtatcagtacagg

SEQ ID NO: 144502 - DNA, 25 bp, E. coli
ggcactcaacacctatcagtacagg

SEQ ID NO: 144503 - DNA, 25 bp, E. coli
gatgtggagaaaaaaatccgccaaa

SEQ ID NO: 144504 - DNA, 25 bp, E. coli
gatgtggagaaataaatccgccaaa

SEQ ID NO: 144505 - DNA, 25 bp, E. coli
caacgctgttttgggaacgagactc

SEQ ID NO: 144506 - DNA, 25 bp, E. coli
caacgctgttttcggaacgagactc

SEQ ID NO: 144507 - DNA, 25 bp, E. coli
tctcaagcgtaaggggcatatccaa

SEQ ID NO: 144508 - DNA, 25 bp, E. coli
tctcaagcgtaacgggcatatccaa

SEQ ID NO: 144509 - DNA, 25 bp, E. coli
gcgatacgctaatctcactggctgt

SEQ ID NO: 144510 - DNA, 25 bp, E. coli
gcgatacgctaaactcactggctgt

SEQ ID NO: 144511 - DNA, 25 bp, E. coli
gactcgcgatgtcatgatgccgcct

SEQ ID NO: 144512 - DNA, 25 bp, E. coli
gactcgcgatgtgatgatgccgcct

SEQ ID NO: 144513 - DNA, 25 bp, E. coli
ccgtcattggttaccgggccaggcg

SEQ ID NO: 144514 - DNA, 25 bp, E. coli
ccgtcattggtttccgggccaggcg

SEQ ID NO: 144515 - DNA, 25 bp, E. coli
ctgttttgggaacgagactcgcgat

SEQ ID NO: 144516 - DNA, 25 bp, E. coli
ctcactggctgtatttgtctgggca

SEQ ID NO: 144517 - DNA, 25 bp, E. coli
ctgttttgggaaggagactcgcgat

SEQ ID NO: 144518 - DNA, 25 bp, E. coli
ctcactggctgtttttgtctgggca

SEQ ID NO: 144519 - DNA, 25 bp, E. coli
gggaatagcgatacgctaaactcac

SEQ ID NO: 144520 - DNA, 25 bp, E. coli
gggaaatatttctcaagcgtaaggg

SEQ ID NO: 144521 - DNA, 25 bp, E. coli
gggaatagcgattcgctaaactcac

SEQ ID NO: 144522 - DNA, 25 bp, E. coli
gggaaatatttcacaagcgtaaggg

SEQ ID NO: 144523 - DNA, 25 bp, E. coli
tggcaacgctgtattgggaacgaga

SEQ ID NO: 144524 - DNA, 25 bp, E. coli
tggcaacgctgttttgggaacgaga

SEQ ID NO: 144525 - DNA, 25 bp, E. coli
gagactcgcgatgtgatgatgccgc

SEQ ID NO: 144526 - DNA, 25 bp, E. coli
gagactcgcgatctgatgatgccgc

SEQ ID NO: 144527 - DNA, 25 bp, E. coli
gcgattttcacctgtttcatcgttc

SEQ ID NO: 144528 - DNA, 25 bp, E. coli
gcgattttcaccagtttcatcgttc

SEQ ID NO: 144529 - DNA, 25 bp, E. coli
catgttgtgttgtgggccgctcttt

SEQ ID NO: 144530 - DNA, 25 bp, E. coli
catttcctgataagcaggataaccg

SEQ ID NO: 144531 - DNA, 25 bp, E. coli
catgttgtgttgagggccgctcttt

SEQ ID NO: 144532 - DNA, 25 bp, E. coli
catttcctgatatgcaggataaccg

SEQ ID NO: 144533 - DNA, 25 bp, E. coli
caggataaccgtcaggaagcaggct

SEQ ID NO: 144534 - DNA, 25 bp, E. coli
caggataaccgtgaggaagcaggct

SEQ ID NO: 144535 - DNA, 25 bp, E. coli
tacatgttgtgtagtgggccgctct

SEQ ID NO: 144536 - DNA, 25 bp, E. coli
tacatgttgtgttgtgggccgctct

SEQ ID NO: 144537 - DNA, 25 bp, E. coli
ataaccgtcaggtagcaggctcgaa

SEQ ID NO: 144538 - DNA, 25 bp, E. coli
ataaccgtcaggaagcaggctcgaa

SEQ ID NO: 144539 - DNA, 25 bp, E. coli
tatgcaggataagcgtcaggaagca

SEQ ID NO: 144540 - DNA, 25 bp, E. coli
tatgcaggataaccgtcaggaagca

SEQ ID NO: 144541 - DNA, 25 bp, E. coli
ttttacatgttgtgttgtgggccgc

SEQ ID NO: 144542 - DNA, 25 bp, E. coli
ttttacatgttgagttgtgggccgc

SEQ ID NO: 144543 - DNA, 25 bp, E. coli
tcatcgttcttttttacatgttgtg

SEQ ID NO: 144544 - DNA, 25 bp, E. coli
tcatcgttctttattacatgttgtg

SEQ ID NO: 144545 - DNA, 25 bp, E. coli
gccgctcttttttgtcatttcctga

SEQ ID NO: 144546 - DNA, 25 bp, E. coli
gccgctctttttagtcatttcctga

SEQ ID NO: 144547 - DNA, 25 bp, E. coli
gatatgcaggattaccgtcaggaag

SEQ ID NO: 144548 - DNA, 25 bp, E. coli
gatatgcaggataaccgtcaggaag

SEQ ID NO: 144549 - DNA, 25 bp, E. coli
aagtcacttcttgttgctggcgtag

SEQ ID NO: 144550 - DNA, 25 bp, E. coli
aagtcacttcttcttgctggcgtag

SEQ ID NO: 144551 - DNA, 25 bp, E. coli
catgctgagtcacggtggaactact

SEQ ID NO: 144552 - DNA, 25 bp, E. coli
catgctgagtcagggtggaactact

SEQ ID NO: 144553 - DNA, 25 bp, E. coli
tacagcaaataccatgacgggtcag

SEQ ID NO: 144554 - DNA, 25 bp, E. coli
tacagcaaatacgatgacgggtcag

SEQ ID NO: 144555 - DNA, 25 bp, E. coli
agccagagcggccaagtaactttag

SEQ ID NO: 144556 - DNA, 25 bp, E. coli
agccagagcggcgaagtaactttag

SEQ ID NO: 144557 - DNA, 25 bp, E. coli
taccaaagaaactgaaatcggcggc

SEQ ID NO: 144558 - DNA, 25 bp, E. coli
taccaaagaaacagaaatcggcggc

SEQ ID NO: 144559 - DNA, 25 bp, E. coli
gcgaaggttactttcactacagcaa

SEQ ID NO: 144560 - DNA, 25 bp, E. coli
gcgaaggttactatcactacagcaa

SEQ ID NO: 144561 - DNA, 25 bp, E. coli
cgttggcgtacgaattctggacagc

SEQ ID NO: 144562 - DNA, 25 bp, E. coli
cgctcaggctgactacaagattgct

SEQ ID NO: 144563 - DNA, 25 bp, E. coli
cgttggcgtacgtattctggacagc

SEQ ID NO: 144564 - DNA, 25 bp, E. coli
cgctcaggctgagtacaagattgct

SEQ ID NO: 144565 - DNA, 25 bp, E. coli
ctgggtgaagtagcagataccgtac

SEQ ID NO: 144566 - DNA, 25 bp, E. coli
ctgggtgaagtaccagataccgtac

SEQ ID NO: 144567 - DNA, 25 bp, E. coli
taacgtgtttgctgatgaaggtcac

SEQ ID NO: 144568 - DNA, 25 bp, E. coli
tcaaagctcgtatggaatccccaag

SEQ ID NO: 144569 - DNA, 25 bp, E. coli
taacgtgtttgcagatgaaggtcac

SEQ ID NO: 144570 - DNA, 25 bp, E. coli
tcaaagctcgtaaggaatccccaag

SEQ ID NO: 144571 - DNA, 25 bp, E. coli
tatcactgatcgacagggtaacgcg

SEQ ID NO: 144572 - DNA, 25 bp, E. coli
tattcgtgctctcaacgccgcaggt

SEQ ID NO: 144573 - DNA, 25 bp, E. coli
tattcgtgctctgaacgccgcaggt

SEQ ID NO: 144574 - DNA, 25 bp, E. coli
tatcactgatcgtcagggtaacgcg

SEQ ID NO: 144575 - DNA, 25 bp, E. coli
tgacggcgtggcacatatccatgct

SEQ ID NO: 144576 - DNA, 25 bp, E. coli
tgacggcgtggctcatatccatgct

SEQ ID NO: 144577 - DNA, 25 bp, E. coli
tgcgctgacgccgtgaaagaatacg

SEQ ID NO: 144578 - DNA, 25 bp, E. coli
tgcgctgacgccctgaaagaatacg

SEQ ID NO: 144579 - DNA, 25 bp, E. coli
tccggtttccgtcgttctcgcaaat

SEQ ID NO: 144580 - DNA, 25 bp, E. coli
tccggtttccgtggttctcgcaaat

SEQ ID NO: 144581 - DNA, 25 bp, E. coli
gaatacggcatctagaatctggaag

SEQ ID NO: 144582 - DNA, 25 bp, E. coli
gaatacggcatcaagaatctggaag

SEQ ID NO: 144583 - DNA, 25 bp, E. coli
gcaaaggcaccatttcgtgcacgta

SEQ ID NO: 144584 - DNA, 25 bp, E. coli
gcaggtttccgcttcactaacatta

SEQ ID NO: 144585 - DNA, 25 bp, E. coli
gcaggtttccgcatcactaacatta

SEQ ID NO: 144586 - DNA, 25 bp, E. coli
gcaaaggcaccaattcgtgcacgta

SEQ ID NO: 144587 - DNA, 25 bp, E. coli
ggtccaggccgcgaatctactattc

SEQ ID NO: 144588 - DNA, 25 bp, E. coli
ggtccaggccgccaatctactattc

SEQ ID NO: 144589 - DNA, 25 bp, E. coli
taagaaaacaagtctctgacggcgt

SEQ ID NO: 144590 - DNA, 25 bp, E. coli
taagaaaacaagactctgacggcgt

SEQ ID NO: 144591 - DNA, 25 bp, E. coli
taacgcgttgggatgggcaacagcc

SEQ ID NO: 144592 - DNA, 25 bp, E. coli
taacgcgttgggttgggcaacagcc

SEQ ID NO: 144593 - DNA, 25 bp, E. coli
tacacgtcggatttgccatgagcat

SEQ ID NO: 144594 - DNA, 25 bp, E. coli
tacacgtcggatatgccatgagcat

SEQ ID NO: 144595 - DNA, 25 bp, E. coli
tattggcgttccaggccaggtgctg

SEQ ID NO: 144596 - DNA, 25 bp, E. coli
tattggcgttcctggccaggtgctg

SEQ ID NO: 144597 - DNA, 25 bp, E. coli
ttgaagtatgtgctatcaagcgcga

SEQ ID NO: 144598 - DNA, 25 bp, E. coli
ttgaagtatgtggtatcaagcgcga

SEQ ID NO: 144599 - DNA, 25 bp, E. coli
tgctggctgtcggtgaagatattca

SEQ ID NO: 144600 - DNA, 25 bp, E. coli
tgctggctgtcgctgaagatattca

SEQ ID NO: 144601 - DNA, 25 bp, E. coli
ccaaagccacattagacgcactgcg

SEQ ID NO: 144602 - DNA, 25 bp, E. coli
ccaaagccacataagacgcactgcg

SEQ ID NO: 144603 - DNA, 25 bp, E. coli
ccagcttgcgcaggttgaagtatgt

SEQ ID NO: 144604 - DNA, 25 bp, E. coli
ccagcttgcgcacgttgaagtatgt

SEQ ID NO: 144605 - DNA, 25 bp, E. coli
gaatatcgccctcatttgtgaaggt

SEQ ID NO: 144606 - DNA, 25 bp, E. coli
gaatatcgccctgatttgtgaaggt

SEQ ID NO: 144607 - DNA, 25 bp, E. coli
gaagatattcaccagcttgcgcagg

SEQ ID NO: 144608 - DNA, 25 bp, E. coli
gaagatattcacgagcttgcgcagg

SEQ ID NO: 144609 - DNA, 25 bp, E. coli
tggattacgacaataccagcgcgtg

SEQ ID NO: 144610 - DNA, 25 bp, E. coli
tggattacgacattaccagcgcgtg

SEQ ID NO: 144611 - DNA, 25 bp, E. coli
tttgtgaaggtaaccctgccgatct

SEQ ID NO: 144612 - DNA, 25 bp, E. coli
tttgtgaaggtatccctgccgatct

SEQ ID NO: 144613 - DNA, 25 bp, E. coli
gacgcactgcgccaaatggattacg

SEQ ID NO: 144614 - DNA, 25 bp, E. coli
gacgcactgcgcgaaatggattacg

SEQ ID NO: 144615 - DNA, 25 bp, E. coli
cacactctggcgatcagccttgaga

SEQ ID NO: 144616 - DNA, 25 bp, E. coli
cacactctggcgttcagccttgaga

SEQ ID NO: 144617 - DNA, 25 bp, E. coli
taaatcggtatgcagcgatctcctc

SEQ ID NO: 144618 - DNA, 25 bp, E. coli
taaatcggtatggagcgatctcctc

SEQ ID NO: 144619 - DNA, 25 bp, E. coli
aacatctccagagctggtattgccg

SEQ ID NO: 144620 - DNA, 25 bp, E. coli
aacatctccagacctggtattgccg

SEQ ID NO: 144621 - DNA, 25 bp, E. coli
tattgccgtcagctgcgttctgcac

SEQ ID NO: 144622 - DNA, 25 bp, E. coli
tttgatctggtctgggataatggcg

SEQ ID NO: 144623 - DNA, 25 bp, E. coli
tattgccgtcaggtgcgttctgcac

SEQ ID NO: 144624 - DNA, 25 bp, E. coli
tttgatctggtcagggataatggcg

SEQ ID NO: 144625 - DNA, 25 bp, E. coli
tgagataatgctctaccacgacgat

SEQ ID NO: 144626 - DNA, 25 bp, E. coli
tgcataacccgaccgacaaacatct

SEQ ID NO: 144627 - DNA, 25 bp, E. coli
tgcataacccgagcgacaaacatct

SEQ ID NO: 144628 - DNA, 25 bp, E. coli
tgagataatgctgtaccacgacgat

SEQ ID NO: 144629 - DNA, 25 bp, E. coli
tgcccgagtggcaagtgcataaccc

SEQ ID NO: 144630 - DNA, 25 bp, E. coli
tgcccgagtggctagtgcataaccc

SEQ ID NO: 144631 - DNA, 25 bp, E. coli
tgcggcgttgcacgttaatttgaaa

SEQ ID NO: 144632 - DNA, 25 bp, E. coli
tgcggcgttgcaggttaatttgaaa

SEQ ID NO: 144633 - DNA, 25 bp, E. coli
gacgatgaaccgctaacgtttgatc

SEQ ID NO: 144634 - DNA, 25 bp, E. coli
gaaagaagcgtactgccacactctg

SEQ ID NO: 144635 - DNA, 25 bp, E. coli
gacgatgaaccggtaacgtttgatc

SEQ ID NO: 144636 - DNA, 25 bp, E. coli
gaaagaagcgtagtgccacactctg

SEQ ID NO: 144637 - DNA, 25 bp, E. coli
aatctgcctggatataacgaaggta

SEQ ID NO: 144638 - DNA, 25 bp, E. coli
aatctgcctggaaataacgaaggta

SEQ ID NO: 144639 - DNA, 25 bp, E. coli
catccatgaggattgggccgtgaaa

SEQ ID NO: 144640 - DNA, 25 bp, E. coli
catccatgaggaatgggccgtgaaa

SEQ ID NO: 144641 - DNA, 25 bp, E. coli
taacggcggctatacgcattgtttt

SEQ ID NO: 144642 - DNA, 25 bp, E. coli
aaataaacggcccatccatgaggaa

SEQ ID NO: 144643 - DNA, 25 bp, E. coli
aaataaacggccgatccatgaggaa

SEQ ID NO: 144644 - DNA, 25 bp, E. coli
taaaaggaacaagatgacttacatg

SEQ ID NO: 144645 - DNA, 25 bp, E. coli
taaaaggaacaacatgacttacatg

SEQ ID NO: 144646 - DNA, 25 bp, E. coli
gacttacatgaatttaacggcggct

SEQ ID NO: 144647 - DNA, 25 bp, E. coli
gacttacatgaaattaacggcggct

SEQ ID NO: 144648 - DNA, 25 bp, E. coli
gaaagtcagttataaaatctgcctg

SEQ ID NO: 144649 - DNA, 25 bp, E. coli
gaaagtcagttaaaaaatctgcctg

SEQ ID NO: 144650 - DNA, 25 bp, E. coli
cgccagttttcaaacgaaagtcagt

SEQ ID NO: 144651 - DNA, 25 bp, E. coli
cgccagttttcatacgaaagtcagt

SEQ ID NO: 144652 - DNA, 25 bp, E. coli
taacagcggagtccgcggttaaata

SEQ ID NO: 144653 - DNA, 25 bp, E. coli
taatccagttttggaaaaacgccag

SEQ ID NO: 144654 - DNA, 25 bp, E. coli
taatccagttttcgaaaaacgccag

SEQ ID NO: 144655 - DNA, 25 bp, E. coli
taacagcggagtgcgcggttaaata

SEQ ID NO: 144656 - DNA, 25 bp, E. coli
taacggcggctaaacgcattgtttt

SEQ ID NO: 144657 - DNA, 25 bp, E. coli
gatgcatatcctgcggttaacagcg

SEQ ID NO: 144658 - DNA, 25 bp, E. coli
gatgcatatcctccggttaacagcg

SEQ ID NO: 144659 - DNA, 25 bp, E. coli
catggtggatgcaggaaccagtccg

SEQ ID NO: 144660 - DNA, 25 bp, E. coli
catggtggatgctggaaccagtccg

SEQ ID NO: 144661 - DNA, 25 bp, E. coli
agcctgctcttcagtgcatggtgga

SEQ ID NO: 144662 - DNA, 25 bp, E. coli
agcctgctcttctgtgcatggtgga

SEQ ID NO: 144663 - DNA, 25 bp, E. coli
atgaaaacgccgaccgcacctgctg

SEQ ID NO: 144664 - DNA, 25 bp, E. coli
atgaaaacgccgtccgcacctgctg

SEQ ID NO: 144665 - DNA, 25 bp, E. coli
tatccattcagcgtgctcttcagtg

SEQ ID NO: 144666 - DNA, 25 bp, E. coli
tatccattcagcctgctcttcagtg

SEQ ID NO: 144667 - DNA, 25 bp, E. coli
ttcagcctgctcatcagtgcatggt

SEQ ID NO: 144668 - DNA, 25 bp, E. coli
ttcagcctgctcttcagtgcatggt

SEQ ID NO: 144669 - DNA, 25 bp, E. coli
tggtggatgctgcaaccagtccgat

SEQ ID NO: 144670 - DNA, 25 bp, E. coli
tggtggatgctggaaccagtccgat

SEQ ID NO: 144671 - DNA, 25 bp, E. coli
tgaattatccatacagcctgctctt

SEQ ID NO: 144672 - DNA, 25 bp, E. coli
tgaattatccattcagcctgctctt

SEQ ID NO: 144673 - DNA, 25 bp, E. coli
tgaatgcatgaatacgccgtccgca

SEQ ID NO: 144674 - DNA, 25 bp, E. coli
tgaatgcatgaaaacgccgtccgca

SEQ ID NO: 144675 - DNA, 25 bp, E. coli
gaatgcatgaaatcgccgtccgcac

SEQ ID NO: 144676 - DNA, 25 bp, E. coli
gaatgcatgaaaacgccgtccgcac

SEQ ID NO: 144677 - DNA, 25 bp, E. coli
cgatttgaatgcttgaaaacgccgt

SEQ ID NO: 144678 - DNA, 25 bp, E. coli
cgatttgaatgcatgaaaacgccgt

SEQ ID NO: 144679 - DNA, 25 bp, E. coli
tggatgctggaaccagtccgatttg

SEQ ID NO: 144680 - DNA, 25 bp, E. coli
tggatgctggaagcagtccgatttg

SEQ ID NO: 144681 - DNA, 25 bp, E. coli
cagggttttcacattgtcgattgcg

SEQ ID NO: 144682 - DNA, 25 bp, E. coli
cagggttttcactttgtcgattgcg

SEQ ID NO: 144683 - DNA, 25 bp, E. coli
catggcaggatgtaacccaactacc

SEQ ID NO: 144684 - DNA, 25 bp, E. coli
catggcaggatgaaacccaactacc

SEQ ID NO: 144685 - DNA, 25 bp, E. coli
atgattcgggaagcgcaacgttcag

SEQ ID NO: 144686 - DNA, 25 bp, E. coli
atgattcgggaaccgcaacgttcag

SEQ ID NO: 144687 - DNA, 25 bp, E. coli
atgtttgtcgcagcgaaggccgtca

SEQ ID NO: 144688 - DNA, 25 bp, E. coli
atgtttgtcgcaccgaaggccgtca

SEQ ID NO: 144689 - DNA, 25 bp, E. coli
acattgtcgattgcgcatggcagga

SEQ ID NO: 144690 - DNA, 25 bp, E. coli
acattgtcgattccgcatggcagga

SEQ ID NO: 144691 - DNA, 25 bp, E. coli
ttggtaaggcgcagatgcagtatgt

SEQ ID NO: 144692 - DNA, 25 bp, E. coli
ttggtaaggcgctgatgcagtatgt

SEQ ID NO: 144693 - DNA, 25 bp, E. coli
ttatggaaggcccatttctggcagc

SEQ ID NO: 144694 - DNA, 25 bp, E. coli
ttatggaaggccgatttctggcagc

SEQ ID NO: 144695 - DNA, 25 bp, E. coli
tcctcgaactgtggctggaaagtac

SEQ ID NO: 144696 - DNA, 25 bp, E. coli
tcctcgaactgtcgctggaaagtac

SEQ ID NO: 144697 - DNA, 25 bp, E. coli
gctgatgcagtatgtgcagcagcgc

SEQ ID NO: 144698 - DNA, 25 bp, E. coli
gctgatgcagtaagtgcagcagcgc

SEQ ID NO: 144699 - DNA, 25 bp, E. coli
gaagcgcaacgtacagaactccccg

SEQ ID NO: 144700 - DNA, 25 bp, E. coli
gaagcgcaacgttcagaactccccg

SEQ ID NO: 144701 - DNA, 25 bp, E. coli
ctgatgctggaggtttatcaaaaaa

SEQ ID NO: 144702 - DNA, 25 bp, E. coli
ctgatgctggagctttatcaaaaaa

SEQ ID NO: 144703 - DNA, 25 bp, E. coli
caatcagtggccaggttgtgctcac

SEQ ID NO: 144704 - DNA, 25 bp, E. coli
caatcagtggcctggttgtgctcac

SEQ ID NO: 144705 - DNA, 25 bp, E. coli
cactggcgctggtgagccgtaagaa

SEQ ID NO: 144706 - DNA, 25 bp, E. coli
cactggcgctggagagccgtaagaa

SEQ ID NO: 144707 - DNA, 25 bp, E. coli
tactcttttcctcgtggctgctcgg

SEQ ID NO: 144708 - DNA, 25 bp, E. coli
taaatacacctttgccattgccctg

SEQ ID NO: 144709 - DNA, 25 bp, E. coli
taaatacaccttagccattgccctg

SEQ ID NO: 144710 - DNA, 25 bp, E. coli
tactcttttcctggtggctgctcgg

SEQ ID NO: 144711 - DNA, 25 bp, E. coli
aggaaagagcaacccactggcaatc

SEQ ID NO: 144712 - DNA, 25 bp, E. coli
aggaaagagcaagccactggcaatc

SEQ ID NO: 144713 - DNA, 25 bp, E. coli
tttattacgtggacgcggaatgcgc

SEQ ID NO: 144714 - DNA, 25 bp, E. coli
tttattacgtggtcgcggaatgcgc

SEQ ID NO: 144715 - DNA, 25 bp, E. coli
tgtttctcggtgtacgcctgcgacg

SEQ ID NO: 144716 - DNA, 25 bp, E. coli
tgtttctcggtgaacgcctgcgacg

SEQ ID NO: 144717 - DNA, 25 bp, E. coli
tcttcgatgaaatgtgccatgctgg

SEQ ID NO: 144718 - DNA, 25 bp, E. coli
tcttcgatgaaaagtgccatgctgg

SEQ ID NO: 144719 - DNA, 25 bp, E. coli
cattgccctgtttcaaacctgcggg

SEQ ID NO: 144720 - DNA, 25 bp, E. coli
cattgccctgttacaaacctgcggg

SEQ ID NO: 144721 - DNA, 25 bp, E. coli
tggtcgctttactggtgccgcaacg

SEQ ID NO: 144722 - DNA, 25 bp, E. coli
tggtcgctttacaggtgccgcaacg

SEQ ID NO: 144723 - DNA, 25 bp, E. coli
gagctataccatgccgttctgggtg

SEQ ID NO: 144724 - DNA, 25 bp, E. coli
gagctataccatcccgttctgggtg

SEQ ID NO: 144725 - DNA, 25 bp, E. coli
cagccactttcaggttattgccgtg

SEQ ID NO: 144726 - DNA, 25 bp, E. coli
cagccactttcacgttattgccgtg

SEQ ID NO: 144727 - DNA, 25 bp, E. coli
atgaacgctctctccctccaggaag

SEQ ID NO: 144728 - DNA, 25 bp, E. coli
atgaacgctctcaccctccaggaag

SEQ ID NO: 144729 - DNA, 25 bp, E. coli
aaattcagagcgagttgatgaacgc

SEQ ID NO: 144730 - DNA, 25 bp, E. coli
aaattcagagcgtgttgatgaacgc

SEQ ID NO: 144731 - DNA, 25 bp, E. coli
tattgccgtgggtgagttgtttgac

SEQ ID NO: 144732 - DNA, 25 bp, E. coli
tattgccgtgggagagttgtttgac

SEQ ID NO: 144733 - DNA, 25 bp, E. coli
ttaaaaaacagctgacggtctatgg

SEQ ID NO: 144734 - DNA, 25 bp, E. coli
ttaaaaaacagcagacggtctatgg

SEQ ID NO: 144735 - DNA, 25 bp, E. coli
tgtttgacggcatgagtcgggttaa

SEQ ID NO: 144736 - DNA, 25 bp, E. coli
tgtttgacggcaagagtcgggttaa

SEQ ID NO: 144737 - DNA, 25 bp, E. coli
tgaagatcccatcgaaaataatgaa

SEQ ID NO: 144738 - DNA, 25 bp, E. coli
tgaagatcccatggaaaataatgaa

SEQ ID NO: 144739 - DNA, 25 bp, E. coli
gcgatggcagccactttcaggttat

SEQ ID NO: 144740 - DNA, 25 bp, E. coli
gcgatggcagcctctttcaggttat

SEQ ID NO: 144741 - DNA, 25 bp, E. coli
gcatgagtcgggttaaaaaacagca

SEQ ID NO: 144742 - DNA, 25 bp, E. coli
gcatgagtcgggataaaaaacagca

SEQ ID NO: 144743 - DNA, 25 bp, E. coli
gaagtccacgtttccggcgatggca

SEQ ID NO: 144744 - DNA, 25 bp, E. coli
gaagtccacgttaccggcgatggca

SEQ ID NO: 144745 - DNA, 25 bp, E. coli
gatggaatatattgcggataaccgc

SEQ ID NO: 144746 - DNA, 25 bp, E. coli
gatggaatatatagcggataaccgc

SEQ ID NO: 144747 - DNA, 25 bp, E. coli
caatgataatctgacctgggtgcgc

SEQ ID NO: 144748 - DNA, 25 bp, E. coli
caatgataatctcacctgggtgcgc

SEQ ID NO: 144749 - DNA, 25 bp, E. coli
cacttagcgagcaggttgccggagc

SEQ ID NO: 144750 - DNA, 25 bp, E. coli
cacttagcgagctggttgccggagc

SEQ ID NO: 144751 - DNA, 25 bp, E. coli
tatgcaaaatcctaatacgtcgccg

SEQ ID NO: 144752 - DNA, 25 bp, E. coli
tatgcaaaatccaaatacgtcgccg

SEQ ID NO: 144753 - DNA, 25 bp, E. coli
tatgctgacccggtcgaaaattcgt

SEQ ID NO: 144754 - DNA, 25 bp, E. coli
tatgaattatgccatggcgtcgccg

SEQ ID NO: 144755 - DNA, 25 bp, E. coli
tatgctgacccgctcgaaaattcgt

SEQ ID NO: 144756 - DNA, 25 bp, E. coli
tatgaattatgcgatggcgtcgccg

SEQ ID NO: 144757 - DNA, 25 bp, E. coli
tattatcgataacctgctcgcccgc

SEQ ID NO: 144758 - DNA, 25 bp, E. coli
tattatcgataagctgctcgcccgc

SEQ ID NO: 144759 - DNA, 25 bp, E. coli
tgtttgactggaagctgcgcggcct

SEQ ID NO: 144760 - DNA, 25 bp, E. coli
tgtttgactggatgctgcgcggcct

SEQ ID NO: 144761 - DNA, 25 bp, E. coli
tgaatcaaactgtcgcggtgacggg

SEQ ID NO: 144762 - DNA, 25 bp, E. coli
tgaatcaaactgacgcggtgacggg

SEQ ID NO: 144763 - DNA, 25 bp, E. coli
tctgtttatctcatcgctggcggcg

SEQ ID NO: 144764 - DNA, 25 bp, E. coli
tctgtttatctcttcgctggcggcg

SEQ ID NO: 144765 - DNA, 25 bp, E. coli
ccgatttcgcgcaagcagtgggtca

SEQ ID NO: 144766 - DNA, 25 bp, E. coli
ccgatttcgcgctagcagtgggtca

SEQ ID NO: 144767 - DNA, 25 bp, E. coli
tggaacacgcataacgcaacgggct

SEQ ID NO: 144768 - DNA, 25 bp, E. coli
tggaacacgcattacgcaacgggct

SEQ ID NO: 144769 - DNA, 25 bp, E. coli
aagatttttctgtgccgacacaagg

SEQ ID NO: 144770 - DNA, 25 bp, E. coli
aagatttttctgagccgacacaagg

SEQ ID NO: 144771 - DNA, 25 bp, E. coli
agatttttctgtgccgacacaaggt

SEQ ID NO: 144772 - DNA, 25 bp, E. coli
agatttttctgtcccgacacaaggt

SEQ ID NO: 144773 - DNA, 25 bp, E. coli
acacaaggtgcgcaatcgccctggg

SEQ ID NO: 144774 - DNA, 25 bp, E. coli
acacaaggtgcggaatcgccctggg

SEQ ID NO: 144775 - DNA, 25 bp, E. coli
tgtgccgacacaaggtgcggaatcg

SEQ ID NO: 144776 - DNA, 25 bp, E. coli
tgtgccgacacatggtgcggaatcg

SEQ ID NO: 144777 - DNA, 25 bp, E. coli
tgccgacacaagctgcggaatcgcc

SEQ ID NO: 144778 - DNA, 25 bp, E. coli
tgccgacacaaggtgcggaatcgcc

SEQ ID NO: 144779 - DNA, 25 bp, E. coli
gccgacacaaggagcggaatcgccc

SEQ ID NO: 144780 - DNA, 25 bp, E. coli
gccgacacaaggtgcggaatcgccc

SEQ ID NO: 144781 - DNA, 25 bp, E. coli
gaagatttttctctgccgacacaag

SEQ ID NO: 144782 - DNA, 25 bp, E. coli
gaagatttttctgtgccgacacaag

SEQ ID NO: 144783 - DNA, 25 bp, E. coli
cgggaagattttactgtgccgacac

SEQ ID NO: 144784 - DNA, 25 bp, E. coli
cgggaagatttttctgtgccgacac

SEQ ID NO: 144785 - DNA, 25 bp, E. coli
gtgccgacacaaggtgcggaatcgc

SEQ ID NO: 144786 - DNA, 25 bp, E. coli
ggaagatttttctgtgccgacacaa

SEQ ID NO: 144787 - DNA, 25 bp, E. coli
gggaagatttttctgtgccgacaca

SEQ ID NO: 144788 - DNA, 25 bp, E. coli
gtgccgacacaacgtgcggaatcgc

SEQ ID NO: 144789 - DNA, 25 bp, E. coli
gggaagatttttgtgtgccgacaca

SEQ ID NO: 144790 - DNA, 25 bp, E. coli
ggaagatttttcagtgccgacacaa

SEQ ID NO: 144791 - DNA, 25 bp, E. coli
aatttgcagaaaaagcccagcgagc

SEQ ID NO: 144792 - DNA, 25 bp, E. coli
aatttgcagaaatagcccagcgagc

SEQ ID NO: 144793 - DNA, 25 bp, E. coli
cactgatggcttgactgaggatgac

SEQ ID NO: 144794 - DNA, 25 bp, E. coli
cactgatggcttcactgaggatgac

SEQ ID NO: 144795 - DNA, 25 bp, E. coli
tatgtcgctatatcaagagcgggca

SEQ ID NO: 144796 - DNA, 25 bp, E. coli
tatgtcgctataacaagagcgggca

SEQ ID NO: 144797 - DNA, 25 bp, E. coli
tatctgcgccaggtttgatgaaacg

SEQ ID NO: 144798 - DNA, 25 bp, E. coli
tatctgcgccagctttgatgaaacg

SEQ ID NO: 144799 - DNA, 25 bp, E. coli
tgtcggctggcgtgagtaaatctgc

SEQ ID NO: 144800 - DNA, 25 bp, E. coli
tgtcggctggcgagagtaaatctgc

SEQ ID NO: 144801 - DNA, 25 bp, E. coli
tgtgatgatagagacggattacccc

SEQ ID NO: 144802 - DNA, 25 bp, E. coli
tgtgatgatagacacggattacccc

SEQ ID NO: 144803 - DNA, 25 bp, E. coli
tgagcaccatcctgaaatgggcggg

SEQ ID NO: 144804 - DNA, 25 bp, E. coli
tgagcaccatccagaaatgggcggg

SEQ ID NO: 144805 - DNA, 25 bp, E. coli
tctcaatcgtcatggttaccgtggg

SEQ ID NO: 144806 - DNA, 25 bp, E. coli
tctcaatcgtcaaggttaccgtggg

SEQ ID NO: 144807 - DNA, 25 bp, E. coli
cgatcatctgaacgtcatccggtca

SEQ ID NO: 144808 - DNA, 25 bp, E. coli
cgatcatctgaaggtcatccggtca

SEQ ID NO: 144809 - DNA, 25 bp, E. coli
ggatttgatcctacgcgtggcgtag

SEQ ID NO: 144810 - DNA, 25 bp, E. coli
ggatttgatccttcgcgtggcgtag

SEQ ID NO: 144811 - DNA, 25 bp, E. coli
gaggcgtttatatctcgtgccagag

SEQ ID NO: 144812 - DNA, 25 bp, E. coli
gaggcgtttataactcgtgccagag

SEQ ID NO: 144813 - DNA, 25 bp, E. coli
caaagtcaccgtagaaggtcacgcg

SEQ ID NO: 144814 - DNA, 25 bp, E. coli
caaagtcaccgttgaaggtcacgcg

SEQ ID NO: 144815 - DNA, 25 bp, E. coli
cagctgcagcagtacaacatcgttt

SEQ ID NO: 144816 - DNA, 25 bp, E. coli
cagctgcagcagaacaacatcgttt

SEQ ID NO: 144817 - DNA, 25 bp, E. coli
cagtactgggtcttgacgaagcggc

SEQ ID NO: 144818 - DNA, 25 bp, E. coli
cagtactgggtcatgacgaagcggc

SEQ ID NO: 144819 - DNA, 25 bp, E. coli
atctccctgggtcaacgtcgtgcga

SEQ ID NO: 144820 - DNA, 25 bp, E. coli
atctccctgggtgaacgtcgtgcga

SEQ ID NO: 144821 - DNA, 25 bp, E. coli
tgtcttccgaagagcaggctcgtct

SEQ ID NO: 144822 - DNA, 25 bp, E. coli
tgtcttccgaagtgcaggctcgtct

SEQ ID NO: 144823 - DNA, 25 bp, E. coli
tgacttcgctcaaatgctggatgca

SEQ ID NO: 144824 - DNA, 25 bp, E. coli
tgacttcgctcatatgctggatgca

SEQ ID NO: 144825 - DNA, 25 bp, E. coli
tgccggcactggtatggatgcgaac

SEQ ID NO: 144826 - DNA, 25 bp, E. coli
tgccggcactggaatggatgcgaac

SEQ ID NO: 144827 - DNA, 25 bp, E. coli
gcaatgacggcaccgaaggcatgct

SEQ ID NO: 144828 - DNA, 25 bp, E. coli
gcaattgcggcatgttcttccaaca

SEQ ID NO: 144829 - DNA, 25 bp, E. coli
gcaattgcggcaagttcttccaaca

SEQ ID NO: 144830 - DNA, 25 bp, E. coli
gcaatgacggcagcgaaggcatgct

SEQ ID NO: 144831 - DNA, 25 bp, E. coli
ggatgcacatgctaacttcctgcgt

SEQ ID NO: 144832 - DNA, 25 bp, E. coli
ggatgcacatgcaaacttcctgcgt

SEQ ID NO: 144833 - DNA, 25 bp, E. coli
gacgaacgtggttctccggaataca

SEQ ID NO: 144834 - DNA, 25 bp, E. coli
gacgaacgtggtactccggaataca

SEQ ID NO: 144835 - DNA, 25 bp, E. coli
caatcaggtcagttttcggcgttta

SEQ ID NO: 144836 - DNA, 25 bp, E. coli
caatcaggtcagatttcggcgttta

SEQ ID NO: 144837 - DNA, 25 bp, E. coli
cagggagggcaaagtaaaccagaat

SEQ ID NO: 144838 - DNA, 25 bp, E. coli
cagggagggcaatgtaaaccagaat

SEQ ID NO: 144839 - DNA, 25 bp, E. coli
ttatcattctattggcagggagggc

SEQ ID NO: 144840 - DNA, 25 bp, E. coli
ttatcattctataggcagggagggc

SEQ ID NO: 144841 - DNA, 25 bp, E. coli
tgatgaatggctaggtgatttaacc

SEQ ID NO: 144842 - DNA, 25 bp, E. coli
tgatgaatggcttggtgatttaacc

SEQ ID NO: 144843 - DNA, 25 bp, E. coli
tcggcgtttaagtgaaactagttct

SEQ ID NO: 144844 - DNA, 25 bp, E. coli
tcggcgtttaagagaaactagttct

SEQ ID NO: 144845 - DNA, 25 bp, E. coli
gctgataatcctttatggaccatag

SEQ ID NO: 144846 - DNA, 25 bp, E. coli
gctgataatcctatatggaccatag

SEQ ID NO: 144847 - DNA, 25 bp, E. coli
ccagaatatggtcaagaacggtttt

SEQ ID NO: 144848 - DNA, 25 bp, E. coli
ccagaatatggtgaagaacggtttt

SEQ ID NO: 144849 - DNA, 25 bp, E. coli
gatattgcgtcaggaaatacatgat

SEQ ID NO: 144850 - DNA, 25 bp, E. coli
gatttaaccggtgtcaatcaggtca

SEQ ID NO: 144851 - DNA, 25 bp, E. coli
gatttaaccggtctcaatcaggtca

SEQ ID NO: 144852 - DNA, 25 bp, E. coli
gatattgcgtcacgaaatacatgat

SEQ ID NO: 144853 - DNA, 25 bp, E. coli
taagattgcttgctctaagtagtgc

SEQ ID NO: 144854 - DNA, 25 bp, E. coli
taagattgcttggtctaagtagtgc

SEQ ID NO: 144855 - DNA, 25 bp, E. coli
gaccatagtcaattatcttttgccg

SEQ ID NO: 144856 - DNA, 25 bp, E. coli
gaccatagtcaaatatcttttgccg

SEQ ID NO: 144857 - DNA, 25 bp, E. coli
tttgtcatgatgacaaggctggcat

SEQ ID NO: 144858 - DNA, 25 bp, E. coli
tttgtcatgatgtcaaggctggcat

SEQ ID NO: 144859 - DNA, 25 bp, E. coli
tttcacccttcaatgcacgcagtgg

SEQ ID NO: 144860 - DNA, 25 bp, E. coli
tttcacccttcattgcacgcagtgg

SEQ ID NO: 144861 - DNA, 25 bp, E. coli
ttttcacccttcaatgcacgcagtg

SEQ ID NO: 144862 - DNA, 25 bp, E. coli
ttgtcatgatgacaaggctggcatc

SEQ ID NO: 144863 - DNA, 25 bp, E. coli
ttgtttgtcatgttgacaaggctgg

SEQ ID NO: 144864 - DNA, 25 bp, E. coli
ttgtttgtcatgatgacaaggctgg

SEQ ID NO: 144865 - DNA, 25 bp, E. coli
ttgtcatgatgagaaggctggcatc

SEQ ID NO: 144866 - DNA, 25 bp, E. coli
ttttcacccttctatgcacgcagtg

SEQ ID NO: 144867 - DNA, 25 bp, E. coli
tgtcatgatgactaggctggcatca

SEQ ID NO: 144868 - DNA, 25 bp, E. coli
tgtttgtcatgaagacaaggctggc

SEQ ID NO: 144869 - DNA, 25 bp, E. coli
tgtttgtcatgatgacaaggctggc

SEQ ID NO: 144870 - DNA, 25 bp, E. coli
tgtcatgatgacaaggctggcatca

SEQ ID NO: 144871 - DNA, 25 bp, E. coli
gctggcatcaatcaaaggcttctca

SEQ ID NO: 144872 - DNA, 25 bp, E. coli
gctggcatcaatgaaaggcttctca

SEQ ID NO: 144873 - DNA, 25 bp, E. coli
gaaaggcttctcaattgcacatatt

SEQ ID NO: 144874 - DNA, 25 bp, E. coli
gaaaggcttctctattgcacatatt

SEQ ID NO: 144875 - DNA, 25 bp, E. coli
gtttgtcatgatcacaaggctggca

SEQ ID NO: 144876 - DNA, 25 bp, E. coli
gtttgtcatgatgacaaggctggca

SEQ ID NO: 144877 - DNA, 25 bp, E. coli
tcaatgcacgcagtggttaacaatc

SEQ ID NO: 144878 - DNA, 25 bp, E. coli
tcaatgcacgcactggttaacaatc

SEQ ID NO: 144879 - DNA, 25 bp, E. coli
caggttgaacaaatgctcgcagagc

SEQ ID NO: 144880 - DNA, 25 bp, E. coli
caggttgaacaattgctcgcagagc

SEQ ID NO: 144881 - DNA, 25 bp, E. coli
tcccgctacagtcatgaacaggttg

SEQ ID NO: 144882 - DNA, 25 bp, E. coli
tccctgatggtgataggcaacatgg

SEQ ID NO: 144883 - DNA, 25 bp, E. coli
tcccgctacagtgatgaacaggttg

SEQ ID NO: 144884 - DNA, 25 bp, E. coli
tccctgatggtgttaggcaacatgg

SEQ ID NO: 144885 - DNA, 25 bp, E. coli
taggcaacatggtcactaaccttat

SEQ ID NO: 144886 - DNA, 25 bp, E. coli
tctatcaacgaacacaaagcgcact

SEQ ID NO: 144887 - DNA, 25 bp, E. coli
taggcaacatggacactaaccttat

SEQ ID NO: 144888 - DNA, 25 bp, E. coli
tctatcaacgaagacaaagcgcact

SEQ ID NO: 144889 - DNA, 25 bp, E. coli
tccgaccgacctttccctgatggtg

SEQ ID NO: 144890 - DNA, 25 bp, E. coli
tccgaccgacctatccctgatggtg

SEQ ID NO: 144891 - DNA, 25 bp, E. coli
gcgccttacagtgctctatcaacga

SEQ ID NO: 144892 - DNA, 25 bp, E. coli
gcgccttacagtcctctatcaacga

SEQ ID NO: 144893 - DNA, 25 bp, E. coli
gcaattgccaacacttttgcccgcg

SEQ ID NO: 144894 - DNA, 25 bp, E. coli
gcaattgccaactcttttgcccgcg

SEQ ID NO: 144895 - DNA, 25 bp, E. coli
tggaaaaacataaggctccgaccga

SEQ ID NO: 144896 - DNA, 25 bp, E. coli
tggaaaaacatatggctccgaccga

SEQ ID NO: 144897 - DNA, 25 bp, E. coli
taaccttatcaacaccagcattgcc

SEQ ID NO: 144898 - DNA, 25 bp, E. coli
taaccttatcaagaccagcattgcc

SEQ ID NO: 144899 - DNA, 25 bp, E. coli
gagctgctcaacctactggaaaaac

SEQ ID NO: 144900 - DNA, 25 bp, E. coli
gagctgctcaacgtactggaaaaac

SEQ ID NO: 144901 - DNA, 25 bp, E. coli
aagttacagagccatgaggcttcac

SEQ ID NO: 144902 - DNA, 25 bp, E. coli
aagttacagagcgatgaggcttcac

SEQ ID NO: 144903 - DNA, 25 bp, E. coli
tacagagcgatgtggcttcacaaag

SEQ ID NO: 144904 - DNA, 25 bp, E. coli
tacagagcgatgaggcttcacaaag

SEQ ID NO: 144905 - DNA, 25 bp, E. coli
acagagcgatgaggcttcacaaagc

SEQ ID NO: 144906 - DNA, 25 bp, E. coli
acagagcgatgacgcttcacaaagc

SEQ ID NO: 144907 - DNA, 25 bp, E. coli
aaagaagttacagagcgatgaggct

SEQ ID NO: 144908 - DNA, 25 bp, E. coli
aaagaagttacacagcgatgaggct

SEQ ID NO: 144909 - DNA, 25 bp, E. coli
tatgaaaagaagttacagagcgatg

SEQ ID NO: 144910 - DNA, 25 bp, E. coli
tatgaaaagaagatacagagcgatg

SEQ ID NO: 144911 - DNA, 25 bp, E. coli
tgattatgaaaagaagttacagagc

SEQ ID NO: 144912 - DNA, 25 bp, E. coli
tgattatgaaaacaagttacagagc

SEQ ID NO: 144913 - DNA, 25 bp, E. coli
tgaaaagaagttacagagcgatgag

SEQ ID NO: 144914 - DNA, 25 bp, E. coli
tgaaaagaagtttcagagcgatgag

SEQ ID NO: 144915 - DNA, 25 bp, E. coli
gcgatgaggcttgacaaagcgagta

SEQ ID NO: 144916 - DNA, 25 bp, E. coli
gcgatgaggcttcacaaagcgagta

SEQ ID NO: 144917 - DNA, 25 bp, E. coli
cgatgaggcttctcaaagcgagtaa

SEQ ID NO: 144918 - DNA, 25 bp, E. coli
cgatgaggcttcacaaagcgagtaa

SEQ ID NO: 144919 - DNA, 25 bp, E. coli
gttacagagcgaagaggcttcacaa

SEQ ID NO: 144920 - DNA, 25 bp, E. coli
gttacagagcgatgaggcttcacaa

SEQ ID NO: 144921 - DNA, 25 bp, E. coli
gagcgatgaggcatcacaaagcgag

SEQ ID NO: 144922 - DNA, 25 bp, E. coli
gagcgatgaggcttcacaaagcgag

SEQ ID NO: 144923 - DNA, 25 bp, E. coli
cagtcaggttaatctgctgtggtcc

SEQ ID NO: 144924 - DNA, 25 bp, E. coli
catgttttcattatccggggccgca

SEQ ID NO: 144925 - DNA, 25 bp, E. coli
catgttttcattttccggggccgca

SEQ ID NO: 144926 - DNA, 25 bp, E. coli
cagtcaggttaaactgctgtggtcc

SEQ ID NO: 144927 - DNA, 25 bp, E. coli
aaactgctgtggaccaccggtgacg

SEQ ID NO: 144928 - DNA, 25 bp, E. coli
aaactgctgtggtccaccggtgacg

SEQ ID NO: 144929 - DNA, 25 bp, E. coli
aaagacgatcccttgtccggccatg

SEQ ID NO: 144930 - DNA, 25 bp, E. coli
aaagacgatcccatgtccggccatg

SEQ ID NO: 144931 - DNA, 25 bp, E. coli
tgtccggccatgttttcattttccg

SEQ ID NO: 144932 - DNA, 25 bp, E. coli
tgtccggccatgatttcattttccg

SEQ ID NO: 144933 - DNA, 25 bp, E. coli
gctgaaagacgatcccatgtccggc

SEQ ID NO: 144934 - DNA, 25 bp, E. coli
gctgaaagacgaacccatgtccggc

SEQ ID NO: 144935 - DNA, 25 bp, E. coli
gacgatcccatgtccggccatgttt

SEQ ID NO: 144936 - DNA, 25 bp, E. coli
gacgatcccatgaccggccatgttt

SEQ ID NO: 144937 - DNA, 25 bp, E. coli
ctgctgtggtcctccggtgacggac

SEQ ID NO: 144938 - DNA, 25 bp, E. coli
ctgctgtggtccaccggtgacggac

SEQ ID NO: 144939 - DNA, 25 bp, E. coli
ggttaaactgctctggtccaccggt

SEQ ID NO: 144940 - DNA, 25 bp, E. coli
ggttaaactgctgtggtccaccggt

SEQ ID NO: 144941 - DNA, 25 bp, E. coli
tggtccaccggtgacggactgtgcc

SEQ ID NO: 144942 - DNA, 25 bp, E. coli
tggtccaccggtcacggactgtgcc

SEQ ID NO: 144943 - DNA, 25 bp, E. coli
tcaacggcctggctgcgaaagtaca

SEQ ID NO: 144944 - DNA, 25 bp, E. coli
tcaacggcctgggtgcgaaagtaca

SEQ ID NO: 144945 - DNA, 25 bp, E. coli
cacatcgatgagtaatacgcgcaac

SEQ ID NO: 144946 - DNA, 25 bp, E. coli
cacatcgatgagaaatacgcgcaac

SEQ ID NO: 144947 - DNA, 25 bp, E. coli
tacagcgcgcgacgctaattcagcg

SEQ ID NO: 144948 - DNA, 25 bp, E. coli
ttaacgctacactgcccgaatacgg

SEQ ID NO: 144949 - DNA, 25 bp, E. coli
ttaacgctacacagcccgaatacgg

SEQ ID NO: 144950 - DNA, 25 bp, E. coli
tacagcgcgcgaggctaattcagcg

SEQ ID NO: 144951 - DNA, 25 bp, E. coli
actttatgttgcaggcggattcgcg

SEQ ID NO: 144952 - DNA, 25 bp, E. coli
actttatgttgctggcggattcgcg

SEQ ID NO: 144953 - DNA, 25 bp, E. coli
aaacaccttcgggagttgatgagcg

SEQ ID NO: 144954 - DNA, 25 bp, E. coli
aaacaccttcggcagttgatgagcg

SEQ ID NO: 144955 - DNA, 25 bp, E. coli
tacgcgcaactattgtcagaagctc

SEQ ID NO: 144956 - DNA, 25 bp, E. coli
tacgcgcaactaatgtcagaagctc

SEQ ID NO: 144957 - DNA, 25 bp, E. coli
tgggaattaactgaaagccagagcg

SEQ ID NO: 144958 - DNA, 25 bp, E. coli
tgggaattaactcaaagccagagcg

SEQ ID NO: 144959 - DNA, 25 bp, E. coli
cgctttgggctatcaggttgacgaa

SEQ ID NO: 144960 - DNA, 25 bp, E. coli
cgctttgggctaacaggttgacgaa

SEQ ID NO: 144961 - DNA, 25 bp, E. coli
gatattttcccgatgcggtcactga

SEQ ID NO: 144962 - DNA, 25 bp, E. coli
gatattttcccgttgcggtcactga

SEQ ID NO: 144963 - DNA, 25 bp, E. coli
gatgaccggttgagcaacgcctggc

SEQ ID NO: 144964 - DNA, 25 bp, E. coli
gatgtgatcacacccgatggtcgcg

SEQ ID NO: 144965 - DNA, 25 bp, E. coli
gatgtgatcacagccgatggtcgcg

SEQ ID NO: 144966 - DNA, 25 bp, E. coli
gatgaccggttgtgcaacgcctggc

SEQ ID NO: 144967 - DNA, 25 bp, E. coli
cacctgggtaaacaagttctcgaat

SEQ ID NO: 144968 - DNA, 25 bp, E. coli
cacctgggtaaagaagttctcgaat

SEQ ID NO: 144969 - DNA, 25 bp, E. coli
atcctggagctttcccgtaccttcg

SEQ ID NO: 144970 - DNA, 25 bp, E. coli
atcctggagcttacccgtaccttcg

SEQ ID NO: 144971 - DNA, 25 bp, E. coli
aaagcccgcgcttccgtgctggcga

SEQ ID NO: 144972 - DNA, 25 bp, E. coli
aaagcccgcgctaccgtgctggcga

SEQ ID NO: 144973 - DNA, 25 bp, E. coli
ttccagcgagttcaacacccagcgc

SEQ ID NO: 144974 - DNA, 25 bp, E. coli
ttccagcgagttgaacacccagcgc

SEQ ID NO: 144975 - DNA, 25 bp, E. coli
tctgccgggtatgctggagctttcc

SEQ ID NO: 144976 - DNA, 25 bp, E. coli
tctgccgggtatcctggagctttcc

SEQ ID NO: 144977 - DNA, 25 bp, E. coli
gccacacgcgaaactgaaactcgat

SEQ ID NO: 144978 - DNA, 25 bp, E. coli
gccacacgcgaatctgaaactcgat

SEQ ID NO: 144979 - DNA, 25 bp, E. coli
gaaactcgatcagctgggtaaagaa

SEQ ID NO: 144980 - DNA, 25 bp, E. coli
gaaactgaaactggatcacctgggt

SEQ ID NO: 144981 - DNA, 25 bp, E. coli
gaaactgaaactcgatcacctgggt

SEQ ID NO: 144982 - DNA, 25 bp, E. coli
gaaactcgatcacctgggtaaagaa

SEQ ID NO: 144983 - DNA, 25 bp, E. coli
gatcacctgggtaaagaagttctcg

SEQ ID NO: 144984 - DNA, 25 bp, E. coli
gatcacctgggttaagaagttctcg

SEQ ID NO: 144985 - DNA, 25 bp, E. coli
ggtatcctggagctttcccgtacct

SEQ ID NO: 144986 - DNA, 25 bp, E. coli
ggtatcctggaggtttcccgtacct

SEQ ID NO: 144987 - DNA, 25 bp, E. coli
tggacctggtggtctttggtcgcgc

SEQ ID NO: 144988 - DNA, 25 bp, E. coli
tggacctggtggactttggtcgcgc

SEQ ID NO: 144989 - DNA, 25 bp, E. coli
cacgttgagctgtgcgacttgctga

SEQ ID NO: 144990 - DNA, 25 bp, E. coli
cacgttgagctgagcgacttgctga

SEQ ID NO: 144991 - DNA, 25 bp, E. coli
tctttaggtaaagatccgcacgttg

SEQ ID NO: 144992 - DNA, 25 bp, E. coli
tctttaggtaaacatccgcacgttg

SEQ ID NO: 144993 - DNA, 25 bp, E. coli
cagacagtgagtattgcaggtcaca

SEQ ID NO: 144994 - DNA, 25 bp, E. coli
cagacagtgagttttgcaggtcaca

SEQ ID NO: 144995 - DNA, 25 bp, E. coli
taaacatccgcacgttgagctgtgc

SEQ ID NO: 144996 - DNA, 25 bp, E. coli
taaacatccgcaggttgagctgtgc

SEQ ID NO: 144997 - DNA, 25 bp, E. coli
tgccgaaggccaggtgaaagtcgac

SEQ ID NO: 144998 - DNA, 25 bp, E. coli
tgcgacttgctgtaactggaaggct

SEQ ID NO: 144999 - DNA, 25 bp, E. coli
tgcgacttgctgaaactggaaggct

SEQ ID NO: 145000 - DNA, 25 bp, E. coli
tgccgaaggccacgtgaaagtcgac

SEQ ID NO: 145001 - DNA, 25 bp, E. coli
gaaaatcgcgatagccgaaggccag

SEQ ID NO: 145002 - DNA, 25 bp, E. coli
gaaaatcgcgattgccgaaggccag

SEQ ID NO: 145003 - DNA, 25 bp, E. coli
ctgaaactggaacgctggagcgaaa

SEQ ID NO: 145004 - DNA, 25 bp, E. coli
ctgaaactggaaggctggagcgaaa

SEQ ID NO: 145005 - DNA, 25 bp, E. coli
cggcgcgcaggccaaaatcgcgatt

SEQ ID NO: 145006 - DNA, 25 bp, E. coli
cggcgcgcaggcgaaaatcgcgatt

SEQ ID NO: 145007 - DNA, 25 bp, E. coli
ggttgaaacgcggaaacgctgcaaa

SEQ ID NO: 145008 - DNA, 25 bp, E. coli
ggttgaaacgcgcaaacgctgcaaa

SEQ ID NO: 145009 - DNA, 25 bp, E. coli
tggcgacattttgtttaggtaaaca

SEQ ID NO: 145010 - DNA, 25 bp, E. coli
tggcgacattttctttaggtaaaca

SEQ ID NO: 145011 - DNA, 25 bp, E. coli
taaacgtatcgaaccggtaggtgct

SEQ ID NO: 145012 - DNA, 25 bp, E. coli
taaacgtatcgatccggtaggtgct

SEQ ID NO: 145013 - DNA, 25 bp, E. coli
tatgctgccgcgagaaaacttccgc

SEQ ID NO: 145014 - DNA, 25 bp, E. coli
tagttgttgatgaagtcacccagcc

SEQ ID NO: 145015 - DNA, 25 bp, E. coli
tatggctgcccgtaatatttgctgg

SEQ ID NO: 145016 - DNA, 25 bp, E. coli
tatgctgccgcgtgaaaacttccgc

SEQ ID NO: 145017 - DNA, 25 bp, E. coli
tatggctgcccgaaatatttgctgg

SEQ ID NO: 145018 - DNA, 25 bp, E. coli
tagttgttgatgtagtcacccagcc

SEQ ID NO: 145019 - DNA, 25 bp, E. coli
tatcgtgcagaatgtgcgtgaagcc

SEQ ID NO: 145020 - DNA, 25 bp, E. coli
tatcgtgcagaaagtgcgtgaagcc

SEQ ID NO: 145021 - DNA, 25 bp, E. coli
tgatgaccgttgacgacctgcaggc

SEQ ID NO: 145022 - DNA, 25 bp, E. coli
tgatgaccgttgtcgacctgcaggc

SEQ ID NO: 145023 - DNA, 25 bp, E. coli
tgcaggctaagcatcaggcggaagc

SEQ ID NO: 145024 - DNA, 25 bp, E. coli
tgcaggctaagcttcaggcggaagc

SEQ ID NO: 145025 - DNA, 25 bp, E. coli
tctggctgatatcgaagggttgacc

SEQ ID NO: 145026 - DNA, 25 bp, E. coli
tctgggcaacaacgctgaagccgtg

SEQ ID NO: 145027 - DNA, 25 bp, E. coli
tctggctgatatggaagggttgacc

SEQ ID NO: 145028 - DNA, 25 bp, E. coli
tctgggcaacaaggctgaagccgtg

SEQ ID NO: 145029 - DNA, 25 bp, E. coli
gacaacatctctctggatctgggca

SEQ ID NO: 145030 - DNA, 25 bp, E. coli
gacaacatctctgtggatctgggca

SEQ ID NO: 145031 - DNA, 25 bp, E. coli
gtttgtacgctgcaagatctcgccg

SEQ ID NO: 145032 - DNA, 25 bp, E. coli
gtttgtacgctggaagatctcgccg

SEQ ID NO: 145033 - DNA, 25 bp, E. coli
aactgctgcgtagcacgttgtggtg

SEQ ID NO: 145034 - DNA, 25 bp, E. coli
cgcgaactcaatgttacctggcaaa

SEQ ID NO: 145035 - DNA, 25 bp, E. coli
cgcgaactcaatcttacctggcaaa

SEQ ID NO: 145036 - DNA, 25 bp, E. coli
tacgcggcccgatcataatccgatt

SEQ ID NO: 145037 - DNA, 25 bp, E. coli
agtgttgcaggccaaagtgtttgat

SEQ ID NO: 145038 - DNA, 25 bp, E. coli
agtgttgcaggcgaaagtgtttgat

SEQ ID NO: 145039 - DNA, 25 bp, E. coli
aactgctgcgtaccacgttgtggtg

SEQ ID NO: 145040 - DNA, 25 bp, E. coli
tacgcggcccgaacataatccgatt

SEQ ID NO: 145041 - DNA, 25 bp, E. coli
ttttaaccccttccagatggctccg

SEQ ID NO: 145042 - DNA, 25 bp, E. coli
ttttaaccccttgcagatggctccg

SEQ ID NO: 145043 - DNA, 25 bp, E. coli
gcctgttacgtcagccgtggtcaac

SEQ ID NO: 145044 - DNA, 25 bp, E. coli
gcctgttacgtctgccgtggtcaac

SEQ ID NO: 145045 - DNA, 25 bp, E. coli
ttacgtcagccgaggtcaacgttaa

SEQ ID NO: 145046 - DNA, 25 bp, E. coli
ttacgtcagccgtggtcaacgttaa

SEQ ID NO: 145047 - DNA, 25 bp, E. coli
cgatcataatcccattgtcgccggt

SEQ ID NO: 145048 - DNA, 25 bp, E. coli
cgatcataatccgattgtcgccggt

SEQ ID NO: 145049 - DNA, 25 bp, E. coli
ctgctcgccggattaatgggtggca

SEQ ID NO: 145050 - DNA, 25 bp, E. coli
ctgctcgccggaataatgggtggca

SEQ ID NO: 145051 - DNA, 25 bp, E. coli
taatgggtggcaccatgctgctttg

SEQ ID NO: 145052 - DNA, 25 bp, E. coli
taatgggtggcagcatgctgctttg

SEQ ID NO: 145053 - DNA, 25 bp, E. coli
gatggctccgcgactgatgatgaat

SEQ ID NO: 145054 - DNA, 25 bp, E. coli
gatggctccgcgtctgatgatgaat

SEQ ID NO: 145055 - DNA, 25 bp, E. coli
caactcactctacaaaatttcagcc

SEQ ID NO: 145056 - DNA, 25 bp, E. coli
caactcactctagaaaatttcagcc

SEQ ID NO: 145057 - DNA, 25 bp, E. coli
acaactcactctacaaaatttcagc

SEQ ID NO: 145058 - DNA, 25 bp, E. coli
acgacaactcactctacaaaatttc

SEQ ID NO: 145059 - DNA, 25 bp, E. coli
acaactcactcttcaaaatttcagc

SEQ ID NO: 145060 - DNA, 25 bp, E. coli
acgtcagcgatgtcgacaactcact

SEQ ID NO: 145061 - DNA, 25 bp, E. coli
acgacaactcacactacaaaatttc

SEQ ID NO: 145062 - DNA, 25 bp, E. coli
acgtcagcgatgacgacaactcact

SEQ ID NO: 145063 - DNA, 25 bp, E. coli
tgacgacaactcactctacaaaatt

SEQ ID NO: 145064 - DNA, 25 bp, E. coli
tgacgacaactctctctacaaaatt

SEQ ID NO: 145065 - DNA, 25 bp, E. coli
gacaactcactcaacaaaatttcag

SEQ ID NO: 145066 - DNA, 25 bp, E. coli
gacaactcactctacaaaatttcag

SEQ ID NO: 145067 - DNA, 25 bp, E. coli
cgacaactcactgtacaaaatttca

SEQ ID NO: 145068 - DNA, 25 bp, E. coli
cgacaactcactctacaaaatttca

SEQ ID NO: 145069 - DNA, 25 bp, E. coli
cgtcagcgatgacgacaactcactc

SEQ ID NO: 145070 - DNA, 25 bp, E. coli
cgtcagcgatgaggacaactcactc

SEQ ID NO: 145071 - DNA, 25 bp, E. coli
gtcagcgatgacgacaactcactct

SEQ ID NO: 145072 - DNA, 25 bp, E. coli
gtcagcgatgaccacaactcactct

SEQ ID NO: 145073 - DNA, 25 bp, E. coli
gacgacaactcactctacaaaattt

SEQ ID NO: 145074 - DNA, 25 bp, E. coli
gacgacaactcagtctacaaaattt

SEQ ID NO: 145075 - DNA, 25 bp, E. coli
actcaccgcgagttaaccgaacaca

SEQ ID NO: 145076 - DNA, 25 bp, E. coli
actcaccgcgagataaccgaacaca

SEQ ID NO: 145077 - DNA, 25 bp, E. coli
gccctcgcgctggacagtaatgaaa

SEQ ID NO: 145078 - DNA, 25 bp, E. coli
cctcgcgctggacagtaatgaaatc

SEQ ID NO: 145079 - DNA, 25 bp, E. coli
cctcgcgctggagagtaatgaaatc

SEQ ID NO: 145080 - DNA, 25 bp, E. coli
gcgctggacagttatgaaatcaccg

SEQ ID NO: 145081 - DNA, 25 bp, E. coli
gccctcgcgctgcacagtaatgaaa

SEQ ID NO: 145082 - DNA, 25 bp, E. coli
gcgctggacagtaatgaaatcaccg

SEQ ID NO: 145083 - DNA, 25 bp, E. coli
gacagtaatgaaatcaccgccctga

SEQ ID NO: 145084 - DNA, 25 bp, E. coli
gacagtaatgaattcaccgccctga

SEQ ID NO: 145085 - DNA, 25 bp, E. coli
cgcgagttaaccgaacacagctggt

SEQ ID NO: 145086 - DNA, 25 bp, E. coli
cgcgagttaacccaacacagctggt

SEQ ID NO: 145087 - DNA, 25 bp, E. coli
gtaatgaaatcaccgccctgatgct

SEQ ID NO: 145088 - DNA, 25 bp, E. coli
ggatctcaactctccgcgagttaac

SEQ ID NO: 145089 - DNA, 25 bp, E. coli
ggatctcaactcaccgcgagttaac

SEQ ID NO: 145090 - DNA, 25 bp, E. coli
gtaatgaaatcagcgccctgatgct

SEQ ID NO: 145091 - DNA, 25 bp, E. coli
tggacagtaatgaaatcaccgccct

SEQ ID NO: 145092 - DNA, 25 bp, E. coli
tggacagtaatgtaatcaccgccct

SEQ ID NO: 145093 - DNA, 25 bp, E. coli
taaccgaacacagctggttgagtcg

SEQ ID NO: 145094 - DNA, 25 bp, E. coli
taaccgaacacacctggttgagtcg

SEQ ID NO: 145095 - DNA, 25 bp, E. coli
gagttaaccgaagacagctggttga

SEQ ID NO: 145096 - DNA, 25 bp, E. coli
gagttaaccgaacacagctggttga

SEQ ID NO: 145097 - DNA, 25 bp, E. coli
aagcaacgtatagcgtgaccgtcac

SEQ ID NO: 145098 - DNA, 25 bp, E. coli
aagcaacgtataccgtgaccgtcac

SEQ ID NO: 145099 - DNA, 25 bp, E. coli
cagcaatggcgtatctgtcgattat

SEQ ID NO: 145100 - DNA, 25 bp, E. coli
cagcaatggcgtttctgtcgattat

SEQ ID NO: 145101 - DNA, 25 bp, E. coli
tatgaaacagagtcgccgatgactt

SEQ ID NO: 145102 - DNA, 25 bp, E. coli
tatgaaacagagacgccgatgactt

SEQ ID NO: 145103 - DNA, 25 bp, E. coli
tgggcaaagcaacgtataccgtgac

SEQ ID NO: 145104 - DNA, 25 bp, E. coli
tgataaaagatctggtgaataccgt

SEQ ID NO: 145105 - DNA, 25 bp, E. coli
tgggcaaagcaaggtataccgtgac

SEQ ID NO: 145106 - DNA, 25 bp, E. coli
tgtcgattatgatacagagacgccg

SEQ ID NO: 145107 - DNA, 25 bp, E. coli
tgataaaagatcaggtgaataccgt

SEQ ID NO: 145108 - DNA, 25 bp, E. coli
tgtcgattatgaaacagagacgccg

SEQ ID NO: 145109 - DNA, 25 bp, E. coli
gccgatgactttgctggtgccagaa

SEQ ID NO: 145110 - DNA, 25 bp, E. coli
gccgatgactttcctggtgccagaa

SEQ ID NO: 145111 - DNA, 25 bp, E. coli
gttcttatgacagggaaaacgaaca

SEQ ID NO: 145112 - DNA, 25 bp, E. coli
gttcttatgacacggaaaacgaaca

SEQ ID NO: 145113 - DNA, 25 bp, E. coli
tggcggctgaagagataaaagatct

SEQ ID NO: 145114 - DNA, 25 bp, E. coli
tggcggctgaagtgataaaagatct

SEQ ID NO: 145115 - DNA, 25 bp, E. coli
gagacgccgatgactttgctggtgc

SEQ ID NO: 145116 - DNA, 25 bp, E. coli
gaccgtcaccaataacagcaatggc

SEQ ID NO: 145117 - DNA, 25 bp, E. coli
gagacgccgatgtctttgctggtgc

SEQ ID NO: 145118 - DNA, 25 bp, E. coli
gaccgtcaccaaaaacagcaatggc

SEQ ID NO: 145119 - DNA, 25 bp, E. coli
catctcgttgataccctttgtctgt

SEQ ID NO: 145120 - DNA, 25 bp, E. coli
catctcgttgattccctttgtctgt

SEQ ID NO: 145121 - DNA, 25 bp, E. coli
tccctttgtctgattgataatgcgc

SEQ ID NO: 145122 - DNA, 25 bp, E. coli
tcgttgattccctttgtctgtttga

SEQ ID NO: 145123 - DNA, 25 bp, E. coli
tccctttgtctgtttgataatgcgc

SEQ ID NO: 145124 - DNA, 25 bp, E. coli
tcgttgattcccattgtctgtttga

SEQ ID NO: 145125 - DNA, 25 bp, E. coli
cctttgtctgttagataatgcgcac

SEQ ID NO: 145126 - DNA, 25 bp, E. coli
cctttgtctgtttgataatgcgcac

SEQ ID NO: 145127 - DNA, 25 bp, E. coli
gggcgttttcatgtcgttgattccc

SEQ ID NO: 145128 - DNA, 25 bp, E. coli
gggcgttttcatctcgttgattccc

SEQ ID NO: 145129 - DNA, 25 bp, E. coli
ccctttgtctgtatgataatgcgca

SEQ ID NO: 145130 - DNA, 25 bp, E. coli
ccctttgtctgtttgataatgcgca

SEQ ID NO: 145131 - DNA, 25 bp, E. coli
cgttgattccctttgtctgtttgat

SEQ ID NO: 145132 - DNA, 25 bp, E. coli
cgttgattccctatgtctgtttgat

SEQ ID NO: 145133 - DNA, 25 bp, E. coli
gttttcatctcgttgattccctttg

SEQ ID NO: 145134 - DNA, 25 bp, E. coli
gattccctttgtgtgtttgataatg

SEQ ID NO: 145135 - DNA, 25 bp, E. coli
gttttcatctcgatgattccctttg

SEQ ID NO: 145136 - DNA, 25 bp, E. coli
gattccctttgtctgtttgataatg

SEQ ID NO: 145137 - DNA, 25 bp, E. coli
ggcgttttcatctcgttgattccct

SEQ ID NO: 145138 - DNA, 25 bp, E. coli
ggcgttttcatcacgttgattccct

SEQ ID NO: 145139 - DNA, 25 bp, E. coli
taaccaggggcgatttcatctcgtt

SEQ ID NO: 145140 - DNA, 25 bp, E. coli
taaccaggggcgttttcatctcgtt

SEQ ID NO: 145141 - DNA, 25 bp, E. coli
cacaggctgagcttgctatttacga

SEQ ID NO: 145142 - DNA, 25 bp, E. coli
cacaggctgagcatgctatttacga

SEQ ID NO: 145143 - DNA, 25 bp, E. coli
catcaccagtgaccgctgctatgga

SEQ ID NO: 145144 - DNA, 25 bp, E. coli
catcaccagtgagcgctgctatgga

SEQ ID NO: 145145 - DNA, 25 bp, E. coli
taaatatttcgtccttgccagcaca

SEQ ID NO: 145146 - DNA, 25 bp, E. coli
taaatatttcgtgcttgccagcaca

SEQ ID NO: 145147 - DNA, 25 bp, E. coli
tatgcaccgccagagttaccgagtg

SEQ ID NO: 145148 - DNA, 25 bp, E. coli
tatgcaccgccacagttaccgagtg

SEQ ID NO: 145149 - DNA, 25 bp, E. coli
tgaccgcgcgaacaatgagtttaat

SEQ ID NO: 145150 - DNA, 25 bp, E. coli
tgaccgcgcgaagaatgagtttaat

SEQ ID NO: 145151 - DNA, 25 bp, E. coli
ccaatattatggagccgggagtgca

SEQ ID NO: 145152 - DNA, 25 bp, E. coli
ccaatattatggtgccgggagtgca

SEQ ID NO: 145153 - DNA, 25 bp, E. coli
gacaaatgtcttatatgaccgcgcg

SEQ ID NO: 145154 - DNA, 25 bp, E. coli
gacaaatgtcttttatgaccgcgcg

SEQ ID NO: 145155 - DNA, 25 bp, E. coli
cttatcatggcggaaagcaagatct

SEQ ID NO: 145156 - DNA, 25 bp, E. coli
cttatcatggcgcaaagcaagatct

SEQ ID NO: 145157 - DNA, 25 bp, E. coli
gggatgctgccgatcattctgataa

SEQ ID NO: 145158 - DNA, 25 bp, E. coli
gggatgctgccgttcattctgataa

SEQ ID NO: 145159 - DNA, 25 bp, E. coli
taatgtttccgagcgttcatggagt

SEQ ID NO: 145160 - DNA, 25 bp, E. coli
taatgtttccgaccgttcatggagt

SEQ ID NO: 145161 - DNA, 25 bp, E. coli
gatgctgaggatgcaacaaaagtcc

SEQ ID NO: 145162 - DNA, 25 bp, E. coli
gatgctgaggatccaacaaaagtcc

SEQ ID NO: 145163 - DNA, 25 bp, E. coli
caaatggcgttacagcagggaaagt

SEQ ID NO: 145164 - DNA, 25 bp, E. coli
caaatggcgttagagcagggaaagt

SEQ ID NO: 145165 - DNA, 25 bp, E. coli
tactggcaaccggaagtgatggtgc

SEQ ID NO: 145166 - DNA, 25 bp, E. coli
tactggcaaccgcaagtgatggtgc

SEQ ID NO: 145167 - DNA, 25 bp, E. coli
aactcaggcatcttggcgactggcg

SEQ ID NO: 145168 - DNA, 25 bp, E. coli
aactcaggcatcatggcgactggcg

SEQ ID NO: 145169 - DNA, 25 bp, E. coli
tatgcaggaagctccctttatcggg

SEQ ID NO: 145170 - DNA, 25 bp, E. coli
tatgcaggaagcaccctttatcggg

SEQ ID NO: 145171 - DNA, 25 bp, E. coli
tgaactatccgcgaaatatgcctgg

SEQ ID NO: 145172 - DNA, 25 bp, E. coli
tgaactatccgccaaatatgcctgg

SEQ ID NO: 145173 - DNA, 25 bp, E. coli
ccggatgtctggagctggcttgaaa

SEQ ID NO: 145174 - DNA, 25 bp, E. coli
ccggatgtctggtgctggcttgaaa

SEQ ID NO: 145175 - DNA, 25 bp, E. coli
gcggagcgccgtgacatcaatggta

SEQ ID NO: 145176 - DNA, 25 bp, E. coli
gcggagcgccgtcacatcaatggta

SEQ ID NO: 145177 - DNA, 25 bp, E. coli
gcaacgtattacacagatctggcca

SEQ ID NO: 145178 - DNA, 25 bp, E. coli
gcaacgtattactcagatctggcca

SEQ ID NO: 145179 - DNA, 25 bp, E. coli
gaacgctggcggaaatcaaaccgca

SEQ ID NO: 145180 - DNA, 25 bp, E. coli
gaacgctggcggtaatcaaaccgca

SEQ ID NO: 145181 - DNA, 25 bp, E. coli
cattggcattgatatcagggcgctc

SEQ ID NO: 145182 - DNA, 25 bp, E. coli
cattggcattgaaatcagggcgctc

SEQ ID NO: 145183 - DNA, 25 bp, E. coli
ggctccgcagcatgaagacgcatta

SEQ ID NO: 145184 - DNA, 25 bp, E. coli
ggctccgcagcaagaagacgcatta

SEQ ID NO: 145185 - DNA, 25 bp, E. coli
aaaaaatgaagatagcccatcagcc

SEQ ID NO: 145186 - DNA, 25 bp, E. coli
aaaaaatgaagaaagcccatcagcc

SEQ ID NO: 145187 - DNA, 25 bp, E. coli
tagcccatcagccatagcggttggg

SEQ ID NO: 145188 - DNA, 25 bp, E. coli
tatcccttccattgcgtggccagag

SEQ ID NO: 145189 - DNA, 25 bp, E. coli
tagcccatcagcgatagcggttggg

SEQ ID NO: 145190 - DNA, 25 bp, E. coli
tatcccttccatagcgtggccagag

SEQ ID NO: 145191 - DNA, 25 bp, E. coli
tgtgccctttcaccaactataaacg

SEQ ID NO: 145192 - DNA, 25 bp, E. coli
tgtgccctttcagcaactataaacg

SEQ ID NO: 145193 - DNA, 25 bp, E. coli
tgaagatagcccatcagccatagcg

SEQ ID NO: 145194 - DNA, 25 bp, E. coli
tgaagatagcccttcagccatagcg

SEQ ID NO: 145195 - DNA, 25 bp, E. coli
ccatagcgtggccagagaaaaaata

SEQ ID NO: 145196 - DNA, 25 bp, E. coli
ccttccatagcgaggccagagaaaa

SEQ ID NO: 145197 - DNA, 25 bp, E. coli
ccttccatagcgtggccagagaaaa

SEQ ID NO: 145198 - DNA, 25 bp, E. coli
ccatagcgtggcgagagaaaaaata

SEQ ID NO: 145199 - DNA, 25 bp, E. coli
gaatggtatcccttccatagcgtgg

SEQ ID NO: 145200 - DNA, 25 bp, E. coli
gaatggtatcccatccatagcgtgg

SEQ ID NO: 145201 - DNA, 25 bp, E. coli
gaacttgattcctgtgccctttcac

SEQ ID NO: 145202 - DNA, 25 bp, E. coli
gaacttgattccagtgccctttcac

SEQ ID NO: 145203 - DNA, 25 bp, E. coli
gattcctgtgccctttcaccaacta

SEQ ID NO: 145204 - DNA, 25 bp, E. coli
gatagcccatcagccatagcggttg

SEQ ID NO: 145205 - DNA, 25 bp, E. coli
gattcctgtgccgtttcaccaacta

SEQ ID NO: 145206 - DNA, 25 bp, E. coli
gatagcccatcacccatagcggttg

SEQ ID NO: 145207 - DNA, 25 bp, E. coli
aatcttgcatggatgagagcggtcc

SEQ ID NO: 145208 - DNA, 25 bp, E. coli
aatcttgcatggttgagagcggtcc

SEQ ID NO: 145209 - DNA, 25 bp, E. coli
cagatctctttgagtgtttaactaa

SEQ ID NO: 145210 - DNA, 25 bp, E. coli
cagatctctttgtgtgtttaactaa

SEQ ID NO: 145211 - DNA, 25 bp, E. coli
catgattttgtaattttgccgggaa

SEQ ID NO: 145212 - DNA, 25 bp, E. coli
catgattttgtatttttgccgggaa

SEQ ID NO: 145213 - DNA, 25 bp, E. coli
tatttgctataattctgagtaaggc

SEQ ID NO: 145214 - DNA, 25 bp, E. coli
tatttgctataaatctgagtaaggc

SEQ ID NO: 145215 - DNA, 25 bp, E. coli
tgccgggaaaaattgcgattaatct

SEQ ID NO: 145216 - DNA, 25 bp, E. coli
tgccgggaaaaaatgcgattaatct

SEQ ID NO: 145217 - DNA, 25 bp, E. coli
tcttgcgaatctaagttatgcatct

SEQ ID NO: 145218 - DNA, 25 bp, E. coli
tcttgcgaatcttagttatgcatct

SEQ ID NO: 145219 - DNA, 25 bp, E. coli
gcaattttgaaccatccacaactga

SEQ ID NO: 145220 - DNA, 25 bp, E. coli
gaatgaccagaagatatcttgcgaa

SEQ ID NO: 145221 - DNA, 25 bp, E. coli
gaatgaccagaacatatcttgcgaa

SEQ ID NO: 145222 - DNA, 25 bp, E. coli
gcaattttgaacgatccacaactga

SEQ ID NO: 145223 - DNA, 25 bp, E. coli
cgcaaattgtttttgaatgaccaga

SEQ ID NO: 145224 - DNA, 25 bp, E. coli
cgcaaattgtttatgaatgaccaga

SEQ ID NO: 145225 - DNA, 25 bp, E. coli
taatactaggatatgacgagagaag

SEQ ID NO: 145226 - DNA, 25 bp, E. coli
taatactaggatttgacgagagaag

SEQ ID NO: 145227 - DNA, 25 bp, E. coli
gagcggtccagaaaactatctcatg

SEQ ID NO: 145228 - DNA, 25 bp, E. coli
gagcggtccagataactatctcatg

SEQ ID NO: 145229 - DNA, 25 bp, E. coli
tacagcaataccgtgcggcaaaatt

SEQ ID NO: 145230 - DNA, 25 bp, E. coli
tacagcaataccctgcggcaaaatt

SEQ ID NO: 145231 - DNA, 25 bp, E. coli
taccgtgcggcataattgcgtattt

SEQ ID NO: 145232 - DNA, 25 bp, E. coli
taccgtgcggcaaaattgcgtattt

SEQ ID NO: 145233 - DNA, 25 bp, E. coli
ttacgaaaatgccaaagtttgtgtc

SEQ ID NO: 145234 - DNA, 25 bp, E. coli
tttggtttacagcaataccgtgcgg

SEQ ID NO: 145235 - DNA, 25 bp, E. coli
ttacgaaaatgcgaaagtttgtgtc

SEQ ID NO: 145236 - DNA, 25 bp, E. coli
tttggtttacaggaataccgtgcgg

SEQ ID NO: 145237 - DNA, 25 bp, E. coli
ttgtgtcgtcaatgctgatgatgcc

SEQ ID NO: 145238 - DNA, 25 bp, E. coli
ttgtgtcgtcaaagctgatgatgcc

SEQ ID NO: 145239 - DNA, 25 bp, E. coli
ttgcgtatttaccaaaatgcgaaag

SEQ ID NO: 145240 - DNA, 25 bp, E. coli
ttgcgtatttacgaaaatgcgaaag

SEQ ID NO: 145241 - DNA, 25 bp, E. coli
tccgtttggtttacagcaataccgt

SEQ ID NO: 145242 - DNA, 25 bp, E. coli
tgcggcaaaattccgtatttacgaa

SEQ ID NO: 145243 - DNA, 25 bp, E. coli
tccgtttggttttcagcaataccgt

SEQ ID NO: 145244 - DNA, 25 bp, E. coli
tgcggcaaaattgcgtatttacgaa

SEQ ID NO: 145245 - DNA, 25 bp, E. coli
gaaaatgcgaaactttgtgtcgtca

SEQ ID NO: 145246 - DNA, 25 bp, E. coli
gaaaatgcgaaagtttgtgtcgtca

SEQ ID NO: 145247 - DNA, 25 bp, E. coli
cgaaagtttgtgacgtcaatgctga

SEQ ID NO: 145248 - DNA, 25 bp, E. coli
cgaaagtttgtgtcgtcaatgctga

SEQ ID NO: 145249 - DNA, 25 bp, E. coli
ggtttacagcaaaaccgtgcggcaa

SEQ ID NO: 145250 - DNA, 25 bp, E. coli
ggtttacagcaataccgtgcggcaa

SEQ ID NO: 145251 - DNA, 25 bp, E. coli
cattattgccggtgggcttaaccgt

SEQ ID NO: 145252 - DNA, 25 bp, E. coli
cattattgccggagggcttaaccgt

SEQ ID NO: 145253 - DNA, 25 bp, E. coli
ttcatacgtcaatggagcgacgccg

SEQ ID NO: 145254 - DNA, 25 bp, E. coli
ttcatacgtcaaaggagcgacgccg

SEQ ID NO: 145255 - DNA, 25 bp, E. coli
tgatttaacgcgacatcacgggcgt

SEQ ID NO: 145256 - DNA, 25 bp, E. coli
tgatttaacgcgtcatcacgggcgt

SEQ ID NO: 145257 - DNA, 25 bp, E. coli
tcgcgtgggcgttttccctggcaaa

SEQ ID NO: 145258 - DNA, 25 bp, E. coli
tcgacaatgtttgtgccgggtatca

SEQ ID NO: 145259 - DNA, 25 bp, E. coli
tcgacaatgtttctgccgggtatca

SEQ ID NO: 145260 - DNA, 25 bp, E. coli
tcgcgtgggcgtattccctggcaaa

SEQ ID NO: 145261 - DNA, 25 bp, E. coli
ccgtagacttggcatcttgccgcag

SEQ ID NO: 145262 - DNA, 25 bp, E. coli
gaaaaactctctggtgggcagcgcc

SEQ ID NO: 145263 - DNA, 25 bp, E. coli
gaaaaactctctcgtgggcagcgcc

SEQ ID NO: 145264 - DNA, 25 bp, E. coli
ccgtagacttgggatcttgccgcag

SEQ ID NO: 145265 - DNA, 25 bp, E. coli
gattcacgagcaaccaacgaaagcg

SEQ ID NO: 145266 - DNA, 25 bp, E. coli
gattcacgagcatccaacgaaagcg

SEQ ID NO: 145267 - DNA, 25 bp, E. coli
ggaaagtcgacgatgctcagcacca

SEQ ID NO: 145268 - DNA, 25 bp, E. coli
tgaaattaaccggtacgcaggagtt

SEQ ID NO: 145269 - DNA, 25 bp, E. coli
ggaaagtcgacgttgctcagcacca

SEQ ID NO: 145270 - DNA, 25 bp, E. coli
tgaaattaaccgctacgcaggagtt

SEQ ID NO: 145271 - DNA, 25 bp, E. coli
taaccgtttatgtactggtgtcgcg

SEQ ID NO: 145272 - DNA, 25 bp, E. coli
taaccgtttatgaactggtgtcgcg

SEQ ID NO: 145273 - DNA, 25 bp, E. coli
aattggcgacgggaaaatcttcgtc

SEQ ID NO: 145274 - DNA, 25 bp, E. coli
aattggcgacggcaaaatcttcgtc

SEQ ID NO: 145275 - DNA, 25 bp, E. coli
caaaatcttcgtcgctgaattgcaa

SEQ ID NO: 145276 - DNA, 25 bp, E. coli
caaaatcttcgtggctgaattgcaa

SEQ ID NO: 145277 - DNA, 25 bp, E. coli
attgatgtggcgtttgctgatgacc

SEQ ID NO: 145278 - DNA, 25 bp, E. coli
attgatgtggcgattgctgatgacc

SEQ ID NO: 145279 - DNA, 25 bp, E. coli
tttcgggcgtcacaaagggcatgcc

SEQ ID NO: 145280 - DNA, 25 bp, E. coli
tttcgggcgtcagaaagggcatgcc

SEQ ID NO: 145281 - DNA, 25 bp, E. coli
tcctgccaaaagtaaaaattgatgt

SEQ ID NO: 145282 - DNA, 25 bp, E. coli
tcctgccaaaagaaaaaattgatgt

SEQ ID NO: 145283 - DNA, 25 bp, E. coli
tcaccgaagtgaaaggtttcgggcg

SEQ ID NO: 145284 - DNA, 25 bp, E. coli
tcttccattggtattcagggcctga

SEQ ID NO: 145285 - DNA, 25 bp, E. coli
tcagaaagggcatgccgagctgtac

SEQ ID NO: 145286 - DNA, 25 bp, E. coli
tcagaaagggcaagccgagctgtac

SEQ ID NO: 145287 - DNA, 25 bp, E. coli
tcttccattggttttcagggcctga

SEQ ID NO: 145288 - DNA, 25 bp, E. coli
tcaccgaagtgataggtttcgggcg

SEQ ID NO: 145289 - DNA, 25 bp, E. coli
gctgatgaccaagtcgatgaagtga

SEQ ID NO: 145290 - DNA, 25 bp, E. coli
gctgatgaccaactcgatgaagtga

SEQ ID NO: 145291 - DNA, 25 bp, E. coli
gcttacaccggataaattggcgacg

SEQ ID NO: 145292 - DNA, 25 bp, E. coli
gcttacaccggaaaaattggcgacg

SEQ ID NO: 145293 - DNA, 25 bp, E. coli
gggcctgaccgtcaccgaagtgaaa

SEQ ID NO: 145294 - DNA, 25 bp, E. coli
gggcctgaccgtgaccgaagtgaaa

SEQ ID NO: 145295 - DNA, 25 bp, E. coli
caataattctcaccgggtgttgcag

SEQ ID NO: 145296 - DNA, 25 bp, E. coli
caataattctcagcgggtgttgcag

SEQ ID NO: 145297 - DNA, 25 bp, E. coli
cagcaaccgtaaaccggatagttcg

SEQ ID NO: 145298 - DNA, 25 bp, E. coli
cagcaaccgtaatccggatagttcg

SEQ ID NO: 145299 - DNA, 25 bp, E. coli
cagcatttagaaaaccagataaaca

SEQ ID NO: 145300 - DNA, 25 bp, E. coli
cagcatttagaataccagataaaca

SEQ ID NO: 145301 - DNA, 25 bp, E. coli
gtcggctttgcacagcccattaata

SEQ ID NO: 145302 - DNA, 25 bp, E. coli
gtcggctttgcagagcccattaata

SEQ ID NO: 145303 - DNA, 25 bp, E. coli
aaatccagcaaatagggatgctgaa

SEQ ID NO: 145304 - DNA, 25 bp, E. coli
aaatccagcaaaaagggatgctgaa

SEQ ID NO: 145305 - DNA, 25 bp, E. coli
gcactcctgccgtttgtcggctttg

SEQ ID NO: 145306 - DNA, 25 bp, E. coli
gcactcctgccgattgtcggctttg

SEQ ID NO: 145307 - DNA, 25 bp, E. coli
taatactctgaagaaccctaaccag

SEQ ID NO: 145308 - DNA, 25 bp, E. coli
taatactctgaacaaccctaaccag

SEQ ID NO: 145309 - DNA, 25 bp, E. coli
cggatagttcgttgaatcagcagca

SEQ ID NO: 145310 - DNA, 25 bp, E. coli
cggatagttcgtagaatcagcagca

SEQ ID NO: 145311 - DNA, 25 bp, E. coli
gataaacaataattctcagcgggtg

SEQ ID NO: 145312 - DNA, 25 bp, E. coli
gataaacaataaatctcagcgggtg

SEQ ID NO: 145313 - DNA, 25 bp, E. coli
ggcagcaaatgcagcccaacaccaa

SEQ ID NO: 145314 - DNA, 25 bp, E. coli
ggcgggatgttaaacagcaaccgta

SEQ ID NO: 145315 - DNA, 25 bp, E. coli
ggcagcaaatgctgcccaacaccaa

SEQ ID NO: 145316 - DNA, 25 bp, E. coli
ggcgggatgttatacagcaaccgta

SEQ ID NO: 145317 - DNA, 25 bp, E. coli
cataaagtggcctgggctgctgtga

SEQ ID NO: 145318 - DNA, 25 bp, E. coli
cataaagtggccagggctgctgtga

SEQ ID NO: 145319 - DNA, 25 bp, E. coli
taaagaagcgttcaacagcgcatgg

SEQ ID NO: 145320 - DNA, 25 bp, E. coli
taaagataaagatgatcggcgtgat

SEQ ID NO: 145321 - DNA, 25 bp, E. coli
taaagaagcgttgaacagcgcatgg

SEQ ID NO: 145322 - DNA, 25 bp, E. coli
taaagataaagaagatcggcgtgat

SEQ ID NO: 145323 - DNA, 25 bp, E. coli
tgcccaggatatctataaagaagcg

SEQ ID NO: 145324 - DNA, 25 bp, E. coli
tgcccaggatatgtataaagaagcg

SEQ ID NO: 145325 - DNA, 25 bp, E. coli
ccgtctcatgcccaggatatctata

SEQ ID NO: 145326 - DNA, 25 bp, E. coli
ccgtctcatgccgaggatatctata

SEQ ID NO: 145327 - DNA, 25 bp, E. coli
gcgcatgggatctatataaagataa

SEQ ID NO: 145328 - DNA, 25 bp, E. coli
gctgctgtgaaggatgaatatgcca

SEQ ID NO: 145329 - DNA, 25 bp, E. coli
gcgcatgggatcaatataaagataa

SEQ ID NO: 145330 - DNA, 25 bp, E. coli
gctgctgtgaagcatgaatatgcca

SEQ ID NO: 145331 - DNA, 25 bp, E. coli
gaagatcggcgtgatgacgccagtc

SEQ ID NO: 145332 - DNA, 25 bp, E. coli
gaagatcggcgtcatgacgccagtc

SEQ ID NO: 145333 - DNA, 25 bp, E. coli
cgttcaacagcggatgggatcaata

SEQ ID NO: 145334 - DNA, 25 bp, E. coli
cgttcaacagcgcatgggatcaata

SEQ ID NO: 145335 - DNA, 25 bp, E. coli
gtgatgacgccagtcgcgaagaaac

SEQ ID NO: 145336 - DNA, 25 bp, E. coli
gtgatgacgccactcgcgaagaaac

SEQ ID NO: 145337 - DNA, 25 bp, E. coli
gatgataaatggcataaaaaatcgt

SEQ ID NO: 145338 - DNA, 25 bp, E. coli
gatgataaatgggataaaaaatcgt

SEQ ID NO: 145339 - DNA, 25 bp, E. coli
cagcggatatctcggtgaccgccgc

SEQ ID NO: 145340 - DNA, 25 bp, E. coli
cagcggatatctgggtgaccgccgc

SEQ ID NO: 145341 - DNA, 25 bp, E. coli
catttacagctgacattagtgaacg

SEQ ID NO: 145342 - DNA, 25 bp, E. coli
catgtattaattcgcatgggaagcg

SEQ ID NO: 145343 - DNA, 25 bp, E. coli
catgtattaattggcatgggaagcg

SEQ ID NO: 145344 - DNA, 25 bp, E. coli
aaatgaagatcaagaagtggtcgcc

SEQ ID NO: 145345 - DNA, 25 bp, E. coli
aaatgaagatcatgaagtggtcgcc

SEQ ID NO: 145346 - DNA, 25 bp, E. coli
tattggcatggataggcaaatgcgc

SEQ ID NO: 145347 - DNA, 25 bp, E. coli
tattggcatggaaaggcaaatgcgc

SEQ ID NO: 145348 - DNA, 25 bp, E. coli
tttatcggtgcacgtaacattctcg

SEQ ID NO: 145349 - DNA, 25 bp, E. coli
tttatcggtgcaggtaacattctcg

SEQ ID NO: 145350 - DNA, 25 bp, E. coli
gcgattattaaaaggtatggcaggg

SEQ ID NO: 145351 - DNA, 25 bp, E. coli
gcgattattaaatggtatggcaggg

SEQ ID NO: 145352 - DNA, 25 bp, E. coli
gaagtggtcgccattgatatccagc

SEQ ID NO: 145353 - DNA, 25 bp, E. coli
gaagtggtcgcctttgatatccagc

SEQ ID NO: 145354 - DNA, 25 bp, E. coli
gaaatatggtttagctgacgtgctg

SEQ ID NO: 145355 - DNA, 25 bp, E. coli
gaaatatggttttgctgacgtgctg

SEQ ID NO: 145356 - DNA, 25 bp, E. coli
catttacagctgtcattagtgaacg

SEQ ID NO: 145357 - DNA, 25 bp, E. coli
tcaattaaccttccgcctgatgaac

SEQ ID NO: 145358 - DNA, 25 bp, E. coli
taatacggtatcaatgctcgactgg

SEQ ID NO: 145359 - DNA, 25 bp, E. coli
taatacggtatctatgctcgactgg

SEQ ID NO: 145360 - DNA, 25 bp, E. coli
tcaattaaccttgcgcctgatgaac

SEQ ID NO: 145361 - DNA, 25 bp, E. coli
aagcccggcctcatggtatgaatga

SEQ ID NO: 145362 - DNA, 25 bp, E. coli
aagcccggcctcttggtatgaatga

SEQ ID NO: 145363 - DNA, 25 bp, E. coli
tatctatccggtacgaagcccggcc

SEQ ID NO: 145364 - DNA, 25 bp, E. coli
ttgaagcaaaaattaaccgacgctg

SEQ ID NO: 145365 - DNA, 25 bp, E. coli
ttgaagcaaaaaataaccgacgctg

SEQ ID NO: 145366 - DNA, 25 bp, E. coli
tatctatccggttcgaagcccggcc

SEQ ID NO: 145367 - DNA, 25 bp, E. coli
ttttagtaaatatctatccggtacg

SEQ ID NO: 145368 - DNA, 25 bp, E. coli
ttttagtaaataactatccggtacg

SEQ ID NO: 145369 - DNA, 25 bp, E. coli
tcctttacggtgataaccgtcgcgt

SEQ ID NO: 145370 - DNA, 25 bp, E. coli
tcctttacggtgttaaccgtcgcgt

SEQ ID NO: 145371 - DNA, 25 bp, E. coli
gcgtaagcaaaatattgccccattt

SEQ ID NO: 145372 - DNA, 25 bp, E. coli
gcgtaagcaaaaaattgccccattt

SEQ ID NO: 145373 - DNA, 25 bp, E. coli
gacaacaactgtcgatttttagtaa

SEQ ID NO: 145374 - DNA, 25 bp, E. coli
gacaacaactgtggatttttagtaa

SEQ ID NO: 145375 - DNA, 25 bp, E. coli
ggtatgaatgattggtttgaagcaa

SEQ ID NO: 145376 - DNA, 25 bp, E. coli
ggattcctcagcgacaacaactgtc

SEQ ID NO: 145377 - DNA, 25 bp, E. coli
ggtatgaatgataggtttgaagcaa

SEQ ID NO: 145378 - DNA, 25 bp, E. coli
ggattcctcagccacaacaactgtc

SEQ ID NO: 145379 - DNA, 25 bp, E. coli
taaccgtcgcgttagcaaaaaattg

SEQ ID NO: 145380 - DNA, 25 bp, E. coli
taaccgtcgcgtaagcaaaaaattg

SEQ ID NO: 145381 - DNA, 25 bp, E. coli
gacgctgatgaatcgtcggttttta

SEQ ID NO: 145382 - DNA, 25 bp, E. coli
gacgctgatgaaacgtcggttttta

SEQ ID NO: 145383 - DNA, 25 bp, E. coli
caccaatttcgtatagagtctcact

SEQ ID NO: 145384 - DNA, 25 bp, E. coli
caaaatcgatttagggtctcaccaa

SEQ ID NO: 145385 - DNA, 25 bp, E. coli
caccaatttcgtttagagtctcact

SEQ ID NO: 145386 - DNA, 25 bp, E. coli
caaaatcgattttgggtctcaccaa

SEQ ID NO: 145387 - DNA, 25 bp, E. coli
catacgcattcgattattttcgaac

SEQ ID NO: 145388 - DNA, 25 bp, E. coli
catacgcattcgtttattttcgaac

SEQ ID NO: 145389 - DNA, 25 bp, E. coli
cacgaccaaacaacttgaaatctgg

SEQ ID NO: 145390 - DNA, 25 bp, E. coli
cacgaccaaacatcttgaaatctgg

SEQ ID NO: 145391 - DNA, 25 bp, E. coli
aacattttgctcgacttttccacga

SEQ ID NO: 145392 - DNA, 25 bp, E. coli
aacattttgctccacttttccacga

SEQ ID NO: 145393 - DNA, 25 bp, E. coli
tattcttcttccttgagtccgcccg

SEQ ID NO: 145394 - DNA, 25 bp, E. coli
tattcttcttccatgagtccgcccg

SEQ ID NO: 145395 - DNA, 25 bp, E. coli
gaaatctggttataataacacgcaa

SEQ ID NO: 145396 - DNA, 25 bp, E. coli
gaacgtgtacatacaaatatgcaca

SEQ ID NO: 145397 - DNA, 25 bp, E. coli
gaacgtgtacattcaaatatgcaca

SEQ ID NO: 145398 - DNA, 25 bp, E. coli
gaaatctggttaaaataacacgcaa

SEQ ID NO: 145399 - DNA, 25 bp, E. coli
gttaaagccatttttcacaaaatcg

SEQ ID NO: 145400 - DNA, 25 bp, E. coli
gttaaagccattattcacaaaatcg

SEQ ID NO: 145401 - DNA, 25 bp, E. coli
taacacgcaacactattcttcttcc

SEQ ID NO: 145402 - DNA, 25 bp, E. coli
taacacgcaacagtattcttcttcc

SEQ ID NO: 145403 - DNA, 25 bp, E. coli
gatgcattatgatatgaacaccaat

SEQ ID NO: 145404 - DNA, 25 bp, E. coli
gatgcattatgaaatgaacaccaat

SEQ ID NO: 145405 - DNA, 25 bp, E. coli
aatggtggccgtatctcgcggagca

SEQ ID NO: 145406 - DNA, 25 bp, E. coli
aatggtggccgtttctcgcggagca

SEQ ID NO: 145407 - DNA, 25 bp, E. coli
agctaacggaatcgtcggtgcgccc

SEQ ID NO: 145408 - DNA, 25 bp, E. coli
agctaacggaatggtcggtgcgccc

SEQ ID NO: 145409 - DNA, 25 bp, E. coli
acaactgcccgccatggacttaagt

SEQ ID NO: 145410 - DNA, 25 bp, E. coli
acaactgcccgcgatggacttaagt

SEQ ID NO: 145411 - DNA, 25 bp, E. coli
tttatcgctggaaggcccgcctgag

SEQ ID NO: 145412 - DNA, 25 bp, E. coli
ttcagggtgagctaacggaatggtc

SEQ ID NO: 145413 - DNA, 25 bp, E. coli
ttggtttatcgctggatggcccgcc

SEQ ID NO: 145414 - DNA, 25 bp, E. coli
ttggtttatcgcaggatggcccgcc

SEQ ID NO: 145415 - DNA, 25 bp, E. coli
ttcagggtgagcaaacggaatggtc

SEQ ID NO: 145416 - DNA, 25 bp, E. coli
tttatcgctggatggcccgcctgag

SEQ ID NO: 145417 - DNA, 25 bp, E. coli
tggtgatattcagggtgagctaacg

SEQ ID NO: 145418 - DNA, 25 bp, E. coli
tggtgatattcacggtgagctaacg

SEQ ID NO: 145419 - DNA, 25 bp, E. coli
ctcgcggagcatcattttcttgttg

SEQ ID NO: 145420 - DNA, 25 bp, E. coli
cggtgcgccccgtggagttcggtga

SEQ ID NO: 145421 - DNA, 25 bp, E. coli
ctggatgacgaaaggtggccgtttc

SEQ ID NO: 145422 - DNA, 25 bp, E. coli
ctggatgacgaatggtggccgtttc

SEQ ID NO: 145423 - DNA, 25 bp, E. coli
cggtgcgccccgaggagttcggtga

SEQ ID NO: 145424 - DNA, 25 bp, E. coli
ctcgcggagcatgattttcttgttg

SEQ ID NO: 145425 - DNA, 25 bp, E. coli
ggacttaagttacatgcgcctggtg

SEQ ID NO: 145426 - DNA, 25 bp, E. coli
ggacttaagttagatgcgcctggtg

SEQ ID NO: 145427 - DNA, 25 bp, E. coli
aagtcagaagcggactgaaacagca

SEQ ID NO: 145428 - DNA, 25 bp, E. coli
aagtcagaagcgcactgaaacagca

SEQ ID NO: 145429 - DNA, 25 bp, E. coli
tagcagtgagccacagcctggcggc

SEQ ID NO: 145430 - DNA, 25 bp, E. coli
tagcagtgagcctcagcctggcggc

SEQ ID NO: 145431 - DNA, 25 bp, E. coli
tttcagatggcgttgtgtctcagcc

SEQ ID NO: 145432 - DNA, 25 bp, E. coli
tttcagatggcgatgtgtctcagcc

SEQ ID NO: 145433 - DNA, 25 bp, E. coli
tgtctcagcctgtcggtagcagtga

SEQ ID NO: 145434 - DNA, 25 bp, E. coli
tgtctcagcctgacggtagcagtga

SEQ ID NO: 145435 - DNA, 25 bp, E. coli
tgaaacagcaacaccgccagaatct

SEQ ID NO: 145436 - DNA, 25 bp, E. coli
tgaaacagcaactccgccagaatct

SEQ ID NO: 145437 - DNA, 25 bp, E. coli
tcttgaggcgcgacttgatgctgaa

SEQ ID NO: 145438 - DNA, 25 bp, E. coli
tcttgaggcgcgtcttgatgctgaa

SEQ ID NO: 145439 - DNA, 25 bp, E. coli
gcctggcggcgatatgatgatgtaa

SEQ ID NO: 145440 - DNA, 25 bp, E. coli
gccagaatcttgaggcgcgtcttga

SEQ ID NO: 145441 - DNA, 25 bp, E. coli
gccagaatcttgtggcgcgtcttga

SEQ ID NO: 145442 - DNA, 25 bp, E. coli
gcctggcggcgaaatgatgatgtaa

SEQ ID NO: 145443 - DNA, 25 bp, E. coli
gaaataaaatctgtggtcactgctg

SEQ ID NO: 145444 - DNA, 25 bp, E. coli
gaaataaaatctctggtcactgctg

SEQ ID NO: 145445 - DNA, 25 bp, E. coli
cgcgggtgacagagctgtttcagat

SEQ ID NO: 145446 - DNA, 25 bp, E. coli
cgcgggtgacagtgctgtttcagat

SEQ ID NO: 145447 - DNA, 25 bp, E. coli
gaccggctgctcgtgagcctgaaga

SEQ ID NO: 145448 - DNA, 25 bp, E. coli
gaccggctgctcctgagcctgaaga

SEQ ID NO: 145449 - DNA, 25 bp, E. coli
caagccgatggagctattggaagca

SEQ ID NO: 145450 - DNA, 25 bp, E. coli
caagccgatggacctattggaagca

SEQ ID NO: 145451 - DNA, 25 bp, E. coli
aaatacttgcgggtggtggcgatcc

SEQ ID NO: 145452 - DNA, 25 bp, E. coli
aaatacttgcggctggtggcgatcc

SEQ ID NO: 145453 - DNA, 25 bp, E. coli
taggaacgatcctcgcaagccaatt

SEQ ID NO: 145454 - DNA, 25 bp, E. coli
taggaacgatccacgcaagccaatt

SEQ ID NO: 145455 - DNA, 25 bp, E. coli
tagtaaggagaggattaaccaggtc

SEQ ID NO: 145456 - DNA, 25 bp, E. coli
tagtaaggagagcattaaccaggtc

SEQ ID NO: 145457 - DNA, 25 bp, E. coli
tgttaaagtgaaaaccgcgaagcca

SEQ ID NO: 145458 - DNA, 25 bp, E. coli
tgttaaagtgaataccgcgaagcca

SEQ ID NO: 145459 - DNA, 25 bp, E. coli
tgcaattgttacaggtcgagccgac

SEQ ID NO: 145460 - DNA, 25 bp, E. coli
tgcaattgttactggtcgagccgac

SEQ ID NO: 145461 - DNA, 25 bp, E. coli
tgccgacgcacgagagaaacgcagt

SEQ ID NO: 145462 - DNA, 25 bp, E. coli
tgccgacgcacgtgagaaacgcagt

SEQ ID NO: 145463 - DNA, 25 bp, E. coli
gacgaaagccgatcgctggtcactg

SEQ ID NO: 145464 - DNA, 25 bp, E. coli
gacgaaagccgaacgctggtcactg

SEQ ID NO: 145465 - DNA, 25 bp, E. coli
gaaaaacactttggaggccgttgct

SEQ ID NO: 145466 - DNA, 25 bp, E. coli
gaaaaacactttcgaggccgttgct

SEQ ID NO: 145467 - DNA, 25 bp, E. coli
gttaaccggtgttcgaacgcaagag

SEQ ID NO: 145468 - DNA, 25 bp, E. coli
gttaaccggtgtacgaacgcaagag

SEQ ID NO: 145469 - DNA, 25 bp, E. coli
ggtttcaggcattccatgagcacaa

SEQ ID NO: 145470 - DNA, 25 bp, E. coli
ggtttcaggcataccatgagcacaa

SEQ ID NO: 145471 - DNA, 25 bp, E. coli
caagaactggcatgagcggatccgt

SEQ ID NO: 145472 - DNA, 25 bp, E. coli
caagaactggcaagagcggatccgt

SEQ ID NO: 145473 - DNA, 25 bp, E. coli
caccgggcaggcactgctaaaagca

SEQ ID NO: 145474 - DNA, 25 bp, E. coli
caccgggcaggctctgctaaaagca

SEQ ID NO: 145475 - DNA, 25 bp, E. coli
aaaattacgctgattctcgaagaag

SEQ ID NO: 145476 - DNA, 25 bp, E. coli
aaaattacgctgtttctcgaagaag

SEQ ID NO: 145477 - DNA, 25 bp, E. coli
taccatgtactgaacaagcggctgg

SEQ ID NO: 145478 - DNA, 25 bp, E. coli
taccatgtactgtacaagcggctgg

SEQ ID NO: 145479 - DNA, 25 bp, E. coli
tgtatccggcagtcaagaactggca

SEQ ID NO: 145480 - DNA, 25 bp, E. coli
tgtatccggcagacaagaactggca

SEQ ID NO: 145481 - DNA, 25 bp, E. coli
gcggcgaaccgcaaagcctctttga

SEQ ID NO: 145482 - DNA, 25 bp, E. coli
gcggcgaaccgctaagcctctttga

SEQ ID NO: 145483 - DNA, 25 bp, E. coli
cattgcggatatagcctgctggccg

SEQ ID NO: 145484 - DNA, 25 bp, E. coli
cattgcggatattgcctgctggccg

SEQ ID NO: 145485 - DNA, 25 bp, E. coli
gttatcaggttgaaactcagcgtct

SEQ ID NO: 145486 - DNA, 25 bp, E. coli
gatcgatctctaattcgccccgaca

SEQ ID NO: 145487 - DNA, 25 bp, E. coli
gttatcaggttgtaactcagcgtct

SEQ ID NO: 145488 - DNA, 25 bp, E. coli
ggttaatgcctgcactcgccagcga

SEQ ID NO: 145489 - DNA, 25 bp, E. coli
ggttaatgcctggactcgccagcga

SEQ ID NO: 145490 - DNA, 25 bp, E. coli
gaggcgagaacttcagcattgcgga

SEQ ID NO: 145491 - DNA, 25 bp, E. coli
gatcgatctctatttcgccccgaca

SEQ ID NO: 145492 - DNA, 25 bp, E. coli
gaggcgagaactacagcattgcgga

SEQ ID NO: 145493 - DNA, 25 bp, E. coli
caacagggatatcaggtcgaaggcc

SEQ ID NO: 145494 - DNA, 25 bp, E. coli
caacagggatatgaggtcgaaggcc

SEQ ID NO: 145495 - DNA, 25 bp, E. coli
attgcgcaaagcgtgttcccggtcg

SEQ ID NO: 145496 - DNA, 25 bp, E. coli
attgcgcaaagcctgttcccggtcg

SEQ ID NO: 145497 - DNA, 25 bp, E. coli
aaaaagtaatcgtcggcatgtccgg

SEQ ID NO: 145498 - DNA, 25 bp, E. coli
aaaggtctgggtatcggtggcacca

SEQ ID NO: 145499 - DNA, 25 bp, E. coli
aaaaagtaatcgacggcatgtccgg

SEQ ID NO: 145500 - DNA, 25 bp, E. coli
aactttgctgcccagtactgggaca

SEQ ID NO: 145501 - DNA, 25 bp, E. coli
aactttgctgccgagtactgggaca

SEQ ID NO: 145502 - DNA, 25 bp, E. coli
aaaggtctgggtttcggtggcacca

SEQ ID NO: 145503 - DNA, 25 bp, E. coli
tgttccttgccgtatataaagccgg

SEQ ID NO: 145504 - DNA, 25 bp, E. coli
tgttccttgccgaatataaagccgg

SEQ ID NO: 145505 - DNA, 25 bp, E. coli
tctataacggtgaagtgtgcctcgg

SEQ ID NO: 145506 - DNA, 25 bp, E. coli
tctataacggtgtagtgtgcctcgg

SEQ ID NO: 145507 - DNA, 25 bp, E. coli
gcggtattattgagcagcgtctgcc

SEQ ID NO: 145508 - DNA, 25 bp, E. coli
gcggtattattgtgcagcgtctgcc

SEQ ID NO: 145509 - DNA, 25 bp, E. coli
gacaagctcggcattgaactgcaca

SEQ ID NO: 145510 - DNA, 25 bp, E. coli
gacaagctcggctttgaactgcaca

SEQ ID NO: 145511 - DNA, 25 bp, E. coli
ggaatattgcacagcggcagcggat

SEQ ID NO: 145512 - DNA, 25 bp, E. coli
ggaatattgcactgcggcagcggat

SEQ ID NO: 145513 - DNA, 25 bp, E. coli
ggtcaccgcgaagaaaaaagactct

SEQ ID NO: 145514 - DNA, 25 bp, E. coli
ggtcaccgcgaacaaaaaagactct

SEQ ID NO: 145515 - DNA, 25 bp, E. coli
caattgcgccgcctcaaatgattta

SEQ ID NO: 145516 - DNA, 25 bp, E. coli
caattgcgccgcgtcaaatgattta

SEQ ID NO: 145517 - DNA, 25 bp, E. coli
caagcggcgcagatacgccgccttt

SEQ ID NO: 145518 - DNA, 25 bp, E. coli
caagcggcgcagttacgccgccttt

SEQ ID NO: 145519 - DNA, 25 bp, E. coli
cagcagtctcaaccggcgcagttac

SEQ ID NO: 145520 - DNA, 25 bp, E. coli
cagcagtctcaagcggcgcagttac

SEQ ID NO: 145521 - DNA, 25 bp, E. coli
tttgtcagcagtctcaagcggcgca

SEQ ID NO: 145522 - DNA, 25 bp, E. coli
tttgtaggaattaatcgccggatgc

SEQ ID NO: 145523 - DNA, 25 bp, E. coli
tttgtcagcagtgtcaagcggcgca

SEQ ID NO: 145524 - DNA, 25 bp, E. coli
tttgtaggaatttatcgccggatgc

SEQ ID NO: 145525 - DNA, 25 bp, E. coli
tgcgtttgtcagcagtctcaagcgg

SEQ ID NO: 145526 - DNA, 25 bp, E. coli
tgcgtttgtcaggagtctcaagcgg

SEQ ID NO: 145527 - DNA, 25 bp, E. coli
cctcaaatgatttacatagtgcgct

SEQ ID NO: 145528 - DNA, 25 bp, E. coli
cctcaaatgattaacatagtgcgct

SEQ ID NO: 145529 - DNA, 25 bp, E. coli
cgccgcatctgggaaacatcctcac

SEQ ID NO: 145530 - DNA, 25 bp, E. coli
cgccgcatctggcaaacatcctcac

SEQ ID NO: 145531 - DNA, 25 bp, E. coli
cggatgcaaggttcacgccgcatct

SEQ ID NO: 145532 - DNA, 25 bp, E. coli
cggatgcaaggtacacgccgcatct

SEQ ID NO: 145533 - DNA, 25 bp, E. coli
tacgccgcctttctaggaattaatc

SEQ ID NO: 145534 - DNA, 25 bp, E. coli
tacgccgcctttgtaggaattaatc

SEQ ID NO: 145535 - DNA, 25 bp, E. coli
taatcgccggatgcaaggttcacgc

SEQ ID NO: 145536 - DNA, 25 bp, E. coli
taatcgccggatccaaggttcacgc

SEQ ID NO: 145537 - DNA, 25 bp, E. coli
cacaaaagttaagcgtgctcattgc

SEQ ID NO: 145538 - DNA, 25 bp, E. coli
cacaaaagttaaccgtgctcattgc

SEQ ID NO: 145539 - DNA, 25 bp, E. coli
acacaaaagttaaccgtgctcattg

SEQ ID NO: 145540 - DNA, 25 bp, E. coli
acggttgattgatttgttgaagtaa

SEQ ID NO: 145541 - DNA, 25 bp, E. coli
acggttgattgaattgttgaagtaa

SEQ ID NO: 145542 - DNA, 25 bp, E. coli
acacaaaagttatccgtgctcattg

SEQ ID NO: 145543 - DNA, 25 bp, E. coli
tgacacaaaagtaaaccgtgctcat

SEQ ID NO: 145544 - DNA, 25 bp, E. coli
tgacacaaaagttaaccgtgctcat

SEQ ID NO: 145545 - DNA, 25 bp, E. coli
gctgacacaaaagttaaccgtgctc

SEQ ID NO: 145546 - DNA, 25 bp, E. coli
gctctgttacggttgattgatttgt

SEQ ID NO: 145547 - DNA, 25 bp, E. coli
gctgacacaaaacttaaccgtgctc

SEQ ID NO: 145548 - DNA, 25 bp, E. coli
gctctgttacggatgattgatttgt

SEQ ID NO: 145549 - DNA, 25 bp, E. coli
gacacaaaagttaaccgtgctcatt

SEQ ID NO: 145550 - DNA, 25 bp, E. coli
gacacaaaagtttaccgtgctcatt

SEQ ID NO: 145551 - DNA, 25 bp, E. coli
cgctgacacaaatgttaaccgtgct

SEQ ID NO: 145552 - DNA, 25 bp, E. coli
cgctgacacaaaagttaaccgtgct

SEQ ID NO: 145553 - DNA, 25 bp, E. coli
ctgacacaaaagataaccgtgctca

SEQ ID NO: 145554 - DNA, 25 bp, E. coli
ctgttacggttgtttgatttgttga

SEQ ID NO: 145555 - DNA, 25 bp, E. coli
ctgttacggttgattgatttgttga

SEQ ID NO: 145556 - DNA, 25 bp, E. coli
ctgacacaaaagttaaccgtgctca

SEQ ID NO: 145557 - DNA, 25 bp, E. coli
gttacggttgattgatttgttgaag

SEQ ID NO: 145558 - DNA, 25 bp, E. coli
gttacggttgatagatttgttgaag

SEQ ID NO: 145559 - DNA, 25 bp, E. coli
caatctgattacagaacatcggcag

SEQ ID NO: 145560 - DNA, 25 bp, E. coli
caatctgattactgaacatcggcag

SEQ ID NO: 145561 - DNA, 25 bp, E. coli
taaaaatacggcttgaaacgagcca

SEQ ID NO: 145562 - DNA, 25 bp, E. coli
taaattttcacacactctgtagcag

SEQ ID NO: 145563 - DNA, 25 bp, E. coli
taaaaatacggcatgaaacgagcca

SEQ ID NO: 145564 - DNA, 25 bp, E. coli
taaattttcacagactctgtagcag

SEQ ID NO: 145565 - DNA, 25 bp, E. coli
atttgcagcaaattaaaaatacggc

SEQ ID NO: 145566 - DNA, 25 bp, E. coli
cggattaggcatctttaagcgtaac

SEQ ID NO: 145567 - DNA, 25 bp, E. coli
atttgcagcaaaataaaaatacggc

SEQ ID NO: 145568 - DNA, 25 bp, E. coli
cggattaggcatgtttaagcgtaac

SEQ ID NO: 145569 - DNA, 25 bp, E. coli
tgaaacgagccatatagggttctcg

SEQ ID NO: 145570 - DNA, 25 bp, E. coli
tgaaacgagccaaatagggttctcg

SEQ ID NO: 145571 - DNA, 25 bp, E. coli
tctgtagcagatcatctaacaatct

SEQ ID NO: 145572 - DNA, 25 bp, E. coli
tctgtagcagatgatctaacaatct

SEQ ID NO: 145573 - DNA, 25 bp, E. coli
gacacgcgtttaatttgcgatacga

SEQ ID NO: 145574 - DNA, 25 bp, E. coli
gaacatcggcagaacaatttgcagc

SEQ ID NO: 145575 - DNA, 25 bp, E. coli
gacacgcgtttattttgcgatacga

SEQ ID NO: 145576 - DNA, 25 bp, E. coli
gaacatcggcagtacaatttgcagc

SEQ ID NO: 145577 - DNA, 25 bp, E. coli
ccgttggcggattaggcatctttaa

SEQ ID NO: 145578 - DNA, 25 bp, E. coli
ccgttggcggataaggcatctttaa

SEQ ID NO: 145579 - DNA, 25 bp, E. coli
taagtaaaatgtaagccgttggcgg

SEQ ID NO: 145580 - DNA, 25 bp, E. coli
taagtaaaatgttagccgttggcgg

SEQ ID NO: 145581 - DNA, 25 bp, E. coli
caacggtcaataaagtgcaacttgg

SEQ ID NO: 145582 - DNA, 25 bp, E. coli
caatatcattttgcaagtactcgaa

SEQ ID NO: 145583 - DNA, 25 bp, E. coli
caatatcattttccaagtactcgaa

SEQ ID NO: 145584 - DNA, 25 bp, E. coli
caacggtcaatatagtgcaacttgg

SEQ ID NO: 145585 - DNA, 25 bp, E. coli
actcgatcaggatcagttactgtca

SEQ ID NO: 145586 - DNA, 25 bp, E. coli
actcgaaagccacggagtaccaacg

SEQ ID NO: 145587 - DNA, 25 bp, E. coli
aagcctacgactttaaactcgatca

SEQ ID NO: 145588 - DNA, 25 bp, E. coli
actcgaaagccagggagtaccaacg

SEQ ID NO: 145589 - DNA, 25 bp, E. coli
actcgatcaggaacagttactgtca

SEQ ID NO: 145590 - DNA, 25 bp, E. coli
aagcctacgactataaactcgatca

SEQ ID NO: 145591 - DNA, 25 bp, E. coli
tttgcaagtactggaaagccacgga

SEQ ID NO: 145592 - DNA, 25 bp, E. coli
tttgcaagtactcgaaagccacgga

SEQ ID NO: 145593 - DNA, 25 bp, E. coli
tgacctgaggcgatatctgaaagag

SEQ ID NO: 145594 - DNA, 25 bp, E. coli
tgacctgaggcgttatctgaaagag

SEQ ID NO: 145595 - DNA, 25 bp, E. coli
gccacggagtaccaacggtcaataa

SEQ ID NO: 145596 - DNA, 25 bp, E. coli
gccacggagtacgaacggtcaataa

SEQ ID NO: 145597 - DNA, 25 bp, E. coli
gactttaaactccatcaggatcagt

SEQ ID NO: 145598 - DNA, 25 bp, E. coli
gactttaaactcgatcaggatcagt

SEQ ID NO: 145599 - DNA, 25 bp, E. coli
cttgctgacctgtggcgttatctga

SEQ ID NO: 145600 - DNA, 25 bp, E. coli
cttgctgacctgaggcgttatctga

SEQ ID NO: 145601 - DNA, 25 bp, E. coli
gagtaccaacggtcaataaagtgca

SEQ ID NO: 145602 - DNA, 25 bp, E. coli
gagtaccaacggacaataaagtgca

SEQ ID NO: 145603 - DNA, 25 bp, E. coli
ctggtagttggtctgaaactcggct

SEQ ID NO: 145604 - DNA, 25 bp, E. coli
ctggtagttggtgtgaaactcggct

SEQ ID NO: 145605 - DNA, 25 bp, E. coli
tactggtagttgctgtgaaactcgg

SEQ ID NO: 145606 - DNA, 25 bp, E. coli
tactggtagttggtgtgaaactcgg

SEQ ID NO: 145607 - DNA, 25 bp, E. coli
aggtttacgcaatagcgacgcgctg

SEQ ID NO: 145608 - DNA, 25 bp, E. coli
actgccggtgatactggtagttggt

SEQ ID NO: 145609 - DNA, 25 bp, E. coli
aggtttacgcaaaagcgacgcgctg

SEQ ID NO: 145610 - DNA, 25 bp, E. coli
actgccggtgattctggtagttggt

SEQ ID NO: 145611 - DNA, 25 bp, E. coli
ttgactgcacagctaatacaacacg

SEQ ID NO: 145612 - DNA, 25 bp, E. coli
ttgactgcacaggtaatacaacacg

SEQ ID NO: 145613 - DNA, 25 bp, E. coli
ccggaaggtttacgcaatagcgacg

SEQ ID NO: 145614 - DNA, 25 bp, E. coli
ccggaaggtttaggcaatagcgacg

SEQ ID NO: 145615 - DNA, 25 bp, E. coli
gaaggtttacgctatagcgacgcgc

SEQ ID NO: 145616 - DNA, 25 bp, E. coli
gaaggtttacgcaatagcgacgcgc

SEQ ID NO: 145617 - DNA, 25 bp, E. coli
gactgcacaggtaatacaacacgcc

SEQ ID NO: 145618 - DNA, 25 bp, E. coli
cgatgttgactgcacaggtaataca

SEQ ID NO: 145619 - DNA, 25 bp, E. coli
cgatgttgactggacaggtaataca

SEQ ID NO: 145620 - DNA, 25 bp, E. coli
ctgcacaggtaaaacaacacgccgg

SEQ ID NO: 145621 - DNA, 25 bp, E. coli
ctgcacaggtaatacaacacgccgg

SEQ ID NO: 145622 - DNA, 25 bp, E. coli
gatactggtagtaggtgtgaaactc

SEQ ID NO: 145623 - DNA, 25 bp, E. coli
gatactggtagttggtgtgaaactc

SEQ ID NO: 145624 - DNA, 25 bp, E. coli
gactgcacaggttatacaacacgcc

SEQ ID NO: 145625 - DNA, 25 bp, E. coli
agtaagcggatggattctcactcca

SEQ ID NO: 145626 - DNA, 25 bp, E. coli
agtaagcggatgcattctcactcca

SEQ ID NO: 145627 - DNA, 25 bp, E. coli
tgattgataaaggaatcatcgttct

SEQ ID NO: 145628 - DNA, 25 bp, E. coli
tgattgataaagcaatcatcgttct

SEQ ID NO: 145629 - DNA, 25 bp, E. coli
tcgcatggagaaaacgggtgattga

SEQ ID NO: 145630 - DNA, 25 bp, E. coli
tgcgctgctggaactgatccgcttt

SEQ ID NO: 145631 - DNA, 25 bp, E. coli
tgcgctgctggatctgatccgcttt

SEQ ID NO: 145632 - DNA, 25 bp, E. coli
tcgcatggagaatacgggtgattga

SEQ ID NO: 145633 - DNA, 25 bp, E. coli
ccatcgcatggacaaaacgggtgat

SEQ ID NO: 145634 - DNA, 25 bp, E. coli
ccatcgcatggagaaaacgggtgat

SEQ ID NO: 145635 - DNA, 25 bp, E. coli
gagaaaacgggtcattgataaagca

SEQ ID NO: 145636 - DNA, 25 bp, E. coli
gagaaaacgggtgattgataaagca

SEQ ID NO: 145637 - DNA, 25 bp, E. coli
ctttctgcttcagcttctgaactga

SEQ ID NO: 145638 - DNA, 25 bp, E. coli
ctttctgcttcaccttctgaactga

SEQ ID NO: 145639 - DNA, 25 bp, E. coli
ggaactgatccgctttctgcttcag

SEQ ID NO: 145640 - DNA, 25 bp, E. coli
ggaactgatccggtttctgcttcag

SEQ ID NO: 145641 - DNA, 25 bp, E. coli
taattgcgctgcaggaactgatccg

SEQ ID NO: 145642 - DNA, 25 bp, E. coli
taattgcgctgctggaactgatccg

SEQ ID NO: 145643 - DNA, 25 bp, E. coli
gatgagtaagcggatgcattctcac

SEQ ID NO: 145644 - DNA, 25 bp, E. coli
gatgcattctcagtccatcgcatgg

SEQ ID NO: 145645 - DNA, 25 bp, E. coli
gatgagtaagcgcatgcattctcac

SEQ ID NO: 145646 - DNA, 25 bp, E. coli
gatgcattctcactccatcgcatgg

SEQ ID NO: 145647 - DNA, 25 bp, E. coli
cacagttacctccacgaagtggtgc

SEQ ID NO: 145648 - DNA, 25 bp, E. coli
cacagttacctcgacgaagtggtgc

SEQ ID NO: 145649 - DNA, 25 bp, E. coli
attgagccgcgagagacggaaacgc

SEQ ID NO: 145650 - DNA, 25 bp, E. coli
attgagccgcgacagacggaaacgc

SEQ ID NO: 145651 - DNA, 25 bp, E. coli
ttcgatgatcatgcgttcaccgtcc

SEQ ID NO: 145652 - DNA, 25 bp, E. coli
ttattgagccgcgagagacggaaac

SEQ ID NO: 145653 - DNA, 25 bp, E. coli
ttcgatgatcatccgttcaccgtcc

SEQ ID NO: 145654 - DNA, 25 bp, E. coli
ttacctcgacgaagtggtgctggat

SEQ ID NO: 145655 - DNA, 25 bp, E. coli
ttattgagccgccagagacggaaac

SEQ ID NO: 145656 - DNA, 25 bp, E. coli
ttacctcgacgatgtggtgctggat

SEQ ID NO: 145657 - DNA, 25 bp, E. coli
tgcgctttattgagccgcgagagac

SEQ ID NO: 145658 - DNA, 25 bp, E. coli
tgcgctttattgtgccgcgagagac

SEQ ID NO: 145659 - DNA, 25 bp, E. coli
gcgcacggacgaagcgacacttatc

SEQ ID NO: 145660 - DNA, 25 bp, E. coli
gcgcacggacgatgcgacacttatc

SEQ ID NO: 145661 - DNA, 25 bp, E. coli
gacccacagttacctcgacgaagtg

SEQ ID NO: 145662 - DNA, 25 bp, E. coli
gacccacagttagctcgacgaagtg

SEQ ID NO: 145663 - DNA, 25 bp, E. coli
cgcgagagacggaaacgcgcaccat

SEQ ID NO: 145664 - DNA, 25 bp, E. coli
cgcgagagacggtaacgcgcaccat

SEQ ID NO: 145665 - DNA, 25 bp, E. coli
ggatcgacccactgttacctcgacg

SEQ ID NO: 145666 - DNA, 25 bp, E. coli
ggatcgacccacagttacctcgacg

SEQ ID NO: 145667 - DNA, 25 bp, E. coli
gagagacggaaaggcgcaccatgca

SEQ ID NO: 145668 - DNA, 25 bp, E. coli
gagagacggaaacgcgcaccatgca

SEQ ID NO: 145669 - DNA, 25 bp, E. coli
tagaagaaagtgttgccgagcctga

SEQ ID NO: 145670 - DNA, 25 bp, E. coli
tagaagaaagtgatgccgagcctga

SEQ ID NO: 145671 - DNA, 25 bp, E. coli
taccggtgagagaaaaggcagaaca

SEQ ID NO: 145672 - DNA, 25 bp, E. coli
taccggtgagagtaaaggcagaaca

SEQ ID NO: 145673 - DNA, 25 bp, E. coli
gccgatttgtgtgcatacccgtctg

SEQ ID NO: 145674 - DNA, 25 bp, E. coli
gccgatttgtgtccatacccgtctg

SEQ ID NO: 145675 - DNA, 25 bp, E. coli
gctttgccggagacagaatttacac

SEQ ID NO: 145676 - DNA, 25 bp, E. coli
gcaggttaaaccagtcagcaaaggg

SEQ ID NO: 145677 - DNA, 25 bp, E. coli
gcaggttaaacctgtcagcaaaggg

SEQ ID NO: 145678 - DNA, 25 bp, E. coli
gctttgccggagtcagaatttacac

SEQ ID NO: 145679 - DNA, 25 bp, E. coli
gaagttttgtcgatacaggcagccc

SEQ ID NO: 145680 - DNA, 25 bp, E. coli
gaagttttgtcgttacaggcagccc

SEQ ID NO: 145681 - DNA, 25 bp, E. coli
gaaaaccggcagatcatccagtaag

SEQ ID NO: 145682 - DNA, 25 bp, E. coli
gacagcttacgagacctgatggaga

SEQ ID NO: 145683 - DNA, 25 bp, E. coli
gaaaattcccgatgagcgatagctg

SEQ ID NO: 145684 - DNA, 25 bp, E. coli
gagcctgaatactcccaaaaacggg

SEQ ID NO: 145685 - DNA, 25 bp, E. coli
gagcctgaatacacccaaaaacggg

SEQ ID NO: 145686 - DNA, 25 bp, E. coli
gaaaattcccgaagagcgatagctg

SEQ ID NO: 145687 - DNA, 25 bp, E. coli
gacagcttacgacacctgatggaga

SEQ ID NO: 145688 - DNA, 25 bp, E. coli
gaaaaccggcagttcatccagtaag

SEQ ID NO: 145689 - DNA, 25 bp, E. coli
cgtaaatcacgtcagggcgcaggtt

SEQ ID NO: 145690 - DNA, 25 bp, E. coli
cgtaaatcacgtgagggcgcaggtt

SEQ ID NO: 145691 - DNA, 25 bp, E. coli
cagcggtcatattctgccatggcag

SEQ ID NO: 145692 - DNA, 25 bp, E. coli
cagcggtcatatactgccatggcag

SEQ ID NO: 145693 - DNA, 25 bp, E. coli
agcatggtctcctgcggatagggcc

SEQ ID NO: 145694 - DNA, 25 bp, E. coli
agcatggtctccagcggatagggcc

SEQ ID NO: 145695 - DNA, 25 bp, E. coli
aaacggctcgatcacagcggtcata

SEQ ID NO: 145696 - DNA, 25 bp, E. coli
aaacggctcgatgacagcggtcata

SEQ ID NO: 145697 - DNA, 25 bp, E. coli
tatcggcgaaggagagttgatggct

SEQ ID NO: 145698 - DNA, 25 bp, E. coli
tatcggcgaaggtgagttgatggct

SEQ ID NO: 145699 - DNA, 25 bp, E. coli
tgcgggagaggataatctcttttcg

SEQ ID NO: 145700 - DNA, 25 bp, E. coli
tgcgggagaggaaaatctcttttcg

SEQ ID NO: 145701 - DNA, 25 bp, E. coli
gccattgcccgcgttgggataaaac

SEQ ID NO: 145702 - DNA, 25 bp, E. coli
gccattgcccgccttgggataaaac

SEQ ID NO: 145703 - DNA, 25 bp, E. coli
gcagtgaatacggagcatggtctcc

SEQ ID NO: 145704 - DNA, 25 bp, E. coli
gcagtgaatacgcagcatggtctcc

SEQ ID NO: 145705 - DNA, 25 bp, E. coli
gaatacgcagcaaggtctccagcgg

SEQ ID NO: 145706 - DNA, 25 bp, E. coli
gaatacgcagcatggtctccagcgg

SEQ ID NO: 145707 - DNA, 25 bp, E. coli
tgcccgccttggcataaaacggctc

SEQ ID NO: 145708 - DNA, 25 bp, E. coli
tgcccgccttgggataaaacggctc

SEQ ID NO: 145709 - DNA, 25 bp, E. coli
cggatagggccgtcggccattgccc

SEQ ID NO: 145710 - DNA, 25 bp, E. coli
cggatagggccgacggccattgccc

SEQ ID NO: 145711 - DNA, 25 bp, E. coli
gaggaaaatctcttttcgggtctga

SEQ ID NO: 145712 - DNA, 25 bp, E. coli
gaggaaaatctcatttcgggtctga

SEQ ID NO: 145713 - DNA, 25 bp, E. coli
cacagagcgggaattcattgagttg

SEQ ID NO: 145714 - DNA, 25 bp, E. coli
cacagagcgggatttcattgagttg

SEQ ID NO: 145715 - DNA, 25 bp, E. coli
cacaacatccgttgatgagcgatct

SEQ ID NO: 145716 - DNA, 25 bp, E. coli
cacaacatccgtagatgagcgatct

SEQ ID NO: 145717 - DNA, 25 bp, E. coli
aaatagaagatttcacagagcggga

SEQ ID NO: 145718 - DNA, 25 bp, E. coli
aaatagaagattacacagagcggga

SEQ ID NO: 145719 - DNA, 25 bp, E. coli
tcttaccagaattacacaacatccg

SEQ ID NO: 145720 - DNA, 25 bp, E. coli
tcttaccagaataacacaacatccg

SEQ ID NO: 145721 - DNA, 25 bp, E. coli
gaagagcttgacaaatattgggatg

SEQ ID NO: 145722 - DNA, 25 bp, E. coli
gaagagcttgactaatattgggatg

SEQ ID NO: 145723 - DNA, 25 bp, E. coli
ctgcaaagaagggagatgataaacc

SEQ ID NO: 145724 - DNA, 25 bp, E. coli
cattgagttgctaggcgagtttaca

SEQ ID NO: 145725 - DNA, 25 bp, E. coli
cattgagttgcttggcgagtttaca

SEQ ID NO: 145726 - DNA, 25 bp, E. coli
ctgcaaagaaggcagatgataaacc

SEQ ID NO: 145727 - DNA, 25 bp, E. coli
tggcgagtttactaatccaaccggg

SEQ ID NO: 145728 - DNA, 25 bp, E. coli
tggcgagtttacaaatccaaccggg

SEQ ID NO: 145729 - DNA, 25 bp, E. coli
ggcggcgttcgcaaggattgccttt

SEQ ID NO: 145730 - DNA, 25 bp, E. coli
ggcggcgttcgctaggattgccttt

SEQ ID NO: 145731 - DNA, 25 bp, E. coli
gagcgatcttatgtactatcctgca

SEQ ID NO: 145732 - DNA, 25 bp, E. coli
gatgatctagaacaacatcttacca

SEQ ID NO: 145733 - DNA, 25 bp, E. coli
gatgatctagaagaacatcttacca

SEQ ID NO: 145734 - DNA, 25 bp, E. coli
gagcgatcttatctactatcctgca

SEQ ID NO: 145735 - DNA, 25 bp, E. coli
cagacacgctccttgaaacaaatta

SEQ ID NO: 145736 - DNA, 25 bp, E. coli
caggagggcaatgagttgcattacc

SEQ ID NO: 145737 - DNA, 25 bp, E. coli
caggagggcaatcagttgcattacc

SEQ ID NO: 145738 - DNA, 25 bp, E. coli
catgaaacaaataatcccgacgaca

SEQ ID NO: 145739 - DNA, 25 bp, E. coli
catgaaacaaattatcccgacgaca

SEQ ID NO: 145740 - DNA, 25 bp, E. coli
cagacacgctccatgaaacaaatta

SEQ ID NO: 145741 - DNA, 25 bp, E. coli
agggcaatcagtagcattaccttgc

SEQ ID NO: 145742 - DNA, 25 bp, E. coli
agggcaatcagttgcattaccttgc

SEQ ID NO: 145743 - DNA, 25 bp, E. coli
tccatgaaacaatttatcccgacga

SEQ ID NO: 145744 - DNA, 25 bp, E. coli
tccatgaaacaaattatcccgacga

SEQ ID NO: 145745 - DNA, 25 bp, E. coli
gacacgctccatgaaacaaattatc

SEQ ID NO: 145746 - DNA, 25 bp, E. coli
gacacgctccatcaaacaaattatc

SEQ ID NO: 145747 - DNA, 25 bp, E. coli
cgctccatgaaagaaattatcccga

SEQ ID NO: 145748 - DNA, 25 bp, E. coli
cgctccatgaaacaaattatcccga

SEQ ID NO: 145749 - DNA, 25 bp, E. coli
gtcagacacgctccatgaaacaaat

SEQ ID NO: 145750 - DNA, 25 bp, E. coli
gtcagacacgctgcatgaaacaaat

SEQ ID NO: 145751 - DNA, 25 bp, E. coli
gtgtcagacacgctccatgaaacaa

SEQ ID NO: 145752 - DNA, 25 bp, E. coli
gtgtcagacacggtccatgaaacaa

SEQ ID NO: 145753 - DNA, 25 bp, E. coli
gtgcaggagggcaatcagttgcatt

SEQ ID NO: 145754 - DNA, 25 bp, E. coli
gtgcaggagggctatcagttgcatt

SEQ ID NO: 145755 - DNA, 25 bp, E. coli
ggagggcaatcagttgcattacctt

SEQ ID NO: 145756 - DNA, 25 bp, E. coli
ggagggcaatcacttgcattacctt

SEQ ID NO: 145757 - DNA, 25 bp, E. coli
agccgatattgcctccgggcaaccg

SEQ ID NO: 145758 - DNA, 25 bp, E. coli
agccgatattgcgtccgggcaaccg

SEQ ID NO: 145759 - DNA, 25 bp, E. coli
acggctacgcggtgcgtttagccga

SEQ ID NO: 145760 - DNA, 25 bp, E. coli
acggctacgcggagcgtttagccga

SEQ ID NO: 145761 - DNA, 25 bp, E. coli
tacgcggtgcgtttagccgatattg

SEQ ID NO: 145762 - DNA, 25 bp, E. coli
tacgcggtgcgtatagccgatattg

SEQ ID NO: 145763 - DNA, 25 bp, E. coli
ttagccgatattccctccgggcaac

SEQ ID NO: 145764 - DNA, 25 bp, E. coli
ttagccgatattgcctccgggcaac

SEQ ID NO: 145765 - DNA, 25 bp, E. coli
tgcctccgggcaaccgctgcccgtt

SEQ ID NO: 145766 - DNA, 25 bp, E. coli
tgcctccgggcatccgctgcccgtt

SEQ ID NO: 145767 - DNA, 25 bp, E. coli
gcgtttagccgatattgcctccggg

SEQ ID NO: 145768 - DNA, 25 bp, E. coli
gcgtttagccgaaattgcctccggg

SEQ ID NO: 145769 - DNA, 25 bp, E. coli
gctacgcggtgcgtttagccgatat

SEQ ID NO: 145770 - DNA, 25 bp, E. coli
gcggtgcgtttagccgatattgcct

SEQ ID NO: 145771 - DNA, 25 bp, E. coli
gcggtgcgtttacccgatattgcct

SEQ ID NO: 145772 - DNA, 25 bp, E. coli
gctacgcggtgcctttagccgatat

SEQ ID NO: 145773 - DNA, 25 bp, E. coli
cgcggtgcgtttagccgatattgcc

SEQ ID NO: 145774 - DNA, 25 bp, E. coli
cgcggtgcgttttgccgatattgcc

SEQ ID NO: 145775 - DNA, 25 bp, E. coli
gtttagccgatattgcctccgggca

SEQ ID NO: 145776 - DNA, 25 bp, E. coli
gtttagccgataatgcctccgggca

SEQ ID NO: 145777 - DNA, 25 bp, E. coli
gtgcgtttagccgatattgcctccg

SEQ ID NO: 145778 - DNA, 25 bp, E. coli
gtgcgtttagcccatattgcctccg

SEQ ID NO: 145779 - DNA, 25 bp, E. coli
tatccgtcaggaagtgtgcgcaatg

SEQ ID NO: 145780 - DNA, 25 bp, E. coli
tttcgggtttcgagaacgagcatct

SEQ ID NO: 145781 - DNA, 25 bp, E. coli
tttcgggtttcgtgaacgagcatct

SEQ ID NO: 145782 - DNA, 25 bp, E. coli
tatccgtcaggatgtgtgcgcaatg

SEQ ID NO: 145783 - DNA, 25 bp, E. coli
tttcgagaacgaccatctcaacttt

SEQ ID NO: 145784 - DNA, 25 bp, E. coli
tttcgagaacgagcatctcaacttt

SEQ ID NO: 145785 - DNA, 25 bp, E. coli
gcctggctatccctcaggaagtgtg

SEQ ID NO: 145786 - DNA, 25 bp, E. coli
gccaaccattttgccgggctggcac

SEQ ID NO: 145787 - DNA, 25 bp, E. coli
gccaaccattttcccgggctggcac

SEQ ID NO: 145788 - DNA, 25 bp, E. coli
gcctggctatccgtcaggaagtgtg

SEQ ID NO: 145789 - DNA, 25 bp, E. coli
gcactggctgttacgggtttcgaga

SEQ ID NO: 145790 - DNA, 25 bp, E. coli
gaagtgtgcgcattgatggcactga

SEQ ID NO: 145791 - DNA, 25 bp, E. coli
gaagtgtgcgcaatgatggcactga

SEQ ID NO: 145792 - DNA, 25 bp, E. coli
gcactggctgtttcgggtttcgaga

SEQ ID NO: 145793 - DNA, 25 bp, E. coli
cgcctgtggttttgccgtgcagctt

SEQ ID NO: 145794 - DNA, 25 bp, E. coli
cgcctgtggtttagccgtgcagctt

SEQ ID NO: 145795 - DNA, 25 bp, E. coli
ctctgcgtgtgcgtttcagcactac

SEQ ID NO: 145796 - DNA, 25 bp, E. coli
ctctgcgtgtgcctttcagcactac

SEQ ID NO: 145797 - DNA, 25 bp, E. coli
gtgcgcaatgatggcactgaatatg

SEQ ID NO: 145798 - DNA, 25 bp, E. coli
gtgcgcaatgatcgcactgaatatg

SEQ ID NO: 145799 - DNA, 25 bp, E. coli
ggcaccgcctgtggttttgccgtgc

SEQ ID NO: 145800 - DNA, 25 bp, E. coli
ggcaccgcctgtcgttttgccgtgc

SEQ ID NO: 145801 - DNA, 25 bp, E. coli
caaaaggcccagtcttccgactgag

SEQ ID NO: 145802 - DNA, 25 bp, E. coli
caacagataaaacaaaaggcccagt

SEQ ID NO: 145803 - DNA, 25 bp, E. coli
caacagataaaagaaaaggcccagt

SEQ ID NO: 145804 - DNA, 25 bp, E. coli
caaaaggcccagacttccgactgag

SEQ ID NO: 145805 - DNA, 25 bp, E. coli
tagttcgaaaaggaaaaaggccatc

SEQ ID NO: 145806 - DNA, 25 bp, E. coli
tagttcgaaaagcaaaaaggccatc

SEQ ID NO: 145807 - DNA, 25 bp, E. coli
tcgcttgatttgttgtctggcagtt

SEQ ID NO: 145808 - DNA, 25 bp, E. coli
tcgcttgatttgatgtctggcagtt

SEQ ID NO: 145809 - DNA, 25 bp, E. coli
tcggatggcctttcgcttgatttga

SEQ ID NO: 145810 - DNA, 25 bp, E. coli
tcggatggccttacgcttgatttga

SEQ ID NO: 145811 - DNA, 25 bp, E. coli
tctggcagtttatggcgggcgtcct

SEQ ID NO: 145812 - DNA, 25 bp, E. coli
tctggcagtttaaggcgggcgtcct

SEQ ID NO: 145813 - DNA, 25 bp, E. coli
gctcccggcggaattgtcctactcg

SEQ ID NO: 145814 - DNA, 25 bp, E. coli
gctcccggcggatttgtcctactcg

SEQ ID NO: 145815 - DNA, 25 bp, E. coli
gcaaaaaggccatcctttcggatgg

SEQ ID NO: 145816 - DNA, 25 bp, E. coli
gcaaaaaggccaacctttcggatgg

SEQ ID NO: 145817 - DNA, 25 bp, E. coli
gttgcttcgcaaggttcaaatccgc

SEQ ID NO: 145818 - DNA, 25 bp, E. coli
gttgcttcgcaacgttcaaatccgc

SEQ ID NO: 145819 - DNA, 25 bp, E. coli
tcctactcgggacagtgttcaccga

SEQ ID NO: 145820 - DNA, 25 bp, E. coli
tcctactcgggagagtgttcaccga

SEQ ID NO: 145821 - DNA, 25 bp, E. coli
gagtgttcaccgtcaaacaacagat

SEQ ID NO: 145822 - DNA, 25 bp, E. coli
gagtgttcaccgacaaacaacagat

SEQ ID NO: 145823 - DNA, 25 bp, E. coli
ggtgacccgtcggtttatcttcctt

SEQ ID NO: 145824 - DNA, 25 bp, E. coli
atccactaaagcattcaccactcag

SEQ ID NO: 145825 - DNA, 25 bp, E. coli
ggtgacccgtcgctttatcttcctt

SEQ ID NO: 145826 - DNA, 25 bp, E. coli
atccactaaagctttcaccactcag

SEQ ID NO: 145827 - DNA, 25 bp, E. coli
tgccggtgacccgtcgctttatctt

SEQ ID NO: 145828 - DNA, 25 bp, E. coli
tgccggtgacccctcgctttatctt

SEQ ID NO: 145829 - DNA, 25 bp, E. coli
tcggcgtggcatgcactaaagcatt

SEQ ID NO: 145830 - DNA, 25 bp, E. coli
tcggcgtggcatccactaaagcatt

SEQ ID NO: 145831 - DNA, 25 bp, E. coli
tcagaagtgaatgcgcatccgcatg

SEQ ID NO: 145832 - DNA, 25 bp, E. coli
ccttcagaagtgtatgcgcatccgc

SEQ ID NO: 145833 - DNA, 25 bp, E. coli
ccttcagaagtgaatgcgcatccgc

SEQ ID NO: 145834 - DNA, 25 bp, E. coli
gcgggttttgtatgtagcgataaca

SEQ ID NO: 145835 - DNA, 25 bp, E. coli
gcgggttttgtaagtagcgataaca

SEQ ID NO: 145836 - DNA, 25 bp, E. coli
gttttgtaagtagcgataacatgca

SEQ ID NO: 145837 - DNA, 25 bp, E. coli
gttttgtaagtaccgataacatgca

SEQ ID NO: 145838 - DNA, 25 bp, E. coli
gtgaaccttcagaagtgaatgcgca

SEQ ID NO: 145839 - DNA, 25 bp, E. coli
ggcatccactaatgcattcaccact

SEQ ID NO: 145840 - DNA, 25 bp, E. coli
ggcatccactaaagcattcaccact

SEQ ID NO: 145841 - DNA, 25 bp, E. coli
gtgaaccttcagtagtgaatgcgca

SEQ ID NO: 145842 - DNA, 25 bp, E. coli
tcagaagtgaatccgcatccgcatg

SEQ ID NO: 145843 - DNA, 25 bp, E. coli
gatgcgggttttgtaagtagcgata

SEQ ID NO: 145844 - DNA, 25 bp, E. coli
gatgcgggttttctaagtagcgata

SEQ ID NO: 145845 - DNA, 25 bp, E. coli
caatcagtagtgtcggctcaggctc

SEQ ID NO: 145846 - DNA, 25 bp, E. coli
caatcagtagtgacggctcaggctc

SEQ ID NO: 145847 - DNA, 25 bp, E. coli
caactgaatcaggtcgtggagcggc

SEQ ID NO: 145848 - DNA, 25 bp, E. coli
caactgaatcagctcgtggagcggc

SEQ ID NO: 145849 - DNA, 25 bp, E. coli
taaatcccgccaggatgacgcaatg

SEQ ID NO: 145850 - DNA, 25 bp, E. coli
taaatcccgccacgatgacgcaatg

SEQ ID NO: 145851 - DNA, 25 bp, E. coli
ttgcgctggtgcaggataaatcccg

SEQ ID NO: 145852 - DNA, 25 bp, E. coli
ttgcgctggtgctggataaatcccg

SEQ ID NO: 145853 - DNA, 25 bp, E. coli
tgatgctggtactgcgaatgctggc

SEQ ID NO: 145854 - DNA, 25 bp, E. coli
tgttgcagatcgtcagcctcagcag

SEQ ID NO: 145855 - DNA, 25 bp, E. coli
tgttgcagatcgacagcctcagcag

SEQ ID NO: 145856 - DNA, 25 bp, E. coli
tgatgctggtacagcgaatgctggc

SEQ ID NO: 145857 - DNA, 25 bp, E. coli
tcgtggagcggctaaagcagatcct

SEQ ID NO: 145858 - DNA, 25 bp, E. coli
tcgttactggttcgtatagcggccc

SEQ ID NO: 145859 - DNA, 25 bp, E. coli
tcgttactggttggtatagcggccc

SEQ ID NO: 145860 - DNA, 25 bp, E. coli
tcgtggagcggcaaaagcagatcct

SEQ ID NO: 145861 - DNA, 25 bp, E. coli
gcgtatttctaatgctcacagccag

SEQ ID NO: 145862 - DNA, 25 bp, E. coli
gcgtatttctaaagctcacagccag

SEQ ID NO: 145863 - DNA, 25 bp, E. coli
ccgatattgattgcctgcgtggtca

SEQ ID NO: 145864 - DNA, 25 bp, E. coli
ccgatattgattccctgcgtggtca

SEQ ID NO: 145865 - DNA, 25 bp, E. coli
gattcaacttacgtgccaaacgcca

SEQ ID NO: 145866 - DNA, 25 bp, E. coli
gattcaacttacctgccaaacgcca

SEQ ID NO: 145867 - DNA, 25 bp, E. coli
taaactctggcctcacagcgagtca

SEQ ID NO: 145868 - DNA, 25 bp, E. coli
taaactctggccacacagcgagtca

SEQ ID NO: 145869 - DNA, 25 bp, E. coli
acacagcgagtcttacatcttcgcc

SEQ ID NO: 145870 - DNA, 25 bp, E. coli
aaaacggttgatctccgcttgccgc

SEQ ID NO: 145871 - DNA, 25 bp, E. coli
acacagcgagtcatacatcttcgcc

SEQ ID NO: 145872 - DNA, 25 bp, E. coli
aaaacggttgatgtccgcttgccgc

SEQ ID NO: 145873 - DNA, 25 bp, E. coli
ttgccgctgcaaaacgtacccatgc

SEQ ID NO: 145874 - DNA, 25 bp, E. coli
ttgccgctgcaatacgtacccatgc

SEQ ID NO: 145875 - DNA, 25 bp, E. coli
tcctcaaaacggatgatctccgctt

SEQ ID NO: 145876 - DNA, 25 bp, E. coli
tcgcatccggtccagtttcgtcacg

SEQ ID NO: 145877 - DNA, 25 bp, E. coli
tcgcatccggtcgagtttcgtcacg

SEQ ID NO: 145878 - DNA, 25 bp, E. coli
tcgagtttcgtcacgtgctggtggc

SEQ ID NO: 145879 - DNA, 25 bp, E. coli
tcgagtttcgtctcgtgctggtggc

SEQ ID NO: 145880 - DNA, 25 bp, E. coli
tcctcaaaacggttgatctccgctt

SEQ ID NO: 145881 - DNA, 25 bp, E. coli
tcagcgtacggtcgaacggttcctt

SEQ ID NO: 145882 - DNA, 25 bp, E. coli
tcagcgtacggtggaacggttcctt

SEQ ID NO: 145883 - DNA, 25 bp, E. coli
gttgatctccgcatgccgctgcaaa

SEQ ID NO: 145884 - DNA, 25 bp, E. coli
gttgatctccgcttgccgctgcaaa

SEQ ID NO: 145885 - DNA, 25 bp, E. coli
tggccacacagccagtcatacatct

SEQ ID NO: 145886 - DNA, 25 bp, E. coli
tggccacacagcgagtcatacatct

SEQ ID NO: 145887 - DNA, 25 bp, E. coli
tcaatggtgggcaggaaatcctcaa

SEQ ID NO: 145888 - DNA, 25 bp, E. coli
tcaatggtgggctggaaatcctcaa

SEQ ID NO: 145889 - DNA, 25 bp, E. coli
aagccgcatccaaaacggaaacgga

SEQ ID NO: 145890 - DNA, 25 bp, E. coli
atgagctggcacagatgttcgggat

SEQ ID NO: 145891 - DNA, 25 bp, E. coli
agccgaaagccgcatccataacgga

SEQ ID NO: 145892 - DNA, 25 bp, E. coli
agctgaacaagtcccgggatattct

SEQ ID NO: 145893 - DNA, 25 bp, E. coli
agccgaaagccggatccataacgga

SEQ ID NO: 145894 - DNA, 25 bp, E. coli
agctgaacaagtgccgggatattct

SEQ ID NO: 145895 - DNA, 25 bp, E. coli
atgagctggcactgatgttcgggat

SEQ ID NO: 145896 - DNA, 25 bp, E. coli
aagccgcatccataacggaaacgga

SEQ ID NO: 145897 - DNA, 25 bp, E. coli
aacaagtgccgggatattctccggg

SEQ ID NO: 145898 - DNA, 25 bp, E. coli
aacaagtgccggcatattctccggg

SEQ ID NO: 145899 - DNA, 25 bp, E. coli
tccataacggaaacggatggtaaag

SEQ ID NO: 145900 - DNA, 25 bp, E. coli
tccataacggaatcggatggtaaag

SEQ ID NO: 145901 - DNA, 25 bp, E. coli
gccgcatccatatcggaaacggatg

SEQ ID NO: 145902 - DNA, 25 bp, E. coli
gccgcatccataacggaaacggatg

SEQ ID NO: 145903 - DNA, 25 bp, E. coli
gctggcactgatgttcgggattacc

SEQ ID NO: 145904 - DNA, 25 bp, E. coli
gctggcactgatcttcgggattacc

SEQ ID NO: 145905 - DNA, 25 bp, E. coli
gcatccataacggaaacggatggta

SEQ ID NO: 145906 - DNA, 25 bp, E. coli
gcatccataacgcaaacggatggta

SEQ ID NO: 145907 - DNA, 25 bp, E. coli
gaaagccgcatcgataacggaaacg

SEQ ID NO: 145908 - DNA, 25 bp, E. coli
gaaagccgcatccataacggaaacg

SEQ ID NO: 145909 - DNA, 25 bp, E. coli
gagctggcactgatgttcgggatta

SEQ ID NO: 145910 - DNA, 25 bp, E. coli
gagctggcactgttgttcgggatta

SEQ ID NO: 145911 - DNA, 25 bp, E. coli
cataatggttcgtcttttagccgtt

SEQ ID NO: 145912 - DNA, 25 bp, E. coli
cttttagccgttttattcagtatag

SEQ ID NO: 145913 - DNA, 25 bp, E. coli
cttttagccgttatattcagtatag

SEQ ID NO: 145914 - DNA, 25 bp, E. coli
cataatggttcgacttttagccgtt

SEQ ID NO: 145915 - DNA, 25 bp, E. coli
tttgcggcggaaactaacagaaagc

SEQ ID NO: 145916 - DNA, 25 bp, E. coli
tttgcggcggaatctaacagaaagc

SEQ ID NO: 145917 - DNA, 25 bp, E. coli
tattcagtatagatttgcggcggaa

SEQ ID NO: 145918 - DNA, 25 bp, E. coli
tattcagtatagttttgcggcggaa

SEQ ID NO: 145919 - DNA, 25 bp, E. coli
tttattcagtatagatttgcggcgg

SEQ ID NO: 145920 - DNA, 25 bp, E. coli
tttattcagtattgatttgcggcgg

SEQ ID NO: 145921 - DNA, 25 bp, E. coli
tcagtatagatttgcggcggaatct

SEQ ID NO: 145922 - DNA, 25 bp, E. coli
tcagtatagattagcggcggaatct

SEQ ID NO: 145923 - DNA, 25 bp, E. coli
gaaagcaagcaaagaaaaaaggcga

SEQ ID NO: 145924 - DNA, 25 bp, E. coli
gaaagcaagcaatgaaaaaaggcga

SEQ ID NO: 145925 - DNA, 25 bp, E. coli
cggcggaatctatcagaaagcaagc

SEQ ID NO: 145926 - DNA, 25 bp, E. coli
cggcggaatctaacagaaagcaagc

SEQ ID NO: 145927 - DNA, 25 bp, E. coli
gatttgcggcggaatctaacagaaa

SEQ ID NO: 145928 - DNA, 25 bp, E. coli
gatttgcggcggtatctaacagaaa

SEQ ID NO: 145929 - DNA, 25 bp, E. coli
ggaatctaacagtaagcaagcaaag

SEQ ID NO: 145930 - DNA, 25 bp, E. coli
ggaatctaacagaaagcaagcaaag

SEQ ID NO: 145931 - DNA, 25 bp, E. coli
gatgatggtttcataatggttcgtc

SEQ ID NO: 145932 - DNA, 25 bp, E. coli
gatgatggtttcttaatggttcgtc

SEQ ID NO: 145933 - DNA, 25 bp, E. coli
taaaataaagcgtctggaaaaccag

SEQ ID NO: 145934 - DNA, 25 bp, E. coli
tagcgatcttcgagatttcggtcac

SEQ ID NO: 145935 - DNA, 25 bp, E. coli
tagcgatcttcgtgatttcggtcac

SEQ ID NO: 145936 - DNA, 25 bp, E. coli
ttcttactggtgttagcgatcttcg

SEQ ID NO: 145937 - DNA, 25 bp, E. coli
ttcggtcacgttgggtgcgcagaac

SEQ ID NO: 145938 - DNA, 25 bp, E. coli
ttcttactggtgatagcgatcttcg

SEQ ID NO: 145939 - DNA, 25 bp, E. coli
ttcggtcacgttcggtgcgcagaac

SEQ ID NO: 145940 - DNA, 25 bp, E. coli
tgcgcagaacgaacaacaggtgacg

SEQ ID NO: 145941 - DNA, 25 bp, E. coli
tgcgcagaacgatcaacaggtgacg

SEQ ID NO: 145942 - DNA, 25 bp, E. coli
gcgcgctgaacgtaaaataaagcga

SEQ ID NO: 145943 - DNA, 25 bp, E. coli
gctatcggttggttgatttgtggcc

SEQ ID NO: 145944 - DNA, 25 bp, E. coli
gctatcggttggatgatttgtggcc

SEQ ID NO: 145945 - DNA, 25 bp, E. coli
gcgcgctgaacgaaaaataaagcga

SEQ ID NO: 145946 - DNA, 25 bp, E. coli
gatttgtggcctgttctggctgcga

SEQ ID NO: 145947 - DNA, 25 bp, E. coli
gatttgtggcctcttctggctgcga

SEQ ID NO: 145948 - DNA, 25 bp, E. coli
tggaaaaccagctttcacccgcgac

SEQ ID NO: 145949 - DNA, 25 bp, E. coli
tggaaaaccagcattcacccgcgac

SEQ ID NO: 145950 - DNA, 25 bp, E. coli
tcacccgcgactgacgtggctgtag

SEQ ID NO: 145951 - DNA, 25 bp, E. coli
tcacccgcgactcacgtggctgtag

SEQ ID NO: 145952 - DNA, 25 bp, E. coli
taaaataaagcgactggaaaaccag

SEQ ID NO: 145953 - DNA, 25 bp, E. coli
gagtaccgtattaccacattgctgg

SEQ ID NO: 145954 - DNA, 25 bp, E. coli
gagtaccgtatttccacattgctgg

SEQ ID NO: 145955 - DNA, 25 bp, E. coli
tactggacctggcaacaggcgcaac

SEQ ID NO: 145956 - DNA, 25 bp, E. coli
tactggacctgggaacaggcgcaac

SEQ ID NO: 145957 - DNA, 25 bp, E. coli
taacggcgacgtccagatcgaactg

SEQ ID NO: 145958 - DNA, 25 bp, E. coli
tcgaactgaccgcttactggacctg

SEQ ID NO: 145959 - DNA, 25 bp, E. coli
tcgaactgaccggttactggacctg

SEQ ID NO: 145960 - DNA, 25 bp, E. coli
tatggatagcgcgtacgaaaccact

SEQ ID NO: 145961 - DNA, 25 bp, E. coli
tatggatagcgcctacgaaaccact

SEQ ID NO: 145962 - DNA, 25 bp, E. coli
ttgcaagtcgcggtggacaaccaga

SEQ ID NO: 145963 - DNA, 25 bp, E. coli
ttgcaagtcgcgctggacaaccaga

SEQ ID NO: 145964 - DNA, 25 bp, E. coli
tccgatatgggcttcaaagtcaccg

SEQ ID NO: 145965 - DNA, 25 bp, E. coli
tccgatatgggcatcaaagtcaccg

SEQ ID NO: 145966 - DNA, 25 bp, E. coli
gcacaaaatcgttctggcagacgcc

SEQ ID NO: 145967 - DNA, 25 bp, E. coli
gcacaaaatcgtactggcagacgcc

SEQ ID NO: 145968 - DNA, 25 bp, E. coli
cgacattatcgatgtgggcaccatt

SEQ ID NO: 145969 - DNA, 25 bp, E. coli
cgctggacgtgggaaaagagtttaa

SEQ ID NO: 145970 - DNA, 25 bp, E. coli
cgacattatcgaagtgggcaccatt

SEQ ID NO: 145971 - DNA, 25 bp, E. coli
cgctggacgtggcaaaagagtttaa

SEQ ID NO: 145972 - DNA, 25 bp, E. coli
cgtgcgtgcggtacgtgacctgaaa

SEQ ID NO: 145973 - DNA, 25 bp, E. coli
cgtgcgtgcggttcgtgacctgaaa

SEQ ID NO: 145974 - DNA, 25 bp, E. coli
ggtggtttatcaccgcagccgtgac

SEQ ID NO: 145975 - DNA, 25 bp, E. coli
ggtggtttatcagcgcagccgtgac

SEQ ID NO: 145976 - DNA, 25 bp, E. coli
taacggcgacgtgcagatcgaactg

SEQ ID NO: 145977 - DNA, 25 bp, E. coli
aatacgcgccgaaatatcattgtgc

SEQ ID NO: 145978 - DNA, 25 bp, E. coli
aatacgcgccgatatatcattgtgc

SEQ ID NO: 145979 - DNA, 25 bp, E. coli
cacacttatgcaacggaatacgcgc

SEQ ID NO: 145980 - DNA, 25 bp, E. coli
cacacttatgcatcggaatacgcgc

SEQ ID NO: 145981 - DNA, 25 bp, E. coli
taaagagaagtctatccccaaaggg

SEQ ID NO: 145982 - DNA, 25 bp, E. coli
taaacatgtctccatcagacgcaca

SEQ ID NO: 145983 - DNA, 25 bp, E. coli
taaagagaagtcaatccccaaaggg

SEQ ID NO: 145984 - DNA, 25 bp, E. coli
taaacatgtctcgatcagacgcaca

SEQ ID NO: 145985 - DNA, 25 bp, E. coli
tacaacgttaattatggcaagccat

SEQ ID NO: 145986 - DNA, 25 bp, E. coli
tacaacgttaataatggcaagccat

SEQ ID NO: 145987 - DNA, 25 bp, E. coli
ttgaagcagttggaccatgacagtg

SEQ ID NO: 145988 - DNA, 25 bp, E. coli
ttgaagcagttgcaccatgacagtg

SEQ ID NO: 145989 - DNA, 25 bp, E. coli
tgtgcttaacctagccagttcaggc

SEQ ID NO: 145990 - DNA, 25 bp, E. coli
tgaattgagtaacccttcaacgacg

SEQ ID NO: 145991 - DNA, 25 bp, E. coli
tgaattgagtaagccttcaacgacg

SEQ ID NO: 145992 - DNA, 25 bp, E. coli
tgtgcttaaccttgccagttcaggc

SEQ ID NO: 145993 - DNA, 25 bp, E. coli
ccaggccagtggcagaagttattac

SEQ ID NO: 145994 - DNA, 25 bp, E. coli
ccaggccagtgggagaagttattac

SEQ ID NO: 145995 - DNA, 25 bp, E. coli
gttcaggcagatacttaaactggcg

SEQ ID NO: 145996 - DNA, 25 bp, E. coli
gttcaggcagattcttaaactggcg

SEQ ID NO: 145997 - DNA, 25 bp, E. coli
taagttcagttgatccaggccagtg

SEQ ID NO: 145998 - DNA, 25 bp, E. coli
taagttcagttgttccaggccagtg

SEQ ID NO: 145999 - DNA, 25 bp, E. coli
taaactggagaatgattcttcagga

SEQ ID NO: 146000 - DNA, 25 bp, E. coli
taaactggagaaagattcttcagga

SEQ ID NO: 146001 - DNA, 25 bp, E. coli
acggttttgaacacctgatgtcggg

SEQ ID NO: 146002 - DNA, 25 bp, E. coli
acggttttgaactcctgatgtcggg

SEQ ID NO: 146003 - DNA, 25 bp, E. coli
aaaaataatggcctctccgccaggg

SEQ ID NO: 146004 - DNA, 25 bp, E. coli
aaaaataatggcgtctccgccaggg

SEQ ID NO: 146005 - DNA, 25 bp, E. coli
tatcctgaacattaactgatacctt

SEQ ID NO: 146006 - DNA, 25 bp, E. coli
tatcctgaacataaactgatacctt

SEQ ID NO: 146007 - DNA, 25 bp, E. coli
tatctgccagtaagaatgatgccgg

SEQ ID NO: 146008 - DNA, 25 bp, E. coli
tatctgccagtatgaatgatgccgg

SEQ ID NO: 146009 - DNA, 25 bp, E. coli
tggtattagtccttgccagcagctg

SEQ ID NO: 146010 - DNA, 25 bp, E. coli
tgatgtcgggtattatgcaggattt

SEQ ID NO: 146011 - DNA, 25 bp, E. coli
tgatgtcgggtaatatgcaggattt

SEQ ID NO: 146012 - DNA, 25 bp, E. coli
gaatcttgagctcaataaactggag

SEQ ID NO: 146013 - DNA, 25 bp, E. coli
gaatcttgagctgaataaactggag

SEQ ID NO: 146014 - DNA, 25 bp, E. coli
tccgccagggtttaattaaaagatg

SEQ ID NO: 146015 - DNA, 25 bp, E. coli
tccgccagggttaaattaaaagatg

SEQ ID NO: 146016 - DNA, 25 bp, E. coli
tggtattagtccatgccagcagctg

SEQ ID NO: 146017 - DNA, 25 bp, E. coli
tcaagaacgtcctaaaataatggcg

SEQ ID NO: 146018 - DNA, 25 bp, E. coli
tcaagaacgtccaaaaataatggcg

SEQ ID NO: 146019 - DNA, 25 bp, E. coli
gacgttaattatcgactgaatcttg

SEQ ID NO: 146020 - DNA, 25 bp, E. coli
gacgttaattatggactgaatcttg

SEQ ID NO: 146021 - DNA, 25 bp, E. coli
caaaacgccatggtttgctcgcaga

SEQ ID NO: 146022 - DNA, 25 bp, E. coli
caaaacgccatgctttgctcgcaga

SEQ ID NO: 146023 - DNA, 25 bp, E. coli
cagtcctgctaatacgttcgtttga

SEQ ID NO: 146024 - DNA, 25 bp, E. coli
cagtcctgctaaaacgttcgtttga

SEQ ID NO: 146025 - DNA, 25 bp, E. coli
aggcttgctgatcccgcgcaacaaa

SEQ ID NO: 146026 - DNA, 25 bp, E. coli
aggcttgctgatgccgcgcaacaaa

SEQ ID NO: 146027 - DNA, 25 bp, E. coli
aaacaactgccgctaggcttgctga

SEQ ID NO: 146028 - DNA, 25 bp, E. coli
aaacaactgccggtaggcttgctga

SEQ ID NO: 146029 - DNA, 25 bp, E. coli
tgctcgcagatgcttggcaaccgac

SEQ ID NO: 146030 - DNA, 25 bp, E. coli
tgctcgcagatggttggcaaccgac

SEQ ID NO: 146031 - DNA, 25 bp, E. coli
cgcgaatattcagcgggagagtccc

SEQ ID NO: 146032 - DNA, 25 bp, E. coli
cgcgaatattcaccgggagagtccc

SEQ ID NO: 146033 - DNA, 25 bp, E. coli
cattcctgatttaaattaacgcgcg

SEQ ID NO: 146034 - DNA, 25 bp, E. coli
cattcctgattttaattaacgcgcg

SEQ ID NO: 146035 - DNA, 25 bp, E. coli
gttggcaaccgaggacagtcctgct

SEQ ID NO: 146036 - DNA, 25 bp, E. coli
gttggcaaccgacgacagtcctgct

SEQ ID NO: 146037 - DNA, 25 bp, E. coli
taattaacgcgccaatattcagcgg

SEQ ID NO: 146038 - DNA, 25 bp, E. coli
taataaaagcgttaacaactgccgc

SEQ ID NO: 146039 - DNA, 25 bp, E. coli
taataaaagcgtaaacaactgccgc

SEQ ID NO: 146040 - DNA, 25 bp, E. coli
taattaacgcgcgaatattcagcgg

SEQ ID NO: 146041 - DNA, 25 bp, E. coli
gagagtcccgttcaaaacaggaaag

SEQ ID NO: 146042 - DNA, 25 bp, E. coli
gagagtcccgttgaaaacaggaaag

SEQ ID NO: 146043 - DNA, 25 bp, E. coli
aatcgccgccgcacttgggtttggt

SEQ ID NO: 146044 - DNA, 25 bp, E. coli
aatcgccgccgctcttgggtttggt

SEQ ID NO: 146045 - DNA, 25 bp, E. coli
aaggagacgcttttgtttcgttggg

SEQ ID NO: 146046 - DNA, 25 bp, E. coli
aaggagacgcttatgtttcgttggg

SEQ ID NO: 146047 - DNA, 25 bp, E. coli
tgttcatgggccgaaaacgacccta

SEQ ID NO: 146048 - DNA, 25 bp, E. coli
tgttcatgggcccaaaacgacccta

SEQ ID NO: 146049 - DNA, 25 bp, E. coli
tgtcgtcgggataattctgttcctg

SEQ ID NO: 146050 - DNA, 25 bp, E. coli
tgtcgtcgggattattctgttcctg

SEQ ID NO: 146051 - DNA, 25 bp, E. coli
cctggtgagtttgttcatgggccga

SEQ ID NO: 146052 - DNA, 25 bp, E. coli
cctggtgagtttcttcatgggccga

SEQ ID NO: 146053 - DNA, 25 bp, E. coli
gctaaaattgtcattgtcgtcggga

SEQ ID NO: 146054 - DNA, 25 bp, E. coli
gctaaaattgtctttgtcgtcggga

SEQ ID NO: 146055 - DNA, 25 bp, E. coli
cgggattattctgttcctggtgagt

SEQ ID NO: 146056 - DNA, 25 bp, E. coli
cgggattattctcttcctggtgagt

SEQ ID NO: 146057 - DNA, 25 bp, E. coli
ctgcaggcgcagctaaaattgtctt

SEQ ID NO: 146058 - DNA, 25 bp, E. coli
ctgcaggcgcaggtaaaattgtctt

SEQ ID NO: 146059 - DNA, 25 bp, E. coli
ggttatcgcgttaatcgccgccgca

SEQ ID NO: 146060 - DNA, 25 bp, E. coli
gggcatcatatttctggttatcgcg

SEQ ID NO: 146061 - DNA, 25 bp, E. coli
gggcatcatattactggttatcgcg

SEQ ID NO: 146062 - DNA, 25 bp, E. coli
ggttatcgcgtttatcgccgccgca

SEQ ID NO: 146063 - DNA, 25 bp, E. coli
tggtaaaggagacgcttatgtttcg

SEQ ID NO: 146064 - DNA, 25 bp, E. coli
tggtaaaggagaggcttatgtttcg

SEQ ID NO: 146065 - DNA, 25 bp, E. coli
caattcgccgatactgagcaaaatg

SEQ ID NO: 146066 - DNA, 25 bp, E. coli
caattcgccgattctgagcaaaatg

SEQ ID NO: 146067 - DNA, 25 bp, E. coli
acgcgatatcgcagaaagaatgtac

SEQ ID NO: 146068 - DNA, 25 bp, E. coli
acgcgatatcgctgaaagaatgtac

SEQ ID NO: 146069 - DNA, 25 bp, E. coli
taggattgcataccaaagaccgttt

SEQ ID NO: 146070 - DNA, 25 bp, E. coli
taggattgcatagcaaagaccgttt

SEQ ID NO: 146071 - DNA, 25 bp, E. coli
ttttgttcacttcatacgcgacggc

SEQ ID NO: 146072 - DNA, 25 bp, E. coli
ttttgttcacttgatacgcgacggc

SEQ ID NO: 146073 - DNA, 25 bp, E. coli
tgttcacttgattcgcgacggctgg

SEQ ID NO: 146074 - DNA, 25 bp, E. coli
tgatagtttcaaagacccccgggtc

SEQ ID NO: 146075 - DNA, 25 bp, E. coli
tgatagtttcaatgacccccgggtc

SEQ ID NO: 146076 - DNA, 25 bp, E. coli
tgttcacttgatacgcgacggctgg

SEQ ID NO: 146077 - DNA, 25 bp, E. coli
tcgtcagttgcctcgcaatttagga

SEQ ID NO: 146078 - DNA, 25 bp, E. coli
tgccacgcaattaaggattgcatag

SEQ ID NO: 146079 - DNA, 25 bp, E. coli
tgccacgcaatttaggattgcatag

SEQ ID NO: 146080 - DNA, 25 bp, E. coli
tcgtcagttgccacgcaatttagga

SEQ ID NO: 146081 - DNA, 25 bp, E. coli
ccccgggtcaatacgccgatactga

SEQ ID NO: 146082 - DNA, 25 bp, E. coli
ccccgggtcaattcgccgatactga

SEQ ID NO: 146083 - DNA, 25 bp, E. coli
cgtcatactttataaatacatttag

SEQ ID NO: 146084 - DNA, 25 bp, E. coli
cttgatacgcgagggctggatatcg

SEQ ID NO: 146085 - DNA, 25 bp, E. coli
cgtcatactttaaaaatacatttag

SEQ ID NO: 146086 - DNA, 25 bp, E. coli
cttgatacgcgacggctggatatcg

SEQ ID NO: 146087 - DNA, 25 bp, E. coli
catttctgaatgactgtttacccct

SEQ ID NO: 146088 - DNA, 25 bp, E. coli
catttctgaatgtctgtttacccct

SEQ ID NO: 146089 - DNA, 25 bp, E. coli
ttacccctatttcaaccggatgcct

SEQ ID NO: 146090 - DNA, 25 bp, E. coli
ttacccctatttgaaccggatgcct

SEQ ID NO: 146091 - DNA, 25 bp, E. coli
tatttattaccgtcattcatttctg

SEQ ID NO: 146092 - DNA, 25 bp, E. coli
tatttattaccgacattcatttctg

SEQ ID NO: 146093 - DNA, 25 bp, E. coli
tattaccgtcattcatttctgaatg

SEQ ID NO: 146094 - DNA, 25 bp, E. coli
tattaccgtcatacatttctgaatg

SEQ ID NO: 146095 - DNA, 25 bp, E. coli
tgtttacccctatttcaaccggatg

SEQ ID NO: 146096 - DNA, 25 bp, E. coli
tgtttacccctaattcaaccggatg

SEQ ID NO: 146097 - DNA, 25 bp, E. coli
tcatttctgaatctctgtttacccc

SEQ ID NO: 146098 - DNA, 25 bp, E. coli
tcatttctgaatgtctgtttacccc

SEQ ID NO: 146099 - DNA, 25 bp, E. coli
gaatgtctgtttacccctatttcaa

SEQ ID NO: 146100 - DNA, 25 bp, E. coli
gaatgtctgttttcccctatttcaa

SEQ ID NO: 146101 - DNA, 25 bp, E. coli
ctatttcaaccgcatgcctcgcatt

SEQ ID NO: 146102 - DNA, 25 bp, E. coli
ctatttcaaccggatgcctcgcatt

SEQ ID NO: 146103 - DNA, 25 bp, E. coli
ggatgcctcgcattcggtttttttt

SEQ ID NO: 146104 - DNA, 25 bp, E. coli
ggatgcctcgcaatcggtttttttt

SEQ ID NO: 146105 - DNA, 25 bp, E. coli
tttctgaatgtctgtttacccctat

SEQ ID NO: 146106 - DNA, 25 bp, E. coli
tttctgaatgtcagtttacccctat

SEQ ID NO: 146107 - DNA, 25 bp, E. coli
taactttatttattaccgtcattca

SEQ ID NO: 146108 - DNA, 25 bp, E. coli
taactttatttaataccgtcattca

SEQ ID NO: 146109 - DNA, 25 bp, E. coli
aatactcggcatactacagggctgg

SEQ ID NO: 146110 - DNA, 25 bp, E. coli
aatactcggcattctacagggctgg

SEQ ID NO: 146111 - DNA, 25 bp, E. coli
caaagggcagttacaggctggcgca

SEQ ID NO: 146112 - DNA, 25 bp, E. coli
caaagggcagtttcaggctggcgca

SEQ ID NO: 146113 - DNA, 25 bp, E. coli
catgcacgggcataaaggttctgac

SEQ ID NO: 146114 - DNA, 25 bp, E. coli
catgcacgggcaaaaaggttctgac

SEQ ID NO: 146115 - DNA, 25 bp, E. coli
tgtctctgaactagcccgaagggta

SEQ ID NO: 146116 - DNA, 25 bp, E. coli
tgtctctgaacttgcccgaagggta

SEQ ID NO: 146117 - DNA, 25 bp, E. coli
tgaatgtaagctcaaatcccggcgt

SEQ ID NO: 146118 - DNA, 25 bp, E. coli
tgaatgtaagctgaaatcccggcgt

SEQ ID NO: 146119 - DNA, 25 bp, E. coli
gacgtttgttgaacctcaggcggaa

SEQ ID NO: 146120 - DNA, 25 bp, E. coli
gacgtttgttgatcctcaggcggaa

SEQ ID NO: 146121 - DNA, 25 bp, E. coli
gaaaactctgtcacgcagggtgccg

SEQ ID NO: 146122 - DNA, 25 bp, E. coli
gaaaactctgtctcgcagggtgccg

SEQ ID NO: 146123 - DNA, 25 bp, E. coli
gatattccactgctcagcgcacctg

SEQ ID NO: 146124 - DNA, 25 bp, E. coli
gatattccactggtcagcgcacctg

SEQ ID NO: 146125 - DNA, 25 bp, E. coli
tggattatcagaggcgtccggcaga

SEQ ID NO: 146126 - DNA, 25 bp, E. coli
tggaaatttgactgcagcaccggca

SEQ ID NO: 146127 - DNA, 25 bp, E. coli
tggaaatttgacagcagcaccggca

SEQ ID NO: 146128 - DNA, 25 bp, E. coli
tggattatcagacgcgtccggcaga

SEQ ID NO: 146129 - DNA, 25 bp, E. coli
taatcctctggtaggcagaaccggc

SEQ ID NO: 146130 - DNA, 25 bp, E. coli
taatcctctggttggcagaaccggc

SEQ ID NO: 146131 - DNA, 25 bp, E. coli
tgctgatttcaaccaccttgtcgat

SEQ ID NO: 146132 - DNA, 25 bp, E. coli
tgctgatttcaagcaccttgtcgat

SEQ ID NO: 146133 - DNA, 25 bp, E. coli
ccttgtcgatcattgagatatcgca

SEQ ID NO: 146134 - DNA, 25 bp, E. coli
gcgcgcagtctggtgatttcaacca

SEQ ID NO: 146135 - DNA, 25 bp, E. coli
ccttgtcgatcaatgagatatcgca

SEQ ID NO: 146136 - DNA, 25 bp, E. coli
gcgcgcagtctgctgatttcaacca

SEQ ID NO: 146137 - DNA, 25 bp, E. coli
gaagaggtgggtgaaaccatccatg

SEQ ID NO: 146138 - DNA, 25 bp, E. coli
gaagaggtgggtcaaaccatccatg

SEQ ID NO: 146139 - DNA, 25 bp, E. coli
gcagtctgctgatttcaaccacctt

SEQ ID NO: 146140 - DNA, 25 bp, E. coli
gcagtctgctgaattcaaccacctt

SEQ ID NO: 146141 - DNA, 25 bp, E. coli
cgggatctcgcggtccaatcttgag

SEQ ID NO: 146142 - DNA, 25 bp, E. coli
cgggatctcgcgctccaatcttgag

SEQ ID NO: 146143 - DNA, 25 bp, E. coli
gtcgatcaatgagatatcgcaaatg

SEQ ID NO: 146144 - DNA, 25 bp, E. coli
ggtgaaaccatcgatgccatgattc

SEQ ID NO: 146145 - DNA, 25 bp, E. coli
ggtgggtgaaacgatccatgccatg

SEQ ID NO: 146146 - DNA, 25 bp, E. coli
gtcgatcaatgacatatcgcaaatg

SEQ ID NO: 146147 - DNA, 25 bp, E. coli
ggtgggtgaaaccatccatgccatg

SEQ ID NO: 146148 - DNA, 25 bp, E. coli
ggtgaaaccatccatgccatgattc

SEQ ID NO: 146149 - DNA, 25 bp, E. coli
tcaaccaccttgtcgatcaatgaga

SEQ ID NO: 146150 - DNA, 25 bp, E. coli
tcaaccaccttgacgatcaatgaga

SEQ ID NO: 146151 - DNA, 25 bp, E. coli
gatgcggtcgggttctcgcgctcca

SEQ ID NO: 146152 - DNA, 25 bp, E. coli
gatgcggtcgggatctcgcgctcca

SEQ ID NO: 146153 - DNA, 25 bp, E. coli
agtaaaatcaaatcatgatccgtca

SEQ ID NO: 146154 - DNA, 25 bp, E. coli
atccgtcagataaaaaaccttctcg

SEQ ID NO: 146155 - DNA, 25 bp, E. coli
agtaaaatcaaaacatgatccgtca

SEQ ID NO: 146156 - DNA, 25 bp, E. coli
atccgtcagatataaaaccttctcg

SEQ ID NO: 146157 - DNA, 25 bp, E. coli
ttaactcgccatcctgatgcggttg

SEQ ID NO: 146158 - DNA, 25 bp, E. coli
tttttaactcgccatcctgatgcgg

SEQ ID NO: 146159 - DNA, 25 bp, E. coli
tttttaactcgcgatcctgatgcgg

SEQ ID NO: 146160 - DNA, 25 bp, E. coli
ttaactcgccatgctgatgcggttg

SEQ ID NO: 146161 - DNA, 25 bp, E. coli
tgaacaggattttttaactcgccat

SEQ ID NO: 146162 - DNA, 25 bp, E. coli
tgaacaggatttattaactcgccat

SEQ ID NO: 146163 - DNA, 25 bp, E. coli
tccgtcagataataaaccttctcgt

SEQ ID NO: 146164 - DNA, 25 bp, E. coli
tccgtcagataaaaaaccttctcgt

SEQ ID NO: 146165 - DNA, 25 bp, E. coli
tcagtaaaatcataacatgatccgt

SEQ ID NO: 146166 - DNA, 25 bp, E. coli
tcagataaaaaagcttctcgtccgg

SEQ ID NO: 146167 - DNA, 25 bp, E. coli
tcagataaaaaaccttctcgtccgg

SEQ ID NO: 146168 - DNA, 25 bp, E. coli
tcagtaaaatcaaaacatgatccgt

SEQ ID NO: 146169 - DNA, 25 bp, E. coli
gaacaggattttttaactcgccatc

SEQ ID NO: 146170 - DNA, 25 bp, E. coli
gaacaggattttataactcgccatc

SEQ ID NO: 146171 - DNA, 25 bp, E. coli
cgtcagtaaaatcaaaacatgatcc

SEQ ID NO: 146172 - DNA, 25 bp, E. coli
cgtcagtaaaatgaaaacatgatcc

SEQ ID NO: 146173 - DNA, 25 bp, E. coli
gattttttaactggccatcctgatg

SEQ ID NO: 146174 - DNA, 25 bp, E. coli
gattttttaactcgccatcctgatg

SEQ ID NO: 146175 - DNA, 25 bp, E. coli
caatcgtcagcctaaatatctcggg

SEQ ID NO: 146176 - DNA, 25 bp, E. coli
caatcgtcagccaaaatatctcggg

SEQ ID NO: 146177 - DNA, 25 bp, E. coli
caccagacctggaaaaaggacgcgg

SEQ ID NO: 146178 - DNA, 25 bp, E. coli
caccagacctggtaaaaggacgcgg

SEQ ID NO: 146179 - DNA, 25 bp, E. coli
aactcgccagagtcagcgcggtgat

SEQ ID NO: 146180 - DNA, 25 bp, E. coli
aactcgccagagacagcgcggtgat

SEQ ID NO: 146181 - DNA, 25 bp, E. coli
tttgatcgcaaagggcgtaccggca

SEQ ID NO: 146182 - DNA, 25 bp, E. coli
tttgatcgcaaacggcgtaccggca

SEQ ID NO: 146183 - DNA, 25 bp, E. coli
tcgggccgtcggtcattattggtcc

SEQ ID NO: 146184 - DNA, 25 bp, E. coli
tccgtctgcgagtgaaactcgccag

SEQ ID NO: 146185 - DNA, 25 bp, E. coli
tcgggccgtcggacattattggtcc

SEQ ID NO: 146186 - DNA, 25 bp, E. coli
tccgtctgcgagagaaactcgccag

SEQ ID NO: 146187 - DNA, 25 bp, E. coli
tcagtggtgcgtcccaataaagtgt

SEQ ID NO: 146188 - DNA, 25 bp, E. coli
tcagtggtgcgtgccaataaagtgt

SEQ ID NO: 146189 - DNA, 25 bp, E. coli
tcgggtttaacgcaccagacctgga

SEQ ID NO: 146190 - DNA, 25 bp, E. coli
tcgggtttaacggaccagacctgga

SEQ ID NO: 146191 - DNA, 25 bp, E. coli
gacgcggaaagaatgtccgtctgcg

SEQ ID NO: 146192 - DNA, 25 bp, E. coli
gatgctatcgggattaacgcaccag

SEQ ID NO: 146193 - DNA, 25 bp, E. coli
gacgcggaaagattgtccgtctgcg

SEQ ID NO: 146194 - DNA, 25 bp, E. coli
gacgcgaaaatcatcaatcgtcagc

SEQ ID NO: 146195 - DNA, 25 bp, E. coli
gatgctatcgggtttaacgcaccag

SEQ ID NO: 146196 - DNA, 25 bp, E. coli
gacgcgaaaatcttcaatcgtcagc

SEQ ID NO: 146197 - DNA, 25 bp, E. coli
caattaacggcgcaatctcacgatt

SEQ ID NO: 146198 - DNA, 25 bp, E. coli
caattaacggcggaatctcacgatt

SEQ ID NO: 146199 - DNA, 25 bp, E. coli
caagcgcagaggattgaaaaaatct

SEQ ID NO: 146200 - DNA, 25 bp, E. coli
cacggcggctcatactctcaataaa

SEQ ID NO: 146201 - DNA, 25 bp, E. coli
cactctgaacattcgcaattaacgg

SEQ ID NO: 146202 - DNA, 25 bp, E. coli
cacggcggctcaaactctcaataaa

SEQ ID NO: 146203 - DNA, 25 bp, E. coli
caagcgcagaggtttgaaaaaatct

SEQ ID NO: 146204 - DNA, 25 bp, E. coli
cactctgaacatacgcaattaacgg

SEQ ID NO: 146205 - DNA, 25 bp, E. coli
taaatccctgttagtaaatgctgct

SEQ ID NO: 146206 - DNA, 25 bp, E. coli
taaatccctgtttgtaaatgctgct

SEQ ID NO: 146207 - DNA, 25 bp, E. coli
tgaaggctctcacttttgctcgcgg

SEQ ID NO: 146208 - DNA, 25 bp, E. coli
tgaaggctctcagttttgctcgcgg

SEQ ID NO: 146209 - DNA, 25 bp, E. coli
tcgcggctccgatactttgctgggt

SEQ ID NO: 146210 - DNA, 25 bp, E. coli
tcgcggctccgaaactttgctgggt

SEQ ID NO: 146211 - DNA, 25 bp, E. coli
gcagctgcctcatgcgcagaggatt

SEQ ID NO: 146212 - DNA, 25 bp, E. coli
gcagctgcctcaagcgcagaggatt

SEQ ID NO: 146213 - DNA, 25 bp, E. coli
cattcattgcctcagccagcagtcg

SEQ ID NO: 146214 - DNA, 25 bp, E. coli
cattcattgcctgagccagcagtcg

SEQ ID NO: 146215 - DNA, 25 bp, E. coli
gattttaaggtgtatcacggcggct

SEQ ID NO: 146216 - DNA, 25 bp, E. coli
gattttaaggtgaatcacggcggct

SEQ ID NO: 146217 - DNA, 25 bp, E. coli
gggctctgaattcaaagtaacttta

SEQ ID NO: 146218 - DNA, 25 bp, E. coli
gggctctgaattgaaagtaacttta

SEQ ID NO: 146219 - DNA, 25 bp, E. coli
tactactacactccgaaactctctt

SEQ ID NO: 146220 - DNA, 25 bp, E. coli
tacaccgatcatgctgaaagctcag

SEQ ID NO: 146221 - DNA, 25 bp, E. coli
tacaccgatcatcctgaaagctcag

SEQ ID NO: 146222 - DNA, 25 bp, E. coli
tactactacactgcgaaactctctt

SEQ ID NO: 146223 - DNA, 25 bp, E. coli
tgcgaaactctcatcgcgcattgat

SEQ ID NO: 146224 - DNA, 25 bp, E. coli
tgcccacggtactccgatcatgctg

SEQ ID NO: 146225 - DNA, 25 bp, E. coli
tgcccacggtacaccgatcatgctg

SEQ ID NO: 146226 - DNA, 25 bp, E. coli
tgcgaaactctcttcgcgcattgat

SEQ ID NO: 146227 - DNA, 25 bp, E. coli
gcctgcgttacttctacactgcgaa

SEQ ID NO: 146228 - DNA, 25 bp, E. coli
gccggtcctggccggaaagatattt

SEQ ID NO: 146229 - DNA, 25 bp, E. coli
gcctgcgttactactacactgcgaa

SEQ ID NO: 146230 - DNA, 25 bp, E. coli
gccggtcctggcgggaaagatattt

SEQ ID NO: 146231 - DNA, 25 bp, E. coli
gctgctgggccagaaagtgaatccg

SEQ ID NO: 146232 - DNA, 25 bp, E. coli
gctgctgggccacaaagtgaatccg

SEQ ID NO: 146233 - DNA, 25 bp, E. coli
ctgggccacaaagtgaatccgttca

SEQ ID NO: 146234 - DNA, 25 bp, E. coli
ctgggccacaaactgaatccgttca

SEQ ID NO: 146235 - DNA, 25 bp, E. coli
ctctgaaggcatggtgatggctgcc

SEQ ID NO: 146236 - DNA, 25 bp, E. coli
ctctgaaggcatcgtgatggctgcc

SEQ ID NO: 146237 - DNA, 25 bp, E. coli
gtaatgcgggctttatcaacaagcg

SEQ ID NO: 146238 - DNA, 25 bp, E. coli
gtaatgcgggctatatcaacaagcg

SEQ ID NO: 146239 - DNA, 25 bp, E. coli
ggcagatgatcccattcaggaaacc

SEQ ID NO: 146240 - DNA, 25 bp, E. coli
ggcagatgatccgattcaggaaacc

SEQ ID NO: 146241 - DNA, 25 bp, E. coli
caactgacggaacgtgtgctggtca

SEQ ID NO: 146242 - DNA, 25 bp, E. coli
caactgacggaaggtgtgctggtca

SEQ ID NO: 146243 - DNA, 25 bp, E. coli
acctttgaggtgcatattctgcgca

SEQ ID NO: 146244 - DNA, 25 bp, E. coli
ataacggttcgcaggttgccacggg

SEQ ID NO: 146245 - DNA, 25 bp, E. coli
ataacggttcgctggttgccacggg

SEQ ID NO: 146246 - DNA, 25 bp, E. coli
acctttgaggtggatattctgcgca

SEQ ID NO: 146247 - DNA, 25 bp, E. coli
tgattgaggatttcagcggcgacca

SEQ ID NO: 146248 - DNA, 25 bp, E. coli
tgattgaggattacagcggcgacca

SEQ ID NO: 146249 - DNA, 25 bp, E. coli
tgagggataaccagcccgatgccat

SEQ ID NO: 146250 - DNA, 25 bp, E. coli
tgagggataacctgcccgatgccat

SEQ ID NO: 146251 - DNA, 25 bp, E. coli
tccatgtcgtgggagtaccgttaca

SEQ ID NO: 146252 - DNA, 25 bp, E. coli
tccatgtcgtggcagtaccgttaca

SEQ ID NO: 146253 - DNA, 25 bp, E. coli
tgccatcaataacccggcgttacgg

SEQ ID NO: 146254 - DNA, 25 bp, E. coli
tgccatcaataagccggcgttacgg

SEQ ID NO: 146255 - DNA, 25 bp, E. coli
tgcgccacgccctcaataaagcggt

SEQ ID NO: 146256 - DNA, 25 bp, E. coli
tgcgccacgcccacaataaagcggt

SEQ ID NO: 146257 - DNA, 25 bp, E. coli
ccagaatctgctcatggccccggtt

SEQ ID NO: 146258 - DNA, 25 bp, E. coli
ccagaatctgctgatggccccggtt

SEQ ID NO: 146259 - DNA, 25 bp, E. coli
gcaacgatgtctctgatatcagcct

SEQ ID NO: 146260 - DNA, 25 bp, E. coli
gcaacgatgtctgtgatatcagcct

SEQ ID NO: 146261 - DNA, 25 bp, E. coli
cgtgtcaggagccaaacagtgaaca

SEQ ID NO: 146262 - DNA, 25 bp, E. coli
cgtgtcaggagcgaaacagtgaaca

SEQ ID NO: 146263 - DNA, 25 bp, E. coli
cagcttgctgtcctggaaactcaaa

SEQ ID NO: 146264 - DNA, 25 bp, E. coli
cagcttgctgtcgtggaaactcaaa

SEQ ID NO: 146265 - DNA, 25 bp, E. coli
cagggatcgttgactccagcgtcag

SEQ ID NO: 146266 - DNA, 25 bp, E. coli
catactgttatttgccgcagggatc

SEQ ID NO: 146267 - DNA, 25 bp, E. coli
cagggatcgttgtctccagcgtcag

SEQ ID NO: 146268 - DNA, 25 bp, E. coli
catagctacagcatgctgtcgtgga

SEQ ID NO: 146269 - DNA, 25 bp, E. coli
catagctacagcttgctgtcgtgga

SEQ ID NO: 146270 - DNA, 25 bp, E. coli
catactgttattagccgcagggatc

SEQ ID NO: 146271 - DNA, 25 bp, E. coli
tacagcttgctgacgtggaaactca

SEQ ID NO: 146272 - DNA, 25 bp, E. coli
tacagcttgctgtcgtggaaactca

SEQ ID NO: 146273 - DNA, 25 bp, E. coli
ttatttgccgcagggatcgttgtct

SEQ ID NO: 146274 - DNA, 25 bp, E. coli
ttatttgccgcacggatcgttgtct

SEQ ID NO: 146275 - DNA, 25 bp, E. coli
tgccgcagggatcgttgtctccagc

SEQ ID NO: 146276 - DNA, 25 bp, E. coli
tgccgcagggatggttgtctccagc

SEQ ID NO: 146277 - DNA, 25 bp, E. coli
tctggataacgtacgcgctgtgccg

SEQ ID NO: 146278 - DNA, 25 bp, E. coli
tctggataacgttcgcgctgtgccg

SEQ ID NO: 146279 - DNA, 25 bp, E. coli
gcgggcatactgttatttgccgcag

SEQ ID NO: 146280 - DNA, 25 bp, E. coli
gctctggataaccttcgcgctgtgc

SEQ ID NO: 146281 - DNA, 25 bp, E. coli
gcgggcatactgatatttgccgcag

SEQ ID NO: 146282 - DNA, 25 bp, E. coli
gctctggataacgttcgcgctgtgc

SEQ ID NO: 146283 - DNA, 25 bp, E. coli
gttcgctctggaaaacgttcgcgct

SEQ ID NO: 146284 - DNA, 25 bp, E. coli
gttcgctctggataacgttcgcgct

SEQ ID NO: 146285 - DNA, 25 bp, E. coli
tagtgtgggaacagctgctgcggta

SEQ ID NO: 146286 - DNA, 25 bp, E. coli
tagtgtgggaactgctgctgcggta

SEQ ID NO: 146287 - DNA, 25 bp, E. coli
tatttttatcggtgcgttgttgagc

SEQ ID NO: 146288 - DNA, 25 bp, E. coli
tatttttatcggagcgttgttgagc

SEQ ID NO: 146289 - DNA, 25 bp, E. coli
tatcggtgcgttgttgagcatgcgt

SEQ ID NO: 146290 - DNA, 25 bp, E. coli
tatcggtgcgttcttgagcatgcgt

SEQ ID NO: 146291 - DNA, 25 bp, E. coli
tttatcggtgcgttgttgagcatgc

SEQ ID NO: 146292 - DNA, 25 bp, E. coli
tttatcggtgcgatgttgagcatgc

SEQ ID NO: 146293 - DNA, 25 bp, E. coli
tcggtgcgttgtagagcatgcgtaa

SEQ ID NO: 146294 - DNA, 25 bp, E. coli
tcggtgcgttgttgagcatgcgtaa

SEQ ID NO: 146295 - DNA, 25 bp, E. coli
gcgttgttgagcatgcgtaaatcgt

SEQ ID NO: 146296 - DNA, 25 bp, E. coli
gcgttgttgagcttgcgtaaatcgt

SEQ ID NO: 146297 - DNA, 25 bp, E. coli
ctggtgtagtgtgggaactgctgct

SEQ ID NO: 146298 - DNA, 25 bp, E. coli
cggtgcgttgttcagcatgcgtaaa

SEQ ID NO: 146299 - DNA, 25 bp, E. coli
ctggtgtagtgtcggaactgctgct

SEQ ID NO: 146300 - DNA, 25 bp, E. coli
cggtgcgttgttgagcatgcgtaaa

SEQ ID NO: 146301 - DNA, 25 bp, E. coli
gttgttgagcatccgtaaatcgtag

SEQ ID NO: 146302 - DNA, 25 bp, E. coli
gttgttgagcatgcgtaaatcgtag

SEQ ID NO: 146303 - DNA, 25 bp, E. coli
gggaactgctgctgcggtaggtatt

SEQ ID NO: 146304 - DNA, 25 bp, E. coli
gtgcgttgttgaccatgcgtaaatc

SEQ ID NO: 146305 - DNA, 25 bp, E. coli
gggaactgctgcagcggtaggtatt

SEQ ID NO: 146306 - DNA, 25 bp, E. coli
gtgcgttgttgagcatgcgtaaatc

SEQ ID NO: 146307 - DNA, 25 bp, E. coli
caggtagacagcaccaaagcacgtt

SEQ ID NO: 146308 - DNA, 25 bp, E. coli
caggtagacagctccaaagcacgtt

SEQ ID NO: 146309 - DNA, 25 bp, E. coli
tagttggtaaatccgcacatcagca

SEQ ID NO: 146310 - DNA, 25 bp, E. coli
tagttggtaaatgcgcacatcagca

SEQ ID NO: 146311 - DNA, 25 bp, E. coli
ttgatcagcggacaaaacagcgccg

SEQ ID NO: 146312 - DNA, 25 bp, E. coli
ttgatcagcggagaaaacagcgccg

SEQ ID NO: 146313 - DNA, 25 bp, E. coli
ttcgagctcgataaaccaaagatgc

SEQ ID NO: 146314 - DNA, 25 bp, E. coli
ttacctccagtaaaagaacaagccg

SEQ ID NO: 146315 - DNA, 25 bp, E. coli
ttacctccagtataagaacaagccg

SEQ ID NO: 146316 - DNA, 25 bp, E. coli
ttcgagctcgattaaccaaagatgc

SEQ ID NO: 146317 - DNA, 25 bp, E. coli
tgaactgcgtgataacaacttctgg

SEQ ID NO: 146318 - DNA, 25 bp, E. coli
tgaactgcgtgaaaacaacttctgg

SEQ ID NO: 146319 - DNA, 25 bp, E. coli
tgctggccatgtagatcaaaacgat

SEQ ID NO: 146320 - DNA, 25 bp, E. coli
tgctggccatgttgatcaaaacgat

SEQ ID NO: 146321 - DNA, 25 bp, E. coli
gccgccgcgttgctggaaaaaatca

SEQ ID NO: 146322 - DNA, 25 bp, E. coli
gccgccgcgttggtggaaaaaatca

SEQ ID NO: 146323 - DNA, 25 bp, E. coli
gctgaaaaactccatacgctgctgg

SEQ ID NO: 146324 - DNA, 25 bp, E. coli
gctgaaaaactcgatacgctgctgg

SEQ ID NO: 146325 - DNA, 25 bp, E. coli
gcaatgtcatcagggagcaaatccg

SEQ ID NO: 146326 - DNA, 25 bp, E. coli
gcaatgtcatcacggagcaaatccg

SEQ ID NO: 146327 - DNA, 25 bp, E. coli
cattagttctgttcgtgctggccat

SEQ ID NO: 146328 - DNA, 25 bp, E. coli
cattagttctgtacgtgctggccat

SEQ ID NO: 146329 - DNA, 25 bp, E. coli
caactgtcggcgcttttccagtatg

SEQ ID NO: 146330 - DNA, 25 bp, E. coli
caactgtcggcggttttccagtatg

SEQ ID NO: 146331 - DNA, 25 bp, E. coli
aagattttatgataaacggcctgcg

SEQ ID NO: 146332 - DNA, 25 bp, E. coli
aagattttatgaaaaacggcctgcg

SEQ ID NO: 146333 - DNA, 25 bp, E. coli
tgtgaaaaaatacgcgacagcgcgc

SEQ ID NO: 146334 - DNA, 25 bp, E. coli
tgtgaaaaaataggcgacagcgcgc

SEQ ID NO: 146335 - DNA, 25 bp, E. coli
tgtctggattttccgctttttgccc

SEQ ID NO: 146336 - DNA, 25 bp, E. coli
tgtctggattttgcgctttttgccc

SEQ ID NO: 146337 - DNA, 25 bp, E. coli
tccagtatgttggtaaagattttat

SEQ ID NO: 146338 - DNA, 25 bp, E. coli
tccagtatgttgctaaagattttat

SEQ ID NO: 146339 - DNA, 25 bp, E. coli
cctgcgggccgttttgttttgtctg

SEQ ID NO: 146340 - DNA, 25 bp, E. coli
cctgcgggccgtattgttttgtctg

SEQ ID NO: 146341 - DNA, 25 bp, E. coli
gactcataaaagtgatgccgctata

SEQ ID NO: 146342 - DNA, 25 bp, E. coli
gactcataaaagagatgccgctata

SEQ ID NO: 146343 - DNA, 25 bp, E. coli
gacagcgcgcaaaaaccgttctcga

SEQ ID NO: 146344 - DNA, 25 bp, E. coli
gacagcgcgcaataaccgttctcga

SEQ ID NO: 146345 - DNA, 25 bp, E. coli
cggcgcttttccagtatgttgctaa

SEQ ID NO: 146346 - DNA, 25 bp, E. coli
cggcgcttttcctgtatgttgctaa

SEQ ID NO: 146347 - DNA, 25 bp, E. coli
ggattttgcgctttttgcccagcat

SEQ ID NO: 146348 - DNA, 25 bp, E. coli
ggattttgcgctatttgcccagcat

SEQ ID NO: 146349 - DNA, 25 bp, E. coli
taaccgttctcgtctcataaaagtg

SEQ ID NO: 146350 - DNA, 25 bp, E. coli
taaccgttctcgactcataaaagtg

SEQ ID NO: 146351 - DNA, 25 bp, E. coli
caaatgcagatgttcgaaatcgcca

SEQ ID NO: 146352 - DNA, 25 bp, E. coli
caacgggaatttatgcctatctgga

SEQ ID NO: 146353 - DNA, 25 bp, E. coli
caacgggaatttttgcctatctgga

SEQ ID NO: 146354 - DNA, 25 bp, E. coli
caaatgcagatgatcgaaatcgcca

SEQ ID NO: 146355 - DNA, 25 bp, E. coli
caaaggcatgttagtcgatcaggac

SEQ ID NO: 146356 - DNA, 25 bp, E. coli
caaaggcatgtttgtcgatcaggac

SEQ ID NO: 146357 - DNA, 25 bp, E. coli
catcggacgcaaattggttcgctct

SEQ ID NO: 146358 - DNA, 25 bp, E. coli
catcggacgcaatttggttcgctct

SEQ ID NO: 146359 - DNA, 25 bp, E. coli
tactggataactggcggatgaaaag

SEQ ID NO: 146360 - DNA, 25 bp, E. coli
tactggataactcgcggatgaaaag

SEQ ID NO: 146361 - DNA, 25 bp, E. coli
tattcgcgagaaatcggctggcacc

SEQ ID NO: 146362 - DNA, 25 bp, E. coli
tattgcgcgacggtcagtggatcgc

SEQ ID NO: 146363 - DNA, 25 bp, E. coli
tattcgcgagaattcggctggcacc

SEQ ID NO: 146364 - DNA, 25 bp, E. coli
tattgcgcgacgctcagtggatcgc

SEQ ID NO: 146365 - DNA, 25 bp, E. coli
tgtaccgcgaaagcaaagcgatttt

SEQ ID NO: 146366 - DNA, 25 bp, E. coli
tgtaccgcgaaaccaaagcgatttt

SEQ ID NO: 146367 - DNA, 25 bp, E. coli
cgtaaattaaaagagcgcggctgcg

SEQ ID NO: 146368 - DNA, 25 bp, E. coli
cgtaaattaaaacagcgcggctgcg

SEQ ID NO: 146369 - DNA, 25 bp, E. coli
gatgaaaagcgatacccagtgggtg

SEQ ID NO: 146370 - DNA, 25 bp, E. coli
ggttgggcgttctcttaaccagcgt

SEQ ID NO: 146371 - DNA, 25 bp, E. coli
gatgaaaagcgaaacccagtgggtg

SEQ ID NO: 146372 - DNA, 25 bp, E. coli
ggttgggcgttcacttaaccagcgt

SEQ ID NO: 146373 - DNA, 25 bp, E. coli
aacgcctgtcattcgcaaactggag

SEQ ID NO: 146374 - DNA, 25 bp, E. coli
aacgcctgtcatacgcaaactggag

SEQ ID NO: 146375 - DNA, 25 bp, E. coli
cagcttgtcggagaaatcccggcca

SEQ ID NO: 146376 - DNA, 25 bp, E. coli
caaactggagattgaagggccggat

SEQ ID NO: 146377 - DNA, 25 bp, E. coli
caaactggagatagaagggccggat

SEQ ID NO: 146378 - DNA, 25 bp, E. coli
cagcttgtcggacaaatcccggcca

SEQ ID NO: 146379 - DNA, 25 bp, E. coli
tactatcacttcagcaggcagcaag

SEQ ID NO: 146380 - DNA, 25 bp, E. coli
tactatcacttctgcaggcagcaag

SEQ ID NO: 146381 - DNA, 25 bp, E. coli
aacagtttttgttgatcccgatcga

SEQ ID NO: 146382 - DNA, 25 bp, E. coli
aacagtttttgtagatcccgatcga

SEQ ID NO: 146383 - DNA, 25 bp, E. coli
tattgtccttgcgttacccaaaggg

SEQ ID NO: 146384 - DNA, 25 bp, E. coli
tattgtccttgccttacccaaaggg

SEQ ID NO: 146385 - DNA, 25 bp, E. coli
tcgacatctggtggtggagtttcca

SEQ ID NO: 146386 - DNA, 25 bp, E. coli
tcgacatctggtcgtggagtttcca

SEQ ID NO: 146387 - DNA, 25 bp, E. coli
gctacccttcaaatatgctggatga

SEQ ID NO: 146388 - DNA, 25 bp, E. coli
gctacccttcaattatgctggatga

SEQ ID NO: 146389 - DNA, 25 bp, E. coli
cgatcgaatcgtacaaccaggaaat

SEQ ID NO: 146390 - DNA, 25 bp, E. coli
cgatcgaatcgttcaaccaggaaat

SEQ ID NO: 146391 - DNA, 25 bp, E. coli
ggagcgccgtccacgcgttacataa

SEQ ID NO: 146392 - DNA, 25 bp, E. coli
ggagcgccgtcctcgcgttacataa

SEQ ID NO: 146393 - DNA, 25 bp, E. coli
taacctcttgtgtgcagcttgtcgg

SEQ ID NO: 146394 - DNA, 25 bp, E. coli
taacctcttgtgagcagcttgtcgg

SEQ ID NO: 146395 - DNA, 25 bp, E. coli
caactttgtatagagagccactgcg

SEQ ID NO: 146396 - DNA, 25 bp, E. coli
caactttgtatacagagccactgcg

SEQ ID NO: 146397 - DNA, 25 bp, E. coli
aactttggcagaacgtaagccgcga

SEQ ID NO: 146398 - DNA, 25 bp, E. coli
aactttggcagatcgtaagccgcga

SEQ ID NO: 146399 - DNA, 25 bp, E. coli
ttcttggtcgaaggcagcaagcgcg

SEQ ID NO: 146400 - DNA, 25 bp, E. coli
ttcttggtcgaacgcagcaagcgcg

SEQ ID NO: 146401 - DNA, 25 bp, E. coli
tcttactacggaccaagttcccgag

SEQ ID NO: 146402 - DNA, 25 bp, E. coli
tcttactacggagcaagttcccgag

SEQ ID NO: 146403 - DNA, 25 bp, E. coli
gccggagactgccagatcatagata

SEQ ID NO: 146404 - DNA, 25 bp, E. coli
gccggagactgcgagatcatagata

SEQ ID NO: 146405 - DNA, 25 bp, E. coli
gatttgacttggtcagggccgagcc

SEQ ID NO: 146406 - DNA, 25 bp, E. coli
gatatagatctcactacgcgcctgc

SEQ ID NO: 146407 - DNA, 25 bp, E. coli
gatatagatctctctacgcgcctgc

SEQ ID NO: 146408 - DNA, 25 bp, E. coli
gatcacataagctccaagcgcgttg

SEQ ID NO: 146409 - DNA, 25 bp, E. coli
gatttgacttggacagggccgagcc

SEQ ID NO: 146410 - DNA, 25 bp, E. coli
gatcacataagcaccaagcgcgttg

SEQ ID NO: 146411 - DNA, 25 bp, E. coli
ggatcgtcaccgtaatctgcttgca

SEQ ID NO: 146412 - DNA, 25 bp, E. coli
ggatcgtcaccgaaatctgcttgca

SEQ ID NO: 146413 - DNA, 25 bp, E. coli
ggccgagcctacatgtgcgaatgat

SEQ ID NO: 146414 - DNA, 25 bp, E. coli
ggccgagcctacttgtgcgaatgat

SEQ ID NO: 146415 - DNA, 25 bp, E. coli
gaccgaaaagatgaagagcagccct

SEQ ID NO: 146416 - DNA, 25 bp, E. coli
gaccgaaaagatcaagagcagccct

SEQ ID NO: 146417 - DNA, 25 bp, E. coli
aatggctgcgggatcacagggaaaa

SEQ ID NO: 146418 - DNA, 25 bp, E. coli
aaggtgatctcaatcagcagactgg

SEQ ID NO: 146419 - DNA, 25 bp, E. coli
caagcagattgcaaccgatgatgaa

SEQ ID NO: 146420 - DNA, 25 bp, E. coli
aatggctgcgggttcacagggaaaa

SEQ ID NO: 146421 - DNA, 25 bp, E. coli
caaaaagaactcttcggaactcccg

SEQ ID NO: 146422 - DNA, 25 bp, E. coli
caaaaagaactcatcggaactcccg

SEQ ID NO: 146423 - DNA, 25 bp, E. coli
aaggtgatctcattcagcagactgg

SEQ ID NO: 146424 - DNA, 25 bp, E. coli
caagcagattgctaccgatgatgaa

SEQ ID NO: 146425 - DNA, 25 bp, E. coli
ttatagagacgccaatgtttacgcg

SEQ ID NO: 146426 - DNA, 25 bp, E. coli
ttatagagacgcgaatgtttacgcg

SEQ ID NO: 146427 - DNA, 25 bp, E. coli
tgtttacgcgtcagatcaagcagat

SEQ ID NO: 146428 - DNA, 25 bp, E. coli
tgtttacgcgtctgatcaagcagat

SEQ ID NO: 146429 - DNA, 25 bp, E. coli
tgacgaaactgctcaaaggcgagat

SEQ ID NO: 146430 - DNA, 25 bp, E. coli
tgacgaaactgcacaaaggcgagat

SEQ ID NO: 146431 - DNA, 25 bp, E. coli
gaataatttactatctggcgacgga

SEQ ID NO: 146432 - DNA, 25 bp, E. coli
gaataatttactttctggcgacgga

SEQ ID NO: 146433 - DNA, 25 bp, E. coli
gattgcgtaaagtccgaatggctgc

SEQ ID NO: 146434 - DNA, 25 bp, E. coli
gtctgacagatacggaaaaagctca

SEQ ID NO: 146435 - DNA, 25 bp, E. coli
gattgcgtaaagaccgaatggctgc

SEQ ID NO: 146436 - DNA, 25 bp, E. coli
gtctgacagatagggaaaaagctca

SEQ ID NO: 146437 - DNA, 25 bp, E. coli
ggtgtacaatgtacctgccagggag

SEQ ID NO: 146438 - DNA, 25 bp, E. coli
ggtgtacaatgttcctgccagggag

SEQ ID NO: 146439 - DNA, 25 bp, E. coli
cacccgttgaacaggatgacgaaga

SEQ ID NO: 146440 - DNA, 25 bp, E. coli
cacccgttgaactggatgacgaaga

SEQ ID NO: 146441 - DNA, 25 bp, E. coli
taaaaatggcgcaccaacatgaccg

SEQ ID NO: 146442 - DNA, 25 bp, E. coli
taaaaatggcgctccaacatgaccg

SEQ ID NO: 146443 - DNA, 25 bp, E. coli
ttaaagtggtctggcataaccgtcc

SEQ ID NO: 146444 - DNA, 25 bp, E. coli
ttaaagtggtctcgcataaccgtcc

SEQ ID NO: 146445 - DNA, 25 bp, E. coli
tgatttggcggagcacttacaggcg

SEQ ID NO: 146446 - DNA, 25 bp, E. coli
tgatttggcggaccacttacaggcg

SEQ ID NO: 146447 - DNA, 25 bp, E. coli
tgacgcacgtagtaaaaggtctgcc

SEQ ID NO: 146448 - DNA, 25 bp, E. coli
tgaatctcgccagtgaagagccgta

SEQ ID NO: 146449 - DNA, 25 bp, E. coli
tgacgcacgtagaaaaaggtctgcc

SEQ ID NO: 146450 - DNA, 25 bp, E. coli
tgaatctcgccactgaagagccgta

SEQ ID NO: 146451 - DNA, 25 bp, E. coli
tcattcaggaagtgatcagcggcgg

SEQ ID NO: 146452 - DNA, 25 bp, E. coli
tcattcaggaagagatcagcggcgg

SEQ ID NO: 146453 - DNA, 25 bp, E. coli
gaacgtaccgctttgcgtcagggcg

SEQ ID NO: 146454 - DNA, 25 bp, E. coli
gaacgtaccgctatgcgtcagggcg

SEQ ID NO: 146455 - DNA, 25 bp, E. coli
cattcgtgggcatcatttgctggca

SEQ ID NO: 146456 - DNA, 25 bp, E. coli
cattcgtgggcaacatttgctggca

SEQ ID NO: 146457 - DNA, 25 bp, E. coli
ggacgcaccggtttttcagcagcat

SEQ ID NO: 146458 - DNA, 25 bp, E. coli
ggacgcaccggtatttcagcagcat

SEQ ID NO: 146459 - DNA, 25 bp, E. coli
taatatcgcgatagaactgccggaa

SEQ ID NO: 146460 - DNA, 25 bp, E. coli
taatatcgcgattgaactgccggaa

SEQ ID NO: 146461 - DNA, 25 bp, E. coli
catcatgagcgatttttacgcctgc

SEQ ID NO: 146462 - DNA, 25 bp, E. coli
catcatgagcgaattttacgcctgc

SEQ ID NO: 146463 - DNA, 25 bp, E. coli
tacgcctgcctgaggtgatgcactt

SEQ ID NO: 146464 - DNA, 25 bp, E. coli
tacgcctgcctgtggtgatgcactt

SEQ ID NO: 146465 - DNA, 25 bp, E. coli
tttccgaagcagatcccgcttggcg

SEQ ID NO: 146466 - DNA, 25 bp, E. coli
tttccgaagcagttcccgcttggcg

SEQ ID NO: 146467 - DNA, 25 bp, E. coli
tgggcacagtctgaggtcagcgcat

SEQ ID NO: 146468 - DNA, 25 bp, E. coli
tgatgcacttatccgggttgtcccg

SEQ ID NO: 146469 - DNA, 25 bp, E. coli
tgggcacagtctcaggtcagcgcat

SEQ ID NO: 146470 - DNA, 25 bp, E. coli
tgatgcacttatgcgggttgtcccg

SEQ ID NO: 146471 - DNA, 25 bp, E. coli
gctgcgccattaattcctgtatcga

SEQ ID NO: 146472 - DNA, 25 bp, E. coli
gctgcgccattatttcctgtatcga

SEQ ID NO: 146473 - DNA, 25 bp, E. coli
cggtaaaaatgtcgcctgggcacag

SEQ ID NO: 146474 - DNA, 25 bp, E. coli
cggtaaaaatgtggcctgggcacag

SEQ ID NO: 146475 - DNA, 25 bp, E. coli
gatcagccgcgatgcgtttccgaag

SEQ ID NO: 146476 - DNA, 25 bp, E. coli
gatcagccgcgaagcgtttccgaag

SEQ ID NO: 146477 - DNA, 25 bp, E. coli
taatatttctgtctctgcgccagct

SEQ ID NO: 146478 - DNA, 25 bp, E. coli
taatatttctgtgtctgcgccagct

SEQ ID NO: 146479 - DNA, 25 bp, E. coli
tcagcgcatggaaggcggaccgcat

SEQ ID NO: 146480 - DNA, 25 bp, E. coli
tcagcgcatggatggcggaccgcat

SEQ ID NO: 146481 - DNA, 25 bp, E. coli
gaccgtttacgagctgatcagccgc

SEQ ID NO: 146482 - DNA, 25 bp, E. coli
gaccgtttacgacctgatcagccgc

SEQ ID NO: 146483 - DNA, 25 bp, E. coli
cacgctaaacgggatcgaactcata

SEQ ID NO: 146484 - DNA, 25 bp, E. coli
cacgctaaacggcatcgaactcata

SEQ ID NO: 146485 - DNA, 25 bp, E. coli
aacagccagcgctgtagtcagtgaa

SEQ ID NO: 146486 - DNA, 25 bp, E. coli
aacagccagcgcagtagtcagtgaa

SEQ ID NO: 146487 - DNA, 25 bp, E. coli
tattcagcgggacttttaagccagg

SEQ ID NO: 146488 - DNA, 25 bp, E. coli
tattcagcgggagttttaagccagg

SEQ ID NO: 146489 - DNA, 25 bp, E. coli
tatatgactgatgaagaatcgccga

SEQ ID NO: 146490 - DNA, 25 bp, E. coli
tatatgactgatcaagaatcgccga

SEQ ID NO: 146491 - DNA, 25 bp, E. coli
tgtgaatggcgaagaatctccagca

SEQ ID NO: 146492 - DNA, 25 bp, E. coli
tgataaatcggctacggacagactt

SEQ ID NO: 146493 - DNA, 25 bp, E. coli
tgataaatcggcaacggacagactt

SEQ ID NO: 146494 - DNA, 25 bp, E. coli
tgtgaatggcgatgaatctccagca

SEQ ID NO: 146495 - DNA, 25 bp, E. coli
tgtcaccgcggtatcaaaacaagat

SEQ ID NO: 146496 - DNA, 25 bp, E. coli
tgtcaccgcggtttcaaaacaagat

SEQ ID NO: 146497 - DNA, 25 bp, E. coli
tctaaatggagccactaaactcgtc

SEQ ID NO: 146498 - DNA, 25 bp, E. coli
tctaaatggagcgactaaactcgtc

SEQ ID NO: 146499 - DNA, 25 bp, E. coli
gacttattgctctggcggtgggtaa

SEQ ID NO: 146500 - DNA, 25 bp, E. coli
gacttattgctcaggcggtgggtaa

SEQ ID NO: 146501 - DNA, 25 bp, E. coli
taaccactgaagacgaaagccatgc

SEQ ID NO: 146502 - DNA, 25 bp, E. coli
taagacctctggaagcgtatctgac

SEQ ID NO: 146503 - DNA, 25 bp, E. coli
taaccactgaagtcgaaagccatgc

SEQ ID NO: 146504 - DNA, 25 bp, E. coli
taagacctctggtagcgtatctgac

SEQ ID NO: 146505 - DNA, 25 bp, E. coli
tgcgcaggcgacagagccagaacgt

SEQ ID NO: 146506 - DNA, 25 bp, E. coli
tgccgccgatgaggctattttcacc

SEQ ID NO: 146507 - DNA, 25 bp, E. coli
tgccgccgatgacgctattttcacc

SEQ ID NO: 146508 - DNA, 25 bp, E. coli
tgcgcaggcgactgagccagaacgt

SEQ ID NO: 146509 - DNA, 25 bp, E. coli
gaaagctggtgggtatttgactgac

SEQ ID NO: 146510 - DNA, 25 bp, E. coli
gacagagccagaacgtcaggtggtc

SEQ ID NO: 146511 - DNA, 25 bp, E. coli
gaactacacgactcaaactttgccc

SEQ ID NO: 146512 - DNA, 25 bp, E. coli
gaaagctggtggctatttgactgac

SEQ ID NO: 146513 - DNA, 25 bp, E. coli
gacagagccagatcgtcaggtggtc

SEQ ID NO: 146514 - DNA, 25 bp, E. coli
gaactacacgacacaaactttgccc

SEQ ID NO: 146515 - DNA, 25 bp, E. coli
cgctattttcacgtgtgacgttggt

SEQ ID NO: 146516 - DNA, 25 bp, E. coli
cgctattttcacctgtgacgttggt

SEQ ID NO: 146517 - DNA, 25 bp, E. coli
cgtctgaagttgttgaagccctgca

SEQ ID NO: 146518 - DNA, 25 bp, E. coli
cgtctgaagttgatgaagccctgca

SEQ ID NO: 146519 - DNA, 25 bp, E. coli
ggcaccgaactagacgacacaaact

SEQ ID NO: 146520 - DNA, 25 bp, E. coli
ggcaccgaactacacgacacaaact

SEQ ID NO: 146521 - DNA, 25 bp, E. coli
ggcaaccatgcactggtatcatgcg

SEQ ID NO: 146522 - DNA, 25 bp, E. coli
ggctatttgactgacggcaccgaac

SEQ ID NO: 146523 - DNA, 25 bp, E. coli
ggcaaccatgcagtggtatcatgcg

SEQ ID NO: 146524 - DNA, 25 bp, E. coli
ggctatttgactcacggcaccgaac

SEQ ID NO: 146525 - DNA, 25 bp, E. coli
gatgacgctattttcacctgtgacg

SEQ ID NO: 146526 - DNA, 25 bp, E. coli
gatgacgctattatcacctgtgacg

SEQ ID NO: 146527 - DNA, 25 bp, E. coli
aatgcattcgtctttgattagcccg

SEQ ID NO: 146528 - DNA, 25 bp, E. coli
aatgcattcgtcattgattagcccg

SEQ ID NO: 146529 - DNA, 25 bp, E. coli
aatatattgcaaacttctggtaggc

SEQ ID NO: 146530 - DNA, 25 bp, E. coli
aatatattgcaatcttctggtaggc

SEQ ID NO: 146531 - DNA, 25 bp, E. coli
cagacaaaaatgcattcgtcattga

SEQ ID NO: 146532 - DNA, 25 bp, E. coli
cagacaaaaatggattcgtcattga

SEQ ID NO: 146533 - DNA, 25 bp, E. coli
catcgcgcatcaggcaagcttacat

SEQ ID NO: 146534 - DNA, 25 bp, E. coli
catcgcgcatcacgcaagcttacat

SEQ ID NO: 146535 - DNA, 25 bp, E. coli
tattgcaatcttctggtaggcctga

SEQ ID NO: 146536 - DNA, 25 bp, E. coli
tattgcaatcttgtggtaggcctga

SEQ ID NO: 146537 - DNA, 25 bp, E. coli
tgtcatcagtatcaaccaccgggta

SEQ ID NO: 146538 - DNA, 25 bp, E. coli
tgtcatcagtatgaaccaccgggta

SEQ ID NO: 146539 - DNA, 25 bp, E. coli
gcaatcttctggaaggcctgataag

SEQ ID NO: 146540 - DNA, 25 bp, E. coli
gcagattgttgagaacgtacgcatt

SEQ ID NO: 146541 - DNA, 25 bp, E. coli
gcaatcttctggtaggcctgataag

SEQ ID NO: 146542 - DNA, 25 bp, E. coli
gcagattgttgacaacgtacgcatt

SEQ ID NO: 146543 - DNA, 25 bp, E. coli
gttgacaacgtacgcattgttcatg

SEQ ID NO: 146544 - DNA, 25 bp, E. coli
gttgacaacgtaggcattgttcatg

SEQ ID NO: 146545 - DNA, 25 bp, E. coli
ggcaagcttacatttgtcatcagta

SEQ ID NO: 146546 - DNA, 25 bp, E. coli
ggcaagcttacaattgtcatcagta

SEQ ID NO: 146547 - DNA, 25 bp, E. coli
taagcatcgcgcatcaggcaagctt

SEQ ID NO: 146548 - DNA, 25 bp, E. coli
taagcatcgcgcttcaggcaagctt

SEQ ID NO: 146549 - DNA, 25 bp, E. coli
catctacgtaacaattcggaatatt

SEQ ID NO: 146550 - DNA, 25 bp, E. coli
catctacgtaactattcggaatatt

SEQ ID NO: 146551 - DNA, 25 bp, E. coli
atggctgattatccggaaataaata

SEQ ID NO: 146552 - DNA, 25 bp, E. coli
atggctgattatgcggaaataaata

SEQ ID NO: 146553 - DNA, 25 bp, E. coli
tattcagaatattctagcggttttt

SEQ ID NO: 146554 - DNA, 25 bp, E. coli
tattttcatctaggtaactattcgg

SEQ ID NO: 146555 - DNA, 25 bp, E. coli
tttcccaccggatttaagtagcagc

SEQ ID NO: 146556 - DNA, 25 bp, E. coli
tttcccaccggaattaagtagcagc

SEQ ID NO: 146557 - DNA, 25 bp, E. coli
tattttcatctacgtaactattcgg

SEQ ID NO: 146558 - DNA, 25 bp, E. coli
tattcagaatatactagcggttttt

SEQ ID NO: 146559 - DNA, 25 bp, E. coli
tcccaccggaattaagtagcagcgg

SEQ ID NO: 146560 - DNA, 25 bp, E. coli
tcccaccggaataaagtagcagcgg

SEQ ID NO: 146561 - DNA, 25 bp, E. coli
ccggaattaagttgcagcggtgaca

SEQ ID NO: 146562 - DNA, 25 bp, E. coli
ccggaattaagtagcagcggtgaca

SEQ ID NO: 146563 - DNA, 25 bp, E. coli
tgcggaaataaaaaatttcccaccg

SEQ ID NO: 146564 - DNA, 25 bp, E. coli
tgcggaaataaataatttcccaccg

SEQ ID NO: 146565 - DNA, 25 bp, E. coli
gcggtgacaagttttttcatctacg

SEQ ID NO: 146566 - DNA, 25 bp, E. coli
gcggtgacaagtattttcatctacg

SEQ ID NO: 146567 - DNA, 25 bp, E. coli
cgtaactattcgcaatattcagaat

SEQ ID NO: 146568 - DNA, 25 bp, E. coli
cgtaactattcggaatattcagaat

SEQ ID NO: 146569 - DNA, 25 bp, E. coli
gtagcagcggtgacaagtattttca

SEQ ID NO: 146570 - DNA, 25 bp, E. coli
gtagcagcggtgtcaagtattttca

SEQ ID NO: 146571 - DNA, 25 bp, E. coli
caataccgcattctgaggcgattca

SEQ ID NO: 146572 - DNA, 25 bp, E. coli
caataccgcattgtgaggcgattca

SEQ ID NO: 146573 - DNA, 25 bp, E. coli
cagagaagcagaattccctaccggg

SEQ ID NO: 146574 - DNA, 25 bp, E. coli
cagagaagcagatttccctaccggg

SEQ ID NO: 146575 - DNA, 25 bp, E. coli
tggttcatgatagctggccacaggc

SEQ ID NO: 146576 - DNA, 25 bp, E. coli
cctaccgggataatgcttgagcagc

SEQ ID NO: 146577 - DNA, 25 bp, E. coli
cctaccgggatattgcttgagcagc

SEQ ID NO: 146578 - DNA, 25 bp, E. coli
gcgattcatgcttagtcgtcagcca

SEQ ID NO: 146579 - DNA, 25 bp, E. coli
gcgattcatgctaagtcgtcagcca

SEQ ID NO: 146580 - DNA, 25 bp, E. coli
gcagcagcaattgaaacttttacgc

SEQ ID NO: 146581 - DNA, 25 bp, E. coli
gcagcagcaattcaaacttttacgc

SEQ ID NO: 146582 - DNA, 25 bp, E. coli
gactaacctgttagttcgtagcgga

SEQ ID NO: 146583 - DNA, 25 bp, E. coli
gactaacctgtttgttcgtagcgga

SEQ ID NO: 146584 - DNA, 25 bp, E. coli
cccatatcggtattgagatgctcgc

SEQ ID NO: 146585 - DNA, 25 bp, E. coli
cccatatcggtaatgagatgctcgc

SEQ ID NO: 146586 - DNA, 25 bp, E. coli
cgatcgtagcgaagttttaacccat

SEQ ID NO: 146587 - DNA, 25 bp, E. coli
cgatcgtagcgatgttttaacccat

SEQ ID NO: 146588 - DNA, 25 bp, E. coli
cggaatttcttttgtcgatcgtagc

SEQ ID NO: 146589 - DNA, 25 bp, E. coli
cggaatttctttagtcgatcgtagc

SEQ ID NO: 146590 - DNA, 25 bp, E. coli
gattgtggaaaatccgcagcagcaa

SEQ ID NO: 146591 - DNA, 25 bp, E. coli
gattgtggaaaaaccgcagcagcaa

SEQ ID NO: 146592 - DNA, 25 bp, E. coli
tggttcatgatacctggccacaggc

SEQ ID NO: 146593 - DNA, 25 bp, E. coli
cacgggttccgtcgcgggagattat

SEQ ID NO: 146594 - DNA, 25 bp, E. coli
cacgggttccgtggcgggagattat

SEQ ID NO: 146595 - DNA, 25 bp, E. coli
catctaacctttgaggagtcttcgg

SEQ ID NO: 146596 - DNA, 25 bp, E. coli
catctaacctttcaggagtcttcgg

SEQ ID NO: 146597 - DNA, 25 bp, E. coli
agtcttcggtttcgccaactcatcc

SEQ ID NO: 146598 - DNA, 25 bp, E. coli
agtcttcggtttggccaactcatcc

SEQ ID NO: 146599 - DNA, 25 bp, E. coli
tttattctttgcgacgggttccgtg

SEQ ID NO: 146600 - DNA, 25 bp, E. coli
tttattctttgccacgggttccgtg

SEQ ID NO: 146601 - DNA, 25 bp, E. coli
tgctcaatacatgtaacctttcagg

SEQ ID NO: 146602 - DNA, 25 bp, E. coli
tgctcaatacatctaacctttcagg

SEQ ID NO: 146603 - DNA, 25 bp, E. coli
ttcaggagtcttgggtttggccaac

SEQ ID NO: 146604 - DNA, 25 bp, E. coli
ttcaggagtcttcggtttggccaac

SEQ ID NO: 146605 - DNA, 25 bp, E. coli
gccgcgtgaacaagaagattattcc

SEQ ID NO: 146606 - DNA, 25 bp, E. coli
gccgcgtgaacatgaagattattcc

SEQ ID NO: 146607 - DNA, 25 bp, E. coli
gcgggagattatcccgcgtgaacat

SEQ ID NO: 146608 - DNA, 25 bp, E. coli
gcgggagattatgccgcgtgaacat

SEQ ID NO: 146609 - DNA, 25 bp, E. coli
gattattcctgggaatactcggaaa

SEQ ID NO: 146610 - DNA, 25 bp, E. coli
gattattcctggcaatactcggaaa

SEQ ID NO: 146611 - DNA, 25 bp, E. coli
tgggaatactcggaaatttgtaagt

SEQ ID NO: 146612 - DNA, 25 bp, E. coli
tgggaatactcgcaaatttgtaagt

SEQ ID NO: 146613 - DNA, 25 bp, E. coli
taagtaatatttaactgctcaatac

SEQ ID NO: 146614 - DNA, 25 bp, E. coli
taagtaatattttactgctcaatac

SEQ ID NO: 146615 - DNA, 25 bp, E. coli
aagagagcgtggacattgccgcaca

SEQ ID NO: 146616 - DNA, 25 bp, E. coli
aagagagcgtggtcattgccgcaca

SEQ ID NO: 146617 - DNA, 25 bp, E. coli
agcgtggtcattcccgcacatcagg

SEQ ID NO: 146618 - DNA, 25 bp, E. coli
agcgtggtcattgccgcacatcagg

SEQ ID NO: 146619 - DNA, 25 bp, E. coli
tggtcattgccggacatcaggcttt

SEQ ID NO: 146620 - DNA, 25 bp, E. coli
tgccgcacatcacgctttattacag

SEQ ID NO: 146621 - DNA, 25 bp, E. coli
tgccgcacatcaggctttattacag

SEQ ID NO: 146622 - DNA, 25 bp, E. coli
gctgggcgcgaaaaataaccaggta

SEQ ID NO: 146623 - DNA, 25 bp, E. coli
gctgggcgcgaataataaccaggta

SEQ ID NO: 146624 - DNA, 25 bp, E. coli
gaagagagcgtggtcattgccgcac

SEQ ID NO: 146625 - DNA, 25 bp, E. coli
gaagagagcgtgctcattgccgcac

SEQ ID NO: 146626 - DNA, 25 bp, E. coli
cattgccgcacatcaggctttatta

SEQ ID NO: 146627 - DNA, 25 bp, E. coli
cattgccgcacaacaggctttatta

SEQ ID NO: 146628 - DNA, 25 bp, E. coli
ggtcattgccgctcatcaggcttta

SEQ ID NO: 146629 - DNA, 25 bp, E. coli
ggtcattgccgcacatcaggcttta

SEQ ID NO: 146630 - DNA, 25 bp, E. coli
tggtcattgccgcacatcaggcttt

SEQ ID NO: 146631 - DNA, 25 bp, E. coli
tcacgaaggtgaagagagcgtggtc

SEQ ID NO: 146632 - DNA, 25 bp, E. coli
tcacgaaggtgatgagagcgtggtc

SEQ ID NO: 146633 - DNA, 25 bp, E. coli
gagagcgtggtctttgccgcacatc

SEQ ID NO: 146634 - DNA, 25 bp, E. coli
gagcgtggtcattgccgcacatcag

SEQ ID NO: 146635 - DNA, 25 bp, E. coli
gagagcgtggtcattgccgcacatc

SEQ ID NO: 146636 - DNA, 25 bp, E. coli
gagcgtggtcatagccgcacatcag

SEQ ID NO: 146637 - DNA, 25 bp, E. coli
caggtaaggctctcggcgataagaa

SEQ ID NO: 146638 - DNA, 25 bp, E. coli
caggtaaggctcacggcgataagaa

SEQ ID NO: 146639 - DNA, 25 bp, E. coli
taaacagtcggtccatttccagaac

SEQ ID NO: 146640 - DNA, 25 bp, E. coli
tgaaagaaaacatctcggcaacctg

SEQ ID NO: 146641 - DNA, 25 bp, E. coli
tgaaagtccttaaacgtgacggcga

SEQ ID NO: 146642 - DNA, 25 bp, E. coli
tgaacgatatcaaaccgatctgggc

SEQ ID NO: 146643 - DNA, 25 bp, E. coli
tgaaagaaaacaactcggcaacctg

SEQ ID NO: 146644 - DNA, 25 bp, E. coli
tgaaagtccttatacgtgacggcga

SEQ ID NO: 146645 - DNA, 25 bp, E. coli
tgaacgatatcataccgatctgggc

SEQ ID NO: 146646 - DNA, 25 bp, E. coli
gccacacgttgggatcaaagtcacc

SEQ ID NO: 146647 - DNA, 25 bp, E. coli
gccacacgttggcatcaaagtcacc

SEQ ID NO: 146648 - DNA, 25 bp, E. coli
cgttgccgacaccaataccgagtgg

SEQ ID NO: 146649 - DNA, 25 bp, E. coli
cgttgccgacacgaataccgagtgg

SEQ ID NO: 146650 - DNA, 25 bp, E. coli
gatattccaggcatggtgaagcgca

SEQ ID NO: 146651 - DNA, 25 bp, E. coli
gatattccaggcttggtgaagcgca

SEQ ID NO: 146652 - DNA, 25 bp, E. coli
taactacgatgccatggatcatgcg

SEQ ID NO: 146653 - DNA, 25 bp, E. coli
taagcagttcgatgagctgcgcgcc

SEQ ID NO: 146654 - DNA, 25 bp, E. coli
taaacagtcggtgcatttccagaac

SEQ ID NO: 146655 - DNA, 25 bp, E. coli
taagcagttcgaagagctgcgcgcc

SEQ ID NO: 146656 - DNA, 25 bp, E. coli
taactacgatgcgatggatcatgcg

SEQ ID NO: 146657 - DNA, 25 bp, E. coli
gacggcgactgggtgcaaattgaaa

SEQ ID NO: 146658 - DNA, 25 bp, E. coli
gacggcgactggctgcaaattgaaa

SEQ ID NO: 146659 - DNA, 25 bp, E. coli
aagttactttgaattcagagccccg

SEQ ID NO: 146660 - DNA, 25 bp, E. coli
aatcctctgcgcttgaggcagctgc

SEQ ID NO: 146661 - DNA, 25 bp, E. coli
aatcctctgcgcatgaggcagctgc

SEQ ID NO: 146662 - DNA, 25 bp, E. coli
aagttactttgatttcagagccccg

SEQ ID NO: 146663 - DNA, 25 bp, E. coli
cagagccccgattaatgtgaacatg

SEQ ID NO: 146664 - DNA, 25 bp, E. coli
cagagccccgataaatgtgaacatg

SEQ ID NO: 146665 - DNA, 25 bp, E. coli
aaatctcaaccctgcaaagtttcgg

SEQ ID NO: 146666 - DNA, 25 bp, E. coli
aaatctcaacccagcaaagtttcgg

SEQ ID NO: 146667 - DNA, 25 bp, E. coli
tgagccgccgtgatacaccttaaaa

SEQ ID NO: 146668 - DNA, 25 bp, E. coli
tgagccgccgtgttacaccttaaaa

SEQ ID NO: 146669 - DNA, 25 bp, E. coli
gccgttaattgcgtatgttcagagt

SEQ ID NO: 146670 - DNA, 25 bp, E. coli
gccgttaattgcctatgttcagagt

SEQ ID NO: 146671 - DNA, 25 bp, E. coli
gcaaagtttcggagccgcgagcaaa

SEQ ID NO: 146672 - DNA, 25 bp, E. coli
gcaaagtttcggtgccgcgagcaaa

SEQ ID NO: 146673 - DNA, 25 bp, E. coli
cgcgactgctgggtcaggcaatgaa

SEQ ID NO: 146674 - DNA, 25 bp, E. coli
ccgcgagcaaaagtgagagccttca

SEQ ID NO: 146675 - DNA, 25 bp, E. coli
ccgcgagcaaaactgagagccttca

SEQ ID NO: 146676 - DNA, 25 bp, E. coli
cgcgactgctggctcaggcaatgaa

SEQ ID NO: 146677 - DNA, 25 bp, E. coli
gatttattgagagtatgagccgccg

SEQ ID NO: 146678 - DNA, 25 bp, E. coli
gatttattgagactatgagccgccg

SEQ ID NO: 146679 - DNA, 25 bp, E. coli
taatagcagcatttactaacaggga

SEQ ID NO: 146680 - DNA, 25 bp, E. coli
taatagcagcatatactaacaggga

SEQ ID NO: 146681 - DNA, 25 bp, E. coli
tacgcgggtacccaacaatatatgg

SEQ ID NO: 146682 - DNA, 25 bp, E. coli
tagaagatgttggtgtactggtagc

SEQ ID NO: 146683 - DNA, 25 bp, E. coli
tagaagatgttgctgtactggtagc

SEQ ID NO: 146684 - DNA, 25 bp, E. coli
tacgcgggtaccgaacaatatatgg

SEQ ID NO: 146685 - DNA, 25 bp, E. coli
ttctggcggattcctgctgctggca

SEQ ID NO: 146686 - DNA, 25 bp, E. coli
ttctggcggattgctgctgctggca

SEQ ID NO: 146687 - DNA, 25 bp, E. coli
tggtggtctggctatcctgttcggt

SEQ ID NO: 146688 - DNA, 25 bp, E. coli
tggtggtctggcaatcctgttcggt

SEQ ID NO: 146689 - DNA, 25 bp, E. coli
gcatcgaccgcctgctgaataaaaa

SEQ ID NO: 146690 - DNA, 25 bp, E. coli
gcatcgaccgccagctgaataaaaa

SEQ ID NO: 146691 - DNA, 25 bp, E. coli
cggcatttttatttcacagcaactt

SEQ ID NO: 146692 - DNA, 25 bp, E. coli
cggcatttttatatcacagcaactt

SEQ ID NO: 146693 - DNA, 25 bp, E. coli
cgggtacccaacaatatatggaagc

SEQ ID NO: 146694 - DNA, 25 bp, E. coli
cgggtacccaactatatatggaagc

SEQ ID NO: 146695 - DNA, 25 bp, E. coli
ggtctggcaatcgtgttcggtttcc

SEQ ID NO: 146696 - DNA, 25 bp, E. coli
ggtctggcaatcctgttcggtttcc

SEQ ID NO: 146697 - DNA, 25 bp, E. coli
ggctttacgctggtgacggcatttt

SEQ ID NO: 146698 - DNA, 25 bp, E. coli
ggctttacgctgctgacggcatttt

SEQ ID NO: 146699 - DNA, 25 bp, E. coli
gaccgcctgctgaataaaaagtggt

SEQ ID NO: 146700 - DNA, 25 bp, E. coli
gagagtatgatgtaaaaattagaag

SEQ ID NO: 146701 - DNA, 25 bp, E. coli
gagagtatgatgaaaaaattagaag

SEQ ID NO: 146702 - DNA, 25 bp, E. coli
gaccgcctgctgtataaaaagtggt

SEQ ID NO: 146703 - DNA, 25 bp, E. coli
aagaatctcttatccgcgttgccgg

SEQ ID NO: 146704 - DNA, 25 bp, E. coli
aagaatctcttaaccgcgttgccgg

SEQ ID NO: 146705 - DNA, 25 bp, E. coli
cacgtggcgtagaaatcgaagcgaa

SEQ ID NO: 146706 - DNA, 25 bp, E. coli
caaacgggcgttaatgttcaggatc

SEQ ID NO: 146707 - DNA, 25 bp, E. coli
caaaacagcgtttatggttacggcg

SEQ ID NO: 146708 - DNA, 25 bp, E. coli
cacgtggcgtagtaatcgaagcgaa

SEQ ID NO: 146709 - DNA, 25 bp, E. coli
caaaacagcgttaatggttacggcg

SEQ ID NO: 146710 - DNA, 25 bp, E. coli
caaacgggcgtttatgttcaggatc

SEQ ID NO: 146711 - DNA, 25 bp, E. coli
taaaaccaacaacctgatggcggac

SEQ ID NO: 146712 - DNA, 25 bp, E. coli
tacgtcgttgatgatgagaagctgc

SEQ ID NO: 146713 - DNA, 25 bp, E. coli
taaaaccaacaagctgatggcggac

SEQ ID NO: 146714 - DNA, 25 bp, E. coli
tacgtcgttgatcatgagaagctgc

SEQ ID NO: 146715 - DNA, 25 bp, E. coli
tatttctgttgtgaccgccgaagag

SEQ ID NO: 146716 - DNA, 25 bp, E. coli
tatttctgttgtcaccgccgaagag

SEQ ID NO: 146717 - DNA, 25 bp, E. coli
tccgatccggcgtatgcttacagca

SEQ ID NO: 146718 - DNA, 25 bp, E. coli
tccgttgataccgagttgcagagca

SEQ ID NO: 146719 - DNA, 25 bp, E. coli
tccgttgatacccagttgcagagca

SEQ ID NO: 146720 - DNA, 25 bp, E. coli
tccgatccggcgaatgcttacagca

SEQ ID NO: 146721 - DNA, 25 bp, E. coli
gccgattcaaaaagtgccacagtct

SEQ ID NO: 146722 - DNA, 25 bp, E. coli
gccgattcaaaatgtgccacagtct

SEQ ID NO: 146723 - DNA, 25 bp, E. coli
tcaacgcctggtatggttacgacga

SEQ ID NO: 146724 - DNA, 25 bp, E. coli
tcaacgcctggtttggttacgacga

SEQ ID NO: 146725 - DNA, 25 bp, E. coli
caatgacgttattgccgatcttgat

SEQ ID NO: 146726 - DNA, 25 bp, E. coli
caactgttgggagcctgggcaggtg

SEQ ID NO: 146727 - DNA, 25 bp, E. coli
caactgttgggaccctgggcaggtg

SEQ ID NO: 146728 - DNA, 25 bp, E. coli
caatgacgttatagccgatcttgat

SEQ ID NO: 146729 - DNA, 25 bp, E. coli
cacgggttaatcttctggtagaagc

SEQ ID NO: 146730 - DNA, 25 bp, E. coli
cacgggttaatcatctggtagaagc

SEQ ID NO: 146731 - DNA, 25 bp, E. coli
tacaacagggcaaagcgcaactgtt

SEQ ID NO: 146732 - DNA, 25 bp, E. coli
tacaacagggcatagcgcaactgtt

SEQ ID NO: 146733 - DNA, 25 bp, E. coli
aacaggcagcggtacatctacaaca

SEQ ID NO: 146734 - DNA, 25 bp, E. coli
acatctacaacagggcaaagcgcaa

SEQ ID NO: 146735 - DNA, 25 bp, E. coli
acatctacaacacggcaaagcgcaa

SEQ ID NO: 146736 - DNA, 25 bp, E. coli
aacaggcagcggaacatctacaaca

SEQ ID NO: 146737 - DNA, 25 bp, E. coli
ttaatcatctggaagaagccctcac

SEQ ID NO: 146738 - DNA, 25 bp, E. coli
ttaatcatctggtagaagccctcac

SEQ ID NO: 146739 - DNA, 25 bp, E. coli
tccgcacgggtttatcatctggtag

SEQ ID NO: 146740 - DNA, 25 bp, E. coli
tccgcacgggttaatcatctggtag

SEQ ID NO: 146741 - DNA, 25 bp, E. coli
gctcaatgacgtaattgccgatctt

SEQ ID NO: 146742 - DNA, 25 bp, E. coli
gctcaatgacgttattgccgatctt

SEQ ID NO: 146743 - DNA, 25 bp, E. coli
gcagcggaacatctacaacagggca

SEQ ID NO: 146744 - DNA, 25 bp, E. coli
gcagcggaacatgtacaacagggca

SEQ ID NO: 146745 - DNA, 25 bp, E. coli
ggaacatctacatcagggcaaagcg

SEQ ID NO: 146746 - DNA, 25 bp, E. coli
ggaacatctacaacagggcaaagcg

SEQ ID NO: 146747 - DNA, 25 bp, E. coli
caaaattaacgttggccattctcaa

SEQ ID NO: 146748 - DNA, 25 bp, E. coli
caaaattaacgtaggccattctcaa

SEQ ID NO: 146749 - DNA, 25 bp, E. coli
aaattaatcaacgatctgcgccagg

SEQ ID NO: 146750 - DNA, 25 bp, E. coli
aaattaatcaaccatctgcgccagg

SEQ ID NO: 146751 - DNA, 25 bp, E. coli
tatgattttcaagtggacgatgcaa

SEQ ID NO: 146752 - DNA, 25 bp, E. coli
tatgattttcaactggacgatgcaa

SEQ ID NO: 146753 - DNA, 25 bp, E. coli
taagcattttaaggatctcgaaggt

SEQ ID NO: 146754 - DNA, 25 bp, E. coli
taagcattttaacgatctcgaaggt

SEQ ID NO: 146755 - DNA, 25 bp, E. coli
tcgccaggctgattatcaaaatgaa

SEQ ID NO: 146756 - DNA, 25 bp, E. coli
tcgccaggctgaatatcaaaatgaa

SEQ ID NO: 146757 - DNA, 25 bp, E. coli
tcaggttgtaaacgagctcaacggg

SEQ ID NO: 146758 - DNA, 25 bp, E. coli
tcaggttgtaaaggagctcaacggg

SEQ ID NO: 146759 - DNA, 25 bp, E. coli
gcttcagcgtggattgaaagcagta

SEQ ID NO: 146760 - DNA, 25 bp, E. coli
gcttcagcgtggtttgaaagcagta

SEQ ID NO: 146761 - DNA, 25 bp, E. coli
gcagtaaagctaacatggcagaatc

SEQ ID NO: 146762 - DNA, 25 bp, E. coli
gcagtaaagctatcatggcagaatc

SEQ ID NO: 146763 - DNA, 25 bp, E. coli
gactgagagaaccaaacgacgtttt

SEQ ID NO: 146764 - DNA, 25 bp, E. coli
ctgcgccaggtgttaattttgatga

SEQ ID NO: 146765 - DNA, 25 bp, E. coli
ctgcgccaggtgataattttgatga

SEQ ID NO: 146766 - DNA, 25 bp, E. coli
ggacgactaccacattcaaagagga

SEQ ID NO: 146767 - DNA, 25 bp, E. coli
ggacgactaccagattcaaagagga

SEQ ID NO: 146768 - DNA, 25 bp, E. coli
gactgagagaacgaaacgacgtttt

SEQ ID NO: 146769 - DNA, 25 bp, E. coli
acctggcggcagaataggctgttca

SEQ ID NO: 146770 - DNA, 25 bp, E. coli
acctggcggcagtataggctgttca

SEQ ID NO: 146771 - DNA, 25 bp, E. coli
tttctgttacctcgagacgtcggga

SEQ ID NO: 146772 - DNA, 25 bp, E. coli
tttctgttacctggagacgtcggga

SEQ ID NO: 146773 - DNA, 25 bp, E. coli
ttacaacgctggctggctcgggatt

SEQ ID NO: 146774 - DNA, 25 bp, E. coli
ttacaacgctgggtggctcgggatt

SEQ ID NO: 146775 - DNA, 25 bp, E. coli
tgttacaaacattaccaggaaaagc

SEQ ID NO: 146776 - DNA, 25 bp, E. coli
tgttacaaacataaccaggaaaagc

SEQ ID NO: 146777 - DNA, 25 bp, E. coli
tgcttgcgggtctgacagcgtcctt

SEQ ID NO: 146778 - DNA, 25 bp, E. coli
tgcttgcgggtcagacagcgtcctt

SEQ ID NO: 146779 - DNA, 25 bp, E. coli
tcctgaacagtgttccaggtcacga

SEQ ID NO: 146780 - DNA, 25 bp, E. coli
tcctgaacagtgatccaggtcacga

SEQ ID NO: 146781 - DNA, 25 bp, E. coli
gcttccagatgcgaaaacgacacgt

SEQ ID NO: 146782 - DNA, 25 bp, E. coli
gcttccagatgccaaaacgacacgt

SEQ ID NO: 146783 - DNA, 25 bp, E. coli
gaataacgcccagatgctgttctta

SEQ ID NO: 146784 - DNA, 25 bp, E. coli
gaataacgcccacatgctgttctta

SEQ ID NO: 146785 - DNA, 25 bp, E. coli
gactacgggcactgaggttaacttt

SEQ ID NO: 146786 - DNA, 25 bp, E. coli
gactacgggcacagaggttaacttt

SEQ ID NO: 146787 - DNA, 25 bp, E. coli
gtattgaccaattcattcgggacag

SEQ ID NO: 146788 - DNA, 25 bp, E. coli
gtattgaccaatacattcgggacag

SEQ ID NO: 146789 - DNA, 25 bp, E. coli
taactgcgcgtcatgcaaaacactg

SEQ ID NO: 146790 - DNA, 25 bp, E. coli
taactgcgcgtcttgcaaaacactg

SEQ ID NO: 146791 - DNA, 25 bp, E. coli
catggcgtaacagcaccttttttga

SEQ ID NO: 146792 - DNA, 25 bp, E. coli
catggcgtaacaccaccttttttga

SEQ ID NO: 146793 - DNA, 25 bp, E. coli
aaccgggcgcaacaaagatattatt

SEQ ID NO: 146794 - DNA, 25 bp, E. coli
aaccgggcgcaagaaagatattatt

SEQ ID NO: 146795 - DNA, 25 bp, E. coli
tagccgctgtgcaatttacctccgg

SEQ ID NO: 146796 - DNA, 25 bp, E. coli
tagccgctgtgctatttacctccgg

SEQ ID NO: 146797 - DNA, 25 bp, E. coli
tttgattggtgctcgcagcgtgttg

SEQ ID NO: 146798 - DNA, 25 bp, E. coli
tttgattggtgcacgcagcgtgttg

SEQ ID NO: 146799 - DNA, 25 bp, E. coli
tgaattagccgctgtgctatttacc

SEQ ID NO: 146800 - DNA, 25 bp, E. coli
tgaattagccgcagtgctatttacc

SEQ ID NO: 146801 - DNA, 25 bp, E. coli
tctgcatggcgttacagcacctttt

SEQ ID NO: 146802 - DNA, 25 bp, E. coli
tctgcatggcgtaacagcacctttt

SEQ ID NO: 146803 - DNA, 25 bp, E. coli
ccttttttgattggtgctcgcagcg

SEQ ID NO: 146804 - DNA, 25 bp, E. coli
ccttttttgattcgtgctcgcagcg

SEQ ID NO: 146805 - DNA, 25 bp, E. coli
gcgtaacagcaccttttttgattgg

SEQ ID NO: 146806 - DNA, 25 bp, E. coli
gcgtaacagcacgttttttgattgg

SEQ ID NO: 146807 - DNA, 25 bp, E. coli
cgctgtgctattaacctccggaacc

SEQ ID NO: 146808 - DNA, 25 bp, E. coli
cgctgtgctatttacctccggaacc

SEQ ID NO: 146809 - DNA, 25 bp, E. coli
ctatataaaaattaccgggcgcaag

SEQ ID NO: 146810 - DNA, 25 bp, E. coli
ctatataaaaataaccgggcgcaag

SEQ ID NO: 146811 - DNA, 25 bp, E. coli
cggcgatgaatttgccgctgtgcta

SEQ ID NO: 146812 - DNA, 25 bp, E. coli
cggcgatgaattagccgctgtgcta

SEQ ID NO: 146813 - DNA, 25 bp, E. coli
caaatgcgacgcgttgctcgatgat

SEQ ID NO: 146814 - DNA, 25 bp, E. coli
caaatgcgacgccttgctcgatgat

SEQ ID NO: 146815 - DNA, 25 bp, E. coli
cctaactgataataacggcccgtat

SEQ ID NO: 146816 - DNA, 25 bp, E. coli
atcggcaaatgcgacgcgttgctcg

SEQ ID NO: 146817 - DNA, 25 bp, E. coli
cctaactgataaaaacggcccgtat

SEQ ID NO: 146818 - DNA, 25 bp, E. coli
atcggcaaatgccacgcgttgctcg

SEQ ID NO: 146819 - DNA, 25 bp, E. coli
ttgctcgatgatgccgtggccctga

SEQ ID NO: 146820 - DNA, 25 bp, E. coli
ttgctcgatgatcccgtggccctga

SEQ ID NO: 146821 - DNA, 25 bp, E. coli
tgataagctaagaggaaccacaccg

SEQ ID NO: 146822 - DNA, 25 bp, E. coli
tgataagctaagtggaaccacaccg

SEQ ID NO: 146823 - DNA, 25 bp, E. coli
tgcttgataagctaagtggaaccac

SEQ ID NO: 146824 - DNA, 25 bp, E. coli
tgcttgataagcaaagtggaaccac

SEQ ID NO: 146825 - DNA, 25 bp, E. coli
gcgtgggataagagcctaactgata

SEQ ID NO: 146826 - DNA, 25 bp, E. coli
gcgtgggataagtgcctaactgata

SEQ ID NO: 146827 - DNA, 25 bp, E. coli
cgcgttgctcgaagatgccgtggcc

SEQ ID NO: 146828 - DNA, 25 bp, E. coli
cgcgttgctcgatgatgccgtggcc

SEQ ID NO: 146829 - DNA, 25 bp, E. coli
cgggattaggcgtgattgcgcaata

SEQ ID NO: 146830 - DNA, 25 bp, E. coli
cgggattaggcgagattgcgcaata

SEQ ID NO: 146831 - DNA, 25 bp, E. coli
gattgcgcaatacgaatctgctcgc

SEQ ID NO: 146832 - DNA, 25 bp, E. coli
gattgcgcaataggaatctgctcgc

SEQ ID NO: 146833 - DNA, 25 bp, E. coli
gatgccgtggccgtgacaccagcga

SEQ ID NO: 146834 - DNA, 25 bp, E. coli
gatgccgtggccctgacaccagcga

SEQ ID NO: 146835 - DNA, 25 bp, E. coli
caactggggctagcagagatggcaa

SEQ ID NO: 146836 - DNA, 25 bp, E. coli
caactggggctaccagagatggcaa

SEQ ID NO: 146837 - DNA, 25 bp, E. coli
tatcctcagtcctcatgccgaagtg

SEQ ID NO: 146838 - DNA, 25 bp, E. coli
tatcctcagtccacatgccgaagtg

SEQ ID NO: 146839 - DNA, 25 bp, E. coli
tccgctgggattatgcaacaactgg

SEQ ID NO: 146840 - DNA, 25 bp, E. coli
tccgctgggattttgcaacaactgg

SEQ ID NO: 146841 - DNA, 25 bp, E. coli
gccatcaatatcgtcagtccacatg

SEQ ID NO: 146842 - DNA, 25 bp, E. coli
gccatcaatatcctcagtccacatg

SEQ ID NO: 146843 - DNA, 25 bp, E. coli
gaagctgtcagtggcgaacgtcaga

SEQ ID NO: 146844 - DNA, 25 bp, E. coli
gaagctgtcagtcgcgaacgtcaga

SEQ ID NO: 146845 - DNA, 25 bp, E. coli
gacttaacgaagctgtcagtcgcga

SEQ ID NO: 146846 - DNA, 25 bp, E. coli
gaacatgcgcttagcactttcatgg

SEQ ID NO: 146847 - DNA, 25 bp, E. coli
gaacatgcgctttgcactttcatgg

SEQ ID NO: 146848 - DNA, 25 bp, E. coli
gacttaacgaaggtgtcagtcgcga

SEQ ID NO: 146849 - DNA, 25 bp, E. coli
cgctttgcacttacatggcgaaaaa

SEQ ID NO: 146850 - DNA, 25 bp, E. coli
cgctttgcactttcatggcgaaaaa

SEQ ID NO: 146851 - DNA, 25 bp, E. coli
ctgtcagtcgcgtacgtcagacggg

SEQ ID NO: 146852 - DNA, 25 bp, E. coli
cgtcggcccgttgcaggataagcaa

SEQ ID NO: 146853 - DNA, 25 bp, E. coli
cgtcggcccgttccaggataagcaa

SEQ ID NO: 146854 - DNA, 25 bp, E. coli
ctgtcagtcgcgaacgtcagacggg

SEQ ID NO: 146855 - DNA, 25 bp, E. coli
gtccacatgccgaagtggacgtaat

SEQ ID NO: 146856 - DNA, 25 bp, E. coli
gtccacatgccgtagtggacgtaat

SEQ ID NO: 146857 - DNA, 25 bp, E. coli
tacgtattggtaacaccagcggaat

SEQ ID NO: 146858 - DNA, 25 bp, E. coli
tacgtattggtatcaccagcggaat

SEQ ID NO: 146859 - DNA, 25 bp, E. coli
tatttaaactacctcagcatgggac

SEQ ID NO: 146860 - DNA, 25 bp, E. coli
tttgtgaacccgcaaatcctcggcg

SEQ ID NO: 146861 - DNA, 25 bp, E. coli
tatttaaactacgtcagcatgggac

SEQ ID NO: 146862 - DNA, 25 bp, E. coli
tttgtgaacccggaaatcctcggcg

SEQ ID NO: 146863 - DNA, 25 bp, E. coli
ttgttaccacctgtttgattgccgg

SEQ ID NO: 146864 - DNA, 25 bp, E. coli
ttgttaccacctctttgattgccgg

SEQ ID NO: 146865 - DNA, 25 bp, E. coli
tcatcacgtcattttcatgccgcgg

SEQ ID NO: 146866 - DNA, 25 bp, E. coli
tcatcacgtcatattcatgccgcgg

SEQ ID NO: 146867 - DNA, 25 bp, E. coli
gatattagcggcctcattggtgaag

SEQ ID NO: 146868 - DNA, 25 bp, E. coli
gatattagcggcgtcattggtgaag

SEQ ID NO: 146869 - DNA, 25 bp, E. coli
ggatatttgctaacttacccgtggc

SEQ ID NO: 146870 - DNA, 25 bp, E. coli
ggatatttgctatcttacccgtggc

SEQ ID NO: 146871 - DNA, 25 bp, E. coli
gggattaaatctgctccaatggaca

SEQ ID NO: 146872 - DNA, 25 bp, E. coli
gggattaaatctcctccaatggaca

SEQ ID NO: 146873 - DNA, 25 bp, E. coli
tggcgatttaagttctcacggcgtg

SEQ ID NO: 146874 - DNA, 25 bp, E. coli
tggcgatttaagatctcacggcgtg

SEQ ID NO: 146875 - DNA, 25 bp, E. coli
taatgaatcaggcacgctttcgcga

SEQ ID NO: 146876 - DNA, 25 bp, E. coli
taatgaatcagggacgctttcgcga

SEQ ID NO: 146877 - DNA, 25 bp, E. coli
gaccaccgtccgcacagaattgatt

SEQ ID NO: 146878 - DNA, 25 bp, E. coli
gaccaccgtccggacagaattgatt

SEQ ID NO: 146879 - DNA, 25 bp, E. coli
caaactcgtcactaacatgcgcaga

SEQ ID NO: 146880 - DNA, 25 bp, E. coli
caaactcgtcacaaacatgcgcaga

SEQ ID NO: 146881 - DNA, 25 bp, E. coli
cagtttactgagagcagggcagcag

SEQ ID NO: 146882 - DNA, 25 bp, E. coli
cagtttactgagtgcagggcagcag

SEQ ID NO: 146883 - DNA, 25 bp, E. coli
aaaaaattagtcttcgatggccctc

SEQ ID NO: 146884 - DNA, 25 bp, E. coli
aaaaaattagtcatcgatggccctc

SEQ ID NO: 146885 - DNA, 25 bp, E. coli
acaataccagaaggcgcaacagtga

SEQ ID NO: 146886 - DNA, 25 bp, E. coli
acaataccagaacgcgcaacagtga

SEQ ID NO: 146887 - DNA, 25 bp, E. coli
ttgatggaacaaacgaagctacagt

SEQ ID NO: 146888 - DNA, 25 bp, E. coli
ttgatggaacaatcgaagctacagt

SEQ ID NO: 146889 - DNA, 25 bp, E. coli
tgtagatccagaagcagaacctcgt

SEQ ID NO: 146890 - DNA, 25 bp, E. coli
tgtagatccagatgcagaacctcgt

SEQ ID NO: 146891 - DNA, 25 bp, E. coli
gagttaccagaacgtcccagaaaga

SEQ ID NO: 146892 - DNA, 25 bp, E. coli
gagttaccagaaggtcccagaaaga

SEQ ID NO: 146893 - DNA, 25 bp, E. coli
gaacctcgtcatggaaaaatagtca

SEQ ID NO: 146894 - DNA, 25 bp, E. coli
gaacctcgtcatcgaaaaatagtca

SEQ ID NO: 146895 - DNA, 25 bp, E. coli
ggtgactccatgactaaccctaatg

SEQ ID NO: 146896 - DNA, 25 bp, E. coli
ggtgactccatgtctaaccctaatg

SEQ ID NO: 146897 - DNA, 25 bp, E. coli
taatatcgtgggttcaggctgggca

SEQ ID NO: 146898 - DNA, 25 bp, E. coli
taatatcgtgggatcaggctgggca

SEQ ID NO: 146899 - DNA, 25 bp, E. coli
gagaaagacatctatacccctggcg

SEQ ID NO: 146900 - DNA, 25 bp, E. coli
gagaaagacatcaatacccctggcg

SEQ ID NO: 146901 - DNA, 25 bp, E. coli
caagatccagtcagtatggcagcgg

SEQ ID NO: 146902 - DNA, 25 bp, E. coli
caagatccagtctgtatggcagcgg

SEQ ID NO: 146903 - DNA, 25 bp, E. coli
taaaaagcaggttgattacgttcca

SEQ ID NO: 146904 - DNA, 25 bp, E. coli
taaaaagcaggtagattacgttcca

SEQ ID NO: 146905 - DNA, 25 bp, E. coli
atattgagttccgtaagcccgccga

SEQ ID NO: 146906 - DNA, 25 bp, E. coli
atattgagttccctaagcccgccga

SEQ ID NO: 146907 - DNA, 25 bp, E. coli
ccgactttgagtttcgcaacggcga

SEQ ID NO: 146908 - DNA, 25 bp, E. coli
ccgactttgagtatcgcaacggcga

SEQ ID NO: 146909 - DNA, 25 bp, E. coli
tagattacgttccaggtacgccatg

SEQ ID NO: 146910 - DNA, 25 bp, E. coli
tagattacgttcgaggtacgccatg

SEQ ID NO: 146911 - DNA, 25 bp, E. coli
ttaggcaatccacaaaacttcaccg

SEQ ID NO: 146912 - DNA, 25 bp, E. coli
ttaggcaatccagaaaacttcaccg

SEQ ID NO: 146913 - DNA, 25 bp, E. coli
tgtatggcagcggaaaataaaaagc

SEQ ID NO: 146914 - DNA, 25 bp, E. coli
tgtatggcagcgcaaaataaaaagc

SEQ ID NO: 146915 - DNA, 25 bp, E. coli
gcaagtacgttggtcgggccgactt

SEQ ID NO: 146916 - DNA, 25 bp, E. coli
gcaagtacgttgctcgggccgactt

SEQ ID NO: 146917 - DNA, 25 bp, E. coli
gacggatgacacagcgaagttaggc

SEQ ID NO: 146918 - DNA, 25 bp, E. coli
gacggatgacactgcgaagttaggc

SEQ ID NO: 146919 - DNA, 25 bp, E. coli
gggcattacgataacggcgatcacg

SEQ ID NO: 146920 - DNA, 25 bp, E. coli
gggcattacgattacggcgatcacg

SEQ ID NO: 146921 - DNA, 25 bp, E. coli
ggcgatcacggttctaacgcaccgg

SEQ ID NO: 146922 - DNA, 25 bp, E. coli
ggcgatcacggtactaacgcaccgg

SEQ ID NO: 146923 - DNA, 25 bp, E. coli
caaatattgcttgtcgctggataac

SEQ ID NO: 146924 - DNA, 25 bp, E. coli
caaagtctggagcacaacagatggt

SEQ ID NO: 146925 - DNA, 25 bp, E. coli
caaatattgcttctcgctggataac

SEQ ID NO: 146926 - DNA, 25 bp, E. coli
caaagtctggaggacaacagatggt

SEQ ID NO: 146927 - DNA, 25 bp, E. coli
tacagggacgaaatcagtgatcctc

SEQ ID NO: 146928 - DNA, 25 bp, E. coli
tacagggacgaattcagtgatcctc

SEQ ID NO: 146929 - DNA, 25 bp, E. coli
gcagggctatgattcgaacgtatta

SEQ ID NO: 146930 - DNA, 25 bp, E. coli
gaatgatggtctttgagcagggcta

SEQ ID NO: 146931 - DNA, 25 bp, E. coli
gcagggctatgaatcgaacgtatta

SEQ ID NO: 146932 - DNA, 25 bp, E. coli
gaatgaacctgctgatggtgccatg

SEQ ID NO: 146933 - DNA, 25 bp, E. coli
gaatgatggtctatgagcagggcta

SEQ ID NO: 146934 - DNA, 25 bp, E. coli
gaatgaacctgcagatggtgccatg

SEQ ID NO: 146935 - DNA, 25 bp, E. coli
gacttatacgtggaagctggttgac

SEQ ID NO: 146936 - DNA, 25 bp, E. coli
gacaaaaaagcattcgccagcgtta

SEQ ID NO: 146937 - DNA, 25 bp, E. coli
gacaaaaaagcaatcgccagcgtta

SEQ ID NO: 146938 - DNA, 25 bp, E. coli
gacttatacgtgcaagctggttgac

SEQ ID NO: 146939 - DNA, 25 bp, E. coli
cgacttgattcgtctggtacaggga

SEQ ID NO: 146940 - DNA, 25 bp, E. coli
cgacttgattcgactggtacaggga

SEQ ID NO: 146941 - DNA, 25 bp, E. coli
taaggaatggactgagccgggaaac

SEQ ID NO: 146942 - DNA, 25 bp, E. coli
taaggaatggacagagccgggaaac

SEQ ID NO: 146943 - DNA, 25 bp, E. coli
gacgttccgggcaggattgacaaaa

SEQ ID NO: 146944 - DNA, 25 bp, E. coli
gacgttccgggctggattgacaaaa

SEQ ID NO: 146945 - DNA, 25 bp, E. coli
cagcgccggtgcacatgtgaaaaac

SEQ ID NO: 146946 - DNA, 25 bp, E. coli
cagcgccggtgctcatgtgaaaaac

SEQ ID NO: 146947 - DNA, 25 bp, E. coli
tatcgcctgaaacagcgcgtgcagt

SEQ ID NO: 146948 - DNA, 25 bp, E. coli
tatcgcctgaaagagcgcgtgcagt

SEQ ID NO: 146949 - DNA, 25 bp, E. coli
tgaacgtcaacatggtcacctgcgg

SEQ ID NO: 146950 - DNA, 25 bp, E. coli
tgaacgtcaacaaggtcacctgcgg

SEQ ID NO: 146951 - DNA, 25 bp, E. coli
gcccttactgcgtgccggtggttaa

SEQ ID NO: 146952 - DNA, 25 bp, E. coli
gcccttactgcgagccggtggttaa

SEQ ID NO: 146953 - DNA, 25 bp, E. coli
gcagtttgaagttatcccgcaggat

SEQ ID NO: 146954 - DNA, 25 bp, E. coli
gcagtttgaagtaatcccgcaggat

SEQ ID NO: 146955 - DNA, 25 bp, E. coli
gaaaaaatggccgagtcactggcgc

SEQ ID NO: 146956 - DNA, 25 bp, E. coli
gacattatgacttccagtgcgctgg

SEQ ID NO: 146957 - DNA, 25 bp, E. coli
gaaaaaatggcccagtcactggcgc

SEQ ID NO: 146958 - DNA, 25 bp, E. coli
gacattatgactaccagtgcgctgg

SEQ ID NO: 146959 - DNA, 25 bp, E. coli
cattgtatttgaagcgaccagcgcc

SEQ ID NO: 146960 - DNA, 25 bp, E. coli
cattccaatggtggcggcagtttca

SEQ ID NO: 146961 - DNA, 25 bp, E. coli
cattccaatggtcgcggcagtttca

SEQ ID NO: 146962 - DNA, 25 bp, E. coli
cattgtatttgatgcgaccagcgcc

SEQ ID NO: 146963 - DNA, 25 bp, E. coli
gatattcgcttatttgacctgacgc

SEQ ID NO: 146964 - DNA, 25 bp, E. coli
gatattcgcttaattgacctgacgc

SEQ ID NO: 146965 - DNA, 25 bp, E. coli
ggcacgcgtgcctatatcgatgaat

SEQ ID NO: 146966 - DNA, 25 bp, E. coli
ggcacgcgtgccaatatcgatgaat

SEQ ID NO: 146967 - DNA, 25 bp, E. coli
tatttatcaccgtcgtcggactgcc

SEQ ID NO: 146968 - DNA, 25 bp, E. coli
tatttatcaccgacgtcggactgcc

SEQ ID NO: 146969 - DNA, 25 bp, E. coli
ttacgggatgctgaatcaccacggc

SEQ ID NO: 146970 - DNA, 25 bp, E. coli
tttacccgcatagctgacgatgatg

SEQ ID NO: 146971 - DNA, 25 bp, E. coli
ttacgggatgctcaatcaccacggc

SEQ ID NO: 146972 - DNA, 25 bp, E. coli
tttacccgcatacctgacgatgatg

SEQ ID NO: 146973 - DNA, 25 bp, E. coli
tgtattacgggagttaacgacatga

SEQ ID NO: 146974 - DNA, 25 bp, E. coli
tgtattacgggacttaacgacatga

SEQ ID NO: 146975 - DNA, 25 bp, E. coli
tcaccacggcgtgttacctttaggg

SEQ ID NO: 146976 - DNA, 25 bp, E. coli
tcaccacggcgtcttacctttaggg

SEQ ID NO: 146977 - DNA, 25 bp, E. coli
ccggtaagcaaataggagaatatct

SEQ ID NO: 146978 - DNA, 25 bp, E. coli
ccggtaagcaaaaaggagaatatct

SEQ ID NO: 146979 - DNA, 25 bp, E. coli
gaaatttgaattatccgagggcacg

SEQ ID NO: 146980 - DNA, 25 bp, E. coli
gaaaaaatacggtgaattactgcct

SEQ ID NO: 146981 - DNA, 25 bp, E. coli
gaaatttgaattttccgagggcacg

SEQ ID NO: 146982 - DNA, 25 bp, E. coli
gaaaaaatacggagaattactgcct

SEQ ID NO: 146983 - DNA, 25 bp, E. coli
cgggcgcgatatattggcgtaagca

SEQ ID NO: 146984 - DNA, 25 bp, E. coli
cgggcgcgatattttggcgtaagca

SEQ ID NO: 146985 - DNA, 25 bp, E. coli
cggactgccgaagatgttgtattac

SEQ ID NO: 146986 - DNA, 25 bp, E. coli
cggactgccgaacatgttgtattac

SEQ ID NO: 146987 - DNA, 25 bp, E. coli
ggattctgtccagaatcgggcgcga

SEQ ID NO: 146988 - DNA, 25 bp, E. coli
ggattctgtccacaatcgggcgcga

SEQ ID NO: 146989 - DNA, 25 bp, E. coli
tacggcatggaacacgcgattgaac

SEQ ID NO: 146990 - DNA, 25 bp, E. coli
tacggcatggaagacgcgattgaac

SEQ ID NO: 146991 - DNA, 25 bp, E. coli
tatgatggaaaatggctacacccgt

SEQ ID NO: 146992 - DNA, 25 bp, E. coli
tatgatggaaaaaggctacacccgt

SEQ ID NO: 146993 - DNA, 25 bp, E. coli
tatctgatcccgaaatatgccgagt

SEQ ID NO: 146994 - DNA, 25 bp, E. coli
tatctgatcccgtaatatgccgagt

SEQ ID NO: 146995 - DNA, 25 bp, E. coli
tcatggtcgatagagcccaggaacc

SEQ ID NO: 146996 - DNA, 25 bp, E. coli
tcatggtcgatacagcccaggaacc

SEQ ID NO: 146997 - DNA, 25 bp, E. coli
ccagctatgaaatactgcgcacggt

SEQ ID NO: 146998 - DNA, 25 bp, E. coli
ccagctatgaaaaactgcgcacggt

SEQ ID NO: 146999 - DNA, 25 bp, E. coli
gctgccaaggacgaagagttcacac

SEQ ID NO: 147000 - DNA, 25 bp, E. coli
gctgccaaggaccaagagttcacac

SEQ ID NO: 147001 - DNA, 25 bp, E. coli
gcgagtctcttaacgccgagctgga

SEQ ID NO: 147002 - DNA, 25 bp, E. coli
gcgagtctcttatcgccgagctgga

SEQ ID NO: 147003 - DNA, 25 bp, E. coli
gaatatcgtgacaacgccggtgtcg

SEQ ID NO: 147004 - DNA, 25 bp, E. coli
gaaggtctggccctcaattctgcaa

SEQ ID NO: 147005 - DNA, 25 bp, E. coli
gaatatcgtgactacgccggtgtcg

SEQ ID NO: 147006 - DNA, 25 bp, E. coli
gaaggtctggccgtcaattctgcaa

SEQ ID NO: 147007 - DNA, 25 bp, E. coli
tcaaccgacgaggagaagaaacacg

SEQ ID NO: 147008 - DNA, 25 bp, E. coli
tcaaccgacgagcagaagaaacacg

SEQ ID NO: 147009 - DNA, 25 bp, E. coli
gatcccaaagcctagtcgtatcagg

SEQ ID NO: 147010 - DNA, 25 bp, E. coli
gatcccaaagccaagtcgtatcagg

SEQ ID NO: 147011 - DNA, 25 bp, E. coli
aatcgtcatcaccatcattctgccg

SEQ ID NO: 147012 - DNA, 25 bp, E. coli
aatcgtcatcacgatcattctgccg

SEQ ID NO: 147013 - DNA, 25 bp, E. coli
tatatccccggtttgattcacgcgt

SEQ ID NO: 147014 - DNA, 25 bp, E. coli
tatatccccggtatgattcacgcgt

SEQ ID NO: 147015 - DNA, 25 bp, E. coli
ttgggcgttcataattaatattctg

SEQ ID NO: 147016 - DNA, 25 bp, E. coli
ttgggcgttcattattaatattctg

SEQ ID NO: 147017 - DNA, 25 bp, E. coli
tgctgctcggtaaagggttcggttg

SEQ ID NO: 147018 - DNA, 25 bp, E. coli
tgctgctcggtatagggttcggttg

SEQ ID NO: 147019 - DNA, 25 bp, E. coli
gccgctcggcgtgctgctcggtaaa

SEQ ID NO: 147020 - DNA, 25 bp, E. coli
gccgctcggcgtcctgctcggtaaa

SEQ ID NO: 147021 - DNA, 25 bp, E. coli
gacactgcttgggtatatccccggt

SEQ ID NO: 147022 - DNA, 25 bp, E. coli
gacactgcttggctatatccccggt

SEQ ID NO: 147023 - DNA, 25 bp, E. coli
ccggtttgattcacgcgttctgggt

SEQ ID NO: 147024 - DNA, 25 bp, E. coli
ccggtttgattctcgcgttctgggt

SEQ ID NO: 147025 - DNA, 25 bp, E. coli
ctggagaatcgtcatcaccatcatt

SEQ ID NO: 147026 - DNA, 25 bp, E. coli
ctggagaatcgtgatcaccatcatt

SEQ ID NO: 147027 - DNA, 25 bp, E. coli
gttctgggtgcaaacccgcgattaa

SEQ ID NO: 147028 - DNA, 25 bp, E. coli
gattcacgcgttgtgggtgcaaacc

SEQ ID NO: 147029 - DNA, 25 bp, E. coli
gattcacgcgttctgggtgcaaacc

SEQ ID NO: 147030 - DNA, 25 bp, E. coli
gttctgggtgcatacccgcgattaa

SEQ ID NO: 147031 - DNA, 25 bp, E. coli
gggtttctggagaatcgtcatcacc

SEQ ID NO: 147032 - DNA, 25 bp, E. coli
gggtttctggagtatcgtcatcacc

SEQ ID NO: 147033 - DNA, 25 bp, E. coli
cagcataaatgatcctgcgcaccaa

SEQ ID NO: 147034 - DNA, 25 bp, E. coli
cataatgtatcggatgaaaagcggg

SEQ ID NO: 147035 - DNA, 25 bp, E. coli
cataatgtatcgcatgaaaagcggg

SEQ ID NO: 147036 - DNA, 25 bp, E. coli
cataaagtaaccttgatcgaagcca

SEQ ID NO: 147037 - DNA, 25 bp, E. coli
cagcataaatgaacctgcgcaccaa

SEQ ID NO: 147038 - DNA, 25 bp, E. coli
cataaagtaaccatgatcgaagcca

SEQ ID NO: 147039 - DNA, 25 bp, E. coli
tactcctgtcaggtgtgatcaccgc

SEQ ID NO: 147040 - DNA, 25 bp, E. coli
tactcctgtcagctgtgatcaccgc

SEQ ID NO: 147041 - DNA, 25 bp, E. coli
aaaacttcgattgtcatgatgagca

SEQ ID NO: 147042 - DNA, 25 bp, E. coli
aaaacttcgattctcatgatgagca

SEQ ID NO: 147043 - DNA, 25 bp, E. coli
tgatcaccgcgctgaatgctcgcgg

SEQ ID NO: 147044 - DNA, 25 bp, E. coli
tgatcaccgcgcagaatgctcgcgg

SEQ ID NO: 147045 - DNA, 25 bp, E. coli
gcttacggctttatattacgggtga

SEQ ID NO: 147046 - DNA, 25 bp, E. coli
gcttacggctttttattacgggtga

SEQ ID NO: 147047 - DNA, 25 bp, E. coli
gctcgcggcctgcaatgttcgcaaa

SEQ ID NO: 147048 - DNA, 25 bp, E. coli
gctcgcggcctggaatgttcgcaaa

SEQ ID NO: 147049 - DNA, 25 bp, E. coli
gatcgaagccatttacacgcacaaa

SEQ ID NO: 147050 - DNA, 25 bp, E. coli
gatcgaagccatatacacgcacaaa

SEQ ID NO: 147051 - DNA, 25 bp, E. coli
ggctaagcctcaagcacaggtcaat

SEQ ID NO: 147052 - DNA, 25 bp, E. coli
ggctaagcctcatgcacaggtcaat

SEQ ID NO: 147053 - DNA, 25 bp, E. coli
taatgaagtctgtcaccagccaggc

SEQ ID NO: 147054 - DNA, 25 bp, E. coli
taatgaagtctgacaccagccaggc

SEQ ID NO: 147055 - DNA, 25 bp, E. coli
tatccgtcggtattttacaaaattg

SEQ ID NO: 147056 - DNA, 25 bp, E. coli
tatccgtcggtaatttacaaaattg

SEQ ID NO: 147057 - DNA, 25 bp, E. coli
tatctccggcggacatacccgtcgt

SEQ ID NO: 147058 - DNA, 25 bp, E. coli
tttcaggccgcaccggcgttagctt

SEQ ID NO: 147059 - DNA, 25 bp, E. coli
tatctccggcggtcatacccgtcgt

SEQ ID NO: 147060 - DNA, 25 bp, E. coli
tttcaggccgcagcggcgttagctt

SEQ ID NO: 147061 - DNA, 25 bp, E. coli
ttgctgcacccagaaatccataggg

SEQ ID NO: 147062 - DNA, 25 bp, E. coli
ttgctgcacccacaaatccataggg

SEQ ID NO: 147063 - DNA, 25 bp, E. coli
tgagattaccagtaaaaagccggcc

SEQ ID NO: 147064 - DNA, 25 bp, E. coli
tgagattaccagaaaaaagccggcc

SEQ ID NO: 147065 - DNA, 25 bp, E. coli
tgaagtaataccgtaaccaccaccg

SEQ ID NO: 147066 - DNA, 25 bp, E. coli
tgaagtaataccctaaccaccaccg

SEQ ID NO: 147067 - DNA, 25 bp, E. coli
tccatagggtatgtgaagtaatacc

SEQ ID NO: 147068 - DNA, 25 bp, E. coli
tccatagggtatctgaagtaatacc

SEQ ID NO: 147069 - DNA, 25 bp, E. coli
cgctaataacctcaatacattcatg

SEQ ID NO: 147070 - DNA, 25 bp, E. coli
cgctaataacctgaatacattcatg

SEQ ID NO: 147071 - DNA, 25 bp, E. coli
gattctggcgctagctaccttgctg

SEQ ID NO: 147072 - DNA, 25 bp, E. coli
gattctggcgcttgctaccttgctg

SEQ ID NO: 147073 - DNA, 25 bp, E. coli
ggtcatacccgtggtctttcaggcc

SEQ ID NO: 147074 - DNA, 25 bp, E. coli
ggtcatacccgtcgtctttcaggcc

SEQ ID NO: 147075 - DNA, 25 bp, E. coli
ggcaaccgatttgtctattcgctaa

SEQ ID NO: 147076 - DNA, 25 bp, E. coli
ggcaaccgatttctctattcgctaa

SEQ ID NO: 147077 - DNA, 25 bp, E. coli
caactgcaagtccagatacggcggt

SEQ ID NO: 147078 - DNA, 25 bp, E. coli
caactgcaagtcgagatacggcggt

SEQ ID NO: 147079 - DNA, 25 bp, E. coli
taaatcgcttgaatacgggcgaact

SEQ ID NO: 147080 - DNA, 25 bp, E. coli
taaagatgtggcttatctgaagcca

SEQ ID NO: 147081 - DNA, 25 bp, E. coli
taaatcgcttgattacgggcgaact

SEQ ID NO: 147082 - DNA, 25 bp, E. coli
taaagatgtggcatatctgaagcca

SEQ ID NO: 147083 - DNA, 25 bp, E. coli
tactacaactgctagtccagatacg

SEQ ID NO: 147084 - DNA, 25 bp, E. coli
tactacaactgcaagtccagatacg

SEQ ID NO: 147085 - DNA, 25 bp, E. coli
tatctgaagccacttactacaactg

SEQ ID NO: 147086 - DNA, 25 bp, E. coli
tatctgaagccagttactacaactg

SEQ ID NO: 147087 - DNA, 25 bp, E. coli
tgattaaatcgcatgaatacgggcg

SEQ ID NO: 147088 - DNA, 25 bp, E. coli
tgattaaatcgcttgaatacgggcg

SEQ ID NO: 147089 - DNA, 25 bp, E. coli
tgaatacgggcgaactgttaaagat

SEQ ID NO: 147090 - DNA, 25 bp, E. coli
tgaagccacttagtacaactgcaag

SEQ ID NO: 147091 - DNA, 25 bp, E. coli
tgaatacgggcgtactgttaaagat

SEQ ID NO: 147092 - DNA, 25 bp, E. coli
tgcaagtccagatacggcggtatgg

SEQ ID NO: 147093 - DNA, 25 bp, E. coli
tgcaagtccagaaacggcggtatgg

SEQ ID NO: 147094 - DNA, 25 bp, E. coli
tgaagccacttactacaactgcaag

SEQ ID NO: 147095 - DNA, 25 bp, E. coli
gcggtatggaatattctgatattaa

SEQ ID NO: 147096 - DNA, 25 bp, E. coli
gcggtatggaattttctgatattaa

SEQ ID NO: 147097 - DNA, 25 bp, E. coli
gatacggcggtaaggaattttctga

SEQ ID NO: 147098 - DNA, 25 bp, E. coli
gatacggcggtatggaattttctga

SEQ ID NO: 147099 - DNA, 25 bp, E. coli
cagcacaggaatttccggatctcga

SEQ ID NO: 147100 - DNA, 25 bp, E. coli
cagcacaggaatatccggatctcga

SEQ ID NO: 147101 - DNA, 25 bp, E. coli
cagccaaaccgcgtgggcgtgaagc

SEQ ID NO: 147102 - DNA, 25 bp, E. coli
cagccaaaccgcctgggcgtgaagc

SEQ ID NO: 147103 - DNA, 25 bp, E. coli
atttatccgcataccgggcaggccg

SEQ ID NO: 147104 - DNA, 25 bp, E. coli
atttatccgcattccgggcaggccg

SEQ ID NO: 147105 - DNA, 25 bp, E. coli
gaagggaataccgtgccgtttatcg

SEQ ID NO: 147106 - DNA, 25 bp, E. coli
gaagggaataccctgccgtttatcg

SEQ ID NO: 147107 - DNA, 25 bp, E. coli
gaagaacgcgcaactggtctcaacc

SEQ ID NO: 147108 - DNA, 25 bp, E. coli
gaaccactgtcaacggtgccttctc

SEQ ID NO: 147109 - DNA, 25 bp, E. coli
gaaccactgtcatcggtgccttctc

SEQ ID NO: 147110 - DNA, 25 bp, E. coli
gaagaacgcgcatctggtctcaacc

SEQ ID NO: 147111 - DNA, 25 bp, E. coli
cgcagttcgaagagccgccgaaaga

SEQ ID NO: 147112 - DNA, 25 bp, E. coli
cgcagttcgaagtgccgccgaaaga

SEQ ID NO: 147113 - DNA, 25 bp, E. coli
ccgagctggcaggacaggaatttcc

SEQ ID NO: 147114 - DNA, 25 bp, E. coli
ccgagctggcagcacaggaatttcc

SEQ ID NO: 147115 - DNA, 25 bp, E. coli
cgataccatttatccgcataccggg

SEQ ID NO: 147116 - DNA, 25 bp, E. coli
cgataccatttaaccgcataccggg

SEQ ID NO: 147117 - DNA, 25 bp, E. coli
gatcatcacgaagcactgtcaacgg

SEQ ID NO: 147118 - DNA, 25 bp, E. coli
gatcatcacgaaccactgtcaacgg

SEQ ID NO: 147119 - DNA, 25 bp, E. coli
ggtctcaaccgtggtgagcggtaaa

SEQ ID NO: 147120 - DNA, 25 bp, E. coli
ggtctcaaccgtcgtgagcggtaaa

SEQ ID NO: 147121 - DNA, 25 bp, E. coli
caatgctaaagcatctggcggtagc

SEQ ID NO: 147122 - DNA, 25 bp, E. coli
caatgctaaagcttctggcggtagc

SEQ ID NO: 147123 - DNA, 25 bp, E. coli
agtagaagtcgccaaaaacaatgct

SEQ ID NO: 147124 - DNA, 25 bp, E. coli
agcatctggcggtagcttccgtcag

SEQ ID NO: 147125 - DNA, 25 bp, E. coli
agcatctggcggaagcttccgtcag

SEQ ID NO: 147126 - DNA, 25 bp, E. coli
agtagaagtcgcgaaaaacaatgct

SEQ ID NO: 147127 - DNA, 25 bp, E. coli
aaacaatgctaaagcatctggcggt

SEQ ID NO: 147128 - DNA, 25 bp, E. coli
aaacaatgctaatgcatctggcggt

SEQ ID NO: 147129 - DNA, 25 bp, E. coli
taccgaattgctgcgcgctaacgat

SEQ ID NO: 147130 - DNA, 25 bp, E. coli
taccgaattgctccgcgctaacgat

SEQ ID NO: 147131 - DNA, 25 bp, E. coli
cctgatcccggaagtagtagaagtc

SEQ ID NO: 147132 - DNA, 25 bp, E. coli
cctgatcccggatgtagtagaagtc

SEQ ID NO: 147133 - DNA, 25 bp, E. coli
gctaaagcatctcgcggtagcttcc

SEQ ID NO: 147134 - DNA, 25 bp, E. coli
gctaaagcatctggcggtagcttcc

SEQ ID NO: 147135 - DNA, 25 bp, E. coli
gaacagcgtaccgaattgctgcgcg

SEQ ID NO: 147136 - DNA, 25 bp, E. coli
gaacagcgtacccaattgctgcgcg

SEQ ID NO: 147137 - DNA, 25 bp, E. coli
cccggatgtagttgaagtcgcgaaa

SEQ ID NO: 147138 - DNA, 25 bp, E. coli
cccggatgtagtagaagtcgcgaaa

SEQ ID NO: 147139 - DNA, 25 bp, E. coli
gatcccggatgttgtagaagtcgcg

SEQ ID NO: 147140 - DNA, 25 bp, E. coli
ggatgtagtagaagtcgcgaaaaac

SEQ ID NO: 147141 - DNA, 25 bp, E. coli
ggatgtagtagatgtcgcgaaaaac

SEQ ID NO: 147142 - DNA, 25 bp, E. coli
gatcccggatgtagtagaagtcgcg

SEQ ID NO: 147143 - DNA, 25 bp, E. coli
caaatacgcgaatgttgacggcacc

SEQ ID NO: 147144 - DNA, 25 bp, E. coli
caaatacgcgaaagttgacggcacc

SEQ ID NO: 147145 - DNA, 25 bp, E. coli
taaagagcgcattgctcaggaagac

SEQ ID NO: 147146 - DNA, 25 bp, E. coli
taaagagcgcatagctcaggaagac

SEQ ID NO: 147147 - DNA, 25 bp, E. coli
tatggatgctggcaaactggtcacc

SEQ ID NO: 147148 - DNA, 25 bp, E. coli
tatggatgctgggaaactggtcacc

SEQ ID NO: 147149 - DNA, 25 bp, E. coli
tctggctccgagctgggtaaacaag

SEQ ID NO: 147150 - DNA, 25 bp, E. coli
tctggctccgaggtgggtaaacaag

SEQ ID NO: 147151 - DNA, 25 bp, E. coli
gaattcgacgtagcggacgaactga

SEQ ID NO: 147152 - DNA, 25 bp, E. coli
gaattcgacgtaccggacgaactga

SEQ ID NO: 147153 - DNA, 25 bp, E. coli
cgaactggtgatcgcgctggttaaa

SEQ ID NO: 147154 - DNA, 25 bp, E. coli
cgatatgctgcgagctgcggtcaaa

SEQ ID NO: 147155 - DNA, 25 bp, E. coli
cgacgttaccggagaagaactgact

SEQ ID NO: 147156 - DNA, 25 bp, E. coli
cgacgttaccggtgaagaactgact

SEQ ID NO: 147157 - DNA, 25 bp, E. coli
cgaactggtgatggcgctggttaaa

SEQ ID NO: 147158 - DNA, 25 bp, E. coli
cgatatgctgcgtgctgcggtcaaa

SEQ ID NO: 147159 - DNA, 25 bp, E. coli
gtatcattctgcttggcgctccggg

SEQ ID NO: 147160 - DNA, 25 bp, E. coli
gtaccattccgcaggcagacgcgat

SEQ ID NO: 147161 - DNA, 25 bp, E. coli
gtaccattccgctggcagacgcgat

SEQ ID NO: 147162 - DNA, 25 bp, E. coli
gtatcattctgcatggcgctccggg

SEQ ID NO: 147163 - DNA, 25 bp, E. coli
ggactcaggctcagttcatcatgga

SEQ ID NO: 147164 - DNA, 25 bp, E. coli
ggactcaggctctgttcatcatgga

SEQ ID NO: 147165 - DNA, 25 bp, E. coli
cagtttatcgatgttaatgccccac

SEQ ID NO: 147166 - DNA, 25 bp, E. coli
catacgtaccaataagaaactggct

SEQ ID NO: 147167 - DNA, 25 bp, E. coli
cagtttatcgatcttaatgccccac

SEQ ID NO: 147168 - DNA, 25 bp, E. coli
catacgtaccaaaaagaaactggct

SEQ ID NO: 147169 - DNA, 25 bp, E. coli
tactcaaaaatagcgtcagtagcgg

SEQ ID NO: 147170 - DNA, 25 bp, E. coli
tactcaaaaataccgtcagtagcgg

SEQ ID NO: 147171 - DNA, 25 bp, E. coli
taaacgcgcgtttattttgagcctg

SEQ ID NO: 147172 - DNA, 25 bp, E. coli
taaacgcgcgttaattttgagcctg

SEQ ID NO: 147173 - DNA, 25 bp, E. coli
tatgaaaggcggatatcttgcggcc

SEQ ID NO: 147174 - DNA, 25 bp, E. coli
tatgaaaggcggttatcttgcggcc

SEQ ID NO: 147175 - DNA, 25 bp, E. coli
tattgatgtttcaggcatgggctgg

SEQ ID NO: 147176 - DNA, 25 bp, E. coli
tattgatgtttctggcatgggctgg

SEQ ID NO: 147177 - DNA, 25 bp, E. coli
tttgagcctgactaatccgaaagcc

SEQ ID NO: 147178 - DNA, 25 bp, E. coli
tttgagcctgacaaatccgaaagcc

SEQ ID NO: 147179 - DNA, 25 bp, E. coli
gcttttgtcacgcagtacatacgta

SEQ ID NO: 147180 - DNA, 25 bp, E. coli
gcttttgtcacggagtacatacgta

SEQ ID NO: 147181 - DNA, 25 bp, E. coli
gaattactggacgtatctggttggg

SEQ ID NO: 147182 - DNA, 25 bp, E. coli
gaattactggacctatctggttggg

SEQ ID NO: 147183 - DNA, 25 bp, E. coli
gacattaattaacaccaccccgata

SEQ ID NO: 147184 - DNA, 25 bp, E. coli
gacattaattaagaccaccccgata

SEQ ID NO: 147185 - DNA, 25 bp, E. coli
ccaaatccgatgtgccccaatacgg

SEQ ID NO: 147186 - DNA, 25 bp, E. coli
ccaaatccgatgagccccaatacgg

SEQ ID NO: 147187 - DNA, 25 bp, E. coli
cactctcgctggtagggcttatggc

SEQ ID NO: 147188 - DNA, 25 bp, E. coli
caaattctgggcctcactgacgctt

SEQ ID NO: 147189 - DNA, 25 bp, E. coli
cactctcgctggaagggcttatggc

SEQ ID NO: 147190 - DNA, 25 bp, E. coli
caaattctgggcgtcactgacgctt

SEQ ID NO: 147191 - DNA, 25 bp, E. coli
tatggcgttacaacccgatttggtc

SEQ ID NO: 147192 - DNA, 25 bp, E. coli
tatggcgttacatcccgatttggtc

SEQ ID NO: 147193 - DNA, 25 bp, E. coli
tgattgcggcaatacggatgaaacc

SEQ ID NO: 147194 - DNA, 25 bp, E. coli
tgattgcggcaaaacggatgaaacc

SEQ ID NO: 147195 - DNA, 25 bp, E. coli
tcgttggtgaaggtcaggcattcgc

SEQ ID NO: 147196 - DNA, 25 bp, E. coli
tcgttggtgaagctcaggcattcgc

SEQ ID NO: 147197 - DNA, 25 bp, E. coli
tcgttgcataccgaggcggcggaat

SEQ ID NO: 147198 - DNA, 25 bp, E. coli
tcgttgcatacccaggcggcggaat

SEQ ID NO: 147199 - DNA, 25 bp, E. coli
gcacggcaggttagcgaacagacac

SEQ ID NO: 147200 - DNA, 25 bp, E. coli
gcacggcaggtttgcgaacagacac

SEQ ID NO: 147201 - DNA, 25 bp, E. coli
gacggaggtttacacagattcttgc

SEQ ID NO: 147202 - DNA, 25 bp, E. coli
gatattattctggttcaggaggccg

SEQ ID NO: 147203 - DNA, 25 bp, E. coli
gattacgcagacttcacgcctggct

SEQ ID NO: 147204 - DNA, 25 bp, E. coli
gattacgcagacatcacgcctggct

SEQ ID NO: 147205 - DNA, 25 bp, E. coli
gatattattctgcttcaggaggccg

SEQ ID NO: 147206 - DNA, 25 bp, E. coli
tcaaccgtcttcagggattacgcag

SEQ ID NO: 147207 - DNA, 25 bp, E. coli
tcaaccgtcttctgggattacgcag

SEQ ID NO: 147208 - DNA, 25 bp, E. coli
gacggaggtttagacagattcttgc

SEQ ID NO: 147209 - DNA, 25 bp, E. coli
cagacggaagagtgaggcatcccgg

SEQ ID NO: 147210 - DNA, 25 bp, E. coli
catcccggtttcaggattttgtggc

SEQ ID NO: 147211 - DNA, 25 bp, E. coli
cagacggaagagagaggcatcccgg

SEQ ID NO: 147212 - DNA, 25 bp, E. coli
catcccggtttctggattttgtggc

SEQ ID NO: 147213 - DNA, 25 bp, E. coli
agacggaagagtcaggcatcccggt

SEQ ID NO: 147214 - DNA, 25 bp, E. coli
attttgtggcctgtggagacatgac

SEQ ID NO: 147215 - DNA, 25 bp, E. coli
agacggaagagtgaggcatcccggt

SEQ ID NO: 147216 - DNA, 25 bp, E. coli
attttgtggcctctggagacatgac

SEQ ID NO: 147217 - DNA, 25 bp, E. coli
tgaggcatcccgctttcaggatttt

SEQ ID NO: 147218 - DNA, 25 bp, E. coli
tgaggcatcccggtttcaggatttt

SEQ ID NO: 147219 - DNA, 25 bp, E. coli
tcaggattttgtcgcctgtggagac

SEQ ID NO: 147220 - DNA, 25 bp, E. coli
tcaggattttgtggcctgtggagac

SEQ ID NO: 147221 - DNA, 25 bp, E. coli
gcatcccggtttgaggattttgtgg

SEQ ID NO: 147222 - DNA, 25 bp, E. coli
gtcagacggaagtgtgaggcatccc

SEQ ID NO: 147223 - DNA, 25 bp, E. coli
gtcagacggaagagtgaggcatccc

SEQ ID NO: 147224 - DNA, 25 bp, E. coli
gcatcccggtttcaggattttgtgg

SEQ ID NO: 147225 - DNA, 25 bp, E. coli
gattttgtggccagtggagacatga

SEQ ID NO: 147226 - DNA, 25 bp, E. coli
gattttgtggcctgtggagacatga

SEQ ID NO: 147227 - DNA, 25 bp, E. coli
ggcatcccggtttcaggattttgtg

SEQ ID NO: 147228 - DNA, 25 bp, E. coli
ggcatcccggttacaggattttgtg

SEQ ID NO: 147229 - DNA, 25 bp, E. coli
tcagacggaagagtgaggcatcccg

SEQ ID NO: 147230 - DNA, 25 bp, E. coli
tcagacggaagactgaggcatcccg

SEQ ID NO: 147231 - DNA, 25 bp, E. coli
atggcgtaaggtatcgcgctctgca

SEQ ID NO: 147232 - DNA, 25 bp, E. coli
acgaggcagttgctgttgaagaact

SEQ ID NO: 147233 - DNA, 25 bp, E. coli
atggcgtaaggtttcgcgctctgca

SEQ ID NO: 147234 - DNA, 25 bp, E. coli
acgaggcagttggtgttgaagaact

SEQ ID NO: 147235 - DNA, 25 bp, E. coli
actatgtaagcagcataaggaatga

SEQ ID NO: 147236 - DNA, 25 bp, E. coli
actatgtaagcaccataaggaatga

SEQ ID NO: 147237 - DNA, 25 bp, E. coli
tttccggtgcgtaaggcaaaaggcg

SEQ ID NO: 147238 - DNA, 25 bp, E. coli
tatctggagcggcagcaatttccgg

SEQ ID NO: 147239 - DNA, 25 bp, E. coli
tatctggagcgggagcaatttccgg

SEQ ID NO: 147240 - DNA, 25 bp, E. coli
tttccggtgcgttaggcaaaaggcg

SEQ ID NO: 147241 - DNA, 25 bp, E. coli
gcggcaggcaaacggacgaggcagt

SEQ ID NO: 147242 - DNA, 25 bp, E. coli
gcggcaggcaaagggacgaggcagt

SEQ ID NO: 147243 - DNA, 25 bp, E. coli
gaagaactatgtaagcagcataagg

SEQ ID NO: 147244 - DNA, 25 bp, E. coli
gcaatttccggtccgtaaggcaaaa

SEQ ID NO: 147245 - DNA, 25 bp, E. coli
gcaatttccggtgcgtaaggcaaaa

SEQ ID NO: 147246 - DNA, 25 bp, E. coli
gaagaactatgttagcagcataagg

SEQ ID NO: 147247 - DNA, 25 bp, E. coli
cgtaaggcaaaaggcggcaggcaaa

SEQ ID NO: 147248 - DNA, 25 bp, E. coli
cgtaaggcaaaacgcggcaggcaaa

SEQ ID NO: 147249 - DNA, 25 bp, E. coli
gtgttgaagaactatgtaagcagca

SEQ ID NO: 147250 - DNA, 25 bp, E. coli
gtgttgaagaacaatgtaagcagca

SEQ ID NO: 147251 - DNA, 25 bp, E. coli
gatggcgtaaggattcgcgctctgc

SEQ ID NO: 147252 - DNA, 25 bp, E. coli
gatggcgtaaggtttcgcgctctgc

SEQ ID NO: 147253 - DNA, 25 bp, E. coli
aatgtatttatcaatcgcgaggcgg

SEQ ID NO: 147254 - DNA, 25 bp, E. coli
caatatctcggcctctggctgaagc

SEQ ID NO: 147255 - DNA, 25 bp, E. coli
caatatctcggcgtctggctgaagc

SEQ ID NO: 147256 - DNA, 25 bp, E. coli
aatgtatttatctatcgcgaggcgg

SEQ ID NO: 147257 - DNA, 25 bp, E. coli
aatattgaaaacctgcctgcgctgc

SEQ ID NO: 147258 - DNA, 25 bp, E. coli
aatattgaaaacgtgcctgcgctgc

SEQ ID NO: 147259 - DNA, 25 bp, E. coli
tacgaatgctttggcccgcataagg

SEQ ID NO: 147260 - DNA, 25 bp, E. coli
tacgaatgctttcgcccgcataagg

SEQ ID NO: 147261 - DNA, 25 bp, E. coli
agtgaactggttgcatgcggcagaa

SEQ ID NO: 147262 - DNA, 25 bp, E. coli
agttctatctctccggcccggttgg

SEQ ID NO: 147263 - DNA, 25 bp, E. coli
agttctatctctgcggcccggttgg

SEQ ID NO: 147264 - DNA, 25 bp, E. coli
agtgaactggttccatgcggcagaa

SEQ ID NO: 147265 - DNA, 25 bp, E. coli
tatcaccagcttcgaactggagccg

SEQ ID NO: 147266 - DNA, 25 bp, E. coli
tatcaccagcttggaactggagccg

SEQ ID NO: 147267 - DNA, 25 bp, E. coli
tctttgactcgctaaccggatggca

SEQ ID NO: 147268 - DNA, 25 bp, E. coli
tctttgactcgcaaaccggatggca

SEQ ID NO: 147269 - DNA, 25 bp, E. coli
ggtgcgttcagccatccgacaatgc

SEQ ID NO: 147270 - DNA, 25 bp, E. coli
ggtgcgttcagcgatccgacaatgc

SEQ ID NO: 147271 - DNA, 25 bp, E. coli
ggaacagtacaacatcgtcggtgaa

SEQ ID NO: 147272 - DNA, 25 bp, E. coli
ggaacagtacaagatcgtcggtgaa

SEQ ID NO: 147273 - DNA, 25 bp, E. coli
taatggcgatcaacgtgaagccctg

SEQ ID NO: 147274 - DNA, 25 bp, E. coli
taatggcgatcatcgtgaagccctg

SEQ ID NO: 147275 - DNA, 25 bp, E. coli
taaaaggttacgtgcaggccatgca

SEQ ID NO: 147276 - DNA, 25 bp, E. coli
taaaaggttacgagcaggccatgca

SEQ ID NO: 147277 - DNA, 25 bp, E. coli
agagattgccatggaagcgcgcgat

SEQ ID NO: 147278 - DNA, 25 bp, E. coli
agagattgccatcgaagcgcgcgat

SEQ ID NO: 147279 - DNA, 25 bp, E. coli
tgttcggtcacgacaaagcggagcg

SEQ ID NO: 147280 - DNA, 25 bp, E. coli
tgttcggtcacgtcaaagcggagcg

SEQ ID NO: 147281 - DNA, 25 bp, E. coli
tcgcgccaggactaagtgactatct

SEQ ID NO: 147282 - DNA, 25 bp, E. coli
tcgcgccaggacaaagtgactatct

SEQ ID NO: 147283 - DNA, 25 bp, E. coli
tctcgaaagcgctggatctgactga

SEQ ID NO: 147284 - DNA, 25 bp, E. coli
tctcgaaagcgcaggatctgactga

SEQ ID NO: 147285 - DNA, 25 bp, E. coli
gtctgtttagctacagccgccgcga

SEQ ID NO: 147286 - DNA, 25 bp, E. coli
gtctgtttagcttcagccgccgcga

SEQ ID NO: 147287 - DNA, 25 bp, E. coli
tggcgtaccgcaaaaaggcagtttc

SEQ ID NO: 147288 - DNA, 25 bp, E. coli
tggatgtggaaatcctgcgctttgc

SEQ ID NO: 147289 - DNA, 25 bp, E. coli
ggcgacacagttatccgggatgatc

SEQ ID NO: 147290 - DNA, 25 bp, E. coli
ggcgacacagttttccgggatgatc

SEQ ID NO: 147291 - DNA, 25 bp, E. coli
tggatgtggaaaacctgcgctttgc

SEQ ID NO: 147292 - DNA, 25 bp, E. coli
tggcgtaccgcataaaggcagtttc

SEQ ID NO: 147293 - DNA, 25 bp, E. coli
gatgatcccgtcaatgctaagcgcc

SEQ ID NO: 147294 - DNA, 25 bp, E. coli
gatgatcccgtctatgctaagcgcc

SEQ ID NO: 147295 - DNA, 25 bp, E. coli
gatcgatccggttgcttcgctggaa

SEQ ID NO: 147296 - DNA, 25 bp, E. coli
gatcgatccggtagcttcgctggaa

SEQ ID NO: 147297 - DNA, 25 bp, E. coli
ttcagaaagtgatcaacagcgccgt

SEQ ID NO: 147298 - DNA, 25 bp, E. coli
ttgagctcagcaaagaaacccgtcg

SEQ ID NO: 147299 - DNA, 25 bp, E. coli
ttgagctcagcatagaaacccgtcg

SEQ ID NO: 147300 - DNA, 25 bp, E. coli
ttcagaaagtgaacaacagcgccgt

SEQ ID NO: 147301 - DNA, 25 bp, E. coli
tgtcatgaaccgacagaagagcccc

SEQ ID NO: 147302 - DNA, 25 bp, E. coli
tgtcatgaaccgtcagaagagcccc

SEQ ID NO: 147303 - DNA, 25 bp, E. coli
tgatgacgcttaatcccagtgtgga

SEQ ID NO: 147304 - DNA, 25 bp, E. coli
tgactgattcaaggactggagcctg

SEQ ID NO: 147305 - DNA, 25 bp, E. coli
tgactgattcaacgactggagcctg

SEQ ID NO: 147306 - DNA, 25 bp, E. coli
tgatgacgcttattcccagtgtgga

SEQ ID NO: 147307 - DNA, 25 bp, E. coli
tccggaaggctcgatcaggctgaaa

SEQ ID NO: 147308 - DNA, 25 bp, E. coli
tccggaaggctccatcaggctgaaa

SEQ ID NO: 147309 - DNA, 25 bp, E. coli
gcccgtatatggtgatgatccccga

SEQ ID NO: 147310 - DNA, 25 bp, E. coli
gcccgtatatggagatgatccccga

SEQ ID NO: 147311 - DNA, 25 bp, E. coli
gcggccctggacaaactgaagatat

SEQ ID NO: 147312 - DNA, 25 bp, E. coli
gcggccctggactaactgaagatat

SEQ ID NO: 147313 - DNA, 25 bp, E. coli
gctgtatattgtctcgccggaaggt

SEQ ID NO: 147314 - DNA, 25 bp, E. coli
gctgtatattgtgtcgccggaaggt

SEQ ID NO: 147315 - DNA, 25 bp, E. coli
cgaactcatcttttccggcgggcat

SEQ ID NO: 147316 - DNA, 25 bp, E. coli
cgaactcatcttatccggcgggcat

SEQ ID NO: 147317 - DNA, 25 bp, E. coli
taatcgtgggcaggtgaatcaccgg

SEQ ID NO: 147318 - DNA, 25 bp, E. coli
taatcgtgggcacgtgaatcaccgg

SEQ ID NO: 147319 - DNA, 25 bp, E. coli
ctttttattgccgatcgcgttatgg

SEQ ID NO: 147320 - DNA, 25 bp, E. coli
ctttttattgcccatcgcgttatgg

SEQ ID NO: 147321 - DNA, 25 bp, E. coli
aaaattggctgtttattgttgctta

SEQ ID NO: 147322 - DNA, 25 bp, E. coli
aaaattggctgtatattgttgctta

SEQ ID NO: 147323 - DNA, 25 bp, E. coli
tatctcgggccgatggttatgattg

SEQ ID NO: 147324 - DNA, 25 bp, E. coli
ttctcgccggacacttaaaattggc

SEQ ID NO: 147325 - DNA, 25 bp, E. coli
tatctcgggccgttggttatgattg

SEQ ID NO: 147326 - DNA, 25 bp, E. coli
ttctcgccggactcttaaaattggc

SEQ ID NO: 147327 - DNA, 25 bp, E. coli
tgttgcttatagcaggagcaaccct

SEQ ID NO: 147328 - DNA, 25 bp, E. coli
tgttgcttataggaggagcaaccct

SEQ ID NO: 147329 - DNA, 25 bp, E. coli
gcaggagcaaccctttttattgccg

SEQ ID NO: 147330 - DNA, 25 bp, E. coli
gcatggctgtcccgcaaaagaataa

SEQ ID NO: 147331 - DNA, 25 bp, E. coli
gcaggagcaaccgtttttattgccg

SEQ ID NO: 147332 - DNA, 25 bp, E. coli
gcatggctgtccggcaaaagaataa

SEQ ID NO: 147333 - DNA, 25 bp, E. coli
gaaatggctgttagttagtggcgat

SEQ ID NO: 147334 - DNA, 25 bp, E. coli
gaaatggctgtttgttagtggcgat

SEQ ID NO: 147335 - DNA, 25 bp, E. coli
cgttatggtcaacgccagccaacaa

SEQ ID NO: 147336 - DNA, 25 bp, E. coli
cgttatggtcaaggccagccaacaa

SEQ ID NO: 147337 - DNA, 25 bp, E. coli
gctgttagttagaggcgataacgga

SEQ ID NO: 147338 - DNA, 25 bp, E. coli
gccgttggttatgattgggccgttt

SEQ ID NO: 147339 - DNA, 25 bp, E. coli
gccgttggttatcattgggccgttt

SEQ ID NO: 147340 - DNA, 25 bp, E. coli
gctgttagttagtggcgataacgga

SEQ ID NO: 147341 - DNA, 25 bp, E. coli
caaactttacgaacgcgtgccggct

SEQ ID NO: 147342 - DNA, 25 bp, E. coli
caaactttacgatcgcgtgccggct

SEQ ID NO: 147343 - DNA, 25 bp, E. coli
taaagtaacgagtgacgaatggaag

SEQ ID NO: 147344 - DNA, 25 bp, E. coli
taaaaccagagctgttccgtcgttg

SEQ ID NO: 147345 - DNA, 25 bp, E. coli
ttgcagcataaactaacgagagacg

SEQ ID NO: 147346 - DNA, 25 bp, E. coli
ttgcagcataaagtaacgagagacg

SEQ ID NO: 147347 - DNA, 25 bp, E. coli
tccgtcgttgttgatcccgggagac

SEQ ID NO: 147348 - DNA, 25 bp, E. coli
tccgtcgttgttcatcccgggagac

SEQ ID NO: 147349 - DNA, 25 bp, E. coli
gcgtgccggcttccgtctggaaata

SEQ ID NO: 147350 - DNA, 25 bp, E. coli
gcgtgccggcttgcgtctggaaata

SEQ ID NO: 147351 - DNA, 25 bp, E. coli
gacgaatggaagttaaaaccagagc

SEQ ID NO: 147352 - DNA, 25 bp, E. coli
gacgaatggaagataaaaccagagc

SEQ ID NO: 147353 - DNA, 25 bp, E. coli
tggaaaaagtgattacccgcacacg

SEQ ID NO: 147354 - DNA, 25 bp, E. coli
tggaaaaagtgaatacccgcacacg

SEQ ID NO: 147355 - DNA, 25 bp, E. coli
ggcttccgtctggaaatatgtcacc

SEQ ID NO: 147356 - DNA, 25 bp, E. coli
ggcttccgtctgcaaatatgtcacc

SEQ ID NO: 147357 - DNA, 25 bp, E. coli
taaaaccagagcagttccgtcgttg

SEQ ID NO: 147358 - DNA, 25 bp, E. coli
taaagtaacgagagacgaatggaag

SEQ ID NO: 147359 - DNA, 25 bp, E. coli
gagacgctggaataagtgattaccc

SEQ ID NO: 147360 - DNA, 25 bp, E. coli
gagacgctggaaaaagtgattaccc

SEQ ID NO: 147361 - DNA, 25 bp, E. coli
gattacccgcactcgttataaactt

SEQ ID NO: 147362 - DNA, 25 bp, E. coli
gattacccgcacacgttataaactt

SEQ ID NO: 147363 - DNA, 25 bp, E. coli
aatgccgattgtcagccgccttgat

SEQ ID NO: 147364 - DNA, 25 bp, E. coli
aatgccgattgtgagccgccttgat

SEQ ID NO: 147365 - DNA, 25 bp, E. coli
agtcatggcgggtaactgaacctga

SEQ ID NO: 147366 - DNA, 25 bp, E. coli
agtcatggcgggaaactgaacctga

SEQ ID NO: 147367 - DNA, 25 bp, E. coli
tatagcgcaggtcgcctggatatcc

SEQ ID NO: 147368 - DNA, 25 bp, E. coli
tatagcgcaggtggcctggatatcc

SEQ ID NO: 147369 - DNA, 25 bp, E. coli
tgtgagccgcctagatgcagaaaat

SEQ ID NO: 147370 - DNA, 25 bp, E. coli
tgtgagccgccttgatgcagaaaat

SEQ ID NO: 147371 - DNA, 25 bp, E. coli
tcgcctggatatgcccgaacttctg

SEQ ID NO: 147372 - DNA, 25 bp, E. coli
tcgcctggatatccccgaacttctg

SEQ ID NO: 147373 - DNA, 25 bp, E. coli
gcgtgatctggtaaacgatcaggga

SEQ ID NO: 147374 - DNA, 25 bp, E. coli
gcgtgatctggttaacgatcaggga

SEQ ID NO: 147375 - DNA, 25 bp, E. coli
gaagcgcgtgatctggttaacgatc

SEQ ID NO: 147376 - DNA, 25 bp, E. coli
gaagcgcgtgatgtggttaacgatc

SEQ ID NO: 147377 - DNA, 25 bp, E. coli
cgaacttctggattacgcccagtca

SEQ ID NO: 147378 - DNA, 25 bp, E. coli
cgaacttctggaatacgcccagtca

SEQ ID NO: 147379 - DNA, 25 bp, E. coli
cattaatgccgattgtgagccgcct

SEQ ID NO: 147380 - DNA, 25 bp, E. coli
cattaatgccgaatgtgagccgcct

SEQ ID NO: 147381 - DNA, 25 bp, E. coli
gattacgcccagacatggcgggaaa

SEQ ID NO: 147382 - DNA, 25 bp, E. coli
gattacgcccagtcatggcgggaaa

SEQ ID NO: 147383 - DNA, 25 bp, E. coli
tgcggtggttactggaggaaaatac

SEQ ID NO: 147384 - DNA, 25 bp, E. coli
tgcggtggttacaggaggaaaatac

SEQ ID NO: 147385 - DNA, 25 bp, E. coli
tacgactcgcactaaggaccggttg

SEQ ID NO: 147386 - DNA, 25 bp, E. coli
tacgactcgcacaaaggaccggttg

SEQ ID NO: 147387 - DNA, 25 bp, E. coli
aaatctatcgctacccggtttcgca

SEQ ID NO: 147388 - DNA, 25 bp, E. coli
aaatctatcgcttcccggtttcgca

SEQ ID NO: 147389 - DNA, 25 bp, E. coli
ttatgtccggtacggcggcagaaat

SEQ ID NO: 147390 - DNA, 25 bp, E. coli
ttatgtccggtagggcggcagaaat

SEQ ID NO: 147391 - DNA, 25 bp, E. coli
tgcatgtgatgtcgcacgcgctgca

SEQ ID NO: 147392 - DNA, 25 bp, E. coli
tgcatgtgatgtggcacgcgctgca

SEQ ID NO: 147393 - DNA, 25 bp, E. coli
tctctgaaggcgcaggcgaaaacct

SEQ ID NO: 147394 - DNA, 25 bp, E. coli
tctctgaaggcggaggcgaaaacct

SEQ ID NO: 147395 - DNA, 25 bp, E. coli
gccatcgtgagcttatgcagcgtct

SEQ ID NO: 147396 - DNA, 25 bp, E. coli
gccatcgtgagcatatgcagcgtct

SEQ ID NO: 147397 - DNA, 25 bp, E. coli
gaaggcatccgttgctacgactcgc

SEQ ID NO: 147398 - DNA, 25 bp, E. coli
gaaggcatccgtagctacgactcgc

SEQ ID NO: 147399 - DNA, 25 bp, E. coli
cgccgccacggttatcaggaaggta

SEQ ID NO: 147400 - DNA, 25 bp, E. coli
ccggtttcgcagagcattgatgagc

SEQ ID NO: 147401 - DNA, 25 bp, E. coli
cgccgccacggtaatcaggaaggta

SEQ ID NO: 147402 - DNA, 25 bp, E. coli
ccggtttcgcagtgcattgatgagc

SEQ ID NO: 147403 - DNA, 25 bp, E. coli
gaccggttgtattccgccatcgtga

SEQ ID NO: 147404 - DNA, 25 bp, E. coli
gatggtttcctcctggaaccgcgca

SEQ ID NO: 147405 - DNA, 25 bp, E. coli
gaccggttgtataccgccatcgtga

SEQ ID NO: 147406 - DNA, 25 bp, E. coli
gatggtttcctcgtggaaccgcgca

SEQ ID NO: 147407 - DNA, 25 bp, E. coli
caacggtatttccatcgacggtgaa

SEQ ID NO: 147408 - DNA, 25 bp, E. coli
caacggtatttcgatcgacggtgaa

SEQ ID NO: 147409 - DNA, 25 bp, E. coli
actgaagaacttccgtcagttgcat

SEQ ID NO: 147410 - DNA, 25 bp, E. coli
acaacggtatttgcatcgacggtga

SEQ ID NO: 147411 - DNA, 25 bp, E. coli
actgaagaacttgcgtcagttgcat

SEQ ID NO: 147412 - DNA, 25 bp, E. coli
acaacggtatttccatcgacggtga

SEQ ID NO: 147413 - DNA, 25 bp, E. coli
ttccgtcagttggattcgaaaaccc

SEQ ID NO: 147414 - DNA, 25 bp, E. coli
ttccgtcagttgcattcgaaaaccc

SEQ ID NO: 147415 - DNA, 25 bp, E. coli
ttacgggccgatcctgcctgagttg

SEQ ID NO: 147416 - DNA, 25 bp, E. coli
ttacgggccgatgctgcctgagttg

SEQ ID NO: 147417 - DNA, 25 bp, E. coli
tgctgcctgagtagctcggcggttc

SEQ ID NO: 147418 - DNA, 25 bp, E. coli
tgctgcctgagttgctcggcggttc

SEQ ID NO: 147419 - DNA, 25 bp, E. coli
gaagaacttccgtcagttgcattcg

SEQ ID NO: 147420 - DNA, 25 bp, E. coli
gaagaacttccgacagttgcattcg

SEQ ID NO: 147421 - DNA, 25 bp, E. coli
gaacttccgtcacttgcattcgaaa

SEQ ID NO: 147422 - DNA, 25 bp, E. coli
gaacttccgtcagttgcattcgaaa

SEQ ID NO: 147423 - DNA, 25 bp, E. coli
ccgatgctgcctgagttgctcggcg

SEQ ID NO: 147424 - DNA, 25 bp, E. coli
ccgatgctgcctcagttgctcggcg

SEQ ID NO: 147425 - DNA, 25 bp, E. coli
cgggccgatgctgcctgagttgctc

SEQ ID NO: 147426 - DNA, 25 bp, E. coli
cgggccgatgctccctgagttgctc

SEQ ID NO: 147427 - DNA, 25 bp, E. coli
tcacaacggtatatccatcgacggt

SEQ ID NO: 147428 - DNA, 25 bp, E. coli
tcacaacggtatttccatcgacggt

SEQ ID NO: 147429 - DNA, 25 bp, E. coli
caaggccggcctagagtttcagaca

SEQ ID NO: 147430 - DNA, 25 bp, E. coli
caaggccggccttgagtttcagaca

SEQ ID NO: 147431 - DNA, 25 bp, E. coli
aattcagatagaagaagcgcgggcc

SEQ ID NO: 147432 - DNA, 25 bp, E. coli
aattcagatagatgaagcgcgggcc

SEQ ID NO: 147433 - DNA, 25 bp, E. coli
catcgagtgcctgacggtttgccac

SEQ ID NO: 147434 - DNA, 25 bp, E. coli
catcgagtgcctcacggtttgccac

SEQ ID NO: 147435 - DNA, 25 bp, E. coli
tatgggcaaaaagaagcaaggccgg

SEQ ID NO: 147436 - DNA, 25 bp, E. coli
tatgggcaaaaacaagcaaggccgg

SEQ ID NO: 147437 - DNA, 25 bp, E. coli
ttaacaaacgcagtatgggacccca

SEQ ID NO: 147438 - DNA, 25 bp, E. coli
ttaacaaacgcactatgggacccca

SEQ ID NO: 147439 - DNA, 25 bp, E. coli
tgaagacgctatcgctgactggatg

SEQ ID NO: 147440 - DNA, 25 bp, E. coli
tgaagacgctatggctgactggatg

SEQ ID NO: 147441 - DNA, 25 bp, E. coli
tcatgcggagcagaaaaccacgtgg

SEQ ID NO: 147442 - DNA, 25 bp, E. coli
tcatgcggagcacaaaaccacgtgg

SEQ ID NO: 147443 - DNA, 25 bp, E. coli
gctataacccggagaatcaggccag

SEQ ID NO: 147444 - DNA, 25 bp, E. coli
gctataacccggtgaatcaggccag

SEQ ID NO: 147445 - DNA, 25 bp, E. coli
tacatcgcaatttcgaccgaccggg

SEQ ID NO: 147446 - DNA, 25 bp, E. coli
taacaagtcagagggctatggccag

SEQ ID NO: 147447 - DNA, 25 bp, E. coli
taacaagtcagacggctatggccag

SEQ ID NO: 147448 - DNA, 25 bp, E. coli
tacatcgcaattacgaccgaccggg

SEQ ID NO: 147449 - DNA, 25 bp, E. coli
gatgtggccttacactttcgcgagg

SEQ ID NO: 147450 - DNA, 25 bp, E. coli
gatgtggccttagactttcgcgagg

SEQ ID NO: 147451 - DNA, 25 bp, E. coli
cataacatcgctttcgtggtggtga

SEQ ID NO: 147452 - DNA, 25 bp, E. coli
cattacgagccagttacagcaatta

SEQ ID NO: 147453 - DNA, 25 bp, E. coli
catcgctttcgtcgtggtgaatatc

SEQ ID NO: 147454 - DNA, 25 bp, E. coli
cataacatcgctatcgtggtggtga

SEQ ID NO: 147455 - DNA, 25 bp, E. coli
catcgctttcgtggtggtgaatatc

SEQ ID NO: 147456 - DNA, 25 bp, E. coli
tacgagccagtttcagcaattaaac

SEQ ID NO: 147457 - DNA, 25 bp, E. coli
tacgagccagttacagcaattaaac

SEQ ID NO: 147458 - DNA, 25 bp, E. coli
aagcgacttgttaaccattacgagc

SEQ ID NO: 147459 - DNA, 25 bp, E. coli
aagcgacttgtttaccattacgagc

SEQ ID NO: 147460 - DNA, 25 bp, E. coli
tgttaaccattacgagccagttaca

SEQ ID NO: 147461 - DNA, 25 bp, E. coli
tgttaaccattaggagccagttaca

SEQ ID NO: 147462 - DNA, 25 bp, E. coli
tcgctttcgtggaggtgaatatcaa

SEQ ID NO: 147463 - DNA, 25 bp, E. coli
tcgctttcgtggtggtgaatatcaa

SEQ ID NO: 147464 - DNA, 25 bp, E. coli
gctttcgtggtggtgaatatcaata

SEQ ID NO: 147465 - DNA, 25 bp, E. coli
gctttcgtggtgctgaatatcaata

SEQ ID NO: 147466 - DNA, 25 bp, E. coli
gacttgttaaccattacgagccagt

SEQ ID NO: 147467 - DNA, 25 bp, E. coli
taaccattacgacccagttacagca

SEQ ID NO: 147468 - DNA, 25 bp, E. coli
taaccattacgagccagttacagca

SEQ ID NO: 147469 - DNA, 25 bp, E. coli
gacttgttaacctttacgagccagt

SEQ ID NO: 147470 - DNA, 25 bp, E. coli
cattacgagccacttacagcaatta

SEQ ID NO: 147471 - DNA, 25 bp, E. coli
gagccagttacagcaattaaacggt

SEQ ID NO: 147472 - DNA, 25 bp, E. coli
gagccagttacaccaattaaacggt

SEQ ID NO: 147473 - DNA, 25 bp, E. coli
caaaggcgctgatggcgtgctgatc

SEQ ID NO: 147474 - DNA, 25 bp, E. coli
caaaggcgctgaaggcgtgctgatc

SEQ ID NO: 147475 - DNA, 25 bp, E. coli
catctgccgatcaaaggcgctgatg

SEQ ID NO: 147476 - DNA, 25 bp, E. coli
catctgccgatctaaggcgctgatg

SEQ ID NO: 147477 - DNA, 25 bp, E. coli
atcaaaggcgctcatggcgtgctga

SEQ ID NO: 147478 - DNA, 25 bp, E. coli
accggcgactcatagccacgggcat

SEQ ID NO: 147479 - DNA, 25 bp, E. coli
atcaaaggcgctgatggcgtgctga

SEQ ID NO: 147480 - DNA, 25 bp, E. coli
accggcgactcaaagccacgggcat

SEQ ID NO: 147481 - DNA, 25 bp, E. coli
aaagccacgggcttctgccgatcaa

SEQ ID NO: 147482 - DNA, 25 bp, E. coli
aaagccacgggcatctgccgatcaa

SEQ ID NO: 147483 - DNA, 25 bp, E. coli
tctgccgatcaaaggcgctgatggc

SEQ ID NO: 147484 - DNA, 25 bp, E. coli
tctgccgatcaatggcgctgatggc

SEQ ID NO: 147485 - DNA, 25 bp, E. coli
gccacgggcatctgccgatcaaagg

SEQ ID NO: 147486 - DNA, 25 bp, E. coli
gccacgggcatcagccgatcaaagg

SEQ ID NO: 147487 - DNA, 25 bp, E. coli
gcgactcaaagcgacgggcatctgc

SEQ ID NO: 147488 - DNA, 25 bp, E. coli
gcgactcaaagccacgggcatctgc

SEQ ID NO: 147489 - DNA, 25 bp, E. coli
ctgccgatcaaacgcgctgatggcg

SEQ ID NO: 147490 - DNA, 25 bp, E. coli
ctgccgatcaaaggcgctgatggcg

SEQ ID NO: 147491 - DNA, 25 bp, E. coli
cgggcatctgcccatcaaaggcgct

SEQ ID NO: 147492 - DNA, 25 bp, E. coli
cgggcatctgccgatcaaaggcgct

SEQ ID NO: 147493 - DNA, 25 bp, E. coli
ggcatctgccgatcaaaggcgctga

SEQ ID NO: 147494 - DNA, 25 bp, E. coli
ggcatctgccgaacaaaggcgctga

SEQ ID NO: 147495 - DNA, 25 bp, E. coli
cagtattaagctcacccgcgagcgt

SEQ ID NO: 147496 - DNA, 25 bp, E. coli
cagtattaagctgacccgcgagcgt

SEQ ID NO: 147497 - DNA, 25 bp, E. coli
aaatcagcggcgtagtggcaaaacc

SEQ ID NO: 147498 - DNA, 25 bp, E. coli
aaatcagcggcgaagtggcaaaacc

SEQ ID NO: 147499 - DNA, 25 bp, E. coli
tatttatcgtatccgctgcgtggaa

SEQ ID NO: 147500 - DNA, 25 bp, E. coli
tattctttatgatgcgtcggcaggt

SEQ ID NO: 147501 - DNA, 25 bp, E. coli
tatttatcgtatgcgctgcgtggaa

SEQ ID NO: 147502 - DNA, 25 bp, E. coli
tattctttatgaagcgtcggcaggt

SEQ ID NO: 147503 - DNA, 25 bp, E. coli
tggtcacaggcttccgaacgattta

SEQ ID NO: 147504 - DNA, 25 bp, E. coli
tggtcacaggctaccgaacgattta

SEQ ID NO: 147505 - DNA, 25 bp, E. coli
tgaaaaccgatcgatggacactgaa

SEQ ID NO: 147506 - DNA, 25 bp, E. coli
tgaaaaccgatccatggacactgaa

SEQ ID NO: 147507 - DNA, 25 bp, E. coli
gcgtctcgacgaagcaatgcatccg

SEQ ID NO: 147508 - DNA, 25 bp, E. coli
gcgtctcgacgatgcaatgcatccg

SEQ ID NO: 147509 - DNA, 25 bp, E. coli
gaatcagatgttacggccgagtcgg

SEQ ID NO: 147510 - DNA, 25 bp, E. coli
gcatcgctgtatggtggcctggatt

SEQ ID NO: 147511 - DNA, 25 bp, E. coli
gcatcgctgtatcgtggcctggatt

SEQ ID NO: 147512 - DNA, 25 bp, E. coli
gaatcagatgtttcggccgagtcgg

SEQ ID NO: 147513 - DNA, 25 bp, E. coli
gaacgatttattggttcaggcggca

SEQ ID NO: 147514 - DNA, 25 bp, E. coli
gaacgatttattcgttcaggcggca

SEQ ID NO: 147515 - DNA, 25 bp, E. coli
ctaatgctggtaccctgaaaaccga

SEQ ID NO: 147516 - DNA, 25 bp, E. coli
ctaatgctggtagcctgaaaaccga

SEQ ID NO: 147517 - DNA, 25 bp, E. coli
aagtcgatatggtcgatgttttccg

SEQ ID NO: 147518 - DNA, 25 bp, E. coli
aagtcgatatggacgatgttttccg

SEQ ID NO: 147519 - DNA, 25 bp, E. coli
tattgcaggcatattaacgtccact

SEQ ID NO: 147520 - DNA, 25 bp, E. coli
tttaacgtccactcacaccattgcg

SEQ ID NO: 147521 - DNA, 25 bp, E. coli
tattgcaggcattttaacgtccact

SEQ ID NO: 147522 - DNA, 25 bp, E. coli
tttaacgtccacacacaccattgcg

SEQ ID NO: 147523 - DNA, 25 bp, E. coli
tcattccggtttcgccaaaagttgc

SEQ ID NO: 147524 - DNA, 25 bp, E. coli
tgatgaaatatcaactcgaccaggg

SEQ ID NO: 147525 - DNA, 25 bp, E. coli
tgatgaaatatctactcgaccaggg

SEQ ID NO: 147526 - DNA, 25 bp, E. coli
tcattccggtttggccaaaagttgc

SEQ ID NO: 147527 - DNA, 25 bp, E. coli
tgaaagaaaccgatattgcaggcat

SEQ ID NO: 147528 - DNA, 25 bp, E. coli
tgaaagaaaccgttattgcaggcat

SEQ ID NO: 147529 - DNA, 25 bp, E. coli
tcgctgcccggctattgagatccct

SEQ ID NO: 147530 - DNA, 25 bp, E. coli
tcgctgcccggcaattgagatccct

SEQ ID NO: 147531 - DNA, 25 bp, E. coli
gattaatgagcaagcggcagtactg

SEQ ID NO: 147532 - DNA, 25 bp, E. coli
gattaatgagcatgcggcagtactg

SEQ ID NO: 147533 - DNA, 25 bp, E. coli
gggcaagcgacatacccgatcgtcc

SEQ ID NO: 147534 - DNA, 25 bp, E. coli
gggtatcacgtctttccggtttcgc

SEQ ID NO: 147535 - DNA, 25 bp, E. coli
gggtatcacgtcattccggtttcgc

SEQ ID NO: 147536 - DNA, 25 bp, E. coli
gggcaagcgacaaacccgatcgtcc

SEQ ID NO: 147537 - DNA, 25 bp, E. coli
gtgatggatcgcagcccggctattg

SEQ ID NO: 147538 - DNA, 25 bp, E. coli
gtgatggatcgctgcccggctattg

SEQ ID NO: 147539 - DNA, 25 bp, E. coli
cacaaacagttgctgatggtggcgc

SEQ ID NO: 147540 - DNA, 25 bp, E. coli
cacaaacagttggtgatggtggcgc

SEQ ID NO: 147541 - DNA, 25 bp, E. coli
catatcaccgtaggctggcagcgag

SEQ ID NO: 147542 - DNA, 25 bp, E. coli
catgagttacgtacgccattgaccg

SEQ ID NO: 147543 - DNA, 25 bp, E. coli
catgagttacgttcgccattgaccg

SEQ ID NO: 147544 - DNA, 25 bp, E. coli
catatcaccgtacgctggcagcgag

SEQ ID NO: 147545 - DNA, 25 bp, E. coli
taaacgctttcgaagcggcgcggag

SEQ ID NO: 147546 - DNA, 25 bp, E. coli
taaacgctttcgtagcggcgcggag

SEQ ID NO: 147547 - DNA, 25 bp, E. coli
tatacggcttactccagatgcagct

SEQ ID NO: 147548 - DNA, 25 bp, E. coli
tataacgccgtgaatcatacgccgg

SEQ ID NO: 147549 - DNA, 25 bp, E. coli
tatacggcttacaccagatgcagct

SEQ ID NO: 147550 - DNA, 25 bp, E. coli
tataacgccgtgtatcatacgccgg

SEQ ID NO: 147551 - DNA, 25 bp, E. coli
ttgataaagcgccttcccggcaaac

SEQ ID NO: 147552 - DNA, 25 bp, E. coli
ttgataaagcgcgttcccggcaaac

SEQ ID NO: 147553 - DNA, 25 bp, E. coli
gaaaaagcgttgcacaccatgcgcg

SEQ ID NO: 147554 - DNA, 25 bp, E. coli
gaaaaagcgttggacaccatgcgcg

SEQ ID NO: 147555 - DNA, 25 bp, E. coli
ggcaacgaagatgagctacgcagtg

SEQ ID NO: 147556 - DNA, 25 bp, E. coli
ggcaacgaagatcagctacgcagtg

SEQ ID NO: 147557 - DNA, 25 bp, E. coli
tcaatctggtgctcaacaccgggcg

SEQ ID NO: 147558 - DNA, 25 bp, E. coli
tcaatctggtgcacaacaccgggcg

SEQ ID NO: 147559 - DNA, 25 bp, E. coli
tcacgcaaatgcatcaactggaagg

SEQ ID NO: 147560 - DNA, 25 bp, E. coli
tcacgcaaatgcttcaactggaagg

SEQ ID NO: 147561 - DNA, 25 bp, E. coli
aatcgcagcgtgaaggccagataag

SEQ ID NO: 147562 - DNA, 25 bp, E. coli
aatcgcagcgtgtaggccagataag

SEQ ID NO: 147563 - DNA, 25 bp, E. coli
caggcgttacataccggatgcggct

SEQ ID NO: 147564 - DNA, 25 bp, E. coli
caggcgttacattccggatgcggct

SEQ ID NO: 147565 - DNA, 25 bp, E. coli
tacaaaatcgcagcgcgtaggcctg

SEQ ID NO: 147566 - DNA, 25 bp, E. coli
tacaaaatcgcagcgtgtaggccag

SEQ ID NO: 147567 - DNA, 25 bp, E. coli
tacaaaatcgcagcgtgtaggcctg

SEQ ID NO: 147568 - DNA, 25 bp, E. coli
tacaaaatcgcaccgtgtaggccag

SEQ ID NO: 147569 - DNA, 25 bp, E. coli
tacaaaatcgcaccgtgtaggcctg

SEQ ID NO: 147570 - DNA, 25 bp, E. coli
tacaaaatcgcaccgcgtaggcctg

SEQ ID NO: 147571 - DNA, 25 bp, E. coli
aaaatcgcagcgtgtaggcctgata

SEQ ID NO: 147572 - DNA, 25 bp, E. coli
aaaatcgcagcgagtaggcctgata

SEQ ID NO: 147573 - DNA, 25 bp, E. coli
ttcgtgccggatgcgctttgcttat

SEQ ID NO: 147574 - DNA, 25 bp, E. coli
ttgactccttcgtgccggatgcgct

SEQ ID NO: 147575 - DNA, 25 bp, E. coli
ttgactccttcgagccggatgcgct

SEQ ID NO: 147576 - DNA, 25 bp, E. coli
ttcgtgccggatccgctttgcttat

SEQ ID NO: 147577 - DNA, 25 bp, E. coli
tgaatgccggatgcgctttgcttat

SEQ ID NO: 147578 - DNA, 25 bp, E. coli
tgaatgccggatccgctttgcttat

SEQ ID NO: 147579 - DNA, 25 bp, E. coli
tcgcatcaggcgttacataccggat

SEQ ID NO: 147580 - DNA, 25 bp, E. coli
tcgcatcaggcgatacataccggat

SEQ ID NO: 147581 - DNA, 25 bp, E. coli
cgttgaatgccggatgcgctttgct

SEQ ID NO: 147582 - DNA, 25 bp, E. coli
cgttgaatgccgcatgcgctttgct

SEQ ID NO: 147583 - DNA, 25 bp, E. coli
cacttacttgactatctttggccgg

SEQ ID NO: 147584 - DNA, 25 bp, E. coli
caacaaagcgcacttacttgacaat

SEQ ID NO: 147585 - DNA, 25 bp, E. coli
cacttacttgacaatctttggccgg

SEQ ID NO: 147586 - DNA, 25 bp, E. coli
caacaaagcgcagttacttgacaat

SEQ ID NO: 147587 - DNA, 25 bp, E. coli
tacttgacaatcattggccggatgg

SEQ ID NO: 147588 - DNA, 25 bp, E. coli
tacttgacaatctttggccggatgg

SEQ ID NO: 147589 - DNA, 25 bp, E. coli
atggccggatggtattacccacccg

SEQ ID NO: 147590 - DNA, 25 bp, E. coli
atggtattacccacccggcctgaga

SEQ ID NO: 147591 - DNA, 25 bp, E. coli
tggccggatggtattacccacccgg

SEQ ID NO: 147592 - DNA, 25 bp, E. coli
atggccggatggaattacccacccg

SEQ ID NO: 147593 - DNA, 25 bp, E. coli
tggccggatggttttacccacccgg

SEQ ID NO: 147594 - DNA, 25 bp, E. coli
atggtattaccctcccggcctgaga

SEQ ID NO: 147595 - DNA, 25 bp, E. coli
ttgcgatgttttgtaggacggataa

SEQ ID NO: 147596 - DNA, 25 bp, E. coli
ttgcgatgttttctaggacggataa

SEQ ID NO: 147597 - DNA, 25 bp, E. coli
tgaaaatggccgcatggtattaccc

SEQ ID NO: 147598 - DNA, 25 bp, E. coli
tgaaaatggccggatggtattaccc

SEQ ID NO: 147599 - DNA, 25 bp, E. coli
tctttggccggatggtattacccac

SEQ ID NO: 147600 - DNA, 25 bp, E. coli
tctttggccggaaggtattacccac

SEQ ID NO: 147601 - DNA, 25 bp, E. coli
gaatttgcgatgttttgtaggacgg

SEQ ID NO: 147602 - DNA, 25 bp, E. coli
gaatttgcgatgatttgtaggacgg

SEQ ID NO: 147603 - DNA, 25 bp, E. coli
ggcctacaagtgcattgcaatctat

SEQ ID NO: 147604 - DNA, 25 bp, E. coli
ggcctacaagtggattgcaatctat

SEQ ID NO: 147605 - DNA, 25 bp, E. coli
caccttccggttcatggcgcaaaac

SEQ ID NO: 147606 - DNA, 25 bp, E. coli
caccttccggttgatggcgcaaaac

SEQ ID NO: 147607 - DNA, 25 bp, E. coli
cattttaatcctgagcgtgcgacgt

SEQ ID NO: 147608 - DNA, 25 bp, E. coli
aaccgttgccgtgtgggatcctgaa

SEQ ID NO: 147609 - DNA, 25 bp, E. coli
aaccgttgccgtctgggatcctgaa

SEQ ID NO: 147610 - DNA, 25 bp, E. coli
caacgggcatttcttttgggcggca

SEQ ID NO: 147611 - DNA, 25 bp, E. coli
caacgggcatttgttttgggcggca

SEQ ID NO: 147612 - DNA, 25 bp, E. coli
ttaaagcagagcgtcagtcggtacc

SEQ ID NO: 147613 - DNA, 25 bp, E. coli
ttaaagcagagcctcagtcggtacc

SEQ ID NO: 147614 - DNA, 25 bp, E. coli
tctcgaaaactgcaatcgcccgtgg

SEQ ID NO: 147615 - DNA, 25 bp, E. coli
tctcgaaaactggaatcgcccgtgg

SEQ ID NO: 147616 - DNA, 25 bp, E. coli
gctcgacggacaccataaggctact

SEQ ID NO: 147617 - DNA, 25 bp, E. coli
gctcgacggacagcataaggctact

SEQ ID NO: 147618 - DNA, 25 bp, E. coli
gctgaaaaatactgctgcgggcgtc

SEQ ID NO: 147619 - DNA, 25 bp, E. coli
gctgaaaaatacagctgcgggcgtc

SEQ ID NO: 147620 - DNA, 25 bp, E. coli
gaagatcgtgaactttacccgacgg

SEQ ID NO: 147621 - DNA, 25 bp, E. coli
gaagatcgtgaagtttacccgacgg

SEQ ID NO: 147622 - DNA, 25 bp, E. coli
gaaaacctgaagtacgtctgctgaa

SEQ ID NO: 147623 - DNA, 25 bp, E. coli
gaaaacctgaagaacgtctgctgaa

SEQ ID NO: 147624 - DNA, 25 bp, E. coli
cattttaatcctcagcgtgcgacgt

SEQ ID NO: 147625 - DNA, 25 bp, E. coli
taatacgtttctggtccgaggctgg

SEQ ID NO: 147626 - DNA, 25 bp, E. coli
taatacgtttctcgtccgaggctgg

SEQ ID NO: 147627 - DNA, 25 bp, E. coli
catgcaggcataccgattgatgtgc

SEQ ID NO: 147628 - DNA, 25 bp, E. coli
catgcaggcatagcgattgatgtgc

SEQ ID NO: 147629 - DNA, 25 bp, E. coli
tgatgtgcatatcgtctcgcctgac

SEQ ID NO: 147630 - DNA, 25 bp, E. coli
tgcaacgagtatgttgacacgtaca

SEQ ID NO: 147631 - DNA, 25 bp, E. coli
tgatgtgcatatggtctcgcctgac

SEQ ID NO: 147632 - DNA, 25 bp, E. coli
tgcaacgagtatcttgacacgtaca

SEQ ID NO: 147633 - DNA, 25 bp, E. coli
gcatacatgaacaacaagccgtgat

SEQ ID NO: 147634 - DNA, 25 bp, E. coli
gcatacatgaactacaagccgtgat

SEQ ID NO: 147635 - DNA, 25 bp, E. coli
gaatctggaaatgggctactcccca

SEQ ID NO: 147636 - DNA, 25 bp, E. coli
gaatctggaaatcggctactcccca

SEQ ID NO: 147637 - DNA, 25 bp, E. coli
gaaagtattcagaccgtacgtgcca

SEQ ID NO: 147638 - DNA, 25 bp, E. coli
gacacgtacatttccggaatctgga

SEQ ID NO: 147639 - DNA, 25 bp, E. coli
gaaagtattcagtccgtacgtgcca

SEQ ID NO: 147640 - DNA, 25 bp, E. coli
gacacgtacattaccggaatctgga

SEQ ID NO: 147641 - DNA, 25 bp, E. coli
gtacgtgccacgttttgcaacgagt

SEQ ID NO: 147642 - DNA, 25 bp, E. coli
gtacgtgccacgatttgcaacgagt

SEQ ID NO: 147643 - DNA, 25 bp, E. coli
tggttttcgcgttcatgcaggcata

SEQ ID NO: 147644 - DNA, 25 bp, E. coli
tggttttcgcgtacatgcaggcata

SEQ ID NO: 147645 - DNA, 25 bp, E. coli
ggctactccccatatgagggcgcaa

SEQ ID NO: 147646 - DNA, 25 bp, E. coli
ggctactccccaaatgagggcgcaa

SEQ ID NO: 147647 - DNA, 25 bp, E. coli
gagggcgcaaccataacatattttg

SEQ ID NO: 147648 - DNA, 25 bp, E. coli
gagggcgcaaccttaacatattttg

SEQ ID NO: 147649 - DNA, 25 bp, E. coli
tacgtccagcacaagtatttccctg

SEQ ID NO: 147650 - DNA, 25 bp, E. coli
aaccctcattgatcctatgttaccc

SEQ ID NO: 147651 - DNA, 25 bp, E. coli
aaccctcattgaacctatgttaccc

SEQ ID NO: 147652 - DNA, 25 bp, E. coli
aagtatttccctgtctgtttgccga

SEQ ID NO: 147653 - DNA, 25 bp, E. coli
aagtatttccctctctgtttgccga

SEQ ID NO: 147654 - DNA, 25 bp, E. coli
aaatccgaaccgttggacggatcag

SEQ ID NO: 147655 - DNA, 25 bp, E. coli
aaatccgaaccgatggacggatcag

SEQ ID NO: 147656 - DNA, 25 bp, E. coli
tacgtccagcactagtatttccctg

SEQ ID NO: 147657 - DNA, 25 bp, E. coli
ttgtttgcccgtccgccactggacg

SEQ ID NO: 147658 - DNA, 25 bp, E. coli
ttgtttgcccgtgcgccactggacg

SEQ ID NO: 147659 - DNA, 25 bp, E. coli
tgtttgccgacacacgcatatgctc

SEQ ID NO: 147660 - DNA, 25 bp, E. coli
tgtttgccgacagacgcatatgctc

SEQ ID NO: 147661 - DNA, 25 bp, E. coli
ccgaaccgttggtcggatcaggcgt

SEQ ID NO: 147662 - DNA, 25 bp, E. coli
ccgaaccgttggacggatcaggcgt

SEQ ID NO: 147663 - DNA, 25 bp, E. coli
gatcaggcgtttacgctacgtccag

SEQ ID NO: 147664 - DNA, 25 bp, E. coli
gatcaggcgttttcgctacgtccag

SEQ ID NO: 147665 - DNA, 25 bp, E. coli
ggcgtttacgctacgtccagcacaa

SEQ ID NO: 147666 - DNA, 25 bp, E. coli
tatgttacccttgtttgcccgtccg

SEQ ID NO: 147667 - DNA, 25 bp, E. coli
tatgttacccttctttgcccgtccg

SEQ ID NO: 147668 - DNA, 25 bp, E. coli
ggcgtttacgcttcgtccagcacaa

SEQ ID NO: 147669 - DNA, 25 bp, E. coli
gacgcatatgctctaaccctcattg

SEQ ID NO: 147670 - DNA, 25 bp, E. coli
gacgcatatgctgtaaccctcattg

SEQ ID NO: 147671 - DNA, 25 bp, E. coli
cacagggcgtcatttttggctgcac

SEQ ID NO: 147672 - DNA, 25 bp, E. coli
cagaaattggtttactggtgccaga

SEQ ID NO: 147673 - DNA, 25 bp, E. coli
cacagggcgtcaattttggctgcac

SEQ ID NO: 147674 - DNA, 25 bp, E. coli
cagaaattggttaactggtgccaga

SEQ ID NO: 147675 - DNA, 25 bp, E. coli
taaatgaaggcaataaacagcggct

SEQ ID NO: 147676 - DNA, 25 bp, E. coli
taaatgaaggcattaaacagcggct

SEQ ID NO: 147677 - DNA, 25 bp, E. coli
aacagcggcttggtgggcttcactc

SEQ ID NO: 147678 - DNA, 25 bp, E. coli
aacagcggcttgctgggcttcactc

SEQ ID NO: 147679 - DNA, 25 bp, E. coli
tgaaatagaagagtgccagcgtcgc

SEQ ID NO: 147680 - DNA, 25 bp, E. coli
tgaaatagaagactgccagcgtcgc

SEQ ID NO: 147681 - DNA, 25 bp, E. coli
tcctgaagcggatgaacgggcgaaa

SEQ ID NO: 147682 - DNA, 25 bp, E. coli
tccatgccgaggatgctgtcgcttt

SEQ ID NO: 147683 - DNA, 25 bp, E. coli
tcctgaagcggaagaacgggcgaaa

SEQ ID NO: 147684 - DNA, 25 bp, E. coli
tccatgccgaggttgctgtcgcttt

SEQ ID NO: 147685 - DNA, 25 bp, E. coli
tctgcgcaagtggtgctacatagcg

SEQ ID NO: 147686 - DNA, 25 bp, E. coli
tctgcgcaagtgctgctacatagcg

SEQ ID NO: 147687 - DNA, 25 bp, E. coli
ccaatacgatgcataaagtggcgga

SEQ ID NO: 147688 - DNA, 25 bp, E. coli
ccaatacgatgcttaaagtggcgga

SEQ ID NO: 147689 - DNA, 25 bp, E. coli
cgcgggcggctgtcggaacaatttt

SEQ ID NO: 147690 - DNA, 25 bp, E. coli
cgcgggcggctgacggaacaatttt

SEQ ID NO: 147691 - DNA, 25 bp, E. coli
gattgctcgccttgcagaacagggc

SEQ ID NO: 147692 - DNA, 25 bp, E. coli
gattgctcgcctagcagaacagggc

SEQ ID NO: 147693 - DNA, 25 bp, E. coli
tagaaaacggtcacgtggttactgc

SEQ ID NO: 147694 - DNA, 25 bp, E. coli
tacgacctgagcaaaggccgcattg

SEQ ID NO: 147695 - DNA, 25 bp, E. coli
tagaaaacggtctcgtggttactgc

SEQ ID NO: 147696 - DNA, 25 bp, E. coli
tacgacctgagctaaggccgcattg

SEQ ID NO: 147697 - DNA, 25 bp, E. coli
aaactacatccggatcctgacgggc

SEQ ID NO: 147698 - DNA, 25 bp, E. coli
aaactacatccgcatcctgacgggc

SEQ ID NO: 147699 - DNA, 25 bp, E. coli
tgactgttgaacagaccccgtacga

SEQ ID NO: 147700 - DNA, 25 bp, E. coli
tgactgttgaactgaccccgtacga

SEQ ID NO: 147701 - DNA, 25 bp, E. coli
tctccggtaaaatgcgcaaaaacta

SEQ ID NO: 147702 - DNA, 25 bp, E. coli
tctccggtaaaaagcgcaaaaacta

SEQ ID NO: 147703 - DNA, 25 bp, E. coli
tcttgaaacgttccctaataccatg

SEQ ID NO: 147704 - DNA, 25 bp, E. coli
tcttgaaacgttgcctaataccatg

SEQ ID NO: 147705 - DNA, 25 bp, E. coli
cctgacgggcgagaaagtgactgtt

SEQ ID NO: 147706 - DNA, 25 bp, E. coli
gccgcattgtctaccgtagtcgctg

SEQ ID NO: 147707 - DNA, 25 bp, E. coli
gccgcattgtcttccgtagtcgctg

SEQ ID NO: 147708 - DNA, 25 bp, E. coli
cctgacgggcgacaaagtgactgtt

SEQ ID NO: 147709 - DNA, 25 bp, E. coli
ccatgttccgcgtagagttagaaaa

SEQ ID NO: 147710 - DNA, 25 bp, E. coli
ccatgttccgcgaagagttagaaaa

SEQ ID NO: 147711 - DNA, 25 bp, E. coli
gacaatattgaaatgcaaggtaccg

SEQ ID NO: 147712 - DNA, 25 bp, E. coli
gacaatattgaattgcaaggtaccg

SEQ ID NO: 147713 - DNA, 25 bp, E. coli
gtggttactgcagacatctccggta

SEQ ID NO: 147714 - DNA, 25 bp, E. coli
gtggttactgcacacatctccggta

SEQ ID NO: 147715 - DNA, 25 bp, E. coli
cacgcttaacggtgctggatgtgtt

SEQ ID NO: 147716 - DNA, 25 bp, E. coli
cacgcttaacggagctggatgtgtt

SEQ ID NO: 147717 - DNA, 25 bp, E. coli
cagcagtgcattgtacggtgaagag

SEQ ID NO: 147718 - DNA, 25 bp, E. coli
cagcagtgcattctacggtgaagag

SEQ ID NO: 147719 - DNA, 25 bp, E. coli
tacggtgaagagttcagtgagtcgc

SEQ ID NO: 147720 - DNA, 25 bp, E. coli
tacggtgaagagatcagtgagtcgc

SEQ ID NO: 147721 - DNA, 25 bp, E. coli
tacccagggattgagcagtgcattc

SEQ ID NO: 147722 - DNA, 25 bp, E. coli
tacccagggattcagcagtgcattc

SEQ ID NO: 147723 - DNA, 25 bp, E. coli
tttgatttgccgctcaacctgcgca

SEQ ID NO: 147724 - DNA, 25 bp, E. coli
tttgatttgccggtcaacctgcgca

SEQ ID NO: 147725 - DNA, 25 bp, E. coli
tgcaagtgctggttgacgcaggcca

SEQ ID NO: 147726 - DNA, 25 bp, E. coli
tgaaaggtgctaacgctcagcgtgg

SEQ ID NO: 147727 - DNA, 25 bp, E. coli
tgaaaggtgctatcgctcagcgtgg

SEQ ID NO: 147728 - DNA, 25 bp, E. coli
tgcaagtgctggatgacgcaggcca

SEQ ID NO: 147729 - DNA, 25 bp, E. coli
gcggatcgtcagttggcgtttgatt

SEQ ID NO: 147730 - DNA, 25 bp, E. coli
gcggatcgtcagatggcgtttgatt

SEQ ID NO: 147731 - DNA, 25 bp, E. coli
cgataatactatccgtcagagtgct

SEQ ID NO: 147732 - DNA, 25 bp, E. coli
cgataatactatgcgtcagagtgct

SEQ ID NO: 147733 - DNA, 25 bp, E. coli
cgttcgctggaggtgatgtgtcatc

SEQ ID NO: 147734 - DNA, 25 bp, E. coli
cgttcgctggagctgatgtgtcatc

SEQ ID NO: 147735 - DNA, 25 bp, E. coli
tcagcgtcgttgtaaggtgctatcg

SEQ ID NO: 147736 - DNA, 25 bp, E. coli
tcagcgtcgttgaaaggtgctatcg

SEQ ID NO: 147737 - DNA, 25 bp, E. coli
taaaacttggaatttatcgtgatca

SEQ ID NO: 147738 - DNA, 25 bp, E. coli
taaaacttggaaattatcgtgatca

SEQ ID NO: 147739 - DNA, 25 bp, E. coli
ttacacctcttttctaattcaaggg

SEQ ID NO: 147740 - DNA, 25 bp, E. coli
ttacacctctttactaattcaaggg

SEQ ID NO: 147741 - DNA, 25 bp, E. coli
aatttatggtctatttcaatggcag

SEQ ID NO: 147742 - DNA, 25 bp, E. coli
aatttatggtctttttcaatggcag

SEQ ID NO: 147743 - DNA, 25 bp, E. coli
tgagctattcactttaggtttagga

SEQ ID NO: 147744 - DNA, 25 bp, E. coli
tgtttaaatcgtcaattcctgcatg

SEQ ID NO: 147745 - DNA, 25 bp, E. coli
tgtttaaatcgtgaattcctgcatg

SEQ ID NO: 147746 - DNA, 25 bp, E. coli
tgagctattcacattaggtttagga

SEQ ID NO: 147747 - DNA, 25 bp, E. coli
tcttttagcaaacccgtattccacg

SEQ ID NO: 147748 - DNA, 25 bp, E. coli
tcttttagcaaagccgtattccacg

SEQ ID NO: 147749 - DNA, 25 bp, E. coli
tcaagggtaaaatggccttttcctg

SEQ ID NO: 147750 - DNA, 25 bp, E. coli
tcaagggtaaaaaggccttttcctg

SEQ ID NO: 147751 - DNA, 25 bp, E. coli
cattaaaagtaaagccaatgagcgt

SEQ ID NO: 147752 - DNA, 25 bp, E. coli
cattaaaagtaatgccaatgagcgt

SEQ ID NO: 147753 - DNA, 25 bp, E. coli
ggatgaaaatattctcttggaacca

SEQ ID NO: 147754 - DNA, 25 bp, E. coli
ggatgaaaatatactcttggaacca

SEQ ID NO: 147755 - DNA, 25 bp, E. coli
ggccttttcctgagccgatttcaaa

SEQ ID NO: 147756 - DNA, 25 bp, E. coli
ggccttttcctgtgccgatttcaaa

SEQ ID NO: 147757 - DNA, 25 bp, E. coli
tcaatggcagttacgaaattacacc

SEQ ID NO: 147758 - DNA, 25 bp, E. coli
tcaatggcagtttcgaaattacacc

SEQ ID NO: 147759 - DNA, 25 bp, E. coli
acgctggtaacaccggcggcggcgt

SEQ ID NO: 147760 - DNA, 25 bp, E. coli
acaggctgatttccgctctggtaac

SEQ ID NO: 147761 - DNA, 25 bp, E. coli
acgctggtaacagcggcggcggcgt

SEQ ID NO: 147762 - DNA, 25 bp, E. coli
acaggctgatttgcgctctggtaac

SEQ ID NO: 147763 - DNA, 25 bp, E. coli
tttccgctctggtaacacccgtgtt

SEQ ID NO: 147764 - DNA, 25 bp, E. coli
tttccgctctggaaacacccgtgtt

SEQ ID NO: 147765 - DNA, 25 bp, E. coli
tgatttccgctcaggtaacacccgt

SEQ ID NO: 147766 - DNA, 25 bp, E. coli
tgatttccgctctggtaacacccgt

SEQ ID NO: 147767 - DNA, 25 bp, E. coli
tccgctctggtaacacccgtgttgc

SEQ ID NO: 147768 - DNA, 25 bp, E. coli
tccgctctggtatcacccgtgttgc

SEQ ID NO: 147769 - DNA, 25 bp, E. coli
gctctggtaacagccgtgttgcttt

SEQ ID NO: 147770 - DNA, 25 bp, E. coli
gctgatttccgcactggtaacaccc

SEQ ID NO: 147771 - DNA, 25 bp, E. coli
gctgatttccgctctggtaacaccc

SEQ ID NO: 147772 - DNA, 25 bp, E. coli
gctctggtaacacccgtgttgcttt

SEQ ID NO: 147773 - DNA, 25 bp, E. coli
ctggcaacgctggtaacaccggcgg

SEQ ID NO: 147774 - DNA, 25 bp, E. coli
ctggcaacgctgctaacaccggcgg

SEQ ID NO: 147775 - DNA, 25 bp, E. coli
gatttccgctctggtaacacccgtg

SEQ ID NO: 147776 - DNA, 25 bp, E. coli
gatttccgctctcgtaacacccgtg

SEQ ID NO: 147777 - DNA, 25 bp, E. coli
ggctgatttccggtctggtaacacc

SEQ ID NO: 147778 - DNA, 25 bp, E. coli
tggcaacgctggtaacaccggcggc

SEQ ID NO: 147779 - DNA, 25 bp, E. coli
tggcaacgctggaaacaccggcggc

SEQ ID NO: 147780 - DNA, 25 bp, E. coli
ggctgatttccgctctggtaacacc

SEQ ID NO: 147781 - DNA, 25 bp, E. coli
aactgtgtgaccacgacacgctgca

SEQ ID NO: 147782 - DNA, 25 bp, E. coli
aactgtgtgacctcgacacgctgca

SEQ ID NO: 147783 - DNA, 25 bp, E. coli
tatccatttgcctgcggagctacgc

SEQ ID NO: 147784 - DNA, 25 bp, E. coli
tatccatttgccagcggagctacgc

SEQ ID NO: 147785 - DNA, 25 bp, E. coli
tttgccagcggagctacgcgaactg

SEQ ID NO: 147786 - DNA, 25 bp, E. coli
ttttattgaagaaagcctgaaaggg

SEQ ID NO: 147787 - DNA, 25 bp, E. coli
ttttattgaagatagcctgaaaggg

SEQ ID NO: 147788 - DNA, 25 bp, E. coli
tttgccagcggacctacgcgaactg

SEQ ID NO: 147789 - DNA, 25 bp, E. coli
tgtgacctcgactcgctgcatcttg

SEQ ID NO: 147790 - DNA, 25 bp, E. coli
tgtgacctcgacacgctgcatcttg

SEQ ID NO: 147791 - DNA, 25 bp, E. coli
tcgacacgctgcatcttgagtcggg

SEQ ID NO: 147792 - DNA, 25 bp, E. coli
tcgacacgctgcttcttgagtcggg

SEQ ID NO: 147793 - DNA, 25 bp, E. coli
gctacgcgaactgtgtgacctcgac

SEQ ID NO: 147794 - DNA, 25 bp, E. coli
gctacgcgaactctgtgacctcgac

SEQ ID NO: 147795 - DNA, 25 bp, E. coli
gcacagcactgaggtgctttattcc

SEQ ID NO: 147796 - DNA, 25 bp, E. coli
gcacagcactgacgtgctttattcc

SEQ ID NO: 147797 - DNA, 25 bp, E. coli
gaaagggcacagcactgacgtgctt

SEQ ID NO: 147798 - DNA, 25 bp, E. coli
gaaagggcacaggactgacgtgctt

SEQ ID NO: 147799 - DNA, 25 bp, E. coli
cggagctacgcgaactgtgtgacct

SEQ ID NO: 147800 - DNA, 25 bp, E. coli
cggagctacgcgtactgtgtgacct

SEQ ID NO: 147801 - DNA, 25 bp, E. coli
tggatatccattagccagcggagct

SEQ ID NO: 147802 - DNA, 25 bp, E. coli
tggatatccatttgccagcggagct

SEQ ID NO: 147803 - DNA, 25 bp, E. coli
agtttccagtggagaagttacgtcg

SEQ ID NO: 147804 - DNA, 25 bp, E. coli
agtttccagtggtgaagttacgtcg

SEQ ID NO: 147805 - DNA, 25 bp, E. coli
actggcaacgcgtcgggaaaacgct

SEQ ID NO: 147806 - DNA, 25 bp, E. coli
actggcaacgcgacgggaaaacgct

SEQ ID NO: 147807 - DNA, 25 bp, E. coli
tgcatttcacggcatggaagaccat

SEQ ID NO: 147808 - DNA, 25 bp, E. coli
tgcatttcacgggatggaagaccat

SEQ ID NO: 147809 - DNA, 25 bp, E. coli
tgccgccgccgctacgtttaatcgt

SEQ ID NO: 147810 - DNA, 25 bp, E. coli
tgccgccgccgcaacgtttaatcgt

SEQ ID NO: 147811 - DNA, 25 bp, E. coli
gccagcgagttttttcatggctcgc

SEQ ID NO: 147812 - DNA, 25 bp, E. coli
gccagcgagtttattcatggctcgc

SEQ ID NO: 147813 - DNA, 25 bp, E. coli
cgcgacgggaaatcgctgatcctcg

SEQ ID NO: 147814 - DNA, 25 bp, E. coli
cgcgacgggaaaacgctgatcctcg

SEQ ID NO: 147815 - DNA, 25 bp, E. coli
gtttattcatgggtcgctgcattta

SEQ ID NO: 147816 - DNA, 25 bp, E. coli
gtttattcatggctcgctgcattta

SEQ ID NO: 147817 - DNA, 25 bp, E. coli
gtcgtccgtcgctggcgctaactgc

SEQ ID NO: 147818 - DNA, 25 bp, E. coli
gtcgtccgtcgcaggcgctaactgc

SEQ ID NO: 147819 - DNA, 25 bp, E. coli
tcagaacgtcagcaaactggcaacg

SEQ ID NO: 147820 - DNA, 25 bp, E. coli
taatcgtgttgatgtccgtcgtccg

SEQ ID NO: 147821 - DNA, 25 bp, E. coli
tcagaacgtcaggaaactggcaacg

SEQ ID NO: 147822 - DNA, 25 bp, E. coli
taatcgtgttgaagtccgtcgtccg

SEQ ID NO: 147823 - DNA, 25 bp, E. coli
gatggaagaccatgaaatttattgg

SEQ ID NO: 147824 - DNA, 25 bp, E. coli
gatggaagaccaagaaatttattgg

SEQ ID NO: 147825 - DNA, 25 bp, E. coli
tagacatcgttaaaccaatcgaaac

SEQ ID NO: 147826 - DNA, 25 bp, E. coli
tagggtttcgcctgtcagcagacaa

SEQ ID NO: 147827 - DNA, 25 bp, E. coli
tagggtttcgccagtcagcagacaa

SEQ ID NO: 147828 - DNA, 25 bp, E. coli
tagacatcgttataccaatcgaaac

SEQ ID NO: 147829 - DNA, 25 bp, E. coli
ttgaaaaccgcctgcggaaacgctg

SEQ ID NO: 147830 - DNA, 25 bp, E. coli
ttgtatcaggaagatgttcagagga

SEQ ID NO: 147831 - DNA, 25 bp, E. coli
ttgtatcaggaacatgttcagagga

SEQ ID NO: 147832 - DNA, 25 bp, E. coli
ttgaaaaccgccagcggaaacgctg

SEQ ID NO: 147833 - DNA, 25 bp, E. coli
tgtcagcagacatataacccgataa

SEQ ID NO: 147834 - DNA, 25 bp, E. coli
tgtcagcagacaaataacccgataa

SEQ ID NO: 147835 - DNA, 25 bp, E. coli
tgaatacattgataaccgccagcgg

SEQ ID NO: 147836 - DNA, 25 bp, E. coli
tgaatacattgaaaaccgccagcgg

SEQ ID NO: 147837 - DNA, 25 bp, E. coli
tcttataaatctgtagggtttcgcc

SEQ ID NO: 147838 - DNA, 25 bp, E. coli
tcttataaatctctagggtttcgcc

SEQ ID NO: 147839 - DNA, 25 bp, E. coli
gacagatatctctcttaaggctttc

SEQ ID NO: 147840 - DNA, 25 bp, E. coli
gacagatatctcacttaaggctttc

SEQ ID NO: 147841 - DNA, 25 bp, E. coli
cgctggcggtttattgtatcaggaa

SEQ ID NO: 147842 - DNA, 25 bp, E. coli
cgctggcggttttttgtatcaggaa

SEQ ID NO: 147843 - DNA, 25 bp, E. coli
gttcagaggaatatttagacatcgt

SEQ ID NO: 147844 - DNA, 25 bp, E. coli
gttcagaggaatttttagacatcgt

SEQ ID NO: 147845 - DNA, 25 bp, E. coli
taacccgataaatcaaggatgagca

SEQ ID NO: 147846 - DNA, 25 bp, E. coli
taacccgataaaacaaggatgagca

SEQ ID NO: 147847 - DNA, 25 bp, E. coli
catcatcagttattccgtgccggaa

SEQ ID NO: 147848 - DNA, 25 bp, E. coli
catcatcagttaatccgtgccggaa

SEQ ID NO: 147849 - DNA, 25 bp, E. coli
tactctctggtgctgctttgcggcg

SEQ ID NO: 147850 - DNA, 25 bp, E. coli
tactgcagaagactatggcgatggc

SEQ ID NO: 147851 - DNA, 25 bp, E. coli
tactctctggtggtgctttgcggcg

SEQ ID NO: 147852 - DNA, 25 bp, E. coli
tactgcagaagagtatggcgatggc

SEQ ID NO: 147853 - DNA, 25 bp, E. coli
agttgatcaatagcgcactggcgca

SEQ ID NO: 147854 - DNA, 25 bp, E. coli
agttgatcaataccgcactggcgca

SEQ ID NO: 147855 - DNA, 25 bp, E. coli
aacttcatcaacaggcggagcggga

SEQ ID NO: 147856 - DNA, 25 bp, E. coli
aacttcatcaactggcggagcggga

SEQ ID NO: 147857 - DNA, 25 bp, E. coli
tgactgtgaaccagaaaagcgcctg

SEQ ID NO: 147858 - DNA, 25 bp, E. coli
tgactgtgaacctgaaaagcgcctg

SEQ ID NO: 147859 - DNA, 25 bp, E. coli
gaatttcccttcctgcaggatggca

SEQ ID NO: 147860 - DNA, 25 bp, E. coli
gaatttcccttcgtgcaggatggca

SEQ ID NO: 147861 - DNA, 25 bp, E. coli
gaacaggaattgacgcgcaggaaca

SEQ ID NO: 147862 - DNA, 25 bp, E. coli
gaacaggaattgtcgcgcaggaaca

SEQ ID NO: 147863 - DNA, 25 bp, E. coli
gttgaacacgttggaatggcgcgcc

SEQ ID NO: 147864 - DNA, 25 bp, E. coli
gatcaatatggtcatgctccgcaag

SEQ ID NO: 147865 - DNA, 25 bp, E. coli
gttgaacacgttcgaatggcgcgcc

SEQ ID NO: 147866 - DNA, 25 bp, E. coli
gatcaatatggtgatgctccgcaag

SEQ ID NO: 147867 - DNA, 25 bp, E. coli
gatggctttgctaacgtgctggcgc

SEQ ID NO: 147868 - DNA, 25 bp, E. coli
gatggctttgcttacgtgctggcgc

SEQ ID NO: 147869 - DNA, 25 bp, E. coli
caatggcaggtgtacaggcaacaac

SEQ ID NO: 147870 - DNA, 25 bp, E. coli
caatggcaggtgaacaggcaacaac

SEQ ID NO: 147871 - DNA, 25 bp, E. coli
cagcatgaatcggaacggaacgacc

SEQ ID NO: 147872 - DNA, 25 bp, E. coli
cagcatgaatcgcaacggaacgacc

SEQ ID NO: 147873 - DNA, 25 bp, E. coli
tacaactgaacatggccagaacgcg

SEQ ID NO: 147874 - DNA, 25 bp, E. coli
tacaactgaacaaggccagaacgcg

SEQ ID NO: 147875 - DNA, 25 bp, E. coli
tcagtcgcaggtgagttccgctaac

SEQ ID NO: 147876 - DNA, 25 bp, E. coli
tctgttcaggacaaaccagccagca

SEQ ID NO: 147877 - DNA, 25 bp, E. coli
tctgcaatcgctttgaaaaaggcgg

SEQ ID NO: 147878 - DNA, 25 bp, E. coli
tcagtcgcaggtcagttccgctaac

SEQ ID NO: 147879 - DNA, 25 bp, E. coli
tctgcaatcgctatgaaaaaggcgg

SEQ ID NO: 147880 - DNA, 25 bp, E. coli
tctgttcaggactaaccagccagca

SEQ ID NO: 147881 - DNA, 25 bp, E. coli
gctaaccaagtataagtcaccgctg

SEQ ID NO: 147882 - DNA, 25 bp, E. coli
gctaaccaagtaaaagtcaccgctg

SEQ ID NO: 147883 - DNA, 25 bp, E. coli
gaaacaatccgatccagtggcgcaa

SEQ ID NO: 147884 - DNA, 25 bp, E. coli
gaaacaatccgaaccagtggcgcaa

SEQ ID NO: 147885 - DNA, 25 bp, E. coli
gttgttgacgacgttccgccagaag

SEQ ID NO: 147886 - DNA, 25 bp, E. coli
gtagtcctgaactaagaaagtccgt

SEQ ID NO: 147887 - DNA, 25 bp, E. coli
gttgttgacgaccttccgccagaag

SEQ ID NO: 147888 - DNA, 25 bp, E. coli
gtagtcctgaacaaagaaagtccgt

SEQ ID NO: 147889 - DNA, 25 bp, E. coli
taatgctggcggtgggaacaaaacc

SEQ ID NO: 147890 - DNA, 25 bp, E. coli
taatgctggcggagggaacaaaacc

SEQ ID NO: 147891 - DNA, 25 bp, E. coli
caaaaccggaacgtaaggcgctgat

SEQ ID NO: 147892 - DNA, 25 bp, E. coli
caaaaccggaacctaaggcgctgat

SEQ ID NO: 147893 - DNA, 25 bp, E. coli
taacggtgactaagcgatgatcctc

SEQ ID NO: 147894 - DNA, 25 bp, E. coli
taaaggcctttttctctccggtgcg

SEQ ID NO: 147895 - DNA, 25 bp, E. coli
taaaggccttttactctccggtgcg

SEQ ID NO: 147896 - DNA, 25 bp, E. coli
tatcgaagatgtcgatgcctgcgca

SEQ ID NO: 147897 - DNA, 25 bp, E. coli
tatcgaagatgtggatgcctgcgca

SEQ ID NO: 147898 - DNA, 25 bp, E. coli
tgttaccgggattacggagccgctg

SEQ ID NO: 147899 - DNA, 25 bp, E. coli
tgttaccgggataacggagccgctg

SEQ ID NO: 147900 - DNA, 25 bp, E. coli
tgaatgccacgaagggaacgcaact

SEQ ID NO: 147901 - DNA, 25 bp, E. coli
tgaatgccacgatgggaacgcaact

SEQ ID NO: 147902 - DNA, 25 bp, E. coli
tctttgcccaatagcgcgacggtgt

SEQ ID NO: 147903 - DNA, 25 bp, E. coli
tctttgcccaattgcgcgacggtgt

SEQ ID NO: 147904 - DNA, 25 bp, E. coli
cattgagctgctcgcgaattgcggc

SEQ ID NO: 147905 - DNA, 25 bp, E. coli
cggtacaaaaaggtctggcgtcgct

SEQ ID NO: 147906 - DNA, 25 bp, E. coli
cattgagctgctggcgaattgcggc

SEQ ID NO: 147907 - DNA, 25 bp, E. coli
cggtacaaaaagctctggcgtcgct

SEQ ID NO: 147908 - DNA, 25 bp, E. coli
tggcgactacatcaccaaatccggg

SEQ ID NO: 147909 - DNA, 25 bp, E. coli
tggcgactacatgaccaaatccggg

SEQ ID NO: 147910 - DNA, 25 bp, E. coli
tcaaaaccgtaaagagcagaccgcg

SEQ ID NO: 147911 - DNA, 25 bp, E. coli
tcaaaaccgtaatgagcagaccgcg

SEQ ID NO: 147912 - DNA, 25 bp, E. coli
taacggtgactatgcgatgatcctc

SEQ ID NO: 147913 - DNA, 25 bp, E. coli
cagaatgtaggactggtgatccgca

SEQ ID NO: 147914 - DNA, 25 bp, E. coli
cagaatgtaggagtggtgatccgca

SEQ ID NO: 147915 - DNA, 25 bp, E. coli
cattcactgactgaaatctggcggg

SEQ ID NO: 147916 - DNA, 25 bp, E. coli
tagggactctcagggaagaaacgac

SEQ ID NO: 147917 - DNA, 25 bp, E. coli
tagggactctcacggaagaaacgac

SEQ ID NO: 147918 - DNA, 25 bp, E. coli
ttaatgaggtcgtcaagcgcatcac

SEQ ID NO: 147919 - DNA, 25 bp, E. coli
ttaatgaggtcgacaagcgcatcac

SEQ ID NO: 147920 - DNA, 25 bp, E. coli
tatcaggtggcaaggtagtgatccc

SEQ ID NO: 147921 - DNA, 25 bp, E. coli
tatcaggtggcatggtagtgatccc

SEQ ID NO: 147922 - DNA, 25 bp, E. coli
tgaaacccgcattagcacactggat

SEQ ID NO: 147923 - DNA, 25 bp, E. coli
tgaaacccgcataagcacactggat

SEQ ID NO: 147924 - DNA, 25 bp, E. coli
gctgaattttaacgcgaccggtgga

SEQ ID NO: 147925 - DNA, 25 bp, E. coli
gctgaattttaaggcgaccggtgga

SEQ ID NO: 147926 - DNA, 25 bp, E. coli
cggaaaagacagagaaggcaggcct

SEQ ID NO: 147927 - DNA, 25 bp, E. coli
cattcactgactcaaatctggcggg

SEQ ID NO: 147928 - DNA, 25 bp, E. coli
cggaaaagacagtgaaggcaggcct

SEQ ID NO: 147929 - DNA, 25 bp, E. coli
cattgaccagatccgcgatgaggct

SEQ ID NO: 147930 - DNA, 25 bp, E. coli
cattgaccagatgcgcgatgaggct

SEQ ID NO: 147931 - DNA, 25 bp, E. coli
tggttggtcttaaactcgcccggcg

SEQ ID NO: 147932 - DNA, 25 bp, E. coli
tggttggtcttatactcgcccggcg

SEQ ID NO: 147933 - DNA, 25 bp, E. coli
taacgcggcaggtgtgaaaggtcca

SEQ ID NO: 147934 - DNA, 25 bp, E. coli
taacgcggcaggagtgaaaggtcca

SEQ ID NO: 147935 - DNA, 25 bp, E. coli
tactaaaacacaatgcgctttccgg

SEQ ID NO: 147936 - DNA, 25 bp, E. coli
tactaaaacacattgcgctttccgg

SEQ ID NO: 147937 - DNA, 25 bp, E. coli
tattagtcatattgagcgcggcgca

SEQ ID NO: 147938 - DNA, 25 bp, E. coli
tattagtcatatagagcgcggcgca

SEQ ID NO: 147939 - DNA, 25 bp, E. coli
ttgatattgctataagcgccgtggg

SEQ ID NO: 147940 - DNA, 25 bp, E. coli
ttgatattgctaaaagcgccgtggg

SEQ ID NO: 147941 - DNA, 25 bp, E. coli
tgttaagtgacgatgacgccctgcc

SEQ ID NO: 147942 - DNA, 25 bp, E. coli
tgttaagtgacgttgacgccctgcc

SEQ ID NO: 147943 - DNA, 25 bp, E. coli
gcctactttaatcccgacagcgtga

SEQ ID NO: 147944 - DNA, 25 bp, E. coli
gcctactttaatgccgacagcgtga

SEQ ID NO: 147945 - DNA, 25 bp, E. coli
gccacagtgccggtaaatgaagcga

SEQ ID NO: 147946 - DNA, 25 bp, E. coli
gccacagtgccgctaaatgaagcga

SEQ ID NO: 147947 - DNA, 25 bp, E. coli
gcgacttctcttgagcaaggacaga

SEQ ID NO: 147948 - DNA, 25 bp, E. coli
gcgacttctcttcagcaaggacaga

SEQ ID NO: 147949 - DNA, 25 bp, E. coli
cattagccagggtgcgaaagatgcc

SEQ ID NO: 147950 - DNA, 25 bp, E. coli
ctataaaagcgcgtgggatgccatt

SEQ ID NO: 147951 - DNA, 25 bp, E. coli
ctataaaagcgcctgggatgccatt

SEQ ID NO: 147952 - DNA, 25 bp, E. coli
cattagccagggagcgaaagatgcc

SEQ ID NO: 147953 - DNA, 25 bp, E. coli
ggacagaatgtcacggcctacttta

SEQ ID NO: 147954 - DNA, 25 bp, E. coli
ggacagaatgtctcggcctacttta

SEQ ID NO: 147955 - DNA, 25 bp, E. coli
taaccagtggttcggtaccatcacc

SEQ ID NO: 147956 - DNA, 25 bp, E. coli
taaccagtggttgggtaccatcacc

SEQ ID NO: 147957 - DNA, 25 bp, E. coli
cagcgggtttctacaatcttggagc

SEQ ID NO: 147958 - DNA, 25 bp, E. coli
cagcgggtttcttcaatcttggagc

SEQ ID NO: 147959 - DNA, 25 bp, E. coli
catttgcagataggttgcgccctga

SEQ ID NO: 147960 - DNA, 25 bp, E. coli
cattttccagtaacaccaggcggtg

SEQ ID NO: 147961 - DNA, 25 bp, E. coli
agttcgcccacgctacgcatttgca

SEQ ID NO: 147962 - DNA, 25 bp, E. coli
agttcgcccacggtacgcatttgca

SEQ ID NO: 147963 - DNA, 25 bp, E. coli
tgttgaagttaagcagccatgcgcc

SEQ ID NO: 147964 - DNA, 25 bp, E. coli
tgttgaagttaaccagccatgcgcc

SEQ ID NO: 147965 - DNA, 25 bp, E. coli
gaagctaccaatcaagatgccccag

SEQ ID NO: 147966 - DNA, 25 bp, E. coli
gaagctaccaatgaagatgccccag

SEQ ID NO: 147967 - DNA, 25 bp, E. coli
gaagttgcatccgacattgtcagac

SEQ ID NO: 147968 - DNA, 25 bp, E. coli
gaagttgcatcccacattgtcagac

SEQ ID NO: 147969 - DNA, 25 bp, E. coli
gacttgcgttcaacatggtgctgga

SEQ ID NO: 147970 - DNA, 25 bp, E. coli
gacttgcgttcatcatggtgctgga

SEQ ID NO: 147971 - DNA, 25 bp, E. coli
cgtcagggaggacaacacaaacgcc

SEQ ID NO: 147972 - DNA, 25 bp, E. coli
catttgcagatacgttgcgccctga

SEQ ID NO: 147973 - DNA, 25 bp, E. coli
cgtcagggaggagaacacaaacgcc

SEQ ID NO: 147974 - DNA, 25 bp, E. coli
cattttccagtatcaccaggcggtg

SEQ ID NO: 147975 - DNA, 25 bp, E. coli
ggacggcatcacaaacgggaacatt

SEQ ID NO: 147976 - DNA, 25 bp, E. coli
ggacggcatcactaacgggaacatt

SEQ ID NO: 147977 - DNA, 25 bp, E. coli
ggctttatccatacgtgcagtcagg

SEQ ID NO: 147978 - DNA, 25 bp, E. coli
ggctttatccattcgtgcagtcagg

SEQ ID NO: 147979 - DNA, 25 bp, E. coli
cttggttaagagaacaggtaagtca

SEQ ID NO: 147980 - DNA, 25 bp, E. coli
cttggttaagagtacaggtaagtca

SEQ ID NO: 147981 - DNA, 25 bp, E. coli
aaatcttgccagattgcagcccgga

SEQ ID NO: 147982 - DNA, 25 bp, E. coli
aaatcttgccagtttgcagcccgga

SEQ ID NO: 147983 - DNA, 25 bp, E. coli
tttgcagcccggtgtacgctcaaag

SEQ ID NO: 147984 - DNA, 25 bp, E. coli
tttgcagcccggagtacgctcaaag

SEQ ID NO: 147985 - DNA, 25 bp, E. coli
ttgccagtttgctgcccggagtacg

SEQ ID NO: 147986 - DNA, 25 bp, E. coli
ttgccagtttgcagcccggagtacg

SEQ ID NO: 147987 - DNA, 25 bp, E. coli
gcgccgtcagcggaattggctcatc

SEQ ID NO: 147988 - DNA, 25 bp, E. coli
gcgccgtcagcgcaattggctcatc

SEQ ID NO: 147989 - DNA, 25 bp, E. coli
gcgcaattggctgatcactttctga

SEQ ID NO: 147990 - DNA, 25 bp, E. coli
gcgcaattggctcatcactttctga

SEQ ID NO: 147991 - DNA, 25 bp, E. coli
cgctctgatttacccgttatcgccg

SEQ ID NO: 147992 - DNA, 25 bp, E. coli
cgatgggaaggaaacgtatggtaca

SEQ ID NO: 147993 - DNA, 25 bp, E. coli
cgctctgatttagccgttatcgccg

SEQ ID NO: 147994 - DNA, 25 bp, E. coli
cgatgggaaggatacgtatggtaca

SEQ ID NO: 147995 - DNA, 25 bp, E. coli
ggccaaaaattgtggcatttattac

SEQ ID NO: 147996 - DNA, 25 bp, E. coli
ggccaaaaattgaggcatttattac

SEQ ID NO: 147997 - DNA, 25 bp, E. coli
gagaacaggtaactcaatatgaatg

SEQ ID NO: 147998 - DNA, 25 bp, E. coli
gagaacaggtaagtcaatatgaatg

SEQ ID NO: 147999 - DNA, 25 bp, E. coli
gaggcatttatttcttggttaagag

SEQ ID NO: 148000 - DNA, 25 bp, E. coli
gaggcatttattacttggttaagag

SEQ ID NO: 148001 - DNA, 25 bp, E. coli
cacgggagccataaccaacgatatt

SEQ ID NO: 148002 - DNA, 25 bp, E. coli
cacgggagccattaccaacgatatt

SEQ ID NO: 148003 - DNA, 25 bp, E. coli
tagcgaataagtacaggcgtgctga

SEQ ID NO: 148004 - DNA, 25 bp, E. coli
tagcgaataagttcaggcgtgctga

SEQ ID NO: 148005 - DNA, 25 bp, E. coli
tattgacgatgaccagtctggccag

SEQ ID NO: 148006 - DNA, 25 bp, E. coli
tattgacgatgagcagtctggccag

SEQ ID NO: 148007 - DNA, 25 bp, E. coli
tcgttatagcgaataagttcaggcg

SEQ ID NO: 148008 - DNA, 25 bp, E. coli
tcgttatagcgattaagttcaggcg

SEQ ID NO: 148009 - DNA, 25 bp, E. coli
tctggccagccaccaacttattgtc

SEQ ID NO: 148010 - DNA, 25 bp, E. coli
tctggccagccagcaacttattgtc

SEQ ID NO: 148011 - DNA, 25 bp, E. coli
ccaacgatattgtcgttatagcgaa

SEQ ID NO: 148012 - DNA, 25 bp, E. coli
ccaacgatattgacgttatagcgaa

SEQ ID NO: 148013 - DNA, 25 bp, E. coli
gcaacttattgtctcaacccgcaac

SEQ ID NO: 148014 - DNA, 25 bp, E. coli
gcaacttattgtgtcaacccgcaac

SEQ ID NO: 148015 - DNA, 25 bp, E. coli
cggtggctgtaatgtttattgacga

SEQ ID NO: 148016 - DNA, 25 bp, E. coli
cggtggctgtaaagtttattgacga

SEQ ID NO: 148017 - DNA, 25 bp, E. coli
tgtctcaacccgcaactcacgggag

SEQ ID NO: 148018 - DNA, 25 bp, E. coli
tgtctcaacccggaactcacgggag

SEQ ID NO: 148019 - DNA, 25 bp, E. coli
gatgaccagtctcgccagccagcaa

SEQ ID NO: 148020 - DNA, 25 bp, E. coli
gagttatttacgaaacggtggctgt

SEQ ID NO: 148021 - DNA, 25 bp, E. coli
gagttatttacgtaacggtggctgt

SEQ ID NO: 148022 - DNA, 25 bp, E. coli
gatgaccagtctggccagccagcaa

SEQ ID NO: 148023 - DNA, 25 bp, E. coli
cacaggaacgcctgaacagaaatat

SEQ ID NO: 148024 - DNA, 25 bp, E. coli
cacaggaacgccagaacagaaatat

SEQ ID NO: 148025 - DNA, 25 bp, E. coli
agccgtgtaccgtgctcagcaggcc

SEQ ID NO: 148026 - DNA, 25 bp, E. coli
agccgtgtaccgagctcagcaggcc

SEQ ID NO: 148027 - DNA, 25 bp, E. coli
tgtaccgtgctctgcaggccgtggc

SEQ ID NO: 148028 - DNA, 25 bp, E. coli
tgtaccgtgctcagcaggccgtggc

SEQ ID NO: 148029 - DNA, 25 bp, E. coli
tgcactggcggaagcacagttcagg

SEQ ID NO: 148030 - DNA, 25 bp, E. coli
tgaagttgcactcgcggaagcacag

SEQ ID NO: 148031 - DNA, 25 bp, E. coli
tgaagttgcactggcggaagcacag

SEQ ID NO: 148032 - DNA, 25 bp, E. coli
tgcactggcggatgcacagttcagg

SEQ ID NO: 148033 - DNA, 25 bp, E. coli
cctgaacagaaaaattgctgccaga

SEQ ID NO: 148034 - DNA, 25 bp, E. coli
cctgaacagaaatattgctgccaga

SEQ ID NO: 148035 - DNA, 25 bp, E. coli
gaacgcctgaactgaaatattgctg

SEQ ID NO: 148036 - DNA, 25 bp, E. coli
gaacgcctgaacagaaatattgctg

SEQ ID NO: 148037 - DNA, 25 bp, E. coli
cccgcgggacggagatgcagattgc

SEQ ID NO: 148038 - DNA, 25 bp, E. coli
cccgcgggacggtgatgcagattgc

SEQ ID NO: 148039 - DNA, 25 bp, E. coli
cgtaatgaagttgcactggcggaag

SEQ ID NO: 148040 - DNA, 25 bp, E. coli
cgtaatgaagttccactggcggaag

SEQ ID NO: 148041 - DNA, 25 bp, E. coli
ggccacacaggatcgcctgaacaga

SEQ ID NO: 148042 - DNA, 25 bp, E. coli
ggccacacaggaacgcctgaacaga

SEQ ID NO: 148043 - DNA, 25 bp, E. coli
gtctggcggccagacaggaacgcct

SEQ ID NO: 148044 - DNA, 25 bp, E. coli
gtctggcggccacacaggaacgcct

SEQ ID NO: 148045 - DNA, 25 bp, E. coli
aatctccggataacgacccataacg

SEQ ID NO: 148046 - DNA, 25 bp, E. coli
aatctccggatatcgacccataacg

SEQ ID NO: 148047 - DNA, 25 bp, E. coli
tatcgacccataacgggcaatgata

SEQ ID NO: 148048 - DNA, 25 bp, E. coli
ttagagattaggattgcggagaata

SEQ ID NO: 148049 - DNA, 25 bp, E. coli
tatcgacccatatcgggcaatgata

SEQ ID NO: 148050 - DNA, 25 bp, E. coli
ttagagattaggtttgcggagaata

SEQ ID NO: 148051 - DNA, 25 bp, E. coli
tgacagggaaaaaggagaaattctc

SEQ ID NO: 148052 - DNA, 25 bp, E. coli
tgacagggaaaatggagaaattctc

SEQ ID NO: 148053 - DNA, 25 bp, E. coli
tccggatatcgagccataacgggca

SEQ ID NO: 148054 - DNA, 25 bp, E. coli
tccggatatcgacccataacgggca

SEQ ID NO: 148055 - DNA, 25 bp, E. coli
ggatatcgacccttaacgggcaatg

SEQ ID NO: 148056 - DNA, 25 bp, E. coli
ggatatcgacccataacgggcaatg

SEQ ID NO: 148057 - DNA, 25 bp, E. coli
ggagaaattctcaataaatgcggta

SEQ ID NO: 148058 - DNA, 25 bp, E. coli
gtaatctccggaaatcgacccataa

SEQ ID NO: 148059 - DNA, 25 bp, E. coli
gtaatctccggatatcgacccataa

SEQ ID NO: 148060 - DNA, 25 bp, E. coli
tggagaaaaatgacagggaaaaagg

SEQ ID NO: 148061 - DNA, 25 bp, E. coli
ggagaaattctctataaatgcggta

SEQ ID NO: 148062 - DNA, 25 bp, E. coli
tggagaaaaatgtcagggaaaaagg

SEQ ID NO: 148063 - DNA, 25 bp, E. coli
gacccataacgggcaatgataaaag

SEQ ID NO: 148064 - DNA, 25 bp, E. coli
gagattaggattgcggagaataaca

SEQ ID NO: 148065 - DNA, 25 bp, E. coli
gacccataacggccaatgataaaag

SEQ ID NO: 148066 - DNA, 25 bp, E. coli
gagattaggattccggagaataaca

SEQ ID NO: 148067 - DNA, 25 bp, E. coli
catccggcaaggagaaaggctatga

SEQ ID NO: 148068 - DNA, 25 bp, E. coli
catccggcaaggtgaaaggctatga

SEQ ID NO: 148069 - DNA, 25 bp, E. coli
atccggcaaggagaaaggctatgaa

SEQ ID NO: 148070 - DNA, 25 bp, E. coli
atccggcaaggacaaaggctatgaa

SEQ ID NO: 148071 - DNA, 25 bp, E. coli
ttacccgccatccggcaaggagaaa

SEQ ID NO: 148072 - DNA, 25 bp, E. coli
ttacccgccatcgggcaaggagaaa

SEQ ID NO: 148073 - DNA, 25 bp, E. coli
tccggcaaggagaaaggctatgaag

SEQ ID NO: 148074 - DNA, 25 bp, E. coli
tccggcaaggagtaaggctatgaag

SEQ ID NO: 148075 - DNA, 25 bp, E. coli
tcttacccgccaaccggcaaggaga

SEQ ID NO: 148076 - DNA, 25 bp, E. coli
tcttacccgccatccggcaaggaga

SEQ ID NO: 148077 - DNA, 25 bp, E. coli
gccatccggcaacgagaaaggctat

SEQ ID NO: 148078 - DNA, 25 bp, E. coli
gccatccggcaaggagaaaggctat

SEQ ID NO: 148079 - DNA, 25 bp, E. coli
ccatccggcaagcagaaaggctatg

SEQ ID NO: 148080 - DNA, 25 bp, E. coli
ccatccggcaaggagaaaggctatg

SEQ ID NO: 148081 - DNA, 25 bp, E. coli
cccgccatccgggaaggagaaaggc

SEQ ID NO: 148082 - DNA, 25 bp, E. coli
cgccatccggcatggagaaaggcta

SEQ ID NO: 148083 - DNA, 25 bp, E. coli
ccgccatccggcaaggagaaaggct

SEQ ID NO: 148084 - DNA, 25 bp, E. coli
cccgccatccggcaaggagaaaggc

SEQ ID NO: 148085 - DNA, 25 bp, E. coli
cgccatccggcaaggagaaaggcta

SEQ ID NO: 148086 - DNA, 25 bp, E. coli
ccgccatccggctaggagaaaggct

SEQ ID NO: 148087 - DNA, 25 bp, E. coli
cttacccgccatgcggcaaggagaa

SEQ ID NO: 148088 - DNA, 25 bp, E. coli
cttacccgccatccggcaaggagaa

SEQ ID NO: 148089 - DNA, 25 bp, E. coli
caacggacgaagatttgcacaaata

SEQ ID NO: 148090 - DNA, 25 bp, E. coli
caacggacgaagttttgcacaaata

SEQ ID NO: 148091 - DNA, 25 bp, E. coli
cacagcaggaagtatcttacctgag

SEQ ID NO: 148092 - DNA, 25 bp, E. coli
cacagcaggaagaatcttacctgag

SEQ ID NO: 148093 - DNA, 25 bp, E. coli
cagtaaatcctgaatgcagtaatca

SEQ ID NO: 148094 - DNA, 25 bp, E. coli
cagtaaatcctgtatgcagtaatca

SEQ ID NO: 148095 - DNA, 25 bp, E. coli
cagtcaatggttttacagtaaatcc

SEQ ID NO: 148096 - DNA, 25 bp, E. coli
cagtcaatggttatacagtaaatcc

SEQ ID NO: 148097 - DNA, 25 bp, E. coli
tatatttttaaagttcacagcagga

SEQ ID NO: 148098 - DNA, 25 bp, E. coli
tattgctcgcaacctggaacagcag

SEQ ID NO: 148099 - DNA, 25 bp, E. coli
tatatttttaaacttcacagcagga

SEQ ID NO: 148100 - DNA, 25 bp, E. coli
tattgctcgcaagctggaacagcag

SEQ ID NO: 148101 - DNA, 25 bp, E. coli
ttatggcgagactaaacactattgc

SEQ ID NO: 148102 - DNA, 25 bp, E. coli
ttatggcgagacaaaacactattgc

SEQ ID NO: 148103 - DNA, 25 bp, E. coli
tccgttatatcgaatcagtcaatgg

SEQ ID NO: 148104 - DNA, 25 bp, E. coli
tccgttatatcgtatcagtcaatgg

SEQ ID NO: 148105 - DNA, 25 bp, E. coli
tcttacctgagattgagctagcatc

SEQ ID NO: 148106 - DNA, 25 bp, E. coli
tcttacctgagaatgagctagcatc

SEQ ID NO: 148107 - DNA, 25 bp, E. coli
tggaacagcagatcaacaacggacg

SEQ ID NO: 148108 - DNA, 25 bp, E. coli
tggaacagcagaacaacaacggacg

SEQ ID NO: 148109 - DNA, 25 bp, E. coli
gagctagcatctatacgttatattg

SEQ ID NO: 148110 - DNA, 25 bp, E. coli
gagctagcatctttacgttatattg

SEQ ID NO: 148111 - DNA, 25 bp, E. coli
ctttcattcacgcttttagggccag

SEQ ID NO: 148112 - DNA, 25 bp, E. coli
ctttcattcacggttttagggccag

SEQ ID NO: 148113 - DNA, 25 bp, E. coli
aaaacggagttgaaggagactggct

SEQ ID NO: 148114 - DNA, 25 bp, E. coli
aaaacggagttgtaggagactggct

SEQ ID NO: 148115 - DNA, 25 bp, E. coli
ttttctatcattggtgaggctggaa

SEQ ID NO: 148116 - DNA, 25 bp, E. coli
ttttctatcattcgtgaggctggaa

SEQ ID NO: 148117 - DNA, 25 bp, E. coli
tgatcaagttgtcgcttaagcagag

SEQ ID NO: 148118 - DNA, 25 bp, E. coli
tgatcaagttgtggcttaagcagag

SEQ ID NO: 148119 - DNA, 25 bp, E. coli
tgcagcccagaggatgtcctttcct

SEQ ID NO: 148120 - DNA, 25 bp, E. coli
tgcagcccagagcatgtcctttcct

SEQ ID NO: 148121 - DNA, 25 bp, E. coli
tcctttcctgaatgaaatcgctgtc

SEQ ID NO: 148122 - DNA, 25 bp, E. coli
tcctttcctgaaagaaatcgctgtc

SEQ ID NO: 148123 - DNA, 25 bp, E. coli
tctacaggctgaaggatgcagccca

SEQ ID NO: 148124 - DNA, 25 bp, E. coli
tctacaggctgatggatgcagccca

SEQ ID NO: 148125 - DNA, 25 bp, E. coli
tctcacacaggaagaagtctacagg

SEQ ID NO: 148126 - DNA, 25 bp, E. coli
tctcacacaggatgaagtctacagg

SEQ ID NO: 148127 - DNA, 25 bp, E. coli
cgccctatcagctgacaacattttt

SEQ ID NO: 148128 - DNA, 25 bp, E. coli
cgccctatcagcagacaacattttt

SEQ ID NO: 148129 - DNA, 25 bp, E. coli
gggccagtgaacttcttgatttacg

SEQ ID NO: 148130 - DNA, 25 bp, E. coli
gggccagtgaacatcttgatttacg

SEQ ID NO: 148131 - DNA, 25 bp, E. coli
gagactggctttttctctcccggaa

SEQ ID NO: 148132 - DNA, 25 bp, E. coli
gagactggctttatctctcccggaa

SEQ ID NO: 148133 - DNA, 25 bp, E. coli
gaatttttcgcattgggcggttacg

SEQ ID NO: 148134 - DNA, 25 bp, E. coli
gaatttttcgcaatgggcggttacg

SEQ ID NO: 148135 - DNA, 25 bp, E. coli
tacgtgctgcgcaacagcaggaggc

SEQ ID NO: 148136 - DNA, 25 bp, E. coli
tacgtgctgcgctacagcaggaggc

SEQ ID NO: 148137 - DNA, 25 bp, E. coli
ttttggtcgtgcactcggtgatgca

SEQ ID NO: 148138 - DNA, 25 bp, E. coli
ttttggtcgtgctctcggtgatgca

SEQ ID NO: 148139 - DNA, 25 bp, E. coli
tgatgaccgttattccgctggtggt

SEQ ID NO: 148140 - DNA, 25 bp, E. coli
tgatgaccgttaatccgctggtggt

SEQ ID NO: 148141 - DNA, 25 bp, E. coli
tgacccctgcatatgcttcctggaa

SEQ ID NO: 148142 - DNA, 25 bp, E. coli
tgcttcctggaatgaatttttcgca

SEQ ID NO: 148143 - DNA, 25 bp, E. coli
tgacccctgcatttgcttcctggaa

SEQ ID NO: 148144 - DNA, 25 bp, E. coli
tgaggcgcgttttcgtgctgcgcaa

SEQ ID NO: 148145 - DNA, 25 bp, E. coli
tgcttcctggaaagaatttttcgca

SEQ ID NO: 148146 - DNA, 25 bp, E. coli
tgaggcgcgtttacgtgctgcgcaa

SEQ ID NO: 148147 - DNA, 25 bp, E. coli
tcgcaatgggcgcttacgccttttt

SEQ ID NO: 148148 - DNA, 25 bp, E. coli
tgcgcaacagcacgaggctgcatga

SEQ ID NO: 148149 - DNA, 25 bp, E. coli
tgcgcaacagcaggaggctgcatga

SEQ ID NO: 148150 - DNA, 25 bp, E. coli
tccgctggtggttttggtcgtgcac

SEQ ID NO: 148151 - DNA, 25 bp, E. coli
tcgcaatgggcggttacgccttttt

SEQ ID NO: 148152 - DNA, 25 bp, E. coli
tccgctggtggtattggtcgtgcac

SEQ ID NO: 148153 - DNA, 25 bp, E. coli
gtggtgatgaccgttattccgctgg

SEQ ID NO: 148154 - DNA, 25 bp, E. coli
gtggtgatgacccttattccgctgg

SEQ ID NO: 148155 - DNA, 25 bp, E. coli
aatgccccatggtttattcacggta

SEQ ID NO: 148156 - DNA, 25 bp, E. coli
aatgccccatggattattcacggta

SEQ ID NO: 148157 - DNA, 25 bp, E. coli
atgccccatggtatattcacggtat

SEQ ID NO: 148158 - DNA, 25 bp, E. coli
atgccccatggtttattcacggtat

SEQ ID NO: 148159 - DNA, 25 bp, E. coli
atgaatgccccatggtttattcacg

SEQ ID NO: 148160 - DNA, 25 bp, E. coli
atgaatgccccaaggtttattcacg

SEQ ID NO: 148161 - DNA, 25 bp, E. coli
tatgaatgccccatggtttattcac

SEQ ID NO: 148162 - DNA, 25 bp, E. coli
tatgaatgccccttggtttattcac

SEQ ID NO: 148163 - DNA, 25 bp, E. coli
tgaatgccccatggtttattcacgg

SEQ ID NO: 148164 - DNA, 25 bp, E. coli
tgaatgccccatcgtttattcacgg

SEQ ID NO: 148165 - DNA, 25 bp, E. coli
tgccccatggttaattcacggtatt

SEQ ID NO: 148166 - DNA, 25 bp, E. coli
tgccccatggtttattcacggtatt

SEQ ID NO: 148167 - DNA, 25 bp, E. coli
gccccatggttttttcacggtattg

SEQ ID NO: 148168 - DNA, 25 bp, E. coli
gccccatggtttattcacggtattg

SEQ ID NO: 148169 - DNA, 25 bp, E. coli
gaatgccccatggtttattcacggt

SEQ ID NO: 148170 - DNA, 25 bp, E. coli
gaatgccccatgctttattcacggt

SEQ ID NO: 148171 - DNA, 25 bp, E. coli
ctatgaatgcccgatggtttattca

SEQ ID NO: 148172 - DNA, 25 bp, E. coli
ctatgaatgccccatggtttattca

SEQ ID NO: 148173 - DNA, 25 bp, E. coli
caatcagggttgttatggtagggaa

SEQ ID NO: 148174 - DNA, 25 bp, E. coli
caatcagggttgatatggtagggaa

SEQ ID NO: 148175 - DNA, 25 bp, E. coli
cacagcggagctaacagccaaaaaa

SEQ ID NO: 148176 - DNA, 25 bp, E. coli
cacagcggagcttacagccaaaaaa

SEQ ID NO: 148177 - DNA, 25 bp, E. coli
agtgatcaggagttttaacacagcc

SEQ ID NO: 148178 - DNA, 25 bp, E. coli
agtgatcaggagatttaacacagcc

SEQ ID NO: 148179 - DNA, 25 bp, E. coli
aaagtacgtggcgtacctctggaga

SEQ ID NO: 148180 - DNA, 25 bp, E. coli
aaagtacgtggcctacctctggaga

SEQ ID NO: 148181 - DNA, 25 bp, E. coli
aaaaaactgaccactgcgctcatcg

SEQ ID NO: 148182 - DNA, 25 bp, E. coli
aaaaaactgacctctgcgctcatcg

SEQ ID NO: 148183 - DNA, 25 bp, E. coli
ttttaacacagcgtgcgctcacagc

SEQ ID NO: 148184 - DNA, 25 bp, E. coli
ttttaacacagcctgcgctcacagc

SEQ ID NO: 148185 - DNA, 25 bp, E. coli
tgcgctcatcgttcgaaagtacgtg

SEQ ID NO: 148186 - DNA, 25 bp, E. coli
tgcgctcatcgtacgaaagtacgtg

SEQ ID NO: 148187 - DNA, 25 bp, E. coli
tcgcttagaccaaaaagtgatcagg

SEQ ID NO: 148188 - DNA, 25 bp, E. coli
tcgcttagaccataaagtgatcagg

SEQ ID NO: 148189 - DNA, 25 bp, E. coli
tcatatgaaaccttcgcttagacca

SEQ ID NO: 148190 - DNA, 25 bp, E. coli
tcatatgaaaccatcgcttagacca

SEQ ID NO: 148191 - DNA, 25 bp, E. coli
cctacctctggagattaaggagaaa

SEQ ID NO: 148192 - DNA, 25 bp, E. coli
cctacctctggacattaaggagaaa

SEQ ID NO: 148193 - DNA, 25 bp, E. coli
ccgccggaggcattcagggttgtta

SEQ ID NO: 148194 - DNA, 25 bp, E. coli
ccgccggaggcaatcagggttgtta

SEQ ID NO: 148195 - DNA, 25 bp, E. coli
aagatctgtctgacgtcaccctcgg

SEQ ID NO: 148196 - DNA, 25 bp, E. coli
aagatctgtctgtcgtcaccctcgg

SEQ ID NO: 148197 - DNA, 25 bp, E. coli
caccgagccggaatacgaagcagct

SEQ ID NO: 148198 - DNA, 25 bp, E. coli
cacaaaccgttcttttccagggcaa

SEQ ID NO: 148199 - DNA, 25 bp, E. coli
cacaaaccgttcatttccagggcaa

SEQ ID NO: 148200 - DNA, 25 bp, E. coli
caccgagccggattacgaagcagct

SEQ ID NO: 148201 - DNA, 25 bp, E. coli
caggcgggtagcaaagcgcagactt

SEQ ID NO: 148202 - DNA, 25 bp, E. coli
caggcgggtagctaagcgcagactt

SEQ ID NO: 148203 - DNA, 25 bp, E. coli
tacggtgtggcaattgctgatggcc

SEQ ID NO: 148204 - DNA, 25 bp, E. coli
tacggtgtggcatttgctgatggcc

SEQ ID NO: 148205 - DNA, 25 bp, E. coli
gcaaagtgctgatcattttcccgag

SEQ ID NO: 148206 - DNA, 25 bp, E. coli
gcagctctggctctactgaaagcat

SEQ ID NO: 148207 - DNA, 25 bp, E. coli
gcagctctggctgtactgaaagcat

SEQ ID NO: 148208 - DNA, 25 bp, E. coli
gcaaagtgctgaacattttcccgag

SEQ ID NO: 148209 - DNA, 25 bp, E. coli
gacaatgtgattatcagccagctgg

SEQ ID NO: 148210 - DNA, 25 bp, E. coli
gacaatgtgattttcagccagctgg

SEQ ID NO: 148211 - DNA, 25 bp, E. coli
cgcagacttttactctcgtggcaaa

SEQ ID NO: 148212 - DNA, 25 bp, E. coli
cgcagacttttagtctcgtggcaaa

SEQ ID NO: 148213 - DNA, 25 bp, E. coli
gtttgcgccgcaacagtacgtaagt

SEQ ID NO: 148214 - DNA, 25 bp, E. coli
gtttgcgccgcatcagtacgtaagt

SEQ ID NO: 148215 - DNA, 25 bp, E. coli
gatggcccactgaaaggtctggcag

SEQ ID NO: 148216 - DNA, 25 bp, E. coli
gatggcccactgtaaggtctggcag

SEQ ID NO: 148217 - DNA, 25 bp, E. coli
acgttgctggctattttctttgttc

SEQ ID NO: 148218 - DNA, 25 bp, E. coli
acgttgctggcttttttctttgttc

SEQ ID NO: 148219 - DNA, 25 bp, E. coli
ttgctggctattatctttgttcctc

SEQ ID NO: 148220 - DNA, 25 bp, E. coli
ttgctggctattttctttgttcctc

SEQ ID NO: 148221 - DNA, 25 bp, E. coli
tgctggctattttctttgttcctct

SEQ ID NO: 148222 - DNA, 25 bp, E. coli
tgctggctatttactttgttcctct

SEQ ID NO: 148223 - DNA, 25 bp, E. coli
gctggctattttctttgttcctctg

SEQ ID NO: 148224 - DNA, 25 bp, E. coli
gctggctattttgtttgttcctctg

SEQ ID NO: 148225 - DNA, 25 bp, E. coli
gcggtacgctgagcgctacgttgct

SEQ ID NO: 148226 - DNA, 25 bp, E. coli
gcggtacgctgaccgctacgttgct

SEQ ID NO: 148227 - DNA, 25 bp, E. coli
cgttgctggctattttctttgttcc

SEQ ID NO: 148228 - DNA, 25 bp, E. coli
cgttgctggctaatttctttgttcc

SEQ ID NO: 148229 - DNA, 25 bp, E. coli
ctacgttgctggctattttctttgt

SEQ ID NO: 148230 - DNA, 25 bp, E. coli
ctacgttgctgggtattttctttgt

SEQ ID NO: 148231 - DNA, 25 bp, E. coli
gttgctggctatattctttgttcct

SEQ ID NO: 148232 - DNA, 25 bp, E. coli
gttgctggctattttctttgttcct

SEQ ID NO: 148233 - DNA, 25 bp, E. coli
ggtacgctgacccctacgttgctgg

SEQ ID NO: 148234 - DNA, 25 bp, E. coli
ggtacgctgaccgctacgttgctgg

SEQ ID NO: 148235 - DNA, 25 bp, E. coli
tggcggtacgctgaccgctacgttg

SEQ ID NO: 148236 - DNA, 25 bp, E. coli
ggcggtacgctgtccgctacgttgc

SEQ ID NO: 148237 - DNA, 25 bp, E. coli
ggcggtacgctgaccgctacgttgc

SEQ ID NO: 148238 - DNA, 25 bp, E. coli
tggcggtacgctcaccgctacgttg

SEQ ID NO: 148239 - DNA, 25 bp, E. coli
caaaatgtatgcgactaacttcgct

SEQ ID NO: 148240 - DNA, 25 bp, E. coli
caaaatgtatgccactaacttcgct

SEQ ID NO: 148241 - DNA, 25 bp, E. coli
tacgatggcagcgtattgatggcgc

SEQ ID NO: 148242 - DNA, 25 bp, E. coli
tacgatggcagcctattgatggcgc

SEQ ID NO: 148243 - DNA, 25 bp, E. coli
tattgatggcgcagcctgtaaaagc

SEQ ID NO: 148244 - DNA, 25 bp, E. coli
tattgatggcgctgcctgtaaaagc

SEQ ID NO: 148245 - DNA, 25 bp, E. coli
ttagccagcaagtggacgccggtta

SEQ ID NO: 148246 - DNA, 25 bp, E. coli
ttagccagcaagaggacgccggtta

SEQ ID NO: 148247 - DNA, 25 bp, E. coli
gcccggcagcaagcatatttacagt

SEQ ID NO: 148248 - DNA, 25 bp, E. coli
gcccggcagcaaccatatttacagt

SEQ ID NO: 148249 - DNA, 25 bp, E. coli
gcaagcatatttacagtgatgtcga

SEQ ID NO: 148250 - DNA, 25 bp, E. coli
gcagcctgtaaatgctaccaccggg

SEQ ID NO: 148251 - DNA, 25 bp, E. coli
gcaagcatattttcagtgatgtcga

SEQ ID NO: 148252 - DNA, 25 bp, E. coli
gcagcctgtaaaagctaccaccggg

SEQ ID NO: 148253 - DNA, 25 bp, E. coli
ccagcaagtggacgccggttatccc

SEQ ID NO: 148254 - DNA, 25 bp, E. coli
ccggcggacccagaatatccgaata

SEQ ID NO: 148255 - DNA, 25 bp, E. coli
ccagcaagtggaggccggttatccc

SEQ ID NO: 148256 - DNA, 25 bp, E. coli
cccacaatatcccaataaagcggtc

SEQ ID NO: 148257 - DNA, 25 bp, E. coli
ccggcggacccacaatatccgaata

SEQ ID NO: 148258 - DNA, 25 bp, E. coli
cccacaatatccgaataaagcggtc

SEQ ID NO: 148259 - DNA, 25 bp, E. coli
taacttcgctctccaaaagctaatg

SEQ ID NO: 148260 - DNA, 25 bp, E. coli
taacttcgctctgcaaaagctaatg

SEQ ID NO: 148261 - DNA, 25 bp, E. coli
cagtcgttgggtgttgagtagctac

SEQ ID NO: 148262 - DNA, 25 bp, E. coli
cagtcgttgggtcttgagtagctac

SEQ ID NO: 148263 - DNA, 25 bp, E. coli
tacattgtatcgttggcgcagtgca

SEQ ID NO: 148264 - DNA, 25 bp, E. coli
tacaaacgcccctatgagtcagacg

SEQ ID NO: 148265 - DNA, 25 bp, E. coli
tacattgtatcgatggcgcagtgca

SEQ ID NO: 148266 - DNA, 25 bp, E. coli
tacaaacgccccaatgagtcagacg

SEQ ID NO: 148267 - DNA, 25 bp, E. coli
gccgggagtaccagagcttcagatt

SEQ ID NO: 148268 - DNA, 25 bp, E. coli
gccgggagtacctgagcttcagatt

SEQ ID NO: 148269 - DNA, 25 bp, E. coli
gacatcggagctcaatctggacgtt

SEQ ID NO: 148270 - DNA, 25 bp, E. coli
gacttgttcatcgagcaggtggagc

SEQ ID NO: 148271 - DNA, 25 bp, E. coli
gacttgttcatccagcaggtggagc

SEQ ID NO: 148272 - DNA, 25 bp, E. coli
gaaagctgccagtagacttgccaaa

SEQ ID NO: 148273 - DNA, 25 bp, E. coli
gacatcggagctgaatctggacgtt

SEQ ID NO: 148274 - DNA, 25 bp, E. coli
gaaagctgccagaagacttgccaaa

SEQ ID NO: 148275 - DNA, 25 bp, E. coli
cgagctgagcttagatggccgaaca

SEQ ID NO: 148276 - DNA, 25 bp, E. coli
cgagctgagctttgatggccgaaca

SEQ ID NO: 148277 - DNA, 25 bp, E. coli
gttgataaactacccgaagcaggcc

SEQ ID NO: 148278 - DNA, 25 bp, E. coli
gttgataaactagccgaagcaggcc

SEQ ID NO: 148279 - DNA, 25 bp, E. coli
taagatctacgatcatagcggcgcc

SEQ ID NO: 148280 - DNA, 25 bp, E. coli
taagatctacgaacatagcggcgcc

SEQ ID NO: 148281 - DNA, 25 bp, E. coli
gagtagctactttgcgacagcctgg

SEQ ID NO: 148282 - DNA, 25 bp, E. coli
gagtagctacttagcgacagcctgg

SEQ ID NO: 148283 - DNA, 25 bp, E. coli
cagcggtcatgtggcgttaaatctc

SEQ ID NO: 148284 - DNA, 25 bp, E. coli
cagcggtcatgtcgcgttaaatctc

SEQ ID NO: 148285 - DNA, 25 bp, E. coli
cagtctgtcgtttatcagctacgac

SEQ ID NO: 148286 - DNA, 25 bp, E. coli
cagtctgtcgttaatcagctacgac

SEQ ID NO: 148287 - DNA, 25 bp, E. coli
tacatcaagccagatttcgagattg

SEQ ID NO: 148288 - DNA, 25 bp, E. coli
tacatcaagccacatttcgagattg

SEQ ID NO: 148289 - DNA, 25 bp, E. coli
aacggtgtccgacgccagcggtcat

SEQ ID NO: 148290 - DNA, 25 bp, E. coli
aacggtgtccgaggccagcggtcat

SEQ ID NO: 148291 - DNA, 25 bp, E. coli
tgtccgacgccagcggtcatgtggc

SEQ ID NO: 148292 - DNA, 25 bp, E. coli
tgtccgacgccaccggtcatgtggc

SEQ ID NO: 148293 - DNA, 25 bp, E. coli
tctgtcgtttatcagctacgaccag

SEQ ID NO: 148294 - DNA, 25 bp, E. coli
tctgtcgtttatgagctacgaccag

SEQ ID NO: 148295 - DNA, 25 bp, E. coli
gccacatttcgagattggtttagct

SEQ ID NO: 148296 - DNA, 25 bp, E. coli
gccacatttcgacattggtttagct

SEQ ID NO: 148297 - DNA, 25 bp, E. coli
ctcgccgcagcccggtaacatttat

SEQ ID NO: 148298 - DNA, 25 bp, E. coli
ctcgccgcagccgggtaacatttat

SEQ ID NO: 148299 - DNA, 25 bp, E. coli
gtaacatttatattcctctcggcca

SEQ ID NO: 148300 - DNA, 25 bp, E. coli
gtaacatttataatcctctcggcca

SEQ ID NO: 148301 - DNA, 25 bp, E. coli
ggcagcgaaacggtgtccgacgcca

SEQ ID NO: 148302 - DNA, 25 bp, E. coli
ggcagcgaaacgctgtccgacgcca

SEQ ID NO: 148303 - DNA, 25 bp, E. coli
ggcaaactacatcaagccacatttc

SEQ ID NO: 148304 - DNA, 25 bp, E. coli
ggcaaactacatgaagccacatttc

SEQ ID NO: 148305 - DNA, 25 bp, E. coli
cacgagttcgtgaaggcaagcttga

SEQ ID NO: 148306 - DNA, 25 bp, E. coli
cacgagttcgtgtaggcaagcttga

SEQ ID NO: 148307 - DNA, 25 bp, E. coli
taaagaactcgagtcaccaaaaggt

SEQ ID NO: 148308 - DNA, 25 bp, E. coli
taaatccagtgatcgcagaacaact

SEQ ID NO: 148309 - DNA, 25 bp, E. coli
taaagaactcgactcaccaaaaggt

SEQ ID NO: 148310 - DNA, 25 bp, E. coli
taaatccagtgaacgcagaacaact

SEQ ID NO: 148311 - DNA, 25 bp, E. coli
aaaggtgttcatgccgagttagatc

SEQ ID NO: 148312 - DNA, 25 bp, E. coli
aaaggtgttcatcccgagttagatc

SEQ ID NO: 148313 - DNA, 25 bp, E. coli
tatacaaaaactacagcggacttcg

SEQ ID NO: 148314 - DNA, 25 bp, E. coli
tatacaaaaacttcagcggacttcg

SEQ ID NO: 148315 - DNA, 25 bp, E. coli
ttcacatgccactcaagaaagtagc

SEQ ID NO: 148316 - DNA, 25 bp, E. coli
ttcacatgccacacaagaaagtagc

SEQ ID NO: 148317 - DNA, 25 bp, E. coli
gccgttgggcaacgtcaatacgtaa

SEQ ID NO: 148318 - DNA, 25 bp, E. coli
gccgttgggcaaggtcaatacgtaa

SEQ ID NO: 148319 - DNA, 25 bp, E. coli
ccaaaacctctgaatctaagcctga

SEQ ID NO: 148320 - DNA, 25 bp, E. coli
ccaaaacctctgtatctaagcctga

SEQ ID NO: 148321 - DNA, 25 bp, E. coli
ggtctcaagcttaaactacatgtcg

SEQ ID NO: 148322 - DNA, 25 bp, E. coli
ggtctcaagctttaactacatgtcg

SEQ ID NO: 148323 - DNA, 25 bp, E. coli
taaaccgcctttcggcatttatgga

SEQ ID NO: 148324 - DNA, 25 bp, E. coli
taaaccgcctttgggcatttatgga

SEQ ID NO: 148325 - DNA, 25 bp, E. coli
gatgaactttatgcggcatcgaagg

SEQ ID NO: 148326 - DNA, 25 bp, E. coli
gatgaactttatccggcatcgaagg

SEQ ID NO: 148327 - DNA, 25 bp, E. coli
ttataccgatggacgcccggacaag

SEQ ID NO: 148328 - DNA, 25 bp, E. coli
taccgtttcactaacgcgtccggtg

SEQ ID NO: 148329 - DNA, 25 bp, E. coli
taccgtttcacttacgcgtccggtg

SEQ ID NO: 148330 - DNA, 25 bp, E. coli
atttacaggactcaacgttgatagc

SEQ ID NO: 148331 - DNA, 25 bp, E. coli
atttacaggactgaacgttgatagc

SEQ ID NO: 148332 - DNA, 25 bp, E. coli
agtgacggtacatttcggtgacgag

SEQ ID NO: 148333 - DNA, 25 bp, E. coli
agtgacggtacaattcggtgacgag

SEQ ID NO: 148334 - DNA, 25 bp, E. coli
acgccagggaatcccagtgacggta

SEQ ID NO: 148335 - DNA, 25 bp, E. coli
acgccagggaatgccagtgacggta

SEQ ID NO: 148336 - DNA, 25 bp, E. coli
tgaatttacaggactcaacgttgat

SEQ ID NO: 148337 - DNA, 25 bp, E. coli
tgaatttacaggtctcaacgttgat

SEQ ID NO: 148338 - DNA, 25 bp, E. coli
ccagggaatgcctgtgacggtacaa

SEQ ID NO: 148339 - DNA, 25 bp, E. coli
gccagtgacggtacaattcggtgac

SEQ ID NO: 148340 - DNA, 25 bp, E. coli
gccagtgacggttcaattcggtgac

SEQ ID NO: 148341 - DNA, 25 bp, E. coli
ccagggaatgccagtgacggtacaa

SEQ ID NO: 148342 - DNA, 25 bp, E. coli
gaatgccagtgagggtacaattcgg

SEQ ID NO: 148343 - DNA, 25 bp, E. coli
gaatgccagtgacggtacaattcgg

SEQ ID NO: 148344 - DNA, 25 bp, E. coli
ccgtttcactaaggcgtccggtgtg

SEQ ID NO: 148345 - DNA, 25 bp, E. coli
ccgtttcactaacgcgtccggtgtg

SEQ ID NO: 148346 - DNA, 25 bp, E. coli
gtggcacggtgtttaccgtttcact

SEQ ID NO: 148347 - DNA, 25 bp, E. coli
gtggcacggtgtataccgtttcact

SEQ ID NO: 148348 - DNA, 25 bp, E. coli
ttataccgatggtcgcccggacaag

SEQ ID NO: 148349 - DNA, 25 bp, E. coli
aattccagtggcattcctgcgttcg

SEQ ID NO: 148350 - DNA, 25 bp, E. coli
aattccagtggctttcctgcgttcg

SEQ ID NO: 148351 - DNA, 25 bp, E. coli
catggactcaactaaccgtagaaat

SEQ ID NO: 148352 - DNA, 25 bp, E. coli
catggactcaacaaaccgtagaaat

SEQ ID NO: 148353 - DNA, 25 bp, E. coli
acgggagaattccagtggctttcct

SEQ ID NO: 148354 - DNA, 25 bp, E. coli
acgggagaattcgagtggctttcct

SEQ ID NO: 148355 - DNA, 25 bp, E. coli
acagctggctggcttgtggcgcggg

SEQ ID NO: 148356 - DNA, 25 bp, E. coli
acagctggctgggttgtggcgcggg

SEQ ID NO: 148357 - DNA, 25 bp, E. coli
tgtggcgcgggtatcattgatgtta

SEQ ID NO: 148358 - DNA, 25 bp, E. coli
tgtggcgcgggtttcattgatgtta

SEQ ID NO: 148359 - DNA, 25 bp, E. coli
ccagtggctttcctgcgttcggtaa

SEQ ID NO: 148360 - DNA, 25 bp, E. coli
ccagtggctttcgtgcgttcggtaa

SEQ ID NO: 148361 - DNA, 25 bp, E. coli
gcgcgggtttcaatgatgttagctt

SEQ ID NO: 148362 - DNA, 25 bp, E. coli
gcgcgggtttcattgatgttagctt

SEQ ID NO: 148363 - DNA, 25 bp, E. coli
gaactgttataatataacaatccct

SEQ ID NO: 148364 - DNA, 25 bp, E. coli
gaactgttataaaataacaatccct

SEQ ID NO: 148365 - DNA, 25 bp, E. coli
gggcatggactctacaaaccgtaga

SEQ ID NO: 148366 - DNA, 25 bp, E. coli
ggagaattccagaggctttcctgcg

SEQ ID NO: 148367 - DNA, 25 bp, E. coli
gggcatggactcaacaaaccgtaga

SEQ ID NO: 148368 - DNA, 25 bp, E. coli
ggagaattccagtggctttcctgcg

SEQ ID NO: 148369 - DNA, 25 bp, E. coli
ggcatggactcaacaaaccgtagaa

SEQ ID NO: 148370 - DNA, 25 bp, E. coli
ggcatggactcatcaaaccgtagaa

SEQ ID NO: 148371 - DNA, 25 bp, E. coli
caacaggtgccgtttgaagtcttct

SEQ ID NO: 148372 - DNA, 25 bp, E. coli
caacaggtgccgattgaagtcttct

SEQ ID NO: 148373 - DNA, 25 bp, E. coli
taaaagcgccatggatgctcagcaa

SEQ ID NO: 148374 - DNA, 25 bp, E. coli
taaaagcgccatcgatgctcagcaa

SEQ ID NO: 148375 - DNA, 25 bp, E. coli
ttatgtctgggctccggcggttaac

SEQ ID NO: 148376 - DNA, 25 bp, E. coli
ttatgtctgggcaccggcggttaac

SEQ ID NO: 148377 - DNA, 25 bp, E. coli
ttttgccgagaaacatcctgaggtc

SEQ ID NO: 148378 - DNA, 25 bp, E. coli
ttttgccgagaatcatcctgaggtc

SEQ ID NO: 148379 - DNA, 25 bp, E. coli
tgattacagccagtacgttacctcg

SEQ ID NO: 148380 - DNA, 25 bp, E. coli
tgattacagccactacgttacctcg

SEQ ID NO: 148381 - DNA, 25 bp, E. coli
tgaccggaccggtgaacaaagcgat

SEQ ID NO: 148382 - DNA, 25 bp, E. coli
tgaccggaccggagaacaaagcgat

SEQ ID NO: 148383 - DNA, 25 bp, E. coli
tgctggcgtcaatactgggtaactc

SEQ ID NO: 148384 - DNA, 25 bp, E. coli
tgctggcgtcaaaactgggtaactc

SEQ ID NO: 148385 - DNA, 25 bp, E. coli
cgacaccgcgcagtttttgaaagag

SEQ ID NO: 148386 - DNA, 25 bp, E. coli
cgacaccgcgcactttttgaaagag

SEQ ID NO: 148387 - DNA, 25 bp, E. coli
cggaaaacatcagcaaactggcgcg

SEQ ID NO: 148388 - DNA, 25 bp, E. coli
cggaaaacatcaccaaactggcgcg

SEQ ID NO: 148389 - DNA, 25 bp, E. coli
ggtaactccgaagcgctggtggtaa

SEQ ID NO: 148390 - DNA, 25 bp, E. coli
ggtaactccgaaccgctggtggtaa

SEQ ID NO: 148391 - DNA, 25 bp, E. coli
ggaatacctatcagacgccgcagca

SEQ ID NO: 148392 - DNA, 25 bp, E. coli
ggaatacctatctgacgccgcagca

SEQ ID NO: 148393 - DNA, 25 bp, E. coli
aagggcggctgaataatgtgatgac

SEQ ID NO: 148394 - DNA, 25 bp, E. coli
aagggcggctgattaatgtgatgac

SEQ ID NO: 148395 - DNA, 25 bp, E. coli
aacgcacaggagtaatggacaatgc

SEQ ID NO: 148396 - DNA, 25 bp, E. coli
aaagctggaattagacattgtcgca

SEQ ID NO: 148397 - DNA, 25 bp, E. coli
aaagctggaatttgacattgtcgca

SEQ ID NO: 148398 - DNA, 25 bp, E. coli
aacgcacaggagaaatggacaatgc

SEQ ID NO: 148399 - DNA, 25 bp, E. coli
tatctgggactgttgaacgcacagg

SEQ ID NO: 148400 - DNA, 25 bp, E. coli
tatctgggactgatgaacgcacagg

SEQ ID NO: 148401 - DNA, 25 bp, E. coli
ttgaagctacttaatctgggactga

SEQ ID NO: 148402 - DNA, 25 bp, E. coli
ttgaagctactttatctgggactga

SEQ ID NO: 148403 - DNA, 25 bp, E. coli
tgatgaacgcactggagaaatggac

SEQ ID NO: 148404 - DNA, 25 bp, E. coli
tgatgaacgcacaggagaaatggac

SEQ ID NO: 148405 - DNA, 25 bp, E. coli
tgcccatccaaacctggaatttgac

SEQ ID NO: 148406 - DNA, 25 bp, E. coli
tgcccatccaaagctggaatttgac

SEQ ID NO: 148407 - DNA, 25 bp, E. coli
ccatttattttgtagggcggctgaa

SEQ ID NO: 148408 - DNA, 25 bp, E. coli
ccatttattttgaagggcggctgaa

SEQ ID NO: 148409 - DNA, 25 bp, E. coli
gacattgtcgcagttagccatttat

SEQ ID NO: 148410 - DNA, 25 bp, E. coli
gacattgtcgcacttagccatttat

SEQ ID NO: 148411 - DNA, 25 bp, E. coli
tggacaatgcccttccaaagctgga

SEQ ID NO: 148412 - DNA, 25 bp, E. coli
tggacaatgcccatccaaagctgga

SEQ ID NO: 148413 - DNA, 25 bp, E. coli
tactttatctgggactgatgaacgc

SEQ ID NO: 148414 - DNA, 25 bp, E. coli
tactttatctggcactgatgaacgc

SEQ ID NO: 148415 - DNA, 25 bp, E. coli
catccagaagcgaaaagtgcccagg

SEQ ID NO: 148416 - DNA, 25 bp, E. coli
catccagaagcgtaaagtgcccagg

SEQ ID NO: 148417 - DNA, 25 bp, E. coli
acgcctgccgaggtgcggatcattg

SEQ ID NO: 148418 - DNA, 25 bp, E. coli
acgcctgccgagctgcggatcattg

SEQ ID NO: 148419 - DNA, 25 bp, E. coli
tacctgcgttttcgcgatcgctgcg

SEQ ID NO: 148420 - DNA, 25 bp, E. coli
tacctgcgttttggcgatcgctgcg

SEQ ID NO: 148421 - DNA, 25 bp, E. coli
ttttcgcgatcggtgcgtctcggca

SEQ ID NO: 148422 - DNA, 25 bp, E. coli
ttttcgcgatcgctgcgtctcggca

SEQ ID NO: 148423 - DNA, 25 bp, E. coli
cctgagacgaaatgtggatgccgga

SEQ ID NO: 148424 - DNA, 25 bp, E. coli
gccgagctgcggttcattgcacgcg

SEQ ID NO: 148425 - DNA, 25 bp, E. coli
gccgagctgcggatcattgcacgcg

SEQ ID NO: 148426 - DNA, 25 bp, E. coli
cctgagacgaaaagtggatgccgga

SEQ ID NO: 148427 - DNA, 25 bp, E. coli
cgacggcctggaagacgatgctgaa

SEQ ID NO: 148428 - DNA, 25 bp, E. coli
cgaaaagtgcccaggccgatttact

SEQ ID NO: 148429 - DNA, 25 bp, E. coli
cgacggcctggatgacgatgctgaa

SEQ ID NO: 148430 - DNA, 25 bp, E. coli
cgaaaagtgccctggccgatttact

SEQ ID NO: 148431 - DNA, 25 bp, E. coli
ctgcgtctcggcaggcattgatgtg

SEQ ID NO: 148432 - DNA, 25 bp, E. coli
ctgcgtctcggctggcattgatgtg

SEQ ID NO: 148433 - DNA, 25 bp, E. coli
ggcgtatccggatgtacatccagaa

SEQ ID NO: 148434 - DNA, 25 bp, E. coli
ggccgatttactcaacctgagacga

SEQ ID NO: 148435 - DNA, 25 bp, E. coli
ggccgatttactgaacctgagacga

SEQ ID NO: 148436 - DNA, 25 bp, E. coli
ggcgtatccggaagtacatccagaa

SEQ ID NO: 148437 - DNA, 25 bp, E. coli
aagtgatgatccgactgaaaccgga

SEQ ID NO: 148438 - DNA, 25 bp, E. coli
aagtgatgatcccactgaaaccgga

SEQ ID NO: 148439 - DNA, 25 bp, E. coli
tgatcccactgaaaccggaagtgga

SEQ ID NO: 148440 - DNA, 25 bp, E. coli
tgatcccactgataccggaagtgga

SEQ ID NO: 148441 - DNA, 25 bp, E. coli
tgtacgtgcgaacgtgttaggttta

SEQ ID NO: 148442 - DNA, 25 bp, E. coli
tgtacgtgcgaaggtgttaggttta

SEQ ID NO: 148443 - DNA, 25 bp, E. coli
tccggtgactggcaatgccaatggc

SEQ ID NO: 148444 - DNA, 25 bp, E. coli
tccggtgactgggaatgccaatggc

SEQ ID NO: 148445 - DNA, 25 bp, E. coli
gcggtgattttgtttcatgccgaat

SEQ ID NO: 148446 - DNA, 25 bp, E. coli
gcggtgattttgattcatgccgaat

SEQ ID NO: 148447 - DNA, 25 bp, E. coli
cccgatgggtgcatggttggtacat

SEQ ID NO: 148448 - DNA, 25 bp, E. coli
cccgatgggtgcttggttggtacat

SEQ ID NO: 148449 - DNA, 25 bp, E. coli
cggtatgattgaagtgacggtgaca

SEQ ID NO: 148450 - DNA, 25 bp, E. coli
cggtatgattgatgtgacggtgaca

SEQ ID NO: 148451 - DNA, 25 bp, E. coli
gattttgtttcatgccgaatgggca

SEQ ID NO: 148452 - DNA, 25 bp, E. coli
gattttgtttcaagccgaatgggca

SEQ ID NO: 148453 - DNA, 25 bp, E. coli
tgcgaaggtgttaggtttaggaaat

SEQ ID NO: 148454 - DNA, 25 bp, E. coli
tggcaatgccaaaggcccgatgggt

SEQ ID NO: 148455 - DNA, 25 bp, E. coli
tggcaatgccaatggcccgatgggt

SEQ ID NO: 148456 - DNA, 25 bp, E. coli
tgcgaaggtgtttggtttaggaaat

SEQ ID NO: 148457 - DNA, 25 bp, E. coli
gaccttaatgcgctgaccgctatca

SEQ ID NO: 148458 - DNA, 25 bp, E. coli
gaccttaatgcggtgaccgctatca

SEQ ID NO: 148459 - DNA, 25 bp, E. coli
taaacgcacataacatcatgatctg

SEQ ID NO: 148460 - DNA, 25 bp, E. coli
taaacgcacatatcatcatgatctg

SEQ ID NO: 148461 - DNA, 25 bp, E. coli
ttcggtcataaaggcacataacatc

SEQ ID NO: 148462 - DNA, 25 bp, E. coli
ttcggtcataaacgcacataacatc

SEQ ID NO: 148463 - DNA, 25 bp, E. coli
tgtggtccgcattcggtcataaacg

SEQ ID NO: 148464 - DNA, 25 bp, E. coli
tgtggtccgcatacggtcataaacg

SEQ ID NO: 148465 - DNA, 25 bp, E. coli
tcatgatctgtgaggttttgtaggc

SEQ ID NO: 148466 - DNA, 25 bp, E. coli
tcatgatctgtgtggttttgtaggc

SEQ ID NO: 148467 - DNA, 25 bp, E. coli
ccaaatgccggatgcgtctctggtt

SEQ ID NO: 148468 - DNA, 25 bp, E. coli
ccaaatgccggaagcgtctctggtt

SEQ ID NO: 148469 - DNA, 25 bp, E. coli
gaatgtggtccggattcggtcataa

SEQ ID NO: 148470 - DNA, 25 bp, E. coli
gcacataacatcatgatctgtgtgg

SEQ ID NO: 148471 - DNA, 25 bp, E. coli
gaatgtggtccgcattcggtcataa

SEQ ID NO: 148472 - DNA, 25 bp, E. coli
gcacataacatcttgatctgtgtgg

SEQ ID NO: 148473 - DNA, 25 bp, E. coli
cgcattcggtcataaacgcacataa

SEQ ID NO: 148474 - DNA, 25 bp, E. coli
cgcattcggtcaaaaacgcacataa

SEQ ID NO: 148475 - DNA, 25 bp, E. coli
gtccgcattcggtcataaacgcaca

SEQ ID NO: 148476 - DNA, 25 bp, E. coli
gtccgcattcggacataaacgcaca

SEQ ID NO: 148477 - DNA, 25 bp, E. coli
ggtcataaacgctcataacatcatg

SEQ ID NO: 148478 - DNA, 25 bp, E. coli
ggtcataaacgcacataacatcatg

SEQ ID NO: 148479 - DNA, 25 bp, E. coli
tgtgaatgtggtgcgcattcggtca

SEQ ID NO: 148480 - DNA, 25 bp, E. coli
tgtgaatgtggtccgcattcggtca

SEQ ID NO: 148481 - DNA, 25 bp, E. coli
catcaggcaattaagcgtttgaaac

SEQ ID NO: 148482 - DNA, 25 bp, E. coli
catcaggcaatttagcgtttgaaac

SEQ ID NO: 148483 - DNA, 25 bp, E. coli
aaagtagcgttgagaaaagtctcgc

SEQ ID NO: 148484 - DNA, 25 bp, E. coli
aaagtagcgttgtgaaaagtctcgc

SEQ ID NO: 148485 - DNA, 25 bp, E. coli
tgtaagaacatgagcaaccgcacat

SEQ ID NO: 148486 - DNA, 25 bp, E. coli
tgtaagaacatgtgcaaccgcacat

SEQ ID NO: 148487 - DNA, 25 bp, E. coli
tcgcgacgcgaaatatcaatctctt

SEQ ID NO: 148488 - DNA, 25 bp, E. coli
tcgcgacgcgaattatcaatctctt

SEQ ID NO: 148489 - DNA, 25 bp, E. coli
tctcgctgactacaggaacagacta

SEQ ID NO: 148490 - DNA, 25 bp, E. coli
tctttgacgtattaattgctgcacc

SEQ ID NO: 148491 - DNA, 25 bp, E. coli
tctcgctgactagaggaacagacta

SEQ ID NO: 148492 - DNA, 25 bp, E. coli
tctttgacgtataaattgctgcacc

SEQ ID NO: 148493 - DNA, 25 bp, E. coli
gccccatccggcttagcgaaactta

SEQ ID NO: 148494 - DNA, 25 bp, E. coli
gccccatccggcatagcgaaactta

SEQ ID NO: 148495 - DNA, 25 bp, E. coli
gaacagactatttttcgcgacgcga

SEQ ID NO: 148496 - DNA, 25 bp, E. coli
gaacagactattattcgcgacgcga

SEQ ID NO: 148497 - DNA, 25 bp, E. coli
gaaaagcagaaataacgccgctgaa

SEQ ID NO: 148498 - DNA, 25 bp, E. coli
gaaattccagcatgatgaaagcggt

SEQ ID NO: 148499 - DNA, 25 bp, E. coli
gaaaagcagaaaaaacgccgctgaa

SEQ ID NO: 148500 - DNA, 25 bp, E. coli
gaaattccagcaagatgaaagcggt

SEQ ID NO: 148501 - DNA, 25 bp, E. coli
taagtttgcggtagaaaggcttgca

SEQ ID NO: 148502 - DNA, 25 bp, E. coli
taagtttgcggttgaaaggcttgca

SEQ ID NO: 148503 - DNA, 25 bp, E. coli
caaaaaacaatcgtaaaatcagcgg

SEQ ID NO: 148504 - DNA, 25 bp, E. coli
caaaaaacaatcctaaaatcagcgg

SEQ ID NO: 148505 - DNA, 25 bp, E. coli
ttgccgggtgctcacggcaaaaaac

SEQ ID NO: 148506 - DNA, 25 bp, E. coli
ttgccgggtgctgacggcaaaaaac

SEQ ID NO: 148507 - DNA, 25 bp, E. coli
tgacggcaaaaatcaatcgtaaaat

SEQ ID NO: 148508 - DNA, 25 bp, E. coli
tgacggcaaaaaacaatcgtaaaat

SEQ ID NO: 148509 - DNA, 25 bp, E. coli
tgctgacggcaaaaaacaatcgtaa

SEQ ID NO: 148510 - DNA, 25 bp, E. coli
tgctgacggcaataaacaatcgtaa

SEQ ID NO: 148511 - DNA, 25 bp, E. coli
gccgggtgctgagggcaaaaaacaa

SEQ ID NO: 148512 - DNA, 25 bp, E. coli
gccgggtgctgacggcaaaaaacaa

SEQ ID NO: 148513 - DNA, 25 bp, E. coli
gctgacggcaaaaaacaatcgtaaa

SEQ ID NO: 148514 - DNA, 25 bp, E. coli
gctgacggcaaataacaatcgtaaa

SEQ ID NO: 148515 - DNA, 25 bp, E. coli
gcaaaaaacaatggtaaaatcagcg

SEQ ID NO: 148516 - DNA, 25 bp, E. coli
gcaaaaaacaatcgtaaaatcagcg

SEQ ID NO: 148517 - DNA, 25 bp, E. coli
cggcaaaaaacattcgtaaaatcag

SEQ ID NO: 148518 - DNA, 25 bp, E. coli
cggcaaaaaacaatcgtaaaatcag

SEQ ID NO: 148519 - DNA, 25 bp, E. coli
ggtgctgacggctaaaaacaatcgt

SEQ ID NO: 148520 - DNA, 25 bp, E. coli
gggtgctgacgggaaaaaacaatcg

SEQ ID NO: 148521 - DNA, 25 bp, E. coli
gggtgctgacggcaaaaaacaatcg

SEQ ID NO: 148522 - DNA, 25 bp, E. coli
gtgctgacggcaaaaaacaatcgta

SEQ ID NO: 148523 - DNA, 25 bp, E. coli
gtgctgacggcataaaacaatcgta

SEQ ID NO: 148524 - DNA, 25 bp, E. coli
ggtgctgacggcaaaaaacaatcgt

SEQ ID NO: 148525 - DNA, 25 bp, E. coli
aagccgcataaacctgcaactttcg

SEQ ID NO: 148526 - DNA, 25 bp, E. coli
aagccgcataaagctgcaactttcg

SEQ ID NO: 148527 - DNA, 25 bp, E. coli
caactttcgcaaatgatgtggtacg

SEQ ID NO: 148528 - DNA, 25 bp, E. coli
cagaatatttatctggctgggtgat

SEQ ID NO: 148529 - DNA, 25 bp, E. coli
caactttcgcaattgatgtggtacg

SEQ ID NO: 148530 - DNA, 25 bp, E. coli
cagaatatttatgtggctgggtgat

SEQ ID NO: 148531 - DNA, 25 bp, E. coli
taaagctgcaacattcgcaaatgat

SEQ ID NO: 148532 - DNA, 25 bp, E. coli
taaagctgcaactttcgcaaatgat

SEQ ID NO: 148533 - DNA, 25 bp, E. coli
taaaaaaccagaatatttatctggc

SEQ ID NO: 148534 - DNA, 25 bp, E. coli
taaaaaaccagattatttatctggc

SEQ ID NO: 148535 - DNA, 25 bp, E. coli
atttatctggctgggtgattttaga

SEQ ID NO: 148536 - DNA, 25 bp, E. coli
atttatctggctcggtgattttaga

SEQ ID NO: 148537 - DNA, 25 bp, E. coli
agctgcaactttggcaaatgatgtg

SEQ ID NO: 148538 - DNA, 25 bp, E. coli
agctgcaactttcgcaaatgatgtg

SEQ ID NO: 148539 - DNA, 25 bp, E. coli
aaaccagaatatatatctggctggg

SEQ ID NO: 148540 - DNA, 25 bp, E. coli
aaaccagaatatttatctggctggg

SEQ ID NO: 148541 - DNA, 25 bp, E. coli
gccgcataaagctgcaactttcgca

SEQ ID NO: 148542 - DNA, 25 bp, E. coli
gccgcataaagcagcaactttcgca

SEQ ID NO: 148543 - DNA, 25 bp, E. coli
gcataaagctgcaactttcgcaaat

SEQ ID NO: 148544 - DNA, 25 bp, E. coli
gcataaagctgctactttcgcaaat

SEQ ID NO: 148545 - DNA, 25 bp, E. coli
ctttcgcaaatgttgtggtacgcat

SEQ ID NO: 148546 - DNA, 25 bp, E. coli
ctttcgcaaatgatgtggtacgcat

SEQ ID NO: 148547 - DNA, 25 bp, E. coli
catcagcagcggtgatctggtgcag

SEQ ID NO: 148548 - DNA, 25 bp, E. coli
catcagcagcggagatctggtgcag

SEQ ID NO: 148549 - DNA, 25 bp, E. coli
aagtgccggtaaaactcaatgtctg

SEQ ID NO: 148550 - DNA, 25 bp, E. coli
aacggatgacatcaaaacgggtaag

SEQ ID NO: 148551 - DNA, 25 bp, E. coli
aacggatgacatgaaaacgggtaag

SEQ ID NO: 148552 - DNA, 25 bp, E. coli
aagtgccggtaatactcaatgtctg

SEQ ID NO: 148553 - DNA, 25 bp, E. coli
tagaagaaggaaaaacggtggcgat

SEQ ID NO: 148554 - DNA, 25 bp, E. coli
tagaagaaggaataacggtggcgat

SEQ ID NO: 148555 - DNA, 25 bp, E. coli
tattccacagggtgaaacaggcgac

SEQ ID NO: 148556 - DNA, 25 bp, E. coli
tattccacagggagaaacaggcgac

SEQ ID NO: 148557 - DNA, 25 bp, E. coli
tgtttttgcggtggcgctgaccgat

SEQ ID NO: 148558 - DNA, 25 bp, E. coli
tgtctgggcagaagccggaaccagt

SEQ ID NO: 148559 - DNA, 25 bp, E. coli
tgtttttgcggtcgcgctgaccgat

SEQ ID NO: 148560 - DNA, 25 bp, E. coli
tgtctgggcagatgccggaaccagt

SEQ ID NO: 148561 - DNA, 25 bp, E. coli
tgaccgaaggtgagtttatgctgcc

SEQ ID NO: 148562 - DNA, 25 bp, E. coli
tgctgcctaagcagaaaacggatga

SEQ ID NO: 148563 - DNA, 25 bp, E. coli
tgctgcctaagctgaaaacggatga

SEQ ID NO: 148564 - DNA, 25 bp, E. coli
tgaccgaaggtgtgtttatgctgcc

SEQ ID NO: 148565 - DNA, 25 bp, E. coli
gaaccagtgcagaagaagtgccggt

SEQ ID NO: 148566 - DNA, 25 bp, E. coli
gaaccagtgcagtagaagtgccggt

SEQ ID NO: 148567 - DNA, 25 bp, E. coli
ggaaaagttcagctgactaacagcg

SEQ ID NO: 148568 - DNA, 25 bp, E. coli
ggaaaagttcaggtgactaacagcg

SEQ ID NO: 148569 - DNA, 25 bp, E. coli
cacttgatgccgtagatgttgtccc

SEQ ID NO: 148570 - DNA, 25 bp, E. coli
cacttgatgccgaagatgttgtccc

SEQ ID NO: 148571 - DNA, 25 bp, E. coli
tactggcgcgaaggaaaactacgtc

SEQ ID NO: 148572 - DNA, 25 bp, E. coli
tactggcgcgaacgaaaactacgtc

SEQ ID NO: 148573 - DNA, 25 bp, E. coli
agaaaacaacgtgcctgagctgctc

SEQ ID NO: 148574 - DNA, 25 bp, E. coli
agaaaacaacgtccctgagctgctc

SEQ ID NO: 148575 - DNA, 25 bp, E. coli
aaaatggttgaagtctcgcatcgac

SEQ ID NO: 148576 - DNA, 25 bp, E. coli
aaaatggttgaactctcgcatcgac

SEQ ID NO: 148577 - DNA, 25 bp, E. coli
tgtgaagtgacgatccggcacggat

SEQ ID NO: 148578 - DNA, 25 bp, E. coli
tgtgaagtgacgttccggcacggat

SEQ ID NO: 148579 - DNA, 25 bp, E. coli
tgtagctgctgccacacctgaatca

SEQ ID NO: 148580 - DNA, 25 bp, E. coli
tgtagctgctgcgacacctgaatca

SEQ ID NO: 148581 - DNA, 25 bp, E. coli
tgaaatcattaaccgcagtgcgtaa

SEQ ID NO: 148582 - DNA, 25 bp, E. coli
tgaaatcattaagcgcagtgcgtaa

SEQ ID NO: 148583 - DNA, 25 bp, E. coli
gaacctgctgattcgggagctcaaa

SEQ ID NO: 148584 - DNA, 25 bp, E. coli
gaacctgctgatacgggagctcaaa

SEQ ID NO: 148585 - DNA, 25 bp, E. coli
ggatcactccgtgtgaatggtgcca

SEQ ID NO: 148586 - DNA, 25 bp, E. coli
ggatcactccgtctgaatggtgcca

SEQ ID NO: 148587 - DNA, 25 bp, E. coli
taatttgctgttgaagtggcgccag

SEQ ID NO: 148588 - DNA, 25 bp, E. coli
taatttgctgttcaagtggcgccag

SEQ ID NO: 148589 - DNA, 25 bp, E. coli
gagctgctcccgataacacttgatg

SEQ ID NO: 148590 - DNA, 25 bp, E. coli
gagctgctcccgttaacacttgatg

SEQ ID NO: 148591 - DNA, 25 bp, E. coli
caacggcacgcaaagtgggagcaag

SEQ ID NO: 148592 - DNA, 25 bp, E. coli
caacggcacgcatagtgggagcaag

SEQ ID NO: 148593 - DNA, 25 bp, E. coli
taaaccaagtgagaatgacatcagt

SEQ ID NO: 148594 - DNA, 25 bp, E. coli
taaaccaagtgacaatgacatcagt

SEQ ID NO: 148595 - DNA, 25 bp, E. coli
tggttgccaccaccgataaaaagcg

SEQ ID NO: 148596 - DNA, 25 bp, E. coli
tctggctgacatcaacggttgcggt

SEQ ID NO: 148597 - DNA, 25 bp, E. coli
tctggctgacatgaacggttgcggt

SEQ ID NO: 148598 - DNA, 25 bp, E. coli
tctctgctgatgaagcaacggcacg

SEQ ID NO: 148599 - DNA, 25 bp, E. coli
tctctgctgatgtagcaacggcacg

SEQ ID NO: 148600 - DNA, 25 bp, E. coli
gcattgctggatactgtggttgcca

SEQ ID NO: 148601 - DNA, 25 bp, E. coli
gcattgctggattctgtggttgcca

SEQ ID NO: 148602 - DNA, 25 bp, E. coli
gaaatggcgaaacgaggcctccctt

SEQ ID NO: 148603 - DNA, 25 bp, E. coli
gaaatggcgaaaggaggcctccctt

SEQ ID NO: 148604 - DNA, 25 bp, E. coli
ggcctccctttctggcaagcggaaa

SEQ ID NO: 148605 - DNA, 25 bp, E. coli
ggcctccctttcaggcaagcggaaa

SEQ ID NO: 148606 - DNA, 25 bp, E. coli
gattgcaggtgagcgtcactacgta

SEQ ID NO: 148607 - DNA, 25 bp, E. coli
gattgcaggtgaccgtcactacgta

SEQ ID NO: 148608 - DNA, 25 bp, E. coli
tggttgccaccagcgataaaaagcg

SEQ ID NO: 148609 - DNA, 25 bp, E. coli
taaccgtcaaagcacaggaaatggc

SEQ ID NO: 148610 - DNA, 25 bp, E. coli
taaccgtcaaaggacaggaaatggc

SEQ ID NO: 148611 - DNA, 25 bp, E. coli
gagcaagacacgcatcgccggttat

SEQ ID NO: 148612 - DNA, 25 bp, E. coli
gagcaagacacggatcgccggttat

SEQ ID NO: 148613 - DNA, 25 bp, E. coli
catggcacagctagcttcctgggaa

SEQ ID NO: 148614 - DNA, 25 bp, E. coli
catggcacagcttgcttcctgggaa

SEQ ID NO: 148615 - DNA, 25 bp, E. coli
aggcaggccgtagcgttaccgatta

SEQ ID NO: 148616 - DNA, 25 bp, E. coli
aggcaggccgtaccgttaccgatta

SEQ ID NO: 148617 - DNA, 25 bp, E. coli
tacgagtggatgagaacagcaatcc

SEQ ID NO: 148618 - DNA, 25 bp, E. coli
tacgcctgagggagagactgtcgtc

SEQ ID NO: 148619 - DNA, 25 bp, E. coli
tacgcctgagggtgagactgtcgtc

SEQ ID NO: 148620 - DNA, 25 bp, E. coli
tacgagtggatgtgaacagcaatcc

SEQ ID NO: 148621 - DNA, 25 bp, E. coli
tgcaggcgcggacaagaataacgtt

SEQ ID NO: 148622 - DNA, 25 bp, E. coli
tgcaggcgcggagaagaataacgtt

SEQ ID NO: 148623 - DNA, 25 bp, E. coli
tcctgggaagcacaagctgacgacg

SEQ ID NO: 148624 - DNA, 25 bp, E. coli
tcctgggaagcagaagctgacgacg

SEQ ID NO: 148625 - DNA, 25 bp, E. coli
gcccctgttgccctgtggaataaaa

SEQ ID NO: 148626 - DNA, 25 bp, E. coli
gcccctgttgccgtgtggaataaaa

SEQ ID NO: 148627 - DNA, 25 bp, E. coli
gaataaaagacatgtggaaccaccg

SEQ ID NO: 148628 - DNA, 25 bp, E. coli
gaataaaagacaagtggaaccaccg

SEQ ID NO: 148629 - DNA, 25 bp, E. coli
ctttgcgcaaggaacggtgactatt

SEQ ID NO: 148630 - DNA, 25 bp, E. coli
ctttgcgcaaggtacggtgactatt

SEQ ID NO: 148631 - DNA, 25 bp, E. coli
ggtgactatttaactgcctggcgaa

SEQ ID NO: 148632 - DNA, 25 bp, E. coli
ggtgactatttatctgcctggcgaa

SEQ ID NO: 148633 - DNA, 25 bp, E. coli
gatgtggcggcaacgattaaatccg

SEQ ID NO: 148634 - DNA, 25 bp, E. coli
gatgtggcggcatcgattaaatccg

SEQ ID NO: 148635 - DNA, 25 bp, E. coli
catggttcggaagaaaacaccgcga

SEQ ID NO: 148636 - DNA, 25 bp, E. coli
aaataccgccatgcagacggaaccg

SEQ ID NO: 148637 - DNA, 25 bp, E. coli
aaataccgccatccagacggaaccg

SEQ ID NO: 148638 - DNA, 25 bp, E. coli
catggttcggaacaaaacaccgcga

SEQ ID NO: 148639 - DNA, 25 bp, E. coli
tggtgcggcagctaaaaactaccgt

SEQ ID NO: 148640 - DNA, 25 bp, E. coli
tggtgcggcagcaaaaaactaccgt

SEQ ID NO: 148641 - DNA, 25 bp, E. coli
tgagccaacgattagggatgttcct

SEQ ID NO: 148642 - DNA, 25 bp, E. coli
tgagccaacgataagggatgttcct

SEQ ID NO: 148643 - DNA, 25 bp, E. coli
tgagcataaatcacgcaacagcctt

SEQ ID NO: 148644 - DNA, 25 bp, E. coli
tgagcataaatctcgcaacagcctt

SEQ ID NO: 148645 - DNA, 25 bp, E. coli
gcatcatgaactgtatgggcaacga

SEQ ID NO: 148646 - DNA, 25 bp, E. coli
gcatcatgaactctatgggcaacga

SEQ ID NO: 148647 - DNA, 25 bp, E. coli
gatctgattcgcacggttaacctga

SEQ ID NO: 148648 - DNA, 25 bp, E. coli
gatctgattcgctcggttaacctga

SEQ ID NO: 148649 - DNA, 25 bp, E. coli
ggcgaaatcgtttatcagaggtcaa

SEQ ID NO: 148650 - DNA, 25 bp, E. coli
ggcgaaatcgttaatcagaggtcaa

SEQ ID NO: 148651 - DNA, 25 bp, E. coli
taacgagtcggctcacttcatgcgt

SEQ ID NO: 148652 - DNA, 25 bp, E. coli
taatgcagccggagcgatagctaca

SEQ ID NO: 148653 - DNA, 25 bp, E. coli
taatgcagccggtgcgatagctaca

SEQ ID NO: 148654 - DNA, 25 bp, E. coli
taacgagtcggcacacttcatgcgt

SEQ ID NO: 148655 - DNA, 25 bp, E. coli
gacgacagttcagtgggccaataaa

SEQ ID NO: 148656 - DNA, 25 bp, E. coli
gacgacagttcactgggccaataaa

SEQ ID NO: 148657 - DNA, 25 bp, E. coli
caatacaagaattaaaaatgttacg

SEQ ID NO: 148658 - DNA, 25 bp, E. coli
caagacgtaaatctggtgatcatgg

SEQ ID NO: 148659 - DNA, 25 bp, E. coli
caagacgtaaatgtggtgatcatgg

SEQ ID NO: 148660 - DNA, 25 bp, E. coli
caatacaagaataaaaaatgttacg

SEQ ID NO: 148661 - DNA, 25 bp, E. coli
tacgggtaactgttatcggtaacat

SEQ ID NO: 148662 - DNA, 25 bp, E. coli
tacgggtaactgatatcggtaacat

SEQ ID NO: 148663 - DNA, 25 bp, E. coli
tatcggtaacattgtccagccggac

SEQ ID NO: 148664 - DNA, 25 bp, E. coli
tatcggtaacatagtccagccggac

SEQ ID NO: 148665 - DNA, 25 bp, E. coli
ttagtcgtgctcaaagtggtgcccc

SEQ ID NO: 148666 - DNA, 25 bp, E. coli
ttagtcgtgctctaagtggtgcccc

SEQ ID NO: 148667 - DNA, 25 bp, E. coli
tggtgcccccactatacaagaatta

SEQ ID NO: 148668 - DNA, 25 bp, E. coli
tgtccagccggagaatatcagaagc

SEQ ID NO: 148669 - DNA, 25 bp, E. coli
tggtgcccccacaatacaagaatta

SEQ ID NO: 148670 - DNA, 25 bp, E. coli
tgtccagccggacaatatcagaagc

SEQ ID NO: 148671 - DNA, 25 bp, E. coli
tccagccggacaatatcagaagcaa

SEQ ID NO: 148672 - DNA, 25 bp, E. coli
tccagccggacattatcagaagcaa

SEQ ID NO: 148673 - DNA, 25 bp, E. coli
ccttaagtgtataagtgtgagctac

SEQ ID NO: 148674 - DNA, 25 bp, E. coli
ccttaagtgtattagtgtgagctac

SEQ ID NO: 148675 - DNA, 25 bp, E. coli
ggtgatcatggtaagtcgtgctcaa

SEQ ID NO: 148676 - DNA, 25 bp, E. coli
ggtgatcatggttagtcgtgctcaa

SEQ ID NO: 148677 - DNA, 25 bp, E. coli
taagtgtgagcttcttcaaatttgt

SEQ ID NO: 148678 - DNA, 25 bp, E. coli
taagtgtgagctacttcaaatttgt

SEQ ID NO: 148679 - DNA, 25 bp, E. coli
cattaccgcctatgcgcaattctgg

SEQ ID NO: 148680 - DNA, 25 bp, E. coli
cattaccgcctaagcgcaattctgg

SEQ ID NO: 148681 - DNA, 25 bp, E. coli
gcagacgtggttgccattaccgcct

SEQ ID NO: 148682 - DNA, 25 bp, E. coli
gcagacgtggttcccattaccgcct

SEQ ID NO: 148683 - DNA, 25 bp, E. coli
accgaccggtgtcgaagcatcattt

SEQ ID NO: 148684 - DNA, 25 bp, E. coli
accgaccggtgtggaagcatcattt

SEQ ID NO: 148685 - DNA, 25 bp, E. coli
tatgcgcaattcaggttccctgggc

SEQ ID NO: 148686 - DNA, 25 bp, E. coli
tatgcgcaattctggttccctgggc

SEQ ID NO: 148687 - DNA, 25 bp, E. coli
ttatccgtgatcattctgttactgg

SEQ ID NO: 148688 - DNA, 25 bp, E. coli
ttactggttctatacctcgccacgg

SEQ ID NO: 148689 - DNA, 25 bp, E. coli
ttatccgtgatctttctgttactgg

SEQ ID NO: 148690 - DNA, 25 bp, E. coli
ttactggttctaaacctcgccacgg

SEQ ID NO: 148691 - DNA, 25 bp, E. coli
tgttctggtgttcttgacactggaa

SEQ ID NO: 148692 - DNA, 25 bp, E. coli
tgttctggtgttgttgacactggaa

SEQ ID NO: 148693 - DNA, 25 bp, E. coli
gaagcatcatttgcacatttgtgga

SEQ ID NO: 148694 - DNA, 25 bp, E. coli
gaagcatcatttccacatttgtgga

SEQ ID NO: 148695 - DNA, 25 bp, E. coli
gactgggttgctacgttatccgtga

SEQ ID NO: 148696 - DNA, 25 bp, E. coli
gactgggttgcttcgttatccgtga

SEQ ID NO: 148697 - DNA, 25 bp, E. coli
tccctgggctttgtgactgggttgc

SEQ ID NO: 148698 - DNA, 25 bp, E. coli
tccctgggctttctgactgggttgc

SEQ ID NO: 148699 - DNA, 25 bp, E. coli
ggcgttctttgtctttgttctggtg

SEQ ID NO: 148700 - DNA, 25 bp, E. coli
ggcgttctttgtgtttgttctggtg

SEQ ID NO: 148701 - DNA, 25 bp, E. coli
cacaggagatgctttggctgttgca

SEQ ID NO: 148702 - DNA, 25 bp, E. coli
cacaggagatgcattggctgttgca

SEQ ID NO: 148703 - DNA, 25 bp, E. coli
agcgaagttcatgctcactacacct

SEQ ID NO: 148704 - DNA, 25 bp, E. coli
agcgaagttcatcctcactacacct

SEQ ID NO: 148705 - DNA, 25 bp, E. coli
tattcacgagttgcgtatcgcctgc

SEQ ID NO: 148706 - DNA, 25 bp, E. coli
tattcctgtgaaatctgccggcaaa

SEQ ID NO: 148707 - DNA, 25 bp, E. coli
tattcacgagttccgtatcgcctgc

SEQ ID NO: 148708 - DNA, 25 bp, E. coli
tattcctgtgaattctgccggcaaa

SEQ ID NO: 148709 - DNA, 25 bp, E. coli
tgatgaacggcgttgatgcacgtcc

SEQ ID NO: 148710 - DNA, 25 bp, E. coli
tgatgaacggcgatgatgcacgtcc

SEQ ID NO: 148711 - DNA, 25 bp, E. coli
tgacgcgtgaaattgcccaggtggt

SEQ ID NO: 148712 - DNA, 25 bp, E. coli
tgacgcgtgaaaatgcccaggtggt

SEQ ID NO: 148713 - DNA, 25 bp, E. coli
tcactacacctttgataccaactgg

SEQ ID NO: 148714 - DNA, 25 bp, E. coli
tcactacaccttagataccaactgg

SEQ ID NO: 148715 - DNA, 25 bp, E. coli
gaacagcgttaacaaacttttcagc

SEQ ID NO: 148716 - DNA, 25 bp, E. coli
gaacagcgttaagaaacttttcagc

SEQ ID NO: 148717 - DNA, 25 bp, E. coli
gaaaccactgactatccgctgtatg

SEQ ID NO: 148718 - DNA, 25 bp, E. coli
gaaaccactgacaatccgctgtatg

SEQ ID NO: 148719 - DNA, 25 bp, E. coli
cgctgtatgcacctctgctggaaga

SEQ ID NO: 148720 - DNA, 25 bp, E. coli
cgctgtatgcacgtctgctggaaga

SEQ ID NO: 148721 - DNA, 25 bp, E. coli
gatgcacgtccgctacgtgcttcgg

SEQ ID NO: 148722 - DNA, 25 bp, E. coli
gatgcacgtccggtacgtgcttcgg

SEQ ID NO: 148723 - DNA, 25 bp, E. coli
aagatccacaaaccatgctgcgcga

SEQ ID NO: 148724 - DNA, 25 bp, E. coli
aagatccacaaagcatgctgcgcga

SEQ ID NO: 148725 - DNA, 25 bp, E. coli
cattattgaacctgtggtgcgtcca

SEQ ID NO: 148726 - DNA, 25 bp, E. coli
cattattgaaccagtggtgcgtcca

SEQ ID NO: 148727 - DNA, 25 bp, E. coli
ttacaaagccgacatgccattaggg

SEQ ID NO: 148728 - DNA, 25 bp, E. coli
tttatcccaggttatggcatcccgg

SEQ ID NO: 148729 - DNA, 25 bp, E. coli
ttacaaagccgagatgccattaggg

SEQ ID NO: 148730 - DNA, 25 bp, E. coli
tttatcccaggtaatggcatcccgg

SEQ ID NO: 148731 - DNA, 25 bp, E. coli
tgaacaaatagtggagcagggcgct

SEQ ID NO: 148732 - DNA, 25 bp, E. coli
tgaacaaatagtcgagcagggcgct

SEQ ID NO: 148733 - DNA, 25 bp, E. coli
gctgaaagatatgtcccgcccaggt

SEQ ID NO: 148734 - DNA, 25 bp, E. coli
gctgaaagatatctcccgcccaggt

SEQ ID NO: 148735 - DNA, 25 bp, E. coli
gaaatagatatgaccgtcgacccgc

SEQ ID NO: 148736 - DNA, 25 bp, E. coli
gaaatagatatgtccgtcgacccgc

SEQ ID NO: 148737 - DNA, 25 bp, E. coli
cgtgaagatgaacccgcagaggaac

SEQ ID NO: 148738 - DNA, 25 bp, E. coli
cgtgaagatgaagccgcagaggaac

SEQ ID NO: 148739 - DNA, 25 bp, E. coli
gataaatttgttggtcgctgccgta

SEQ ID NO: 148740 - DNA, 25 bp, E. coli
gataaatttgttcgtcgctgccgta

SEQ ID NO: 148741 - DNA, 25 bp, E. coli
gacccgcataaaccccgtgaaatgg

SEQ ID NO: 148742 - DNA, 25 bp, E. coli
gatgaaaaaaccatacttgccgcct

SEQ ID NO: 148743 - DNA, 25 bp, E. coli
gatgaaaaaaccttacttgccgcct

SEQ ID NO: 148744 - DNA, 25 bp, E. coli
gacccgcataaagcccgtgaaatgg

SEQ ID NO: 148745 - DNA, 25 bp, E. coli
aatggattaagagcgccaatgagcg

SEQ ID NO: 148746 - DNA, 25 bp, E. coli
caatgatgctaaccctggcgcaggc

SEQ ID NO: 148747 - DNA, 25 bp, E. coli
aatggattaagaccgccaatgagcg

SEQ ID NO: 148748 - DNA, 25 bp, E. coli
caatgatgctaagcctggcgcaggc

SEQ ID NO: 148749 - DNA, 25 bp, E. coli
tatgcgttggcttatgaactggcgc

SEQ ID NO: 148750 - DNA, 25 bp, E. coli
tatgcgttggctaatgaactggcgc

SEQ ID NO: 148751 - DNA, 25 bp, E. coli
tatttgccagaaggttagccgcaca

SEQ ID NO: 148752 - DNA, 25 bp, E. coli
tatttgccagaacgttagccgcaca

SEQ ID NO: 148753 - DNA, 25 bp, E. coli
tgctgatgcgccagcaggacaaact

SEQ ID NO: 148754 - DNA, 25 bp, E. coli
tgctgatgcgcctgcaggacaaact

SEQ ID NO: 148755 - DNA, 25 bp, E. coli
tcggttacgtgaagccaacgagcag

SEQ ID NO: 148756 - DNA, 25 bp, E. coli
tcggttacgtgatgccaacgagcag

SEQ ID NO: 148757 - DNA, 25 bp, E. coli
tcatagtgatgctgcctgaaacggg

SEQ ID NO: 148758 - DNA, 25 bp, E. coli
tcattatagaaaacaccaccgggaa

SEQ ID NO: 148759 - DNA, 25 bp, E. coli
tcatagtgatgcagcctgaaacggg

SEQ ID NO: 148760 - DNA, 25 bp, E. coli
tcattatagaaatcaccaccgggaa

SEQ ID NO: 148761 - DNA, 25 bp, E. coli
tcagcaggcgttaagcgggatattc

SEQ ID NO: 148762 - DNA, 25 bp, E. coli
tcagcaggcgtttagcgggatattc

SEQ ID NO: 148763 - DNA, 25 bp, E. coli
cctgattttcagacggcagacgggc

SEQ ID NO: 148764 - DNA, 25 bp, E. coli
cctgattttcagtcggcagacgggc

SEQ ID NO: 148765 - DNA, 25 bp, E. coli
gtttgctattcacgagttcgccgcc

SEQ ID NO: 148766 - DNA, 25 bp, E. coli
gtttgctattcaggagttcgccgcc

SEQ ID NO: 148767 - DNA, 25 bp, E. coli
taaagtggccgatcgttcagggaga

SEQ ID NO: 148768 - DNA, 25 bp, E. coli
taaagtggccgaacgttcagggaga

SEQ ID NO: 148769 - DNA, 25 bp, E. coli
tatgtacctcgtaggtttaccgcgc

SEQ ID NO: 148770 - DNA, 25 bp, E. coli
tatgtacctcgttggtttaccgcgc

SEQ ID NO: 148771 - DNA, 25 bp, E. coli
tatgctgatcggcattctgattgcc

SEQ ID NO: 148772 - DNA, 25 bp, E. coli
tatgctgatcgggattctgattgcc

SEQ ID NO: 148773 - DNA, 25 bp, E. coli
tacctgcatcattccggtgttagcg

SEQ ID NO: 148774 - DNA, 25 bp, E. coli
tacctgcatcataccggtgttagcg

SEQ ID NO: 148775 - DNA, 25 bp, E. coli
ttttgcgcgacaggctggatgatcg

SEQ ID NO: 148776 - DNA, 25 bp, E. coli
ttggtatcacgctgatttgcgccgg

SEQ ID NO: 148777 - DNA, 25 bp, E. coli
ttggtatcacgcagatttgcgccgg

SEQ ID NO: 148778 - DNA, 25 bp, E. coli
ttttgcgcgacacgctggatgatcg

SEQ ID NO: 148779 - DNA, 25 bp, E. coli
tgttgttatcaccaccctcagcgtt

SEQ ID NO: 148780 - DNA, 25 bp, E. coli
tgttgttatcacgaccctcagcgtt

SEQ ID NO: 148781 - DNA, 25 bp, E. coli
gccgttttcatttcgcgcgggcgta

SEQ ID NO: 148782 - DNA, 25 bp, E. coli
gccgttttcattacgcgcgggcgta

SEQ ID NO: 148783 - DNA, 25 bp, E. coli
gcgtagccagctcgaccttaggtat

SEQ ID NO: 148784 - DNA, 25 bp, E. coli
gctgattatgttcgtcgcgcctgga

SEQ ID NO: 148785 - DNA, 25 bp, E. coli
gctgattatgttggtcgcgcctgga

SEQ ID NO: 148786 - DNA, 25 bp, E. coli
gcgtagccagctggaccttaggtat

SEQ ID NO: 148787 - DNA, 25 bp, E. coli
taagccacgtaccttgatgatcacc

SEQ ID NO: 148788 - DNA, 25 bp, E. coli
taagccacgtacgttgatgatcacc

SEQ ID NO: 148789 - DNA, 25 bp, E. coli
aggtattcgtacgtttcgcgccgca

SEQ ID NO: 148790 - DNA, 25 bp, E. coli
aggtattcgtacctttcgcgccgca

SEQ ID NO: 148791 - DNA, 25 bp, E. coli
taccaatgtgatacatatgcatggg

SEQ ID NO: 148792 - DNA, 25 bp, E. coli
taccaatgtgattcatatgcatggg

SEQ ID NO: 148793 - DNA, 25 bp, E. coli
tttatccggcgggtgggtttgttca

SEQ ID NO: 148794 - DNA, 25 bp, E. coli
tttatatggcgtagtcgatggccga

SEQ ID NO: 148795 - DNA, 25 bp, E. coli
tttatatggcgttgtcgatggccga

SEQ ID NO: 148796 - DNA, 25 bp, E. coli
tttatccggcggctgggtttgttca

SEQ ID NO: 148797 - DNA, 25 bp, E. coli
tgttcacgaagcgaaactgcatggc

SEQ ID NO: 148798 - DNA, 25 bp, E. coli
tgttcacgaagccaaactgcatggc

SEQ ID NO: 148799 - DNA, 25 bp, E. coli
tgcagcagccagtaattcagcctaa

SEQ ID NO: 148800 - DNA, 25 bp, E. coli
tgcagcagccagaaattcagcctaa

SEQ ID NO: 148801 - DNA, 25 bp, E. coli
tgcgcgagcgttagcgtcagcgtat

SEQ ID NO: 148802 - DNA, 25 bp, E. coli
tgccggaagcaaaggaaaaaccaag

SEQ ID NO: 148803 - DNA, 25 bp, E. coli
tgcgcgagcgtttgcgtcagcgtat

SEQ ID NO: 148804 - DNA, 25 bp, E. coli
tgccggaagcaatggaaaaaccaag

SEQ ID NO: 148805 - DNA, 25 bp, E. coli
tcagagataaagtggtgccggaagc

SEQ ID NO: 148806 - DNA, 25 bp, E. coli
tcagagataaagaggtgccggaagc

SEQ ID NO: 148807 - DNA, 25 bp, E. coli
gaaaaaccaagactactcgtactga

SEQ ID NO: 148808 - DNA, 25 bp, E. coli
gaaaaaccaagagtactcgtactga

SEQ ID NO: 148809 - DNA, 25 bp, E. coli
cgcagatggcctctgggaagaacat

SEQ ID NO: 148810 - DNA, 25 bp, E. coli
cgcagatggcctgtgggaagaacat

SEQ ID NO: 148811 - DNA, 25 bp, E. coli
ttgttaccgattaaatttcagcgcg

SEQ ID NO: 148812 - DNA, 25 bp, E. coli
ttgttaccgatttaatttcagcgcg

SEQ ID NO: 148813 - DNA, 25 bp, E. coli
tgttcttgttaccgattaaatttca

SEQ ID NO: 148814 - DNA, 25 bp, E. coli
tgttcttgttacggattaaatttca

SEQ ID NO: 148815 - DNA, 25 bp, E. coli
tcagctaatgttgttgttaccgatt

SEQ ID NO: 148816 - DNA, 25 bp, E. coli
ttcttgttaccgattaaatttcagc

SEQ ID NO: 148817 - DNA, 25 bp, E. coli
tcttgttaccgaataaatttcagcg

SEQ ID NO: 148818 - DNA, 25 bp, E. coli
tcttgttaccgattaaatttcagcg

SEQ ID NO: 148819 - DNA, 25 bp, E. coli
tcagctaatgttcttgttaccgatt

SEQ ID NO: 148820 - DNA, 25 bp, E. coli
ttcttgttaccgtttaaatttcagc

SEQ ID NO: 148821 - DNA, 25 bp, E. coli
cttgttaccgataaaatttcagcgc

SEQ ID NO: 148822 - DNA, 25 bp, E. coli
cttgttaccgattaaatttcagcgc

SEQ ID NO: 148823 - DNA, 25 bp, E. coli
gttcttgttaccgattaaatttcag

SEQ ID NO: 148824 - DNA, 25 bp, E. coli
gtcagctaatgtacttgttaccgat

SEQ ID NO: 148825 - DNA, 25 bp, E. coli
gtcagctaatgttcttgttaccgat

SEQ ID NO: 148826 - DNA, 25 bp, E. coli
gttcttgttacccattaaatttcag

SEQ ID NO: 148827 - DNA, 25 bp, E. coli
cataagcgtgtcgtgagttatatgc

SEQ ID NO: 148828 - DNA, 25 bp, E. coli
cataagcgtgtcctgagttatatgc

SEQ ID NO: 148829 - DNA, 25 bp, E. coli
atcttctggatcgtcgccgtggcgg

SEQ ID NO: 148830 - DNA, 25 bp, E. coli
atcttctggatcctcgccgtggcgg

SEQ ID NO: 148831 - DNA, 25 bp, E. coli
tgcggccagcgtcgttatcaacgct

SEQ ID NO: 148832 - DNA, 25 bp, E. coli
tgcggccagcgtggttatcaacgct

SEQ ID NO: 148833 - DNA, 25 bp, E. coli
gccagcgtggttatcaacgctttga

SEQ ID NO: 148834 - DNA, 25 bp, E. coli
gccagcgtggttttcaacgctttga

SEQ ID NO: 148835 - DNA, 25 bp, E. coli
cgctttgatgcgagatatctacccg

SEQ ID NO: 148836 - DNA, 25 bp, E. coli
cgctttgatgcgtgatatctacccg

SEQ ID NO: 148837 - DNA, 25 bp, E. coli
cggcaatgatcttctttctgatcaa

SEQ ID NO: 148838 - DNA, 25 bp, E. coli
cttctttctgatgaaagaaacctta

SEQ ID NO: 148839 - DNA, 25 bp, E. coli
cttctttctgatcaaagaaacctta

SEQ ID NO: 148840 - DNA, 25 bp, E. coli
cggcaatgatctactttctgatcaa

SEQ ID NO: 148841 - DNA, 25 bp, E. coli
cgtgtcctgagtaatatgctggcca

SEQ ID NO: 148842 - DNA, 25 bp, E. coli
cgtgtcctgagttatatgctggcca

SEQ ID NO: 148843 - DNA, 25 bp, E. coli
gttccgtcataagcgtgtcctgagt

SEQ ID NO: 148844 - DNA, 25 bp, E. coli
gttccgtcataaccgtgtcctgagt

SEQ ID NO: 148845 - DNA, 25 bp, E. coli
tggttatcaacggtttgatgcgtga

SEQ ID NO: 148846 - DNA, 25 bp, E. coli
tggttatcaacgctttgatgcgtga

SEQ ID NO: 148847 - DNA, 25 bp, E. coli
gatcctcgccgtcgcggcgattctg

SEQ ID NO: 148848 - DNA, 25 bp, E. coli
gatcctcgccgtggcggcgattctg

SEQ ID NO: 148849 - DNA, 25 bp, E. coli
catgtccatacgtaacacggcgtta

SEQ ID NO: 148850 - DNA, 25 bp, E. coli
catgtccatacgaaacacggcgtta

SEQ ID NO: 148851 - DNA, 25 bp, E. coli
taaagcgttttctggcggtaatgcg

SEQ ID NO: 148852 - DNA, 25 bp, E. coli
taaagcgttttcaggcggtaatgcg

SEQ ID NO: 148853 - DNA, 25 bp, E. coli
aaaaccctggcgtcaatcggcgata

SEQ ID NO: 148854 - DNA, 25 bp, E. coli
aaaaccctggcgacaatcggcgata

SEQ ID NO: 148855 - DNA, 25 bp, E. coli
tttttggcgacttcaccgaaggcgt

SEQ ID NO: 148856 - DNA, 25 bp, E. coli
tttttggcgactacaccgaaggcgt

SEQ ID NO: 148857 - DNA, 25 bp, E. coli
tgggcgtcgatatcagccatgtcca

SEQ ID NO: 148858 - DNA, 25 bp, E. coli
tgggcgtcgataacagccatgtcca

SEQ ID NO: 148859 - DNA, 25 bp, E. coli
tgccctgagtgaagaggattacgcc

SEQ ID NO: 148860 - DNA, 25 bp, E. coli
tgccctgagtgatgaggattacgcc

SEQ ID NO: 148861 - DNA, 25 bp, E. coli
gcgttaccgcactaactcaggtgga

SEQ ID NO: 148862 - DNA, 25 bp, E. coli
gcgttaccgcacaaactcaggtgga

SEQ ID NO: 148863 - DNA, 25 bp, E. coli
cgaaggcgtgatcgccgactttgcc

SEQ ID NO: 148864 - DNA, 25 bp, E. coli
cgaaggcgtgatggccgactttgcc

SEQ ID NO: 148865 - DNA, 25 bp, E. coli
gataactgcgtccatatctacccgc

SEQ ID NO: 148866 - DNA, 25 bp, E. coli
gataactgcgtcgatatctacccgc

SEQ ID NO: 148867 - DNA, 25 bp, E. coli
ggtggaactgcaggacaatgatcgc

SEQ ID NO: 148868 - DNA, 25 bp, E. coli
gtgacgatgacttcggcacaaagct

SEQ ID NO: 148869 - DNA, 25 bp, E. coli
gtgacgatgactacggcacaaagct

SEQ ID NO: 148870 - DNA, 25 bp, E. coli
ggtggaactgcacgacaatgatcgc

SEQ ID NO: 148871 - DNA, 25 bp, E. coli
caacagcatgtatcagaccgcacag

SEQ ID NO: 148872 - DNA, 25 bp, E. coli
caacagcatgtaacagaccgcacag

SEQ ID NO: 148873 - DNA, 25 bp, E. coli
agtggatctgatgaacacccgcgat

SEQ ID NO: 148874 - DNA, 25 bp, E. coli
agtggatctgatcaacacccgcgat

SEQ ID NO: 148875 - DNA, 25 bp, E. coli
aaatcgtcggcaagaacgtgggcac

SEQ ID NO: 148876 - DNA, 25 bp, E. coli
aaatcgtcggcatgaacgtgggcac

SEQ ID NO: 148877 - DNA, 25 bp, E. coli
aaagtgccatatgaagtgggccgcg

SEQ ID NO: 148878 - DNA, 25 bp, E. coli
aaagtgccatatcaagtgggccgcg

SEQ ID NO: 148879 - DNA, 25 bp, E. coli
tatggaacagaatggtggcggcaac

SEQ ID NO: 148880 - DNA, 25 bp, E. coli
tatggaacagaaaggtggcggcaac

SEQ ID NO: 148881 - DNA, 25 bp, E. coli
tttaactacccgacgatggcggaag

SEQ ID NO: 148882 - DNA, 25 bp, E. coli
tatcaaaatgttggcggcggttgca

SEQ ID NO: 148883 - DNA, 25 bp, E. coli
tatcaaaatgttcgcggcggttgca

SEQ ID NO: 148884 - DNA, 25 bp, E. coli
tttaactacccgtcgatggcggaag

SEQ ID NO: 148885 - DNA, 25 bp, E. coli
tgattaatcaacaaacgcgcatgcg

SEQ ID NO: 148886 - DNA, 25 bp, E. coli
tgattaatcaactaacgcgcatgcg

SEQ ID NO: 148887 - DNA, 25 bp, E. coli
cctggttaagcaaggtgcgcgcgtc

SEQ ID NO: 148888 - DNA, 25 bp, E. coli
cctggttaagcatggtgcgcgcgtc

SEQ ID NO: 148889 - DNA, 25 bp, E. coli
gaatatgcgtcgatcttccgcggta

SEQ ID NO: 148890 - DNA, 25 bp, E. coli
gaatatgcgtcgttcttccgcggta

SEQ ID NO: 148891 - DNA, 25 bp, E. coli
gagcgcgctgccgaaattattcata

SEQ ID NO: 148892 - DNA, 25 bp, E. coli
gagcgcgctgcccaaattattcata

SEQ ID NO: 148893 - DNA, 25 bp, E. coli
cattagcaataagggaggacggacg

SEQ ID NO: 148894 - DNA, 25 bp, E. coli
agattgtagaactgggcgacgcgca

SEQ ID NO: 148895 - DNA, 25 bp, E. coli
agattgtagaacagggcgacgcgca

SEQ ID NO: 148896 - DNA, 25 bp, E. coli
tttctacgaacgttgcccgctggca

SEQ ID NO: 148897 - DNA, 25 bp, E. coli
tttctacgaacgatgcccgctggca

SEQ ID NO: 148898 - DNA, 25 bp, E. coli
tgggcgacgcgcagcaggtgctgac

SEQ ID NO: 148899 - DNA, 25 bp, E. coli
tgggcgacgcgctgcaggtgctgac

SEQ ID NO: 148900 - DNA, 25 bp, E. coli
tctcgggcagatagtagaactgggc

SEQ ID NO: 148901 - DNA, 25 bp, E. coli
tctcgggcagattgtagaactgggc

SEQ ID NO: 148902 - DNA, 25 bp, E. coli
ccacggatgtgaagtccggcaatca

SEQ ID NO: 148903 - DNA, 25 bp, E. coli
gccgcaaggctgatttttctacgaa

SEQ ID NO: 148904 - DNA, 25 bp, E. coli
ccacggatgtgatgtccggcaatca

SEQ ID NO: 148905 - DNA, 25 bp, E. coli
gccgcaaggctgttttttctacgaa

SEQ ID NO: 148906 - DNA, 25 bp, E. coli
cgctggcaaccctcggatgtgaagt

SEQ ID NO: 148907 - DNA, 25 bp, E. coli
cgctggcaacccacggatgtgaagt

SEQ ID NO: 148908 - DNA, 25 bp, E. coli
cattagcaataacggaggacggacg

SEQ ID NO: 148909 - DNA, 25 bp, E. coli
ggaggacggacgtgagctccggtgc

SEQ ID NO: 148910 - DNA, 25 bp, E. coli
ggaggacggacgagagctccggtgc

SEQ ID NO: 148911 - DNA, 25 bp, E. coli
gtgctgacggcagctgcacatccat

SEQ ID NO: 148912 - DNA, 25 bp, E. coli
gtccggcaatcattagcaataaggg

SEQ ID NO: 148913 - DNA, 25 bp, E. coli
gtccggcaatcaatagcaataaggg

SEQ ID NO: 148914 - DNA, 25 bp, E. coli
gtgctgacggcacctgcacatccat

SEQ ID NO: 148915 - DNA, 25 bp, E. coli
aatcagctggcgtgcaatgtgcaaa

SEQ ID NO: 148916 - DNA, 25 bp, E. coli
aatcagctggcgagcaatgtgcaaa

SEQ ID NO: 148917 - DNA, 25 bp, E. coli
caccgtgggagcagttgttctggca

SEQ ID NO: 148918 - DNA, 25 bp, E. coli
caccgtgggagctgttgttctggca

SEQ ID NO: 148919 - DNA, 25 bp, E. coli
acagagccaatacgcgtcttgatgc

SEQ ID NO: 148920 - DNA, 25 bp, E. coli
aaatgccaaaatcgcccggcttgag

SEQ ID NO: 148921 - DNA, 25 bp, E. coli
acagagccaataggcgtcttgatgc

SEQ ID NO: 148922 - DNA, 25 bp, E. coli
aaatgccaaaatggcccggcttgag

SEQ ID NO: 148923 - DNA, 25 bp, E. coli
tatgctgccaaatccgaagctaaca

SEQ ID NO: 148924 - DNA, 25 bp, E. coli
tatgctgccaaaaccgaagctaaca

SEQ ID NO: 148925 - DNA, 25 bp, E. coli
tgaaaacgattttcaccgtgggagc

SEQ ID NO: 148926 - DNA, 25 bp, E. coli
tgaaaacgatttacaccgtgggagc

SEQ ID NO: 148927 - DNA, 25 bp, E. coli
tcagtggctgcgtcaatgagcaaaa

SEQ ID NO: 148928 - DNA, 25 bp, E. coli
tcagtggctgcgacaatgagcaaaa

SEQ ID NO: 148929 - DNA, 25 bp, E. coli
ccggcttgagcacgatatgaaagca

SEQ ID NO: 148930 - DNA, 25 bp, E. coli
ccggcttgagcaggatatgaaagca

SEQ ID NO: 148931 - DNA, 25 bp, E. coli
gaagctaacagagccaatacgcgtc

SEQ ID NO: 148932 - DNA, 25 bp, E. coli
gaagctaacagacccaatacgcgtc

SEQ ID NO: 148933 - DNA, 25 bp, E. coli
gcaatgtgcaaacattaaatgccaa

SEQ ID NO: 148934 - DNA, 25 bp, E. coli
gcaatgtgcaaagattaaatgccaa

SEQ ID NO: 148935 - DNA, 25 bp, E. coli
cgctgcttgcgtttgtacgcagaat

SEQ ID NO: 148936 - DNA, 25 bp, E. coli
cgctgcttgcgtatgtacgcagaat

SEQ ID NO: 148937 - DNA, 25 bp, E. coli
caggatattgcatcggatttaccgc

SEQ ID NO: 148938 - DNA, 25 bp, E. coli
caggatattgcaacggatttaccgc

SEQ ID NO: 148939 - DNA, 25 bp, E. coli
atatcactccgcagactgccgatca

SEQ ID NO: 148940 - DNA, 25 bp, E. coli
atatcactccgctgactgccgatca

SEQ ID NO: 148941 - DNA, 25 bp, E. coli
tttaaattgcatgaaccggtacagg

SEQ ID NO: 148942 - DNA, 25 bp, E. coli
tttaaattgcatcaaccggtacagg

SEQ ID NO: 148943 - DNA, 25 bp, E. coli
tgctttctgatgtaggactcagcct

SEQ ID NO: 148944 - DNA, 25 bp, E. coli
tgctttctgatgaaggactcagcct

SEQ ID NO: 148945 - DNA, 25 bp, E. coli
ccagttcgccaataggtgagcatga

SEQ ID NO: 148946 - DNA, 25 bp, E. coli
ccagttcgccaaaaggtgagcatga

SEQ ID NO: 148947 - DNA, 25 bp, E. coli
gaaaatatgatcaatggcagaccga

SEQ ID NO: 148948 - DNA, 25 bp, E. coli
gaactggcaatcaatcgacgagctg

SEQ ID NO: 148949 - DNA, 25 bp, E. coli
gaaaatatgatctatggcagaccga

SEQ ID NO: 148950 - DNA, 25 bp, E. coli
gaactggcaatctatcgacgagctg

SEQ ID NO: 148951 - DNA, 25 bp, E. coli
ccacgcattagaagaactttcccgc

SEQ ID NO: 148952 - DNA, 25 bp, E. coli
cgattaccgaatccgacgctggcgg

SEQ ID NO: 148953 - DNA, 25 bp, E. coli
cgattaccgaatgcgacgctggcgg

SEQ ID NO: 148954 - DNA, 25 bp, E. coli
cccgtgcgctggcattgctttctga

SEQ ID NO: 148955 - DNA, 25 bp, E. coli
ccacgcattagatgaactttcccgc

SEQ ID NO: 148956 - DNA, 25 bp, E. coli
cccgtgcgctgggattgctttctga

SEQ ID NO: 148957 - DNA, 25 bp, E. coli
gatccagaaacggtgaatgcccgtg

SEQ ID NO: 148958 - DNA, 25 bp, E. coli
gatccagaaacgctgaatgcccgtg

SEQ ID NO: 148959 - DNA, 25 bp, E. coli
cagcttaataacgtgcttagagccc

SEQ ID NO: 148960 - DNA, 25 bp, E. coli
cagcttaataacctgcttagagccc

SEQ ID NO: 148961 - DNA, 25 bp, E. coli
aaaagagatcgcgtggaagccctgc

SEQ ID NO: 148962 - DNA, 25 bp, E. coli
aaaagagatcgcctggaagccctgc

SEQ ID NO: 148963 - DNA, 25 bp, E. coli
tagtttgttagtcgcgtgtccgtcc

SEQ ID NO: 148964 - DNA, 25 bp, E. coli
tagtttgttagtggcgtgtccgtcc

SEQ ID NO: 148965 - DNA, 25 bp, E. coli
tgcgaaacccaacgtgcatgccgag

SEQ ID NO: 148966 - DNA, 25 bp, E. coli
tgcgaaacccaaggtgcatgccgag

SEQ ID NO: 148967 - DNA, 25 bp, E. coli
gccgcaaaaaattgtcgcaaacgac

SEQ ID NO: 148968 - DNA, 25 bp, E. coli
gccgcaaaaaatagtcgcaaacgac

SEQ ID NO: 148969 - DNA, 25 bp, E. coli
gctggcaagcgattgtaaagactga

SEQ ID NO: 148970 - DNA, 25 bp, E. coli
gctggcaagcgaatgtaaagactga

SEQ ID NO: 148971 - DNA, 25 bp, E. coli
gactgactaagcatgtagtaccgag

SEQ ID NO: 148972 - DNA, 25 bp, E. coli
gcggttggcctcgtaaaaagccgca

SEQ ID NO: 148973 - DNA, 25 bp, E. coli
gcggttggcctcctaaaaagccgca

SEQ ID NO: 148974 - DNA, 25 bp, E. coli
gactgactaagcttgtagtaccgag

SEQ ID NO: 148975 - DNA, 25 bp, E. coli
cgacgaaaactaggctttagcagct

SEQ ID NO: 148976 - DNA, 25 bp, E. coli
cgacgaaaactacgctttagcagct

SEQ ID NO: 148977 - DNA, 25 bp, E. coli
gattcgacgggatttgcgaaaccca

SEQ ID NO: 148978 - DNA, 25 bp, E. coli
gattcgacgggaattgcgaaaccca

SEQ ID NO: 148979 - DNA, 25 bp, E. coli
gaggtcaaaccctaaagagatcgcg

SEQ ID NO: 148980 - DNA, 25 bp, E. coli
gaggtcaaacccaaaagagatcgcg

SEQ ID NO: 148981 - DNA, 25 bp, E. coli
tacattttacagcttgcccaacgca

SEQ ID NO: 148982 - DNA, 25 bp, E. coli
tacattttacaggttgcccaacgca

SEQ ID NO: 148983 - DNA, 25 bp, E. coli
tatccagggccaattggtgcggtga

SEQ ID NO: 148984 - DNA, 25 bp, E. coli
tatccagggccatttggtgcggtga

SEQ ID NO: 148985 - DNA, 25 bp, E. coli
tttgacgggatacaacacctggctg

SEQ ID NO: 148986 - DNA, 25 bp, E. coli
tattgatcaccatgctggcgcgcag

SEQ ID NO: 148987 - DNA, 25 bp, E. coli
tattgatcaccaagctggcgcgcag

SEQ ID NO: 148988 - DNA, 25 bp, E. coli
tttgacgggatagaacacctggctg

SEQ ID NO: 148989 - DNA, 25 bp, E. coli
tggtcccggcaaatcataaagatcg

SEQ ID NO: 148990 - DNA, 25 bp, E. coli
tggtcccggcaattcataaagatcg

SEQ ID NO: 148991 - DNA, 25 bp, E. coli
tcgagtgctacaggaacgtctgggc

SEQ ID NO: 148992 - DNA, 25 bp, E. coli
tcgagtgctacacgaacgtctgggc

SEQ ID NO: 148993 - DNA, 25 bp, E. coli
tctgaatttcgggatgtgctgcgct

SEQ ID NO: 148994 - DNA, 25 bp, E. coli
tctgaatttcggcatgtgctgcgct

SEQ ID NO: 148995 - DNA, 25 bp, E. coli
gcaaaagcagaggaacgggcgataa

SEQ ID NO: 148996 - DNA, 25 bp, E. coli
gcaaaagcagagcaacgggcgataa

SEQ ID NO: 148997 - DNA, 25 bp, E. coli
gattttaagacaggcatccgtcagc

SEQ ID NO: 148998 - DNA, 25 bp, E. coli
gattttaagacacgcatccgtcagc

SEQ ID NO: 148999 - DNA, 25 bp, E. coli
gggccgcccagaaacgtgatcatgt

SEQ ID NO: 149000 - DNA, 25 bp, E. coli
gggccgcccagatacgtgatcatgt

SEQ ID NO: 149001 - DNA, 25 bp, E. coli
taatgcgcgaatgtgtaccacgctg

SEQ ID NO: 149002 - DNA, 25 bp, E. coli
taatgcgcgaatctgtaccacgctg

SEQ ID NO: 149003 - DNA, 25 bp, E. coli
cacatgaagagaagggcgaagtccc

SEQ ID NO: 149004 - DNA, 25 bp, E. coli
cacatgaagagatgggcgaagtccc

SEQ ID NO: 149005 - DNA, 25 bp, E. coli
catactgaaaatcccgttaccggga

SEQ ID NO: 149006 - DNA, 25 bp, E. coli
catactgaaaatgccgttaccggga

SEQ ID NO: 149007 - DNA, 25 bp, E. coli
taaaccggttgcagatcctgcgccg

SEQ ID NO: 149008 - DNA, 25 bp, E. coli
tacatttctcatgcgcaaacagggc

SEQ ID NO: 149009 - DNA, 25 bp, E. coli
taaaccggttgctgatcctgcgccg

SEQ ID NO: 149010 - DNA, 25 bp, E. coli
taaagtttgattcccgcccatgcga

SEQ ID NO: 149011 - DNA, 25 bp, E. coli
tacatttctcatccgcaaacagggc

SEQ ID NO: 149012 - DNA, 25 bp, E. coli
taaagtttgattgccgcccatgcga

SEQ ID NO: 149013 - DNA, 25 bp, E. coli
tattgaagaacgaggcgatctggcg

SEQ ID NO: 149014 - DNA, 25 bp, E. coli
tattgaagaacgtggcgatctggcg

SEQ ID NO: 149015 - DNA, 25 bp, E. coli
tatcaaaagctgcaaggcgacgcca

SEQ ID NO: 149016 - DNA, 25 bp, E. coli
tatcaaaagctggaaggcgacgcca

SEQ ID NO: 149017 - DNA, 25 bp, E. coli
tgttaaaccagttccgccgtgaagc

SEQ ID NO: 149018 - DNA, 25 bp, E. coli
tgattactgaccactaccagaccgg

SEQ ID NO: 149019 - DNA, 25 bp, E. coli
tgattactgacctctaccagaccgg

SEQ ID NO: 149020 - DNA, 25 bp, E. coli
tgttaaaccagtaccgccgtgaagc

SEQ ID NO: 149021 - DNA, 25 bp, E. coli
tgcatgatgatgagctggaacccgc

SEQ ID NO: 149022 - DNA, 25 bp, E. coli
tgcatgatgatgtgctggaacccgc

SEQ ID NO: 149023 - DNA, 25 bp, E. coli
gcgaagctattttgcacggtgccga

SEQ ID NO: 149024 - DNA, 25 bp, E. coli
gcgaagctatttagcacggtgccga

SEQ ID NO: 149025 - DNA, 25 bp, E. coli
cactgctttaatggtctgtacgtca

SEQ ID NO: 149026 - DNA, 25 bp, E. coli
cactgctttaatcgtctgtacgtca

SEQ ID NO: 149027 - DNA, 25 bp, E. coli
tcctgtcatcagcaccgtaaacagc

SEQ ID NO: 149028 - DNA, 25 bp, E. coli
tcctgtcatcaggaccgtaaacagc

SEQ ID NO: 149029 - DNA, 25 bp, E. coli
tcggttggaaaagggtcctgtcatc

SEQ ID NO: 149030 - DNA, 25 bp, E. coli
tcggttggaaaacggtcctgtcatc

SEQ ID NO: 149031 - DNA, 25 bp, E. coli
ccgttgatgtgctttaagccacgca

SEQ ID NO: 149032 - DNA, 25 bp, E. coli
gcgggtgatgcatcaattatttttc

SEQ ID NO: 149033 - DNA, 25 bp, E. coli
gcgggtgatgcaacaattatttttc

SEQ ID NO: 149034 - DNA, 25 bp, E. coli
gaagcgttaaagcaatgtgcactac

SEQ ID NO: 149035 - DNA, 25 bp, E. coli
gaagcgttaaaggaatgtgcactac

SEQ ID NO: 149036 - DNA, 25 bp, E. coli
cgataactcttgtagggacttgcct

SEQ ID NO: 149037 - DNA, 25 bp, E. coli
cgataactcttgaagggacttgcct

SEQ ID NO: 149038 - DNA, 25 bp, E. coli
ccgttgatgtgcattaagccacgca

SEQ ID NO: 149039 - DNA, 25 bp, E. coli
ggaccgtaaacagcaataaagtgga

SEQ ID NO: 149040 - DNA, 25 bp, E. coli
ggaccgtaaacaccaataaagtgga

SEQ ID NO: 149041 - DNA, 25 bp, E. coli
ggtctgtacgtcaaaccgttgatgt

SEQ ID NO: 149042 - DNA, 25 bp, E. coli
ggtctgtacgtctaaccgttgatgt

SEQ ID NO: 149043 - DNA, 25 bp, E. coli
gggacttgcctttctacactgcttt

SEQ ID NO: 149044 - DNA, 25 bp, E. coli
gggacttgccttactacactgcttt

SEQ ID NO: 149045 - DNA, 25 bp, E. coli
taagccacgcattggcgggtgatgc

SEQ ID NO: 149046 - DNA, 25 bp, E. coli
taagccacgcataggcgggtgatgc

SEQ ID NO: 149047 - DNA, 25 bp, E. coli
caactggcggatgattaacttgccg

SEQ ID NO: 149048 - DNA, 25 bp, E. coli
caactggcggatcattaacttgccg

SEQ ID NO: 149049 - DNA, 25 bp, E. coli
atacgccaaccgcagagacaattgt

SEQ ID NO: 149050 - DNA, 25 bp, E. coli
atacgccaaccggagagacaattgt

SEQ ID NO: 149051 - DNA, 25 bp, E. coli
tacgcgtgacgcgatacccgataaa

SEQ ID NO: 149052 - DNA, 25 bp, E. coli
tatccgcgagtttacgcgtgacgcc

SEQ ID NO: 149053 - DNA, 25 bp, E. coli
tacgcgtgacgccatacccgataaa

SEQ ID NO: 149054 - DNA, 25 bp, E. coli
tatccgcgagttaacgcgtgacgcc

SEQ ID NO: 149055 - DNA, 25 bp, E. coli
tccgcgagtttaggcgtgacgccat

SEQ ID NO: 149056 - DNA, 25 bp, E. coli
tccgcgagtttacgcgtgacgccat

SEQ ID NO: 149057 - DNA, 25 bp, E. coli
cggatatccgcgtgtttacgcgtga

SEQ ID NO: 149058 - DNA, 25 bp, E. coli
cggatatccgcgagtttacgcgtga

SEQ ID NO: 149059 - DNA, 25 bp, E. coli
gttatacgccaaccggagagacaat

SEQ ID NO: 149060 - DNA, 25 bp, E. coli
gtttacgcgtgaggccatacccgat

SEQ ID NO: 149061 - DNA, 25 bp, E. coli
gtttacgcgtgacgccatacccgat

SEQ ID NO: 149062 - DNA, 25 bp, E. coli
gttatacgccaagcggagagacaat

SEQ ID NO: 149063 - DNA, 25 bp, E. coli
tggcggatgatttacttgccggttg

SEQ ID NO: 149064 - DNA, 25 bp, E. coli
tggcggatgattaacttgccggttg

SEQ ID NO: 149065 - DNA, 25 bp, E. coli
gatgattaacttcccggttggcccg

SEQ ID NO: 149066 - DNA, 25 bp, E. coli
gagtttacgcgtgacgccatacccg

SEQ ID NO: 149067 - DNA, 25 bp, E. coli
gatgattaacttgccggttggcccg

SEQ ID NO: 149068 - DNA, 25 bp, E. coli
gagtttacgcgtcacgccatacccg

SEQ ID NO: 149069 - DNA, 25 bp, E. coli
caaaatggtgagagattccctgcgc

SEQ ID NO: 149070 - DNA, 25 bp, E. coli
caaaatggtgagtgattccctgcgc

SEQ ID NO: 149071 - DNA, 25 bp, E. coli
aagatcctgccctggcgtaccgtga

SEQ ID NO: 149072 - DNA, 25 bp, E. coli
aagatcctgcccaggcgtaccgtga

SEQ ID NO: 149073 - DNA, 25 bp, E. coli
tttaccttccgcttaccgccgatga

SEQ ID NO: 149074 - DNA, 25 bp, E. coli
tttaccttccgcataccgccgatga

SEQ ID NO: 149075 - DNA, 25 bp, E. coli
tcgaagaagatatcctggcgcaggc

SEQ ID NO: 149076 - DNA, 25 bp, E. coli
tcgaagaagataacctggcgcaggc

SEQ ID NO: 149077 - DNA, 25 bp, E. coli
tcgaaccgttaaaccgctatcagga

SEQ ID NO: 149078 - DNA, 25 bp, E. coli
tcgaaccgttaatccgctatcagga

SEQ ID NO: 149079 - DNA, 25 bp, E. coli
gcctggacggcgtccgcaaaatggt

SEQ ID NO: 149080 - DNA, 25 bp, E. coli
gcctggacggcgaccgcaaaatggt

SEQ ID NO: 149081 - DNA, 25 bp, E. coli
ctggagaaatttcgttatatcaaag

SEQ ID NO: 149082 - DNA, 25 bp, E. coli
ctggagaaatttggttatatcaaag

SEQ ID NO: 149083 - DNA, 25 bp, E. coli
gattatcggcgaattctatcacatg

SEQ ID NO: 149084 - DNA, 25 bp, E. coli
gattccctgcgcctactggaacagg

SEQ ID NO: 149085 - DNA, 25 bp, E. coli
gattccctgcgcgtactggaacagg

SEQ ID NO: 149086 - DNA, 25 bp, E. coli
gatttccacgcgctgtttgaacagc

SEQ ID NO: 149087 - DNA, 25 bp, E. coli
gattatcggcgatttctatcacatg

SEQ ID NO: 149088 - DNA, 25 bp, E. coli
gatttccacgcggtgtttgaacagc

SEQ ID NO: 149089 - DNA, 25 bp, E. coli
gggcatgtttaccttccgcttaccg

SEQ ID NO: 149090 - DNA, 25 bp, E. coli
gggcatgtttacgttccgcttaccg

SEQ ID NO: 149091 - DNA, 25 bp, E. coli
aatccagcgggtacagtcagacacg

SEQ ID NO: 149092 - DNA, 25 bp, E. coli
aatccagcgggttcagtcagacacg

SEQ ID NO: 149093 - DNA, 25 bp, E. coli
tatcgcgatgataaccccggagaat

SEQ ID NO: 149094 - DNA, 25 bp, E. coli
tatcgcagaagtcacccggaaaatc

SEQ ID NO: 149095 - DNA, 25 bp, E. coli
tatcgcagaagtgacccggaaaatc

SEQ ID NO: 149096 - DNA, 25 bp, E. coli
tatcgcgatgattaccccggagaat

SEQ ID NO: 149097 - DNA, 25 bp, E. coli
tgatagatgagacgcttctgggcca

SEQ ID NO: 149098 - DNA, 25 bp, E. coli
tgatagatgagaggcttctgggcca

SEQ ID NO: 149099 - DNA, 25 bp, E. coli
gaaaatgcccgacagatagcacagg

SEQ ID NO: 149100 - DNA, 25 bp, E. coli
gaaaatgcccgagagatagcacagg

SEQ ID NO: 149101 - DNA, 25 bp, E. coli
cattgatgcttctgcgctgcgtacg

SEQ ID NO: 149102 - DNA, 25 bp, E. coli
cattgatgcttcagcgctgcgtacg

SEQ ID NO: 149103 - DNA, 25 bp, E. coli
gatatttattcgacatgccgcctga

SEQ ID NO: 149104 - DNA, 25 bp, E. coli
gattcagttacaccgtaatggccgc

SEQ ID NO: 149105 - DNA, 25 bp, E. coli
gatatcagtggagccatcacggcga

SEQ ID NO: 149106 - DNA, 25 bp, E. coli
gattcagttacagcgtaatggccgc

SEQ ID NO: 149107 - DNA, 25 bp, E. coli
gatatcagtggacccatcacggcga

SEQ ID NO: 149108 - DNA, 25 bp, E. coli
gatatttattcgtcatgccgcctga

SEQ ID NO: 149109 - DNA, 25 bp, E. coli
ggccgtgaccatacagcaaatccag

SEQ ID NO: 149110 - DNA, 25 bp, E. coli
ggccgtgaccattcagcaaatccag

SEQ ID NO: 149111 - DNA, 25 bp, E. coli
gagtgaaattacctcgaccacggat

SEQ ID NO: 149112 - DNA, 25 bp, E. coli
gagtgaaattacgtcgaccacggat

SEQ ID NO: 149113 - DNA, 25 bp, E. coli
caagctggcgatggatatggcaaaa

SEQ ID NO: 149114 - DNA, 25 bp, E. coli
caagctggcgatcgatatggcaaaa

SEQ ID NO: 149115 - DNA, 25 bp, E. coli
cagacgtatcagttgccgattatcg

SEQ ID NO: 149116 - DNA, 25 bp, E. coli
cagacgtatcagatgccgattatcg

SEQ ID NO: 149117 - DNA, 25 bp, E. coli
agcgggcggcatcaaacaaatcaag

SEQ ID NO: 149118 - DNA, 25 bp, E. coli
aggtatgtttacctgcggccaccag

SEQ ID NO: 149119 - DNA, 25 bp, E. coli
agcgggcggcatgaaacaaatcaag

SEQ ID NO: 149120 - DNA, 25 bp, E. coli
aggtatgtttacgtgcggccaccag

SEQ ID NO: 149121 - DNA, 25 bp, E. coli
aaatcaaggcgctggcgcagacgta

SEQ ID NO: 149122 - DNA, 25 bp, E. coli
aaatcaaggcgcaggcgcagacgta

SEQ ID NO: 149123 - DNA, 25 bp, E. coli
tatggcaaaagacatgaacgcgggt

SEQ ID NO: 149124 - DNA, 25 bp, E. coli
tatccgtataacttgatgctgggcg

SEQ ID NO: 149125 - DNA, 25 bp, E. coli
tatccgtataacatgatgctgggcg

SEQ ID NO: 149126 - DNA, 25 bp, E. coli
tatggcaaaagagatgaacgcgggt

SEQ ID NO: 149127 - DNA, 25 bp, E. coli
tgctgggcgatgtacatatgcgtcg

SEQ ID NO: 149128 - DNA, 25 bp, E. coli
tgctgggcgatgaacatatgcgtcg

SEQ ID NO: 149129 - DNA, 25 bp, E. coli
gcgttcgcgccgcacttaaaagcgg

SEQ ID NO: 149130 - DNA, 25 bp, E. coli
gcgttcgcgccggacttaaaagcgg

SEQ ID NO: 149131 - DNA, 25 bp, E. coli
gccagaaaccaagggctatccgtat

SEQ ID NO: 149132 - DNA, 25 bp, E. coli
gccaccagcggctgcctattgaaca

SEQ ID NO: 149133 - DNA, 25 bp, E. coli
gccagaaaccaacggctatccgtat

SEQ ID NO: 149134 - DNA, 25 bp, E. coli
gccaccagcggcagcctattgaaca

SEQ ID NO: 149135 - DNA, 25 bp, E. coli
caagctgctgaaagcgttaggtgca

SEQ ID NO: 149136 - DNA, 25 bp, E. coli
caagctgctgaatgcgttaggtgca

SEQ ID NO: 149137 - DNA, 25 bp, E. coli
catgatttgggaagccgaaaagcgc

SEQ ID NO: 149138 - DNA, 25 bp, E. coli
catcggtaacggtcgcattctggcg

SEQ ID NO: 149139 - DNA, 25 bp, E. coli
catcggtaacggacgcattctggcg

SEQ ID NO: 149140 - DNA, 25 bp, E. coli
catgatttgggatgccgaaaagcgc

SEQ ID NO: 149141 - DNA, 25 bp, E. coli
tgtcgccagcaaaccagagaaatac

SEQ ID NO: 149142 - DNA, 25 bp, E. coli
tgtcgccagcaatccagagaaatac

SEQ ID NO: 149143 - DNA, 25 bp, E. coli
gcttcagcgttaagtgccgtatcgg

SEQ ID NO: 149144 - DNA, 25 bp, E. coli
gctaaaggcatgaaaggcgcaatcc

SEQ ID NO: 149145 - DNA, 25 bp, E. coli
gcttcagcgttatgtgccgtatcgg

SEQ ID NO: 149146 - DNA, 25 bp, E. coli
gctaaaggcatgtaaggcgcaatcc

SEQ ID NO: 149147 - DNA, 25 bp, E. coli
gaaggtggaatcacgtaaccccagc

SEQ ID NO: 149148 - DNA, 25 bp, E. coli
gaaggtggaatctcgtaaccccagc

SEQ ID NO: 149149 - DNA, 25 bp, E. coli
gaaaccatgagtattgaacgccgca

SEQ ID NO: 149150 - DNA, 25 bp, E. coli
gaaaccatgagttttgaacgccgca

SEQ ID NO: 149151 - DNA, 25 bp, E. coli
cggcgtgctgaatccaggcgttgaa

SEQ ID NO: 149152 - DNA, 25 bp, E. coli
cggcgtgctgaaaccaggcgttgaa

SEQ ID NO: 149153 - DNA, 25 bp, E. coli
gtaataccgggattgcactggccta

SEQ ID NO: 149154 - DNA, 25 bp, E. coli
gtaataccgggaatgcactggccta

SEQ ID NO: 149155 - DNA, 25 bp, E. coli
tggttcgcctgaatcgcatcggtaa

SEQ ID NO: 149156 - DNA, 25 bp, E. coli
tggttcgcctgattcgcatcggtaa

SEQ ID NO: 149157 - DNA, 25 bp, E. coli
aaccgggaaagctcaaatgattgaa

SEQ ID NO: 149158 - DNA, 25 bp, E. coli
cagaagcgttttgctgtaccgaaat

SEQ ID NO: 149159 - DNA, 25 bp, E. coli
cagaagcgttttcctgtaccgaaat

SEQ ID NO: 149160 - DNA, 25 bp, E. coli
tacagaagcgttatcctgtaccgaa

SEQ ID NO: 149161 - DNA, 25 bp, E. coli
tacagaagcgttttcctgtaccgaa

SEQ ID NO: 149162 - DNA, 25 bp, E. coli
aaacctgtcggtctagcccaggaca

SEQ ID NO: 149163 - DNA, 25 bp, E. coli
gtagcccaggactaacttaaaatct

SEQ ID NO: 149164 - DNA, 25 bp, E. coli
aaacctgtcggtgtagcccaggaca

SEQ ID NO: 149165 - DNA, 25 bp, E. coli
gtagcccaggacaaacttaaaatct

SEQ ID NO: 149166 - DNA, 25 bp, E. coli
aaccgggaaagcacaaatgattgaa

SEQ ID NO: 149167 - DNA, 25 bp, E. coli
tcggtgtagcccaggacaaacttaa

SEQ ID NO: 149168 - DNA, 25 bp, E. coli
tcggtgtagccctggacaaacttaa

SEQ ID NO: 149169 - DNA, 25 bp, E. coli
cctgtcggtgtagcccaggacaaac

SEQ ID NO: 149170 - DNA, 25 bp, E. coli
cctgtcggtgtaccccaggacaaac

SEQ ID NO: 149171 - DNA, 25 bp, E. coli
gaattgccagacaaagaatcagttc

SEQ ID NO: 149172 - DNA, 25 bp, E. coli
gaattgccagactaagaatcagttc

SEQ ID NO: 149173 - DNA, 25 bp, E. coli
gaaagcacaaatgattgaatacggg

SEQ ID NO: 149174 - DNA, 25 bp, E. coli
gaaagcacaaatcattgaatacggg

SEQ ID NO: 149175 - DNA, 25 bp, E. coli
cggaaaacctgtgggtgtagcccag

SEQ ID NO: 149176 - DNA, 25 bp, E. coli
cggaaaacctgtcggtgtagcccag

SEQ ID NO: 149177 - DNA, 25 bp, E. coli
ggacaatcaactctgctcaggtagc

SEQ ID NO: 149178 - DNA, 25 bp, E. coli
ggacaatcaactgtgctcaggtagc

SEQ ID NO: 149179 - DNA, 25 bp, E. coli
tacagctgttcacgacgggcgatga

SEQ ID NO: 149180 - DNA, 25 bp, E. coli
tacagctgttcaggacgggcgatga

SEQ ID NO: 149181 - DNA, 25 bp, E. coli
agaatcctcttctgtcacgcgtgca

SEQ ID NO: 149182 - DNA, 25 bp, E. coli
agaatcctcttcagtcacgcgtgca

SEQ ID NO: 149183 - DNA, 25 bp, E. coli
tttaccatggtgtacgcctcacgag

SEQ ID NO: 149184 - DNA, 25 bp, E. coli
tttaccatggtgaacgcctcacgag

SEQ ID NO: 149185 - DNA, 25 bp, E. coli
ttattctgttttcacttggcggcgc

SEQ ID NO: 149186 - DNA, 25 bp, E. coli
ttattctgttttgacttggcggcgc

SEQ ID NO: 149187 - DNA, 25 bp, E. coli
tcggcgctcagttgatgggctacca

SEQ ID NO: 149188 - DNA, 25 bp, E. coli
tcaggatcgaaatacgggacagccg

SEQ ID NO: 149189 - DNA, 25 bp, E. coli
tcaggatcgaaaaacgggacagccg

SEQ ID NO: 149190 - DNA, 25 bp, E. coli
tcggcgctcagtagatgggctacca

SEQ ID NO: 149191 - DNA, 25 bp, E. coli
gacagtcaggaagtgcagtatcagg

SEQ ID NO: 149192 - DNA, 25 bp, E. coli
gacagtcaggaactgcagtatcagg

SEQ ID NO: 149193 - DNA, 25 bp, E. coli
cgcatcgtggtgagggttatcgcca

SEQ ID NO: 149194 - DNA, 25 bp, E. coli
cgcatcgtggtgtgggttatcgcca

SEQ ID NO: 149195 - DNA, 25 bp, E. coli
ggtattgattgtcctgaccgccgta

SEQ ID NO: 149196 - DNA, 25 bp, E. coli
ggtattgattgtgctgaccgccgta

SEQ ID NO: 149197 - DNA, 25 bp, E. coli
taatggtccggctgggctatgacag

SEQ ID NO: 149198 - DNA, 25 bp, E. coli
taatggtccggcagggctatgacag

SEQ ID NO: 149199 - DNA, 25 bp, E. coli
taacggtatcctcgcgcttattcgc

SEQ ID NO: 149200 - DNA, 25 bp, E. coli
taacggtatcctggcgcttattcgc

SEQ ID NO: 149201 - DNA, 25 bp, E. coli
aaccagttgggcagatgattggcac

SEQ ID NO: 149202 - DNA, 25 bp, E. coli
aaccagttgggctgatgattggcac

SEQ ID NO: 149203 - DNA, 25 bp, E. coli
tatgcctagcattgatgcgcctggg

SEQ ID NO: 149204 - DNA, 25 bp, E. coli
tatgcctagcatagatgcgcctggg

SEQ ID NO: 149205 - DNA, 25 bp, E. coli
tatagtgtcctacacacgctgagcg

SEQ ID NO: 149206 - DNA, 25 bp, E. coli
tatagtgtcctagacacgctgagcg

SEQ ID NO: 149207 - DNA, 25 bp, E. coli
tgattggcacgggatcacgctgaaa

SEQ ID NO: 149208 - DNA, 25 bp, E. coli
tgattggcacggcatcacgctgaaa

SEQ ID NO: 149209 - DNA, 25 bp, E. coli
tgagcgcatacaacggcgagcacgt

SEQ ID NO: 149210 - DNA, 25 bp, E. coli
tgagcgcatacatcggcgagcacgt

SEQ ID NO: 149211 - DNA, 25 bp, E. coli
tcagggcagccgcaggaaagtttta

SEQ ID NO: 149212 - DNA, 25 bp, E. coli
tcagggcagccggaggaaagtttta

SEQ ID NO: 149213 - DNA, 25 bp, E. coli
gaacaggaaaaagcgtggaatcgtc

SEQ ID NO: 149214 - DNA, 25 bp, E. coli
gaacaggaaaaaccgtggaatcgtc

SEQ ID NO: 149215 - DNA, 25 bp, E. coli
cattgataacgaaaagggctaccac

SEQ ID NO: 149216 - DNA, 25 bp, E. coli
cattgataacgataagggctaccac

SEQ ID NO: 149217 - DNA, 25 bp, E. coli
gggctaccacactgcaagcgtctat

SEQ ID NO: 149218 - DNA, 25 bp, E. coli
gggctaccacacagcaagcgtctat

SEQ ID NO: 149219 - DNA, 25 bp, E. coli
ggaattaatcgagctgacgccagaa

SEQ ID NO: 149220 - DNA, 25 bp, E. coli
ggaattaatcgacctgacgccagaa

SEQ ID NO: 149221 - DNA, 25 bp, E. coli
ggcgagcacgttcccagcattgata

SEQ ID NO: 149222 - DNA, 25 bp, E. coli
ggcgagcacgttgccagcattgata

SEQ ID NO: 149223 - DNA, 25 bp, E. coli
aactggcatccgctttgcaaacaag

SEQ ID NO: 149224 - DNA, 25 bp, E. coli
aactggcatccggtttgcaaacaag

SEQ ID NO: 149225 - DNA, 25 bp, E. coli
ttttagataacgtaatgttaacaga

SEQ ID NO: 149226 - DNA, 25 bp, E. coli
ttttagataacgaaatgttaacaga

SEQ ID NO: 149227 - DNA, 25 bp, E. coli
tttttaaaaactggcatccgctttg

SEQ ID NO: 149228 - DNA, 25 bp, E. coli
tttttaaaaactcgcatccgctttg

SEQ ID NO: 149229 - DNA, 25 bp, E. coli
tcgcgcacagatgcatgttttatgt

SEQ ID NO: 149230 - DNA, 25 bp, E. coli
tcccctcttgtacattggcaacagg

SEQ ID NO: 149231 - DNA, 25 bp, E. coli
tcccctcttgtagattggcaacagg

SEQ ID NO: 149232 - DNA, 25 bp, E. coli
tcgcgcacagatccatgttttatgt

SEQ ID NO: 149233 - DNA, 25 bp, E. coli
tctgcactctcaacgcgcacagatg

SEQ ID NO: 149234 - DNA, 25 bp, E. coli
tctgcactctcatcgcgcacagatg

SEQ ID NO: 149235 - DNA, 25 bp, E. coli
gctttgcaaacatgccaatacgcgg

SEQ ID NO: 149236 - DNA, 25 bp, E. coli
gctttgcaaacaagccaatacgcgg

SEQ ID NO: 149237 - DNA, 25 bp, E. coli
gcaactgttttgaccgtttagtcca

SEQ ID NO: 149238 - DNA, 25 bp, E. coli
gcaactgttttgtccgtttagtcca

SEQ ID NO: 149239 - DNA, 25 bp, E. coli
gtttagtccactttttaccagatat

SEQ ID NO: 149240 - DNA, 25 bp, E. coli
gtttagtccactatttaccagatat

SEQ ID NO: 149241 - DNA, 25 bp, E. coli
gattggcaacagcatagcaaaaccc

SEQ ID NO: 149242 - DNA, 25 bp, E. coli
gttttatgtgcaactgttttgaccg

SEQ ID NO: 149243 - DNA, 25 bp, E. coli
gttttatgtgcatctgttttgaccg

SEQ ID NO: 149244 - DNA, 25 bp, E. coli
gattggcaacaggatagcaaaaccc

SEQ ID NO: 149245 - DNA, 25 bp, E. coli
aactcggcgtatcacgtaattcact

SEQ ID NO: 149246 - DNA, 25 bp, E. coli
aactcggcgtatgacgtaattcact

SEQ ID NO: 149247 - DNA, 25 bp, E. coli
tagccgtcagcgcatgtatctggtg

SEQ ID NO: 149248 - DNA, 25 bp, E. coli
tagccgtcagcggatgtatctggtg

SEQ ID NO: 149249 - DNA, 25 bp, E. coli
tgcaactcggcgaatcacgtaattc

SEQ ID NO: 149250 - DNA, 25 bp, E. coli
tgcaactcggcgtatcacgtaattc

SEQ ID NO: 149251 - DNA, 25 bp, E. coli
tgccaccggttttttcacaactgac

SEQ ID NO: 149252 - DNA, 25 bp, E. coli
tgccaccggtttattcacaactgac

SEQ ID NO: 149253 - DNA, 25 bp, E. coli
tcagcggatgtaactggtgccaccg

SEQ ID NO: 149254 - DNA, 25 bp, E. coli
tcagcggatgtatctggtgccaccg

SEQ ID NO: 149255 - DNA, 25 bp, E. coli
gccgaagcctcacataacatcgtgc

SEQ ID NO: 149256 - DNA, 25 bp, E. coli
gccgaagcctcagataacatcgtgc

SEQ ID NO: 149257 - DNA, 25 bp, E. coli
ccgtcagcggatgtatctggtgcca

SEQ ID NO: 149258 - DNA, 25 bp, E. coli
ccgtcagcggatctatctggtgcca

SEQ ID NO: 149259 - DNA, 25 bp, E. coli
gcggatgtatctcgtgccaccggtt

SEQ ID NO: 149260 - DNA, 25 bp, E. coli
gcggatgtatctggtgccaccggtt

SEQ ID NO: 149261 - DNA, 25 bp, E. coli
gaagcctcacataacatcgtgctgc

SEQ ID NO: 149262 - DNA, 25 bp, E. coli
gaagcctcacattacatcgtgctgc

SEQ ID NO: 149263 - DNA, 25 bp, E. coli
ctcacataacatggtgctgctgcaa

SEQ ID NO: 149264 - DNA, 25 bp, E. coli
ctcacataacatcgtgctgctgcaa

SEQ ID NO: 149265 - DNA, 25 bp, E. coli
ggtgccaccggtattttcacaactg

SEQ ID NO: 149266 - DNA, 25 bp, E. coli
ggtgccaccggttttttcacaactg

SEQ ID NO: 149267 - DNA, 25 bp, E. coli
cagtatggtttctcctttgatgatc

SEQ ID NO: 149268 - DNA, 25 bp, E. coli
cagtatggtttcacctttgatgatc

SEQ ID NO: 149269 - DNA, 25 bp, E. coli
tacgcgtgtatatcaccggtggcgg

SEQ ID NO: 149270 - DNA, 25 bp, E. coli
tacgcgtgtataacaccggtggcgg

SEQ ID NO: 149271 - DNA, 25 bp, E. coli
tgcaatatctggtcggcggttccgt

SEQ ID NO: 149272 - DNA, 25 bp, E. coli
tgcaatatctggacggcggttccgt

SEQ ID NO: 149273 - DNA, 25 bp, E. coli
ccatcgaaaaacagggcgttggcct

SEQ ID NO: 149274 - DNA, 25 bp, E. coli
ccatcgaaaaactgggcgttggcct

SEQ ID NO: 149275 - DNA, 25 bp, E. coli
gcctggtggttgatccgatgagcct

SEQ ID NO: 149276 - DNA, 25 bp, E. coli
gcctggtggttgttccgatgagcct

SEQ ID NO: 149277 - DNA, 25 bp, E. coli
gttgcagcggctaccagtatggttt

SEQ ID NO: 149278 - DNA, 25 bp, E. coli
gtttcatcgtgaccaacccgaacgc

SEQ ID NO: 149279 - DNA, 25 bp, E. coli
gatatgaccatcgaaaaacagggcg

SEQ ID NO: 149280 - DNA, 25 bp, E. coli
gatatgaccatccaaaaacagggcg

SEQ ID NO: 149281 - DNA, 25 bp, E. coli
gtgaccaacccgaacgcgaaaagca

SEQ ID NO: 149282 - DNA, 25 bp, E. coli
gttgcagcggcttccagtatggttt

SEQ ID NO: 149283 - DNA, 25 bp, E. coli
gtttcatcgtgagcaacccgaacgc

SEQ ID NO: 149284 - DNA, 25 bp, E. coli
gtgaccaacccgtacgcgaaaagca

SEQ ID NO: 149285 - DNA, 25 bp, E. coli
tggaaggttctcctttcatcgtgac

SEQ ID NO: 149286 - DNA, 25 bp, E. coli
tggaaggttctcgtttcatcgtgac

SEQ ID NO: 149287 - DNA, 25 bp, E. coli
gatccgatgagcgtgcaatatctgg

SEQ ID NO: 149288 - DNA, 25 bp, E. coli
gatccgatgagcctgcaatatctgg

SEQ ID NO: 149289 - DNA, 25 bp, E. coli
tactcgataaagtaactccgtcaca

SEQ ID NO: 149290 - DNA, 25 bp, E. coli
tactcgataaagaaactccgtcaca

SEQ ID NO: 149291 - DNA, 25 bp, E. coli
agtaactccgtctcagtgggctgca

SEQ ID NO: 149292 - DNA, 25 bp, E. coli
agtaactccgtcacagtgggctgca

SEQ ID NO: 149293 - DNA, 25 bp, E. coli
tgggcattgcagatactcgataaag

SEQ ID NO: 149294 - DNA, 25 bp, E. coli
tctgggcattgcagttactcgataa

SEQ ID NO: 149295 - DNA, 25 bp, E. coli
tctgggcattgctgttactcgataa

SEQ ID NO: 149296 - DNA, 25 bp, E. coli
taaagtaactccgtcacagtgggct

SEQ ID NO: 149297 - DNA, 25 bp, E. coli
taaagtaactccctcacagtgggct

SEQ ID NO: 149298 - DNA, 25 bp, E. coli
cgataaagtaacaccgtcacagtgg

SEQ ID NO: 149299 - DNA, 25 bp, E. coli
cgataaagtaactccgtcacagtgg

SEQ ID NO: 149300 - DNA, 25 bp, E. coli
ctccgtcacagtgggctgcaatcgg

SEQ ID NO: 149301 - DNA, 25 bp, E. coli
ctccgtcacagtcggctgcaatcgg

SEQ ID NO: 149302 - DNA, 25 bp, E. coli
gtcacagtgggcagcaatcggtgtg

SEQ ID NO: 149303 - DNA, 25 bp, E. coli
gtcacagtgggctgcaatcggtgtg

SEQ ID NO: 149304 - DNA, 25 bp, E. coli
ggtttctgggcaatgcagttactcg

SEQ ID NO: 149305 - DNA, 25 bp, E. coli
ggtttctgggcattgcagttactcg

SEQ ID NO: 149306 - DNA, 25 bp, E. coli
tgggcattgcagttactcgataaag

SEQ ID NO: 149307 - DNA, 25 bp, E. coli
ggcattgcagtttctcgataaagta

SEQ ID NO: 149308 - DNA, 25 bp, E. coli
ggcattgcagttactcgataaagta

SEQ ID NO: 149309 - DNA, 25 bp, E. coli
taactccgtcacagtgggctgcaat

SEQ ID NO: 149310 - DNA, 25 bp, E. coli
taactccgtcactgtgggctgcaat

SEQ ID NO: 149311 - DNA, 25 bp, E. coli
cagatatctacatgcccagcgaggg

SEQ ID NO: 149312 - DNA, 25 bp, E. coli
cagatatctacaagcccagcgaggg

SEQ ID NO: 149313 - DNA, 25 bp, E. coli
tatccggtggaacaagttgacccga

SEQ ID NO: 149314 - DNA, 25 bp, E. coli
tatccggtggaagaagttgacccga

SEQ ID NO: 149315 - DNA, 25 bp, E. coli
tattccagaaatgcgtgatgccctc

SEQ ID NO: 149316 - DNA, 25 bp, E. coli
tatcgaccaggtgacacgtcttggc

SEQ ID NO: 149317 - DNA, 25 bp, E. coli
tatcgaccaggtcacacgtcttggc

SEQ ID NO: 149318 - DNA, 25 bp, E. coli
tattccagaaatccgtgatgccctc

SEQ ID NO: 149319 - DNA, 25 bp, E. coli
tcggccagccatttgatcaaccagg

SEQ ID NO: 149320 - DNA, 25 bp, E. coli
tcggccagccatatgatcaaccagg

SEQ ID NO: 149321 - DNA, 25 bp, E. coli
gcggtaaattatgggcacagcatgt

SEQ ID NO: 149322 - DNA, 25 bp, E. coli
gcggtaaattatcggcacagcatgt

SEQ ID NO: 149323 - DNA, 25 bp, E. coli
gaaatcgaaacgttcatccagcgcc

SEQ ID NO: 149324 - DNA, 25 bp, E. coli
gaaatcgaaacgatcatccagcgcc

SEQ ID NO: 149325 - DNA, 25 bp, E. coli
tggaacggcccttatcccagtggtg

SEQ ID NO: 149326 - DNA, 25 bp, E. coli
tggcccaatggagggaacgtctcgc

SEQ ID NO: 149327 - DNA, 25 bp, E. coli
tggaacggccctaatcccagtggtg

SEQ ID NO: 149328 - DNA, 25 bp, E. coli
tggcccaatggacggaacgtctcgc

SEQ ID NO: 149329 - DNA, 25 bp, E. coli
tacaatatgccattgcctgcggtgc

SEQ ID NO: 149330 - DNA, 25 bp, E. coli
tacaatatgccaatgcctgcggtgc

SEQ ID NO: 149331 - DNA, 25 bp, E. coli
taatatacatcgtctggctgctgac

SEQ ID NO: 149332 - DNA, 25 bp, E. coli
taatatacatcgactggctgctgac

SEQ ID NO: 149333 - DNA, 25 bp, E. coli
taccgcgtggctcgtttcaacctga

SEQ ID NO: 149334 - DNA, 25 bp, E. coli
taccgcgtggctggtttcaacctga

SEQ ID NO: 149335 - DNA, 25 bp, E. coli
ttcaacctgaattcggcaacctgga

SEQ ID NO: 149336 - DNA, 25 bp, E. coli
ttcaacctgaatacggcaacctgga

SEQ ID NO: 149337 - DNA, 25 bp, E. coli
tgattagtctgccaacaagctttgc

SEQ ID NO: 149338 - DNA, 25 bp, E. coli
tgattagtctgcgaacaagctttgc

SEQ ID NO: 149339 - DNA, 25 bp, E. coli
tgtgaagatgaatagcaggcttacc

SEQ ID NO: 149340 - DNA, 25 bp, E. coli
tgaagattctctcaaacaactggcg

SEQ ID NO: 149341 - DNA, 25 bp, E. coli
tgaagattctctgaaacaactggcg

SEQ ID NO: 149342 - DNA, 25 bp, E. coli
tcgatggcttaagcgccgttgagca

SEQ ID NO: 149343 - DNA, 25 bp, E. coli
tcgatggcttaaccgccgttgagca

SEQ ID NO: 149344 - DNA, 25 bp, E. coli
taatttagcgggtgaaggaccgcgc

SEQ ID NO: 149345 - DNA, 25 bp, E. coli
taatttagcgggagaaggaccgcgc

SEQ ID NO: 149346 - DNA, 25 bp, E. coli
ccggcagaaagcattgttccgcata

SEQ ID NO: 149347 - DNA, 25 bp, E. coli
ccggcagaaagctttgttccgcata

SEQ ID NO: 149348 - DNA, 25 bp, E. coli
gaacgctataaagcctaccgcgtgg

SEQ ID NO: 149349 - DNA, 25 bp, E. coli
gcagattttgcctccgctttcacag

SEQ ID NO: 149350 - DNA, 25 bp, E. coli
gaacgctataaaccctaccgcgtgg

SEQ ID NO: 149351 - DNA, 25 bp, E. coli
gcagattttgccaccgctttcacag

SEQ ID NO: 149352 - DNA, 25 bp, E. coli
tggacaatgacaccaccgtcgatgg

SEQ ID NO: 149353 - DNA, 25 bp, E. coli
tggacaatgacagcaccgtcgatgg

SEQ ID NO: 149354 - DNA, 25 bp, E. coli
tgtgaagatgaaaagcaggcttacc

SEQ ID NO: 149355 - DNA, 25 bp, E. coli
caactatttctatttccaacggtgg

SEQ ID NO: 149356 - DNA, 25 bp, E. coli
caactatttctaattccaacggtgg

SEQ ID NO: 149357 - DNA, 25 bp, E. coli
taaaaccgccagaaatcagggcaaa

SEQ ID NO: 149358 - DNA, 25 bp, E. coli
taaaaccgccagtaatcagggcaaa

SEQ ID NO: 149359 - DNA, 25 bp, E. coli
ttcttatgccaataatgatcgtcga

SEQ ID NO: 149360 - DNA, 25 bp, E. coli
ttcttatgccaaaaatgatcgtcga

SEQ ID NO: 149361 - DNA, 25 bp, E. coli
tgatcgtcgatttccccataaaatg

SEQ ID NO: 149362 - DNA, 25 bp, E. coli
tgatcgtcgattaccccataaaatg

SEQ ID NO: 149363 - DNA, 25 bp, E. coli
tgctagccaatttaaaaagaacgcc

SEQ ID NO: 149364 - DNA, 25 bp, E. coli
tgctagccaattaaaaaagaacgcc

SEQ ID NO: 149365 - DNA, 25 bp, E. coli
gaaacatcgggcttaaatgggcatg

SEQ ID NO: 149366 - DNA, 25 bp, E. coli
gaaacatcgggcataaatgggcatg

SEQ ID NO: 149367 - DNA, 25 bp, E. coli
cccataaaatgtcagcgatgccgaa

SEQ ID NO: 149368 - DNA, 25 bp, E. coli
cccataaaatgtgagcgatgccgaa

SEQ ID NO: 149369 - DNA, 25 bp, E. coli
ctgaataggtattagggatgtagcc

SEQ ID NO: 149370 - DNA, 25 bp, E. coli
cattccgggagtagtgagcctttca

SEQ ID NO: 149371 - DNA, 25 bp, E. coli
ctgaataggtataagggatgtagcc

SEQ ID NO: 149372 - DNA, 25 bp, E. coli
cattccgggagttgtgagcctttca

SEQ ID NO: 149373 - DNA, 25 bp, E. coli
gggcaaagataatccgcattccggg

SEQ ID NO: 149374 - DNA, 25 bp, E. coli
gggcaaagataaaccgcattccggg

SEQ ID NO: 149375 - DNA, 25 bp, E. coli
taacccctgaataagtagctctgaa

SEQ ID NO: 149376 - DNA, 25 bp, E. coli
taacccctgaattagtagctctgaa

SEQ ID NO: 149377 - DNA, 25 bp, E. coli
caaggtcgtacacgtgcagtattac

SEQ ID NO: 149378 - DNA, 25 bp, E. coli
aatatcgcgacagaccaacaatggg

SEQ ID NO: 149379 - DNA, 25 bp, E. coli
aatatcgcgacacaccaacaatggg

SEQ ID NO: 149380 - DNA, 25 bp, E. coli
caaggtcgtacaggtgcagtattac

SEQ ID NO: 149381 - DNA, 25 bp, E. coli
cacaagtactgactggacaggaaca

SEQ ID NO: 149382 - DNA, 25 bp, E. coli
caaaggatttacaagactgggatgc

SEQ ID NO: 149383 - DNA, 25 bp, E. coli
caaaggatttactagactgggatgc

SEQ ID NO: 149384 - DNA, 25 bp, E. coli
cacaagtactgagtggacaggaaca

SEQ ID NO: 149385 - DNA, 25 bp, E. coli
tgataaaaccgggaaggaggatcct

SEQ ID NO: 149386 - DNA, 25 bp, E. coli
tgataaaaccggcaaggaggatcct

SEQ ID NO: 149387 - DNA, 25 bp, E. coli
gccgtagcctaccagaatgctcagt

SEQ ID NO: 149388 - DNA, 25 bp, E. coli
gccgtagcctacgagaatgctcagt

SEQ ID NO: 149389 - DNA, 25 bp, E. coli
gaagtccgcattgaaggtcacacaa

SEQ ID NO: 149390 - DNA, 25 bp, E. coli
gaacattgggtatccatgtcggacc

SEQ ID NO: 149391 - DNA, 25 bp, E. coli
gaacattgggtaaccatgtcggacc

SEQ ID NO: 149392 - DNA, 25 bp, E. coli
gaagtccgcattcaaggtcacacaa

SEQ ID NO: 149393 - DNA, 25 bp, E. coli
tgtcggacctaatggctgggctgat

SEQ ID NO: 149394 - DNA, 25 bp, E. coli
tgtcggacctaaaggctgggctgat

SEQ ID NO: 149395 - DNA, 25 bp, E. coli
taatatggcactatcgcaaggtcgt

SEQ ID NO: 149396 - DNA, 25 bp, E. coli
taatatggcactttcgcaaggtcgt

SEQ ID NO: 149397 - DNA, 25 bp, E. coli
gaggatcctaatcgctctcgtcgtg

SEQ ID NO: 149398 - DNA, 25 bp, E. coli
gaggatcctaatggctctcgtcgtg

SEQ ID NO: 149399 - DNA, 25 bp, E. coli
catcgacttgctcgttgagcgttac

SEQ ID NO: 149400 - DNA, 25 bp, E. coli
catcgacttgctggttgagcgttac

SEQ ID NO: 149401 - DNA, 25 bp, E. coli
taaactgatccgacgtctgggtggt

SEQ ID NO: 149402 - DNA, 25 bp, E. coli
taaactgatccgtcgtctgggtggt

SEQ ID NO: 149403 - DNA, 25 bp, E. coli
tatcaacctgttcgatctcggcggc

SEQ ID NO: 149404 - DNA, 25 bp, E. coli
tttccgcgatgtcaccagcttactg

SEQ ID NO: 149405 - DNA, 25 bp, E. coli
tatcaacctgttggatctcggcggc

SEQ ID NO: 149406 - DNA, 25 bp, E. coli
tttccgcgatgtgaccagcttactg

SEQ ID NO: 149407 - DNA, 25 bp, E. coli
tgagcgttacaataatgcgggcatt

SEQ ID NO: 149408 - DNA, 25 bp, E. coli
tgagcgttacaaaaatgcgggcatt

SEQ ID NO: 149409 - DNA, 25 bp, E. coli
tcttgtttggcgctccggtagctct

SEQ ID NO: 149410 - DNA, 25 bp, E. coli
tcttgtttggcggtccggtagctct

SEQ ID NO: 149411 - DNA, 25 bp, E. coli
gcaaactgccgcctgaaaccatcag

SEQ ID NO: 149412 - DNA, 25 bp, E. coli
gcaaactgccgcgtgaaaccatcag

SEQ ID NO: 149413 - DNA, 25 bp, E. coli
gaacagcgtctccaaaaacagggca

SEQ ID NO: 149414 - DNA, 25 bp, E. coli
gaacagcgtctcgaaaaacagggca

SEQ ID NO: 149415 - DNA, 25 bp, E. coli
tggaagacccgatagcttacgctct

SEQ ID NO: 149416 - DNA, 25 bp, E. coli
tggaagacccgaaagcttacgctct

SEQ ID NO: 149417 - DNA, 25 bp, E. coli
ggcggcactatcgaagcgaccgtta

SEQ ID NO: 149418 - DNA, 25 bp, E. coli
ggcggcactatccaagcgaccgtta

SEQ ID NO: 149419 - DNA, 25 bp, E. coli
tcaaaccgggcgtcaaagttctggt

SEQ ID NO: 149420 - DNA, 25 bp, E. coli
tcaaaccgggcgacaaagttctggt

SEQ ID NO: 149421 - DNA, 25 bp, E. coli
aagatcagttctaccacggcgttgg

SEQ ID NO: 149422 - DNA, 25 bp, E. coli
aatggtcaactgtacgacaccctga

SEQ ID NO: 149423 - DNA, 25 bp, E. coli
aatggtcaactgaacgacaccctga

SEQ ID NO: 149424 - DNA, 25 bp, E. coli
aagatcagttcttccacggcgttgg

SEQ ID NO: 149425 - DNA, 25 bp, E. coli
caaaactttctctgggctgatgtgg

SEQ ID NO: 149426 - DNA, 25 bp, E. coli
caaaactttctcagggctgatgtgg

SEQ ID NO: 149427 - DNA, 25 bp, E. coli
cagcgactacgatgtcaaagcggaa

SEQ ID NO: 149428 - DNA, 25 bp, E. coli
cagcgactacgaagtcaaagcggaa

SEQ ID NO: 149429 - DNA, 25 bp, E. coli
tatcaacggcgccaaaaaattcgcc

SEQ ID NO: 149430 - DNA, 25 bp, E. coli
tatcaacggcgcgaaaaaattcgcc

SEQ ID NO: 149431 - DNA, 25 bp, E. coli
tgtatgccagcgttggtcgtacccg

SEQ ID NO: 149432 - DNA, 25 bp, E. coli
tgataaaaatgcctgatgttccccg

SEQ ID NO: 149433 - DNA, 25 bp, E. coli
tgataaaaatgcgtgatgttccccg

SEQ ID NO: 149434 - DNA, 25 bp, E. coli
tgtatgccagcgatggtcgtacccg

SEQ ID NO: 149435 - DNA, 25 bp, E. coli
gcgcgccgtggacagtgaaaaaata

SEQ ID NO: 149436 - DNA, 25 bp, E. coli
gcgcgccgtggagagtgaaaaaata

SEQ ID NO: 149437 - DNA, 25 bp, E. coli
gaagccttcacccaaaaagatcagt

SEQ ID NO: 149438 - DNA, 25 bp, E. coli
gaaccgctgccgtcatttatcgcta

SEQ ID NO: 149439 - DNA, 25 bp, E. coli
gaaccgctgccgacatttatcgcta

SEQ ID NO: 149440 - DNA, 25 bp, E. coli
gaagccttcaccgaaaaagatcagt

SEQ ID NO: 149441 - DNA, 25 bp, E. coli
gatgtattcacccaaggtcacggga

SEQ ID NO: 149442 - DNA, 25 bp, E. coli
gatgtattcaccgaaggtcacggga

SEQ ID NO: 149443 - DNA, 25 bp, E. coli
caacttgccgtgtcaaataatgatg

SEQ ID NO: 149444 - DNA, 25 bp, E. coli
aaggatggtcgttttatcgtgacgc

SEQ ID NO: 149445 - DNA, 25 bp, E. coli
aaggatggtcgtattatcgtgacgc

SEQ ID NO: 149446 - DNA, 25 bp, E. coli
aattaagatttcgtcgtagcgcgaa

SEQ ID NO: 149447 - DNA, 25 bp, E. coli
aattaagatttcctcgtagcgcgaa

SEQ ID NO: 149448 - DNA, 25 bp, E. coli
caacttgccgtgacaaataatgatg

SEQ ID NO: 149449 - DNA, 25 bp, E. coli
taaattagcgttcccacccgatcag

SEQ ID NO: 149450 - DNA, 25 bp, E. coli
taaattagcgttgccacccgatcag

SEQ ID NO: 149451 - DNA, 25 bp, E. coli
gattaacccgacaccctattacctg

SEQ ID NO: 149452 - DNA, 25 bp, E. coli
gattaacccgactccctattacctg

SEQ ID NO: 149453 - DNA, 25 bp, E. coli
tgactgagaataggctacagctcgc

SEQ ID NO: 149454 - DNA, 25 bp, E. coli
tgactgagaatacgctacagctcgc

SEQ ID NO: 149455 - DNA, 25 bp, E. coli
cctgacggtaacagagttgaatgcc

SEQ ID NO: 149456 - DNA, 25 bp, E. coli
ccgatcaggccggagaaaaattaag

SEQ ID NO: 149457 - DNA, 25 bp, E. coli
cctctgtttgcgatgaagggaaaaa

SEQ ID NO: 149458 - DNA, 25 bp, E. coli
cctgacggtaactgagttgaatgcc

SEQ ID NO: 149459 - DNA, 25 bp, E. coli
cctctgtttgcgttgaagggaaaaa

SEQ ID NO: 149460 - DNA, 25 bp, E. coli
gcaggtatcctgatgttcatggcaa

SEQ ID NO: 149461 - DNA, 25 bp, E. coli
gcaggtatcctgttgttcatggcaa

SEQ ID NO: 149462 - DNA, 25 bp, E. coli
ccgatcaggccgcagaaaaattaag

SEQ ID NO: 149463 - DNA, 25 bp, E. coli
tcaatcatgggtggaaaatgccgat

SEQ ID NO: 149464 - DNA, 25 bp, E. coli
tcaatcatgggtcgaaaatgccgat

SEQ ID NO: 149465 - DNA, 25 bp, E. coli
aagagcagtatccactgcaagagaa

SEQ ID NO: 149466 - DNA, 25 bp, E. coli
aagagcagtatcgactgcaagagaa

SEQ ID NO: 149467 - DNA, 25 bp, E. coli
cactgcaagagaacggacagatact

SEQ ID NO: 149468 - DNA, 25 bp, E. coli
cactgcaagagatcggacagatact

SEQ ID NO: 149469 - DNA, 25 bp, E. coli
cagtatccactgcaagagaacggac

SEQ ID NO: 149470 - DNA, 25 bp, E. coli
cagtatccactggaagagaacggac

SEQ ID NO: 149471 - DNA, 25 bp, E. coli
agttcgtggaaggagacatccgcaa

SEQ ID NO: 149472 - DNA, 25 bp, E. coli
agttcgtggaagcagacatccgcaa

SEQ ID NO: 149473 - DNA, 25 bp, E. coli
acttaatccgcacggcgtgctggca

SEQ ID NO: 149474 - DNA, 25 bp, E. coli
acttaatccgcagggcgtgctggca

SEQ ID NO: 149475 - DNA, 25 bp, E. coli
tatccactgcaagagaacggacaga

SEQ ID NO: 149476 - DNA, 25 bp, E. coli
tatccactgcaacagaacggacaga

SEQ ID NO: 149477 - DNA, 25 bp, E. coli
tctttacttaatgcgcagggcgtgc

SEQ ID NO: 149478 - DNA, 25 bp, E. coli
tctttacttaatccgcagggcgtgc

SEQ ID NO: 149479 - DNA, 25 bp, E. coli
gccagttcgtggaagcagacatccg

SEQ ID NO: 149480 - DNA, 25 bp, E. coli
gccagttcgtggtagcagacatccg

SEQ ID NO: 149481 - DNA, 25 bp, E. coli
gcaagagaacggtcagatactgctg

SEQ ID NO: 149482 - DNA, 25 bp, E. coli
gcaagagaacggacagatactgctg

SEQ ID NO: 149483 - DNA, 25 bp, E. coli
gactgccagttcctggaagcagaca

SEQ ID NO: 149484 - DNA, 25 bp, E. coli
gactgccagttcgtggaagcagaca

SEQ ID NO: 149485 - DNA, 25 bp, E. coli
tggtttctttacttaatccgcaggg

SEQ ID NO: 149486 - DNA, 25 bp, E. coli
tggtttctttacataatccgcaggg

SEQ ID NO: 149487 - DNA, 25 bp, E. coli
taaagttttgagcattaacacatga

SEQ ID NO: 149488 - DNA, 25 bp, E. coli
taaagttttgaggattaacacatga

SEQ ID NO: 149489 - DNA, 25 bp, E. coli
cgtaaagacgggtggcgaataagca

SEQ ID NO: 149490 - DNA, 25 bp, E. coli
cgtaaagacgggaggcgaataagca

SEQ ID NO: 149491 - DNA, 25 bp, E. coli
aacacgtacttttgcgcccgggcat

SEQ ID NO: 149492 - DNA, 25 bp, E. coli
aacacgtactttagcgcccgggcat

SEQ ID NO: 149493 - DNA, 25 bp, E. coli
ttgtgcaaaagacgcccgtaaagac

SEQ ID NO: 149494 - DNA, 25 bp, E. coli
ttgtgcaaaagaggcccgtaaagac

SEQ ID NO: 149495 - DNA, 25 bp, E. coli
tatatccagtgcgagacttcggtga

SEQ ID NO: 149496 - DNA, 25 bp, E. coli
tatatccagtgccagacttcggtga

SEQ ID NO: 149497 - DNA, 25 bp, E. coli
tattgtgattgtggccagtgtacgg

SEQ ID NO: 149498 - DNA, 25 bp, E. coli
tattgtgattgtcgccagtgtacgg

SEQ ID NO: 149499 - DNA, 25 bp, E. coli
ccagtgtacggatggtgtatatcca

SEQ ID NO: 149500 - DNA, 25 bp, E. coli
ccagtgtacggaaggtgtatatcca

SEQ ID NO: 149501 - DNA, 25 bp, E. coli
gaaggtgtatatccagtgccagact

SEQ ID NO: 149502 - DNA, 25 bp, E. coli
gaaggtgtatatgcagtgccagact

SEQ ID NO: 149503 - DNA, 25 bp, E. coli
gacaaaacacgtacttttgcgcccg

SEQ ID NO: 149504 - DNA, 25 bp, E. coli
gacaaaacacgttcttttgcgcccg

SEQ ID NO: 149505 - DNA, 25 bp, E. coli
cgcccgggcataaagttttgaggat

SEQ ID NO: 149506 - DNA, 25 bp, E. coli
cgcccgggcatatagttttgaggat

SEQ ID NO: 149507 - DNA, 25 bp, E. coli
tggtctggttgtccaaaagaggccc

SEQ ID NO: 149508 - DNA, 25 bp, E. coli
tggtctggttgtgcaaaagaggccc

SEQ ID NO: 149509 - DNA, 25 bp, E. coli
aagcgatggcgcctaaaaccggtgc

SEQ ID NO: 149510 - DNA, 25 bp, E. coli
aagcgatggcgcgtaaaaccggtgc

SEQ ID NO: 149511 - DNA, 25 bp, E. coli
taacattctgctcatcggtccgacc

SEQ ID NO: 149512 - DNA, 25 bp, E. coli
acgtttccggtgaaggcgtacagca

SEQ ID NO: 149513 - DNA, 25 bp, E. coli
acgtttccggtgtaggcgtacagca

SEQ ID NO: 149514 - DNA, 25 bp, E. coli
aactgatcgaaggtacggtagctgc

SEQ ID NO: 149515 - DNA, 25 bp, E. coli
aactgatcgaagctacggtagctgc

SEQ ID NO: 149516 - DNA, 25 bp, E. coli
tgaccaagcagtatcaggcgctgtt

SEQ ID NO: 149517 - DNA, 25 bp, E. coli
tgaccaagcagtttcaggcgctgtt

SEQ ID NO: 149518 - DNA, 25 bp, E. coli
tgcggcaaaagcgagcatgaagtgc

SEQ ID NO: 149519 - DNA, 25 bp, E. coli
tgcggcaaaagccagcatgaagtgc

SEQ ID NO: 149520 - DNA, 25 bp, E. coli
tctggaattccgtgacgaggcgctg

SEQ ID NO: 149521 - DNA, 25 bp, E. coli
tctgattcagatgctcaaagagccg

SEQ ID NO: 149522 - DNA, 25 bp, E. coli
tctgattcagatcctcaaagagccg

SEQ ID NO: 149523 - DNA, 25 bp, E. coli
tctggaattccgagacgaggcgctg

SEQ ID NO: 149524 - DNA, 25 bp, E. coli
gaagtccgacaatgcaagcgaaggc

SEQ ID NO: 149525 - DNA, 25 bp, E. coli
gaagtccgacaaagcaagcgaaggc

SEQ ID NO: 149526 - DNA, 25 bp, E. coli
gaagttgcaccggatcgtgaacgca

SEQ ID NO: 149527 - DNA, 25 bp, E. coli
gaagttgcaccgcatcgtgaacgca

SEQ ID NO: 149528 - DNA, 25 bp, E. coli
gataaacgcaaacatggctcaggca

SEQ ID NO: 149529 - DNA, 25 bp, E. coli
gataaacgcaaagatggctcaggca

SEQ ID NO: 149530 - DNA, 25 bp, E. coli
taacattctgctgatcggtccgacc

SEQ ID NO: 149531 - DNA, 25 bp, E. coli
caaacgtactggtgagcgctgcaat

SEQ ID NO: 149532 - DNA, 25 bp, E. coli
caaacgtactggagagcgctgcaat

SEQ ID NO: 149533 - DNA, 25 bp, E. coli
taccgacggcgaaggagtctgttgc

SEQ ID NO: 149534 - DNA, 25 bp, E. coli
taccgacggcgatggagtctgttgc

SEQ ID NO: 149535 - DNA, 25 bp, E. coli
tattgcactggcgacctatggcgag

SEQ ID NO: 149536 - DNA, 25 bp, E. coli
tattgcactggccacctatggcgag

SEQ ID NO: 149537 - DNA, 25 bp, E. coli
tgttcagtatcagccgtcaggccat

SEQ ID NO: 149538 - DNA, 25 bp, E. coli
tgttcagtatcacccgtcaggccat

SEQ ID NO: 149539 - DNA, 25 bp, E. coli
gaatataaatacctcaccaccggag

SEQ ID NO: 149540 - DNA, 25 bp, E. coli
gaatataaatacgtcaccaccggag

SEQ ID NO: 149541 - DNA, 25 bp, E. coli
cattgcgatggtcggaaaaccggtc

SEQ ID NO: 149542 - DNA, 25 bp, E. coli
cattgcgatggtgggaaaaccggtc

SEQ ID NO: 149543 - DNA, 25 bp, E. coli
tgtcccgatgaatctgggccgtgcg

SEQ ID NO: 149544 - DNA, 25 bp, E. coli
tgtcccgatgaaactgggccgtgcg

SEQ ID NO: 149545 - DNA, 25 bp, E. coli
ggaagatgcccctgaaacctatgaa

SEQ ID NO: 149546 - DNA, 25 bp, E. coli
tggctgcgtcaataggctccgatac

SEQ ID NO: 149547 - DNA, 25 bp, E. coli
ggaagatgccccagaaacctatgaa

SEQ ID NO: 149548 - DNA, 25 bp, E. coli
tggctgcgtcaaaaggctccgatac

SEQ ID NO: 149549 - DNA, 25 bp, E. coli
gatgaaaacagtttccgtgcgcagg

SEQ ID NO: 149550 - DNA, 25 bp, E. coli
gatgaaaacagtatccgtgcgcagg

SEQ ID NO: 149551 - DNA, 25 bp, E. coli
gaccctgcgtgattatgcccgtatg

SEQ ID NO: 149552 - DNA, 25 bp, E. coli
gaccctgcgtgaatatgcccgtatg

SEQ ID NO: 149553 - DNA, 25 bp, E. coli
tacagccttagtcttccgttatcgg

SEQ ID NO: 149554 - DNA, 25 bp, E. coli
tacagccttagtgttccgttatcgg

SEQ ID NO: 149555 - DNA, 25 bp, E. coli
tacgggctgccagttacctggtgtc

SEQ ID NO: 149556 - DNA, 25 bp, E. coli
tacgggctgccacttacctggtgtc

SEQ ID NO: 149557 - DNA, 25 bp, E. coli
tatttctggttacagcagtgtcaag

SEQ ID NO: 149558 - DNA, 25 bp, E. coli
tatttctggttagagcagtgtcaag

SEQ ID NO: 149559 - DNA, 25 bp, E. coli
tgtcaagagggatttctcagcccct

SEQ ID NO: 149560 - DNA, 25 bp, E. coli
tgtcttatacaggaatgggcatagg

SEQ ID NO: 149561 - DNA, 25 bp, E. coli
tgtcaagagggaattctcagcccct

SEQ ID NO: 149562 - DNA, 25 bp, E. coli
tgtcttatacagcaatgggcatagg

SEQ ID NO: 149563 - DNA, 25 bp, E. coli
tctcttaggttattctggcaaatcc

SEQ ID NO: 149564 - DNA, 25 bp, E. coli
tctcttaggttaatctggcaaatcc

SEQ ID NO: 149565 - DNA, 25 bp, E. coli
tctgatacagaatgcttcacagcgc

SEQ ID NO: 149566 - DNA, 25 bp, E. coli
tctcagggcaggtgcattaatacgc

SEQ ID NO: 149567 - DNA, 25 bp, E. coli
tctgatacagaaagcttcacagcgc

SEQ ID NO: 149568 - DNA, 25 bp, E. coli
tctcagggcaggagcattaatacgc

SEQ ID NO: 149569 - DNA, 25 bp, E. coli
ggtgtcccgcaaaacagccttagtg

SEQ ID NO: 149570 - DNA, 25 bp, E. coli
ggcaaatcctttacgttactctctg

SEQ ID NO: 149571 - DNA, 25 bp, E. coli
ggtgtcccgcaatacagccttagtg

SEQ ID NO: 149572 - DNA, 25 bp, E. coli
ggcaaatccttttcgttactctctg

SEQ ID NO: 149573 - DNA, 25 bp, E. coli
tcacagcgctctcttaccggagaga

SEQ ID NO: 149574 - DNA, 25 bp, E. coli
tcacagcgctctgttaccggagaga

SEQ ID NO: 149575 - DNA, 25 bp, E. coli
tttcgccatgacagagatgcgctgt

SEQ ID NO: 149576 - DNA, 25 bp, E. coli
tattaattgttcaactggctggtgg

SEQ ID NO: 149577 - DNA, 25 bp, E. coli
tattaattgttctactggctggtgg

SEQ ID NO: 149578 - DNA, 25 bp, E. coli
tttcgccatgactgagatgcgctgt

SEQ ID NO: 149579 - DNA, 25 bp, E. coli
tgtaaagcttttcgccatgacagag

SEQ ID NO: 149580 - DNA, 25 bp, E. coli
tgtaaagcttttggccatgacagag

SEQ ID NO: 149581 - DNA, 25 bp, E. coli
tcatcttaaacgttactgtaaagct

SEQ ID NO: 149582 - DNA, 25 bp, E. coli
tcatcttaaacgatactgtaaagct

SEQ ID NO: 149583 - DNA, 25 bp, E. coli
gcccgaagtaaaatagataaacgct

SEQ ID NO: 149584 - DNA, 25 bp, E. coli
gcccgaagtaaattagataaacgct

SEQ ID NO: 149585 - DNA, 25 bp, E. coli
gaaggtgaaaagcatgtttattgcc

SEQ ID NO: 149586 - DNA, 25 bp, E. coli
gaaggtgaaaaggatgtttattgcc

SEQ ID NO: 149587 - DNA, 25 bp, E. coli
ccgataaagaagtgtttgaaaagca

SEQ ID NO: 149588 - DNA, 25 bp, E. coli
ccgataaagaagagtttgaaaagca

SEQ ID NO: 149589 - DNA, 25 bp, E. coli
ctactggctggtggctattttcttc

SEQ ID NO: 149590 - DNA, 25 bp, E. coli
ctactggctggtcgctattttcttc

SEQ ID NO: 149591 - DNA, 25 bp, E. coli
gataaacgctccgataaagaagtgt

SEQ ID NO: 149592 - DNA, 25 bp, E. coli
gataaacgctcccataaagaagtgt

SEQ ID NO: 149593 - DNA, 25 bp, E. coli
gtggctattttcatcatcttaaacg

SEQ ID NO: 149594 - DNA, 25 bp, E. coli
gtggctattttcttcatcttaaacg

SEQ ID NO: 149595 - DNA, 25 bp, E. coli
gatgcgctgttagctgcccgaagta

SEQ ID NO: 149596 - DNA, 25 bp, E. coli
gatgcgctgttacctgcccgaagta

SEQ ID NO: 149597 - DNA, 25 bp, E. coli
caatatgctgttcaaaagactggca

SEQ ID NO: 149598 - DNA, 25 bp, E. coli
caatatgctgttgaaaagactggca

SEQ ID NO: 149599 - DNA, 25 bp, E. coli
cactggatggaattcgcgctggtcg

SEQ ID NO: 149600 - DNA, 25 bp, E. coli
cactggatggaaatcgcgctggtcg

SEQ ID NO: 149601 - DNA, 25 bp, E. coli
tatttcatctgcaggtgatcacctc

SEQ ID NO: 149602 - DNA, 25 bp, E. coli
tatttcatctgctggtgatcacctc

SEQ ID NO: 149603 - DNA, 25 bp, E. coli
ttgccttctggcctagcccggatgc

SEQ ID NO: 149604 - DNA, 25 bp, E. coli
tttttaaccgcctgcgtcagagtcg

SEQ ID NO: 149605 - DNA, 25 bp, E. coli
ttgccttctggcgtagcccggatgc

SEQ ID NO: 149606 - DNA, 25 bp, E. coli
tttttaaccgccagcgtcagagtcg

SEQ ID NO: 149607 - DNA, 25 bp, E. coli
tgttcggtaacgacagcgacacgct

SEQ ID NO: 149608 - DNA, 25 bp, E. coli
tgttcggtaacgtcagcgacacgct

SEQ ID NO: 149609 - DNA, 25 bp, E. coli
gcctttatggctcaacactggatgg

SEQ ID NO: 149610 - DNA, 25 bp, E. coli
gcctttatggctgaacactggatgg

SEQ ID NO: 149611 - DNA, 25 bp, E. coli
cgcgctggtcgattactgtttcaaa

SEQ ID NO: 149612 - DNA, 25 bp, E. coli
cgacagcgtccagactgttcggtaa

SEQ ID NO: 149613 - DNA, 25 bp, E. coli
cgaaatcaacgcattgcaggcgagt

SEQ ID NO: 149614 - DNA, 25 bp, E. coli
cgcgctggtcgaatactgtttcaaa

SEQ ID NO: 149615 - DNA, 25 bp, E. coli
cgaaatcaacgctttgcaggcgagt

SEQ ID NO: 149616 - DNA, 25 bp, E. coli
cgacagcgtccacactgttcggtaa

SEQ ID NO: 149617 - DNA, 25 bp, E. coli
tcaacctgtttgacgcccgtatcgc

SEQ ID NO: 149618 - DNA, 25 bp, E. coli
tcaacctgtttgtcgcccgtatcgc

SEQ ID NO: 149619 - DNA, 25 bp, E. coli
cacataccgctttggtgaagaccac

SEQ ID NO: 149620 - DNA, 25 bp, E. coli
cacataccgcttaggtgaagaccac

SEQ ID NO: 149621 - DNA, 25 bp, E. coli
cagttcgtatcagatgttgccggga

SEQ ID NO: 149622 - DNA, 25 bp, E. coli
cacgagtcccgttgtgagcgttata

SEQ ID NO: 149623 - DNA, 25 bp, E. coli
cagttcgtatcacatgttgccggga

SEQ ID NO: 149624 - DNA, 25 bp, E. coli
cacgagtcccgtagtgagcgttata

SEQ ID NO: 149625 - DNA, 25 bp, E. coli
tactcaactctcacgatggaaccag

SEQ ID NO: 149626 - DNA, 25 bp, E. coli
tactcaactctctcgatggaaccag

SEQ ID NO: 149627 - DNA, 25 bp, E. coli
ttggcgcagcaatccttatccgtcg

SEQ ID NO: 149628 - DNA, 25 bp, E. coli
ttggcgcagcaaaccttatccgtcg

SEQ ID NO: 149629 - DNA, 25 bp, E. coli
gaagggcagatctccggtaaacagg

SEQ ID NO: 149630 - DNA, 25 bp, E. coli
gaagagctgtttcgcgtagtgccca

SEQ ID NO: 149631 - DNA, 25 bp, E. coli
gaagagctgtttggcgtagtgccca

SEQ ID NO: 149632 - DNA, 25 bp, E. coli
gaagggcagatcaccggtaaacagg

SEQ ID NO: 149633 - DNA, 25 bp, E. coli
ccgggtcgtcgtcaacatacaaagc

SEQ ID NO: 149634 - DNA, 25 bp, E. coli
cgtgaaacttaaccgggcactgtgg

SEQ ID NO: 149635 - DNA, 25 bp, E. coli
ccgggtcgtcgtgaacatacaaagc

SEQ ID NO: 149636 - DNA, 25 bp, E. coli
cgtgaaacttaagcgggcactgtgg

SEQ ID NO: 149637 - DNA, 25 bp, E. coli
ggagtctgcttatgacccgtctggc

SEQ ID NO: 149638 - DNA, 25 bp, E. coli
ggagtctgcttaagacccgtctggc

SEQ ID NO: 149639 - DNA, 25 bp, E. coli
taatgccaaaggaggacggtcacat

SEQ ID NO: 149640 - DNA, 25 bp, E. coli
taatgccaaaggtggacggtcacat

SEQ ID NO: 149641 - DNA, 25 bp, E. coli
aaggctaccacatcgaaccggcaat

SEQ ID NO: 149642 - DNA, 25 bp, E. coli
aaggctaccacaacgaaccggcaat

SEQ ID NO: 149643 - DNA, 25 bp, E. coli
cactcaacctcattcccggtgaagg

SEQ ID NO: 149644 - DNA, 25 bp, E. coli
cactcaacctcaatcccggtgaagg

SEQ ID NO: 149645 - DNA, 25 bp, E. coli
attatgacgcgccagccacaagcgg

SEQ ID NO: 149646 - DNA, 25 bp, E. coli
attatgacgcgcgagccacaagcgg

SEQ ID NO: 149647 - DNA, 25 bp, E. coli
acatcgaaccgggaatccacagtat

SEQ ID NO: 149648 - DNA, 25 bp, E. coli
acatcgaaccggcaatccacagtat

SEQ ID NO: 149649 - DNA, 25 bp, E. coli
aaactcccattatgacgcgcgagcc

SEQ ID NO: 149650 - DNA, 25 bp, E. coli
aaactcccattaagacgcgcgagcc

SEQ ID NO: 149651 - DNA, 25 bp, E. coli
tcattcccggtgtaggctaccacat

SEQ ID NO: 149652 - DNA, 25 bp, E. coli
tcattcccggtgaaggctaccacat

SEQ ID NO: 149653 - DNA, 25 bp, E. coli
gaaccggcaatcgacagtatcaaaa

SEQ ID NO: 149654 - DNA, 25 bp, E. coli
gaaccggcaatccacagtatcaaaa

SEQ ID NO: 149655 - DNA, 25 bp, E. coli
cgcgagccacaagcgggcagtctgt

SEQ ID NO: 149656 - DNA, 25 bp, E. coli
cgcgagccacaaccgggcagtctgt

SEQ ID NO: 149657 - DNA, 25 bp, E. coli
ggtgaaggctaccacatcgaaccgg

SEQ ID NO: 149658 - DNA, 25 bp, E. coli
ggtgaaggctacgacatcgaaccgg

SEQ ID NO: 149659 - DNA, 25 bp, E. coli
ggcaatccacagtatcaaaactccc

SEQ ID NO: 149660 - DNA, 25 bp, E. coli
ggcaatccacagaatcaaaactccc

SEQ ID NO: 149661 - DNA, 25 bp, E. coli
tcaaaactcccattatgacgcgcga

SEQ ID NO: 149662 - DNA, 25 bp, E. coli
tcaaaactcccaatatgacgcgcga

SEQ ID NO: 149663 - DNA, 25 bp, E. coli
aatggtcgcggagctgaatcgccga

SEQ ID NO: 149664 - DNA, 25 bp, E. coli
aatggtcgcggacctgaatcgccga

SEQ ID NO: 149665 - DNA, 25 bp, E. coli
taccgttaccgtattcaggcagaac

SEQ ID NO: 149666 - DNA, 25 bp, E. coli
tatgaccaggccgagcttgatcagc

SEQ ID NO: 149667 - DNA, 25 bp, E. coli
taccgttaccgttttcaggcagaac

SEQ ID NO: 149668 - DNA, 25 bp, E. coli
tatgaccaggcccagcttgatcagc

SEQ ID NO: 149669 - DNA, 25 bp, E. coli
tatatgcaaaaacagaacgggctcg

SEQ ID NO: 149670 - DNA, 25 bp, E. coli
tatatgcaaaaagagaacgggctcg

SEQ ID NO: 149671 - DNA, 25 bp, E. coli
tgatcagctaatccacggcagcagc

SEQ ID NO: 149672 - DNA, 25 bp, E. coli
tgatcagctaatgcacggcagcagc

SEQ ID NO: 149673 - DNA, 25 bp, E. coli
ccaaaaggcttaacgccgcagacgt

SEQ ID NO: 149674 - DNA, 25 bp, E. coli
ccggctggcggctaaagaaaatggc

SEQ ID NO: 149675 - DNA, 25 bp, E. coli
ccaaaaggcttatcgccgcagacgt

SEQ ID NO: 149676 - DNA, 25 bp, E. coli
ccggctggcggcaaaagaaaatggc

SEQ ID NO: 149677 - DNA, 25 bp, E. coli
gcttcccgctttcaagaggcgctca

SEQ ID NO: 149678 - DNA, 25 bp, E. coli
gcttcccgctttgaagaggcgctca

SEQ ID NO: 149679 - DNA, 25 bp, E. coli
ggattgacgcgcttcaggactatga

SEQ ID NO: 149680 - DNA, 25 bp, E. coli
ggattgacgcgcatcaggactatga

SEQ ID NO: 149681 - DNA, 25 bp, E. coli
ggatcctcgtcggttgccaaaaggc

SEQ ID NO: 149682 - DNA, 25 bp, E. coli
ggatcctcgtcgcttgccaaaaggc

SEQ ID NO: 149683 - DNA, 25 bp, E. coli
taacgcgcgttgcaaaagtgatgtg

SEQ ID NO: 149684 - DNA, 25 bp, E. coli
taacgcgcgttggaaaagtgatgtg

SEQ ID NO: 149685 - DNA, 25 bp, E. coli
catgaccgtggtgcgtatcgataaa

SEQ ID NO: 149686 - DNA, 25 bp, E. coli
catgaccgtggtccgtatcgataaa

SEQ ID NO: 149687 - DNA, 25 bp, E. coli
taacttcggcaaccagaacgtcggt

SEQ ID NO: 149688 - DNA, 25 bp, E. coli
taccgcatggaagtgaagggcaagc

SEQ ID NO: 149689 - DNA, 25 bp, E. coli
taccgcatggaactgaagggcaagc

SEQ ID NO: 149690 - DNA, 25 bp, E. coli
tttacaggcgctagatgaccacggc

SEQ ID NO: 149691 - DNA, 25 bp, E. coli
tttacaggcgcttgatgaccacggc

SEQ ID NO: 149692 - DNA, 25 bp, E. coli
tctccaccaaaatacgctacggcgg

SEQ ID NO: 149693 - DNA, 25 bp, E. coli
tctccaccaaaaaacgctacggcgg

SEQ ID NO: 149694 - DNA, 25 bp, E. coli
tcccggaagtgcaggcggtaaacgc

SEQ ID NO: 149695 - DNA, 25 bp, E. coli
tcccggaagtgctggcggtaaacgc

SEQ ID NO: 149696 - DNA, 25 bp, E. coli
tctgagtatgaaatggcaggcgcgc

SEQ ID NO: 149697 - DNA, 25 bp, E. coli
tctgagtatgaattggcaggcgcgc

SEQ ID NO: 149698 - DNA, 25 bp, E. coli
gcatgccgtggagcgaaatcgacta

SEQ ID NO: 149699 - DNA, 25 bp, E. coli
gcatgccgtggaccgaaatcgacta

SEQ ID NO: 149700 - DNA, 25 bp, E. coli
gataaagtctcttaccgcaccaggc

SEQ ID NO: 149701 - DNA, 25 bp, E. coli
gatttgccggaatccaaagcctggg

SEQ ID NO: 149702 - DNA, 25 bp, E. coli
gatttgccggaaaccaaagcctggg

SEQ ID NO: 149703 - DNA, 25 bp, E. coli
gataaagtctctaaccgcaccaggc

SEQ ID NO: 149704 - DNA, 25 bp, E. coli
tgtgggcgctctgctcgaaagtaaa

SEQ ID NO: 149705 - DNA, 25 bp, E. coli
tgtgggcgctctcctcgaaagtaaa

SEQ ID NO: 149706 - DNA, 25 bp, E. coli
taacttcggcaagcagaacgtcggt

SEQ ID NO: 149707 - DNA, 25 bp, E. coli
aagcatgtcatgctcgccgggatcg

SEQ ID NO: 149708 - DNA, 25 bp, E. coli
aagcatgtcatggtcgccgggatcg

SEQ ID NO: 149709 - DNA, 25 bp, E. coli
cagtcgctgggaattgtcgtcaccg

SEQ ID NO: 149710 - DNA, 25 bp, E. coli
cagtcgctgggatttgtcgtcaccg

SEQ ID NO: 149711 - DNA, 25 bp, E. coli
tatacggcggctttctggaatgacc

SEQ ID NO: 149712 - DNA, 25 bp, E. coli
tatacggcggctatctggaatgacc

SEQ ID NO: 149713 - DNA, 25 bp, E. coli
ttttgcccgcaatgccgactgtgct

SEQ ID NO: 149714 - DNA, 25 bp, E. coli
ttttgcccgcaaagccgactgtgct

SEQ ID NO: 149715 - DNA, 25 bp, E. coli
tgcggaaatttataaccacgccgtg

SEQ ID NO: 149716 - DNA, 25 bp, E. coli
tgcggaaatttaaaaccacgccgtg

SEQ ID NO: 149717 - DNA, 25 bp, E. coli
tctggaatgaccaaacggtggatgc

SEQ ID NO: 149718 - DNA, 25 bp, E. coli
tctggaatgacctaacggtggatgc

SEQ ID NO: 149719 - DNA, 25 bp, E. coli
gaacattcggtttatgtccatcccg

SEQ ID NO: 149720 - DNA, 25 bp, E. coli
gaacattcggttaatgtccatcccg

SEQ ID NO: 149721 - DNA, 25 bp, E. coli
gatcgaatcgcataatcaggcctcg

SEQ ID NO: 149722 - DNA, 25 bp, E. coli
taagccgattgattgatgaagcgcg

SEQ ID NO: 149723 - DNA, 25 bp, E. coli
taagccgattgaatgatgaagcgcg

SEQ ID NO: 149724 - DNA, 25 bp, E. coli
taaccgcattgcctggtttgaagcg

SEQ ID NO: 149725 - DNA, 25 bp, E. coli
taaccgcattgcgtggtttgaagcg

SEQ ID NO: 149726 - DNA, 25 bp, E. coli
gatggttttcgccataccgtggaac

SEQ ID NO: 149727 - DNA, 25 bp, E. coli
gatggttttcgcgataccgtggaac

SEQ ID NO: 149728 - DNA, 25 bp, E. coli
gatcgaatcgcaaaatcaggcctcg

SEQ ID NO: 149729 - DNA, 25 bp, E. coli
aaccatatcgccctgagcgagcagg

SEQ ID NO: 149730 - DNA, 25 bp, E. coli
aaccatatcgccgtgagcgagcagg

SEQ ID NO: 149731 - DNA, 25 bp, E. coli
tactggtggcgcatcgctacatcac

SEQ ID NO: 149732 - DNA, 25 bp, E. coli
tactggtggcgcttcgctacatcac

SEQ ID NO: 149733 - DNA, 25 bp, E. coli
agtcggtcgacaggctgctgacgct

SEQ ID NO: 149734 - DNA, 25 bp, E. coli
agtcggtcgacacgctgctgacgct

SEQ ID NO: 149735 - DNA, 25 bp, E. coli
tatactccacagcattgccatacgc

SEQ ID NO: 149736 - DNA, 25 bp, E. coli
tatactccacaggattgccatacgc

SEQ ID NO: 149737 - DNA, 25 bp, E. coli
tccatcagaaggtgaaacaccatgc

SEQ ID NO: 149738 - DNA, 25 bp, E. coli
tccatcagaaggagaaacaccatgc

SEQ ID NO: 149739 - DNA, 25 bp, E. coli
ctgtattatggcgtcggcgtcgaga

SEQ ID NO: 149740 - DNA, 25 bp, E. coli
ctgtattatggcctcggcgtcgaga

SEQ ID NO: 149741 - DNA, 25 bp, E. coli
gattcgacgtgctggtcaacggctc

SEQ ID NO: 149742 - DNA, 25 bp, E. coli
gattcgacgtgcaggtcaacggctc

SEQ ID NO: 149743 - DNA, 25 bp, E. coli
ggaactccgcctccgggaacaaact

SEQ ID NO: 149744 - DNA, 25 bp, E. coli
ggaactccgcctgcgggaacaaact

SEQ ID NO: 149745 - DNA, 25 bp, E. coli
ggagaaacaccatgcctgcttgtga

SEQ ID NO: 149746 - DNA, 25 bp, E. coli
ggcgcgctatcaatcggcgctgctg

SEQ ID NO: 149747 - DNA, 25 bp, E. coli
ggagaaacaccaagcctgcttgtga

SEQ ID NO: 149748 - DNA, 25 bp, E. coli
ggcgcgctatcattcggcgctgctg

SEQ ID NO: 149749 - DNA, 25 bp, E. coli
taagctggcacggtaacggtctgta

SEQ ID NO: 149750 - DNA, 25 bp, E. coli
taagctggcacgctaacggtctgta

SEQ ID NO: 149751 - DNA, 25 bp, E. coli
cattataatgcactaattgggttgc

SEQ ID NO: 149752 - DNA, 25 bp, E. coli
tactcagcaggaaactctcggggaa

SEQ ID NO: 149753 - DNA, 25 bp, E. coli
tactcagcaggatactctcggggaa

SEQ ID NO: 149754 - DNA, 25 bp, E. coli
tgactgagatttagaaagatggacg

SEQ ID NO: 149755 - DNA, 25 bp, E. coli
tgaaagatggacgtaatctgagtcg

SEQ ID NO: 149756 - DNA, 25 bp, E. coli
tgaaagatggacctaatctgagtcg

SEQ ID NO: 149757 - DNA, 25 bp, E. coli
tgactgagattttgaaagatggacg

SEQ ID NO: 149758 - DNA, 25 bp, E. coli
tctgagtcgaaactcgctttgtgcc

SEQ ID NO: 149759 - DNA, 25 bp, E. coli
tctgagtcgaaagtcgctttgtgcc

SEQ ID NO: 149760 - DNA, 25 bp, E. coli
gacgtaatctgagtcgaaagtcgct

SEQ ID NO: 149761 - DNA, 25 bp, E. coli
gaaagtcgctttgtgccaaacttct

SEQ ID NO: 149762 - DNA, 25 bp, E. coli
gaaagtcgctttctgccaaacttct

SEQ ID NO: 149763 - DNA, 25 bp, E. coli
gacgtaatctgactcgaaagtcgct

SEQ ID NO: 149764 - DNA, 25 bp, E. coli
cgctttgtgccatacttctttgccg

SEQ ID NO: 149765 - DNA, 25 bp, E. coli
cgctttgtgccaaacttctttgccg

SEQ ID NO: 149766 - DNA, 25 bp, E. coli
cgttactttgcaaaagctaacttgc

SEQ ID NO: 149767 - DNA, 25 bp, E. coli
cattataatgcagtaattgggttgc

SEQ ID NO: 149768 - DNA, 25 bp, E. coli
cgttactttgcataagctaacttgc

SEQ ID NO: 149769 - DNA, 25 bp, E. coli
gggaagaggaactgaaacattataa

SEQ ID NO: 149770 - DNA, 25 bp, E. coli
gggaagaggaacagaaacattataa

SEQ ID NO: 149771 - DNA, 25 bp, E. coli
ggagcaatcactcgttactttgcaa

SEQ ID NO: 149772 - DNA, 25 bp, E. coli
ggagcaatcactggttactttgcaa

SEQ ID NO: 149773 - DNA, 25 bp, E. coli
caacggctgggtatcaacatggaca

SEQ ID NO: 149774 - DNA, 25 bp, E. coli
aaccgtggacgcaggaatttcgaca

SEQ ID NO: 149775 - DNA, 25 bp, E. coli
aatttcgtctggactacaaaggcac

SEQ ID NO: 149776 - DNA, 25 bp, E. coli
aatttcgtctggtctacaaaggcac

SEQ ID NO: 149777 - DNA, 25 bp, E. coli
caacggctgggtttcaacatggaca

SEQ ID NO: 149778 - DNA, 25 bp, E. coli
caaagcccggttttcgactcgctga

SEQ ID NO: 149779 - DNA, 25 bp, E. coli
caaagcccggttatcgactcgctga

SEQ ID NO: 149780 - DNA, 25 bp, E. coli
tacaatgcctggtgtcgcacgaaca

SEQ ID NO: 149781 - DNA, 25 bp, E. coli
tacaatgcctggagtcgcacgaaca

SEQ ID NO: 149782 - DNA, 25 bp, E. coli
attttgattatgtgaaccccgccgc

SEQ ID NO: 149783 - DNA, 25 bp, E. coli
attttgattatgagaaccccgccgc

SEQ ID NO: 149784 - DNA, 25 bp, E. coli
aaccgtggacgctggaatttcgaca

SEQ ID NO: 149785 - DNA, 25 bp, E. coli
ttacgacttccgatgacgaaccagg

SEQ ID NO: 149786 - DNA, 25 bp, E. coli
ttacgacttccgttgacgaaccagg

SEQ ID NO: 149787 - DNA, 25 bp, E. coli
ccaatgtggtacatggcggaagacc

SEQ ID NO: 149788 - DNA, 25 bp, E. coli
ccaatgtggtacttggcggaagacc

SEQ ID NO: 149789 - DNA, 25 bp, E. coli
gaaccaggcagtaattacccgctga

SEQ ID NO: 149790 - DNA, 25 bp, E. coli
gaaccaggcagttattacccgctga

SEQ ID NO: 149791 - DNA, 25 bp, E. coli
cgcattgagttacctaaacccggca

SEQ ID NO: 149792 - DNA, 25 bp, E. coli
cgcattgagttagctaaacccggca

SEQ ID NO: 149793 - DNA, 25 bp, E. coli
gatttgcgtatgcaaaacgacgcca

SEQ ID NO: 149794 - DNA, 25 bp, E. coli
gatttgcgtatggaaaacgacgcca

SEQ ID NO: 149795 - DNA, 25 bp, E. coli
catttgcgcttgatccaatgccgga

SEQ ID NO: 149796 - DNA, 25 bp, E. coli
catttgcgcttgttccaatgccgga

SEQ ID NO: 149797 - DNA, 25 bp, E. coli
tacgtagccgttaccgtcaactgtg

SEQ ID NO: 149798 - DNA, 25 bp, E. coli
taaaactggtgcctatcctggtggt

SEQ ID NO: 149799 - DNA, 25 bp, E. coli
tacgtagccgtttccgtcaactgtg

SEQ ID NO: 149800 - DNA, 25 bp, E. coli
aacatggcctttcgtgagcagctac

SEQ ID NO: 149801 - DNA, 25 bp, E. coli
aacatggcctttggtgagcagctac

SEQ ID NO: 149802 - DNA, 25 bp, E. coli
tacgcgagatggtacgttatgtcac

SEQ ID NO: 149803 - DNA, 25 bp, E. coli
tacgcgagatggaacgttatgtcac

SEQ ID NO: 149804 - DNA, 25 bp, E. coli
tgtcgattttcttcggtctggcgct

SEQ ID NO: 149805 - DNA, 25 bp, E. coli
tgtcgattttctacggtctggcgct

SEQ ID NO: 149806 - DNA, 25 bp, E. coli
tgaactggcggctagtgaaacgcgt

SEQ ID NO: 149807 - DNA, 25 bp, E. coli
tgaactggcggcaagtgaaacgcgt

SEQ ID NO: 149808 - DNA, 25 bp, E. coli
tgcgccgggattgccaactattttg

SEQ ID NO: 149809 - DNA, 25 bp, E. coli
tgcgccgggattcccaactattttg

SEQ ID NO: 149810 - DNA, 25 bp, E. coli
tctggcgctgtttaccctggttgct

SEQ ID NO: 149811 - DNA, 25 bp, E. coli
tctggcgctgttaaccctggttgct

SEQ ID NO: 149812 - DNA, 25 bp, E. coli
gaattgctggatgaagtcgaccgtg

SEQ ID NO: 149813 - DNA, 25 bp, E. coli
gaattgctggatcaagtcgaccgtg

SEQ ID NO: 149814 - DNA, 25 bp, E. coli
taaaactggtgcgtatcctggtggt

SEQ ID NO: 149815 - DNA, 25 bp, E. coli
gatccaatgccgcacaacatggcct

SEQ ID NO: 149816 - DNA, 25 bp, E. coli
gatccaatgccggacaacatggcct

SEQ ID NO: 149817 - DNA, 25 bp, E. coli
acggatgtcgaacgccgctatcagc

SEQ ID NO: 149818 - DNA, 25 bp, E. coli
caataagctttataccgggatcacc

SEQ ID NO: 149819 - DNA, 25 bp, E. coli
acggatgtcgaaggccgctatcagc

SEQ ID NO: 149820 - DNA, 25 bp, E. coli
caataagctttaaaccgggatcacc

SEQ ID NO: 149821 - DNA, 25 bp, E. coli
tataccgggatcaccacggatgtcg

SEQ ID NO: 149822 - DNA, 25 bp, E. coli
tataccgggatctccacggatgtcg

SEQ ID NO: 149823 - DNA, 25 bp, E. coli
tgacaccctggtttctttacttgat

SEQ ID NO: 149824 - DNA, 25 bp, E. coli
tgaccaaacggcaaaaagagcgtct

SEQ ID NO: 149825 - DNA, 25 bp, E. coli
tgaccaaacggctaaaagagcgtct

SEQ ID NO: 149826 - DNA, 25 bp, E. coli
tgacaccctggtatctttacttgat

SEQ ID NO: 149827 - DNA, 25 bp, E. coli
tccgtaccgccgacaataagcttta

SEQ ID NO: 149828 - DNA, 25 bp, E. coli
tccgtaccgccgtcaataagcttta

SEQ ID NO: 149829 - DNA, 25 bp, E. coli
tctttacttgatccgtaccgccgac

SEQ ID NO: 149830 - DNA, 25 bp, E. coli
tctttacttgatgcgtaccgccgac

SEQ ID NO: 149831 - DNA, 25 bp, E. coli
gcaaaccccggagattaaaagcgat

SEQ ID NO: 149832 - DNA, 25 bp, E. coli
gcaaaccccggacattaaaagcgat

SEQ ID NO: 149833 - DNA, 25 bp, E. coli
gaatatcgcgtttagcaactgacca

SEQ ID NO: 149834 - DNA, 25 bp, E. coli
gaatatcgcgttaagcaactgacca

SEQ ID NO: 149835 - DNA, 25 bp, E. coli
cgctatcagcagcaccaaagcggca

SEQ ID NO: 149836 - DNA, 25 bp, E. coli
cgctatcagcaggaccaaagcggca

SEQ ID NO: 149837 - DNA, 25 bp, E. coli
gttaagcaactgtccaaacggcaaa

SEQ ID NO: 149838 - DNA, 25 bp, E. coli
gttaagcaactgaccaaacggcaaa

SEQ ID NO: 149839 - DNA, 25 bp, E. coli
caatatcttattggccttgggtatg

SEQ ID NO: 149840 - DNA, 25 bp, E. coli
aattaatgaccaatggctcacagcc

SEQ ID NO: 149841 - DNA, 25 bp, E. coli
caatatcttattcgccttgggtatg

SEQ ID NO: 149842 - DNA, 25 bp, E. coli
aattaatgaccattggctcacagcc

SEQ ID NO: 149843 - DNA, 25 bp, E. coli
catggcgctaacatcagtgtctttg

SEQ ID NO: 149844 - DNA, 25 bp, E. coli
catggcgctaacttcagtgtctttg

SEQ ID NO: 149845 - DNA, 25 bp, E. coli
aacaggtaccaccaaacatggcgct

SEQ ID NO: 149846 - DNA, 25 bp, E. coli
aacaggtaccacgaaacatggcgct

SEQ ID NO: 149847 - DNA, 25 bp, E. coli
tagagttttttgaacgtgcagctca

SEQ ID NO: 149848 - DNA, 25 bp, E. coli
tagagttttttgtacgtgcagctca

SEQ ID NO: 149849 - DNA, 25 bp, E. coli
tattcattcttgttggaggctggca

SEQ ID NO: 149850 - DNA, 25 bp, E. coli
tattcattcttgatggaggctggca

SEQ ID NO: 149851 - DNA, 25 bp, E. coli
tactgttaccgggtttcacgatggg

SEQ ID NO: 149852 - DNA, 25 bp, E. coli
tactgttaccggctttcacgatggg

SEQ ID NO: 149853 - DNA, 25 bp, E. coli
ccttgggtatgatgatggtatcgcc

SEQ ID NO: 149854 - DNA, 25 bp, E. coli
ccttgggtatgaagatggtatcgcc

SEQ ID NO: 149855 - DNA, 25 bp, E. coli
cgcattaggcattcaacaggtacca

SEQ ID NO: 149856 - DNA, 25 bp, E. coli
cgcattaggcatacaacaggtacca

SEQ ID NO: 149857 - DNA, 25 bp, E. coli
gggatattgaagtacgcattaggca

SEQ ID NO: 149858 - DNA, 25 bp, E. coli
gggatattgaagaacgcattaggca

SEQ ID NO: 149859 - DNA, 25 bp, E. coli
ggaaccaatcaattataccgactct

SEQ ID NO: 149860 - DNA, 25 bp, E. coli
ggaaccaatcaaatataccgactct

SEQ ID NO: 149861 - DNA, 25 bp, E. coli
cactgtactgtcacagccgctttaa

SEQ ID NO: 149862 - DNA, 25 bp, E. coli
cactgtactgtctcagccgctttaa

SEQ ID NO: 149863 - DNA, 25 bp, E. coli
ctgccggaaacttcggcggtagcgt

SEQ ID NO: 149864 - DNA, 25 bp, E. coli
ctgccggaaactacggcggtagcgt

SEQ ID NO: 149865 - DNA, 25 bp, E. coli
tacgccgtagaaagaaaggttgtca

SEQ ID NO: 149866 - DNA, 25 bp, E. coli
tagaaagaaaggttgtcagtaaggg

SEQ ID NO: 149867 - DNA, 25 bp, E. coli
tagaaagaaaggatgtcagtaaggg

SEQ ID NO: 149868 - DNA, 25 bp, E. coli
tagcgtgcctgatcgcaagcgtagc

SEQ ID NO: 149869 - DNA, 25 bp, E. coli
tacgccgtagaatgaaaggttgtca

SEQ ID NO: 149870 - DNA, 25 bp, E. coli
tagcgtgcctgaacgcaagcgtagc

SEQ ID NO: 149871 - DNA, 25 bp, E. coli
ttacgttcacggcagatggcggctg

SEQ ID NO: 149872 - DNA, 25 bp, E. coli
ttacgttcacgggagatggcggctg

SEQ ID NO: 149873 - DNA, 25 bp, E. coli
tgaacgcaagcgaagcactgtactg

SEQ ID NO: 149874 - DNA, 25 bp, E. coli
tgaacgcaagcgtagcactgtactg

SEQ ID NO: 149875 - DNA, 25 bp, E. coli
tcggcggtagcgtgcctgaacgcaa

SEQ ID NO: 149876 - DNA, 25 bp, E. coli
tcggcggtagcgagcctgaacgcaa

SEQ ID NO: 149877 - DNA, 25 bp, E. coli
gctgtttttgtaatacgccgtagaa

SEQ ID NO: 149878 - DNA, 25 bp, E. coli
gctgtttttgtattacgccgtagaa

SEQ ID NO: 149879 - DNA, 25 bp, E. coli
gcaagcgtagcagtgtactgtcaca

SEQ ID NO: 149880 - DNA, 25 bp, E. coli
gcaagcgtagcactgtactgtcaca

SEQ ID NO: 149881 - DNA, 25 bp, E. coli
gaaacttcggcggtagcgtgcctga

SEQ ID NO: 149882 - DNA, 25 bp, E. coli
gaaacttcggcgctagcgtgcctga

SEQ ID NO: 149883 - DNA, 25 bp, E. coli
aagaagtggcgctgggctgaaatcc

SEQ ID NO: 149884 - DNA, 25 bp, E. coli
aagaagtggcgcagggctgaaatcc

SEQ ID NO: 149885 - DNA, 25 bp, E. coli
acgaaagcgcggcaactgggtatca

SEQ ID NO: 149886 - DNA, 25 bp, E. coli
acgaaagcgcgggaactgggtatca

SEQ ID NO: 149887 - DNA, 25 bp, E. coli
tctgattggccgtagtgagtcagcc

SEQ ID NO: 149888 - DNA, 25 bp, E. coli
tctgattggccgaagtgagtcagcc

SEQ ID NO: 149889 - DNA, 25 bp, E. coli
gctgaaatcctgttactccggcagt

SEQ ID NO: 149890 - DNA, 25 bp, E. coli
gctgaaatcctgatactccggcagt

SEQ ID NO: 149891 - DNA, 25 bp, E. coli
gaaattgccgaaaagtttgggatga

SEQ ID NO: 149892 - DNA, 25 bp, E. coli
gaaattgccgaatagtttgggatga

SEQ ID NO: 149893 - DNA, 25 bp, E. coli
cgggaacgatgacagtcgaaagcat

SEQ ID NO: 149894 - DNA, 25 bp, E. coli
cgtggcaactgcatcagcgtggtgt

SEQ ID NO: 149895 - DNA, 25 bp, E. coli
cgtggcaactgcttcagcgtggtgt

SEQ ID NO: 149896 - DNA, 25 bp, E. coli
cgggaacgatgagagtcgaaagcat

SEQ ID NO: 149897 - DNA, 25 bp, E. coli
ggtgattatcacgagtcagccaaat

SEQ ID NO: 149898 - DNA, 25 bp, E. coli
ggtgattatcaccagtcagccaaat

SEQ ID NO: 149899 - DNA, 25 bp, E. coli
tcagccaaatgtacacagcgtgata

SEQ ID NO: 149900 - DNA, 25 bp, E. coli
tcagccaaatgttcacagcgtgata

SEQ ID NO: 149901 - DNA, 25 bp, E. coli
gagtcagccgtctggacgaaagcgc

SEQ ID NO: 149902 - DNA, 25 bp, E. coli
gagagtcgaaagcatcggttatctg

SEQ ID NO: 149903 - DNA, 25 bp, E. coli
gagagtcgaaaggatcggttatctg

SEQ ID NO: 149904 - DNA, 25 bp, E. coli
gagtcagccgtcaggacgaaagcgc

SEQ ID NO: 149905 - DNA, 25 bp, E. coli
taaacggtggtatactgtgcaggtc

SEQ ID NO: 149906 - DNA, 25 bp, E. coli
taaacggtggtaaactgtgcaggtc

SEQ ID NO: 149907 - DNA, 25 bp, E. coli
attatctgcacactaaacggtggta

SEQ ID NO: 149908 - DNA, 25 bp, E. coli
attatctgcacagtaaacggtggta

SEQ ID NO: 149909 - DNA, 25 bp, E. coli
aaagcgaggatggtatgtctactca

SEQ ID NO: 149910 - DNA, 25 bp, E. coli
aaagcgaggatgctatgtctactca

SEQ ID NO: 149911 - DNA, 25 bp, E. coli
tagaacttgaatttgctgacctgct

SEQ ID NO: 149912 - DNA, 25 bp, E. coli
tagaacttgaatatgctgacctgct

SEQ ID NO: 149913 - DNA, 25 bp, E. coli
tgcaggtcttgtctaaaagcgagga

SEQ ID NO: 149914 - DNA, 25 bp, E. coli
tgcaggtcttgtgtaaaagcgagga

SEQ ID NO: 149915 - DNA, 25 bp, E. coli
tgctgaattaaatgaagaaatctac

SEQ ID NO: 149916 - DNA, 25 bp, E. coli
tgctgaattaaaagaagaaatctac

SEQ ID NO: 149917 - DNA, 25 bp, E. coli
cctgcttactctgtcttctgctgaa

SEQ ID NO: 149918 - DNA, 25 bp, E. coli
ccattgaatttttacgccgtgacca

SEQ ID NO: 149919 - DNA, 25 bp, E. coli
ccattgaattttaacgccgtgacca

SEQ ID NO: 149920 - DNA, 25 bp, E. coli
cctgcttactctctcttctgctgaa

SEQ ID NO: 149921 - DNA, 25 bp, E. coli
gctatgtctactcaacttgatccca

SEQ ID NO: 149922 - DNA, 25 bp, E. coli
gctatgtctactgaacttgatccca

SEQ ID NO: 149923 - DNA, 25 bp, E. coli
gcaatctttcacgtgcccaatatct

SEQ ID NO: 149924 - DNA, 25 bp, E. coli
gaatttgctgacgtgcttactctct

SEQ ID NO: 149925 - DNA, 25 bp, E. coli
gaatttgctgacctgcttactctct

SEQ ID NO: 149926 - DNA, 25 bp, E. coli
gcaatctttcacctgcccaatatct

SEQ ID NO: 149927 - DNA, 25 bp, E. coli
cacatatagtgaaacggatggtcgc

SEQ ID NO: 149928 - DNA, 25 bp, E. coli
cacatatagtgatacggatggtcgc

SEQ ID NO: 149929 - DNA, 25 bp, E. coli
cagacggtccgtatcacatatagtg

SEQ ID NO: 149930 - DNA, 25 bp, E. coli
cagacggtccgtttcacatatagtg

SEQ ID NO: 149931 - DNA, 25 bp, E. coli
tacttacagggcttaatggtggtcc

SEQ ID NO: 149932 - DNA, 25 bp, E. coli
tacttacagggcataatggtggtcc

SEQ ID NO: 149933 - DNA, 25 bp, E. coli
ttctcatttggtacgcgacggtggg

SEQ ID NO: 149934 - DNA, 25 bp, E. coli
ttctcatttggttcgcgacggtggg

SEQ ID NO: 149935 - DNA, 25 bp, E. coli
tccgaggcggttggatgcccaatta

SEQ ID NO: 149936 - DNA, 25 bp, E. coli
tccgaggcggttcgatgcccaatta

SEQ ID NO: 149937 - DNA, 25 bp, E. coli
gaagcgctcaggcatataatgttaa

SEQ ID NO: 149938 - DNA, 25 bp, E. coli
gaagcgctcagggatataatgttaa

SEQ ID NO: 149939 - DNA, 25 bp, E. coli
ccgccagtggcgctggagaaattac

SEQ ID NO: 149940 - DNA, 25 bp, E. coli
ccgccagtggcggtggagaaattac

SEQ ID NO: 149941 - DNA, 25 bp, E. coli
cttaatggtggtcctgaagcgctca

SEQ ID NO: 149942 - DNA, 25 bp, E. coli
cttaatggtggtgctgaagcgctca

SEQ ID NO: 149943 - DNA, 25 bp, E. coli
gttcaggtaacacacaatcacatgg

SEQ ID NO: 149944 - DNA, 25 bp, E. coli
gttcaggtaacagacaatcacatgg

SEQ ID NO: 149945 - DNA, 25 bp, E. coli
gagaaattacagtaggcgggcagac

SEQ ID NO: 149946 - DNA, 25 bp, E. coli
gagaaattacagaaggcgggcagac

SEQ ID NO: 149947 - DNA, 25 bp, E. coli
gagagccttcagagtccatccgagg

SEQ ID NO: 149948 - DNA, 25 bp, E. coli
gagagccttcagtgtccatccgagg

SEQ ID NO: 149949 - DNA, 25 bp, E. coli
catatccctctttttgccggtcgcg

SEQ ID NO: 149950 - DNA, 25 bp, E. coli
catatccctcttattgccggtcgcg

SEQ ID NO: 149951 - DNA, 25 bp, E. coli
taacttctgcgttgcatacatgagg

SEQ ID NO: 149952 - DNA, 25 bp, E. coli
aaaatggcgggcgatatcaacgcag

SEQ ID NO: 149953 - DNA, 25 bp, E. coli
aaaatggcgggccatatcaacgcag

SEQ ID NO: 149954 - DNA, 25 bp, E. coli
aagaagtatataggctacgaggtac

SEQ ID NO: 149955 - DNA, 25 bp, E. coli
aaatccgaaacagtctcgcctggcg

SEQ ID NO: 149956 - DNA, 25 bp, E. coli
aagaagtatatacgctacgaggtac

SEQ ID NO: 149957 - DNA, 25 bp, E. coli
aaatccgaaacactctcgcctggcg

SEQ ID NO: 149958 - DNA, 25 bp, E. coli
tatcaacgcagtgtcagaaatccga

SEQ ID NO: 149959 - DNA, 25 bp, E. coli
tatcaacgcagtctcagaaatccga

SEQ ID NO: 149960 - DNA, 25 bp, E. coli
tcttgtcggcggttgcgctgacgtt

SEQ ID NO: 149961 - DNA, 25 bp, E. coli
tcttgtcggcggatgcgctgacgtt

SEQ ID NO: 149962 - DNA, 25 bp, E. coli
ggtcgcgatgacattcctgtgtaaa

SEQ ID NO: 149963 - DNA, 25 bp, E. coli
ggtcgcgatgactttcctgtgtaaa

SEQ ID NO: 149964 - DNA, 25 bp, E. coli
tggcgataaccgtcttgtcggcggt

SEQ ID NO: 149965 - DNA, 25 bp, E. coli
tggcgataaccgacttgtcggcggt

SEQ ID NO: 149966 - DNA, 25 bp, E. coli
taacttctgcgtagcatacatgagg

SEQ ID NO: 149967 - DNA, 25 bp, E. coli
tacgaggtacttcataacttctgcg

SEQ ID NO: 149968 - DNA, 25 bp, E. coli
tacgaggtacttgataacttctgcg

SEQ ID NO: 149969 - DNA, 25 bp, E. coli
gacgttgcgtcgagatatcatcagg

SEQ ID NO: 149970 - DNA, 25 bp, E. coli
gacgttgcgtcgtgatatcatcagg

SEQ ID NO: 149971 - DNA, 25 bp, E. coli
caatactggcaacagcgtcaggcac

SEQ ID NO: 149972 - DNA, 25 bp, E. coli
aatccgtcagggtggttttgctggc

SEQ ID NO: 149973 - DNA, 25 bp, E. coli
aatccgtcagggaggttttgctggc

SEQ ID NO: 149974 - DNA, 25 bp, E. coli
caatactggcaagagcgtcaggcac

SEQ ID NO: 149975 - DNA, 25 bp, E. coli
tatcagctgtcgacatcaggcgtga

SEQ ID NO: 149976 - DNA, 25 bp, E. coli
tatcagctgtcgtcatcaggcgtga

SEQ ID NO: 149977 - DNA, 25 bp, E. coli
tttacgcctggctggaggataccca

SEQ ID NO: 149978 - DNA, 25 bp, E. coli
ttaaccgatggttcaccgctgtggg

SEQ ID NO: 149979 - DNA, 25 bp, E. coli
tttacgcctggcaggaggataccca

SEQ ID NO: 149980 - DNA, 25 bp, E. coli
ttaaccgatggtacaccgctgtggg

SEQ ID NO: 149981 - DNA, 25 bp, E. coli
tgaagccagaaacctcggtaacggt

SEQ ID NO: 149982 - DNA, 25 bp, E. coli
tgaactggcgcacaatcgtctggct

SEQ ID NO: 149983 - DNA, 25 bp, E. coli
tgaagccagaaagctcggtaacggt

SEQ ID NO: 149984 - DNA, 25 bp, E. coli
tgaactggcgcagaatcgtctggct

SEQ ID NO: 149985 - DNA, 25 bp, E. coli
tcaggcacctgcctggttagcgtct

SEQ ID NO: 149986 - DNA, 25 bp, E. coli
tcaggcacctgcgtggttagcgtct

SEQ ID NO: 149987 - DNA, 25 bp, E. coli
gcgcaaaacaaacctcaggaagtct

SEQ ID NO: 149988 - DNA, 25 bp, E. coli
gcgcaaaacaaagctcaggaagtct

SEQ ID NO: 149989 - DNA, 25 bp, E. coli
taatcgggttttgccagtgccgacg

SEQ ID NO: 149990 - DNA, 25 bp, E. coli
taatcgggttttcccagtgccgacg

SEQ ID NO: 149991 - DNA, 25 bp, E. coli
cttgcggaggagacgccgttacaac

SEQ ID NO: 149992 - DNA, 25 bp, E. coli
cttgcggaggagtcgccgttacaac

SEQ ID NO: 149993 - DNA, 25 bp, E. coli
cagggctttggctgttagtgtcttc

SEQ ID NO: 149994 - DNA, 25 bp, E. coli
cagttagtgtctacacatgtcgggc

SEQ ID NO: 149995 - DNA, 25 bp, E. coli
cagggctttggcagttagtgtcttc

SEQ ID NO: 149996 - DNA, 25 bp, E. coli
cagttagtgtcttcacatgtcgggc

SEQ ID NO: 149997 - DNA, 25 bp, E. coli
atgaacggactcacggcaacgggtg

SEQ ID NO: 149998 - DNA, 25 bp, E. coli
atgaacggactctcggcaacgggtg

SEQ ID NO: 149999 - DNA, 25 bp, E. coli
tattaggaaccaatggcttcgtcgc

SEQ ID NO: 150000 - DNA, 25 bp, E. coli
tattaggaaccattggcttcgtcgc

SEQ ID NO: 150001 - DNA, 25 bp, E. coli
tgtcttcacatgtcgggctctctca

SEQ ID NO: 150002 - DNA, 25 bp, E. coli
tgtcttcacatgacgggctctctca

SEQ ID NO: 150003 - DNA, 25 bp, E. coli
tgcagtttttatcccgcaggcggcg

SEQ ID NO: 150004 - DNA, 25 bp, E. coli
tgcagtttttatgccgcaggcggcg

SEQ ID NO: 150005 - DNA, 25 bp, E. coli
gcttcgtcgccttttgcagttttta

SEQ ID NO: 150006 - DNA, 25 bp, E. coli
gcggttaattattccgggatggtgt

SEQ ID NO: 150007 - DNA, 25 bp, E. coli
gcttcgtcgcctattgcagttttta

SEQ ID NO: 150008 - DNA, 25 bp, E. coli
gcggttaattataccgggatggtgt

SEQ ID NO: 150009 - DNA, 25 bp, E. coli
ccgtcggtatttctgcagggctttg

SEQ ID NO: 150010 - DNA, 25 bp, E. coli
ccgtcggtatttgtgcagggctttg

SEQ ID NO: 150011 - DNA, 25 bp, E. coli
cggcaacgggtgtcaccgtcggtat

SEQ ID NO: 150012 - DNA, 25 bp, E. coli
cggcaacgggtgacaccgtcggtat

SEQ ID NO: 150013 - DNA, 25 bp, E. coli
tgggaattattaggaaccattggct

SEQ ID NO: 150014 - DNA, 25 bp, E. coli
tgggaattattacgaaccattggct

SEQ ID NO: 150015 - DNA, 25 bp, E. coli
cactgaaggctatcgcactgccgaa

SEQ ID NO: 150016 - DNA, 25 bp, E. coli
cactgaaggctaacgcactgccgaa

SEQ ID NO: 150017 - DNA, 25 bp, E. coli
taaaacagctcaacgtgcgtgacca

SEQ ID NO: 150018 - DNA, 25 bp, E. coli
taaaacagctcatcgtgcgtgacca

SEQ ID NO: 150019 - DNA, 25 bp, E. coli
tcgcctggcacgtgaaaacgttagg

SEQ ID NO: 150020 - DNA, 25 bp, E. coli
tcgcctggcacgagaaaacgttagg

SEQ ID NO: 150021 - DNA, 25 bp, E. coli
tcttcacggacgatggaagcgcgca

SEQ ID NO: 150022 - DNA, 25 bp, E. coli
tctgctaccggatgtggacctcgaa

SEQ ID NO: 150023 - DNA, 25 bp, E. coli
tcttcacggacgttggaagcgcgca

SEQ ID NO: 150024 - DNA, 25 bp, E. coli
tctggtcaataatcacggcatcgcc

SEQ ID NO: 150025 - DNA, 25 bp, E. coli
tctgctaccggaagtggacctcgaa

SEQ ID NO: 150026 - DNA, 25 bp, E. coli
tctggtcaataaacacggcatcgcc

SEQ ID NO: 150027 - DNA, 25 bp, E. coli
gcggtgggcgctccaactttaccaa

SEQ ID NO: 150028 - DNA, 25 bp, E. coli
gcggtgggcgctgcaactttaccaa

SEQ ID NO: 150029 - DNA, 25 bp, E. coli
gaaaccttcctgtatgagcagcgta

SEQ ID NO: 150030 - DNA, 25 bp, E. coli
gaaaccttcctgaatgagcagcgta

SEQ ID NO: 150031 - DNA, 25 bp, E. coli
tataacttccagtgggcgtggtcga

SEQ ID NO: 150032 - DNA, 25 bp, E. coli
tataacttccagagggcgtggtcga

SEQ ID NO: 150033 - DNA, 25 bp, E. coli
gacgccgggttcagctgatcgataa

SEQ ID NO: 150034 - DNA, 25 bp, E. coli
gatgactccgcgcagcagattgtcg

SEQ ID NO: 150035 - DNA, 25 bp, E. coli
gatgactccgcggagcagattgtcg

SEQ ID NO: 150036 - DNA, 25 bp, E. coli
gacgccgggttctgctgatcgataa

SEQ ID NO: 150037 - DNA, 25 bp, E. coli
cacctcccgaagaaggtgccgaaga

SEQ ID NO: 150038 - DNA, 25 bp, E. coli
cagacggcacctcccgaagaaggtg

SEQ ID NO: 150039 - DNA, 25 bp, E. coli
cacctcccgaagtaggtgccgaaga

SEQ ID NO: 150040 - DNA, 25 bp, E. coli
cagattactcatttaacttagggaa

SEQ ID NO: 150041 - DNA, 25 bp, E. coli
cagacggcacctgccgaagaaggtg

SEQ ID NO: 150042 - DNA, 25 bp, E. coli
cagattactcatataacttagggaa

SEQ ID NO: 150043 - DNA, 25 bp, E. coli
tgaaatacacacgatcagattactc

SEQ ID NO: 150044 - DNA, 25 bp, E. coli
tgaaatacacaccatcagattactc

SEQ ID NO: 150045 - DNA, 25 bp, E. coli
gccgaagaaaaatcgattaactcat

SEQ ID NO: 150046 - DNA, 25 bp, E. coli
gccgaagaaaaaacgattaactcat

SEQ ID NO: 150047 - DNA, 25 bp, E. coli
gaaaaaacgatttactcatcacgcg

SEQ ID NO: 150048 - DNA, 25 bp, E. coli
gaaaaaacgattaactcatcacgcg

SEQ ID NO: 150049 - DNA, 25 bp, E. coli
cgggatcgtgttaaaccagacggca

SEQ ID NO: 150050 - DNA, 25 bp, E. coli
cgagcgggatcgtgtttaaccagac

SEQ ID NO: 150051 - DNA, 25 bp, E. coli
cgagcgggatcgagtttaaccagac

SEQ ID NO: 150052 - DNA, 25 bp, E. coli
cgggatcgtgtttaaccagacggca

SEQ ID NO: 150053 - DNA, 25 bp, E. coli
cttagggaaaaatgcgagcgggatc

SEQ ID NO: 150054 - DNA, 25 bp, E. coli
cttagggaaaaaagcgagcgggatc

SEQ ID NO: 150055 - DNA, 25 bp, E. coli
ggctgacaaggtgtatctgaaatac

SEQ ID NO: 150056 - DNA, 25 bp, E. coli
ggctgacaaggtctatctgaaatac

SEQ ID NO: 150057 - DNA, 25 bp, E. coli
taacttagggaataatgcgagcggg

SEQ ID NO: 150058 - DNA, 25 bp, E. coli
taacttagggaaaaatgcgagcggg

SEQ ID NO: 150059 - DNA, 25 bp, E. coli
atgaaaaggatgattgcgctggatg

SEQ ID NO: 150060 - DNA, 25 bp, E. coli
atgaaaaggatgtttgcgctggatg

SEQ ID NO: 150061 - DNA, 25 bp, E. coli
tacgctggtgctgcaaacggtgctg

SEQ ID NO: 150062 - DNA, 25 bp, E. coli
tacgctggtgctccaaacggtgctg

SEQ ID NO: 150063 - DNA, 25 bp, E. coli
tgataaccggcctgccatttaccat

SEQ ID NO: 150064 - DNA, 25 bp, E. coli
tgataaccggccagccatttaccat

SEQ ID NO: 150065 - DNA, 25 bp, E. coli
tgcaaacggtgctgcccgcgctgtg

SEQ ID NO: 150066 - DNA, 25 bp, E. coli
tgctgcccgcgctgtggtttgccga

SEQ ID NO: 150067 - DNA, 25 bp, E. coli
tgcaaacggtgcagcccgcgctgtg

SEQ ID NO: 150068 - DNA, 25 bp, E. coli
tgctgcccgcgcagtggtttgccga

SEQ ID NO: 150069 - DNA, 25 bp, E. coli
tgccgatggaccttcgcgtgttgaa

SEQ ID NO: 150070 - DNA, 25 bp, E. coli
tgccgatggaccatcgcgtgttgaa

SEQ ID NO: 150071 - DNA, 25 bp, E. coli
gctggtgctgcaaacggtgctgccc

SEQ ID NO: 150072 - DNA, 25 bp, E. coli
gctggtgctgcatacggtgctgccc

SEQ ID NO: 150073 - DNA, 25 bp, E. coli
gaagttgtacgcaggtgctgcaaac

SEQ ID NO: 150074 - DNA, 25 bp, E. coli
gaagttgtacgctggtgctgcaaac

SEQ ID NO: 150075 - DNA, 25 bp, E. coli
cccgcgctgtggattgccgatggac

SEQ ID NO: 150076 - DNA, 25 bp, E. coli
cccgcgctgtggtttgccgatggac

SEQ ID NO: 150077 - DNA, 25 bp, E. coli
tgtggtttgccgttggaccttcgcg

SEQ ID NO: 150078 - DNA, 25 bp, E. coli
tgtggtttgccgatggaccttcgcg

SEQ ID NO: 150079 - DNA, 25 bp, E. coli
tggaccttcgcgagttgaagtgagc

SEQ ID NO: 150080 - DNA, 25 bp, E. coli
tggaccttcgcgtgttgaagtgagc

SEQ ID NO: 150081 - DNA, 25 bp, E. coli
aatgcgctggcaggcggctggttgt

SEQ ID NO: 150082 - DNA, 25 bp, E. coli
aatgcgctggcacgcggctggttgt

SEQ ID NO: 150083 - DNA, 25 bp, E. coli
cacataagtcgttttactatctggg

SEQ ID NO: 150084 - DNA, 25 bp, E. coli
cacataagtcgtattactatctggg

SEQ ID NO: 150085 - DNA, 25 bp, E. coli
actggcagcaaaacatcagattgat

SEQ ID NO: 150086 - DNA, 25 bp, E. coli
actggcagcaaatcatcagattgat

SEQ ID NO: 150087 - DNA, 25 bp, E. coli
ttttctcgcctttgctgcactggca

SEQ ID NO: 150088 - DNA, 25 bp, E. coli
ttttctcgccttagctgcactggca

SEQ ID NO: 150089 - DNA, 25 bp, E. coli
tgctgcaccggaccaaaatgcgctg

SEQ ID NO: 150090 - DNA, 25 bp, E. coli
tgcaccggagcataatgcgctggca

SEQ ID NO: 150091 - DNA, 25 bp, E. coli
tgcaccggagcaaaatgcgctggca

SEQ ID NO: 150092 - DNA, 25 bp, E. coli
tgctgcaccggagcaaaatgcgctg

SEQ ID NO: 150093 - DNA, 25 bp, E. coli
gctgcactggcagcaaaacatcaga

SEQ ID NO: 150094 - DNA, 25 bp, E. coli
gctgcactggcaccaaaacatcaga

SEQ ID NO: 150095 - DNA, 25 bp, E. coli
cgcgctggtgccgtttggctttatt

SEQ ID NO: 150096 - DNA, 25 bp, E. coli
ccccggttatgcacataagtcgttt

SEQ ID NO: 150097 - DNA, 25 bp, E. coli
cgcgctggtgccctttggctttatt

SEQ ID NO: 150098 - DNA, 25 bp, E. coli
ccccggttatgctcataagtcgttt

SEQ ID NO: 150099 - DNA, 25 bp, E. coli
gataaccccggtaatgcacataagt

SEQ ID NO: 150100 - DNA, 25 bp, E. coli
gataaccccggttatgcacataagt

SEQ ID NO: 150101 - DNA, 25 bp, E. coli
tggctttattctagctgcaccggag

SEQ ID NO: 150102 - DNA, 25 bp, E. coli
tggctttattcttgctgcaccggag

SEQ ID NO: 150103 - DNA, 25 bp, E. coli
catcatgcataaagtgacaacgtca

SEQ ID NO: 150104 - DNA, 25 bp, E. coli
catcatgcataatgtgacaacgtca

SEQ ID NO: 150105 - DNA, 25 bp, E. coli
caggttcacattatcagtactgatg

SEQ ID NO: 150106 - DNA, 25 bp, E. coli
caggttcacattttcagtactgatg

SEQ ID NO: 150107 - DNA, 25 bp, E. coli
aacctcgtcagaagttgtgttcttg

SEQ ID NO: 150108 - DNA, 25 bp, E. coli
aacctcgtcagatgttgtgttcttg

SEQ ID NO: 150109 - DNA, 25 bp, E. coli
tgtgacaacgtctcaaaacttagtg

SEQ ID NO: 150110 - DNA, 25 bp, E. coli
tgtgacaacgtcacaaaacttagtg

SEQ ID NO: 150111 - DNA, 25 bp, E. coli
taaaagggcaactattcgccgttgc

SEQ ID NO: 150112 - DNA, 25 bp, E. coli
taaaagggcaacaattcgccgttgc

SEQ ID NO: 150113 - DNA, 25 bp, E. coli
tctgtgggcggtatagtcaggttca

SEQ ID NO: 150114 - DNA, 25 bp, E. coli
tcttgttagcaagcgcgctctgtgg

SEQ ID NO: 150115 - DNA, 25 bp, E. coli
tctgtgggcggtttagtcaggttca

SEQ ID NO: 150116 - DNA, 25 bp, E. coli
tcttgttagcaaccgcgctctgtgg

SEQ ID NO: 150117 - DNA, 25 bp, E. coli
gcttttcatacactggatgccctga

SEQ ID NO: 150118 - DNA, 25 bp, E. coli
gcttttcatacagtggatgccctga

SEQ ID NO: 150119 - DNA, 25 bp, E. coli
ggattgcctgcacctgccaggttgt

SEQ ID NO: 150120 - DNA, 25 bp, E. coli
ggattgcctgcagctgccaggttgt

SEQ ID NO: 150121 - DNA, 25 bp, E. coli
ggcaggtgtgcctgcttttcataca

SEQ ID NO: 150122 - DNA, 25 bp, E. coli
ggcaggtgtgccagcttttcataca

SEQ ID NO: 150123 - DNA, 25 bp, E. coli
gatgccctgaaaatagatgtacaca

SEQ ID NO: 150124 - DNA, 25 bp, E. coli
gatgccctgaaattagatgtacaca

SEQ ID NO: 150125 - DNA, 25 bp, E. coli
aattcgcacgaaatttgtttgtcgg

SEQ ID NO: 150126 - DNA, 25 bp, E. coli
aattcgcacgaattttgtttgtcgg

SEQ ID NO: 150127 - DNA, 25 bp, E. coli
aatacagggctggaatcatccggcc

SEQ ID NO: 150128 - DNA, 25 bp, E. coli
aatacagggctgcaatcatccggcc

SEQ ID NO: 150129 - DNA, 25 bp, E. coli
caaacgtgtgcgactgcaggaaaac

SEQ ID NO: 150130 - DNA, 25 bp, E. coli
caaacgtgtgcgtctgcaggaaaac

SEQ ID NO: 150131 - DNA, 25 bp, E. coli
taaaacgttaattcacacccaggag

SEQ ID NO: 150132 - DNA, 25 bp, E. coli
taaaacgttaatacacacccaggag

SEQ ID NO: 150133 - DNA, 25 bp, E. coli
aaaacatccggcacaccagacagca

SEQ ID NO: 150134 - DNA, 25 bp, E. coli
aacgcgattttagcggtaattcgca

SEQ ID NO: 150135 - DNA, 25 bp, E. coli
aaaacatccggctcaccagacagca

SEQ ID NO: 150136 - DNA, 25 bp, E. coli
aacgcgattttaccggtaattcgca

SEQ ID NO: 150137 - DNA, 25 bp, E. coli
tgtttgtcggacctagttcggataa

SEQ ID NO: 150138 - DNA, 25 bp, E. coli
tgtttgtcggacgtagttcggataa

SEQ ID NO: 150139 - DNA, 25 bp, E. coli
tccggcccttttatctgatatgata

SEQ ID NO: 150140 - DNA, 25 bp, E. coli
tccggcccttttttctgatatgata

SEQ ID NO: 150141 - DNA, 25 bp, E. coli
tctgatatgataggcaaacgtgtgc

SEQ ID NO: 150142 - DNA, 25 bp, E. coli
tctgcaggaaaaggcgattttagcg

SEQ ID NO: 150143 - DNA, 25 bp, E. coli
tctgatatgatacgcaaacgtgtgc

SEQ ID NO: 150144 - DNA, 25 bp, E. coli
tctgcaggaaaacgcgattttagcg

SEQ ID NO: 150145 - DNA, 25 bp, E. coli
ccagacagcaaaagattttaaaacg

SEQ ID NO: 150146 - DNA, 25 bp, E. coli
ccagacagcaaatgattttaaaacg

SEQ ID NO: 150147 - DNA, 25 bp, E. coli
tattaacccgatgctgatggcctgg

SEQ ID NO: 150148 - DNA, 25 bp, E. coli
tatttgtctgggatcagccaccgtc

SEQ ID NO: 150149 - DNA, 25 bp, E. coli
tattcgcgatctataccatgggcct

SEQ ID NO: 150150 - DNA, 25 bp, E. coli
tattcgcgatctttaccatgggcct

SEQ ID NO: 150151 - DNA, 25 bp, E. coli
tatttgtctgggttcagccaccgtc

SEQ ID NO: 150152 - DNA, 25 bp, E. coli
tattaacccgatcctgatggcctgg

SEQ ID NO: 150153 - DNA, 25 bp, E. coli
tgggatcagtttactcacggcaatg

SEQ ID NO: 150154 - DNA, 25 bp, E. coli
gcctgaccaccaaagaaacgctgtt

SEQ ID NO: 150155 - DNA, 25 bp, E. coli
gcctgaccaccatagaaacgctgtt

SEQ ID NO: 150156 - DNA, 25 bp, E. coli
gaaacgctgttaacctggacgctga

SEQ ID NO: 150157 - DNA, 25 bp, E. coli
gaaacgctgttatcctggacgctga

SEQ ID NO: 150158 - DNA, 25 bp, E. coli
gattcagcgaaaccgaaatgccagg

SEQ ID NO: 150159 - DNA, 25 bp, E. coli
gattcagcgaaagcgaaatgccagg

SEQ ID NO: 150160 - DNA, 25 bp, E. coli
ggtaattcaacgatcgccatgctga

SEQ ID NO: 150161 - DNA, 25 bp, E. coli
ggtaattcaacgttcgccatgctga

SEQ ID NO: 150162 - DNA, 25 bp, E. coli
ggaatatagcctctctcggcgcgac

SEQ ID NO: 150163 - DNA, 25 bp, E. coli
tgggatcagttttctcacggcaatg

SEQ ID NO: 150164 - DNA, 25 bp, E. coli
ggaaaacaatccgtgacctgatgga

SEQ ID NO: 150165 - DNA, 25 bp, E. coli
ggaaaacaatccctgacctgatgga

SEQ ID NO: 150166 - DNA, 25 bp, E. coli
ggaatatagcctgtctcggcgcgac

SEQ ID NO: 150167 - DNA, 25 bp, E. coli
gatgactcatgcgaaaagtgccgcg

SEQ ID NO: 150168 - DNA, 25 bp, E. coli
gatgactcatgccaaaagtgccgcg

SEQ ID NO: 150169 - DNA, 25 bp, E. coli
gaatacagttacggtaactttagcg

SEQ ID NO: 150170 - DNA, 25 bp, E. coli
gaatacagttaccgtaactttagcg

SEQ ID NO: 150171 - DNA, 25 bp, E. coli
agccagaaggagcatcagacaggtc

SEQ ID NO: 150172 - DNA, 25 bp, E. coli
agccagaaggaggatcagacaggtc

SEQ ID NO: 150173 - DNA, 25 bp, E. coli
aaactatgaactcattgtgaaaggg

SEQ ID NO: 150174 - DNA, 25 bp, E. coli
aactgattgtgaaagggatccgcaa

SEQ ID NO: 150175 - DNA, 25 bp, E. coli
aactgattgtgatagggatccgcaa

SEQ ID NO: 150176 - DNA, 25 bp, E. coli
aaactatgaactgattgtgaaaggg

SEQ ID NO: 150177 - DNA, 25 bp, E. coli
tatgaactgattgtgaaagggatcc

SEQ ID NO: 150178 - DNA, 25 bp, E. coli
tatgaactgattctgaaagggatcc

SEQ ID NO: 150179 - DNA, 25 bp, E. coli
tgaactgattgtgaaagggatccgc

SEQ ID NO: 150180 - DNA, 25 bp, E. coli
tgaactgattgtcaaagggatccgc

SEQ ID NO: 150181 - DNA, 25 bp, E. coli
ccagaaggagcaacagacaggtctt

SEQ ID NO: 150182 - DNA, 25 bp, E. coli
ccagaaggagcatcagacaggtctt

SEQ ID NO: 150183 - DNA, 25 bp, E. coli
gaaggagcatcagacaggtcttcct

SEQ ID NO: 150184 - DNA, 25 bp, E. coli
gaaggagcatcacacaggtcttcct

SEQ ID NO: 150185 - DNA, 25 bp, E. coli
ctgattgtgaaagggatccgcaatt

SEQ ID NO: 150186 - DNA, 25 bp, E. coli
ctgattgtgaaacggatccgcaatt

SEQ ID NO: 150187 - DNA, 25 bp, E. coli
gattgtgaaagggatccgcaatttt

SEQ ID NO: 150188 - DNA, 25 bp, E. coli
gattgtgaaaggcatccgcaatttt

SEQ ID NO: 150189 - DNA, 25 bp, E. coli
ggagcatcagactggtcttcctgga

SEQ ID NO: 150190 - DNA, 25 bp, E. coli
ggagcatcagacaggtcttcctgga

SEQ ID NO: 150191 - DNA, 25 bp, E. coli
caagaaaggcgctatcgtaaccggt

SEQ ID NO: 150192 - DNA, 25 bp, E. coli
caagaaaggcgcaatcgtaaccggt

SEQ ID NO: 150193 - DNA, 25 bp, E. coli
cactgacatggcgtggaaacgcgtt

SEQ ID NO: 150194 - DNA, 25 bp, E. coli
cactgacatggcctggaaacgcgtt

SEQ ID NO: 150195 - DNA, 25 bp, E. coli
tatcgaatccgaaaacagcgcagag

SEQ ID NO: 150196 - DNA, 25 bp, E. coli
taccctggttctcagcgttggcgac

SEQ ID NO: 150197 - DNA, 25 bp, E. coli
taccctggttctgagcgttggcgac

SEQ ID NO: 150198 - DNA, 25 bp, E. coli
tatccggaaggttccaaactgactg

SEQ ID NO: 150199 - DNA, 25 bp, E. coli
tatccggaaggtaccaaactgactg

SEQ ID NO: 150200 - DNA, 25 bp, E. coli
tatctccctgggtctgaaacagtgc

SEQ ID NO: 150201 - DNA, 25 bp, E. coli
tatcgaatccgataacagcgcagag

SEQ ID NO: 150202 - DNA, 25 bp, E. coli
tatctccctgggactgaaacagtgc

SEQ ID NO: 150203 - DNA, 25 bp, E. coli
tgaaactctgctgtcccgtgagaaa

SEQ ID NO: 150204 - DNA, 25 bp, E. coli
tgaaactctgctctcccgtgagaaa

SEQ ID NO: 150205 - DNA, 25 bp, E. coli
cctgaaacagctcggcgaagatccg

SEQ ID NO: 150206 - DNA, 25 bp, E. coli
cctgaaacagctgggcgaagatccg

SEQ ID NO: 150207 - DNA, 25 bp, E. coli
gaacgtgaacgtatctccctgggcg

SEQ ID NO: 150208 - DNA, 25 bp, E. coli
gaaacagtgcaatgctaacccgtgg

SEQ ID NO: 150209 - DNA, 25 bp, E. coli
gaaacagtgcaaagctaacccgtgg

SEQ ID NO: 150210 - DNA, 25 bp, E. coli
gaacgtgaacgtttctccctgggcg

SEQ ID NO: 150211 - DNA, 25 bp, E. coli
taactgcagttgacgctaaaggcgc

SEQ ID NO: 150212 - DNA, 25 bp, E. coli
taactgcagttgtcgctaaaggcgc

SEQ ID NO: 150213 - DNA, 25 bp, E. coli
cattttccgcgtaggttatattggg

SEQ ID NO: 150214 - DNA, 25 bp, E. coli
cattttccgcgttggttatattggg

SEQ ID NO: 150215 - DNA, 25 bp, E. coli
tggtgatttcagctccacgctggat

SEQ ID NO: 150216 - DNA, 25 bp, E. coli
tcctgcggcagatgaaaagtggtcc

SEQ ID NO: 150217 - DNA, 25 bp, E. coli
tcctgcggcagaagaaaagtggtcc

SEQ ID NO: 150218 - DNA, 25 bp, E. coli
tcatgccgcctggttattaatgttg

SEQ ID NO: 150219 - DNA, 25 bp, E. coli
tctgttatttatacctttggctggg

SEQ ID NO: 150220 - DNA, 25 bp, E. coli
tcatgccgcctgcttattaatgttg

SEQ ID NO: 150221 - DNA, 25 bp, E. coli
tctgttatttattcctttggctggg

SEQ ID NO: 150222 - DNA, 25 bp, E. coli
ccacgctggatgacgttgacgtttt

SEQ ID NO: 150223 - DNA, 25 bp, E. coli
ccacgctggatgtcgttgacgtttt

SEQ ID NO: 150224 - DNA, 25 bp, E. coli
gcgctgataagtattctggcattga

SEQ ID NO: 150225 - DNA, 25 bp, E. coli
gcgctgataagttttctggcattga

SEQ ID NO: 150226 - DNA, 25 bp, E. coli
gactcattaattttcaccgctccgg

SEQ ID NO: 150227 - DNA, 25 bp, E. coli
gactcattaattatcaccgctccgg

SEQ ID NO: 150228 - DNA, 25 bp, E. coli
gacatggcggacaccttgacaggat

SEQ ID NO: 150229 - DNA, 25 bp, E. coli
gacatggcggactccttgacaggat

SEQ ID NO: 150230 - DNA, 25 bp, E. coli
ctggcattgaaagaatattgtacgc

SEQ ID NO: 150231 - DNA, 25 bp, E. coli
ctggcattgaaacaatattgtacgc

SEQ ID NO: 150232 - DNA, 25 bp, E. coli
tggtgatttcaggtccacgctggat

SEQ ID NO: 150233 - DNA, 25 bp, E. coli
taattttagcaacgctgataaaccg

SEQ ID NO: 150234 - DNA, 25 bp, E. coli
taattttagcaaggctgataaaccg

SEQ ID NO: 150235 - DNA, 25 bp, E. coli
cagtcatcaagcaggtgtcatcggc

SEQ ID NO: 150236 - DNA, 25 bp, E. coli
cagtcatcaagctggtgtcatcggc

SEQ ID NO: 150237 - DNA, 25 bp, E. coli
taaatgcactctctgcgcggttgga

SEQ ID NO: 150238 - DNA, 25 bp, E. coli
taaatgcactctgtgcgcggttgga

SEQ ID NO: 150239 - DNA, 25 bp, E. coli
atcaagcaggtgacatcggctggca

SEQ ID NO: 150240 - DNA, 25 bp, E. coli
atcaagcaggtgtcatcggctggca

SEQ ID NO: 150241 - DNA, 25 bp, E. coli
tgatcgccagtcatcaagcaggtgt

SEQ ID NO: 150242 - DNA, 25 bp, E. coli
tgatcgccagtcttcaagcaggtgt

SEQ ID NO: 150243 - DNA, 25 bp, E. coli
cgcaaagtgaaaccggcatttgacc

SEQ ID NO: 150244 - DNA, 25 bp, E. coli
cgcaaagtgaaagcggcatttgacc

SEQ ID NO: 150245 - DNA, 25 bp, E. coli
cgtggtggcgctcactgcgaaatac

SEQ ID NO: 150246 - DNA, 25 bp, E. coli
cgtggtggcgctgactgcgaaatac

SEQ ID NO: 150247 - DNA, 25 bp, E. coli
cggtcgagagctacgcgccgctgat

SEQ ID NO: 150248 - DNA, 25 bp, E. coli
cggtcgagagcttcgcgccgctgat

SEQ ID NO: 150249 - DNA, 25 bp, E. coli
gtcgctacggtcgagagctacgcgc

SEQ ID NO: 150250 - DNA, 25 bp, E. coli
gtcgctacggtccagagctacgcgc

SEQ ID NO: 150251 - DNA, 25 bp, E. coli
ggttggatgagctgatcgccagtca

SEQ ID NO: 150252 - DNA, 25 bp, E. coli
ggttggatgagcagatcgccagtca

SEQ ID NO: 150253 - DNA, 25 bp, E. coli
gatgtggcgctgatcgcccgtcttg

SEQ ID NO: 150254 - DNA, 25 bp, E. coli
gagcgggtaaatgcactctgtgcgc

SEQ ID NO: 150255 - DNA, 25 bp, E. coli
gatgtggcgctgttcgcccgtcttg

SEQ ID NO: 150256 - DNA, 25 bp, E. coli
gagcgggtaaatccactctgtgcgc

SEQ ID NO: 150257 - DNA, 25 bp, E. coli
caaactgaagatggtcggacagcgc

SEQ ID NO: 150258 - DNA, 25 bp, E. coli
caaactgaagatcgtcggacagcgc

SEQ ID NO: 150259 - DNA, 25 bp, E. coli
cacgccgttagtattgctgccgaca

SEQ ID NO: 150260 - DNA, 25 bp, E. coli
cacgccgttagttttgctgccgaca

SEQ ID NO: 150261 - DNA, 25 bp, E. coli
tatcgcccggttcaagaaactgcca

SEQ ID NO: 150262 - DNA, 25 bp, E. coli
tatcgcccggttgaagaaactgcca

SEQ ID NO: 150263 - DNA, 25 bp, E. coli
tatattcagcttaccggtaccagcg

SEQ ID NO: 150264 - DNA, 25 bp, E. coli
tatttggtcatgatgagcccggcga

SEQ ID NO: 150265 - DNA, 25 bp, E. coli
tatttggtcatgttgagcccggcga

SEQ ID NO: 150266 - DNA, 25 bp, E. coli
tatattcagctttccggtaccagcg

SEQ ID NO: 150267 - DNA, 25 bp, E. coli
tcagggattagccatactcagacag

SEQ ID NO: 150268 - DNA, 25 bp, E. coli
tctgaaggtgcatatacagcggcgc

SEQ ID NO: 150269 - DNA, 25 bp, E. coli
tctgaaggtgcaaatacagcggcgc

SEQ ID NO: 150270 - DNA, 25 bp, E. coli
tcagggattagcgatactcagacag

SEQ ID NO: 150271 - DNA, 25 bp, E. coli
gattatcaataggaacggcggcgtc

SEQ ID NO: 150272 - DNA, 25 bp, E. coli
gattatcaatagcaacggcggcgtc

SEQ ID NO: 150273 - DNA, 25 bp, E. coli
taatgtccgcgtcgagtgtagtaac

SEQ ID NO: 150274 - DNA, 25 bp, E. coli
taatgtccgcgtggagtgtagtaac

SEQ ID NO: 150275 - DNA, 25 bp, E. coli
taactacacatcaggtggcgcgaca

SEQ ID NO: 150276 - DNA, 25 bp, E. coli
taattatgacgctgcagagatggca

SEQ ID NO: 150277 - DNA, 25 bp, E. coli
taattatgacgcagcagagatggca

SEQ ID NO: 150278 - DNA, 25 bp, E. coli
taactacacatctggtggcgcgaca

SEQ ID NO: 150279 - DNA, 25 bp, E. coli
caaaaccggtctggatgccgcaggt

SEQ ID NO: 150280 - DNA, 25 bp, E. coli
caaaaccggtctcgatgccgcaggt

SEQ ID NO: 150281 - DNA, 25 bp, E. coli
caaaaaagaacggtggtctgacggt

SEQ ID NO: 150282 - DNA, 25 bp, E. coli
caaaaaagaacgctggtctgacggt

SEQ ID NO: 150283 - DNA, 25 bp, E. coli
catcgacgcgatggcagaccttatc

SEQ ID NO: 150284 - DNA, 25 bp, E. coli
catcgacgcgatcgcagaccttatc

SEQ ID NO: 150285 - DNA, 25 bp, E. coli
tacggcaaacaagcaagcgaagtct

SEQ ID NO: 150286 - DNA, 25 bp, E. coli
tacggcaaacaaccaagcgaagtct

SEQ ID NO: 150287 - DNA, 25 bp, E. coli
aaagccaagtttgcctactacgcgg

SEQ ID NO: 150288 - DNA, 25 bp, E. coli
aaagccaagtttccctactacgcgg

SEQ ID NO: 150289 - DNA, 25 bp, E. coli
ttgaagcggcacagaaagaaccagc

SEQ ID NO: 150290 - DNA, 25 bp, E. coli
ttgaagcggcactgaaagaaccagc

SEQ ID NO: 150291 - DNA, 25 bp, E. coli
tctggaaacaaaaggtgaatacggc

SEQ ID NO: 150292 - DNA, 25 bp, E. coli
tctgacggtaaacatccggctgctt

SEQ ID NO: 150293 - DNA, 25 bp, E. coli
tctggaaacaaatggtgaatacggc

SEQ ID NO: 150294 - DNA, 25 bp, E. coli
tctgacggtaaagatccggctgctt

SEQ ID NO: 150295 - DNA, 25 bp, E. coli
gaaagcctcttatgatgtcgccaaa

SEQ ID NO: 150296 - DNA, 25 bp, E. coli
gaaagcctcttaagatgtcgccaaa

SEQ ID NO: 150297 - DNA, 25 bp, E. coli
taaggtatttagctacgcctgcccg

SEQ ID NO: 150298 - DNA, 25 bp, E. coli
taaggtatttaggtacgcctgcccg

SEQ ID NO: 150299 - DNA, 25 bp, E. coli
gaccttatccgtgagttagcaagca

SEQ ID NO: 150300 - DNA, 25 bp, E. coli
gaccttatccgtcagttagcaagca

SEQ ID NO: 150301 - DNA, 25 bp, E. coli
ttccggttgtgagaggcccggtatt

SEQ ID NO: 150302 - DNA, 25 bp, E. coli
ttccggttgtgacaggcccggtatt

SEQ ID NO: 150303 - DNA, 25 bp, E. coli
tacctgcgacttctgcgcaagaaga

SEQ ID NO: 150304 - DNA, 25 bp, E. coli
tacctgcgacttgtgcgcaagaaga

SEQ ID NO: 150305 - DNA, 25 bp, E. coli
tatttggtttgcgtctggtcgagga

SEQ ID NO: 150306 - DNA, 25 bp, E. coli
tatttggtttgcctctggtcgagga

SEQ ID NO: 150307 - DNA, 25 bp, E. coli
ttaccagcggcatgcgtgttacggc

SEQ ID NO: 150308 - DNA, 25 bp, E. coli
ttaccagcggcaagcgtgttacggc

SEQ ID NO: 150309 - DNA, 25 bp, E. coli
tgccggtggagtttgaacctccacg

SEQ ID NO: 150310 - DNA, 25 bp, E. coli
tgccggtggagtatgaacctccacg

SEQ ID NO: 150311 - DNA, 25 bp, E. coli
tctgcgcaagaacaatacgacacgc

SEQ ID NO: 150312 - DNA, 25 bp, E. coli
tctgcgcaagaagaatacgacacgc

SEQ ID NO: 150313 - DNA, 25 bp, E. coli
gcccggtatttggtttgcctctggt

SEQ ID NO: 150314 - DNA, 25 bp, E. coli
gcccggtatttgctttgcctctggt

SEQ ID NO: 150315 - DNA, 25 bp, E. coli
gaagaatacgactcgctgtttggcg

SEQ ID NO: 150316 - DNA, 25 bp, E. coli
gaagaatacgacacgctgtttggcg

SEQ ID NO: 150317 - DNA, 25 bp, E. coli
gacacgctgtttggcgaagtagtat

SEQ ID NO: 150318 - DNA, 25 bp, E. coli
gacacgctgtttcgcgaagtagtat

SEQ ID NO: 150319 - DNA, 25 bp, E. coli
gggacgtttgtttccagcggcaagc

SEQ ID NO: 150320 - DNA, 25 bp, E. coli
gggacgtttgttaccagcggcaagc

SEQ ID NO: 150321 - DNA, 25 bp, E. coli
tggagtgtcgattgctacctgcgac

SEQ ID NO: 150322 - DNA, 25 bp, E. coli
tggagtgtcgatagctacctgcgac

SEQ ID NO: 150323 - DNA, 25 bp, E. coli
cattagccatcggagaactggaaag

SEQ ID NO: 150324 - DNA, 25 bp, E. coli
cattagccatcgcagaactggaaag

SEQ ID NO: 150325 - DNA, 25 bp, E. coli
atgatcgcggagtttgaatcacgca

SEQ ID NO: 150326 - DNA, 25 bp, E. coli
atgatcgcggagattgaatcacgca

SEQ ID NO: 150327 - DNA, 25 bp, E. coli
tatggttgaccaagccagtgatgat

SEQ ID NO: 150328 - DNA, 25 bp, E. coli
tatggttgaccatgccagtgatgat

SEQ ID NO: 150329 - DNA, 25 bp, E. coli
tgatgagttgtttgccagtgggtat

SEQ ID NO: 150330 - DNA, 25 bp, E. coli
tgatgagttgttagccagtgggtat

SEQ ID NO: 150331 - DNA, 25 bp, E. coli
ccagtgatgatgagttgtttgccag

SEQ ID NO: 150332 - DNA, 25 bp, E. coli
ccatcgcagaactggaaagtggtga

SEQ ID NO: 150333 - DNA, 25 bp, E. coli
ccagtgggtatttgcgtggccacct

SEQ ID NO: 150334 - DNA, 25 bp, E. coli
ccagtgggtattagcgtggccacct

SEQ ID NO: 150335 - DNA, 25 bp, E. coli
gccagagtctggaaaaagccattgg

SEQ ID NO: 150336 - DNA, 25 bp, E. coli
gccagagtctggtaaaagccattgg

SEQ ID NO: 150337 - DNA, 25 bp, E. coli
ccagtgatgatgtgttgtttgccag

SEQ ID NO: 150338 - DNA, 25 bp, E. coli
ccatcgcagaacaggaaagtggtga

SEQ ID NO: 150339 - DNA, 25 bp, E. coli
cgcattctggcaataatcgacggta

SEQ ID NO: 150340 - DNA, 25 bp, E. coli
cgcattctggcattaatcgacggta

SEQ ID NO: 150341 - DNA, 25 bp, E. coli
ggagtttgaatcacgcattctggca

SEQ ID NO: 150342 - DNA, 25 bp, E. coli
ggagtttgaatctcgcattctggca

SEQ ID NO: 150343 - DNA, 25 bp, E. coli
taatcgacggtaaggttgaccatgc

SEQ ID NO: 150344 - DNA, 25 bp, E. coli
taatcgacggtatggttgaccatgc

SEQ ID NO: 150345 - DNA, 25 bp, E. coli
aacataaaggcgctttcgggtgcct

SEQ ID NO: 150346 - DNA, 25 bp, E. coli
aacataaaggcggtttcgggtgcct

SEQ ID NO: 150347 - DNA, 25 bp, E. coli
tagcgtttattagtgaggtaacacc

SEQ ID NO: 150348 - DNA, 25 bp, E. coli
tattcttctgctcactctttaaaag

SEQ ID NO: 150349 - DNA, 25 bp, E. coli
tagcgtttattactgaggtaacacc

SEQ ID NO: 150350 - DNA, 25 bp, E. coli
tattcttctgctgactctttaaaag

SEQ ID NO: 150351 - DNA, 25 bp, E. coli
taaaagctttctatagttcccgctc

SEQ ID NO: 150352 - DNA, 25 bp, E. coli
taaaagctttctttagttcccgctc

SEQ ID NO: 150353 - DNA, 25 bp, E. coli
tccagtgaaacccataaaaattaat

SEQ ID NO: 150354 - DNA, 25 bp, E. coli
tccagtgaaaccgataaaaattaat

SEQ ID NO: 150355 - DNA, 25 bp, E. coli
tcagaaacataaaggcgctttcggg

SEQ ID NO: 150356 - DNA, 25 bp, E. coli
tcagaaacataatggcgctttcggg

SEQ ID NO: 150357 - DNA, 25 bp, E. coli
cctccggtgatataatggcattcag

SEQ ID NO: 150358 - DNA, 25 bp, E. coli
cctccggtgataaaatggcattcag

SEQ ID NO: 150359 - DNA, 25 bp, E. coli
cgcaagatttataacctccggtgat

SEQ ID NO: 150360 - DNA, 25 bp, E. coli
cgcaagatttattacctccggtgat

SEQ ID NO: 150361 - DNA, 25 bp, E. coli
ggcattcagctcgttaataagagag

SEQ ID NO: 150362 - DNA, 25 bp, E. coli
ggcattcagctccttaataagagag

SEQ ID NO: 150363 - DNA, 25 bp, E. coli
tcgggtgcctttattatttccagtg

SEQ ID NO: 150364 - DNA, 25 bp, E. coli
tcgggtgccttttttatttccagtg

SEQ ID NO: 150365 - DNA, 25 bp, E. coli
taagcgttagcgattattactgagg

SEQ ID NO: 150366 - DNA, 25 bp, E. coli
taagcgttagcgtttattactgagg

SEQ ID NO: 150367 - DNA, 25 bp, E. coli
cagcaactactcactggccgtacta

SEQ ID NO: 150368 - DNA, 25 bp, E. coli
cagcaactactctctggccgtacta

SEQ ID NO: 150369 - DNA, 25 bp, E. coli
actctctggccgtactatcgcttaa

SEQ ID NO: 150370 - DNA, 25 bp, E. coli
actctctggccgaactatcgcttaa

SEQ ID NO: 150371 - DNA, 25 bp, E. coli
ttctgctgtgtagcccagttgttcc

SEQ ID NO: 150372 - DNA, 25 bp, E. coli
ttctgctgtgtaccccagttgttcc

SEQ ID NO: 150373 - DNA, 25 bp, E. coli
tgtgtagcccagttgttccttgttg

SEQ ID NO: 150374 - DNA, 25 bp, E. coli
tgtgtagcccagatgttccttgttg

SEQ ID NO: 150375 - DNA, 25 bp, E. coli
tcgcttaaaagtcatatcatcaggc

SEQ ID NO: 150376 - DNA, 25 bp, E. coli
tcgcttaaaagtgatatcatcaggc

SEQ ID NO: 150377 - DNA, 25 bp, E. coli
gcatttcttctgctgtgtagcccag

SEQ ID NO: 150378 - DNA, 25 bp, E. coli
gcatttcttctggtgtgtagcccag

SEQ ID NO: 150379 - DNA, 25 bp, E. coli
gacgaacacagcaactactctctgg

SEQ ID NO: 150380 - DNA, 25 bp, E. coli
cccagttgttccatgttggtatcaa

SEQ ID NO: 150381 - DNA, 25 bp, E. coli
cccagttgttccttgttggtatcaa

SEQ ID NO: 150382 - DNA, 25 bp, E. coli
gatatcatcaggcatttcttctgct

SEQ ID NO: 150383 - DNA, 25 bp, E. coli
gatcatcactgaagatgggcaaaga

SEQ ID NO: 150384 - DNA, 25 bp, E. coli
gatatcatcagggatttcttctgct

SEQ ID NO: 150385 - DNA, 25 bp, E. coli
gatcatcactgatgatgggcaaaga

SEQ ID NO: 150386 - DNA, 25 bp, E. coli
gttggtatcaacgagatcatcactg

SEQ ID NO: 150387 - DNA, 25 bp, E. coli
gttggtatcaaccagatcatcactg

SEQ ID NO: 150388 - DNA, 25 bp, E. coli
gacgaacacagctactactctctgg

SEQ ID NO: 150389 - DNA, 25 bp, E. coli
cagtgcacgctggtggtaataccca

SEQ ID NO: 150390 - DNA, 25 bp, E. coli
cagtgcacgctgctggtaataccca

SEQ ID NO: 150391 - DNA, 25 bp, E. coli
agccgtagaggtggttcaagtcgac

SEQ ID NO: 150392 - DNA, 25 bp, E. coli
agccgtagaggtcgttcaagtcgac

SEQ ID NO: 150393 - DNA, 25 bp, E. coli
tatttcggcagctggttgcgttcga

SEQ ID NO: 150394 - DNA, 25 bp, E. coli
tatttcggcagcaggttgcgttcga

SEQ ID NO: 150395 - DNA, 25 bp, E. coli
tatatcgtactgtgccggtgcttgc

SEQ ID NO: 150396 - DNA, 25 bp, E. coli
tatatcgtactgagccggtgcttgc

SEQ ID NO: 150397 - DNA, 25 bp, E. coli
ttcaaaggtgtaatcttccagcggc

SEQ ID NO: 150398 - DNA, 25 bp, E. coli
ttcaaaggtgtattcttccagcggc

SEQ ID NO: 150399 - DNA, 25 bp, E. coli
tcggcgttgcggtaaccttcaaagg

SEQ ID NO: 150400 - DNA, 25 bp, E. coli
tcggcgttgcggaaaccttcaaagg

SEQ ID NO: 150401 - DNA, 25 bp, E. coli
ccattctgaggatggttgttatccc

SEQ ID NO: 150402 - DNA, 25 bp, E. coli
ccattctgaggaaggttgttatccc

SEQ ID NO: 150403 - DNA, 25 bp, E. coli
ccacggcggtcgctgcattaatcgc

SEQ ID NO: 150404 - DNA, 25 bp, E. coli
ccacggcggtcggtgcattaatcgc

SEQ ID NO: 150405 - DNA, 25 bp, E. coli
ctttggcgacatcgcgtaccgcgta

SEQ ID NO: 150406 - DNA, 25 bp, E. coli
ctttggcgacatggcgtaccgcgta

SEQ ID NO: 150407 - DNA, 25 bp, E. coli
gatttgtcgatcgagctgcctttgg

SEQ ID NO: 150408 - DNA, 25 bp, E. coli
gatttgtcgatccagctgcctttgg

SEQ ID NO: 150409 - DNA, 25 bp, E. coli
taatcgctacgcgacagccgtagag

SEQ ID NO: 150410 - DNA, 25 bp, E. coli
taatcgctacgccacagccgtagag

SEQ ID NO: 150411 - DNA, 25 bp, E. coli
ttagctaccggtgagaccatttttt

SEQ ID NO: 150412 - DNA, 25 bp, E. coli
ttagctaccggtcagaccatttttt

SEQ ID NO: 150413 - DNA, 25 bp, E. coli
tttccagctctgagaccttgtcttg

SEQ ID NO: 150414 - DNA, 25 bp, E. coli
tttccagctctgtgaccttgtcttg

SEQ ID NO: 150415 - DNA, 25 bp, E. coli
tttttgcgcgctgcttctgtgaaca

SEQ ID NO: 150416 - DNA, 25 bp, E. coli
tttttgcgcgctccttctgtgaaca

SEQ ID NO: 150417 - DNA, 25 bp, E. coli
tgtgtggcagctgatttttgcgcgc

SEQ ID NO: 150418 - DNA, 25 bp, E. coli
tgtgtggcagctcatttttgcgcgc

SEQ ID NO: 150419 - DNA, 25 bp, E. coli
tgaccttgtcttcgttaactcaatg

SEQ ID NO: 150420 - DNA, 25 bp, E. coli
tgatgtaacatattcacttacgtga

SEQ ID NO: 150421 - DNA, 25 bp, E. coli
tgatgtaacataatcacttacgtga

SEQ ID NO: 150422 - DNA, 25 bp, E. coli
tgaccttgtcttggttaactcaatg

SEQ ID NO: 150423 - DNA, 25 bp, E. coli
tctgtgaacagtaattaagcgggct

SEQ ID NO: 150424 - DNA, 25 bp, E. coli
tctgtgaacagttattaagcgggct

SEQ ID NO: 150425 - DNA, 25 bp, E. coli
gcgggcttttcgttttcgtctatct

SEQ ID NO: 150426 - DNA, 25 bp, E. coli
gcgggcttttcgatttcgtctatct

SEQ ID NO: 150427 - DNA, 25 bp, E. coli
cttacgtgatgtgcgtgttttgcga

SEQ ID NO: 150428 - DNA, 25 bp, E. coli
cttacgtgatgtccgtgttttgcga

SEQ ID NO: 150429 - DNA, 25 bp, E. coli
cttcgctttgttctgttgtgtggca

SEQ ID NO: 150430 - DNA, 25 bp, E. coli
cgtctatctcttaagctaccggtca

SEQ ID NO: 150431 - DNA, 25 bp, E. coli
cgtctatctctttagctaccggtca

SEQ ID NO: 150432 - DNA, 25 bp, E. coli
cttcgctttgttgtgttgtgtggca

SEQ ID NO: 150433 - DNA, 25 bp, E. coli
caacgggcgcgaatcacttcggtac

SEQ ID NO: 150434 - DNA, 25 bp, E. coli
caacgggcgcgattcacttcggtac

SEQ ID NO: 150435 - DNA, 25 bp, E. coli
cacgaagagaaacacgaggagcgca

SEQ ID NO: 150436 - DNA, 25 bp, E. coli
cacgaagagaaagacgaggagcgca

SEQ ID NO: 150437 - DNA, 25 bp, E. coli
caaatctgtatcatggcttgccgga

SEQ ID NO: 150438 - DNA, 25 bp, E. coli
caaatctgtatcttggcttgccgga

SEQ ID NO: 150439 - DNA, 25 bp, E. coli
tacgtgctgcaccatgctgacaagc

SEQ ID NO: 150440 - DNA, 25 bp, E. coli
tacgtgctgcacgatgctgacaagc

SEQ ID NO: 150441 - DNA, 25 bp, E. coli
aaatgtacgctgtgcgttgaccgcg

SEQ ID NO: 150442 - DNA, 25 bp, E. coli
aaatgtacgctgagcgttgaccgcg

SEQ ID NO: 150443 - DNA, 25 bp, E. coli
tattcagtatgccaacggtatcgtc

SEQ ID NO: 150444 - DNA, 25 bp, E. coli
tattcagtatgcgaacggtatcgtc

SEQ ID NO: 150445 - DNA, 25 bp, E. coli
tctcggaagtggtgcagaacgacaa

SEQ ID NO: 150446 - DNA, 25 bp, E. coli
tctcggaagtggagcagaacgacaa

SEQ ID NO: 150447 - DNA, 25 bp, E. coli
tccactacgtggctgtcggtccgaa

SEQ ID NO: 150448 - DNA, 25 bp, E. coli
tccactacgtgggtgtcggtccgaa

SEQ ID NO: 150449 - DNA, 25 bp, E. coli
gacaaactggaatggctgatccgca

SEQ ID NO: 150450 - DNA, 25 bp, E. coli
gaaagagtcgatcaaaacgctggcg

SEQ ID NO: 150451 - DNA, 25 bp, E. coli
gacaaactggaaaggctgatccgca

SEQ ID NO: 150452 - DNA, 25 bp, E. coli
gaaagagtcgatgaaaacgctggcg

SEQ ID NO: 150453 - DNA, 25 bp, E. coli
cgataccgtcggcaataacattggg

SEQ ID NO: 150454 - DNA, 25 bp, E. coli
cgataccgtcgggaataacattggg

SEQ ID NO: 150455 - DNA, 25 bp, E. coli
catcactcagtatagaagcggccct

SEQ ID NO: 150456 - DNA, 25 bp, E. coli
cagtttgatggatacgccgcatcgc

SEQ ID NO: 150457 - DNA, 25 bp, E. coli
cagtttgatggaaacgccgcatcgc

SEQ ID NO: 150458 - DNA, 25 bp, E. coli
catcactcagtaaagaagcggccct

SEQ ID NO: 150459 - DNA, 25 bp, E. coli
tagttgcgcgaggactggaaacacc

SEQ ID NO: 150460 - DNA, 25 bp, E. coli
tagttgcgcgagcactggaaacacc

SEQ ID NO: 150461 - DNA, 25 bp, E. coli
tgaccgaaatcatgcagctgctgaa

SEQ ID NO: 150462 - DNA, 25 bp, E. coli
tgaccgaaatcaagcagctgctgaa

SEQ ID NO: 150463 - DNA, 25 bp, E. coli
gccgcatcgcatcgctaaaatgtat

SEQ ID NO: 150464 - DNA, 25 bp, E. coli
gccgcatcgcatggctaaaatgtat

SEQ ID NO: 150465 - DNA, 25 bp, E. coli
gcccgcccgtgcttgaaatggataa

SEQ ID NO: 150466 - DNA, 25 bp, E. coli
gcccgcccgtgcatgaaatggataa

SEQ ID NO: 150467 - DNA, 25 bp, E. coli
gctgctgggcacgaataacgtggct

SEQ ID NO: 150468 - DNA, 25 bp, E. coli
gctgctgaatctggacctggctgat

SEQ ID NO: 150469 - DNA, 25 bp, E. coli
gctgctgggcaccaataacgtggct

SEQ ID NO: 150470 - DNA, 25 bp, E. coli
gctgctgaatctcgacctggctgat

SEQ ID NO: 150471 - DNA, 25 bp, E. coli
gaagcggccctggttcatgaagcgt

SEQ ID NO: 150472 - DNA, 25 bp, E. coli
gaagcggccctgcttcatgaagcgt

SEQ ID NO: 150473 - DNA, 25 bp, E. coli
cgatgaaatggtcaccgtgcgcgat

SEQ ID NO: 150474 - DNA, 25 bp, E. coli
cgatgaaatggtgaccgtgcgcgat

SEQ ID NO: 150475 - DNA, 25 bp, E. coli
tggataacgaaacgcgcaaaagcct

SEQ ID NO: 150476 - DNA, 25 bp, E. coli
tggataacgaaaggcgcaaaagcct

SEQ ID NO: 150477 - DNA, 25 bp, E. coli
actgcccgcgaaggactgaaactac

SEQ ID NO: 150478 - DNA, 25 bp, E. coli
actgcccgcgaacgactgaaactac

SEQ ID NO: 150479 - DNA, 25 bp, E. coli
actgacggaatgctctgtgcgcccc

SEQ ID NO: 150480 - DNA, 25 bp, E. coli
acgactgcccgccaaggactgaaac

SEQ ID NO: 150481 - DNA, 25 bp, E. coli
actgacggaatggtctgtgcgcccc

SEQ ID NO: 150482 - DNA, 25 bp, E. coli
acgactgcccgcgaaggactgaaac

SEQ ID NO: 150483 - DNA, 25 bp, E. coli
tgcgccccgatgtatttggtgaatt

SEQ ID NO: 150484 - DNA, 25 bp, E. coli
tgcgccccgatgaatttggtgaatt

SEQ ID NO: 150485 - DNA, 25 bp, E. coli
gcccgcgaaggactgaaactacatg

SEQ ID NO: 150486 - DNA, 25 bp, E. coli
gccccgatgaatttggtgaatttct

SEQ ID NO: 150487 - DNA, 25 bp, E. coli
gcccgcgaaggagtgaaactacatg

SEQ ID NO: 150488 - DNA, 25 bp, E. coli
gccccgatgaatatggtgaatttct

SEQ ID NO: 150489 - DNA, 25 bp, E. coli
gaaggactgaaactacatgcgcctg

SEQ ID NO: 150490 - DNA, 25 bp, E. coli
gaaggactgaaagtacatgcgcctg

SEQ ID NO: 150491 - DNA, 25 bp, E. coli
gaatttggtgaatttctggtggcga

SEQ ID NO: 150492 - DNA, 25 bp, E. coli
gaatttggtgaaattctggtggcga

SEQ ID NO: 150493 - DNA, 25 bp, E. coli
ctgtgcgccccgttgaatttggtga

SEQ ID NO: 150494 - DNA, 25 bp, E. coli
ctgtgcgccccgatgaatttggtga

SEQ ID NO: 150495 - DNA, 25 bp, E. coli
ggactgaaactacatgcgcctggtg

SEQ ID NO: 150496 - DNA, 25 bp, E. coli
ggaatggtctgtccgccccgatgaa

SEQ ID NO: 150497 - DNA, 25 bp, E. coli
ggaatggtctgtgcgccccgatgaa

SEQ ID NO: 150498 - DNA, 25 bp, E. coli
ggactgaaactagatgcgcctggtg

SEQ ID NO: 150499 - DNA, 25 bp, E. coli
atgaatcagcacaacacccgcctta

SEQ ID NO: 150500 - DNA, 25 bp, E. coli
cacccgccttatacgtttaccagag

SEQ ID NO: 150501 - DNA, 25 bp, E. coli
cacccgccttattcgtttaccagag

SEQ ID NO: 150502 - DNA, 25 bp, E. coli
atgaatcagcactacacccgcctta

SEQ ID NO: 150503 - DNA, 25 bp, E. coli
taccagaggttcagcatcgaactgg

SEQ ID NO: 150504 - DNA, 25 bp, E. coli
tatcacctcatcaaccaaaatcgtt

SEQ ID NO: 150505 - DNA, 25 bp, E. coli
taccagaggttctgcatcgaactgg

SEQ ID NO: 150506 - DNA, 25 bp, E. coli
tatcacctcatctaccaaaatcgtt

SEQ ID NO: 150507 - DNA, 25 bp, E. coli
gcgcgctctgttgctttcattgaaa

SEQ ID NO: 150508 - DNA, 25 bp, E. coli
gcgcgctctgttcctttcattgaaa

SEQ ID NO: 150509 - DNA, 25 bp, E. coli
gacgaatggattcaattaactatcg

SEQ ID NO: 150510 - DNA, 25 bp, E. coli
gacgaatggattgaattaactatcg

SEQ ID NO: 150511 - DNA, 25 bp, E. coli
ccgttaaaatcggtgcgcgctctgt

SEQ ID NO: 150512 - DNA, 25 bp, E. coli
ccgttaaaatcgctgcgcgctctgt

SEQ ID NO: 150513 - DNA, 25 bp, E. coli
cgaaaattcaagtaagcatgttgcc

SEQ ID NO: 150514 - DNA, 25 bp, E. coli
cgaaaattcaagaaagcatgttgcc

SEQ ID NO: 150515 - DNA, 25 bp, E. coli
ctggatacggtatagcttggatcta

SEQ ID NO: 150516 - DNA, 25 bp, E. coli
cattgaaagtgatgtagacgaatgg

SEQ ID NO: 150517 - DNA, 25 bp, E. coli
cattgaaagtgaagtagacgaatgg

SEQ ID NO: 150518 - DNA, 25 bp, E. coli
ctggatacggtaaagcttggatcta

SEQ ID NO: 150519 - DNA, 25 bp, E. coli
ggtaaagcttggttctatcacctca

SEQ ID NO: 150520 - DNA, 25 bp, E. coli
ggtaaagcttggatctatcacctca

SEQ ID NO: 150521 - DNA, 25 bp, E. coli
cagcgttacgctagtttcacccggg

SEQ ID NO: 150522 - DNA, 25 bp, E. coli
cagcgttacgcttgtttcacccggg

SEQ ID NO: 150523 - DNA, 25 bp, E. coli
agtaccaacagctctggcggcatgg

SEQ ID NO: 150524 - DNA, 25 bp, E. coli
agtaccaacagcactggcggcatgg

SEQ ID NO: 150525 - DNA, 25 bp, E. coli
aactggcaggtctaccgaatgcaga

SEQ ID NO: 150526 - DNA, 25 bp, E. coli
aactggcaggtcaaccgaatgcaga

SEQ ID NO: 150527 - DNA, 25 bp, E. coli
tgttgatggtgatgattgtcactgc

SEQ ID NO: 150528 - DNA, 25 bp, E. coli
tgtgtcagcatctgcgttacgctag

SEQ ID NO: 150529 - DNA, 25 bp, E. coli
tgtgtcagcatcagcgttacgctag

SEQ ID NO: 150530 - DNA, 25 bp, E. coli
tgttgatggtgaagattgtcactgc

SEQ ID NO: 150531 - DNA, 25 bp, E. coli
tgatgattgtcagtgcgttatcggg

SEQ ID NO: 150532 - DNA, 25 bp, E. coli
tgatgattgtcactgcgttatcggg

SEQ ID NO: 150533 - DNA, 25 bp, E. coli
tgcgttatcgggattccagcgaaca

SEQ ID NO: 150534 - DNA, 25 bp, E. coli
tgcgttatcgggtttccagcgaaca

SEQ ID NO: 150535 - DNA, 25 bp, E. coli
tcgcaggcgggatgtgtcagcatca

SEQ ID NO: 150536 - DNA, 25 bp, E. coli
tcgcaggcgggaagtgtcagcatca

SEQ ID NO: 150537 - DNA, 25 bp, E. coli
ccagcgaacattaatgaacagtctt

SEQ ID NO: 150538 - DNA, 25 bp, E. coli
ccagcgaacatttatgaacagtctt

SEQ ID NO: 150539 - DNA, 25 bp, E. coli
cgaatgcagacatcgcaggcgggat

SEQ ID NO: 150540 - DNA, 25 bp, E. coli
cgaatgcagacaacgcaggcgggat

SEQ ID NO: 150541 - DNA, 25 bp, E. coli
cgggtttccagcgaacattaatgaa

SEQ ID NO: 150542 - DNA, 25 bp, E. coli
cgggtttccagccaacattaatgaa

SEQ ID NO: 150543 - DNA, 25 bp, E. coli
taaagtggcaagcaaatccagcaag

SEQ ID NO: 150544 - DNA, 25 bp, E. coli
taaagcaatcgccaatcagggctgt

SEQ ID NO: 150545 - DNA, 25 bp, E. coli
taaagcaatcgcgaatcagggctgt

SEQ ID NO: 150546 - DNA, 25 bp, E. coli
taaagtggcaaggaaatccagcaag

SEQ ID NO: 150547 - DNA, 25 bp, E. coli
tattaataccgatttggctatcagc

SEQ ID NO: 150548 - DNA, 25 bp, E. coli
tattaataccgaattggctatcagc

SEQ ID NO: 150549 - DNA, 25 bp, E. coli
tcaggtctgaatccttataaagccg

SEQ ID NO: 150550 - DNA, 25 bp, E. coli
tcaggtctgaatgcttataaagccg

SEQ ID NO: 150551 - DNA, 25 bp, E. coli
gcggcaataaagtggcaagcaaatc

SEQ ID NO: 150552 - DNA, 25 bp, E. coli
gcggcaataaagaggcaagcaaatc

SEQ ID NO: 150553 - DNA, 25 bp, E. coli
gaatgcttataaagccgcaacatta

SEQ ID NO: 150554 - DNA, 25 bp, E. coli
gaatgcttataatgccgcaacatta

SEQ ID NO: 150555 - DNA, 25 bp, E. coli
gacaggatgtcagaatacgcacggt

SEQ ID NO: 150556 - DNA, 25 bp, E. coli
gacaggatgtcacaatacgcacggt

SEQ ID NO: 150557 - DNA, 25 bp, E. coli
gatttggctatcagctcaggtctga

SEQ ID NO: 150558 - DNA, 25 bp, E. coli
gatttggctatctgctcaggtctga

SEQ ID NO: 150559 - DNA, 25 bp, E. coli
taagcgatgctgatgctaaagcaat

SEQ ID NO: 150560 - DNA, 25 bp, E. coli
tcagaatacgcacggtattaatacc

SEQ ID NO: 150561 - DNA, 25 bp, E. coli
tcagaatacgcagggtattaatacc

SEQ ID NO: 150562 - DNA, 25 bp, E. coli
taagcgatgctgttgctaaagcaat

SEQ ID NO: 150563 - DNA, 25 bp, E. coli
gatgctaaagcaatcgccaatcagg

SEQ ID NO: 150564 - DNA, 25 bp, E. coli
gatgctaaagcattcgccaatcagg

SEQ ID NO: 150565 - DNA, 25 bp, E. coli
atacagccgggcagtgacgtcatcg

SEQ ID NO: 150566 - DNA, 25 bp, E. coli
atacagccgggctgtgacgtcatcg

SEQ ID NO: 150567 - DNA, 25 bp, E. coli
tccggaagacggatgttgcgcacgt

SEQ ID NO: 150568 - DNA, 25 bp, E. coli
tccggaagacggttgttgcgcacgt

SEQ ID NO: 150569 - DNA, 25 bp, E. coli
tcggtgaacgcagtatggcgacgct

SEQ ID NO: 150570 - DNA, 25 bp, E. coli
tcggtgaacgcactatggcgacgct

SEQ ID NO: 150571 - DNA, 25 bp, E. coli
cctttgacgtggtgatatggatgac

SEQ ID NO: 150572 - DNA, 25 bp, E. coli
cctttgacgtggagatatggatgac

SEQ ID NO: 150573 - DNA, 25 bp, E. coli
gcgatatacgcagcgaattgagcgg

SEQ ID NO: 150574 - DNA, 25 bp, E. coli
gcgatatacgcaccgaattgagcgg

SEQ ID NO: 150575 - DNA, 25 bp, E. coli
cgtattcggtgaacgcactatggcg

SEQ ID NO: 150576 - DNA, 25 bp, E. coli
cgtattcggtgatcgcactatggcg

SEQ ID NO: 150577 - DNA, 25 bp, E. coli
ctgctgtcacccattgacgtggtga

SEQ ID NO: 150578 - DNA, 25 bp, E. coli
ctgctgtcaccctttgacgtggtga

SEQ ID NO: 150579 - DNA, 25 bp, E. coli
gggcgtcttatgagcctgctgtcac

SEQ ID NO: 150580 - DNA, 25 bp, E. coli
gggcgtcttatgtgcctgctgtcac

SEQ ID NO: 150581 - DNA, 25 bp, E. coli
taacctgaatctgaggcagcacctg

SEQ ID NO: 150582 - DNA, 25 bp, E. coli
taatcagcaagcgatatacgcagcg

SEQ ID NO: 150583 - DNA, 25 bp, E. coli
taacctgaatctcaggcagcacctg

SEQ ID NO: 150584 - DNA, 25 bp, E. coli
taatcagcaagccatatacgcagcg

SEQ ID NO: 150585 - DNA, 25 bp, E. coli
gacgtcatcgtctgcgcggaaatgg

SEQ ID NO: 150586 - DNA, 25 bp, E. coli
gacgtcatcgtcagcgcggaaatgg

SEQ ID NO: 150587 - DNA, 25 bp, E. coli
caactttaccctgatgtgtcgcgat

SEQ ID NO: 150588 - DNA, 25 bp, E. coli
caactttaccctcatgtgtcgcgat

SEQ ID NO: 150589 - DNA, 25 bp, E. coli
atcaaccaggcgctggagatcgtgc

SEQ ID NO: 150590 - DNA, 25 bp, E. coli
atcaaccaggcggtggagatcgtgc

SEQ ID NO: 150591 - DNA, 25 bp, E. coli
tatccaactgattccggctatgcgc

SEQ ID NO: 150592 - DNA, 25 bp, E. coli
tatccaactgataccggctatgcgc

SEQ ID NO: 150593 - DNA, 25 bp, E. coli
tatgcgctcggctgtaaaattgaag

SEQ ID NO: 150594 - DNA, 25 bp, E. coli
tatgcgctcggcagtaaaattgaag

SEQ ID NO: 150595 - DNA, 25 bp, E. coli
tatttgtcgtattcgccagctgccg

SEQ ID NO: 150596 - DNA, 25 bp, E. coli
tttccacttcgcaaatgctgccagg

SEQ ID NO: 150597 - DNA, 25 bp, E. coli
tatttgtcgtatacgccagctgccg

SEQ ID NO: 150598 - DNA, 25 bp, E. coli
tttccacttcgctaatgctgccagg

SEQ ID NO: 150599 - DNA, 25 bp, E. coli
tgggcgaaccgatgctttccacttc

SEQ ID NO: 150600 - DNA, 25 bp, E. coli
tgggcgaaccgaagctttccacttc

SEQ ID NO: 150601 - DNA, 25 bp, E. coli
gccacgccgtctgttgcaggaaaaa

SEQ ID NO: 150602 - DNA, 25 bp, E. coli
gccacgccgtctcttgcaggaaaaa

SEQ ID NO: 150603 - DNA, 25 bp, E. coli
gctgccggacggacacaactttacc

SEQ ID NO: 150604 - DNA, 25 bp, E. coli
gctgccggacggtcacaactttacc

SEQ ID NO: 150605 - DNA, 25 bp, E. coli
gatttgattattcacggcggctatc

SEQ ID NO: 150606 - DNA, 25 bp, E. coli
gatttgattattgacggcggctatc

SEQ ID NO: 150607 - DNA, 25 bp, E. coli
ggaaaaacgcaaaaccatcggtatg

SEQ ID NO: 150608 - DNA, 25 bp, E. coli
ggaaaaacgcaataccatcggtatg

SEQ ID NO: 150609 - DNA, 25 bp, E. coli
aggcaaacatattcccacagcccgt

SEQ ID NO: 150610 - DNA, 25 bp, E. coli
aggcaaacatatacccacagcccgt

SEQ ID NO: 150611 - DNA, 25 bp, E. coli
ttgtgtagcgacctgccccagcggc

SEQ ID NO: 150612 - DNA, 25 bp, E. coli
ttgtgtagcgacgtgccccagcggc

SEQ ID NO: 150613 - DNA, 25 bp, E. coli
ttgagtcaggccaacccaccgtgtg

SEQ ID NO: 150614 - DNA, 25 bp, E. coli
ttgagtcaggcctacccaccgtgtg

SEQ ID NO: 150615 - DNA, 25 bp, E. coli
tgcgaacactgcgttaaccccagtt

SEQ ID NO: 150616 - DNA, 25 bp, E. coli
tgcgaacactgccttaaccccagtt

SEQ ID NO: 150617 - DNA, 25 bp, E. coli
tccaaccagtcaacgggaaatggcg

SEQ ID NO: 150618 - DNA, 25 bp, E. coli
tccaaccagtcatcgggaaatggcg

SEQ ID NO: 150619 - DNA, 25 bp, E. coli
tcagtcttacgcagatgcgggcggc

SEQ ID NO: 150620 - DNA, 25 bp, E. coli
tcagtcttacgctgatgcgggcggc

SEQ ID NO: 150621 - DNA, 25 bp, E. coli
ccacgaattgagacaggccaaccca

SEQ ID NO: 150622 - DNA, 25 bp, E. coli
ccacgaattgagtcaggccaaccca

SEQ ID NO: 150623 - DNA, 25 bp, E. coli
gaagaccgttttctcattccaacca

SEQ ID NO: 150624 - DNA, 25 bp, E. coli
gaagaccgttttgtcattccaacca

SEQ ID NO: 150625 - DNA, 25 bp, E. coli
gatacccgcgccattgacgaagtag

SEQ ID NO: 150626 - DNA, 25 bp, E. coli
gatacccgcgcctttgacgaagtag

SEQ ID NO: 150627 - DNA, 25 bp, E. coli
gtggaaggcgtttccgatacccgcg

SEQ ID NO: 150628 - DNA, 25 bp, E. coli
gtggaaggcgttaccgatacccgcg

SEQ ID NO: 150629 - DNA, 25 bp, E. coli
taaccccagttgtgtagcgacctgc

SEQ ID NO: 150630 - DNA, 25 bp, E. coli
taaccccagttgagtagcgacctgc

SEQ ID NO: 150631 - DNA, 25 bp, E. coli
ttagcgatgatgattgtcaggcccc

SEQ ID NO: 150632 - DNA, 25 bp, E. coli
ttagcgatgatgtttgtcaggcccc

SEQ ID NO: 150633 - DNA, 25 bp, E. coli
tgatcattgtgcttgttatggcgcg

SEQ ID NO: 150634 - DNA, 25 bp, E. coli
tgatcattgtgcatgttatggcgcg

SEQ ID NO: 150635 - DNA, 25 bp, E. coli
tgatgtttgtcaggccccggacgat

SEQ ID NO: 150636 - DNA, 25 bp, E. coli
tgatgtttgtcacgccccggacgat

SEQ ID NO: 150637 - DNA, 25 bp, E. coli
gccacgatgatctttgtgcttgtta

SEQ ID NO: 150638 - DNA, 25 bp, E. coli
gccacgatgatcattgtgcttgtta

SEQ ID NO: 150639 - DNA, 25 bp, E. coli
cccggacgatgatcgccacgatgat

SEQ ID NO: 150640 - DNA, 25 bp, E. coli
cccggacgatgaacgccacgatgat

SEQ ID NO: 150641 - DNA, 25 bp, E. coli
cgatgatgtttgtcaggccccggac

SEQ ID NO: 150642 - DNA, 25 bp, E. coli
cgatgatgtttgacaggccccggac

SEQ ID NO: 150643 - DNA, 25 bp, E. coli
cgatggcggcggtccatatgggtgc

SEQ ID NO: 150644 - DNA, 25 bp, E. coli
cgatggcggcggaccatatgggtgc

SEQ ID NO: 150645 - DNA, 25 bp, E. coli
cattgtgcttgtaatggcgcggcga

SEQ ID NO: 150646 - DNA, 25 bp, E. coli
cattgtgcttgttatggcgcggcga

SEQ ID NO: 150647 - DNA, 25 bp, E. coli
gatcgccacgatcatcattgtgctt

SEQ ID NO: 150648 - DNA, 25 bp, E. coli
gtcaggccccggacgatgatcgcca

SEQ ID NO: 150649 - DNA, 25 bp, E. coli
gtcaggccccggtcgatgatcgcca

SEQ ID NO: 150650 - DNA, 25 bp, E. coli
gatgatcgccacgatgatcattgtg

SEQ ID NO: 150651 - DNA, 25 bp, E. coli
gatgatcgccaccatgatcattgtg

SEQ ID NO: 150652 - DNA, 25 bp, E. coli
gatcgccacgatgatcattgtgctt

SEQ ID NO: 150653 - DNA, 25 bp, E. coli
caacggctgaaggatgacgcaatgg

SEQ ID NO: 150654 - DNA, 25 bp, E. coli
caacggctgaagcatgacgcaatgg

SEQ ID NO: 150655 - DNA, 25 bp, E. coli
caaaatattcgatcgtctggagcgc

SEQ ID NO: 150656 - DNA, 25 bp, E. coli
caaaatattcgaacgtctggagcgc

SEQ ID NO: 150657 - DNA, 25 bp, E. coli
cagatgagctgaacgattacggcga

SEQ ID NO: 150658 - DNA, 25 bp, E. coli
ctttaaggcggactatgtcgacggc

SEQ ID NO: 150659 - DNA, 25 bp, E. coli
cagatgagctgatcgattacggcga

SEQ ID NO: 150660 - DNA, 25 bp, E. coli
ctttaaggcggagtatgtcgacggc

SEQ ID NO: 150661 - DNA, 25 bp, E. coli
tacatcggaaaatacctggacagcc

SEQ ID NO: 150662 - DNA, 25 bp, E. coli
tacatcggaaaaaacctggacagcc

SEQ ID NO: 150663 - DNA, 25 bp, E. coli
tatctgagccaggacgcgttaagcg

SEQ ID NO: 150664 - DNA, 25 bp, E. coli
tatctgagccagcacgcgttaagcg

SEQ ID NO: 150665 - DNA, 25 bp, E. coli
tgaccatggatgaaacgctgaaggc

SEQ ID NO: 150666 - DNA, 25 bp, E. coli
tgaccatggatgtaacgctgaaggc

SEQ ID NO: 150667 - DNA, 25 bp, E. coli
gaatctctcggcgtgcatatcggtg

SEQ ID NO: 150668 - DNA, 25 bp, E. coli
gaatctctcggcctgcatatcggtg

SEQ ID NO: 150669 - DNA, 25 bp, E. coli
gaatggatgcgctcactgaaacggc

SEQ ID NO: 150670 - DNA, 25 bp, E. coli
gaatggatgcgcacactgaaacggc

SEQ ID NO: 150671 - DNA, 25 bp, E. coli
gaaaaactctgccatggctttggcg

SEQ ID NO: 150672 - DNA, 25 bp, E. coli
gaaaaactctgcgatggctttggcg

SEQ ID NO: 150673 - DNA, 25 bp, E. coli
taatcatggcgtaagcagcacggag

SEQ ID NO: 150674 - DNA, 25 bp, E. coli
taatcatggcgttagcagcacggag

SEQ ID NO: 150675 - DNA, 25 bp, E. coli
caagcggcagtaccagtatgccaac

SEQ ID NO: 150676 - DNA, 25 bp, E. coli
caagcggcagtagcagtatgccaac

SEQ ID NO: 150677 - DNA, 25 bp, E. coli
cagcgccgcgtgtctcagggcactg

SEQ ID NO: 150678 - DNA, 25 bp, E. coli
cagcgccgcgtgactcagggcactg

SEQ ID NO: 150679 - DNA, 25 bp, E. coli
actaccggctttgtgtccgtcccag

SEQ ID NO: 150680 - DNA, 25 bp, E. coli
actaccggctttctgtccgtcccag

SEQ ID NO: 150681 - DNA, 25 bp, E. coli
tttgtgttcatcgacactttcaggc

SEQ ID NO: 150682 - DNA, 25 bp, E. coli
tttgtgttcatccacactttcaggc

SEQ ID NO: 150683 - DNA, 25 bp, E. coli
tctgtccgtccctgaccaccagttt

SEQ ID NO: 150684 - DNA, 25 bp, E. coli
tctgtccgtcccagaccaccagttt

SEQ ID NO: 150685 - DNA, 25 bp, E. coli
tgagccggatcattaccggcaaaaa

SEQ ID NO: 150686 - DNA, 25 bp, E. coli
tgagccggatcaataccggcaaaaa

SEQ ID NO: 150687 - DNA, 25 bp, E. coli
tctgtgccttcatgcggcagtacca

SEQ ID NO: 150688 - DNA, 25 bp, E. coli
tcattaccggcataaatacgtactt

SEQ ID NO: 150689 - DNA, 25 bp, E. coli
tctgtgccttcaagcggcagtacca

SEQ ID NO: 150690 - DNA, 25 bp, E. coli
tcattaccggcaaaaatacgtactt

SEQ ID NO: 150691 - DNA, 25 bp, E. coli
ccttcaagcggcagtaccagtatgc

SEQ ID NO: 150692 - DNA, 25 bp, E. coli
ccttcaagcggctgtaccagtatgc

SEQ ID NO: 150693 - DNA, 25 bp, E. coli
gtgttcatccacactttcaggccag

SEQ ID NO: 150694 - DNA, 25 bp, E. coli
gtgttcatccactctttcaggccag

SEQ ID NO: 150695 - DNA, 25 bp, E. coli
gatcattaccgggaaaaatacgtac

SEQ ID NO: 150696 - DNA, 25 bp, E. coli
gatcattaccggcaaaaatacgtac

SEQ ID NO: 150697 - DNA, 25 bp, E. coli
caacgcggtaagtcgggaattatct

SEQ ID NO: 150698 - DNA, 25 bp, E. coli
aatacgctgcccacggtcagctgcg

SEQ ID NO: 150699 - DNA, 25 bp, E. coli
aatacgctgccctcggtcagctgcg

SEQ ID NO: 150700 - DNA, 25 bp, E. coli
caacaagcctaacgttcgcttcgtg

SEQ ID NO: 150701 - DNA, 25 bp, E. coli
caacaagcctaaggttcgcttcgtg

SEQ ID NO: 150702 - DNA, 25 bp, E. coli
caacgcggtaagacgggaattatct

SEQ ID NO: 150703 - DNA, 25 bp, E. coli
agattatcgacagcgtactttccgg

SEQ ID NO: 150704 - DNA, 25 bp, E. coli
agattatcgacaccgtactttccgg

SEQ ID NO: 150705 - DNA, 25 bp, E. coli
tcagctgcgtcagcgttttccgacg

SEQ ID NO: 150706 - DNA, 25 bp, E. coli
tcagctgcgtcaccgttttccgacg

SEQ ID NO: 150707 - DNA, 25 bp, E. coli
ccaggaagagattatcgacaccgta

SEQ ID NO: 150708 - DNA, 25 bp, E. coli
ccaggaagagataatcgacaccgta

SEQ ID NO: 150709 - DNA, 25 bp, E. coli
gcaaatccgcctcctttatatcgcg

SEQ ID NO: 150710 - DNA, 25 bp, E. coli
gcaaatccgcctgctttatatcgcg

SEQ ID NO: 150711 - DNA, 25 bp, E. coli
cccgcgagcagcagcttgaagtaat

SEQ ID NO: 150712 - DNA, 25 bp, E. coli
cgaacgtcataatctcaatgcgatg

SEQ ID NO: 150713 - DNA, 25 bp, E. coli
cccgcgagcagctgcttgaagtaat

SEQ ID NO: 150714 - DNA, 25 bp, E. coli
cgaacgtcataaactcaatgcgatg

SEQ ID NO: 150715 - DNA, 25 bp, E. coli
gttgcaggatatggaacgtcataaa

SEQ ID NO: 150716 - DNA, 25 bp, E. coli
gttgcaggatatcgaacgtcataaa

SEQ ID NO: 150717 - DNA, 25 bp, E. coli
ggcatgggcatctacaagcctaacg

SEQ ID NO: 150718 - DNA, 25 bp, E. coli
ggcatgggcatcaacaagcctaacg

SEQ ID NO: 150719 - DNA, 25 bp, E. coli
cagtgtgatgaataaccgttgacgg

SEQ ID NO: 150720 - DNA, 25 bp, E. coli
cagtgtgatgaaaaaccgttgacgg

SEQ ID NO: 150721 - DNA, 25 bp, E. coli
taaacgcgaccgcatcgtcttgaat

SEQ ID NO: 150722 - DNA, 25 bp, E. coli
taaacgcgaccggatcgtcttgaat

SEQ ID NO: 150723 - DNA, 25 bp, E. coli
tttgtttacgattatcaactactgc

SEQ ID NO: 150724 - DNA, 25 bp, E. coli
tttgtttacgataatcaactactgc

SEQ ID NO: 150725 - DNA, 25 bp, E. coli
tgcaaaccgatacgctggaatacca

SEQ ID NO: 150726 - DNA, 25 bp, E. coli
tgcaaaccgataggctggaatacca

SEQ ID NO: 150727 - DNA, 25 bp, E. coli
ccgatacgctggtataccagtgtga

SEQ ID NO: 150728 - DNA, 25 bp, E. coli
gcatcgtcttgattaactgtcagtt

SEQ ID NO: 150729 - DNA, 25 bp, E. coli
gcatcgtcttgaataactgtcagtt

SEQ ID NO: 150730 - DNA, 25 bp, E. coli
gaataccagtgtcatgaaaaaccgt

SEQ ID NO: 150731 - DNA, 25 bp, E. coli
gaagcgactgtctataaacgcgacc

SEQ ID NO: 150732 - DNA, 25 bp, E. coli
gaagcgactgtcaataaacgcgacc

SEQ ID NO: 150733 - DNA, 25 bp, E. coli
gaataccagtgtgatgaaaaaccgt

SEQ ID NO: 150734 - DNA, 25 bp, E. coli
cgttgacggtcatactgaataatcc

SEQ ID NO: 150735 - DNA, 25 bp, E. coli
cgttgacggtcaaactgaataatcc

SEQ ID NO: 150736 - DNA, 25 bp, E. coli
ccgatacgctggaataccagtgtga

SEQ ID NO: 150737 - DNA, 25 bp, E. coli
gtcaaactgaataatccgcgccagg

SEQ ID NO: 150738 - DNA, 25 bp, E. coli
gtcaaactgaattatccgcgccagg

SEQ ID NO: 150739 - DNA, 25 bp, E. coli
tcaactactgcaactcaaacagggc

SEQ ID NO: 150740 - DNA, 25 bp, E. coli
tcaactactgcatctcaaacagggc

SEQ ID NO: 150741 - DNA, 25 bp, E. coli
caggcgatgctgtctgcaccgttat

SEQ ID NO: 150742 - DNA, 25 bp, E. coli
caggcgatgctgactgcaccgttat

SEQ ID NO: 150743 - DNA, 25 bp, E. coli
aactgctggccccttataccggtga

SEQ ID NO: 150744 - DNA, 25 bp, E. coli
aactgctggcccgttataccggtga

SEQ ID NO: 150745 - DNA, 25 bp, E. coli
tatggcacccggaccgcttgaagtg

SEQ ID NO: 150746 - DNA, 25 bp, E. coli
tatggcacccggtccgcttgaagtg

SEQ ID NO: 150747 - DNA, 25 bp, E. coli
tataccggtgatatcgccgctgaag

SEQ ID NO: 150748 - DNA, 25 bp, E. coli
tataccggtgatttcgccgctgaag

SEQ ID NO: 150749 - DNA, 25 bp, E. coli
tgattctggtgtacagcgaacgcca

SEQ ID NO: 150750 - DNA, 25 bp, E. coli
tgattctggtgttcagcgaacgcca

SEQ ID NO: 150751 - DNA, 25 bp, E. coli
tgcatcacggcaataagcgccagca

SEQ ID NO: 150752 - DNA, 25 bp, E. coli
tgcatcacggcattaagcgccagca

SEQ ID NO: 150753 - DNA, 25 bp, E. coli
tgcgcgtggaggaaaaaggcttttc

SEQ ID NO: 150754 - DNA, 25 bp, E. coli
tgcgcgtggaggtaaaaggcttttc

SEQ ID NO: 150755 - DNA, 25 bp, E. coli
tctggcagagttcgaccctgcggaa

SEQ ID NO: 150756 - DNA, 25 bp, E. coli
tctggcagagttggaccctgcggaa

SEQ ID NO: 150757 - DNA, 25 bp, E. coli
gaaacttcgcgaacgccagcagctt

SEQ ID NO: 150758 - DNA, 25 bp, E. coli
gaaacttcgcgatcgccagcagctt

SEQ ID NO: 150759 - DNA, 25 bp, E. coli
gatattcaggtggtgcaaaacttcg

SEQ ID NO: 150760 - DNA, 25 bp, E. coli
gatattcaggtgctgcaaaacttcg

SEQ ID NO: 150761 - DNA, 25 bp, E. coli
gaggcgcaaagttcctgcatcacgg

SEQ ID NO: 150762 - DNA, 25 bp, E. coli
gaggcgcaaagtacctgcatcacgg

SEQ ID NO: 150763 - DNA, 25 bp, E. coli
caataatgatatcgaaccattcagc

SEQ ID NO: 150764 - DNA, 25 bp, E. coli
caataatgatatggaaccattcagc

SEQ ID NO: 150765 - DNA, 25 bp, E. coli
cagagagccgcatgatttttaattt

SEQ ID NO: 150766 - DNA, 25 bp, E. coli
cagagagccgcaagatttttaattt

SEQ ID NO: 150767 - DNA, 25 bp, E. coli
catgaaaatgagatcagagagccgc

SEQ ID NO: 150768 - DNA, 25 bp, E. coli
catgaaaatgagttcagagagccgc

SEQ ID NO: 150769 - DNA, 25 bp, E. coli
tactctggcgtaggtgcgtgattct

SEQ ID NO: 150770 - DNA, 25 bp, E. coli
tactctggcgtacgtgcgtgattct

SEQ ID NO: 150771 - DNA, 25 bp, E. coli
tagagtccgttatcaatgctaaata

SEQ ID NO: 150772 - DNA, 25 bp, E. coli
tagagtccgttaacaatgctaaata

SEQ ID NO: 150773 - DNA, 25 bp, E. coli
tatgacaggcgagggagtgtccaat

SEQ ID NO: 150774 - DNA, 25 bp, E. coli
tatgacaggcgacggagtgtccaat

SEQ ID NO: 150775 - DNA, 25 bp, E. coli
taagtgaggtatataattagagtcc

SEQ ID NO: 150776 - DNA, 25 bp, E. coli
tctaatcattatcacaggcgaggga

SEQ ID NO: 150777 - DNA, 25 bp, E. coli
tctgttcaatgattttactctggcg

SEQ ID NO: 150778 - DNA, 25 bp, E. coli
tctgttcaatgaatttactctggcg

SEQ ID NO: 150779 - DNA, 25 bp, E. coli
taagtgaggtatttaattagagtcc

SEQ ID NO: 150780 - DNA, 25 bp, E. coli
tctaatcattatgacaggcgaggga

SEQ ID NO: 150781 - DNA, 25 bp, E. coli
gcgtgattctcggttgttgtctcat

SEQ ID NO: 150782 - DNA, 25 bp, E. coli
gcgtgattctcgcttgttgtctcat

SEQ ID NO: 150783 - DNA, 25 bp, E. coli
gaattccaccatatctctgttcaat

SEQ ID NO: 150784 - DNA, 25 bp, E. coli
gaattccaccatttctctgttcaat

SEQ ID NO: 150785 - DNA, 25 bp, E. coli
aatggagatcacttagtttgctaag

SEQ ID NO: 150786 - DNA, 25 bp, E. coli
aatactatggtgtttactcttgagg

SEQ ID NO: 150787 - DNA, 25 bp, E. coli
aatactatggtgattactcttgagg

SEQ ID NO: 150788 - DNA, 25 bp, E. coli
aatggagatcacatagtttgctaag

SEQ ID NO: 150789 - DNA, 25 bp, E. coli
cactaaatcaatcgaaatggagatc

SEQ ID NO: 150790 - DNA, 25 bp, E. coli
cactaaatcaatggaaatggagatc

SEQ ID NO: 150791 - DNA, 25 bp, E. coli
tacggacatttcaataaatgcccgt

SEQ ID NO: 150792 - DNA, 25 bp, E. coli
taaatgcccgtataaacagagtatg

SEQ ID NO: 150793 - DNA, 25 bp, E. coli
taaatgcccgtaaaaacagagtatg

SEQ ID NO: 150794 - DNA, 25 bp, E. coli
tacggacatttctataaatgcccgt

SEQ ID NO: 150795 - DNA, 25 bp, E. coli
gctaagtatattggtatttacggca

SEQ ID NO: 150796 - DNA, 25 bp, E. coli
gctaagtatattcgtatttacggca

SEQ ID NO: 150797 - DNA, 25 bp, E. coli
gaaatgaggcttaaatgttgcaacg

SEQ ID NO: 150798 - DNA, 25 bp, E. coli
gaaatgaggctttaatgttgcaacg

SEQ ID NO: 150799 - DNA, 25 bp, E. coli
cggcctatttataaaatacggacat

SEQ ID NO: 150800 - DNA, 25 bp, E. coli
cggcctatttattaaatacggacat

SEQ ID NO: 150801 - DNA, 25 bp, E. coli
taacatggttaagatttatgccact

SEQ ID NO: 150802 - DNA, 25 bp, E. coli
taatgttgcaacgtaaaactttacg

SEQ ID NO: 150803 - DNA, 25 bp, E. coli
taatgttgcaacctaaaactttacg

SEQ ID NO: 150804 - DNA, 25 bp, E. coli
taacatggttaacatttatgccact

SEQ ID NO: 150805 - DNA, 25 bp, E. coli
gagtatgattctggctggtcgttga

SEQ ID NO: 150806 - DNA, 25 bp, E. coli
gagtatgattctcgctggtcgttga

SEQ ID NO: 150807 - DNA, 25 bp, E. coli
caaacaagttgggaggagatgcacc

SEQ ID NO: 150808 - DNA, 25 bp, E. coli
caaagggttactcatcgctggtgct

SEQ ID NO: 150809 - DNA, 25 bp, E. coli
cactcaatagtatagcggttggcag

SEQ ID NO: 150810 - DNA, 25 bp, E. coli
cactcaatagtaaagcggttggcag

SEQ ID NO: 150811 - DNA, 25 bp, E. coli
caaacaagttggcaggagatgcacc

SEQ ID NO: 150812 - DNA, 25 bp, E. coli
caaagggttactgatcgctggtgct

SEQ ID NO: 150813 - DNA, 25 bp, E. coli
catttaatcccgtccttgccggtgg

SEQ ID NO: 150814 - DNA, 25 bp, E. coli
catttaatcccgaccttgccggtgg

SEQ ID NO: 150815 - DNA, 25 bp, E. coli
taacaatcaatagggaaggtatcgc

SEQ ID NO: 150816 - DNA, 25 bp, E. coli
taacaatcaatacggaaggtatcgc

SEQ ID NO: 150817 - DNA, 25 bp, E. coli
tatcgaaggattgagggaaacagca

SEQ ID NO: 150818 - DNA, 25 bp, E. coli
tatcgaaggattcagggaaacagca

SEQ ID NO: 150819 - DNA, 25 bp, E. coli
tttaggatgggatacaggtgaaccg

SEQ ID NO: 150820 - DNA, 25 bp, E. coli
tttaggatgggaaacaggtgaaccg

SEQ ID NO: 150821 - DNA, 25 bp, E. coli
tttcggagccagtggagcagtatca

SEQ ID NO: 150822 - DNA, 25 bp, E. coli
tttcggagccagaggagcagtatca

SEQ ID NO: 150823 - DNA, 25 bp, E. coli
tgccggtggtcctatagaaaacctg

SEQ ID NO: 150824 - DNA, 25 bp, E. coli
tgccggtggtccaatagaaaacctg

SEQ ID NO: 150825 - DNA, 25 bp, E. coli
gaatcatttgaggatttcggagcca

SEQ ID NO: 150826 - DNA, 25 bp, E. coli
gaatcatttgagcatttcggagcca

SEQ ID NO: 150827 - DNA, 25 bp, E. coli
gatgcacctgctcgttacgatcaag

SEQ ID NO: 150828 - DNA, 25 bp, E. coli
gatgcacctgctggttacgatcaag

SEQ ID NO: 150829 - DNA, 25 bp, E. coli
attttatggcgggagatcgttaacg

SEQ ID NO: 150830 - DNA, 25 bp, E. coli
atggcgggagatggttaacgagatc

SEQ ID NO: 150831 - DNA, 25 bp, E. coli
atggcgggagatcgttaacgagatc

SEQ ID NO: 150832 - DNA, 25 bp, E. coli
attttatggcggcagatcgttaacg

SEQ ID NO: 150833 - DNA, 25 bp, E. coli
tatggcgggagatcgttaacgagat

SEQ ID NO: 150834 - DNA, 25 bp, E. coli
tatggcgggagaacgttaacgagat

SEQ ID NO: 150835 - DNA, 25 bp, E. coli
ttatggcgggagttcgttaacgaga

SEQ ID NO: 150836 - DNA, 25 bp, E. coli
ttatggcgggagatcgttaacgaga

SEQ ID NO: 150837 - DNA, 25 bp, E. coli
tttatggcgggacatcgttaacgag

SEQ ID NO: 150838 - DNA, 25 bp, E. coli
tttatggcgggagatcgttaacgag

SEQ ID NO: 150839 - DNA, 25 bp, E. coli
gcgggagatcgtaaacgagatcgcc

SEQ ID NO: 150840 - DNA, 25 bp, E. coli
gcgggagatcgttaacgagatcgcc

SEQ ID NO: 150841 - DNA, 25 bp, E. coli
cgggagatcgtttacgagatcgcca

SEQ ID NO: 150842 - DNA, 25 bp, E. coli
cgggagatcgttaacgagatcgcca

SEQ ID NO: 150843 - DNA, 25 bp, E. coli
ttttatggcgggtgatcgttaacga

SEQ ID NO: 150844 - DNA, 25 bp, E. coli
ttttatggcgggagatcgttaacga

SEQ ID NO: 150845 - DNA, 25 bp, E. coli
gggagatcgttatcgagatcgccac

SEQ ID NO: 150846 - DNA, 25 bp, E. coli
gggagatcgttaacgagatcgccac

SEQ ID NO: 150847 - DNA, 25 bp, E. coli
ggagatcgttaacgagatcgccacg

SEQ ID NO: 150848 - DNA, 25 bp, E. coli
ggagatcgttaaggagatcgccacg

SEQ ID NO: 150849 - DNA, 25 bp, E. coli
tggcgggagatccttaacgagatcg

SEQ ID NO: 150850 - DNA, 25 bp, E. coli
tggcgggagatcgttaacgagatcg

SEQ ID NO: 150851 - DNA, 25 bp, E. coli
tactggatggcacgagaagcctgta

SEQ ID NO: 150852 - DNA, 25 bp, E. coli
tactggatggcaggagaagcctgta

SEQ ID NO: 150853 - DNA, 25 bp, E. coli
ttcagacaaaaagccgggtgaagcc

SEQ ID NO: 150854 - DNA, 25 bp, E. coli
ttcagacaaaaacccgggtgaagcc

SEQ ID NO: 150855 - DNA, 25 bp, E. coli
ttgagccctggcaaggcgatggcct

SEQ ID NO: 150856 - DNA, 25 bp, E. coli
ttgagccctggctaggcgatggcct

SEQ ID NO: 150857 - DNA, 25 bp, E. coli
tgaagccgctgtactctggatcaag

SEQ ID NO: 150858 - DNA, 25 bp, E. coli
tgaagccgctgttctctggatcaag

SEQ ID NO: 150859 - DNA, 25 bp, E. coli
tcccgtaaaccagcatcgtctgatg

SEQ ID NO: 150860 - DNA, 25 bp, E. coli
tcccgtaaaccaccatcgtctgatg

SEQ ID NO: 150861 - DNA, 25 bp, E. coli
tcggcaagatgtatggcaggaaaca

SEQ ID NO: 150862 - DNA, 25 bp, E. coli
tcttcgctggcgacgatgatccagg

SEQ ID NO: 150863 - DNA, 25 bp, E. coli
tcggcaagatgtttggcaggaaaca

SEQ ID NO: 150864 - DNA, 25 bp, E. coli
tcttcgctggcgtcgatgatccagg

SEQ ID NO: 150865 - DNA, 25 bp, E. coli
cgttttgacatcgttctcgacagtg

SEQ ID NO: 150866 - DNA, 25 bp, E. coli
cgttttgacatccttctcgacagtg

SEQ ID NO: 150867 - DNA, 25 bp, E. coli
cgaagttgcataacggttccgggca

SEQ ID NO: 150868 - DNA, 25 bp, E. coli
cgaagttgcatatcggttccgggca

SEQ ID NO: 150869 - DNA, 25 bp, E. coli
gtgtgcatgcaaccagcctgcgtta

SEQ ID NO: 150870 - DNA, 25 bp, E. coli
gtgtgcatgcaagcagcctgcgtta

SEQ ID NO: 150871 - DNA, 25 bp, E. coli
gatgtgccaatctgcgtgtgcatgc

SEQ ID NO: 150872 - DNA, 25 bp, E. coli
gatgtgccaatcagcgtgtgcatgc

SEQ ID NO: 150873 - DNA, 25 bp, E. coli
gaattttcagccaggtaatttaccg

SEQ ID NO: 150874 - DNA, 25 bp, E. coli
gaattttcagcctggtaatttaccg

SEQ ID NO: 150875 - DNA, 25 bp, E. coli
cagatttatcgcgtgaagcgacctc

SEQ ID NO: 150876 - DNA, 25 bp, E. coli
cagatttatcgcctgaagcgacctc

SEQ ID NO: 150877 - DNA, 25 bp, E. coli
catgatggcgttctaaatctggaac

SEQ ID NO: 150878 - DNA, 25 bp, E. coli
catgatggcgttgtaaatctggaac

SEQ ID NO: 150879 - DNA, 25 bp, E. coli
tgaagcgacctcatgcgaaggtgag

SEQ ID NO: 150880 - DNA, 25 bp, E. coli
tgaagcgacctcttgcgaaggtgag

SEQ ID NO: 150881 - DNA, 25 bp, E. coli
tgcgcggaagtattcatctaacggg

SEQ ID NO: 150882 - DNA, 25 bp, E. coli
tgcgcggaagtaatcatctaacggg

SEQ ID NO: 150883 - DNA, 25 bp, E. coli
tcttgcgaaggtcaggcgcaccgtc

SEQ ID NO: 150884 - DNA, 25 bp, E. coli
tcttgcgaaggtgaggcgcaccgtc

SEQ ID NO: 150885 - DNA, 25 bp, E. coli
gcaccgtcgctgtgactgaaagctt

SEQ ID NO: 150886 - DNA, 25 bp, E. coli
gcaccgtcgctgagactgaaagctt

SEQ ID NO: 150887 - DNA, 25 bp, E. coli
cgcgctgtcaggattcgtttcagat

SEQ ID NO: 150888 - DNA, 25 bp, E. coli
cgcgctgtcaggtttcgtttcagat

SEQ ID NO: 150889 - DNA, 25 bp, E. coli
ggtaatttaccggttcaggtctata

SEQ ID NO: 150890 - DNA, 25 bp, E. coli
gtgttgaatatattttgcgcggaag

SEQ ID NO: 150891 - DNA, 25 bp, E. coli
gtgttgaatataatttgcgcggaag

SEQ ID NO: 150892 - DNA, 25 bp, E. coli
ggtaatttaccgcttcaggtctata

SEQ ID NO: 150893 - DNA, 25 bp, E. coli
gagaggattccaactgttacgtaga

SEQ ID NO: 150894 - DNA, 25 bp, E. coli
gagaggattccatctgttacgtaga

SEQ ID NO: 150895 - DNA, 25 bp, E. coli
cagaactggaaacccagctccgtca

SEQ ID NO: 150896 - DNA, 25 bp, E. coli
cagaactggaaagccagctccgtca

SEQ ID NO: 150897 - DNA, 25 bp, E. coli
tacctcattcgcattgcagaactgg

SEQ ID NO: 150898 - DNA, 25 bp, E. coli
actggaaagccagctccgtcagaaa

SEQ ID NO: 150899 - DNA, 25 bp, E. coli
actggaaagccacctccgtcagaaa

SEQ ID NO: 150900 - DNA, 25 bp, E. coli
tacctcattcgctttgcagaactgg

SEQ ID NO: 150901 - DNA, 25 bp, E. coli
ttcgcattgcagtactggaaagcca

SEQ ID NO: 150902 - DNA, 25 bp, E. coli
ttcgcattgcagaactggaaagcca

SEQ ID NO: 150903 - DNA, 25 bp, E. coli
tgcagaactggatagccagctccgt

SEQ ID NO: 150904 - DNA, 25 bp, E. coli
tgcagaactggaaagccagctccgt

SEQ ID NO: 150905 - DNA, 25 bp, E. coli
cctcattcgcatagcagaactggaa

SEQ ID NO: 150906 - DNA, 25 bp, E. coli
cctcattcgcattgcagaactggaa

SEQ ID NO: 150907 - DNA, 25 bp, E. coli
gaactggaaagccagctccgtcaga

SEQ ID NO: 150908 - DNA, 25 bp, E. coli
gaactggaaagcgagctccgtcaga

SEQ ID NO: 150909 - DNA, 25 bp, E. coli
cgcattgcagaagtggaaagccagc

SEQ ID NO: 150910 - DNA, 25 bp, E. coli
cgcattgcagaactggaaagccagc

SEQ ID NO: 150911 - DNA, 25 bp, E. coli
cattgcagaactcgaaagccagctc

SEQ ID NO: 150912 - DNA, 25 bp, E. coli
cattcgcattgcagaactggaaagc

SEQ ID NO: 150913 - DNA, 25 bp, E. coli
cattcgcattgctgaactggaaagc

SEQ ID NO: 150914 - DNA, 25 bp, E. coli
cattgcagaactggaaagccagctc

SEQ ID NO: 150915 - DNA, 25 bp, E. coli
ggaaagccagctgcgtcagaaagac

SEQ ID NO: 150916 - DNA, 25 bp, E. coli
ggaaagccagctccgtcagaaagac

SEQ ID NO: 150917 - DNA, 25 bp, E. coli
attatcgccccggaagacaacgaca

SEQ ID NO: 150918 - DNA, 25 bp, E. coli
atagaagtgaatcgcaacggcaaag

SEQ ID NO: 150919 - DNA, 25 bp, E. coli
attatcgccccgcaagacaacgaca

SEQ ID NO: 150920 - DNA, 25 bp, E. coli
atagaagtgaatggcaacggcaaag

SEQ ID NO: 150921 - DNA, 25 bp, E. coli
tatcgccccggatgacaacgacaac

SEQ ID NO: 150922 - DNA, 25 bp, E. coli
tatcgccccggaagacaacgacaac

SEQ ID NO: 150923 - DNA, 25 bp, E. coli
tatagaagtgaaaggcaacggcaaa

SEQ ID NO: 150924 - DNA, 25 bp, E. coli
tatagaagtgaatggcaacggcaaa

SEQ ID NO: 150925 - DNA, 25 bp, E. coli
ttatcgccccggaagacaacgacaa

SEQ ID NO: 150926 - DNA, 25 bp, E. coli
ttatcgccccggtagacaacgacaa

SEQ ID NO: 150927 - DNA, 25 bp, E. coli
tccggcgggtctcgcgtgcgcggat

SEQ ID NO: 150928 - DNA, 25 bp, E. coli
tccggcgggtctggcgtgcgcggat

SEQ ID NO: 150929 - DNA, 25 bp, E. coli
gctggattcgcacgggcgcattatc

SEQ ID NO: 150930 - DNA, 25 bp, E. coli
gctgggtatagaagtgaatggcaac

SEQ ID NO: 150931 - DNA, 25 bp, E. coli
gctggattcgcaggggcgcattatc

SEQ ID NO: 150932 - DNA, 25 bp, E. coli
gctgggtatagatgtgaatggcaac

SEQ ID NO: 150933 - DNA, 25 bp, E. coli
ccgctgggtatagaagtgaatggca

SEQ ID NO: 150934 - DNA, 25 bp, E. coli
ccgctgggtatacaagtgaatggca

SEQ ID NO: 150935 - DNA, 25 bp, E. coli
ctgggtatagaagtgaatggcaacg

SEQ ID NO: 150936 - DNA, 25 bp, E. coli
ctgggtatagaactgaatggcaacg

SEQ ID NO: 150937 - DNA, 25 bp, E. coli
ggtatagaagtgtatggcaacggca

SEQ ID NO: 150938 - DNA, 25 bp, E. coli
ggtatagaagtgaatggcaacggca

SEQ ID NO: 150939 - DNA, 25 bp, E. coli
catttggtccctttgtggatggaca

SEQ ID NO: 150940 - DNA, 25 bp, E. coli
catttggtccctatgtggatggaca

SEQ ID NO: 150941 - DNA, 25 bp, E. coli
tgatgatacccggacatttggtccc

SEQ ID NO: 150942 - DNA, 25 bp, E. coli
tgatgatacccgcacatttggtccc

SEQ ID NO: 150943 - DNA, 25 bp, E. coli
tctattacagttatattaatcatgg

SEQ ID NO: 150944 - DNA, 25 bp, E. coli
tctattacagttttattaatcatgg

SEQ ID NO: 150945 - DNA, 25 bp, E. coli
gccgccgggtcatggtgatgatacc

SEQ ID NO: 150946 - DNA, 25 bp, E. coli
gcaaagggccgtatgaaggcttatt

SEQ ID NO: 150947 - DNA, 25 bp, E. coli
gcaaagggccgtttgaaggcttatt

SEQ ID NO: 150948 - DNA, 25 bp, E. coli
gccgccgggtcaaggtgatgatacc

SEQ ID NO: 150949 - DNA, 25 bp, E. coli
gcaagggtaatttaagttgagccgc

SEQ ID NO: 150950 - DNA, 25 bp, E. coli
gaaggcttattagttatcgatatga

SEQ ID NO: 150951 - DNA, 25 bp, E. coli
gaaggcttattacttatcgatatga

SEQ ID NO: 150952 - DNA, 25 bp, E. coli
gcaagggtaattaaagttgagccgc

SEQ ID NO: 150953 - DNA, 25 bp, E. coli
gaactcaacttcattgtaatatggg

SEQ ID NO: 150954 - DNA, 25 bp, E. coli
gaactcaacttctttgtaatatggg

SEQ ID NO: 150955 - DNA, 25 bp, E. coli
gatacccgcacatttggtccctatg

SEQ ID NO: 150956 - DNA, 25 bp, E. coli
gatacccgcacaattggtccctatg

SEQ ID NO: 150957 - DNA, 25 bp, E. coli
ggtcatggtgatcatacccgcacat

SEQ ID NO: 150958 - DNA, 25 bp, E. coli
ggtcatggtgatgatacccgcacat

SEQ ID NO: 150959 - DNA, 25 bp, E. coli
taattaaagttgtgccgccgggtca

SEQ ID NO: 150960 - DNA, 25 bp, E. coli
taattaaagttgagccgccgggtca

SEQ ID NO: 150961 - DNA, 25 bp, E. coli
tagaaaggcgttaataggcaaaacg

SEQ ID NO: 150962 - DNA, 25 bp, E. coli
tagaaaggcgtttataggcaaaacg

SEQ ID NO: 150963 - DNA, 25 bp, E. coli
taggcaaaacgaaatgaaacgaaag

SEQ ID NO: 150964 - DNA, 25 bp, E. coli
taggcaaaacgatatgaaacgaaag

SEQ ID NO: 150965 - DNA, 25 bp, E. coli
tgaaagtcactgtaacgagagtagc

SEQ ID NO: 150966 - DNA, 25 bp, E. coli
tgaaagtcactgaaacgagagtagc

SEQ ID NO: 150967 - DNA, 25 bp, E. coli
tcctctccagttgagattactgcga

SEQ ID NO: 150968 - DNA, 25 bp, E. coli
tcctctccagttcagattactgcga

SEQ ID NO: 150969 - DNA, 25 bp, E. coli
tcagttgatactccgtcatggtgag

SEQ ID NO: 150970 - DNA, 25 bp, E. coli
tctgatctgattcacaaaagaaaca

SEQ ID NO: 150971 - DNA, 25 bp, E. coli
tctgatctgattgacaaaagaaaca

SEQ ID NO: 150972 - DNA, 25 bp, E. coli
tcagttgatactgcgtcatggtgag

SEQ ID NO: 150973 - DNA, 25 bp, E. coli
gaaagataatggatttctgatctga

SEQ ID NO: 150974 - DNA, 25 bp, E. coli
gaaagataatggttttctgatctga

SEQ ID NO: 150975 - DNA, 25 bp, E. coli
cgagagtagcttccgtcaatgggca

SEQ ID NO: 150976 - DNA, 25 bp, E. coli
cgagagtagcttgcgtcaatgggca

SEQ ID NO: 150977 - DNA, 25 bp, E. coli
cgtcatggtgagttaaaaataaaac

SEQ ID NO: 150978 - DNA, 25 bp, E. coli
cttgcatttgcttaatagaaaggcg

SEQ ID NO: 150979 - DNA, 25 bp, E. coli
cgtcatggtgagataaaaataaaac

SEQ ID NO: 150980 - DNA, 25 bp, E. coli
cttgcatttgctaaatagaaaggcg

SEQ ID NO: 150981 - DNA, 25 bp, E. coli
tcaatgggcaaggtgggcttgcatt

SEQ ID NO: 150982 - DNA, 25 bp, E. coli
tcaatgggcaagctgggcttgcatt

SEQ ID NO: 150983 - DNA, 25 bp, E. coli
aatgtccctaaagacaatgagtctg

SEQ ID NO: 150984 - DNA, 25 bp, E. coli
caacgatgggctttgtatacccgac

SEQ ID NO: 150985 - DNA, 25 bp, E. coli
aatgtccctaaacacaatgagtctg

SEQ ID NO: 150986 - DNA, 25 bp, E. coli
caacgatgggctatgtatacccgac

SEQ ID NO: 150987 - DNA, 25 bp, E. coli
taaaaactctccttgtgtgatccga

SEQ ID NO: 150988 - DNA, 25 bp, E. coli
taaaaactctccatgtgtgatccga

SEQ ID NO: 150989 - DNA, 25 bp, E. coli
cccgggactcatctctgttaactta

SEQ ID NO: 150990 - DNA, 25 bp, E. coli
cccgggactcatgtctgttaactta

SEQ ID NO: 150991 - DNA, 25 bp, E. coli
aaaagtagaaaagccgctgatgagc

SEQ ID NO: 150992 - DNA, 25 bp, E. coli
aaaagtagaaaacccgctgatgagc

SEQ ID NO: 150993 - DNA, 25 bp, E. coli
tattattagcagtgctattacggcc

SEQ ID NO: 150994 - DNA, 25 bp, E. coli
tattattagcagagctattacggcc

SEQ ID NO: 150995 - DNA, 25 bp, E. coli
tattacggccaatgtacagcataag

SEQ ID NO: 150996 - DNA, 25 bp, E. coli
tattacggccaaagtacagcataag

SEQ ID NO: 150997 - DNA, 25 bp, E. coli
gcttttaaagcctatcaaccagtca

SEQ ID NO: 150998 - DNA, 25 bp, E. coli
gcttttaaagccaatcaaccagtca

SEQ ID NO: 150999 - DNA, 25 bp, E. coli
gatttttgctgatgatggcgacatg

SEQ ID NO: 151000 - DNA, 25 bp, E. coli
gatttttgctgaagatggcgacatg

SEQ ID NO: 151001 - DNA, 25 bp, E. coli
taatgttgaatctcatcccgggact

SEQ ID NO: 151002 - DNA, 25 bp, E. coli
taatgttgaatcacatcccgggact

SEQ ID NO: 151003 - DNA, 25 bp, E. coli
tcaaccagtcatcaagacagacggg

SEQ ID NO: 151004 - DNA, 25 bp, E. coli
tcaaccagtcatgaagacagacggg

SEQ ID NO: 151005 - DNA, 25 bp, E. coli
cagatagatagtctgcgtactcgaa

SEQ ID NO: 151006 - DNA, 25 bp, E. coli
catgctttattcaatcaaaaatcgc

SEQ ID NO: 151007 - DNA, 25 bp, E. coli
catgctttattctatcaaaaatcgc

SEQ ID NO: 151008 - DNA, 25 bp, E. coli
ctcgaaatgataatggtaacataaa

SEQ ID NO: 151009 - DNA, 25 bp, E. coli
ctcgaaatgatattggtaacataaa

SEQ ID NO: 151010 - DNA, 25 bp, E. coli
cagatagatagtgtgcgtactcgaa

SEQ ID NO: 151011 - DNA, 25 bp, E. coli
tataatgttacttagtagcatcggc

SEQ ID NO: 151012 - DNA, 25 bp, E. coli
tataatgttactaagtagcatcggc

SEQ ID NO: 151013 - DNA, 25 bp, E. coli
tgtgcgtactcgaaatgatattggt

SEQ ID NO: 151014 - DNA, 25 bp, E. coli
tgtgcgtactcgtaatgatattggt

SEQ ID NO: 151015 - DNA, 25 bp, E. coli
tacttagtagcatcggcaatttaca

SEQ ID NO: 151016 - DNA, 25 bp, E. coli
tacttagtagcaacggcaatttaca

SEQ ID NO: 151017 - DNA, 25 bp, E. coli
ccttaaaaaacagatagatagtgtg

SEQ ID NO: 151018 - DNA, 25 bp, E. coli
ccttaaaaaacacatagatagtgtg

SEQ ID NO: 151019 - DNA, 25 bp, E. coli
gcatcggcaattaacataacttaca

SEQ ID NO: 151020 - DNA, 25 bp, E. coli
gcatcggcaatttacataacttaca

SEQ ID NO: 151021 - DNA, 25 bp, E. coli
cgtgataaatatgtcaaaagatttc

SEQ ID NO: 151022 - DNA, 25 bp, E. coli
cgtgataaatatctcaaaagatttc

SEQ ID NO: 151023 - DNA, 25 bp, E. coli
gtcaaatatcacgttttctcatgct

SEQ ID NO: 151024 - DNA, 25 bp, E. coli
gtcaaatatcaccttttctcatgct

SEQ ID NO: 151025 - DNA, 25 bp, E. coli
ggtaacataaatagctttattcgtg

SEQ ID NO: 151026 - DNA, 25 bp, E. coli
ggtaacataaattgctttattcgtg

SEQ ID NO: 151027 - DNA, 25 bp, E. coli
aggtcgctgtctacgtagactacga

SEQ ID NO: 151028 - DNA, 25 bp, E. coli
aggtcgctgtcttcgtagactacga

SEQ ID NO: 151029 - DNA, 25 bp, E. coli
tgtcttcgtagactacgaatctgag

SEQ ID NO: 151030 - DNA, 25 bp, E. coli
tgtcttcgtagagtacgaatctgag

SEQ ID NO: 151031 - DNA, 25 bp, E. coli
tcgctgtcttcgaagactacgaatc

SEQ ID NO: 151032 - DNA, 25 bp, E. coli
tcgtagactacgaatctgagaagta

SEQ ID NO: 151033 - DNA, 25 bp, E. coli
tcgtagactacgtatctgagaagta

SEQ ID NO: 151034 - DNA, 25 bp, E. coli
tcgctgtcttcgtagactacgaatc

SEQ ID NO: 151035 - DNA, 25 bp, E. coli
tcttcgtagactacgaatctgagaa

SEQ ID NO: 151036 - DNA, 25 bp, E. coli
tcttcgtagacttcgaatctgagaa

SEQ ID NO: 151037 - DNA, 25 bp, E. coli
gctgtcttcgtagactacgaatctg

SEQ ID NO: 151038 - DNA, 25 bp, E. coli
gctgtcttcgtacactacgaatctg

SEQ ID NO: 151039 - DNA, 25 bp, E. coli
cttcgtagactaggaatctgagaag

SEQ ID NO: 151040 - DNA, 25 bp, E. coli
cttcgtagactacgaatctgagaag

SEQ ID NO: 151041 - DNA, 25 bp, E. coli
cgtagactacgattctgagaagtaa

SEQ ID NO: 151042 - DNA, 25 bp, E. coli
cgtagactacgaatctgagaagtaa

SEQ ID NO: 151043 - DNA, 25 bp, E. coli
ggtcgctgtcttggtagactacgaa

SEQ ID NO: 151044 - DNA, 25 bp, E. coli
gtcgctgtcttcgtagactacgaat

SEQ ID NO: 151045 - DNA, 25 bp, E. coli
ggtcgctgtcttcgtagactacgaa

SEQ ID NO: 151046 - DNA, 25 bp, E. coli
gtcgctgtcttcctagactacgaat

SEQ ID NO: 151047 - DNA, 25 bp, E. coli
gaggtcgctgtcatcgtagactacg

SEQ ID NO: 151048 - DNA, 25 bp, E. coli
gaggtcgctgtcttcgtagactacg

SEQ ID NO: 151049 - DNA, 25 bp, E. coli
aatgggtccggtcgcttctcaggaa

SEQ ID NO: 151050 - DNA, 25 bp, E. coli
caatgggtccggtggcttctcagga

SEQ ID NO: 151051 - DNA, 25 bp, E. coli
aatgggtccggtggcttctcaggaa

SEQ ID NO: 151052 - DNA, 25 bp, E. coli
caatgggtccggaggcttctcagga

SEQ ID NO: 151053 - DNA, 25 bp, E. coli
ttaccaatgggtccggtggcttctc

SEQ ID NO: 151054 - DNA, 25 bp, E. coli
ttaccaatgggtgcggtggcttctc

SEQ ID NO: 151055 - DNA, 25 bp, E. coli
tgttaccaatggctccggtggcttc

SEQ ID NO: 151056 - DNA, 25 bp, E. coli
tgttaccaatgggtccggtggcttc

SEQ ID NO: 151057 - DNA, 25 bp, E. coli
ccaatgggtccggtggcttctcagg

SEQ ID NO: 151058 - DNA, 25 bp, E. coli
ccaatgggtccgctggcttctcagg

SEQ ID NO: 151059 - DNA, 25 bp, E. coli
gctgttaccaatcggtccggtggct

SEQ ID NO: 151060 - DNA, 25 bp, E. coli
gctcgtccctgtggcgttggtgatc

SEQ ID NO: 151061 - DNA, 25 bp, E. coli
gctcgtccctgtcgcgttggtgatc

SEQ ID NO: 151062 - DNA, 25 bp, E. coli
gctgttaccaatgggtccggtggct

SEQ ID NO: 151063 - DNA, 25 bp, E. coli
cgtccctgtggccttggtgatcgca

SEQ ID NO: 151064 - DNA, 25 bp, E. coli
cgtccctgtggcgttggtgatcgca

SEQ ID NO: 151065 - DNA, 25 bp, E. coli
gttaccaatgggtccggtggcttct

SEQ ID NO: 151066 - DNA, 25 bp, E. coli
gttaccaatgggaccggtggcttct

SEQ ID NO: 151067 - DNA, 25 bp, E. coli
gggtccggtggcttctcaggaagcg

SEQ ID NO: 151068 - DNA, 25 bp, E. coli
gggtccggtggcatctcaggaagcg

SEQ ID NO: 151069 - DNA, 25 bp, E. coli
tgggtccggtggcttctcaggaagc

SEQ ID NO: 151070 - DNA, 25 bp, E. coli
tgggtccggtgggttctcaggaagc

SEQ ID NO: 151071 - DNA, 25 bp, E. coli
aatgtccatagctcaacaggtaggg

SEQ ID NO: 151072 - DNA, 25 bp, E. coli
aatgtccatagcacaacaggtaggg

SEQ ID NO: 151073 - DNA, 25 bp, E. coli
tattcaacgtaatttggcccctgga

SEQ ID NO: 151074 - DNA, 25 bp, E. coli
tattcaacgtaaattggcccctgga

SEQ ID NO: 151075 - DNA, 25 bp, E. coli
tgtattgccaattcccgccaggtaa

SEQ ID NO: 151076 - DNA, 25 bp, E. coli
tgtattgccaatacccgccaggtaa

SEQ ID NO: 151077 - DNA, 25 bp, E. coli
tcatgccttagaggattcagtacgc

SEQ ID NO: 151078 - DNA, 25 bp, E. coli
tcatgccttagacgattcagtacgc

SEQ ID NO: 151079 - DNA, 25 bp, E. coli
gcaattgatcaaccctgggcaggta

SEQ ID NO: 151080 - DNA, 25 bp, E. coli
gcaattgatcaagcctgggcaggta

SEQ ID NO: 151081 - DNA, 25 bp, E. coli
gacttttgctgtaccgatcacggga

SEQ ID NO: 151082 - DNA, 25 bp, E. coli
gacttttgctgttccgatcacggga

SEQ ID NO: 151083 - DNA, 25 bp, E. coli
cgtaatgctccccaatcgttgcctg

SEQ ID NO: 151084 - DNA, 25 bp, E. coli
ccctggagccatgcgacgtaatgct

SEQ ID NO: 151085 - DNA, 25 bp, E. coli
cgttaaaaaatctcagctccggtct

SEQ ID NO: 151086 - DNA, 25 bp, E. coli
ccctggagccatccgacgtaatgct

SEQ ID NO: 151087 - DNA, 25 bp, E. coli
cgtaatgctcccgaatcgttgcctg

SEQ ID NO: 151088 - DNA, 25 bp, E. coli
cgttaaaaaatcacagctccggtct

SEQ ID NO: 151089 - DNA, 25 bp, E. coli
cgatcacgggatgaatgaatggcta

SEQ ID NO: 151090 - DNA, 25 bp, E. coli
cgatcacgggatcaatgaatggcta

SEQ ID NO: 151091 - DNA, 25 bp, E. coli
gatgcagtctatcgcacaatgtcca

SEQ ID NO: 151092 - DNA, 25 bp, E. coli
gatgcagtctatggcacaatgtcca

SEQ ID NO: 151093 - DNA, 25 bp, E. coli
accttcgttgcgctgccgcattatg

SEQ ID NO: 151094 - DNA, 25 bp, E. coli
accttcgttgcggtgccgcattatg

SEQ ID NO: 151095 - DNA, 25 bp, E. coli
tgcgctgccgcattatgtgcgctta

SEQ ID NO: 151096 - DNA, 25 bp, E. coli
tgcgctgccgcaatatgtgcgctta

SEQ ID NO: 151097 - DNA, 25 bp, E. coli
gctgccgcattatgtgcgcttaacc

SEQ ID NO: 151098 - DNA, 25 bp, E. coli
gctggcgctaaccttcgttgcgctg

SEQ ID NO: 151099 - DNA, 25 bp, E. coli
gcgctgccgcataatgtgcgcttaa

SEQ ID NO: 151100 - DNA, 25 bp, E. coli
gcgctgccgcattatgtgcgcttaa

SEQ ID NO: 151101 - DNA, 25 bp, E. coli
gctaaccttcgtagcgctgccgcat

SEQ ID NO: 151102 - DNA, 25 bp, E. coli
gctggcgctaacgttcgttgcgctg

SEQ ID NO: 151103 - DNA, 25 bp, E. coli
gctgccgcattaagtgcgcttaacc

SEQ ID NO: 151104 - DNA, 25 bp, E. coli
gctaaccttcgttgcgctgccgcat

SEQ ID NO: 151105 - DNA, 25 bp, E. coli
gcactgatgacgtggggcgtgatgt

SEQ ID NO: 151106 - DNA, 25 bp, E. coli
gcactgatgacgaggggcgtgatgt

SEQ ID NO: 151107 - DNA, 25 bp, E. coli
cgcgctggcgctaaccttcgttgcg

SEQ ID NO: 151108 - DNA, 25 bp, E. coli
cgcgctggcgcttaccttcgttgcg

SEQ ID NO: 151109 - DNA, 25 bp, E. coli
cttcgttgcgctgccgcattatgtg

SEQ ID NO: 151110 - DNA, 25 bp, E. coli
cttcgttgcgctcccgcattatgtg

SEQ ID NO: 151111 - DNA, 25 bp, E. coli
gttgcgctgccggattatgtgcgct

SEQ ID NO: 151112 - DNA, 25 bp, E. coli
gttgcgctgccgcattatgtgcgct

SEQ ID NO: 151113 - DNA, 25 bp, E. coli
ggcgctaaccttggttgcgctgccg

SEQ ID NO: 151114 - DNA, 25 bp, E. coli
ggcgctaaccttcgttgcgctgccg

SEQ ID NO: 151115 - DNA, 25 bp, E. coli
ttgtggcggatcacaaagccaaagg

SEQ ID NO: 151116 - DNA, 25 bp, E. coli
ttgtggcggatctcaaagccaaagg

SEQ ID NO: 151117 - DNA, 25 bp, E. coli
tgatgacgtgatgggcgaaagcctc

SEQ ID NO: 151118 - DNA, 25 bp, E. coli
tgctgccaggaattgtggcggatct

SEQ ID NO: 151119 - DNA, 25 bp, E. coli
tgatgacgtgatcggcgaaagcctc

SEQ ID NO: 151120 - DNA, 25 bp, E. coli
tgctgggtaaagacggcaaaccgtt

SEQ ID NO: 151121 - DNA, 25 bp, E. coli
tgctgccaggaaatgtggcggatct

SEQ ID NO: 151122 - DNA, 25 bp, E. coli
tgctgggtaaagtcggcaaaccgtt

SEQ ID NO: 151123 - DNA, 25 bp, E. coli
gccaggaattgtcgcggatctcaaa

SEQ ID NO: 151124 - DNA, 25 bp, E. coli
gccaggaattgtggcggatctcaaa

SEQ ID NO: 151125 - DNA, 25 bp, E. coli
gcatgatgctgggtaaagacggcaa

SEQ ID NO: 151126 - DNA, 25 bp, E. coli
gcatgatgctggctaaagacggcaa

SEQ ID NO: 151127 - DNA, 25 bp, E. coli
gaattgtggcggatctcaaagccaa

SEQ ID NO: 151128 - DNA, 25 bp, E. coli
gaattgtggcggttctcaaagccaa

SEQ ID NO: 151129 - DNA, 25 bp, E. coli
cccgcgcgggtggtacagtgaaact

SEQ ID NO: 151130 - DNA, 25 bp, E. coli
cccgcgcgggtgctacagtgaaact

SEQ ID NO: 151131 - DNA, 25 bp, E. coli
tgatgggcgaaagcctctacaaccc

SEQ ID NO: 151132 - DNA, 25 bp, E. coli
gggtggtacagtgaaactggccgat

SEQ ID NO: 151133 - DNA, 25 bp, E. coli
gggtggtacagtcaaactggccgat

SEQ ID NO: 151134 - DNA, 25 bp, E. coli
tgatgggcgaaaccctctacaaccc

SEQ ID NO: 151135 - DNA, 25 bp, E. coli
gacgtgatgggcgaaagcctctaca

SEQ ID NO: 151136 - DNA, 25 bp, E. coli
gacgtgatgggccaaagcctctaca

SEQ ID NO: 151137 - DNA, 25 bp, E. coli
caagtgttgatctgagtaaaggcca

SEQ ID NO: 151138 - DNA, 25 bp, E. coli
caagtgttgatcagagtaaaggcca

SEQ ID NO: 151139 - DNA, 25 bp, E. coli
cagagtctggtgtcggcacggttaa

SEQ ID NO: 151140 - DNA, 25 bp, E. coli
cagagtctggtgacggcacggttaa

SEQ ID NO: 151141 - DNA, 25 bp, E. coli
tatgataacagctataccctggtcg

SEQ ID NO: 151142 - DNA, 25 bp, E. coli
tatgataacagcaataccctggtcg

SEQ ID NO: 151143 - DNA, 25 bp, E. coli
ttctgttagcactgaagcgggcgcg

SEQ ID NO: 151144 - DNA, 25 bp, E. coli
ttacaggcgagatcgtggattcacc

SEQ ID NO: 151145 - DNA, 25 bp, E. coli
ttacaggcgagaacgtggattcacc

SEQ ID NO: 151146 - DNA, 25 bp, E. coli
ttctgttagcacagaagcgggcgcg

SEQ ID NO: 151147 - DNA, 25 bp, E. coli
tgcggttggtgagaaatccccggca

SEQ ID NO: 151148 - DNA, 25 bp, E. coli
tgcggttggtgacaaatccccggca

SEQ ID NO: 151149 - DNA, 25 bp, E. coli
tgactctcagaagcaggaagttgtg

SEQ ID NO: 151150 - DNA, 25 bp, E. coli
tgactctcagaaccaggaagttgtg

SEQ ID NO: 151151 - DNA, 25 bp, E. coli
gaagattgcgataccaccacgatga

SEQ ID NO: 151152 - DNA, 25 bp, E. coli
gaagattgcgattccaccacgatga

SEQ ID NO: 151153 - DNA, 25 bp, E. coli
cgtttttgccttaaccgcactggcg

SEQ ID NO: 151154 - DNA, 25 bp, E. coli
cgtttttgcctttaccgcactggcg

SEQ ID NO: 151155 - DNA, 25 bp, E. coli
gattcaccttgcctactgtccgttg

SEQ ID NO: 151156 - DNA, 25 bp, E. coli
gattcaccttgcgtactgtccgttg

SEQ ID NO: 151157 - DNA, 25 bp, E. coli
taacgaccggttacggcaatgcgca

SEQ ID NO: 151158 - DNA, 25 bp, E. coli
taacgaccggtttcggcaatgcgca

SEQ ID NO: 151159 - DNA, 25 bp, E. coli
aactggcggcgctgattggcgaaaa

SEQ ID NO: 151160 - DNA, 25 bp, E. coli
tactggtggcaactgacatcgctgc

SEQ ID NO: 151161 - DNA, 25 bp, E. coli
tactggtggcaagtgacatcgctgc

SEQ ID NO: 151162 - DNA, 25 bp, E. coli
aactggcggcgcagattggcgaaaa

SEQ ID NO: 151163 - DNA, 25 bp, E. coli
tattcagcagcaggcgatccctgcg

SEQ ID NO: 151164 - DNA, 25 bp, E. coli
tattcagcagcacgcgatccctgcg

SEQ ID NO: 151165 - DNA, 25 bp, E. coli
tgttgatgaacagaaactgctgcgt

SEQ ID NO: 151166 - DNA, 25 bp, E. coli
tgttgatgaacacaaactgctgcgt

SEQ ID NO: 151167 - DNA, 25 bp, E. coli
tctgacgatattaaagccctggcgg

SEQ ID NO: 151168 - DNA, 25 bp, E. coli
tctgacgatatttaagccctggcgg

SEQ ID NO: 151169 - DNA, 25 bp, E. coli
gaagctgaccgcatgctcgacatgg

SEQ ID NO: 151170 - DNA, 25 bp, E. coli
gaagctgaccgcttgctcgacatgg

SEQ ID NO: 151171 - DNA, 25 bp, E. coli
gaaaaactgttggacaacccgctgg

SEQ ID NO: 151172 - DNA, 25 bp, E. coli
gaaaacgtccgtcattacagcaaat

SEQ ID NO: 151173 - DNA, 25 bp, E. coli
gaaaacgtccgtgattacagcaaat

SEQ ID NO: 151174 - DNA, 25 bp, E. coli
gaaaaactgttgcacaacccgctgg

SEQ ID NO: 151175 - DNA, 25 bp, E. coli
cgttgccgagcacggttaccgtgaa

SEQ ID NO: 151176 - DNA, 25 bp, E. coli
cgttgccgagcagggttaccgtgaa

SEQ ID NO: 151177 - DNA, 25 bp, E. coli
gatatccgtcgcctgttaacaaaac

SEQ ID NO: 151178 - DNA, 25 bp, E. coli
gatatccgtcgcgtgttaacaaaac

SEQ ID NO: 151179 - DNA, 25 bp, E. coli
ggtttaagccctcatatcctgcgcg

SEQ ID NO: 151180 - DNA, 25 bp, E. coli
ggtttaagccctgatatcctgcgcg

SEQ ID NO: 151181 - DNA, 25 bp, E. coli
ttttgtgaccgagttgagccagccg

SEQ ID NO: 151182 - DNA, 25 bp, E. coli
ttttgtgaccgacttgagccagccg

SEQ ID NO: 151183 - DNA, 25 bp, E. coli
tgtacgacgcgtatcgtgactggtg

SEQ ID NO: 151184 - DNA, 25 bp, E. coli
tgtacgacgcgtttcgtgactggtg

SEQ ID NO: 151185 - DNA, 25 bp, E. coli
tgcagtgccgtttaagtgggtatcg

SEQ ID NO: 151186 - DNA, 25 bp, E. coli
tgaaggtgttctccagcgtatccgt

SEQ ID NO: 151187 - DNA, 25 bp, E. coli
tgaaggtgttctgcagcgtatccgt

SEQ ID NO: 151188 - DNA, 25 bp, E. coli
tgcagtgccgttaaagtgggtatcg

SEQ ID NO: 151189 - DNA, 25 bp, E. coli
tctcacggtcacactgaaggtgttc

SEQ ID NO: 151190 - DNA, 25 bp, E. coli
tctcacggtcactctgaaggtgttc

SEQ ID NO: 151191 - DNA, 25 bp, E. coli
gaatctggcgtggtaaccgatccgc

SEQ ID NO: 151192 - DNA, 25 bp, E. coli
gaatctggcgtgctaaccgatccgc

SEQ ID NO: 151193 - DNA, 25 bp, E. coli
gatcaccgccgtagctgatgcagta

SEQ ID NO: 151194 - DNA, 25 bp, E. coli
gatcaccgccgttgctgatgcagta

SEQ ID NO: 151195 - DNA, 25 bp, E. coli
gtgaaactcgcgctaaatatcctga

SEQ ID NO: 151196 - DNA, 25 bp, E. coli
gtgaaactcgcggtaaatatcctga

SEQ ID NO: 151197 - DNA, 25 bp, E. coli
ggcggtatccgtttctcaggcgata

SEQ ID NO: 151198 - DNA, 25 bp, E. coli
ggctttgctggcaacccggttgtta

SEQ ID NO: 151199 - DNA, 25 bp, E. coli
ggcggtatccgtatctcaggcgata

SEQ ID NO: 151200 - DNA, 25 bp, E. coli
ggctttgctggctacccggttgtta

SEQ ID NO: 151201 - DNA, 25 bp, E. coli
gagatattgcccttgctacgtatcg

SEQ ID NO: 151202 - DNA, 25 bp, E. coli
gagatattgcccatgctacgtatcg

SEQ ID NO: 151203 - DNA, 25 bp, E. coli
acgcgtggcactcagggagttttcc

SEQ ID NO: 151204 - DNA, 25 bp, E. coli
acgcgtggcactgagggagttttcc

SEQ ID NO: 151205 - DNA, 25 bp, E. coli
tattgcattgcggagaaacgcgtgg

SEQ ID NO: 151206 - DNA, 25 bp, E. coli
tattgcattgcgcagaaacgcgtgg

SEQ ID NO: 151207 - DNA, 25 bp, E. coli
tccttgtacgactgcagcgaagaag

SEQ ID NO: 151208 - DNA, 25 bp, E. coli
tccttgtacgacagcagcgaagaag

SEQ ID NO: 151209 - DNA, 25 bp, E. coli
ccagctgaaggcctgtgattgcgat

SEQ ID NO: 151210 - DNA, 25 bp, E. coli
ccagctgaaggcgtgtgattgcgat

SEQ ID NO: 151211 - DNA, 25 bp, E. coli
gaatgtccgtcatattgcattgcgc

SEQ ID NO: 151212 - DNA, 25 bp, E. coli
gaatgtccgtcaaattgcattgcgc

SEQ ID NO: 151213 - DNA, 25 bp, E. coli
gaaaagctgtttgttaagcgcctga

SEQ ID NO: 151214 - DNA, 25 bp, E. coli
gaaaagctgtttcttaagcgcctga

SEQ ID NO: 151215 - DNA, 25 bp, E. coli
cttctggagcaaaagacgaacggca

SEQ ID NO: 151216 - DNA, 25 bp, E. coli
cttctggagcaatagacgaacggca

SEQ ID NO: 151217 - DNA, 25 bp, E. coli
ggaccctttccctgcttctggagca

SEQ ID NO: 151218 - DNA, 25 bp, E. coli
tggttatccgcctcgaatgtccgtc

SEQ ID NO: 151219 - DNA, 25 bp, E. coli
tggttatccgccacgaatgtccgtc

SEQ ID NO: 151220 - DNA, 25 bp, E. coli
ggaccctttcccagcttctggagca

SEQ ID NO: 151221 - DNA, 25 bp, E. coli
taatcaaagcggatatccacgccca

SEQ ID NO: 151222 - DNA, 25 bp, E. coli
taatcaaagcggttatccacgccca

SEQ ID NO: 151223 - DNA, 25 bp, E. coli
gacgaacggcaattgcagtgcttcc

SEQ ID NO: 151224 - DNA, 25 bp, E. coli
gacgaacggcaaatgcagtgcttcc

SEQ ID NO: 151225 - DNA, 25 bp, E. coli
cagataaaaacgcattgaacctcga

SEQ ID NO: 151226 - DNA, 25 bp, E. coli
cagataaaaacggattgaacctcga

SEQ ID NO: 151227 - DNA, 25 bp, E. coli
taaaagcagaaatttatctgtttcc

SEQ ID NO: 151228 - DNA, 25 bp, E. coli
tacacttcctcaaaataattgcaca

SEQ ID NO: 151229 - DNA, 25 bp, E. coli
taaaagcagaaaattatctgtttcc

SEQ ID NO: 151230 - DNA, 25 bp, E. coli
tacacttcctcataataattgcaca

SEQ ID NO: 151231 - DNA, 25 bp, E. coli
tgttcatataaaacttaaaagcaga

SEQ ID NO: 151232 - DNA, 25 bp, E. coli
tgttcatataaatcttaaaagcaga

SEQ ID NO: 151233 - DNA, 25 bp, E. coli
tgaacctcgaataacgttgtctagt

SEQ ID NO: 151234 - DNA, 25 bp, E. coli
tgaacctcgaattacgttgtctagt

SEQ ID NO: 151235 - DNA, 25 bp, E. coli
gaagttgcttcacataaaaacgcat

SEQ ID NO: 151236 - DNA, 25 bp, E. coli
gaatgacatgctcttttattgttca

SEQ ID NO: 151237 - DNA, 25 bp, E. coli
gaatgacatgctgttttattgttca

SEQ ID NO: 151238 - DNA, 25 bp, E. coli
gaagttgcttcagataaaaacgcat

SEQ ID NO: 151239 - DNA, 25 bp, E. coli
cgttgtctagtaacacgaattaggg

SEQ ID NO: 151240 - DNA, 25 bp, E. coli
cgttgtctagtatcacgaattaggg

SEQ ID NO: 151241 - DNA, 25 bp, E. coli
cttattggtatagtgaagttgcttc

SEQ ID NO: 151242 - DNA, 25 bp, E. coli
tcggtgaatacccttacttattggt

SEQ ID NO: 151243 - DNA, 25 bp, E. coli
cttattggtatactgaagttgcttc

SEQ ID NO: 151244 - DNA, 25 bp, E. coli
tcggtgaataccgttacttattggt

SEQ ID NO: 151245 - DNA, 25 bp, E. coli
gagtacaaaatttctacacttcctc

SEQ ID NO: 151246 - DNA, 25 bp, E. coli
gagtacaaaattactacacttcctc

SEQ ID NO: 151247 - DNA, 25 bp, E. coli
caggcttgccgtgttgtgaggtacc

SEQ ID NO: 151248 - DNA, 25 bp, E. coli
caggcttgccgtcttgtgaggtacc

SEQ ID NO: 151249 - DNA, 25 bp, E. coli
atcccgggaggtacgagtattgccg

SEQ ID NO: 151250 - DNA, 25 bp, E. coli
atcccgggaggttcgagtattgccg

SEQ ID NO: 151251 - DNA, 25 bp, E. coli
tatgcagcggagtctgaagcgccgc

SEQ ID NO: 151252 - DNA, 25 bp, E. coli
tatgcagcggagactgaagcgccgc

SEQ ID NO: 151253 - DNA, 25 bp, E. coli
ttctttcctctgatatgccatcacc

SEQ ID NO: 151254 - DNA, 25 bp, E. coli
ttctttcctctgttatgccatcacc

SEQ ID NO: 151255 - DNA, 25 bp, E. coli
tgttgtgaggtagccggatattatc

SEQ ID NO: 151256 - DNA, 25 bp, E. coli
tgttgtgaggtacccggatattatc

SEQ ID NO: 151257 - DNA, 25 bp, E. coli
tgaagcgccgcattgcaggcttgcc

SEQ ID NO: 151258 - DNA, 25 bp, E. coli
tgaagcgccgcaatgcaggcttgcc

SEQ ID NO: 151259 - DNA, 25 bp, E. coli
tgccgtgttgtgtggtacccggata

SEQ ID NO: 151260 - DNA, 25 bp, E. coli
tgccgtgttgtgaggtacccggata

SEQ ID NO: 151261 - DNA, 25 bp, E. coli
cctggacagtatccagcggagactg

SEQ ID NO: 151262 - DNA, 25 bp, E. coli
cctggacagtatgcagcggagactg

SEQ ID NO: 151263 - DNA, 25 bp, E. coli
gctcacctggacagtatgcagcgga

SEQ ID NO: 151264 - DNA, 25 bp, E. coli
gctcacctggactgtatgcagcgga

SEQ ID NO: 151265 - DNA, 25 bp, E. coli
gcggagactgaagcgccgcaatgca

SEQ ID NO: 151266 - DNA, 25 bp, E. coli
gcggagactgaaccgccgcaatgca

SEQ ID NO: 151267 - DNA, 25 bp, E. coli
gacattttctttgctctgttatgcc

SEQ ID NO: 151268 - DNA, 25 bp, E. coli
gacattttctttcctctgttatgcc

SEQ ID NO: 151269 - DNA, 25 bp, E. coli
cactaccggcttagatgtcgatctg

SEQ ID NO: 151270 - DNA, 25 bp, E. coli
cactaccggctttgatgtcgatctg

SEQ ID NO: 151271 - DNA, 25 bp, E. coli
cagactacgcaatgacagccgctga

SEQ ID NO: 151272 - DNA, 25 bp, E. coli
cagactacgcaaagacagccgctga

SEQ ID NO: 151273 - DNA, 25 bp, E. coli
gcgattggcgctctcctgagtgaaa

SEQ ID NO: 151274 - DNA, 25 bp, E. coli
gcgattggcgctgtcctgagtgaaa

SEQ ID NO: 151275 - DNA, 25 bp, E. coli
gaaatcaaggtggagctgctgccga

SEQ ID NO: 151276 - DNA, 25 bp, E. coli
gaaatcaaggtgcagctgctgccga

SEQ ID NO: 151277 - DNA, 25 bp, E. coli
cccgctgtggcgagaaaaaagacaa

SEQ ID NO: 151278 - DNA, 25 bp, E. coli
cccgctgtggcgtgaaaaaagacaa

SEQ ID NO: 151279 - DNA, 25 bp, E. coli
ctgatgtacgtgatgctgtggcgca

SEQ ID NO: 151280 - DNA, 25 bp, E. coli
ctgatgtacgtgttgctgtggcgca

SEQ ID NO: 151281 - DNA, 25 bp, E. coli
gtaaccgcaacgtgcagaccgtgct

SEQ ID NO: 151282 - DNA, 25 bp, E. coli
gtaaccgcaacgagcagaccgtgct

SEQ ID NO: 151283 - DNA, 25 bp, E. coli
tcacgggcgcgtctgcataaagcga

SEQ ID NO: 151284 - DNA, 25 bp, E. coli
tcacgggcgcgtgtgcataaagcga

SEQ ID NO: 151285 - DNA, 25 bp, E. coli
tcaagggcgttcagtccacggtcaa

SEQ ID NO: 151286 - DNA, 25 bp, E. coli
tcaagggcgttctgtccacggtcaa

SEQ ID NO: 151287 - DNA, 25 bp, E. coli
gagtgaaagtaatccggcttccgcc

SEQ ID NO: 151288 - DNA, 25 bp, E. coli
gaggcgctcaacaggatgacgtgct

SEQ ID NO: 151289 - DNA, 25 bp, E. coli
gaggcgctcaactggatgacgtgct

SEQ ID NO: 151290 - DNA, 25 bp, E. coli
gagtgaaagtaaaccggcttccgcc

SEQ ID NO: 151291 - DNA, 25 bp, E. coli
caacagccgcccagcaaatgggcaa

SEQ ID NO: 151292 - DNA, 25 bp, E. coli
caacagccgccctgcaaatgggcaa

SEQ ID NO: 151293 - DNA, 25 bp, E. coli
caggatgatgcgctgtttcccaatc

SEQ ID NO: 151294 - DNA, 25 bp, E. coli
caggatgatgcggtgtttcccaatc

SEQ ID NO: 151295 - DNA, 25 bp, E. coli
agccgccctgcatatgggcaatgaa

SEQ ID NO: 151296 - DNA, 25 bp, E. coli
agccgccctgcaaatgggcaatgaa

SEQ ID NO: 151297 - DNA, 25 bp, E. coli
aaaacgccgtagagatcccaacagc

SEQ ID NO: 151298 - DNA, 25 bp, E. coli
aaaacgccgtagtgatcccaacagc

SEQ ID NO: 151299 - DNA, 25 bp, E. coli
tgataccaccgggatcgtggtgatc

SEQ ID NO: 151300 - DNA, 25 bp, E. coli
tgataccaccggcatcgtggtgatc

SEQ ID NO: 151301 - DNA, 25 bp, E. coli
gctgtttcccaatcagtttgttaac

SEQ ID NO: 151302 - DNA, 25 bp, E. coli
gctgtttcccaaacagtttgttaac

SEQ ID NO: 151303 - DNA, 25 bp, E. coli
cgatcgcgtggtgacagacggcatt

SEQ ID NO: 151304 - DNA, 25 bp, E. coli
cgcgtggtgacagacggcattgatc

SEQ ID NO: 151305 - DNA, 25 bp, E. coli
cgatcgcgtggtcacagacggcatt

SEQ ID NO: 151306 - DNA, 25 bp, E. coli
cgcgtggtgacacacggcattgatc

SEQ ID NO: 151307 - DNA, 25 bp, E. coli
ggatcgtggtgaacacccagacgca

SEQ ID NO: 151308 - DNA, 25 bp, E. coli
ggatcgtggtgatcacccagacgca

SEQ ID NO: 151309 - DNA, 25 bp, E. coli
tccagtggtgattccaccgggatcg

SEQ ID NO: 151310 - DNA, 25 bp, E. coli
tccagtggtgataccaccgggatcg

SEQ ID NO: 151311 - DNA, 25 bp, E. coli
tcacccagacgcatcctatcgattt

SEQ ID NO: 151312 - DNA, 25 bp, E. coli
tcacccagacgcttcctatcgattt

SEQ ID NO: 151313 - DNA, 25 bp, E. coli
caactcaaggtgctctccatgggaa

SEQ ID NO: 151314 - DNA, 25 bp, E. coli
caactcaaggtggtctccatgggaa

SEQ ID NO: 151315 - DNA, 25 bp, E. coli
tactgcctgcgagcggaaataggga

SEQ ID NO: 151316 - DNA, 25 bp, E. coli
tactgcctgcgaccggaaataggga

SEQ ID NO: 151317 - DNA, 25 bp, E. coli
aaagcagtgatctaagctcgtcgcg

SEQ ID NO: 151318 - DNA, 25 bp, E. coli
aaagcagtgatcaaagctcgtcgcg

SEQ ID NO: 151319 - DNA, 25 bp, E. coli
tcgtcgcgaggcaaaacgtgtgctg

SEQ ID NO: 151320 - DNA, 25 bp, E. coli
tcgtcgcgaggctaaacgtgtgctg

SEQ ID NO: 151321 - DNA, 25 bp, E. coli
gaaggtggaaattgcgccgttcgcc

SEQ ID NO: 151322 - DNA, 25 bp, E. coli
gaatcggtcaccacgcttgtgcaga

SEQ ID NO: 151323 - DNA, 25 bp, E. coli
gaaggtggaaatagcgccgttcgcc

SEQ ID NO: 151324 - DNA, 25 bp, E. coli
gaatcggtcacctcgcttgtgcaga

SEQ ID NO: 151325 - DNA, 25 bp, E. coli
gactgccgcgcatatgaaaatgttt

SEQ ID NO: 151326 - DNA, 25 bp, E. coli
gacaggattatcgtcacccgtccag

SEQ ID NO: 151327 - DNA, 25 bp, E. coli
gacaggattatcctcacccgtccag

SEQ ID NO: 151328 - DNA, 25 bp, E. coli
gactgccgcgcaaatgaaaatgttt

SEQ ID NO: 151329 - DNA, 25 bp, E. coli
taagcagcgtgaagaagaatcggtc

SEQ ID NO: 151330 - DNA, 25 bp, E. coli
taagtgacgcgctggaacgtttcga

SEQ ID NO: 151331 - DNA, 25 bp, E. coli
taagcagctgattttcgccacgggc

SEQ ID NO: 151332 - DNA, 25 bp, E. coli
taagtgacgcgcaggaacgtttcga

SEQ ID NO: 151333 - DNA, 25 bp, E. coli
taagcagctgatattcgccacgggc

SEQ ID NO: 151334 - DNA, 25 bp, E. coli
taagcagcgtgatgaagaatcggtc

SEQ ID NO: 151335 - DNA, 25 bp, E. coli
cagcacaggacagcaatgaagcgac

SEQ ID NO: 151336 - DNA, 25 bp, E. coli
caggacagcaatcaagcgacttaaa

SEQ ID NO: 151337 - DNA, 25 bp, E. coli
cagcacaggacaccaatgaagcgac

SEQ ID NO: 151338 - DNA, 25 bp, E. coli
caggacagcaatgaagcgacttaaa

SEQ ID NO: 151339 - DNA, 25 bp, E. coli
tattcagccaggacgctttgttttg

SEQ ID NO: 151340 - DNA, 25 bp, E. coli
tattcagccaggtcgctttgttttg

SEQ ID NO: 151341 - DNA, 25 bp, E. coli
ttttgcctggcgatatggcaggagc

SEQ ID NO: 151342 - DNA, 25 bp, E. coli
ttttgcctggcgttatggcaggagc

SEQ ID NO: 151343 - DNA, 25 bp, E. coli
tgttcaggcgacgaccggcggaatt

SEQ ID NO: 151344 - DNA, 25 bp, E. coli
tgttcaggcgaccaccggcggaatt

SEQ ID NO: 151345 - DNA, 25 bp, E. coli
gaatcacttcctccgttttgaccgc

SEQ ID NO: 151346 - DNA, 25 bp, E. coli
gaatcacttcctgcgttttgaccgc

SEQ ID NO: 151347 - DNA, 25 bp, E. coli
cttcctgcgttttgaccgccagatt

SEQ ID NO: 151348 - DNA, 25 bp, E. coli
cttcctgcgtttagaccgccagatt

SEQ ID NO: 151349 - DNA, 25 bp, E. coli
gtctgttcaggccaccaccggcgga

SEQ ID NO: 151350 - DNA, 25 bp, E. coli
gttctataagaaacacttcctgcgt

SEQ ID NO: 151351 - DNA, 25 bp, E. coli
gtctgttcaggcgaccaccggcgga

SEQ ID NO: 151352 - DNA, 25 bp, E. coli
gttctataagaatcacttcctgcgt

SEQ ID NO: 151353 - DNA, 25 bp, E. coli
tggcgatatggcaggagcgcccgcg

SEQ ID NO: 151354 - DNA, 25 bp, E. coli
ggacgctttgttatgcctggcgata

SEQ ID NO: 151355 - DNA, 25 bp, E. coli
tggcgatatggctggagcgcccgcg

SEQ ID NO: 151356 - DNA, 25 bp, E. coli
ggacgctttgttttgcctggcgata

SEQ ID NO: 151357 - DNA, 25 bp, E. coli
catttccgttatgctgccaggactt

SEQ ID NO: 151358 - DNA, 25 bp, E. coli
catttccgttatcctgccaggactt

SEQ ID NO: 151359 - DNA, 25 bp, E. coli
tttccgttatcctgccaggacttgt

SEQ ID NO: 151360 - DNA, 25 bp, E. coli
tgatcgccatttccgttatcctgcc

SEQ ID NO: 151361 - DNA, 25 bp, E. coli
tgatcgccatttgcgttatcctgcc

SEQ ID NO: 151362 - DNA, 25 bp, E. coli
tttccgttatccagccaggacttgt

SEQ ID NO: 151363 - DNA, 25 bp, E. coli
tcgccatttccgatatcctgccagg

SEQ ID NO: 151364 - DNA, 25 bp, E. coli
tcgccatttccgttatcctgccagg

SEQ ID NO: 151365 - DNA, 25 bp, E. coli
gccatttccgttatcctgccaggac

SEQ ID NO: 151366 - DNA, 25 bp, E. coli
gccatttccgttttcctgccaggac

SEQ ID NO: 151367 - DNA, 25 bp, E. coli
gcgcgagctgatcgccatttccgtt

SEQ ID NO: 151368 - DNA, 25 bp, E. coli
gcgcgagctgatggccatttccgtt

SEQ ID NO: 151369 - DNA, 25 bp, E. coli
gctgatcgccatatccgttatcctg

SEQ ID NO: 151370 - DNA, 25 bp, E. coli
gctgatcgccatttccgttatcctg

SEQ ID NO: 151371 - DNA, 25 bp, E. coli
cgccatttccgttatcctgccagga

SEQ ID NO: 151372 - DNA, 25 bp, E. coli
cgttatcctgcctggacttgttgac

SEQ ID NO: 151373 - DNA, 25 bp, E. coli
cgagctgatcgccatttccgttatc

SEQ ID NO: 151374 - DNA, 25 bp, E. coli
cgttatcctgccaggacttgttgac

SEQ ID NO: 151375 - DNA, 25 bp, E. coli
cgagctgatcgcgatttccgttatc

SEQ ID NO: 151376 - DNA, 25 bp, E. coli
cgccatttccgtaatcctgccagga

SEQ ID NO: 151377 - DNA, 25 bp, E. coli
gagctgatcgccatttccgttatcc

SEQ ID NO: 151378 - DNA, 25 bp, E. coli
gagctgatcgccttttccgttatcc

SEQ ID NO: 151379 - DNA, 25 bp, E. coli
aaagttgcgccatgattgtcgccgc

SEQ ID NO: 151380 - DNA, 25 bp, E. coli
aaagttgcgccaagattgtcgccgc

SEQ ID NO: 151381 - DNA, 25 bp, E. coli
taccgccaggtgcttgagcaaaacg

SEQ ID NO: 151382 - DNA, 25 bp, E. coli
taccgccaggtggttgagcaaaacg

SEQ ID NO: 151383 - DNA, 25 bp, E. coli
tgggtgatcctcacttccggtgtcg

SEQ ID NO: 151384 - DNA, 25 bp, E. coli
tgggtgatcctctcttccggtgtcg

SEQ ID NO: 151385 - DNA, 25 bp, E. coli
tcgacgaaatgatggctaaacgccg

SEQ ID NO: 151386 - DNA, 25 bp, E. coli
tcgacgaaatgaaggctaaacgccg

SEQ ID NO: 151387 - DNA, 25 bp, E. coli
gctacagatcaaacaagacggtggc

SEQ ID NO: 151388 - DNA, 25 bp, E. coli
gctacagatcaatcaagacggtggc

SEQ ID NO: 151389 - DNA, 25 bp, E. coli
gaacaagcgatcatcgatgccgcca

SEQ ID NO: 151390 - DNA, 25 bp, E. coli
gacgaaaaactgatcccgcgtgccg

SEQ ID NO: 151391 - DNA, 25 bp, E. coli
gaacaagcgatcttcgatgccgcca

SEQ ID NO: 151392 - DNA, 25 bp, E. coli
gacgaaaaactgttcccgcgtgccg

SEQ ID NO: 151393 - DNA, 25 bp, E. coli
cgtagtgatgaagatgcgcagcaac

SEQ ID NO: 151394 - DNA, 25 bp, E. coli
cgtagtgatgaacatgcgcagcaac

SEQ ID NO: 151395 - DNA, 25 bp, E. coli
ggtggcaaagccttaaaactgctgg

SEQ ID NO: 151396 - DNA, 25 bp, E. coli
ggtggcaaagccataaaactgctgg

SEQ ID NO: 151397 - DNA, 25 bp, E. coli
ggcgctgacctcaacaaagttgaaa

SEQ ID NO: 151398 - DNA, 25 bp, E. coli
ggcgctgacctctacaaagttgaaa

SEQ ID NO: 151399 - DNA, 25 bp, E. coli
gatgagttcattgctggcaacggta

SEQ ID NO: 151400 - DNA, 25 bp, E. coli
gatgagttcattcctggcaacggta

SEQ ID NO: 151401 - DNA, 25 bp, E. coli
caaacaacagctgggtgccatagag

SEQ ID NO: 151402 - DNA, 25 bp, E. coli
caaacaacagctcggtgccatagag

SEQ ID NO: 151403 - DNA, 25 bp, E. coli
cagaaatactggttcgcctgcgcca

SEQ ID NO: 151404 - DNA, 25 bp, E. coli
cagaaatactggatcgcctgcgcca

SEQ ID NO: 151405 - DNA, 25 bp, E. coli
tcttgatgagctcaaaagtgcccgg

SEQ ID NO: 151406 - DNA, 25 bp, E. coli
tcttgatgagctgaaaagtgcccgg

SEQ ID NO: 151407 - DNA, 25 bp, E. coli
gagcgaagtttacgcaggcctcctt

SEQ ID NO: 151408 - DNA, 25 bp, E. coli
gagcgaagtttaggcaggcctcctt

SEQ ID NO: 151409 - DNA, 25 bp, E. coli
gattgccggtcccaaaggaaagccg

SEQ ID NO: 151410 - DNA, 25 bp, E. coli
cggaacctgatgacacccttcggga

SEQ ID NO: 151411 - DNA, 25 bp, E. coli
gattgccggtccgaaaggaaagccg

SEQ ID NO: 151412 - DNA, 25 bp, E. coli
cggaacctgatgtcacccttcggga

SEQ ID NO: 151413 - DNA, 25 bp, E. coli
gggtttccaccgcaaccgaagattg

SEQ ID NO: 151414 - DNA, 25 bp, E. coli
ggaacatctgcggtttgccacaggg

SEQ ID NO: 151415 - DNA, 25 bp, E. coli
gggtttccaccggaaccgaagattg

SEQ ID NO: 151416 - DNA, 25 bp, E. coli
ggaacatctgcgctttgccacaggg

SEQ ID NO: 151417 - DNA, 25 bp, E. coli
taatcccagacgcaacagagcgaag

SEQ ID NO: 151418 - DNA, 25 bp, E. coli
taatcccagacggaacagagcgaag

SEQ ID NO: 151419 - DNA, 25 bp, E. coli
gatgatatctgctccagctgtccgt

SEQ ID NO: 151420 - DNA, 25 bp, E. coli
gatgatatctgcaccagctgtccgt

SEQ ID NO: 151421 - DNA, 25 bp, E. coli
gaccagaggctacgaggacgatcat

SEQ ID NO: 151422 - DNA, 25 bp, E. coli
gaccagaggctaggaggacgatcat

SEQ ID NO: 151423 - DNA, 25 bp, E. coli
aaggttactggcaaccgcaagtggc

SEQ ID NO: 151424 - DNA, 25 bp, E. coli
caatgacggcagagcgagaagtacc

SEQ ID NO: 151425 - DNA, 25 bp, E. coli
caatgacggcagtgcgagaagtacc

SEQ ID NO: 151426 - DNA, 25 bp, E. coli
aaggttactggctaccgcaagtggc

SEQ ID NO: 151427 - DNA, 25 bp, E. coli
aacactttcacactcgctgggcggc

SEQ ID NO: 151428 - DNA, 25 bp, E. coli
aacactttcacagtcgctgggcggc

SEQ ID NO: 151429 - DNA, 25 bp, E. coli
tatgggcggcaatcagtaacgtatc

SEQ ID NO: 151430 - DNA, 25 bp, E. coli
tatgggcggcaaacagtaacgtatc

SEQ ID NO: 151431 - DNA, 25 bp, E. coli
tataacgcgggctttgacgcgccag

SEQ ID NO: 151432 - DNA, 25 bp, E. coli
tataacgcgggcattgacgcgccag

SEQ ID NO: 151433 - DNA, 25 bp, E. coli
tggtgaataacctgccgcaaggcgt

SEQ ID NO: 151434 - DNA, 25 bp, E. coli
tggtgaataaccagccgcaaggcgt

SEQ ID NO: 151435 - DNA, 25 bp, E. coli
tctaaagatgacaacggcgaaggcg

SEQ ID NO: 151436 - DNA, 25 bp, E. coli
tcagcggcgatctgtcatacaaaga

SEQ ID NO: 151437 - DNA, 25 bp, E. coli
tctaaagatgactacggcgaaggcg

SEQ ID NO: 151438 - DNA, 25 bp, E. coli
tcagcggcgatcagtcatacaaaga

SEQ ID NO: 151439 - DNA, 25 bp, E. coli
gaaggattgcagtacaccacggtag

SEQ ID NO: 151440 - DNA, 25 bp, E. coli
gaatcccctgcgactgaaactcgaa

SEQ ID NO: 151441 - DNA, 25 bp, E. coli
gaaggattgcagaacaccacggtag

SEQ ID NO: 151442 - DNA, 25 bp, E. coli
gaatcccctgcgtctgaaactcgaa

SEQ ID NO: 151443 - DNA, 25 bp, E. coli
gtgaattcagcgtcaactaccggga

SEQ ID NO: 151444 - DNA, 25 bp, E. coli
gtgaattcagcgacaactaccggga

SEQ ID NO: 151445 - DNA, 25 bp, E. coli
aataacctgatctcggcaattgtcg

SEQ ID NO: 151446 - DNA, 25 bp, E. coli
aataacctgatcacggcaattgtcg

SEQ ID NO: 151447 - DNA, 25 bp, E. coli
taaaaatgaagcctaccgggatgct

SEQ ID NO: 151448 - DNA, 25 bp, E. coli
taaaaatgaagcgtaccgggatgct

SEQ ID NO: 151449 - DNA, 25 bp, E. coli
tacacccgcgatgtctttggcagcg

SEQ ID NO: 151450 - DNA, 25 bp, E. coli
tacacccgcgatctctttggcagcg

SEQ ID NO: 151451 - DNA, 25 bp, E. coli
aactctcgcctggaacgtgatctcg

SEQ ID NO: 151452 - DNA, 25 bp, E. coli
aactctcgcctgcaacgtgatctcg

SEQ ID NO: 151453 - DNA, 25 bp, E. coli
tatggtcatcaattcaacggttccc

SEQ ID NO: 151454 - DNA, 25 bp, E. coli
taccgtcacgcgatgctatgctgaa

SEQ ID NO: 151455 - DNA, 25 bp, E. coli
tatggtcatcaaatcaacggttccc

SEQ ID NO: 151456 - DNA, 25 bp, E. coli
tatgtaggcttgacaaacgggcttc

SEQ ID NO: 151457 - DNA, 25 bp, E. coli
taccgtcacgcgttgctatgctgaa

SEQ ID NO: 151458 - DNA, 25 bp, E. coli
tatgtaggcttgtcaaacgggcttc

SEQ ID NO: 151459 - DNA, 25 bp, E. coli
tgtttaccgactgcactgaagcaga

SEQ ID NO: 151460 - DNA, 25 bp, E. coli
tgtttaccgactccactgaagcaga

SEQ ID NO: 151461 - DNA, 25 bp, E. coli
tgaaaatcaccaattccggtactgg

SEQ ID NO: 151462 - DNA, 25 bp, E. coli
tgaaaatcaccatttccggtactgg

SEQ ID NO: 151463 - DNA, 25 bp, E. coli
gaaagataccaaccagttactggcg

SEQ ID NO: 151464 - DNA, 25 bp, E. coli
gaaagataccaagcagttactggcg

SEQ ID NO: 151465 - DNA, 25 bp, E. coli
tggcaaccattacaacaatccgtcg

SEQ ID NO: 151466 - DNA, 25 bp, E. coli
tggcaaccattagaacaatccgtcg

SEQ ID NO: 151467 - DNA, 25 bp, E. coli
cacggacagcgtatcggtcgtcgta

SEQ ID NO: 151468 - DNA, 25 bp, E. coli
cacggacagcgtttcggtcgtcgta

SEQ ID NO: 151469 - DNA, 25 bp, E. coli
tactgcgatggataaatccaacacc

SEQ ID NO: 151470 - DNA, 25 bp, E. coli
tactcaaagttggtaaagacgcgac

SEQ ID NO: 151471 - DNA, 25 bp, E. coli
tactgcgatggaaaaatccaacacc

SEQ ID NO: 151472 - DNA, 25 bp, E. coli
tactcaaagttgctaaagacgcgac

SEQ ID NO: 151473 - DNA, 25 bp, E. coli
agctgctgtgcagaaactgtttgaa

SEQ ID NO: 151474 - DNA, 25 bp, E. coli
agctgctgtgcacaaactgtttgaa

SEQ ID NO: 151475 - DNA, 25 bp, E. coli
tctgaaaaagcgtctactgcgatgg

SEQ ID NO: 151476 - DNA, 25 bp, E. coli
tcgtcgtagcgagtggaaaaaagct

SEQ ID NO: 151477 - DNA, 25 bp, E. coli
tcgtcgtagcgactggaaaaaagct

SEQ ID NO: 151478 - DNA, 25 bp, E. coli
tctgaaaaagcgactactgcgatgg

SEQ ID NO: 151479 - DNA, 25 bp, E. coli
gaagtcgaagtccttaacaccctgg

SEQ ID NO: 151480 - DNA, 25 bp, E. coli
gaagtcgaagtcgttaacaccctgg

SEQ ID NO: 151481 - DNA, 25 bp, E. coli
cgtgcaccgcacctttctgaaaaag

SEQ ID NO: 151482 - DNA, 25 bp, E. coli
cgtgcaccgcacgtttctgaaaaag

SEQ ID NO: 151483 - DNA, 25 bp, E. coli
ggaaagttaaacgtcacggacagcg

SEQ ID NO: 151484 - DNA, 25 bp, E. coli
ggaaagttaaacctcacggacagcg

SEQ ID NO: 151485 - DNA, 25 bp, E. coli
tggaaaaaagctaacgtcaccctga

SEQ ID NO: 151486 - DNA, 25 bp, E. coli
tggaaaaaagcttacgtcaccctga

SEQ ID NO: 151487 - DNA, 25 bp, E. coli
gacgcgaccaaaccagaaatcaaag

SEQ ID NO: 151488 - DNA, 25 bp, E. coli
gacgcgaccaaagcagaaatcaaag

SEQ ID NO: 151489 - DNA, 25 bp, E. coli
aatgatccacaatggctttcccggg

SEQ ID NO: 151490 - DNA, 25 bp, E. coli
caaggttgggagtcattgcatcgtc

SEQ ID NO: 151491 - DNA, 25 bp, E. coli
aatgatccacaaaggctttcccggg

SEQ ID NO: 151492 - DNA, 25 bp, E. coli
caaggttgggagacattgcatcgtc

SEQ ID NO: 151493 - DNA, 25 bp, E. coli
taaaacggcgtttgccattgagctg

SEQ ID NO: 151494 - DNA, 25 bp, E. coli
taaaacggcgttagccattgagctg

SEQ ID NO: 151495 - DNA, 25 bp, E. coli
tatcaggtgcatcagttcgccatcg

SEQ ID NO: 151496 - DNA, 25 bp, E. coli
tatcgaggtgttagcgccacgagac

SEQ ID NO: 151497 - DNA, 25 bp, E. coli
tatcgaggtgtttgcgccacgagac

SEQ ID NO: 151498 - DNA, 25 bp, E. coli
tatcaggtgcatgagttcgccatcg

SEQ ID NO: 151499 - DNA, 25 bp, E. coli
tgatatcagtaaggcgagcctgcct

SEQ ID NO: 151500 - DNA, 25 bp, E. coli
tgatatcagtaacgcgagcctgcct

SEQ ID NO: 151501 - DNA, 25 bp, E. coli
tgaaaaaccagatcaggcgcgtgac

SEQ ID NO: 151502 - DNA, 25 bp, E. coli
tgaaaaaccagaacaggcgcgtgac

SEQ ID NO: 151503 - DNA, 25 bp, E. coli
tcaggagacgctctaccgtatcagg

SEQ ID NO: 151504 - DNA, 25 bp, E. coli
tcaggagacgctgtaccgtatcagg

SEQ ID NO: 151505 - DNA, 25 bp, E. coli
ccagaattgagctacaggcggcaga

SEQ ID NO: 151506 - DNA, 25 bp, E. coli
ccagaattgagcaacaggcggcaga

SEQ ID NO: 151507 - DNA, 25 bp, E. coli
gttttgaagcagtagtccgggcgct

SEQ ID NO: 151508 - DNA, 25 bp, E. coli
gttttgaagcagaagtccgggcgct

SEQ ID NO: 151509 - DNA, 25 bp, E. coli
tggcgaagcggctgataacctggct

SEQ ID NO: 151510 - DNA, 25 bp, E. coli
tggcgaagcggcagataacctggct

SEQ ID NO: 151511 - DNA, 25 bp, E. coli
cacaaattgccgagcagcttaaacg

SEQ ID NO: 151512 - DNA, 25 bp, E. coli
cacaaattgccgtgcagcttaaacg

SEQ ID NO: 151513 - DNA, 25 bp, E. coli
tataccagtcaggagtcatttcagg

SEQ ID NO: 151514 - DNA, 25 bp, E. coli
tataccagtcagcagtcatttcagg

SEQ ID NO: 151515 - DNA, 25 bp, E. coli
tggtacattaacgaaagccggacgt

SEQ ID NO: 151516 - DNA, 25 bp, E. coli
tggtacattaaccaaagccggacgt

SEQ ID NO: 151517 - DNA, 25 bp, E. coli
tcatttcaggatcccatgtcgcgga

SEQ ID NO: 151518 - DNA, 25 bp, E. coli
tcatttcaggatgccatgtcgcgga

SEQ ID NO: 151519 - DNA, 25 bp, E. coli
gcgtcaacgctggagatttttcatc

SEQ ID NO: 151520 - DNA, 25 bp, E. coli
gcgtcaacgctgcagatttttcatc

SEQ ID NO: 151521 - DNA, 25 bp, E. coli
ccgacggagagagaaatattgcgct

SEQ ID NO: 151522 - DNA, 25 bp, E. coli
ccgacggagagacaaatattgcgct

SEQ ID NO: 151523 - DNA, 25 bp, E. coli
cattaaatggtgtacgtcaggcgac

SEQ ID NO: 151524 - DNA, 25 bp, E. coli
cattaaatggtgaacgtcaggcgac

SEQ ID NO: 151525 - DNA, 25 bp, E. coli
gtcgcgtggctactcaatgacacaa

SEQ ID NO: 151526 - DNA, 25 bp, E. coli
gtcgcgtggctagtcaatgacacaa

SEQ ID NO: 151527 - DNA, 25 bp, E. coli
tggcgattaagtttccgcgtacccg

SEQ ID NO: 151528 - DNA, 25 bp, E. coli
tggcgattaagtatccgcgtacccg

SEQ ID NO: 151529 - DNA, 25 bp, E. coli
taatgtgatgtccaaactgggcgtc

SEQ ID NO: 151530 - DNA, 25 bp, E. coli
taatgtgatgtcgaaactgggcgtc

SEQ ID NO: 151531 - DNA, 25 bp, E. coli
gatgatgatattgaagctcggctga

SEQ ID NO: 151532 - DNA, 25 bp, E. coli
gatgatgatattcaagctcggctga

SEQ ID NO: 151533 - DNA, 25 bp, E. coli
caatagtaacaagaggcaacgagct

SEQ ID NO: 151534 - DNA, 25 bp, E. coli
aatgatccaggccttcactgccagc

SEQ ID NO: 151535 - DNA, 25 bp, E. coli
caatagtaacaacaggcaacgagct

SEQ ID NO: 151536 - DNA, 25 bp, E. coli
aatgatccaggcgttcactgccagc

SEQ ID NO: 151537 - DNA, 25 bp, E. coli
cagggttgacaagtatttgcgcaat

SEQ ID NO: 151538 - DNA, 25 bp, E. coli
cagggttgacaactatttgcgcaat

SEQ ID NO: 151539 - DNA, 25 bp, E. coli
taaaaacaaccgagataacaccagg

SEQ ID NO: 151540 - DNA, 25 bp, E. coli
tatgagctcagaataccaaaacgga

SEQ ID NO: 151541 - DNA, 25 bp, E. coli
tatgagctcagattaccaaaacgga

SEQ ID NO: 151542 - DNA, 25 bp, E. coli
tcctggtcaaattacctatgagctc

SEQ ID NO: 151543 - DNA, 25 bp, E. coli
taattacaccgctctatggccttac

SEQ ID NO: 151544 - DNA, 25 bp, E. coli
taattacaccgcactatggccttac

SEQ ID NO: 151545 - DNA, 25 bp, E. coli
tcctggtcaaataacctatgagctc

SEQ ID NO: 151546 - DNA, 25 bp, E. coli
gaaagattattgctgatccctgtgg

SEQ ID NO: 151547 - DNA, 25 bp, E. coli
gacattgatcactttgaggtgacga

SEQ ID NO: 151548 - DNA, 25 bp, E. coli
gacattgatcacattgaggtgacga

SEQ ID NO: 151549 - DNA, 25 bp, E. coli
gaaagattattggtgatccctgtgg

SEQ ID NO: 151550 - DNA, 25 bp, E. coli
cattcagccgcatactgacagtgag

SEQ ID NO: 151551 - DNA, 25 bp, E. coli
cattcagccgcaaactgacagtgag

SEQ ID NO: 151552 - DNA, 25 bp, E. coli
taatgcctttccttcaatgatccag

SEQ ID NO: 151553 - DNA, 25 bp, E. coli
taatgcctttccatcaatgatccag

SEQ ID NO: 151554 - DNA, 25 bp, E. coli
taaaaacaaccgtgataacaccagg

SEQ ID NO: 151555 - DNA, 25 bp, E. coli
acgcagacgtattccttttttgttg

SEQ ID NO: 151556 - DNA, 25 bp, E. coli
acgcagacgtataccttttttgttg

SEQ ID NO: 151557 - DNA, 25 bp, E. coli
tatgcataaaaagcagcggctggac

SEQ ID NO: 151558 - DNA, 25 bp, E. coli
tatgcataaaaaccagcggctggac

SEQ ID NO: 151559 - DNA, 25 bp, E. coli
ttttgttgtaagagagaccttgccg

SEQ ID NO: 151560 - DNA, 25 bp, E. coli
ttttgttgtaagtgagaccttgccg

SEQ ID NO: 151561 - DNA, 25 bp, E. coli
tgaaaaaacacaaccggtcaccggg

SEQ ID NO: 151562 - DNA, 25 bp, E. coli
tgaaaaaacacatccggtcaccggg

SEQ ID NO: 151563 - DNA, 25 bp, E. coli
ccggaaggcgaggtctatgcataaa

SEQ ID NO: 151564 - DNA, 25 bp, E. coli
ccggaaggcgagctctatgcataaa

SEQ ID NO: 151565 - DNA, 25 bp, E. coli
gcaacccgaaagcaatacgcagacg

SEQ ID NO: 151566 - DNA, 25 bp, E. coli
gcaacccgaaaggaatacgcagacg

SEQ ID NO: 151567 - DNA, 25 bp, E. coli
cgtcattacgatctgtgaaaaaaca

SEQ ID NO: 151568 - DNA, 25 bp, E. coli
cgtcattacgatgtgtgaaaaaaca

SEQ ID NO: 151569 - DNA, 25 bp, E. coli
cattgccggtcgatcgtcattacga

SEQ ID NO: 151570 - DNA, 25 bp, E. coli
cattgccggtcgttcgtcattacga

SEQ ID NO: 151571 - DNA, 25 bp, E. coli
tggacgtcttccgacgttggccgtt

SEQ ID NO: 151572 - DNA, 25 bp, E. coli
gggagtaacttcattgccggtcgat

SEQ ID NO: 151573 - DNA, 25 bp, E. coli
tggacgtcttcccacgttggccgtt

SEQ ID NO: 151574 - DNA, 25 bp, E. coli
gggagtaacttctttgccggtcgat

SEQ ID NO: 151575 - DNA, 25 bp, E. coli
taagtgagacctagccggaaggcga

SEQ ID NO: 151576 - DNA, 25 bp, E. coli
taagtgagaccttgccggaaggcga

SEQ ID NO: 151577 - DNA, 25 bp, E. coli
catcaataacgaagaagccttcgcc

SEQ ID NO: 151578 - DNA, 25 bp, E. coli
catcaataacgatgaagccttcgcc

SEQ ID NO: 151579 - DNA, 25 bp, E. coli
tacaaacggtatcgacatgacgaat

SEQ ID NO: 151580 - DNA, 25 bp, E. coli
tacaaacggtatggacatgacgaat

SEQ ID NO: 151581 - DNA, 25 bp, E. coli
aatcgcaaccgctgtaccaccggta

SEQ ID NO: 151582 - DNA, 25 bp, E. coli
aatcgcaaccgcagtaccaccggta

SEQ ID NO: 151583 - DNA, 25 bp, E. coli
accagcggacgaccagccggttttg

SEQ ID NO: 151584 - DNA, 25 bp, E. coli
accagcggacgagcagccggttttg

SEQ ID NO: 151585 - DNA, 25 bp, E. coli
tgatcgtagctgcaaatacaaacgg

SEQ ID NO: 151586 - DNA, 25 bp, E. coli
tgatcgtagctggaaatacaaacgg

SEQ ID NO: 151587 - DNA, 25 bp, E. coli
tgcgcgtttcagcactttaagctcg

SEQ ID NO: 151588 - DNA, 25 bp, E. coli
tgcgcgtttcaggactttaagctcg

SEQ ID NO: 151589 - DNA, 25 bp, E. coli
gacaaagtgcgcatttggatacatt

SEQ ID NO: 151590 - DNA, 25 bp, E. coli
gacaaagtgcgcttttggatacatt

SEQ ID NO: 151591 - DNA, 25 bp, E. coli
cgacatgacgaaaacccagttcacg

SEQ ID NO: 151592 - DNA, 25 bp, E. coli
cgacatgacgaatacccagttcacg

SEQ ID NO: 151593 - DNA, 25 bp, E. coli
gattggcgggaccaatacgacgccc

SEQ ID NO: 151594 - DNA, 25 bp, E. coli
gattggcgggacgaatacgacgccc

SEQ ID NO: 151595 - DNA, 25 bp, E. coli
ggatacatttcacgaatcgcaaccg

SEQ ID NO: 151596 - DNA, 25 bp, E. coli
ggatacatttcaggaatcgcaaccg

SEQ ID NO: 151597 - DNA, 25 bp, E. coli
taagctcgcgctggttgtcgtgatc

SEQ ID NO: 151598 - DNA, 25 bp, E. coli
taagctcgcgctcgttgtcgtgatc

SEQ ID NO: 151599 - DNA, 25 bp, E. coli
cacaaatgggatcactaatgaacgg

SEQ ID NO: 151600 - DNA, 25 bp, E. coli
cacaaatgggatgactaatgaacgg

SEQ ID NO: 151601 - DNA, 25 bp, E. coli
cataaacggagggaaataatgctgg

SEQ ID NO: 151602 - DNA, 25 bp, E. coli
cataaacggaggcaaataatgctgg

SEQ ID NO: 151603 - DNA, 25 bp, E. coli
taaaccggcggtgaatgcttgcatg

SEQ ID NO: 151604 - DNA, 25 bp, E. coli
taaaccggcggtcaatgcttgcatg

SEQ ID NO: 151605 - DNA, 25 bp, E. coli
gcttttacgctatcaggcattttcc

SEQ ID NO: 151606 - DNA, 25 bp, E. coli
gcttttacgctaacaggcattttcc

SEQ ID NO: 151607 - DNA, 25 bp, E. coli
gaatgtttttatcgccgtactggga

SEQ ID NO: 151608 - DNA, 25 bp, E. coli
gaatgtttttatggccgtactggga

SEQ ID NO: 151609 - DNA, 25 bp, E. coli
ggagataatccctcacctaaccggc

SEQ ID NO: 151610 - DNA, 25 bp, E. coli
ggcattttcctggactgataacgaa

SEQ ID NO: 151611 - DNA, 25 bp, E. coli
ggcattttcctgcactgataacgaa

SEQ ID NO: 151612 - DNA, 25 bp, E. coli
ggccgcgtatttgagccacaaatgg

SEQ ID NO: 151613 - DNA, 25 bp, E. coli
ggagataatcccacacctaaccggc

SEQ ID NO: 151614 - DNA, 25 bp, E. coli
ggccgcgtatttcagccacaaatgg

SEQ ID NO: 151615 - DNA, 25 bp, E. coli
taacgaatcgttcacacagtagcat

SEQ ID NO: 151616 - DNA, 25 bp, E. coli
taaggtaagcgaggaaacacaccac

SEQ ID NO: 151617 - DNA, 25 bp, E. coli
taaggtaagcgacgaaacacaccac

SEQ ID NO: 151618 - DNA, 25 bp, E. coli
taacgaatcgttgacacagtagcat

SEQ ID NO: 151619 - DNA, 25 bp, E. coli
taaccggcccctagttacagttgtg

SEQ ID NO: 151620 - DNA, 25 bp, E. coli
taaccggccccttgttacagttgtg

SEQ ID NO: 151621 - DNA, 25 bp, E. coli
cattgttatcatttgtagggtcgag

SEQ ID NO: 151622 - DNA, 25 bp, E. coli
cattgttatcatatgtagggtcgag

SEQ ID NO: 151623 - DNA, 25 bp, E. coli
catcggttgtcgcatgcgacgccat

SEQ ID NO: 151624 - DNA, 25 bp, E. coli
catcggttgtcggatgcgacgccat

SEQ ID NO: 151625 - DNA, 25 bp, E. coli
acagttcagttcaccccgtaggcct

SEQ ID NO: 151626 - DNA, 25 bp, E. coli
acagttcagttctccccgtaggcct

SEQ ID NO: 151627 - DNA, 25 bp, E. coli
tgtcgaatacaatcaacgggcgttt

SEQ ID NO: 151628 - DNA, 25 bp, E. coli
tgtcgaatacaaacaacgggcgttt

SEQ ID NO: 151629 - DNA, 25 bp, E. coli
tcgagattgttgtcggatgcgacgc

SEQ ID NO: 151630 - DNA, 25 bp, E. coli
tcgagattgttgacggatgcgacgc

SEQ ID NO: 151631 - DNA, 25 bp, E. coli
tcaggcatcggcagtcgaatacaat

SEQ ID NO: 151632 - DNA, 25 bp, E. coli
tcaggcatcggctgtcgaatacaat

SEQ ID NO: 151633 - DNA, 25 bp, E. coli
cctgataagtcacgtcagcggcgca

SEQ ID NO: 151634 - DNA, 25 bp, E. coli
cctgataagtcaggtcagcggcgca

SEQ ID NO: 151635 - DNA, 25 bp, E. coli
gacctacagttcagtgcaccccgta

SEQ ID NO: 151636 - DNA, 25 bp, E. coli
gacctacagttcagtgcacctcgta

SEQ ID NO: 151637 - DNA, 25 bp, E. coli
gttcagtgcacctcgtaggcctgat

SEQ ID NO: 151638 - DNA, 25 bp, E. coli
gttcagtgcaccacgtaggcctgat

SEQ ID NO: 151639 - DNA, 25 bp, E. coli
gacctacagttctgtgcacctcgta

SEQ ID NO: 151640 - DNA, 25 bp, E. coli
gatgcgacgccaaccgtcttatccg

SEQ ID NO: 151641 - DNA, 25 bp, E. coli
gatgcgacgccatccgtcttatccg

SEQ ID NO: 151642 - DNA, 25 bp, E. coli
gacctacagttctgtgcaccccgta

SEQ ID NO: 151643 - DNA, 25 bp, E. coli
tacgtcgaagagatcactgactatg

SEQ ID NO: 151644 - DNA, 25 bp, E. coli
atttccgccatcgaatggcgcgtcg

SEQ ID NO: 151645 - DNA, 25 bp, E. coli
atttccgccatccaatggcgcgtcg

SEQ ID NO: 151646 - DNA, 25 bp, E. coli
actatttccgccttccaatggcgcg

SEQ ID NO: 151647 - DNA, 25 bp, E. coli
actatttccgccatccaatggcgcg

SEQ ID NO: 151648 - DNA, 25 bp, E. coli
tacgtcgaagagttcactgactatg

SEQ ID NO: 151649 - DNA, 25 bp, E. coli
ttccatccagtgttcgacgttgatc

SEQ ID NO: 151650 - DNA, 25 bp, E. coli
ttccatccagtgatcgacgttgatc

SEQ ID NO: 151651 - DNA, 25 bp, E. coli
tcggacgccattcaaatcagtaaag

SEQ ID NO: 151652 - DNA, 25 bp, E. coli
tcggacgccattgaaatcagtaaag

SEQ ID NO: 151653 - DNA, 25 bp, E. coli
ccatccagtgttggacgttgatcaa

SEQ ID NO: 151654 - DNA, 25 bp, E. coli
ccatccagtgttcgacgttgatcaa

SEQ ID NO: 151655 - DNA, 25 bp, E. coli
gctttcggacgccattgaaatcagt

SEQ ID NO: 151656 - DNA, 25 bp, E. coli
gctttcggacgcgattgaaatcagt

SEQ ID NO: 151657 - DNA, 25 bp, E. coli
gaacatgcagggaggaaattcgttg

SEQ ID NO: 151658 - DNA, 25 bp, E. coli
gaacatgcagggtggaaattcgttg

SEQ ID NO: 151659 - DNA, 25 bp, E. coli
cgaagagatcacagactatgtgctg

SEQ ID NO: 151660 - DNA, 25 bp, E. coli
cgaagagatcactgactatgtgctg

SEQ ID NO: 151661 - DNA, 25 bp, E. coli
cgtcgaagagatcactgactatgtg

SEQ ID NO: 151662 - DNA, 25 bp, E. coli
cgtcgaagagatgactgactatgtg

SEQ ID NO: 151663 - DNA, 25 bp, E. coli
ggacgccattgatatcagtaaaggc

SEQ ID NO: 151664 - DNA, 25 bp, E. coli
ggacgccattgaaatcagtaaaggc

SEQ ID NO: 151665 - DNA, 25 bp, E. coli
caggtgaatagctaaatgatggccc

SEQ ID NO: 151666 - DNA, 25 bp, E. coli
caggtgaatagcaaaatgatggccc

SEQ ID NO: 151667 - DNA, 25 bp, E. coli
cagtgctctggctcaaaaacacggg

SEQ ID NO: 151668 - DNA, 25 bp, E. coli
cagtgctctggcacaaaaacacggg

SEQ ID NO: 151669 - DNA, 25 bp, E. coli
aaaaatggccgcagaattcggtctg

SEQ ID NO: 151670 - DNA, 25 bp, E. coli
aaaaatggccgctgaattcggtctg

SEQ ID NO: 151671 - DNA, 25 bp, E. coli
tgtctttgaccacgcagaaaaccgg

SEQ ID NO: 151672 - DNA, 25 bp, E. coli
tgtctttgaccaggcagaaaaccgg

SEQ ID NO: 151673 - DNA, 25 bp, E. coli
tgatggccctgaccggtaattcgca

SEQ ID NO: 151674 - DNA, 25 bp, E. coli
tgatggccctgagcggtaattcgca

SEQ ID NO: 151675 - DNA, 25 bp, E. coli
tcatgatgagcataccacgctgggt

SEQ ID NO: 151676 - DNA, 25 bp, E. coli
tcatgatgagcaaaccacgctgggt

SEQ ID NO: 151677 - DNA, 25 bp, E. coli
tcaccttgacggaagatatcgcctc

SEQ ID NO: 151678 - DNA, 25 bp, E. coli
ccggatgcacacgataaaagctgtt

SEQ ID NO: 151679 - DNA, 25 bp, E. coli
ccggatgcacaccataaaagctgtt

SEQ ID NO: 151680 - DNA, 25 bp, E. coli
gctggtcgccgaatgcagtgctctg

SEQ ID NO: 151681 - DNA, 25 bp, E. coli
gctggtcgccgattgcagtgctctg

SEQ ID NO: 151682 - DNA, 25 bp, E. coli
taagttcctccactgtctgcctgca

SEQ ID NO: 151683 - DNA, 25 bp, E. coli
tcaccttgacggtagatatcgcctc

SEQ ID NO: 151684 - DNA, 25 bp, E. coli
taagttcctccagtgtctgcctgca

SEQ ID NO: 151685 - DNA, 25 bp, E. coli
gatgaagtctttcaatctccggcaa

SEQ ID NO: 151686 - DNA, 25 bp, E. coli
gatgaagtctttgaatctccggcaa

SEQ ID NO: 151687 - DNA, 25 bp, E. coli
cagcgtaacggtaactgggtgacgg

SEQ ID NO: 151688 - DNA, 25 bp, E. coli
cagcgtaacggttactgggtgacgg

SEQ ID NO: 151689 - DNA, 25 bp, E. coli
ctgattcagttgcagcgtaacggta

SEQ ID NO: 151690 - DNA, 25 bp, E. coli
ctgattcagttggagcgtaacggta

SEQ ID NO: 151691 - DNA, 25 bp, E. coli
agttgcagcgtatcggtaactgggt

SEQ ID NO: 151692 - DNA, 25 bp, E. coli
agttgcagcgtaacggtaactgggt

SEQ ID NO: 151693 - DNA, 25 bp, E. coli
tgtccgactgctgattcagttgcag

SEQ ID NO: 151694 - DNA, 25 bp, E. coli
tgtccgactgctcattcagttgcag

SEQ ID NO: 151695 - DNA, 25 bp, E. coli
tgctgattcagttgcagcgtaacgg

SEQ ID NO: 151696 - DNA, 25 bp, E. coli
tgcagcgtaacgctaactgggtgac

SEQ ID NO: 151697 - DNA, 25 bp, E. coli
tgcagcgtaacggtaactgggtgac

SEQ ID NO: 151698 - DNA, 25 bp, E. coli
tgctgattcagtagcagcgtaacgg

SEQ ID NO: 151699 - DNA, 25 bp, E. coli
tccgactgctgattcagttgcagcg

SEQ ID NO: 151700 - DNA, 25 bp, E. coli
tccgactgctgaatcagttgcagcg

SEQ ID NO: 151701 - DNA, 25 bp, E. coli
tcagttgcagcgtaacggtaactgg

SEQ ID NO: 151702 - DNA, 25 bp, E. coli
tcagttgcagcgaaacggtaactgg

SEQ ID NO: 151703 - DNA, 25 bp, E. coli
gactgctgattcagttgcagcgtaa

SEQ ID NO: 151704 - DNA, 25 bp, E. coli
gactgctgattctgttgcagcgtaa

SEQ ID NO: 151705 - DNA, 25 bp, E. coli
ctgtccgactgcagattcagttgca

SEQ ID NO: 151706 - DNA, 25 bp, E. coli
ctgtccgactgctgattcagttgca

SEQ ID NO: 151707 - DNA, 25 bp, E. coli
gattcagttgcagcgtaacggtaac

SEQ ID NO: 151708 - DNA, 25 bp, E. coli
gattcagttgcaccgtaacggtaac

SEQ ID NO: 151709 - DNA, 25 bp, E. coli
caagcatggttaatcgttgtgggac

SEQ ID NO: 151710 - DNA, 25 bp, E. coli
ccccttgcttcaacgttaggaatta

SEQ ID NO: 151711 - DNA, 25 bp, E. coli
ccccttgcttcatcgttaggaatta

SEQ ID NO: 151712 - DNA, 25 bp, E. coli
cactgcatcagtgcttcaagcatgg

SEQ ID NO: 151713 - DNA, 25 bp, E. coli
caagcatggttattcgttgtgggac

SEQ ID NO: 151714 - DNA, 25 bp, E. coli
cactgcatcagtccttcaagcatgg

SEQ ID NO: 151715 - DNA, 25 bp, E. coli
caggtataatctgctggcgggtgat

SEQ ID NO: 151716 - DNA, 25 bp, E. coli
caggtataatctcctggcgggtgat

SEQ ID NO: 151717 - DNA, 25 bp, E. coli
tactcagtcacacatgatgcaggca

SEQ ID NO: 151718 - DNA, 25 bp, E. coli
tactcagtcacagatgatgcaggca

SEQ ID NO: 151719 - DNA, 25 bp, E. coli
tagtgctgataaaactgacgcatgg

SEQ ID NO: 151720 - DNA, 25 bp, E. coli
tagtgctgataatactgacgcatgg

SEQ ID NO: 151721 - DNA, 25 bp, E. coli
tgtgggacgcttaaccaacgcaacc

SEQ ID NO: 151722 - DNA, 25 bp, E. coli
tgtgggacgctttaccaacgcaacc

SEQ ID NO: 151723 - DNA, 25 bp, E. coli
gaattgcggtcaacccactgcatca

SEQ ID NO: 151724 - DNA, 25 bp, E. coli
gaattgcggtcatcccactgcatca

SEQ ID NO: 151725 - DNA, 25 bp, E. coli
tgtcttttgcacaggagttcccctt

SEQ ID NO: 151726 - DNA, 25 bp, E. coli
tgtcttttgcactggagttcccctt

SEQ ID NO: 151727 - DNA, 25 bp, E. coli
ggcgggtgattttacaccaatactc

SEQ ID NO: 151728 - DNA, 25 bp, E. coli
ggcgggtgatttaacaccaatactc

SEQ ID NO: 151729 - DNA, 25 bp, E. coli
gatgcaggcaagtcaactttcagaa

SEQ ID NO: 151730 - DNA, 25 bp, E. coli
gatgcaggcaagacaactttcagaa

SEQ ID NO: 151731 - DNA, 25 bp, E. coli
aaggttgaagcaccacctgcgccga

SEQ ID NO: 151732 - DNA, 25 bp, E. coli
aaggttgaagcagcacctgcgccga

SEQ ID NO: 151733 - DNA, 25 bp, E. coli
cacgccagtgcacggtaaaattacc

SEQ ID NO: 151734 - DNA, 25 bp, E. coli
cacgccagtgcagggtaaaattacc

SEQ ID NO: 151735 - DNA, 25 bp, E. coli
caccgagtttgaaccggaacctgca

SEQ ID NO: 151736 - DNA, 25 bp, E. coli
caccgagtttgatccggaacctgca

SEQ ID NO: 151737 - DNA, 25 bp, E. coli
tacccgtattctggttgggccggat

SEQ ID NO: 151738 - DNA, 25 bp, E. coli
tacttccagggctgctggacgggca

SEQ ID NO: 151739 - DNA, 25 bp, E. coli
tacttccagggcagctggacgggca

SEQ ID NO: 151740 - DNA, 25 bp, E. coli
tacccgtattctcgttgggccggat

SEQ ID NO: 151741 - DNA, 25 bp, E. coli
tatcgggtttattcgtcgccatcca

SEQ ID NO: 151742 - DNA, 25 bp, E. coli
tattgcagccaaaaacaccgagttt

SEQ ID NO: 151743 - DNA, 25 bp, E. coli
tattgcagccaataacaccgagttt

SEQ ID NO: 151744 - DNA, 25 bp, E. coli
tatcgggtttatacgtcgccatcca

SEQ ID NO: 151745 - DNA, 25 bp, E. coli
tcgatccggccagtattgcagccaa

SEQ ID NO: 151746 - DNA, 25 bp, E. coli
tcgatccggccactattgcagccaa

SEQ ID NO: 151747 - DNA, 25 bp, E. coli
gggtgattgtacatccagggctgct

SEQ ID NO: 151748 - DNA, 25 bp, E. coli
gggtgattgtacttccagggctgct

SEQ ID NO: 151749 - DNA, 25 bp, E. coli
taagtggcgtggaaatgggctatac

SEQ ID NO: 151750 - DNA, 25 bp, E. coli
taagtggcgtggtaatgggctatac

SEQ ID NO: 151751 - DNA, 25 bp, E. coli
gatgagcctgatttgatgccagccg

SEQ ID NO: 151752 - DNA, 25 bp, E. coli
gatgagcctgatatgatgccagccg

SEQ ID NO: 151753 - DNA, 25 bp, E. coli
catgacgtggcatttcaaaaactcc

SEQ ID NO: 151754 - DNA, 25 bp, E. coli
catgacgtggcaattcaaaaactcc

SEQ ID NO: 151755 - DNA, 25 bp, E. coli
caaaccgatcgtcgcaatttactcc

SEQ ID NO: 151756 - DNA, 25 bp, E. coli
caaaccgatcgtggcaatttactcc

SEQ ID NO: 151757 - DNA, 25 bp, E. coli
tattttgatgtagcgattgccgagc

SEQ ID NO: 151758 - DNA, 25 bp, E. coli
tattttgatgtaccgattgccgagc

SEQ ID NO: 151759 - DNA, 25 bp, E. coli
tggtggctacaatccgatcgtggca

SEQ ID NO: 151760 - DNA, 25 bp, E. coli
tggtggctacaaaccgatcgtggca

SEQ ID NO: 151761 - DNA, 25 bp, E. coli
tgatgtagcgattgccgagcaacac

SEQ ID NO: 151762 - DNA, 25 bp, E. coli
tgatgtagcgatagccgagcaacac

SEQ ID NO: 151763 - DNA, 25 bp, E. coli
gcgattggtggcaacaaaccgatcg

SEQ ID NO: 151764 - DNA, 25 bp, E. coli
gcgattggtggctacaaaccgatcg

SEQ ID NO: 151765 - DNA, 25 bp, E. coli
gcaattcaaaaagtcccggtcctgt

SEQ ID NO: 151766 - DNA, 25 bp, E. coli
gcaattcaaaaactcccggtcctgt

SEQ ID NO: 151767 - DNA, 25 bp, E. coli
gacgtggcaattcaaaaactcccgg

SEQ ID NO: 151768 - DNA, 25 bp, E. coli
cgtggcaatttagtccaccttcctg

SEQ ID NO: 151769 - DNA, 25 bp, E. coli
cgatcgtggcaaattactccacctt

SEQ ID NO: 151770 - DNA, 25 bp, E. coli
cgatcgtggcaatttactccacctt

SEQ ID NO: 151771 - DNA, 25 bp, E. coli
cgtggcaatttactccaccttcctg

SEQ ID NO: 151772 - DNA, 25 bp, E. coli
ggctacaaaccgttcgtggcaattt

SEQ ID NO: 151773 - DNA, 25 bp, E. coli
ggctacaaaccgatcgtggcaattt

SEQ ID NO: 151774 - DNA, 25 bp, E. coli
gacgtggcaattgaaaaactcccgg

SEQ ID NO: 151775 - DNA, 25 bp, E. coli
aatgtttgccgactgggctgtgcgg

SEQ ID NO: 151776 - DNA, 25 bp, E. coli
aatgtttgccgagtgggctgtgcgg

SEQ ID NO: 151777 - DNA, 25 bp, E. coli
cgggccgtgctgatttactggcgaa

SEQ ID NO: 151778 - DNA, 25 bp, E. coli
cgggccgtgctgttttactggcgaa

SEQ ID NO: 151779 - DNA, 25 bp, E. coli
actggcgaatggatactggacgttg

SEQ ID NO: 151780 - DNA, 25 bp, E. coli
actggcgaatggttactggacgttg

SEQ ID NO: 151781 - DNA, 25 bp, E. coli
tttactggcgaatggttactggacg

SEQ ID NO: 151782 - DNA, 25 bp, E. coli
tttactggcgaaaggttactggacg

SEQ ID NO: 151783 - DNA, 25 bp, E. coli
tgctgttttactcgcgaatggttac

SEQ ID NO: 151784 - DNA, 25 bp, E. coli
tgctgttttactggcgaatggttac

SEQ ID NO: 151785 - DNA, 25 bp, E. coli
tctggatgggaatgtttgccgactg

SEQ ID NO: 151786 - DNA, 25 bp, E. coli
tctggatgggaaagtttgccgactg

SEQ ID NO: 151787 - DNA, 25 bp, E. coli
tcatgggtgctagccgctggattta

SEQ ID NO: 151788 - DNA, 25 bp, E. coli
tcatgggtgctacccgctggattta

SEQ ID NO: 151789 - DNA, 25 bp, E. coli
gctgtgcgggccgtgctgttttact

SEQ ID NO: 151790 - DNA, 25 bp, E. coli
gctgtgcgggccctgctgttttact

SEQ ID NO: 151791 - DNA, 25 bp, E. coli
ccgcaaaagtgtgaaaaaaagccag

SEQ ID NO: 151792 - DNA, 25 bp, E. coli
ccgcaaaagtgtcaaaaaaagccag

SEQ ID NO: 151793 - DNA, 25 bp, E. coli
ctttatttatgcgtatttggtccgc

SEQ ID NO: 151794 - DNA, 25 bp, E. coli
ctttatttatgcctatttggtccgc

SEQ ID NO: 151795 - DNA, 25 bp, E. coli
gtgattctgattaggctaaatgctt

SEQ ID NO: 151796 - DNA, 25 bp, E. coli
gtgattctgatttggctaaatgctt

SEQ ID NO: 151797 - DNA, 25 bp, E. coli
cacgcagaaccaagcgctggtgctg

SEQ ID NO: 151798 - DNA, 25 bp, E. coli
caacacgagcaagaaggaaagcggc

SEQ ID NO: 151799 - DNA, 25 bp, E. coli
caacacgagcaacaaggaaagcggc

SEQ ID NO: 151800 - DNA, 25 bp, E. coli
cacgcagaaccatgcgctggtgctg

SEQ ID NO: 151801 - DNA, 25 bp, E. coli
agtgcaaacgcgtttatgatccggc

SEQ ID NO: 151802 - DNA, 25 bp, E. coli
agtgcaaacgcgattatgatccggc

SEQ ID NO: 151803 - DNA, 25 bp, E. coli
tgaccctgctctactcagcaaaaaa

SEQ ID NO: 151804 - DNA, 25 bp, E. coli
tgaccctgctcttctcagcaaaaaa

SEQ ID NO: 151805 - DNA, 25 bp, E. coli
tgcgcaaagcctatcacggcgaagt

SEQ ID NO: 151806 - DNA, 25 bp, E. coli
tgcgcaaagcctttcacggcgaagt

SEQ ID NO: 151807 - DNA, 25 bp, E. coli
gcgagcaatatcttgcagaactggc

SEQ ID NO: 151808 - DNA, 25 bp, E. coli
gcgagcaatatcatgcagaactggc

SEQ ID NO: 151809 - DNA, 25 bp, E. coli
gcaacctttcgcgagcaatatcttg

SEQ ID NO: 151810 - DNA, 25 bp, E. coli
gcaaaaaacaccacgcagaaccatg

SEQ ID NO: 151811 - DNA, 25 bp, E. coli
gcaaaaaacacctcgcagaaccatg

SEQ ID NO: 151812 - DNA, 25 bp, E. coli
gcaacctttcgccagcaatatcttg

SEQ ID NO: 151813 - DNA, 25 bp, E. coli
gacatcgccaaaaaacagccgctga

SEQ ID NO: 151814 - DNA, 25 bp, E. coli
gacatcgccaaataacagccgctga

SEQ ID NO: 151815 - DNA, 25 bp, E. coli
gataaagaaatctcgccgtcaacgg

SEQ ID NO: 151816 - DNA, 25 bp, E. coli
gataaagaaatcacgccgtcaacgg

SEQ ID NO: 151817 - DNA, 25 bp, E. coli
gatgaatattcactgcaaacgcgtt

SEQ ID NO: 151818 - DNA, 25 bp, E. coli
gatgaatattcagtgcaaacgcgtt

SEQ ID NO: 151819 - DNA, 25 bp, E. coli
caactgctcaatacttcacgggact

SEQ ID NO: 151820 - DNA, 25 bp, E. coli
cacgggacttgattcgccatgctgg

SEQ ID NO: 151821 - DNA, 25 bp, E. coli
cacgggacttgaatcgccatgctgg

SEQ ID NO: 151822 - DNA, 25 bp, E. coli
caactgctcaattcttcacgggact

SEQ ID NO: 151823 - DNA, 25 bp, E. coli
taaaaaactggtacagccggatcca

SEQ ID NO: 151824 - DNA, 25 bp, E. coli
taaaaaactggttcagccggatcca

SEQ ID NO: 151825 - DNA, 25 bp, E. coli
tgtaatctcacagctgaagccctgg

SEQ ID NO: 151826 - DNA, 25 bp, E. coli
tgtaatctcacacctgaagccctgg

SEQ ID NO: 151827 - DNA, 25 bp, E. coli
gacaacgatcgcatcagagctgtaa

SEQ ID NO: 151828 - DNA, 25 bp, E. coli
gacaacgatcgcttcagagctgtaa

SEQ ID NO: 151829 - DNA, 25 bp, E. coli
cgcgcgggcgtgtacgtttcaaact

SEQ ID NO: 151830 - DNA, 25 bp, E. coli
cgcgcgggcgtgaacgtttcaaact

SEQ ID NO: 151831 - DNA, 25 bp, E. coli
cgagacattactggaagaaacgcgc

SEQ ID NO: 151832 - DNA, 25 bp, E. coli
cgagacattactcgaagaaacgcgc

SEQ ID NO: 151833 - DNA, 25 bp, E. coli
gtaaattcgctggatcaacaaggtg

SEQ ID NO: 151834 - DNA, 25 bp, E. coli
gggcaaccgatttaagacgacaacg

SEQ ID NO: 151835 - DNA, 25 bp, E. coli
gtaaattcgctgcatcaacaaggtg

SEQ ID NO: 151836 - DNA, 25 bp, E. coli
gggcaaccgattaaagacgacaacg

SEQ ID NO: 151837 - DNA, 25 bp, E. coli
ggcaacgattttaacggcgagacat

SEQ ID NO: 151838 - DNA, 25 bp, E. coli
ggcaacgatttttacggcgagacat

SEQ ID NO: 151839 - DNA, 25 bp, E. coli
taatatcgcgcataacctggctctg

SEQ ID NO: 151840 - DNA, 25 bp, E. coli
taatatcgcgcaaaacctggctctg

SEQ ID NO: 151841 - DNA, 25 bp, E. coli
caccttgtgtaacgctatggcggaa

SEQ ID NO: 151842 - DNA, 25 bp, E. coli
caccttgtgtaaggctatggcggaa

SEQ ID NO: 151843 - DNA, 25 bp, E. coli
catgctacagttccaggagaagggc

SEQ ID NO: 151844 - DNA, 25 bp, E. coli
catgctacagttgcaggagaagggc

SEQ ID NO: 151845 - DNA, 25 bp, E. coli
aactttgagcgcgttttggccgaga

SEQ ID NO: 151846 - DNA, 25 bp, E. coli
aactttgagcgccttttggccgaga

SEQ ID NO: 151847 - DNA, 25 bp, E. coli
tattgcgtcgccaacgcgcgtttcg

SEQ ID NO: 151848 - DNA, 25 bp, E. coli
tattaccattgatggcccaagcggt

SEQ ID NO: 151849 - DNA, 25 bp, E. coli
tattgcgtcgcctacgcgcgtttcg

SEQ ID NO: 151850 - DNA, 25 bp, E. coli
tattaccattgaaggcccaagcggt

SEQ ID NO: 151851 - DNA, 25 bp, E. coli
ttggccgagatcaaagaacgcgacg

SEQ ID NO: 151852 - DNA, 25 bp, E. coli
ttggccgagatctaagaacgcgacg

SEQ ID NO: 151853 - DNA, 25 bp, E. coli
gaaaattttcctagacgcctcctcg

SEQ ID NO: 151854 - DNA, 25 bp, E. coli
gaaaattttccttgacgcctcctcg

SEQ ID NO: 151855 - DNA, 25 bp, E. coli
cgaaattcgtacacaggaagtggcg

SEQ ID NO: 151856 - DNA, 25 bp, E. coli
cgaaattcgtactcaggaagtggcg

SEQ ID NO: 151857 - DNA, 25 bp, E. coli
cgggtgcaatttatcgcgtactggc

SEQ ID NO: 151858 - DNA, 25 bp, E. coli
cgggtgcaatttttcgcgtactggc

SEQ ID NO: 151859 - DNA, 25 bp, E. coli
ggattccaccaccttaagcattgag

SEQ ID NO: 151860 - DNA, 25 bp, E. coli
ggattccaccacgttaagcattgag

SEQ ID NO: 151861 - DNA, 25 bp, E. coli
tggcggaagcgttgcaatggcatct

SEQ ID NO: 151862 - DNA, 25 bp, E. coli
tggcggaagcgtagcaatggcatct

SEQ ID NO: 151863 - DNA, 25 bp, E. coli
aattatcggcgaaatcgatctgcgc

SEQ ID NO: 151864 - DNA, 25 bp, E. coli
aattatcggcgatatcgatctgcgc

SEQ ID NO: 151865 - DNA, 25 bp, E. coli
cattcttggctgctgcgaacgttac

SEQ ID NO: 151866 - DNA, 25 bp, E. coli
cattcttggctggtgcgaacgttac

SEQ ID NO: 151867 - DNA, 25 bp, E. coli
attatccagtcggatccggtgctga

SEQ ID NO: 151868 - DNA, 25 bp, E. coli
attatccagtcgcatccggtgctga

SEQ ID NO: 151869 - DNA, 25 bp, E. coli
tgattgaccgcctgaactggatgcg

SEQ ID NO: 151870 - DNA, 25 bp, E. coli
tgattgaccgccagaactggatgcg

SEQ ID NO: 151871 - DNA, 25 bp, E. coli
tgagtgccataaccgcaataacgcc

SEQ ID NO: 151872 - DNA, 25 bp, E. coli
tgagtgccataagcgcaataacgcc

SEQ ID NO: 151873 - DNA, 25 bp, E. coli
tcacctgggaaaaaatgtgcggcgc

SEQ ID NO: 151874 - DNA, 25 bp, E. coli
tcacctgggaaataatgtgcggcgc

SEQ ID NO: 151875 - DNA, 25 bp, E. coli
gcttataccaacttgagcgagcaga

SEQ ID NO: 151876 - DNA, 25 bp, E. coli
gcttataccaacatgagcgagcaga

SEQ ID NO: 151877 - DNA, 25 bp, E. coli
cgttattaacgtcggcatcgccatg

SEQ ID NO: 151878 - DNA, 25 bp, E. coli
cgattaacgtggagccgggcatgac

SEQ ID NO: 151879 - DNA, 25 bp, E. coli
cgttattaacgtgggcatcgccatg

SEQ ID NO: 151880 - DNA, 25 bp, E. coli
cgattaacgtggtgccgggcatgac

SEQ ID NO: 151881 - DNA, 25 bp, E. coli
gatttctcccgtcagatgcgcgaaa

SEQ ID NO: 151882 - DNA, 25 bp, E. coli
gataacattgccgattcgccgctgg

SEQ ID NO: 151883 - DNA, 25 bp, E. coli
gataacattgcccattcgccgctgg

SEQ ID NO: 151884 - DNA, 25 bp, E. coli
gatttctcccgtgagatgcgcgaaa

SEQ ID NO: 151885 - DNA, 25 bp, E. coli
aattagacggcaattacggacaggc

SEQ ID NO: 151886 - DNA, 25 bp, E. coli
aattagacggcatttacggacaggc

SEQ ID NO: 151887 - DNA, 25 bp, E. coli
cacatttgatctactctggcggaca

SEQ ID NO: 151888 - DNA, 25 bp, E. coli
cacatttgatcttctctggcggaca

SEQ ID NO: 151889 - DNA, 25 bp, E. coli
taaaaccggtcatcttgagcaagcc

SEQ ID NO: 151890 - DNA, 25 bp, E. coli
taaaaccggtcaacttgagcaagcc

SEQ ID NO: 151891 - DNA, 25 bp, E. coli
tatcggtgacgcagcaacgcaatgg

SEQ ID NO: 151892 - DNA, 25 bp, E. coli
tatcggtgacgctgcaacgcaatgg

SEQ ID NO: 151893 - DNA, 25 bp, E. coli
ttctggaaccactaatgcatcgggc

SEQ ID NO: 151894 - DNA, 25 bp, E. coli
ttctggaaccacaaatgcatcgggc

SEQ ID NO: 151895 - DNA, 25 bp, E. coli
tgtgataatgccagcgacggactct

SEQ ID NO: 151896 - DNA, 25 bp, E. coli
tgtgataatgcctgcgacggactct

SEQ ID NO: 151897 - DNA, 25 bp, E. coli
tgctggaaaacgagggaacatctgg

SEQ ID NO: 151898 - DNA, 25 bp, E. coli
tgctggaaaacgtgggaacatctgg

SEQ ID NO: 151899 - DNA, 25 bp, E. coli
gcttcgcctgcgttgcaaaacagtg

SEQ ID NO: 151900 - DNA, 25 bp, E. coli
gcttcgcctgcgatgcaaaacagtg

SEQ ID NO: 151901 - DNA, 25 bp, E. coli
gcaatggcgcactatctgtttctgg

SEQ ID NO: 151902 - DNA, 25 bp, E. coli
gcaatggcgcacaatctgtttctgg

SEQ ID NO: 151903 - DNA, 25 bp, E. coli
gaaagttacatctatgccgtgcagg

SEQ ID NO: 151904 - DNA, 25 bp, E. coli
gaaagttacatcaatgccgtgcagg

SEQ ID NO: 151905 - DNA, 25 bp, E. coli
cgtagttatagtctccctgctggaa

SEQ ID NO: 151906 - DNA, 25 bp, E. coli
cgtagttatagtgtccctgctggaa

SEQ ID NO: 151907 - DNA, 25 bp, E. coli
caacatttgccgttgcagccaggcg

SEQ ID NO: 151908 - DNA, 25 bp, E. coli
caacatttgccgatgcagccaggcg

SEQ ID NO: 151909 - DNA, 25 bp, E. coli
cagacaagaggaggtgatgaacacc

SEQ ID NO: 151910 - DNA, 25 bp, E. coli
cagacaagaggacgtgatgaacacc

SEQ ID NO: 151911 - DNA, 25 bp, E. coli
aaacgctggattcgattacggctgc

SEQ ID NO: 151912 - DNA, 25 bp, E. coli
aaagggcgctcggtcatacgctgaa

SEQ ID NO: 151913 - DNA, 25 bp, E. coli
aaagggcgctcgctcatacgctgaa

SEQ ID NO: 151914 - DNA, 25 bp, E. coli
aaacgctggattggattacggctgc

SEQ ID NO: 151915 - DNA, 25 bp, E. coli
tatacgtggcctgcatgatgaactg

SEQ ID NO: 151916 - DNA, 25 bp, E. coli
tattgctgaagcagcacgtactgcc

SEQ ID NO: 151917 - DNA, 25 bp, E. coli
tattgctgaagctgcacgtactgcc

SEQ ID NO: 151918 - DNA, 25 bp, E. coli
tatacgtggcctccatgatgaactg

SEQ ID NO: 151919 - DNA, 25 bp, E. coli
ttttcgctcaacattcagggactgg

SEQ ID NO: 151920 - DNA, 25 bp, E. coli
ttttcgctcaactttcagggactgg

SEQ ID NO: 151921 - DNA, 25 bp, E. coli
tgatacttacaggaactcgctcggg

SEQ ID NO: 151922 - DNA, 25 bp, E. coli
tgatacttacagcaactcgctcggg

SEQ ID NO: 151923 - DNA, 25 bp, E. coli
tcctcaactgggagcaaaaacgctg

SEQ ID NO: 151924 - DNA, 25 bp, E. coli
tcctcaactgggtgcaaaaacgctg

SEQ ID NO: 151925 - DNA, 25 bp, E. coli
gggaattaccggtctgacccttcat

SEQ ID NO: 151926 - DNA, 25 bp, E. coli
gggaattaccggactgacccttcat

SEQ ID NO: 151927 - DNA, 25 bp, E. coli
taaccttgtcagaaacggcaagccg

SEQ ID NO: 151928 - DNA, 25 bp, E. coli
taaccttgtcagtaacggcaagccg

SEQ ID NO: 151929 - DNA, 25 bp, E. coli
ctgccgctaataatcgtccccgttg

SEQ ID NO: 151930 - DNA, 25 bp, E. coli
ctgccgctaatattcgtccccgttg

SEQ ID NO: 151931 - DNA, 25 bp, E. coli
aaaggctacggaggatttatccacg

SEQ ID NO: 151932 - DNA, 25 bp, E. coli
aaaggctacggacgatttatccacg

SEQ ID NO: 151933 - DNA, 25 bp, E. coli
tatccacgacagatttgagatggtg

SEQ ID NO: 151934 - DNA, 25 bp, E. coli
tattcctttgctgcatctgtgtgcc

SEQ ID NO: 151935 - DNA, 25 bp, E. coli
tattcctttgctccatctgtgtgcc

SEQ ID NO: 151936 - DNA, 25 bp, E. coli
tatccacgacagttttgagatggtg

SEQ ID NO: 151937 - DNA, 25 bp, E. coli
tgtatcagatgtaaatgcgatcctg

SEQ ID NO: 151938 - DNA, 25 bp, E. coli
tgtatcagatgttaatgcgatcctg

SEQ ID NO: 151939 - DNA, 25 bp, E. coli
tgcaaacggtcgaaatagcgcagaa

SEQ ID NO: 151940 - DNA, 25 bp, E. coli
tgagatggtggcaaacaactctgtt

SEQ ID NO: 151941 - DNA, 25 bp, E. coli
tgctacctaagtctaaaggctacgg

SEQ ID NO: 151942 - DNA, 25 bp, E. coli
tgcaaacggtcgtaatagcgcagaa

SEQ ID NO: 151943 - DNA, 25 bp, E. coli
tgctacctaagtgtaaaggctacgg

SEQ ID NO: 151944 - DNA, 25 bp, E. coli
tgagatggtggctaacaactctgtt

SEQ ID NO: 151945 - DNA, 25 bp, E. coli
gcttaaaagctctgcaaacggtcga

SEQ ID NO: 151946 - DNA, 25 bp, E. coli
gcttaaaagctcagcaaacggtcga

SEQ ID NO: 151947 - DNA, 25 bp, E. coli
gaaaattacgttatgcctcttgcca

SEQ ID NO: 151948 - DNA, 25 bp, E. coli
gaaaattacgttttgcctcttgcca

SEQ ID NO: 151949 - DNA, 25 bp, E. coli
gatcctgaataaaaatcacccttgc

SEQ ID NO: 151950 - DNA, 25 bp, E. coli
gatcctgaataataatcacccttgc

SEQ ID NO: 151951 - DNA, 25 bp, E. coli
caatgtctgattttacgtgcggcgt

SEQ ID NO: 151952 - DNA, 25 bp, E. coli
caatgtctgattatacgtgcggcgt

SEQ ID NO: 151953 - DNA, 25 bp, E. coli
aactggatgcccagcaacagctggg

SEQ ID NO: 151954 - DNA, 25 bp, E. coli
cagtggattgaatatgccgtgcgcg

SEQ ID NO: 151955 - DNA, 25 bp, E. coli
cagtggattgaaaatgccgtgcgcg

SEQ ID NO: 151956 - DNA, 25 bp, E. coli
taaacgatacatacaaagtggtgcg

SEQ ID NO: 151957 - DNA, 25 bp, E. coli
taaacgatacattcaaagtggtgcg

SEQ ID NO: 151958 - DNA, 25 bp, E. coli
aactggatgccctgcaacagctggg

SEQ ID NO: 151959 - DNA, 25 bp, E. coli
tagtggcacaagagaccgatattcc

SEQ ID NO: 151960 - DNA, 25 bp, E. coli
tagtggcacaagtgaccgatattcc

SEQ ID NO: 151961 - DNA, 25 bp, E. coli
tgaagttgatttcgcgctacccgtg

SEQ ID NO: 151962 - DNA, 25 bp, E. coli
tgaagttgatttggcgctacccgtg

SEQ ID NO: 151963 - DNA, 25 bp, E. coli
tcgcggtaaaactactttgcgggtg

SEQ ID NO: 151964 - DNA, 25 bp, E. coli
tcgcggtaaaacaactttgcgggtg

SEQ ID NO: 151965 - DNA, 25 bp, E. coli
ccaaaattgcgggatcaaatacggg

SEQ ID NO: 151966 - DNA, 25 bp, E. coli
ccaaaattgcggcatcaaatacggg

SEQ ID NO: 151967 - DNA, 25 bp, E. coli
gcattacgtcagatagccagcgccg

SEQ ID NO: 151968 - DNA, 25 bp, E. coli
gcattacgtcagttagccagcgccg

SEQ ID NO: 151969 - DNA, 25 bp, E. coli
gaatgtagaaaggaccgcgtactgg

SEQ ID NO: 151970 - DNA, 25 bp, E. coli
gaatgtagaaagcaccgcgtactgg

SEQ ID NO: 151971 - DNA, 25 bp, E. coli
cgtgcgcggcacctttgatcatcaa

SEQ ID NO: 151972 - DNA, 25 bp, E. coli
cgtgcgcggcacgtttgatcatcaa

SEQ ID NO: 151973 - DNA, 25 bp, E. coli
aatacctgcatgagcgctacctgag

SEQ ID NO: 151974 - DNA, 25 bp, E. coli
aatacctgcatgtgcgctacctgag

SEQ ID NO: 151975 - DNA, 25 bp, E. coli
caaagcacaggtcgaagccatcagg

SEQ ID NO: 151976 - DNA, 25 bp, E. coli
caaagcacaggtggaagccatcagg

SEQ ID NO: 151977 - DNA, 25 bp, E. coli
tacggcggtcagtgaaaactggcag

SEQ ID NO: 151978 - DNA, 25 bp, E. coli
tacggcggtcagagaaaactggcag

SEQ ID NO: 151979 - DNA, 25 bp, E. coli
aaacaatgctactggccagactggc

SEQ ID NO: 151980 - DNA, 25 bp, E. coli
aaacaatgctacaggccagactggc

SEQ ID NO: 151981 - DNA, 25 bp, E. coli
tatcgatgtcggactctttcgggcg

SEQ ID NO: 151982 - DNA, 25 bp, E. coli
tatcgatgtcggtctctttcgggcg

SEQ ID NO: 151983 - DNA, 25 bp, E. coli
tgtggaaaaccatcaaggcgggaca

SEQ ID NO: 151984 - DNA, 25 bp, E. coli
tgtggaaaaccaacaaggcgggaca

SEQ ID NO: 151985 - DNA, 25 bp, E. coli
tcccgcaggagatagccagaaactt

SEQ ID NO: 151986 - DNA, 25 bp, E. coli
tcccgcaggagaaagccagaaactt

SEQ ID NO: 151987 - DNA, 25 bp, E. coli
ccccggcgttgatggcgtgaacaaa

SEQ ID NO: 151988 - DNA, 25 bp, E. coli
ccccggcgttgaaggcgtgaacaaa

SEQ ID NO: 151989 - DNA, 25 bp, E. coli
ggctcattcgcatacgcagtcgtta

SEQ ID NO: 151990 - DNA, 25 bp, E. coli
ggctcattcgcaaacgcagtcgtta

SEQ ID NO: 151991 - DNA, 25 bp, E. coli
gatgcgagtggtctcaacgatcccg

SEQ ID NO: 151992 - DNA, 25 bp, E. coli
gatcgtattgttcagcgggccatgc

SEQ ID NO: 151993 - DNA, 25 bp, E. coli
gatcgtattgttgagcgggccatgc

SEQ ID NO: 151994 - DNA, 25 bp, E. coli
gatgcgagtggtgtcaacgatcccg

SEQ ID NO: 151995 - DNA, 25 bp, E. coli
tatccgctatgacatggcagtgccg

SEQ ID NO: 151996 - DNA, 25 bp, E. coli
tatccgctatgagatggcagtgccg

SEQ ID NO: 151997 - DNA, 25 bp, E. coli
tatatcgaagcgtatcagcctggca

SEQ ID NO: 151998 - DNA, 25 bp, E. coli
tattacgtactcgacgggcaaacgg

SEQ ID NO: 151999 - DNA, 25 bp, E. coli
tattcacccgcaaaagaagagtggg

SEQ ID NO: 152000 - DNA, 25 bp, E. coli
tatttgagaagaacgaagcgcagcg

SEQ ID NO: 152001 - DNA, 25 bp, E. coli
tatttgagaagatcgaagcgcagcg

SEQ ID NO: 152002 - DNA, 25 bp, E. coli
tatatcgaagcgaatcagcctggca

SEQ ID NO: 152003 - DNA, 25 bp, E. coli
tattattcatgatgcctggcagagc

SEQ ID NO: 152004 - DNA, 25 bp, E. coli
tattacgtactccacgggcaaacgg

SEQ ID NO: 152005 - DNA, 25 bp, E. coli
tattcacccgcataagaagagtggg

SEQ ID NO: 152006 - DNA, 25 bp, E. coli
tattattcatgaagcctggcagagc

SEQ ID NO: 152007 - DNA, 25 bp, E. coli
ccctggccgcgtcaagaagttatca

SEQ ID NO: 152008 - DNA, 25 bp, E. coli
ccctggccgcgtgaagaagttatca

SEQ ID NO: 152009 - DNA, 25 bp, E. coli
gatatcaaaattccccacgcgcgta

SEQ ID NO: 152010 - DNA, 25 bp, E. coli
gatctgcttttaaggcctgggcggc

SEQ ID NO: 152011 - DNA, 25 bp, E. coli
gatatcaaaattgcccacgcgcgta

SEQ ID NO: 152012 - DNA, 25 bp, E. coli
gatctgcttttatggcctgggcggc

SEQ ID NO: 152013 - DNA, 25 bp, E. coli
taatctgctggaaccgctggcaaca

SEQ ID NO: 152014 - DNA, 25 bp, E. coli
taatctgctggatccgctggcaaca

SEQ ID NO: 152015 - DNA, 25 bp, E. coli
gagataatctgggaaccctgaaagg

SEQ ID NO: 152016 - DNA, 25 bp, E. coli
gagataatctggcaaccctgaaagg

SEQ ID NO: 152017 - DNA, 25 bp, E. coli
caaattgtcttcaggcaaatccgcg

SEQ ID NO: 152018 - DNA, 25 bp, E. coli
caaattgtcttctggcaaatccgcg

SEQ ID NO: 152019 - DNA, 25 bp, E. coli
catcagcagctgatgcccatggcaa

SEQ ID NO: 152020 - DNA, 25 bp, E. coli
catcagcagctgttgcccatggcaa

SEQ ID NO: 152021 - DNA, 25 bp, E. coli
tacgctggcacgcagcattggaaca

SEQ ID NO: 152022 - DNA, 25 bp, E. coli
tacgctggcacggagcattggaaca

SEQ ID NO: 152023 - DNA, 25 bp, E. coli
tattttaggcgtgtccgccggtgcc

SEQ ID NO: 152024 - DNA, 25 bp, E. coli
tattttaggcgtctccgccggtgcc

SEQ ID NO: 152025 - DNA, 25 bp, E. coli
ttggaacaacagtaatcccacttgg

SEQ ID NO: 152026 - DNA, 25 bp, E. coli
ttggaacaacagaaatcccacttgg

SEQ ID NO: 152027 - DNA, 25 bp, E. coli
tctgaccgcttttgttggcgcaccg

SEQ ID NO: 152028 - DNA, 25 bp, E. coli
tctgaccgctttagttggcgcaccg

SEQ ID NO: 152029 - DNA, 25 bp, E. coli
gccggaaccacctatcagggaatgt

SEQ ID NO: 152030 - DNA, 25 bp, E. coli
gccggaaccaccaatcagggaatgt

SEQ ID NO: 152031 - DNA, 25 bp, E. coli
cccatggcaatgtgtactggcgcga

SEQ ID NO: 152032 - DNA, 25 bp, E. coli
cccatggcaatgagtactggcgcga

SEQ ID NO: 152033 - DNA, 25 bp, E. coli
ctccgctggcgcttgaatttactca

SEQ ID NO: 152034 - DNA, 25 bp, E. coli
ctccgctggcgcatgaatttactca

SEQ ID NO: 152035 - DNA, 25 bp, E. coli
gttgaccggtcaaaaccatcagcag

SEQ ID NO: 152036 - DNA, 25 bp, E. coli
gttgattacgcgtcgggtgacccgc

SEQ ID NO: 152037 - DNA, 25 bp, E. coli
gttgattacgcgacgggtgacccgc

SEQ ID NO: 152038 - DNA, 25 bp, E. coli
gttgaccggtcataaccatcagcag

SEQ ID NO: 152039 - DNA, 25 bp, E. coli
caccataaggttagcctcttactcg

SEQ ID NO: 152040 - DNA, 25 bp, E. coli
caccataaggtttgcctcttactcg

SEQ ID NO: 152041 - DNA, 25 bp, E. coli
cataaggttagcctcttactcgttg

SEQ ID NO: 152042 - DNA, 25 bp, E. coli
cataaggttagcgtcttactcgttg

SEQ ID NO: 152043 - DNA, 25 bp, E. coli
tagcctcttactggttggaaatcaa

SEQ ID NO: 152044 - DNA, 25 bp, E. coli
tagcctcttactcgttggaaatcaa

SEQ ID NO: 152045 - DNA, 25 bp, E. coli
tatagacaccattaggttagcctct

SEQ ID NO: 152046 - DNA, 25 bp, E. coli
tatagacaccataaggttagcctct

SEQ ID NO: 152047 - DNA, 25 bp, E. coli
ttactcgttggaaatcaacacaggg

SEQ ID NO: 152048 - DNA, 25 bp, E. coli
ttactcgttggatatcaacacaggg

SEQ ID NO: 152049 - DNA, 25 bp, E. coli
tgtatagacaccataaggttagcct

SEQ ID NO: 152050 - DNA, 25 bp, E. coli
tgtatagacaccttaaggttagcct

SEQ ID NO: 152051 - DNA, 25 bp, E. coli
gcctcttactcgttggaaatcaaca

SEQ ID NO: 152052 - DNA, 25 bp, E. coli
gcctcttactcgatggaaatcaaca

SEQ ID NO: 152053 - DNA, 25 bp, E. coli
gaaatcaacacagggggctgggaat

SEQ ID NO: 152054 - DNA, 25 bp, E. coli
gaaatcaacacacggggctgggaat

SEQ ID NO: 152055 - DNA, 25 bp, E. coli
gacaccataaggatagcctcttact

SEQ ID NO: 152056 - DNA, 25 bp, E. coli
gacaccataaggttagcctcttact

SEQ ID NO: 152057 - DNA, 25 bp, E. coli
ggttagcctcttactcgttggaaat

SEQ ID NO: 152058 - DNA, 25 bp, E. coli
ggttagcctctttctcgttggaaat

SEQ ID NO: 152059 - DNA, 25 bp, E. coli
taaggttagcctgttactcgttgga

SEQ ID NO: 152060 - DNA, 25 bp, E. coli
taaggttagcctcttactcgttgga

SEQ ID NO: 152061 - DNA, 25 bp, E. coli
cacatcgttgccctctctgaaagaa

SEQ ID NO: 152062 - DNA, 25 bp, E. coli
cacatcgttgccgtctctgaaagaa

SEQ ID NO: 152063 - DNA, 25 bp, E. coli
cagccactgccgtattaaatgttta

SEQ ID NO: 152064 - DNA, 25 bp, E. coli
cagccactgccgaattaaatgttta

SEQ ID NO: 152065 - DNA, 25 bp, E. coli
taaatgtttacagtctcaacaaagg

SEQ ID NO: 152066 - DNA, 25 bp, E. coli
taaatgtttacactctcaacaaagg

SEQ ID NO: 152067 - DNA, 25 bp, E. coli
acgtgaaatttttagtgaagatggc

SEQ ID NO: 152068 - DNA, 25 bp, E. coli
acgtgaaattttaagtgaagatggc

SEQ ID NO: 152069 - DNA, 25 bp, E. coli
aaatgaatttgtgacatcgttgccg

SEQ ID NO: 152070 - DNA, 25 bp, E. coli
aaatgaatttgtcacatcgttgccg

SEQ ID NO: 152071 - DNA, 25 bp, E. coli
tcattttgtggatgggcttgtgacg

SEQ ID NO: 152072 - DNA, 25 bp, E. coli
tctgaaagaagcagggattaaggct

SEQ ID NO: 152073 - DNA, 25 bp, E. coli
tctgaaagaagctgggattaaggct

SEQ ID NO: 152074 - DNA, 25 bp, E. coli
tcattttgtggaagggcttgtgacg

SEQ ID NO: 152075 - DNA, 25 bp, E. coli
gcctctatactgtgcgcgttgagaa

SEQ ID NO: 152076 - DNA, 25 bp, E. coli
gcctctatactgagcgcgttgagaa

SEQ ID NO: 152077 - DNA, 25 bp, E. coli
cggatggttttaatttgcgtgcaaa

SEQ ID NO: 152078 - DNA, 25 bp, E. coli
cggatggttttattttgcgtgcaaa

SEQ ID NO: 152079 - DNA, 25 bp, E. coli
ggcgctattgtctgccactgccgta

SEQ ID NO: 152080 - DNA, 25 bp, E. coli
ggcgctattgtcagccactgccgta

SEQ ID NO: 152081 - DNA, 25 bp, E. coli
tcaacaaaggaagagtggagctgcg

SEQ ID NO: 152082 - DNA, 25 bp, E. coli
tcaacaaaggaacagtggagctgcg

SEQ ID NO: 152083 - DNA, 25 bp, E. coli
catggcaggaaagaagtcaggtact

SEQ ID NO: 152084 - DNA, 25 bp, E. coli
catggcaggaaacaagtcaggtact

SEQ ID NO: 152085 - DNA, 25 bp, E. coli
aggtactcactttctgctatcagcg

SEQ ID NO: 152086 - DNA, 25 bp, E. coli
aggtactcacttactgctatcagcg

SEQ ID NO: 152087 - DNA, 25 bp, E. coli
tacctgagacgagtgttaccctgca

SEQ ID NO: 152088 - DNA, 25 bp, E. coli
tacctgagacgactgttaccctgca

SEQ ID NO: 152089 - DNA, 25 bp, E. coli
tgttaccaggcgaggcccagttgga

SEQ ID NO: 152090 - DNA, 25 bp, E. coli
tgttaccaggcgtggcccagttgga

SEQ ID NO: 152091 - DNA, 25 bp, E. coli
tgatacgccatgtaattgagcgcca

SEQ ID NO: 152092 - DNA, 25 bp, E. coli
tgatacgccatgaaattgagcgcca

SEQ ID NO: 152093 - DNA, 25 bp, E. coli
tgagcgccatctcgttcaaccgcag

SEQ ID NO: 152094 - DNA, 25 bp, E. coli
tgagcgccatctggttcaaccgcag

SEQ ID NO: 152095 - DNA, 25 bp, E. coli
tctggcgccactaatacctgagacg

SEQ ID NO: 152096 - DNA, 25 bp, E. coli
tctggcgccacttatacctgagacg

SEQ ID NO: 152097 - DNA, 25 bp, E. coli
ggaaatcgttctataccttgacccg

SEQ ID NO: 152098 - DNA, 25 bp, E. coli
ggaaatcgttctttaccttgacccg

SEQ ID NO: 152099 - DNA, 25 bp, E. coli
tcaaccgcaggagatggaaatcgtt

SEQ ID NO: 152100 - DNA, 25 bp, E. coli
taatgcattatgctaccacgctgct

SEQ ID NO: 152101 - DNA, 25 bp, E. coli
taatggtcatttagccgtacagcct

SEQ ID NO: 152102 - DNA, 25 bp, E. coli
tcaaccgcaggacatggaaatcgtt

SEQ ID NO: 152103 - DNA, 25 bp, E. coli
taatggtcattttgccgtacagcct

SEQ ID NO: 152104 - DNA, 25 bp, E. coli
taatgcattatggtaccacgctgct

SEQ ID NO: 152105 - DNA, 25 bp, E. coli
caagtgctcgcatcattcgcttatg

SEQ ID NO: 152106 - DNA, 25 bp, E. coli
caagtgctcgcaacattcgcttatg

SEQ ID NO: 152107 - DNA, 25 bp, E. coli
caaaaagcccgaagatgagcgactc

SEQ ID NO: 152108 - DNA, 25 bp, E. coli
cacctggtcacgcactgttaagccg

SEQ ID NO: 152109 - DNA, 25 bp, E. coli
cacctggtcacggactgttaagccg

SEQ ID NO: 152110 - DNA, 25 bp, E. coli
caaaaagcccgatgatgagcgactc

SEQ ID NO: 152111 - DNA, 25 bp, E. coli
tatgcggattatagccgtagtgccg

SEQ ID NO: 152112 - DNA, 25 bp, E. coli
tatgcggattattgccgtagtgccg

SEQ ID NO: 152113 - DNA, 25 bp, E. coli
tgttaagccgctctatgacgctctg

SEQ ID NO: 152114 - DNA, 25 bp, E. coli
tgttaagccgctgtatgacgctctg

SEQ ID NO: 152115 - DNA, 25 bp, E. coli
tgcaatttgcacacaaggtatcggg

SEQ ID NO: 152116 - DNA, 25 bp, E. coli
tgcaatttgcactcaaggtatcggg

SEQ ID NO: 152117 - DNA, 25 bp, E. coli
tccggtactgatgtgatggctgcta

SEQ ID NO: 152118 - DNA, 25 bp, E. coli
tccggtactgatctgatggctgcta

SEQ ID NO: 152119 - DNA, 25 bp, E. coli
gcgctgtgacgatgctaatcccaaa

SEQ ID NO: 152120 - DNA, 25 bp, E. coli
gcgctgtgacgaagctaatcccaaa

SEQ ID NO: 152121 - DNA, 25 bp, E. coli
gtaagcacgaactcagccagaacga

SEQ ID NO: 152122 - DNA, 25 bp, E. coli
ggatggcgcaatcacaagccggatt

SEQ ID NO: 152123 - DNA, 25 bp, E. coli
gtaagcacgaacacagccagaacga

SEQ ID NO: 152124 - DNA, 25 bp, E. coli
ggatggcgcaatgacaagccggatt

SEQ ID NO: 152125 - DNA, 25 bp, E. coli
taaggcaaaggtactgcaagtgctc

SEQ ID NO: 152126 - DNA, 25 bp, E. coli
taaggcaaaggttctgcaagtgctc

SEQ ID NO: 152127 - DNA, 25 bp, E. coli
caaccttgttgcttctgcgactgaa

SEQ ID NO: 152128 - DNA, 25 bp, E. coli
caaccttgttgcatctgcgactgaa

SEQ ID NO: 152129 - DNA, 25 bp, E. coli
catgcgccgctgcaaaagaatcagg

SEQ ID NO: 152130 - DNA, 25 bp, E. coli
catgcgccgctggaaaagaatcagg

SEQ ID NO: 152131 - DNA, 25 bp, E. coli
taaagacgtgtagctgaccattccg

SEQ ID NO: 152132 - DNA, 25 bp, E. coli
taaagacgtgtacctgaccattccg

SEQ ID NO: 152133 - DNA, 25 bp, E. coli
aacagcagtgaattgcatgcgccgc

SEQ ID NO: 152134 - DNA, 25 bp, E. coli
aacagcagtgaaatgcatgcgccgc

SEQ ID NO: 152135 - DNA, 25 bp, E. coli
tattcgccagctcaaccgtaacggc

SEQ ID NO: 152136 - DNA, 25 bp, E. coli
tattcgccagctgaaccgtaacggc

SEQ ID NO: 152137 - DNA, 25 bp, E. coli
tgaaaaatacccacttccagacggt

SEQ ID NO: 152138 - DNA, 25 bp, E. coli
tgaaaaataccctcttccagacggt

SEQ ID NO: 152139 - DNA, 25 bp, E. coli
tgccagcctgaccaaaatgatgacc

SEQ ID NO: 152140 - DNA, 25 bp, E. coli
tgccagcctgacgaaaatgatgacc

SEQ ID NO: 152141 - DNA, 25 bp, E. coli
gaatgtcgacgggatcaaaaccgga

SEQ ID NO: 152142 - DNA, 25 bp, E. coli
gaatgtcgacggcatcaaaaccgga

SEQ ID NO: 152143 - DNA, 25 bp, E. coli
ccgattttgccgctggtagccagga

SEQ ID NO: 152144 - DNA, 25 bp, E. coli
ccgcgtggtcgcttgaaagatctga

SEQ ID NO: 152145 - DNA, 25 bp, E. coli
ccgcgtggtcgcatgaaagatctga

SEQ ID NO: 152146 - DNA, 25 bp, E. coli
ccgattttgccggtggtagccagga

SEQ ID NO: 152147 - DNA, 25 bp, E. coli
taacgatgcttgtgtcgccatggcc

SEQ ID NO: 152148 - DNA, 25 bp, E. coli
taacgatgcttgagtcgccatggcc

SEQ ID NO: 152149 - DNA, 25 bp, E. coli
agcagccgctgtactcctcgaaaaa

SEQ ID NO: 152150 - DNA, 25 bp, E. coli
agcagccgctgttctcctcgaaaaa

SEQ ID NO: 152151 - DNA, 25 bp, E. coli
aaagcgccgaatgtaccaccgcgta

SEQ ID NO: 152152 - DNA, 25 bp, E. coli
aaagcgccgaatctaccaccgcgta

SEQ ID NO: 152153 - DNA, 25 bp, E. coli
tacgccacccgtcaagactgtgttg

SEQ ID NO: 152154 - DNA, 25 bp, E. coli
tacccgtggcggatttggtgaatct

SEQ ID NO: 152155 - DNA, 25 bp, E. coli
tacgccacccgtgaagactgtgttg

SEQ ID NO: 152156 - DNA, 25 bp, E. coli
tacccgtggcggttttggtgaatct

SEQ ID NO: 152157 - DNA, 25 bp, E. coli
tgttgccaaacatagcactatgcag

SEQ ID NO: 152158 - DNA, 25 bp, E. coli
tgttgccaaacaaagcactatgcag

SEQ ID NO: 152159 - DNA, 25 bp, E. coli
gacgactgttcagctgcaaacccag

SEQ ID NO: 152160 - DNA, 25 bp, E. coli
gacgactgttcacctgcaaacccag

SEQ ID NO: 152161 - DNA, 25 bp, E. coli
ctgaaagaagccgaacgtactgcgc

SEQ ID NO: 152162 - DNA, 25 bp, E. coli
ctcttctcgttctatgggtggctga

SEQ ID NO: 152163 - DNA, 25 bp, E. coli
ctgaaagaagcccaacgtactgcgc

SEQ ID NO: 152164 - DNA, 25 bp, E. coli
ctcttctcgttcaatgggtggctga

SEQ ID NO: 152165 - DNA, 25 bp, E. coli
ggtaaaaactatcgcgcagcccagc

SEQ ID NO: 152166 - DNA, 25 bp, E. coli
ggtaaaaactatggcgcagcccagc

SEQ ID NO: 152167 - DNA, 25 bp, E. coli
tggcatggcacctgaaaaccaggcg

SEQ ID NO: 152168 - DNA, 25 bp, E. coli
tggcatggcaccagaaaaccaggcg

SEQ ID NO: 152169 - DNA, 25 bp, E. coli
gagtttctggatgccgctgatggcc

SEQ ID NO: 152170 - DNA, 25 bp, E. coli
gagtttctggatcccgctgatggcc

SEQ ID NO: 152171 - DNA, 25 bp, E. coli
taaaatcaaagtgctggtcgcgacg

SEQ ID NO: 152172 - DNA, 25 bp, E. coli
taaaatcaaagtcctggtcgcgacg

SEQ ID NO: 152173 - DNA, 25 bp, E. coli
aaactactggttgtacagcgcaccg

SEQ ID NO: 152174 - DNA, 25 bp, E. coli
aaactactggttctacagcgcaccg

SEQ ID NO: 152175 - DNA, 25 bp, E. coli
ttgtcggttactaccaacaggtggg

SEQ ID NO: 152176 - DNA, 25 bp, E. coli
ttgtcggttacttccaacaggtggg

SEQ ID NO: 152177 - DNA, 25 bp, E. coli
tgattacccctcctttgatgccagg

SEQ ID NO: 152178 - DNA, 25 bp, E. coli
tgattacccctcgtttgatgccagg

SEQ ID NO: 152179 - DNA, 25 bp, E. coli
ccagggagtatcaggagcaggcact

SEQ ID NO: 152180 - DNA, 25 bp, E. coli
ccagggagtatctggagcaggcact

SEQ ID NO: 152181 - DNA, 25 bp, E. coli
cgtgctatagataccgcagttggca

SEQ ID NO: 152182 - DNA, 25 bp, E. coli
cgtggattctgcttggacgctgaca

SEQ ID NO: 152183 - DNA, 25 bp, E. coli
ctttgtggtggtcaagaccgcgcta

SEQ ID NO: 152184 - DNA, 25 bp, E. coli
cgtgctatagattccgcagttggca

SEQ ID NO: 152185 - DNA, 25 bp, E. coli
ctttgtggtggtgaagaccgcgcta

SEQ ID NO: 152186 - DNA, 25 bp, E. coli
cgtggattctgcatggacgctgaca

SEQ ID NO: 152187 - DNA, 25 bp, E. coli
gtaacaccagcgctactttcaggga

SEQ ID NO: 152188 - DNA, 25 bp, E. coli
gatattttgcgcgaactgcctgcga

SEQ ID NO: 152189 - DNA, 25 bp, E. coli
gttttatatccagtcgctgaccgca

SEQ ID NO: 152190 - DNA, 25 bp, E. coli
gttttatatccactcgctgaccgca

SEQ ID NO: 152191 - DNA, 25 bp, E. coli
gatattttgcgccaactgcctgcga

SEQ ID NO: 152192 - DNA, 25 bp, E. coli
gtaacaccagcggtactttcaggga

SEQ ID NO: 152193 - DNA, 25 bp, E. coli
aatcgaagtttagatggcaggcggc

SEQ ID NO: 152194 - DNA, 25 bp, E. coli
aatcgaagtttacatggcaggcggc

SEQ ID NO: 152195 - DNA, 25 bp, E. coli
caaagcatactctaacaagccgtgg

SEQ ID NO: 152196 - DNA, 25 bp, E. coli
caaagcatactcaaacaagccgtgg

SEQ ID NO: 152197 - DNA, 25 bp, E. coli
taaaacagctaatggatgccgaaac

SEQ ID NO: 152198 - DNA, 25 bp, E. coli
taaaacagctaaaggatgccgaaac

SEQ ID NO: 152199 - DNA, 25 bp, E. coli
attttgcgcccgattggcagccgcc

SEQ ID NO: 152200 - DNA, 25 bp, E. coli
attttgcgcccgtttggcagccgcc

SEQ ID NO: 152201 - DNA, 25 bp, E. coli
taccgccatgatttctacccgaatg

SEQ ID NO: 152202 - DNA, 25 bp, E. coli
taccgccatgatatctacccgaatg

SEQ ID NO: 152203 - DNA, 25 bp, E. coli
ttcccactgcttggcgagctgcaaa

SEQ ID NO: 152204 - DNA, 25 bp, E. coli
ttcccactgcttcgcgagctgcaaa

SEQ ID NO: 152205 - DNA, 25 bp, E. coli
cgaaagtaataagcaacaggcagtg

SEQ ID NO: 152206 - DNA, 25 bp, E. coli
cccgaatgcctgttgacgtggtgga

SEQ ID NO: 152207 - DNA, 25 bp, E. coli
cccgaatgcctgatgacgtggtgga

SEQ ID NO: 152208 - DNA, 25 bp, E. coli
cgaaagtaataaccaacaggcagtg

SEQ ID NO: 152209 - DNA, 25 bp, E. coli
tggaagaaggactcaaccgtctggg

SEQ ID NO: 152210 - DNA, 25 bp, E. coli
tggaagaaggacacaaccgtctggg

SEQ ID NO: 152211 - DNA, 25 bp, E. coli
taatgccgtcagtaggctacgaagg

SEQ ID NO: 152212 - DNA, 25 bp, E. coli
taatgccgtcagaaggctacgaagg

SEQ ID NO: 152213 - DNA, 25 bp, E. coli
gagattgtcgcttactttaccgcca

SEQ ID NO: 152214 - DNA, 25 bp, E. coli
gagattgtcgctaactttaccgcca

SEQ ID NO: 152215 - DNA, 25 bp, E. coli
cagctatccgtaaggcgtgttcggt

SEQ ID NO: 152216 - DNA, 25 bp, E. coli
cagctatccgtatggcgtgttcggt

SEQ ID NO: 152217 - DNA, 25 bp, E. coli
taacagctatccgtatggcgtgttc

SEQ ID NO: 152218 - DNA, 25 bp, E. coli
taacagctatccctatggcgtgttc

SEQ ID NO: 152219 - DNA, 25 bp, E. coli
agttaacagctatccgtatggcgtg

SEQ ID NO: 152220 - DNA, 25 bp, E. coli
agctatccgtatggcgtgttcggtt

SEQ ID NO: 152221 - DNA, 25 bp, E. coli
agttaacagctaaccgtatggcgtg

SEQ ID NO: 152222 - DNA, 25 bp, E. coli
atgccagttaacagctatccgtatg

SEQ ID NO: 152223 - DNA, 25 bp, E. coli
atgccagttaactgctatccgtatg

SEQ ID NO: 152224 - DNA, 25 bp, E. coli
atccgtatggcgagttcggttttgc

SEQ ID NO: 152225 - DNA, 25 bp, E. coli
agctatccgtatcgcgtgttcggtt

SEQ ID NO: 152226 - DNA, 25 bp, E. coli
atccgtatggcgtgttcggttttgc

SEQ ID NO: 152227 - DNA, 25 bp, E. coli
ttttgcgaataaaaaatggttactg

SEQ ID NO: 152228 - DNA, 25 bp, E. coli
ttttgcgaataataaatggttactg

SEQ ID NO: 152229 - DNA, 25 bp, E. coli
tgcgaataaaaattggttactgtag

SEQ ID NO: 152230 - DNA, 25 bp, E. coli
tgcgaataaaaaatggttactgtag

SEQ ID NO: 152231 - DNA, 25 bp, E. coli
tgccagttaacagctatccgtatgg

SEQ ID NO: 152232 - DNA, 25 bp, E. coli
tgccagttaacacctatccgtatgg

SEQ ID NO: 152233 - DNA, 25 bp, E. coli
ccagttaacagctatccgtatggcg

SEQ ID NO: 152234 - DNA, 25 bp, E. coli
ccagttaacagcaatccgtatggcg

SEQ ID NO: 152235 - DNA, 25 bp, E. coli
gttaacagctatccgtatggcgtgt

SEQ ID NO: 152236 - DNA, 25 bp, E. coli
gttaacagctatgcgtatggcgtgt

SEQ ID NO: 152237 - DNA, 25 bp, E. coli
catctgggtgtcaacgcttgccgta

SEQ ID NO: 152238 - DNA, 25 bp, E. coli
catctgggtgtctacgcttgccgta

SEQ ID NO: 152239 - DNA, 25 bp, E. coli
ttccgtacgactaaagtgattttca

SEQ ID NO: 152240 - DNA, 25 bp, E. coli
ttccgtacgacttaagtgattttca

SEQ ID NO: 152241 - DNA, 25 bp, E. coli
ttgcggtctaccgtttacgcgccag

SEQ ID NO: 152242 - DNA, 25 bp, E. coli
ttgcggtctaccctttacgcgccag

SEQ ID NO: 152243 - DNA, 25 bp, E. coli
ttacgagcatctcggtgtctacgct

SEQ ID NO: 152244 - DNA, 25 bp, E. coli
ttacgagcatctgggtgtctacgct

SEQ ID NO: 152245 - DNA, 25 bp, E. coli
tgttgactggagcttctccggcacc

SEQ ID NO: 152246 - DNA, 25 bp, E. coli
tgttgactggaggttctccggcacc

SEQ ID NO: 152247 - DNA, 25 bp, E. coli
tgactggagcttctccggcaccacg

SEQ ID NO: 152248 - DNA, 25 bp, E. coli
tgactggagcttgtccggcaccacg

SEQ ID NO: 152249 - DNA, 25 bp, E. coli
cgattatccgttagttgactggagc

SEQ ID NO: 152250 - DNA, 25 bp, E. coli
ccgtttgttgacaggagcttctccg

SEQ ID NO: 152251 - DNA, 25 bp, E. coli
ccgtttgttgactggagcttctccg

SEQ ID NO: 152252 - DNA, 25 bp, E. coli
cgattatccgtttgttgactggagc

SEQ ID NO: 152253 - DNA, 25 bp, E. coli
gtctaccgtttacgcgccagtccga

SEQ ID NO: 152254 - DNA, 25 bp, E. coli
gtctaccgtttaggcgccagtccga

SEQ ID NO: 152255 - DNA, 25 bp, E. coli
gggtgtctacgcttgccgtattatc

SEQ ID NO: 152256 - DNA, 25 bp, E. coli
gggtgtctacgcatgccgtattatc

SEQ ID NO: 152257 - DNA, 25 bp, E. coli
tacgactaaagtgattttcatgacg

SEQ ID NO: 152258 - DNA, 25 bp, E. coli
tacgactaaagtcattttcatgacg

SEQ ID NO: 152259 - DNA, 25 bp, E. coli
catggattatcgacagcgtccggca

SEQ ID NO: 152260 - DNA, 25 bp, E. coli
catggattatcgtcagcgtccggca

SEQ ID NO: 152261 - DNA, 25 bp, E. coli
taacgacgaacggaaactgaatggt

SEQ ID NO: 152262 - DNA, 25 bp, E. coli
agtgaccttcctgtctgaccgtgtg

SEQ ID NO: 152263 - DNA, 25 bp, E. coli
agtgaccttcctctctgaccgtgtg

SEQ ID NO: 152264 - DNA, 25 bp, E. coli
aaaacgcgatggctattcaggtgcc

SEQ ID NO: 152265 - DNA, 25 bp, E. coli
aacgtcgtctggtgctgccggatga

SEQ ID NO: 152266 - DNA, 25 bp, E. coli
aaaacgcgatgggtattcaggtgcc

SEQ ID NO: 152267 - DNA, 25 bp, E. coli
aacgtcgtctggagctgccggatga

SEQ ID NO: 152268 - DNA, 25 bp, E. coli
tatctcgccgcgctgaatgaggcat

SEQ ID NO: 152269 - DNA, 25 bp, E. coli
tatctcgccgcggtgaatgaggcat

SEQ ID NO: 152270 - DNA, 25 bp, E. coli
tggtgccgtacatagaactcgagcg

SEQ ID NO: 152271 - DNA, 25 bp, E. coli
tggtgccgtacaaagaactcgagcg

SEQ ID NO: 152272 - DNA, 25 bp, E. coli
tgaaaatggcagtgatccttaccgg

SEQ ID NO: 152273 - DNA, 25 bp, E. coli
tgaaaatggcagagatccttaccgg

SEQ ID NO: 152274 - DNA, 25 bp, E. coli
tcatcaacgaacagggcgacaagaa

SEQ ID NO: 152275 - DNA, 25 bp, E. coli
tcatcaacgaactgggcgacaagaa

SEQ ID NO: 152276 - DNA, 25 bp, E. coli
gcgtgcgtgaaacctccatgaaaat

SEQ ID NO: 152277 - DNA, 25 bp, E. coli
gcgtgcgtgaaagctccatgaaaat

SEQ ID NO: 152278 - DNA, 25 bp, E. coli
gatatccactggtgcatgaccggcg

SEQ ID NO: 152279 - DNA, 25 bp, E. coli
gatatccactggagcatgaccggcg

SEQ ID NO: 152280 - DNA, 25 bp, E. coli
taacgacgaacgcaaactgaatggt

SEQ ID NO: 152281 - DNA, 25 bp, E. coli
taccacctcgtttcgcggcgcaggt

SEQ ID NO: 152282 - DNA, 25 bp, E. coli
taccacctcgttacgcggcgcaggt

SEQ ID NO: 152283 - DNA, 25 bp, E. coli
atggcgctaccacctcgtttcgcgg

SEQ ID NO: 152284 - DNA, 25 bp, E. coli
actggctccgtcagtgattctctct

SEQ ID NO: 152285 - DNA, 25 bp, E. coli
atggcgctaccagctcgtttcgcgg

SEQ ID NO: 152286 - DNA, 25 bp, E. coli
actggctccgtctgtgattctctct

SEQ ID NO: 152287 - DNA, 25 bp, E. coli
tctctgggaattatctcgattaccg

SEQ ID NO: 152288 - DNA, 25 bp, E. coli
tctctgggaattttctcgattaccg

SEQ ID NO: 152289 - DNA, 25 bp, E. coli
gctggaactggctccgtcagtgatt

SEQ ID NO: 152290 - DNA, 25 bp, E. coli
gctggaactggcaccgtcagtgatt

SEQ ID NO: 152291 - DNA, 25 bp, E. coli
gaattatctcgaataccgatggtct

SEQ ID NO: 152292 - DNA, 25 bp, E. coli
gaattatctcgattaccgatggtct

SEQ ID NO: 152293 - DNA, 25 bp, E. coli
gaactggctccgtcagtgattctct

SEQ ID NO: 152294 - DNA, 25 bp, E. coli
gaactggctccgacagtgattctct

SEQ ID NO: 152295 - DNA, 25 bp, E. coli
cgcgctggaactggctccgtcagtg

SEQ ID NO: 152296 - DNA, 25 bp, E. coli
cgcgctggaactcgctccgtcagtg

SEQ ID NO: 152297 - DNA, 25 bp, E. coli
cgcaggtggcacaggagctaaagat

SEQ ID NO: 152298 - DNA, 25 bp, E. coli
cgcaggtggcactggagctaaagat

SEQ ID NO: 152299 - DNA, 25 bp, E. coli
gattctctctctgggaattatctcg

SEQ ID NO: 152300 - DNA, 25 bp, E. coli
gattctctctctcggaattatctcg

SEQ ID NO: 152301 - DNA, 25 bp, E. coli
tggcacaggagcaaaagatggcttt

SEQ ID NO: 152302 - DNA, 25 bp, E. coli
tggcacaggagctaaagatggcttt

SEQ ID NO: 152303 - DNA, 25 bp, E. coli
aacgtaccgctgtagcccagcgcga

SEQ ID NO: 152304 - DNA, 25 bp, E. coli
agaacatcactgtactctccggcgg

SEQ ID NO: 152305 - DNA, 25 bp, E. coli
atcactgaactctccggcggtaacc

SEQ ID NO: 152306 - DNA, 25 bp, E. coli
atcactgaactcaccggcggtaacc

SEQ ID NO: 152307 - DNA, 25 bp, E. coli
agaacatcactgaactctccggcgg

SEQ ID NO: 152308 - DNA, 25 bp, E. coli
aactgcctgtttcgcgttgataaac

SEQ ID NO: 152309 - DNA, 25 bp, E. coli
aactgcctgtttggcgttgataaac

SEQ ID NO: 152310 - DNA, 25 bp, E. coli
aacgtaccgctgaagcccagcgcga

SEQ ID NO: 152311 - DNA, 25 bp, E. coli
tatcgctcagaacatagctatcagc

SEQ ID NO: 152312 - DNA, 25 bp, E. coli
tatcgctcagaagatagctatcagc

SEQ ID NO: 152313 - DNA, 25 bp, E. coli
tgatgaactgccagtttggcgttga

SEQ ID NO: 152314 - DNA, 25 bp, E. coli
tgtcacccggaactgatcattttcg

SEQ ID NO: 152315 - DNA, 25 bp, E. coli
tgatgaactgcctgtttggcgttga

SEQ ID NO: 152316 - DNA, 25 bp, E. coli
tgtcacccggaagtgatcattttcg

SEQ ID NO: 152317 - DNA, 25 bp, E. coli
tgctgtcacccggaagtgatcattt

SEQ ID NO: 152318 - DNA, 25 bp, E. coli
tgctgtcacccgcaagtgatcattt

SEQ ID NO: 152319 - DNA, 25 bp, E. coli
tctccggcggtatccagcagaaagt

SEQ ID NO: 152320 - DNA, 25 bp, E. coli
tctccggcggtaaccagcagaaagt

SEQ ID NO: 152321 - DNA, 25 bp, E. coli
cggcggtaaccaccagaaagtcctg

SEQ ID NO: 152322 - DNA, 25 bp, E. coli
cggcggtaaccagcagaaagtcctg

SEQ ID NO: 152323 - DNA, 25 bp, E. coli
cttttctatcgctcagaacatagct

SEQ ID NO: 152324 - DNA, 25 bp, E. coli
cttttctatcgcacagaacatagct

SEQ ID NO: 152325 - DNA, 25 bp, E. coli
taaacagtattttgtccagccgtcg

SEQ ID NO: 152326 - DNA, 25 bp, E. coli
taaaccgaaagatcgcctgacaccg

SEQ ID NO: 152327 - DNA, 25 bp, E. coli
taaacagtatttagtccagccgtcg

SEQ ID NO: 152328 - DNA, 25 bp, E. coli
taaaccgaaagaacgcctgacaccg

SEQ ID NO: 152329 - DNA, 25 bp, E. coli
tatgtgaaatccataggcgacagcg

SEQ ID NO: 152330 - DNA, 25 bp, E. coli
tatgtgaaatccttaggcgacagcg

SEQ ID NO: 152331 - DNA, 25 bp, E. coli
tatttgccgggatcagccgcaataa

SEQ ID NO: 152332 - DNA, 25 bp, E. coli
tatttgccgggaacagccgcaataa

SEQ ID NO: 152333 - DNA, 25 bp, E. coli
cctgcctgcgctcggaagataaaca

SEQ ID NO: 152334 - DNA, 25 bp, E. coli
cctttggtcactgggcatcgctgga

SEQ ID NO: 152335 - DNA, 25 bp, E. coli
cctttggtcactcggcatcgctgga

SEQ ID NO: 152336 - DNA, 25 bp, E. coli
ccggatgccgaccagctgcttaact

SEQ ID NO: 152337 - DNA, 25 bp, E. coli
cctgcctgcgctgggaagataaaca

SEQ ID NO: 152338 - DNA, 25 bp, E. coli
gcagtgggatctgcagaccgccaaa

SEQ ID NO: 152339 - DNA, 25 bp, E. coli
gcagtgggatctccagaccgccaaa

SEQ ID NO: 152340 - DNA, 25 bp, E. coli
ccggatgccgacgagctgcttaact

SEQ ID NO: 152341 - DNA, 25 bp, E. coli
gatatgccaaattactggtcaccgg

SEQ ID NO: 152342 - DNA, 25 bp, E. coli
gatatgtacagcaaagaatcgccgg

SEQ ID NO: 152343 - DNA, 25 bp, E. coli
gatatgccaaataactggtcaccgg

SEQ ID NO: 152344 - DNA, 25 bp, E. coli
gatatgtacagctaagaatcgccgg

SEQ ID NO: 152345 - DNA, 25 bp, E. coli
ggaaagataccctctggctgacggg

SEQ ID NO: 152346 - DNA, 25 bp, E. coli
ggaaagatacccactggctgacggg

SEQ ID NO: 152347 - DNA, 25 bp, E. coli
catgctctcagaattaacttaactg

SEQ ID NO: 152348 - DNA, 25 bp, E. coli
catgctctcagatttaacttaactg

SEQ ID NO: 152349 - DNA, 25 bp, E. coli
cgcaacgaaaaagaattcagatttt

SEQ ID NO: 152350 - DNA, 25 bp, E. coli
cgcaacgaaaaacaattcagatttt

SEQ ID NO: 152351 - DNA, 25 bp, E. coli
aaaaagcccggtccaatatacgccg

SEQ ID NO: 152352 - DNA, 25 bp, E. coli
aaaaagcccggtgcaatatacgccg

SEQ ID NO: 152353 - DNA, 25 bp, E. coli
tatacgccgggcctcaattttattg

SEQ ID NO: 152354 - DNA, 25 bp, E. coli
tatacgccgggcgtcaattttattg

SEQ ID NO: 152355 - DNA, 25 bp, E. coli
tagtctataagatatttggcaaaaa

SEQ ID NO: 152356 - DNA, 25 bp, E. coli
tagtctataagaaatttggcaaaaa

SEQ ID NO: 152357 - DNA, 25 bp, E. coli
gcatcctgataacagctaaaagttt

SEQ ID NO: 152358 - DNA, 25 bp, E. coli
gcatcctgataagagctaaaagttt

SEQ ID NO: 152359 - DNA, 25 bp, E. coli
gaatcatgatgtttttagcatcctg

SEQ ID NO: 152360 - DNA, 25 bp, E. coli
gaattaacttaactgtgaatcatga

SEQ ID NO: 152361 - DNA, 25 bp, E. coli
gaatcatgatgtatttagcatcctg

SEQ ID NO: 152362 - DNA, 25 bp, E. coli
gaattaacttaagtgtgaatcatga

SEQ ID NO: 152363 - DNA, 25 bp, E. coli
cgatggtcaacgcaacgaaaaacaa

SEQ ID NO: 152364 - DNA, 25 bp, E. coli
cgatggtcaacggaacgaaaaacaa

SEQ ID NO: 152365 - DNA, 25 bp, E. coli
taagcagtgaaaattagtctataag

SEQ ID NO: 152366 - DNA, 25 bp, E. coli
taacgctacgttcttcgatggtcaa

SEQ ID NO: 152367 - DNA, 25 bp, E. coli
taacgctacgttgttcgatggtcaa

SEQ ID NO: 152368 - DNA, 25 bp, E. coli
taagcagtgaaatttagtctataag

SEQ ID NO: 152369 - DNA, 25 bp, E. coli
aacctgcccttgtttcagcgcgctt

SEQ ID NO: 152370 - DNA, 25 bp, E. coli
aacctgcccttgattcagcgcgctt

SEQ ID NO: 152371 - DNA, 25 bp, E. coli
cacgcaatttttgatactctaaata

SEQ ID NO: 152372 - DNA, 25 bp, E. coli
cacgcaatttttcatactctaaata

SEQ ID NO: 152373 - DNA, 25 bp, E. coli
aaatcacagggctgggaaacctgcc

SEQ ID NO: 152374 - DNA, 25 bp, E. coli
aaatcacagggcagggaaacctgcc

SEQ ID NO: 152375 - DNA, 25 bp, E. coli
tttcagcgcgcttttagagcacgca

SEQ ID NO: 152376 - DNA, 25 bp, E. coli
tttcagcgcgctattagagcacgca

SEQ ID NO: 152377 - DNA, 25 bp, E. coli
tgtttcagcgcgcttttagagcacg

SEQ ID NO: 152378 - DNA, 25 bp, E. coli
tgtttcagcgcggttttagagcacg

SEQ ID NO: 152379 - DNA, 25 bp, E. coli
gcgcgcttttagagcacgcaatttt

SEQ ID NO: 152380 - DNA, 25 bp, E. coli
gcgcgcttttagtgcacgcaatttt

SEQ ID NO: 152381 - DNA, 25 bp, E. coli
gcccttgtttcaccgcgcttttaga

SEQ ID NO: 152382 - DNA, 25 bp, E. coli
gcccttgtttcagcgcgcttttaga

SEQ ID NO: 152383 - DNA, 25 bp, E. coli
gcagggaaacctgcccttgtttcag

SEQ ID NO: 152384 - DNA, 25 bp, E. coli
gcagggaaacctccccttgtttcag

SEQ ID NO: 152385 - DNA, 25 bp, E. coli
cgcttttagagctcgcaatttttca

SEQ ID NO: 152386 - DNA, 25 bp, E. coli
cgcttttagagcacgcaatttttca

SEQ ID NO: 152387 - DNA, 25 bp, E. coli
ggaaacctgcccatgtttcagcgcg

SEQ ID NO: 152388 - DNA, 25 bp, E. coli
ggaaacctgcccttgtttcagcgcg

SEQ ID NO: 152389 - DNA, 25 bp, E. coli
tcagcgcgctttaagagcacgcaat

SEQ ID NO: 152390 - DNA, 25 bp, E. coli
tcagcgcgcttttagagcacgcaat

SEQ ID NO: 152391 - DNA, 25 bp, E. coli
caatgtttgggcgatttttattacg

SEQ ID NO: 152392 - DNA, 25 bp, E. coli
caatgtttgggccatttttattacg

SEQ ID NO: 152393 - DNA, 25 bp, E. coli
tataaaaagtcgtttttctgcttag

SEQ ID NO: 152394 - DNA, 25 bp, E. coli
tataaaaagtcgattttctgcttag

SEQ ID NO: 152395 - DNA, 25 bp, E. coli
agtcgtttttctgcttaggattttg

SEQ ID NO: 152396 - DNA, 25 bp, E. coli
agtcgtttttctccttaggattttg

SEQ ID NO: 152397 - DNA, 25 bp, E. coli
aaagtctgttttaaatattatcatg

SEQ ID NO: 152398 - DNA, 25 bp, E. coli
aaagtctgtttttaatattatcatg

SEQ ID NO: 152399 - DNA, 25 bp, E. coli
tattacgataataaagtctgttttt

SEQ ID NO: 152400 - DNA, 25 bp, E. coli
tttgatcgcccgtacagcaatgttt

SEQ ID NO: 152401 - DNA, 25 bp, E. coli
tttgatcgcccgaacagcaatgttt

SEQ ID NO: 152402 - DNA, 25 bp, E. coli
tattacgataattaagtctgttttt

SEQ ID NO: 152403 - DNA, 25 bp, E. coli
ttatttaaattatgcctgtaatgcc

SEQ ID NO: 152404 - DNA, 25 bp, E. coli
ttatttaaattaagcctgtaatgcc

SEQ ID NO: 152405 - DNA, 25 bp, E. coli
tgtttgggcgatttttattacgata

SEQ ID NO: 152406 - DNA, 25 bp, E. coli
tgtttgggcgatatttattacgata

SEQ ID NO: 152407 - DNA, 25 bp, E. coli
cccgaacagcaaagtttgggcgatt

SEQ ID NO: 152408 - DNA, 25 bp, E. coli
cccgaacagcaatgtttgggcgatt

SEQ ID NO: 152409 - DNA, 25 bp, E. coli
ctgtaatgccttccttccattgcgg

SEQ ID NO: 152410 - DNA, 25 bp, E. coli
ctgtaatgccttgcttccattgcgg

SEQ ID NO: 152411 - DNA, 25 bp, E. coli
gatcgcccgaacagcaatgtttggg

SEQ ID NO: 152412 - DNA, 25 bp, E. coli
gatcgcccgaactgcaatgtttggg

SEQ ID NO: 152413 - DNA, 25 bp, E. coli
ctcttgagttatatatttccggtta

SEQ ID NO: 152414 - DNA, 25 bp, E. coli
ctcttgagttatttatttccggtta

SEQ ID NO: 152415 - DNA, 25 bp, E. coli
agtgcaggaattatattttcgccgg

SEQ ID NO: 152416 - DNA, 25 bp, E. coli
agtgcaggaattttattttcgccgg

SEQ ID NO: 152417 - DNA, 25 bp, E. coli
tatatttccggttatctattgtgga

SEQ ID NO: 152418 - DNA, 25 bp, E. coli
tatttccggttatctattgtggaaa

SEQ ID NO: 152419 - DNA, 25 bp, E. coli
tatatttccggtaatctattgtgga

SEQ ID NO: 152420 - DNA, 25 bp, E. coli
tatctcttgagttatatatttccgg

SEQ ID NO: 152421 - DNA, 25 bp, E. coli
tatttccggttaactattgtggaaa

SEQ ID NO: 152422 - DNA, 25 bp, E. coli
tatctcttgagtaatatatttccgg

SEQ ID NO: 152423 - DNA, 25 bp, E. coli
tgcaggaattattttttcgccggat

SEQ ID NO: 152424 - DNA, 25 bp, E. coli
tgcaggaattatattttcgccggat

SEQ ID NO: 152425 - DNA, 25 bp, E. coli
tccggttatctattgtggaaattta

SEQ ID NO: 152426 - DNA, 25 bp, E. coli
tccggttatctaatgtggaaattta

SEQ ID NO: 152427 - DNA, 25 bp, E. coli
cttgagttatatttttccggttatc

SEQ ID NO: 152428 - DNA, 25 bp, E. coli
cttgagttatatatttccggttatc

SEQ ID NO: 152429 - DNA, 25 bp, E. coli
gtgcaggaattaaattttcgccgga

SEQ ID NO: 152430 - DNA, 25 bp, E. coli
gtgcaggaattatattttcgccgga

SEQ ID NO: 152431 - DNA, 25 bp, E. coli
taagtgcaggaaatatattttcgcc

SEQ ID NO: 152432 - DNA, 25 bp, E. coli
taagtgcaggaattatattttcgcc

SEQ ID NO: 152433 - DNA, 25 bp, E. coli
gatgcaatatctcttgagttatata

SEQ ID NO: 152434 - DNA, 25 bp, E. coli
gatgcaatatctgttgagttatata

SEQ ID NO: 152435 - DNA, 25 bp, E. coli
caagaataacagtagatgaaagtga

SEQ ID NO: 152436 - DNA, 25 bp, E. coli
caagaataacagaagatgaaagtga

SEQ ID NO: 152437 - DNA, 25 bp, E. coli
caaaaatacaaggactgacagtacg

SEQ ID NO: 152438 - DNA, 25 bp, E. coli
caaaaatacaagcactgacagtacg

SEQ ID NO: 152439 - DNA, 25 bp, E. coli
cagacagtgaaagcaaaaatacaag

SEQ ID NO: 152440 - DNA, 25 bp, E. coli
cagacagtgaaaccaaaaatacaag

SEQ ID NO: 152441 - DNA, 25 bp, E. coli
tacactcttcaagatcagacagtga

SEQ ID NO: 152442 - DNA, 25 bp, E. coli
tacactcttcaacatcagacagtga

SEQ ID NO: 152443 - DNA, 25 bp, E. coli
aaattcccatttgaactaagacaag

SEQ ID NO: 152444 - DNA, 25 bp, E. coli
aaattcccatttcaactaagacaag

SEQ ID NO: 152445 - DNA, 25 bp, E. coli
tgtgagcaatcaaaaagaatggaat

SEQ ID NO: 152446 - DNA, 25 bp, E. coli
tgtgagcaatcataaagaatggaat

SEQ ID NO: 152447 - DNA, 25 bp, E. coli
gcactgacagtaggttatttaatga

SEQ ID NO: 152448 - DNA, 25 bp, E. coli
gcactgacagtacgttatttaatga

SEQ ID NO: 152449 - DNA, 25 bp, E. coli
gatttcgcatcaagaataacagaag

SEQ ID NO: 152450 - DNA, 25 bp, E. coli
gatttcgcatcatgaataacagaag

SEQ ID NO: 152451 - DNA, 25 bp, E. coli
ggctaacaatattttacactcttca

SEQ ID NO: 152452 - DNA, 25 bp, E. coli
ggctaacaatatattacactcttca

SEQ ID NO: 152453 - DNA, 25 bp, E. coli
tcaactaagacatgatttcgcatca

SEQ ID NO: 152454 - DNA, 25 bp, E. coli
tcaactaagacaagatttcgcatca

SEQ ID NO: 152455 - DNA, 25 bp, E. coli
gagagttggcatttgtgagcaatca

SEQ ID NO: 152456 - DNA, 25 bp, E. coli
gagagttggcatatgtgagcaatca

SEQ ID NO: 152457 - DNA, 25 bp, E. coli
cagtgtggttacaaaccgggctttg

SEQ ID NO: 152458 - DNA, 25 bp, E. coli
cagtgtggttactaaccgggctttg

SEQ ID NO: 152459 - DNA, 25 bp, E. coli
agccgcgctcgaataccatgaaaat

SEQ ID NO: 152460 - DNA, 25 bp, E. coli
agccgcgctcgattaccatgaaaat

SEQ ID NO: 152461 - DNA, 25 bp, E. coli
aaaccgctcagcctggcgaccatat

SEQ ID NO: 152462 - DNA, 25 bp, E. coli
aaaccgctcagcgtggcgaccatat

SEQ ID NO: 152463 - DNA, 25 bp, E. coli
tattgctgtgctggagccgcgctcg

SEQ ID NO: 152464 - DNA, 25 bp, E. coli
tattgctgtgctcgagccgcgctcg

SEQ ID NO: 152465 - DNA, 25 bp, E. coli
tgaccaccgatgcttccgaatggga

SEQ ID NO: 152466 - DNA, 25 bp, E. coli
tgaccaccgatggttccgaatggga

SEQ ID NO: 152467 - DNA, 25 bp, E. coli
tcagcctggcgaccatattctggtg

SEQ ID NO: 152468 - DNA, 25 bp, E. coli
gaacagtgtggttacaaaccgggct

SEQ ID NO: 152469 - DNA, 25 bp, E. coli
gaaaaagctgaccaccgatgcttcc

SEQ ID NO: 152470 - DNA, 25 bp, E. coli
gaacagtgtggtaacaaaccgggct

SEQ ID NO: 152471 - DNA, 25 bp, E. coli
gaaaaagctgacgaccgatgcttcc

SEQ ID NO: 152472 - DNA, 25 bp, E. coli
tggagccgcgctcgaataccatgaa

SEQ ID NO: 152473 - DNA, 25 bp, E. coli
tggagccgcgctggaataccatgaa

SEQ ID NO: 152474 - DNA, 25 bp, E. coli
tcagcctggcgagcatattctggtg

SEQ ID NO: 152475 - DNA, 25 bp, E. coli
gaccatattctgctgatgagcaacg

SEQ ID NO: 152476 - DNA, 25 bp, E. coli
gatgcttccgaatgggaagttttgc

SEQ ID NO: 152477 - DNA, 25 bp, E. coli
gaccatattctggtgatgagcaacg

SEQ ID NO: 152478 - DNA, 25 bp, E. coli
gatgcttccgaaagggaagttttgc

SEQ ID NO: 152479 - DNA, 25 bp, E. coli
aaattattggcggccctggtggtga

SEQ ID NO: 152480 - DNA, 25 bp, E. coli
aacacgatgagttcacacctggaag

SEQ ID NO: 152481 - DNA, 25 bp, E. coli
aaattattggcgcccctggtggtga

SEQ ID NO: 152482 - DNA, 25 bp, E. coli
aacacgatgagtacacacctggaag

SEQ ID NO: 152483 - DNA, 25 bp, E. coli
tgttatggcgaaaggcctgacccgt

SEQ ID NO: 152484 - DNA, 25 bp, E. coli
tgttatggcgaatggcctgacccgt

SEQ ID NO: 152485 - DNA, 25 bp, E. coli
gcgaatggcctgacccgttctggct

SEQ ID NO: 152486 - DNA, 25 bp, E. coli
gcgaatggcctgtcccgttctggct

SEQ ID NO: 152487 - DNA, 25 bp, E. coli
gactggttcgccaacacgatgagta

SEQ ID NO: 152488 - DNA, 25 bp, E. coli
gactggttcgcctacacgatgagta

SEQ ID NO: 152489 - DNA, 25 bp, E. coli
gacccgttctgggtttatcgactgg

SEQ ID NO: 152490 - DNA, 25 bp, E. coli
gacccgttctggctttatcgactgg

SEQ ID NO: 152491 - DNA, 25 bp, E. coli
cctggcaacgctggttgttatggcg

SEQ ID NO: 152492 - DNA, 25 bp, E. coli
ccgcaggcgtggcattactttgcag

SEQ ID NO: 152493 - DNA, 25 bp, E. coli
ccgcaggcgtgggattactttgcag

SEQ ID NO: 152494 - DNA, 25 bp, E. coli
cctggcaacgctcgttgttatggcg

SEQ ID NO: 152495 - DNA, 25 bp, E. coli
gtggcattacttagcagtgtttgtg

SEQ ID NO: 152496 - DNA, 25 bp, E. coli
gtggcattactttgcagtgtttgtg

SEQ ID NO: 152497 - DNA, 25 bp, E. coli
ggctttatcgacaggttcgccaaca

SEQ ID NO: 152498 - DNA, 25 bp, E. coli
ggctttatcgactggttcgccaaca

SEQ ID NO: 152499 - DNA, 25 bp, E. coli
gatgagtacacacctggaaggcttc

SEQ ID NO: 152500 - DNA, 25 bp, E. coli
gatgagtacacagctggaaggcttc

SEQ ID NO: 152501 - DNA, 25 bp, E. coli
aataaattttcgtggagatcattcc

SEQ ID NO: 152502 - DNA, 25 bp, E. coli
aataaattttcgaggagatcattcc

SEQ ID NO: 152503 - DNA, 25 bp, E. coli
caaatagcctgctataatcgtgggc

SEQ ID NO: 152504 - DNA, 25 bp, E. coli
caaatagcctgcaataatcgtgggc

SEQ ID NO: 152505 - DNA, 25 bp, E. coli
tgaaccttcttaacagaaatagatg

SEQ ID NO: 152506 - DNA, 25 bp, E. coli
tgaaccttcttatcagaaatagatg

SEQ ID NO: 152507 - DNA, 25 bp, E. coli
tccttgggcggaaacgagttttatt

SEQ ID NO: 152508 - DNA, 25 bp, E. coli
tccttgggcggatacgagttttatt

SEQ ID NO: 152509 - DNA, 25 bp, E. coli
tcgtgggctgttagcttccttgggc

SEQ ID NO: 152510 - DNA, 25 bp, E. coli
tcgtgggctgtttgcttccttgggc

SEQ ID NO: 152511 - DNA, 25 bp, E. coli
gcaagtatgctttcaaaacacaatt

SEQ ID NO: 152512 - DNA, 25 bp, E. coli
gcaagtatgcttacaaaacacaatt

SEQ ID NO: 152513 - DNA, 25 bp, E. coli
gacgagatttttgctgttatgatat

SEQ ID NO: 152514 - DNA, 25 bp, E. coli
gacgagatttttcctgttatgatat

SEQ ID NO: 152515 - DNA, 25 bp, E. coli
gatttccacataataaaagcaagta

SEQ ID NO: 152516 - DNA, 25 bp, E. coli
gatttccacatattaaaagcaagta

SEQ ID NO: 152517 - DNA, 25 bp, E. coli
taacacatgttatcgatttaccagt

SEQ ID NO: 152518 - DNA, 25 bp, E. coli
taagtaagacacctggcaaatagcc

SEQ ID NO: 152519 - DNA, 25 bp, E. coli
taagtaagacacgtggcaaatagcc

SEQ ID NO: 152520 - DNA, 25 bp, E. coli
taacacatgttaacgatttaccagt

SEQ ID NO: 152521 - DNA, 25 bp, E. coli
gatgtgaaggagaaagtaagacacc

SEQ ID NO: 152522 - DNA, 25 bp, E. coli
gatgtgaaggagtaagtaagacacc

SEQ ID NO: 152523 - DNA, 25 bp, E. coli
catttgcgttgagcggatgtatcac

SEQ ID NO: 152524 - DNA, 25 bp, E. coli
catttgcgttgaccggatgtatcac

SEQ ID NO: 152525 - DNA, 25 bp, E. coli
tacgctctattacgactggaacaac

SEQ ID NO: 152526 - DNA, 25 bp, E. coli
tacgctctattaggactggaacaac

SEQ ID NO: 152527 - DNA, 25 bp, E. coli
tggtttccaatagtgcaagccgtcc

SEQ ID NO: 152528 - DNA, 25 bp, E. coli
tccacatgccgagcaatggcggtca

SEQ ID NO: 152529 - DNA, 25 bp, E. coli
tccggcaatccatggtgaaagaatc

SEQ ID NO: 152530 - DNA, 25 bp, E. coli
tccggcaatccaaggtgaaagaatc

SEQ ID NO: 152531 - DNA, 25 bp, E. coli
tccacatgccgaccaatggcggtca

SEQ ID NO: 152532 - DNA, 25 bp, E. coli
gaatttctctggagctattacgctc

SEQ ID NO: 152533 - DNA, 25 bp, E. coli
gaatttctctggtgctattacgctc

SEQ ID NO: 152534 - DNA, 25 bp, E. coli
cgctggcagaagttagtaacggtac

SEQ ID NO: 152535 - DNA, 25 bp, E. coli
cgctggcagaagatagtaacggtac

SEQ ID NO: 152536 - DNA, 25 bp, E. coli
tggttaaaatgctgaacgatccggc

SEQ ID NO: 152537 - DNA, 25 bp, E. coli
tggttaaaatgcagaacgatccggc

SEQ ID NO: 152538 - DNA, 25 bp, E. coli
tggactatctgttgaccaccggcgg

SEQ ID NO: 152539 - DNA, 25 bp, E. coli
tggtttccaatactgcaagccgtcc

SEQ ID NO: 152540 - DNA, 25 bp, E. coli
tggcggtcagacacgattaagggtt

SEQ ID NO: 152541 - DNA, 25 bp, E. coli
tggactatctgtagaccaccggcgg

SEQ ID NO: 152542 - DNA, 25 bp, E. coli
tggcggtcagactcgattaagggtt

SEQ ID NO: 152543 - DNA, 25 bp, E. coli
taaggcactggcaacacaatatggt

SEQ ID NO: 152544 - DNA, 25 bp, E. coli
taaggcactggctacacaatatggt

SEQ ID NO: 152545 - DNA, 25 bp, E. coli
caatcatgcctgcactggtcgggta

SEQ ID NO: 152546 - DNA, 25 bp, E. coli
caatcatgcctggactggtcgggta

SEQ ID NO: 152547 - DNA, 25 bp, E. coli
agaaggccgatgacatgtacacgca

SEQ ID NO: 152548 - DNA, 25 bp, E. coli
agaaggccgatgtcatgtacacgca

SEQ ID NO: 152549 - DNA, 25 bp, E. coli
tacgccgcagtgactgatcaacaaa

SEQ ID NO: 152550 - DNA, 25 bp, E. coli
tacgccgcagtgtctgatcaacaaa

SEQ ID NO: 152551 - DNA, 25 bp, E. coli
tttgagcattatgaagccggatggc

SEQ ID NO: 152552 - DNA, 25 bp, E. coli
tttgagcattatcaagccggatggc

SEQ ID NO: 152553 - DNA, 25 bp, E. coli
ttatcagaacagtgaagaaggccga

SEQ ID NO: 152554 - DNA, 25 bp, E. coli
ttatcagaacagagaagaaggccga

SEQ ID NO: 152555 - DNA, 25 bp, E. coli
tgcaacatgggatattcgaaagccg

SEQ ID NO: 152556 - DNA, 25 bp, E. coli
tgcaacatgggaaattcgaaagccg

SEQ ID NO: 152557 - DNA, 25 bp, E. coli
gaaaagaactccttatgatcgaccg

SEQ ID NO: 152558 - DNA, 25 bp, E. coli
gaaaagaactccatatgatcgaccg

SEQ ID NO: 152559 - DNA, 25 bp, E. coli
cgaaatgatgctgcttgacgcgaag

SEQ ID NO: 152560 - DNA, 25 bp, E. coli
cgaaatgatgctccttgacgcgaag

SEQ ID NO: 152561 - DNA, 25 bp, E. coli
cattattccggtcgtgcaacatggg

SEQ ID NO: 152562 - DNA, 25 bp, E. coli
cattattccggtggtgcaacatggg

SEQ ID NO: 152563 - DNA, 25 bp, E. coli
gataagtccaggatttacgccgcag

SEQ ID NO: 152564 - DNA, 25 bp, E. coli
gataagtccaggttttacgccgcag

SEQ ID NO: 152565 - DNA, 25 bp, E. coli
gtatcgccatgtttaacccggacgg

SEQ ID NO: 152566 - DNA, 25 bp, E. coli
gtatcgccatgtataacccggacgg

SEQ ID NO: 152567 - DNA, 25 bp, E. coli
caagtatggtcagtagggtatgcaa

SEQ ID NO: 152568 - DNA, 25 bp, E. coli
caagtatggtcactagggtatgcaa

SEQ ID NO: 152569 - DNA, 25 bp, E. coli
aaaattcatgtgcttcctatgtcag

SEQ ID NO: 152570 - DNA, 25 bp, E. coli
aaaattcatgtggttcctatgtcag

SEQ ID NO: 152571 - DNA, 25 bp, E. coli
aactgaacttgccaaaatgtttgac

SEQ ID NO: 152572 - DNA, 25 bp, E. coli
aactgaacttgcgaaaatgtttgac

SEQ ID NO: 152573 - DNA, 25 bp, E. coli
tagggtatgcaactgaacttgccaa

SEQ ID NO: 152574 - DNA, 25 bp, E. coli
tagggtatgcaagtgaacttgccaa

SEQ ID NO: 152575 - DNA, 25 bp, E. coli
ttcccgtttcttcctgcagaccaga

SEQ ID NO: 152576 - DNA, 25 bp, E. coli
ttcccgtttcttgctgcagaccaga

SEQ ID NO: 152577 - DNA, 25 bp, E. coli
cctatgtcagacgaggtagttgaac

SEQ ID NO: 152578 - DNA, 25 bp, E. coli
ccaatctgcgagtacgcggtactgc

SEQ ID NO: 152579 - DNA, 25 bp, E. coli
cctatgtcagaccaggtagttgaac

SEQ ID NO: 152580 - DNA, 25 bp, E. coli
ccaatctgcgagaacgcggtactgc

SEQ ID NO: 152581 - DNA, 25 bp, E. coli
gaagaagccaatgtgcgagaacgcg

SEQ ID NO: 152582 - DNA, 25 bp, E. coli
gaagaagccaatctgcgagaacgcg

SEQ ID NO: 152583 - DNA, 25 bp, E. coli
cgagcacaagaaccaagtatggtca

SEQ ID NO: 152584 - DNA, 25 bp, E. coli
cgagcacaagaagcaagtatggtca

SEQ ID NO: 152585 - DNA, 25 bp, E. coli
gtttcttcctgctgaccagatcccg

SEQ ID NO: 152586 - DNA, 25 bp, E. coli
gtttcttcctgcagaccagatcccg

SEQ ID NO: 152587 - DNA, 25 bp, E. coli
tggtacgagcactagaagcaagtat

SEQ ID NO: 152588 - DNA, 25 bp, E. coli
tggtacgagcacaagaagcaagtat

SEQ ID NO: 152589 - DNA, 25 bp, E. coli
caaagtttgcacgtctgcggctgcg

SEQ ID NO: 152590 - DNA, 25 bp, E. coli
cactgtcgttcattgttgtatcctg

SEQ ID NO: 152591 - DNA, 25 bp, E. coli
cactgtcgttcaatgttgtatcctg

SEQ ID NO: 152592 - DNA, 25 bp, E. coli
caaagtttgcacctctgcggctgcg

SEQ ID NO: 152593 - DNA, 25 bp, E. coli
tatgatcaggtttaccgagcgagca

SEQ ID NO: 152594 - DNA, 25 bp, E. coli
tatcctgttttttagtgatggcggc

SEQ ID NO: 152595 - DNA, 25 bp, E. coli
tatgatcaggttaaccgagcgagca

SEQ ID NO: 152596 - DNA, 25 bp, E. coli
tatcctgtttttaagtgatggcggc

SEQ ID NO: 152597 - DNA, 25 bp, E. coli
ttcattagggcgcagttacaccacg

SEQ ID NO: 152598 - DNA, 25 bp, E. coli
ttcattagggcggagttacaccacg

SEQ ID NO: 152599 - DNA, 25 bp, E. coli
ttaccgagcgagcatcctcacgctg

SEQ ID NO: 152600 - DNA, 25 bp, E. coli
ttaccgagcgaggatcctcacgctg

SEQ ID NO: 152601 - DNA, 25 bp, E. coli
tcctcacgctgacggaactaaaaaa

SEQ ID NO: 152602 - DNA, 25 bp, E. coli
tcctcacgctgagggaactaaaaaa

SEQ ID NO: 152603 - DNA, 25 bp, E. coli
ccggaataatgatgtctctgtgtag

SEQ ID NO: 152604 - DNA, 25 bp, E. coli
ccggaataatgaagtctctgtgtag

SEQ ID NO: 152605 - DNA, 25 bp, E. coli
ctctgtgtagcgaaagatttgtctc

SEQ ID NO: 152606 - DNA, 25 bp, E. coli
ctctgtgtagcgtaagatttgtctc

SEQ ID NO: 152607 - DNA, 25 bp, E. coli
gatttgtctcttcattagggcgcag

SEQ ID NO: 152608 - DNA, 25 bp, E. coli
gtttctggtaaacattatgatcagg

SEQ ID NO: 152609 - DNA, 25 bp, E. coli
gtttctggtaaagattatgatcagg

SEQ ID NO: 152610 - DNA, 25 bp, E. coli
gatttgtctcttgattagggcgcag

SEQ ID NO: 152611 - DNA, 25 bp, E. coli
cagcgcagaaaaacaattaacccgg

SEQ ID NO: 152612 - DNA, 25 bp, E. coli
cagcgcagaaaatcaattaacccgg

SEQ ID NO: 152613 - DNA, 25 bp, E. coli
cattatgagattgccagttacggga

SEQ ID NO: 152614 - DNA, 25 bp, E. coli
cattatgagattcccagttacggga

SEQ ID NO: 152615 - DNA, 25 bp, E. coli
agaaaaacgaagtgcgtgatgccgc

SEQ ID NO: 152616 - DNA, 25 bp, E. coli
agaaaaacgaagagcgtgatgccgc

SEQ ID NO: 152617 - DNA, 25 bp, E. coli
ttaagtcaggcttttcatgcgcacc

SEQ ID NO: 152618 - DNA, 25 bp, E. coli
ttaagtcaggctattcatgcgcacc

SEQ ID NO: 152619 - DNA, 25 bp, E. coli
tgaggtcatcgatagtaccgagaaa

SEQ ID NO: 152620 - DNA, 25 bp, E. coli
tgaggtcatcgaaagtaccgagaaa

SEQ ID NO: 152621 - DNA, 25 bp, E. coli
ccgcagcacagatagtcgagcatta

SEQ ID NO: 152622 - DNA, 25 bp, E. coli
ccgcagcacagaaagtcgagcatta

SEQ ID NO: 152623 - DNA, 25 bp, E. coli
gttacgggacattagcgacgctggc

SEQ ID NO: 152624 - DNA, 25 bp, E. coli
gttacgggacataagcgacgctggc

SEQ ID NO: 152625 - DNA, 25 bp, E. coli
ggaagaagaaaaggccaccgacatc

SEQ ID NO: 152626 - DNA, 25 bp, E. coli
gtgatgccgcactgattgccgcagc

SEQ ID NO: 152627 - DNA, 25 bp, E. coli
gtgatgccgcacagattgccgcagc

SEQ ID NO: 152628 - DNA, 25 bp, E. coli
ggaagaagaaaacgccaccgacatc

SEQ ID NO: 152629 - DNA, 25 bp, E. coli
ggcaaaactcgctagagcaacatca

SEQ ID NO: 152630 - DNA, 25 bp, E. coli
ggcaaaactcgcaagagcaacatca

SEQ ID NO: 152631 - DNA, 25 bp, E. coli
taagcgcatgaattgtgtggcaatg

SEQ ID NO: 152632 - DNA, 25 bp, E. coli
taagcgcatgaaatgtgtggcaatg

SEQ ID NO: 152633 - DNA, 25 bp, E. coli
tacggatggccagtgcaggcttttc

SEQ ID NO: 152634 - DNA, 25 bp, E. coli
tacggatggccactgcaggcttttc

SEQ ID NO: 152635 - DNA, 25 bp, E. coli
taacatatgttaacgaaagctggcc

SEQ ID NO: 152636 - DNA, 25 bp, E. coli
taacatatgttatcgaaagctggcc

SEQ ID NO: 152637 - DNA, 25 bp, E. coli
tattttaatgtgcagcagcgtgcgg

SEQ ID NO: 152638 - DNA, 25 bp, E. coli
tattttaatgtggagcagcgtgcgg

SEQ ID NO: 152639 - DNA, 25 bp, E. coli
tgacgacaatagtagcggcaagcct

SEQ ID NO: 152640 - DNA, 25 bp, E. coli
tgacgacaatagaagcggcaagcct

SEQ ID NO: 152641 - DNA, 25 bp, E. coli
tctgatgactgggaaaaaaggcaac

SEQ ID NO: 152642 - DNA, 25 bp, E. coli
tcatctcagaaagaaggcaagtggt

SEQ ID NO: 152643 - DNA, 25 bp, E. coli
tcatctcagaaacaaggcaagtggt

SEQ ID NO: 152644 - DNA, 25 bp, E. coli
tctgatgactggcaaaaaaggcaac

SEQ ID NO: 152645 - DNA, 25 bp, E. coli
tcacgtgtacagagatggatccatc

SEQ ID NO: 152646 - DNA, 25 bp, E. coli
tcacgtgtacagtgatggatccatc

SEQ ID NO: 152647 - DNA, 25 bp, E. coli
gaagatattcggagcggcatggaca

SEQ ID NO: 152648 - DNA, 25 bp, E. coli
gaagatattcggtgcggcatggaca

SEQ ID NO: 152649 - DNA, 25 bp, E. coli
tggatccatccacaagctgcgcttg

SEQ ID NO: 152650 - DNA, 25 bp, E. coli
tggatccatccagaagctgcgcttg

SEQ ID NO: 152651 - DNA, 25 bp, E. coli
tcacttggtggaccatgtgcgccta

SEQ ID NO: 152652 - DNA, 25 bp, E. coli
taagcatctttcacccagacagtgg

SEQ ID NO: 152653 - DNA, 25 bp, E. coli
taagcatctttctcccagacagtgg

SEQ ID NO: 152654 - DNA, 25 bp, E. coli
tcacttggtggagcatgtgcgccta

SEQ ID NO: 152655 - DNA, 25 bp, E. coli
cacagcgctggcgaaatatcgtcaa

SEQ ID NO: 152656 - DNA, 25 bp, E. coli
cagcgctggcgatatatcgtcaaca

SEQ ID NO: 152657 - DNA, 25 bp, E. coli
cacagcgctggccaaatatcgtcaa

SEQ ID NO: 152658 - DNA, 25 bp, E. coli
cagcgctggcgaaatatcgtcaaca

SEQ ID NO: 152659 - DNA, 25 bp, E. coli
aaatatcgtcaagaacgggaggcgg

SEQ ID NO: 152660 - DNA, 25 bp, E. coli
aaatatcgtcaacaacgggaggcgg

SEQ ID NO: 152661 - DNA, 25 bp, E. coli
tttggccacgcagccgcgttaaagc

SEQ ID NO: 152662 - DNA, 25 bp, E. coli
tttggccacgcacccgcgttaaagc

SEQ ID NO: 152663 - DNA, 25 bp, E. coli
ttgcgcgacatggacagcaaaaacg

SEQ ID NO: 152664 - DNA, 25 bp, E. coli
ttgcgcgacatgcacagcaaaaacg

SEQ ID NO: 152665 - DNA, 25 bp, E. coli
tgcttccggcgcctgatgttgattc

SEQ ID NO: 152666 - DNA, 25 bp, E. coli
tgcttccggcgcgtgatgttgattc

SEQ ID NO: 152667 - DNA, 25 bp, E. coli
tgccacagcgctcgcgaaatatcgt

SEQ ID NO: 152668 - DNA, 25 bp, E. coli
tgccacagcgctggcgaaatatcgt

SEQ ID NO: 152669 - DNA, 25 bp, E. coli
ccggcgcgtgatgttgattccttta

SEQ ID NO: 152670 - DNA, 25 bp, E. coli
ccggcgcgtgatcttgattccttta

SEQ ID NO: 152671 - DNA, 25 bp, E. coli
cttcaattgcgccacatgcacagca

SEQ ID NO: 152672 - DNA, 25 bp, E. coli
cttcaattgcgcgacatgcacagca

SEQ ID NO: 152673 - DNA, 25 bp, E. coli
ggcgcgtgatgttgattcctttatt

SEQ ID NO: 152674 - DNA, 25 bp, E. coli
ggcgcgtgatgtagattcctttatt

SEQ ID NO: 152675 - DNA, 25 bp, E. coli
gagctttggccacgcagccgcgtta

SEQ ID NO: 152676 - DNA, 25 bp, E. coli
gagctttggccaggcagccgcgtta

SEQ ID NO: 152677 - DNA, 25 bp, E. coli
cagaaacgaatactggcgaccaggt

SEQ ID NO: 152678 - DNA, 25 bp, E. coli
cagaaacgaatagtggcgaccaggt

SEQ ID NO: 152679 - DNA, 25 bp, E. coli
tactagcataaagacagaaacgaat

SEQ ID NO: 152680 - DNA, 25 bp, E. coli
tactagcataaacacagaaacgaat

SEQ ID NO: 152681 - DNA, 25 bp, E. coli
taaaaaatgttatacgcagttgcgc

SEQ ID NO: 152682 - DNA, 25 bp, E. coli
tacgtcactttatgagcaattcgca

SEQ ID NO: 152683 - DNA, 25 bp, E. coli
taaaaaatgttaaacgcagttgcgc

SEQ ID NO: 152684 - DNA, 25 bp, E. coli
tacgtcactttaagagcaattcgca

SEQ ID NO: 152685 - DNA, 25 bp, E. coli
ataccagtcgaatagcgttgccgcg

SEQ ID NO: 152686 - DNA, 25 bp, E. coli
ataccagtcgaaaagcgttgccgcg

SEQ ID NO: 152687 - DNA, 25 bp, E. coli
tgccgcgcgctctgagttaattgtt

SEQ ID NO: 152688 - DNA, 25 bp, E. coli
tgccgcgcgctcagagttaattgtt

SEQ ID NO: 152689 - DNA, 25 bp, E. coli
gcagttgcgcaaattatccgccttt

SEQ ID NO: 152690 - DNA, 25 bp, E. coli
gcagttgcgcaatttatccgccttt

SEQ ID NO: 152691 - DNA, 25 bp, E. coli
cgaccaggtcttccggataaagcgg

SEQ ID NO: 152692 - DNA, 25 bp, E. coli
cgaccaggtcttgcggataaagcgg

SEQ ID NO: 152693 - DNA, 25 bp, E. coli
cgcggcaattatagggatttcatcc

SEQ ID NO: 152694 - DNA, 25 bp, E. coli
cgcggcaattattgggatttcatcc

SEQ ID NO: 152695 - DNA, 25 bp, E. coli
gatttcatccgtgtgataccagtcg

SEQ ID NO: 152696 - DNA, 25 bp, E. coli
gatttcatccgtctgataccagtcg

SEQ ID NO: 152697 - DNA, 25 bp, E. coli
taattgttgacaaagaattcccggg

SEQ ID NO: 152698 - DNA, 25 bp, E. coli
taattgttgacatagaattcccggg

SEQ ID NO: 152699 - DNA, 25 bp, E. coli
aagctatagaagtaacgctgccctg

SEQ ID NO: 152700 - DNA, 25 bp, E. coli
aagctatagaagaaacgctgccctg

SEQ ID NO: 152701 - DNA, 25 bp, E. coli
caagctatagaacaaacgctgccct

SEQ ID NO: 152702 - DNA, 25 bp, E. coli
caagctatagaagaaacgctgccct

SEQ ID NO: 152703 - DNA, 25 bp, E. coli
cacatttccgtcaagctatagaaga

SEQ ID NO: 152704 - DNA, 25 bp, E. coli
cacatttccgtctagctatagaaga

SEQ ID NO: 152705 - DNA, 25 bp, E. coli
catttccgtcaacctatagaagaaa

SEQ ID NO: 152706 - DNA, 25 bp, E. coli
catttccgtcaagctatagaagaaa

SEQ ID NO: 152707 - DNA, 25 bp, E. coli
tacacatttccgacaagctatagaa

SEQ ID NO: 152708 - DNA, 25 bp, E. coli
tacacatttccgtcaagctatagaa

SEQ ID NO: 152709 - DNA, 25 bp, E. coli
agctatagaagatacgctgccctgg

SEQ ID NO: 152710 - DNA, 25 bp, E. coli
agctatagaagaaacgctgccctgg

SEQ ID NO: 152711 - DNA, 25 bp, E. coli
ttccgtcaagctatagaagaaacgc

SEQ ID NO: 152712 - DNA, 25 bp, E. coli
ttccgtcaagctttagaagaaacgc

SEQ ID NO: 152713 - DNA, 25 bp, E. coli
tccgtcaagctatagaagaaacgct

SEQ ID NO: 152714 - DNA, 25 bp, E. coli
tccgtcaagctaaagaagaaacgct

SEQ ID NO: 152715 - DNA, 25 bp, E. coli
cgtcaagctatacaagaaacgctgc

SEQ ID NO: 152716 - DNA, 25 bp, E. coli
cgtcaagctatagaagaaacgctgc

SEQ ID NO: 152717 - DNA, 25 bp, E. coli
gattacacatttccgtcaagctata

SEQ ID NO: 152718 - DNA, 25 bp, E. coli
gattacacatttgcgtcaagctata

SEQ ID NO: 152719 - DNA, 25 bp, E. coli
tcaagctatagaagaaacgctgccc

SEQ ID NO: 152720 - DNA, 25 bp, E. coli
tcaagctatagatgaaacgctgccc

SEQ ID NO: 152721 - DNA, 25 bp, E. coli
caagcccggtcattttttctcgtgc

SEQ ID NO: 152722 - DNA, 25 bp, E. coli
caagcccggtcaatttttctcgtgc

SEQ ID NO: 152723 - DNA, 25 bp, E. coli
cattttttctcgagcggtgaagcga

SEQ ID NO: 152724 - DNA, 25 bp, E. coli
cattttttctcgtgcggtgaagcga

SEQ ID NO: 152725 - DNA, 25 bp, E. coli
agagacttctttccctgtattcttg

SEQ ID NO: 152726 - DNA, 25 bp, E. coli
agagacttctttgcctgtattcttg

SEQ ID NO: 152727 - DNA, 25 bp, E. coli
tgtattcttgttgagctcggcgatt

SEQ ID NO: 152728 - DNA, 25 bp, E. coli
tgtattcttgttcagctcggcgatt

SEQ ID NO: 152729 - DNA, 25 bp, E. coli
tgacatcataactttcaagcccggt

SEQ ID NO: 152730 - DNA, 25 bp, E. coli
tgacatcataacattcaagcccggt

SEQ ID NO: 152731 - DNA, 25 bp, E. coli
tgcggtgaagcgaatttcagagact

SEQ ID NO: 152732 - DNA, 25 bp, E. coli
tgcggtgaagcgtatttcagagact

SEQ ID NO: 152733 - DNA, 25 bp, E. coli
tcacattattttgattttgacatca

SEQ ID NO: 152734 - DNA, 25 bp, E. coli
tcacattattttcattttgacatca

SEQ ID NO: 152735 - DNA, 25 bp, E. coli
tcggcgatttccctttcggcttgtt

SEQ ID NO: 152736 - DNA, 25 bp, E. coli
tcggcgatttccgtttcggcttgtt

SEQ ID NO: 152737 - DNA, 25 bp, E. coli
gaatttcagagagttctttccctgt

SEQ ID NO: 152738 - DNA, 25 bp, E. coli
gaatttcagagacttctttccctgt

SEQ ID NO: 152739 - DNA, 25 bp, E. coli
cggcgattttttccgcgataaagtc

SEQ ID NO: 152740 - DNA, 25 bp, E. coli
cggcgattttttgcgcgataaagtc

SEQ ID NO: 152741 - DNA, 25 bp, E. coli
gataaagtcggccatttccgtttcg

SEQ ID NO: 152742 - DNA, 25 bp, E. coli
gataaagtcggcgatttccgtttcg

SEQ ID NO: 152743 - DNA, 25 bp, E. coli
cataaaaaagcaggttgggagtcgt

SEQ ID NO: 152744 - DNA, 25 bp, E. coli
cataaaaaagcacgttgggagtcgt

SEQ ID NO: 152745 - DNA, 25 bp, E. coli
taaaaaagcaggttgggagtcgtca

SEQ ID NO: 152746 - DNA, 25 bp, E. coli
taaaaaagcaggatgggagtcgtca

SEQ ID NO: 152747 - DNA, 25 bp, E. coli
aaaaagcaggttcggagtcgtcagg

SEQ ID NO: 152748 - DNA, 25 bp, E. coli
aaaaaagcaggtagggagtcgtcag

SEQ ID NO: 152749 - DNA, 25 bp, E. coli
aaaaaagcaggttgggagtcgtcag

SEQ ID NO: 152750 - DNA, 25 bp, E. coli
aaaaagcaggttgggagtcgtcagg

SEQ ID NO: 152751 - DNA, 25 bp, E. coli
tttgcggtacgctatcgccgggtta

SEQ ID NO: 152752 - DNA, 25 bp, E. coli
tttgcggtacgcaatcgccgggtta

SEQ ID NO: 152753 - DNA, 25 bp, E. coli
tcataaaaaagcaggttgggagtcg

SEQ ID NO: 152754 - DNA, 25 bp, E. coli
tcataaaaaagctggttgggagtcg

SEQ ID NO: 152755 - DNA, 25 bp, E. coli
gccaccattatataattatcgctgt

SEQ ID NO: 152756 - DNA, 25 bp, E. coli
gccaccattataaaattatcgctgt

SEQ ID NO: 152757 - DNA, 25 bp, E. coli
gccgggttatgcgagaatcataaaa

SEQ ID NO: 152758 - DNA, 25 bp, E. coli
gccgggttatgccagaatcataaaa

SEQ ID NO: 152759 - DNA, 25 bp, E. coli
gcgtcttatcatcccaccattataa

SEQ ID NO: 152760 - DNA, 25 bp, E. coli
gctatcgccgggatatgccagaatc

SEQ ID NO: 152761 - DNA, 25 bp, E. coli
gctgttttgcggaacgctatcgccg

SEQ ID NO: 152762 - DNA, 25 bp, E. coli
gcgtcttatcatgccaccattataa

SEQ ID NO: 152763 - DNA, 25 bp, E. coli
gctgttttgcggtacgctatcgccg

SEQ ID NO: 152764 - DNA, 25 bp, E. coli
gctatcgccgggttatgccagaatc

SEQ ID NO: 152765 - DNA, 25 bp, E. coli
aagcctatgccttgctcagtatgag

SEQ ID NO: 152766 - DNA, 25 bp, E. coli
aagcctatgcctagctcagtatgag

SEQ ID NO: 152767 - DNA, 25 bp, E. coli
cataaacttgcgctaagcaaagcct

SEQ ID NO: 152768 - DNA, 25 bp, E. coli
cataaacttgcggtaagcaaagcct

SEQ ID NO: 152769 - DNA, 25 bp, E. coli
actgggagtagcctgtattatgagc

SEQ ID NO: 152770 - DNA, 25 bp, E. coli
actgggagtagcgtgtattatgagc

SEQ ID NO: 152771 - DNA, 25 bp, E. coli
tatgtgctggtatggattgcttcaa

SEQ ID NO: 152772 - DNA, 25 bp, E. coli
tatgtgctggtaaggattgcttcaa

SEQ ID NO: 152773 - DNA, 25 bp, E. coli
tgacgcacttatgggattttatcgc

SEQ ID NO: 152774 - DNA, 25 bp, E. coli
tgacgcacttatcggattttatcgc

SEQ ID NO: 152775 - DNA, 25 bp, E. coli
tcgggctgctgggttatctgctttc

SEQ ID NO: 152776 - DNA, 25 bp, E. coli
tcgggctgctggcttatctgctttc

SEQ ID NO: 152777 - DNA, 25 bp, E. coli
tcgctgaaagcactactgggagtag

SEQ ID NO: 152778 - DNA, 25 bp, E. coli
tcgctgaaagcagtactgggagtag

SEQ ID NO: 152779 - DNA, 25 bp, E. coli
cctgtattatgaccgggttgatgct

SEQ ID NO: 152780 - DNA, 25 bp, E. coli
cctgtattatgagcgggttgatgct

SEQ ID NO: 152781 - DNA, 25 bp, E. coli
gcttcaatggtacttcccggctggg

SEQ ID NO: 152782 - DNA, 25 bp, E. coli
gcttcaatggtagttcccggctggg

SEQ ID NO: 152783 - DNA, 25 bp, E. coli
ggaagggactttttcgctgaaagca

SEQ ID NO: 152784 - DNA, 25 bp, E. coli
ggaagggactttatcgctgaaagca

SEQ ID NO: 152785 - DNA, 25 bp, E. coli
taagcctgggttttgcggcgagtca

SEQ ID NO: 152786 - DNA, 25 bp, E. coli
taagcctgggttatgcggcgagtca

SEQ ID NO: 152787 - DNA, 25 bp, E. coli
taaaaaacgtgcaggcgacctatgg

SEQ ID NO: 152788 - DNA, 25 bp, E. coli
aactggcgaaacttctcctggaacg

SEQ ID NO: 152789 - DNA, 25 bp, E. coli
aactggcgaaacatctcctggaacg

SEQ ID NO: 152790 - DNA, 25 bp, E. coli
taccgatgacgatatgttgccctcc

SEQ ID NO: 152791 - DNA, 25 bp, E. coli
tagcccgtatgacgaaaaccgcgtg

SEQ ID NO: 152792 - DNA, 25 bp, E. coli
taccgatgacgaaatgttgccctcc

SEQ ID NO: 152793 - DNA, 25 bp, E. coli
tagcccgtatgaggaaaaccgcgtg

SEQ ID NO: 152794 - DNA, 25 bp, E. coli
tatgattggcgaaacctggacggca

SEQ ID NO: 152795 - DNA, 25 bp, E. coli
tatgattggcgatacctggacggca

SEQ ID NO: 152796 - DNA, 25 bp, E. coli
tatcaatcagccgtaccacagggcg

SEQ ID NO: 152797 - DNA, 25 bp, E. coli
tatcaatcagccctaccacagggcg

SEQ ID NO: 152798 - DNA, 25 bp, E. coli
tgtccattgaaaacgccaccgggat

SEQ ID NO: 152799 - DNA, 25 bp, E. coli
tgtccattgaaatcgccaccgggat

SEQ ID NO: 152800 - DNA, 25 bp, E. coli
tctgatttctgggtaacgggcaacc

SEQ ID NO: 152801 - DNA, 25 bp, E. coli
tctgatttctggctaacgggcaacc

SEQ ID NO: 152802 - DNA, 25 bp, E. coli
gacttaaacacgtccagtagcggcg

SEQ ID NO: 152803 - DNA, 25 bp, E. coli
gacttaaacacgaccagtagcggcg

SEQ ID NO: 152804 - DNA, 25 bp, E. coli
cattctcaagcgtgaaggtcagacc

SEQ ID NO: 152805 - DNA, 25 bp, E. coli
cattctcaagcgagaaggtcagacc

SEQ ID NO: 152806 - DNA, 25 bp, E. coli
cattttgattatggcgccagaggcg

SEQ ID NO: 152807 - DNA, 25 bp, E. coli
cattttgattatcgcgccagaggcg

SEQ ID NO: 152808 - DNA, 25 bp, E. coli
taaaaaacgtgctggcgacctatgg

SEQ ID NO: 152809 - DNA, 25 bp, E. coli
cacgcgctgggtacacagattgacg

SEQ ID NO: 152810 - DNA, 25 bp, E. coli
cacgcgctgggttcacagattgacg

SEQ ID NO: 152811 - DNA, 25 bp, E. coli
tataccgaaccacaagttgcatggg

SEQ ID NO: 152812 - DNA, 25 bp, E. coli
tataccgaaccagaagttgcatggg

SEQ ID NO: 152813 - DNA, 25 bp, E. coli
aaagcgctggctgaacacggtatcg

SEQ ID NO: 152814 - DNA, 25 bp, E. coli
aaagcgctggctcaacacggtatcg

SEQ ID NO: 152815 - DNA, 25 bp, E. coli
tatcatcggtctcgaaatgggcacc

SEQ ID NO: 152816 - DNA, 25 bp, E. coli
tatcatcggtctggaaatgggcacc

SEQ ID NO: 152817 - DNA, 25 bp, E. coli
tgttcacgaaggacacgttgccgct

SEQ ID NO: 152818 - DNA, 25 bp, E. coli
tgttcacgaaggtcacgttgccgct

SEQ ID NO: 152819 - DNA, 25 bp, E. coli
tgctggaaaccatagttaccgccgt

SEQ ID NO: 152820 - DNA, 25 bp, E. coli
tgctggaaaccaaagttaccgccgt

SEQ ID NO: 152821 - DNA, 25 bp, E. coli
gaaagaagtacctgaacgcctgctg

SEQ ID NO: 152822 - DNA, 25 bp, E. coli
gaaagaagtaccagaacgcctgctg

SEQ ID NO: 152823 - DNA, 25 bp, E. coli
cgctgaagttatggccggtaagaaa

SEQ ID NO: 152824 - DNA, 25 bp, E. coli
cgaaaggccgcatagtcaaagtggt

SEQ ID NO: 152825 - DNA, 25 bp, E. coli
cgaaaggccgcaaagtcaaagtggt

SEQ ID NO: 152826 - DNA, 25 bp, E. coli
cgctgaagttatcgccggtaagaaa

SEQ ID NO: 152827 - DNA, 25 bp, E. coli
tcaaagtggtcaacggtctgggtaa

SEQ ID NO: 152828 - DNA, 25 bp, E. coli
tcaaagtggtcatcggtctgggtaa

SEQ ID NO: 152829 - DNA, 25 bp, E. coli
gaccgtggtttcatccgcgttgaca

SEQ ID NO: 152830 - DNA, 25 bp, E. coli
gaccgtggtttcttccgcgttgaca

SEQ ID NO: 152831 - DNA, 25 bp, E. coli
caaccgcgtggaagatggcgaatac

SEQ ID NO: 152832 - DNA, 25 bp, E. coli
caaccgcgtggatgatggcgaatac

SEQ ID NO: 152833 - DNA, 25 bp, E. coli
gaatcacgtacctcccgttcaaaag

SEQ ID NO: 152834 - DNA, 25 bp, E. coli
gaatcacgtaccacccgttcaaaag

SEQ ID NO: 152835 - DNA, 25 bp, E. coli
actggctgatcggtgaatcacgtac

SEQ ID NO: 152836 - DNA, 25 bp, E. coli
actggctgatcgctgaatcacgtac

SEQ ID NO: 152837 - DNA, 25 bp, E. coli
taccgggccaaaacgataaatcgct

SEQ ID NO: 152838 - DNA, 25 bp, E. coli
taccgggccaaatcgataaatcgct

SEQ ID NO: 152839 - DNA, 25 bp, E. coli
tgcctacggttcgattctgatcgtg

SEQ ID NO: 152840 - DNA, 25 bp, E. coli
tgcctacggttccattctgatcgtg

SEQ ID NO: 152841 - DNA, 25 bp, E. coli
gaatacggtgtagcgattgcctacg

SEQ ID NO: 152842 - DNA, 25 bp, E. coli
gaatacggtgtaccgattgcctacg

SEQ ID NO: 152843 - DNA, 25 bp, E. coli
gacggcttacatcctcaaccgcgtg

SEQ ID NO: 152844 - DNA, 25 bp, E. coli
cggcgatcctctcggcgctgattta

SEQ ID NO: 152845 - DNA, 25 bp, E. coli
cattgtgttcctcgtcacgccggat

SEQ ID NO: 152846 - DNA, 25 bp, E. coli
cggcgatcctctgggcgctgattta

SEQ ID NO: 152847 - DNA, 25 bp, E. coli
cattgtgttcctggtcacgccggat

SEQ ID NO: 152848 - DNA, 25 bp, E. coli
gatttacagcttagtgcgcgccatt

SEQ ID NO: 152849 - DNA, 25 bp, E. coli
gatttacagctttgtgcgcgccatt

SEQ ID NO: 152850 - DNA, 25 bp, E. coli
ggatacccgcgttgcgacggcttac

SEQ ID NO: 152851 - DNA, 25 bp, E. coli
ggatacccgcgtagcgacggcttac

SEQ ID NO: 152852 - DNA, 25 bp, E. coli
gacggcttacatgctcaaccgcgtg

SEQ ID NO: 152853 - DNA, 25 bp, E. coli
aatccgcatcccctgctggtggtgg

SEQ ID NO: 152854 - DNA, 25 bp, E. coli
aatccgcatcccgtgctggtggtgg

SEQ ID NO: 152855 - DNA, 25 bp, E. coli
tacgccgcggtactgacggtcatca

SEQ ID NO: 152856 - DNA, 25 bp, E. coli
aactcccgttgggagtcattgacga

SEQ ID NO: 152857 - DNA, 25 bp, E. coli
aaaactgacgcgaacgtgctggcgc

SEQ ID NO: 152858 - DNA, 25 bp, E. coli
aaaactgacgcgtacgtgctggcgc

SEQ ID NO: 152859 - DNA, 25 bp, E. coli
aactcccgttggcagtcattgacga

SEQ ID NO: 152860 - DNA, 25 bp, E. coli
tacgccgcggtagtgacggtcatca

SEQ ID NO: 152861 - DNA, 25 bp, E. coli
tgttcgatgccggaaaaatcagcgg

SEQ ID NO: 152862 - DNA, 25 bp, E. coli
tgttcgatgccgcaaaaatcagcgg

SEQ ID NO: 152863 - DNA, 25 bp, E. coli
tcccgattgatgaaacggatctggt

SEQ ID NO: 152864 - DNA, 25 bp, E. coli
tcccgattgatgtaacggatctggt

SEQ ID NO: 152865 - DNA, 25 bp, E. coli
gcaatttgccggtggcgatcccgat

SEQ ID NO: 152866 - DNA, 25 bp, E. coli
gcaatttgccggaggcgatcccgat

SEQ ID NO: 152867 - DNA, 25 bp, E. coli
gactatatcgacattggtacgcctc

SEQ ID NO: 152868 - DNA, 25 bp, E. coli
gactatatcgactttggtacgcctc

SEQ ID NO: 152869 - DNA, 25 bp, E. coli
gaacaacggctgagtcgggtactga

SEQ ID NO: 152870 - DNA, 25 bp, E. coli
gaacaacggctgtgtcgggtactga

SEQ ID NO: 152871 - DNA, 25 bp, E. coli
cattgacgaagtgattgtccgcgcg

SEQ ID NO: 152872 - DNA, 25 bp, E. coli
cattgacgaagtcattgtccgcgcg

SEQ ID NO: 152873 - DNA, 25 bp, E. coli
ggtgttacgccccaaatcattacgc

SEQ ID NO: 152874 - DNA, 25 bp, E. coli
ggtgttacgcccgaaatcattacgc

SEQ ID NO: 152875 - DNA, 25 bp, E. coli
catcaacaccggtcggtacgataca

SEQ ID NO: 152876 - DNA, 25 bp, E. coli
catcaacaccggacggtacgataca

SEQ ID NO: 152877 - DNA, 25 bp, E. coli
tacgatacaaacaccagtgactggc

SEQ ID NO: 152878 - DNA, 25 bp, E. coli
tacaaacaccagagactggcgggac

SEQ ID NO: 152879 - DNA, 25 bp, E. coli
tacaaacaccagtgactggcgggac

SEQ ID NO: 152880 - DNA, 25 bp, E. coli
aacaccagtgacaggcgggacgaag

SEQ ID NO: 152881 - DNA, 25 bp, E. coli
aacaccagtgactggcgggacgaag

SEQ ID NO: 152882 - DNA, 25 bp, E. coli
tacgatacaaactccagtgactggc

SEQ ID NO: 152883 - DNA, 25 bp, E. coli
ttaagccggtgctgacacacggaaa

SEQ ID NO: 152884 - DNA, 25 bp, E. coli
ttaagccggtgcagacacacggaaa

SEQ ID NO: 152885 - DNA, 25 bp, E. coli
tgcagacacacggaaaacgcacatc

SEQ ID NO: 152886 - DNA, 25 bp, E. coli
tgcagacacacgcaaaacgcacatc

SEQ ID NO: 152887 - DNA, 25 bp, E. coli
gacacacggaaatcgcacatcaaca

SEQ ID NO: 152888 - DNA, 25 bp, E. coli
gacacacggaaaacgcacatcaaca

SEQ ID NO: 152889 - DNA, 25 bp, E. coli
cggaaaacgcacttcaacaccggac

SEQ ID NO: 152890 - DNA, 25 bp, E. coli
cggaaaacgcacatcaacaccggac

SEQ ID NO: 152891 - DNA, 25 bp, E. coli
ggacgaagggaaagacgaatcagtc

SEQ ID NO: 152892 - DNA, 25 bp, E. coli
ggacggtacgattcaaacaccagtg

SEQ ID NO: 152893 - DNA, 25 bp, E. coli
ggacggtacgatacaaacaccagtg

SEQ ID NO: 152894 - DNA, 25 bp, E. coli
ggacgaagggaatgacgaatcagtc

SEQ ID NO: 152895 - DNA, 25 bp, E. coli
gacgaatcagtctggaaatgatgac

SEQ ID NO: 152896 - DNA, 25 bp, E. coli
gacgaatcagtcaggaaatgatgac

SEQ ID NO: 152897 - DNA, 25 bp, E. coli
aatgccatctatagcggtgccagcg

SEQ ID NO: 152898 - DNA, 25 bp, E. coli
caatattctggcattgaacgcggcg

SEQ ID NO: 152899 - DNA, 25 bp, E. coli
aatgccatctattgcggtgccagcg

SEQ ID NO: 152900 - DNA, 25 bp, E. coli
caatattctggctttgaacgcggcg

SEQ ID NO: 152901 - DNA, 25 bp, E. coli
tatttatcacaatgcgctggcggag

SEQ ID NO: 152902 - DNA, 25 bp, E. coli
tatttatcacaaagcgctggcggag

SEQ ID NO: 152903 - DNA, 25 bp, E. coli
gcattcgtcatattgcaggcggcga

SEQ ID NO: 152904 - DNA, 25 bp, E. coli
gcattcgtcataatgcaggcggcga

SEQ ID NO: 152905 - DNA, 25 bp, E. coli
gatggaccgggttactcaacagaac

SEQ ID NO: 152906 - DNA, 25 bp, E. coli
gatggaccgggtaactcaacagaac

SEQ ID NO: 152907 - DNA, 25 bp, E. coli
ccgcagcggcagtgatcaaacgtaa

SEQ ID NO: 152908 - DNA, 25 bp, E. coli
ccgcagcggcagagatcaaacgtaa

SEQ ID NO: 152909 - DNA, 25 bp, E. coli
cccagggatatcaggacggtttcga

SEQ ID NO: 152910 - DNA, 25 bp, E. coli
cccagggatatctggacggtttcga

SEQ ID NO: 152911 - DNA, 25 bp, E. coli
gataacaatgccacctacagccagg

SEQ ID NO: 152912 - DNA, 25 bp, E. coli
gttctttgatcagccgacccaggga

SEQ ID NO: 152913 - DNA, 25 bp, E. coli
gataacaatgcctcctacagccagg

SEQ ID NO: 152914 - DNA, 25 bp, E. coli
gttctttgatcacccgacccaggga

SEQ ID NO: 152915 - DNA, 25 bp, E. coli
ggatgttggctcaacgctggtcgaa

SEQ ID NO: 152916 - DNA, 25 bp, E. coli
ggatgttggctctacgctggtcgaa

SEQ ID NO: 152917 - DNA, 25 bp, E. coli
ggagaagtgcgtaatctggcccagc

SEQ ID NO: 152918 - DNA, 25 bp, E. coli
ggagaagtgcgttatctggcccagc

SEQ ID NO: 152919 - DNA, 25 bp, E. coli
ctcgatctttatgaaagctcccgca

SEQ ID NO: 152920 - DNA, 25 bp, E. coli
ctcgatctttatcaaagctcccgca

SEQ ID NO: 152921 - DNA, 25 bp, E. coli
aaagctcccgcaactgcgttgcggg

SEQ ID NO: 152922 - DNA, 25 bp, E. coli
aaagctcccgcatctgcgttgcggg

SEQ ID NO: 152923 - DNA, 25 bp, E. coli
tttatcaaagctcccgcatctgcgt

SEQ ID NO: 152924 - DNA, 25 bp, E. coli
tttatcaaagctgccgcatctgcgt

SEQ ID NO: 152925 - DNA, 25 bp, E. coli
tctgcgttgcggcagcgtctggtgg

SEQ ID NO: 152926 - DNA, 25 bp, E. coli
tctgcgttgcgggagcgtctggtgg

SEQ ID NO: 152927 - DNA, 25 bp, E. coli
gaaaagtggtgccagcttgcgcaat

SEQ ID NO: 152928 - DNA, 25 bp, E. coli
gaaaagtggtgcgagcttgcgcaat

SEQ ID NO: 152929 - DNA, 25 bp, E. coli
ccgcatctgcgttgcgggagcgtct

SEQ ID NO: 152930 - DNA, 25 bp, E. coli
ccgcatctgcgtagcgggagcgtct

SEQ ID NO: 152931 - DNA, 25 bp, E. coli
cggaaaatctgtcccgggttgtgga

SEQ ID NO: 152932 - DNA, 25 bp, E. coli
cggaaaatctgtgccgggttgtgga

SEQ ID NO: 152933 - DNA, 25 bp, E. coli
gtggtgccagcttgcgcaattttgt

SEQ ID NO: 152934 - DNA, 25 bp, E. coli
gtggtgccagctagcgcaattttgt

SEQ ID NO: 152935 - DNA, 25 bp, E. coli
tcaaagctcccggatctgcgttgcg

SEQ ID NO: 152936 - DNA, 25 bp, E. coli
tcaaagctcccgcatctgcgttgcg

SEQ ID NO: 152937 - DNA, 25 bp, E. coli
gatgaaaagtggagccagcttgcgc

SEQ ID NO: 152938 - DNA, 25 bp, E. coli
gatgaaaagtggtgccagcttgcgc

SEQ ID NO: 152939 - DNA, 25 bp, E. coli
gatgatgaaaagaggtgccagcttg

SEQ ID NO: 152940 - DNA, 25 bp, E. coli
gatgatgaaaagtggtgccagcttg

SEQ ID NO: 152941 - DNA, 25 bp, E. coli
caatctgagcgttcctgaagggtta

SEQ ID NO: 152942 - DNA, 25 bp, E. coli
caatctgagcgtacctgaagggtta

SEQ ID NO: 152943 - DNA, 25 bp, E. coli
atcttagatgggatgttattttacc

SEQ ID NO: 152944 - DNA, 25 bp, E. coli
atcttagatgggttgttattttacc

SEQ ID NO: 152945 - DNA, 25 bp, E. coli
gaaagggttaatatcttagatggga

SEQ ID NO: 152946 - DNA, 25 bp, E. coli
gaaagggttaatttcttagatggga

SEQ ID NO: 152947 - DNA, 25 bp, E. coli
ttattttaccggatggcaactcgcc

SEQ ID NO: 152948 - DNA, 25 bp, E. coli
ttattttaccggttggcaactcgcc

SEQ ID NO: 152949 - DNA, 25 bp, E. coli
tgagcgttcctgtagggttaataaa

SEQ ID NO: 152950 - DNA, 25 bp, E. coli
tgagcgttcctgaagggttaataaa

SEQ ID NO: 152951 - DNA, 25 bp, E. coli
tctgagcgttcctgaagggttaata

SEQ ID NO: 152952 - DNA, 25 bp, E. coli
tctgagcgttccagaagggttaata

SEQ ID NO: 152953 - DNA, 25 bp, E. coli
ccatccggtatttcacgcttagatg

SEQ ID NO: 152954 - DNA, 25 bp, E. coli
ccatccggtattacacgcttagatg

SEQ ID NO: 152955 - DNA, 25 bp, E. coli
gcaactcgccatccggtatttcacg

SEQ ID NO: 152956 - DNA, 25 bp, E. coli
gcaactcgccatgcggtatttcacg

SEQ ID NO: 152957 - DNA, 25 bp, E. coli
cgccatccggtaattcacgcttaga

SEQ ID NO: 152958 - DNA, 25 bp, E. coli
cgccatccggtatttcacgcttaga

SEQ ID NO: 152959 - DNA, 25 bp, E. coli
tggcaactcgccatccggtatttca

SEQ ID NO: 152960 - DNA, 25 bp, E. coli
tggcaactcgccttccggtatttca

SEQ ID NO: 152961 - DNA, 25 bp, E. coli
gatgttattttagcggatggcaact

SEQ ID NO: 152962 - DNA, 25 bp, E. coli
gatgttattttaccggatggcaact

SEQ ID NO: 152963 - DNA, 25 bp, E. coli
aattaccctacactgcatcaggcgg

SEQ ID NO: 152964 - DNA, 25 bp, E. coli
aattaccctacagtgcatcaggcgg

SEQ ID NO: 152965 - DNA, 25 bp, E. coli
tttaatgccgaactgcttgagtcca

SEQ ID NO: 152966 - DNA, 25 bp, E. coli
tttaatgccgaagtgcttgagtcca

SEQ ID NO: 152967 - DNA, 25 bp, E. coli
ttgttcacgtcagcccggaaatgca

SEQ ID NO: 152968 - DNA, 25 bp, E. coli
ttgttcacgtcaccccggaaatgca

SEQ ID NO: 152969 - DNA, 25 bp, E. coli
tgaaagagcgcgctgccaaatccgt

SEQ ID NO: 152970 - DNA, 25 bp, E. coli
tgctggaaattcaaaccctctggcc

SEQ ID NO: 152971 - DNA, 25 bp, E. coli
tgaaagagcgcggtgccaaatccgt

SEQ ID NO: 152972 - DNA, 25 bp, E. coli
tgctggaaattctaaccctctggcc

SEQ ID NO: 152973 - DNA, 25 bp, E. coli
tcttagccacgctcatgaagtcgtg

SEQ ID NO: 152974 - DNA, 25 bp, E. coli
tctggcagcacctacttaatggtcg

SEQ ID NO: 152975 - DNA, 25 bp, E. coli
tctggcagcaccaacttaatggtcg

SEQ ID NO: 152976 - DNA, 25 bp, E. coli
tcttagccacgcacatgaagtcgtg

SEQ ID NO: 152977 - DNA, 25 bp, E. coli
gaagcgactatcgtacgcacctgta

SEQ ID NO: 152978 - DNA, 25 bp, E. coli
gaaaaaagccatgccagtgaagcga

SEQ ID NO: 152979 - DNA, 25 bp, E. coli
gaaaaaagccatcccagtgaagcga

SEQ ID NO: 152980 - DNA, 25 bp, E. coli
gaagcgactatcctacgcacctgta

SEQ ID NO: 152981 - DNA, 25 bp, E. coli
gattggtatttctaactctggcagc

SEQ ID NO: 152982 - DNA, 25 bp, E. coli
gattggtatttcaaactctggcagc

SEQ ID NO: 152983 - DNA, 25 bp, E. coli
gagaaataccgctcccgtgaagagt

SEQ ID NO: 152984 - DNA, 25 bp, E. coli
gagaaataccgcacccgtgaagagt

SEQ ID NO: 152985 - DNA, 25 bp, E. coli
caagtttgaaatgaccagggtgcgt

SEQ ID NO: 152986 - DNA, 25 bp, E. coli
caagtttgaaatcaccagggtgcgt

SEQ ID NO: 152987 - DNA, 25 bp, E. coli
caggatgctgttgctaccgctgaaa

SEQ ID NO: 152988 - DNA, 25 bp, E. coli
caggatgctgttcctaccgctgaaa

SEQ ID NO: 152989 - DNA, 25 bp, E. coli
taaagaggcctatcgtcaaatcgtc

SEQ ID NO: 152990 - DNA, 25 bp, E. coli
taaagaggcctaacgtcaaatcgtc

SEQ ID NO: 152991 - DNA, 25 bp, E. coli
tatccggctctgatgaaccattggg

SEQ ID NO: 152992 - DNA, 25 bp, E. coli
tatccggctctgttgaaccattggg

SEQ ID NO: 152993 - DNA, 25 bp, E. coli
tttgcccaaactggaaggacttgcg

SEQ ID NO: 152994 - DNA, 25 bp, E. coli
tttgcccaaactcgaaggacttgcg

SEQ ID NO: 152995 - DNA, 25 bp, E. coli
tgtgtgacgaaagcgggaactatcc

SEQ ID NO: 152996 - DNA, 25 bp, E. coli
tgtgtgacgaaaccgggaactatcc

SEQ ID NO: 152997 - DNA, 25 bp, E. coli
gaaatgagtaccgaaccgcaggatg

SEQ ID NO: 152998 - DNA, 25 bp, E. coli
gaaatgagtacccaaccgcaggatg

SEQ ID NO: 152999 - DNA, 25 bp, E. coli
ggtcaggccggcgaacaagtttgaa

SEQ ID NO: 153000 - DNA, 25 bp, E. coli
ggattacttcgaaggcgaggccgat

SEQ ID NO: 153001 - DNA, 25 bp, E. coli
ggattacttcgatggcgaggccgat

SEQ ID NO: 153002 - DNA, 25 bp, E. coli
ggtcaggccggccaacaagtttgaa

SEQ ID NO: 153003 - DNA, 25 bp, E. coli
taatccacagtacacagggcagtcg

SEQ ID NO: 153004 - DNA, 25 bp, E. coli
taatccacagtagacagggcagtcg

SEQ ID NO: 153005 - DNA, 25 bp, E. coli
gagtacacaccgcaaatcaagtcgt

SEQ ID NO: 153006 - DNA, 25 bp, E. coli
gagtacacaccggaaatcaagtcgt

SEQ ID NO: 153007 - DNA, 25 bp, E. coli
cagtggcaggaacgtggtaataacc

SEQ ID NO: 153008 - DNA, 25 bp, E. coli
cagtggcaggaaggtggtaataacc

SEQ ID NO: 153009 - DNA, 25 bp, E. coli
tagccagccagatgtcaatgatgcc

SEQ ID NO: 153010 - DNA, 25 bp, E. coli
tagccagccagaagtcaatgatgcc

SEQ ID NO: 153011 - DNA, 25 bp, E. coli
tgagatcccgggagttgcgactacc

SEQ ID NO: 153012 - DNA, 25 bp, E. coli
tgagatcccgggtgttgcgactacc

SEQ ID NO: 153013 - DNA, 25 bp, E. coli
tcgtcaaatcgatgccaaccagggc

SEQ ID NO: 153014 - DNA, 25 bp, E. coli
tcgtcaaatcgaagccaaccagggc

SEQ ID NO: 153015 - DNA, 25 bp, E. coli
tcgtcgcgcagaaaaagaaggtgcc

SEQ ID NO: 153016 - DNA, 25 bp, E. coli
tcgtcgcgcagataaagaaggtgcc

SEQ ID NO: 153017 - DNA, 25 bp, E. coli
ccagtcatcaaatggcgggcgttac

SEQ ID NO: 153018 - DNA, 25 bp, E. coli
ccagtcatcaaaaggcgggcgttac

SEQ ID NO: 153019 - DNA, 25 bp, E. coli
gcagcgatgatggtcccgttcgaca

SEQ ID NO: 153020 - DNA, 25 bp, E. coli
gcagcgatgatgctcccgttcgaca

SEQ ID NO: 153021 - DNA, 25 bp, E. coli
gattccgaagcacgacgtgcagctc

SEQ ID NO: 153022 - DNA, 25 bp, E. coli
gattccgaagcaggacgtgcagctc

SEQ ID NO: 153023 - DNA, 25 bp, E. coli
taattaacggtgttgtcgaactgcc

SEQ ID NO: 153024 - DNA, 25 bp, E. coli
taagaaacgtatcgtccagagcccg

SEQ ID NO: 153025 - DNA, 25 bp, E. coli
taactggcgtgtcgtcgctgacctc

SEQ ID NO: 153026 - DNA, 25 bp, E. coli
taactggcgtgtggtcgctgacctc

SEQ ID NO: 153027 - DNA, 25 bp, E. coli
taagaaacgtatggtccagagcccg

SEQ ID NO: 153028 - DNA, 25 bp, E. coli
taattaacggtgatgtcgaactgcc

SEQ ID NO: 153029 - DNA, 25 bp, E. coli
aatggtttccgctgcgtaatcgcgc

SEQ ID NO: 153030 - DNA, 25 bp, E. coli
aatggtttccgcagcgtaatcgcgc

SEQ ID NO: 153031 - DNA, 25 bp, E. coli
taacactgggatgaccgctttccgg

SEQ ID NO: 153032 - DNA, 25 bp, E. coli
tatgtgctggcgtttctcgaccgtt

SEQ ID NO: 153033 - DNA, 25 bp, E. coli
tatgtgctggcgattctcgaccgtt

SEQ ID NO: 153034 - DNA, 25 bp, E. coli
tgagcaccgctttgcttgacgccgt

SEQ ID NO: 153035 - DNA, 25 bp, E. coli
tgagcaccgcttagcttgacgccgt

SEQ ID NO: 153036 - DNA, 25 bp, E. coli
gctgttctatatcggcgcaccgctg

SEQ ID NO: 153037 - DNA, 25 bp, E. coli
gctgttctatatgggcgcaccgctg

SEQ ID NO: 153038 - DNA, 25 bp, E. coli
gcaccgctggcgataacactgggat

SEQ ID NO: 153039 - DNA, 25 bp, E. coli
gcaccgctggcgttaacactgggat

SEQ ID NO: 153040 - DNA, 25 bp, E. coli
cgaatcttttgatgcgcaaactggg

SEQ ID NO: 153041 - DNA, 25 bp, E. coli
cgaatcttttgaagcgcaaactggg

SEQ ID NO: 153042 - DNA, 25 bp, E. coli
gattggtacgactacactgctgtgg

SEQ ID NO: 153043 - DNA, 25 bp, E. coli
gttttgccaaactgacctaccagat

SEQ ID NO: 153044 - DNA, 25 bp, E. coli
gattggtacgacaacactgctgtgg

SEQ ID NO: 153045 - DNA, 25 bp, E. coli
gttttgccaaacagacctaccagat

SEQ ID NO: 153046 - DNA, 25 bp, E. coli
tggcatgggccgatactgaagcgaa

SEQ ID NO: 153047 - DNA, 25 bp, E. coli
tggcatgggccgttactgaagcgaa

SEQ ID NO: 153048 - DNA, 25 bp, E. coli
taatgaagcttaagcgctgggagca

SEQ ID NO: 153049 - DNA, 25 bp, E. coli
taatgaagcttatgcgctgggagca

SEQ ID NO: 153050 - DNA, 25 bp, E. coli
taacactgggatcaccgctttccgg

SEQ ID NO: 153051 - DNA, 25 bp, E. coli
cagaccttttacttcacgtaatcgg

SEQ ID NO: 153052 - DNA, 25 bp, E. coli
cacgtaatcggaattggctgaatat

SEQ ID NO: 153053 - DNA, 25 bp, E. coli
cacgtaatcggatttggctgaatat

SEQ ID NO: 153054 - DNA, 25 bp, E. coli
cagaccttttacatcacgtaatcgg

SEQ ID NO: 153055 - DNA, 25 bp, E. coli
acttcacgtaatgggatttggctga

SEQ ID NO: 153056 - DNA, 25 bp, E. coli
acttcacgtaatcggatttggctga

SEQ ID NO: 153057 - DNA, 25 bp, E. coli
tatctttcagacgttttacttcacg

SEQ ID NO: 153058 - DNA, 25 bp, E. coli
tatctttcagaccttttacttcacg

SEQ ID NO: 153059 - DNA, 25 bp, E. coli
tttacttcacgtaatcggatttggc

SEQ ID NO: 153060 - DNA, 25 bp, E. coli
tttacttcacgttatcggatttggc

SEQ ID NO: 153061 - DNA, 25 bp, E. coli
gctgaatattttagccgccccagtc

SEQ ID NO: 153062 - DNA, 25 bp, E. coli
gctgaatatttttgccgccccagtc

SEQ ID NO: 153063 - DNA, 25 bp, E. coli
gtagggtacagacgtaagatgttct

SEQ ID NO: 153064 - DNA, 25 bp, E. coli
gatttggctgaatattttagccgcc

SEQ ID NO: 153065 - DNA, 25 bp, E. coli
gtagggtacagaggtaagatgttct

SEQ ID NO: 153066 - DNA, 25 bp, E. coli
gatttggctgaaaattttagccgcc

SEQ ID NO: 153067 - DNA, 25 bp, E. coli
ggtaagatgttcaatctttcagacc

SEQ ID NO: 153068 - DNA, 25 bp, E. coli
ggtacagaggtatgatgttctatct

SEQ ID NO: 153069 - DNA, 25 bp, E. coli
ggtacagaggtaagatgttctatct

SEQ ID NO: 153070 - DNA, 25 bp, E. coli
ggtaagatgttctatctttcagacc

SEQ ID NO: 153071 - DNA, 25 bp, E. coli
gatgttctatctttcagacctttta

SEQ ID NO: 153072 - DNA, 25 bp, E. coli
gatgttctatctatcagacctttta

SEQ ID NO: 153073 - DNA, 25 bp, E. coli
aatagccaggattatgtcgcacagg

SEQ ID NO: 153074 - DNA, 25 bp, E. coli
aatagccaggataatgtcgcacagg

SEQ ID NO: 153075 - DNA, 25 bp, E. coli
caaagagttacttactatgcggcgg

SEQ ID NO: 153076 - DNA, 25 bp, E. coli
caaagagttactaactatgcggcgg

SEQ ID NO: 153077 - DNA, 25 bp, E. coli
tacggcccggcagttttacatcaaa

SEQ ID NO: 153078 - DNA, 25 bp, E. coli
tacggcccggcacttttacatcaaa

SEQ ID NO: 153079 - DNA, 25 bp, E. coli
tgatattaccctgagtacccgcgct

SEQ ID NO: 153080 - DNA, 25 bp, E. coli
tgatattaccctcagtacccgcgct

SEQ ID NO: 153081 - DNA, 25 bp, E. coli
tgtttgatattgattacggcccggc

SEQ ID NO: 153082 - DNA, 25 bp, E. coli
tgtttgatattgtttacggcccggc

SEQ ID NO: 153083 - DNA, 25 bp, E. coli
tgaagagcgtatgtctccagggacg

SEQ ID NO: 153084 - DNA, 25 bp, E. coli
tgaagagcgtatctctccagggacg

SEQ ID NO: 153085 - DNA, 25 bp, E. coli
tctcactggcagaaagaaagtccgc

SEQ ID NO: 153086 - DNA, 25 bp, E. coli
tctcactggcagtaagaaagtccgc

SEQ ID NO: 153087 - DNA, 25 bp, E. coli
cctttgtcaaagagcgcggtgtggc

SEQ ID NO: 153088 - DNA, 25 bp, E. coli
ccaatgttcaacatgcggaggcacg

SEQ ID NO: 153089 - DNA, 25 bp, E. coli
ccaatgttcaacttgcggaggcacg

SEQ ID NO: 153090 - DNA, 25 bp, E. coli
cctttgtcaaagtgcgcggtgtggc

SEQ ID NO: 153091 - DNA, 25 bp, E. coli
gaatgctttataatgggcggctgcc

SEQ ID NO: 153092 - DNA, 25 bp, E. coli
gaatgctttatattgggcggctgcc

SEQ ID NO: 153093 - DNA, 25 bp, E. coli
gcaacattgaacagtgcgacgcgtt

SEQ ID NO: 153094 - DNA, 25 bp, E. coli
gcaacattgaactgtgcgacgcgtt

SEQ ID NO: 153095 - DNA, 25 bp, E. coli
gaaaatcccctgattcgggtgggcg

SEQ ID NO: 153096 - DNA, 25 bp, E. coli
gaaaatcccctgtttcgggtgggcg

SEQ ID NO: 153097 - DNA, 25 bp, E. coli
caggcagagcctattattcgatcga

SEQ ID NO: 153098 - DNA, 25 bp, E. coli
caggcagagccttttattcgatcga

SEQ ID NO: 153099 - DNA, 25 bp, E. coli
tatgacgcaacgatgggtgccctgc

SEQ ID NO: 153100 - DNA, 25 bp, E. coli
tatgacgcaacgttgggtgccctgc

SEQ ID NO: 153101 - DNA, 25 bp, E. coli
tatacagatgctgggttccatgcca

SEQ ID NO: 153102 - DNA, 25 bp, E. coli
tatacagatgctcggttccatgcca

SEQ ID NO: 153103 - DNA, 25 bp, E. coli
tctatgacaaggaagggatgcccgt

SEQ ID NO: 153104 - DNA, 25 bp, E. coli
tctccagagagtcatcatcgtgccg

SEQ ID NO: 153105 - DNA, 25 bp, E. coli
tctatgacaaggtagggatgcccgt

SEQ ID NO: 153106 - DNA, 25 bp, E. coli
tctccagagagtgatcatcgtgccg

SEQ ID NO: 153107 - DNA, 25 bp, E. coli
cctgctgggaggttatgtcacggac

SEQ ID NO: 153108 - DNA, 25 bp, E. coli
cctgctgggaggatatgtcacggac

SEQ ID NO: 153109 - DNA, 25 bp, E. coli
gaatcagtctggctcagctaaggca

SEQ ID NO: 153110 - DNA, 25 bp, E. coli
gaatcagtctgggtcagctaaggca

SEQ ID NO: 153111 - DNA, 25 bp, E. coli
gatacaaagctgttgcggactcgcc

SEQ ID NO: 153112 - DNA, 25 bp, E. coli
gatacaaagctgatgcggactcgcc

SEQ ID NO: 153113 - DNA, 25 bp, E. coli
ggtaacgcgcttcatgaaaatcccc

SEQ ID NO: 153114 - DNA, 25 bp, E. coli
ggtaacgcgcttgatgaaaatcccc

SEQ ID NO: 153115 - DNA, 25 bp, E. coli
gatgagcaaaacgatgacgccgaag

SEQ ID NO: 153116 - DNA, 25 bp, E. coli
gatgagcaaaaccatgacgccgaag

SEQ ID NO: 153117 - DNA, 25 bp, E. coli
caaaccttgcctctttttgaagatg

SEQ ID NO: 153118 - DNA, 25 bp, E. coli
caaaccttgcctgtttttgaagatg

SEQ ID NO: 153119 - DNA, 25 bp, E. coli
caggcgttcaactagccattttgcg

SEQ ID NO: 153120 - DNA, 25 bp, E. coli
caggcgttcaacaagccattttgcg

SEQ ID NO: 153121 - DNA, 25 bp, E. coli
aaaaccattgttattagtctcacac

SEQ ID NO: 153122 - DNA, 25 bp, E. coli
aaaaccattgtttttagtctcacac

SEQ ID NO: 153123 - DNA, 25 bp, E. coli
tattgtctctgtattggtaacgccg

SEQ ID NO: 153124 - DNA, 25 bp, E. coli
tattgtctctgttttggtaacgccg

SEQ ID NO: 153125 - DNA, 25 bp, E. coli
gccattttgcgaacctgttcccgga

SEQ ID NO: 153126 - DNA, 25 bp, E. coli
gccattttgcgatcctgttcccgga

SEQ ID NO: 153127 - DNA, 25 bp, E. coli
gctaatcaggcatagtttgcgtcaa

SEQ ID NO: 153128 - DNA, 25 bp, E. coli
gctaatcaggcaaagtttgcgtcaa

SEQ ID NO: 153129 - DNA, 25 bp, E. coli
gattgataacaaaagaggtgccagg

SEQ ID NO: 153130 - DNA, 25 bp, E. coli
gatattctgttttgccacaggtgca

SEQ ID NO: 153131 - DNA, 25 bp, E. coli
gatattctgtttagccacaggtgca

SEQ ID NO: 153132 - DNA, 25 bp, E. coli
gattgataacaatagaggtgccagg

SEQ ID NO: 153133 - DNA, 25 bp, E. coli
ggtgcaattatctgcggcgtacgcg

SEQ ID NO: 153134 - DNA, 25 bp, E. coli
ggtgcaattatcagcggcgtacgcg

SEQ ID NO: 153135 - DNA, 25 bp, E. coli
ggcaaaggcataagctaaaaaccat

SEQ ID NO: 153136 - DNA, 25 bp, E. coli
ggcaaaggcatatgctaaaaaccat

SEQ ID NO: 153137 - DNA, 25 bp, E. coli
gatgtatatagataaacaggcgttc

SEQ ID NO: 153138 - DNA, 25 bp, E. coli
gatgtatatagaaaaacaggcgttc

SEQ ID NO: 153139 - DNA, 25 bp, E. coli
aatcggtgtcgtattcgcatactgg

SEQ ID NO: 153140 - DNA, 25 bp, E. coli
aatcggtgtcgttttcgcatactgg

SEQ ID NO: 153141 - DNA, 25 bp, E. coli
caggcaccgacggacgagtagataa

SEQ ID NO: 153142 - DNA, 25 bp, E. coli
caggcaccgacgcacgagtagataa

SEQ ID NO: 153143 - DNA, 25 bp, E. coli
tacgggtcatgcgactgttaaatcg

SEQ ID NO: 153144 - DNA, 25 bp, E. coli
taaagctgatgaccagtacgatacg

SEQ ID NO: 153145 - DNA, 25 bp, E. coli
taaagctgatgagcagtacgatacg

SEQ ID NO: 153146 - DNA, 25 bp, E. coli
tacgggtcatgccactgttaaatcg

SEQ ID NO: 153147 - DNA, 25 bp, E. coli
ttcgcatactggttgcctgactcac

SEQ ID NO: 153148 - DNA, 25 bp, E. coli
ttcgcatactggatgcctgactcac

SEQ ID NO: 153149 - DNA, 25 bp, E. coli
tgagcagtacgaaacgggtcatgcg

SEQ ID NO: 153150 - DNA, 25 bp, E. coli
tgagcagtacgatacgggtcatgcg

SEQ ID NO: 153151 - DNA, 25 bp, E. coli
tctgatggtgctcccaggcaccgac

SEQ ID NO: 153152 - DNA, 25 bp, E. coli
tcatgcgactgtaaaatcggtgtcg

SEQ ID NO: 153153 - DNA, 25 bp, E. coli
tcatgcgactgttaaatcggtgtcg

SEQ ID NO: 153154 - DNA, 25 bp, E. coli
tctgatggtgctgccaggcaccgac

SEQ ID NO: 153155 - DNA, 25 bp, E. coli
gacgagtagataaaacggccaaaga

SEQ ID NO: 153156 - DNA, 25 bp, E. coli
gacgagtagatataacggccaaaga

SEQ ID NO: 153157 - DNA, 25 bp, E. coli
cggccaaagaagtagataaagctga

SEQ ID NO: 153158 - DNA, 25 bp, E. coli
cttttttgctctgatggtgctgcca

SEQ ID NO: 153159 - DNA, 25 bp, E. coli
cttttttgctctcatggtgctgcca

SEQ ID NO: 153160 - DNA, 25 bp, E. coli
cggccaaagaagaagataaagctga

SEQ ID NO: 153161 - DNA, 25 bp, E. coli
cagctagaaagtttgggaaaagcag

SEQ ID NO: 153162 - DNA, 25 bp, E. coli
cagctagaaagtatgggaaaagcag

SEQ ID NO: 153163 - DNA, 25 bp, E. coli
aacagctagaaagtatgggaaaagc

SEQ ID NO: 153164 - DNA, 25 bp, E. coli
aacagctagaaactatgggaaaagc

SEQ ID NO: 153165 - DNA, 25 bp, E. coli
tagaaagtatggcaaaagcagtgcg

SEQ ID NO: 153166 - DNA, 25 bp, E. coli
tagaaagtatgggaaaagcagtgcg

SEQ ID NO: 153167 - DNA, 25 bp, E. coli
ttagccagacactgaacactccgca

SEQ ID NO: 153168 - DNA, 25 bp, E. coli
ttagccagacacagaacactccgca

SEQ ID NO: 153169 - DNA, 25 bp, E. coli
tgcacgaatggtcggcgttgcgtta

SEQ ID NO: 153170 - DNA, 25 bp, E. coli
tgcacgaatggtgggcgttgcgtta

SEQ ID NO: 153171 - DNA, 25 bp, E. coli
tgctgaaacagctagaaagtatggg

SEQ ID NO: 153172 - DNA, 25 bp, E. coli
tgctgaaacagcaagaaagtatggg

SEQ ID NO: 153173 - DNA, 25 bp, E. coli
cctgtctgcacgaatggtgggcgtt

SEQ ID NO: 153174 - DNA, 25 bp, E. coli
ccatgctgaaactgctagaaagtat

SEQ ID NO: 153175 - DNA, 25 bp, E. coli
ccatgctgaaacagctagaaagtat

SEQ ID NO: 153176 - DNA, 25 bp, E. coli
cctgtctgcacgtatggtgggcgtt

SEQ ID NO: 153177 - DNA, 25 bp, E. coli
gaaacagctagatagtatgggaaaa

SEQ ID NO: 153178 - DNA, 25 bp, E. coli
gaaacagctagaaagtatgggaaaa

SEQ ID NO: 153179 - DNA, 25 bp, E. coli
ctgaaacagctacaaagtatgggaa

SEQ ID NO: 153180 - DNA, 25 bp, E. coli
ctgaaacagctagaaagtatgggaa

SEQ ID NO: 153181 - DNA, 25 bp, E. coli
gattagccagactctgaacactccg

SEQ ID NO: 153182 - DNA, 25 bp, E. coli
gattagccagacactgaacactccg

SEQ ID NO: 153183 - DNA, 25 bp, E. coli
caacaagaaatggtgcgacgtgtca

SEQ ID NO: 153184 - DNA, 25 bp, E. coli
caacaagaaatgctgcgacgtgtca

SEQ ID NO: 153185 - DNA, 25 bp, E. coli
aaaaggttctgtacctgccctgcaa

SEQ ID NO: 153186 - DNA, 25 bp, E. coli
aaatgctgcgacctgtcagtaaacg

SEQ ID NO: 153187 - DNA, 25 bp, E. coli
aaatgctgcgacgtgtcagtaaacg

SEQ ID NO: 153188 - DNA, 25 bp, E. coli
aaaaggttctgttcctgccctgcaa

SEQ ID NO: 153189 - DNA, 25 bp, E. coli
ttatgacgatgtagaagtgatcatc

SEQ ID NO: 153190 - DNA, 25 bp, E. coli
ttatgacgatgttgaagtgatcatc

SEQ ID NO: 153191 - DNA, 25 bp, E. coli
tgttcctgccctgcaacaagaaatg

SEQ ID NO: 153192 - DNA, 25 bp, E. coli
tgtagaagtgatgatcaaatccacc

SEQ ID NO: 153193 - DNA, 25 bp, E. coli
tgtagaagtgatcatcaaatccacc

SEQ ID NO: 153194 - DNA, 25 bp, E. coli
tgttcctgccctccaacaagaaatg

SEQ ID NO: 153195 - DNA, 25 bp, E. coli
tgccctgcaacaagaaatgctgcga

SEQ ID NO: 153196 - DNA, 25 bp, E. coli
tgccctgcaacatgaaatgctgcga

SEQ ID NO: 153197 - DNA, 25 bp, E. coli
gctgcgacgtgtgagtaaacgttat

SEQ ID NO: 153198 - DNA, 25 bp, E. coli
gctgcgacgtgtcagtaaacgttat

SEQ ID NO: 153199 - DNA, 25 bp, E. coli
cgcagccaaaatcaacaaaatgcca

SEQ ID NO: 153200 - DNA, 25 bp, E. coli
cgcagccaaaatgaacaaaatgcca

SEQ ID NO: 153201 - DNA, 25 bp, E. coli
gatcatcaaatcgaccagcaacgat

SEQ ID NO: 153202 - DNA, 25 bp, E. coli
gatcatcaaatccaccagcaacgat

SEQ ID NO: 153203 - DNA, 25 bp, E. coli
tcaacaaaatgccaaaaggttctgt

SEQ ID NO: 153204 - DNA, 25 bp, E. coli
tcaacaaaatgcgaaaaggttctgt

SEQ ID NO: 153205 - DNA, 25 bp, E. coli
caagctatgttgtcatcatgggcgg

SEQ ID NO: 153206 - DNA, 25 bp, E. coli
caagctatgttgacatcatgggcgg

SEQ ID NO: 153207 - DNA, 25 bp, E. coli
taaaagccgacttctcgctggcaaa

SEQ ID NO: 153208 - DNA, 25 bp, E. coli
tacggcctgaccatgcgttatctcg

SEQ ID NO: 153209 - DNA, 25 bp, E. coli
taaaagccgactactcgctggcaaa

SEQ ID NO: 153210 - DNA, 25 bp, E. coli
tacggcctgaccttgcgttatctcg

SEQ ID NO: 153211 - DNA, 25 bp, E. coli
aaagagtggaacaatgcaggacgcc

SEQ ID NO: 153212 - DNA, 25 bp, E. coli
aaaaccgatgcatgaagccgctgcc

SEQ ID NO: 153213 - DNA, 25 bp, E. coli
aaaaccgatgcaagaagccgctgcc

SEQ ID NO: 153214 - DNA, 25 bp, E. coli
aaagagtggaactatgcaggacgcc

SEQ ID NO: 153215 - DNA, 25 bp, E. coli
tgattgtcggtaggctgatgacgcc

SEQ ID NO: 153216 - DNA, 25 bp, E. coli
tgattgtcggtacgctgatgacgcc

SEQ ID NO: 153217 - DNA, 25 bp, E. coli
tgatgacgccaattatcaacggcaa

SEQ ID NO: 153218 - DNA, 25 bp, E. coli
tgatgacgccaaatatcaacggcaa

SEQ ID NO: 153219 - DNA, 25 bp, E. coli
ccgggcagttgaaagagcgcaagat

SEQ ID NO: 153220 - DNA, 25 bp, E. coli
ccgggcagttgatagagcgcaagat

SEQ ID NO: 153221 - DNA, 25 bp, E. coli
ccgggatgtcctatgcgatgaacgc

SEQ ID NO: 153222 - DNA, 25 bp, E. coli
gcattccggcgcagtatgactacat

SEQ ID NO: 153223 - DNA, 25 bp, E. coli
gcattccggcgctgtatgactacat

SEQ ID NO: 153224 - DNA, 25 bp, E. coli
ccgggatgtcctttgcgatgaacgc

SEQ ID NO: 153225 - DNA, 25 bp, E. coli
gatcggtaatatgaactacggcctg

SEQ ID NO: 153226 - DNA, 25 bp, E. coli
gatcggtaatatcaactacggcctg

SEQ ID NO: 153227 - DNA, 25 bp, E. coli
cagcggcaaattttataaagggacg

SEQ ID NO: 153228 - DNA, 25 bp, E. coli
aatatccggcctatgcagcggcaaa

SEQ ID NO: 153229 - DNA, 25 bp, E. coli
cagcggcaaattatataaagggacg

SEQ ID NO: 153230 - DNA, 25 bp, E. coli
aatatccggcctttgcagcggcaaa

SEQ ID NO: 153231 - DNA, 25 bp, E. coli
tatctttagtccatctgcaccctga

SEQ ID NO: 153232 - DNA, 25 bp, E. coli
tatctttagtccttctgcaccctga

SEQ ID NO: 153233 - DNA, 25 bp, E. coli
ttaaggcattaccacaatatccggc

SEQ ID NO: 153234 - DNA, 25 bp, E. coli
ttaaggcattacgacaatatccggc

SEQ ID NO: 153235 - DNA, 25 bp, E. coli
tgtaaaggcgatcgcaaaatggcga

SEQ ID NO: 153236 - DNA, 25 bp, E. coli
tgtaaaggcgatggcaaaatggcga

SEQ ID NO: 153237 - DNA, 25 bp, E. coli
tcttctctggttttgggctgtacgc

SEQ ID NO: 153238 - DNA, 25 bp, E. coli
tcttctctggttatgggctgtacgc

SEQ ID NO: 153239 - DNA, 25 bp, E. coli
gatatgccccgacagttggttaagg

SEQ ID NO: 153240 - DNA, 25 bp, E. coli
gatatgccccgagagttggttaagg

SEQ ID NO: 153241 - DNA, 25 bp, E. coli
cgatttgagaagcacaggccgcgta

SEQ ID NO: 153242 - DNA, 25 bp, E. coli
cgatttgagaaggacaggccgcgta

SEQ ID NO: 153243 - DNA, 25 bp, E. coli
gatggtactgtcacccgaattgagt

SEQ ID NO: 153244 - DNA, 25 bp, E. coli
gagccgcaccatgtgtttgatgagc

SEQ ID NO: 153245 - DNA, 25 bp, E. coli
gagtttatccgtacagagccgcacc

SEQ ID NO: 153246 - DNA, 25 bp, E. coli
gagtttatccgttcagagccgcacc

SEQ ID NO: 153247 - DNA, 25 bp, E. coli
gagccgcaccatctgtttgatgagc

SEQ ID NO: 153248 - DNA, 25 bp, E. coli
gatggtactgtctcccgaattgagt

SEQ ID NO: 153249 - DNA, 25 bp, E. coli
accgctgttgtgttttaccgccgct

SEQ ID NO: 153250 - DNA, 25 bp, E. coli
accgctgttgtgatttaccgccgct

SEQ ID NO: 153251 - DNA, 25 bp, E. coli
tatgtggcgtgtaagtccagctgtg

SEQ ID NO: 153252 - DNA, 25 bp, E. coli
tatgtggcgtgttagtccagctgtg

SEQ ID NO: 153253 - DNA, 25 bp, E. coli
ttttggttcgcttcctattatcgcg

SEQ ID NO: 153254 - DNA, 25 bp, E. coli
ttttggttcgctacctattatcgcg

SEQ ID NO: 153255 - DNA, 25 bp, E. coli
tgttagtccagctgtggacttttgg

SEQ ID NO: 153256 - DNA, 25 bp, E. coli
tgttgtgttttaccgccgctgccac

SEQ ID NO: 153257 - DNA, 25 bp, E. coli
tgttagtccagcagtggacttttgg

SEQ ID NO: 153258 - DNA, 25 bp, E. coli
tgtcactaccgttccgctgttgtgt

SEQ ID NO: 153259 - DNA, 25 bp, E. coli
tgtcactaccgtaccgctgttgtgt

SEQ ID NO: 153260 - DNA, 25 bp, E. coli
tgttgtgttttagcgccgctgccac

SEQ ID NO: 153261 - DNA, 25 bp, E. coli
tctggcgatatgtggcgtgttagtc

SEQ ID NO: 153262 - DNA, 25 bp, E. coli
tctggcgatatgaggcgtgttagtc

SEQ ID NO: 153263 - DNA, 25 bp, E. coli
cgatatgtggcgtgttagtccagct

SEQ ID NO: 153264 - DNA, 25 bp, E. coli
cgatatgtggcgagttagtccagct

SEQ ID NO: 153265 - DNA, 25 bp, E. coli
gttcgctacctaatatcgcgctggg

SEQ ID NO: 153266 - DNA, 25 bp, E. coli
gttcgctacctattatcgcgctggg

SEQ ID NO: 153267 - DNA, 25 bp, E. coli
ggtattgtcactaccgtaccgctgt

SEQ ID NO: 153268 - DNA, 25 bp, E. coli
ggtattgtcacttccgtaccgctgt

SEQ ID NO: 153269 - DNA, 25 bp, E. coli
tggacttttggtacgctacctatta

SEQ ID NO: 153270 - DNA, 25 bp, E. coli
tggacttttggttcgctacctatta

SEQ ID NO: 153271 - DNA, 25 bp, E. coli
caaactctgattactgtcgctggca

SEQ ID NO: 153272 - DNA, 25 bp, E. coli
caaactctgatttctgtcgctggca

SEQ ID NO: 153273 - DNA, 25 bp, E. coli
cagattagcgatgccttacgtcagg

SEQ ID NO: 153274 - DNA, 25 bp, E. coli
cagattagcgatcccttacgtcagg

SEQ ID NO: 153275 - DNA, 25 bp, E. coli
atagcgcatatcgagcgccgccaga

SEQ ID NO: 153276 - DNA, 25 bp, E. coli
atagcgcatatccagcgccgccaga

SEQ ID NO: 153277 - DNA, 25 bp, E. coli
aagcagcagctttctaacgaccaaa

SEQ ID NO: 153278 - DNA, 25 bp, E. coli
aagcagcagcttactaacgaccaaa

SEQ ID NO: 153279 - DNA, 25 bp, E. coli
tattcgcgcgcgttttgacgatcgc

SEQ ID NO: 153280 - DNA, 25 bp, E. coli
tattcgcgcgcgatttgacgatcgc

SEQ ID NO: 153281 - DNA, 25 bp, E. coli
tcgatcattgatcctggctggcgct

SEQ ID NO: 153282 - DNA, 25 bp, E. coli
tcgatcattgatgctggctggcgct

SEQ ID NO: 153283 - DNA, 25 bp, E. coli
tctgttgatgtcagcgtggcatggc

SEQ ID NO: 153284 - DNA, 25 bp, E. coli
tctgttgatgtctgcgtggcatggc

SEQ ID NO: 153285 - DNA, 25 bp, E. coli
gcatctggcgaaaagacagcggcga

SEQ ID NO: 153286 - DNA, 25 bp, E. coli
gctggcaacccaacgagaaaacgtt

SEQ ID NO: 153287 - DNA, 25 bp, E. coli
gctggcaacccatcgagaaaacgtt

SEQ ID NO: 153288 - DNA, 25 bp, E. coli
gcatctggcgaatagacagcggcga

SEQ ID NO: 153289 - DNA, 25 bp, E. coli
ccgccagtggatatgctgaagacca

SEQ ID NO: 153290 - DNA, 25 bp, E. coli
ccgccagtggatttgctgaagacca

SEQ ID NO: 153291 - DNA, 25 bp, E. coli
tggcgataccaccacgcgagagtat

SEQ ID NO: 153292 - DNA, 25 bp, E. coli
tggcgataccacgacgcgagagtat

SEQ ID NO: 153293 - DNA, 25 bp, E. coli
aatattattaacttctcccgcgagc

SEQ ID NO: 153294 - DNA, 25 bp, E. coli
aatattattaacatctcccgcgagc

SEQ ID NO: 153295 - DNA, 25 bp, E. coli
taaacgtgaattagatgccgccggt

SEQ ID NO: 153296 - DNA, 25 bp, E. coli
taaacgtgaatttgatgccgccggt

SEQ ID NO: 153297 - DNA, 25 bp, E. coli
tatgcagtaaacatcgtggcggcac

SEQ ID NO: 153298 - DNA, 25 bp, E. coli
tatgcagtaaacttcgtggcggcac

SEQ ID NO: 153299 - DNA, 25 bp, E. coli
ttgtcgatagcaaaaacggcgcggg

SEQ ID NO: 153300 - DNA, 25 bp, E. coli
ttgtcgatagcataaacggcgcggg

SEQ ID NO: 153301 - DNA, 25 bp, E. coli
tcccgtaaaatcgatgccactgttg

SEQ ID NO: 153302 - DNA, 25 bp, E. coli
tccgtgccggagaatatgttgacct

SEQ ID NO: 153303 - DNA, 25 bp, E. coli
tcccgtaaaatccatgccactgttg

SEQ ID NO: 153304 - DNA, 25 bp, E. coli
tccgtgccggagtatatgttgacct

SEQ ID NO: 153305 - DNA, 25 bp, E. coli
tcattgctgtacacggtgccgcagg

SEQ ID NO: 153306 - DNA, 25 bp, E. coli
tcattgctgtactcggtgccgcagg

SEQ ID NO: 153307 - DNA, 25 bp, E. coli
ccaggcgctgctcctaagttatgca

SEQ ID NO: 153308 - DNA, 25 bp, E. coli
ccaggcgctgctgctaagttatgca

SEQ ID NO: 153309 - DNA, 25 bp, E. coli
gcgatctgcaaaacgtgtactggga

SEQ ID NO: 153310 - DNA, 25 bp, E. coli
gcgatctgcaaatcgtgtactggga

SEQ ID NO: 153311 - DNA, 25 bp, E. coli
gaatcgcctgatgatctcccgtaaa

SEQ ID NO: 153312 - DNA, 25 bp, E. coli
gaatcgcctgatcatctcccgtaaa

SEQ ID NO: 153313 - DNA, 25 bp, E. coli
taatttcgtggtccgcgtctggagc

SEQ ID NO: 153314 - DNA, 25 bp, E. coli
taatttcgtggtgcgcgtctggagc

SEQ ID NO: 153315 - DNA, 25 bp, E. coli
catgctgtacgaaggttgggccacc

SEQ ID NO: 153316 - DNA, 25 bp, E. coli
catgctgtacgatggttgggccacc

SEQ ID NO: 153317 - DNA, 25 bp, E. coli
taaagcaatgatggatgccgccgcc

SEQ ID NO: 153318 - DNA, 25 bp, E. coli
taaagcaatgatcgatgccgccgcc

SEQ ID NO: 153319 - DNA, 25 bp, E. coli
attatcacgcggatggcccaatggc

SEQ ID NO: 153320 - DNA, 25 bp, E. coli
attatcacgcggttggcccaatggc

SEQ ID NO: 153321 - DNA, 25 bp, E. coli
aaaacgtattttccactctggcccg

SEQ ID NO: 153322 - DNA, 25 bp, E. coli
aaaacgtattttgcactctggcccg

SEQ ID NO: 153323 - DNA, 25 bp, E. coli
tgtcgatgccaccaataacagccgt

SEQ ID NO: 153324 - DNA, 25 bp, E. coli
tgtcgatgccacgaataacagccgt

SEQ ID NO: 153325 - DNA, 25 bp, E. coli
tgaaagcagcaaacgcacaacacgg

SEQ ID NO: 153326 - DNA, 25 bp, E. coli
tgaaagcagcaatcgcacaacacgg

SEQ ID NO: 153327 - DNA, 25 bp, E. coli
taaggttctccgttttggcgccaat

SEQ ID NO: 153328 - DNA, 25 bp, E. coli
tcgtcaaatttgagggaggcacccc

SEQ ID NO: 153329 - DNA, 25 bp, E. coli
taaggttctccgatttggcgccaat

SEQ ID NO: 153330 - DNA, 25 bp, E. coli
tcgtcaaatttgtgggaggcacccc

SEQ ID NO: 153331 - DNA, 25 bp, E. coli
gaagttctcaatcgtctggcctgga

SEQ ID NO: 153332 - DNA, 25 bp, E. coli
gaagttctcaatggtctggcctgga

SEQ ID NO: 153333 - DNA, 25 bp, E. coli
taacagccgtcggatgcaagccatc

SEQ ID NO: 153334 - DNA, 25 bp, E. coli
taacagccgtcgcatgcaagccatc

SEQ ID NO: 153335 - DNA, 25 bp, E. coli
gatgctgctgctcacctgggtgata

SEQ ID NO: 153336 - DNA, 25 bp, E. coli
gatgctgctgctgacctgggtgata

SEQ ID NO: 153337 - DNA, 25 bp, E. coli
caatgctctggttcgccagctggca

SEQ ID NO: 153338 - DNA, 25 bp, E. coli
caatgctctggtacgccagctggca

SEQ ID NO: 153339 - DNA, 25 bp, E. coli
catcaactgatgcaggcctgcacag

SEQ ID NO: 153340 - DNA, 25 bp, E. coli
catcaactgatggaggcctgcacag

SEQ ID NO: 153341 - DNA, 25 bp, E. coli
ttacagcgggaacatctggatgtgc

SEQ ID NO: 153342 - DNA, 25 bp, E. coli
tttatgcaggcgtatggagcagccc

SEQ ID NO: 153343 - DNA, 25 bp, E. coli
ttacagcgggaagatctggatgtgc

SEQ ID NO: 153344 - DNA, 25 bp, E. coli
tttatgcaggcgaatggagcagccc

SEQ ID NO: 153345 - DNA, 25 bp, E. coli
tgctcgacagctggaattacagcgg

SEQ ID NO: 153346 - DNA, 25 bp, E. coli
tgaatccggtgtcatgcctgacccc

SEQ ID NO: 153347 - DNA, 25 bp, E. coli
tgaatccggtgtgatgcctgacccc

SEQ ID NO: 153348 - DNA, 25 bp, E. coli
tgctcgacagctcgaattacagcgg

SEQ ID NO: 153349 - DNA, 25 bp, E. coli
gcaaattaactgagctgcgcgcgaa

SEQ ID NO: 153350 - DNA, 25 bp, E. coli
gcaaattaactgtgctgcgcgcgaa

SEQ ID NO: 153351 - DNA, 25 bp, E. coli
gacatagtgagacccgaaaagccgt

SEQ ID NO: 153352 - DNA, 25 bp, E. coli
gacatagtgagagccgaaaagccgt

SEQ ID NO: 153353 - DNA, 25 bp, E. coli
cccatgatggttggtgattgccaga

SEQ ID NO: 153354 - DNA, 25 bp, E. coli
cccatgatggttcgtgattgccaga

SEQ ID NO: 153355 - DNA, 25 bp, E. coli
gatagaatcactgctcactgccatg

SEQ ID NO: 153356 - DNA, 25 bp, E. coli
gattgccagagctcttacacccctg

SEQ ID NO: 153357 - DNA, 25 bp, E. coli
gattgccagagcacttacacccctg

SEQ ID NO: 153358 - DNA, 25 bp, E. coli
gatagaatcactcctcactgccatg

SEQ ID NO: 153359 - DNA, 25 bp, E. coli
caagtgatcattcagtacggcggct

SEQ ID NO: 153360 - DNA, 25 bp, E. coli
caagtgatcattgagtacggcggct

SEQ ID NO: 153361 - DNA, 25 bp, E. coli
tactgaaaactctgggtgctgcggc

SEQ ID NO: 153362 - DNA, 25 bp, E. coli
tactgaaaactcagggtgctgcggc

SEQ ID NO: 153363 - DNA, 25 bp, E. coli
tatgctgaaagacatcggcgcacag

SEQ ID NO: 153364 - DNA, 25 bp, E. coli
tatgctgaaagagatcggcgcacag

SEQ ID NO: 153365 - DNA, 25 bp, E. coli
tatcgcttacgatcctgtatgggca

SEQ ID NO: 153366 - DNA, 25 bp, E. coli
tatcgcttacgaacctgtatgggca

SEQ ID NO: 153367 - DNA, 25 bp, E. coli
tgggcaatcggttctggcaaatctg

SEQ ID NO: 153368 - DNA, 25 bp, E. coli
tgggcaatcggtactggcaaatctg

SEQ ID NO: 153369 - DNA, 25 bp, E. coli
tgacgctaacatggctgaacaagtg

SEQ ID NO: 153370 - DNA, 25 bp, E. coli
tgacgctaacatcgctgaacaagtg

SEQ ID NO: 153371 - DNA, 25 bp, E. coli
tgcgcaaaacgtcgacctgaacctg

SEQ ID NO: 153372 - DNA, 25 bp, E. coli
tgcgcaaaacgtggacctgaacctg

SEQ ID NO: 153373 - DNA, 25 bp, E. coli
gactccggttctgtgcatcggtgaa

SEQ ID NO: 153374 - DNA, 25 bp, E. coli
gactccggttctctgcatcggtgaa

SEQ ID NO: 153375 - DNA, 25 bp, E. coli
gttgcaatcgcagcaccggaaatgt

SEQ ID NO: 153376 - DNA, 25 bp, E. coli
gttgcaatcgcaccaccggaaatgt

SEQ ID NO: 153377 - DNA, 25 bp, E. coli
ggtgaaacctctgctgctatgctga

SEQ ID NO: 153378 - DNA, 25 bp, E. coli
ggtgaaacctctcctgctatgctga

SEQ ID NO: 153379 - DNA, 25 bp, E. coli
taactggaaactgaacggcagccgc

SEQ ID NO: 153380 - DNA, 25 bp, E. coli
taactggaaactcaacggcagccgc

SEQ ID NO: 153381 - DNA, 25 bp, E. coli
aaccttaatcaaataattcctctga

SEQ ID NO: 153382 - DNA, 25 bp, E. coli
aatttgctataccttattctgcgcg

SEQ ID NO: 153383 - DNA, 25 bp, E. coli
aatttgctatacgttattctgcgcg

SEQ ID NO: 153384 - DNA, 25 bp, E. coli
aaccttaatcaattaattcctctga

SEQ ID NO: 153385 - DNA, 25 bp, E. coli
taaatatcatttcttacgccttaag

SEQ ID NO: 153386 - DNA, 25 bp, E. coli
aataagtctggtcaatgtatcgaag

SEQ ID NO: 153387 - DNA, 25 bp, E. coli
aataagtctggtgaatgtatcgaag

SEQ ID NO: 153388 - DNA, 25 bp, E. coli
tcctaaaggagatgttcagttagcc

SEQ ID NO: 153389 - DNA, 25 bp, E. coli
tatttgccttttatccccatttcgg

SEQ ID NO: 153390 - DNA, 25 bp, E. coli
tatttgccttttttccccatttcgg

SEQ ID NO: 153391 - DNA, 25 bp, E. coli
tcctaaaggagaagttcagttagcc

SEQ ID NO: 153392 - DNA, 25 bp, E. coli
tcctctgaaatgttaataagtctgg

SEQ ID NO: 153393 - DNA, 25 bp, E. coli
tcctctgaaatgataataagtctgg

SEQ ID NO: 153394 - DNA, 25 bp, E. coli
tcagttagccgaaaaatatcatttg

SEQ ID NO: 153395 - DNA, 25 bp, E. coli
tcagttagccgataaatatcatttg

SEQ ID NO: 153396 - DNA, 25 bp, E. coli
gaatgtatcgaagataatacataca

SEQ ID NO: 153397 - DNA, 25 bp, E. coli
gaatgtatcgaacataatacataca

SEQ ID NO: 153398 - DNA, 25 bp, E. coli
ggagaagttcagatagccgataaat

SEQ ID NO: 153399 - DNA, 25 bp, E. coli
gggagtgaaaacatcctaaaggaga

SEQ ID NO: 153400 - DNA, 25 bp, E. coli
ggagaagttcagttagccgataaat

SEQ ID NO: 153401 - DNA, 25 bp, E. coli
gggagtgaaaacttcctaaaggaga

SEQ ID NO: 153402 - DNA, 25 bp, E. coli
taaatatcatttgttacgccttaag

SEQ ID NO: 153403 - DNA, 25 bp, E. coli
aagaaagggctttatatatcacgca

SEQ ID NO: 153404 - DNA, 25 bp, E. coli
aagaaagggcttaatatatcacgca

SEQ ID NO: 153405 - DNA, 25 bp, E. coli
cacttattggatttagtatgcttga

SEQ ID NO: 153406 - DNA, 25 bp, E. coli
cacttattggatatagtatgcttga

SEQ ID NO: 153407 - DNA, 25 bp, E. coli
taacaattcggtgagtctgtcggag

SEQ ID NO: 153408 - DNA, 25 bp, E. coli
actctctccttaaaaccaattgttc

SEQ ID NO: 153409 - DNA, 25 bp, E. coli
actctctccttataaccaattgttc

SEQ ID NO: 153410 - DNA, 25 bp, E. coli
ttatcatatttacgaagagatcagg

SEQ ID NO: 153411 - DNA, 25 bp, E. coli
ttatcatatttaggaagagatcagg

SEQ ID NO: 153412 - DNA, 25 bp, E. coli
tgttgaatcaatgaattactcgttc

SEQ ID NO: 153413 - DNA, 25 bp, E. coli
tgttgaatcaatcaattactcgttc

SEQ ID NO: 153414 - DNA, 25 bp, E. coli
tctgtcggagagacaagaaaattcc

SEQ ID NO: 153415 - DNA, 25 bp, E. coli
tctgtcggagagtcaagaaaattcc

SEQ ID NO: 153416 - DNA, 25 bp, E. coli
cgcatatttatttattggatagtca

SEQ ID NO: 153417 - DNA, 25 bp, E. coli
cgcatatttattaattggatagtca

SEQ ID NO: 153418 - DNA, 25 bp, E. coli
gtatgcttgatttaaatggcggaca

SEQ ID NO: 153419 - DNA, 25 bp, E. coli
gtatgcttgattaaaatggcggaca

SEQ ID NO: 153420 - DNA, 25 bp, E. coli
ggatagtcattacatgttgaatcaa

SEQ ID NO: 153421 - DNA, 25 bp, E. coli
ggatagtcattagatgttgaatcaa

SEQ ID NO: 153422 - DNA, 25 bp, E. coli
taagtctaatgtcatttaaaggcat

SEQ ID NO: 153423 - DNA, 25 bp, E. coli
taagtctaatgtgatttaaaggcat

SEQ ID NO: 153424 - DNA, 25 bp, E. coli
taacaattcggtcagtctgtcggag

SEQ ID NO: 153425 - DNA, 25 bp, E. coli
aaacggcgcgatgacttcattacag

SEQ ID NO: 153426 - DNA, 25 bp, E. coli
aaacggcgcgatcacttcattacag

SEQ ID NO: 153427 - DNA, 25 bp, E. coli
ttcgttgcacgatctggagcagctc

SEQ ID NO: 153428 - DNA, 25 bp, E. coli
ttcgttgcacgaactggagcagctc

SEQ ID NO: 153429 - DNA, 25 bp, E. coli
tgtgggtggattatcaaaacggcgc

SEQ ID NO: 153430 - DNA, 25 bp, E. coli
tgtgggtggattttcaaaacggcgc

SEQ ID NO: 153431 - DNA, 25 bp, E. coli
tcaggccgttaacaagccactgtgg

SEQ ID NO: 153432 - DNA, 25 bp, E. coli
tcggcatcatcagcaacggctttag

SEQ ID NO: 153433 - DNA, 25 bp, E. coli
tcaggccgttaagaagccactgtgg

SEQ ID NO: 153434 - DNA, 25 bp, E. coli
tcattacagcttgagcacgggcggt

SEQ ID NO: 153435 - DNA, 25 bp, E. coli
tcattacagcttcagcacgggcggt

SEQ ID NO: 153436 - DNA, 25 bp, E. coli
tcggcatcatcaccaacggctttag

SEQ ID NO: 153437 - DNA, 25 bp, E. coli
gcctttattaatccgatggcggaaa

SEQ ID NO: 153438 - DNA, 25 bp, E. coli
gcctttattaatgcgatggcggaaa

SEQ ID NO: 153439 - DNA, 25 bp, E. coli
gaagattttcagcactatcaggccg

SEQ ID NO: 153440 - DNA, 25 bp, E. coli
gaagattttcaggactatcaggccg

SEQ ID NO: 153441 - DNA, 25 bp, E. coli
gatattctcggtcgcatcaacgccg

SEQ ID NO: 153442 - DNA, 25 bp, E. coli
gatattctcggtggcatcaacgccg

SEQ ID NO: 153443 - DNA, 25 bp, E. coli
ggagcagctcctgtgtaaacactga

SEQ ID NO: 153444 - DNA, 25 bp, E. coli
ggagcagctcctctgtaaacactga

SEQ ID NO: 153445 - DNA, 25 bp, E. coli
taacgccattcgtggcaacgccaaa

SEQ ID NO: 153446 - DNA, 25 bp, E. coli
taacgccattcgaggcaacgccaaa

SEQ ID NO: 153447 - DNA, 25 bp, E. coli
aagccattgacgcctatacgccgcg

SEQ ID NO: 153448 - DNA, 25 bp, E. coli
aagccattgacggctatacgccgcg

SEQ ID NO: 153449 - DNA, 25 bp, E. coli
caaagccattgacggctatacgccg

SEQ ID NO: 153450 - DNA, 25 bp, E. coli
caaagccattgagggctatacgccg

SEQ ID NO: 153451 - DNA, 25 bp, E. coli
cacgccaaagccattgacggctata

SEQ ID NO: 153452 - DNA, 25 bp, E. coli
cacgccaaagcctttgacggctata

SEQ ID NO: 153453 - DNA, 25 bp, E. coli
acgccaaagccattgacggctatac

SEQ ID NO: 153454 - DNA, 25 bp, E. coli
acgccaaagccaatgacggctatac

SEQ ID NO: 153455 - DNA, 25 bp, E. coli
ccacgccaaagccattgacggctat

SEQ ID NO: 153456 - DNA, 25 bp, E. coli
gccaaagccattcacggctatacgc

SEQ ID NO: 153457 - DNA, 25 bp, E. coli
ccaaagccattgtcggctatacgcc

SEQ ID NO: 153458 - DNA, 25 bp, E. coli
ccacgccaaagcgattgacggctat

SEQ ID NO: 153459 - DNA, 25 bp, E. coli
ccaaagccattgacggctatacgcc

SEQ ID NO: 153460 - DNA, 25 bp, E. coli
gccaaagccattgacggctatacgc

SEQ ID NO: 153461 - DNA, 25 bp, E. coli
cgccaaagccatagacggctatacg

SEQ ID NO: 153462 - DNA, 25 bp, E. coli
cgccaaagccattgacggctatacg

SEQ ID NO: 153463 - DNA, 25 bp, E. coli
ctatacgccgcgggattacttaacc

SEQ ID NO: 153464 - DNA, 25 bp, E. coli
ctatacgccgcgcgattacttaacc

SEQ ID NO: 153465 - DNA, 25 bp, E. coli
ggtcgtctgggctgggcaacagtaa

SEQ ID NO: 153466 - DNA, 25 bp, E. coli
ggtcgtctgggcagggcaacagtaa

SEQ ID NO: 153467 - DNA, 25 bp, E. coli
ggctatacgccgcgcgattacttaa

SEQ ID NO: 153468 - DNA, 25 bp, E. coli
ggctatacgccgggcgattacttaa

SEQ ID NO: 153469 - DNA, 25 bp, E. coli
caacatttttcaatcgtgacgaacg

SEQ ID NO: 153470 - DNA, 25 bp, E. coli
caacgtgttgctgggtgattcacaa

SEQ ID NO: 153471 - DNA, 25 bp, E. coli
caacgtgttgctcggtgattcacaa

SEQ ID NO: 153472 - DNA, 25 bp, E. coli
caacatttttcattcgtgacgaacg

SEQ ID NO: 153473 - DNA, 25 bp, E. coli
catcatcctgtcgaactattgccgg

SEQ ID NO: 153474 - DNA, 25 bp, E. coli
catcatcctgtccaactattgccgg

SEQ ID NO: 153475 - DNA, 25 bp, E. coli
tacgcacgcgcagcttatgggtaat

SEQ ID NO: 153476 - DNA, 25 bp, E. coli
tacattgattaccttacgcacgcgc

SEQ ID NO: 153477 - DNA, 25 bp, E. coli
tacattgattacgttacgcacgcgc

SEQ ID NO: 153478 - DNA, 25 bp, E. coli
atgaccgcgtattggctggcccagg

SEQ ID NO: 153479 - DNA, 25 bp, E. coli
atgaccgcgtataggctggcccagg

SEQ ID NO: 153480 - DNA, 25 bp, E. coli
tacgcacgcgcaccttatgggtaat

SEQ ID NO: 153481 - DNA, 25 bp, E. coli
tattgtgctgactggcggaattggc

SEQ ID NO: 153482 - DNA, 25 bp, E. coli
tattgtgctgacaggcggaattggc

SEQ ID NO: 153483 - DNA, 25 bp, E. coli
tgggtgattcacaacttctgggcgg

SEQ ID NO: 153484 - DNA, 25 bp, E. coli
tgggtgattcactacttctgggcgg

SEQ ID NO: 153485 - DNA, 25 bp, E. coli
gcggaattggccacgcgaagttcca

SEQ ID NO: 153486 - DNA, 25 bp, E. coli
gcggaattggcctcgcgaagttcca

SEQ ID NO: 153487 - DNA, 25 bp, E. coli
cgtgacgaacgtggcttcaaaaagc

SEQ ID NO: 153488 - DNA, 25 bp, E. coli
cgtgacgaacgtcgcttcaaaaagc

SEQ ID NO: 153489 - DNA, 25 bp, E. coli
ggtgccagtgccatccttaatgcca

SEQ ID NO: 153490 - DNA, 25 bp, E. coli
ggtgccagtgccttccttaatgcca

SEQ ID NO: 153491 - DNA, 25 bp, E. coli
aagtcgttatagtgccgcacgccgg

SEQ ID NO: 153492 - DNA, 25 bp, E. coli
aagtcgttatagagccgcacgccgg

SEQ ID NO: 153493 - DNA, 25 bp, E. coli
agttaaaagcgcagatggatgcgaa

SEQ ID NO: 153494 - DNA, 25 bp, E. coli
agttaaaagcgctgatggatgcgaa

SEQ ID NO: 153495 - DNA, 25 bp, E. coli
aaatggctccttcttgtggaagtcg

SEQ ID NO: 153496 - DNA, 25 bp, E. coli
aaatggctccttgttgtggaagtcg

SEQ ID NO: 153497 - DNA, 25 bp, E. coli
ttatagtgccgctcgccggaggagt

SEQ ID NO: 153498 - DNA, 25 bp, E. coli
ttatagtgccgcacgccggaggagt

SEQ ID NO: 153499 - DNA, 25 bp, E. coli
tgccgcacgccggaggagttaaaag

SEQ ID NO: 153500 - DNA, 25 bp, E. coli
tgccgcacgccgcaggagttaaaag

SEQ ID NO: 153501 - DNA, 25 bp, E. coli
gaaagtggtatatgaaaatggctcc

SEQ ID NO: 153502 - DNA, 25 bp, E. coli
gaaagtggtataagaaaatggctcc

SEQ ID NO: 153503 - DNA, 25 bp, E. coli
ccgcacgccggaggagttaaaagcg

SEQ ID NO: 153504 - DNA, 25 bp, E. coli
ccgcacgccggacgagttaaaagcg

SEQ ID NO: 153505 - DNA, 25 bp, E. coli
ggtataagaaaaaggctccttgttg

SEQ ID NO: 153506 - DNA, 25 bp, E. coli
ggatggtcactgtaagtggtataag

SEQ ID NO: 153507 - DNA, 25 bp, E. coli
ggatggtcactgaaagtggtataag

SEQ ID NO: 153508 - DNA, 25 bp, E. coli
ggtataagaaaatggctccttgttg

SEQ ID NO: 153509 - DNA, 25 bp, E. coli
tggaagtcgttatagtgccgcacgc

SEQ ID NO: 153510 - DNA, 25 bp, E. coli
tggctccttgttgtggaagtcgtta

SEQ ID NO: 153511 - DNA, 25 bp, E. coli
tggaagtcgttaaagtgccgcacgc

SEQ ID NO: 153512 - DNA, 25 bp, E. coli
tggctccttgttctggaagtcgtta

SEQ ID NO: 153513 - DNA, 25 bp, E. coli
caacgcgctcgataagcatttgcag

SEQ ID NO: 153514 - DNA, 25 bp, E. coli
caacgcgctcgaaaagcatttgcag

SEQ ID NO: 153515 - DNA, 25 bp, E. coli
tatgttagctgggaacgtctggacc

SEQ ID NO: 153516 - DNA, 25 bp, E. coli
tatgttagctggcaacgtctggacc

SEQ ID NO: 153517 - DNA, 25 bp, E. coli
ttttgtgtgattctgccaggcgcga

SEQ ID NO: 153518 - DNA, 25 bp, E. coli
ttttgtgtgattgtgccaggcgcga

SEQ ID NO: 153519 - DNA, 25 bp, E. coli
tgcattaaccctgctgtgggcgctc

SEQ ID NO: 153520 - DNA, 25 bp, E. coli
tgcattaaccctcctgtgggcgctc

SEQ ID NO: 153521 - DNA, 25 bp, E. coli
gacaatgaaattaccgctgcactgg

SEQ ID NO: 153522 - DNA, 25 bp, E. coli
gacaatgaaatttccgctgcactgg

SEQ ID NO: 153523 - DNA, 25 bp, E. coli
cgatttcggcagtatcagcattgca

SEQ ID NO: 153524 - DNA, 25 bp, E. coli
cgatttcggcagaatcagcattgca

SEQ ID NO: 153525 - DNA, 25 bp, E. coli
gggaatctcctgtctcgcgaaaatg

SEQ ID NO: 153526 - DNA, 25 bp, E. coli
gggaatctcctgactcgcgaaaatg

SEQ ID NO: 153527 - DNA, 25 bp, E. coli
tggcgcaggcaatggaacatgacac

SEQ ID NO: 153528 - DNA, 25 bp, E. coli
tggcgcaggcaaaggaacatgacac

SEQ ID NO: 153529 - DNA, 25 bp, E. coli
taataactactggtatggcgtgctg

SEQ ID NO: 153530 - DNA, 25 bp, E. coli
taataactactgctatggcgtgctg

SEQ ID NO: 153531 - DNA, 25 bp, E. coli
gatcctcgtgaagtggccttgctgg

SEQ ID NO: 153532 - DNA, 25 bp, E. coli
gagttcgaacaggatcgcgacgagc

SEQ ID NO: 153533 - DNA, 25 bp, E. coli
gagttcgaacagcatcgcgacgagc

SEQ ID NO: 153534 - DNA, 25 bp, E. coli
gatcctcgtgaactggccttgctgg

SEQ ID NO: 153535 - DNA, 25 bp, E. coli
aagagtttggcgacttgctgacgga

SEQ ID NO: 153536 - DNA, 25 bp, E. coli
aagagtttggcgtcttgctgacgga

SEQ ID NO: 153537 - DNA, 25 bp, E. coli
catccggttggcgatcaggtgataa

SEQ ID NO: 153538 - DNA, 25 bp, E. coli
catccggttggccatcaggtgataa

SEQ ID NO: 153539 - DNA, 25 bp, E. coli
tactgaacgtgccaaagctttagcg

SEQ ID NO: 153540 - DNA, 25 bp, E. coli
tactgaacgtgcgaaagctttagcg

SEQ ID NO: 153541 - DNA, 25 bp, E. coli
aaaaagtgacgaatagtattggcgc

SEQ ID NO: 153542 - DNA, 25 bp, E. coli
aaaaagtgacgattagtattggcgc

SEQ ID NO: 153543 - DNA, 25 bp, E. coli
ttcaaaaaagtctacgacacctggg

SEQ ID NO: 153544 - DNA, 25 bp, E. coli
tagtgaaaacacaaaacagcgcaat

SEQ ID NO: 153545 - DNA, 25 bp, E. coli
tatgaccgtagggaattttcaaact

SEQ ID NO: 153546 - DNA, 25 bp, E. coli
tagtgaaaacactaaacagcgcaat

SEQ ID NO: 153547 - DNA, 25 bp, E. coli
tatgaccgtaggcaattttcaaact

SEQ ID NO: 153548 - DNA, 25 bp, E. coli
ttcaaaaaagtcaacgacacctggg

SEQ ID NO: 153549 - DNA, 25 bp, E. coli
tgctgacggacaacgatactgaacg

SEQ ID NO: 153550 - DNA, 25 bp, E. coli
tgaggaagttgtaccacgatcaacc

SEQ ID NO: 153551 - DNA, 25 bp, E. coli
tgaggaagttgttccacgatcaacc

SEQ ID NO: 153552 - DNA, 25 bp, E. coli
tgctgacggacatcgatactgaacg

SEQ ID NO: 153553 - DNA, 25 bp, E. coli
gccatatattcagtgcgctacgagt

SEQ ID NO: 153554 - DNA, 25 bp, E. coli
gccatatattcactgcgctacgagt

SEQ ID NO: 153555 - DNA, 25 bp, E. coli
gagctacaatttacacattgccgag

SEQ ID NO: 153556 - DNA, 25 bp, E. coli
gagctacaattttcacattgccgag

SEQ ID NO: 153557 - DNA, 25 bp, E. coli
caatcgatgtcatatgtttcaccgg

SEQ ID NO: 153558 - DNA, 25 bp, E. coli
caatcgatgtcaaatgtttcaccgg

SEQ ID NO: 153559 - DNA, 25 bp, E. coli
caaacgatttcagtttgtagccaat

SEQ ID NO: 153560 - DNA, 25 bp, E. coli
cagttgagtgatcttttattgtgga

SEQ ID NO: 153561 - DNA, 25 bp, E. coli
caaacgatttcactttgtagccaat

SEQ ID NO: 153562 - DNA, 25 bp, E. coli
cagttgagtgatgttttattgtgga

SEQ ID NO: 153563 - DNA, 25 bp, E. coli
tttattgtggaaattgcgaagctga

SEQ ID NO: 153564 - DNA, 25 bp, E. coli
tttcaccggataaaggcacagggca

SEQ ID NO: 153565 - DNA, 25 bp, E. coli
tttattgtggaatttgcgaagctga

SEQ ID NO: 153566 - DNA, 25 bp, E. coli
tttcaccggatataggcacagggca

SEQ ID NO: 153567 - DNA, 25 bp, E. coli
tgtagccaataatattaatcgcgcg

SEQ ID NO: 153568 - DNA, 25 bp, E. coli
tgtagccaataaaattaatcgcgcg

SEQ ID NO: 153569 - DNA, 25 bp, E. coli
gcacagggcaggcaaaggtaaatat

SEQ ID NO: 153570 - DNA, 25 bp, E. coli
gcacagggcagggaaaggtaaatat

SEQ ID NO: 153571 - DNA, 25 bp, E. coli
gaaaggtaaataatcagttgagtga

SEQ ID NO: 153572 - DNA, 25 bp, E. coli
gaaaggtaaatattcagttgagtga

SEQ ID NO: 153573 - DNA, 25 bp, E. coli
gttattaaatgtgaaacgatttcag

SEQ ID NO: 153574 - DNA, 25 bp, E. coli
gttattaaatgtcaaacgatttcag

SEQ ID NO: 153575 - DNA, 25 bp, E. coli
taatcgcgcggattttaatgatcgg

SEQ ID NO: 153576 - DNA, 25 bp, E. coli
taatgatcggtgtcaatcgatgtca

SEQ ID NO: 153577 - DNA, 25 bp, E. coli
taatgatcggtgacaatcgatgtca

SEQ ID NO: 153578 - DNA, 25 bp, E. coli
taatcgcgcggaatttaatgatcgg

SEQ ID NO: 153579 - DNA, 25 bp, E. coli
caacactatgacgaactggttgccg

SEQ ID NO: 153580 - DNA, 25 bp, E. coli
cacaaggcgatgagacgctggcgtt

SEQ ID NO: 153581 - DNA, 25 bp, E. coli
caacactatgaccaactggttgccg

SEQ ID NO: 153582 - DNA, 25 bp, E. coli
cacaaggcgatgtgacgctggcgtt

SEQ ID NO: 153583 - DNA, 25 bp, E. coli
ataaagaccgcctggccgttgacgc

SEQ ID NO: 153584 - DNA, 25 bp, E. coli
accgccaggccgttgacgcctttat

SEQ ID NO: 153585 - DNA, 25 bp, E. coli
ataaagaccgccaggccgttgacgc

SEQ ID NO: 153586 - DNA, 25 bp, E. coli
accgccaggccgatgacgcctttat

SEQ ID NO: 153587 - DNA, 25 bp, E. coli
ttcctatgccaagcaactcggcgct

SEQ ID NO: 153588 - DNA, 25 bp, E. coli
ttcctatgccaaccaactcggcgct

SEQ ID NO: 153589 - DNA, 25 bp, E. coli
tctgcgttttctcgacacgaaacgg

SEQ ID NO: 153590 - DNA, 25 bp, E. coli
tctgcgttttctggacacgaaacgg

SEQ ID NO: 153591 - DNA, 25 bp, E. coli
tctcgacacgaatcgggaaaatgcc

SEQ ID NO: 153592 - DNA, 25 bp, E. coli
tctcgacacgaaacgggaaaatgcc

SEQ ID NO: 153593 - DNA, 25 bp, E. coli
cgatgagacgctggcgttgcaactg

SEQ ID NO: 153594 - DNA, 25 bp, E. coli
cgatgagacgctcgcgttgcaactg

SEQ ID NO: 153595 - DNA, 25 bp, E. coli
tggtcgggcggttaattccgcactg

SEQ ID NO: 153596 - DNA, 25 bp, E. coli
ggcaagccgtttcccgatgtggcca

SEQ ID NO: 153597 - DNA, 25 bp, E. coli
ggcaagccgtttgccgatgtggcca

SEQ ID NO: 153598 - DNA, 25 bp, E. coli
tggtcgggcggtaaattccgcactg

SEQ ID NO: 153599 - DNA, 25 bp, E. coli
gatgtggccatctgccaacactatg

SEQ ID NO: 153600 - DNA, 25 bp, E. coli
gatgtggccatcagccaacactatg

SEQ ID NO: 153601 - DNA, 25 bp, E. coli
taaatcgatgctggagtccgggtgc

SEQ ID NO: 153602 - DNA, 25 bp, E. coli
taaatcgatgctcgagtccgggtgc

SEQ ID NO: 153603 - DNA, 25 bp, E. coli
aaacgtgctcttagaccgggatgcc

SEQ ID NO: 153604 - DNA, 25 bp, E. coli
aaacgtgctctttgaccgggatgcc

SEQ ID NO: 153605 - DNA, 25 bp, E. coli
tatcgtcaggaatggcaaaaggtgc

SEQ ID NO: 153606 - DNA, 25 bp, E. coli
tatcgtcaggaaaggcaaaaggtgc

SEQ ID NO: 153607 - DNA, 25 bp, E. coli
tatgcacagtgaggcggctaaatcg

SEQ ID NO: 153608 - DNA, 25 bp, E. coli
tatgcacagtgacgcggctaaatcg

SEQ ID NO: 153609 - DNA, 25 bp, E. coli
tgcaaaatcggtgcgcctgatgacg

SEQ ID NO: 153610 - DNA, 25 bp, E. coli
tgaaaatttgtcgaccactgtgggc

SEQ ID NO: 153611 - DNA, 25 bp, E. coli
tgaaaatttgtccaccactgtgggc

SEQ ID NO: 153612 - DNA, 25 bp, E. coli
tgagagctatattccgccgttactg

SEQ ID NO: 153613 - DNA, 25 bp, E. coli
tgcaaaatcggtccgcctgatgacg

SEQ ID NO: 153614 - DNA, 25 bp, E. coli
tgagagctatataccgccgttactg

SEQ ID NO: 153615 - DNA, 25 bp, E. coli
tcggaaagctgaaaacgcaggcagt

SEQ ID NO: 153616 - DNA, 25 bp, E. coli
tcggaaagctgataacgcaggcagt

SEQ ID NO: 153617 - DNA, 25 bp, E. coli
gaagaggccgacttttacctgtccg

SEQ ID NO: 153618 - DNA, 25 bp, E. coli
gaagaggccgacatttacctgtccg

SEQ ID NO: 153619 - DNA, 25 bp, E. coli
gaacaatgggcgacctgaaacctga

SEQ ID NO: 153620 - DNA, 25 bp, E. coli
gaacaatgggcgtcctgaaacctga

SEQ ID NO: 153621 - DNA, 25 bp, E. coli
gatatggccgttcagcgtcatgcgc

SEQ ID NO: 153622 - DNA, 25 bp, E. coli
gatatggccgttgagcgtcatgcgc

SEQ ID NO: 153623 - DNA, 25 bp, E. coli
aagaccgactggtagagttgctgcc

SEQ ID NO: 153624 - DNA, 25 bp, E. coli
aagaccgactggaagagttgctgcc

SEQ ID NO: 153625 - DNA, 25 bp, E. coli
caaaacgtaatggtctggagccgca

SEQ ID NO: 153626 - DNA, 25 bp, E. coli
caaaacgtaatgctctggagccgca

SEQ ID NO: 153627 - DNA, 25 bp, E. coli
cagacgttctgacgcgtctaccgga

SEQ ID NO: 153628 - DNA, 25 bp, E. coli
cagacgttctgaggcgtctaccgga

SEQ ID NO: 153629 - DNA, 25 bp, E. coli
tattcgccggttgactgatggccgg

SEQ ID NO: 153630 - DNA, 25 bp, E. coli
tattcgccggttcactgatggccgg

SEQ ID NO: 153631 - DNA, 25 bp, E. coli
ttatatcctgaaccggcgcgatgaa

SEQ ID NO: 153632 - DNA, 25 bp, E. coli
ttatatcctgaagcggcgcgatgaa

SEQ ID NO: 153633 - DNA, 25 bp, E. coli
tgcttcctgagtgacggagccgtgc

SEQ ID NO: 153634 - DNA, 25 bp, E. coli
tgagccttctggtaacggcaaaacg

SEQ ID NO: 153635 - DNA, 25 bp, E. coli
tgcttcctgagtcacggagccgtgc

SEQ ID NO: 153636 - DNA, 25 bp, E. coli
tgagccttctggaaacggcaaaacg

SEQ ID NO: 153637 - DNA, 25 bp, E. coli
tgcctggctgacagacgttctgacg

SEQ ID NO: 153638 - DNA, 25 bp, E. coli
tgcctggctgactgacgttctgacg

SEQ ID NO: 153639 - DNA, 25 bp, E. coli
gcgatgaactgagctgcttcctgag

SEQ ID NO: 153640 - DNA, 25 bp, E. coli
gcgatgaactgacctgcttcctgag

SEQ ID NO: 153641 - DNA, 25 bp, E. coli
gcggaaagcatgcttattcgccggt

SEQ ID NO: 153642 - DNA, 25 bp, E. coli
gcggaaagcatggttattcgccggt

SEQ ID NO: 153643 - DNA, 25 bp, E. coli
gtgcccctggacaacaatatctgcg

SEQ ID NO: 153644 - DNA, 25 bp, E. coli
gtgcccctggactacaatatctgcg

SEQ ID NO: 153645 - DNA, 25 bp, E. coli
caaagatgttctcttagccgcgcaa

SEQ ID NO: 153646 - DNA, 25 bp, E. coli
cacagcagcggccattttacgtagt

SEQ ID NO: 153647 - DNA, 25 bp, E. coli
cacagcagcggcgattttacgtagt

SEQ ID NO: 153648 - DNA, 25 bp, E. coli
caaagatgttctgttagccgcgcaa

SEQ ID NO: 153649 - DNA, 25 bp, E. coli
taaagccgaagcaattgccgctgca

SEQ ID NO: 153650 - DNA, 25 bp, E. coli
taaagccgaagctattgccgctgca

SEQ ID NO: 153651 - DNA, 25 bp, E. coli
tatttcgtcacaccaaattcgcctg

SEQ ID NO: 153652 - DNA, 25 bp, E. coli
tattattccggctccgttgcgggca

SEQ ID NO: 153653 - DNA, 25 bp, E. coli
tatttcgtcacagcaaattcgcctg

SEQ ID NO: 153654 - DNA, 25 bp, E. coli
tattattccggcaccgttgcgggca

SEQ ID NO: 153655 - DNA, 25 bp, E. coli
ttttcgctgcaacatgtccgggtga

SEQ ID NO: 153656 - DNA, 25 bp, E. coli
ttggcgaggcaagcatgaatacgct

SEQ ID NO: 153657 - DNA, 25 bp, E. coli
ttttcgctgcaagatgtccgggtga

SEQ ID NO: 153658 - DNA, 25 bp, E. coli
ttggcgaggcaaccatgaatacgct

SEQ ID NO: 153659 - DNA, 25 bp, E. coli
tgaatacgctgcaacgcttaagtgg

SEQ ID NO: 153660 - DNA, 25 bp, E. coli
tgaatacgctgctacgcttaagtgg

SEQ ID NO: 153661 - DNA, 25 bp, E. coli
tccggttatatctgccagggcgaac

SEQ ID NO: 153662 - DNA, 25 bp, E. coli
tccggttatatcagccagggcgaac

SEQ ID NO: 153663 - DNA, 25 bp, E. coli
tggttaccgatcaggacacagcagc

SEQ ID NO: 153664 - DNA, 25 bp, E. coli
tggagaaagggcttcagtccggcat

SEQ ID NO: 153665 - DNA, 25 bp, E. coli
tggagaaagggcatcagtccggcat

SEQ ID NO: 153666 - DNA, 25 bp, E. coli
tggttaccgatctggacacagcagc

SEQ ID NO: 153667 - DNA, 25 bp, E. coli
aacgcctgggaaccacatatgtacg

SEQ ID NO: 153668 - DNA, 25 bp, E. coli
aacgcctgggaagcacatatgtacg

SEQ ID NO: 153669 - DNA, 25 bp, E. coli
ttttatttttatcagccgacctggc

SEQ ID NO: 153670 - DNA, 25 bp, E. coli
ttttatcagccgacctggctcaacg

SEQ ID NO: 153671 - DNA, 25 bp, E. coli
ttttatcagccgtcctggctcaacg

SEQ ID NO: 153672 - DNA, 25 bp, E. coli
ttttatttttatgagccgacctggc

SEQ ID NO: 153673 - DNA, 25 bp, E. coli
tgggaagcacatttgtacgaaaggg

SEQ ID NO: 153674 - DNA, 25 bp, E. coli
tgggaagcacatatgtacgaaaggg

SEQ ID NO: 153675 - DNA, 25 bp, E. coli
tgacggaaaagagtatctacctgtc

SEQ ID NO: 153676 - DNA, 25 bp, E. coli
tgacggaaaagactatctacctgtc

SEQ ID NO: 153677 - DNA, 25 bp, E. coli
tacctgtcttcctgggcgcttacgg

SEQ ID NO: 153678 - DNA, 25 bp, E. coli
tacctgtcttccagggcgcttacgg

SEQ ID NO: 153679 - DNA, 25 bp, E. coli
tcttcctgggcgcttacggaaccgg

SEQ ID NO: 153680 - DNA, 25 bp, E. coli
tcttcctgggcggttacggaaccgg

SEQ ID NO: 153681 - DNA, 25 bp, E. coli
gcgcttacggaaccggacgacattt

SEQ ID NO: 153682 - DNA, 25 bp, E. coli
gcgcttacggaagcggacgacattt

SEQ ID NO: 153683 - DNA, 25 bp, E. coli
ggacgacattttttatttttatcag

SEQ ID NO: 153684 - DNA, 25 bp, E. coli
tggctcaacgccagggaagcacata

SEQ ID NO: 153685 - DNA, 25 bp, E. coli
tggctcaacgcctgggaagcacata

SEQ ID NO: 153686 - DNA, 25 bp, E. coli
ggacgacattttatatttttatcag

SEQ ID NO: 153687 - DNA, 25 bp, E. coli
gagtatctacctctcttcctgggcg

SEQ ID NO: 153688 - DNA, 25 bp, E. coli
gagtatctacctgtcttcctgggcg

SEQ ID NO: 153689 - DNA, 25 bp, E. coli
caattggttatatcgttggcacgac

SEQ ID NO: 153690 - DNA, 25 bp, E. coli
caattggttataacgttggcacgac

SEQ ID NO: 153691 - DNA, 25 bp, E. coli
catgaagtgggcaggtcacacgtct

SEQ ID NO: 153692 - DNA, 25 bp, E. coli
catgaagtgggctggtcacacgtct

SEQ ID NO: 153693 - DNA, 25 bp, E. coli
aaaacgcgtctacttctggtcgatc

SEQ ID NO: 153694 - DNA, 25 bp, E. coli
aaaacgcgtctagttctggtcgatc

SEQ ID NO: 153695 - DNA, 25 bp, E. coli
tacctggtgctgctgggcgatatca

SEQ ID NO: 153696 - DNA, 25 bp, E. coli
tacctggtgctggtgggcgatatca

SEQ ID NO: 153697 - DNA, 25 bp, E. coli
tatcggccttgaacccgtgggaatg

SEQ ID NO: 153698 - DNA, 25 bp, E. coli
tatcggccttgatcccgtgggaatg

SEQ ID NO: 153699 - DNA, 25 bp, E. coli
ccaaagttaaagtgccgttcagcgt

SEQ ID NO: 153700 - DNA, 25 bp, E. coli
ccaaagttaaagagccgttcagcgt

SEQ ID NO: 153701 - DNA, 25 bp, E. coli
gatcagcggtctatccggtggcctg

SEQ ID NO: 153702 - DNA, 25 bp, E. coli
gatcagcggtctttccggtggcctg

SEQ ID NO: 153703 - DNA, 25 bp, E. coli
ggttgaaagtcatccacgagccaaa

SEQ ID NO: 153704 - DNA, 25 bp, E. coli
ggttgaaagtcaaccacgagccaaa

SEQ ID NO: 153705 - DNA, 25 bp, E. coli
ggtgttcatgccttaatcgcggtac

SEQ ID NO: 153706 - DNA, 25 bp, E. coli
ggtgttcatgccataatcgcggtac

SEQ ID NO: 153707 - DNA, 25 bp, E. coli
gatgatcatcgggtttatggcgctg

SEQ ID NO: 153708 - DNA, 25 bp, E. coli
gagttctttaagacaggctgcgagc

SEQ ID NO: 153709 - DNA, 25 bp, E. coli
gagttctttaagtcaggctgcgagc

SEQ ID NO: 153710 - DNA, 25 bp, E. coli
gatgatcatcggctttatggcgctg

SEQ ID NO: 153711 - DNA, 25 bp, E. coli
caattttgacagacaacagcggcaa

SEQ ID NO: 153712 - DNA, 25 bp, E. coli
caattttgacagtcaacagcggcaa

SEQ ID NO: 153713 - DNA, 25 bp, E. coli
cagactggcagaggatttcaatcaa

SEQ ID NO: 153714 - DNA, 25 bp, E. coli
gaagtcggtacggtgacaaaactgg

SEQ ID NO: 153715 - DNA, 25 bp, E. coli
gaagtcggtacgctgacaaaactgg

SEQ ID NO: 153716 - DNA, 25 bp, E. coli
cagactggcagacgatttcaatcaa

SEQ ID NO: 153717 - DNA, 25 bp, E. coli
tatctaccttataagcggcgctggc

SEQ ID NO: 153718 - DNA, 25 bp, E. coli
tatttctcatgaactgcgcacgcct

SEQ ID NO: 153719 - DNA, 25 bp, E. coli
tattgatcacgaagcactgggcggt

SEQ ID NO: 153720 - DNA, 25 bp, E. coli
tatctaccttattagcggcgctggc

SEQ ID NO: 153721 - DNA, 25 bp, E. coli
tatttctcatgatctgcgcacgcct

SEQ ID NO: 153722 - DNA, 25 bp, E. coli
tattgatcacgatgcactgggcggt

SEQ ID NO: 153723 - DNA, 25 bp, E. coli
tgataacaacgaagataagcccggc

SEQ ID NO: 153724 - DNA, 25 bp, E. coli
tgataacaacgatgataagcccggc

SEQ ID NO: 153725 - DNA, 25 bp, E. coli
cctttagcagtagtgcgcggcgaac

SEQ ID NO: 153726 - DNA, 25 bp, E. coli
cctttagcagtactgcgcggcgaac

SEQ ID NO: 153727 - DNA, 25 bp, E. coli
gctggctccggttaaacgactggtg

SEQ ID NO: 153728 - DNA, 25 bp, E. coli
gctggctccggtaaaacgactggtg

SEQ ID NO: 153729 - DNA, 25 bp, E. coli
taataaagtgctcgttggcccgcga

SEQ ID NO: 153730 - DNA, 25 bp, E. coli
taataaagtgctggttggcccgcga

SEQ ID NO: 153731 - DNA, 25 bp, E. coli
gagacgctggcttctttacaggcag

SEQ ID NO: 153732 - DNA, 25 bp, E. coli
gagacgctggctactttacaggcag

SEQ ID NO: 153733 - DNA, 25 bp, E. coli
cagcggccttatcattaaagctcag

SEQ ID NO: 153734 - DNA, 25 bp, E. coli
cagcggccttatgattaaagctcag

SEQ ID NO: 153735 - DNA, 25 bp, E. coli
tactgaagaggcaaacagcaatact

SEQ ID NO: 153736 - DNA, 25 bp, E. coli
tactgaagaggctaacagcaatact

SEQ ID NO: 153737 - DNA, 25 bp, E. coli
taccgtggttgactcagctcgcgtc

SEQ ID NO: 153738 - DNA, 25 bp, E. coli
taccgtggttgagtcagctcgcgtc

SEQ ID NO: 153739 - DNA, 25 bp, E. coli
tatcgacgatttgagcggccttatc

SEQ ID NO: 153740 - DNA, 25 bp, E. coli
tatcgacgatttcagcggccttatc

SEQ ID NO: 153741 - DNA, 25 bp, E. coli
tcgcgtcaacgatgcgatgtgtaaa

SEQ ID NO: 153742 - DNA, 25 bp, E. coli
tcgcgtcaacgaagcgatgtgtaaa

SEQ ID NO: 153743 - DNA, 25 bp, E. coli
gcgccttaccgtcgttgactcagct

SEQ ID NO: 153744 - DNA, 25 bp, E. coli
gcgccttaccgtggttgactcagct

SEQ ID NO: 153745 - DNA, 25 bp, E. coli
gactcagctcgcgtcaacgatgcga

SEQ ID NO: 153746 - DNA, 25 bp, E. coli
gaaagccattgaggcctgtattact

SEQ ID NO: 153747 - DNA, 25 bp, E. coli
gaaagccattgacgcctgtattact

SEQ ID NO: 153748 - DNA, 25 bp, E. coli
gactcagctcgcctcaacgatgcga

SEQ ID NO: 153749 - DNA, 25 bp, E. coli
cattgacgcctgaattactcgtctg

SEQ ID NO: 153750 - DNA, 25 bp, E. coli
cattgacgcctgtattactcgtctg

SEQ ID NO: 153751 - DNA, 25 bp, E. coli
gatttcagcggccttatcattaaag

SEQ ID NO: 153752 - DNA, 25 bp, E. coli
gatttcagcggcgttatcattaaag

SEQ ID NO: 153753 - DNA, 25 bp, E. coli
gaggctaacagcaatactgaagaag

SEQ ID NO: 153754 - DNA, 25 bp, E. coli
gaggctaacagctatactgaagaag

SEQ ID NO: 153755 - DNA, 25 bp, E. coli
tacagcctggtgtaacctgggcgct

SEQ ID NO: 153756 - DNA, 25 bp, E. coli
tactcttcaggatttaccgggcaaa

SEQ ID NO: 153757 - DNA, 25 bp, E. coli
taaagccagtaagagtgtaccggat

SEQ ID NO: 153758 - DNA, 25 bp, E. coli
taaagccagtaacagtgtaccggat

SEQ ID NO: 153759 - DNA, 25 bp, E. coli
tactcttcaggaattaccgggcaaa

SEQ ID NO: 153760 - DNA, 25 bp, E. coli
tacagcctggtgaaacctgggcgct

SEQ ID NO: 153761 - DNA, 25 bp, E. coli
tgtgaaaccagaatcactgcccgct

SEQ ID NO: 153762 - DNA, 25 bp, E. coli
tgtgaaaccagattcactgcccgct

SEQ ID NO: 153763 - DNA, 25 bp, E. coli
tgaagttcaactcgatggcgcagcc

SEQ ID NO: 153764 - DNA, 25 bp, E. coli
tgaagttcaactggatggcgcagcc

SEQ ID NO: 153765 - DNA, 25 bp, E. coli
tcaggtgccgcagcctatggtggaa

SEQ ID NO: 153766 - DNA, 25 bp, E. coli
tcaggtgccgcaccctatggtggaa

SEQ ID NO: 153767 - DNA, 25 bp, E. coli
gcccgctttcattagccagtgggaa

SEQ ID NO: 153768 - DNA, 25 bp, E. coli
gcccgctttcataagccagtgggaa

SEQ ID NO: 153769 - DNA, 25 bp, E. coli
cgctcccggctgatggattgcaaaa

SEQ ID NO: 153770 - DNA, 25 bp, E. coli
cgctcccggctgttggattgcaaaa

SEQ ID NO: 153771 - DNA, 25 bp, E. coli
cgtcagcaaaaagcaccactgggtg

SEQ ID NO: 153772 - DNA, 25 bp, E. coli
cgtcagcaaaaaccaccactgggtg

SEQ ID NO: 153773 - DNA, 25 bp, E. coli
gttcagcaaagctttccgcgccgga

SEQ ID NO: 153774 - DNA, 25 bp, E. coli
gttcagcaaagcattccgcgccgga

SEQ ID NO: 153775 - DNA, 25 bp, E. coli
taatgttgctctgaccgccagtggc

SEQ ID NO: 153776 - DNA, 25 bp, E. coli
taatgttgctctcaccgccagtggc

SEQ ID NO: 153777 - DNA, 25 bp, E. coli
ataaacactcgagcggcggtgtcgg

SEQ ID NO: 153778 - DNA, 25 bp, E. coli
agcgatgctcatgcggttccccgat

SEQ ID NO: 153779 - DNA, 25 bp, E. coli
ataaacactcgaccggcggtgtcgg

SEQ ID NO: 153780 - DNA, 25 bp, E. coli
agcgatgctcatccggttccccgat

SEQ ID NO: 153781 - DNA, 25 bp, E. coli
tacctcgtctctattccacgggagg

SEQ ID NO: 153782 - DNA, 25 bp, E. coli
tacctcgtctcttttccacgggagg

SEQ ID NO: 153783 - DNA, 25 bp, E. coli
ttgccggatgatgcagcgatgctca

SEQ ID NO: 153784 - DNA, 25 bp, E. coli
ttgataaacactcgaccggcggtgt

SEQ ID NO: 153785 - DNA, 25 bp, E. coli
ttgataaacactggaccggcggtgt

SEQ ID NO: 153786 - DNA, 25 bp, E. coli
ttgccggatgatccagcgatgctca

SEQ ID NO: 153787 - DNA, 25 bp, E. coli
tgttgataaacagtcgaccggcggt

SEQ ID NO: 153788 - DNA, 25 bp, E. coli
tgttgataaacactcgaccggcggt

SEQ ID NO: 153789 - DNA, 25 bp, E. coli
ggaggttaccttctttctcgcacaa

SEQ ID NO: 153790 - DNA, 25 bp, E. coli
ggaggttaccttgtttctcgcacaa

SEQ ID NO: 153791 - DNA, 25 bp, E. coli
gatgcagcgatgctcatccggttcc

SEQ ID NO: 153792 - DNA, 25 bp, E. coli
gattacctcgtctcttttccacggg

SEQ ID NO: 153793 - DNA, 25 bp, E. coli
gatgcagcgatggtcatccggttcc

SEQ ID NO: 153794 - DNA, 25 bp, E. coli
gatgatgcagcgttgctcatccggt

SEQ ID NO: 153795 - DNA, 25 bp, E. coli
gaccggcggtgtcggcgatgtgact

SEQ ID NO: 153796 - DNA, 25 bp, E. coli
gaccggcggtgtgggcgatgtgact

SEQ ID NO: 153797 - DNA, 25 bp, E. coli
gatgatgcagcgatgctcatccggt

SEQ ID NO: 153798 - DNA, 25 bp, E. coli
gattacctcgtcacttttccacggg

SEQ ID NO: 153799 - DNA, 25 bp, E. coli
atgaggtgatccgcgccgctgaaac

SEQ ID NO: 153800 - DNA, 25 bp, E. coli
atgaggtgatccccgccgctgaaac

SEQ ID NO: 153801 - DNA, 25 bp, E. coli
aagtgaacgccagccgggtcgactt

SEQ ID NO: 153802 - DNA, 25 bp, E. coli
aagtgaacgccacccgggtcgactt

SEQ ID NO: 153803 - DNA, 25 bp, E. coli
tttacgatggttcgcggagacaacg

SEQ ID NO: 153804 - DNA, 25 bp, E. coli
tttacgatggttggcggagacaacg

SEQ ID NO: 153805 - DNA, 25 bp, E. coli
gccagccgggtccacttctttacga

SEQ ID NO: 153806 - DNA, 25 bp, E. coli
gccagccgggtcgacttctttacga

SEQ ID NO: 153807 - DNA, 25 bp, E. coli
gacttctttacgttggttcgcggag

SEQ ID NO: 153808 - DNA, 25 bp, E. coli
gacttctttacgatggttcgcggag

SEQ ID NO: 153809 - DNA, 25 bp, E. coli
cgacccgccagctctggatgtccgt

SEQ ID NO: 153810 - DNA, 25 bp, E. coli
gccgggtcgactactttacgatggt

SEQ ID NO: 153811 - DNA, 25 bp, E. coli
cccgctggacgctgaccgtatggca

SEQ ID NO: 153812 - DNA, 25 bp, E. coli
cgacccgccagcactggatgtccgt

SEQ ID NO: 153813 - DNA, 25 bp, E. coli
cccgctggacgcagaccgtatggca

SEQ ID NO: 153814 - DNA, 25 bp, E. coli
gccgggtcgacttctttacgatggt

SEQ ID NO: 153815 - DNA, 25 bp, E. coli
ctgaccgtatgggacgcattgccgc

SEQ ID NO: 153816 - DNA, 25 bp, E. coli
ctgaccgtatggcacgcattgccgc

SEQ ID NO: 153817 - DNA, 25 bp, E. coli
gatggttcgcggagacaacgcatga

SEQ ID NO: 153818 - DNA, 25 bp, E. coli
gacgctgaccgtttggcacgcattg

SEQ ID NO: 153819 - DNA, 25 bp, E. coli
gacgctgaccgtatggcacgcattg

SEQ ID NO: 153820 - DNA, 25 bp, E. coli
gatggttcgcggtgacaacgcatga

SEQ ID NO: 153821 - DNA, 25 bp, E. coli
catactgtttttaaaatagaatggt

SEQ ID NO: 153822 - DNA, 25 bp, E. coli
catactgttttttaaatagaatggt

SEQ ID NO: 153823 - DNA, 25 bp, E. coli
taaaaacaatgagaaaaatagatga

SEQ ID NO: 153824 - DNA, 25 bp, E. coli
taaaaacaatgacaaaaatagatga

SEQ ID NO: 153825 - DNA, 25 bp, E. coli
atttatctgatttactaccgggccg

SEQ ID NO: 153826 - DNA, 25 bp, E. coli
atttatctgattaactaccgggccg

SEQ ID NO: 153827 - DNA, 25 bp, E. coli
tagaatggtgattaaaaacaatgag

SEQ ID NO: 153828 - DNA, 25 bp, E. coli
tagaatggtgataaaaaacaatgag

SEQ ID NO: 153829 - DNA, 25 bp, E. coli
tttaaacggcgtgatttataaatga

SEQ ID NO: 153830 - DNA, 25 bp, E. coli
tattgtcggaatttatctgattaac

SEQ ID NO: 153831 - DNA, 25 bp, E. coli
tattgtcggaatatatctgattaac

SEQ ID NO: 153832 - DNA, 25 bp, E. coli
tttaaacggcgtcatttataaatga

SEQ ID NO: 153833 - DNA, 25 bp, E. coli
tttatcgatatgtgatcgaagtcga

SEQ ID NO: 153834 - DNA, 25 bp, E. coli
tttatcgatatgagatcgaagtcga

SEQ ID NO: 153835 - DNA, 25 bp, E. coli
tgagatataaggtgaattactggta

SEQ ID NO: 153836 - DNA, 25 bp, E. coli
tgagatataaggagaattactggta

SEQ ID NO: 153837 - DNA, 25 bp, E. coli
tcgaagtcgaaaagagatataaggt

SEQ ID NO: 153838 - DNA, 25 bp, E. coli
tcgaagtcgaaatgagatataaggt

SEQ ID NO: 153839 - DNA, 25 bp, E. coli
tctgattaactagcgggccgtagac

SEQ ID NO: 153840 - DNA, 25 bp, E. coli
tctgattaactaccgggccgtagac

SEQ ID NO: 153841 - DNA, 25 bp, E. coli
taaggtgaattagtggtatttgaaa

SEQ ID NO: 153842 - DNA, 25 bp, E. coli
taaggtgaattactggtatttgaaa

SEQ ID NO: 153843 - DNA, 25 bp, E. coli
caatagcctggcgatgccggtgaaa

SEQ ID NO: 153844 - DNA, 25 bp, E. coli
caatagcctggccatgccggtgaaa

SEQ ID NO: 153845 - DNA, 25 bp, E. coli
tacaacaattgcagcgtaccggact

SEQ ID NO: 153846 - DNA, 25 bp, E. coli
tacaacaattgctgcgtaccggact

SEQ ID NO: 153847 - DNA, 25 bp, E. coli
taacggtttgatgaacgtcgcgcag

SEQ ID NO: 153848 - DNA, 25 bp, E. coli
taaaggtttttgtaacagccgacag

SEQ ID NO: 153849 - DNA, 25 bp, E. coli
taaaggtttttgaaacagccgacag

SEQ ID NO: 153850 - DNA, 25 bp, E. coli
actatcgtcagcgacaaaggccgcg

SEQ ID NO: 153851 - DNA, 25 bp, E. coli
actatcgtcagccacaaaggccgcg

SEQ ID NO: 153852 - DNA, 25 bp, E. coli
tgaagtgagcattaacgacgaccgt

SEQ ID NO: 153853 - DNA, 25 bp, E. coli
tgaaaactggaattatacgccgctg

SEQ ID NO: 153854 - DNA, 25 bp, E. coli
tgaaaactggaaatatacgccgctg

SEQ ID NO: 153855 - DNA, 25 bp, E. coli
tgaagtgagcataaacgacgaccgt

SEQ ID NO: 153856 - DNA, 25 bp, E. coli
gcatatcgccgtgaagcgcggtcaa

SEQ ID NO: 153857 - DNA, 25 bp, E. coli
gcatatcgccgtcaagcgcggtcaa

SEQ ID NO: 153858 - DNA, 25 bp, E. coli
gaagtggatacgtaaccgcagctgg

SEQ ID NO: 153859 - DNA, 25 bp, E. coli
gaagtggatacgaaaccgcagctgg

SEQ ID NO: 153860 - DNA, 25 bp, E. coli
gatcaatcagcacgatgcccagcag

SEQ ID NO: 153861 - DNA, 25 bp, E. coli
gatcaatcagcaggatgcccagcag

SEQ ID NO: 153862 - DNA, 25 bp, E. coli
taacggtttgatcaacgtcgcgcag

SEQ ID NO: 153863 - DNA, 25 bp, E. coli
gatgatgtgaaaagcagccacggcg

SEQ ID NO: 153864 - DNA, 25 bp, E. coli
gatgatgtgaaatgcagccacggcg

SEQ ID NO: 153865 - DNA, 25 bp, E. coli
cagtctagcccgttggcatcaccat

SEQ ID NO: 153866 - DNA, 25 bp, E. coli
cagtctagcccgatggcatcaccat

SEQ ID NO: 153867 - DNA, 25 bp, E. coli
tttgtcaacagtctagcccgatggc

SEQ ID NO: 153868 - DNA, 25 bp, E. coli
tatcatcgggctgagatttatgaca

SEQ ID NO: 153869 - DNA, 25 bp, E. coli
tatcatcgggctcagatttatgaca

SEQ ID NO: 153870 - DNA, 25 bp, E. coli
tttgtcaacagtgtagcccgatggc

SEQ ID NO: 153871 - DNA, 25 bp, E. coli
tgtcaacagtcttgcccgatggcat

SEQ ID NO: 153872 - DNA, 25 bp, E. coli
tgtcaacagtctagcccgatggcat

SEQ ID NO: 153873 - DNA, 25 bp, E. coli
tcaggcctacgtggatcgatcaatt

SEQ ID NO: 153874 - DNA, 25 bp, E. coli
tcaggcctacgtcgatcgatcaatt

SEQ ID NO: 153875 - DNA, 25 bp, E. coli
tcgggctgagatatatgacaaacgc

SEQ ID NO: 153876 - DNA, 25 bp, E. coli
tcgggctgagatttatgacaaacgc

SEQ ID NO: 153877 - DNA, 25 bp, E. coli
gctgagatttatcacaaacgcaaaa

SEQ ID NO: 153878 - DNA, 25 bp, E. coli
gctgagatttatgacaaacgcaaaa

SEQ ID NO: 153879 - DNA, 25 bp, E. coli
gcactttgtcaacagtctagcccga

SEQ ID NO: 153880 - DNA, 25 bp, E. coli
gcactttgtcaagagtctagcccga

SEQ ID NO: 153881 - DNA, 25 bp, E. coli
cgatggatttatgatcgggctgaga

SEQ ID NO: 153882 - DNA, 25 bp, E. coli
cgatggatttatcatcgggctgaga

SEQ ID NO: 153883 - DNA, 25 bp, E. coli
ggcctacgtggaacgatcaatttat

SEQ ID NO: 153884 - DNA, 25 bp, E. coli
ggcctacgtggatcgatcaatttat

SEQ ID NO: 153885 - DNA, 25 bp, E. coli
tacgtggatcgatcaatttattgaa

SEQ ID NO: 153886 - DNA, 25 bp, E. coli
tacgtggatcgaacaatttattgaa

SEQ ID NO: 153887 - DNA, 25 bp, E. coli
caggccttgcggtcacggcaatggc

SEQ ID NO: 153888 - DNA, 25 bp, E. coli
caggccttgcggacacggcaatggc

SEQ ID NO: 153889 - DNA, 25 bp, E. coli
taaaaatcagctagaagtgatgcgc

SEQ ID NO: 153890 - DNA, 25 bp, E. coli
taaaaatcagcttgaagtgatgcgc

SEQ ID NO: 153891 - DNA, 25 bp, E. coli
agatattgataacggaacgttgcct

SEQ ID NO: 153892 - DNA, 25 bp, E. coli
agatattgataagggaacgttgcct

SEQ ID NO: 153893 - DNA, 25 bp, E. coli
tcagttacaccattgaagcaggcaa

SEQ ID NO: 153894 - DNA, 25 bp, E. coli
tcagttacaccaatgaagcaggcaa

SEQ ID NO: 153895 - DNA, 25 bp, E. coli
gcgcattcagcagcagcaagatatt

SEQ ID NO: 153896 - DNA, 25 bp, E. coli
gcgcattcagcaccagcaagatatt

SEQ ID NO: 153897 - DNA, 25 bp, E. coli
gcagcaagatattgataacggaacg

SEQ ID NO: 153898 - DNA, 25 bp, E. coli
gcagcaagatatagataacggaacg

SEQ ID NO: 153899 - DNA, 25 bp, E. coli
cgacattctcggctcccgtaaaaat

SEQ ID NO: 153900 - DNA, 25 bp, E. coli
cgacattctcgggtcccgtaaaaat

SEQ ID NO: 153901 - DNA, 25 bp, E. coli
cattcagcagcagcaagatattgat

SEQ ID NO: 153902 - DNA, 25 bp, E. coli
cattcagcagcaccaagatattgat

SEQ ID NO: 153903 - DNA, 25 bp, E. coli
ggcaccatcagtaacaccaatgaag

SEQ ID NO: 153904 - DNA, 25 bp, E. coli
ggcaccatcagttacaccaatgaag

SEQ ID NO: 153905 - DNA, 25 bp, E. coli
ggctcccgtaaatatcagcttgaag

SEQ ID NO: 153906 - DNA, 25 bp, E. coli
ggctcccgtaaaaatcagcttgaag

SEQ ID NO: 153907 - DNA, 25 bp, E. coli
taacggcaccatgagttacaccaat

SEQ ID NO: 153908 - DNA, 25 bp, E. coli
taacggcaccatcagttacaccaat

SEQ ID NO: 153909 - DNA, 25 bp, E. coli
aaccacgtattaagctgtattccgg

SEQ ID NO: 153910 - DNA, 25 bp, E. coli
aaccacgtattatgctgtattccgg

SEQ ID NO: 153911 - DNA, 25 bp, E. coli
aactgaccttcagcattgcggataa

SEQ ID NO: 153912 - DNA, 25 bp, E. coli
aactgaccttcaccattgcggataa

SEQ ID NO: 153913 - DNA, 25 bp, E. coli
tattaagctgtaatccggcatcgcc

SEQ ID NO: 153914 - DNA, 25 bp, E. coli
tattaagctgtattccggcatcgcc

SEQ ID NO: 153915 - DNA, 25 bp, E. coli
tgtattccggcatcgccagtgcaac

SEQ ID NO: 153916 - DNA, 25 bp, E. coli
tgtattccggcaacgccagtgcaac

SEQ ID NO: 153917 - DNA, 25 bp, E. coli
tgaaatgaatgaggtttattgtctg

SEQ ID NO: 153918 - DNA, 25 bp, E. coli
tgaaatgaatgacgtttattgtctg

SEQ ID NO: 153919 - DNA, 25 bp, E. coli
tcactggcgaacgacgtattaagct

SEQ ID NO: 153920 - DNA, 25 bp, E. coli
tcactggcgaaccacgtattaagct

SEQ ID NO: 153921 - DNA, 25 bp, E. coli
ccggaaatatgttcactggttgttt

SEQ ID NO: 153922 - DNA, 25 bp, E. coli
ccggaaatatgtacactggttgttt

SEQ ID NO: 153923 - DNA, 25 bp, E. coli
gcatcgccagtggaactgaccttca

SEQ ID NO: 153924 - DNA, 25 bp, E. coli
gcatcgccagtgcaactgaccttca

SEQ ID NO: 153925 - DNA, 25 bp, E. coli
gaagcccttcactggcgaaccacgt

SEQ ID NO: 153926 - DNA, 25 bp, E. coli
gaagcccttcacaggcgaaccacgt

SEQ ID NO: 153927 - DNA, 25 bp, E. coli
tcactggttgtttttgtatcttccc

SEQ ID NO: 153928 - DNA, 25 bp, E. coli
taacccgccggatatatgttcactg

SEQ ID NO: 153929 - DNA, 25 bp, E. coli
tcactggttgttattgtatcttccc

SEQ ID NO: 153930 - DNA, 25 bp, E. coli
taacccgccggaaatatgttcactg

SEQ ID NO: 153931 - DNA, 25 bp, E. coli
caaaacacgtttcgtcgctgaagaa

SEQ ID NO: 153932 - DNA, 25 bp, E. coli
caaaaacgcgtccatggtctgctgg

SEQ ID NO: 153933 - DNA, 25 bp, E. coli
caaaagctgacttcaccgatgcggt

SEQ ID NO: 153934 - DNA, 25 bp, E. coli
caaaacacgtttggtcgctgaagaa

SEQ ID NO: 153935 - DNA, 25 bp, E. coli
caaaagctgactacaccgatgcggt

SEQ ID NO: 153936 - DNA, 25 bp, E. coli
caaaaacgcgtcgatggtctgctgg

SEQ ID NO: 153937 - DNA, 25 bp, E. coli
catggccgggcgttatctgattgaa

SEQ ID NO: 153938 - DNA, 25 bp, E. coli
catggccgggcgatatctgattgaa

SEQ ID NO: 153939 - DNA, 25 bp, E. coli
ttgcttccagaatggttacaccctg

SEQ ID NO: 153940 - DNA, 25 bp, E. coli
ttgcttccagaaaggttacaccctg

SEQ ID NO: 153941 - DNA, 25 bp, E. coli
tgctggaagagtttcgccatatccc

SEQ ID NO: 153942 - DNA, 25 bp, E. coli
tgctggaagagtatcgccatatccc

SEQ ID NO: 153943 - DNA, 25 bp, E. coli
tcggttatgataacgtgcgcaacgc

SEQ ID NO: 153944 - DNA, 25 bp, E. coli
tcggttatgatatcgtgcgcaacgc

SEQ ID NO: 153945 - DNA, 25 bp, E. coli
gaacaatcttgacaaacagcgggct

SEQ ID NO: 153946 - DNA, 25 bp, E. coli
gaacaatcttgagaaacagcgggct

SEQ ID NO: 153947 - DNA, 25 bp, E. coli
ggttaaccacaccaagtctatcggt

SEQ ID NO: 153948 - DNA, 25 bp, E. coli
ggttaaccacacgaagtctatcggt

SEQ ID NO: 153949 - DNA, 25 bp, E. coli
gaccagcagcgatgcggcctatttt

SEQ ID NO: 153950 - DNA, 25 bp, E. coli
gatgtgttctgactacccagagccg

SEQ ID NO: 153951 - DNA, 25 bp, E. coli
gatgtgttctgagtacccagagccg

SEQ ID NO: 153952 - DNA, 25 bp, E. coli
gaccagcagcgaagcggcctatttt

SEQ ID NO: 153953 - DNA, 25 bp, E. coli
aatgtgacttgtccggcagacccag

SEQ ID NO: 153954 - DNA, 25 bp, E. coli
aatgtgacttgtgcggcagacccag

SEQ ID NO: 153955 - DNA, 25 bp, E. coli
caaaagatctaatagtggtcgggca

SEQ ID NO: 153956 - DNA, 25 bp, E. coli
caaaagatctaaaagtggtcgggca

SEQ ID NO: 153957 - DNA, 25 bp, E. coli
agattaacggtgatgacgccacggc

SEQ ID NO: 153958 - DNA, 25 bp, E. coli
agattaacggtgttgacgccacggc

SEQ ID NO: 153959 - DNA, 25 bp, E. coli
cacgggtaccaatatcgcgggcaat

SEQ ID NO: 153960 - DNA, 25 bp, E. coli
cacgggtaccaaaatcgcgggcaat

SEQ ID NO: 153961 - DNA, 25 bp, E. coli
tgttaacaacgatggcgagagcgcc

SEQ ID NO: 153962 - DNA, 25 bp, E. coli
tgttaacaacgaaggcgagagcgcc

SEQ ID NO: 153963 - DNA, 25 bp, E. coli
tcgaacaaaacctgatgccatggct

SEQ ID NO: 153964 - DNA, 25 bp, E. coli
tcgaacaaaaccagatgccatggct

SEQ ID NO: 153965 - DNA, 25 bp, E. coli
gaataacactgttgcccttgaaggg

SEQ ID NO: 153966 - DNA, 25 bp, E. coli
gaataacactgtagcccttgaaggg

SEQ ID NO: 153967 - DNA, 25 bp, E. coli
gaaattggcagtggcgctacgctaa

SEQ ID NO: 153968 - DNA, 25 bp, E. coli
gaaattggcagtcgcgctacgctaa

SEQ ID NO: 153969 - DNA, 25 bp, E. coli
cattggtgacaacggcacggttaac

SEQ ID NO: 153970 - DNA, 25 bp, E. coli
cattggtgacaagggcacggttaac

SEQ ID NO: 153971 - DNA, 25 bp, E. coli
gattggagagaataacgcgcttgca

SEQ ID NO: 153972 - DNA, 25 bp, E. coli
gattaatggtgatgacgccacggca

SEQ ID NO: 153973 - DNA, 25 bp, E. coli
gattaatggtgaagacgccacggca

SEQ ID NO: 153974 - DNA, 25 bp, E. coli
gattggagagaaaaacgcgcttgca

SEQ ID NO: 153975 - DNA, 25 bp, E. coli
cacatttttgttgtgcgcgcagcgt

SEQ ID NO: 153976 - DNA, 25 bp, E. coli
cacatttttgttctgcgcgcagcgt

SEQ ID NO: 153977 - DNA, 25 bp, E. coli
tatgggcgtgcaaccgacgcagtgt

SEQ ID NO: 153978 - DNA, 25 bp, E. coli
tatgggcgtgcatccgacgcagtgt

SEQ ID NO: 153979 - DNA, 25 bp, E. coli
tattttgacgccctcgtcgctgccg

SEQ ID NO: 153980 - DNA, 25 bp, E. coli
tattttgacgccgtcgtcgctgccg

SEQ ID NO: 153981 - DNA, 25 bp, E. coli
tgagctgaatcaggccgatctcgac

SEQ ID NO: 153982 - DNA, 25 bp, E. coli
tgagctgaatcacgccgatctcgac

SEQ ID NO: 153983 - DNA, 25 bp, E. coli
tagggcactacggtcttcagtacga

SEQ ID NO: 153984 - DNA, 25 bp, E. coli
cgttagcgcgtgaaaaaacagaagc

SEQ ID NO: 153985 - DNA, 25 bp, E. coli
cgttagcgcgtgtaaaaacagaagc

SEQ ID NO: 153986 - DNA, 25 bp, E. coli
cgatttcggtatacaggcggcccgt

SEQ ID NO: 153987 - DNA, 25 bp, E. coli
cgatttcggtattcaggcggcccgt

SEQ ID NO: 153988 - DNA, 25 bp, E. coli
cgtggcgcgaagaattagggcacta

SEQ ID NO: 153989 - DNA, 25 bp, E. coli
cgtggcgcgaagtattagggcacta

SEQ ID NO: 153990 - DNA, 25 bp, E. coli
tcgtcgcccaatcgctgtaggaacg

SEQ ID NO: 153991 - DNA, 25 bp, E. coli
tcgtcgcccaatggctgtaggaacg

SEQ ID NO: 153992 - DNA, 25 bp, E. coli
tagggcactacgctcttcagtacga

SEQ ID NO: 153993 - DNA, 25 bp, E. coli
taaacccgcgcctgacacatttttg

SEQ ID NO: 153994 - DNA, 25 bp, E. coli
taaacccgcgccagacacatttttg

SEQ ID NO: 153995 - DNA, 25 bp, E. coli
gatctcgacccggatgcgttagcgc

SEQ ID NO: 153996 - DNA, 25 bp, E. coli
gatctcgacccgcatgcgttagcgc

SEQ ID NO: 153997 - DNA, 25 bp, E. coli
catattaccttaatgcgcgacgcca

SEQ ID NO: 153998 - DNA, 25 bp, E. coli
catattaccttattgcgcgacgcca

SEQ ID NO: 153999 - DNA, 25 bp, E. coli
tttacgcctcctggtttgcccgtgg

SEQ ID NO: 154000 - DNA, 25 bp, E. coli
ttcacactcacggttgatgacgccg

SEQ ID NO: 154001 - DNA, 25 bp, E. coli
ttcacactcacgcttgatgacgccg

SEQ ID NO: 154002 - DNA, 25 bp, E. coli
tttacgcctcctcgtttgcccgtgg

SEQ ID NO: 154003 - DNA, 25 bp, E. coli
tgacggagttcaccctttacgcctc

SEQ ID NO: 154004 - DNA, 25 bp, E. coli
tgacggagttcagcctttacgcctc

SEQ ID NO: 154005 - DNA, 25 bp, E. coli
tctggcatttttaggcgaagtgagc

SEQ ID NO: 154006 - DNA, 25 bp, E. coli
tctggcattttttggcgaagtgagc

SEQ ID NO: 154007 - DNA, 25 bp, E. coli
gaaggcgctttctcttttagccgga

SEQ ID NO: 154008 - DNA, 25 bp, E. coli
gaaggcgctttcacttttagccgga

SEQ ID NO: 154009 - DNA, 25 bp, E. coli
gacggattcgtctacctggtttcac

SEQ ID NO: 154010 - DNA, 25 bp, E. coli
gacggattcgtcaacctggtttcac

SEQ ID NO: 154011 - DNA, 25 bp, E. coli
cccgcagcggttcttttcaaagcaa

SEQ ID NO: 154012 - DNA, 25 bp, E. coli
cgataatttgcaactgactctggca

SEQ ID NO: 154013 - DNA, 25 bp, E. coli
cgataatttgcatctgactctggca

SEQ ID NO: 154014 - DNA, 25 bp, E. coli
cgacttacctgctgaaatccgcgaa

SEQ ID NO: 154015 - DNA, 25 bp, E. coli
cccgcagcggttgttttcaaagcaa

SEQ ID NO: 154016 - DNA, 25 bp, E. coli
cgcggcttaatccagctggcgaata

SEQ ID NO: 154017 - DNA, 25 bp, E. coli
cgcggcttaatcgagctggcgaata

SEQ ID NO: 154018 - DNA, 25 bp, E. coli
cgacttacctgcagaaatccgcgaa

SEQ ID NO: 154019 - DNA, 25 bp, E. coli
cagcgggtatacaggcgaaaatgcg

SEQ ID NO: 154020 - DNA, 25 bp, E. coli
cagcgggtatactggcgaaaatgcg

SEQ ID NO: 154021 - DNA, 25 bp, E. coli
catgggatacgcagggaaacgcgcc

SEQ ID NO: 154022 - DNA, 25 bp, E. coli
catgggatacgctgggaaacgcgcc

SEQ ID NO: 154023 - DNA, 25 bp, E. coli
agagcaactgggtcagcgggtatac

SEQ ID NO: 154024 - DNA, 25 bp, E. coli
agagcaactgggacagcgggtatac

SEQ ID NO: 154025 - DNA, 25 bp, E. coli
tatgcagacggaagcgcatgggata

SEQ ID NO: 154026 - DNA, 25 bp, E. coli
tatgcagacggatgcgcatgggata

SEQ ID NO: 154027 - DNA, 25 bp, E. coli
tatcactccggatgatgtgcatccg

SEQ ID NO: 154028 - DNA, 25 bp, E. coli
tatcactccggaagatgtgcatccg

SEQ ID NO: 154029 - DNA, 25 bp, E. coli
tctaccgtggtgagttcagaatcgg

SEQ ID NO: 154030 - DNA, 25 bp, E. coli
tctaccgtggtgtgttcagaatcgg

SEQ ID NO: 154031 - DNA, 25 bp, E. coli
tcagaatcggcgaaacttaccaccc

SEQ ID NO: 154032 - DNA, 25 bp, E. coli
tcagaatcggcgtaacttaccaccc

SEQ ID NO: 154033 - DNA, 25 bp, E. coli
gccaaactgcgtcatggcaatacgg

SEQ ID NO: 154034 - DNA, 25 bp, E. coli
gccaaactgcgtgatggcaatacgg

SEQ ID NO: 154035 - DNA, 25 bp, E. coli
cgcttataggatagccgccggtgta

SEQ ID NO: 154036 - DNA, 25 bp, E. coli
cgcttataggattgccgccggtgta

SEQ ID NO: 154037 - DNA, 25 bp, E. coli
ggtgctgaaaatgcgtaatgcccgg

SEQ ID NO: 154038 - DNA, 25 bp, E. coli
ggtgctgaaaatccgtaatgcccgg

SEQ ID NO: 154039 - DNA, 25 bp, E. coli
gatgcggtcgcgtaaataccggtac

SEQ ID NO: 154040 - DNA, 25 bp, E. coli
gatgcggtcgcgaaaataccggtac

SEQ ID NO: 154041 - DNA, 25 bp, E. coli
ttgcacggtcgcgatcagcatacgc

SEQ ID NO: 154042 - DNA, 25 bp, E. coli
ttgcacggtcgccatcagcatacgc

SEQ ID NO: 154043 - DNA, 25 bp, E. coli
tgcggaatcaatgcgacagcagcac

SEQ ID NO: 154044 - DNA, 25 bp, E. coli
tcgtcctgttgcacggtcgcgatca

SEQ ID NO: 154045 - DNA, 25 bp, E. coli
tcgtcctgttgctcggtcgcgatca

SEQ ID NO: 154046 - DNA, 25 bp, E. coli
tgcggaatcaatccgacagcagcac

SEQ ID NO: 154047 - DNA, 25 bp, E. coli
tcaggccagacaggtagctgaacga

SEQ ID NO: 154048 - DNA, 25 bp, E. coli
tcaggccagacacgtagctgaacga

SEQ ID NO: 154049 - DNA, 25 bp, E. coli
gccactgctgcggtatgttaatagt

SEQ ID NO: 154050 - DNA, 25 bp, E. coli
gccactgctgcgctatgttaatagt

SEQ ID NO: 154051 - DNA, 25 bp, E. coli
gctgaacgatggcttctgctaaaca

SEQ ID NO: 154052 - DNA, 25 bp, E. coli
gctgaacgatgggttctgctaaaca

SEQ ID NO: 154053 - DNA, 25 bp, E. coli
gacaggtagctgaacgatggcttct

SEQ ID NO: 154054 - DNA, 25 bp, E. coli
gacaggtagctgtacgatggcttct

SEQ ID NO: 154055 - DNA, 25 bp, E. coli
ctgctgcggtatcttaatagtcaat

SEQ ID NO: 154056 - DNA, 25 bp, E. coli
ctgctgcggtatgttaatagtcaat

SEQ ID NO: 154057 - DNA, 25 bp, E. coli
gatcgctgcggattcaatgcgacag

SEQ ID NO: 154058 - DNA, 25 bp, E. coli
gtctcgcgtgatcgctgcggaatca

SEQ ID NO: 154059 - DNA, 25 bp, E. coli
gtctcgcgtgatggctgcggaatca

SEQ ID NO: 154060 - DNA, 25 bp, E. coli
ggcttctgctaatcaatattggcga

SEQ ID NO: 154061 - DNA, 25 bp, E. coli
ggcttctgctaaacaatattggcga

SEQ ID NO: 154062 - DNA, 25 bp, E. coli
gatcgctgcggaatcaatgcgacag

SEQ ID NO: 154063 - DNA, 25 bp, E. coli
caacattgccagtttgcgtgccggt

SEQ ID NO: 154064 - DNA, 25 bp, E. coli
aacgccaacattcccagtttgcgtg

SEQ ID NO: 154065 - DNA, 25 bp, E. coli
caacattgccagattgcgtgccggt

SEQ ID NO: 154066 - DNA, 25 bp, E. coli
cacatggcgtttttggtggtgccga

SEQ ID NO: 154067 - DNA, 25 bp, E. coli
cacatggcgtttatggtggtgccga

SEQ ID NO: 154068 - DNA, 25 bp, E. coli
cgtttttggtggagccgatggtcgg

SEQ ID NO: 154069 - DNA, 25 bp, E. coli
cgtttttggtggtgccgatggtcgg

SEQ ID NO: 154070 - DNA, 25 bp, E. coli
acattgccagttagcgtgccggtgg

SEQ ID NO: 154071 - DNA, 25 bp, E. coli
aacgccaacattgccagtttgcgtg

SEQ ID NO: 154072 - DNA, 25 bp, E. coli
acattgccagtttgcgtgccggtgg

SEQ ID NO: 154073 - DNA, 25 bp, E. coli
tgtggttggcatcttcttgattgtg

SEQ ID NO: 154074 - DNA, 25 bp, E. coli
tgtggttggcatgttcttgattgtg

SEQ ID NO: 154075 - DNA, 25 bp, E. coli
tgaccaggaagtgccgacggcgttt

SEQ ID NO: 154076 - DNA, 25 bp, E. coli
tgaccaggaagtcccgacggcgttt

SEQ ID NO: 154077 - DNA, 25 bp, E. coli
tcgcacatggcgtttttggtggtgc

SEQ ID NO: 154078 - DNA, 25 bp, E. coli
tcgcacatggcgattttggtggtgc

SEQ ID NO: 154079 - DNA, 25 bp, E. coli
ccggtgggcgtgaggttggcatctt

SEQ ID NO: 154080 - DNA, 25 bp, E. coli
ccggtgggcgtgtggttggcatctt

SEQ ID NO: 154081 - DNA, 25 bp, E. coli
gcgtgtggttggcatcttcttgatt

SEQ ID NO: 154082 - DNA, 25 bp, E. coli
gcgtgtggttgggatcttcttgatt

SEQ ID NO: 154083 - DNA, 25 bp, E. coli
ggcatcttcttgattgtggttgttg

SEQ ID NO: 154084 - DNA, 25 bp, E. coli
ggcatcttcttgtttgtggttgttg

SEQ ID NO: 154085 - DNA, 25 bp, E. coli
caagttactggcaagcgtccggtga

SEQ ID NO: 154086 - DNA, 25 bp, E. coli
caagttactggctagcgtccggtga

SEQ ID NO: 154087 - DNA, 25 bp, E. coli
caccgtttctgggttgagagcgaga

SEQ ID NO: 154088 - DNA, 25 bp, E. coli
caccgtttctggcttgagagcgaga

SEQ ID NO: 154089 - DNA, 25 bp, E. coli
aaaaaggcatcgatacagttctggc

SEQ ID NO: 154090 - DNA, 25 bp, E. coli
aaaaaggcatcgttacagttctggc

SEQ ID NO: 154091 - DNA, 25 bp, E. coli
ttctggctgaactgcgtgcccgtgg

SEQ ID NO: 154092 - DNA, 25 bp, E. coli
ttctggctgaacagcgtgcccgtgg

SEQ ID NO: 154093 - DNA, 25 bp, E. coli
tctgctaaaggtatgcgtgtaatcg

SEQ ID NO: 154094 - DNA, 25 bp, E. coli
tctgctaaaggtttgcgtgtaatcg

SEQ ID NO: 154095 - DNA, 25 bp, E. coli
gcgagaagcgttttgtcaccctgcg

SEQ ID NO: 154096 - DNA, 25 bp, E. coli
gcgagaagcgttatgtcaccctgcg

SEQ ID NO: 154097 - DNA, 25 bp, E. coli
gaacctgcactctcaccgtttctgg

SEQ ID NO: 154098 - DNA, 25 bp, E. coli
gcactgaacgcgtctaaacgccgtt

SEQ ID NO: 154099 - DNA, 25 bp, E. coli
gaacctgcactcacaccgtttctgg

SEQ ID NO: 154100 - DNA, 25 bp, E. coli
gcactgaacgcgactaaacgccgtt

SEQ ID NO: 154101 - DNA, 25 bp, E. coli
gtaacaaccgttcccacgcactgaa

SEQ ID NO: 154102 - DNA, 25 bp, E. coli
gtcaccctgcgcgtatctgctaaag

SEQ ID NO: 154103 - DNA, 25 bp, E. coli
tgtcccgagtctgccaagttactgg

SEQ ID NO: 154104 - DNA, 25 bp, E. coli
tgtcccgagtctcccaagttactgg

SEQ ID NO: 154105 - DNA, 25 bp, E. coli
gtaacaaccgttgccacgcactgaa

SEQ ID NO: 154106 - DNA, 25 bp, E. coli
gtcaccctgcgcctatctgctaaag

SEQ ID NO: 154107 - DNA, 25 bp, E. coli
cactattttattgacggtagcaatc

SEQ ID NO: 154108 - DNA, 25 bp, E. coli
cactattttattcacggtagcaatc

SEQ ID NO: 154109 - DNA, 25 bp, E. coli
caggcctgtttgacgctgaatgagc

SEQ ID NO: 154110 - DNA, 25 bp, E. coli
caggcctgtttgtcgctgaatgagc

SEQ ID NO: 154111 - DNA, 25 bp, E. coli
tactccaggcctgtttgtcgctgaa

SEQ ID NO: 154112 - DNA, 25 bp, E. coli
tactccaggcctctttgtcgctgaa

SEQ ID NO: 154113 - DNA, 25 bp, E. coli
acagtatgatttccacagtaaataa

SEQ ID NO: 154114 - DNA, 25 bp, E. coli
acagtatgatttgcacagtaaataa

SEQ ID NO: 154115 - DNA, 25 bp, E. coli
tattgacggtagcaatctgttctgt

SEQ ID NO: 154116 - DNA, 25 bp, E. coli
tattgacggtaggaatctgttctgt

SEQ ID NO: 154117 - DNA, 25 bp, E. coli
tgttttcaactctctcacttccagc

SEQ ID NO: 154118 - DNA, 25 bp, E. coli
tgttttcaactcactcacttccagc

SEQ ID NO: 154119 - DNA, 25 bp, E. coli
tctataaacagtatgatttgcacag

SEQ ID NO: 154120 - DNA, 25 bp, E. coli
tcacttccagctgaacctgaaaatt

SEQ ID NO: 154121 - DNA, 25 bp, E. coli
tcacttccagctcaacctgaaaatt

SEQ ID NO: 154122 - DNA, 25 bp, E. coli
tctataaacagtttgatttgcacag

SEQ ID NO: 154123 - DNA, 25 bp, E. coli
gcaatctgttctcttttcaactcac

SEQ ID NO: 154124 - DNA, 25 bp, E. coli
gcaatctgttctgttttcaactcac

SEQ ID NO: 154125 - DNA, 25 bp, E. coli
gtttgtcgctgattgagctccacta

SEQ ID NO: 154126 - DNA, 25 bp, E. coli
gtttgtcgctgaatgagctccacta

SEQ ID NO: 154127 - DNA, 25 bp, E. coli
gagctccactattttattgacggta

SEQ ID NO: 154128 - DNA, 25 bp, E. coli
gagctccactatattattgacggta

SEQ ID NO: 154129 - DNA, 25 bp, E. coli
caacgttggcggtgatatggccacc

SEQ ID NO: 154130 - DNA, 25 bp, E. coli
caacgttggcggagatatggccacc

SEQ ID NO: 154131 - DNA, 25 bp, E. coli
tacatgccgaaaggttctgctcagg

SEQ ID NO: 154132 - DNA, 25 bp, E. coli
tacatgccgaaacgttctgctcagg

SEQ ID NO: 154133 - DNA, 25 bp, E. coli
taggtatgcgcgagctgggtaatcc

SEQ ID NO: 154134 - DNA, 25 bp, E. coli
taggtatgcgcgtgctgggtaatcc

SEQ ID NO: 154135 - DNA, 25 bp, E. coli
ttatctggtcgacgtctatagcccg

SEQ ID NO: 154136 - DNA, 25 bp, E. coli
ttatcagcactgtaggcgacaccga

SEQ ID NO: 154137 - DNA, 25 bp, E. coli
ttatcagcactgaaggcgacaccga

SEQ ID NO: 154138 - DNA, 25 bp, E. coli
ttatctggtcgaggtctatagcccg

SEQ ID NO: 154139 - DNA, 25 bp, E. coli
tgttgaacctgagaaagctgactgt

SEQ ID NO: 154140 - DNA, 25 bp, E. coli
tgttgaacctgacaaagctgactgt

SEQ ID NO: 154141 - DNA, 25 bp, E. coli
tgaagccgtcgagcaaatgcgtgaa

SEQ ID NO: 154142 - DNA, 25 bp, E. coli
tgaagccgtcgaccaaatgcgtgaa

SEQ ID NO: 154143 - DNA, 25 bp, E. coli
tctgggaaggcaaacacgctgtagc

SEQ ID NO: 154144 - DNA, 25 bp, E. coli
tctgggaaggcatacacgctgtagc

SEQ ID NO: 154145 - DNA, 25 bp, E. coli
gctgggaaatccaacgtaactgcgc

SEQ ID NO: 154146 - DNA, 25 bp, E. coli
gctgggaaatcctacgtaactgcgc

SEQ ID NO: 154147 - DNA, 25 bp, E. coli
gaaacgctgtcatttgagcacctga

SEQ ID NO: 154148 - DNA, 25 bp, E. coli
gacgtgaagcactaccgcgaagttg

SEQ ID NO: 154149 - DNA, 25 bp, E. coli
gaaacgctgtcaattgagcacctga

SEQ ID NO: 154150 - DNA, 25 bp, E. coli
gacgtgaagcacaaccgcgaagttg

SEQ ID NO: 154151 - DNA, 25 bp, E. coli
aatgactttatgcatcgcggtcgcg

SEQ ID NO: 154152 - DNA, 25 bp, E. coli
aatgactttatggatcgcggtcgcg

SEQ ID NO: 154153 - DNA, 25 bp, E. coli
agctggtgctcaatcgtctcgacga

SEQ ID NO: 154154 - DNA, 25 bp, E. coli
agctggtgctcattcgtctcgacga

SEQ ID NO: 154155 - DNA, 25 bp, E. coli
tttatccgcctgaaagactggagcg

SEQ ID NO: 154156 - DNA, 25 bp, E. coli
ttttaaagcaggcaccgatccggac

SEQ ID NO: 154157 - DNA, 25 bp, E. coli
tttatccgcctgtaagactggagcg

SEQ ID NO: 154158 - DNA, 25 bp, E. coli
ttttaaagcagggaccgatccggac

SEQ ID NO: 154159 - DNA, 25 bp, E. coli
tgatatggagttgcaggaccacgct

SEQ ID NO: 154160 - DNA, 25 bp, E. coli
tgatatggagttccaggaccacgct

SEQ ID NO: 154161 - DNA, 25 bp, E. coli
tgaaaacgctgcaggaagctatcgc

SEQ ID NO: 154162 - DNA, 25 bp, E. coli
tgaaaacgctgctggaagctatcgc

SEQ ID NO: 154163 - DNA, 25 bp, E. coli
gccacgacctgtttgaagcgacgct

SEQ ID NO: 154164 - DNA, 25 bp, E. coli
gccacgacctgtatgaagcgacgct

SEQ ID NO: 154165 - DNA, 25 bp, E. coli
gaagaaagtctaagtgcaggcagct

SEQ ID NO: 154166 - DNA, 25 bp, E. coli
gaagaaagtctatgtgcaggcagct

SEQ ID NO: 154167 - DNA, 25 bp, E. coli
cgtgacccaggtaatcgagcaaaat

SEQ ID NO: 154168 - DNA, 25 bp, E. coli
cgtgacccaggttatcgagcaaaat

SEQ ID NO: 154169 - DNA, 25 bp, E. coli
gatttatgtcctgctgcttggcggc

SEQ ID NO: 154170 - DNA, 25 bp, E. coli
gatttatgtcctcctgcttggcggc

SEQ ID NO: 154171 - DNA, 25 bp, E. coli
taatattcaggacccgttaagccgc

SEQ ID NO: 154172 - DNA, 25 bp, E. coli
taatattcaggagccgttaagccgc

SEQ ID NO: 154173 - DNA, 25 bp, E. coli
taaatcgcttccctttccgtggtgc

SEQ ID NO: 154174 - DNA, 25 bp, E. coli
tgttaacggcgaccgtaactcccag

SEQ ID NO: 154175 - DNA, 25 bp, E. coli
tgttaacggcgagcgtaactcccag

SEQ ID NO: 154176 - DNA, 25 bp, E. coli
tgaaaaagacagcaccgttctctgc

SEQ ID NO: 154177 - DNA, 25 bp, E. coli
tgaaaaagacaggaccgttctctgc

SEQ ID NO: 154178 - DNA, 25 bp, E. coli
tgccagcatcgatgactttacccgt

SEQ ID NO: 154179 - DNA, 25 bp, E. coli
tgccagcatcgaagactttacccgt

SEQ ID NO: 154180 - DNA, 25 bp, E. coli
gaaggcacccgctgctttatcgatg

SEQ ID NO: 154181 - DNA, 25 bp, E. coli
gaaggcacccgcagctttatcgatg

SEQ ID NO: 154182 - DNA, 25 bp, E. coli
ccgactaccttgagggctttgatgc

SEQ ID NO: 154183 - DNA, 25 bp, E. coli
ccgactaccttgtgggctttgatgc

SEQ ID NO: 154184 - DNA, 25 bp, E. coli
gataatatgcgtcccgtcagtgtgc

SEQ ID NO: 154185 - DNA, 25 bp, E. coli
gatcgtcctgtagtggttctgcgca

SEQ ID NO: 154186 - DNA, 25 bp, E. coli
gatcgtcctgtactggttctgcgca

SEQ ID NO: 154187 - DNA, 25 bp, E. coli
gattgaagcaaagcagaccgctgat

SEQ ID NO: 154188 - DNA, 25 bp, E. coli
gattgaagcaaaccagaccgctgat

SEQ ID NO: 154189 - DNA, 25 bp, E. coli
gataatatgcgtgccgtcagtgtgc

SEQ ID NO: 154190 - DNA, 25 bp, E. coli
tggattgaagactgggccgactacc

SEQ ID NO: 154191 - DNA, 25 bp, E. coli
tggattgaagacagggccgactacc

SEQ ID NO: 154192 - DNA, 25 bp, E. coli
tcagcattatcagtggcgatcgtcc

SEQ ID NO: 154193 - DNA, 25 bp, E. coli
tcagcattatcactggcgatcgtcc

SEQ ID NO: 154194 - DNA, 25 bp, E. coli
taaatcgcttccgtttccgtggtgc

SEQ ID NO: 154195 - DNA, 25 bp, E. coli
aatacctgtatgtggacctaccgct

SEQ ID NO: 154196 - DNA, 25 bp, E. coli
aatacctgtatgaggacctaccgct

SEQ ID NO: 154197 - DNA, 25 bp, E. coli
taccgctctgatcagtgtggttaca

SEQ ID NO: 154198 - DNA, 25 bp, E. coli
taccgctctgatgagtgtggttaca

SEQ ID NO: 154199 - DNA, 25 bp, E. coli
tacctgtatgtgcacctaccgctct

SEQ ID NO: 154200 - DNA, 25 bp, E. coli
tatgtggacctagcgctctgatgag

SEQ ID NO: 154201 - DNA, 25 bp, E. coli
tatgtggacctaccgctctgatgag

SEQ ID NO: 154202 - DNA, 25 bp, E. coli
tacctgtatgtggacctaccgctct

SEQ ID NO: 154203 - DNA, 25 bp, E. coli
tgatgagtgtggttacacgggcggg

SEQ ID NO: 154204 - DNA, 25 bp, E. coli
tgtatgtggaccaaccgctctgatg

SEQ ID NO: 154205 - DNA, 25 bp, E. coli
tgtatgtggacctaccgctctgatg

SEQ ID NO: 154206 - DNA, 25 bp, E. coli
tgatgagtgtggatacacgggcggg

SEQ ID NO: 154207 - DNA, 25 bp, E. coli
cctgtatgtggagctaccgctctga

SEQ ID NO: 154208 - DNA, 25 bp, E. coli
cctgtatgtggacctaccgctctga

SEQ ID NO: 154209 - DNA, 25 bp, E. coli
ccgctctgatgagtgtggttacacg

SEQ ID NO: 154210 - DNA, 25 bp, E. coli
ccgctctgatgactgtggttacacg

SEQ ID NO: 154211 - DNA, 25 bp, E. coli
ctctgatgagtgtggttacacgggc

SEQ ID NO: 154212 - DNA, 25 bp, E. coli
ctctgatgagtgaggttacacgggc

SEQ ID NO: 154213 - DNA, 25 bp, E. coli
tggacctaccgcactgatgagtgtg

SEQ ID NO: 154214 - DNA, 25 bp, E. coli
tggacctaccgctctgatgagtgtg

SEQ ID NO: 154215 - DNA, 25 bp, E. coli
gacctaccgctcagatgagtgtggt

SEQ ID NO: 154216 - DNA, 25 bp, E. coli
gacctaccgctctgatgagtgtggt

SEQ ID NO: 154217 - DNA, 25 bp, E. coli
caaatcctggtaaacgtgcgttaca

SEQ ID NO: 154218 - DNA, 25 bp, E. coli
caaatcctggtatacgtgcgttaca

SEQ ID NO: 154219 - DNA, 25 bp, E. coli
acgtgtgctgttccgtaaatccggc

SEQ ID NO: 154220 - DNA, 25 bp, E. coli
acgtgtgctgttgcgtaaatccggc

SEQ ID NO: 154221 - DNA, 25 bp, E. coli
tgttcccgcaaaacctggtaaacgt

SEQ ID NO: 154222 - DNA, 25 bp, E. coli
tgttcccgcaaatcctggtaaacgt

SEQ ID NO: 154223 - DNA, 25 bp, E. coli
tcccgcaaatcctggtaaacgtgcg

SEQ ID NO: 154224 - DNA, 25 bp, E. coli
tccgctggagcaagaatcagtcaaa

SEQ ID NO: 154225 - DNA, 25 bp, E. coli
tccgctggagcatgaatcagtcaaa

SEQ ID NO: 154226 - DNA, 25 bp, E. coli
tcccgcaaatccaggtaaacgtgcg

SEQ ID NO: 154227 - DNA, 25 bp, E. coli
ccgtggacgtgtcctgttgcgtaaa

SEQ ID NO: 154228 - DNA, 25 bp, E. coli
gcggcgatccgcaggagcatgaatc

SEQ ID NO: 154229 - DNA, 25 bp, E. coli
gcggcgatccgctggagcatgaatc

SEQ ID NO: 154230 - DNA, 25 bp, E. coli
cgctggagcatgaatcagtcaaagc

SEQ ID NO: 154231 - DNA, 25 bp, E. coli
cgctggagcatgtatcagtcaaagc

SEQ ID NO: 154232 - DNA, 25 bp, E. coli
ccgtggacgtgtgctgttgcgtaaa

SEQ ID NO: 154233 - DNA, 25 bp, E. coli
cggcgctgggtacccgtggacgtgt

SEQ ID NO: 154234 - DNA, 25 bp, E. coli
cggcgctgggtagccgtggacgtgt

SEQ ID NO: 154235 - DNA, 25 bp, E. coli
tggacgtgtgctcttgcgtaaatcc

SEQ ID NO: 154236 - DNA, 25 bp, E. coli
tggacgtgtgctgttgcgtaaatcc

SEQ ID NO: 154237 - DNA, 25 bp, E. coli
gatccgctggagcatgaatcagtca

SEQ ID NO: 154238 - DNA, 25 bp, E. coli
gatccgctggaggatgaatcagtca

SEQ ID NO: 154239 - DNA, 25 bp, E. coli
tatctctggcgtgaagaacgcccgg

SEQ ID NO: 154240 - DNA, 25 bp, E. coli
tatctctggcgtcaagaacgcccgg

SEQ ID NO: 154241 - DNA, 25 bp, E. coli
tgtcggctacgatgaaatttttggc

SEQ ID NO: 154242 - DNA, 25 bp, E. coli
tgtcggctacgaagaaatttttggc

SEQ ID NO: 154243 - DNA, 25 bp, E. coli
tgcgtgaaatcgaccgtcgcgtgcg

SEQ ID NO: 154244 - DNA, 25 bp, E. coli
tgcgtgaaatcgtccgtcgcgtgcg

SEQ ID NO: 154245 - DNA, 25 bp, E. coli
tctgggcgaccgcagcgaaaatgct

SEQ ID NO: 154246 - DNA, 25 bp, E. coli
tctgggcgaccggagcgaaaatgct

SEQ ID NO: 154247 - DNA, 25 bp, E. coli
gctgaaaaaagaagtcggcgatctg

SEQ ID NO: 154248 - DNA, 25 bp, E. coli
gctgaaaaaagatgtcggcgatctg

SEQ ID NO: 154249 - DNA, 25 bp, E. coli
gactcaccgtttgcgtattgtcggc

SEQ ID NO: 154250 - DNA, 25 bp, E. coli
gactcaccgtttccgtattgtcggc

SEQ ID NO: 154251 - DNA, 25 bp, E. coli
gattacatctctatcgattccccga

SEQ ID NO: 154252 - DNA, 25 bp, E. coli
gattacatctctttcgattccccga

SEQ ID NO: 154253 - DNA, 25 bp, E. coli
gtcgcgtgcgctatctcactaaatg

SEQ ID NO: 154254 - DNA, 25 bp, E. coli
gtcgcgtgcgctttctcactaaatg

SEQ ID NO: 154255 - DNA, 25 bp, E. coli
tggagattgaaatcgacgatggcgt

SEQ ID NO: 154256 - DNA, 25 bp, E. coli
tggagattgaaaacgacgatggcgt

SEQ ID NO: 154257 - DNA, 25 bp, E. coli
taatgctatcgactacgtgaaaccg

SEQ ID NO: 154258 - DNA, 25 bp, E. coli
taatgctatcgagtacgtgaaaccg

SEQ ID NO: 154259 - DNA, 25 bp, E. coli
gatggcccgcgctttgctgaaaaaa

SEQ ID NO: 154260 - DNA, 25 bp, E. coli
gatggcccgcgcattgctgaaaaaa

SEQ ID NO: 154261 - DNA, 25 bp, E. coli
aatgactcattagttttgcaacgga

SEQ ID NO: 154262 - DNA, 25 bp, E. coli
aatgactcattacttttgcaacgga

SEQ ID NO: 154263 - DNA, 25 bp, E. coli
caagtgtgtccacattgcgtcgtta

SEQ ID NO: 154264 - DNA, 25 bp, E. coli
caagtgtgtccagattgcgtcgtta

SEQ ID NO: 154265 - DNA, 25 bp, E. coli
cacctgtaatcatgaaaaatgactc

SEQ ID NO: 154266 - DNA, 25 bp, E. coli
cagaatttatttagtccaccggcca

SEQ ID NO: 154267 - DNA, 25 bp, E. coli
caacggattttgtgtaatggcagcc

SEQ ID NO: 154268 - DNA, 25 bp, E. coli
cacctgtaatcaagaaaaatgactc

SEQ ID NO: 154269 - DNA, 25 bp, E. coli
caacggattttgagtaatggcagcc

SEQ ID NO: 154270 - DNA, 25 bp, E. coli
cagaatttattttgtccaccggcca

SEQ ID NO: 154271 - DNA, 25 bp, E. coli
aaacaaggccggatatggcgagtgc

SEQ ID NO: 154272 - DNA, 25 bp, E. coli
cagaagtaatcctccaagtgtgtcc

SEQ ID NO: 154273 - DNA, 25 bp, E. coli
cagaagtaatccaccaagtgtgtcc

SEQ ID NO: 154274 - DNA, 25 bp, E. coli
aaacaaggccggttatggcgagtgc

SEQ ID NO: 154275 - DNA, 25 bp, E. coli
tgtccaccggccatgaaacaaggcc

SEQ ID NO: 154276 - DNA, 25 bp, E. coli
tgggctgctgaataatacagaagta

SEQ ID NO: 154277 - DNA, 25 bp, E. coli
tgggctgctgaaaaatacagaagta

SEQ ID NO: 154278 - DNA, 25 bp, E. coli
tgtccaccggccttgaaacaaggcc

SEQ ID NO: 154279 - DNA, 25 bp, E. coli
cattgcgtcgttttgctaagcagaa

SEQ ID NO: 154280 - DNA, 25 bp, E. coli
cattgcgtcgttatgctaagcagaa

SEQ ID NO: 154281 - DNA, 25 bp, E. coli
taactcttgaagtatgggctgctga

SEQ ID NO: 154282 - DNA, 25 bp, E. coli
taactcttgaagaatgggctgctga

SEQ ID NO: 154283 - DNA, 25 bp, E. coli
caagaaggtagttgcaaccgggcaa

SEQ ID NO: 154284 - DNA, 25 bp, E. coli
caaggtgcttatcgtaatactgcga

SEQ ID NO: 154285 - DNA, 25 bp, E. coli
caagaaggtagtagcaaccgggcaa

SEQ ID NO: 154286 - DNA, 25 bp, E. coli
caattgtagtgctgagacagtcgca

SEQ ID NO: 154287 - DNA, 25 bp, E. coli
caattgtagtgcagagacagtcgca

SEQ ID NO: 154288 - DNA, 25 bp, E. coli
caaggtgcttatggtaatactgcga

SEQ ID NO: 154289 - DNA, 25 bp, E. coli
cagccgcagcagcttatgatttagc

SEQ ID NO: 154290 - DNA, 25 bp, E. coli
cagtatggtactgaaaaaacggcaa

SEQ ID NO: 154291 - DNA, 25 bp, E. coli
cagccgcagcaggttatgatttagc

SEQ ID NO: 154292 - DNA, 25 bp, E. coli
cagtatggtactcaaaaaacggcaa

SEQ ID NO: 154293 - DNA, 25 bp, E. coli
catatattgatctggcgggcagtgc

SEQ ID NO: 154294 - DNA, 25 bp, E. coli
catatattgatcaggcgggcagtgc

SEQ ID NO: 154295 - DNA, 25 bp, E. coli
tgttaacaatactgggtgcgcctgg

SEQ ID NO: 154296 - DNA, 25 bp, E. coli
tgttaacaatacagggtgcgcctgg

SEQ ID NO: 154297 - DNA, 25 bp, E. coli
tcagttacggcagggaggctcaaaa

SEQ ID NO: 154298 - DNA, 25 bp, E. coli
tcagttacggcacggaggctcaaaa

SEQ ID NO: 154299 - DNA, 25 bp, E. coli
ccataattggtcaagctgggactaa

SEQ ID NO: 154300 - DNA, 25 bp, E. coli
ccataattggtctagctgggactaa

SEQ ID NO: 154301 - DNA, 25 bp, E. coli
gcaaatggctattcgcgtgacacaa

SEQ ID NO: 154302 - DNA, 25 bp, E. coli
gcaaatggctatacgcgtgacacaa

SEQ ID NO: 154303 - DNA, 25 bp, E. coli
taagtcttcatttaatcaggcagcc

SEQ ID NO: 154304 - DNA, 25 bp, E. coli
taagtcttcattaaatcaggcagcc

SEQ ID NO: 154305 - DNA, 25 bp, E. coli
caaaactggcaacgtcgcaaggtgg

SEQ ID NO: 154306 - DNA, 25 bp, E. coli
caaaactggcaaggtcgcaaggtgg

SEQ ID NO: 154307 - DNA, 25 bp, E. coli
caaaatgctggcctattccgggatc

SEQ ID NO: 154308 - DNA, 25 bp, E. coli
caaaatgctggcgtattccgggatc

SEQ ID NO: 154309 - DNA, 25 bp, E. coli
ttattacctcgatcacctggcctgg

SEQ ID NO: 154310 - DNA, 25 bp, E. coli
ttattacctcgaacacctggcctgg

SEQ ID NO: 154311 - DNA, 25 bp, E. coli
tgaaccggatcaccaaaacagcctg

SEQ ID NO: 154312 - DNA, 25 bp, E. coli
tgaaccggatcagcaaaacagcctg

SEQ ID NO: 154313 - DNA, 25 bp, E. coli
tctggatatgttcagccaccgcctg

SEQ ID NO: 154314 - DNA, 25 bp, E. coli
tcagtgcgctgaaacgggatacgtc

SEQ ID NO: 154315 - DNA, 25 bp, E. coli
tctggatatgttgagccaccgcctg

SEQ ID NO: 154316 - DNA, 25 bp, E. coli
gaaaccctgcgtatcagcgccgatg

SEQ ID NO: 154317 - DNA, 25 bp, E. coli
gaaaccctgcgtttcagcgccgatg

SEQ ID NO: 154318 - DNA, 25 bp, E. coli
gaaattatctgtggcctggtgtccc

SEQ ID NO: 154319 - DNA, 25 bp, E. coli
gaaattatctgtcgcctggtgtccc

SEQ ID NO: 154320 - DNA, 25 bp, E. coli
gataacaaaagtgcgctgctgggct

SEQ ID NO: 154321 - DNA, 25 bp, E. coli
gataacaaaagtccgctgctgggct

SEQ ID NO: 154322 - DNA, 25 bp, E. coli
tcagaagtgacgctgcaaaactggc

SEQ ID NO: 154323 - DNA, 25 bp, E. coli
tcacatcagttttcgtaacggcggt

SEQ ID NO: 154324 - DNA, 25 bp, E. coli
tcagaagtgacggtgcaaaactggc

SEQ ID NO: 154325 - DNA, 25 bp, E. coli
tcacatcagtttacgtaacggcggt

SEQ ID NO: 154326 - DNA, 25 bp, E. coli
tcagtgcgctgatacgggatacgtc

SEQ ID NO: 154327 - DNA, 25 bp, E. coli
acctgcccgtgggatgaatatctgg

SEQ ID NO: 154328 - DNA, 25 bp, E. coli
acctgcccgtggcatgaatatctgg

SEQ ID NO: 154329 - DNA, 25 bp, E. coli
tatctggcatggattgccactctgg

SEQ ID NO: 154330 - DNA, 25 bp, E. coli
tatctggcatggtttgccactctgg

SEQ ID NO: 154331 - DNA, 25 bp, E. coli
tcgacattaaccttgtgccgatgct

SEQ ID NO: 154332 - DNA, 25 bp, E. coli
tcgacattaaccatgtgccgatgct

SEQ ID NO: 154333 - DNA, 25 bp, E. coli
tctatttgatggagaggagactgcg

SEQ ID NO: 154334 - DNA, 25 bp, E. coli
tctatttgatggtgaggagactgcg

SEQ ID NO: 154335 - DNA, 25 bp, E. coli
cctggcgattggtcaccaccttggg

SEQ ID NO: 154336 - DNA, 25 bp, E. coli
cctggcgattggacaccaccttggg

SEQ ID NO: 154337 - DNA, 25 bp, E. coli
gcattcgataaagcccgggcagcgc

SEQ ID NO: 154338 - DNA, 25 bp, E. coli
gcattcgataaaccccgggcagcgc

SEQ ID NO: 154339 - DNA, 25 bp, E. coli
gaaatatggtgagatcgtcatcgac

SEQ ID NO: 154340 - DNA, 25 bp, E. coli
gaaatatggtgacatcgtcatcgac

SEQ ID NO: 154341 - DNA, 25 bp, E. coli
gaaaaggtggtgttcagtcaactga

SEQ ID NO: 154342 - DNA, 25 bp, E. coli
gaaaaggtggtgatcagtcaactga

SEQ ID NO: 154343 - DNA, 25 bp, E. coli
ccgaggcgcagcaggtggtctatta

SEQ ID NO: 154344 - DNA, 25 bp, E. coli
ccgaggcgcagctggtggtctatta

SEQ ID NO: 154345 - DNA, 25 bp, E. coli
gatattcatcaggaaaacgccatct

SEQ ID NO: 154346 - DNA, 25 bp, E. coli
gatattcatcagcaaaacgccatct

SEQ ID NO: 154347 - DNA, 25 bp, E. coli
ggtggtctattacagcctggcgatt

SEQ ID NO: 154348 - DNA, 25 bp, E. coli
ggtggtctattagagcctggcgatt

SEQ ID NO: 154349 - DNA, 25 bp, E. coli
catactaaaaaaacttatgcagcgt

SEQ ID NO: 154350 - DNA, 25 bp, E. coli
ctaaaaaaacttatgcagcgtctgt

SEQ ID NO: 154351 - DNA, 25 bp, E. coli
ctaaaaaaacttttgcagcgtctgt

SEQ ID NO: 154352 - DNA, 25 bp, E. coli
catactaaaaaatcttatgcagcgt

SEQ ID NO: 154353 - DNA, 25 bp, E. coli
tactaaaaaaacatatgcagcgtct

SEQ ID NO: 154354 - DNA, 25 bp, E. coli
tactaaaaaaacttatgcagcgtct

SEQ ID NO: 154355 - DNA, 25 bp, E. coli
taaaaaaacttaagcagcgtctgtg

SEQ ID NO: 154356 - DNA, 25 bp, E. coli
taaaaaaacttatgcagcgtctgtg

SEQ ID NO: 154357 - DNA, 25 bp, E. coli
atactaaaaaaacttatgcagcgtc

SEQ ID NO: 154358 - DNA, 25 bp, E. coli
atgaacatactataaaaacttatgc

SEQ ID NO: 154359 - DNA, 25 bp, E. coli
atgaacatactaaaaaaacttatgc

SEQ ID NO: 154360 - DNA, 25 bp, E. coli
atactaaaaaaagttatgcagcgtc

SEQ ID NO: 154361 - DNA, 25 bp, E. coli
actaaaaaaactaatgcagcgtctg

SEQ ID NO: 154362 - DNA, 25 bp, E. coli
acatactaaaaatacttatgcagcg

SEQ ID NO: 154363 - DNA, 25 bp, E. coli
acatactaaaaaaacttatgcagcg

SEQ ID NO: 154364 - DNA, 25 bp, E. coli
aacatactaaaataacttatgcagc

SEQ ID NO: 154365 - DNA, 25 bp, E. coli
actaaaaaaacttatgcagcgtctg

SEQ ID NO: 154366 - DNA, 25 bp, E. coli
aacatactaaaaaaacttatgcagc

SEQ ID NO: 154367 - DNA, 25 bp, E. coli
tgaacatactaataaaacttatgca

SEQ ID NO: 154368 - DNA, 25 bp, E. coli
tgaacatactaaaaaaacttatgca

SEQ ID NO: 154369 - DNA, 25 bp, E. coli
gaacatactaaaaaaacttatgcag

SEQ ID NO: 154370 - DNA, 25 bp, E. coli
gaacatactaaataaacttatgcag

SEQ ID NO: 154371 - DNA, 25 bp, E. coli
cagagcgttaccttgcccttaaaca

SEQ ID NO: 154372 - DNA, 25 bp, E. coli
cagagcgttaccatgcccttaaaca

SEQ ID NO: 154373 - DNA, 25 bp, E. coli
tatttgattatcgtttgcgcggcat

SEQ ID NO: 154374 - DNA, 25 bp, E. coli
tatttgattatcctttgcgcggcat

SEQ ID NO: 154375 - DNA, 25 bp, E. coli
tatcaattcccaggctgtttcagag

SEQ ID NO: 154376 - DNA, 25 bp, E. coli
tatcaattcccacgctgtttcagag

SEQ ID NO: 154377 - DNA, 25 bp, E. coli
ttactttagtaacctcctgggattc

SEQ ID NO: 154378 - DNA, 25 bp, E. coli
tgggattcattcacttgccgccttc

SEQ ID NO: 154379 - DNA, 25 bp, E. coli
ttactttagtaagctcctgggattc

SEQ ID NO: 154380 - DNA, 25 bp, E. coli
tgggattcattctcttgccgccttc

SEQ ID NO: 154381 - DNA, 25 bp, E. coli
tgccgccttcctgtaaaccgaatta

SEQ ID NO: 154382 - DNA, 25 bp, E. coli
tgccgccttcctctaaaccgaatta

SEQ ID NO: 154383 - DNA, 25 bp, E. coli
tacttcgggttagatgtgctgcggc

SEQ ID NO: 154384 - DNA, 25 bp, E. coli
tacttcgggttacatgtgctgcggc

SEQ ID NO: 154385 - DNA, 25 bp, E. coli
gacaggctcccagaggagaaaaccg

SEQ ID NO: 154386 - DNA, 25 bp, E. coli
gacaggctcccacaggagaaaaccg

SEQ ID NO: 154387 - DNA, 25 bp, E. coli
cgccggatttcattaagagccatta

SEQ ID NO: 154388 - DNA, 25 bp, E. coli
cgatttatcagagggccgacaggct

SEQ ID NO: 154389 - DNA, 25 bp, E. coli
cgatttatcagacggccgacaggct

SEQ ID NO: 154390 - DNA, 25 bp, E. coli
cgccggatttcaataagagccatta

SEQ ID NO: 154391 - DNA, 25 bp, E. coli
ggaatactccttaatacccatctgc

SEQ ID NO: 154392 - DNA, 25 bp, E. coli
ggaatactcctttatacccatctgc

SEQ ID NO: 154393 - DNA, 25 bp, E. coli
aattgccggagtcgcgacgttcagc

SEQ ID NO: 154394 - DNA, 25 bp, E. coli
aattgccggagtggcgacgttcagc

SEQ ID NO: 154395 - DNA, 25 bp, E. coli
acctacgctttaataattgccggag

SEQ ID NO: 154396 - DNA, 25 bp, E. coli
agtggcgacgttgagcacatcttct

SEQ ID NO: 154397 - DNA, 25 bp, E. coli
acctacgctttattaattgccggag

SEQ ID NO: 154398 - DNA, 25 bp, E. coli
agtggcgacgttcagcacatcttct

SEQ ID NO: 154399 - DNA, 25 bp, E. coli
acgctttattaaatgccggagtggc

SEQ ID NO: 154400 - DNA, 25 bp, E. coli
acgctttattaattgccggagtggc

SEQ ID NO: 154401 - DNA, 25 bp, E. coli
tattaattgccgcagtggcgacgtt

SEQ ID NO: 154402 - DNA, 25 bp, E. coli
tattaattgccggagtggcgacgtt

SEQ ID NO: 154403 - DNA, 25 bp, E. coli
ttaattgccggagtggcgacgttca

SEQ ID NO: 154404 - DNA, 25 bp, E. coli
ttaattgccggactggcgacgttca

SEQ ID NO: 154405 - DNA, 25 bp, E. coli
tgccggagtggcgacgttcagcaca

SEQ ID NO: 154406 - DNA, 25 bp, E. coli
tgccggagtggccacgttcagcaca

SEQ ID NO: 154407 - DNA, 25 bp, E. coli
gctttattaattgccggagtggcga

SEQ ID NO: 154408 - DNA, 25 bp, E. coli
gctttattaattcccggagtggcga

SEQ ID NO: 154409 - DNA, 25 bp, E. coli
cggagtggcgacgttcagcacatct

SEQ ID NO: 154410 - DNA, 25 bp, E. coli
cggagtggcgaccttcagcacatct

SEQ ID NO: 154411 - DNA, 25 bp, E. coli
gttctgtaaccttcgctttattaat

SEQ ID NO: 154412 - DNA, 25 bp, E. coli
gttctgtaacctacgctttattaat

SEQ ID NO: 154413 - DNA, 25 bp, E. coli
taacctacgcttaattaattgccgg

SEQ ID NO: 154414 - DNA, 25 bp, E. coli
taacctacgctttattaattgccgg

SEQ ID NO: 154415 - DNA, 25 bp, E. coli
cagacgaatgaagtgctctggcagc

SEQ ID NO: 154416 - DNA, 25 bp, E. coli
cagacgaatgaactgctctggcagc

SEQ ID NO: 154417 - DNA, 25 bp, E. coli
agtaaaggccgcgtcgccagtgaac

SEQ ID NO: 154418 - DNA, 25 bp, E. coli
acccgctatgacgatgaccgttttg

SEQ ID NO: 154419 - DNA, 25 bp, E. coli
agtaaaggccgcctcgccagtgaac

SEQ ID NO: 154420 - DNA, 25 bp, E. coli
acccgctatgaccatgaccgttttg

SEQ ID NO: 154421 - DNA, 25 bp, E. coli
acggtgcatcatgcgcagacgaatg

SEQ ID NO: 154422 - DNA, 25 bp, E. coli
acggtgcatcatccgcagacgaatg

SEQ ID NO: 154423 - DNA, 25 bp, E. coli
aacacctgacggagcatcatccgca

SEQ ID NO: 154424 - DNA, 25 bp, E. coli
aacacctgacggtgcatcatccgca

SEQ ID NO: 154425 - DNA, 25 bp, E. coli
tatggttatgacagtaaaggccgcc

SEQ ID NO: 154426 - DNA, 25 bp, E. coli
tatggttatgactgtaaaggccgcc

SEQ ID NO: 154427 - DNA, 25 bp, E. coli
ttatgacagtaatggccgcctcgcc

SEQ ID NO: 154428 - DNA, 25 bp, E. coli
ttatgacagtaaaggccgcctcgcc

SEQ ID NO: 154429 - DNA, 25 bp, E. coli
tgaccatgaccgatttggtcaggtg

SEQ ID NO: 154430 - DNA, 25 bp, E. coli
tgaccatgaccgttttggtcaggtg

SEQ ID NO: 154431 - DNA, 25 bp, E. coli
tcgccagtgaacacctgacggtgca

SEQ ID NO: 154432 - DNA, 25 bp, E. coli
tcgccagtgaactcctgacggtgca

SEQ ID NO: 154433 - DNA, 25 bp, E. coli
gcagcaatacactggtgcgcagctt

SEQ ID NO: 154434 - DNA, 25 bp, E. coli
gcagcaatacacaggtgcgcagctt

SEQ ID NO: 154435 - DNA, 25 bp, E. coli
ccgggtgacggtgcactatggttat

SEQ ID NO: 154436 - DNA, 25 bp, E. coli
ccgggtgacggtccactatggttat

SEQ ID NO: 154437 - DNA, 25 bp, E. coli
aggatgaagcataatattttctggc

SEQ ID NO: 154438 - DNA, 25 bp, E. coli
aggatgaagcattatattttctggc

SEQ ID NO: 154439 - DNA, 25 bp, E. coli
actttccaggatcaagcattatatt

SEQ ID NO: 154440 - DNA, 25 bp, E. coli
actttccaggatgaagcattatatt

SEQ ID NO: 154441 - DNA, 25 bp, E. coli
tatttatacaattctgctgttgcgg

SEQ ID NO: 154442 - DNA, 25 bp, E. coli
tatttatacaatactgctgttgcgg

SEQ ID NO: 154443 - DNA, 25 bp, E. coli
tattttatcatctgcattggtggaa

SEQ ID NO: 154444 - DNA, 25 bp, E. coli
tattttatcatcagcattggtggaa

SEQ ID NO: 154445 - DNA, 25 bp, E. coli
ccataacgccagataatagtgttgc

SEQ ID NO: 154446 - DNA, 25 bp, E. coli
gccagataatagagttgcaaataaa

SEQ ID NO: 154447 - DNA, 25 bp, E. coli
gccagataatagtgttgcaaataaa

SEQ ID NO: 154448 - DNA, 25 bp, E. coli
ccataacgccagttaatagtgttgc

SEQ ID NO: 154449 - DNA, 25 bp, E. coli
gaattattatcatttcgcatcgatg

SEQ ID NO: 154450 - DNA, 25 bp, E. coli
gaattattatcaattcgcatcgatg

SEQ ID NO: 154451 - DNA, 25 bp, E. coli
gaactgtcggtgttgctgatactga

SEQ ID NO: 154452 - DNA, 25 bp, E. coli
gaactgtcggtgatgctgatactga

SEQ ID NO: 154453 - DNA, 25 bp, E. coli
ctgctgttgcggatgaattattatc

SEQ ID NO: 154454 - DNA, 25 bp, E. coli
cattggtggaaaatgccataacgcc

SEQ ID NO: 154455 - DNA, 25 bp, E. coli
cattggtggaaattgccataacgcc

SEQ ID NO: 154456 - DNA, 25 bp, E. coli
ctgctgttgcggttgaattattatc

SEQ ID NO: 154457 - DNA, 25 bp, E. coli
gagacgctgatatgtttcagaatta

SEQ ID NO: 154458 - DNA, 25 bp, E. coli
gagacgctgataagtttcagaatta

SEQ ID NO: 154459 - DNA, 25 bp, E. coli
caacaggcagtcatcgaagaggcgt

SEQ ID NO: 154460 - DNA, 25 bp, E. coli
caacccggcgctgaaacttgaagag

SEQ ID NO: 154461 - DNA, 25 bp, E. coli
cactggcgcactatgggtcaaacga

SEQ ID NO: 154462 - DNA, 25 bp, E. coli
caacaggcagtcttcgaagaggcgt

SEQ ID NO: 154463 - DNA, 25 bp, E. coli
caacccggcgctcaaacttgaagag

SEQ ID NO: 154464 - DNA, 25 bp, E. coli
cactggcgcactttgggtcaaacga

SEQ ID NO: 154465 - DNA, 25 bp, E. coli
taaaaggtctgctatctctgatggg

SEQ ID NO: 154466 - DNA, 25 bp, E. coli
taacatgggccaactggataccgcg

SEQ ID NO: 154467 - DNA, 25 bp, E. coli
taaaaggtctgcaatctctgatggg

SEQ ID NO: 154468 - DNA, 25 bp, E. coli
tatcggtacggtgttagacaacgcc

SEQ ID NO: 154469 - DNA, 25 bp, E. coli
tatcggtacggtcttagacaacgcc

SEQ ID NO: 154470 - DNA, 25 bp, E. coli
ccatcgacgacaggcaggtaggtta

SEQ ID NO: 154471 - DNA, 25 bp, E. coli
gccattaaaccgagaaaccgccgag

SEQ ID NO: 154472 - DNA, 25 bp, E. coli
gccattaaaccgtgaaaccgccgag

SEQ ID NO: 154473 - DNA, 25 bp, E. coli
ccatcgacgacacgcaggtaggtta

SEQ ID NO: 154474 - DNA, 25 bp, E. coli
gaaaaccgttctggcagtcagtcgc

SEQ ID NO: 154475 - DNA, 25 bp, E. coli
gaaaaccgttctcgcagtcagtcgc

SEQ ID NO: 154476 - DNA, 25 bp, E. coli
cattgaacgtgagagaagtcgcgca

SEQ ID NO: 154477 - DNA, 25 bp, E. coli
cattgaacgtgacagaagtcgcgca

SEQ ID NO: 154478 - DNA, 25 bp, E. coli
taacatgggccatctggataccgcg

SEQ ID NO: 154479 - DNA, 25 bp, E. coli
gatgtaccagcactcaacggcgttt

SEQ ID NO: 154480 - DNA, 25 bp, E. coli
gatgtaccagcagtcaacggcgttt

SEQ ID NO: 154481 - DNA, 25 bp, E. coli
acggccggtgccacgatggtgttat

SEQ ID NO: 154482 - DNA, 25 bp, E. coli
acggccggtgcctcgatggtgttat

SEQ ID NO: 154483 - DNA, 25 bp, E. coli
cttcacggccggtgcctcgatggtg

SEQ ID NO: 154484 - DNA, 25 bp, E. coli
cttcacggccggagcctcgatggtg

SEQ ID NO: 154485 - DNA, 25 bp, E. coli
ttatggggtacagccctgagtgccg

SEQ ID NO: 154486 - DNA, 25 bp, E. coli
ttatggggtacacccctgagtgccg

SEQ ID NO: 154487 - DNA, 25 bp, E. coli
ttcacggccggtgcctcgatggtgt

SEQ ID NO: 154488 - DNA, 25 bp, E. coli
ttcacggccggtccctcgatggtgt

SEQ ID NO: 154489 - DNA, 25 bp, E. coli
tcgatggtgttaaggggtacagccc

SEQ ID NO: 154490 - DNA, 25 bp, E. coli
tcgatggtgttatggggtacagccc

SEQ ID NO: 154491 - DNA, 25 bp, E. coli
tcttcacggccggtgcctcgatggt

SEQ ID NO: 154492 - DNA, 25 bp, E. coli
tcttcacggccgctgcctcgatggt

SEQ ID NO: 154493 - DNA, 25 bp, E. coli
cctcgatggtgtaatggggtacagc

SEQ ID NO: 154494 - DNA, 25 bp, E. coli
gccggtgcctcgatggtgttatggg

SEQ ID NO: 154495 - DNA, 25 bp, E. coli
gccggtgcctcgttggtgttatggg

SEQ ID NO: 154496 - DNA, 25 bp, E. coli
cctcgatggtgttatggggtacagc

SEQ ID NO: 154497 - DNA, 25 bp, E. coli
cgatggtgttatcgggtacagccct

SEQ ID NO: 154498 - DNA, 25 bp, E. coli
cgatggtgttatggggtacagccct

SEQ ID NO: 154499 - DNA, 25 bp, E. coli
cggccggtgcctcgatggtgttatg

SEQ ID NO: 154500 - DNA, 25 bp, E. coli
cggccggtgcctggatggtgttatg

SEQ ID NO: 154501 - DNA, 25 bp, E. coli
gttatggggtacagccctgagtgcc

SEQ ID NO: 154502 - DNA, 25 bp, E. coli
gttatggggtactgccctgagtgcc

SEQ ID NO: 154503 - DNA, 25 bp, E. coli
aacctcggcgatgaacctccagttg

SEQ ID NO: 154504 - DNA, 25 bp, E. coli
catgactgccttgcaaaccttgaag

SEQ ID NO: 154505 - DNA, 25 bp, E. coli
catgactgccttccaaaccttgaag

SEQ ID NO: 154506 - DNA, 25 bp, E. coli
aacctcggcgatcaacctccagttg

SEQ ID NO: 154507 - DNA, 25 bp, E. coli
aaatggcggaagacaggtaatcgac

SEQ ID NO: 154508 - DNA, 25 bp, E. coli
aaatggcggaagtcaggtaatcgac

SEQ ID NO: 154509 - DNA, 25 bp, E. coli
tatgcaggatctacagaaatggcgg

SEQ ID NO: 154510 - DNA, 25 bp, E. coli
tatgcaggatcttcagaaatggcgg

SEQ ID NO: 154511 - DNA, 25 bp, E. coli
tattccgttgttatgtcaatgcgac

SEQ ID NO: 154512 - DNA, 25 bp, E. coli
tattccgttgttttgtcaatgcgac

SEQ ID NO: 154513 - DNA, 25 bp, E. coli
ccaaaagacatgttatcgcacagct

SEQ ID NO: 154514 - DNA, 25 bp, E. coli
ccttgaagaaagcaatcatggctgg

SEQ ID NO: 154515 - DNA, 25 bp, E. coli
ccttgaagaaaggaatcatggctgg

SEQ ID NO: 154516 - DNA, 25 bp, E. coli
ccaaaagacatgatatcgcacagct

SEQ ID NO: 154517 - DNA, 25 bp, E. coli
gatcgacgaataactggatgacacc

SEQ ID NO: 154518 - DNA, 25 bp, E. coli
gatcgacgaatatctggatgacacc

SEQ ID NO: 154519 - DNA, 25 bp, E. coli
gattgagcatatagcgaccttcgca

SEQ ID NO: 154520 - DNA, 25 bp, E. coli
gattgagcatattgcgaccttcgca

SEQ ID NO: 154521 - DNA, 25 bp, E. coli
tcaatgcgacgaaagagaatcctgc

SEQ ID NO: 154522 - DNA, 25 bp, E. coli
taagctcattgagcagatcgacgaa

SEQ ID NO: 154523 - DNA, 25 bp, E. coli
taagctcattgaccagatcgacgaa

SEQ ID NO: 154524 - DNA, 25 bp, E. coli
tcaatgcgacgatagagaatcctgc

SEQ ID NO: 154525 - DNA, 25 bp, E. coli
aagttcatgcaacaagccgtaccgg

SEQ ID NO: 154526 - DNA, 25 bp, E. coli
aagttcatgcaagaagccgtaccgg

SEQ ID NO: 154527 - DNA, 25 bp, E. coli
caaagtgcttactggcctgacgaaa

SEQ ID NO: 154528 - DNA, 25 bp, E. coli
caaagtgcttacaggcctgacgaaa

SEQ ID NO: 154529 - DNA, 25 bp, E. coli
tataacccggttgagtggacgaagt

SEQ ID NO: 154530 - DNA, 25 bp, E. coli
tacatggcagcggaaggcgtagaac

SEQ ID NO: 154531 - DNA, 25 bp, E. coli
tacatggcagcgcaaggcgtagaac

SEQ ID NO: 154532 - DNA, 25 bp, E. coli
tataacccggttcagtggacgaagt

SEQ ID NO: 154533 - DNA, 25 bp, E. coli
aacatctctatgtagtcggcccggg

SEQ ID NO: 154534 - DNA, 25 bp, E. coli
aacatctctatgaagtcggcccggg

SEQ ID NO: 154535 - DNA, 25 bp, E. coli
tatggcggcgagctatccaattgtc

SEQ ID NO: 154536 - DNA, 25 bp, E. coli
tatggcggcgaggtatccaattgtc

SEQ ID NO: 154537 - DNA, 25 bp, E. coli
tctcaaaccgttcgaatgctggctg

SEQ ID NO: 154538 - DNA, 25 bp, E. coli
tctcactgtgcgctgatgaaaccag

SEQ ID NO: 154539 - DNA, 25 bp, E. coli
tctcaaaccgttggaatgctggctg

SEQ ID NO: 154540 - DNA, 25 bp, E. coli
tctcactgtgcggtgatgaaaccag

SEQ ID NO: 154541 - DNA, 25 bp, E. coli
gctgaagaactgtataaaacctggc

SEQ ID NO: 154542 - DNA, 25 bp, E. coli
gctgaagaactgaataaaacctggc

SEQ ID NO: 154543 - DNA, 25 bp, E. coli
gatgtgaaatgcgaaaccaatggtg

SEQ ID NO: 154544 - DNA, 25 bp, E. coli
gacgaaacgcatagtcgacaccctg

SEQ ID NO: 154545 - DNA, 25 bp, E. coli
gatgtgaaatgccaaaccaatggtg

SEQ ID NO: 154546 - DNA, 25 bp, E. coli
gacgaaacgcattgtcgacaccctg

SEQ ID NO: 154547 - DNA, 25 bp, E. coli
taaaggcgctggcacaagcgatgca

SEQ ID NO: 154548 - DNA, 25 bp, E. coli
taaaggcgctgggacaagcgatgca

SEQ ID NO: 154549 - DNA, 25 bp, E. coli
tatcgataccgctgaagtgctggaa

SEQ ID NO: 154550 - DNA, 25 bp, E. coli
tatcgataccgcagaagtgctggaa

SEQ ID NO: 154551 - DNA, 25 bp, E. coli
tgttagctatttgacgcagcggtgc

SEQ ID NO: 154552 - DNA, 25 bp, E. coli
tgttagctatttcacgcagcggtgc

SEQ ID NO: 154553 - DNA, 25 bp, E. coli
tgcatcaggccgcaaaaccgcttgg

SEQ ID NO: 154554 - DNA, 25 bp, E. coli
tgcatcaggccggaaaaccgcttgg

SEQ ID NO: 154555 - DNA, 25 bp, E. coli
gctttgcaccggttaagcagcaggt

SEQ ID NO: 154556 - DNA, 25 bp, E. coli
gctttgcaccggataagcagcaggt

SEQ ID NO: 154557 - DNA, 25 bp, E. coli
gcagaacattgctgaagcggcgagc

SEQ ID NO: 154558 - DNA, 25 bp, E. coli
gaataacgcgcgctgaaatccgtcc

SEQ ID NO: 154559 - DNA, 25 bp, E. coli
gcagaacattgcagaagcggcgagc

SEQ ID NO: 154560 - DNA, 25 bp, E. coli
gaataacgcgcggtgaaatccgtcc

SEQ ID NO: 154561 - DNA, 25 bp, E. coli
cgatgacggaaaggcgcaatgtgct

SEQ ID NO: 154562 - DNA, 25 bp, E. coli
cgatgacggaaacgcgcaatgtgct

SEQ ID NO: 154563 - DNA, 25 bp, E. coli
gattgaagcggcacgaataacgcgc

SEQ ID NO: 154564 - DNA, 25 bp, E. coli
gataagctggttacccgcgtgctgg

SEQ ID NO: 154565 - DNA, 25 bp, E. coli
gattgaagcggctcgaataacgcgc

SEQ ID NO: 154566 - DNA, 25 bp, E. coli
gataagctggtttcccgcgtgctgg

SEQ ID NO: 154567 - DNA, 25 bp, E. coli
taattctgagcgcatgcggcgtcta

SEQ ID NO: 154568 - DNA, 25 bp, E. coli
taattctgagcggatgcggcgtcta

SEQ ID NO: 154569 - DNA, 25 bp, E. coli
aatgcgccccgatcaggatgacagg

SEQ ID NO: 154570 - DNA, 25 bp, E. coli
aatgcgccccgaacaggatgacagg

SEQ ID NO: 154571 - DNA, 25 bp, E. coli
cagggcgtaaaaacgtgggacacat

SEQ ID NO: 154572 - DNA, 25 bp, E. coli
cagggcgtaaaatcgtgggacacat

SEQ ID NO: 154573 - DNA, 25 bp, E. coli
ttctgttagaatccgccccgaacag

SEQ ID NO: 154574 - DNA, 25 bp, E. coli
ttctgttagaatgcgccccgaacag

SEQ ID NO: 154575 - DNA, 25 bp, E. coli
ttttctgttagattgcgccccgaac

SEQ ID NO: 154576 - DNA, 25 bp, E. coli
ttttctgttagaatgcgccccgaac

SEQ ID NO: 154577 - DNA, 25 bp, E. coli
tgatgcgcgggatggaaatccctac

SEQ ID NO: 154578 - DNA, 25 bp, E. coli
tgatgcgcgggaaggaaatccctac

SEQ ID NO: 154579 - DNA, 25 bp, E. coli
tctttttctgttagaatgcgccccg

SEQ ID NO: 154580 - DNA, 25 bp, E. coli
tcaggcctacgcaggggtagaaccg

SEQ ID NO: 154581 - DNA, 25 bp, E. coli
tctttttctgtttgaatgcgccccg

SEQ ID NO: 154582 - DNA, 25 bp, E. coli
tcaggcctacgctggggtagaaccg

SEQ ID NO: 154583 - DNA, 25 bp, E. coli
ccatttttattgttgcgcgggaagg

SEQ ID NO: 154584 - DNA, 25 bp, E. coli
ccatttttattgatgcgcgggaagg

SEQ ID NO: 154585 - DNA, 25 bp, E. coli
gacagggcgtaatatcgtgggacac

SEQ ID NO: 154586 - DNA, 25 bp, E. coli
gacagggcgtaaaatcgtgggacac

SEQ ID NO: 154587 - DNA, 25 bp, E. coli
ccgaacaggatgtcagggcgtaaaa

SEQ ID NO: 154588 - DNA, 25 bp, E. coli
ccgaacaggatgacagggcgtaaaa

SEQ ID NO: 154589 - DNA, 25 bp, E. coli
gcgcgggaaggaaatccctacgcaa

SEQ ID NO: 154590 - DNA, 25 bp, E. coli
gcgcgggaaggatatccctacgcaa

SEQ ID NO: 154591 - DNA, 25 bp, E. coli
acatcggtttgaggccgacggtcga

SEQ ID NO: 154592 - DNA, 25 bp, E. coli
acatcggtttgacgccgacggtcga

SEQ ID NO: 154593 - DNA, 25 bp, E. coli
actggagccgcacatcggtttgacg

SEQ ID NO: 154594 - DNA, 25 bp, E. coli
actggagccgcagatcggtttgacg

SEQ ID NO: 154595 - DNA, 25 bp, E. coli
ttgacgccgacggtcgaagcgatga

SEQ ID NO: 154596 - DNA, 25 bp, E. coli
ttgacgccgacgctcgaagcgatga

SEQ ID NO: 154597 - DNA, 25 bp, E. coli
tgacgccgacggtcgaagcgatgat

SEQ ID NO: 154598 - DNA, 25 bp, E. coli
tgacgccgacggacgaagcgatgat

SEQ ID NO: 154599 - DNA, 25 bp, E. coli
gcgaatcaggcgaggaagctatccc

SEQ ID NO: 154600 - DNA, 25 bp, E. coli
gcgaatcaggcgtggaagctatccc

SEQ ID NO: 154601 - DNA, 25 bp, E. coli
cgaatcaggcgtcgaagctatccca

SEQ ID NO: 154602 - DNA, 25 bp, E. coli
cgcacatcggtttgacgccgacggt

SEQ ID NO: 154603 - DNA, 25 bp, E. coli
cgaatcaggcgtggaagctatccca

SEQ ID NO: 154604 - DNA, 25 bp, E. coli
cgcacatcggttagacgccgacggt

SEQ ID NO: 154605 - DNA, 25 bp, E. coli
ctgcgcgaatcaggcgtggaagcta

SEQ ID NO: 154606 - DNA, 25 bp, E. coli
ctgcgcgaatcacgcgtggaagcta

SEQ ID NO: 154607 - DNA, 25 bp, E. coli
ggaatcactggagccgcacatcggt

SEQ ID NO: 154608 - DNA, 25 bp, E. coli
ggaatcactggacccgcacatcggt

SEQ ID NO: 154609 - DNA, 25 bp, E. coli
tggagccgcacaacggtttgacgcc

SEQ ID NO: 154610 - DNA, 25 bp, E. coli
tggagccgcacatcggtttgacgcc

SEQ ID NO: 154611 - DNA, 25 bp, E. coli
tcactggagccggacatcggtttga

SEQ ID NO: 154612 - DNA, 25 bp, E. coli
tcactggagccgcacatcggtttga

SEQ ID NO: 154613 - DNA, 25 bp, E. coli
cagtagtctggctggtcgccgctgc

SEQ ID NO: 154614 - DNA, 25 bp, E. coli
cagtagtctggcaggtcgccgctgc

SEQ ID NO: 154615 - DNA, 25 bp, E. coli
agtagtctggcaggtcgccgctgct

SEQ ID NO: 154616 - DNA, 25 bp, E. coli
agtagtctggcacgtcgccgctgct

SEQ ID NO: 154617 - DNA, 25 bp, E. coli
tagtctggcaggtcgccgctgctac

SEQ ID NO: 154618 - DNA, 25 bp, E. coli
tagtctggcaggacgccgctgctac

SEQ ID NO: 154619 - DNA, 25 bp, E. coli
tcgacgaacgttcccggtagtgatg

SEQ ID NO: 154620 - DNA, 25 bp, E. coli
tcgccgctgctacgccagcgagtgc

SEQ ID NO: 154621 - DNA, 25 bp, E. coli
tcgacgaacgttgccggtagtgatg

SEQ ID NO: 154622 - DNA, 25 bp, E. coli
tgcctcgacgaaggttcccggtagt

SEQ ID NO: 154623 - DNA, 25 bp, E. coli
tgcctcgacgaacgttcccggtagt

SEQ ID NO: 154624 - DNA, 25 bp, E. coli
tcgccgctgctaggccagcgagtgc

SEQ ID NO: 154625 - DNA, 25 bp, E. coli
gcctcgacgaacgttcccggtagtg

SEQ ID NO: 154626 - DNA, 25 bp, E. coli
cgacgaacgttcccggtagtgatga

SEQ ID NO: 154627 - DNA, 25 bp, E. coli
cgacgaacgttcgcggtagtgatga

SEQ ID NO: 154628 - DNA, 25 bp, E. coli
gcctcgacgaaccttcccggtagtg

SEQ ID NO: 154629 - DNA, 25 bp, E. coli
gtagtctggcaggtcgccgctgcta

SEQ ID NO: 154630 - DNA, 25 bp, E. coli
gtcgccgctgcttcgccagcgagtg

SEQ ID NO: 154631 - DNA, 25 bp, E. coli
gtcgccgctgctacgccagcgagtg

SEQ ID NO: 154632 - DNA, 25 bp, E. coli
ggtcgccgctgctacgccagcgagt

SEQ ID NO: 154633 - DNA, 25 bp, E. coli
ggtcgccgctgcaacgccagcgagt

SEQ ID NO: 154634 - DNA, 25 bp, E. coli
gtagtctggcagctcgccgctgcta

SEQ ID NO: 154635 - DNA, 25 bp, E. coli
aagtgattacgcgtgaaactaccgc

SEQ ID NO: 154636 - DNA, 25 bp, E. coli
aagtgattacgcctgaaactaccgc

SEQ ID NO: 154637 - DNA, 25 bp, E. coli
taaatacctgcaagagcaacgcatc

SEQ ID NO: 154638 - DNA, 25 bp, E. coli
taaatacctgcatgagcaacgcatc

SEQ ID NO: 154639 - DNA, 25 bp, E. coli
agcctacctggcgttctgcaaagcg

SEQ ID NO: 154640 - DNA, 25 bp, E. coli
agcctacctggccttctgcaaagcg

SEQ ID NO: 154641 - DNA, 25 bp, E. coli
tgaaacggcgtattatcgacggcgt

SEQ ID NO: 154642 - DNA, 25 bp, E. coli
tgaaacggcgtaatatcgacggcgt

SEQ ID NO: 154643 - DNA, 25 bp, E. coli
tgatgcaacggctgtatgaccaggg

SEQ ID NO: 154644 - DNA, 25 bp, E. coli
tgatgcaacggcagtatgaccaggg

SEQ ID NO: 154645 - DNA, 25 bp, E. coli
tgctgccagcgtactatgaacaagg

SEQ ID NO: 154646 - DNA, 25 bp, E. coli
tgctgccagcgttctatgaacaagg

SEQ ID NO: 154647 - DNA, 25 bp, E. coli
tctgctggcgcgagacgcaaaaggc

SEQ ID NO: 154648 - DNA, 25 bp, E. coli
tctgctggcgcgtgacgcaaaaggc

SEQ ID NO: 154649 - DNA, 25 bp, E. coli
gcatcgacacctagcaactggcgag

SEQ ID NO: 154650 - DNA, 25 bp, E. coli
gcatcgacaccttgcaactggcgag

SEQ ID NO: 154651 - DNA, 25 bp, E. coli
gcaaagcgcatatactgcatcccgt

SEQ ID NO: 154652 - DNA, 25 bp, E. coli
gcaaagcgcataaactgcatcccgt

SEQ ID NO: 154653 - DNA, 25 bp, E. coli
gaagaaatgttaccccactggcagt

SEQ ID NO: 154654 - DNA, 25 bp, E. coli
gaagaaatgttagcccactggcagt

SEQ ID NO: 154655 - DNA, 25 bp, E. coli
gattcgttgtcagaaaatctcgccg

SEQ ID NO: 154656 - DNA, 25 bp, E. coli
gattcgttgtcacaaaatctcgccg

SEQ ID NO: 154657 - DNA, 25 bp, E. coli
caaagatgatccctcaatggtggcc

SEQ ID NO: 154658 - DNA, 25 bp, E. coli
caaagatgatccgtcaatggtggcc

SEQ ID NO: 154659 - DNA, 25 bp, E. coli
cagacaattgtagatacgcgcaacg

SEQ ID NO: 154660 - DNA, 25 bp, E. coli
cagacaattgtacatacgcgcaacg

SEQ ID NO: 154661 - DNA, 25 bp, E. coli
ttaaacaactggacaaacaagcgtg

SEQ ID NO: 154662 - DNA, 25 bp, E. coli
ttaaacaactggtcaaacaagcgtg

SEQ ID NO: 154663 - DNA, 25 bp, E. coli
tgtcggcagcgtacaatgcacaagc

SEQ ID NO: 154664 - DNA, 25 bp, E. coli
tgtcggcagcgttcaatgcacaagc

SEQ ID NO: 154665 - DNA, 25 bp, E. coli
tgcacaagctgaaacctggttcgat

SEQ ID NO: 154666 - DNA, 25 bp, E. coli
tgacgactgaaaccctggatgcaat

SEQ ID NO: 154667 - DNA, 25 bp, E. coli
tgcacaagctgatacctggttcgat

SEQ ID NO: 154668 - DNA, 25 bp, E. coli
tgaagggatcaacgcgctattactg

SEQ ID NO: 154669 - DNA, 25 bp, E. coli
tgaagggatcaaggcgctattactg

SEQ ID NO: 154670 - DNA, 25 bp, E. coli
tgacgactgaaagcctggatgcaat

SEQ ID NO: 154671 - DNA, 25 bp, E. coli
cctgttaagctcaggtggagtgcca

SEQ ID NO: 154672 - DNA, 25 bp, E. coli
cctgttaagctctggtggagtgcca

SEQ ID NO: 154673 - DNA, 25 bp, E. coli
ggattgccgcctctttgacgactga

SEQ ID NO: 154674 - DNA, 25 bp, E. coli
ggattgccgcctgtttgacgactga

SEQ ID NO: 154675 - DNA, 25 bp, E. coli
taacagtattcatagcagcgcagac

SEQ ID NO: 154676 - DNA, 25 bp, E. coli
taacagtattcaaagcagcgcagac

SEQ ID NO: 154677 - DNA, 25 bp, E. coli
gagattattccgcatgccagcgtaa

SEQ ID NO: 154678 - DNA, 25 bp, E. coli
gagattattccggatgccagcgtaa

SEQ ID NO: 154679 - DNA, 25 bp, E. coli
tacgatctgctttcagcagggcccg

SEQ ID NO: 154680 - DNA, 25 bp, E. coli
caaggaaggttatatcaagcgtctg

SEQ ID NO: 154681 - DNA, 25 bp, E. coli
aaatgggaaccgaggacgacatcac

SEQ ID NO: 154682 - DNA, 25 bp, E. coli
aaatgggaaccgtggacgacatcac

SEQ ID NO: 154683 - DNA, 25 bp, E. coli
caaggaaggttaaatcaagcgtctg

SEQ ID NO: 154684 - DNA, 25 bp, E. coli
tatgtcctcgttaatcctggtgaac

SEQ ID NO: 154685 - DNA, 25 bp, E. coli
tatgtcctcgtttatcctggtgaac

SEQ ID NO: 154686 - DNA, 25 bp, E. coli
tacgatctgcttacagcagggcccg

SEQ ID NO: 154687 - DNA, 25 bp, E. coli
tatatcaagcgtgtgcctgccgatc

SEQ ID NO: 154688 - DNA, 25 bp, E. coli
tatatcaagcgtctgcctgccgatc

SEQ ID NO: 154689 - DNA, 25 bp, E. coli
tgggcaataaagtaaaggcggataa

SEQ ID NO: 154690 - DNA, 25 bp, E. coli
tgggcaataaagaaaaggcggataa

SEQ ID NO: 154691 - DNA, 25 bp, E. coli
cctggtgaacatcgtgcatacgatc

SEQ ID NO: 154692 - DNA, 25 bp, E. coli
cctggtgaacatggtgcatacgatc

SEQ ID NO: 154693 - DNA, 25 bp, E. coli
gcgcaacggatatgcaacgcggttt

SEQ ID NO: 154694 - DNA, 25 bp, E. coli
gcgcaacggataagcaacgcggttt

SEQ ID NO: 154695 - DNA, 25 bp, E. coli
cgctggccgcaatctataacaagga

SEQ ID NO: 154696 - DNA, 25 bp, E. coli
cgctggccgcaaactataacaagga

SEQ ID NO: 154697 - DNA, 25 bp, E. coli
gatatgtacaaagtcgacaatcatc

SEQ ID NO: 154698 - DNA, 25 bp, E. coli
gatatgtacaaactcgacaatcatc

SEQ ID NO: 154699 - DNA, 25 bp, E. coli
ggataagcaaaaagccgtcagcgat

SEQ ID NO: 154700 - DNA, 25 bp, E. coli
ggataagcaaaatgccgtcagcgat

SEQ ID NO: 154701 - DNA, 25 bp, E. coli
catcaggtcattaccgacgggacgc

SEQ ID NO: 154702 - DNA, 25 bp, E. coli
catcaggtcatttccgacgggacgc

SEQ ID NO: 154703 - DNA, 25 bp, E. coli
taaaccgggcgaatacgacctggtg

SEQ ID NO: 154704 - DNA, 25 bp, E. coli
taaaccgggcgattacgacctggtg

SEQ ID NO: 154705 - DNA, 25 bp, E. coli
tattcagttgcctgatatgaccggg

SEQ ID NO: 154706 - DNA, 25 bp, E. coli
tattcagttgccagatatgaccggg

SEQ ID NO: 154707 - DNA, 25 bp, E. coli
tgtggaacctcaacagtaacgccgt

SEQ ID NO: 154708 - DNA, 25 bp, E. coli
tgtaggaccgaagctgatcaccgac

SEQ ID NO: 154709 - DNA, 25 bp, E. coli
tgtggaacctcatcagtaacgccgt

SEQ ID NO: 154710 - DNA, 25 bp, E. coli
tgtaggaccgaacctgatcaccgac

SEQ ID NO: 154711 - DNA, 25 bp, E. coli
gaagcaaattcgactgctggcgcag

SEQ ID NO: 154712 - DNA, 25 bp, E. coli
gaagcaaattcgtctgctggcgcag

SEQ ID NO: 154713 - DNA, 25 bp, E. coli
gacgatatgcctttaccggcgctga

SEQ ID NO: 154714 - DNA, 25 bp, E. coli
gacgatatgcctataccggcgctga

SEQ ID NO: 154715 - DNA, 25 bp, E. coli
tggaaaatctctgcgcattgcaggc

SEQ ID NO: 154716 - DNA, 25 bp, E. coli
tggaaaatctctccgcattgcaggc

SEQ ID NO: 154717 - DNA, 25 bp, E. coli
tatgggcggcgaaattacggttacc

SEQ ID NO: 154718 - DNA, 25 bp, E. coli
taaccgctaacgagctgaaagacaa

SEQ ID NO: 154719 - DNA, 25 bp, E. coli
tatgggcggcgatattacggttacc

SEQ ID NO: 154720 - DNA, 25 bp, E. coli
taaccgctaacgtgctgaaagacaa

SEQ ID NO: 154721 - DNA, 25 bp, E. coli
gagttttccggctgtaaccgcgcga

SEQ ID NO: 154722 - DNA, 25 bp, E. coli
gagttttccggcagtaaccgcgcga

SEQ ID NO: 154723 - DNA, 25 bp, E. coli
aagttctgccgtatcaccgcggaag

SEQ ID NO: 154724 - DNA, 25 bp, E. coli
aagttctgccgtttcaccgcggaag

SEQ ID NO: 154725 - DNA, 25 bp, E. coli
caccgaaagcggaaagattgtccca

SEQ ID NO: 154726 - DNA, 25 bp, E. coli
caccgaaagcggtaagattgtccca

SEQ ID NO: 154727 - DNA, 25 bp, E. coli
agctggctcgcgctatcaaacgcgc

SEQ ID NO: 154728 - DNA, 25 bp, E. coli
agattgtcccaagccgtatcaccgg

SEQ ID NO: 154729 - DNA, 25 bp, E. coli
agctggctcgcggtatcaaacgcgc

SEQ ID NO: 154730 - DNA, 25 bp, E. coli
agattgtcccaacccgtatcaccgg

SEQ ID NO: 154731 - DNA, 25 bp, E. coli
tatttccgtcgtggcaagttctgcc

SEQ ID NO: 154732 - DNA, 25 bp, E. coli
tatttccgtcgtcgcaagttctgcc

SEQ ID NO: 154733 - DNA, 25 bp, E. coli
tgctgccgtacactgatcgccatca

SEQ ID NO: 154734 - DNA, 25 bp, E. coli
tgctgccgtacagtgatcgccatca

SEQ ID NO: 154735 - DNA, 25 bp, E. coli
ccgtgcaaaatagcagcgtcagctg

SEQ ID NO: 154736 - DNA, 25 bp, E. coli
ccgtgcaaaataccagcgtcagctg

SEQ ID NO: 154737 - DNA, 25 bp, E. coli
gaaaaactacatgaccgaaagcggt

SEQ ID NO: 154738 - DNA, 25 bp, E. coli
gaaaaactacatcaccgaaagcggt

SEQ ID NO: 154739 - DNA, 25 bp, E. coli
cgcggaaggcgtacaagagatcgac

SEQ ID NO: 154740 - DNA, 25 bp, E. coli
cgcggaaggcgttcaagagatcgac

SEQ ID NO: 154741 - DNA, 25 bp, E. coli
cgtatcaccggtacccgtgcaaaat

SEQ ID NO: 154742 - DNA, 25 bp, E. coli
cgtatcaccggttcccgtgcaaaat

SEQ ID NO: 154743 - DNA, 25 bp, E. coli
gatatcgctacgctgaaaaactaca

SEQ ID NO: 154744 - DNA, 25 bp, E. coli
gatatcgctacggtgaaaaactaca

SEQ ID NO: 154745 - DNA, 25 bp, E. coli
caatgaaagtataaatttgtcagga

SEQ ID NO: 154746 - DNA, 25 bp, E. coli
caatgaaagtattaatttgtcagga

SEQ ID NO: 154747 - DNA, 25 bp, E. coli
cagccatttttcagttatccacgcg

SEQ ID NO: 154748 - DNA, 25 bp, E. coli
cacaattttaatttcggacagcaag

SEQ ID NO: 154749 - DNA, 25 bp, E. coli
cacaattttaatatcggacagcaag

SEQ ID NO: 154750 - DNA, 25 bp, E. coli
cagccatttttctgttatccacgcg

SEQ ID NO: 154751 - DNA, 25 bp, E. coli
taaagaatttagaatgggaagtccg

SEQ ID NO: 154752 - DNA, 25 bp, E. coli
taaagaatttagtatgggaagtccg

SEQ ID NO: 154753 - DNA, 25 bp, E. coli
tattgaatcaggtaaaaacattcac

SEQ ID NO: 154754 - DNA, 25 bp, E. coli
tattgaatcaggaaaaaacattcac

SEQ ID NO: 154755 - DNA, 25 bp, E. coli
tcgtgcagccattgcacccagcgag

SEQ ID NO: 154756 - DNA, 25 bp, E. coli
tcgtgcagccatagcacccagcgag

SEQ ID NO: 154757 - DNA, 25 bp, E. coli
gcctgggcgggctatcagccatttt

SEQ ID NO: 154758 - DNA, 25 bp, E. coli
gcctgggcgggcaatcagccatttt

SEQ ID NO: 154759 - DNA, 25 bp, E. coli
ggaaagaccggtgccaggcgataat

SEQ ID NO: 154760 - DNA, 25 bp, E. coli
ggtgccaggcgataatgaagcatta

SEQ ID NO: 154761 - DNA, 25 bp, E. coli
ggtgccaggcgaaaatgaagcatta

SEQ ID NO: 154762 - DNA, 25 bp, E. coli
ggaaagaccggtcccaggcgataat

SEQ ID NO: 154763 - DNA, 25 bp, E. coli
taattccgtataattcttgtcagca

SEQ ID NO: 154764 - DNA, 25 bp, E. coli
taatatcggacaccaagttgcggta

SEQ ID NO: 154765 - DNA, 25 bp, E. coli
taatatcggacagcaagttgcggta

SEQ ID NO: 154766 - DNA, 25 bp, E. coli
taattccgtatatttcttgtcagca

SEQ ID NO: 154767 - DNA, 25 bp, E. coli
tacgcccgtgctccatggttcttgc

SEQ ID NO: 154768 - DNA, 25 bp, E. coli
tacgcccgtgctgcatggttcttgc

SEQ ID NO: 154769 - DNA, 25 bp, E. coli
ttggtaacaacgacaccgtgggcgc

SEQ ID NO: 154770 - DNA, 25 bp, E. coli
tttactatccatgacggttacgccg

SEQ ID NO: 154771 - DNA, 25 bp, E. coli
ttggtaacaacgtcaccgtgggcgc

SEQ ID NO: 154772 - DNA, 25 bp, E. coli
tttactatccatcacggttacgccg

SEQ ID NO: 154773 - DNA, 25 bp, E. coli
tgtccacacattcgcaacggcgtcg

SEQ ID NO: 154774 - DNA, 25 bp, E. coli
tgtccacacattggcaacggcgtcg

SEQ ID NO: 154775 - DNA, 25 bp, E. coli
gccaacagctggtgtttacgcccgt

SEQ ID NO: 154776 - DNA, 25 bp, E. coli
gccaacagctggagtttacgcccgt

SEQ ID NO: 154777 - DNA, 25 bp, E. coli
gcgtcgaactcggtgccaacgtcat

SEQ ID NO: 154778 - DNA, 25 bp, E. coli
gctcatttttgtacggtgtggcgca

SEQ ID NO: 154779 - DNA, 25 bp, E. coli
gctcatttttgttcggtgtggcgca

SEQ ID NO: 154780 - DNA, 25 bp, E. coli
gcgtcgaactcgctgccaacgtcat

SEQ ID NO: 154781 - DNA, 25 bp, E. coli
ccgctgctggtgctgtatcgcatta

SEQ ID NO: 154782 - DNA, 25 bp, E. coli
ccgctgctggtggtgtatcgcatta

SEQ ID NO: 154783 - DNA, 25 bp, E. coli
cgtggtgccgataacatggcatgtc

SEQ ID NO: 154784 - DNA, 25 bp, E. coli
cggcgtcactatgggcaatcgtggt

SEQ ID NO: 154785 - DNA, 25 bp, E. coli
cgtggtgccgattacatggcatgtc

SEQ ID NO: 154786 - DNA, 25 bp, E. coli
cggcgtcactatcggcaatcgtggt

SEQ ID NO: 154787 - DNA, 25 bp, E. coli
gtggtgctcgacactgtcccggaca

SEQ ID NO: 154788 - DNA, 25 bp, E. coli
gtggtgctcgactctgtcccggaca

SEQ ID NO: 154789 - DNA, 25 bp, E. coli
catcggcacttgacggtaattactt

SEQ ID NO: 154790 - DNA, 25 bp, E. coli
catcggcacttgtcggtaattactt

SEQ ID NO: 154791 - DNA, 25 bp, E. coli
taccgttgtctctcgtccaggttta

SEQ ID NO: 154792 - DNA, 25 bp, E. coli
tactcctgatagtaagtcatcggca

SEQ ID NO: 154793 - DNA, 25 bp, E. coli
taccgttgtctcacgtccaggttta

SEQ ID NO: 154794 - DNA, 25 bp, E. coli
tactcctgatagaaagtcatcggca

SEQ ID NO: 154795 - DNA, 25 bp, E. coli
tttcgtccctaacgaaacctcatag

SEQ ID NO: 154796 - DNA, 25 bp, E. coli
tttcgtccctaaggaaacctcatag

SEQ ID NO: 154797 - DNA, 25 bp, E. coli
tgctattggaatcaagagagtaacg

SEQ ID NO: 154798 - DNA, 25 bp, E. coli
tgctattggaatgaagagagtaacg

SEQ ID NO: 154799 - DNA, 25 bp, E. coli
tctgttttcagggtaaccgggaatc

SEQ ID NO: 154800 - DNA, 25 bp, E. coli
tctgttttcaggctaaccgggaatc

SEQ ID NO: 154801 - DNA, 25 bp, E. coli
cctgcgggtgcctgagactttctgt

SEQ ID NO: 154802 - DNA, 25 bp, E. coli
cctgcgggtgccagagactttctgt

SEQ ID NO: 154803 - DNA, 25 bp, E. coli
gaaacctcatagcatgcctgcgggt

SEQ ID NO: 154804 - DNA, 25 bp, E. coli
gaaaaattctggtaaacagcacgca

SEQ ID NO: 154805 - DNA, 25 bp, E. coli
gaaacctcataggatgcctgcgggt

SEQ ID NO: 154806 - DNA, 25 bp, E. coli
gaaaaattctggaaaacagcacgca

SEQ ID NO: 154807 - DNA, 25 bp, E. coli
tggctaacccgaatgacgaaaaatt

SEQ ID NO: 154808 - DNA, 25 bp, E. coli
tggctaacccgattgacgaaaaatt

SEQ ID NO: 154809 - DNA, 25 bp, E. coli
taacgaatggcttaactggctaacc

SEQ ID NO: 154810 - DNA, 25 bp, E. coli
taacgaatggctaaactggctaacc

SEQ ID NO: 154811 - DNA, 25 bp, E. coli
cagaaacagcgtgtggcgcttgcac

SEQ ID NO: 154812 - DNA, 25 bp, E. coli
cagaaacagcgtctggcgcttgcac

SEQ ID NO: 154813 - DNA, 25 bp, E. coli
tttggcctgacggtgttgccacggc

SEQ ID NO: 154814 - DNA, 25 bp, E. coli
tttggcctgacgctgttgccacggc

SEQ ID NO: 154815 - DNA, 25 bp, E. coli
ttgccacggcgtcaacgcccgaatg

SEQ ID NO: 154816 - DNA, 25 bp, E. coli
ttcgtgacccaccaccaggaagagg

SEQ ID NO: 154817 - DNA, 25 bp, E. coli
ttgccacggcgtgaacgcccgaatg

SEQ ID NO: 154818 - DNA, 25 bp, E. coli
ttcgtgacccacgaccaggaagagg

SEQ ID NO: 154819 - DNA, 25 bp, E. coli
tgaaccggcgacacgttttgtgctg

SEQ ID NO: 154820 - DNA, 25 bp, E. coli
tgaaccggcgactcgttttgtgctg

SEQ ID NO: 154821 - DNA, 25 bp, E. coli
ccgatcgtgtagaggtgatgagtca

SEQ ID NO: 154822 - DNA, 25 bp, E. coli
ccgatcgtgtagtggtgatgagtca

SEQ ID NO: 154823 - DNA, 25 bp, E. coli
gcagctcgcgcaactggcggatcgt

SEQ ID NO: 154824 - DNA, 25 bp, E. coli
gcagctcgcgcatctggcggatcgt

SEQ ID NO: 154825 - DNA, 25 bp, E. coli
gaactgaaattctccagcgtgttcg

SEQ ID NO: 154826 - DNA, 25 bp, E. coli
gaactgaaattcaccagcgtgttcg

SEQ ID NO: 154827 - DNA, 25 bp, E. coli
ctgcacgcgcggcaccgtaaagtcg

SEQ ID NO: 154828 - DNA, 25 bp, E. coli
ctgcacgcgcgggaccgtaaagtcg

SEQ ID NO: 154829 - DNA, 25 bp, E. coli
tggagatggtgctgctcgcgcatct

SEQ ID NO: 154830 - DNA, 25 bp, E. coli
tggagatggtgcagctcgcgcatct

SEQ ID NO: 154831 - DNA, 25 bp, E. coli
gtttatgggcgacgtaaaccgcctg

SEQ ID NO: 154832 - DNA, 25 bp, E. coli
gtttatgggcgaggtaaaccgcctg

SEQ ID NO: 154833 - DNA, 25 bp, E. coli
catgttaagcagttcccctgtcgaa

SEQ ID NO: 154834 - DNA, 25 bp, E. coli
catgttaagcagatcccctgtcgaa

SEQ ID NO: 154835 - DNA, 25 bp, E. coli
tagtagcactcatgctaagcggctg

SEQ ID NO: 154836 - DNA, 25 bp, E. coli
taccaatgcagaagaattagtcggc

SEQ ID NO: 154837 - DNA, 25 bp, E. coli
taccaatgcagatgaattagtcggc

SEQ ID NO: 154838 - DNA, 25 bp, E. coli
tagtagcactcaagctaagcggctg

SEQ ID NO: 154839 - DNA, 25 bp, E. coli
tcttgccaggccactaatcaggact

SEQ ID NO: 154840 - DNA, 25 bp, E. coli
tcttgccaggcctctaatcaggact

SEQ ID NO: 154841 - DNA, 25 bp, E. coli
gcgccacgccggaccgaatttatac

SEQ ID NO: 154842 - DNA, 25 bp, E. coli
gcgccacgccggtccgaatttatac

SEQ ID NO: 154843 - DNA, 25 bp, E. coli
gaattagtcggcaaaccgttccgcg

SEQ ID NO: 154844 - DNA, 25 bp, E. coli
gaattagtcggctaaccgttccgcg

SEQ ID NO: 154845 - DNA, 25 bp, E. coli
gaaagcggagcctgcaaaaccgaaa

SEQ ID NO: 154846 - DNA, 25 bp, E. coli
gaaagcggagccagcaaaaccgaaa

SEQ ID NO: 154847 - DNA, 25 bp, E. coli
cgatctcggtgatgtcagtggcgac

SEQ ID NO: 154848 - DNA, 25 bp, E. coli
cgatctcggtgaagtcagtggcgac

SEQ ID NO: 154849 - DNA, 25 bp, E. coli
cgtaagcggatggaaatcaacgcct

SEQ ID NO: 154850 - DNA, 25 bp, E. coli
cgtaagcggatgcaaatcaacgcct

SEQ ID NO: 154851 - DNA, 25 bp, E. coli
gtcgaacccgttcaaagcactgcac

SEQ ID NO: 154852 - DNA, 25 bp, E. coli
gtcgaacccgttgaaagcactgcac

SEQ ID NO: 154853 - DNA, 25 bp, E. coli
taagcggctgttgcatgttaagcag

SEQ ID NO: 154854 - DNA, 25 bp, E. coli
taagcggctgttccatgttaagcag

SEQ ID NO: 154855 - DNA, 25 bp, E. coli
caatcgtaaagaagccaatgcggga

SEQ ID NO: 154856 - DNA, 25 bp, E. coli
caaccgatgtggcagtacaacagca

SEQ ID NO: 154857 - DNA, 25 bp, E. coli
caatcgtaaagatgccaatgcggga

SEQ ID NO: 154858 - DNA, 25 bp, E. coli
caaaaacgggttgcagataacagcc

SEQ ID NO: 154859 - DNA, 25 bp, E. coli
caaaaacgggttccagataacagcc

SEQ ID NO: 154860 - DNA, 25 bp, E. coli
caaatgcaaagtctggcgcaggagt

SEQ ID NO: 154861 - DNA, 25 bp, E. coli
caaccgatgtgggagtacaacagca

SEQ ID NO: 154862 - DNA, 25 bp, E. coli
caaatgcaaagtgtggcgcaggagt

SEQ ID NO: 154863 - DNA, 25 bp, E. coli
taactctggcatctcgcaatcggag

SEQ ID NO: 154864 - DNA, 25 bp, E. coli
aaaatgaggctaatcagcgcaccgc

SEQ ID NO: 154865 - DNA, 25 bp, E. coli
aaaatgaggctattcagcgcaccgc

SEQ ID NO: 154866 - DNA, 25 bp, E. coli
ttacagagcaactggcgcagatcgt

SEQ ID NO: 154867 - DNA, 25 bp, E. coli
ttacagagcaacaggcgcagatcgt

SEQ ID NO: 154868 - DNA, 25 bp, E. coli
tggtgataccatagaagcggcggca

SEQ ID NO: 154869 - DNA, 25 bp, E. coli
tggtgataccattgaagcggcggca

SEQ ID NO: 154870 - DNA, 25 bp, E. coli
tctgcccaggcagatgaacaaattg

SEQ ID NO: 154871 - DNA, 25 bp, E. coli
tctgcccaggcacatgaacaaattg

SEQ ID NO: 154872 - DNA, 25 bp, E. coli
gaatctgcggtgtctgtcggaacat

SEQ ID NO: 154873 - DNA, 25 bp, E. coli
gaatctgcggtgactgtcggaacat

SEQ ID NO: 154874 - DNA, 25 bp, E. coli
gacagtctgcggaaactgacgccca

SEQ ID NO: 154875 - DNA, 25 bp, E. coli
gacagtctgcggtaactgacgccca

SEQ ID NO: 154876 - DNA, 25 bp, E. coli
taactctggcatgtcgcaatcggag

SEQ ID NO: 154877 - DNA, 25 bp, E. coli
taaagctgatcaggttatcccatgg

SEQ ID NO: 154878 - DNA, 25 bp, E. coli
taaagctgatcacgttatcccatgg

SEQ ID NO: 154879 - DNA, 25 bp, E. coli
aacggttgatcctaatcccggatgg

SEQ ID NO: 154880 - DNA, 25 bp, E. coli
aacggttgatccaaatcccggatgg

SEQ ID NO: 154881 - DNA, 25 bp, E. coli
tcccggatggcgaacacattgatgc

SEQ ID NO: 154882 - DNA, 25 bp, E. coli
tgccggaaatatgtccgcccactgg

SEQ ID NO: 154883 - DNA, 25 bp, E. coli
tcccggatggcgtacacattgatgc

SEQ ID NO: 154884 - DNA, 25 bp, E. coli
tgccggaaatatctccgcccactgg

SEQ ID NO: 154885 - DNA, 25 bp, E. coli
gccatcaatgtgctgcgccatcgca

SEQ ID NO: 154886 - DNA, 25 bp, E. coli
gccatcaatgtggtgcgccatcgca

SEQ ID NO: 154887 - DNA, 25 bp, E. coli
ccggcagtggctacttacttgatga

SEQ ID NO: 154888 - DNA, 25 bp, E. coli
ccggcagtggcttcttacttgatga

SEQ ID NO: 154889 - DNA, 25 bp, E. coli
gccggattgctgcacgatacgcaaa

SEQ ID NO: 154890 - DNA, 25 bp, E. coli
gccggattgctggacgatacgcaaa

SEQ ID NO: 154891 - DNA, 25 bp, E. coli
cattcatgctcacggcaatgccgga

SEQ ID NO: 154892 - DNA, 25 bp, E. coli
cattcatgctcagggcaatgccgga

SEQ ID NO: 154893 - DNA, 25 bp, E. coli
taaggacggtacacgtctgcaaggc

SEQ ID NO: 154894 - DNA, 25 bp, E. coli
taaggacggtactcgtctgcaaggc

SEQ ID NO: 154895 - DNA, 25 bp, E. coli
ggccgctggtcacttggttacccga

SEQ ID NO: 154896 - DNA, 25 bp, E. coli
gatgctttttcccatcgtcacggcg

SEQ ID NO: 154897 - DNA, 25 bp, E. coli
gatgctttttccgatcgtcacggcg

SEQ ID NO: 154898 - DNA, 25 bp, E. coli
ggccgctggtcagttggttacccga

SEQ ID NO: 154899 - DNA, 25 bp, E. coli
tttgagagagtaagggttaacccac

SEQ ID NO: 154900 - DNA, 25 bp, E. coli
tttgagagagtatgggttaacccac

SEQ ID NO: 154901 - DNA, 25 bp, E. coli
ttctctggaggatggtaagactggt

SEQ ID NO: 154902 - DNA, 25 bp, E. coli
ttctctggaggaaggtaagactggt

SEQ ID NO: 154903 - DNA, 25 bp, E. coli
tgtattccagacaacatgagacggg

SEQ ID NO: 154904 - DNA, 25 bp, E. coli
tgtattccagactacatgagacggg

SEQ ID NO: 154905 - DNA, 25 bp, E. coli
tcttggcaagagtgataagaggcga

SEQ ID NO: 154906 - DNA, 25 bp, E. coli
tcttggcaagagagataagaggcga

SEQ ID NO: 154907 - DNA, 25 bp, E. coli
gaatacaggtatgcgcaaggcgcaa

SEQ ID NO: 154908 - DNA, 25 bp, E. coli
gaatacaggtatccgcaaggcgcaa

SEQ ID NO: 154909 - DNA, 25 bp, E. coli
gacatgagtcatttgcgcacgaaag

SEQ ID NO: 154910 - DNA, 25 bp, E. coli
gaaaatggcggtgtttcgtctgcca

SEQ ID NO: 154911 - DNA, 25 bp, E. coli
gaaaatggcggtctttcgtctgcca

SEQ ID NO: 154912 - DNA, 25 bp, E. coli
gacatgagtcatatgcgcacgaaag

SEQ ID NO: 154913 - DNA, 25 bp, E. coli
cgcaaggcgcaaggacagtttatat

SEQ ID NO: 154914 - DNA, 25 bp, E. coli
cgcaaggcgcaacgacagtttatat

SEQ ID NO: 154915 - DNA, 25 bp, E. coli
gatttacgactacgagaagatctgg

SEQ ID NO: 154916 - DNA, 25 bp, E. coli
gatttacgactaggagaagatctgg

SEQ ID NO: 154917 - DNA, 25 bp, E. coli
taagaggcgagctaagatattagca

SEQ ID NO: 154918 - DNA, 25 bp, E. coli
taagaggcgagcaaagatattagca

SEQ ID NO: 154919 - DNA, 25 bp, E. coli
gatgcagttatagaaaggtaaccgg

SEQ ID NO: 154920 - DNA, 25 bp, E. coli
gatgcagttatacaaaggtaaccgg

SEQ ID NO: 154921 - DNA, 25 bp, E. coli
caaggctaaagattattcttggtgc

SEQ ID NO: 154922 - DNA, 25 bp, E. coli
caaggctaaagaatattcttggtgc

SEQ ID NO: 154923 - DNA, 25 bp, E. coli
taacgtatataatagcaggcaggaa

SEQ ID NO: 154924 - DNA, 25 bp, E. coli
tttgctcaactacaacttaatcgtc

SEQ ID NO: 154925 - DNA, 25 bp, E. coli
tttgctcaactagaacttaatcgtc

SEQ ID NO: 154926 - DNA, 25 bp, E. coli
tcgaacaggtggataaagagcttgt

SEQ ID NO: 154927 - DNA, 25 bp, E. coli
tcgaacaggtggttaaagagcttgt

SEQ ID NO: 154928 - DNA, 25 bp, E. coli
tcttggtgcggaagtagctaaggct

SEQ ID NO: 154929 - DNA, 25 bp, E. coli
tcttggtgcggatgtagctaaggct

SEQ ID NO: 154930 - DNA, 25 bp, E. coli
gctatgcattgccatatcgaacagg

SEQ ID NO: 154931 - DNA, 25 bp, E. coli
gcaggcaggaagattctcgcgcaaa

SEQ ID NO: 154932 - DNA, 25 bp, E. coli
gcaggcaggaagtttctcgcgcaaa

SEQ ID NO: 154933 - DNA, 25 bp, E. coli
gctatgcattgcgatatcgaacagg

SEQ ID NO: 154934 - DNA, 25 bp, E. coli
ctcgcgcaaatgcatagaagacaaa

SEQ ID NO: 154935 - DNA, 25 bp, E. coli
ctcgcgcaaatggatagaagacaaa

SEQ ID NO: 154936 - DNA, 25 bp, E. coli
gggattttgcttacagtatctgacc

SEQ ID NO: 154937 - DNA, 25 bp, E. coli
gggattttgctttcagtatctgacc

SEQ ID NO: 154938 - DNA, 25 bp, E. coli
tggagaaatcagaacgtaagaaagt

SEQ ID NO: 154939 - DNA, 25 bp, E. coli
tggagaaatcagtacgtaagaaagt

SEQ ID NO: 154940 - DNA, 25 bp, E. coli
taatcgtcttaactctctggagaaa

SEQ ID NO: 154941 - DNA, 25 bp, E. coli
taacgtatataaaagcaggcaggaa

SEQ ID NO: 154942 - DNA, 25 bp, E. coli
taatcgtcttaagtctctggagaaa

SEQ ID NO: 154943 - DNA, 25 bp, E. coli
tacacaatttatttatttcatggtc

SEQ ID NO: 154944 - DNA, 25 bp, E. coli
taaagcagagttttgtttaagctct

SEQ ID NO: 154945 - DNA, 25 bp, E. coli
taaagcagagttatgtttaagctct

SEQ ID NO: 154946 - DNA, 25 bp, E. coli
tacacaatttatatatttcatggtc

SEQ ID NO: 154947 - DNA, 25 bp, E. coli
tatgttttaaattactaattggtcg

SEQ ID NO: 154948 - DNA, 25 bp, E. coli
tatgttttaaataactaattggtcg

SEQ ID NO: 154949 - DNA, 25 bp, E. coli
tgtgaattataggaaagtatgtttg

SEQ ID NO: 154950 - DNA, 25 bp, E. coli
tgtccctttaataataaagcagagt

SEQ ID NO: 154951 - DNA, 25 bp, E. coli
tgtccctttaattataaagcagagt

SEQ ID NO: 154952 - DNA, 25 bp, E. coli
tgtgaattatagcaaagtatgtttg

SEQ ID NO: 154953 - DNA, 25 bp, E. coli
taattggtcgggttagtgcatccgg

SEQ ID NO: 154954 - DNA, 25 bp, E. coli
taattggtcgggatagtgcatccgg

SEQ ID NO: 154955 - DNA, 25 bp, E. coli
tctactggcaattttggatgtcttc

SEQ ID NO: 154956 - DNA, 25 bp, E. coli
tctactggcaatattggatgtcttc

SEQ ID NO: 154957 - DNA, 25 bp, E. coli
gctttctttatattcgccagaagga

SEQ ID NO: 154958 - DNA, 25 bp, E. coli
gctttctttataatcgccagaagga

SEQ ID NO: 154959 - DNA, 25 bp, E. coli
gataataatctactggcaatattgg

SEQ ID NO: 154960 - DNA, 25 bp, E. coli
gataataatctagtggcaatattgg

SEQ ID NO: 154961 - DNA, 25 bp, E. coli
gggttagtgcatccggctttcttta

SEQ ID NO: 154962 - DNA, 25 bp, E. coli
gggttagtgcatgcggctttcttta

SEQ ID NO: 154963 - DNA, 25 bp, E. coli
taagctctgctttatttatttgagt

SEQ ID NO: 154964 - DNA, 25 bp, E. coli
taagctctgcttaatttatttgagt

SEQ ID NO: 154965 - DNA, 25 bp, E. coli
tattgtcctgttttgcgccagcggc

SEQ ID NO: 154966 - DNA, 25 bp, E. coli
tattgtcctgttatgcgccagcggc

SEQ ID NO: 154967 - DNA, 25 bp, E. coli
tggtcatcggcccttttatcaacgc

SEQ ID NO: 154968 - DNA, 25 bp, E. coli
tggtcatcggccgttttatcaacgc

SEQ ID NO: 154969 - DNA, 25 bp, E. coli
tgatcttcgcctcctcgctgggtat

SEQ ID NO: 154970 - DNA, 25 bp, E. coli
tgatggcagacttcagcgccgtagg

SEQ ID NO: 154971 - DNA, 25 bp, E. coli
tgatcttcgcctgctcgctgggtat

SEQ ID NO: 154972 - DNA, 25 bp, E. coli
tgatggcagactacagcgccgtagg

SEQ ID NO: 154973 - DNA, 25 bp, E. coli
tgaacgaagggatgaccggcgatcc

SEQ ID NO: 154974 - DNA, 25 bp, E. coli
tgaccacaccgtcgatgatggcaga

SEQ ID NO: 154975 - DNA, 25 bp, E. coli
tgaacgaagggaagaccggcgatcc

SEQ ID NO: 154976 - DNA, 25 bp, E. coli
tgaccacaccgtggatgatggcaga

SEQ ID NO: 154977 - DNA, 25 bp, E. coli
gaacgtatccgcctctccatgacat

SEQ ID NO: 154978 - DNA, 25 bp, E. coli
gaacgtatccgcgtctccatgacat

SEQ ID NO: 154979 - DNA, 25 bp, E. coli
cccggtggtcaacatgcttccagca

SEQ ID NO: 154980 - DNA, 25 bp, E. coli
cccggtggtcaagatgcttccagca

SEQ ID NO: 154981 - DNA, 25 bp, E. coli
cgtaggcggttttttgctgctggca

SEQ ID NO: 154982 - DNA, 25 bp, E. coli
cgtaggcggtttattgctgctggca

SEQ ID NO: 154983 - DNA, 25 bp, E. coli
tggcaaccggataacgcatctgtgg

SEQ ID NO: 154984 - DNA, 25 bp, E. coli
ggcattaaaatgttcccggtggtca

SEQ ID NO: 154985 - DNA, 25 bp, E. coli
tggcaaccggattacgcatctgtgg

SEQ ID NO: 154986 - DNA, 25 bp, E. coli
ggcattaaaatgatcccggtggtca

SEQ ID NO: 154987 - DNA, 25 bp, E. coli
atacgccgggcacacgtgtctgcgc

SEQ ID NO: 154988 - DNA, 25 bp, E. coli
atacgccgggcagacgtgtctgcgc

SEQ ID NO: 154989 - DNA, 25 bp, E. coli
actgtggcggagagatccccgccgc

SEQ ID NO: 154990 - DNA, 25 bp, E. coli
actgtggcggagtgatccccgccgc

SEQ ID NO: 154991 - DNA, 25 bp, E. coli
tgtaaccggctgacacgtaagcgcc

SEQ ID NO: 154992 - DNA, 25 bp, E. coli
tgtaaccggctgtcacgtaagcgcc

SEQ ID NO: 154993 - DNA, 25 bp, E. coli
tccgttgtgtgaactgccagaacat

SEQ ID NO: 154994 - DNA, 25 bp, E. coli
tgctgtgccggaagccatccgttgt

SEQ ID NO: 154995 - DNA, 25 bp, E. coli
tccgttgtgtgatctgccagaacat

SEQ ID NO: 154996 - DNA, 25 bp, E. coli
tgccagaacatcttggaggcccgtc

SEQ ID NO: 154997 - DNA, 25 bp, E. coli
tgccagaacatcatggaggcccgtc

SEQ ID NO: 154998 - DNA, 25 bp, E. coli
tgctgtgccggatgccatccgttgt

SEQ ID NO: 154999 - DNA, 25 bp, E. coli
gaacgcgcccttagtaaccggctga

SEQ ID NO: 155000 - DNA, 25 bp, E. coli
gaacgcgccctttgtaaccggctga

SEQ ID NO: 155001 - DNA, 25 bp, E. coli
cgtcttgttgctgtgccggatgcca

SEQ ID NO: 155002 - DNA, 25 bp, E. coli
cgtcttgttgctctgccggatgcca

SEQ ID NO: 155003 - DNA, 25 bp, E. coli
gattcagatcgtcctcaggctgtga

SEQ ID NO: 155004 - DNA, 25 bp, E. coli
gattcagatcgtgctcaggctgtga

SEQ ID NO: 155005 - DNA, 25 bp, E. coli
taagcgccaggctgtggatacgccg

SEQ ID NO: 155006 - DNA, 25 bp, E. coli
taagcgccaggcagtggatacgccg

SEQ ID NO: 155007 - DNA, 25 bp, E. coli
gaggcccgtcatctgggtcagcatc

SEQ ID NO: 155008 - DNA, 25 bp, E. coli
gaggcccgtcatgtgggtcagcatc

SEQ ID NO: 155009 - DNA, 25 bp, E. coli
agcaacaatgggcaaaagataacgg

SEQ ID NO: 155010 - DNA, 25 bp, E. coli
agcaacaatggggaaaagataacgg

SEQ ID NO: 155011 - DNA, 25 bp, E. coli
tttgagcaacaatgggcaaaagata

SEQ ID NO: 155012 - DNA, 25 bp, E. coli
ttgagcaacaatgggcaaaagataa

SEQ ID NO: 155013 - DNA, 25 bp, E. coli
tttgagcaacaaagggcaaaagata

SEQ ID NO: 155014 - DNA, 25 bp, E. coli
ttgagcaacaatcggcaaaagataa

SEQ ID NO: 155015 - DNA, 25 bp, E. coli
tgagcaacaatgggcaaaagataac

SEQ ID NO: 155016 - DNA, 25 bp, E. coli
tgagcaacaatgcgcaaaagataac

SEQ ID NO: 155017 - DNA, 25 bp, E. coli
gccgtttgagcatcaatgggcaaaa

SEQ ID NO: 155018 - DNA, 25 bp, E. coli
gccgtttgagcaacaatgggcaaaa

SEQ ID NO: 155019 - DNA, 25 bp, E. coli
cgtttgagcaactatgggcaaaaga

SEQ ID NO: 155020 - DNA, 25 bp, E. coli
ccgccgtttgagcaacaatgggcaa

SEQ ID NO: 155021 - DNA, 25 bp, E. coli
ccgtttgagcaacaatgggcaaaag

SEQ ID NO: 155022 - DNA, 25 bp, E. coli
cgccgtttgagcaacaatgggcaaa

SEQ ID NO: 155023 - DNA, 25 bp, E. coli
cgccgtttgagctacaatgggcaaa

SEQ ID NO: 155024 - DNA, 25 bp, E. coli
ccgccgtttgaggaacaatgggcaa

SEQ ID NO: 155025 - DNA, 25 bp, E. coli
cgtttgagcaacaatgggcaaaaga

SEQ ID NO: 155026 - DNA, 25 bp, E. coli
ccgtttgagcaagaatgggcaaaag

SEQ ID NO: 155027 - DNA, 25 bp, E. coli
gtttgagcaacattgggcaaaagat

SEQ ID NO: 155028 - DNA, 25 bp, E. coli
gtttgagcaacaatgggcaaaagat

SEQ ID NO: 155029 - DNA, 25 bp, E. coli
gagcaacaatggccaaaagataacg

SEQ ID NO: 155030 - DNA, 25 bp, E. coli
gagcaacaatgggcaaaagataacg

SEQ ID NO: 155031 - DNA, 25 bp, E. coli
catgattaaactcatctctgcggca

SEQ ID NO: 155032 - DNA, 25 bp, E. coli
catgattaaactgatctctgcggca

SEQ ID NO: 155033 - DNA, 25 bp, E. coli
aaggctatttacacgccgggagtct

SEQ ID NO: 155034 - DNA, 25 bp, E. coli
aaggctatttactcgccgggagtct

SEQ ID NO: 155035 - DNA, 25 bp, E. coli
tatctattcattaagcgggctgctg

SEQ ID NO: 155036 - DNA, 25 bp, E. coli
tatctattcatttagcgggctgctg

SEQ ID NO: 155037 - DNA, 25 bp, E. coli
tgtcgttctcgttctggcaaggcgc

SEQ ID NO: 155038 - DNA, 25 bp, E. coli
tgtcgttctcgtactggcaaggcgc

SEQ ID NO: 155039 - DNA, 25 bp, E. coli
tcctgctaacggcagcaagtctgtg

SEQ ID NO: 155040 - DNA, 25 bp, E. coli
tcctgctaacgggagcaagtctgtg

SEQ ID NO: 155041 - DNA, 25 bp, E. coli
tcagctatgaaatctgtctggcgct

SEQ ID NO: 155042 - DNA, 25 bp, E. coli
ccgggagtctgtaattcgtcagcta

SEQ ID NO: 155043 - DNA, 25 bp, E. coli
ccgggagtctgttattcgtcagcta

SEQ ID NO: 155044 - DNA, 25 bp, E. coli
gctttccttaggctatgcggcgacc

SEQ ID NO: 155045 - DNA, 25 bp, E. coli
gctttccttagggtatgcggcgacc

SEQ ID NO: 155046 - DNA, 25 bp, E. coli
gctgctgttaatcttcacggttgga

SEQ ID NO: 155047 - DNA, 25 bp, E. coli
gctgctgttaatgttcacggttgga

SEQ ID NO: 155048 - DNA, 25 bp, E. coli
tggcccagcctgacaattctctttg

SEQ ID NO: 155049 - DNA, 25 bp, E. coli
tggcccagcctgtcaattctctttg

SEQ ID NO: 155050 - DNA, 25 bp, E. coli
taatatcaccaccagcccattgagt

SEQ ID NO: 155051 - DNA, 25 bp, E. coli
tcagctatgaaaactgtctggcgct

SEQ ID NO: 155052 - DNA, 25 bp, E. coli
taatatcaccacgagcccattgagt

SEQ ID NO: 155053 - DNA, 25 bp, E. coli
cacccaccagtgaagaggcacagaa

SEQ ID NO: 155054 - DNA, 25 bp, E. coli
cacagaaagtgttggccgggtatat

SEQ ID NO: 155055 - DNA, 25 bp, E. coli
cactggatctgcatcgcgccattgt

SEQ ID NO: 155056 - DNA, 25 bp, E. coli
cactggatctgcttcgcgccattgt

SEQ ID NO: 155057 - DNA, 25 bp, E. coli
cacccaccagtgtagaggcacagaa

SEQ ID NO: 155058 - DNA, 25 bp, E. coli
cacagaaagtgtaggccgggtatat

SEQ ID NO: 155059 - DNA, 25 bp, E. coli
cagttgcgtccgtcattacccgtaa

SEQ ID NO: 155060 - DNA, 25 bp, E. coli
cagttgcgtccgacattacccgtaa

SEQ ID NO: 155061 - DNA, 25 bp, E. coli
ttgttgcgtcatgcgatggcatcca

SEQ ID NO: 155062 - DNA, 25 bp, E. coli
ttgttgcgtcatccgatggcatcca

SEQ ID NO: 155063 - DNA, 25 bp, E. coli
tgttagcttgcttgaggagtacctg

SEQ ID NO: 155064 - DNA, 25 bp, E. coli
tgttagcttgctagaggagtacctg

SEQ ID NO: 155065 - DNA, 25 bp, E. coli
tctgcattgtatacttcctggacgc

SEQ ID NO: 155066 - DNA, 25 bp, E. coli
tctgcattgtattcttcctggacgc

SEQ ID NO: 155067 - DNA, 25 bp, E. coli
tctaatcgaggtattatggcgggca

SEQ ID NO: 155068 - DNA, 25 bp, E. coli
tctaatcgaggttttatggcgggca

SEQ ID NO: 155069 - DNA, 25 bp, E. coli
gaagcgaaaatcgacccactggatc

SEQ ID NO: 155070 - DNA, 25 bp, E. coli
gaagcgaaaatccacccactggatc

SEQ ID NO: 155071 - DNA, 25 bp, E. coli
gtttaaatatcacttgcgtccgtca

SEQ ID NO: 155072 - DNA, 25 bp, E. coli
gtttaaatatcagttgcgtccgtca

SEQ ID NO: 155073 - DNA, 25 bp, E. coli
tggacgctaagtatcaccgcaccca

SEQ ID NO: 155074 - DNA, 25 bp, E. coli
tggacgctaagtttcaccgcaccca

SEQ ID NO: 155075 - DNA, 25 bp, E. coli
caacaagtgcttttgaacgtggtca

SEQ ID NO: 155076 - DNA, 25 bp, E. coli
caacaagtgcttatgaacgtggtca

SEQ ID NO: 155077 - DNA, 25 bp, E. coli
taaaatggtgcttaacctggacagg

SEQ ID NO: 155078 - DNA, 25 bp, E. coli
taaaatggtgctaaacctggacagg

SEQ ID NO: 155079 - DNA, 25 bp, E. coli
tagaaattgccgatgggagtcgccg

SEQ ID NO: 155080 - DNA, 25 bp, E. coli
tagaaattgccgttgggagtcgccg

SEQ ID NO: 155081 - DNA, 25 bp, E. coli
tgactggtcaacagacaccggcgtt

SEQ ID NO: 155082 - DNA, 25 bp, E. coli
tgactggtcaactgacaccggcgtt

SEQ ID NO: 155083 - DNA, 25 bp, E. coli
gcttactgaggaggcactggatgat

SEQ ID NO: 155084 - DNA, 25 bp, E. coli
gcttactgaggacgcactggatgat

SEQ ID NO: 155085 - DNA, 25 bp, E. coli
gaagcgtgcgcctgttattccaaaa

SEQ ID NO: 155086 - DNA, 25 bp, E. coli
gaagcgtgcgccagttattccaaaa

SEQ ID NO: 155087 - DNA, 25 bp, E. coli
cgtggtcagcgtaatgcaagccgat

SEQ ID NO: 155088 - DNA, 25 bp, E. coli
cgtggtcagcgttatgcaagccgat

SEQ ID NO: 155089 - DNA, 25 bp, E. coli
ggaacttgaaaagccagcaccctga

SEQ ID NO: 155090 - DNA, 25 bp, E. coli
ggaacttgaaaacccagcaccctga

SEQ ID NO: 155091 - DNA, 25 bp, E. coli
taatgaacgtgaccaggagctgctt

SEQ ID NO: 155092 - DNA, 25 bp, E. coli
taattgcgcgcgaaggagtaatggc

SEQ ID NO: 155093 - DNA, 25 bp, E. coli
taattgcgcgcgtaggagtaatggc

SEQ ID NO: 155094 - DNA, 25 bp, E. coli
taatgaacgtgagcaggagctgctt

SEQ ID NO: 155095 - DNA, 25 bp, E. coli
gagtcgccgtcgaaaagctgctgca

SEQ ID NO: 155096 - DNA, 25 bp, E. coli
gagtcgccgtcgtaaagctgctgca

SEQ ID NO: 155097 - DNA, 25 bp, E. coli
cacagttagggctgggcgaagaaca

SEQ ID NO: 155098 - DNA, 25 bp, E. coli
cacagttagggcagggcgaagaaca

SEQ ID NO: 155099 - DNA, 25 bp, E. coli
catgttgttgaagaggcgcgtatcc

SEQ ID NO: 155100 - DNA, 25 bp, E. coli
catgttgttgaacaggcgcgtatcc

SEQ ID NO: 155101 - DNA, 25 bp, E. coli
aaaacgatccgcctctgaacgagat

SEQ ID NO: 155102 - DNA, 25 bp, E. coli
aaaacgatccgcgtctgaacgagat

SEQ ID NO: 155103 - DNA, 25 bp, E. coli
tatcgttacggtcgtcagattgccg

SEQ ID NO: 155104 - DNA, 25 bp, E. coli
tatcgttacggtggtcagattgccg

SEQ ID NO: 155105 - DNA, 25 bp, E. coli
tgaacgagattgtcagccatctgaa

SEQ ID NO: 155106 - DNA, 25 bp, E. coli
tgaacgagattgacagccatctgaa

SEQ ID NO: 155107 - DNA, 25 bp, E. coli
tatctcctacggtgcctgcggtaac

SEQ ID NO: 155108 - DNA, 25 bp, E. coli
tatctcctacggagcctgcggtaac

SEQ ID NO: 155109 - DNA, 25 bp, E. coli
gcatgaaggcgtcgttactgaaaaa

SEQ ID NO: 155110 - DNA, 25 bp, E. coli
gcatgaaggcgtggttactgaaaaa

SEQ ID NO: 155111 - DNA, 25 bp, E. coli
gatattttactgattaccggcgcgg

SEQ ID NO: 155112 - DNA, 25 bp, E. coli
gatattttactgtttaccggcgcgg

SEQ ID NO: 155113 - DNA, 25 bp, E. coli
ggatgaatccatggccagcatgaag

SEQ ID NO: 155114 - DNA, 25 bp, E. coli
ggatgaatccatcgccagcatgaag

SEQ ID NO: 155115 - DNA, 25 bp, E. coli
tggagcagaaaaatcacgcccgtgg

SEQ ID NO: 155116 - DNA, 25 bp, E. coli
tggagcagaaaattcacgcccgtgg

SEQ ID NO: 155117 - DNA, 25 bp, E. coli
gatgcagaacgcatcggcattaaag

SEQ ID NO: 155118 - DNA, 25 bp, E. coli
gatgcagaacgcttcggcattaaag

SEQ ID NO: 155119 - DNA, 25 bp, E. coli
taaaggcgttgtcaccatcagcgtt

SEQ ID NO: 155120 - DNA, 25 bp, E. coli
taaaggcgttgtgaccatcagcgtt

SEQ ID NO: 155121 - DNA, 25 bp, E. coli
aaaaacaatgatgaagcccaccgca

SEQ ID NO: 155122 - DNA, 25 bp, E. coli
aaaaacaatgatcaagcccaccgca

SEQ ID NO: 155123 - DNA, 25 bp, E. coli
aaataaggcagaccttcgcgccctg

SEQ ID NO: 155124 - DNA, 25 bp, E. coli
aaataaggcagagcttcgcgccctg

SEQ ID NO: 155125 - DNA, 25 bp, E. coli
tagaaggctcgctggtgaacgtacg

SEQ ID NO: 155126 - DNA, 25 bp, E. coli
tagaaggctcgcaggtgaacgtacg

SEQ ID NO: 155127 - DNA, 25 bp, E. coli
tatattgccattcagcaggcccgct

SEQ ID NO: 155128 - DNA, 25 bp, E. coli
tatattgccattgagcaggcccgct

SEQ ID NO: 155129 - DNA, 25 bp, E. coli
ttcgcgaactgtagcacaagtcggc

SEQ ID NO: 155130 - DNA, 25 bp, E. coli
ttcgcgaactgttgcacaagtcggc

SEQ ID NO: 155131 - DNA, 25 bp, E. coli
tgaaaatttacttctgccacgcgca

SEQ ID NO: 155132 - DNA, 25 bp, E. coli
tgaaaatttactactgccacgcgca

SEQ ID NO: 155133 - DNA, 25 bp, E. coli
tccaaaggtgatagagcgggtcgaa

SEQ ID NO: 155134 - DNA, 25 bp, E. coli
tccaaaggtgattgagcgggtcgaa

SEQ ID NO: 155135 - DNA, 25 bp, E. coli
gctgaatgtccatcatcgcgtgaag

SEQ ID NO: 155136 - DNA, 25 bp, E. coli
gctgaatgtccaacatcgcgtgaag

SEQ ID NO: 155137 - DNA, 25 bp, E. coli
gaaatattcaacttgctgctggcgg

SEQ ID NO: 155138 - DNA, 25 bp, E. coli
gaaatattcaacatgctgctggcgg

SEQ ID NO: 155139 - DNA, 25 bp, E. coli
gtatatcgggctcgatcaacctgaa

SEQ ID NO: 155140 - DNA, 25 bp, E. coli
gtatatcgggctggatcaacctgaa

SEQ ID NO: 155141 - DNA, 25 bp, E. coli
aaccgatgtttagcctggaagagcg

SEQ ID NO: 155142 - DNA, 25 bp, E. coli
aaccgatgtttaccctggaagagcg

SEQ ID NO: 155143 - DNA, 25 bp, E. coli
catatcgatatcctgacgcgcgcca

SEQ ID NO: 155144 - DNA, 25 bp, E. coli
catatcgatatcgtgacgcgcgcca

SEQ ID NO: 155145 - DNA, 25 bp, E. coli
atcaggcgctgaaggcgaagttagc

SEQ ID NO: 155146 - DNA, 25 bp, E. coli
atcaggcgctgatggcgaagttagc

SEQ ID NO: 155147 - DNA, 25 bp, E. coli
tttgaatatgaaatgcagctggcgc

SEQ ID NO: 155148 - DNA, 25 bp, E. coli
tttgaatatgaattgcagctggcgc

SEQ ID NO: 155149 - DNA, 25 bp, E. coli
tgcagctggcgcttatgaatcgcca

SEQ ID NO: 155150 - DNA, 25 bp, E. coli
tgcagctggcgcatatgaatcgcca

SEQ ID NO: 155151 - DNA, 25 bp, E. coli
tcgatcacgttattctggcgattgc

SEQ ID NO: 155152 - DNA, 25 bp, E. coli
tgccggagaatgaccatcaggcgct

SEQ ID NO: 155153 - DNA, 25 bp, E. coli
tcgatcacgttaatctggcgattgc

SEQ ID NO: 155154 - DNA, 25 bp, E. coli
tgccggagaatgtccatcaggcgct

SEQ ID NO: 155155 - DNA, 25 bp, E. coli
gaatcgccacttaatgccggaactg

SEQ ID NO: 155156 - DNA, 25 bp, E. coli
gaatcgccactttatgccggaactg

SEQ ID NO: 155157 - DNA, 25 bp, E. coli
gaacttcgcccgtaatcaacacgct

SEQ ID NO: 155158 - DNA, 25 bp, E. coli
gaacttcgcccgaaatcaacacgct

SEQ ID NO: 155159 - DNA, 25 bp, E. coli
ctacggtgctgattcgtggcctgcg

SEQ ID NO: 155160 - DNA, 25 bp, E. coli
ctacggtgctgaatcgtggcctgcg

SEQ ID NO: 155161 - DNA, 25 bp, E. coli
gatgtcacccatatcctgccggaga

SEQ ID NO: 155162 - DNA, 25 bp, E. coli
gatgtcacccatttcctgccggaga

SEQ ID NO: 155163 - DNA, 25 bp, E. coli
caacatgtgctgaatgataatccct

SEQ ID NO: 155164 - DNA, 25 bp, E. coli
caacatgtgctgtatgataatccct

SEQ ID NO: 155165 - DNA, 25 bp, E. coli
tacaacatgtgcagaatgataatcc

SEQ ID NO: 155166 - DNA, 25 bp, E. coli
tacaacatgtgctgaatgataatcc

SEQ ID NO: 155167 - DNA, 25 bp, E. coli
accgttaaaattgtttgggctgatg

SEQ ID NO: 155168 - DNA, 25 bp, E. coli
caccgttaaaatactttgggctgat

SEQ ID NO: 155169 - DNA, 25 bp, E. coli
accgttaaaattctttgggctgatg

SEQ ID NO: 155170 - DNA, 25 bp, E. coli
caccgttaaaattctttgggctgat

SEQ ID NO: 155171 - DNA, 25 bp, E. coli
aacatgtgctgattgataatccctt

SEQ ID NO: 155172 - DNA, 25 bp, E. coli
aacatgtgctgaatgataatccctt

SEQ ID NO: 155173 - DNA, 25 bp, E. coli
acaacatgtgctgaatgataatccc

SEQ ID NO: 155174 - DNA, 25 bp, E. coli
acaacatgtgctcaatgataatccc

SEQ ID NO: 155175 - DNA, 25 bp, E. coli
acatgtgctgaaagataatcccttc

SEQ ID NO: 155176 - DNA, 25 bp, E. coli
acatgtgctgaatgataatcccttc

SEQ ID NO: 155177 - DNA, 25 bp, E. coli
gacaccgttaaaattctttgggctg

SEQ ID NO: 155178 - DNA, 25 bp, E. coli
gacaccgttaaatttctttgggctg

SEQ ID NO: 155179 - DNA, 25 bp, E. coli
ccgttaaaattctttgggctgatgc

SEQ ID NO: 155180 - DNA, 25 bp, E. coli
ccgttaaaattcattgggctgatgc

SEQ ID NO: 155181 - DNA, 25 bp, E. coli
gtacaacatgtgctgaatgataatc

SEQ ID NO: 155182 - DNA, 25 bp, E. coli
gtacaacatgtggtgaatgataatc

SEQ ID NO: 155183 - DNA, 25 bp, E. coli
atgagttaaccaggcggcttgccaa

SEQ ID NO: 155184 - DNA, 25 bp, E. coli
atgagttaaccacgcggcttgccaa

SEQ ID NO: 155185 - DNA, 25 bp, E. coli
tttatggatgagataaccacgcggc

SEQ ID NO: 155186 - DNA, 25 bp, E. coli
tttatggatgagttaaccacgcggc

SEQ ID NO: 155187 - DNA, 25 bp, E. coli
tgttgaatggcgtggcgttattgcc

SEQ ID NO: 155188 - DNA, 25 bp, E. coli
tgttgaatggcgaggcgttattgcc

SEQ ID NO: 155189 - DNA, 25 bp, E. coli
tgcatttcgctctgcgagttcgcgc

SEQ ID NO: 155190 - DNA, 25 bp, E. coli
tgcatttcgctcagcgagttcgcgc

SEQ ID NO: 155191 - DNA, 25 bp, E. coli
tgcctgtaaacaggggcttgcgaac

SEQ ID NO: 155192 - DNA, 25 bp, E. coli
tcgcgccctggttgtgttgaatggc

SEQ ID NO: 155193 - DNA, 25 bp, E. coli
tgcctgtaaacacgggcttgcgaac

SEQ ID NO: 155194 - DNA, 25 bp, E. coli
tcgcgccctggtagtgttgaatggc

SEQ ID NO: 155195 - DNA, 25 bp, E. coli
gccattgcgcgaaattttatggatg

SEQ ID NO: 155196 - DNA, 25 bp, E. coli
gccattgcgcgatattttatggatg

SEQ ID NO: 155197 - DNA, 25 bp, E. coli
cccagaccgttgtatgctttatttg

SEQ ID NO: 155198 - DNA, 25 bp, E. coli
cccagaccgttgaatgctttatttg

SEQ ID NO: 155199 - DNA, 25 bp, E. coli
ctggtgcgcctgtttgcaccgtgga

SEQ ID NO: 155200 - DNA, 25 bp, E. coli
ctggtgcgcctgattgcaccgtgga

SEQ ID NO: 155201 - DNA, 25 bp, E. coli
gagttcgcgcccaggttgtgttgaa

SEQ ID NO: 155202 - DNA, 25 bp, E. coli
gaccgttgtatgctttatttgcggg

SEQ ID NO: 155203 - DNA, 25 bp, E. coli
gagttcgcgccctggttgtgttgaa

SEQ ID NO: 155204 - DNA, 25 bp, E. coli
gaccgttgtatggtttatttgcggg

SEQ ID NO: 155205 - DNA, 25 bp, E. coli
cagaccactggtagacgagttaaat

SEQ ID NO: 155206 - DNA, 25 bp, E. coli
cagaccactggttgacgagttaaat

SEQ ID NO: 155207 - DNA, 25 bp, E. coli
taaagatactttagtcagaccactg

SEQ ID NO: 155208 - DNA, 25 bp, E. coli
taaagatacttttgtcagaccactg

SEQ ID NO: 155209 - DNA, 25 bp, E. coli
tagtaatgcgacatttcgcgcaggt

SEQ ID NO: 155210 - DNA, 25 bp, E. coli
tagtaatgcgacttttcgcgcaggt

SEQ ID NO: 155211 - DNA, 25 bp, E. coli
tattcctcgcatggaaacagcacct

SEQ ID NO: 155212 - DNA, 25 bp, E. coli
tattcctcgcatcgaaacagcacct

SEQ ID NO: 155213 - DNA, 25 bp, E. coli
tatttggcggataaaatggcactgc

SEQ ID NO: 155214 - DNA, 25 bp, E. coli
tatttggcggattaaatggcactgc

SEQ ID NO: 155215 - DNA, 25 bp, E. coli
tgatgaacagactcttgaagtcggc

SEQ ID NO: 155216 - DNA, 25 bp, E. coli
tgatgaacagacacttgaagtcggc

SEQ ID NO: 155217 - DNA, 25 bp, E. coli
tctttagcagaaatagactgggcaa

SEQ ID NO: 155218 - DNA, 25 bp, E. coli
tctttagcagaattagactgggcaa

SEQ ID NO: 155219 - DNA, 25 bp, E. coli
gcacctaaaaacgaaagagattcgt

SEQ ID NO: 155220 - DNA, 25 bp, E. coli
gaagtcggcgatagcttaaggagaa

SEQ ID NO: 155221 - DNA, 25 bp, E. coli
gaaggtaactcaaatctcgcgttta

SEQ ID NO: 155222 - DNA, 25 bp, E. coli
gcacctaaaaaccaaagagattcgt

SEQ ID NO: 155223 - DNA, 25 bp, E. coli
gaagtcggcgattgcttaaggagaa

SEQ ID NO: 155224 - DNA, 25 bp, E. coli
gaaggtaactcatatctcgcgttta

SEQ ID NO: 155225 - DNA, 25 bp, E. coli
cccatgcaaaagtggataaagatac

SEQ ID NO: 155226 - DNA, 25 bp, E. coli
cccatgcaaaagaggataaagatac

SEQ ID NO: 155227 - DNA, 25 bp, E. coli
gaacggattttcagggatccggcga

SEQ ID NO: 155228 - DNA, 25 bp, E. coli
gaacggattttctgggatccggcga

SEQ ID NO: 155229 - DNA, 25 bp, E. coli
ttgggcgaacggtttttctgggatc

SEQ ID NO: 155230 - DNA, 25 bp, E. coli
ttgggcgaacggattttctgggatc

SEQ ID NO: 155231 - DNA, 25 bp, E. coli
attttctgggatgcggcgaccgata

SEQ ID NO: 155232 - DNA, 25 bp, E. coli
attttctgggatccggcgaccgata

SEQ ID NO: 155233 - DNA, 25 bp, E. coli
tgatgcgatgctgttgggcgaacgg

SEQ ID NO: 155234 - DNA, 25 bp, E. coli
tgggcgaacggaatttctgggatcc

SEQ ID NO: 155235 - DNA, 25 bp, E. coli
tgggcgaacggattttctgggatcc

SEQ ID NO: 155236 - DNA, 25 bp, E. coli
tgctgttgggcgtacggattttctg

SEQ ID NO: 155237 - DNA, 25 bp, E. coli
tgctgttgggcgaacggattttctg

SEQ ID NO: 155238 - DNA, 25 bp, E. coli
tgatgcgatgctcttgggcgaacgg

SEQ ID NO: 155239 - DNA, 25 bp, E. coli
gcgaacggatttactgggatccggc

SEQ ID NO: 155240 - DNA, 25 bp, E. coli
gcgaacggattttctgggatccggc

SEQ ID NO: 155241 - DNA, 25 bp, E. coli
cggcgaccgatagcctgactattaa

SEQ ID NO: 155242 - DNA, 25 bp, E. coli
cggcgaccgataccctgactattaa

SEQ ID NO: 155243 - DNA, 25 bp, E. coli
gattttctgggatccggcgaccgat

SEQ ID NO: 155244 - DNA, 25 bp, E. coli
gattttctgggaaccggcgaccgat

SEQ ID NO: 155245 - DNA, 25 bp, E. coli
ggattttctgggttccggcgaccga

SEQ ID NO: 155246 - DNA, 25 bp, E. coli
ggattttctgggatccggcgaccga

SEQ ID NO: 155247 - DNA, 25 bp, E. coli
ggcgaccgatacgctgactattaaa

SEQ ID NO: 155248 - DNA, 25 bp, E. coli
ggcgaccgataccctgactattaaa

SEQ ID NO: 155249 - DNA, 25 bp, E. coli
cagaatctccgtgtaaattcgaagc

SEQ ID NO: 155250 - DNA, 25 bp, E. coli
cagacgttgatagcggaacattaac

SEQ ID NO: 155251 - DNA, 25 bp, E. coli
cagaatctccgtctaaattcgaagc

SEQ ID NO: 155252 - DNA, 25 bp, E. coli
cagacgttgataccggaacattaac

SEQ ID NO: 155253 - DNA, 25 bp, E. coli
taaagcaaaatacctgaaactgaca

SEQ ID NO: 155254 - DNA, 25 bp, E. coli
taaagcaaaatagctgaaactgaca

SEQ ID NO: 155255 - DNA, 25 bp, E. coli
aacgataaggcgatagccagtagca

SEQ ID NO: 155256 - DNA, 25 bp, E. coli
aacgataaggcgttagccagtagca

SEQ ID NO: 155257 - DNA, 25 bp, E. coli
tagccagtagcaacgataccgtggg

SEQ ID NO: 155258 - DNA, 25 bp, E. coli
tagccagtagcatcgataccgtggg

SEQ ID NO: 155259 - DNA, 25 bp, E. coli
tatttaggtgataacagcgatgtcc

SEQ ID NO: 155260 - DNA, 25 bp, E. coli
tatttaggtgattacagcgatgtcc

SEQ ID NO: 155261 - DNA, 25 bp, E. coli
tgattaccaacgataaaataaccgg

SEQ ID NO: 155262 - DNA, 25 bp, E. coli
tgattaccaacgttaaaataaccgg

SEQ ID NO: 155263 - DNA, 25 bp, E. coli
tgcagtcggtgtaaccagcagcatg

SEQ ID NO: 155264 - DNA, 25 bp, E. coli
tgcagtcggtgttaccagcagcatg

SEQ ID NO: 155265 - DNA, 25 bp, E. coli
cgatgtcctggatgtttctgcacct

SEQ ID NO: 155266 - DNA, 25 bp, E. coli
cgatgtcctggaagtttctgcacct

SEQ ID NO: 155267 - DNA, 25 bp, E. coli
gttgctggtgtataactctcgttga

SEQ ID NO: 155268 - DNA, 25 bp, E. coli
gttgctggtgtaaaactctcgttga

SEQ ID NO: 155269 - DNA, 25 bp, E. coli
gggaatattgcacaatctccgtgta

SEQ ID NO: 155270 - DNA, 25 bp, E. coli
gggaatattgcagaatctccgtgta

SEQ ID NO: 155271 - DNA, 25 bp, E. coli
caacggagtcgcaaaagactatgcg

SEQ ID NO: 155272 - DNA, 25 bp, E. coli
caacgcccttggctggacactggat

SEQ ID NO: 155273 - DNA, 25 bp, E. coli
caacggagtcgctaaagactatgcg

SEQ ID NO: 155274 - DNA, 25 bp, E. coli
caacgcccttgggtggacactggat

SEQ ID NO: 155275 - DNA, 25 bp, E. coli
tataccgaggataaaagccgtcata

SEQ ID NO: 155276 - DNA, 25 bp, E. coli
tataccgaggattaaagccgtcata

SEQ ID NO: 155277 - DNA, 25 bp, E. coli
ttttactggctgtagctggccgctg

SEQ ID NO: 155278 - DNA, 25 bp, E. coli
ttttactggctgaagctggccgctg

SEQ ID NO: 155279 - DNA, 25 bp, E. coli
tgtgaagcacagtattccttagggc

SEQ ID NO: 155280 - DNA, 25 bp, E. coli
tgtgaagcacagaattccttagggc

SEQ ID NO: 155281 - DNA, 25 bp, E. coli
tccttagggcaatagtataccgagg

SEQ ID NO: 155282 - DNA, 25 bp, E. coli
tccttagggcaaaagtataccgagg

SEQ ID NO: 155283 - DNA, 25 bp, E. coli
tcttctggctgaaaaaagctgccct

SEQ ID NO: 155284 - DNA, 25 bp, E. coli
tcttctggctgataaaagctgccct

SEQ ID NO: 155285 - DNA, 25 bp, E. coli
ctggtatcagattgccgcggagagc

SEQ ID NO: 155286 - DNA, 25 bp, E. coli
ctggtatcagatagccgcggagagc

SEQ ID NO: 155287 - DNA, 25 bp, E. coli
gataatgagcaagccatcttctggc

SEQ ID NO: 155288 - DNA, 25 bp, E. coli
gataatgagcaacccatcttctggc

SEQ ID NO: 155289 - DNA, 25 bp, E. coli
ggacactggatcgtggagaagcccc

SEQ ID NO: 155290 - DNA, 25 bp, E. coli
ggccgctgagcatggtcattgtgaa

SEQ ID NO: 155291 - DNA, 25 bp, E. coli
ggacactggatcctggagaagcccc

SEQ ID NO: 155292 - DNA, 25 bp, E. coli
ggccgctgagcaaggtcattgtgaa

SEQ ID NO: 155293 - DNA, 25 bp, E. coli
cataaaccaggtaaagtatgggaga

SEQ ID NO: 155294 - DNA, 25 bp, E. coli
caggcatatttcctttgtgataaaa

SEQ ID NO: 155295 - DNA, 25 bp, E. coli
cataaaccaggttaagtatgggaga

SEQ ID NO: 155296 - DNA, 25 bp, E. coli
caggcatatttcgtttgtgataaaa

SEQ ID NO: 155297 - DNA, 25 bp, E. coli
tacaaattaaacaaaatggagggca

SEQ ID NO: 155298 - DNA, 25 bp, E. coli
tacaaattaaactaaatggagggca

SEQ ID NO: 155299 - DNA, 25 bp, E. coli
tatgtctctgactgctgctcaggca

SEQ ID NO: 155300 - DNA, 25 bp, E. coli
tatgggagattatcgccctatctac

SEQ ID NO: 155301 - DNA, 25 bp, E. coli
tagtggttgcaatccttacgtgcca

SEQ ID NO: 155302 - DNA, 25 bp, E. coli
tatgtctctgacagctgctcaggca

SEQ ID NO: 155303 - DNA, 25 bp, E. coli
tatgggagattaacgccctatctac

SEQ ID NO: 155304 - DNA, 25 bp, E. coli
tagtggttgcaaaccttacgtgcca

SEQ ID NO: 155305 - DNA, 25 bp, E. coli
tattgcactgtttattggtgcgagg

SEQ ID NO: 155306 - DNA, 25 bp, E. coli
tattgcactgttaattggtgcgagg

SEQ ID NO: 155307 - DNA, 25 bp, E. coli
ccttacgtgccacttatgtctctga

SEQ ID NO: 155308 - DNA, 25 bp, E. coli
ccttacgtgccagttatgtctctga

SEQ ID NO: 155309 - DNA, 25 bp, E. coli
ccctatctacccctctattggtggg

SEQ ID NO: 155310 - DNA, 25 bp, E. coli
ccctatctacccgtctattggtggg

SEQ ID NO: 155311 - DNA, 25 bp, E. coli
ctctattggtgggttagtggttgca

SEQ ID NO: 155312 - DNA, 25 bp, E. coli
ctctattggtggcttagtggttgca

SEQ ID NO: 155313 - DNA, 25 bp, E. coli
ggagggcaattttccataaaccagg

SEQ ID NO: 155314 - DNA, 25 bp, E. coli
ggagggcaatttaccataaaccagg

SEQ ID NO: 155315 - DNA, 25 bp, E. coli
aaggatcgacgggattagcaagtca

SEQ ID NO: 155316 - DNA, 25 bp, E. coli
caagtcaggaggtcttatgaatgag

SEQ ID NO: 155317 - DNA, 25 bp, E. coli
caagtcaggaggacttatgaatgag

SEQ ID NO: 155318 - DNA, 25 bp, E. coli
aaggatcgacggcattagcaagtca

SEQ ID NO: 155319 - DNA, 25 bp, E. coli
caggaggtcttatgaatgagttcaa

SEQ ID NO: 155320 - DNA, 25 bp, E. coli
caggaggtcttaagaatgagttcaa

SEQ ID NO: 155321 - DNA, 25 bp, E. coli
acgggattagcaagtcaggaggtct

SEQ ID NO: 155322 - DNA, 25 bp, E. coli
acgggattagcatgtcaggaggtct

SEQ ID NO: 155323 - DNA, 25 bp, E. coli
tagcaagtcaggaggtcttatgaat

SEQ ID NO: 155324 - DNA, 25 bp, E. coli
tagcaagtcaggtggtcttatgaat

SEQ ID NO: 155325 - DNA, 25 bp, E. coli
tccctcaaggatggacgggattagc

SEQ ID NO: 155326 - DNA, 25 bp, E. coli
tccctcaaggatcgacgggattagc

SEQ ID NO: 155327 - DNA, 25 bp, E. coli
tcatccctcaaggatcgacgggatt

SEQ ID NO: 155328 - DNA, 25 bp, E. coli
tcatccctcaagcatcgacgggatt

SEQ ID NO: 155329 - DNA, 25 bp, E. coli
cctcaaggatcgtcgggattagcaa

SEQ ID NO: 155330 - DNA, 25 bp, E. coli
cctcaaggatcgacgggattagcaa

SEQ ID NO: 155331 - DNA, 25 bp, E. coli
gattagcaagtctggaggtcttatg

SEQ ID NO: 155332 - DNA, 25 bp, E. coli
gattagcaagtcaggaggtcttatg

SEQ ID NO: 155333 - DNA, 25 bp, E. coli
gatcgacgggattagcaagtcagga

SEQ ID NO: 155334 - DNA, 25 bp, E. coli
gatcgacgggataagcaagtcagga

SEQ ID NO: 155335 - DNA, 25 bp, E. coli
gggattagcaagacaggaggtctta

SEQ ID NO: 155336 - DNA, 25 bp, E. coli
gggattagcaagtcaggaggtctta

SEQ ID NO: 155337 - DNA, 25 bp, E. coli
aacgcgctttatatactgaaaacag

SEQ ID NO: 155338 - DNA, 25 bp, E. coli
cagcgtcaaagatacgcgctttatt

SEQ ID NO: 155339 - DNA, 25 bp, E. coli
cagcgtcaaagaaacgcgctttatt

SEQ ID NO: 155340 - DNA, 25 bp, E. coli
aacgcgctttatttactgaaaacag

SEQ ID NO: 155341 - DNA, 25 bp, E. coli
tatttactgaaaacaggtgacccga

SEQ ID NO: 155342 - DNA, 25 bp, E. coli
tatttactgaaatcaggtgacccga

SEQ ID NO: 155343 - DNA, 25 bp, E. coli
gcacatcagggatagtaaaaaaggt

SEQ ID NO: 155344 - DNA, 25 bp, E. coli
gcacatcagggaaagtaaaaaaggt

SEQ ID NO: 155345 - DNA, 25 bp, E. coli
gaaaacaggtgacccgataagcact

SEQ ID NO: 155346 - DNA, 25 bp, E. coli
gaaaacaggtgagccgataagcact

SEQ ID NO: 155347 - DNA, 25 bp, E. coli
cgataagcacttcctctacaatggg

SEQ ID NO: 155348 - DNA, 25 bp, E. coli
cgttacagcgtcaaagaaacgcgct

SEQ ID NO: 155349 - DNA, 25 bp, E. coli
cgttacagcgtctaagaaacgcgct

SEQ ID NO: 155350 - DNA, 25 bp, E. coli
cgataagcacttgctctacaatggg

SEQ ID NO: 155351 - DNA, 25 bp, E. coli
cttcctctacaaagggggcgcacat

SEQ ID NO: 155352 - DNA, 25 bp, E. coli
cttcctctacaatgggggcgcacat

SEQ ID NO: 155353 - DNA, 25 bp, E. coli
gggcgcacatcacggaaagtaaaaa

SEQ ID NO: 155354 - DNA, 25 bp, E. coli
gggcgcacatcagggaaagtaaaaa

SEQ ID NO: 155355 - DNA, 25 bp, E. coli
ggtgacccgataagcacttcctcta

SEQ ID NO: 155356 - DNA, 25 bp, E. coli
ggtgacccgatatgcacttcctcta

SEQ ID NO: 155357 - DNA, 25 bp, E. coli
gtgttaccgttagagcgtcaaagaa

SEQ ID NO: 155358 - DNA, 25 bp, E. coli
gtgttaccgttacagcgtcaaagaa

SEQ ID NO: 155359 - DNA, 25 bp, E. coli
taacaattatttaacatactggaca

SEQ ID NO: 155360 - DNA, 25 bp, E. coli
tacatgtgcaataccgtaacctgga

SEQ ID NO: 155361 - DNA, 25 bp, E. coli
tacatgtgcaattccgtaacctgga

SEQ ID NO: 155362 - DNA, 25 bp, E. coli
tacatgtgtgttcccgtaggtcgga

SEQ ID NO: 155363 - DNA, 25 bp, E. coli
tacatgtgcaatgctcctggccgga

SEQ ID NO: 155364 - DNA, 25 bp, E. coli
taacaattattttacatactggaca

SEQ ID NO: 155365 - DNA, 25 bp, E. coli
tacatgtgcaatcctcctggccgga

SEQ ID NO: 155366 - DNA, 25 bp, E. coli
tacatgtgtgttgccgtaggtcgga

SEQ ID NO: 155367 - DNA, 25 bp, E. coli
gcatccggcgttttcaccgggcgta

SEQ ID NO: 155368 - DNA, 25 bp, E. coli
gcatccggcgttatcaccgggcgta

SEQ ID NO: 155369 - DNA, 25 bp, E. coli
gaactcatccgagcacataacaatt

SEQ ID NO: 155370 - DNA, 25 bp, E. coli
gaactcatccgaccacataacaatt

SEQ ID NO: 155371 - DNA, 25 bp, E. coli
cgggcgtattctttttgaatcccat

SEQ ID NO: 155372 - DNA, 25 bp, E. coli
ctccggcgacggctaaattagaact

SEQ ID NO: 155373 - DNA, 25 bp, E. coli
cgggcgtattctatttgaatcccat

SEQ ID NO: 155374 - DNA, 25 bp, E. coli
ctccggcgacgggtaaattagaact

SEQ ID NO: 155375 - DNA, 25 bp, E. coli
tttttgaatcccttcacaaaccccg

SEQ ID NO: 155376 - DNA, 25 bp, E. coli
tttttgaatcccatcacaaaccccg

SEQ ID NO: 155377 - DNA, 25 bp, E. coli
ggctaaattagatctcatccgacca

SEQ ID NO: 155378 - DNA, 25 bp, E. coli
ggctaaattagaactcatccgacca

SEQ ID NO: 155379 - DNA, 25 bp, E. coli
taacctggataaaacgcgacaagcg

SEQ ID NO: 155380 - DNA, 25 bp, E. coli
taacctggataatacgcgacaagcg

SEQ ID NO: 155381 - DNA, 25 bp, E. coli
caagtctgggctcctggctaagtta

SEQ ID NO: 155382 - DNA, 25 bp, E. coli
caagtctgggctgctggctaagtta

SEQ ID NO: 155383 - DNA, 25 bp, E. coli
tacgattgcgattctgaccgccgca

SEQ ID NO: 155384 - DNA, 25 bp, E. coli
tatgccttaagtatgattccgttcg

SEQ ID NO: 155385 - DNA, 25 bp, E. coli
tatggattttctccctacgattgcg

SEQ ID NO: 155386 - DNA, 25 bp, E. coli
tatgccttaagtttgattccgttcg

SEQ ID NO: 155387 - DNA, 25 bp, E. coli
tatggattttctgcctacgattgcg

SEQ ID NO: 155388 - DNA, 25 bp, E. coli
taccaaaacggtcaaaggctggctg

SEQ ID NO: 155389 - DNA, 25 bp, E. coli
taccaaaacggtgaaaggctggctg

SEQ ID NO: 155390 - DNA, 25 bp, E. coli
tacgattgcgatactgaccgccgca

SEQ ID NO: 155391 - DNA, 25 bp, E. coli
tattcaagatatcatcgctgcgctc

SEQ ID NO: 155392 - DNA, 25 bp, E. coli
tattcaagatatgatcgctgcgctc

SEQ ID NO: 155393 - DNA, 25 bp, E. coli
tcgttaaacgccatgaagatcaggt

SEQ ID NO: 155394 - DNA, 25 bp, E. coli
tcgttaaacgccttgaagatcaggt

SEQ ID NO: 155395 - DNA, 25 bp, E. coli
gctgctgccaaccatggcgggaatt

SEQ ID NO: 155396 - DNA, 25 bp, E. coli
gctgcgctctgggaacacgactttg

SEQ ID NO: 155397 - DNA, 25 bp, E. coli
gctgcgctctggcaacacgactttg

SEQ ID NO: 155398 - DNA, 25 bp, E. coli
gctgctgccaacgatggcgggaatt

SEQ ID NO: 155399 - DNA, 25 bp, E. coli
ggctggcacagcttcctgctaaata

SEQ ID NO: 155400 - DNA, 25 bp, E. coli
ggctggcacagcatcctgctaaata

SEQ ID NO: 155401 - DNA, 25 bp, E. coli
taatgacgttcctgatgatcctgcc

SEQ ID NO: 155402 - DNA, 25 bp, E. coli
taatgacgttccagatgatcctgcc

SEQ ID NO: 155403 - DNA, 25 bp, E. coli
aatttccgggaatgaagaagatgcc

SEQ ID NO: 155404 - DNA, 25 bp, E. coli
aatttccgggaaagaagaagatgcc

SEQ ID NO: 155405 - DNA, 25 bp, E. coli
caaaactgcgtaatgaacgcggaga

SEQ ID NO: 155406 - DNA, 25 bp, E. coli
caaaactgcgtattgaacgcggaga

SEQ ID NO: 155407 - DNA, 25 bp, E. coli
aacacattggcgaggcaatttccgg

SEQ ID NO: 155408 - DNA, 25 bp, E. coli
aacacattggcgtggcaatttccgg

SEQ ID NO: 155409 - DNA, 25 bp, E. coli
tatgcaaaaagagcagtgcgacctc

SEQ ID NO: 155410 - DNA, 25 bp, E. coli
tatgcaaaaagaccagtgcgacctc

SEQ ID NO: 155411 - DNA, 25 bp, E. coli
gaagatgccttagtggtgaataaag

SEQ ID NO: 155412 - DNA, 25 bp, E. coli
gaagatgccttactggtgaataaag

SEQ ID NO: 155413 - DNA, 25 bp, E. coli
cttaagcgagttctatccgggtatc

SEQ ID NO: 155414 - DNA, 25 bp, E. coli
cgggtatctactaccctgcaacaga

SEQ ID NO: 155415 - DNA, 25 bp, E. coli
cttaagcgagttgtatccgggtatc

SEQ ID NO: 155416 - DNA, 25 bp, E. coli
cgggtatctacttccctgcaacaga

SEQ ID NO: 155417 - DNA, 25 bp, E. coli
tggagctcgccagacataatgacgc

SEQ ID NO: 155418 - DNA, 25 bp, E. coli
tggagctcgccacacataatgacgc

SEQ ID NO: 155419 - DNA, 25 bp, E. coli
tcaatggccgaagacaaaactgcgt

SEQ ID NO: 155420 - DNA, 25 bp, E. coli
tcaaccgtttgaagccggcatatcg

SEQ ID NO: 155421 - DNA, 25 bp, E. coli
tcaaccgtttgatgccggcatatcg

SEQ ID NO: 155422 - DNA, 25 bp, E. coli
tcaatggccgaacacaaaactgcgt

SEQ ID NO: 155423 - DNA, 25 bp, E. coli
gagaaatgccggaaacactgctgga

SEQ ID NO: 155424 - DNA, 25 bp, E. coli
gagaaatgccggtaacactgctgga

SEQ ID NO: 155425 - DNA, 25 bp, E. coli
caggaactctcagtggcaactgtta

SEQ ID NO: 155426 - DNA, 25 bp, E. coli
caggaactctcactggcaactgtta

SEQ ID NO: 155427 - DNA, 25 bp, E. coli
atttccggtactgcccgttgctgcg

SEQ ID NO: 155428 - DNA, 25 bp, E. coli
atttccggtactccccgttgctgcg

SEQ ID NO: 155429 - DNA, 25 bp, E. coli
aaaaatgcccatcccgtcaccagga

SEQ ID NO: 155430 - DNA, 25 bp, E. coli
aaaaatgcccatgccgtcaccagga

SEQ ID NO: 155431 - DNA, 25 bp, E. coli
tgccgatattgcgatgcatcagttt

SEQ ID NO: 155432 - DNA, 25 bp, E. coli
tgccgatattgccatgcatcagttt

SEQ ID NO: 155433 - DNA, 25 bp, E. coli
cctgctggaaactctgtgggatcgt

SEQ ID NO: 155434 - DNA, 25 bp, E. coli
cctgctggaaacactgtgggatcgt

SEQ ID NO: 155435 - DNA, 25 bp, E. coli
gcaggcaaccagtgcggtttattca

SEQ ID NO: 155436 - DNA, 25 bp, E. coli
gcaggcaaccagagcggtttattca

SEQ ID NO: 155437 - DNA, 25 bp, E. coli
gcaactgttacacccagggtggcaa

SEQ ID NO: 155438 - DNA, 25 bp, E. coli
gaataccgggagctttaccgtcagt

SEQ ID NO: 155439 - DNA, 25 bp, E. coli
gaataccgggaggtttaccgtcagt

SEQ ID NO: 155440 - DNA, 25 bp, E. coli
gcaactgttacagccagggtggcaa

SEQ ID NO: 155441 - DNA, 25 bp, E. coli
cggttcacttttccggtctggatgt

SEQ ID NO: 155442 - DNA, 25 bp, E. coli
cggttcacttttgcggtctggatgt

SEQ ID NO: 155443 - DNA, 25 bp, E. coli
ggaccgcattatccgcctgctggaa

SEQ ID NO: 155444 - DNA, 25 bp, E. coli
ggaccgcattatgcgcctgctggaa

SEQ ID NO: 155445 - DNA, 25 bp, E. coli
gatgaacgtgcgtatgctgccgata

SEQ ID NO: 155446 - DNA, 25 bp, E. coli
gatgaacgtgcgaatgctgccgata

SEQ ID NO: 155447 - DNA, 25 bp, E. coli
aagtagtggaactaggaccgtgcgc

SEQ ID NO: 155448 - DNA, 25 bp, E. coli
aagtagtggaacaaggaccgtgcgc

SEQ ID NO: 155449 - DNA, 25 bp, E. coli
tcggtgggttttggccatcagcaaa

SEQ ID NO: 155450 - DNA, 25 bp, E. coli
tcggtgggttttcgccatcagcaaa

SEQ ID NO: 155451 - DNA, 25 bp, E. coli
gcattgtcagaatactggcccaccg

SEQ ID NO: 155452 - DNA, 25 bp, E. coli
gcattgtcagaaaactggcccaccg

SEQ ID NO: 155453 - DNA, 25 bp, E. coli
gaaggcttacgggttcaccagccga

SEQ ID NO: 155454 - DNA, 25 bp, E. coli
gcaaaatttaaaacgccgccagctg

SEQ ID NO: 155455 - DNA, 25 bp, E. coli
gcaaaatttaaatcgccgccagctg

SEQ ID NO: 155456 - DNA, 25 bp, E. coli
gaaggcttacggcttcaccagccga

SEQ ID NO: 155457 - DNA, 25 bp, E. coli
cgatttgcacgtagtccgcgcgtta

SEQ ID NO: 155458 - DNA, 25 bp, E. coli
cgcagcaggagtttacgcgtcagct

SEQ ID NO: 155459 - DNA, 25 bp, E. coli
cgcagcaggagtatacgcgtcagct

SEQ ID NO: 155460 - DNA, 25 bp, E. coli
cgatttgcacgttgtccgcgcgtta

SEQ ID NO: 155461 - DNA, 25 bp, E. coli
gattatccgcatcagctctccggcg

SEQ ID NO: 155462 - DNA, 25 bp, E. coli
gattatccgcatgagctctccggcg

SEQ ID NO: 155463 - DNA, 25 bp, E. coli
gggattagatcctgaaacacgccac

SEQ ID NO: 155464 - DNA, 25 bp, E. coli
gggattagatccagaaacacgccac

SEQ ID NO: 155465 - DNA, 25 bp, E. coli
taatgcaaaacggtcgctgtgtcga

SEQ ID NO: 155466 - DNA, 25 bp, E. coli
taatgcaaaacgctcgctgtgtcga

SEQ ID NO: 155467 - DNA, 25 bp, E. coli
gatggcgctgttaacgcgaccggaa

SEQ ID NO: 155468 - DNA, 25 bp, E. coli
gatggcgctgtttacgcgaccggaa

SEQ ID NO: 155469 - DNA, 25 bp, E. coli
catttgccagctacgtgatgcaggc

SEQ ID NO: 155470 - DNA, 25 bp, E. coli
catattctgctgtccatctggctgg

SEQ ID NO: 155471 - DNA, 25 bp, E. coli
catattctgctgaccatctggctgg

SEQ ID NO: 155472 - DNA, 25 bp, E. coli
tgggcattatggaacacggcgcata

SEQ ID NO: 155473 - DNA, 25 bp, E. coli
tgggcattatggtacacggcgcata

SEQ ID NO: 155474 - DNA, 25 bp, E. coli
tgacgcgtaaagagatcctcaccaa

SEQ ID NO: 155475 - DNA, 25 bp, E. coli
tgacgcgtaaagtgatcctcaccaa

SEQ ID NO: 155476 - DNA, 25 bp, E. coli
tgccgatgcgccattaatgactgat

SEQ ID NO: 155477 - DNA, 25 bp, E. coli
tgccgatgcgcctttaatgactgat

SEQ ID NO: 155478 - DNA, 25 bp, E. coli
tcaccggtgtgtgcgcgtctgttaa

SEQ ID NO: 155479 - DNA, 25 bp, E. coli
tcaccggtgtgtccgcgtctgttaa

SEQ ID NO: 155480 - DNA, 25 bp, E. coli
tctggtcacggccaatacggcagtg

SEQ ID NO: 155481 - DNA, 25 bp, E. coli
tctggtcacggcgaatacggcagtg

SEQ ID NO: 155482 - DNA, 25 bp, E. coli
cctggcactggaccggattttttgt

SEQ ID NO: 155483 - DNA, 25 bp, E. coli
cctggcactggagcggattttttgt

SEQ ID NO: 155484 - DNA, 25 bp, E. coli
ccgtttctgaaaccgcctgccgatg

SEQ ID NO: 155485 - DNA, 25 bp, E. coli
ccgtttctgaaagcgcctgccgatg

SEQ ID NO: 155486 - DNA, 25 bp, E. coli
catttgccagcttcgtgatgcaggc

SEQ ID NO: 155487 - DNA, 25 bp, E. coli
ggcctgttagcgtccctgttttaca

SEQ ID NO: 155488 - DNA, 25 bp, E. coli
ggcgtgtcgaagattgtctccggca

SEQ ID NO: 155489 - DNA, 25 bp, E. coli
ggcgtgtcgaagtttgtctccggca

SEQ ID NO: 155490 - DNA, 25 bp, E. coli
ggcctgttagcgaccctgttttaca

SEQ ID NO: 155491 - DNA, 25 bp, E. coli
caaaatatgttatggttgcgccctc

SEQ ID NO: 155492 - DNA, 25 bp, E. coli
caaaatatgttaaggttgcgccctc

SEQ ID NO: 155493 - DNA, 25 bp, E. coli
caggcgagaccatatgcacatcaat

SEQ ID NO: 155494 - DNA, 25 bp, E. coli
cagattccggaaatgtacgtgtcaa

SEQ ID NO: 155495 - DNA, 25 bp, E. coli
catactcgttgcaaaacgtggcacg

SEQ ID NO: 155496 - DNA, 25 bp, E. coli
cagattccggaattgtacgtgtcaa

SEQ ID NO: 155497 - DNA, 25 bp, E. coli
catactcgttgctaaacgtggcacg

SEQ ID NO: 155498 - DNA, 25 bp, E. coli
caggcgagaccaaatgcacatcaat

SEQ ID NO: 155499 - DNA, 25 bp, E. coli
aaaccatcacgggttgttgttcatg

SEQ ID NO: 155500 - DNA, 25 bp, E. coli
aaaccatcacggcttgttgttcatg

SEQ ID NO: 155501 - DNA, 25 bp, E. coli
aacgtggcacgttcggactgaatac

SEQ ID NO: 155502 - DNA, 25 bp, E. coli
aacgtggcacgtacggactgaatac

SEQ ID NO: 155503 - DNA, 25 bp, E. coli
tatgcctgcatgaacgcgaaaacca

SEQ ID NO: 155504 - DNA, 25 bp, E. coli
tatgcctgcatgtacgcgaaaacca

SEQ ID NO: 155505 - DNA, 25 bp, E. coli
tgaatactttcactcaggcgagacc

SEQ ID NO: 155506 - DNA, 25 bp, E. coli
tgaatactttcagtcaggcgagacc

SEQ ID NO: 155507 - DNA, 25 bp, E. coli
gcacatcaatcggtatgcctgcatg

SEQ ID NO: 155508 - DNA, 25 bp, E. coli
gcacatcaatcgctatgcctgcatg

SEQ ID NO: 155509 - DNA, 25 bp, E. coli
taataatcagacttagcttaggcta

SEQ ID NO: 155510 - DNA, 25 bp, E. coli
taataatcagacatagcttaggcta

SEQ ID NO: 155511 - DNA, 25 bp, E. coli
gagtagccgattaccagattccgga

SEQ ID NO: 155512 - DNA, 25 bp, E. coli
gagtagccgatttccagattccgga

SEQ ID NO: 155513 - DNA, 25 bp, E. coli
catggttgctttcgtgttacagcga

SEQ ID NO: 155514 - DNA, 25 bp, E. coli
cagacactggcaacattggtgggag

SEQ ID NO: 155515 - DNA, 25 bp, E. coli
catggttgctttggtgttacagcga

SEQ ID NO: 155516 - DNA, 25 bp, E. coli
cattgctttggtcagcccggttgaa

SEQ ID NO: 155517 - DNA, 25 bp, E. coli
cagacactggcatcattggtgggag

SEQ ID NO: 155518 - DNA, 25 bp, E. coli
cattgctttggtgagcccggttgaa

SEQ ID NO: 155519 - DNA, 25 bp, E. coli
aacttgcagggcgtgaggcctatga

SEQ ID NO: 155520 - DNA, 25 bp, E. coli
aacttgcagggcctgaggcctatga

SEQ ID NO: 155521 - DNA, 25 bp, E. coli
tattgcttgtgaggagaacacgttc

SEQ ID NO: 155522 - DNA, 25 bp, E. coli
tattgcttgtgacgagaacacgttc

SEQ ID NO: 155523 - DNA, 25 bp, E. coli
tgttcgtgagcaacttatggcagct

SEQ ID NO: 155524 - DNA, 25 bp, E. coli
tgttcgtgagcatcttatggcagct

SEQ ID NO: 155525 - DNA, 25 bp, E. coli
ccagctcgaagcgtggcaggagcat

SEQ ID NO: 155526 - DNA, 25 bp, E. coli
ccagctcgaagcctggcaggagcat

SEQ ID NO: 155527 - DNA, 25 bp, E. coli
gcagctactgctgacttgaacggag

SEQ ID NO: 155528 - DNA, 25 bp, E. coli
gcagctactgctcacttgaacggag

SEQ ID NO: 155529 - DNA, 25 bp, E. coli
cttgaacggagcaacgaaaggccag

SEQ ID NO: 155530 - DNA, 25 bp, E. coli
cttgaacggagctacgaaaggccag

SEQ ID NO: 155531 - DNA, 25 bp, E. coli
taagacactggaacgcctgaagacg

SEQ ID NO: 155532 - DNA, 25 bp, E. coli
taagacactggatcgcctgaagacg

SEQ ID NO: 155533 - DNA, 25 bp, E. coli
gaggcctatgaaaaccagacactgg

SEQ ID NO: 155534 - DNA, 25 bp, E. coli
gaggcctatgaataccagacactgg

SEQ ID NO: 155535 - DNA, 25 bp, E. coli
aatcggagcttcaggtctgagtaac

SEQ ID NO: 155536 - DNA, 25 bp, E. coli
aatcggagcttctggtctgagtaac

SEQ ID NO: 155537 - DNA, 25 bp, E. coli
cattttcgtctggatgatgacctgc

SEQ ID NO: 155538 - DNA, 25 bp, E. coli
aacaagccagcgcactggtaccaga

SEQ ID NO: 155539 - DNA, 25 bp, E. coli
aacaagccagcggactggtaccaga

SEQ ID NO: 155540 - DNA, 25 bp, E. coli
tattgcctctgtcatgcacctggga

SEQ ID NO: 155541 - DNA, 25 bp, E. coli
tattgcctctgtgatgcacctggga

SEQ ID NO: 155542 - DNA, 25 bp, E. coli
tgggatcgccacagcgggcgtttaa

SEQ ID NO: 155543 - DNA, 25 bp, E. coli
tgggatcgccactgcgggcgtttaa

SEQ ID NO: 155544 - DNA, 25 bp, E. coli
tcatcggtaaaatgccgcaagcgtt

SEQ ID NO: 155545 - DNA, 25 bp, E. coli
tcatcggtaaaaagccgcaagcgtt

SEQ ID NO: 155546 - DNA, 25 bp, E. coli
cgtgtggtattgatatgcgcaggtc

SEQ ID NO: 155547 - DNA, 25 bp, E. coli
cgtgtggtattgttatgcgcaggtc

SEQ ID NO: 155548 - DNA, 25 bp, E. coli
cattttcgtctgcatgatgacctgc

SEQ ID NO: 155549 - DNA, 25 bp, E. coli
gattacgcctccttacaggtctggc

SEQ ID NO: 155550 - DNA, 25 bp, E. coli
gattacgcctccatacaggtctggc

SEQ ID NO: 155551 - DNA, 25 bp, E. coli
ggcataacggtttcactacgctggc

SEQ ID NO: 155552 - DNA, 25 bp, E. coli
ggcataacggttacactacgctggc

SEQ ID NO: 155553 - DNA, 25 bp, E. coli
taacgagattgcagccggttccata

SEQ ID NO: 155554 - DNA, 25 bp, E. coli
taacgagattgctgccggttccata

SEQ ID NO: 155555 - DNA, 25 bp, E. coli
gatgacctgcgtctatcaaatcgac

SEQ ID NO: 155556 - DNA, 25 bp, E. coli
gatgacctgcgtgtatcaaatcgac

SEQ ID NO: 155557 - DNA, 25 bp, E. coli
aatgctaaaggctacggactacccg

SEQ ID NO: 155558 - DNA, 25 bp, E. coli
caatggcttttcagacggatgcgag

SEQ ID NO: 155559 - DNA, 25 bp, E. coli
aatgctaaaggcaacggactacccg

SEQ ID NO: 155560 - DNA, 25 bp, E. coli
caatggcttttctgacggatgcgag

SEQ ID NO: 155561 - DNA, 25 bp, E. coli
gaaagactccccagttgaaaagcat

SEQ ID NO: 155562 - DNA, 25 bp, E. coli
cagaatgttgttgagccggaacacc

SEQ ID NO: 155563 - DNA, 25 bp, E. coli
cagaatgttgttcagccggaacacc

SEQ ID NO: 155564 - DNA, 25 bp, E. coli
gaaagactcccctgttgaaaagcat

SEQ ID NO: 155565 - DNA, 25 bp, E. coli
tcatctggaagatgcatcaaccgaa

SEQ ID NO: 155566 - DNA, 25 bp, E. coli
tcatctggaagaagcatcaaccgaa

SEQ ID NO: 155567 - DNA, 25 bp, E. coli
gcttcacgaggagagcgacaacgat

SEQ ID NO: 155568 - DNA, 25 bp, E. coli
gcttcacgaggacagcgacaacgat

SEQ ID NO: 155569 - DNA, 25 bp, E. coli
gaagccacgcctcaactctctgggt

SEQ ID NO: 155570 - DNA, 25 bp, E. coli
gaagccacgcctgaactctctgggt

SEQ ID NO: 155571 - DNA, 25 bp, E. coli
gagcggcgcatcttggcttacagaa

SEQ ID NO: 155572 - DNA, 25 bp, E. coli
gagcggcgcatcatggcttacagaa

SEQ ID NO: 155573 - DNA, 25 bp, E. coli
ggacatgagcttgccagaacctacg

SEQ ID NO: 155574 - DNA, 25 bp, E. coli
gtaaatcctacgtcacgaagccacg

SEQ ID NO: 155575 - DNA, 25 bp, E. coli
gtaaatcctacgacacgaagccacg

SEQ ID NO: 155576 - DNA, 25 bp, E. coli
ggacatgagcttcccagaacctacg

SEQ ID NO: 155577 - DNA, 25 bp, E. coli
taagatgaagtcaccagcgccaaga

SEQ ID NO: 155578 - DNA, 25 bp, E. coli
taagatgaagtctccagcgccaaga

SEQ ID NO: 155579 - DNA, 25 bp, E. coli
cagatggtccggcacccggatatcc

SEQ ID NO: 155580 - DNA, 25 bp, E. coli
cagatggtccgggacccggatatcc

SEQ ID NO: 155581 - DNA, 25 bp, E. coli
catgttcagaatgagccattcccgt

SEQ ID NO: 155582 - DNA, 25 bp, E. coli
catgttcagaatcagccattcccgt

SEQ ID NO: 155583 - DNA, 25 bp, E. coli
accgactatcagatggtccggcacc

SEQ ID NO: 155584 - DNA, 25 bp, E. coli
accgactatcagttggtccggcacc

SEQ ID NO: 155585 - DNA, 25 bp, E. coli
tgttcagaatcagccattcccgtgc

SEQ ID NO: 155586 - DNA, 25 bp, E. coli
tgttcagaatcacccattcccgtgc

SEQ ID NO: 155587 - DNA, 25 bp, E. coli
tccagtcccgccttgttcagaatca

SEQ ID NO: 155588 - DNA, 25 bp, E. coli
tccagtcccgccatgttcagaatca

SEQ ID NO: 155589 - DNA, 25 bp, E. coli
ccagtcccgccatgttcagaatcag

SEQ ID NO: 155590 - DNA, 25 bp, E. coli
ccagtcccgccaagttcagaatcag

SEQ ID NO: 155591 - DNA, 25 bp, E. coli
gccaccgactatgagatggtccggc

SEQ ID NO: 155592 - DNA, 25 bp, E. coli
cccgccatgttcagaatcagccatt

SEQ ID NO: 155593 - DNA, 25 bp, E. coli
cccgccatgttctgaatcagccatt

SEQ ID NO: 155594 - DNA, 25 bp, E. coli
gccaccgactatcagatggtccggc

SEQ ID NO: 155595 - DNA, 25 bp, E. coli
ctatcagatggtccggcacccggat

SEQ ID NO: 155596 - DNA, 25 bp, E. coli
ctatcagatggtgcggcacccggat

SEQ ID NO: 155597 - DNA, 25 bp, E. coli
gtcccgccatgttcagaatcagcca

SEQ ID NO: 155598 - DNA, 25 bp, E. coli
gtcccgccatgtacagaatcagcca

SEQ ID NO: 155599 - DNA, 25 bp, E. coli
gatggtccggcagccggatatccac

SEQ ID NO: 155600 - DNA, 25 bp, E. coli
gatggtccggcacccggatatccac

SEQ ID NO: 155601 - DNA, 25 bp, E. coli
aaggtgaaggtaagcgtcgcctgac

SEQ ID NO: 155602 - DNA, 25 bp, E. coli
aaggtgaaggtatgcgtcgcctgac

SEQ ID NO: 155603 - DNA, 25 bp, E. coli
caccatgcgtatgttgcaggaagag

SEQ ID NO: 155604 - DNA, 25 bp, E. coli
caccatgcgtatcttgcaggaagag

SEQ ID NO: 155605 - DNA, 25 bp, E. coli
taaaaggccgtgtagataaacgtct

SEQ ID NO: 155606 - DNA, 25 bp, E. coli
taaaaggccgtgaagataaacgtct

SEQ ID NO: 155607 - DNA, 25 bp, E. coli
attgtgccgaaacatcgctccgcac

SEQ ID NO: 155608 - DNA, 25 bp, E. coli
attgtgccgaaagatcgctccgcac

SEQ ID NO: 155609 - DNA, 25 bp, E. coli
tgaacattgcgaagagttgatcagc

SEQ ID NO: 155610 - DNA, 25 bp, E. coli
tgaacattgcgatgagttgatcagc

SEQ ID NO: 155611 - DNA, 25 bp, E. coli
tctcgacgagaaaagcgacggtgcc

SEQ ID NO: 155612 - DNA, 25 bp, E. coli
tctcgacgagaatagcgacggtgcc

SEQ ID NO: 155613 - DNA, 25 bp, E. coli
gccggatctgatcgcttcgctcgat

SEQ ID NO: 155614 - DNA, 25 bp, E. coli
gccggatctgatggcttcgctcgat

SEQ ID NO: 155615 - DNA, 25 bp, E. coli
gaatatctggatcgtcggtacggca

SEQ ID NO: 155616 - DNA, 25 bp, E. coli
gaatatctggatggtcggtacggca

SEQ ID NO: 155617 - DNA, 25 bp, E. coli
cgacggtgccgtccatcagggcatt

SEQ ID NO: 155618 - DNA, 25 bp, E. coli
cgacggtgccgtgcatcagggcatt

SEQ ID NO: 155619 - DNA, 25 bp, E. coli
ggagcgcgcccctgaacgttttcag

SEQ ID NO: 155620 - DNA, 25 bp, E. coli
ggagcgcgccccagaacgttttcag

SEQ ID NO: 155621 - DNA, 25 bp, E. coli
ggcaaaccgccattatctcgacgag

SEQ ID NO: 155622 - DNA, 25 bp, E. coli
ggcaaaccgccaatatctcgacgag

SEQ ID NO: 155623 - DNA, 25 bp, E. coli
ttttggttcactcccgatcatcgcg

SEQ ID NO: 155624 - DNA, 25 bp, E. coli
ttttggttcactgccgatcatcgcg

SEQ ID NO: 155625 - DNA, 25 bp, E. coli
tgttgtgttttagtgcagcggcgac

SEQ ID NO: 155626 - DNA, 25 bp, E. coli
tgttttactgcaccggcgacacgcc

SEQ ID NO: 155627 - DNA, 25 bp, E. coli
tgttttactgcagcggcgacacgcc

SEQ ID NO: 155628 - DNA, 25 bp, E. coli
tgttgtgttttactgcagcggcgac

SEQ ID NO: 155629 - DNA, 25 bp, E. coli
tgctggttcagttgtggacttttgg

SEQ ID NO: 155630 - DNA, 25 bp, E. coli
tgctggttcagtagtggacttttgg

SEQ ID NO: 155631 - DNA, 25 bp, E. coli
ccaccgtgccacagttgtgttttac

SEQ ID NO: 155632 - DNA, 25 bp, E. coli
ccaccgtgccactgttgtgttttac

SEQ ID NO: 155633 - DNA, 25 bp, E. coli
cgatatgtggagagctggttcagtt

SEQ ID NO: 155634 - DNA, 25 bp, E. coli
cgccagcgtacttcaaactgattta

SEQ ID NO: 155635 - DNA, 25 bp, E. coli
cgatatgtggagtgctggttcagtt

SEQ ID NO: 155636 - DNA, 25 bp, E. coli
cgccagcgtactacaaactgattta

SEQ ID NO: 155637 - DNA, 25 bp, E. coli
gttcactgccgaacatcgcgctggg

SEQ ID NO: 155638 - DNA, 25 bp, E. coli
gttcactgccgatcatcgcgctggg

SEQ ID NO: 155639 - DNA, 25 bp, E. coli
gggtattgcgccagcgtacttcaaa

SEQ ID NO: 155640 - DNA, 25 bp, E. coli
gggtattgcgcctgcgtacttcaaa

SEQ ID NO: 155641 - DNA, 25 bp, E. coli
tggacttttggttcactgccgatca

SEQ ID NO: 155642 - DNA, 25 bp, E. coli
ggcgacacgcctccgtctctcaacg

SEQ ID NO: 155643 - DNA, 25 bp, E. coli
ggcgacacgcctgcgtctctcaacg

SEQ ID NO: 155644 - DNA, 25 bp, E. coli
tggacttttggtacactgccgatca

SEQ ID NO: 155645 - DNA, 25 bp, E. coli
tactgtatgaactagggcatggcga

SEQ ID NO: 155646 - DNA, 25 bp, E. coli
tactgtatgaacaagggcatggcga

SEQ ID NO: 155647 - DNA, 25 bp, E. coli
tatgacttaggtgcgtaccggctgg

SEQ ID NO: 155648 - DNA, 25 bp, E. coli
tatgacttaggtccgtaccggctgg

SEQ ID NO: 155649 - DNA, 25 bp, E. coli
tatactgcccggcaaactggatgcg

SEQ ID NO: 155650 - DNA, 25 bp, E. coli
tatactgcccgggaaactggatgcg

SEQ ID NO: 155651 - DNA, 25 bp, E. coli
tgaaagaactcgcacgctactggag

SEQ ID NO: 155652 - DNA, 25 bp, E. coli
tgaaagaactcggacgctactggag

SEQ ID NO: 155653 - DNA, 25 bp, E. coli
tcagcacgggatgttttacggaacg

SEQ ID NO: 155654 - DNA, 25 bp, E. coli
tcagcacgggatcttttacggaacg

SEQ ID NO: 155655 - DNA, 25 bp, E. coli
gaaccggtgcctcttatcactgaaa

SEQ ID NO: 155656 - DNA, 25 bp, E. coli
gaaccggtgcctgttatcactgaaa

SEQ ID NO: 155657 - DNA, 25 bp, E. coli
gaaatcgccaacgagctggtaagcc

SEQ ID NO: 155658 - DNA, 25 bp, E. coli
gaaatcgccaaccagctggtaagcc

SEQ ID NO: 155659 - DNA, 25 bp, E. coli
cccgcgcagagtagaggaaatcaac

SEQ ID NO: 155660 - DNA, 25 bp, E. coli
cccgcgcagagttgaggaaatcaac

SEQ ID NO: 155661 - DNA, 25 bp, E. coli
ggaagcaaaatctgccgaacaggcg

SEQ ID NO: 155662 - DNA, 25 bp, E. coli
ggaagcaaaatcagccgaacaggcg

SEQ ID NO: 155663 - DNA, 25 bp, E. coli
gatgagtccattgacctgcctgcag

SEQ ID NO: 155664 - DNA, 25 bp, E. coli
gatgagtccattcacctgcctgcag

SEQ ID NO: 155665 - DNA, 25 bp, E. coli
gatgcggcgcgcaaatcattagtgg

SEQ ID NO: 155666 - DNA, 25 bp, E. coli
gatgcggcgcgctaatcattagtgg

SEQ ID NO: 155667 - DNA, 25 bp, E. coli
accttatcagccatgtgggtatggg

SEQ ID NO: 155668 - DNA, 25 bp, E. coli
accttatcagccttgtgggtatggg

SEQ ID NO: 155669 - DNA, 25 bp, E. coli
tatgcgttttttgcatagcagaaaa

SEQ ID NO: 155670 - DNA, 25 bp, E. coli
tatgcgttttttccatagcagaaaa

SEQ ID NO: 155671 - DNA, 25 bp, E. coli
tttgtgtatgtgtgttgcttgagcc

SEQ ID NO: 155672 - DNA, 25 bp, E. coli
tttgtgtatgtgagttgcttgagcc

SEQ ID NO: 155673 - DNA, 25 bp, E. coli
ttcctggagctgaaaaaccttatca

SEQ ID NO: 155674 - DNA, 25 bp, E. coli
ttcctggagctgtaaaaccttatca

SEQ ID NO: 155675 - DNA, 25 bp, E. coli
tgtttcttgctatgcgttttttgca

SEQ ID NO: 155676 - DNA, 25 bp, E. coli
tgttgcttgagcgaggaaaattcct

SEQ ID NO: 155677 - DNA, 25 bp, E. coli
tgtatgtgtgttgcttgagccagga

SEQ ID NO: 155678 - DNA, 25 bp, E. coli
tgtttcttgctaagcgttttttgca

SEQ ID NO: 155679 - DNA, 25 bp, E. coli
tgtatgtgtgttccttgagccagga

SEQ ID NO: 155680 - DNA, 25 bp, E. coli
tgttgcttgagccaggaaaattcct

SEQ ID NO: 155681 - DNA, 25 bp, E. coli
tgagccaggaaaattcctggagctg

SEQ ID NO: 155682 - DNA, 25 bp, E. coli
tgagccaggaaatttcctggagctg

SEQ ID NO: 155683 - DNA, 25 bp, E. coli
tgaaaaaccttaacagccatgtggg

SEQ ID NO: 155684 - DNA, 25 bp, E. coli
tgaaaaaccttatcagccatgtggg

SEQ ID NO: 155685 - DNA, 25 bp, E. coli
cgttttttgcattgcagaaaaatga

SEQ ID NO: 155686 - DNA, 25 bp, E. coli
cgttttttgcatagcagaaaaatga

SEQ ID NO: 155687 - DNA, 25 bp, E. coli
gggaaaatgcaagtatgtttcttgc

SEQ ID NO: 155688 - DNA, 25 bp, E. coli
gggaaaatgcaactatgtttcttgc

SEQ ID NO: 155689 - DNA, 25 bp, E. coli
caatgaaatgtgagaggccgaaacc

SEQ ID NO: 155690 - DNA, 25 bp, E. coli
caatgaaatgtgtgaggccgaaacc

SEQ ID NO: 155691 - DNA, 25 bp, E. coli
tactcgctggaaaaagaacagggcg

SEQ ID NO: 155692 - DNA, 25 bp, E. coli
tactcgctggaataagaacagggcg

SEQ ID NO: 155693 - DNA, 25 bp, E. coli
ttttggcgtaaacaccgatcgtctg

SEQ ID NO: 155694 - DNA, 25 bp, E. coli
ttttggcgtaaagaccgatcgtctg

SEQ ID NO: 155695 - DNA, 25 bp, E. coli
tattggcttcctccatgactactcg

SEQ ID NO: 155696 - DNA, 25 bp, E. coli
tatcaaaagaaggtcaggaactggc

SEQ ID NO: 155697 - DNA, 25 bp, E. coli
tattggcttcctgcatgactactcg

SEQ ID NO: 155698 - DNA, 25 bp, E. coli
tatcaaaagaagctcaggaactggc

SEQ ID NO: 155699 - DNA, 25 bp, E. coli
tgctggaaagatctcaccaaaccgg

SEQ ID NO: 155700 - DNA, 25 bp, E. coli
tgctggaaagatgtcaccaaaccgg

SEQ ID NO: 155701 - DNA, 25 bp, E. coli
tccgcgatccggcaaaagtgaaagg

SEQ ID NO: 155702 - DNA, 25 bp, E. coli
tccgcgatccgggaaaagtgaaagg

SEQ ID NO: 155703 - DNA, 25 bp, E. coli
tctgaaagagaataacctgccggtg

SEQ ID NO: 155704 - DNA, 25 bp, E. coli
tctgaaagagaaaaacctgccggtg

SEQ ID NO: 155705 - DNA, 25 bp, E. coli
cggaagcaccctcgcaaaagtcgat

SEQ ID NO: 155706 - DNA, 25 bp, E. coli
cggaagcaccctggcaaaagtcgat

SEQ ID NO: 155707 - DNA, 25 bp, E. coli
gtataaatccccaaaccttgagcag

SEQ ID NO: 155708 - DNA, 25 bp, E. coli
gtataaatcccctaaccttgagcag

SEQ ID NO: 155709 - DNA, 25 bp, E. coli
gtcagcattctgtaaggcgcgcgca

SEQ ID NO: 155710 - DNA, 25 bp, E. coli
gtcagcattctgaaaggcgcgcgca

SEQ ID NO: 155711 - DNA, 25 bp, E. coli
caaaggtatgacgactactttggtg

SEQ ID NO: 155712 - DNA, 25 bp, E. coli
cactactttggtcttgggtaacgct

SEQ ID NO: 155713 - DNA, 25 bp, E. coli
cactactttggtgttgggtaacgct

SEQ ID NO: 155714 - DNA, 25 bp, E. coli
caaaggtatgaccactactttggtg

SEQ ID NO: 155715 - DNA, 25 bp, E. coli
acaacaggcgctcaaaggtatgacc

SEQ ID NO: 155716 - DNA, 25 bp, E. coli
acaacaggcgctgaaaggtatgacc

SEQ ID NO: 155717 - DNA, 25 bp, E. coli
tattggccttagctgtttctgccac

SEQ ID NO: 155718 - DNA, 25 bp, E. coli
tattggccttaggtgtttctgccac

SEQ ID NO: 155719 - DNA, 25 bp, E. coli
ttttagctccggctggctacaggat

SEQ ID NO: 155720 - DNA, 25 bp, E. coli
ttttagctccgggtggctacaggat

SEQ ID NO: 155721 - DNA, 25 bp, E. coli
tcaaggacaacaggcgctcaaaggt

SEQ ID NO: 155722 - DNA, 25 bp, E. coli
tcaaggacaacacgcgctcaaaggt

SEQ ID NO: 155723 - DNA, 25 bp, E. coli
ccggctggctactggatgagatcac

SEQ ID NO: 155724 - DNA, 25 bp, E. coli
ccggctggctacaggatgagatcac

SEQ ID NO: 155725 - DNA, 25 bp, E. coli
ggatactgttaccagcactctgaat

SEQ ID NO: 155726 - DNA, 25 bp, E. coli
ggatactgttacgagcactctgaat

SEQ ID NO: 155727 - DNA, 25 bp, E. coli
ggctacttcagccaccgatctgctg

SEQ ID NO: 155728 - DNA, 25 bp, E. coli
tgcgtttgagtttattggccttagc

SEQ ID NO: 155729 - DNA, 25 bp, E. coli
tgcgtttgagttaattggccttagc

SEQ ID NO: 155730 - DNA, 25 bp, E. coli
ggctacttcagcgaccgatctgctg

SEQ ID NO: 155731 - DNA, 25 bp, E. coli
taacgctttcgagaaagagtactgg

SEQ ID NO: 155732 - DNA, 25 bp, E. coli
taacgctttcgacaaagagtactgg

SEQ ID NO: 155733 - DNA, 25 bp, E. coli
accgcgaccaaggtggttctatgga

SEQ ID NO: 155734 - DNA, 25 bp, E. coli
attatgaagaccgaaggcctgaagc

SEQ ID NO: 155735 - DNA, 25 bp, E. coli
agaccgaaggccagaagcaggcgct

SEQ ID NO: 155736 - DNA, 25 bp, E. coli
agaccgaaggcctgaagcaggcgct

SEQ ID NO: 155737 - DNA, 25 bp, E. coli
attatgaagacccaaggcctgaagc

SEQ ID NO: 155738 - DNA, 25 bp, E. coli
atgaagaccgaaggcctgaagcagg

SEQ ID NO: 155739 - DNA, 25 bp, E. coli
atgaagaccgaacgcctgaagcagg

SEQ ID NO: 155740 - DNA, 25 bp, E. coli
accgcgaccaagctggttctatgga

SEQ ID NO: 155741 - DNA, 25 bp, E. coli
tatgaagaccgatggcctgaagcag

SEQ ID NO: 155742 - DNA, 25 bp, E. coli
tatgaagaccgaaggcctgaagcag

SEQ ID NO: 155743 - DNA, 25 bp, E. coli
tgaccgcgaccaagctggttctatg

SEQ ID NO: 155744 - DNA, 25 bp, E. coli
tgaccgcgaccatgctggttctatg

SEQ ID NO: 155745 - DNA, 25 bp, E. coli
ccaagctggttcaatggagctgaaa

SEQ ID NO: 155746 - DNA, 25 bp, E. coli
ccaagctggttctatggagctgaaa

SEQ ID NO: 155747 - DNA, 25 bp, E. coli
cgcgaccaagctcgttctatggagc

SEQ ID NO: 155748 - DNA, 25 bp, E. coli
cgaaggcctgaagcaggcgctgaat

SEQ ID NO: 155749 - DNA, 25 bp, E. coli
cgaaggcctgaaccaggcgctgaat

SEQ ID NO: 155750 - DNA, 25 bp, E. coli
cgcgaccaagctggttctatggagc

SEQ ID NO: 155751 - DNA, 25 bp, E. coli
gattgaccgcgagcaagctggttct

SEQ ID NO: 155752 - DNA, 25 bp, E. coli
gattgaccgcgaccaagctggttct

SEQ ID NO: 155753 - DNA, 25 bp, E. coli
gaccaagctggtactatggagctga

SEQ ID NO: 155754 - DNA, 25 bp, E. coli
gaccaagctggttctatggagctga

SEQ ID NO: 155755 - DNA, 25 bp, E. coli
aacgaactggctcatgctgcaatga

SEQ ID NO: 155756 - DNA, 25 bp, E. coli
aacgaactggctgatgctgcaatga

SEQ ID NO: 155757 - DNA, 25 bp, E. coli
taccgttgaatcaccgtttgctgaa

SEQ ID NO: 155758 - DNA, 25 bp, E. coli
taccgttgaatctccgtttgctgaa

SEQ ID NO: 155759 - DNA, 25 bp, E. coli
attgataaattatgcctggcaggca

SEQ ID NO: 155760 - DNA, 25 bp, E. coli
attgataaattaagcctggcaggca

SEQ ID NO: 155761 - DNA, 25 bp, E. coli
taccttcgaaggtgctgccgcgttc

SEQ ID NO: 155762 - DNA, 25 bp, E. coli
taccttcgaaggagctgccgcgttc

SEQ ID NO: 155763 - DNA, 25 bp, E. coli
tgaccaatcaggtctacccaacatt

SEQ ID NO: 155764 - DNA, 25 bp, E. coli
tgaccaatcaggactacccaacatt

SEQ ID NO: 155765 - DNA, 25 bp, E. coli
tctgagcagcatgaagaagagaaac

SEQ ID NO: 155766 - DNA, 25 bp, E. coli
tctgagcagcatcaagaagagaaac

SEQ ID NO: 155767 - DNA, 25 bp, E. coli
gctttatcagcatatgagcgcctgg

SEQ ID NO: 155768 - DNA, 25 bp, E. coli
gctttatcagcaaatgagcgcctgg

SEQ ID NO: 155769 - DNA, 25 bp, E. coli
gtttgattacctcactgataccggc

SEQ ID NO: 155770 - DNA, 25 bp, E. coli
gtttgattacctgactgataccggc

SEQ ID NO: 155771 - DNA, 25 bp, E. coli
taatgagcagatcaacctggaactg

SEQ ID NO: 155772 - DNA, 25 bp, E. coli
tcacgcccaggatgagatgacgcat

SEQ ID NO: 155773 - DNA, 25 bp, E. coli
taatgagcagatgaacctggaactg

SEQ ID NO: 155774 - DNA, 25 bp, E. coli
tcacgcccaggaagagatgacgcat

SEQ ID NO: 155775 - DNA, 25 bp, E. coli
gagcgcctggtgcagctatcatacc

SEQ ID NO: 155776 - DNA, 25 bp, E. coli
gagcgcctggtggagctatcatacc

SEQ ID NO: 155777 - DNA, 25 bp, E. coli
caaggaactgtgaaaaaggagtggc

SEQ ID NO: 155778 - DNA, 25 bp, E. coli
caaggaactgtgtaaaaggagtggc

SEQ ID NO: 155779 - DNA, 25 bp, E. coli
aataaattagcctgatggcctgaac

SEQ ID NO: 155780 - DNA, 25 bp, E. coli
aataaattagccagatggcctgaac

SEQ ID NO: 155781 - DNA, 25 bp, E. coli
aatcacaatgttatctcagagatga

SEQ ID NO: 155782 - DNA, 25 bp, E. coli
aatcacaatgttttctcagagatga

SEQ ID NO: 155783 - DNA, 25 bp, E. coli
tagaatagcgcggacaaggaactgt

SEQ ID NO: 155784 - DNA, 25 bp, E. coli
ttgacgtaatttagcttttctctcg

SEQ ID NO: 155785 - DNA, 25 bp, E. coli
ttgacgtaattttgcttttctctcg

SEQ ID NO: 155786 - DNA, 25 bp, E. coli
tagaatagcgcgcacaaggaactgt

SEQ ID NO: 155787 - DNA, 25 bp, E. coli
ttttctctcgtttgaatagcgcgca

SEQ ID NO: 155788 - DNA, 25 bp, E. coli
ttttctctcgttagaatagcgcgca

SEQ ID NO: 155789 - DNA, 25 bp, E. coli
gcctgaactactcggccattagggt

SEQ ID NO: 155790 - DNA, 25 bp, E. coli
gcctgaactactgggccattagggt

SEQ ID NO: 155791 - DNA, 25 bp, E. coli
gccattagggtattgggttatgcta

SEQ ID NO: 155792 - DNA, 25 bp, E. coli
gccattagggtaatgggttatgcta

SEQ ID NO: 155793 - DNA, 25 bp, E. coli
gaattaaacacttttttatccgctg

SEQ ID NO: 155794 - DNA, 25 bp, E. coli
gaattaaacactattttatccgctg

SEQ ID NO: 155795 - DNA, 25 bp, E. coli
cgataatgcagacgtaatttacaga

SEQ ID NO: 155796 - DNA, 25 bp, E. coli
cgataatgcagaggtaatttacaga

SEQ ID NO: 155797 - DNA, 25 bp, E. coli
gagatgactcataacttcggatttc

SEQ ID NO: 155798 - DNA, 25 bp, E. coli
gagatgactcattacttcggatttc

SEQ ID NO: 155799 - DNA, 25 bp, E. coli
aagcaggccgggtcgattgatccag

SEQ ID NO: 155800 - DNA, 25 bp, E. coli
aagcaggccgggacgattgatccag

SEQ ID NO: 155801 - DNA, 25 bp, E. coli
cataaatatgatcagcaggctgctc

SEQ ID NO: 155802 - DNA, 25 bp, E. coli
cataaatatgatgagcaggctgctc

SEQ ID NO: 155803 - DNA, 25 bp, E. coli
tatgcagttgattaaagcaggccgg

SEQ ID NO: 155804 - DNA, 25 bp, E. coli
tatgcagttgataaaagcaggccgg

SEQ ID NO: 155805 - DNA, 25 bp, E. coli
tgatccaggtcatcgccgaattgag

SEQ ID NO: 155806 - DNA, 25 bp, E. coli
tgatccaggtcaacgccgaattgag

SEQ ID NO: 155807 - DNA, 25 bp, E. coli
tgctcatccagaaagcttccagcgg

SEQ ID NO: 155808 - DNA, 25 bp, E. coli
tgctcatccagatagcttccagcgg

SEQ ID NO: 155809 - DNA, 25 bp, E. coli
tcgcatcggttattacggtgaagag

SEQ ID NO: 155810 - DNA, 25 bp, E. coli
tcgcatcggttaatacggtgaagag

SEQ ID NO: 155811 - DNA, 25 bp, E. coli
ccagcggatttcgaacttatcggga

SEQ ID NO: 155812 - DNA, 25 bp, E. coli
ccagcggatttccaacttatcggga

SEQ ID NO: 155813 - DNA, 25 bp, E. coli
gaaagctgatactggtcaaatggca

SEQ ID NO: 155814 - DNA, 25 bp, E. coli
gaaagctgatacaggtcaaatggca

SEQ ID NO: 155815 - DNA, 25 bp, E. coli
ccgaattgagcttaaaatggcaggc

SEQ ID NO: 155816 - DNA, 25 bp, E. coli
ccgaattgagctaaaaatggcaggc

SEQ ID NO: 155817 - DNA, 25 bp, E. coli
cttatcctgcctagaactgacgaca

SEQ ID NO: 155818 - DNA, 25 bp, E. coli
cttatcctgccttgaactgacgaca

SEQ ID NO: 155819 - DNA, 25 bp, E. coli
gtttttgcctaatatccatcaggag

SEQ ID NO: 155820 - DNA, 25 bp, E. coli
gtttttgcctaaaatccatcaggag

SEQ ID NO: 155821 - DNA, 25 bp, E. coli
caagctccaggagctgggcgcaact

SEQ ID NO: 155822 - DNA, 25 bp, E. coli
caagctccaggacctgggcgcaact

SEQ ID NO: 155823 - DNA, 25 bp, E. coli
agatgtatcctttgaccgttccggg

SEQ ID NO: 155824 - DNA, 25 bp, E. coli
agatgtatccttagaccgttccggg

SEQ ID NO: 155825 - DNA, 25 bp, E. coli
cacaggtaattgcaccgaacggttc

SEQ ID NO: 155826 - DNA, 25 bp, E. coli
cacaggtaattggaccgaacggttc

SEQ ID NO: 155827 - DNA, 25 bp, E. coli
tgaacaactgaagtacaccggtaac

SEQ ID NO: 155828 - DNA, 25 bp, E. coli
tgaacaactgaactacaccggtaac

SEQ ID NO: 155829 - DNA, 25 bp, E. coli
tcgctgaacgcggtctggaaaaagg

SEQ ID NO: 155830 - DNA, 25 bp, E. coli
tcgctgaacgcgctctggaaaaagg

SEQ ID NO: 155831 - DNA, 25 bp, E. coli
tctactgtagaataagctatcgctg

SEQ ID NO: 155832 - DNA, 25 bp, E. coli
tctactgtagaaaaagctatcgctg

SEQ ID NO: 155833 - DNA, 25 bp, E. coli
ccggtaacaaagacgcggctgcagc

SEQ ID NO: 155834 - DNA, 25 bp, E. coli
ccggtaacaaagtcgcggctgcagc

SEQ ID NO: 155835 - DNA, 25 bp, E. coli
gctgtgggtaaacctgtcgctgaac

SEQ ID NO: 155836 - DNA, 25 bp, E. coli
gctgtgggtaaagctgtcgctgaac

SEQ ID NO: 155837 - DNA, 25 bp, E. coli
gaagttctggtagctgcttctactg

SEQ ID NO: 155838 - DNA, 25 bp, E. coli
gaagttctggtacctgcttctactg

SEQ ID NO: 155839 - DNA, 25 bp, E. coli
gcaactcgcctggtggtacatcgta

SEQ ID NO: 155840 - DNA, 25 bp, E. coli
gcaactcgcctgctggtacatcgta

SEQ ID NO: 155841 - DNA, 25 bp, E. coli
gaaatctgctcgtatccgtcgtgcg

SEQ ID NO: 155842 - DNA, 25 bp, E. coli
gaaatctgctcgaatccgtcgtgcg

SEQ ID NO: 155843 - DNA, 25 bp, E. coli
catctattgaatgcgcaacgcgcag

SEQ ID NO: 155844 - DNA, 25 bp, E. coli
caggtaaaggactaaattcatttgc

SEQ ID NO: 155845 - DNA, 25 bp, E. coli
catctattgaatccgcaacgcgcag

SEQ ID NO: 155846 - DNA, 25 bp, E. coli
caggtaaaggacaaaattcatttgc

SEQ ID NO: 155847 - DNA, 25 bp, E. coli
aatgtagatccggaaggtttggttg

SEQ ID NO: 155848 - DNA, 25 bp, E. coli
aatgtagatccgcaaggtttggttg

SEQ ID NO: 155849 - DNA, 25 bp, E. coli
tatcccaggcgttttcacaatcggg

SEQ ID NO: 155850 - DNA, 25 bp, E. coli
tagctgatgagattaatatcccagg

SEQ ID NO: 155851 - DNA, 25 bp, E. coli
tagctgatgagaataatatcccagg

SEQ ID NO: 155852 - DNA, 25 bp, E. coli
tatcatgacagcaaaagatctagca

SEQ ID NO: 155853 - DNA, 25 bp, E. coli
tatcatgacagctaaagatctagca

SEQ ID NO: 155854 - DNA, 25 bp, E. coli
tataccccgaaactgatcttatcca

SEQ ID NO: 155855 - DNA, 25 bp, E. coli
tatcccaggcgtattcacaatcggg

SEQ ID NO: 155856 - DNA, 25 bp, E. coli
tataccccgaaagtgatcttatcca

SEQ ID NO: 155857 - DNA, 25 bp, E. coli
tgaatccggtcataaatgtagatcc

SEQ ID NO: 155858 - DNA, 25 bp, E. coli
tgaatccggtcaaaaatgtagatcc

SEQ ID NO: 155859 - DNA, 25 bp, E. coli
tccgcaacgcgctgtatcatgacag

SEQ ID NO: 155860 - DNA, 25 bp, E. coli
tccgcaacgcgcagtatcatgacag

SEQ ID NO: 155861 - DNA, 25 bp, E. coli
gatataaatttaaaccccgaaagtg

SEQ ID NO: 155862 - DNA, 25 bp, E. coli
gatataaatttataccccgaaagtg

SEQ ID NO: 155863 - DNA, 25 bp, E. coli
gatcttatccatactgtagctgatg

SEQ ID NO: 155864 - DNA, 25 bp, E. coli
gatcttatccattctgtagctgatg

SEQ ID NO: 155865 - DNA, 25 bp, E. coli
caatcgatggtttgcggtcagtgcc

SEQ ID NO: 155866 - DNA, 25 bp, E. coli
caatcgatggttagcggtcagtgcc

SEQ ID NO: 155867 - DNA, 25 bp, E. coli
catatgccaaaactgcagaacgccg

SEQ ID NO: 155868 - DNA, 25 bp, E. coli
catatgccaaaagtgcagaacgccg

SEQ ID NO: 155869 - DNA, 25 bp, E. coli
tacttcgacggctaaaacaaagcgg

SEQ ID NO: 155870 - DNA, 25 bp, E. coli
taaaagcccggatgtggcgcgtctg

SEQ ID NO: 155871 - DNA, 25 bp, E. coli
taaaagcccggaagtggcgcgtctg

SEQ ID NO: 155872 - DNA, 25 bp, E. coli
tacttcgacggcaaaaacaaagcgg

SEQ ID NO: 155873 - DNA, 25 bp, E. coli
acgatatccgtcatgcccagtggcg

SEQ ID NO: 155874 - DNA, 25 bp, E. coli
acgatatccgtcttgcccagtggcg

SEQ ID NO: 155875 - DNA, 25 bp, E. coli
aaaacgctgaagttggtccgctacc

SEQ ID NO: 155876 - DNA, 25 bp, E. coli
aaaacgctgaagatggtccgctacc

SEQ ID NO: 155877 - DNA, 25 bp, E. coli
tatgaaacctggacagcgggcattc

SEQ ID NO: 155878 - DNA, 25 bp, E. coli
tatgaaacctggtcagcgggcattc

SEQ ID NO: 155879 - DNA, 25 bp, E. coli
tgtgaccgatgtccgtgaaaccctg

SEQ ID NO: 155880 - DNA, 25 bp, E. coli
tgtgaccgatgtgcgtgaaaccctg

SEQ ID NO: 155881 - DNA, 25 bp, E. coli
tcatatgcacgctccggaagaaggt

SEQ ID NO: 155882 - DNA, 25 bp, E. coli
tcatatgcacgcaccggaagaaggt

SEQ ID NO: 155883 - DNA, 25 bp, E. coli
gaagaatgaaacctttgccccgcag

SEQ ID NO: 155884 - DNA, 25 bp, E. coli
gaagaatgaaacgtttgccccgcag

SEQ ID NO: 155885 - DNA, 25 bp, E. coli
tcaaaacggtgatcccgcagtggga

SEQ ID NO: 155886 - DNA, 25 bp, E. coli
tcaaaacggtgaacccgcagtggga

SEQ ID NO: 155887 - DNA, 25 bp, E. coli
tactgattatcttggtattaacccc

SEQ ID NO: 155888 - DNA, 25 bp, E. coli
tactgattatctaggtattaacccc

SEQ ID NO: 155889 - DNA, 25 bp, E. coli
gtcggtacggaacctattccgcttg

SEQ ID NO: 155890 - DNA, 25 bp, E. coli
attcttcgtgatgatcgtccggtag

SEQ ID NO: 155891 - DNA, 25 bp, E. coli
agtgttgctgaacttactgattatc

SEQ ID NO: 155892 - DNA, 25 bp, E. coli
agtgttgctgaagttactgattatc

SEQ ID NO: 155893 - DNA, 25 bp, E. coli
attcttcgtgatcatcgtccggtag

SEQ ID NO: 155894 - DNA, 25 bp, E. coli
gtcggtacggaagctattccgcttg

SEQ ID NO: 155895 - DNA, 25 bp, E. coli
tatttagccgtgtactcaatgaata

SEQ ID NO: 155896 - DNA, 25 bp, E. coli
tatttagccgtgaactcaatgaata

SEQ ID NO: 155897 - DNA, 25 bp, E. coli
tgctgtcagtgttgctgaagttact

SEQ ID NO: 155898 - DNA, 25 bp, E. coli
tgctgtcagtgtagctgaagttact

SEQ ID NO: 155899 - DNA, 25 bp, E. coli
gcctctacgcgggttttggcagtaa

SEQ ID NO: 155900 - DNA, 25 bp, E. coli
gcctctacgcggcttttggcagtaa

SEQ ID NO: 155901 - DNA, 25 bp, E. coli
gctgaagttactgattatcttggta

SEQ ID NO: 155902 - DNA, 25 bp, E. coli
gctgggttattttgccgtgtactca

SEQ ID NO: 155903 - DNA, 25 bp, E. coli
gctgggttatttagccgtgtactca

SEQ ID NO: 155904 - DNA, 25 bp, E. coli
gctgaagttactcattatcttggta

SEQ ID NO: 155905 - DNA, 25 bp, E. coli
gatattcttcgtgatgatcgtccgg

SEQ ID NO: 155906 - DNA, 25 bp, E. coli
gatattcttcgtcatgatcgtccgg

SEQ ID NO: 155907 - DNA, 25 bp, E. coli
ggttatttagccgtgtactcaatga

SEQ ID NO: 155908 - DNA, 25 bp, E. coli
ggttatttagccctgtactcaatga

SEQ ID NO: 155909 - DNA, 25 bp, E. coli
aatatcggagtctgttacctgccgc

SEQ ID NO: 155910 - DNA, 25 bp, E. coli
aatatcggagtcagttacctgccgc

SEQ ID NO: 155911 - DNA, 25 bp, E. coli
aattgtttgagaaaattggtcgacg

SEQ ID NO: 155912 - DNA, 25 bp, E. coli
aattgtttgagataattggtcgacg

SEQ ID NO: 155913 - DNA, 25 bp, E. coli
caaatatcggagtcagttacctgcc

SEQ ID NO: 155914 - DNA, 25 bp, E. coli
caaatatcggagacagttacctgcc

SEQ ID NO: 155915 - DNA, 25 bp, E. coli
agtcagttacctcccgcgttttgcg

SEQ ID NO: 155916 - DNA, 25 bp, E. coli
agtcagttacctgccgcgttttgcg

SEQ ID NO: 155917 - DNA, 25 bp, E. coli
tatcggagtcagttacctgccgcgt

SEQ ID NO: 155918 - DNA, 25 bp, E. coli
tatcggagtcagatacctgccgcgt

SEQ ID NO: 155919 - DNA, 25 bp, E. coli
tcggagtcagtttcctgccgcgttt

SEQ ID NO: 155920 - DNA, 25 bp, E. coli
tcggagtcagttacctgccgcgttt

SEQ ID NO: 155921 - DNA, 25 bp, E. coli
gccgcgttttgccgtggtaaaagag

SEQ ID NO: 155922 - DNA, 25 bp, E. coli
gccgcgttttgcggtggtaaaagag

SEQ ID NO: 155923 - DNA, 25 bp, E. coli
cggcaaatatcgcagtcagttacct

SEQ ID NO: 155924 - DNA, 25 bp, E. coli
cggcaaatatcggagtcagttacct

SEQ ID NO: 155925 - DNA, 25 bp, E. coli
gtttgagaaaattggtcgacgaatg

SEQ ID NO: 155926 - DNA, 25 bp, E. coli
gtttgagaaaataggtcgacgaatg

SEQ ID NO: 155927 - DNA, 25 bp, E. coli
ggagtcagttacgtgccgcgttttg

SEQ ID NO: 155928 - DNA, 25 bp, E. coli
ggagtcagttacctgccgcgttttg

SEQ ID NO: 155929 - DNA, 25 bp, E. coli
gagttgggtgaacaaccgctggcgc

SEQ ID NO: 155930 - DNA, 25 bp, E. coli
gagttgggtgaagaaccgctggcgc

SEQ ID NO: 155931 - DNA, 25 bp, E. coli
caggatatcgcccaagcgaccatca

SEQ ID NO: 155932 - DNA, 25 bp, E. coli
caggatatcgccgaagcgaccatca

SEQ ID NO: 155933 - DNA, 25 bp, E. coli
caggacgcaatttaaaacgctgcgg

SEQ ID NO: 155934 - DNA, 25 bp, E. coli
caggacgcaattaaaaacgctgcgg

SEQ ID NO: 155935 - DNA, 25 bp, E. coli
agtgaaaattgaaacccagggcgcg

SEQ ID NO: 155936 - DNA, 25 bp, E. coli
agtgaaaattgatacccagggcgcg

SEQ ID NO: 155937 - DNA, 25 bp, E. coli
aacgaacgtttcgaatcacgcgacg

SEQ ID NO: 155938 - DNA, 25 bp, E. coli
aaactgattgccatatgtgcctgcc

SEQ ID NO: 155939 - DNA, 25 bp, E. coli
aacgaacgtttccaatcacgcgacg

SEQ ID NO: 155940 - DNA, 25 bp, E. coli
aaactgattgccttatgtgcctgcc

SEQ ID NO: 155941 - DNA, 25 bp, E. coli
tatgaaatcactatgcaggacgcaa

SEQ ID NO: 155942 - DNA, 25 bp, E. coli
tatgaaatcactttgcaggacgcaa

SEQ ID NO: 155943 - DNA, 25 bp, E. coli
ttatggccgctcaggcgctggaaga

SEQ ID NO: 155944 - DNA, 25 bp, E. coli
ttatggccgctctggcgctggaaga

SEQ ID NO: 155945 - DNA, 25 bp, E. coli
tccgtggcagtttccccggaagata

SEQ ID NO: 155946 - DNA, 25 bp, E. coli
tccgtggcagttaccccggaagata

SEQ ID NO: 155947 - DNA, 25 bp, E. coli
cgcggacggtatgcagaatcgcctg

SEQ ID NO: 155948 - DNA, 25 bp, E. coli
cgcggacggtatccagaatcgcctg

SEQ ID NO: 155949 - DNA, 25 bp, E. coli
cggtagaagccgcttatgaagtgaa

SEQ ID NO: 155950 - DNA, 25 bp, E. coli
cggtagaagccggttatgaagtgaa

SEQ ID NO: 155951 - DNA, 25 bp, E. coli
gagatgattgcctctgaacaacagt

SEQ ID NO: 155952 - DNA, 25 bp, E. coli
gagatgattgccactgaacaacagt

SEQ ID NO: 155953 - DNA, 25 bp, E. coli
ctcgcagtgaactctatgcgtacat

SEQ ID NO: 155954 - DNA, 25 bp, E. coli
ctcgcagtgaacactatgcgtacat

SEQ ID NO: 155955 - DNA, 25 bp, E. coli
catacctctcgctgtgaacactatg

SEQ ID NO: 155956 - DNA, 25 bp, E. coli
catacctctcgcagtgaacactatg

SEQ ID NO: 155957 - DNA, 25 bp, E. coli
accgacatacctctcgcagtgaaca

SEQ ID NO: 155958 - DNA, 25 bp, E. coli
accgacatacctgtcgcagtgaaca

SEQ ID NO: 155959 - DNA, 25 bp, E. coli
aaaccgacatacgtctcgcagtgaa

SEQ ID NO: 155960 - DNA, 25 bp, E. coli
aaaccgacatacctctcgcagtgaa

SEQ ID NO: 155961 - DNA, 25 bp, E. coli
tacctctcgcagtgaacactatgcg

SEQ ID NO: 155962 - DNA, 25 bp, E. coli
tacctctcgcagagaacactatgcg

SEQ ID NO: 155963 - DNA, 25 bp, E. coli
tgcggtcagtctgtgggagaattgc

SEQ ID NO: 155964 - DNA, 25 bp, E. coli
tgcggtcagtctctgggagaattgc

SEQ ID NO: 155965 - DNA, 25 bp, E. coli
cctctcgcagtgaacactatgcgta

SEQ ID NO: 155966 - DNA, 25 bp, E. coli
cctctcgcagtgtacactatgcgta

SEQ ID NO: 155967 - DNA, 25 bp, E. coli
gaaaaccgacatacctctcgcagtg

SEQ ID NO: 155968 - DNA, 25 bp, E. coli
gaaaaccgacattcctctcgcagtg

SEQ ID NO: 155969 - DNA, 25 bp, E. coli
cgaagaactgatccgccatgtaccg

SEQ ID NO: 155970 - DNA, 25 bp, E. coli
cgaagaactgatgcgccatgtaccg

SEQ ID NO: 155971 - DNA, 25 bp, E. coli
cgacatacctctggcagtgaacact

SEQ ID NO: 155972 - DNA, 25 bp, E. coli
cgacatacctctcgcagtgaacact

SEQ ID NO: 155973 - DNA, 25 bp, E. coli
gggaaaaccgacttacctctcgcag

SEQ ID NO: 155974 - DNA, 25 bp, E. coli
gggaaaaccgacatacctctcgcag

SEQ ID NO: 155975 - DNA, 25 bp, E. coli
aattctcaaagcaggcggtttcacc

SEQ ID NO: 155976 - DNA, 25 bp, E. coli
aattctcaaagctggcggtttcacc

SEQ ID NO: 155977 - DNA, 25 bp, E. coli
tacaatcccgaccaactggtgttgg

SEQ ID NO: 155978 - DNA, 25 bp, E. coli
tactggcacaccttctgctggaacg

SEQ ID NO: 155979 - DNA, 25 bp, E. coli
tacaatcccgacgaactggtgttgg

SEQ ID NO: 155980 - DNA, 25 bp, E. coli
tactggcacaccatctgctggaacg

SEQ ID NO: 155981 - DNA, 25 bp, E. coli
attgaagctaacgacgcgacgctgg

SEQ ID NO: 155982 - DNA, 25 bp, E. coli
attgaagctaaccacgcgacgctgg

SEQ ID NO: 155983 - DNA, 25 bp, E. coli
tattttgaccaggtcgatcgcgttc

SEQ ID NO: 155984 - DNA, 25 bp, E. coli
tattttgaccagctcgatcgcgttc

SEQ ID NO: 155985 - DNA, 25 bp, E. coli
ttgttacagcgaaggaagcaaccca

SEQ ID NO: 155986 - DNA, 25 bp, E. coli
ttgttacagcgatggaagcaaccca

SEQ ID NO: 155987 - DNA, 25 bp, E. coli
tctccggtgcatcagagtggtcgcc

SEQ ID NO: 155988 - DNA, 25 bp, E. coli
tctccggtgcatgagagtggtcgcc

SEQ ID NO: 155989 - DNA, 25 bp, E. coli
tctgttttacggacatatcggcgcg

SEQ ID NO: 155990 - DNA, 25 bp, E. coli
tctgttttacggtcatatcggcgcg

SEQ ID NO: 155991 - DNA, 25 bp, E. coli
cccgaacagtgtcgaagagaatgcg

SEQ ID NO: 155992 - DNA, 25 bp, E. coli
cccgaacagtgtggaagagaatgcg

SEQ ID NO: 155993 - DNA, 25 bp, E. coli
gtttaatcgtccgtggcagcagcct

SEQ ID NO: 155994 - DNA, 25 bp, E. coli
gtttaatcgtccctggcagcagcct

SEQ ID NO: 155995 - DNA, 25 bp, E. coli
gggcacgttgcttatcgaaccgaaa

SEQ ID NO: 155996 - DNA, 25 bp, E. coli
gggcacgttgctaatcgaaccgaaa

SEQ ID NO: 155997 - DNA, 25 bp, E. coli
aatacgccagcatctaatacgcctg

SEQ ID NO: 155998 - DNA, 25 bp, E. coli
caatggtaatgtttatcagaatgcc

SEQ ID NO: 155999 - DNA, 25 bp, E. coli
caatggtaatgtatatcagaatgcc

SEQ ID NO: 156000 - DNA, 25 bp, E. coli
aatacgccagcaactaatacgcctg

SEQ ID NO: 156001 - DNA, 25 bp, E. coli
atgccccgctgggagcttcctgtaa

SEQ ID NO: 156002 - DNA, 25 bp, E. coli
atgccccgctggcagcttcctgtaa

SEQ ID NO: 156003 - DNA, 25 bp, E. coli
aaatcactcagtttggtaacccagg

SEQ ID NO: 156004 - DNA, 25 bp, E. coli
aaatcactcagtatggtaacccagg

SEQ ID NO: 156005 - DNA, 25 bp, E. coli
tatcggtggtgcaaataatgccccg

SEQ ID NO: 156006 - DNA, 25 bp, E. coli
tatcggtggtgctaataatgccccg

SEQ ID NO: 156007 - DNA, 25 bp, E. coli
tcagaatgcctggtgggttggttct

SEQ ID NO: 156008 - DNA, 25 bp, E. coli
gcgtggcaccagtgtagaaaactcc

SEQ ID NO: 156009 - DNA, 25 bp, E. coli
gcgtggcaccagagtagaaaactcc

SEQ ID NO: 156010 - DNA, 25 bp, E. coli
gaaactccagttactccaactccgg

SEQ ID NO: 156011 - DNA, 25 bp, E. coli
gaaactccagtttctccaactccgg

SEQ ID NO: 156012 - DNA, 25 bp, E. coli
gtaacgattactgactgcaggcgtg

SEQ ID NO: 156013 - DNA, 25 bp, E. coli
gtaacgattactcactgcaggcgtg

SEQ ID NO: 156014 - DNA, 25 bp, E. coli
tggttctgaagattgcccgcgtggc

SEQ ID NO: 156015 - DNA, 25 bp, E. coli
tggttctgaagaatgcccgcgtggc

SEQ ID NO: 156016 - DNA, 25 bp, E. coli
taatggcggcgtcattattgcgaat

SEQ ID NO: 156017 - DNA, 25 bp, E. coli
tcagaatgcctgctgggttggttct

SEQ ID NO: 156018 - DNA, 25 bp, E. coli
taatggcggcgtgattattgcgaat

SEQ ID NO: 156019 - DNA, 25 bp, E. coli
caatgtatgagggtaagcaaaccgg

SEQ ID NO: 156020 - DNA, 25 bp, E. coli
caatgtatgaggctaagcaaaccgg

SEQ ID NO: 156021 - DNA, 25 bp, E. coli
agtatgtttcacagcgtggtcgcga

SEQ ID NO: 156022 - DNA, 25 bp, E. coli
agtatgtttcactgcgtggtcgcga

SEQ ID NO: 156023 - DNA, 25 bp, E. coli
aaatttatttgcagacgatccgtag

SEQ ID NO: 156024 - DNA, 25 bp, E. coli
aaatttatttgctgacgatccgtag

SEQ ID NO: 156025 - DNA, 25 bp, E. coli
tacctacgggcaattaatcggcgat

SEQ ID NO: 156026 - DNA, 25 bp, E. coli
tacctacgggcatttaatcggcgat

SEQ ID NO: 156027 - DNA, 25 bp, E. coli
ttgaaaatcactcgcaggacgcgca

SEQ ID NO: 156028 - DNA, 25 bp, E. coli
ttgaaaatcactggcaggacgcgca

SEQ ID NO: 156029 - DNA, 25 bp, E. coli
gaagcatgtcgtccaggtgtcagaa

SEQ ID NO: 156030 - DNA, 25 bp, E. coli
gaagggcatatctacattaccgtga

SEQ ID NO: 156031 - DNA, 25 bp, E. coli
gaagcatgtcgtgcaggtgtcagaa

SEQ ID NO: 156032 - DNA, 25 bp, E. coli
gaagggcatatcaacattaccgtga

SEQ ID NO: 156033 - DNA, 25 bp, E. coli
ggtgtcagaatttgccagttagtcg

SEQ ID NO: 156034 - DNA, 25 bp, E. coli
ggtgtcagaattagccagttagtcg

SEQ ID NO: 156035 - DNA, 25 bp, E. coli
gtcgcgagagatcccagtaagccag

SEQ ID NO: 156036 - DNA, 25 bp, E. coli
gtcgcgagagatgccagtaagccag

SEQ ID NO: 156037 - DNA, 25 bp, E. coli
taatcggcgatgaagtattacgcac

SEQ ID NO: 156038 - DNA, 25 bp, E. coli
taatcggcgatgtagtattacgcac

SEQ ID NO: 156039 - DNA, 25 bp, E. coli
gatgaattaccttacgttcggctaa

SEQ ID NO: 156040 - DNA, 25 bp, E. coli
gatgaattacctaacgttcggctaa

SEQ ID NO: 156041 - DNA, 25 bp, E. coli
tattgagttagggatgatactgggc

SEQ ID NO: 156042 - DNA, 25 bp, E. coli
tattgagttaggcatgatactgggc

SEQ ID NO: 156043 - DNA, 25 bp, E. coli
ttgagtgcagcaacaacgacggcga

SEQ ID NO: 156044 - DNA, 25 bp, E. coli
ttgagtgcagcatcaacgacggcga

SEQ ID NO: 156045 - DNA, 25 bp, E. coli
tgggcgcgcgtgaattgctttgcac

SEQ ID NO: 156046 - DNA, 25 bp, E. coli
tgggcgcgcgtgtattgctttgcac

SEQ ID NO: 156047 - DNA, 25 bp, E. coli
ggcgacgggccggattaacaccttc

SEQ ID NO: 156048 - DNA, 25 bp, E. coli
cctgtttcaacatggagcgtcctga

SEQ ID NO: 156049 - DNA, 25 bp, E. coli
cctgtttcaacaaggagcgtcctga

SEQ ID NO: 156050 - DNA, 25 bp, E. coli
ggcgacgggccgcattaacaccttc

SEQ ID NO: 156051 - DNA, 25 bp, E. coli
ctgatggcgcaaaccgtcggcgtct

SEQ ID NO: 156052 - DNA, 25 bp, E. coli
ctgatggcgcaatccgtcggcgtct

SEQ ID NO: 156053 - DNA, 25 bp, E. coli
gtactggcaccgtttctcgacccgg

SEQ ID NO: 156054 - DNA, 25 bp, E. coli
gtgtgccgcgtgacggtttcgccca

SEQ ID NO: 156055 - DNA, 25 bp, E. coli
gtgtgccgcgtgtcggtttcgccca

SEQ ID NO: 156056 - DNA, 25 bp, E. coli
gtactggcaccgattctcgacccgg

SEQ ID NO: 156057 - DNA, 25 bp, E. coli
ggtttcgcccagaggcgtactggca

SEQ ID NO: 156058 - DNA, 25 bp, E. coli
ggtttcgcccagtggcgtactggca

SEQ ID NO: 156059 - DNA, 25 bp, E. coli
gatcgcttcggctgttttgagtgca

SEQ ID NO: 156060 - DNA, 25 bp, E. coli
gatcgcttcggcagttttgagtgca

SEQ ID NO: 156061 - DNA, 25 bp, E. coli
gacgcgcccatgatactgctggaag

SEQ ID NO: 156062 - DNA, 25 bp, E. coli
gacgcgcccatgttactgctggaag

SEQ ID NO: 156063 - DNA, 25 bp, E. coli
aataatcaaatacgatattctggcg

SEQ ID NO: 156064 - DNA, 25 bp, E. coli
caattaaaaactacatggtagtcgc

SEQ ID NO: 156065 - DNA, 25 bp, E. coli
aataatcaaataggatattctggcg

SEQ ID NO: 156066 - DNA, 25 bp, E. coli
caattaaaaacttcatggtagtcgc

SEQ ID NO: 156067 - DNA, 25 bp, E. coli
tatggcgggttgatttttatatgcc

SEQ ID NO: 156068 - DNA, 25 bp, E. coli
tatggcgggttgttttttatatgcc

SEQ ID NO: 156069 - DNA, 25 bp, E. coli
aattatcagcaacccaatactttca

SEQ ID NO: 156070 - DNA, 25 bp, E. coli
aattatcagcaagccaatactttca

SEQ ID NO: 156071 - DNA, 25 bp, E. coli
tattctggcgtacctatacccctat

SEQ ID NO: 156072 - DNA, 25 bp, E. coli
tattctggcgtagctatacccctat

SEQ ID NO: 156073 - DNA, 25 bp, E. coli
tatatgcctaaacacaaaaaattgt

SEQ ID NO: 156074 - DNA, 25 bp, E. coli
tatatgcctaaagacaaaaaattgt

SEQ ID NO: 156075 - DNA, 25 bp, E. coli
ttttaacccgcccttcatatggcgg

SEQ ID NO: 156076 - DNA, 25 bp, E. coli
ttttaacccgccgttcatatggcgg

SEQ ID NO: 156077 - DNA, 25 bp, E. coli
tgaaaatgacgtgtatctatacccc

SEQ ID NO: 156078 - DNA, 25 bp, E. coli
tgaaaatgacgtctatctatacccc

SEQ ID NO: 156079 - DNA, 25 bp, E. coli
gaatagaacagctcaaattatcagc

SEQ ID NO: 156080 - DNA, 25 bp, E. coli
gaatagaacagcacaaattatcagc

SEQ ID NO: 156081 - DNA, 25 bp, E. coli
ggtagtcgcattaataaccctatga

SEQ ID NO: 156082 - DNA, 25 bp, E. coli
ggtagtcgcatttataaccctatga

SEQ ID NO: 156083 - DNA, 25 bp, E. coli
tacccctattctatatccttaaagg

SEQ ID NO: 156084 - DNA, 25 bp, E. coli
tacccctattctttatccttaaagg

SEQ ID NO: 156085 - DNA, 25 bp, E. coli
taaagtgcaccgtccgtgaatttaa

SEQ ID NO: 156086 - DNA, 25 bp, E. coli
taaagtgcaccgaccgtgaatttaa

SEQ ID NO: 156087 - DNA, 25 bp, E. coli
atttaaccctgacccgaagactctg

SEQ ID NO: 156088 - DNA, 25 bp, E. coli
cacctaaagtgctccgaccgtgaat

SEQ ID NO: 156089 - DNA, 25 bp, E. coli
atttaaccctgagccgaagactctg

SEQ ID NO: 156090 - DNA, 25 bp, E. coli
cacctaaagtgcaccgaccgtgaat

SEQ ID NO: 156091 - DNA, 25 bp, E. coli
gtgcaccgaccgtgaatttaaccct

SEQ ID NO: 156092 - DNA, 25 bp, E. coli
gtgcaccgaccgagaatttaaccct

SEQ ID NO: 156093 - DNA, 25 bp, E. coli
tttcacctaaagtgcaccgaccgtg

SEQ ID NO: 156094 - DNA, 25 bp, E. coli
tttcacctaaagagcaccgaccgtg

SEQ ID NO: 156095 - DNA, 25 bp, E. coli
tttttcacctaaagtgcaccgaccg

SEQ ID NO: 156096 - DNA, 25 bp, E. coli
tttttcacctaatgtgcaccgaccg

SEQ ID NO: 156097 - DNA, 25 bp, E. coli
tgaatttaacccagacccgaagact

SEQ ID NO: 156098 - DNA, 25 bp, E. coli
tgaatttaaccctgacccgaagact

SEQ ID NO: 156099 - DNA, 25 bp, E. coli
gcgactcaacctttttcacctaaag

SEQ ID NO: 156100 - DNA, 25 bp, E. coli
gctttgcgactctacctttttcacc

SEQ ID NO: 156101 - DNA, 25 bp, E. coli
gcgactcaacctatttcacctaaag

SEQ ID NO: 156102 - DNA, 25 bp, E. coli
gctttgcgactcaacctttttcacc

SEQ ID NO: 156103 - DNA, 25 bp, E. coli
gcaccgaccgtgtatttaaccctga

SEQ ID NO: 156104 - DNA, 25 bp, E. coli
gcaccgaccgtgaatttaaccctga

SEQ ID NO: 156105 - DNA, 25 bp, E. coli
gactcaacctttatcacctaaagtg

SEQ ID NO: 156106 - DNA, 25 bp, E. coli
gactcaacctttttcacctaaagtg

SEQ ID NO: 156107 - DNA, 25 bp, E. coli
caaacagctattagcagcagagaaa

SEQ ID NO: 156108 - DNA, 25 bp, E. coli
caaacagctatttgcagcagagaaa

SEQ ID NO: 156109 - DNA, 25 bp, E. coli
cagagaaatttgtgctactccaaca

SEQ ID NO: 156110 - DNA, 25 bp, E. coli
cagagaaatttgagctactccaaca

SEQ ID NO: 156111 - DNA, 25 bp, E. coli
cagccaaccgggttttacaccaacg

SEQ ID NO: 156112 - DNA, 25 bp, E. coli
cagccaaccgggatttacaccaacg

SEQ ID NO: 156113 - DNA, 25 bp, E. coli
aaaacttcaaacagctatttgcagc

SEQ ID NO: 156114 - DNA, 25 bp, E. coli
aaaacttcaaactgctatttgcagc

SEQ ID NO: 156115 - DNA, 25 bp, E. coli
tttgtgctactcgaacatgaccaga

SEQ ID NO: 156116 - DNA, 25 bp, E. coli
tttgtgctactccaacatgaccaga

SEQ ID NO: 156117 - DNA, 25 bp, E. coli
tttacaccaacgctgagaatccaca

SEQ ID NO: 156118 - DNA, 25 bp, E. coli
tttacaccaacggtgagaatccaca

SEQ ID NO: 156119 - DNA, 25 bp, E. coli
tgaaaacgtcaatacagccaaccgg

SEQ ID NO: 156120 - DNA, 25 bp, E. coli
tgaaaacgtcaaaacagccaaccgg

SEQ ID NO: 156121 - DNA, 25 bp, E. coli
tccaacatgaccagaacaatcagct

SEQ ID NO: 156122 - DNA, 25 bp, E. coli
tccaacatgacctgaacaatcagct

SEQ ID NO: 156123 - DNA, 25 bp, E. coli
gaacaatcagcttaatatttagcaa

SEQ ID NO: 156124 - DNA, 25 bp, E. coli
gaacaatcagctaaatatttagcaa

SEQ ID NO: 156125 - DNA, 25 bp, E. coli
cgtcaatacagcgaaccgggattta

SEQ ID NO: 156126 - DNA, 25 bp, E. coli
cgtcaatacagccaaccgggattta

SEQ ID NO: 156127 - DNA, 25 bp, E. coli
ctatttgcagcagagaaatttgtgc

SEQ ID NO: 156128 - DNA, 25 bp, E. coli
ctatttgcagcacagaaatttgtgc

SEQ ID NO: 156129 - DNA, 25 bp, E. coli
caaaatctgtaaccgcggcgagtct

SEQ ID NO: 156130 - DNA, 25 bp, E. coli
caaaatctgtaagcgcggcgagtct

SEQ ID NO: 156131 - DNA, 25 bp, E. coli
tattctgaccgacccgaatgcctct

SEQ ID NO: 156132 - DNA, 25 bp, E. coli
tattctgaccgagccgaatgcctct

SEQ ID NO: 156133 - DNA, 25 bp, E. coli
gaagtgaccccgaaaaatatcctga

SEQ ID NO: 156134 - DNA, 25 bp, E. coli
gcaaaaaactgcgtgaaggccagct

SEQ ID NO: 156135 - DNA, 25 bp, E. coli
gcaaaaaactgcctgaaggccagct

SEQ ID NO: 156136 - DNA, 25 bp, E. coli
gaagtgaccccgtaaaatatcctga

SEQ ID NO: 156137 - DNA, 25 bp, E. coli
gaaaccgtctgacctgatcccggaa

SEQ ID NO: 156138 - DNA, 25 bp, E. coli
gaaaaaccgttatcgcgctgaagaa

SEQ ID NO: 156139 - DNA, 25 bp, E. coli
gaaaaaccgttaacgcgctgaagaa

SEQ ID NO: 156140 - DNA, 25 bp, E. coli
gaaaccgtctgagctgatcccggaa

SEQ ID NO: 156141 - DNA, 25 bp, E. coli
cgaaactggtgatcccggaagagct

SEQ ID NO: 156142 - DNA, 25 bp, E. coli
cgatgccgccgtgaaaatggtacgc

SEQ ID NO: 156143 - DNA, 25 bp, E. coli
cgatgccgccgtcaaaatggtacgc

SEQ ID NO: 156144 - DNA, 25 bp, E. coli
cgaaactggtgaacccggaagagct

SEQ ID NO: 156145 - DNA, 25 bp, E. coli
gataagcacatcatcggccaggaca

SEQ ID NO: 156146 - DNA, 25 bp, E. coli
gataagcacatcttcggccaggaca

SEQ ID NO: 156147 - DNA, 25 bp, E. coli
ggtacgcgtccaggctatcgagaaa

SEQ ID NO: 156148 - DNA, 25 bp, E. coli
ggtacgcgtccacgctatcgagaaa

SEQ ID NO: 156149 - DNA, 25 bp, E. coli
tggaagagatgagcagccagctgca

SEQ ID NO: 156150 - DNA, 25 bp, E. coli
tggaagagatgaccagccagctgca

SEQ ID NO: 156151 - DNA, 25 bp, E. coli
tactgtaaataacgccctgagggtg

SEQ ID NO: 156152 - DNA, 25 bp, E. coli
tactgtaaataaggccctgagggtg

SEQ ID NO: 156153 - DNA, 25 bp, E. coli
agcgtaatggtgtacgtgctgcgta

SEQ ID NO: 156154 - DNA, 25 bp, E. coli
agcgtaatggtgaacgtgctgcgta

SEQ ID NO: 156155 - DNA, 25 bp, E. coli
aaatactgtaaaaaaggccctgagg

SEQ ID NO: 156156 - DNA, 25 bp, E. coli
aaatactgtaaataaggccctgagg

SEQ ID NO: 156157 - DNA, 25 bp, E. coli
tatttacgggtggacatgacccgcg

SEQ ID NO: 156158 - DNA, 25 bp, E. coli
tatttacgggtgcacatgacccgcg

SEQ ID NO: 156159 - DNA, 25 bp, E. coli
ttttctggatgccaaccgggagaag

SEQ ID NO: 156160 - DNA, 25 bp, E. coli
ttttctggatgcgaaccgggagaag

SEQ ID NO: 156161 - DNA, 25 bp, E. coli
tgtacgtgctgcgtatatccataaa

SEQ ID NO: 156162 - DNA, 25 bp, E. coli
tgtacgtgctgcctatatccataaa

SEQ ID NO: 156163 - DNA, 25 bp, E. coli
tgcattgattgaatcaggtttgtgg

SEQ ID NO: 156164 - DNA, 25 bp, E. coli
tgcattgattgattcaggtttgtgg

SEQ ID NO: 156165 - DNA, 25 bp, E. coli
gaaccgggagaacggtatcagtccg

SEQ ID NO: 156166 - DNA, 25 bp, E. coli
gaacggcgactgttgttgcaatggt

SEQ ID NO: 156167 - DNA, 25 bp, E. coli
gaacggcgactgatgttgcaatggt

SEQ ID NO: 156168 - DNA, 25 bp, E. coli
gaaccgggagaagggtatcagtccg

SEQ ID NO: 156169 - DNA, 25 bp, E. coli
cgattttctggatgcgaaccgggag

SEQ ID NO: 156170 - DNA, 25 bp, E. coli
cgattttctggaagcgaaccgggag

SEQ ID NO: 156171 - DNA, 25 bp, E. coli
gatgttgcaatggtgggccgatttt

SEQ ID NO: 156172 - DNA, 25 bp, E. coli
gatgttgcaatgctgggccgatttt

SEQ ID NO: 156173 - DNA, 25 bp, E. coli
tagagaaagaagttcgccaggagca

SEQ ID NO: 156174 - DNA, 25 bp, E. coli
ttgccgataacgtgaaaagcgtccg

SEQ ID NO: 156175 - DNA, 25 bp, E. coli
tatcaaaggtctcgtacttagcccg

SEQ ID NO: 156176 - DNA, 25 bp, E. coli
ttgccgataacgagaaaagcgtccg

SEQ ID NO: 156177 - DNA, 25 bp, E. coli
tagagaaagaagatcgccaggagca

SEQ ID NO: 156178 - DNA, 25 bp, E. coli
tatcaaaggtctggtacttagcccg

SEQ ID NO: 156179 - DNA, 25 bp, E. coli
tatcagttgtcggaataccgcgccg

SEQ ID NO: 156180 - DNA, 25 bp, E. coli
tatcagttgtcgcaataccgcgccg

SEQ ID NO: 156181 - DNA, 25 bp, E. coli
tttaacccatcctaagcgagcagtg

SEQ ID NO: 156182 - DNA, 25 bp, E. coli
ttaacgctgaaactgtgggtgccca

SEQ ID NO: 156183 - DNA, 25 bp, E. coli
tttttgaccgcaacaacccgtggca

SEQ ID NO: 156184 - DNA, 25 bp, E. coli
ttatggtacggctgaaacggcggcc

SEQ ID NO: 156185 - DNA, 25 bp, E. coli
tttaacccatccaaagcgagcagtg

SEQ ID NO: 156186 - DNA, 25 bp, E. coli
ttatggtacggcagaaacggcggcc

SEQ ID NO: 156187 - DNA, 25 bp, E. coli
ttaacgctgaaagtgtgggtgccca

SEQ ID NO: 156188 - DNA, 25 bp, E. coli
tttttgaccgcatcaacccgtggca

SEQ ID NO: 156189 - DNA, 25 bp, E. coli
gaaagctgggaactactcgacaacg

SEQ ID NO: 156190 - DNA, 25 bp, E. coli
gaaagctgggaagtactcgacaacg

SEQ ID NO: 156191 - DNA, 25 bp, E. coli
cattgcgtttgctggcctatcggta

SEQ ID NO: 156192 - DNA, 25 bp, E. coli
cattgcgtttgcaggcctatcggta

SEQ ID NO: 156193 - DNA, 25 bp, E. coli
gtattgaagcctatgacgaagcgca

SEQ ID NO: 156194 - DNA, 25 bp, E. coli
gtattgaagcctttgacgaagcgca

SEQ ID NO: 156195 - DNA, 25 bp, E. coli
taaaccgctggtcttccctgacgaa

SEQ ID NO: 156196 - DNA, 25 bp, E. coli
tacgattactccatctacggcggcc

SEQ ID NO: 156197 - DNA, 25 bp, E. coli
taaaccgctggtgttccctgacgaa

SEQ ID NO: 156198 - DNA, 25 bp, E. coli
tacgattactccttctacggcggcc

SEQ ID NO: 156199 - DNA, 25 bp, E. coli
atattgtcgaactgggccagccgct

SEQ ID NO: 156200 - DNA, 25 bp, E. coli
atattgtcgaacagggccagccgct

SEQ ID NO: 156201 - DNA, 25 bp, E. coli
tatcatctcgacctgaaagttggcg

SEQ ID NO: 156202 - DNA, 25 bp, E. coli
tatcatctcgacgtgaaagttggcg

SEQ ID NO: 156203 - DNA, 25 bp, E. coli
tagcctggtcaaacgcgaactggcg

SEQ ID NO: 156204 - DNA, 25 bp, E. coli
tataaccgtggtgtgactgaacccc

SEQ ID NO: 156205 - DNA, 25 bp, E. coli
tagcctggtcaatcgcgaactggcg

SEQ ID NO: 156206 - DNA, 25 bp, E. coli
tataaccgtggtctgactgaacccc

SEQ ID NO: 156207 - DNA, 25 bp, E. coli
tgatatcaccagacaccgtgcagga

SEQ ID NO: 156208 - DNA, 25 bp, E. coli
tgatatcaccagtcaccgtgcagga

SEQ ID NO: 156209 - DNA, 25 bp, E. coli
tcaggcgcgcgaagagttagcaaaa

SEQ ID NO: 156210 - DNA, 25 bp, E. coli
tcaggcgcgcgatgagttagcaaaa

SEQ ID NO: 156211 - DNA, 25 bp, E. coli
gaaacccagcgttcggtgatccgtg

SEQ ID NO: 156212 - DNA, 25 bp, E. coli
gaaacccagcgtacggtgatccgtg

SEQ ID NO: 156213 - DNA, 25 bp, E. coli
gatattccccggaatggtggcgacg

SEQ ID NO: 156214 - DNA, 25 bp, E. coli
gatattccccggtatggtggcgacg

SEQ ID NO: 156215 - DNA, 25 bp, E. coli
tggaaaacaaactcagcgacgtgcg

SEQ ID NO: 156216 - DNA, 25 bp, E. coli
tggaaaacaaacacagcgacgtgcg

SEQ ID NO: 156217 - DNA, 25 bp, E. coli
cagcgttacaaactggtgccggagt

SEQ ID NO: 156218 - DNA, 25 bp, E. coli
cagcgttacaaagtggtgccggagt

SEQ ID NO: 156219 - DNA, 25 bp, E. coli
tatgtccgcgctctgcaaatccaga

SEQ ID NO: 156220 - DNA, 25 bp, E. coli
tatgtccgcgctgtgcaaatccaga

SEQ ID NO: 156221 - DNA, 25 bp, E. coli
ttatgatgatgtgccgatggtcccg

SEQ ID NO: 156222 - DNA, 25 bp, E. coli
ttatgatgatgtcccgatggtcccg

SEQ ID NO: 156223 - DNA, 25 bp, E. coli
tccagaatggaccaaggcaagtcgg

SEQ ID NO: 156224 - DNA, 25 bp, E. coli
tcctcaaaatgagcggaagacgcgg

SEQ ID NO: 156225 - DNA, 25 bp, E. coli
tcctcaaaatgaccggaagacgcgg

SEQ ID NO: 156226 - DNA, 25 bp, E. coli
tccttggcgaagatgcactacgtag

SEQ ID NO: 156227 - DNA, 25 bp, E. coli
tccagaatggacgaaggcaagtcgg

SEQ ID NO: 156228 - DNA, 25 bp, E. coli
tccttggcgaagttgcactacgtag

SEQ ID NO: 156229 - DNA, 25 bp, E. coli
gctggcctggtcgaaactcaataac

SEQ ID NO: 156230 - DNA, 25 bp, E. coli
gctggcctggtccaaactcaataac

SEQ ID NO: 156231 - DNA, 25 bp, E. coli
gaaggcgttcgaactccaccgtatg

SEQ ID NO: 156232 - DNA, 25 bp, E. coli
gaaggcgttcgatctccaccgtatg

SEQ ID NO: 156233 - DNA, 25 bp, E. coli
cctggtaatgtggttgatggcgcac

SEQ ID NO: 156234 - DNA, 25 bp, E. coli
cctggtaatgtgcttgatggcgcac

SEQ ID NO: 156235 - DNA, 25 bp, E. coli
ggcgattctcgaaaccaacgggcaa

SEQ ID NO: 156236 - DNA, 25 bp, E. coli
tggaagatcttctggaaggcaagcc

SEQ ID NO: 156237 - DNA, 25 bp, E. coli
ggcgattctcgataccaacgggcaa

SEQ ID NO: 156238 - DNA, 25 bp, E. coli
tggaagatcttcaggaaggcaagcc

SEQ ID NO: 156239 - DNA, 25 bp, E. coli
catcgcaggtgttattaagtgcgcc

SEQ ID NO: 156240 - DNA, 25 bp, E. coli
catcgcaggtgtaattaagtgcgcc

SEQ ID NO: 156241 - DNA, 25 bp, E. coli
tactcaacgcgttagtcaggcgtcg

SEQ ID NO: 156242 - DNA, 25 bp, E. coli
tactcaacgcgtaagtcaggcgtcg

SEQ ID NO: 156243 - DNA, 25 bp, E. coli
tacttgctgcccacgatggtgcatc

SEQ ID NO: 156244 - DNA, 25 bp, E. coli
tacttgctgccctcgatggtgcatc

SEQ ID NO: 156245 - DNA, 25 bp, E. coli
atggcgaacgcctaagcgcgcaagg

SEQ ID NO: 156246 - DNA, 25 bp, E. coli
atggcgaacgccaaagcgcgcaagg

SEQ ID NO: 156247 - DNA, 25 bp, E. coli
ttgatggttaaagtgcaaccgctgg

SEQ ID NO: 156248 - DNA, 25 bp, E. coli
ttgatggttaaactgcaaccgctgg

SEQ ID NO: 156249 - DNA, 25 bp, E. coli
tgacgaagccgtcgcggttgctacc

SEQ ID NO: 156250 - DNA, 25 bp, E. coli
tgacgaagccgtggcggttgctacc

SEQ ID NO: 156251 - DNA, 25 bp, E. coli
tgctaccgccgatatgctgcgtcag

SEQ ID NO: 156252 - DNA, 25 bp, E. coli
tgctaccgccgaaatgctgcgtcag

SEQ ID NO: 156253 - DNA, 25 bp, E. coli
gccgtcttacctgagttacttgctg

SEQ ID NO: 156254 - DNA, 25 bp, E. coli
gccgtcttacctcagttacttgctg

SEQ ID NO: 156255 - DNA, 25 bp, E. coli
gctgcaaattggacagttgatggtt

SEQ ID NO: 156256 - DNA, 25 bp, E. coli
gctgcaaattggtcagttgatggtt

SEQ ID NO: 156257 - DNA, 25 bp, E. coli
gctacttgccagagcgtatgccgat

SEQ ID NO: 156258 - DNA, 25 bp, E. coli
gctacttgccagtgcgtatgccgat

SEQ ID NO: 156259 - DNA, 25 bp, E. coli
tggctactgccggatatgacaggcg

SEQ ID NO: 156260 - DNA, 25 bp, E. coli
tggctactgccgcatatgacaggcg

SEQ ID NO: 156261 - DNA, 25 bp, E. coli
caaaaaccagcttatacaggatata

SEQ ID NO: 156262 - DNA, 25 bp, E. coli
caaaaaccagctaatacaggatata

SEQ ID NO: 156263 - DNA, 25 bp, E. coli
tacaggatataaacgcagaggttcg

SEQ ID NO: 156264 - DNA, 25 bp, E. coli
tacaattgaagaagcgattgcccgc

SEQ ID NO: 156265 - DNA, 25 bp, E. coli
tacaattgaagatgcgattgcccgc

SEQ ID NO: 156266 - DNA, 25 bp, E. coli
tacaggatataatcgcagaggttcg

SEQ ID NO: 156267 - DNA, 25 bp, E. coli
atgaatgtgaagtgtgcggtgcccc

SEQ ID NO: 156268 - DNA, 25 bp, E. coli
atgaatgtgaagagtgcggtgcccc

SEQ ID NO: 156269 - DNA, 25 bp, E. coli
ttgaagatgcgattgcccgcgctcg

SEQ ID NO: 156270 - DNA, 25 bp, E. coli
ttgaagatgcgaatgcccgcgctcg

SEQ ID NO: 156271 - DNA, 25 bp, E. coli
gaagccattcctggcgtgcgcttat

SEQ ID NO: 156272 - DNA, 25 bp, E. coli
gaagccattcctcgcgtgcgcttat

SEQ ID NO: 156273 - DNA, 25 bp, E. coli
gaacagatcaactgtacaattgaag

SEQ ID NO: 156274 - DNA, 25 bp, E. coli
gaacagatcaacagtacaattgaag

SEQ ID NO: 156275 - DNA, 25 bp, E. coli
cgtcgggaagcctttcctggcgtgc

SEQ ID NO: 156276 - DNA, 25 bp, E. coli
cgtcgggaagccattcctggcgtgc

SEQ ID NO: 156277 - DNA, 25 bp, E. coli
gatataatcgcacaggttcgaaaga

SEQ ID NO: 156278 - DNA, 25 bp, E. coli
gatataatcgcagaggttcgaaaga

SEQ ID NO: 156279 - DNA, 25 bp, E. coli
ggagaaagatttacaaaaaccagct

SEQ ID NO: 156280 - DNA, 25 bp, E. coli
ggagaaagattttcaaaaaccagct

SEQ ID NO: 156281 - DNA, 25 bp, E. coli
gatgacgccgtcaacgaacagatca

SEQ ID NO: 156282 - DNA, 25 bp, E. coli
gatgacgccgtctacgaacagatca

SEQ ID NO: 156283 - DNA, 25 bp, E. coli
caaatttatgaagtggttcagcaac

SEQ ID NO: 156284 - DNA, 25 bp, E. coli
caaatttatgaactggttcagcaac

SEQ ID NO: 156285 - DNA, 25 bp, E. coli
tactcgatgtggttagtcttgaccc

SEQ ID NO: 156286 - DNA, 25 bp, E. coli
tactcgatgtggatagtcttgaccc

SEQ ID NO: 156287 - DNA, 25 bp, E. coli
taggcagtagcgatatgttacaaac

SEQ ID NO: 156288 - DNA, 25 bp, E. coli
taggcagtagcgttatgttacaaac

SEQ ID NO: 156289 - DNA, 25 bp, E. coli
tttgtctgtggtaacggtgtaggca

SEQ ID NO: 156290 - DNA, 25 bp, E. coli
tttgtctgtggttacggtgtaggca

SEQ ID NO: 156291 - DNA, 25 bp, E. coli
tgaaatggaacataccgccgcaggt

SEQ ID NO: 156292 - DNA, 25 bp, E. coli
tgaaatggaacaaaccgccgcaggt

SEQ ID NO: 156293 - DNA, 25 bp, E. coli
gcggatttaccgactgggcggatat

SEQ ID NO: 156294 - DNA, 25 bp, E. coli
gcggatttaccgtctgggcggatat

SEQ ID NO: 156295 - DNA, 25 bp, E. coli
gttaaaaaagcggtgaccaaatatg

SEQ ID NO: 156296 - DNA, 25 bp, E. coli
ccgcaggtgaagacggcggatttac

SEQ ID NO: 156297 - DNA, 25 bp, E. coli
gttaaaaaagcgctgaccaaatatg

SEQ ID NO: 156298 - DNA, 25 bp, E. coli
ccgcaggtgaagtcggcggatttac

SEQ ID NO: 156299 - DNA, 25 bp, E. coli
ggacggtgaaactattggtcagcaa

SEQ ID NO: 156300 - DNA, 25 bp, E. coli
gggcaatatttgtttccgatagaga

SEQ ID NO: 156301 - DNA, 25 bp, E. coli
gggcaatatttgattccgatagaga

SEQ ID NO: 156302 - DNA, 25 bp, E. coli
ggacggtgaaacaattggtcagcaa

SEQ ID NO: 156303 - DNA, 25 bp, E. coli
tagtcttgaccccaaacaagggcaa

SEQ ID NO: 156304 - DNA, 25 bp, E. coli
tagtcttgacccgaaacaagggcaa

SEQ ID NO: 156305 - DNA, 25 bp, E. coli
taacgaagctccaccggtaaaaatg

SEQ ID NO: 156306 - DNA, 25 bp, E. coli
taacgaagctcctccggtaaaaatg

SEQ ID NO: 156307 - DNA, 25 bp, E. coli
tatagctgtcagcaaacaccgtcga

SEQ ID NO: 156308 - DNA, 25 bp, E. coli
tattgcgtcctctgtaagcggagca

SEQ ID NO: 156309 - DNA, 25 bp, E. coli
tttggcaccagacttaaaagacagc

SEQ ID NO: 156310 - DNA, 25 bp, E. coli
tattgcgtcctcagtaagcggagca

SEQ ID NO: 156311 - DNA, 25 bp, E. coli
tatagctgtcaggaaacaccgtcga

SEQ ID NO: 156312 - DNA, 25 bp, E. coli
tttggcaccagagttaaaagacagc

SEQ ID NO: 156313 - DNA, 25 bp, E. coli
tgttataacacaccagaagagcacc

SEQ ID NO: 156314 - DNA, 25 bp, E. coli
tgttataacacagcagaagagcacc

SEQ ID NO: 156315 - DNA, 25 bp, E. coli
tgaacgtcctgttgctgctggctgg

SEQ ID NO: 156316 - DNA, 25 bp, E. coli
tgagctcaacttaatccgacaggat

SEQ ID NO: 156317 - DNA, 25 bp, E. coli
tgagctcaactttatccgacaggat

SEQ ID NO: 156318 - DNA, 25 bp, E. coli
tgaacgtcctgtagctgctggctgg

SEQ ID NO: 156319 - DNA, 25 bp, E. coli
catttatggcagtgccagcatgggc

SEQ ID NO: 156320 - DNA, 25 bp, E. coli
cttttgataaggcacagatggccac

SEQ ID NO: 156321 - DNA, 25 bp, E. coli
catttatggcagagccagcatgggc

SEQ ID NO: 156322 - DNA, 25 bp, E. coli
cttttgataagggacagatggccac

SEQ ID NO: 156323 - DNA, 25 bp, E. coli
taatggaatgcgtggttcagccgca

SEQ ID NO: 156324 - DNA, 25 bp, E. coli
taatggaatgcgaggttcagccgca

SEQ ID NO: 156325 - DNA, 25 bp, E. coli
gaggcttctgcgtcacctgcaaatg

SEQ ID NO: 156326 - DNA, 25 bp, E. coli
gaggcttctgcgacacctgcaaatg

SEQ ID NO: 156327 - DNA, 25 bp, E. coli
aatgtcacctttaccgcagcgcaaa

SEQ ID NO: 156328 - DNA, 25 bp, E. coli
aatgtcaccttttccgcagcgcaaa

SEQ ID NO: 156329 - DNA, 25 bp, E. coli
taacgatttcgttgcaattggcagc

SEQ ID NO: 156330 - DNA, 25 bp, E. coli
tagcgataaattccagcaggccggg

SEQ ID NO: 156331 - DNA, 25 bp, E. coli
tagcgataaattgcagcaggccggg

SEQ ID NO: 156332 - DNA, 25 bp, E. coli
ttagacttgacgcacattgtgcagc

SEQ ID NO: 156333 - DNA, 25 bp, E. coli
ttagacttgacggacattgtgcagc

SEQ ID NO: 156334 - DNA, 25 bp, E. coli
gaaattagcgccttcatcgacggaa

SEQ ID NO: 156335 - DNA, 25 bp, E. coli
gaaaagccagccctgcgaagatgag

SEQ ID NO: 156336 - DNA, 25 bp, E. coli
gaaaagccagccgtgcgaagatgag

SEQ ID NO: 156337 - DNA, 25 bp, E. coli
gaaattagcgccatcatcgacggaa

SEQ ID NO: 156338 - DNA, 25 bp, E. coli
cgtctgtaaagcctatgccccgaca

SEQ ID NO: 156339 - DNA, 25 bp, E. coli
cgtctgtaaagcgtatgccccgaca

SEQ ID NO: 156340 - DNA, 25 bp, E. coli
gatctgctgctatcctccggcaaaa

SEQ ID NO: 156341 - DNA, 25 bp, E. coli
gatctgctgctaacctccggcaaaa

SEQ ID NO: 156342 - DNA, 25 bp, E. coli
gatagacgacattacgcagcggttg

SEQ ID NO: 156343 - DNA, 25 bp, E. coli
gatagacgacataacgcagcggttg

SEQ ID NO: 156344 - DNA, 25 bp, E. coli
taatgtagggatgccaggatcgcga

SEQ ID NO: 156345 - DNA, 25 bp, E. coli
taatgtagggatcccaggatcgcga

SEQ ID NO: 156346 - DNA, 25 bp, E. coli
taacgatttcgtagcaattggcagc

SEQ ID NO: 156347 - DNA, 25 bp, E. coli
gacgccggtctattttgccccagag

SEQ ID NO: 156348 - DNA, 25 bp, E. coli
gacgccggtctaatttgccccagag

SEQ ID NO: 156349 - DNA, 25 bp, E. coli
cacattatcggagtggattcggaac

SEQ ID NO: 156350 - DNA, 25 bp, E. coli
cacattatcggactggattcggaac

SEQ ID NO: 156351 - DNA, 25 bp, E. coli
cagttacgtttttcagccctcgaga

SEQ ID NO: 156352 - DNA, 25 bp, E. coli
cagttacgttttacagccctcgaga

SEQ ID NO: 156353 - DNA, 25 bp, E. coli
tttaagcgtcgatcgggctactcgc

SEQ ID NO: 156354 - DNA, 25 bp, E. coli
tttacccggctgaaggagtcgttcg

SEQ ID NO: 156355 - DNA, 25 bp, E. coli
tttacccggctgtaggagtcgttcg

SEQ ID NO: 156356 - DNA, 25 bp, E. coli
tttaagcgtcgaacgggctactcgc

SEQ ID NO: 156357 - DNA, 25 bp, E. coli
tcccttggccaaatgatgagcggct

SEQ ID NO: 156358 - DNA, 25 bp, E. coli
tcccttggccaattgatgagcggct

SEQ ID NO: 156359 - DNA, 25 bp, E. coli
tctgaatggaggcacagttccctgg

SEQ ID NO: 156360 - DNA, 25 bp, E. coli
tctgaatggagggacagttccctgg

SEQ ID NO: 156361 - DNA, 25 bp, E. coli
tctgggctatgcctcagctgaatcg

SEQ ID NO: 156362 - DNA, 25 bp, E. coli
tctgggctatgcgtcagctgaatcg

SEQ ID NO: 156363 - DNA, 25 bp, E. coli
gccactgggttcagcaaatgcacgt

SEQ ID NO: 156364 - DNA, 25 bp, E. coli
gccactgggttctgcaaatgcacgt

SEQ ID NO: 156365 - DNA, 25 bp, E. coli
gacgggattaacatttcgccactgg

SEQ ID NO: 156366 - DNA, 25 bp, E. coli
gaaaatgtcactagaactcccttgg

SEQ ID NO: 156367 - DNA, 25 bp, E. coli
gaaagcgtctggctagtgcatgcca

SEQ ID NO: 156368 - DNA, 25 bp, E. coli
gaaagcgtctgggtagtgcatgcca

SEQ ID NO: 156369 - DNA, 25 bp, E. coli
gaaaatgtcacttgaactcccttgg

SEQ ID NO: 156370 - DNA, 25 bp, E. coli
gacgggattaacttttcgccactgg

SEQ ID NO: 156371 - DNA, 25 bp, E. coli
aaggatcttgagcacgagaaccgcc

SEQ ID NO: 156372 - DNA, 25 bp, E. coli
aatacggcggcaaggaggcttctga

SEQ ID NO: 156373 - DNA, 25 bp, E. coli
aaggatcttgaggacgagaaccgcc

SEQ ID NO: 156374 - DNA, 25 bp, E. coli
aatacggcggcatggaggcttctga

SEQ ID NO: 156375 - DNA, 25 bp, E. coli
caaatgtttgcccacctgagtctgg

SEQ ID NO: 156376 - DNA, 25 bp, E. coli
caaatgtttgccgacctgagtctgg

SEQ ID NO: 156377 - DNA, 25 bp, E. coli
caactggaagtccaaatacggcggc

SEQ ID NO: 156378 - DNA, 25 bp, E. coli
caactggaagtcgaaatacggcggc

SEQ ID NO: 156379 - DNA, 25 bp, E. coli
cagatcatcgccctgattaagtcgg

SEQ ID NO: 156380 - DNA, 25 bp, E. coli
cagatcatcgccgtgattaagtcgg

SEQ ID NO: 156381 - DNA, 25 bp, E. coli
ttaaagatgtctctcgcgaggccgg

SEQ ID NO: 156382 - DNA, 25 bp, E. coli
ttaaagatgtctgtcgcgaggccgg

SEQ ID NO: 156383 - DNA, 25 bp, E. coli
tgaagccacctattacaactggaag

SEQ ID NO: 156384 - DNA, 25 bp, E. coli
tgaagccacctaatacaactggaag

SEQ ID NO: 156385 - DNA, 25 bp, E. coli
ccgggcgctgaaagacgttatcgaa

SEQ ID NO: 156386 - DNA, 25 bp, E. coli
ccgggcgctgaatgacgttatcgaa

SEQ ID NO: 156387 - DNA, 25 bp, E. coli
gagaaccgccgtctaaaacaaatgt

SEQ ID NO: 156388 - DNA, 25 bp, E. coli
gagaaccgccgtgtaaaacaaatgt

SEQ ID NO: 156389 - DNA, 25 bp, E. coli
cgcgaggccggaatctctgaagcca

SEQ ID NO: 156390 - DNA, 25 bp, E. coli
cgcgaggccggattctctgaagcca

SEQ ID NO: 156391 - DNA, 25 bp, E. coli
taagtcggttgatgccggacgaact

SEQ ID NO: 156392 - DNA, 25 bp, E. coli
taagtcggttgaagccggacgaact

SEQ ID NO: 156393 - DNA, 25 bp, E. coli
tacggtgaccgccaaaattcgcgcc

SEQ ID NO: 156394 - DNA, 25 bp, E. coli
tacggtgaccgcgaaaattcgcgcc

SEQ ID NO: 156395 - DNA, 25 bp, E. coli
tatcaccgatggtgcggaaaccgcc

SEQ ID NO: 156396 - DNA, 25 bp, E. coli
tatgtcaccggatgagttatcccgc

SEQ ID NO: 156397 - DNA, 25 bp, E. coli
tatgtcaccggaagagttatcccgc

SEQ ID NO: 156398 - DNA, 25 bp, E. coli
tatcaccgatggagcggaaaccgcc

SEQ ID NO: 156399 - DNA, 25 bp, E. coli
tcccgcgtgctggatgttttcaaaa

SEQ ID NO: 156400 - DNA, 25 bp, E. coli
tcccgcgtgctgcatgttttcaaaa

SEQ ID NO: 156401 - DNA, 25 bp, E. coli
tcagatgtgctgcagcgtctcaagc

SEQ ID NO: 156402 - DNA, 25 bp, E. coli
tcagatgtgctggagcgtctcaagc

SEQ ID NO: 156403 - DNA, 25 bp, E. coli
ccattcatgtggcaaagcgcgagct

SEQ ID NO: 156404 - DNA, 25 bp, E. coli
ccattcatgtgggaaagcgcgagct

SEQ ID NO: 156405 - DNA, 25 bp, E. coli
ccatctggaaggtgatgcaccggca

SEQ ID NO: 156406 - DNA, 25 bp, E. coli
ccatctggaaggagatgcaccggca

SEQ ID NO: 156407 - DNA, 25 bp, E. coli
gcgagcttgcccaggatgatgagac

SEQ ID NO: 156408 - DNA, 25 bp, E. coli
gcgagcttgccctggatgatgagac

SEQ ID NO: 156409 - DNA, 25 bp, E. coli
taaccgctgggtgaaatcgcagacg

SEQ ID NO: 156410 - DNA, 25 bp, E. coli
taaccgctgggtcaaatcgcagacg

SEQ ID NO: 156411 - DNA, 25 bp, E. coli
gacgccgtttgctggcagtatgaaa

SEQ ID NO: 156412 - DNA, 25 bp, E. coli
gagacttatacaaccgcgctgctgg

SEQ ID NO: 156413 - DNA, 25 bp, E. coli
gacgccgtttgcaggcagtatgaaa

SEQ ID NO: 156414 - DNA, 25 bp, E. coli
gagacttatacatccgcgctgctgg

SEQ ID NO: 156415 - DNA, 25 bp, E. coli
catatatggagacctattttgaaca

SEQ ID NO: 156416 - DNA, 25 bp, E. coli
catatatggagagctattttgaaca

SEQ ID NO: 156417 - DNA, 25 bp, E. coli
atatggagagcttttttgaacatga

SEQ ID NO: 156418 - DNA, 25 bp, E. coli
atatggagagctattttgaacatga

SEQ ID NO: 156419 - DNA, 25 bp, E. coli
aacttttcatatttggagagctatt

SEQ ID NO: 156420 - DNA, 25 bp, E. coli
aacttttcatatatggagagctatt

SEQ ID NO: 156421 - DNA, 25 bp, E. coli
acttttcatataaggagagctattt

SEQ ID NO: 156422 - DNA, 25 bp, E. coli
acttttcatatatggagagctattt

SEQ ID NO: 156423 - DNA, 25 bp, E. coli
tatatggagagcaattttgaacatg

SEQ ID NO: 156424 - DNA, 25 bp, E. coli
tatatggagagctattttgaacatg

SEQ ID NO: 156425 - DNA, 25 bp, E. coli
tttcatatatggagagctattttga

SEQ ID NO: 156426 - DNA, 25 bp, E. coli
tttcatatatggtgagctattttga

SEQ ID NO: 156427 - DNA, 25 bp, E. coli
tgaacttttcatatatggagagcta

SEQ ID NO: 156428 - DNA, 25 bp, E. coli
tgaacttttcatttatggagagcta

SEQ ID NO: 156429 - DNA, 25 bp, E. coli
tcatatatggagtgctattttgaac

SEQ ID NO: 156430 - DNA, 25 bp, E. coli
tcatatatggagagctattttgaac

SEQ ID NO: 156431 - DNA, 25 bp, E. coli
gaacttttcatatatggagagctat

SEQ ID NO: 156432 - DNA, 25 bp, E. coli
gaacttttcataaatggagagctat

SEQ ID NO: 156433 - DNA, 25 bp, E. coli
cttttcatatatcgagagctatttt

SEQ ID NO: 156434 - DNA, 25 bp, E. coli
cttttcatatatggagagctatttt

SEQ ID NO: 156435 - DNA, 25 bp, E. coli
gtgaacttttcatatatggagagct

SEQ ID NO: 156436 - DNA, 25 bp, E. coli
gtgaacttttcaaatatggagagct

SEQ ID NO: 156437 - DNA, 25 bp, E. coli
cagtaaaaaaagaggtgtggctggc

SEQ ID NO: 156438 - DNA, 25 bp, E. coli
cagtaaaaaaagtggtgtggctggc

SEQ ID NO: 156439 - DNA, 25 bp, E. coli
tgttcccgacggtcgagtcagtaaa

SEQ ID NO: 156440 - DNA, 25 bp, E. coli
tgttcccgacggacgagtcagtaaa

SEQ ID NO: 156441 - DNA, 25 bp, E. coli
ccaggccgcgtcacagaaatggaca

SEQ ID NO: 156442 - DNA, 25 bp, E. coli
gccgcgtcacagtaatggacaatgc

SEQ ID NO: 156443 - DNA, 25 bp, E. coli
ccaggccgcgtctcagaaatggaca

SEQ ID NO: 156444 - DNA, 25 bp, E. coli
gccgcgtcacagaaatggacaatgc

SEQ ID NO: 156445 - DNA, 25 bp, E. coli
gaaatggacaatcccgttaagggac

SEQ ID NO: 156446 - DNA, 25 bp, E. coli
gaaatggacaatgccgttaagggac

SEQ ID NO: 156447 - DNA, 25 bp, E. coli
gacgtttttcgcatatccggcagat

SEQ ID NO: 156448 - DNA, 25 bp, E. coli
gacgtttttcgcttatccggcagat

SEQ ID NO: 156449 - DNA, 25 bp, E. coli
gacaatgccgttaagggactggcga

SEQ ID NO: 156450 - DNA, 25 bp, E. coli
gacaatgccgtttagggactggcga

SEQ ID NO: 156451 - DNA, 25 bp, E. coli
cgtttttcgcttttccggcagatat

SEQ ID NO: 156452 - DNA, 25 bp, E. coli
cgtttttcgcttatccggcagatat

SEQ ID NO: 156453 - DNA, 25 bp, E. coli
cgttaagggactcgcgaatggcaat

SEQ ID NO: 156454 - DNA, 25 bp, E. coli
ccgttaagggactggcgaatggcaa

SEQ ID NO: 156455 - DNA, 25 bp, E. coli
ccgttaagggacaggcgaatggcaa

SEQ ID NO: 156456 - DNA, 25 bp, E. coli
cgttaagggactggcgaatggcaat

SEQ ID NO: 156457 - DNA, 25 bp, E. coli
ggcgacgtttttcgcttatccggca

SEQ ID NO: 156458 - DNA, 25 bp, E. coli
ggcgacgtttttggcttatccggca

SEQ ID NO: 156459 - DNA, 25 bp, E. coli
ccctacgggctggtgtggttcgatc

SEQ ID NO: 156460 - DNA, 25 bp, E. coli
ccctacgggctgctgtggttcgatc

SEQ ID NO: 156461 - DNA, 25 bp, E. coli
aaaacgcccatgcaacaccgctttg

SEQ ID NO: 156462 - DNA, 25 bp, E. coli
aaaacgcccatggaacaccgctttg

SEQ ID NO: 156463 - DNA, 25 bp, E. coli
tttttggcggcaaaacgcccatgga

SEQ ID NO: 156464 - DNA, 25 bp, E. coli
tttttggcggcataacgcccatgga

SEQ ID NO: 156465 - DNA, 25 bp, E. coli
tgttttgcgccaacgaagcgattca

SEQ ID NO: 156466 - DNA, 25 bp, E. coli
tgttttgcgccatcgaagcgattca

SEQ ID NO: 156467 - DNA, 25 bp, E. coli
gactgccgtatcagccaggtggtga

SEQ ID NO: 156468 - DNA, 25 bp, E. coli
gactgccgtatctgccaggtggtga

SEQ ID NO: 156469 - DNA, 25 bp, E. coli
cgctgtgtgtaattacacttagcgc

SEQ ID NO: 156470 - DNA, 25 bp, E. coli
ccgtatcagccacgtggtgagcgtc

SEQ ID NO: 156471 - DNA, 25 bp, E. coli
cgctgtgtgtaaatacacttagcgc

SEQ ID NO: 156472 - DNA, 25 bp, E. coli
ccgtatcagccaggtggtgagcgtc

SEQ ID NO: 156473 - DNA, 25 bp, E. coli
ctggtttcgtttcactgccgtatca

SEQ ID NO: 156474 - DNA, 25 bp, E. coli
cattactggtgtgcctgaatcgtgg

SEQ ID NO: 156475 - DNA, 25 bp, E. coli
cattactggtgtccctgaatcgtgg

SEQ ID NO: 156476 - DNA, 25 bp, E. coli
ctggtttcgtttgactgccgtatca

SEQ ID NO: 156477 - DNA, 25 bp, E. coli
ggtgagcgtcgggacccacgacatt

SEQ ID NO: 156478 - DNA, 25 bp, E. coli
ggtgagcgtcggcacccacgacatt

SEQ ID NO: 156479 - DNA, 25 bp, E. coli
tcaatgaaaatcgaacgctgtgtgt

SEQ ID NO: 156480 - DNA, 25 bp, E. coli
tcaatgaaaatccaacgctgtgtgt

SEQ ID NO: 156481 - DNA, 25 bp, E. coli
catcgtttttagaggcgcacagccc

SEQ ID NO: 156482 - DNA, 25 bp, E. coli
catcgtttttagtggcgcacagccc

SEQ ID NO: 156483 - DNA, 25 bp, E. coli
tacgatgtgcagaacaaagcgggcg

SEQ ID NO: 156484 - DNA, 25 bp, E. coli
tacgatgtgcagtacaaagcgggcg

SEQ ID NO: 156485 - DNA, 25 bp, E. coli
tatgccgagaacatcaacgctggtc

SEQ ID NO: 156486 - DNA, 25 bp, E. coli
tatgccgagaacttcaacgctggtc

SEQ ID NO: 156487 - DNA, 25 bp, E. coli
tttccgcaacgatgaagccttcctg

SEQ ID NO: 156488 - DNA, 25 bp, E. coli
tttccgcaacgaagaagccttcctg

SEQ ID NO: 156489 - DNA, 25 bp, E. coli
tgccgtttccggtatgctgactgaa

SEQ ID NO: 156490 - DNA, 25 bp, E. coli
tgactatccggtcctgatggcagcg

SEQ ID NO: 156491 - DNA, 25 bp, E. coli
tgactatccggtgctgatggcagcg

SEQ ID NO: 156492 - DNA, 25 bp, E. coli
tgccgtttccggaatgctgactgaa

SEQ ID NO: 156493 - DNA, 25 bp, E. coli
tgctggagccgagcaagaagatgtc

SEQ ID NO: 156494 - DNA, 25 bp, E. coli
tgctggagccgaccaagaagatgtc

SEQ ID NO: 156495 - DNA, 25 bp, E. coli
gccaggatgcactgaagctgcgtaa

SEQ ID NO: 156496 - DNA, 25 bp, E. coli
gccaggatgcacagaagctgcgtaa

SEQ ID NO: 156497 - DNA, 25 bp, E. coli
gaactgctatacgtacttcggcgaa

SEQ ID NO: 156498 - DNA, 25 bp, E. coli
gaactgctatacctacttcggcgaa

SEQ ID NO: 156499 - DNA, 25 bp, E. coli
gtatcgatcctgagaaaagcaccat

SEQ ID NO: 156500 - DNA, 25 bp, E. coli
gtatcgatcctgtgaaaagcaccat

SEQ ID NO: 156501 - DNA, 25 bp, E. coli
taactacatgggagcgctgcgtcag

SEQ ID NO: 156502 - DNA, 25 bp, E. coli
taactacatgggtgcgctgcgtcag

SEQ ID NO: 156503 - DNA, 25 bp, E. coli
tacatattcacggtggcaaaaaata

SEQ ID NO: 156504 - DNA, 25 bp, E. coli
tacatattcacgctggcaaaaaata

SEQ ID NO: 156505 - DNA, 25 bp, E. coli
tattcacggtgggaaaaaatataaa

SEQ ID NO: 156506 - DNA, 25 bp, E. coli
tattttcgcgttgattcacgaactg

SEQ ID NO: 156507 - DNA, 25 bp, E. coli
tattttcgcgttcattcacgaactg

SEQ ID NO: 156508 - DNA, 25 bp, E. coli
tattcacggtggcaaaaaatataaa

SEQ ID NO: 156509 - DNA, 25 bp, E. coli
tcttattttcgccttgattcacgaa

SEQ ID NO: 156510 - DNA, 25 bp, E. coli
tcttattttcgcgttgattcacgaa

SEQ ID NO: 156511 - DNA, 25 bp, E. coli
cgaactgttaattacatattcacgg

SEQ ID NO: 156512 - DNA, 25 bp, E. coli
cgcgttgattcaggaactgttaatt

SEQ ID NO: 156513 - DNA, 25 bp, E. coli
cgaactgttaataacatattcacgg

SEQ ID NO: 156514 - DNA, 25 bp, E. coli
cgcgttgattcacgaactgttaatt

SEQ ID NO: 156515 - DNA, 25 bp, E. coli
ctgttaattacatattcacggtggc

SEQ ID NO: 156516 - DNA, 25 bp, E. coli
ctgttaattacaaattcacggtggc

SEQ ID NO: 156517 - DNA, 25 bp, E. coli
gttaattacataatcacggtggcaa

SEQ ID NO: 156518 - DNA, 25 bp, E. coli
gttgattcacgatctgttaattaca

SEQ ID NO: 156519 - DNA, 25 bp, E. coli
gttgattcacgaactgttaattaca

SEQ ID NO: 156520 - DNA, 25 bp, E. coli
gttaattacatattcacggtggcaa

SEQ ID NO: 156521 - DNA, 25 bp, E. coli
tggcaaaaaatataaaaccacattt

SEQ ID NO: 156522 - DNA, 25 bp, E. coli
tggcaaaaaataaaaaaccacattt

SEQ ID NO: 156523 - DNA, 25 bp, E. coli
taattacatattgacggtggcaaaa

SEQ ID NO: 156524 - DNA, 25 bp, E. coli
taattacatattcacggtggcaaaa

SEQ ID NO: 156525 - DNA, 25 bp, E. coli
aatcggcagattccagagcaggagc

SEQ ID NO: 156526 - DNA, 25 bp, E. coli
aatcggcagattgcagagcaggagc

SEQ ID NO: 156527 - DNA, 25 bp, E. coli
tatcgcggttgatcccattgaaggc

SEQ ID NO: 156528 - DNA, 25 bp, E. coli
tatcgcggttgaacccattgaaggc

SEQ ID NO: 156529 - DNA, 25 bp, E. coli
tttgccctgccggatggcgatgtcg

SEQ ID NO: 156530 - DNA, 25 bp, E. coli
tttgccctgccgcatggcgatgtcg

SEQ ID NO: 156531 - DNA, 25 bp, E. coli
tgatgtacaccaacggcggtgcgcc

SEQ ID NO: 156532 - DNA, 25 bp, E. coli
tgatgtacaccatcggcggtgcgcc

SEQ ID NO: 156533 - DNA, 25 bp, E. coli
gcggcgcggacctaacgtgtaatat

SEQ ID NO: 156534 - DNA, 25 bp, E. coli
gcggcgcggaccaaacgtgtaatat

SEQ ID NO: 156535 - DNA, 25 bp, E. coli
gcagacattactgatcggcggcgcg

SEQ ID NO: 156536 - DNA, 25 bp, E. coli
gcagacattactcatcggcggcgcg

SEQ ID NO: 156537 - DNA, 25 bp, E. coli
gaacggtatccaacagacggcgaat

SEQ ID NO: 156538 - DNA, 25 bp, E. coli
gaacggtatccatcagacggcgaat

SEQ ID NO: 156539 - DNA, 25 bp, E. coli
gttaaccgtgtgaactcgctcgatg

SEQ ID NO: 156540 - DNA, 25 bp, E. coli
gatatcctcttttgcgctacgggcg

SEQ ID NO: 156541 - DNA, 25 bp, E. coli
gatatcctctttagcgctacgggcg

SEQ ID NO: 156542 - DNA, 25 bp, E. coli
gttaaccgtgtgtactcgctcgatg

SEQ ID NO: 156543 - DNA, 25 bp, E. coli
ggagaaattgacgatgcgccgatgc

SEQ ID NO: 156544 - DNA, 25 bp, E. coli
ggagaaattgaccatgcgccgatgc

SEQ ID NO: 156545 - DNA, 25 bp, E. coli
gagatagcctgttacatgcgcccga

SEQ ID NO: 156546 - DNA, 25 bp, E. coli
gagatagcctgtaacatgcgcccga

SEQ ID NO: 156547 - DNA, 25 bp, E. coli
aatcaactgaatgaaccctggccgg

SEQ ID NO: 156548 - DNA, 25 bp, E. coli
aatcaactgaatcaaccctggccgg

SEQ ID NO: 156549 - DNA, 25 bp, E. coli
aaatggctttcagccggtcgaagcg

SEQ ID NO: 156550 - DNA, 25 bp, E. coli
aaatggctttcacccggtcgaagcg

SEQ ID NO: 156551 - DNA, 25 bp, E. coli
ttttttatgacgcatcctgagcgcg

SEQ ID NO: 156552 - DNA, 25 bp, E. coli
ttttttatgacggatcctgagcgcg

SEQ ID NO: 156553 - DNA, 25 bp, E. coli
tgcttcgtgctccaacaaaatggct

SEQ ID NO: 156554 - DNA, 25 bp, E. coli
tgcttcgtgctcgaacaaaatggct

SEQ ID NO: 156555 - DNA, 25 bp, E. coli
tcgaagcggaagtttatgacagtgc

SEQ ID NO: 156556 - DNA, 25 bp, E. coli
tcgaagcggaagattatgacagtgc

SEQ ID NO: 156557 - DNA, 25 bp, E. coli
gccgcgagcagcagttaaaccacgt

SEQ ID NO: 156558 - DNA, 25 bp, E. coli
gccgcgagcagctgttaaaccacgt

SEQ ID NO: 156559 - DNA, 25 bp, E. coli
gcggctccggtatccagttcatcaa

SEQ ID NO: 156560 - DNA, 25 bp, E. coli
gcggctccggtaaccagttcatcaa

SEQ ID NO: 156561 - DNA, 25 bp, E. coli
cgaatcaaagcggtaatgcgccgta

SEQ ID NO: 156562 - DNA, 25 bp, E. coli
cgaatcaaagcgctaatgcgccgta

SEQ ID NO: 156563 - DNA, 25 bp, E. coli
gttcatcaaacagctcaagcgcgag

SEQ ID NO: 156564 - DNA, 25 bp, E. coli
gttcatcaaacacctcaagcgcgag

SEQ ID NO: 156565 - DNA, 25 bp, E. coli
ggatgactatatcaccaagccgttt

SEQ ID NO: 156566 - DNA, 25 bp, E. coli
ggatgactatatgaccaagccgttt

SEQ ID NO: 156567 - DNA, 25 bp, E. coli
gatgtccacattggtcgcctgcgta

SEQ ID NO: 156568 - DNA, 25 bp, E. coli
gatgtccacattcgtcgcctgcgta

SEQ ID NO: 156569 - DNA, 25 bp, E. coli
caggaaaaatctcaaaatcggtacg

SEQ ID NO: 156570 - DNA, 25 bp, E. coli
caggaaaaatctgaaaatcggtacg

SEQ ID NO: 156571 - DNA, 25 bp, E. coli
caggaaactacgtgggcagcaaaaa

SEQ ID NO: 156572 - DNA, 25 bp, E. coli
caggaaactacgagggcagcaaaaa

SEQ ID NO: 156573 - DNA, 25 bp, E. coli
taacagtatcttagttatacaaggg

SEQ ID NO: 156574 - DNA, 25 bp, E. coli
aaatgcaacgcccaccagtcgggct

SEQ ID NO: 156575 - DNA, 25 bp, E. coli
aaatgcaacgccgaccagtcgggct

SEQ ID NO: 156576 - DNA, 25 bp, E. coli
tggtaacaccggcaaatgcaacgcc

SEQ ID NO: 156577 - DNA, 25 bp, E. coli
tggtaacaccgggaaatgcaacgcc

SEQ ID NO: 156578 - DNA, 25 bp, E. coli
tccaatcgtggttcgcagtactgca

SEQ ID NO: 156579 - DNA, 25 bp, E. coli
tccaatcgtggtacgcagtactgca

SEQ ID NO: 156580 - DNA, 25 bp, E. coli
gcagcaaaaacgtatggtaacaccg

SEQ ID NO: 156581 - DNA, 25 bp, E. coli
gcagcaaaaacgaatggtaacaccg

SEQ ID NO: 156582 - DNA, 25 bp, E. coli
gtactgcacacacgattaccgggct

SEQ ID NO: 156583 - DNA, 25 bp, E. coli
gattaccgggctttacaggagcggt

SEQ ID NO: 156584 - DNA, 25 bp, E. coli
gattaccgggctatacaggagcggt

SEQ ID NO: 156585 - DNA, 25 bp, E. coli
gtactgcacacaggattaccgggct

SEQ ID NO: 156586 - DNA, 25 bp, E. coli
gggcattgaggaaatcaggaaaaat

SEQ ID NO: 156587 - DNA, 25 bp, E. coli
gggcattgaggatatcaggaaaaat

SEQ ID NO: 156588 - DNA, 25 bp, E. coli
taacagtatctttgttatacaaggg

SEQ ID NO: 156589 - DNA, 25 bp, E. coli
tcaaaatcggtagggacaggaaact

SEQ ID NO: 156590 - DNA, 25 bp, E. coli
tcaaaatcggtacggacaggaaact

SEQ ID NO: 156591 - DNA, 25 bp, E. coli
caaaatgtgaatagtagctgacctg

SEQ ID NO: 156592 - DNA, 25 bp, E. coli
caaaatgtgaattgtagctgacctg

SEQ ID NO: 156593 - DNA, 25 bp, E. coli
tataaagtaaacgatgacccttcgg

SEQ ID NO: 156594 - DNA, 25 bp, E. coli
taacaacctggattcgagccgtcat

SEQ ID NO: 156595 - DNA, 25 bp, E. coli
taacaacctggaatcgagccgtcat

SEQ ID NO: 156596 - DNA, 25 bp, E. coli
tataaagtaaaccatgacccttcgg

SEQ ID NO: 156597 - DNA, 25 bp, E. coli
tagctgacctggcacttgtacccgg

SEQ ID NO: 156598 - DNA, 25 bp, E. coli
tagctgacctgggacttgtacccgg

SEQ ID NO: 156599 - DNA, 25 bp, E. coli
tcgggaacttcagggtaaaatgact

SEQ ID NO: 156600 - DNA, 25 bp, E. coli
tcgggaacttcacggtaaaatgact

SEQ ID NO: 156601 - DNA, 25 bp, E. coli
tctggtcccggttaggagttatgcc

SEQ ID NO: 156602 - DNA, 25 bp, E. coli
tctggtcccggtaaggagttatgcc

SEQ ID NO: 156603 - DNA, 25 bp, E. coli
gttatgccgggcaggccgaacagcc

SEQ ID NO: 156604 - DNA, 25 bp, E. coli
gttatgccgggctggccgaacagcc

SEQ ID NO: 156605 - DNA, 25 bp, E. coli
gggtgaagacttcccctatcaggaa

SEQ ID NO: 156606 - DNA, 25 bp, E. coli
gggtgaagacttgccctatcaggaa

SEQ ID NO: 156607 - DNA, 25 bp, E. coli
ggcgcaacgccctataaagtaaacg

SEQ ID NO: 156608 - DNA, 25 bp, E. coli
ggcgcaacgcccaataaagtaaacg

SEQ ID NO: 156609 - DNA, 25 bp, E. coli
tcaagaggtatatcaaatgcaagct

SEQ ID NO: 156610 - DNA, 25 bp, E. coli
tcaagaggtataacaaatgcaagct

SEQ ID NO: 156611 - DNA, 25 bp, E. coli
gagccgtcatacaacggcgcaacgc

SEQ ID NO: 156612 - DNA, 25 bp, E. coli
gagccgtcatactacggcgcaacgc

SEQ ID NO: 156613 - DNA, 25 bp, E. coli
caatgcgtaacgataattcccctta

SEQ ID NO: 156614 - DNA, 25 bp, E. coli
caatgcgtaacgttaattcccctta

SEQ ID NO: 156615 - DNA, 25 bp, E. coli
cactctcgcgatttttcaggcggac

SEQ ID NO: 156616 - DNA, 25 bp, E. coli
cactctcgcgatatttcaggcggac

SEQ ID NO: 156617 - DNA, 25 bp, E. coli
caaatatttcgctgcaggagtatcc

SEQ ID NO: 156618 - DNA, 25 bp, E. coli
caaatatttcgcagcaggagtatcc

SEQ ID NO: 156619 - DNA, 25 bp, E. coli
catgggtcaccttatgcgccactct

SEQ ID NO: 156620 - DNA, 25 bp, E. coli
caggcggacttagtatcccgtaaag

SEQ ID NO: 156621 - DNA, 25 bp, E. coli
catgggtcacctaatgcgccactct

SEQ ID NO: 156622 - DNA, 25 bp, E. coli
caggcggacttactatcccgtaaag

SEQ ID NO: 156623 - DNA, 25 bp, E. coli
taaatgttgcgaaatgtgagtgagc

SEQ ID NO: 156624 - DNA, 25 bp, E. coli
taaatgttgcgatatgtgagtgagc

SEQ ID NO: 156625 - DNA, 25 bp, E. coli
gactaaacggaacaacatgggtcac

SEQ ID NO: 156626 - DNA, 25 bp, E. coli
gactaaacggaagaacatgggtcac

SEQ ID NO: 156627 - DNA, 25 bp, E. coli
tgcctggaattgtcttaaagtaaag

SEQ ID NO: 156628 - DNA, 25 bp, E. coli
tgcctggaattgacttaaagtaaag

SEQ ID NO: 156629 - DNA, 25 bp, E. coli
ggcataccctcagtcaatgcgtaac

SEQ ID NO: 156630 - DNA, 25 bp, E. coli
ggcataccctcactcaatgcgtaac

SEQ ID NO: 156631 - DNA, 25 bp, E. coli
taggataacatgttaaacgttacgg

SEQ ID NO: 156632 - DNA, 25 bp, E. coli
taggataacatgataaacgttacgg

SEQ ID NO: 156633 - DNA, 25 bp, E. coli
gagtatcctggaagatgttcgtagg

SEQ ID NO: 156634 - DNA, 25 bp, E. coli
gagtatcctggatgatgttcgtagg

SEQ ID NO: 156635 - DNA, 25 bp, E. coli
aagtagagcaagcactggcgacgac

SEQ ID NO: 156636 - DNA, 25 bp, E. coli
aagtagagcaaggactggcgacgac

SEQ ID NO: 156637 - DNA, 25 bp, E. coli
ataacatgcccgctctgccggtggg

SEQ ID NO: 156638 - DNA, 25 bp, E. coli
ataacatgcccggtctgccggtggg

SEQ ID NO: 156639 - DNA, 25 bp, E. coli
acatgcccggtctgccggtgggtaa

SEQ ID NO: 156640 - DNA, 25 bp, E. coli
acatgcccggtcagccggtgggtaa

SEQ ID NO: 156641 - DNA, 25 bp, E. coli
tatttccagccacgggcactgatgg

SEQ ID NO: 156642 - DNA, 25 bp, E. coli
tatttccagccaggggcactgatgg

SEQ ID NO: 156643 - DNA, 25 bp, E. coli
ttttcggcatgcttaacatgcccgg

SEQ ID NO: 156644 - DNA, 25 bp, E. coli
ttttcggcatgcataacatgcccgg

SEQ ID NO: 156645 - DNA, 25 bp, E. coli
ccggtgctagttcccgcacatatca

SEQ ID NO: 156646 - DNA, 25 bp, E. coli
gccatcgatccgctgctagttgccg

SEQ ID NO: 156647 - DNA, 25 bp, E. coli
gccatcgatccggtgctagttgccg

SEQ ID NO: 156648 - DNA, 25 bp, E. coli
ccggtgctagttgccgcacatatca

SEQ ID NO: 156649 - DNA, 25 bp, E. coli
gctatgaagtagagcaaggactggc

SEQ ID NO: 156650 - DNA, 25 bp, E. coli
gctatgaagtagtgcaaggactggc

SEQ ID NO: 156651 - DNA, 25 bp, E. coli
gtgggtaagtttaatttccagccag

SEQ ID NO: 156652 - DNA, 25 bp, E. coli
gggttacgacttcaacgatgcaagt

SEQ ID NO: 156653 - DNA, 25 bp, E. coli
gggttacgacttgaacgatgcaagt

SEQ ID NO: 156654 - DNA, 25 bp, E. coli
gatccggtgctacttgccgcacata

SEQ ID NO: 156655 - DNA, 25 bp, E. coli
gtgggtaagttttatttccagccag

SEQ ID NO: 156656 - DNA, 25 bp, E. coli
gatccggtgctagttgccgcacata

SEQ ID NO: 156657 - DNA, 25 bp, E. coli
tacaacaagcgttgctacggcaaag

SEQ ID NO: 156658 - DNA, 25 bp, E. coli
tacaacaagcgtagctacggcaaag

SEQ ID NO: 156659 - DNA, 25 bp, E. coli
taaaagctattgttgccttcccgca

SEQ ID NO: 156660 - DNA, 25 bp, E. coli
taaaagctattgatgccttcccgca

SEQ ID NO: 156661 - DNA, 25 bp, E. coli
taccaaaagctgaacgcggagaact

SEQ ID NO: 156662 - DNA, 25 bp, E. coli
taccaaaagctgtacgcggagaact

SEQ ID NO: 156663 - DNA, 25 bp, E. coli
tatatgccagtcaggcactgaaacg

SEQ ID NO: 156664 - DNA, 25 bp, E. coli
tatatgccagtctggcactgaaacg

SEQ ID NO: 156665 - DNA, 25 bp, E. coli
tgcaagccagttagctaccaaaagc

SEQ ID NO: 156666 - DNA, 25 bp, E. coli
tgcaagccagtttgctaccaaaagc

SEQ ID NO: 156667 - DNA, 25 bp, E. coli
tcccgcaagcggaggtatatgccag

SEQ ID NO: 156668 - DNA, 25 bp, E. coli
tcccgcaagcggtggtatatgccag

SEQ ID NO: 156669 - DNA, 25 bp, E. coli
gcatttttgcggttaatcagcccga

SEQ ID NO: 156670 - DNA, 25 bp, E. coli
gcatttttgcggataatcagcccga

SEQ ID NO: 156671 - DNA, 25 bp, E. coli
gcacaaaccgtgtgggtcggcgaaa

SEQ ID NO: 156672 - DNA, 25 bp, E. coli
gcacaaaccgtgagggtcggcgaaa

SEQ ID NO: 156673 - DNA, 25 bp, E. coli
cgcggagaactgctcgtaaaagcta

SEQ ID NO: 156674 - DNA, 25 bp, E. coli
cgcggagaactggtcgtaaaagcta

SEQ ID NO: 156675 - DNA, 25 bp, E. coli
ctggataagttaagcggtgtcacac

SEQ ID NO: 156676 - DNA, 25 bp, E. coli
ctggataagttatgcggtgtcacac

SEQ ID NO: 156677 - DNA, 25 bp, E. coli
taagcggtgtcacaccggagaaacg

SEQ ID NO: 156678 - DNA, 25 bp, E. coli
taagcggtgtcagaccggagaaacg

SEQ ID NO: 156679 - DNA, 25 bp, E. coli
caacaattacgcctgttgaaccaag

SEQ ID NO: 156680 - DNA, 25 bp, E. coli
caacaattacgcgtgttgaaccaag

SEQ ID NO: 156681 - DNA, 25 bp, E. coli
taaatatgatgggtattagaaagtc

SEQ ID NO: 156682 - DNA, 25 bp, E. coli
taaatatgatggctattagaaagtc

SEQ ID NO: 156683 - DNA, 25 bp, E. coli
ttcaacttccaattcaccaaacggt

SEQ ID NO: 156684 - DNA, 25 bp, E. coli
ttcaacttccaaatcaccaaacggt

SEQ ID NO: 156685 - DNA, 25 bp, E. coli
tcgtgtccaaacagactgcaacaat

SEQ ID NO: 156686 - DNA, 25 bp, E. coli
tcgtgtccaaactgactgcaacaat

SEQ ID NO: 156687 - DNA, 25 bp, E. coli
tctgtttcctccgtgcatttgtggg

SEQ ID NO: 156688 - DNA, 25 bp, E. coli
tctccgcgctgtacgtgtccaaact

SEQ ID NO: 156689 - DNA, 25 bp, E. coli
tctccgcgctgttcgtgtccaaact

SEQ ID NO: 156690 - DNA, 25 bp, E. coli
tctgtttcctccctgcatttgtggg

SEQ ID NO: 156691 - DNA, 25 bp, E. coli
gcctgttgaacctagttcttattcc

SEQ ID NO: 156692 - DNA, 25 bp, E. coli
gtcattaaatttataagggtgcgca

SEQ ID NO: 156693 - DNA, 25 bp, E. coli
gtcattaaatttttaagggtgcgca

SEQ ID NO: 156694 - DNA, 25 bp, E. coli
gcctgttgaaccaagttcttattcc

SEQ ID NO: 156695 - DNA, 25 bp, E. coli
gaactaagttcagcaggctatttta

SEQ ID NO: 156696 - DNA, 25 bp, E. coli
gaactaagttcaccaggctatttta

SEQ ID NO: 156697 - DNA, 25 bp, E. coli
gggaggatttcgacttgaactaagt

SEQ ID NO: 156698 - DNA, 25 bp, E. coli
gggaggatttcgtcttgaactaagt

SEQ ID NO: 156699 - DNA, 25 bp, E. coli
tcacgtccgttaaaaatatgatggc

SEQ ID NO: 156700 - DNA, 25 bp, E. coli
tcacgtccgttataaatatgatggc

SEQ ID NO: 156701 - DNA, 25 bp, E. coli
aatcgcggttaaaggcatgttgcca

SEQ ID NO: 156702 - DNA, 25 bp, E. coli
aatcgcggttaatggcatgttgcca

SEQ ID NO: 156703 - DNA, 25 bp, E. coli
catcggtggtatgaaacaagcgacc

SEQ ID NO: 156704 - DNA, 25 bp, E. coli
catcggtggtatcaaacaagcgacc

SEQ ID NO: 156705 - DNA, 25 bp, E. coli
catgttgccaaaaggcccgctgggt

SEQ ID NO: 156706 - DNA, 25 bp, E. coli
catgttgccaaatggcccgctgggt

SEQ ID NO: 156707 - DNA, 25 bp, E. coli
tacactccgcacgtagataccggtg

SEQ ID NO: 156708 - DNA, 25 bp, E. coli
tacactccgcacctagataccggtg

SEQ ID NO: 156709 - DNA, 25 bp, E. coli
tttacgcgggtatcgagcacaacca

SEQ ID NO: 156710 - DNA, 25 bp, E. coli
tttacgcgggtaacgagcacaacca

SEQ ID NO: 156711 - DNA, 25 bp, E. coli
tgctgtaaccggcaacaagcgtact

SEQ ID NO: 156712 - DNA, 25 bp, E. coli
tgctgtaaccgggaacaagcgtact

SEQ ID NO: 156713 - DNA, 25 bp, E. coli
tctggctactgatctggctcgtcgc

SEQ ID NO: 156714 - DNA, 25 bp, E. coli
tctggctactgaactggctcgtcgc

SEQ ID NO: 156715 - DNA, 25 bp, E. coli
gccgtcctgagcgtgtgattgaaat

SEQ ID NO: 156716 - DNA, 25 bp, E. coli
gccgtcctgagcctgtgattgaaat

SEQ ID NO: 156717 - DNA, 25 bp, E. coli
gaagagatgattcctcgccgtcctg

SEQ ID NO: 156718 - DNA, 25 bp, E. coli
gaagagatgattgctcgccgtcctg

SEQ ID NO: 156719 - DNA, 25 bp, E. coli
cgcggtaagcactaagcggaataca

SEQ ID NO: 156720 - DNA, 25 bp, E. coli
cgcggtaagcacaaagcggaataca

SEQ ID NO: 156721 - DNA, 25 bp, E. coli
cgactggtatgttgttgacgcgacc

SEQ ID NO: 156722 - DNA, 25 bp, E. coli
cgactggtatgtagttgacgcgacc

SEQ ID NO: 156723 - DNA, 25 bp, E. coli
aatcatcgcggacaggaggtcgcca

SEQ ID NO: 156724 - DNA, 25 bp, E. coli
aatcatcgcggagaggaggtcgcca

SEQ ID NO: 156725 - DNA, 25 bp, E. coli
caacacaaattgaaggaacccctgt

SEQ ID NO: 156726 - DNA, 25 bp, E. coli
caacacaaattgtaggaacccctgt

SEQ ID NO: 156727 - DNA, 25 bp, E. coli
ttaaacaggtgataaagggtgagcg

SEQ ID NO: 156728 - DNA, 25 bp, E. coli
ttaaacaggtgaaaaagggtgagcg

SEQ ID NO: 156729 - DNA, 25 bp, E. coli
tcctataagtgttgggtaatcctca

SEQ ID NO: 156730 - DNA, 25 bp, E. coli
tcctataagtgtagggtaatcctca

SEQ ID NO: 156731 - DNA, 25 bp, E. coli
ccatcaagatgggttgctgaacata

SEQ ID NO: 156732 - DNA, 25 bp, E. coli
ccatcaagatggcttgctgaacata

SEQ ID NO: 156733 - DNA, 25 bp, E. coli
gcgttatctcgcctaaatcaacaca

SEQ ID NO: 156734 - DNA, 25 bp, E. coli
gcgttatctcgcgtaaatcaacaca

SEQ ID NO: 156735 - DNA, 25 bp, E. coli
gaatatgttattcaaatcatcgcgg

SEQ ID NO: 156736 - DNA, 25 bp, E. coli
gaatatgttattgaaatcatcgcgg

SEQ ID NO: 156737 - DNA, 25 bp, E. coli
tgaaccaggcacattaagtttaact

SEQ ID NO: 156738 - DNA, 25 bp, E. coli
tgaaccaggcactttaagtttaact

SEQ ID NO: 156739 - DNA, 25 bp, E. coli
ccctgtaaggtaactcctataagtg

SEQ ID NO: 156740 - DNA, 25 bp, E. coli
cgatttttgatagttgaaccaggca

SEQ ID NO: 156741 - DNA, 25 bp, E. coli
cgatttttgatacttgaaccaggca

SEQ ID NO: 156742 - DNA, 25 bp, E. coli
ccctgtaaggtatctcctataagtg

SEQ ID NO: 156743 - DNA, 25 bp, E. coli
tcaaaatttcatttgccaacacaga

SEQ ID NO: 156744 - DNA, 25 bp, E. coli
tcaaaatttcatatgccaacacaga

SEQ ID NO: 156745 - DNA, 25 bp, E. coli
caagcgcgcagcgatttatcaaagg

SEQ ID NO: 156746 - DNA, 25 bp, E. coli
caagcgcgcagccatttatcaaagg

SEQ ID NO: 156747 - DNA, 25 bp, E. coli
tactgaacgcgatgctaactggtgg

SEQ ID NO: 156748 - DNA, 25 bp, E. coli
tactgaacgcgaagctaactggtgg

SEQ ID NO: 156749 - DNA, 25 bp, E. coli
tattaattcattatgtcggcccgac

SEQ ID NO: 156750 - DNA, 25 bp, E. coli
tattaattcattttgtcggcccgac

SEQ ID NO: 156751 - DNA, 25 bp, E. coli
tatcaaaggcaatgaagcatcgccc

SEQ ID NO: 156752 - DNA, 25 bp, E. coli
tatcaaaggcaaagaagcatcgccc

SEQ ID NO: 156753 - DNA, 25 bp, E. coli
ttactgggccggttatccaagcgcg

SEQ ID NO: 156754 - DNA, 25 bp, E. coli
ttactgggccggatatccaagcgcg

SEQ ID NO: 156755 - DNA, 25 bp, E. coli
tgtacctggatggtgatatcgcctg

SEQ ID NO: 156756 - DNA, 25 bp, E. coli
tgtacctggatgctgatatcgcctg

SEQ ID NO: 156757 - DNA, 25 bp, E. coli
tccatctggtgatttgtgaacggct

SEQ ID NO: 156758 - DNA, 25 bp, E. coli
tccatctggtgaattgtgaacggct

SEQ ID NO: 156759 - DNA, 25 bp, E. coli
tcatcttcgatgtaaggccagcggt

SEQ ID NO: 156760 - DNA, 25 bp, E. coli
tcatcttcgatgaaaggccagcggt

SEQ ID NO: 156761 - DNA, 25 bp, E. coli
cctgtcagggaatcttaaagccgct

SEQ ID NO: 156762 - DNA, 25 bp, E. coli
cctgtcagggaaacttaaagccgct

SEQ ID NO: 156763 - DNA, 25 bp, E. coli
ggcttaaggcataaccgacgaccaa

SEQ ID NO: 156764 - DNA, 25 bp, E. coli
ggcttaaggcattaccgacgaccaa

SEQ ID NO: 156765 - DNA, 25 bp, E. coli
taattaatacactagcgtgggcgca

SEQ ID NO: 156766 - DNA, 25 bp, E. coli
taattaatacacaagcgtgggcgca

SEQ ID NO: 156767 - DNA, 25 bp, E. coli
cattatccgacacacatgtacggga

SEQ ID NO: 156768 - DNA, 25 bp, E. coli
catgtacgggagctatctcgctgcc

SEQ ID NO: 156769 - DNA, 25 bp, E. coli
cattatccgacagacatgtacggga

SEQ ID NO: 156770 - DNA, 25 bp, E. coli
catgtacgggaggtatctcgctgcc

SEQ ID NO: 156771 - DNA, 25 bp, E. coli
acacatgtacggcaggtatctcgct

SEQ ID NO: 156772 - DNA, 25 bp, E. coli
acacatgtacgggaggtatctcgct

SEQ ID NO: 156773 - DNA, 25 bp, E. coli
tatccgacacacatgtacgggaggt

SEQ ID NO: 156774 - DNA, 25 bp, E. coli
tatccgacacacttgtacgggaggt

SEQ ID NO: 156775 - DNA, 25 bp, E. coli
tgtgtgatgcagataattttctcgt

SEQ ID NO: 156776 - DNA, 25 bp, E. coli
tgatgcagttaattttctcgtggaa

SEQ ID NO: 156777 - DNA, 25 bp, E. coli
tgtgtgatgcagttaattttctcgt

SEQ ID NO: 156778 - DNA, 25 bp, E. coli
tgcagttaattttctcgtggaaaaa

SEQ ID NO: 156779 - DNA, 25 bp, E. coli
tgcagttaatttactcgtggaaaaa

SEQ ID NO: 156780 - DNA, 25 bp, E. coli
tgatgcagttaaatttctcgtggaa

SEQ ID NO: 156781 - DNA, 25 bp, E. coli
tccgacacacatgtacgggaggtat

SEQ ID NO: 156782 - DNA, 25 bp, E. coli
tccgacacacatctacgggaggtat

SEQ ID NO: 156783 - DNA, 25 bp, E. coli
tcactgtgtgatgcagttaattttc

SEQ ID NO: 156784 - DNA, 25 bp, E. coli
tcactgtgtgatccagttaattttc

SEQ ID NO: 156785 - DNA, 25 bp, E. coli
cgacacacatgttcgggaggtatct

SEQ ID NO: 156786 - DNA, 25 bp, E. coli
cgacacacatgtacgggaggtatct

SEQ ID NO: 156787 - DNA, 25 bp, E. coli
tgtacgggaggtatctcgctgcccg

SEQ ID NO: 156788 - DNA, 25 bp, E. coli
tgtacgggaggtttctcgctgcccg

SEQ ID NO: 156789 - DNA, 25 bp, E. coli
catcgcccggcatgtaataaaaatg

SEQ ID NO: 156790 - DNA, 25 bp, E. coli
catgtaataaaaatgccactacggc

SEQ ID NO: 156791 - DNA, 25 bp, E. coli
catcgcccggcaagtaataaaaatg

SEQ ID NO: 156792 - DNA, 25 bp, E. coli
catgtaataaaattgccactacggc

SEQ ID NO: 156793 - DNA, 25 bp, E. coli
aaatgataccgggtagttacgctat

SEQ ID NO: 156794 - DNA, 25 bp, E. coli
aaatgataccggctagttacgctat

SEQ ID NO: 156795 - DNA, 25 bp, E. coli
agttacgctattatcttcccgcagg

SEQ ID NO: 156796 - DNA, 25 bp, E. coli
agttacgctattttcttcccgcagg

SEQ ID NO: 156797 - DNA, 25 bp, E. coli
tttcttcccgcacgatgtacatcgc

SEQ ID NO: 156798 - DNA, 25 bp, E. coli
tttcttcccgcaggatgtacatcgc

SEQ ID NO: 156799 - DNA, 25 bp, E. coli
gccactacggcaatacgcaagatcg

SEQ ID NO: 156800 - DNA, 25 bp, E. coli
gccactacggcattacgcaagatcg

SEQ ID NO: 156801 - DNA, 25 bp, E. coli
gcaggatgtacatcgcccggcatgt

SEQ ID NO: 156802 - DNA, 25 bp, E. coli
gcaggatgtacaacgcccggcatgt

SEQ ID NO: 156803 - DNA, 25 bp, E. coli
cgcaagatcgtgcttaaagtggccc

SEQ ID NO: 156804 - DNA, 25 bp, E. coli
cgcaagatcgtggttaaagtggccc

SEQ ID NO: 156805 - DNA, 25 bp, E. coli
gattttctgcgctccaccgacttca

SEQ ID NO: 156806 - DNA, 25 bp, E. coli
gattttctgcgcaccaccgacttca

SEQ ID NO: 156807 - DNA, 25 bp, E. coli
taaccacacgcgaggcggtagaaaa

SEQ ID NO: 156808 - DNA, 25 bp, E. coli
taaagtggccctggctgctttataa

SEQ ID NO: 156809 - DNA, 25 bp, E. coli
taaagtggccctcgctgctttataa

SEQ ID NO: 156810 - DNA, 25 bp, E. coli
taaccacacgcgtggcggtagaaaa

SEQ ID NO: 156811 - DNA, 25 bp, E. coli
caatcaatttatttgaacaaggcgg

SEQ ID NO: 156812 - DNA, 25 bp, E. coli
caatcaatttatatgaacaaggcgg

SEQ ID NO: 156813 - DNA, 25 bp, E. coli
cacttatacaaaaatcacctgcgag

SEQ ID NO: 156814 - DNA, 25 bp, E. coli
cacttatacaaatatcacctgcgag

SEQ ID NO: 156815 - DNA, 25 bp, E. coli
catcgacgaaacaacgtcacttata

SEQ ID NO: 156816 - DNA, 25 bp, E. coli
catcgacgaaactacgtcacttata

SEQ ID NO: 156817 - DNA, 25 bp, E. coli
tacaactggcgacatgcatagcgag

SEQ ID NO: 156818 - DNA, 25 bp, E. coli
tacaactggcgagatgcatagcgag

SEQ ID NO: 156819 - DNA, 25 bp, E. coli
aacgtgatactcttcacatcgacga

SEQ ID NO: 156820 - DNA, 25 bp, E. coli
aacgtgatactcatcacatcgacga

SEQ ID NO: 156821 - DNA, 25 bp, E. coli
tgtattttgcgtctcattccgtgcc

SEQ ID NO: 156822 - DNA, 25 bp, E. coli
tgtattttgcgtgtcattccgtgcc

SEQ ID NO: 156823 - DNA, 25 bp, E. coli
tcagtaggttagttatcaatcaatt

SEQ ID NO: 156824 - DNA, 25 bp, E. coli
tcagtaggttagatatcaatcaatt

SEQ ID NO: 156825 - DNA, 25 bp, E. coli
gccacgcggtattaaacaagttcat

SEQ ID NO: 156826 - DNA, 25 bp, E. coli
gccacgcggtataaaacaagttcat

SEQ ID NO: 156827 - DNA, 25 bp, E. coli
gctgctgtgactcccacgcggtata

SEQ ID NO: 156828 - DNA, 25 bp, E. coli
gctgctgtgactgccacgcggtata

SEQ ID NO: 156829 - DNA, 25 bp, E. coli
gaacaaggcggtcaattctcttcga

SEQ ID NO: 156830 - DNA, 25 bp, E. coli
gaacaaggcggtgaattctcttcga

SEQ ID NO: 156831 - DNA, 25 bp, E. coli
cattccgtgcctataacgctgctgt

SEQ ID NO: 156832 - DNA, 25 bp, E. coli
cattccgtgcctttaacgctgctgt

SEQ ID NO: 156833 - DNA, 25 bp, E. coli
taaagatccgaggtataacgatgac

SEQ ID NO: 156834 - DNA, 25 bp, E. coli
ttaaatagcgctgaggcccaaaact

SEQ ID NO: 156835 - DNA, 25 bp, E. coli
taaagatccgagctataacgatgac

SEQ ID NO: 156836 - DNA, 25 bp, E. coli
ttaaatagcgctcaggcccaaaact

SEQ ID NO: 156837 - DNA, 25 bp, E. coli
cagttccgtaatccaaactttggtg

SEQ ID NO: 156838 - DNA, 25 bp, E. coli
cagttccgtaatgcaaactttggtg

SEQ ID NO: 156839 - DNA, 25 bp, E. coli
tggtggtaacccaaataatggcgct

SEQ ID NO: 156840 - DNA, 25 bp, E. coli
tggtggtaaccctaataatggcgct

SEQ ID NO: 156841 - DNA, 25 bp, E. coli
tgaacgtgacagatcgtaaaaccgg

SEQ ID NO: 156842 - DNA, 25 bp, E. coli
tgaacgtgacagttcgtaaaaccgg

SEQ ID NO: 156843 - DNA, 25 bp, E. coli
tcgccattaagttgggctggaacca

SEQ ID NO: 156844 - DNA, 25 bp, E. coli
tcgccattaagtagggctggaacca

SEQ ID NO: 156845 - DNA, 25 bp, E. coli
gctactgtcgaaaattaataccggt

SEQ ID NO: 156846 - DNA, 25 bp, E. coli
gctactgtcgaatattaataccggt

SEQ ID NO: 156847 - DNA, 25 bp, E. coli
gaaccatgacttaccagttccgtaa

SEQ ID NO: 156848 - DNA, 25 bp, E. coli
gaaccatgactttccagttccgtaa

SEQ ID NO: 156849 - DNA, 25 bp, E. coli
ccgcgatggtcaattgcagttgaac

SEQ ID NO: 156850 - DNA, 25 bp, E. coli
ccgcgatggtcatttgcagttgaac

SEQ ID NO: 156851 - DNA, 25 bp, E. coli
ggccgcatggtgtccaacgattata

SEQ ID NO: 156852 - DNA, 25 bp, E. coli
ggccgcatggtgaccaacgattata

SEQ ID NO: 156853 - DNA, 25 bp, E. coli
gataactttactgaggccatccagt

SEQ ID NO: 156854 - DNA, 25 bp, E. coli
gataactttactcaggccatccagt

SEQ ID NO: 156855 - DNA, 25 bp, E. coli
tactgttgcatccttacatactgcc

SEQ ID NO: 156856 - DNA, 25 bp, E. coli
tacgccacggtagataaagtaaccg

SEQ ID NO: 156857 - DNA, 25 bp, E. coli
taaagtaaccgtcgcgtaatggcta

SEQ ID NO: 156858 - DNA, 25 bp, E. coli
tactgttgcatcgttacatactgcc

SEQ ID NO: 156859 - DNA, 25 bp, E. coli
taaagtaaccgtggcgtaatggcta

SEQ ID NO: 156860 - DNA, 25 bp, E. coli
tacgccacggtacataaagtaaccg

SEQ ID NO: 156861 - DNA, 25 bp, E. coli
cacaccgcgaaacatccgttaagtt

SEQ ID NO: 156862 - DNA, 25 bp, E. coli
cacaccgcgaaagatccgttaagtt

SEQ ID NO: 156863 - DNA, 25 bp, E. coli
aacgcaccgttattattgaccagac

SEQ ID NO: 156864 - DNA, 25 bp, E. coli
aacgcaccgttaatattgaccagac

SEQ ID NO: 156865 - DNA, 25 bp, E. coli
tgacaaagcccacattcactaaggc

SEQ ID NO: 156866 - DNA, 25 bp, E. coli
tgacaaagcccagattcactaaggc

SEQ ID NO: 156867 - DNA, 25 bp, E. coli
tgagaattgagatgccggtgaacca

SEQ ID NO: 156868 - DNA, 25 bp, E. coli
tgagaattgagaagccggtgaacca

SEQ ID NO: 156869 - DNA, 25 bp, E. coli
tcgctgcaggtacgtttaaatgaga

SEQ ID NO: 156870 - DNA, 25 bp, E. coli
tcgctgcaggtaggtttaaatgaga

SEQ ID NO: 156871 - DNA, 25 bp, E. coli
tcattcataaaagattacgccacgg

SEQ ID NO: 156872 - DNA, 25 bp, E. coli
tcattcataaaacattacgccacgg

SEQ ID NO: 156873 - DNA, 25 bp, E. coli
cttaaagtcagcaaaaacgcaccgt

SEQ ID NO: 156874 - DNA, 25 bp, E. coli
cttaaagtcagctaaaacgcaccgt

SEQ ID NO: 156875 - DNA, 25 bp, E. coli
taagaccgtctgagtgctcgtgaca

SEQ ID NO: 156876 - DNA, 25 bp, E. coli
taagaccgtctgtgtgctcgtgaca

SEQ ID NO: 156877 - DNA, 25 bp, E. coli
tactgtttattgtctgggaggctca

SEQ ID NO: 156878 - DNA, 25 bp, E. coli
taaatgtggtgtcgcagtactgacc

SEQ ID NO: 156879 - DNA, 25 bp, E. coli
tactgtttattgactgggaggctca

SEQ ID NO: 156880 - DNA, 25 bp, E. coli
taaatgtggtgtggcagtactgacc

SEQ ID NO: 156881 - DNA, 25 bp, E. coli
tattaacggagatagtccttactgg

SEQ ID NO: 156882 - DNA, 25 bp, E. coli
tattaacggagaaagtccttactgg

SEQ ID NO: 156883 - DNA, 25 bp, E. coli
tgatgtggcccgcaggaaaaaacgt

SEQ ID NO: 156884 - DNA, 25 bp, E. coli
tgatgtggcccggaggaaaaaacgt

SEQ ID NO: 156885 - DNA, 25 bp, E. coli
tgcgcaagcgcatatcaaaaccagc

SEQ ID NO: 156886 - DNA, 25 bp, E. coli
tgcgcaagcgcaaatcaaaaccagc

SEQ ID NO: 156887 - DNA, 25 bp, E. coli
tccttactggagagaatgttctgcg

SEQ ID NO: 156888 - DNA, 25 bp, E. coli
tccttactggagtgaatgttctgcg

SEQ ID NO: 156889 - DNA, 25 bp, E. coli
gactggaaaactggtgatatctgga

SEQ ID NO: 156890 - DNA, 25 bp, E. coli
gactggaaaactcgtgatatctgga

SEQ ID NO: 156891 - DNA, 25 bp, E. coli
gcggatgagtccgttaaccggttca

SEQ ID NO: 156892 - DNA, 25 bp, E. coli
gcggatgagtcccttaaccggttca

SEQ ID NO: 156893 - DNA, 25 bp, E. coli
ggaagaggccataacagacatgacg

SEQ ID NO: 156894 - DNA, 25 bp, E. coli
tggatatatcactccagaacccgtg

SEQ ID NO: 156895 - DNA, 25 bp, E. coli
tggatatatcacaccagaacccgtg

SEQ ID NO: 156896 - DNA, 25 bp, E. coli
ggaagaggccattacagacatgacg

SEQ ID NO: 156897 - DNA, 25 bp, E. coli
taaccggttcatgggactggtgtcc

SEQ ID NO: 156898 - DNA, 25 bp, E. coli
taaccggttcatcggactggtgtcc

SEQ ID NO: 156899 - DNA, 25 bp, E. coli
tatcccgactcatatggagcgtctg

SEQ ID NO: 156900 - DNA, 25 bp, E. coli
tatcccgactcaaatggagcgtctg

SEQ ID NO: 156901 - DNA, 25 bp, E. coli
tatacagcacggtaaacccggacct

SEQ ID NO: 156902 - DNA, 25 bp, E. coli
tatacagcacggaaaacccggacct

SEQ ID NO: 156903 - DNA, 25 bp, E. coli
tgtgtcgtgcgttaccgtgctgctg

SEQ ID NO: 156904 - DNA, 25 bp, E. coli
tgattctggtcgacttcaagctgga

SEQ ID NO: 156905 - DNA, 25 bp, E. coli
tgattctggtcgtcttcaagctgga

SEQ ID NO: 156906 - DNA, 25 bp, E. coli
tgtgtcgtgcgtaaccgtgctgctg

SEQ ID NO: 156907 - DNA, 25 bp, E. coli
tcttactgcgaatcctttggctggg

SEQ ID NO: 156908 - DNA, 25 bp, E. coli
tcttactgcgaaacctttggctggg

SEQ ID NO: 156909 - DNA, 25 bp, E. coli
cctgtgggacaatgaaacgctggag

SEQ ID NO: 156910 - DNA, 25 bp, E. coli
cctgtgggacaaagaaacgctggag

SEQ ID NO: 156911 - DNA, 25 bp, E. coli
gctgacctacaatgcgaacgacgtg

SEQ ID NO: 156912 - DNA, 25 bp, E. coli
gctgacctacaaagcgaacgacgtg

SEQ ID NO: 156913 - DNA, 25 bp, E. coli
gaattccgcaatgatacgtcagcag

SEQ ID NO: 156914 - DNA, 25 bp, E. coli
gaattccgcaatcatacgtcagcag

SEQ ID NO: 156915 - DNA, 25 bp, E. coli
ggctctctggtgtaacgtcttggaa

SEQ ID NO: 156916 - DNA, 25 bp, E. coli
ggctctctggtgaaacgtcttggaa

SEQ ID NO: 156917 - DNA, 25 bp, E. coli
gatctgttcctgaaaaacgacgcca

SEQ ID NO: 156918 - DNA, 25 bp, E. coli
gatctgttcctgtaaaacgacgcca

SEQ ID NO: 156919 - DNA, 25 bp, E. coli
gacctgttggtggtcgaattccgca

SEQ ID NO: 156920 - DNA, 25 bp, E. coli
gacctgttggtgctcgaattccgca

SEQ ID NO: 156921 - DNA, 25 bp, E. coli
gcaatgggccctatacctgcctgat

SEQ ID NO: 156922 - DNA, 25 bp, E. coli
gcaatgggccctttacctgcctgat

SEQ ID NO: 156923 - DNA, 25 bp, E. coli
agtcctcgcggtatacgccgaacgc

SEQ ID NO: 156924 - DNA, 25 bp, E. coli
agtcctcgcggtttacgccgaacgc

SEQ ID NO: 156925 - DNA, 25 bp, E. coli
acctgcctgatgagcatcaccctga

SEQ ID NO: 156926 - DNA, 25 bp, E. coli
acctgcctgatgtgcatcaccctga

SEQ ID NO: 156927 - DNA, 25 bp, E. coli
tatacctgcctgatgagcatcaccc

SEQ ID NO: 156928 - DNA, 25 bp, E. coli
tatacctgcctgttgagcatcaccc

SEQ ID NO: 156929 - DNA, 25 bp, E. coli
gacgttccggatttcgccggagtcc

SEQ ID NO: 156930 - DNA, 25 bp, E. coli
gacgttccggatatcgccggagtcc

SEQ ID NO: 156931 - DNA, 25 bp, E. coli
gaactgacaatagtggagaactgta

SEQ ID NO: 156932 - DNA, 25 bp, E. coli
gaactgacaatactggagaactgta

SEQ ID NO: 156933 - DNA, 25 bp, E. coli
cctgaactgacaatagtggagaact

SEQ ID NO: 156934 - DNA, 25 bp, E. coli
cgccaggaccgcaatgggccctata

SEQ ID NO: 156935 - DNA, 25 bp, E. coli
cgccaggaccgctatgggccctata

SEQ ID NO: 156936 - DNA, 25 bp, E. coli
cctgaactgacattagtggagaact

SEQ ID NO: 156937 - DNA, 25 bp, E. coli
cggtatacgccgaacgccgccagga

SEQ ID NO: 156938 - DNA, 25 bp, E. coli
cggtatacgccgtacgccgccagga

SEQ ID NO: 156939 - DNA, 25 bp, E. coli
gatatcgccggagtcctcgcggtat

SEQ ID NO: 156940 - DNA, 25 bp, E. coli
gatatcgccggactcctcgcggtat

SEQ ID NO: 156941 - DNA, 25 bp, E. coli
gggccctataccagcctgatgagca

SEQ ID NO: 156942 - DNA, 25 bp, E. coli
gggccctatacctgcctgatgagca

SEQ ID NO: 156943 - DNA, 25 bp, E. coli
aatttcctcgtgtcgattcacgctg

SEQ ID NO: 156944 - DNA, 25 bp, E. coli
aatttcctcgtgacgattcacgctg

SEQ ID NO: 156945 - DNA, 25 bp, E. coli
caaacgggcgtgtttcagggactgc

SEQ ID NO: 156946 - DNA, 25 bp, E. coli
caaacgggcgtgattcagggactgc

SEQ ID NO: 156947 - DNA, 25 bp, E. coli
taaacgtcgaccagaacacgccagc

SEQ ID NO: 156948 - DNA, 25 bp, E. coli
taaacgtcgacctgaacacgccagc

SEQ ID NO: 156949 - DNA, 25 bp, E. coli
aacacgccagccttggcgttctgcg

SEQ ID NO: 156950 - DNA, 25 bp, E. coli
aacacgccagccatggcgttctgcg

SEQ ID NO: 156951 - DNA, 25 bp, E. coli
tcgcgcgtaaatagcgtactttgct

SEQ ID NO: 156952 - DNA, 25 bp, E. coli
tcgcgcgtaaattgcgtactttgct

SEQ ID NO: 156953 - DNA, 25 bp, E. coli
gcgctcgccggatatcccatcagta

SEQ ID NO: 156954 - DNA, 25 bp, E. coli
gcgctcgccggaaatcccatcagta

SEQ ID NO: 156955 - DNA, 25 bp, E. coli
gcgtactttgctcaatgacgatccg

SEQ ID NO: 156956 - DNA, 25 bp, E. coli
gcgtactttgctgaatgacgatccg

SEQ ID NO: 156957 - DNA, 25 bp, E. coli
cgcagtgcgactggcgcttccgtat

SEQ ID NO: 156958 - DNA, 25 bp, E. coli
cgcagtgcgactcgcgcttccgtat

SEQ ID NO: 156959 - DNA, 25 bp, E. coli
cgtgtcgattcacgctgatgccgca

SEQ ID NO: 156960 - DNA, 25 bp, E. coli
cgtgtcgattcaggctgatgccgca

SEQ ID NO: 156961 - DNA, 25 bp, E. coli
tggcgcttccgtatgggtgctctct

SEQ ID NO: 156962 - DNA, 25 bp, E. coli
tggcgcttccgtttgggtgctctct

SEQ ID NO: 156963 - DNA, 25 bp, E. coli
gatgccgcaccgaaccgcagtgcga

SEQ ID NO: 156964 - DNA, 25 bp, E. coli
gatgccgcaccgtaccgcagtgcga

SEQ ID NO: 156965 - DNA, 25 bp, E. coli
caagctgctaatggagggaatgtcg

SEQ ID NO: 156966 - DNA, 25 bp, E. coli
caagctgctaatcgagggaatgtcg

SEQ ID NO: 156967 - DNA, 25 bp, E. coli
aaaagaatgcctgaacctggtcaag

SEQ ID NO: 156968 - DNA, 25 bp, E. coli
aaaagaatgcctcaacctggtcaag

SEQ ID NO: 156969 - DNA, 25 bp, E. coli
tatgaaaaactaggcatccagagtg

SEQ ID NO: 156970 - DNA, 25 bp, E. coli
tatgaaaaactacgcatccagagtg

SEQ ID NO: 156971 - DNA, 25 bp, E. coli
tatcgttatctgcaggcgtttccgg

SEQ ID NO: 156972 - DNA, 25 bp, E. coli
tatcgtgtccgataaagaacggctt

SEQ ID NO: 156973 - DNA, 25 bp, E. coli
tatcgttatctggaggcgtttccgg

SEQ ID NO: 156974 - DNA, 25 bp, E. coli
tatcatccgcaactcattagtggca

SEQ ID NO: 156975 - DNA, 25 bp, E. coli
tatcgtgtccgaaaaagaacggctt

SEQ ID NO: 156976 - DNA, 25 bp, E. coli
tatcatccgcaagtcattagtggca

SEQ ID NO: 156977 - DNA, 25 bp, E. coli
gaatgtcggttacagaaatctcaca

SEQ ID NO: 156978 - DNA, 25 bp, E. coli
gaatgtcggttagagaaatctcaca

SEQ ID NO: 156979 - DNA, 25 bp, E. coli
gacgttgcctggtatcgtgtccgaa

SEQ ID NO: 156980 - DNA, 25 bp, E. coli
gaacggcttttagtcaagctgctaa

SEQ ID NO: 156981 - DNA, 25 bp, E. coli
gaacggcttttactcaagctgctaa

SEQ ID NO: 156982 - DNA, 25 bp, E. coli
ccttctggcgggttatcttttttca

SEQ ID NO: 156983 - DNA, 25 bp, E. coli
ccttctggcgggatatcttttttca

SEQ ID NO: 156984 - DNA, 25 bp, E. coli
tcacatcaaaagtagcagctgtatg

SEQ ID NO: 156985 - DNA, 25 bp, E. coli
tcacatcaaaagaagcagctgtatg

SEQ ID NO: 156986 - DNA, 25 bp, E. coli
gacgttgcctggaatcgtgtccgaa

SEQ ID NO: 156987 - DNA, 25 bp, E. coli
caacccgccgtattatgagcaagga

SEQ ID NO: 156988 - DNA, 25 bp, E. coli
caacccgccgtaatatgagcaagga

SEQ ID NO: 156989 - DNA, 25 bp, E. coli
cacctcacttgatcaccagacttta

SEQ ID NO: 156990 - DNA, 25 bp, E. coli
cacctcacttgaacaccagacttta

SEQ ID NO: 156991 - DNA, 25 bp, E. coli
atgtcgcccagtccccgtggttaga

SEQ ID NO: 156992 - DNA, 25 bp, E. coli
agaccgcgcgctatgatttaatcat

SEQ ID NO: 156993 - DNA, 25 bp, E. coli
atgtcgcccagtgcccgtggttaga

SEQ ID NO: 156994 - DNA, 25 bp, E. coli
agaccgcgcgctttgatttaatcat

SEQ ID NO: 156995 - DNA, 25 bp, E. coli
gccactcaggcgcaggaaaatgtcg

SEQ ID NO: 156996 - DNA, 25 bp, E. coli
gccactcaggcggaggaaaatgtcg

SEQ ID NO: 156997 - DNA, 25 bp, E. coli
gcttgctggcacagatgctggcgca

SEQ ID NO: 156998 - DNA, 25 bp, E. coli
gcgaaccagtgacagcgtgataatt

SEQ ID NO: 156999 - DNA, 25 bp, E. coli
gcgaaccagtgagagcgtgataatt

SEQ ID NO: 157000 - DNA, 25 bp, E. coli
gcttgctggcactgatgctggcgca

SEQ ID NO: 157001 - DNA, 25 bp, E. coli
gactttacttacatgcgcggcggag

SEQ ID NO: 157002 - DNA, 25 bp, E. coli
gactttacttacttgcgcggcggag

SEQ ID NO: 157003 - DNA, 25 bp, E. coli
cgtggttagagagaattaacgtcca

SEQ ID NO: 157004 - DNA, 25 bp, E. coli
cgtggttagagacaattaacgtcca

SEQ ID NO: 157005 - DNA, 25 bp, E. coli
taattgatgccgttgagctggaaag

SEQ ID NO: 157006 - DNA, 25 bp, E. coli
tcagcagtgggtaacacagcagacc

SEQ ID NO: 157007 - DNA, 25 bp, E. coli
taattgatgccgatgagctggaaag

SEQ ID NO: 157008 - DNA, 25 bp, E. coli
tcagcagtgggttacacagcagacc

SEQ ID NO: 157009 - DNA, 25 bp, E. coli
actggctcggcccaggtcggtaatc

SEQ ID NO: 157010 - DNA, 25 bp, E. coli
aggagtaatggcttgggaaccacca

SEQ ID NO: 157011 - DNA, 25 bp, E. coli
atgctgtggccggatgatgcgctac

SEQ ID NO: 157012 - DNA, 25 bp, E. coli
actggctcggccgaggtcggtaatc

SEQ ID NO: 157013 - DNA, 25 bp, E. coli
aggagtaatggcatgggaaccacca

SEQ ID NO: 157014 - DNA, 25 bp, E. coli
atgctgtggccgcatgatgcgctac

SEQ ID NO: 157015 - DNA, 25 bp, E. coli
tagccagatgctctggccggatgat

SEQ ID NO: 157016 - DNA, 25 bp, E. coli
tagccagatgctgtggccggatgat

SEQ ID NO: 157017 - DNA, 25 bp, E. coli
gcccaggtcggtaatctgtacgtta

SEQ ID NO: 157018 - DNA, 25 bp, E. coli
ccgtgctggcagtgggtagccagat

SEQ ID NO: 157019 - DNA, 25 bp, E. coli
ccgtgctggcagagggtagccagat

SEQ ID NO: 157020 - DNA, 25 bp, E. coli
gcccaggtcggttatctgtacgtta

SEQ ID NO: 157021 - DNA, 25 bp, E. coli
gctgtggccggatgatgcgctacat

SEQ ID NO: 157022 - DNA, 25 bp, E. coli
gctcggcccaggacggtaatctgta

SEQ ID NO: 157023 - DNA, 25 bp, E. coli
gctgtggccggaagatgcgctacat

SEQ ID NO: 157024 - DNA, 25 bp, E. coli
gctcggcccaggtcggtaatctgta

SEQ ID NO: 157025 - DNA, 25 bp, E. coli
gatattggtatttacatcgatgccg

SEQ ID NO: 157026 - DNA, 25 bp, E. coli
gatattggtattaacatcgatgccg

SEQ ID NO: 157027 - DNA, 25 bp, E. coli
gtctggcctcgcactcttcagccct

SEQ ID NO: 157028 - DNA, 25 bp, E. coli
gtctggcctcgctctcttcagccct

SEQ ID NO: 157029 - DNA, 25 bp, E. coli
gagtaatggcatcggaaccaccacc

SEQ ID NO: 157030 - DNA, 25 bp, E. coli
gagtaatggcatgggaaccaccacc

SEQ ID NO: 157031 - DNA, 25 bp, E. coli
tattctgggcaatccgtaccgccag

SEQ ID NO: 157032 - DNA, 25 bp, E. coli
tattctgggcaaaccgtaccgccag

SEQ ID NO: 157033 - DNA, 25 bp, E. coli
tgagcagattatcgagatggcacgc

SEQ ID NO: 157034 - DNA, 25 bp, E. coli
tgagcagattatggagatggcacgc

SEQ ID NO: 157035 - DNA, 25 bp, E. coli
tcgtaagtccgtccgccgtaaactg

SEQ ID NO: 157036 - DNA, 25 bp, E. coli
tcgtaagtccgtgcgccgtaaactg

SEQ ID NO: 157037 - DNA, 25 bp, E. coli
ccgtggcaccacatctgagcagatt

SEQ ID NO: 157038 - DNA, 25 bp, E. coli
ccgtggcaccacttctgagcagatt

SEQ ID NO: 157039 - DNA, 25 bp, E. coli
gaatgctcggtgttcaacggcgtct

SEQ ID NO: 157040 - DNA, 25 bp, E. coli
gaatgctcggtgatcaacggcgtct

SEQ ID NO: 157041 - DNA, 25 bp, E. coli
gaaacctcgtgtcatatcgcgctgg

SEQ ID NO: 157042 - DNA, 25 bp, E. coli
gaaagtgtacctggcttctgcggca

SEQ ID NO: 157043 - DNA, 25 bp, E. coli
gaaacctcgtgtgatatcgcgctgg

SEQ ID NO: 157044 - DNA, 25 bp, E. coli
gaaagtgtacctcgcttctgcggca

SEQ ID NO: 157045 - DNA, 25 bp, E. coli
cccgcgaatgggtagatctggatat

SEQ ID NO: 157046 - DNA, 25 bp, E. coli
cccgcgaatgggaagatctggatat

SEQ ID NO: 157047 - DNA, 25 bp, E. coli
ctgtttgaagaataacgccgccaca

SEQ ID NO: 157048 - DNA, 25 bp, E. coli
ctgtttgaagaaaaacgccgccaca

SEQ ID NO: 157049 - DNA, 25 bp, E. coli
ggtgcttcagcatcgcggtcaggat

SEQ ID NO: 157050 - DNA, 25 bp, E. coli
ggtgcttcagcaacgcggtcaggat

SEQ ID NO: 157051 - DNA, 25 bp, E. coli
gagttccgcgattaaaacgtcctgc

SEQ ID NO: 157052 - DNA, 25 bp, E. coli
gagttccgcgataaaaacgtcctgc

SEQ ID NO: 157053 - DNA, 25 bp, E. coli
aaaaagagctggatcaggctgccgg

SEQ ID NO: 157054 - DNA, 25 bp, E. coli
aaagccgaatactaagcctcgcgag

SEQ ID NO: 157055 - DNA, 25 bp, E. coli
aaagccgaatacaaagcctcgcgag

SEQ ID NO: 157056 - DNA, 25 bp, E. coli
aaaaagagctggttcaggctgccgg

SEQ ID NO: 157057 - DNA, 25 bp, E. coli
tgctttaccctggtgtacttcgtgg

SEQ ID NO: 157058 - DNA, 25 bp, E. coli
tgttcagcaacctcgcggatatgat

SEQ ID NO: 157059 - DNA, 25 bp, E. coli
tgctttaccctgctgtacttcgtgg

SEQ ID NO: 157060 - DNA, 25 bp, E. coli
tgttcagcaaccacgcggatatgat

SEQ ID NO: 157061 - DNA, 25 bp, E. coli
tctttaaaaagcagggagcgcacgg

SEQ ID NO: 157062 - DNA, 25 bp, E. coli
tctttaaaaagctgggagcgcacgg

SEQ ID NO: 157063 - DNA, 25 bp, E. coli
gcgtcttccgtagtggcgatgccat

SEQ ID NO: 157064 - DNA, 25 bp, E. coli
gcgtcttccgtactggcgatgccat

SEQ ID NO: 157065 - DNA, 25 bp, E. coli
gaaaatgttgccattacggaggcag

SEQ ID NO: 157066 - DNA, 25 bp, E. coli
gaaaatgttgcctttacggaggcag

SEQ ID NO: 157067 - DNA, 25 bp, E. coli
gatatgatgctgacccaaatcgcca

SEQ ID NO: 157068 - DNA, 25 bp, E. coli
gatatgatgctgtcccaaatcgcca

SEQ ID NO: 157069 - DNA, 25 bp, E. coli
tcacaaacgctgcatgacgaagtct

SEQ ID NO: 157070 - DNA, 25 bp, E. coli
tcacaaacgctggatgacgaagtct

SEQ ID NO: 157071 - DNA, 25 bp, E. coli
tcaacatgtgcacgccgggacgtga

SEQ ID NO: 157072 - DNA, 25 bp, E. coli
tcaacatgtgcaggccgggacgtga

SEQ ID NO: 157073 - DNA, 25 bp, E. coli
gatgcggaagtgaaactctactcaa

SEQ ID NO: 157074 - DNA, 25 bp, E. coli
gatgcggaagtgtaactctactcaa

SEQ ID NO: 157075 - DNA, 25 bp, E. coli
caattgttaccgctcgatagcgaac

SEQ ID NO: 157076 - DNA, 25 bp, E. coli
caattgttaccggtcgatagcgaac

SEQ ID NO: 157077 - DNA, 25 bp, E. coli
catggcatggccgaatcgcgtgaac

SEQ ID NO: 157078 - DNA, 25 bp, E. coli
catggcatggcccaatcgcgtgaac

SEQ ID NO: 157079 - DNA, 25 bp, E. coli
tatggacgccgttaagcagagcaaa

SEQ ID NO: 157080 - DNA, 25 bp, E. coli
tatggacgccgtaaagcagagcaaa

SEQ ID NO: 157081 - DNA, 25 bp, E. coli
ttaagtgggcaagaagccgcttgcg

SEQ ID NO: 157082 - DNA, 25 bp, E. coli
ttaagtgggcaacaagccgcttgcg

SEQ ID NO: 157083 - DNA, 25 bp, E. coli
tcgccagaaaagaggtgatgcgtct

SEQ ID NO: 157084 - DNA, 25 bp, E. coli
tcgccagaaaagtggtgatgcgtct

SEQ ID NO: 157085 - DNA, 25 bp, E. coli
ccttgagcaaaaaggcgtggtgtcc

SEQ ID NO: 157086 - DNA, 25 bp, E. coli
ccttgagcaaaatggcgtggtgtcc

SEQ ID NO: 157087 - DNA, 25 bp, E. coli
ctggaatacattgaagcgcgttggc

SEQ ID NO: 157088 - DNA, 25 bp, E. coli
ctggaatacattcaagcgcgttggc

SEQ ID NO: 157089 - DNA, 25 bp, E. coli
ggatatgcgcgatccacaatgtgtg

SEQ ID NO: 157090 - DNA, 25 bp, E. coli
ggatatgcgcgaaccacaatgtgtg

SEQ ID NO: 157091 - DNA, 25 bp, E. coli
tcaatggtgcgcaatcaggacggca

SEQ ID NO: 157092 - DNA, 25 bp, E. coli
tcaatggtgcgctatcaggacggca

SEQ ID NO: 157093 - DNA, 25 bp, E. coli
taatctgggatacgctgaccttgag

SEQ ID NO: 157094 - DNA, 25 bp, E. coli
taatctgggataggctgaccttgag

SEQ ID NO: 157095 - DNA, 25 bp, E. coli
gatccgcgcgggaaaaaccattttg

SEQ ID NO: 157096 - DNA, 25 bp, E. coli
gatccgcgcgggtaaaaccattttg

SEQ ID NO: 157097 - DNA, 25 bp, E. coli
aagcttcactgctatattttctcgg

SEQ ID NO: 157098 - DNA, 25 bp, E. coli
aagcttcactgcaatattttctcgg

SEQ ID NO: 157099 - DNA, 25 bp, E. coli
cactgcaatattatctcggttcgtc

SEQ ID NO: 157100 - DNA, 25 bp, E. coli
cactgcaatattttctcggttcgtc

SEQ ID NO: 157101 - DNA, 25 bp, E. coli
cttcaacgtcttttttgcaaaggtg

SEQ ID NO: 157102 - DNA, 25 bp, E. coli
catgtgccatctggtctttttcggc

SEQ ID NO: 157103 - DNA, 25 bp, E. coli
cttcaacgtcttatttgcaaaggtg

SEQ ID NO: 157104 - DNA, 25 bp, E. coli
catgtgccatctcgtctttttcggc

SEQ ID NO: 157105 - DNA, 25 bp, E. coli
taaaatcccgtggatgaagtgaagc

SEQ ID NO: 157106 - DNA, 25 bp, E. coli
taaaatcccgtgcatgaagtgaagc

SEQ ID NO: 157107 - DNA, 25 bp, E. coli
caatagctttgcattcttcaacgtc

SEQ ID NO: 157108 - DNA, 25 bp, E. coli
caatagctttgctttcttcaacgtc

SEQ ID NO: 157109 - DNA, 25 bp, E. coli
ttaaagttcatgagccatctggtct

SEQ ID NO: 157110 - DNA, 25 bp, E. coli
ttaaagttcatgtgccatctggtct

SEQ ID NO: 157111 - DNA, 25 bp, E. coli
tcttttttgcaaaggtggtaagcac

SEQ ID NO: 157112 - DNA, 25 bp, E. coli
tcttttttgcaatggtggtaagcac

SEQ ID NO: 157113 - DNA, 25 bp, E. coli
gaagtgaagcattctttcaatagct

SEQ ID NO: 157114 - DNA, 25 bp, E. coli
gaagtgaagcatactttcaatagct

SEQ ID NO: 157115 - DNA, 25 bp, E. coli
ctttttcggcacaagcttcactgca

SEQ ID NO: 157116 - DNA, 25 bp, E. coli
ctttttcggcactagcttcactgca

SEQ ID NO: 157117 - DNA, 25 bp, E. coli
gttcgtcttttgataaaatcccgtg

SEQ ID NO: 157118 - DNA, 25 bp, E. coli
gttcgtcttttgttaaaatcccgtg

SEQ ID NO: 157119 - DNA, 25 bp, E. coli
taacacctgtaaacctcaaaccgcg

SEQ ID NO: 157120 - DNA, 25 bp, E. coli
tttgttgatgaatatcgcgcgccgg

SEQ ID NO: 157121 - DNA, 25 bp, E. coli
tttgttgatgaaaatcgcgcgccgg

SEQ ID NO: 157122 - DNA, 25 bp, E. coli
tcgacacctgcgtggagattgccag

SEQ ID NO: 157123 - DNA, 25 bp, E. coli
tcgacacctgcgaggagattgccag

SEQ ID NO: 157124 - DNA, 25 bp, E. coli
gcccacagcaaggtagagaatcagt

SEQ ID NO: 157125 - DNA, 25 bp, E. coli
gcgccgcgtggtttcagtatcgtca

SEQ ID NO: 157126 - DNA, 25 bp, E. coli
gcccacagcaagctagagaatcagt

SEQ ID NO: 157127 - DNA, 25 bp, E. coli
gcgccgcgtggtatcagtatcgtca

SEQ ID NO: 157128 - DNA, 25 bp, E. coli
gaaactggcgcaggagaatccaacc

SEQ ID NO: 157129 - DNA, 25 bp, E. coli
gaaactggcgcacgagaatccaacc

SEQ ID NO: 157130 - DNA, 25 bp, E. coli
cgaacgccctctccggattatggaa

SEQ ID NO: 157131 - DNA, 25 bp, E. coli
cgatgtgttctgtgtcaacggcgac

SEQ ID NO: 157132 - DNA, 25 bp, E. coli
cgatgtgttctgagtcaacggcgac

SEQ ID NO: 157133 - DNA, 25 bp, E. coli
cgaacgccctctgcggattatggaa

SEQ ID NO: 157134 - DNA, 25 bp, E. coli
gattgaatcttcaggcgtgcacctg

SEQ ID NO: 157135 - DNA, 25 bp, E. coli
gattgaatcttctggcgtgcacctg

SEQ ID NO: 157136 - DNA, 25 bp, E. coli
taattgagcatcagcgcgaacgtgc

SEQ ID NO: 157137 - DNA, 25 bp, E. coli
tcaaaccgcgtttggtgcgctgatg

SEQ ID NO: 157138 - DNA, 25 bp, E. coli
taattgagcatctgcgcgaacgtgc

SEQ ID NO: 157139 - DNA, 25 bp, E. coli
taacacctgtaatcctcaaaccgcg

SEQ ID NO: 157140 - DNA, 25 bp, E. coli
tcaaaccgcgttaggtgcgctgatg

SEQ ID NO: 157141 - DNA, 25 bp, E. coli
caacgtcaaattacgcggcatagga

SEQ ID NO: 157142 - DNA, 25 bp, E. coli
caacgtcaaatttcgcggcatagga

SEQ ID NO: 157143 - DNA, 25 bp, E. coli
cagataccattatccaactgggcga

SEQ ID NO: 157144 - DNA, 25 bp, E. coli
cagataccattaaccaactgggcga

SEQ ID NO: 157145 - DNA, 25 bp, E. coli
aaattatctgctcgcgtctgaaacg

SEQ ID NO: 157146 - DNA, 25 bp, E. coli
aaattatctgctggcgtctgaaacg

SEQ ID NO: 157147 - DNA, 25 bp, E. coli
tattcgcgttgagaaccctaacctg

SEQ ID NO: 157148 - DNA, 25 bp, E. coli
tttccgcgtcaatgtcgagacagaa

SEQ ID NO: 157149 - DNA, 25 bp, E. coli
tattcgcgttgacaaccctaacctg

SEQ ID NO: 157150 - DNA, 25 bp, E. coli
tttccgcgtcaaagtcgagacagaa

SEQ ID NO: 157151 - DNA, 25 bp, E. coli
tgtgaataccctcgtcaatggcgaa

SEQ ID NO: 157152 - DNA, 25 bp, E. coli
tgtgaataccctggtcaatggcgaa

SEQ ID NO: 157153 - DNA, 25 bp, E. coli
cctctcggtcgtaggtctgaaatct

SEQ ID NO: 157154 - DNA, 25 bp, E. coli
cctctcggtcgttggtctgaaatct

SEQ ID NO: 157155 - DNA, 25 bp, E. coli
cgagtcttcacggaccaatggcggc

SEQ ID NO: 157156 - DNA, 25 bp, E. coli
cgagtcttcacgcaccaatggcggc

SEQ ID NO: 157157 - DNA, 25 bp, E. coli
gattttgcgcgagctgggtacacca

SEQ ID NO: 157158 - DNA, 25 bp, E. coli
gattttgcgcgacctgggtacacca

SEQ ID NO: 157159 - DNA, 25 bp, E. coli
tggcggcgcgctcatcaagactatc

SEQ ID NO: 157160 - DNA, 25 bp, E. coli
tggcggcgcgctgatcaagactatc

SEQ ID NO: 157161 - DNA, 25 bp, E. coli
gatgtaccgattgtcaacggcgaca

SEQ ID NO: 157162 - DNA, 25 bp, E. coli
gatgtaccgattctcaacggcgaca

SEQ ID NO: 157163 - DNA, 25 bp, E. coli
aattctcacgccatccgtaggccgg

SEQ ID NO: 157164 - DNA, 25 bp, E. coli
aattctcacgccttccgtaggccgg

SEQ ID NO: 157165 - DNA, 25 bp, E. coli
cagtcgtgctgggatgggcatacaa

SEQ ID NO: 157166 - DNA, 25 bp, E. coli
cagtcgtgctggcatgggcatacaa

SEQ ID NO: 157167 - DNA, 25 bp, E. coli
agacgtttatcggatccggcagtcg

SEQ ID NO: 157168 - DNA, 25 bp, E. coli
agacgtttatcgcatccggcagtcg

SEQ ID NO: 157169 - DNA, 25 bp, E. coli
aggccggacaagtcgtttatcgcat

SEQ ID NO: 157170 - DNA, 25 bp, E. coli
aggccggacaagacgtttatcgcat

SEQ ID NO: 157171 - DNA, 25 bp, E. coli
aaatgcacgttcacggcagtcatca

SEQ ID NO: 157172 - DNA, 25 bp, E. coli
aaatgcacgttctcggcagtcatca

SEQ ID NO: 157173 - DNA, 25 bp, E. coli
tatcagacctacaaattctcacgcc

SEQ ID NO: 157174 - DNA, 25 bp, E. coli
tatcagacctactaattctcacgcc

SEQ ID NO: 157175 - DNA, 25 bp, E. coli
tgggcatacaaattgcacgttctcg

SEQ ID NO: 157176 - DNA, 25 bp, E. coli
tgggcatacaaaatgcacgttctcg

SEQ ID NO: 157177 - DNA, 25 bp, E. coli
gccagccgcgtattcagaactattt

SEQ ID NO: 157178 - DNA, 25 bp, E. coli
gccagccgcgtaatcagaactattt

SEQ ID NO: 157179 - DNA, 25 bp, E. coli
gaactatttaatgactgcctacggg

SEQ ID NO: 157180 - DNA, 25 bp, E. coli
gaactatttaatcactgcctacggg

SEQ ID NO: 157181 - DNA, 25 bp, E. coli
ctacgggcgaaatgtaggccggaca

SEQ ID NO: 157182 - DNA, 25 bp, E. coli
ctacgggcgaaaagtaggccggaca

SEQ ID NO: 157183 - DNA, 25 bp, E. coli
taatgactgccttcgggcgaaatgt

SEQ ID NO: 157184 - DNA, 25 bp, E. coli
taatgactgcctacgggcgaaatgt

SEQ ID NO: 157185 - DNA, 25 bp, E. coli
agccctgaaagaggcgcagactcgt

SEQ ID NO: 157186 - DNA, 25 bp, E. coli
agccctgaaagacgcgcagactcgt

SEQ ID NO: 157187 - DNA, 25 bp, E. coli
aaacgcccagaatggtgaaatcatg

SEQ ID NO: 157188 - DNA, 25 bp, E. coli
aaacgcccagaaaggtgaaatcatg

SEQ ID NO: 157189 - DNA, 25 bp, E. coli
tacgaggaagagatggcgaaagatc

SEQ ID NO: 157190 - DNA, 25 bp, E. coli
tacgaggaagagttggcgaaagatc

SEQ ID NO: 157191 - DNA, 25 bp, E. coli
tgaagccctgaatgacgcgcagact

SEQ ID NO: 157192 - DNA, 25 bp, E. coli
tgaagccctgaaagacgcgcagact

SEQ ID NO: 157193 - DNA, 25 bp, E. coli
tcagactgtcgatgaagccctgaaa

SEQ ID NO: 157194 - DNA, 25 bp, E. coli
tcagactgtcgaagaagccctgaaa

SEQ ID NO: 157195 - DNA, 25 bp, E. coli
gaaaacgcccagaaaggtgaaatca

SEQ ID NO: 157196 - DNA, 25 bp, E. coli
gaaaacgcccagtaaggtgaaatca

SEQ ID NO: 157197 - DNA, 25 bp, E. coli
cgctgaagtcttacgaggaagagtt

SEQ ID NO: 157198 - DNA, 25 bp, E. coli
cgctgaagtctttcgaggaagagtt

SEQ ID NO: 157199 - DNA, 25 bp, E. coli
cggtcgtcagactgtcgatgaagcc

SEQ ID NO: 157200 - DNA, 25 bp, E. coli
cgtagcgctgaactcttacgaggaa

SEQ ID NO: 157201 - DNA, 25 bp, E. coli
cggtcgtcagacagtcgatgaagcc

SEQ ID NO: 157202 - DNA, 25 bp, E. coli
cgtagcgctgaagtcttacgaggaa

SEQ ID NO: 157203 - DNA, 25 bp, E. coli
gtgccgtagcgcagaagtcttacga

SEQ ID NO: 157204 - DNA, 25 bp, E. coli
gtgccgtagcgctgaagtcttacga

SEQ ID NO: 157205 - DNA, 25 bp, E. coli
ggaagagttggcgaaagatccacgt

SEQ ID NO: 157206 - DNA, 25 bp, E. coli
ggaagagttggccaaagatccacgt

SEQ ID NO: 157207 - DNA, 25 bp, E. coli
atgcatctgccagcacccggaaaaa

SEQ ID NO: 157208 - DNA, 25 bp, E. coli
atgcatctgccaccacccggaaaaa

SEQ ID NO: 157209 - DNA, 25 bp, E. coli
aaaaaagtggcggtggttgactgta

SEQ ID NO: 157210 - DNA, 25 bp, E. coli
aaaaaagtggcgctggttgactgta

SEQ ID NO: 157211 - DNA, 25 bp, E. coli
tatgcgtaaattcctgaccatcctg

SEQ ID NO: 157212 - DNA, 25 bp, E. coli
tatgcgtaaattgctgaccatcctg

SEQ ID NO: 157213 - DNA, 25 bp, E. coli
tgtggtaacctgctttaatccggtg

SEQ ID NO: 157214 - DNA, 25 bp, E. coli
gactgtatgcgttaattgctgacca

SEQ ID NO: 157215 - DNA, 25 bp, E. coli
gactgtatgcgtaaattgctgacca

SEQ ID NO: 157216 - DNA, 25 bp, E. coli
gaaagaggcgttttacatgcatctg

SEQ ID NO: 157217 - DNA, 25 bp, E. coli
gaaagaggcgttatacatgcatctg

SEQ ID NO: 157218 - DNA, 25 bp, E. coli
ggcgttttacatgcatctgccagca

SEQ ID NO: 157219 - DNA, 25 bp, E. coli
tggcagcgcttgtggtaacctggtt

SEQ ID NO: 157220 - DNA, 25 bp, E. coli
tggtttaatccggtgaaagaggcgt

SEQ ID NO: 157221 - DNA, 25 bp, E. coli
ggcgttttacatccatctgccagca

SEQ ID NO: 157222 - DNA, 25 bp, E. coli
tggcgctggttgtctgtatgcgtaa

SEQ ID NO: 157223 - DNA, 25 bp, E. coli
tggtttaatccgctgaaagaggcgt

SEQ ID NO: 157224 - DNA, 25 bp, E. coli
tggcgctggttgactgtatgcgtaa

SEQ ID NO: 157225 - DNA, 25 bp, E. coli
tgtggtaacctggtttaatccggtg

SEQ ID NO: 157226 - DNA, 25 bp, E. coli
tggcagcgcttgaggtaacctggtt

SEQ ID NO: 157227 - DNA, 25 bp, E. coli
gaccatcctgaaggcaatgctcaga

SEQ ID NO: 157228 - DNA, 25 bp, E. coli
gaccatcctgaacgcaatgctcaga

SEQ ID NO: 157229 - DNA, 25 bp, E. coli
aacggtcgctgaggattattatgcc

SEQ ID NO: 157230 - DNA, 25 bp, E. coli
aaattgactgccaaagtggtacagc

SEQ ID NO: 157231 - DNA, 25 bp, E. coli
aacggtcgctgacgattattatgcc

SEQ ID NO: 157232 - DNA, 25 bp, E. coli
aaattgactgcctaagtggtacagc

SEQ ID NO: 157233 - DNA, 25 bp, E. coli
tgtggaaacggtcgctgacgattat

SEQ ID NO: 157234 - DNA, 25 bp, E. coli
tgtggaaacggtggctgacgattat

SEQ ID NO: 157235 - DNA, 25 bp, E. coli
tgactgccaaagaggtacagcttta

SEQ ID NO: 157236 - DNA, 25 bp, E. coli
tgactgccaaagtggtacagcttta

SEQ ID NO: 157237 - DNA, 25 bp, E. coli
tcgctgacgattattatgcccgtag

SEQ ID NO: 157238 - DNA, 25 bp, E. coli
tcgctgacgatttttatgcccgtag

SEQ ID NO: 157239 - DNA, 25 bp, E. coli
tgccaaagtggtacagctttatggc

SEQ ID NO: 157240 - DNA, 25 bp, E. coli
tgccaaagtggttcagctttatggc

SEQ ID NO: 157241 - DNA, 25 bp, E. coli
tctcgccgcccgtgcagtgagtggt

SEQ ID NO: 157242 - DNA, 25 bp, E. coli
tctcgccgcccgagcagtgagtggt

SEQ ID NO: 157243 - DNA, 25 bp, E. coli
gcaaaattgactgccaaagtggtac

SEQ ID NO: 157244 - DNA, 25 bp, E. coli
gcaaaattgactcccaaagtggtac

SEQ ID NO: 157245 - DNA, 25 bp, E. coli
cccgtgcagtgactggtgtggaaac

SEQ ID NO: 157246 - DNA, 25 bp, E. coli
cccgtgcagtgagtggtgtggaaac

SEQ ID NO: 157247 - DNA, 25 bp, E. coli
cggcaaaattgactgccaaagtggt

SEQ ID NO: 157248 - DNA, 25 bp, E. coli
cggcaaaattgagtgccaaagtggt

SEQ ID NO: 157249 - DNA, 25 bp, E. coli
ggtcgctgacgattattatgcccgt

SEQ ID NO: 157250 - DNA, 25 bp, E. coli
ggtcgctgacgaatattatgcccgt

SEQ ID NO: 157251 - DNA, 25 bp, E. coli
cactctcgccagtaggtacgttatg

SEQ ID NO: 157252 - DNA, 25 bp, E. coli
cactctcgccagaaggtacgttatg

SEQ ID NO: 157253 - DNA, 25 bp, E. coli
taaacattcccacactgcggcaagg

SEQ ID NO: 157254 - DNA, 25 bp, E. coli
taaacattcccagactgcggcaagg

SEQ ID NO: 157255 - DNA, 25 bp, E. coli
tatcaggatggcaaacttggtcaaa

SEQ ID NO: 157256 - DNA, 25 bp, E. coli
tatcaggatggctaacttggtcaaa

SEQ ID NO: 157257 - DNA, 25 bp, E. coli
tattgactgtctggaggttgacctg

SEQ ID NO: 157258 - DNA, 25 bp, E. coli
tattgactgtctcgaggttgacctg

SEQ ID NO: 157259 - DNA, 25 bp, E. coli
tgactactcaaaatactttaccggg

SEQ ID NO: 157260 - DNA, 25 bp, E. coli
tgactactcaaattactttaccggg

SEQ ID NO: 157261 - DNA, 25 bp, E. coli
tccggaaaatatcgccgcgaaggcc

SEQ ID NO: 157262 - DNA, 25 bp, E. coli
tccggaaaatatggccgcgaaggcc

SEQ ID NO: 157263 - DNA, 25 bp, E. coli
gaagagctatgggagacgttacgca

SEQ ID NO: 157264 - DNA, 25 bp, E. coli
gaagagctatggcagacgttacgca

SEQ ID NO: 157265 - DNA, 25 bp, E. coli
gaacaatagccgttggtatgactga

SEQ ID NO: 157266 - DNA, 25 bp, E. coli
gaacaatagccgatggtatgactga

SEQ ID NO: 157267 - DNA, 25 bp, E. coli
cgggaaggcgcgtgataagttaact

SEQ ID NO: 157268 - DNA, 25 bp, E. coli
cgggaaggcgcgagataagttaact

SEQ ID NO: 157269 - DNA, 25 bp, E. coli
gttgcagctgaataagagcaccagg

SEQ ID NO: 157270 - DNA, 25 bp, E. coli
gtaataccactatagatccaggcct

SEQ ID NO: 157271 - DNA, 25 bp, E. coli
gtaataccactaaagatccaggcct

SEQ ID NO: 157272 - DNA, 25 bp, E. coli
gttgcagctgaaaaagagcaccagg

SEQ ID NO: 157273 - DNA, 25 bp, E. coli
aaacgcgccggaatgtacgctcaga

SEQ ID NO: 157274 - DNA, 25 bp, E. coli
aaacgcgccggattgtacgctcaga

SEQ ID NO: 157275 - DNA, 25 bp, E. coli
tttaacggcacggtacttggcacgc

SEQ ID NO: 157276 - DNA, 25 bp, E. coli
tttaacggcacgctacttggcacgc

SEQ ID NO: 157277 - DNA, 25 bp, E. coli
tattccggtgcgtttcagctgctgg

SEQ ID NO: 157278 - DNA, 25 bp, E. coli
tattccggtgcgattcagctgctgg

SEQ ID NO: 157279 - DNA, 25 bp, E. coli
tgagcatcgggtatacatcgccaaa

SEQ ID NO: 157280 - DNA, 25 bp, E. coli
tgaacaggccagactgcaacaaaag

SEQ ID NO: 157281 - DNA, 25 bp, E. coli
tgaacaggccagtctgcaacaaaag

SEQ ID NO: 157282 - DNA, 25 bp, E. coli
tgagcatcgggtttacatcgccaaa

SEQ ID NO: 157283 - DNA, 25 bp, E. coli
tgctgaaaactatccgaaaacacgg

SEQ ID NO: 157284 - DNA, 25 bp, E. coli
tgctgaaaactaaccgaaaacacgg

SEQ ID NO: 157285 - DNA, 25 bp, E. coli
tcgccaaacaggatgacaaaccggt

SEQ ID NO: 157286 - DNA, 25 bp, E. coli
tcgccaaacaggttgacaaaccggt

SEQ ID NO: 157287 - DNA, 25 bp, E. coli
gaaaacacggcaatacgttggcgct

SEQ ID NO: 157288 - DNA, 25 bp, E. coli
gaaaacacggcattacgttggcgct

SEQ ID NO: 157289 - DNA, 25 bp, E. coli
tggttaatgcggaaaaacgcgccgg

SEQ ID NO: 157290 - DNA, 25 bp, E. coli
tggttaatgcggtaaaacgcgccgg

SEQ ID NO: 157291 - DNA, 25 bp, E. coli
tcaacagggttaactgcggccatca

SEQ ID NO: 157292 - DNA, 25 bp, E. coli
tcaacagggttatctgcggccatca

SEQ ID NO: 157293 - DNA, 25 bp, E. coli
gagttgctatctcgtaactgcgcca

SEQ ID NO: 157294 - DNA, 25 bp, E. coli
gagttgctatctggtaactgcgcca

SEQ ID NO: 157295 - DNA, 25 bp, E. coli
aacggacggtcagttacagcacaat

SEQ ID NO: 157296 - DNA, 25 bp, E. coli
acggtcacttactgcacaattgcga

SEQ ID NO: 157297 - DNA, 25 bp, E. coli
acggtcacttacagcacaattgcga

SEQ ID NO: 157298 - DNA, 25 bp, E. coli
aaacggacggtctcttacagcacaa

SEQ ID NO: 157299 - DNA, 25 bp, E. coli
aaacggacggtcacttacagcacaa

SEQ ID NO: 157300 - DNA, 25 bp, E. coli
aacggacggtcacttacagcacaat

SEQ ID NO: 157301 - DNA, 25 bp, E. coli
tgtgaaaacggagggtcacttacag

SEQ ID NO: 157302 - DNA, 25 bp, E. coli
tgactgtgaaaagggacggtcactt

SEQ ID NO: 157303 - DNA, 25 bp, E. coli
tgaaaacggacgctcacttacagca

SEQ ID NO: 157304 - DNA, 25 bp, E. coli
tgaaaacggacggtcacttacagca

SEQ ID NO: 157305 - DNA, 25 bp, E. coli
tgactgtgaaaacggacggtcactt

SEQ ID NO: 157306 - DNA, 25 bp, E. coli
gaaaacggacggacacttacagcac

SEQ ID NO: 157307 - DNA, 25 bp, E. coli
gaaaacggacggtcacttacagcac

SEQ ID NO: 157308 - DNA, 25 bp, E. coli
cggacggtcactaacagcacaattg

SEQ ID NO: 157309 - DNA, 25 bp, E. coli
cggacggtcacttacagcacaattg

SEQ ID NO: 157310 - DNA, 25 bp, E. coli
ggtcacttacaggacaattgcgact

SEQ ID NO: 157311 - DNA, 25 bp, E. coli
ggtcacttacagcacaattgcgact

SEQ ID NO: 157312 - DNA, 25 bp, E. coli
ggacggtcacttacagcacaattgc

SEQ ID NO: 157313 - DNA, 25 bp, E. coli
ggacggtcactttcagcacaattgc

SEQ ID NO: 157314 - DNA, 25 bp, E. coli
tgtgaaaacggacggtcacttacag

SEQ ID NO: 157315 - DNA, 25 bp, E. coli
gacggtcacttagagcacaattgcg

SEQ ID NO: 157316 - DNA, 25 bp, E. coli
gacggtcacttacagcacaattgcg

SEQ ID NO: 157317 - DNA, 25 bp, E. coli
cacgcagcctgtcgtggtttcggaa

SEQ ID NO: 157318 - DNA, 25 bp, E. coli
cacctgaggtggaagtattgagcaa

SEQ ID NO: 157319 - DNA, 25 bp, E. coli
cacctgaggtggtagtattgagcaa

SEQ ID NO: 157320 - DNA, 25 bp, E. coli
cacgcagcctgtggtggtttcggaa

SEQ ID NO: 157321 - DNA, 25 bp, E. coli
tacgagcccttattcatctgcgcag

SEQ ID NO: 157322 - DNA, 25 bp, E. coli
tacgagcccttaatcatctgcgcag

SEQ ID NO: 157323 - DNA, 25 bp, E. coli
agaatttcagcccttcatggacggt

SEQ ID NO: 157324 - DNA, 25 bp, E. coli
agaatttcagccgttcatggacggt

SEQ ID NO: 157325 - DNA, 25 bp, E. coli
tattggcacagacttgggcatggac

SEQ ID NO: 157326 - DNA, 25 bp, E. coli
tattggcacagagttgggcatggac

SEQ ID NO: 157327 - DNA, 25 bp, E. coli
tcactggagcaggatggattcacgc

SEQ ID NO: 157328 - DNA, 25 bp, E. coli
gaaagcggatacgagaaaacgtctg

SEQ ID NO: 157329 - DNA, 25 bp, E. coli
gaaagcggataccagaaaacgtctg

SEQ ID NO: 157330 - DNA, 25 bp, E. coli
cccaatgtcatgacttccagtgaaa

SEQ ID NO: 157331 - DNA, 25 bp, E. coli
cccaatgtcatgtcttccagtgaaa

SEQ ID NO: 157332 - DNA, 25 bp, E. coli
ctggacagatgaccgtattggcaca

SEQ ID NO: 157333 - DNA, 25 bp, E. coli
ctggacagatgagcgtattggcaca

SEQ ID NO: 157334 - DNA, 25 bp, E. coli
gggacaggcatctcgtattgccgca

SEQ ID NO: 157335 - DNA, 25 bp, E. coli
ggacctttcgcgactgggctggaca

SEQ ID NO: 157336 - DNA, 25 bp, E. coli
gggacaggcatcacgtattgccgca

SEQ ID NO: 157337 - DNA, 25 bp, E. coli
ggacctttcgcgtctgggctggaca

SEQ ID NO: 157338 - DNA, 25 bp, E. coli
tcactggagcagcatggattcacgc

SEQ ID NO: 157339 - DNA, 25 bp, E. coli
aatgctggcgcgaatgcacggtatc

SEQ ID NO: 157340 - DNA, 25 bp, E. coli
aatgctggcgcgtatgcacggtatc

SEQ ID NO: 157341 - DNA, 25 bp, E. coli
tatgggccatgtgccgatgagtcac

SEQ ID NO: 157342 - DNA, 25 bp, E. coli
tatgggccatgtcccgatgagtcac

SEQ ID NO: 157343 - DNA, 25 bp, E. coli
ttaattacgacgaagtgattcgccc

SEQ ID NO: 157344 - DNA, 25 bp, E. coli
ttaattacgacgtagtgattcgccc

SEQ ID NO: 157345 - DNA, 25 bp, E. coli
tgtggttcatccttgcaggcactgc

SEQ ID NO: 157346 - DNA, 25 bp, E. coli
tgtggttcatccatgcaggcactgc

SEQ ID NO: 157347 - DNA, 25 bp, E. coli
gaagatcaacctcaacggtggcgcg

SEQ ID NO: 157348 - DNA, 25 bp, E. coli
gcaccacgctgcagaatctgatgga

SEQ ID NO: 157349 - DNA, 25 bp, E. coli
gcaccacgctgctgaatctgatgga

SEQ ID NO: 157350 - DNA, 25 bp, E. coli
gcaatgtcgccaaagcggcgggcat

SEQ ID NO: 157351 - DNA, 25 bp, E. coli
gaagatcaacctgaacggtggcgcg

SEQ ID NO: 157352 - DNA, 25 bp, E. coli
gcaatgtcgccatagcggcgggcat

SEQ ID NO: 157353 - DNA, 25 bp, E. coli
gacgttcagtttggtctggcgacga

SEQ ID NO: 157354 - DNA, 25 bp, E. coli
ggttgttccggtccgcgtatcagca

SEQ ID NO: 157355 - DNA, 25 bp, E. coli
ggttgttccggtgcgcgtatcagca

SEQ ID NO: 157356 - DNA, 25 bp, E. coli
ggcatgatgggcttaacggcagaaa

SEQ ID NO: 157357 - DNA, 25 bp, E. coli
ggcatgatgggcataacggcagaaa

SEQ ID NO: 157358 - DNA, 25 bp, E. coli
taatatcgcccgaaacgcggcgctg

SEQ ID NO: 157359 - DNA, 25 bp, E. coli
taatatcgcccgtaacgcggcgctg

SEQ ID NO: 157360 - DNA, 25 bp, E. coli
gacgttcagtttcgtctggcgacga

SEQ ID NO: 157361 - DNA, 25 bp, E. coli
tttttctcttcaaccgaaccggctg

SEQ ID NO: 157362 - DNA, 25 bp, E. coli
tttttctcttcatccgaaccggctg

SEQ ID NO: 157363 - DNA, 25 bp, E. coli
tgcatttttatttcaaccgctcatc

SEQ ID NO: 157364 - DNA, 25 bp, E. coli
tgcatttttattacaaccgctcatc

SEQ ID NO: 157365 - DNA, 25 bp, E. coli
tcggctcaggaagacaagcggaaaa

SEQ ID NO: 157366 - DNA, 25 bp, E. coli
tcaggaagacaaccggaaaaatgca

SEQ ID NO: 157367 - DNA, 25 bp, E. coli
tcaggaagacaagcggaaaaatgca

SEQ ID NO: 157368 - DNA, 25 bp, E. coli
tcttcaaccgaagcggctgtttgtg

SEQ ID NO: 157369 - DNA, 25 bp, E. coli
tcggctcaggaacacaagcggaaaa

SEQ ID NO: 157370 - DNA, 25 bp, E. coli
tcttcaaccgaaccggctgtttgtg

SEQ ID NO: 157371 - DNA, 25 bp, E. coli
ccgtgtcgatggtggcgcattatag

SEQ ID NO: 157372 - DNA, 25 bp, E. coli
ccgtgtcgatggaggcgcattatag

SEQ ID NO: 157373 - DNA, 25 bp, E. coli
gaagacaagcggtaaaatgcatttt

SEQ ID NO: 157374 - DNA, 25 bp, E. coli
gaagtgattcacttccgccgtgtcg

SEQ ID NO: 157375 - DNA, 25 bp, E. coli
gaagacaagcggaaaaatgcatttt

SEQ ID NO: 157376 - DNA, 25 bp, E. coli
gaagtgattcacatccgccgtgtcg

SEQ ID NO: 157377 - DNA, 25 bp, E. coli
cgcattatagggagtcggctcagga

SEQ ID NO: 157378 - DNA, 25 bp, E. coli
cgcattatagggtgtcggctcagga

SEQ ID NO: 157379 - DNA, 25 bp, E. coli
ggctgtttgtgtcaagtgattcaca

SEQ ID NO: 157380 - DNA, 25 bp, E. coli
ggctgtttgtgtgaagtgattcaca

SEQ ID NO: 157381 - DNA, 25 bp, E. coli
tcacatccgccgtgtcgatggaggc

SEQ ID NO: 157382 - DNA, 25 bp, E. coli
tcacatccgccgagtcgatggaggc

SEQ ID NO: 157383 - DNA, 25 bp, E. coli
tactggctaaaacctacggcggtgc

SEQ ID NO: 157384 - DNA, 25 bp, E. coli
tacattctgtcctaagatgaaggcg

SEQ ID NO: 157385 - DNA, 25 bp, E. coli
tacattctgtccaaagatgaaggcg

SEQ ID NO: 157386 - DNA, 25 bp, E. coli
tactggctaaaagctacggcggtgc

SEQ ID NO: 157387 - DNA, 25 bp, E. coli
tttcgcaatccgtgaaggcggccgt

SEQ ID NO: 157388 - DNA, 25 bp, E. coli
ttaaaaacatgaacaccggtgctgc

SEQ ID NO: 157389 - DNA, 25 bp, E. coli
ttaaaaacatgatcaccggtgctgc

SEQ ID NO: 157390 - DNA, 25 bp, E. coli
tttcgcaatccgagaaggcggccgt

SEQ ID NO: 157391 - DNA, 25 bp, E. coli
tgccgggcgacaacatcaaaatggt

SEQ ID NO: 157392 - DNA, 25 bp, E. coli
tgccgggcgacatcatcaaaatggt

SEQ ID NO: 157393 - DNA, 25 bp, E. coli
tctgctctgaaagcgctggaaggcg

SEQ ID NO: 157394 - DNA, 25 bp, E. coli
tctgctctgaaaccgctggaaggcg

SEQ ID NO: 157395 - DNA, 25 bp, E. coli
gaaatcgaacgtcgtcaggtactgg

SEQ ID NO: 157396 - DNA, 25 bp, E. coli
gaaatcgaacgtggtcaggtactgg

SEQ ID NO: 157397 - DNA, 25 bp, E. coli
gaaaatcctggatctggctggcttc

SEQ ID NO: 157398 - DNA, 25 bp, E. coli
gaaaatcctggaactggctggcttc

SEQ ID NO: 157399 - DNA, 25 bp, E. coli
gttcttcaaaggctaccgtccgcag

SEQ ID NO: 157400 - DNA, 25 bp, E. coli
gttcttcaaagggtaccgtccgcag

SEQ ID NO: 157401 - DNA, 25 bp, E. coli
ggtaggcgttccctacatcatcgtg

SEQ ID NO: 157402 - DNA, 25 bp, E. coli
gggcacgccgactatgttaaaaaca

SEQ ID NO: 157403 - DNA, 25 bp, E. coli
gggcacgccgacaatgttaaaaaca

SEQ ID NO: 157404 - DNA, 25 bp, E. coli
ggtaggcgttccgtacatcatcgtg

SEQ ID NO: 157405 - DNA, 25 bp, E. coli
caaataccccatgtggttgtgagag

SEQ ID NO: 157406 - DNA, 25 bp, E. coli
caaataccccatctggttgtgagag

SEQ ID NO: 157407 - DNA, 25 bp, E. coli
cagactctgtagcagatcgccagga

SEQ ID NO: 157408 - DNA, 25 bp, E. coli
cagactctgtaggagatcgccagga

SEQ ID NO: 157409 - DNA, 25 bp, E. coli
agacgattctatcttcgtcgacagg

SEQ ID NO: 157410 - DNA, 25 bp, E. coli
agacgattctatgttcgtcgacagg

SEQ ID NO: 157411 - DNA, 25 bp, E. coli
taggagatcgccaggaaataagcga

SEQ ID NO: 157412 - DNA, 25 bp, E. coli
taggagatcgcctggaaataagcga

SEQ ID NO: 157413 - DNA, 25 bp, E. coli
gcattgtctgtatgcgccttgtaag

SEQ ID NO: 157414 - DNA, 25 bp, E. coli
gcattgtctgtaagcgccttgtaag

SEQ ID NO: 157415 - DNA, 25 bp, E. coli
gaaattttccttaaggcattgtctg

SEQ ID NO: 157416 - DNA, 25 bp, E. coli
gaaattttcctttaggcattgtctg

SEQ ID NO: 157417 - DNA, 25 bp, E. coli
gacttcgcgaaatagacgattctat

SEQ ID NO: 157418 - DNA, 25 bp, E. coli
gacttcgcgaaaaagacgattctat

SEQ ID NO: 157419 - DNA, 25 bp, E. coli
ccccatctggttgtgagagatctct

SEQ ID NO: 157420 - DNA, 25 bp, E. coli
cgccaggaaatatgcgaatacttaa

SEQ ID NO: 157421 - DNA, 25 bp, E. coli
ccccatctggttctgagagatctct

SEQ ID NO: 157422 - DNA, 25 bp, E. coli
cgccaggaaataagcgaatacttaa

SEQ ID NO: 157423 - DNA, 25 bp, E. coli
taagcgccttgttagacttcgcgaa

SEQ ID NO: 157424 - DNA, 25 bp, E. coli
taagcgccttgtaagacttcgcgaa

SEQ ID NO: 157425 - DNA, 25 bp, E. coli
gagagatctctttcagactctgtag

SEQ ID NO: 157426 - DNA, 25 bp, E. coli
gagagatctcttacagactctgtag

SEQ ID NO: 157427 - DNA, 25 bp, E. coli
cacttttctggtgagctggctggga

SEQ ID NO: 157428 - DNA, 25 bp, E. coli
cacttttctggtcagctggctggga

SEQ ID NO: 157429 - DNA, 25 bp, E. coli
cagatagcgcaagcagagattcagt

SEQ ID NO: 157430 - DNA, 25 bp, E. coli
cagatagcgcaaccagagattcagt

SEQ ID NO: 157431 - DNA, 25 bp, E. coli
tacaaagtgttgatctggcgcgaga

SEQ ID NO: 157432 - DNA, 25 bp, E. coli
tacaaagtgttgttctggcgcgaga

SEQ ID NO: 157433 - DNA, 25 bp, E. coli
agcactggcgttgacttatctggag

SEQ ID NO: 157434 - DNA, 25 bp, E. coli
agcactggcgttcacttatctggag

SEQ ID NO: 157435 - DNA, 25 bp, E. coli
tacgccaggttgttcacggcactcg

SEQ ID NO: 157436 - DNA, 25 bp, E. coli
tacgccaggttgatcacggcactcg

SEQ ID NO: 157437 - DNA, 25 bp, E. coli
tattaacccaaatgttcgttgccgg

SEQ ID NO: 157438 - DNA, 25 bp, E. coli
tattgatttcgtggcgggtgatgcc

SEQ ID NO: 157439 - DNA, 25 bp, E. coli
tattgatttcgtcgcgggtgatgcc

SEQ ID NO: 157440 - DNA, 25 bp, E. coli
tattaacccaaaagttcgttgccgg

SEQ ID NO: 157441 - DNA, 25 bp, E. coli
tctacgatcatttcaggccgaaggt

SEQ ID NO: 157442 - DNA, 25 bp, E. coli
tctacgatcattacaggccgaaggt

SEQ ID NO: 157443 - DNA, 25 bp, E. coli
gaatatctcctctgctttacgccag

SEQ ID NO: 157444 - DNA, 25 bp, E. coli
gaatatctcctcagctttacgccag

SEQ ID NO: 157445 - DNA, 25 bp, E. coli
tggattaacggccatcgcctggcta

SEQ ID NO: 157446 - DNA, 25 bp, E. coli
tggattaacggcgatcgcctggcta

SEQ ID NO: 157447 - DNA, 25 bp, E. coli
tcaacttacccggaagtgcgctcgg

SEQ ID NO: 157448 - DNA, 25 bp, E. coli
tcaacttacccgcaagtgcgctcgg

SEQ ID NO: 157449 - DNA, 25 bp, E. coli
caaacgcaatgtggtcagtgcagag

SEQ ID NO: 157450 - DNA, 25 bp, E. coli
caaatggtgttcagtacgcgctgaa

SEQ ID NO: 157451 - DNA, 25 bp, E. coli
caaatggtgttctgtacgcgctgaa

SEQ ID NO: 157452 - DNA, 25 bp, E. coli
caaacgcaatgtcgtcagtgcagag

SEQ ID NO: 157453 - DNA, 25 bp, E. coli
cataaaagacacaatcgccgggata

SEQ ID NO: 157454 - DNA, 25 bp, E. coli
cataaaagacactatcgccgggata

SEQ ID NO: 157455 - DNA, 25 bp, E. coli
taaagatctgatggcctctggcgca

SEQ ID NO: 157456 - DNA, 25 bp, E. coli
taaagatctgatcgcctctggcgca

SEQ ID NO: 157457 - DNA, 25 bp, E. coli
tgaccagtgatgtgacgctgcgaat

SEQ ID NO: 157458 - DNA, 25 bp, E. coli
tgaaagccggcgaatcaaagacatt

SEQ ID NO: 157459 - DNA, 25 bp, E. coli
tgaaagccggcgtatcaaagacatt

SEQ ID NO: 157460 - DNA, 25 bp, E. coli
tgaccagtgatgagacgctgcgaat

SEQ ID NO: 157461 - DNA, 25 bp, E. coli
tcctgctggcaaaagacgtgatata

SEQ ID NO: 157462 - DNA, 25 bp, E. coli
tcctgctggcaatagacgtgatata

SEQ ID NO: 157463 - DNA, 25 bp, E. coli
tcacgataatccatccggtgggaca

SEQ ID NO: 157464 - DNA, 25 bp, E. coli
gcaaaaggtattccggagacacaga

SEQ ID NO: 157465 - DNA, 25 bp, E. coli
gcaaaaggtattgcggagacacaga

SEQ ID NO: 157466 - DNA, 25 bp, E. coli
cgaataccagatccaactgtccggg

SEQ ID NO: 157467 - DNA, 25 bp, E. coli
cgaataccagatgcaactgtccggg

SEQ ID NO: 157468 - DNA, 25 bp, E. coli
cggtgggacacctgtaaaagcggct

SEQ ID NO: 157469 - DNA, 25 bp, E. coli
cggtgggacaccagtaaaagcggct

SEQ ID NO: 157470 - DNA, 25 bp, E. coli
tcacgataatccttccggtgggaca

SEQ ID NO: 157471 - DNA, 25 bp, E. coli
aatactttgcgctgcctggaccgtc

SEQ ID NO: 157472 - DNA, 25 bp, E. coli
aatactttgcgcagcctggaccgtc

SEQ ID NO: 157473 - DNA, 25 bp, E. coli
caaactggtgatagagtctggcgac

SEQ ID NO: 157474 - DNA, 25 bp, E. coli
caaactggtgattgagtctggcgac

SEQ ID NO: 157475 - DNA, 25 bp, E. coli
aaaatcactctctgcaaacgaatcg

SEQ ID NO: 157476 - DNA, 25 bp, E. coli
aaaatcactctcagcaaacgaatcg

SEQ ID NO: 157477 - DNA, 25 bp, E. coli
tgcgcactggcattgagcacaactg

SEQ ID NO: 157478 - DNA, 25 bp, E. coli
tgcgcactggcaatgagcacaactg

SEQ ID NO: 157479 - DNA, 25 bp, E. coli
tcatgccgaaactaacaaactggtg

SEQ ID NO: 157480 - DNA, 25 bp, E. coli
tcatgccgaaacaaacaaactggtg

SEQ ID NO: 157481 - DNA, 25 bp, E. coli
tctgcgccagaatgtgaataaacgc

SEQ ID NO: 157482 - DNA, 25 bp, E. coli
tctgcgccagaaagtgaataaacgc

SEQ ID NO: 157483 - DNA, 25 bp, E. coli
gccaacatcaatccctactgggagc

SEQ ID NO: 157484 - DNA, 25 bp, E. coli
gccaacatcaatgcctactgggagc

SEQ ID NO: 157485 - DNA, 25 bp, E. coli
gaccgtcgaactcgccgcgttatta

SEQ ID NO: 157486 - DNA, 25 bp, E. coli
gaccgtcgaactggccgcgttatta

SEQ ID NO: 157487 - DNA, 25 bp, E. coli
gaaaaagagtggcataaagccgacg

SEQ ID NO: 157488 - DNA, 25 bp, E. coli
gaaaaagagtgggataaagccgacg

SEQ ID NO: 157489 - DNA, 25 bp, E. coli
cgccgctatggaaaaagagcaatgg

SEQ ID NO: 157490 - DNA, 25 bp, E. coli
cgccgctatggataaagagcaatgg

SEQ ID NO: 157491 - DNA, 25 bp, E. coli
gtctggcgacagtgcacaaagccgc

SEQ ID NO: 157492 - DNA, 25 bp, E. coli
gtctggcgacagagcacaaagccgc

SEQ ID NO: 157493 - DNA, 25 bp, E. coli
caaacaggtgctcgagtggtcgaaa

SEQ ID NO: 157494 - DNA, 25 bp, E. coli
caaacaggtgctggagtggtcgaaa

SEQ ID NO: 157495 - DNA, 25 bp, E. coli
tactggccgcagatcaaacaggtgc

SEQ ID NO: 157496 - DNA, 25 bp, E. coli
tacggcacatgaatccaacgctgga

SEQ ID NO: 157497 - DNA, 25 bp, E. coli
tactggccgcagttcaaacaggtgc

SEQ ID NO: 157498 - DNA, 25 bp, E. coli
aactctctggcgtttacgagcatca

SEQ ID NO: 157499 - DNA, 25 bp, E. coli
aactctctggcgattacgagcatca

SEQ ID NO: 157500 - DNA, 25 bp, E. coli
tacggcacatgattccaacgctgga

SEQ ID NO: 157501 - DNA, 25 bp, E. coli
tcccgaatatgatgcgcaaacgctg

SEQ ID NO: 157502 - DNA, 25 bp, E. coli
tcccgaatatgaagcgcaaacgctg

SEQ ID NO: 157503 - DNA, 25 bp, E. coli
tctgacgcgtggctttgatgattca

SEQ ID NO: 157504 - DNA, 25 bp, E. coli
tctgacgcgtgggtttgatgattca

SEQ ID NO: 157505 - DNA, 25 bp, E. coli
gcgagctggcgttgtcacggtaatt

SEQ ID NO: 157506 - DNA, 25 bp, E. coli
gcgagctggcgtagtcacggtaatt

SEQ ID NO: 157507 - DNA, 25 bp, E. coli
gaaagatcacgtcacctcgacgctg

SEQ ID NO: 157508 - DNA, 25 bp, E. coli
gaaagatcacgtgacctcgacgctg

SEQ ID NO: 157509 - DNA, 25 bp, E. coli
cattcgcgctatgctgactttccgg

SEQ ID NO: 157510 - DNA, 25 bp, E. coli
cattcgcgctatcctgactttccgg

SEQ ID NO: 157511 - DNA, 25 bp, E. coli
taagcgcattgcgtttgtgacgggc

SEQ ID NO: 157512 - DNA, 25 bp, E. coli
taagcgcattgcctttgtgacgggc

SEQ ID NO: 157513 - DNA, 25 bp, E. coli
taatgatgtcgcatactggccgcag

SEQ ID NO: 157514 - DNA, 25 bp, E. coli
taatgatgtcgcttactggccgcag

SEQ ID NO: 157515 - DNA, 25 bp, E. coli
aataatcatcgcgagcgtctcgctg

SEQ ID NO: 157516 - DNA, 25 bp, E. coli
aataatcatcgccagcgtctcgctg

SEQ ID NO: 157517 - DNA, 25 bp, E. coli
caaatacgtcgcgtttgtggtggcg

SEQ ID NO: 157518 - DNA, 25 bp, E. coli
caaatacgtcgcctttgtggtggcg

SEQ ID NO: 157519 - DNA, 25 bp, E. coli
tacgcgcagtggcaaatacgtcgcc

SEQ ID NO: 157520 - DNA, 25 bp, E. coli
tacgcgcagtgggaaatacgtcgcc

SEQ ID NO: 157521 - DNA, 25 bp, E. coli
ttcacgcacggtatccgctttggcg

SEQ ID NO: 157522 - DNA, 25 bp, E. coli
ttcgccagcggccttgatatgggtc

SEQ ID NO: 157523 - DNA, 25 bp, E. coli
ttcacgcacggtttccgctttggcg

SEQ ID NO: 157524 - DNA, 25 bp, E. coli
ttcgccagcggcgttgatatgggtc

SEQ ID NO: 157525 - DNA, 25 bp, E. coli
tgtggtggcgaccatcaataatcat

SEQ ID NO: 157526 - DNA, 25 bp, E. coli
tgtggtggcgacgatcaataatcat

SEQ ID NO: 157527 - DNA, 25 bp, E. coli
tcagatcccaggtgcgttttgccgc

SEQ ID NO: 157528 - DNA, 25 bp, E. coli
tctcgctgcgcatggtgacaaaggc

SEQ ID NO: 157529 - DNA, 25 bp, E. coli
tctcgctgcgcaaggtgacaaaggc

SEQ ID NO: 157530 - DNA, 25 bp, E. coli
tcagatcccaggagcgttttgccgc

SEQ ID NO: 157531 - DNA, 25 bp, E. coli
cgctttggcggagacatccaccatg

SEQ ID NO: 157532 - DNA, 25 bp, E. coli
cgttgatatgggacagttgcgacat

SEQ ID NO: 157533 - DNA, 25 bp, E. coli
cgctttggcggacacatccaccatg

SEQ ID NO: 157534 - DNA, 25 bp, E. coli
cgttgatatgggtcagttgcgacat

SEQ ID NO: 157535 - DNA, 25 bp, E. coli
ggagacatccaccatgtgcgcttcg

SEQ ID NO: 157536 - DNA, 25 bp, E. coli
ggagacatccacgatgtgcgcttcg

SEQ ID NO: 157537 - DNA, 25 bp, E. coli
cataaagattctctgctgccgggca

SEQ ID NO: 157538 - DNA, 25 bp, E. coli
cataaagattctgtgctgccgggca

SEQ ID NO: 157539 - DNA, 25 bp, E. coli
tacagcctggaatcgttgcgcgatc

SEQ ID NO: 157540 - DNA, 25 bp, E. coli
tacagcctggaaacgttgcgcgatc

SEQ ID NO: 157541 - DNA, 25 bp, E. coli
tatctgttccacaagcagcaggcgg

SEQ ID NO: 157542 - DNA, 25 bp, E. coli
tttgcacaagataaggagagcgcct

SEQ ID NO: 157543 - DNA, 25 bp, E. coli
tatatgacagcgaaggaacgccagc

SEQ ID NO: 157544 - DNA, 25 bp, E. coli
tatatgacagcgtaggaacgccagc

SEQ ID NO: 157545 - DNA, 25 bp, E. coli
tatctgttccactagcagcaggcgg

SEQ ID NO: 157546 - DNA, 25 bp, E. coli
tttgcacaagattaggagagcgcct

SEQ ID NO: 157547 - DNA, 25 bp, E. coli
tttatctaccgtatggccgggcgcg

SEQ ID NO: 157548 - DNA, 25 bp, E. coli
ttgatgattatacccgcagcgacga

SEQ ID NO: 157549 - DNA, 25 bp, E. coli
tttatctaccgtttggccgggcgcg

SEQ ID NO: 157550 - DNA, 25 bp, E. coli
ttgatgattatagccgcagcgacga

SEQ ID NO: 157551 - DNA, 25 bp, E. coli
gcaggatcgttacacccaggagtta

SEQ ID NO: 157552 - DNA, 25 bp, E. coli
gaagatctgaaatatgccctgcgcg

SEQ ID NO: 157553 - DNA, 25 bp, E. coli
gaagatctgaaaaatgccctgcgcg

SEQ ID NO: 157554 - DNA, 25 bp, E. coli
gcaggatcgttagacccaggagtta

SEQ ID NO: 157555 - DNA, 25 bp, E. coli
cattatctgatccaccgtggcctgg

SEQ ID NO: 157556 - DNA, 25 bp, E. coli
cattatctgatcgaccgtggcctgg

SEQ ID NO: 157557 - DNA, 25 bp, E. coli
gatagcccaggataatgcagcgcgt

SEQ ID NO: 157558 - DNA, 25 bp, E. coli
gatagcccaggaaaatgcagcgcgt

SEQ ID NO: 157559 - DNA, 25 bp, E. coli
taaatacacatattgcgctggcgcc

SEQ ID NO: 157560 - DNA, 25 bp, E. coli
taaatacacataatgcgctggcgcc

SEQ ID NO: 157561 - DNA, 25 bp, E. coli
tatgtggatgcgcttaaccaggcac

SEQ ID NO: 157562 - DNA, 25 bp, E. coli
taccggcgtacagaatatggaacag

SEQ ID NO: 157563 - DNA, 25 bp, E. coli
tatgtggatgcggttaaccaggcac

SEQ ID NO: 157564 - DNA, 25 bp, E. coli
tatgcggaacaaatcaaggcgggcc

SEQ ID NO: 157565 - DNA, 25 bp, E. coli
taccggcgtacacaatatggaacag

SEQ ID NO: 157566 - DNA, 25 bp, E. coli
tatgcggaacaattcaaggcgggcc

SEQ ID NO: 157567 - DNA, 25 bp, E. coli
tgaggcaaaagcaacattcccggga

SEQ ID NO: 157568 - DNA, 25 bp, E. coli
tgattatggacgtggatgccaccca

SEQ ID NO: 157569 - DNA, 25 bp, E. coli
tgaggcaaaagctacattcccggga

SEQ ID NO: 157570 - DNA, 25 bp, E. coli
tgattatggacgaggatgccaccca

SEQ ID NO: 157571 - DNA, 25 bp, E. coli
tgaagcctggtttgtcgggccacac

SEQ ID NO: 157572 - DNA, 25 bp, E. coli
tgaagcctggttagtcgggccacac

SEQ ID NO: 157573 - DNA, 25 bp, E. coli
tctcgatgacctgaaaaaacgccgt

SEQ ID NO: 157574 - DNA, 25 bp, E. coli
tctcgatgacctcaaaaaacgccgt

SEQ ID NO: 157575 - DNA, 25 bp, E. coli
gaatggaggccaaaacacggactga

SEQ ID NO: 157576 - DNA, 25 bp, E. coli
gaatggaggccataacacggactga

SEQ ID NO: 157577 - DNA, 25 bp, E. coli
gataccacggtttctgaaggccagc

SEQ ID NO: 157578 - DNA, 25 bp, E. coli
gataccacggttactgaaggccagc

SEQ ID NO: 157579 - DNA, 25 bp, E. coli
taatgccagtgctcagcgggaagtc

SEQ ID NO: 157580 - DNA, 25 bp, E. coli
taatgccagtgcacagcgggaagtc

SEQ ID NO: 157581 - DNA, 25 bp, E. coli
taacagctcagggtgtagcgacctg

SEQ ID NO: 157582 - DNA, 25 bp, E. coli
tacaatgccagctatcgtaccaccg

SEQ ID NO: 157583 - DNA, 25 bp, E. coli
tacaatgccagcaatcgtaccaccg

SEQ ID NO: 157584 - DNA, 25 bp, E. coli
tagcctggcgttccagtatgccgaa

SEQ ID NO: 157585 - DNA, 25 bp, E. coli
tatcgagggtgactcaacggctacc

SEQ ID NO: 157586 - DNA, 25 bp, E. coli
tagcctggcgttgcagtatgccgaa

SEQ ID NO: 157587 - DNA, 25 bp, E. coli
tatcgagggtgagtcaacggctacc

SEQ ID NO: 157588 - DNA, 25 bp, E. coli
tgatgatcgataccgccaacggcgt

SEQ ID NO: 157589 - DNA, 25 bp, E. coli
tgatgatcgatagcgccaacggcgt

SEQ ID NO: 157590 - DNA, 25 bp, E. coli
tctatttgacgtggctatcgagggt

SEQ ID NO: 157591 - DNA, 25 bp, E. coli
tctggcaatagctctggtaacggtg

SEQ ID NO: 157592 - DNA, 25 bp, E. coli
tctggcaatagcactggtaacggtg

SEQ ID NO: 157593 - DNA, 25 bp, E. coli
tctggagcggcgtcgttagcgtaca

SEQ ID NO: 157594 - DNA, 25 bp, E. coli
tctatttgacgtcgctatcgagggt

SEQ ID NO: 157595 - DNA, 25 bp, E. coli
tctggagcggcgacgttagcgtaca

SEQ ID NO: 157596 - DNA, 25 bp, E. coli
gaaaaaactggccataccgtgatga

SEQ ID NO: 157597 - DNA, 25 bp, E. coli
gaaaaaactggcgataccgtgatga

SEQ ID NO: 157598 - DNA, 25 bp, E. coli
gattacagcactctaccggaaggca

SEQ ID NO: 157599 - DNA, 25 bp, E. coli
gattacagcactgtaccggaaggca

SEQ ID NO: 157600 - DNA, 25 bp, E. coli
taagctggttgtcacgccactcggt

SEQ ID NO: 157601 - DNA, 25 bp, E. coli
taacagctcaggctgtagcgacctg

SEQ ID NO: 157602 - DNA, 25 bp, E. coli
taagctggttgtgacgccactcggt

SEQ ID NO: 157603 - DNA, 25 bp, E. coli
caattcggctggactaatccggtgc

SEQ ID NO: 157604 - DNA, 25 bp, E. coli
caattcggctggtctaatccggtgc

SEQ ID NO: 157605 - DNA, 25 bp, E. coli
cacggtcgtgttttggcggctgaaa

SEQ ID NO: 157606 - DNA, 25 bp, E. coli
cacggtcgtgttatggcggctgaaa

SEQ ID NO: 157607 - DNA, 25 bp, E. coli
caggtggcacaagtggtagaaagta

SEQ ID NO: 157608 - DNA, 25 bp, E. coli
caggtggcacaactggtagaaagta

SEQ ID NO: 157609 - DNA, 25 bp, E. coli
aaattattgcggctcacggtcgtgt

SEQ ID NO: 157610 - DNA, 25 bp, E. coli
aaattattgcgggtcacggtcgtgt

SEQ ID NO: 157611 - DNA, 25 bp, E. coli
tccggtgctgattgacgaaaagggc

SEQ ID NO: 157612 - DNA, 25 bp, E. coli
tccggtgctgatagacgaaaagggc

SEQ ID NO: 157613 - DNA, 25 bp, E. coli
tcattgttctgtctggcctgacgga

SEQ ID NO: 157614 - DNA, 25 bp, E. coli
tcattgttctgtgtggcctgacgga

SEQ ID NO: 157615 - DNA, 25 bp, E. coli
gacgaaaagggcgaaattattgcgg

SEQ ID NO: 157616 - DNA, 25 bp, E. coli
gaaagtattaagcaattcggctgga

SEQ ID NO: 157617 - DNA, 25 bp, E. coli
gacgaaaagggccaaattattgcgg

SEQ ID NO: 157618 - DNA, 25 bp, E. coli
gaaagtattaaggaattcggctgga

SEQ ID NO: 157619 - DNA, 25 bp, E. coli
ggcggctgaaatcctcaaaatggat

SEQ ID NO: 157620 - DNA, 25 bp, E. coli
ggcggctgaaatgctcaaaatggat

SEQ ID NO: 157621 - DNA, 25 bp, E. coli
tcaaaatggattgtgttccggtcat

SEQ ID NO: 157622 - DNA, 25 bp, E. coli
tcaaaatggattctgttccggtcat

SEQ ID NO: 157623 - DNA, 25 bp, E. coli
gacgcacagtactgagcaggtggca

SEQ ID NO: 157624 - DNA, 25 bp, E. coli
gacgcacagtacagagcaggtggca

SEQ ID NO: 157625 - DNA, 25 bp, E. coli
cattttaatgatcaccccagcggca

SEQ ID NO: 157626 - DNA, 25 bp, E. coli
tactggcaggatgtatcgcgctggc

SEQ ID NO: 157627 - DNA, 25 bp, E. coli
tactggcaggatctatcgcgctggc

SEQ ID NO: 157628 - DNA, 25 bp, E. coli
aaatatgacgatccctgtgacccga

SEQ ID NO: 157629 - DNA, 25 bp, E. coli
aaagatttctcatcgctggtggcgc

SEQ ID NO: 157630 - DNA, 25 bp, E. coli
aaagatttctcaacgctggtggcgc

SEQ ID NO: 157631 - DNA, 25 bp, E. coli
aaatatgacgatgcctgtgacccga

SEQ ID NO: 157632 - DNA, 25 bp, E. coli
tgcggtggcgaagaaagtcgttaac

SEQ ID NO: 157633 - DNA, 25 bp, E. coli
tgcggtggcgaacaaagtcgttaac

SEQ ID NO: 157634 - DNA, 25 bp, E. coli
tcttgagaaagtgaaaccgcagcgt

SEQ ID NO: 157635 - DNA, 25 bp, E. coli
tctgacatctacgaagacgaaggca

SEQ ID NO: 157636 - DNA, 25 bp, E. coli
tctgacatctaccaagacgaaggca

SEQ ID NO: 157637 - DNA, 25 bp, E. coli
tcttgagaaagtcaaaccgcagcgt

SEQ ID NO: 157638 - DNA, 25 bp, E. coli
gctggtgaccaagccgaagaactac

SEQ ID NO: 157639 - DNA, 25 bp, E. coli
gctggtgaccaacccgaagaactac

SEQ ID NO: 157640 - DNA, 25 bp, E. coli
gaagaactacgatcaggttccggcg

SEQ ID NO: 157641 - DNA, 25 bp, E. coli
gaagaactacgaacaggttccggcg

SEQ ID NO: 157642 - DNA, 25 bp, E. coli
cgcagtacggtgtccaggagtttac

SEQ ID NO: 157643 - DNA, 25 bp, E. coli
cgcagtacggtgaccaggagtttac

SEQ ID NO: 157644 - DNA, 25 bp, E. coli
cattcagcaatatggctctggcaga

SEQ ID NO: 157645 - DNA, 25 bp, E. coli
cattttaatgatgaccccagcggca

SEQ ID NO: 157646 - DNA, 25 bp, E. coli
cattcagcaataaggctctggcaga

SEQ ID NO: 157647 - DNA, 25 bp, E. coli
aattgcctctcaggccgatggcggg

SEQ ID NO: 157648 - DNA, 25 bp, E. coli
aattgcctctcacgccgatggcggg

SEQ ID NO: 157649 - DNA, 25 bp, E. coli
aacgttggcactcgcgctgtgggca

SEQ ID NO: 157650 - DNA, 25 bp, E. coli
aacgttggcactggcgctgtgggca

SEQ ID NO: 157651 - DNA, 25 bp, E. coli
acatttctgggagtgatttcatcgc

SEQ ID NO: 157652 - DNA, 25 bp, E. coli
acatttctgggactgatttcatcgc

SEQ ID NO: 157653 - DNA, 25 bp, E. coli
tatggtactgacgattcgtcaacga

SEQ ID NO: 157654 - DNA, 25 bp, E. coli
tatggtactgaccattcgtcaacga

SEQ ID NO: 157655 - DNA, 25 bp, E. coli
tgcaattgcctcacacgccgatggc

SEQ ID NO: 157656 - DNA, 25 bp, E. coli
tgcaattgcctctcacgccgatggc

SEQ ID NO: 157657 - DNA, 25 bp, E. coli
tcgccacaaataaggtactgaccat

SEQ ID NO: 157658 - DNA, 25 bp, E. coli
tcgccacaaatatggtactgaccat

SEQ ID NO: 157659 - DNA, 25 bp, E. coli
tctcacgccgatcgcgggtgaatat

SEQ ID NO: 157660 - DNA, 25 bp, E. coli
tctcacgccgatggcgggtgaatat

SEQ ID NO: 157661 - DNA, 25 bp, E. coli
gactgatttcatcgcctgacggcac

SEQ ID NO: 157662 - DNA, 25 bp, E. coli
ggtactgaccatacgtcaacgactt

SEQ ID NO: 157663 - DNA, 25 bp, E. coli
ggtactgaccattcgtcaacgactt

SEQ ID NO: 157664 - DNA, 25 bp, E. coli
taatgatgtcctggccacaaatatg

SEQ ID NO: 157665 - DNA, 25 bp, E. coli
taatgatgtcctcgccacaaatatg

SEQ ID NO: 157666 - DNA, 25 bp, E. coli
tcacggtctgcaattgcctctcacg

SEQ ID NO: 157667 - DNA, 25 bp, E. coli
tcacggtctgcatttgcctctcacg

SEQ ID NO: 157668 - DNA, 25 bp, E. coli
gactgatttcatggcctgacggcac

SEQ ID NO: 157669 - DNA, 25 bp, E. coli
caccatgcgcagatgactgagtcgg

SEQ ID NO: 157670 - DNA, 25 bp, E. coli
caccatgcgcagttgactgagtcgg

SEQ ID NO: 157671 - DNA, 25 bp, E. coli
catgcgcagttgactgagtcggtaa

SEQ ID NO: 157672 - DNA, 25 bp, E. coli
catgcgcagttgtctgagtcggtaa

SEQ ID NO: 157673 - DNA, 25 bp, E. coli
atcgctcagccagggaacgtgggta

SEQ ID NO: 157674 - DNA, 25 bp, E. coli
atcgctcagccacggaacgtgggta

SEQ ID NO: 157675 - DNA, 25 bp, E. coli
atgcaccatgcgcagttgactgagt

SEQ ID NO: 157676 - DNA, 25 bp, E. coli
atgcaccatgcggagttgactgagt

SEQ ID NO: 157677 - DNA, 25 bp, E. coli
tgactgagtcggaaaacccgttcaa

SEQ ID NO: 157678 - DNA, 25 bp, E. coli
tgactgagtcggtaaacccgttcaa

SEQ ID NO: 157679 - DNA, 25 bp, E. coli
gcagttgactgagtcggtaaacccg

SEQ ID NO: 157680 - DNA, 25 bp, E. coli
gctcagccagggaacgtgggtaatc

SEQ ID NO: 157681 - DNA, 25 bp, E. coli
gcagttgactgactcggtaaacccg

SEQ ID NO: 157682 - DNA, 25 bp, E. coli
gctcagccagggtacgtgggtaatc

SEQ ID NO: 157683 - DNA, 25 bp, E. coli
cgttcaacccgaatgcccaggcgat

SEQ ID NO: 157684 - DNA, 25 bp, E. coli
cgacctgggcagctttggcctctgc

SEQ ID NO: 157685 - DNA, 25 bp, E. coli
cgacctgggcaggtttggcctctgc

SEQ ID NO: 157686 - DNA, 25 bp, E. coli
cgttcaacccgattgcccaggcgat

SEQ ID NO: 157687 - DNA, 25 bp, E. coli
gggtctatcggctcgtcgataacca

SEQ ID NO: 157688 - DNA, 25 bp, E. coli
gggtctatcggcacgtcgataacca

SEQ ID NO: 157689 - DNA, 25 bp, E. coli
tggccgcagtttttccaggggtttg

SEQ ID NO: 157690 - DNA, 25 bp, E. coli
tggccgcagtttatccaggggtttg

SEQ ID NO: 157691 - DNA, 25 bp, E. coli
caatgctctatttaactcccggtaa

SEQ ID NO: 157692 - DNA, 25 bp, E. coli
caatgctctattaaactcccggtaa

SEQ ID NO: 157693 - DNA, 25 bp, E. coli
cacccttaaagaatagccaatgctc

SEQ ID NO: 157694 - DNA, 25 bp, E. coli
cacccttaaagattagccaatgctc

SEQ ID NO: 157695 - DNA, 25 bp, E. coli
ttgtgtcaccccatccaattggatt

SEQ ID NO: 157696 - DNA, 25 bp, E. coli
ttgtgtcaccccttccaattggatt

SEQ ID NO: 157697 - DNA, 25 bp, E. coli
tgcgtcgtcctctcttcaggtaagg

SEQ ID NO: 157698 - DNA, 25 bp, E. coli
tcccggtaaatcatgaaacatctgc

SEQ ID NO: 157699 - DNA, 25 bp, E. coli
tcccggtaaatcttgaaacatctgc

SEQ ID NO: 157700 - DNA, 25 bp, E. coli
tcaggtaaggctctgaatactcatg

SEQ ID NO: 157701 - DNA, 25 bp, E. coli
tcaggtaaggctgtgaatactcatg

SEQ ID NO: 157702 - DNA, 25 bp, E. coli
gaaacatctgcgcttactcctgtat

SEQ ID NO: 157703 - DNA, 25 bp, E. coli
gaaacatctgcggttactcctgtat

SEQ ID NO: 157704 - DNA, 25 bp, E. coli
ctgaacggcgcaccactctgtgcat

SEQ ID NO: 157705 - DNA, 25 bp, E. coli
ctgaacggcgcagcactctgtgcat

SEQ ID NO: 157706 - DNA, 25 bp, E. coli
ggatttttgacttctggttgtgaca

SEQ ID NO: 157707 - DNA, 25 bp, E. coli
ggatttttgactactggttgtgaca

SEQ ID NO: 157708 - DNA, 25 bp, E. coli
ggcatcgcgcccgagatttaatgaa

SEQ ID NO: 157709 - DNA, 25 bp, E. coli
tgcgtcgtcctcacttcaggtaagg

SEQ ID NO: 157710 - DNA, 25 bp, E. coli
ggcatcgcgccccagatttaatgaa

SEQ ID NO: 157711 - DNA, 25 bp, E. coli
tactcatgtattcagccacccttaa

SEQ ID NO: 157712 - DNA, 25 bp, E. coli
tactcatgtattgagccacccttaa

SEQ ID NO: 157713 - DNA, 25 bp, E. coli
cagaacagcgtctccaggagtggtt

SEQ ID NO: 157714 - DNA, 25 bp, E. coli
cagaacagcgtcaccaggagtggtt

SEQ ID NO: 157715 - DNA, 25 bp, E. coli
tattcagcagcgatggcagaacagc

SEQ ID NO: 157716 - DNA, 25 bp, E. coli
tattcagcagcgttggcagaacagc

SEQ ID NO: 157717 - DNA, 25 bp, E. coli
tgttaaacctgatgctgacgccaga

SEQ ID NO: 157718 - DNA, 25 bp, E. coli
tgtcgacctgctaaagaatgcctac

SEQ ID NO: 157719 - DNA, 25 bp, E. coli
tgttaaacctgaagctgacgccaga

SEQ ID NO: 157720 - DNA, 25 bp, E. coli
tgtcgacctgcttaagaatgcctac

SEQ ID NO: 157721 - DNA, 25 bp, E. coli
tgacgccagatgagcgcgaagcgtt

SEQ ID NO: 157722 - DNA, 25 bp, E. coli
tgacgccagatgtgcgcgaagcgtt

SEQ ID NO: 157723 - DNA, 25 bp, E. coli
tcgcgacgattaggcgtggatctaa

SEQ ID NO: 157724 - DNA, 25 bp, E. coli
tcgaagagctgtagcgcggcgaaat

SEQ ID NO: 157725 - DNA, 25 bp, E. coli
tcgcgacgattacgcgtggatctaa

SEQ ID NO: 157726 - DNA, 25 bp, E. coli
tcgaagagctgttgcgcggcgaaat

SEQ ID NO: 157727 - DNA, 25 bp, E. coli
gcgaaatgagcctgcgtgagttaaa

SEQ ID NO: 157728 - DNA, 25 bp, E. coli
gcgaaatgagccagcgtgagttaaa

SEQ ID NO: 157729 - DNA, 25 bp, E. coli
gaatgcctaccataacgatctccat

SEQ ID NO: 157730 - DNA, 25 bp, E. coli
gaatgcctaccaaaacgatctccat

SEQ ID NO: 157731 - DNA, 25 bp, E. coli
gactcgcgtgcgtattgtcgaagag

SEQ ID NO: 157732 - DNA, 25 bp, E. coli
gactcgcgtgcgaattgtcgaagag

SEQ ID NO: 157733 - DNA, 25 bp, E. coli
gagtggttacgttttgtcgacctgc

SEQ ID NO: 157734 - DNA, 25 bp, E. coli
gagtggttacgtattgtcgacctgc

SEQ ID NO: 157735 - DNA, 25 bp, E. coli
aatgcttgcgcaagcccgccagaaa

SEQ ID NO: 157736 - DNA, 25 bp, E. coli
caagcccgccagaaagatgctgcag

SEQ ID NO: 157737 - DNA, 25 bp, E. coli
aatgcttgcgcatgcccgccagaaa

SEQ ID NO: 157738 - DNA, 25 bp, E. coli
caagcccgccagtaagatgctgcag

SEQ ID NO: 157739 - DNA, 25 bp, E. coli
cacgcagagttagagcgccagagtg

SEQ ID NO: 157740 - DNA, 25 bp, E. coli
cacgcagagttacagcgccagagtg

SEQ ID NO: 157741 - DNA, 25 bp, E. coli
tgagcaacacgctgagttacagcgc

SEQ ID NO: 157742 - DNA, 25 bp, E. coli
tgagcaacacgcagagttacagcgc

SEQ ID NO: 157743 - DNA, 25 bp, E. coli
tcgtattcagccgatcacactatgg

SEQ ID NO: 157744 - DNA, 25 bp, E. coli
tcgtattcagcccatcacactatgg

SEQ ID NO: 157745 - DNA, 25 bp, E. coli
gcgcactatgagcaacacgcagagt

SEQ ID NO: 157746 - DNA, 25 bp, E. coli
gcgcactatgaggaacacgcagagt

SEQ ID NO: 157747 - DNA, 25 bp, E. coli
gcactatgagcaacacgcagagtta

SEQ ID NO: 157748 - DNA, 25 bp, E. coli
gcactatgagcatcacgcagagtta

SEQ ID NO: 157749 - DNA, 25 bp, E. coli
gcaacacgcagagttacagcgccag

SEQ ID NO: 157750 - DNA, 25 bp, E. coli
gcaacacgcagacttacagcgccag

SEQ ID NO: 157751 - DNA, 25 bp, E. coli
ccgccagaaagaagctgcagaccat

SEQ ID NO: 157752 - DNA, 25 bp, E. coli
ccgccagaaagatgctgcagaccat

SEQ ID NO: 157753 - DNA, 25 bp, E. coli
ctatgagcaacacgcagagttacag

SEQ ID NO: 157754 - DNA, 25 bp, E. coli
ctatgagcaacaggcagagttacag

SEQ ID NO: 157755 - DNA, 25 bp, E. coli
gtattcagcccatcacactatggtt

SEQ ID NO: 157756 - DNA, 25 bp, E. coli
gtattcagcccaacacactatggtt

SEQ ID NO: 157757 - DNA, 25 bp, E. coli
cacgagagcgttcatcttagtgaat

SEQ ID NO: 157758 - DNA, 25 bp, E. coli
cacgagagcgttgatcttagtgaat

SEQ ID NO: 157759 - DNA, 25 bp, E. coli
ctcaatgacgttcacctcgggttct

SEQ ID NO: 157760 - DNA, 25 bp, E. coli
ctcaatgacgttgacctcgggttct

SEQ ID NO: 157761 - DNA, 25 bp, E. coli
atgacgttgaccacgggttctaccg

SEQ ID NO: 157762 - DNA, 25 bp, E. coli
atgacgttgacctcgggttctaccg

SEQ ID NO: 157763 - DNA, 25 bp, E. coli
tttggtcatcgaccggtggcggtga

SEQ ID NO: 157764 - DNA, 25 bp, E. coli
tttggtcatcgagcggtggcggtga

SEQ ID NO: 157765 - DNA, 25 bp, E. coli
tgatggagtatgaccacgagagcgt

SEQ ID NO: 157766 - DNA, 25 bp, E. coli
tgatggagtatgtccacgagagcgt

SEQ ID NO: 157767 - DNA, 25 bp, E. coli
gcgttgatcttagtgaatgggtgaa

SEQ ID NO: 157768 - DNA, 25 bp, E. coli
gcgttgatcttactgaatgggtgaa

SEQ ID NO: 157769 - DNA, 25 bp, E. coli
gtaacgggcaacaggtttcactggt

SEQ ID NO: 157770 - DNA, 25 bp, E. coli
gtaacgggcaactggtttcactggt

SEQ ID NO: 157771 - DNA, 25 bp, E. coli
cgggcaactggtatcactggttaat

SEQ ID NO: 157772 - DNA, 25 bp, E. coli
cgggcaactggtttcactggttaat

SEQ ID NO: 157773 - DNA, 25 bp, E. coli
ggcgtaacgggcaactggtttcact

SEQ ID NO: 157774 - DNA, 25 bp, E. coli
ggcgtaacgggctactggtttcact

SEQ ID NO: 157775 - DNA, 25 bp, E. coli
gagtatgaccacgagagcgttgatc

SEQ ID NO: 157776 - DNA, 25 bp, E. coli
gagtatgaccaccagagcgttgatc

SEQ ID NO: 157777 - DNA, 25 bp, E. coli
gaccacgagagcgttgatcttagtg

SEQ ID NO: 157778 - DNA, 25 bp, E. coli
gaccacgagagccttgatcttagtg

SEQ ID NO: 157779 - DNA, 25 bp, E. coli
cacctgaaagggatgacagccgttg

SEQ ID NO: 157780 - DNA, 25 bp, E. coli
cacctgaaagggttgacagccgttg

SEQ ID NO: 157781 - DNA, 25 bp, E. coli
catttggtggcaggaacacgagcat

SEQ ID NO: 157782 - DNA, 25 bp, E. coli
catttggtggcacgaacacgagcat

SEQ ID NO: 157783 - DNA, 25 bp, E. coli
caggcgcgcatgcacatactgtcgg

SEQ ID NO: 157784 - DNA, 25 bp, E. coli
caggcgcgcatggacatactgtcgg

SEQ ID NO: 157785 - DNA, 25 bp, E. coli
tacccatagtataagcgggaccgca

SEQ ID NO: 157786 - DNA, 25 bp, E. coli
tagtggccagactcgtaatgcaggg

SEQ ID NO: 157787 - DNA, 25 bp, E. coli
tatgagcacaacaagcggtagtggc

SEQ ID NO: 157788 - DNA, 25 bp, E. coli
tatgagcacaactagcggtagtggc

SEQ ID NO: 157789 - DNA, 25 bp, E. coli
tacccatagtattagcgggaccgca

SEQ ID NO: 157790 - DNA, 25 bp, E. coli
tagtggccagacacgtaatgcaggg

SEQ ID NO: 157791 - DNA, 25 bp, E. coli
tattcgttcacgtcgggatacgacc

SEQ ID NO: 157792 - DNA, 25 bp, E. coli
tattcgttcacgacgggatacgacc

SEQ ID NO: 157793 - DNA, 25 bp, E. coli
gccgttggcgaacgtgagttactca

SEQ ID NO: 157794 - DNA, 25 bp, E. coli
gccgttggcgaaggtgagttactca

SEQ ID NO: 157795 - DNA, 25 bp, E. coli
ggtgcgcaccaacacaagagttccg

SEQ ID NO: 157796 - DNA, 25 bp, E. coli
ggtgcgcaccaagacaagagttccg

SEQ ID NO: 157797 - DNA, 25 bp, E. coli
gatggtgctcattcccactcgctgt

SEQ ID NO: 157798 - DNA, 25 bp, E. coli
gagttttatccagtcggtgcaccaa

SEQ ID NO: 157799 - DNA, 25 bp, E. coli
gagttttatccactcggtgcaccaa

SEQ ID NO: 157800 - DNA, 25 bp, E. coli
gatggtgctcatacccactcgctgt

SEQ ID NO: 157801 - DNA, 25 bp, E. coli
aagttgatacccgtagagcgtcgcc

SEQ ID NO: 157802 - DNA, 25 bp, E. coli
aagttgatacccctagagcgtcgcc

SEQ ID NO: 157803 - DNA, 25 bp, E. coli
cagtgtgtcgggtaaaccgttcctg

SEQ ID NO: 157804 - DNA, 25 bp, E. coli
catggctggcgttaccattaagcga

SEQ ID NO: 157805 - DNA, 25 bp, E. coli
cagtgtgtcgggaaaaccgttcctg

SEQ ID NO: 157806 - DNA, 25 bp, E. coli
catggctggcgtaaccattaagcga

SEQ ID NO: 157807 - DNA, 25 bp, E. coli
agtcacggtgaatcgggcgattgcc

SEQ ID NO: 157808 - DNA, 25 bp, E. coli
agtcacggtgaaacgggcgattgcc

SEQ ID NO: 157809 - DNA, 25 bp, E. coli
tatctatctggaagcgggaacgacc

SEQ ID NO: 157810 - DNA, 25 bp, E. coli
tattggcaagctcgcggcaagtctt

SEQ ID NO: 157811 - DNA, 25 bp, E. coli
tattggcaagctggcggcaagtctt

SEQ ID NO: 157812 - DNA, 25 bp, E. coli
tatctatctggatgcgggaacgacc

SEQ ID NO: 157813 - DNA, 25 bp, E. coli
tgcggactacttgctcgacaacagt

SEQ ID NO: 157814 - DNA, 25 bp, E. coli
tgcggactacttcctcgacaacagt

SEQ ID NO: 157815 - DNA, 25 bp, E. coli
tcatcaggtaaaaactgcgctggca

SEQ ID NO: 157816 - DNA, 25 bp, E. coli
tcatcaggtaaatactgcgctggca

SEQ ID NO: 157817 - DNA, 25 bp, E. coli
cgggatttacaataactggagcagc

SEQ ID NO: 157818 - DNA, 25 bp, E. coli
cgggatttacaaaaactggagcagc

SEQ ID NO: 157819 - DNA, 25 bp, E. coli
tggcaatgacgcaaaaagcggctat

SEQ ID NO: 157820 - DNA, 25 bp, E. coli
tggcaatgacgctaaaagcggctat

SEQ ID NO: 157821 - DNA, 25 bp, E. coli
gagcgtcgccaattcatccttgaga

SEQ ID NO: 157822 - DNA, 25 bp, E. coli
gagcgtcgccaaatcatccttgaga

SEQ ID NO: 157823 - DNA, 25 bp, E. coli
tacctgtatgaaaggcacgactcag

SEQ ID NO: 157824 - DNA, 25 bp, E. coli
tacctgtatgaatggcacgactcag

SEQ ID NO: 157825 - DNA, 25 bp, E. coli
tgtgctcacgattcgccctgcgttc

SEQ ID NO: 157826 - DNA, 25 bp, E. coli
tgtgctcacgatacgccctgcgttc

SEQ ID NO: 157827 - DNA, 25 bp, E. coli
tcgccctgcgttgcggtttatgacg

SEQ ID NO: 157828 - DNA, 25 bp, E. coli
tcgccctgcgttccggtttatgacg

SEQ ID NO: 157829 - DNA, 25 bp, E. coli
tttatgacgatcagggtcgtctggt

SEQ ID NO: 157830 - DNA, 25 bp, E. coli
tttatgacgatctgggtcgtctggt

SEQ ID NO: 157831 - DNA, 25 bp, E. coli
gctcaccgcattcctggcgggctgt

SEQ ID NO: 157832 - DNA, 25 bp, E. coli
gctcaccgcattgctggcgggctgt

SEQ ID NO: 157833 - DNA, 25 bp, E. coli
gaaaggcacgacacaggataactgg

SEQ ID NO: 157834 - DNA, 25 bp, E. coli
gaaaggcacgactcaggataactgg

SEQ ID NO: 157835 - DNA, 25 bp, E. coli
ctcaggataactcggaaacggctgg

SEQ ID NO: 157836 - DNA, 25 bp, E. coli
ctggcgggctgtgctcacgattcgc

SEQ ID NO: 157837 - DNA, 25 bp, E. coli
ctggttcacacctatacctgtatga

SEQ ID NO: 157838 - DNA, 25 bp, E. coli
ctggcgggctgtcctcacgattcgc

SEQ ID NO: 157839 - DNA, 25 bp, E. coli
cattgctcaccgcattgctggcggg

SEQ ID NO: 157840 - DNA, 25 bp, E. coli
cattgctcaccggattgctggcggg

SEQ ID NO: 157841 - DNA, 25 bp, E. coli
ctcaggataactgggaaacggctgg

SEQ ID NO: 157842 - DNA, 25 bp, E. coli
ctggttcacaccaatacctgtatga

SEQ ID NO: 157843 - DNA, 25 bp, E. coli
gatcagggtcgtctggttcacacca

SEQ ID NO: 157844 - DNA, 25 bp, E. coli
gatcagggtcgtgtggttcacacca

SEQ ID NO: 157845 - DNA, 25 bp, E. coli
caactgctggttgatagcggctcga

SEQ ID NO: 157846 - DNA, 25 bp, E. coli
caaatcggcgatcaacagggctggt

SEQ ID NO: 157847 - DNA, 25 bp, E. coli
caactgctggttcatagcggctcga

SEQ ID NO: 157848 - DNA, 25 bp, E. coli
caccgagtgtaatgggcgtctggca

SEQ ID NO: 157849 - DNA, 25 bp, E. coli
caaatcggcgatgaacagggctggt

SEQ ID NO: 157850 - DNA, 25 bp, E. coli
caccgagtgtaaagggcgtctggca

SEQ ID NO: 157851 - DNA, 25 bp, E. coli
tataaatcggctgaaagcgtggtgc

SEQ ID NO: 157852 - DNA, 25 bp, E. coli
tataaatcggctcaaagcgtggtgc

SEQ ID NO: 157853 - DNA, 25 bp, E. coli
tatattgcggaagatgacgatgcgc

SEQ ID NO: 157854 - DNA, 25 bp, E. coli
tatattgcggaacatgacgatgcgc

SEQ ID NO: 157855 - DNA, 25 bp, E. coli
tgattattcccggttcacgcggcga

SEQ ID NO: 157856 - DNA, 25 bp, E. coli
tgattattcccgcttcacgcggcga

SEQ ID NO: 157857 - DNA, 25 bp, E. coli
tttgttagcgcgtgccaaatcggcg

SEQ ID NO: 157858 - DNA, 25 bp, E. coli
tttgttagcgcgagccaaatcggcg

SEQ ID NO: 157859 - DNA, 25 bp, E. coli
gaaagctggctggaggaaaacctgc

SEQ ID NO: 157860 - DNA, 25 bp, E. coli
gaaagctggctgcaggaaaacctgc

SEQ ID NO: 157861 - DNA, 25 bp, E. coli
ggttaattattcctgtcgcgcgact

SEQ ID NO: 157862 - DNA, 25 bp, E. coli
ggttaattattcgtgtcgcgcgact

SEQ ID NO: 157863 - DNA, 25 bp, E. coli
tggttgcatcgttaaggcgccacgc

SEQ ID NO: 157864 - DNA, 25 bp, E. coli
tggttgcatcgtaaaggcgccacgc

SEQ ID NO: 157865 - DNA, 25 bp, E. coli
taatgcaacaagataaggccaccgg

SEQ ID NO: 157866 - DNA, 25 bp, E. coli
taatgcaacaagttaaggccaccgg

SEQ ID NO: 157867 - DNA, 25 bp, E. coli
catttgcgccgttaacctgatgagc

SEQ ID NO: 157868 - DNA, 25 bp, E. coli
catcatgattgtggccggtttcggc

SEQ ID NO: 157869 - DNA, 25 bp, E. coli
catcatgattgtcgccggtttcggc

SEQ ID NO: 157870 - DNA, 25 bp, E. coli
catttgcgccgtaaacctgatgagc

SEQ ID NO: 157871 - DNA, 25 bp, E. coli
tatatgggtgtctggttcccgacgg

SEQ ID NO: 157872 - DNA, 25 bp, E. coli
tatggcactgggatcagcaattggc

SEQ ID NO: 157873 - DNA, 25 bp, E. coli
tatatgggtgtcaggttcccgacgg

SEQ ID NO: 157874 - DNA, 25 bp, E. coli
tatggcactgggttcagcaattggc

SEQ ID NO: 157875 - DNA, 25 bp, E. coli
tatattatcggtcgtatcgcggcgt

SEQ ID NO: 157876 - DNA, 25 bp, E. coli
tatctacccgtgcaatcaggttggc

SEQ ID NO: 157877 - DNA, 25 bp, E. coli
tatctacccgtggaatcaggttggc

SEQ ID NO: 157878 - DNA, 25 bp, E. coli
tatattatcggtggtatcgcggcgt

SEQ ID NO: 157879 - DNA, 25 bp, E. coli
ttcataacctgtggagcaacggcgg

SEQ ID NO: 157880 - DNA, 25 bp, E. coli
ttcataacctgtcgagcaacggcgg

SEQ ID NO: 157881 - DNA, 25 bp, E. coli
gcgattaactccctgccgatgcgta

SEQ ID NO: 157882 - DNA, 25 bp, E. coli
gcgattaactccgtgccgatgcgta

SEQ ID NO: 157883 - DNA, 25 bp, E. coli
gaaattatcgggtttaccgccggtg

SEQ ID NO: 157884 - DNA, 25 bp, E. coli
gaaattatcgggattaccgccggtg

SEQ ID NO: 157885 - DNA, 25 bp, E. coli
gaaatccttattgtcgccatcgccg

SEQ ID NO: 157886 - DNA, 25 bp, E. coli
gaaatccttattctcgccatcgccg

SEQ ID NO: 157887 - DNA, 25 bp, E. coli
cgttatgcgcaggaaaacctcggcc

SEQ ID NO: 157888 - DNA, 25 bp, E. coli
cgttatgcgcagcaaaacctcggcc

SEQ ID NO: 157889 - DNA, 25 bp, E. coli
aaccacaggtcaatagtgccaccgg

SEQ ID NO: 157890 - DNA, 25 bp, E. coli
caaccacaggtcattagtgccaccg

SEQ ID NO: 157891 - DNA, 25 bp, E. coli
aaccacaggtcattagtgccaccgg

SEQ ID NO: 157892 - DNA, 25 bp, E. coli
caaccacaggtctttagtgccaccg

SEQ ID NO: 157893 - DNA, 25 bp, E. coli
cacaggtcattactgccaccggcgt

SEQ ID NO: 157894 - DNA, 25 bp, E. coli
cacaggtcattagtgccaccggcgt

SEQ ID NO: 157895 - DNA, 25 bp, E. coli
cattagtgccacgggcgtggtaaaa

SEQ ID NO: 157896 - DNA, 25 bp, E. coli
caggtcattagtcccaccggcgtgg

SEQ ID NO: 157897 - DNA, 25 bp, E. coli
cattagtgccaccggcgtggtaaaa

SEQ ID NO: 157898 - DNA, 25 bp, E. coli
caggtcattagtgccaccggcgtgg

SEQ ID NO: 157899 - DNA, 25 bp, E. coli
accacaggtcataagtgccaccggc

SEQ ID NO: 157900 - DNA, 25 bp, E. coli
accacaggtcattagtgccaccggc

SEQ ID NO: 157901 - DNA, 25 bp, E. coli
acaaccacaggtcattagtgccacc

SEQ ID NO: 157902 - DNA, 25 bp, E. coli
acaaccacaggtgattagtgccacc

SEQ ID NO: 157903 - DNA, 25 bp, E. coli
acaggtcattagtgccaccggcgtg

SEQ ID NO: 157904 - DNA, 25 bp, E. coli
acaggtcattagagccaccggcgtg

SEQ ID NO: 157905 - DNA, 25 bp, E. coli
tcattagtgccagcggcgtggtaaa

SEQ ID NO: 157906 - DNA, 25 bp, E. coli
tcattagtgccaccggcgtggtaaa

SEQ ID NO: 157907 - DNA, 25 bp, E. coli
ccacaggtcattagtgccaccggcg

SEQ ID NO: 157908 - DNA, 25 bp, E. coli
ccacaggtcatttgtgccaccggcg

SEQ ID NO: 157909 - DNA, 25 bp, E. coli
gtcattagtgcctccggcgtggtaa

SEQ ID NO: 157910 - DNA, 25 bp, E. coli
gtcattagtgccaccggcgtggtaa

SEQ ID NO: 157911 - DNA, 25 bp, E. coli
catgtcgttatttatgggcagaatt

SEQ ID NO: 157912 - DNA, 25 bp, E. coli
catgtcgttattaatgggcagaatt

SEQ ID NO: 157913 - DNA, 25 bp, E. coli
tatggtctgagtgagaagaagaacg

SEQ ID NO: 157914 - DNA, 25 bp, E. coli
tatggtctgagtcagaagaagaacg

SEQ ID NO: 157915 - DNA, 25 bp, E. coli
ttgcgggaatatcgtctgagtcaga

SEQ ID NO: 157916 - DNA, 25 bp, E. coli
ttgcgggaatatggtctgagtcaga

SEQ ID NO: 157917 - DNA, 25 bp, E. coli
tgtcgttattaaagggcagaatttc

SEQ ID NO: 157918 - DNA, 25 bp, E. coli
tgtcgttattaatgggcagaatttc

SEQ ID NO: 157919 - DNA, 25 bp, E. coli
tgcgggaatatggtctgagtcagaa

SEQ ID NO: 157920 - DNA, 25 bp, E. coli
tgcgggaatatgctctgagtcagaa

SEQ ID NO: 157921 - DNA, 25 bp, E. coli
tcgttattaatgcgcagaatttcct

SEQ ID NO: 157922 - DNA, 25 bp, E. coli
tcgttattaatgggcagaatttcct

SEQ ID NO: 157923 - DNA, 25 bp, E. coli
gaatatggtctgagtcagaagaaga

SEQ ID NO: 157924 - DNA, 25 bp, E. coli
gcatgtcgttataaatgggcagaat

SEQ ID NO: 157925 - DNA, 25 bp, E. coli
gaatatggtctgtgtcagaagaaga

SEQ ID NO: 157926 - DNA, 25 bp, E. coli
gcatgtcgttattaatgggcagaat

SEQ ID NO: 157927 - DNA, 25 bp, E. coli
gtcgttattaatgggcagaatttcc

SEQ ID NO: 157928 - DNA, 25 bp, E. coli
gggaatatggtctgagtcagaagaa

SEQ ID NO: 157929 - DNA, 25 bp, E. coli
gtcgttattaatcggcagaatttcc

SEQ ID NO: 157930 - DNA, 25 bp, E. coli
gggaatatggtcagagtcagaagaa

SEQ ID NO: 157931 - DNA, 25 bp, E. coli
tggtctgagtcacaagaagaacgaa

SEQ ID NO: 157932 - DNA, 25 bp, E. coli
tggtctgagtcagaagaagaacgaa

SEQ ID NO: 157933 - DNA, 25 bp, E. coli
catcaggttgattatttcggctgcc

SEQ ID NO: 157934 - DNA, 25 bp, E. coli
catcaggttgataatttcggctgcc

SEQ ID NO: 157935 - DNA, 25 bp, E. coli
tcgatgattttctgcgccagctcgc

SEQ ID NO: 157936 - DNA, 25 bp, E. coli
tcctgcaacagaggctgaatgctgc

SEQ ID NO: 157937 - DNA, 25 bp, E. coli
tcctgcaacagacgctgaatgctgc

SEQ ID NO: 157938 - DNA, 25 bp, E. coli
tcgatgattttcagcgccagctcgc

SEQ ID NO: 157939 - DNA, 25 bp, E. coli
gcaagccattcactacttcggtcag

SEQ ID NO: 157940 - DNA, 25 bp, E. coli
gcagacgttcatggaacaacgccag

SEQ ID NO: 157941 - DNA, 25 bp, E. coli
gaatttctcgcgcagtggctgctcg

SEQ ID NO: 157942 - DNA, 25 bp, E. coli
gcaagccattcagtacttcggtcag

SEQ ID NO: 157943 - DNA, 25 bp, E. coli
gaatttctcgcggagtggctgctcg

SEQ ID NO: 157944 - DNA, 25 bp, E. coli
gcagacgttcatcgaacaacgccag

SEQ ID NO: 157945 - DNA, 25 bp, E. coli
gattctgaccgtcgagcaagccatt

SEQ ID NO: 157946 - DNA, 25 bp, E. coli
gattctgaccgtggagcaagccatt

SEQ ID NO: 157947 - DNA, 25 bp, E. coli
ggcgcgcttcagttgcaccagaatg

SEQ ID NO: 157948 - DNA, 25 bp, E. coli
ggcgcgcttcagatgcaccagaatg

SEQ ID NO: 157949 - DNA, 25 bp, E. coli
ggcgatacgcaagatcacgtcgtgg

SEQ ID NO: 157950 - DNA, 25 bp, E. coli
ggcgatacgcaacatcacgtcgtgg

SEQ ID NO: 157951 - DNA, 25 bp, E. coli
tcacgcacggcggtaataacggctt

SEQ ID NO: 157952 - DNA, 25 bp, E. coli
tcacgcacggcgctaataacggctt

SEQ ID NO: 157953 - DNA, 25 bp, E. coli
gagcgtttcaattccgctggcggta

SEQ ID NO: 157954 - DNA, 25 bp, E. coli
gagcgtttcaataccgctggcggta

SEQ ID NO: 157955 - DNA, 25 bp, E. coli
catttcggttcaaggttgatgggtt

SEQ ID NO: 157956 - DNA, 25 bp, E. coli
catttcggttcatggttgatgggtt

SEQ ID NO: 157957 - DNA, 25 bp, E. coli
gtccccattttgtggagcccatcaa

SEQ ID NO: 157958 - DNA, 25 bp, E. coli
attttgtggagcccatcaaccccgc

SEQ ID NO: 157959 - DNA, 25 bp, E. coli
gtccccattttgaggagcccatcaa

SEQ ID NO: 157960 - DNA, 25 bp, E. coli
gatgtccccattatgtggagcccat

SEQ ID NO: 157961 - DNA, 25 bp, E. coli
actgcttttcttagatgtccccatt

SEQ ID NO: 157962 - DNA, 25 bp, E. coli
actgcttttctttgatgtccccatt

SEQ ID NO: 157963 - DNA, 25 bp, E. coli
attttgtggagcgcatcaaccccgc

SEQ ID NO: 157964 - DNA, 25 bp, E. coli
gatgtccccattttgtggagcccat

SEQ ID NO: 157965 - DNA, 25 bp, E. coli
cccgccatttcggttcaaggttgat

SEQ ID NO: 157966 - DNA, 25 bp, E. coli
cccgccatttcgcttcaaggttgat

SEQ ID NO: 157967 - DNA, 25 bp, E. coli
tgatgtccccattttgtggagccca

SEQ ID NO: 157968 - DNA, 25 bp, E. coli
tgatgtccccatattgtggagccca

SEQ ID NO: 157969 - DNA, 25 bp, E. coli
gcttttctttgatgtccccattttg

SEQ ID NO: 157970 - DNA, 25 bp, E. coli
gcttttctttgaagtccccattttg

SEQ ID NO: 157971 - DNA, 25 bp, E. coli
cgccatttcggttcaaggttgatgg

SEQ ID NO: 157972 - DNA, 25 bp, E. coli
cgccatttcggtacaaggttgatgg

SEQ ID NO: 157973 - DNA, 25 bp, E. coli
ctttgatgtcccgattttgtggagc

SEQ ID NO: 157974 - DNA, 25 bp, E. coli
ctttgatgtccccattttgtggagc

SEQ ID NO: 157975 - DNA, 25 bp, E. coli
tcaaccccgccatttcggttcaagg

SEQ ID NO: 157976 - DNA, 25 bp, E. coli
tcaaccccgccaattcggttcaagg

SEQ ID NO: 157977 - DNA, 25 bp, E. coli
catggataaaggttacggaggaaga

SEQ ID NO: 157978 - DNA, 25 bp, E. coli
catggataaaggatacggaggaaga

SEQ ID NO: 157979 - DNA, 25 bp, E. coli
catcatggataaaggatacggagga

SEQ ID NO: 157980 - DNA, 25 bp, E. coli
catcatggataatggatacggagga

SEQ ID NO: 157981 - DNA, 25 bp, E. coli
ttgcctgcaaactgtactgatattg

SEQ ID NO: 157982 - DNA, 25 bp, E. coli
ttgcctgcaaacagtactgatattg

SEQ ID NO: 157983 - DNA, 25 bp, E. coli
tgctggaagcctgtaagatgtatcg

SEQ ID NO: 157984 - DNA, 25 bp, E. coli
tgcaaacagtactgatattgcactg

SEQ ID NO: 157985 - DNA, 25 bp, E. coli
tgcaaacagtacagatattgcactg

SEQ ID NO: 157986 - DNA, 25 bp, E. coli
tgctggaagcctctaagatgtatcg

SEQ ID NO: 157987 - DNA, 25 bp, E. coli
cctgtaagatgtatcgggtgttgct

SEQ ID NO: 157988 - DNA, 25 bp, E. coli
cctgtaagatgtttcgggtgttgct

SEQ ID NO: 157989 - DNA, 25 bp, E. coli
gaacggcacatcatggataaaggat

SEQ ID NO: 157990 - DNA, 25 bp, E. coli
gaacggcacatcttggataaaggat

SEQ ID NO: 157991 - DNA, 25 bp, E. coli
gtggaacggcacatcatggataaag

SEQ ID NO: 157992 - DNA, 25 bp, E. coli
gtggaacggcacttcatggataaag

SEQ ID NO: 157993 - DNA, 25 bp, E. coli
tggataaaggatacggaggaagaaa

SEQ ID NO: 157994 - DNA, 25 bp, E. coli
tggataaaggattcggaggaagaaa

SEQ ID NO: 157995 - DNA, 25 bp, E. coli
tggaagcctgtaagatgtatcgggt

SEQ ID NO: 157996 - DNA, 25 bp, E. coli
ggcacatcatggttaaaggatacgg

SEQ ID NO: 157997 - DNA, 25 bp, E. coli
tggaagcctgtatgatgtatcgggt

SEQ ID NO: 157998 - DNA, 25 bp, E. coli
ggcacatcatggataaaggatacgg

SEQ ID NO: 157999 - DNA, 25 bp, E. coli
aatggtgttttcacatagggatgaa

SEQ ID NO: 158000 - DNA, 25 bp, E. coli
aatggtgttttctcatagggatgaa

SEQ ID NO: 158001 - DNA, 25 bp, E. coli
cataaatggtgttttctcataggga

SEQ ID NO: 158002 - DNA, 25 bp, E. coli
cataaatggtgtattctcataggga

SEQ ID NO: 158003 - DNA, 25 bp, E. coli
tacagatcataaatggtgttttctc

SEQ ID NO: 158004 - DNA, 25 bp, E. coli
tacaatacagatgataaatggtgtt

SEQ ID NO: 158005 - DNA, 25 bp, E. coli
tacagatcataattggtgttttctc

SEQ ID NO: 158006 - DNA, 25 bp, E. coli
tacaatacagatcataaatggtgtt

SEQ ID NO: 158007 - DNA, 25 bp, E. coli
tattccatgttcagtatcttctact

SEQ ID NO: 158008 - DNA, 25 bp, E. coli
tattccatgttctgtatcttctact

SEQ ID NO: 158009 - DNA, 25 bp, E. coli
ttttcaatgagtgagttttattcca

SEQ ID NO: 158010 - DNA, 25 bp, E. coli
ttttcaatgagtcagttttattcca

SEQ ID NO: 158011 - DNA, 25 bp, E. coli
tctactttgtttacaatacagatca

SEQ ID NO: 158012 - DNA, 25 bp, E. coli
tctactttgttttcaatacagatca

SEQ ID NO: 158013 - DNA, 25 bp, E. coli
ccatgttcagtaacttctactttgt

SEQ ID NO: 158014 - DNA, 25 bp, E. coli
ccatgttcagtatcttctactttgt

SEQ ID NO: 158015 - DNA, 25 bp, E. coli
ctcatagggatgtaagagtgttatc

SEQ ID NO: 158016 - DNA, 25 bp, E. coli
ctcatagggatgaaagagtgttatc

SEQ ID NO: 158017 - DNA, 25 bp, E. coli
ggatgaaagagtgttatcattttaa

SEQ ID NO: 158018 - DNA, 25 bp, E. coli
ggatgaaagagtcttatcattttaa

SEQ ID NO: 158019 - DNA, 25 bp, E. coli
gagtgagttttattccatgttcagt

SEQ ID NO: 158020 - DNA, 25 bp, E. coli
gagtgagttttaatccatgttcagt

SEQ ID NO: 158021 - DNA, 25 bp, E. coli
caactcgtcgaaaaaagccagctca

SEQ ID NO: 158022 - DNA, 25 bp, E. coli
caacggaagaacaatgggacgaact

SEQ ID NO: 158023 - DNA, 25 bp, E. coli
caacggaagaactatgggacgaact

SEQ ID NO: 158024 - DNA, 25 bp, E. coli
cagctcatgttaggcctggcaacgg

SEQ ID NO: 158025 - DNA, 25 bp, E. coli
caactcgtcgaataaagccagctca

SEQ ID NO: 158026 - DNA, 25 bp, E. coli
cagctcatgttacgcctggcaacgg

SEQ ID NO: 158027 - DNA, 25 bp, E. coli
cagtcatcggtgcaaaaatcggtgt

SEQ ID NO: 158028 - DNA, 25 bp, E. coli
cagtcatcggtggaaaaatcggtgt

SEQ ID NO: 158029 - DNA, 25 bp, E. coli
tacagattcggaaggatgaactggc

SEQ ID NO: 158030 - DNA, 25 bp, E. coli
tacagattcggatggatgaactggc

SEQ ID NO: 158031 - DNA, 25 bp, E. coli
tatttcgcctggcaacaactcgtcg

SEQ ID NO: 158032 - DNA, 25 bp, E. coli
tatttcgcctgggaacaactcgtcg

SEQ ID NO: 158033 - DNA, 25 bp, E. coli
tgctggctccgctggataacctctt

SEQ ID NO: 158034 - DNA, 25 bp, E. coli
tgctggctccgcaggataacctctt

SEQ ID NO: 158035 - DNA, 25 bp, E. coli
tgcctatggcgaacagggcggcttt

SEQ ID NO: 158036 - DNA, 25 bp, E. coli
tgcctatggcgatcagggcggcttt

SEQ ID NO: 158037 - DNA, 25 bp, E. coli
tctcgacaacgatagcaaggtaaag

SEQ ID NO: 158038 - DNA, 25 bp, E. coli
tctcgacaacgaaagcaaggtaaag

SEQ ID NO: 158039 - DNA, 25 bp, E. coli
gaaactggtcggtcagtcatcggtg

SEQ ID NO: 158040 - DNA, 25 bp, E. coli
gaaactggtcggacagtcatcggtg

SEQ ID NO: 158041 - DNA, 25 bp, E. coli
gggacgaactcaacgccagcgaaat

SEQ ID NO: 158042 - DNA, 25 bp, E. coli
gggacgaactcatcgccagcgaaat

SEQ ID NO: 158043 - DNA, 25 bp, E. coli
tacacagattaagtgggaagaagcc

SEQ ID NO: 158044 - DNA, 25 bp, E. coli
tacacagattaactgggaagaagcc

SEQ ID NO: 158045 - DNA, 25 bp, E. coli
ttttgtagctcaccagttgatgaac

SEQ ID NO: 158046 - DNA, 25 bp, E. coli
ttttgtagctcagcagttgatgaac

SEQ ID NO: 158047 - DNA, 25 bp, E. coli
tgtattcacgctatggtaaccagta

SEQ ID NO: 158048 - DNA, 25 bp, E. coli
tgtacacaaattccgctttcaacga

SEQ ID NO: 158049 - DNA, 25 bp, E. coli
tgtacacaaattgcgctttcaacga

SEQ ID NO: 158050 - DNA, 25 bp, E. coli
tgtattcacgctttggtaaccagta

SEQ ID NO: 158051 - DNA, 25 bp, E. coli
tccagtttcagacaaacagcgctaa

SEQ ID NO: 158052 - DNA, 25 bp, E. coli
tccagtttcagagaaacagcgctaa

SEQ ID NO: 158053 - DNA, 25 bp, E. coli
ccagttgatgaagttaagaaagggc

SEQ ID NO: 158054 - DNA, 25 bp, E. coli
ccagttgatgaacttaagaaagggc

SEQ ID NO: 158055 - DNA, 25 bp, E. coli
gcactccgggattatcctgtacaca

SEQ ID NO: 158056 - DNA, 25 bp, E. coli
gcactccgggataatcctgtacaca

SEQ ID NO: 158057 - DNA, 25 bp, E. coli
gaagaagcctataccagtttcagac

SEQ ID NO: 158058 - DNA, 25 bp, E. coli
gaagaagcctattccagtttcagac

SEQ ID NO: 158059 - DNA, 25 bp, E. coli
gtaaccagtacccacaattttgtag

SEQ ID NO: 158060 - DNA, 25 bp, E. coli
gtaaccagtaccgacaattttgtag

SEQ ID NO: 158061 - DNA, 25 bp, E. coli
taagaaagggctggatgcactccgg

SEQ ID NO: 158062 - DNA, 25 bp, E. coli
tcaacgatttgtaaaaccgatggta

SEQ ID NO: 158063 - DNA, 25 bp, E. coli
tcaacgatttgttaaaccgatggta

SEQ ID NO: 158064 - DNA, 25 bp, E. coli
taagaaagggctcgatgcactccgg

SEQ ID NO: 158065 - DNA, 25 bp, E. coli
cttaccgacgcggtgttcgatttgc

SEQ ID NO: 158066 - DNA, 25 bp, E. coli
accgacgcgctgttcgatttgctta

SEQ ID NO: 158067 - DNA, 25 bp, E. coli
accgacgcgctgatcgatttgctta

SEQ ID NO: 158068 - DNA, 25 bp, E. coli
cttaccgacgcgctgttcgatttgc

SEQ ID NO: 158069 - DNA, 25 bp, E. coli
tttgcttatcgcactgctgaaggtg

SEQ ID NO: 158070 - DNA, 25 bp, E. coli
ttctggcggtgcataccgacgcgct

SEQ ID NO: 158071 - DNA, 25 bp, E. coli
ttctggcggtgcttaccgacgcgct

SEQ ID NO: 158072 - DNA, 25 bp, E. coli
tttgcttatcgctctgctgaaggtg

SEQ ID NO: 158073 - DNA, 25 bp, E. coli
tgttctggcggtgcttaccgacgcg

SEQ ID NO: 158074 - DNA, 25 bp, E. coli
tgttctggcggtccttaccgacgcg

SEQ ID NO: 158075 - DNA, 25 bp, E. coli
gcggtgcttacccacgcgctgttcg

SEQ ID NO: 158076 - DNA, 25 bp, E. coli
gcttatcgcactgctgaaggtgaaa

SEQ ID NO: 158077 - DNA, 25 bp, E. coli
gcggtgcttaccgacgcgctgttcg

SEQ ID NO: 158078 - DNA, 25 bp, E. coli
gcttatcgcactcctgaaggtgaaa

SEQ ID NO: 158079 - DNA, 25 bp, E. coli
cgcgctgttcgatttgcttatcgca

SEQ ID NO: 158080 - DNA, 25 bp, E. coli
cgcgctgttcgaattgcttatcgca

SEQ ID NO: 158081 - DNA, 25 bp, E. coli
cgatttgcttatggcactgctgaag

SEQ ID NO: 158082 - DNA, 25 bp, E. coli
cgatttgcttatcgcactgctgaag

SEQ ID NO: 158083 - DNA, 25 bp, E. coli
ggtgcttaccgacgcgctgttcgat

SEQ ID NO: 158084 - DNA, 25 bp, E. coli
ggtgcttaccgaggcgctgttcgat

SEQ ID NO: 158085 - DNA, 25 bp, E. coli
gacgcgctgttccatttgcttatcg

SEQ ID NO: 158086 - DNA, 25 bp, E. coli
gacgcgctgttcgatttgcttatcg

SEQ ID NO: 158087 - DNA, 25 bp, E. coli
cacgcatctgggaaacaaaggcaaa

SEQ ID NO: 158088 - DNA, 25 bp, E. coli
cacgcatctgggtaacaaaggcaaa

SEQ ID NO: 158089 - DNA, 25 bp, E. coli
catcgcctgtcgaggaatggtgaaa

SEQ ID NO: 158090 - DNA, 25 bp, E. coli
catcgcctgtcgtggaatggtgaaa

SEQ ID NO: 158091 - DNA, 25 bp, E. coli
tactggcaggcatttacacgcatct

SEQ ID NO: 158092 - DNA, 25 bp, E. coli
tactggcaggcaattacacgcatct

SEQ ID NO: 158093 - DNA, 25 bp, E. coli
agcgattcggcttctacggcgtgca

SEQ ID NO: 158094 - DNA, 25 bp, E. coli
agcgattcggctactacggcgtgca

SEQ ID NO: 158095 - DNA, 25 bp, E. coli
tattcagtcaccaacaacctgtgcg

SEQ ID NO: 158096 - DNA, 25 bp, E. coli
tattcagtcacctacaacctgtgcg

SEQ ID NO: 158097 - DNA, 25 bp, E. coli
tgatgcacaacgtagaagtcgccaa

SEQ ID NO: 158098 - DNA, 25 bp, E. coli
tgatgcacaacgaagaagtcgccaa

SEQ ID NO: 158099 - DNA, 25 bp, E. coli
gcgattggctacttcatgaccggca

SEQ ID NO: 158100 - DNA, 25 bp, E. coli
gcgattggctacatcatgaccggca

SEQ ID NO: 158101 - DNA, 25 bp, E. coli
gaactgtttattagcgcccttggcc

SEQ ID NO: 158102 - DNA, 25 bp, E. coli
gactatcgctgtgggtaacggcctg

SEQ ID NO: 158103 - DNA, 25 bp, E. coli
gaaacgcatgattgcgacgccggaa

SEQ ID NO: 158104 - DNA, 25 bp, E. coli
gaaacgcatgatagcgacgccggaa

SEQ ID NO: 158105 - DNA, 25 bp, E. coli
gaactgtttatttgcgcccttggcc

SEQ ID NO: 158106 - DNA, 25 bp, E. coli
gactatcgctgtcggtaacggcctg

SEQ ID NO: 158107 - DNA, 25 bp, E. coli
cattcaagctggataaaaccgggcg

SEQ ID NO: 158108 - DNA, 25 bp, E. coli
cattcaagctggttaaaaccgggcg

SEQ ID NO: 158109 - DNA, 25 bp, E. coli
agaaatcccctgtaagcacagcggc

SEQ ID NO: 158110 - DNA, 25 bp, E. coli
ataaacggggagctgtatgcacaaa

SEQ ID NO: 158111 - DNA, 25 bp, E. coli
ataaacggggaggtgtatgcacaaa

SEQ ID NO: 158112 - DNA, 25 bp, E. coli
agaaatcccctgaaagcacagcggc

SEQ ID NO: 158113 - DNA, 25 bp, E. coli
aaacggggagctgtatgcacaaagc

SEQ ID NO: 158114 - DNA, 25 bp, E. coli
acggggagctgtatgcacaaagcat

SEQ ID NO: 158115 - DNA, 25 bp, E. coli
acggggagctgtttgcacaaagcat

SEQ ID NO: 158116 - DNA, 25 bp, E. coli
aaacggggagctctatgcacaaagc

SEQ ID NO: 158117 - DNA, 25 bp, E. coli
tatccgggtaggagcgatcactttc

SEQ ID NO: 158118 - DNA, 25 bp, E. coli
tatccgggtaggtgcgatcactttc

SEQ ID NO: 158119 - DNA, 25 bp, E. coli
tgttatcagaaaacccctgaaagca

SEQ ID NO: 158120 - DNA, 25 bp, E. coli
tgttatcagaaatcccctgaaagca

SEQ ID NO: 158121 - DNA, 25 bp, E. coli
tcagaaatccccagaaagcacagcg

SEQ ID NO: 158122 - DNA, 25 bp, E. coli
tcagaaatcccctgaaagcacagcg

SEQ ID NO: 158123 - DNA, 25 bp, E. coli
cgggtaggtgcgttcactttcgtct

SEQ ID NO: 158124 - DNA, 25 bp, E. coli
cgggtaggtgcgatcactttcgtct

SEQ ID NO: 158125 - DNA, 25 bp, E. coli
tcacgataatatgcgggtaggtgcg

SEQ ID NO: 158126 - DNA, 25 bp, E. coli
taataaacggggagctgtatgcaca

SEQ ID NO: 158127 - DNA, 25 bp, E. coli
taatatccgggtaggtgcgatcact

SEQ ID NO: 158128 - DNA, 25 bp, E. coli
taataaacggggtgctgtatgcaca

SEQ ID NO: 158129 - DNA, 25 bp, E. coli
tcacgataatatccgggtaggtgcg

SEQ ID NO: 158130 - DNA, 25 bp, E. coli
taatatccgggttggtgcgatcact

SEQ ID NO: 158131 - DNA, 25 bp, E. coli
cataacggcagaatttgaacaggtc

SEQ ID NO: 158132 - DNA, 25 bp, E. coli
cataacggcagattttgaacaggtc

SEQ ID NO: 158133 - DNA, 25 bp, E. coli
agtggacgccaccttatgactggaa

SEQ ID NO: 158134 - DNA, 25 bp, E. coli
agtggacgccacgttatgactggaa

SEQ ID NO: 158135 - DNA, 25 bp, E. coli
tatcagagccgatagtggtgacagt

SEQ ID NO: 158136 - DNA, 25 bp, E. coli
tatcagagccgaaagtggtgacagt

SEQ ID NO: 158137 - DNA, 25 bp, E. coli
ttgtcgtaaatgctcggcaagcgtg

SEQ ID NO: 158138 - DNA, 25 bp, E. coli
ttgtcgtaaatggtcggcaagcgtg

SEQ ID NO: 158139 - DNA, 25 bp, E. coli
tgtgaacacccatctttaaaagcct

SEQ ID NO: 158140 - DNA, 25 bp, E. coli
tgtgaacacccaactttaaaagcct

SEQ ID NO: 158141 - DNA, 25 bp, E. coli
tgactggaaacccatcagggtggtt

SEQ ID NO: 158142 - DNA, 25 bp, E. coli
tgactggaaaccgatcagggtggtt

SEQ ID NO: 158143 - DNA, 25 bp, E. coli
cgtttcactggatagtgcgcccgga

SEQ ID NO: 158144 - DNA, 25 bp, E. coli
cgtttcactggaaagtgcgcccgga

SEQ ID NO: 158145 - DNA, 25 bp, E. coli
gtcgtgcggcgggactgaataacca

SEQ ID NO: 158146 - DNA, 25 bp, E. coli
gtcgtgcggcggcactgaataacca

SEQ ID NO: 158147 - DNA, 25 bp, E. coli
ggcgctgtgggtaaccataacggca

SEQ ID NO: 158148 - DNA, 25 bp, E. coli
ggcgctgtgggttaccataacggca

SEQ ID NO: 158149 - DNA, 25 bp, E. coli
taaccagttgtcgacttacagcgtg

SEQ ID NO: 158150 - DNA, 25 bp, E. coli
taaaagcctttctggaacggcacgg

SEQ ID NO: 158151 - DNA, 25 bp, E. coli
taaaagcctttcaggaacggcacgg

SEQ ID NO: 158152 - DNA, 25 bp, E. coli
taaccagttgtccacttacagcgtg

SEQ ID NO: 158153 - DNA, 25 bp, E. coli
caaagctgcacgtcataaggctaac

SEQ ID NO: 158154 - DNA, 25 bp, E. coli
caaagctgcacgacataaggctaac

SEQ ID NO: 158155 - DNA, 25 bp, E. coli
tatcaaatcagcaaagaagcgcgcc

SEQ ID NO: 158156 - DNA, 25 bp, E. coli
tatcaaatcagctaagaagcgcgcc

SEQ ID NO: 158157 - DNA, 25 bp, E. coli
tcgaagctggcgacaaagctgctgc

SEQ ID NO: 158158 - DNA, 25 bp, E. coli
tcgtggaccgtcaggctgctaaagg

SEQ ID NO: 158159 - DNA, 25 bp, E. coli
tcgtggaccgtctggctgctaaagg

SEQ ID NO: 158160 - DNA, 25 bp, E. coli
tcgaagctggcgtcaaagctgctgc

SEQ ID NO: 158161 - DNA, 25 bp, E. coli
tctgaaaaggctggtaagcacaacg

SEQ ID NO: 158162 - DNA, 25 bp, E. coli
tctgaaaaggctcgtaagcacaacg

SEQ ID NO: 158163 - DNA, 25 bp, E. coli
gctgctgcacagaaagcatttaacg

SEQ ID NO: 158164 - DNA, 25 bp, E. coli
gctgctgcacagtaagcatttaacg

SEQ ID NO: 158165 - DNA, 25 bp, E. coli
gcaagccgtcgctctatgatgcgta

SEQ ID NO: 158166 - DNA, 25 bp, E. coli
gaagcgcgccattcagtctgaaaag

SEQ ID NO: 158167 - DNA, 25 bp, E. coli
gaagcgcgccatacagtctgaaaag

SEQ ID NO: 158168 - DNA, 25 bp, E. coli
gcaagccgtcgcactatgatgcgta

SEQ ID NO: 158169 - DNA, 25 bp, E. coli
ggtctgatccacaaaaacaaagctg

SEQ ID NO: 158170 - DNA, 25 bp, E. coli
ggtctgatccactaaaacaaagctg

SEQ ID NO: 158171 - DNA, 25 bp, E. coli
tcaagaaagtatacgcagctatcga

SEQ ID NO: 158172 - DNA, 25 bp, E. coli
taaggctaacctgactgcacagatc

SEQ ID NO: 158173 - DNA, 25 bp, E. coli
tcaagaaagtattcgcagctatcga

SEQ ID NO: 158174 - DNA, 25 bp, E. coli
taaggctaacctcactgcacagatc

SEQ ID NO: 158175 - DNA, 25 bp, E. coli
attacggcgaatgacctcagcaacc

SEQ ID NO: 158176 - DNA, 25 bp, E. coli
attacggcgaatcacctcagcaacc

SEQ ID NO: 158177 - DNA, 25 bp, E. coli
ttccagtggtacctaattttctccg

SEQ ID NO: 158178 - DNA, 25 bp, E. coli
ttccagtggtacgtaattttctccg

SEQ ID NO: 158179 - DNA, 25 bp, E. coli
tgattccggcaacgcggcggattaa

SEQ ID NO: 158180 - DNA, 25 bp, E. coli
tgattccggcaaggcggcggattaa

SEQ ID NO: 158181 - DNA, 25 bp, E. coli
cctcagcaaccagacgaacataatt

SEQ ID NO: 158182 - DNA, 25 bp, E. coli
cctcagcaaccacacgaacataatt

SEQ ID NO: 158183 - DNA, 25 bp, E. coli
cgaacataatttacggcggtcacgc

SEQ ID NO: 158184 - DNA, 25 bp, E. coli
cgaacataattttcggcggtcacgc

SEQ ID NO: 158185 - DNA, 25 bp, E. coli
cgtttcccgatacagtgccacgcgg

SEQ ID NO: 158186 - DNA, 25 bp, E. coli
ctgctggctgataccggcaacgcgg

SEQ ID NO: 158187 - DNA, 25 bp, E. coli
cgtttcccgatagagtgccacgcgg

SEQ ID NO: 158188 - DNA, 25 bp, E. coli
ctgctggctgattccggcaacgcgg

SEQ ID NO: 158189 - DNA, 25 bp, E. coli
gatacagtgccaggcggcgattgta

SEQ ID NO: 158190 - DNA, 25 bp, E. coli
gatacagtgccacgcggcgattgta

SEQ ID NO: 158191 - DNA, 25 bp, E. coli
tggataccattagggcgaatcacct

SEQ ID NO: 158192 - DNA, 25 bp, E. coli
tggataccattacggcgaatcacct

SEQ ID NO: 158193 - DNA, 25 bp, E. coli
taattttctccgattcccgatacag

SEQ ID NO: 158194 - DNA, 25 bp, E. coli
taagctggatacgattacggcgaat

SEQ ID NO: 158195 - DNA, 25 bp, E. coli
taattttctccgtttcccgatacag

SEQ ID NO: 158196 - DNA, 25 bp, E. coli
taagctggataccattacggcgaat

SEQ ID NO: 158197 - DNA, 25 bp, E. coli
tacgagtgattaccctggtcgtgat

SEQ ID NO: 158198 - DNA, 25 bp, E. coli
tacgagtgattagcctggtcgtgat

SEQ ID NO: 158199 - DNA, 25 bp, E. coli
tagcgtggtggtgattattatccca

SEQ ID NO: 158200 - DNA, 25 bp, E. coli
tagcgtggtggtcattattatccca

SEQ ID NO: 158201 - DNA, 25 bp, E. coli
tattatcccaccgtgcggggctgca

SEQ ID NO: 158202 - DNA, 25 bp, E. coli
tattatcccaccctgcggggctgca

SEQ ID NO: 158203 - DNA, 25 bp, E. coli
tgattagcctggtcgtgattagcgt

SEQ ID NO: 158204 - DNA, 25 bp, E. coli
tgattagcctggacgtgattagcgt

SEQ ID NO: 158205 - DNA, 25 bp, E. coli
ttagcctggtcgtgattagcgtggt

SEQ ID NO: 158206 - DNA, 25 bp, E. coli
ttagcctggtcgagattagcgtggt

SEQ ID NO: 158207 - DNA, 25 bp, E. coli
tgacagcccttcaacgagtgattag

SEQ ID NO: 158208 - DNA, 25 bp, E. coli
tgacagcccttctacgagtgattag

SEQ ID NO: 158209 - DNA, 25 bp, E. coli
tcgtgattagcgtggtggtgattat

SEQ ID NO: 158210 - DNA, 25 bp, E. coli
tcgtgattagcgaggtggtgattat

SEQ ID NO: 158211 - DNA, 25 bp, E. coli
tgcacttggacgaggaaaggcttag

SEQ ID NO: 158212 - DNA, 25 bp, E. coli
gcccttctacgagtgattagcctgg

SEQ ID NO: 158213 - DNA, 25 bp, E. coli
tgcacttggacgtggaaaggcttag

SEQ ID NO: 158214 - DNA, 25 bp, E. coli
gcccttctacgactgattagcctgg

SEQ ID NO: 158215 - DNA, 25 bp, E. coli
cttctacgagtgattagcctggtcg

SEQ ID NO: 158216 - DNA, 25 bp, E. coli
cttctacgagtgtttagcctggtcg

SEQ ID NO: 158217 - DNA, 25 bp, E. coli
ggtgattattatcccaccgtgcggg

SEQ ID NO: 158218 - DNA, 25 bp, E. coli
ggtgattattatgccaccgtgcggg

SEQ ID NO: 158219 - DNA, 25 bp, E. coli
caatcgcagagttttttcaggcaac

SEQ ID NO: 158220 - DNA, 25 bp, E. coli
caatcgcagagtattttcaggcaac

SEQ ID NO: 158221 - DNA, 25 bp, E. coli
tacttgctgacaggagaaaaggctc

SEQ ID NO: 158222 - DNA, 25 bp, E. coli
tacttgctgacacgagaaaaggctc

SEQ ID NO: 158223 - DNA, 25 bp, E. coli
aaaacctttgttccacgccgtctgg

SEQ ID NO: 158224 - DNA, 25 bp, E. coli
aaattgtgatgacggatatcgcccc

SEQ ID NO: 158225 - DNA, 25 bp, E. coli
aaaacctttgttgcacgccgtctgg

SEQ ID NO: 158226 - DNA, 25 bp, E. coli
aaattgtgatgagggatatcgcccc

SEQ ID NO: 158227 - DNA, 25 bp, E. coli
tatccctgaaaccacaatagagacg

SEQ ID NO: 158228 - DNA, 25 bp, E. coli
tatacagggctaacgtccgaatggc

SEQ ID NO: 158229 - DNA, 25 bp, E. coli
tatacagggctatcgtccgaatggc

SEQ ID NO: 158230 - DNA, 25 bp, E. coli
tatccctgaaacgacaatagagacg

SEQ ID NO: 158231 - DNA, 25 bp, E. coli
ccaggaaatcagcaaagaggccact

SEQ ID NO: 158232 - DNA, 25 bp, E. coli
ccaggaaatcaggaaagaggccact

SEQ ID NO: 158233 - DNA, 25 bp, E. coli
gaagaacgattctatgtcccggaga

SEQ ID NO: 158234 - DNA, 25 bp, E. coli
gaagaacgattcaatgtcccggaga

SEQ ID NO: 158235 - DNA, 25 bp, E. coli
gaaaaggctccgcaacgcgtcaata

SEQ ID NO: 158236 - DNA, 25 bp, E. coli
gaaaaggctccggaacgcgtcaata

SEQ ID NO: 158237 - DNA, 25 bp, E. coli
ggttttgatacagcacagttccgga

SEQ ID NO: 158238 - DNA, 25 bp, E. coli
ggttttgatacaccacagttccgga

SEQ ID NO: 158239 - DNA, 25 bp, E. coli
taagcaagcacaccaacaacgttcg

SEQ ID NO: 158240 - DNA, 25 bp, E. coli
taagcaagcacagcaacaacgttcg

SEQ ID NO: 158241 - DNA, 25 bp, E. coli
aatgaccggcgtgccgaaagaccag

SEQ ID NO: 158242 - DNA, 25 bp, E. coli
aatgaccggcgtcccgaaagaccag

SEQ ID NO: 158243 - DNA, 25 bp, E. coli
agaccagttagaacaactggcgcag

SEQ ID NO: 158244 - DNA, 25 bp, E. coli
agaccagttagatcaactggcgcag

SEQ ID NO: 158245 - DNA, 25 bp, E. coli
tgccgaaagaccagttagaacaact

SEQ ID NO: 158246 - DNA, 25 bp, E. coli
tgccgaaagacctgttagaacaact

SEQ ID NO: 158247 - DNA, 25 bp, E. coli
gcgtgccgaaagaccagttagaaca

SEQ ID NO: 158248 - DNA, 25 bp, E. coli
gcgtgccgaaagtccagttagaaca

SEQ ID NO: 158249 - DNA, 25 bp, E. coli
gccgaaagaccacttagaacaactg

SEQ ID NO: 158250 - DNA, 25 bp, E. coli
gccgaaagaccagttagaacaactg

SEQ ID NO: 158251 - DNA, 25 bp, E. coli
gaaagaccagttagaacaactggcg

SEQ ID NO: 158252 - DNA, 25 bp, E. coli
gaaatgaccggcgtgccgaaagacc

SEQ ID NO: 158253 - DNA, 25 bp, E. coli
gaaagaccagtttgaacaactggcg

SEQ ID NO: 158254 - DNA, 25 bp, E. coli
gaaatgaccggcctgccgaaagacc

SEQ ID NO: 158255 - DNA, 25 bp, E. coli
cggcgtgccgaatgaccagttagaa

SEQ ID NO: 158256 - DNA, 25 bp, E. coli
cgtgccgaaagagcagttagaacaa

SEQ ID NO: 158257 - DNA, 25 bp, E. coli
cggcgtgccgaaagaccagttagaa

SEQ ID NO: 158258 - DNA, 25 bp, E. coli
cgtgccgaaagaccagttagaacaa

SEQ ID NO: 158259 - DNA, 25 bp, E. coli
ggcgtgccgaaagaccagttagaac

SEQ ID NO: 158260 - DNA, 25 bp, E. coli
ggcgtgccgaaacaccagttagaac

SEQ ID NO: 158261 - DNA, 25 bp, E. coli
gaccggcgtgccgaaagaccagtta

SEQ ID NO: 158262 - DNA, 25 bp, E. coli
gaccggcgtgcccaaagaccagtta

SEQ ID NO: 158263 - DNA, 25 bp, E. coli
aatggtcatacttaaattggccgcg

SEQ ID NO: 158264 - DNA, 25 bp, E. coli
aatggtcatactaaaattggccgcg

SEQ ID NO: 158265 - DNA, 25 bp, E. coli
taaaacgctcgaagaagtgaaaccg

SEQ ID NO: 158266 - DNA, 25 bp, E. coli
taaaacgctcgatgaagtgaaaccg

SEQ ID NO: 158267 - DNA, 25 bp, E. coli
tatgtcattgcgcagggtaaccacg

SEQ ID NO: 158268 - DNA, 25 bp, E. coli
tatgtcattgcggagggtaaccacg

SEQ ID NO: 158269 - DNA, 25 bp, E. coli
tccaaccgccattgtggaagagggc

SEQ ID NO: 158270 - DNA, 25 bp, E. coli
tccaaccgccatagtggaagagggc

SEQ ID NO: 158271 - DNA, 25 bp, E. coli
gcacattgcgcacgattgtacggta

SEQ ID NO: 158272 - DNA, 25 bp, E. coli
gcacattgcgcaggattgtacggta

SEQ ID NO: 158273 - DNA, 25 bp, E. coli
gaaacatatccggaagtgaaagcct

SEQ ID NO: 158274 - DNA, 25 bp, E. coli
gaaagcgtcaccattcatcgtggca

SEQ ID NO: 158275 - DNA, 25 bp, E. coli
gaaacatatccgcaagtgaaagcct

SEQ ID NO: 158276 - DNA, 25 bp, E. coli
gaaagcgtcacctttcatcgtggca

SEQ ID NO: 158277 - DNA, 25 bp, E. coli
gatttctttgcaggctcaacgcgcg

SEQ ID NO: 158278 - DNA, 25 bp, E. coli
gatttctttgcacgctcaacgcgcg

SEQ ID NO: 158279 - DNA, 25 bp, E. coli
gatttatcagttcgcctccatcggc

SEQ ID NO: 158280 - DNA, 25 bp, E. coli
gatttatcagttggcctccatcggc

SEQ ID NO: 158281 - DNA, 25 bp, E. coli
gtcaatatcgaacggctgaagcgcc

SEQ ID NO: 158282 - DNA, 25 bp, E. coli
gtcaatatcgaagggctgaagcgcc

SEQ ID NO: 158283 - DNA, 25 bp, E. coli
gagggtaccgtactgaaatctcacg

SEQ ID NO: 158284 - DNA, 25 bp, E. coli
gagggtaccgtagtgaaatctcacg

SEQ ID NO: 158285 - DNA, 25 bp, E. coli
caagtacgaggatgacgtggaccga

SEQ ID NO: 158286 - DNA, 25 bp, E. coli
caagtacgaggaagacgtggaccga

SEQ ID NO: 158287 - DNA, 25 bp, E. coli
cactccccggtgtatggcaagtacg

SEQ ID NO: 158288 - DNA, 25 bp, E. coli
cactccccggtgaatggcaagtacg

SEQ ID NO: 158289 - DNA, 25 bp, E. coli
catgcgccccaatccgacgtttgat

SEQ ID NO: 158290 - DNA, 25 bp, E. coli
catgcgccccaaaccgacgtttgat

SEQ ID NO: 158291 - DNA, 25 bp, E. coli
agatatcccggataacgtgctcggg

SEQ ID NO: 158292 - DNA, 25 bp, E. coli
agatatcccggaaaacgtgctcggg

SEQ ID NO: 158293 - DNA, 25 bp, E. coli
tagcgccgaaaatctctaccagatg

SEQ ID NO: 158294 - DNA, 25 bp, E. coli
tagcgccgaaaaactctaccagatg

SEQ ID NO: 158295 - DNA, 25 bp, E. coli
tctctgtcagaattcggcgttccgg

SEQ ID NO: 158296 - DNA, 25 bp, E. coli
tctctgtcagaaatcggcgttccgg

SEQ ID NO: 158297 - DNA, 25 bp, E. coli
gacgggcgaagcgttaatctcgttt

SEQ ID NO: 158298 - DNA, 25 bp, E. coli
gacgggcgaagccttaatctcgttt

SEQ ID NO: 158299 - DNA, 25 bp, E. coli
cgatcagggattcttgctgctcgac

SEQ ID NO: 158300 - DNA, 25 bp, E. coli
cgatcagggattgttgctgctcgac

SEQ ID NO: 158301 - DNA, 25 bp, E. coli
ggcgtaaatgacaggcaacctcata

SEQ ID NO: 158302 - DNA, 25 bp, E. coli
ggcgtaaatgactggcaacctcata

SEQ ID NO: 158303 - DNA, 25 bp, E. coli
taatctcgtttcacgatgcgaaagg

SEQ ID NO: 158304 - DNA, 25 bp, E. coli
taatctcgtttctcgatgcgaaagg

SEQ ID NO: 158305 - DNA, 25 bp, E. coli
gagcgcaatggcatggttaaccact

SEQ ID NO: 158306 - DNA, 25 bp, E. coli
gagcgcaatggcttggttaaccact

SEQ ID NO: 158307 - DNA, 25 bp, E. coli
cacggtctgtatctgctggtcaaac

SEQ ID NO: 158308 - DNA, 25 bp, E. coli
cacggtctgtatgtgctggtcaaac

SEQ ID NO: 158309 - DNA, 25 bp, E. coli
catccgtaagatcctggcgctgaac

SEQ ID NO: 158310 - DNA, 25 bp, E. coli
catccgtaagatgctggcgctgaac

SEQ ID NO: 158311 - DNA, 25 bp, E. coli
tacgttattccagtcgaggtgccaa

SEQ ID NO: 158312 - DNA, 25 bp, E. coli
tatgtgcagtgatatctgggtgccc

SEQ ID NO: 158313 - DNA, 25 bp, E. coli
tacgttattccactcgaggtgccaa

SEQ ID NO: 158314 - DNA, 25 bp, E. coli
tatgtgcagtgaaatctgggtgccc

SEQ ID NO: 158315 - DNA, 25 bp, E. coli
tgagtcaccaagtgcgcaacactgt

SEQ ID NO: 158316 - DNA, 25 bp, E. coli
tgacagttatcaccaaggacgggaa

SEQ ID NO: 158317 - DNA, 25 bp, E. coli
tgacccctacaacccgatgagtgaa

SEQ ID NO: 158318 - DNA, 25 bp, E. coli
tgagtcaccaagagcgcaacactgt

SEQ ID NO: 158319 - DNA, 25 bp, E. coli
tgacagttatcagcaaggacgggaa

SEQ ID NO: 158320 - DNA, 25 bp, E. coli
tgacccctacaagccgatgagtgaa

SEQ ID NO: 158321 - DNA, 25 bp, E. coli
tgcaaatcttgacggcgtgacggct

SEQ ID NO: 158322 - DNA, 25 bp, E. coli
tgcaaatcttgagggcgtgacggct

SEQ ID NO: 158323 - DNA, 25 bp, E. coli
tccggtttatggacgcaagatgcag

SEQ ID NO: 158324 - DNA, 25 bp, E. coli
tccggtttatggtcgcaagatgcag

SEQ ID NO: 158325 - DNA, 25 bp, E. coli
cctgagctgcttgaacggattgaca

SEQ ID NO: 158326 - DNA, 25 bp, E. coli
cctgagctgcttcaacggattgaca

SEQ ID NO: 158327 - DNA, 25 bp, E. coli
taaggccgaacatatggaagcccgc

SEQ ID NO: 158328 - DNA, 25 bp, E. coli
taaggccgaacaaatggaagcccgc

SEQ ID NO: 158329 - DNA, 25 bp, E. coli
aagagcttcgccgtacgctttcgcg

SEQ ID NO: 158330 - DNA, 25 bp, E. coli
aagagcttcgccctacgctttcgcg

SEQ ID NO: 158331 - DNA, 25 bp, E. coli
gaaatctaacgagaagccttctaag

SEQ ID NO: 158332 - DNA, 25 bp, E. coli
gaaatctaacgacaagccttctaag

SEQ ID NO: 158333 - DNA, 25 bp, E. coli
tacgctttcgcgttatgcactgact

SEQ ID NO: 158334 - DNA, 25 bp, E. coli
tacgctttcgcgatatgcactgact

SEQ ID NO: 158335 - DNA, 25 bp, E. coli
tcgccgtacgctatcgcgttatgca

SEQ ID NO: 158336 - DNA, 25 bp, E. coli
tctaagggaaagtgcttcgccgtac

SEQ ID NO: 158337 - DNA, 25 bp, E. coli
tctaagggaaagagcttcgccgtac

SEQ ID NO: 158338 - DNA, 25 bp, E. coli
tcgccgtacgctttcgcgttatgca

SEQ ID NO: 158339 - DNA, 25 bp, E. coli
gccttctaagggtaagagcttcgcc

SEQ ID NO: 158340 - DNA, 25 bp, E. coli
gccttctaagggaaagagcttcgcc

SEQ ID NO: 158341 - DNA, 25 bp, E. coli
cgacaagccttctaagggaaagagc

SEQ ID NO: 158342 - DNA, 25 bp, E. coli
cgacaagccttcaaagggaaagagc

SEQ ID NO: 158343 - DNA, 25 bp, E. coli
gggaaagagcttggccgtacgcttt

SEQ ID NO: 158344 - DNA, 25 bp, E. coli
gggaaagagcttcgccgtacgcttt

SEQ ID NO: 158345 - DNA, 25 bp, E. coli
taacgacaagccttctaagggaaag

SEQ ID NO: 158346 - DNA, 25 bp, E. coli
taagggaaagagcttcgccgtacgc

SEQ ID NO: 158347 - DNA, 25 bp, E. coli
taacgacaagccatctaagggaaag

SEQ ID NO: 158348 - DNA, 25 bp, E. coli
taagggaaagaggttcgccgtacgc

SEQ ID NO: 158349 - DNA, 25 bp, E. coli
gagcttcgccgttcgctttcgcgtt

SEQ ID NO: 158350 - DNA, 25 bp, E. coli
gagcttcgccgtacgctttcgcgtt

SEQ ID NO: 158351 - DNA, 25 bp, E. coli
caacccgcgcaagggccaacaaaga

SEQ ID NO: 158352 - DNA, 25 bp, E. coli
caacccgcgcaacggccaacaaaga

SEQ ID NO: 158353 - DNA, 25 bp, E. coli
actatcacggcgctgatggcccggt

SEQ ID NO: 158354 - DNA, 25 bp, E. coli
actatcacggcggtgatggcccggt

SEQ ID NO: 158355 - DNA, 25 bp, E. coli
attcgtggacaggaagcgctgccga

SEQ ID NO: 158356 - DNA, 25 bp, E. coli
attcgtggacagcaagcgctgccga

SEQ ID NO: 158357 - DNA, 25 bp, E. coli
tatgggtgaaaaggactatcacggc

SEQ ID NO: 158358 - DNA, 25 bp, E. coli
tatgggtgaaaacgactatcacggc

SEQ ID NO: 158359 - DNA, 25 bp, E. coli
tgattcgtggacaggaagcgctgcc

SEQ ID NO: 158360 - DNA, 25 bp, E. coli
tgattcgtggactggaagcgctgcc

SEQ ID NO: 158361 - DNA, 25 bp, E. coli
tgaaaacgactatcacggcggtgat

SEQ ID NO: 158362 - DNA, 25 bp, E. coli
tgaaaacgactaacacggcggtgat

SEQ ID NO: 158363 - DNA, 25 bp, E. coli
tcgcgatatgggagaaaacgactat

SEQ ID NO: 158364 - DNA, 25 bp, E. coli
tcgcgatatgggtgaaaacgactat

SEQ ID NO: 158365 - DNA, 25 bp, E. coli
gccgagactcgcgatatgggtgaaa

SEQ ID NO: 158366 - DNA, 25 bp, E. coli
gccgagactcgccatatgggtgaaa

SEQ ID NO: 158367 - DNA, 25 bp, E. coli
gactcgcgatatcggtgaaaacgac

SEQ ID NO: 158368 - DNA, 25 bp, E. coli
gactcgcgatatgggtgaaaacgac

SEQ ID NO: 158369 - DNA, 25 bp, E. coli
cgtacacgggttagaaggcctgcgt

SEQ ID NO: 158370 - DNA, 25 bp, E. coli
cgtacacgggtttgaaggcctgcgt

SEQ ID NO: 158371 - DNA, 25 bp, E. coli
gttagaaggcctgcgtgtggtggat

SEQ ID NO: 158372 - DNA, 25 bp, E. coli
gttagaaggcctccgtgtggtggat

SEQ ID NO: 158373 - DNA, 25 bp, E. coli
catgtactggatagggtgccggttc

SEQ ID NO: 158374 - DNA, 25 bp, E. coli
catgtactggattgggtgccggttc

SEQ ID NO: 158375 - DNA, 25 bp, E. coli
tactgttacgcggattgcagggagt

SEQ ID NO: 158376 - DNA, 25 bp, E. coli
tactgttacgcgcattgcagggagt

SEQ ID NO: 158377 - DNA, 25 bp, E. coli
taccggcctggtatgcttcgctggg

SEQ ID NO: 158378 - DNA, 25 bp, E. coli
taccggcctggtttgcttcgctggg

SEQ ID NO: 158379 - DNA, 25 bp, E. coli
tttaagttgggcgagcactggcagc

SEQ ID NO: 158380 - DNA, 25 bp, E. coli
tttaagttgggccagcactggcagc

SEQ ID NO: 158381 - DNA, 25 bp, E. coli
tgaaacatttttgtctcgggcgcac

SEQ ID NO: 158382 - DNA, 25 bp, E. coli
tgaaacatttttctctcgggcgcac

SEQ ID NO: 158383 - DNA, 25 bp, E. coli
tcatggtgagaaagcgttaccggcc

SEQ ID NO: 158384 - DNA, 25 bp, E. coli
tcatggtgagaatgcgttaccggcc

SEQ ID NO: 158385 - DNA, 25 bp, E. coli
gaagaaaacctcgttcgtggtcgtg

SEQ ID NO: 158386 - DNA, 25 bp, E. coli
gaagaaaacctccttcgtggtcgtg

SEQ ID NO: 158387 - DNA, 25 bp, E. coli
cgcatgtcgatatggtggagacgcc

SEQ ID NO: 158388 - DNA, 25 bp, E. coli
cgtaatgatagcgatgcccgtgcca

SEQ ID NO: 158389 - DNA, 25 bp, E. coli
cgcatgtcgataaggtggagacgcc

SEQ ID NO: 158390 - DNA, 25 bp, E. coli
cgtaatgatagccatgcccgtgcca

SEQ ID NO: 158391 - DNA, 25 bp, E. coli
cgtgcatggcaatactggctggcgc

SEQ ID NO: 158392 - DNA, 25 bp, E. coli
cttgaagcgttcattcggcgggtga

SEQ ID NO: 158393 - DNA, 25 bp, E. coli
cgtgcatggcaaaactggctggcgc

SEQ ID NO: 158394 - DNA, 25 bp, E. coli
cttgaagcgttctttcggcgggtga

SEQ ID NO: 158395 - DNA, 25 bp, E. coli
caccgctgatggaggcggtttcctc

SEQ ID NO: 158396 - DNA, 25 bp, E. coli
caccgctgatggtggcggtttcctc

SEQ ID NO: 158397 - DNA, 25 bp, E. coli
acgccgccgcttctgggaaaaactg

SEQ ID NO: 158398 - DNA, 25 bp, E. coli
acgccgccgcttgtgggaaaaactg

SEQ ID NO: 158399 - DNA, 25 bp, E. coli
acgatgggtgaacgccgccgcttct

SEQ ID NO: 158400 - DNA, 25 bp, E. coli
acgatgggtgaaggccgccgcttct

SEQ ID NO: 158401 - DNA, 25 bp, E. coli
tacgccgggcagttacgcggtcggg

SEQ ID NO: 158402 - DNA, 25 bp, E. coli
tacgccgggcagatacgcggtcggg

SEQ ID NO: 158403 - DNA, 25 bp, E. coli
ttcctctggcggtacttctccggtt

SEQ ID NO: 158404 - DNA, 25 bp, E. coli
ttcctctggcggaacttctccggtt

SEQ ID NO: 158405 - DNA, 25 bp, E. coli
tgaacgccgccggttctgggaaaaa

SEQ ID NO: 158406 - DNA, 25 bp, E. coli
tgaacgccgccgcttctgggaaaaa

SEQ ID NO: 158407 - DNA, 25 bp, E. coli
gccgccgcttctgggaaaaactgtt

SEQ ID NO: 158408 - DNA, 25 bp, E. coli
gccgcttctgggtaaaactgttcgt

SEQ ID NO: 158409 - DNA, 25 bp, E. coli
gccgccgcttctcggaaaaactgtt

SEQ ID NO: 158410 - DNA, 25 bp, E. coli
gccgcttctgggaaaaactgttcgt

SEQ ID NO: 158411 - DNA, 25 bp, E. coli
tggcggtttcctgtggcggtacttc

SEQ ID NO: 158412 - DNA, 25 bp, E. coli
gcggtttcctctggcggtacttctc

SEQ ID NO: 158413 - DNA, 25 bp, E. coli
gcggtttcctctcgcggtacttctc

SEQ ID NO: 158414 - DNA, 25 bp, E. coli
tggcggtttcctctggcggtacttc

SEQ ID NO: 158415 - DNA, 25 bp, E. coli
cgctcaccgctgatggtggcggttt

SEQ ID NO: 158416 - DNA, 25 bp, E. coli
cgctcaccgctgttggtggcggttt

SEQ ID NO: 158417 - DNA, 25 bp, E. coli
aatcaccaggagttatggcgcacca

SEQ ID NO: 158418 - DNA, 25 bp, E. coli
aatcaccaggagatatggcgcacca

SEQ ID NO: 158419 - DNA, 25 bp, E. coli
tatctatatggtgaaacgcgcccgt

SEQ ID NO: 158420 - DNA, 25 bp, E. coli
tatctatatggtcaaacgcgcccgt

SEQ ID NO: 158421 - DNA, 25 bp, E. coli
ttcgataccacattgcgcgacggtg

SEQ ID NO: 158422 - DNA, 25 bp, E. coli
ttcgataccacaatgcgcgacggtg

SEQ ID NO: 158423 - DNA, 25 bp, E. coli
tgattacgatctcgaggcgctggcc

SEQ ID NO: 158424 - DNA, 25 bp, E. coli
tgattacgatctggaggcgctggcc

SEQ ID NO: 158425 - DNA, 25 bp, E. coli
tgaaatacagcctgaccgccaaagg

SEQ ID NO: 158426 - DNA, 25 bp, E. coli
tgaacaggcgttacaggcaagcttg

SEQ ID NO: 158427 - DNA, 25 bp, E. coli
tgaacaggcgtttcaggcaagcttg

SEQ ID NO: 158428 - DNA, 25 bp, E. coli
tgaaatacagccagaccgccaaagg

SEQ ID NO: 158429 - DNA, 25 bp, E. coli
gccgaatccctgtaagtcgccgaag

SEQ ID NO: 158430 - DNA, 25 bp, E. coli
gccgaatccctgaaagtcgccgaag

SEQ ID NO: 158431 - DNA, 25 bp, E. coli
gcaccagccagtaagttagccagat

SEQ ID NO: 158432 - DNA, 25 bp, E. coli
gcaccagccagttagttagccagat

SEQ ID NO: 158433 - DNA, 25 bp, E. coli
gatttgtaatatgccgatcccggca

SEQ ID NO: 158434 - DNA, 25 bp, E. coli
gatttgtaatatcccgatcccggca

SEQ ID NO: 158435 - DNA, 25 bp, E. coli
taagcagcaagatgagccggagcat

SEQ ID NO: 158436 - DNA, 25 bp, E. coli
taagcagcaagaagagccggagcat

SEQ ID NO: 158437 - DNA, 25 bp, E. coli
tcaacattccggacaccgtgggcta

SEQ ID NO: 158438 - DNA, 25 bp, E. coli
tcaacattccggtcaccgtgggcta

SEQ ID NO: 158439 - DNA, 25 bp, E. coli
caaacaagatctcgcaacgggaggc

SEQ ID NO: 158440 - DNA, 25 bp, E. coli
caaacaagatctggcaacgggaggc

SEQ ID NO: 158441 - DNA, 25 bp, E. coli
tacaaagtgaacaagcagtggctgc

SEQ ID NO: 158442 - DNA, 25 bp, E. coli
taaagtgaatatgaacggcggtgcg

SEQ ID NO: 158443 - DNA, 25 bp, E. coli
taacggcactatcgtaatctacagc

SEQ ID NO: 158444 - DNA, 25 bp, E. coli
tacaaagtgaactagcagtggctgc

SEQ ID NO: 158445 - DNA, 25 bp, E. coli
taacggcactatggtaatctacagc

SEQ ID NO: 158446 - DNA, 25 bp, E. coli
taaagtgaatatcaacggcggtgcg

SEQ ID NO: 158447 - DNA, 25 bp, E. coli
tagtgcgcaggatgtacaaccagct

SEQ ID NO: 158448 - DNA, 25 bp, E. coli
tagtgcgcaggaagtacaaccagct

SEQ ID NO: 158449 - DNA, 25 bp, E. coli
tgtacgtcaggtggcttcattcccg

SEQ ID NO: 158450 - DNA, 25 bp, E. coli
tgtacgtcaggtcgcttcattcccg

SEQ ID NO: 158451 - DNA, 25 bp, E. coli
tgaactgcgcgtatctgactatgac

SEQ ID NO: 158452 - DNA, 25 bp, E. coli
tgaactgcgcgtttctgactatgac

SEQ ID NO: 158453 - DNA, 25 bp, E. coli
tcctggatgaaaggccaagtctggc

SEQ ID NO: 158454 - DNA, 25 bp, E. coli
tcctggatgaaacgccaagtctggc

SEQ ID NO: 158455 - DNA, 25 bp, E. coli
cggcacctgaagttattggcggcat

SEQ ID NO: 158456 - DNA, 25 bp, E. coli
cggcacctgaagatattggcggcat

SEQ ID NO: 158457 - DNA, 25 bp, E. coli
ggtgcgccacaaggtattacctggg

SEQ ID NO: 158458 - DNA, 25 bp, E. coli
ggtgcgccacaacgtattacctggg

SEQ ID NO: 158459 - DNA, 25 bp, E. coli
tcaacttgttgacactggcggcgca

SEQ ID NO: 158460 - DNA, 25 bp, E. coli
tcaacttgttgagactggcggcgca

SEQ ID NO: 158461 - DNA, 25 bp, E. coli
cagaagagctggttgtcacattgta

SEQ ID NO: 158462 - DNA, 25 bp, E. coli
cagaagagctggatgtcacattgta

SEQ ID NO: 158463 - DNA, 25 bp, E. coli
tacgcctgaacacgctggaagcagt

SEQ ID NO: 158464 - DNA, 25 bp, E. coli
tacgcctgaacaggctggaagcagt

SEQ ID NO: 158465 - DNA, 25 bp, E. coli
tatgaccagagggaagcagaagagc

SEQ ID NO: 158466 - DNA, 25 bp, E. coli
tatgaccagaggcaagcagaagagc

SEQ ID NO: 158467 - DNA, 25 bp, E. coli
ttacgcagcatgaagaaatccgggc

SEQ ID NO: 158468 - DNA, 25 bp, E. coli
ttctccggcaaacgtacgaaggacg

SEQ ID NO: 158469 - DNA, 25 bp, E. coli
ttctccggcaaaggtacgaaggacg

SEQ ID NO: 158470 - DNA, 25 bp, E. coli
ttacgcagcatgtagaaatccgggc

SEQ ID NO: 158471 - DNA, 25 bp, E. coli
gcagttaatgagcttttacgcagca

SEQ ID NO: 158472 - DNA, 25 bp, E. coli
gcagttaatgaggttttacgcagca

SEQ ID NO: 158473 - DNA, 25 bp, E. coli
gaatgtttaaatggtactcacccgg

SEQ ID NO: 158474 - DNA, 25 bp, E. coli
gaatgtttaaatcgtactcacccgg

SEQ ID NO: 158475 - DNA, 25 bp, E. coli
gaaacgtattgcaggttggttagcc

SEQ ID NO: 158476 - DNA, 25 bp, E. coli
gaaacgtattgctggttggttagcc

SEQ ID NO: 158477 - DNA, 25 bp, E. coli
ctggaaaaaccggaacttgaggcat

SEQ ID NO: 158478 - DNA, 25 bp, E. coli
cattgtacagactcagaggcgttga

SEQ ID NO: 158479 - DNA, 25 bp, E. coli
ctggaaaaaccgcaacttgaggcat

SEQ ID NO: 158480 - DNA, 25 bp, E. coli
cattgtacagacacagaggcgttga

SEQ ID NO: 158481 - DNA, 25 bp, E. coli
gttagccgtggctgaacacatgctt

SEQ ID NO: 158482 - DNA, 25 bp, E. coli
gttagccgtggcagaacacatgctt

SEQ ID NO: 158483 - DNA, 25 bp, E. coli
aattgtggtttcaccggacatcggc

SEQ ID NO: 158484 - DNA, 25 bp, E. coli
aattgtggtttctccggacatcggc

SEQ ID NO: 158485 - DNA, 25 bp, E. coli
tatggcaatcatcgacaaacgtcgt

SEQ ID NO: 158486 - DNA, 25 bp, E. coli
tatggcaatcatggacaaacgtcgt

SEQ ID NO: 158487 - DNA, 25 bp, E. coli
tatcccctacttaggctatgcgcgc

SEQ ID NO: 158488 - DNA, 25 bp, E. coli
tatcccctactttggctatgcgcgc

SEQ ID NO: 158489 - DNA, 25 bp, E. coli
tgaaatcaaatctctgccgaacgtg

SEQ ID NO: 158490 - DNA, 25 bp, E. coli
tgaaatcaaatcactgccgaacgtg

SEQ ID NO: 158491 - DNA, 25 bp, E. coli
gattcagggtttgttcgacgttccg

SEQ ID NO: 158492 - DNA, 25 bp, E. coli
gctaagctgctgtacgataccgata

SEQ ID NO: 158493 - DNA, 25 bp, E. coli
gattcagggtttcttcgacgttccg

SEQ ID NO: 158494 - DNA, 25 bp, E. coli
gctaagctgctgaacgataccgata

SEQ ID NO: 158495 - DNA, 25 bp, E. coli
gacagtggatctccacgctgaacag

SEQ ID NO: 158496 - DNA, 25 bp, E. coli
gacagtggatctgcacgctgaacag

SEQ ID NO: 158497 - DNA, 25 bp, E. coli
cgatcctgctggtagacatgctgca

SEQ ID NO: 158498 - DNA, 25 bp, E. coli
cgatcctgctggaagacatgctgca

SEQ ID NO: 158499 - DNA, 25 bp, E. coli
gatatgatcgactctggcggtacgc

SEQ ID NO: 158500 - DNA, 25 bp, E. coli
gatatgatcgacactggcggtacgc

SEQ ID NO: 158501 - DNA, 25 bp, E. coli
taacgtatttggaagcccgatcctg

SEQ ID NO: 158502 - DNA, 25 bp, E. coli
taacgtatttggtagcccgatcctg

SEQ ID NO: 158503 - DNA, 25 bp, E. coli
gaccctgtcaggaatgctggccgaa

SEQ ID NO: 158504 - DNA, 25 bp, E. coli
gaccctgtcaggtatgctggccgaa

SEQ ID NO: 158505 - DNA, 25 bp, E. coli
cagatcgtgaatctaaagggttaca

SEQ ID NO: 158506 - DNA, 25 bp, E. coli
catgtttcaacccttcagatcgtga

SEQ ID NO: 158507 - DNA, 25 bp, E. coli
catgtttcaaccgttcagatcgtga

SEQ ID NO: 158508 - DNA, 25 bp, E. coli
cagatcgtgaatgtaaagggttaca

SEQ ID NO: 158509 - DNA, 25 bp, E. coli
tatattatcaacaagaccagacact

SEQ ID NO: 158510 - DNA, 25 bp, E. coli
tatattatcaactagaccagacact

SEQ ID NO: 158511 - DNA, 25 bp, E. coli
tgttcctcacatgcacacattggta

SEQ ID NO: 158512 - DNA, 25 bp, E. coli
tgttcctcacatccacacattggta

SEQ ID NO: 158513 - DNA, 25 bp, E. coli
gaatagataagaaagcgtaaccgcg

SEQ ID NO: 158514 - DNA, 25 bp, E. coli
gaatagataagatagcgtaaccgcg

SEQ ID NO: 158515 - DNA, 25 bp, E. coli
gacaaaacacgacgtaaggcgcaat

SEQ ID NO: 158516 - DNA, 25 bp, E. coli
gacaaaacacgaggtaaggcgcaat

SEQ ID NO: 158517 - DNA, 25 bp, E. coli
gattaagtagccagatatgtgttac

SEQ ID NO: 158518 - DNA, 25 bp, E. coli
gattaagtagcctgatatgtgttac

SEQ ID NO: 158519 - DNA, 25 bp, E. coli
ggttaatctttgtacgtatgtcatg

SEQ ID NO: 158520 - DNA, 25 bp, E. coli
ggttaatctttgaacgtatgtcatg

SEQ ID NO: 158521 - DNA, 25 bp, E. coli
taaggcgcaatacccagttattaga

SEQ ID NO: 158522 - DNA, 25 bp, E. coli
taactaacaagcaaaccttcaaacg

SEQ ID NO: 158523 - DNA, 25 bp, E. coli
taaggcgcaatagccagttattaga

SEQ ID NO: 158524 - DNA, 25 bp, E. coli
taactaacaagctaaccttcaaacg

SEQ ID NO: 158525 - DNA, 25 bp, E. coli
gaccagacacttatagaattagtga

SEQ ID NO: 158526 - DNA, 25 bp, E. coli
gaccagacacttttagaattagtga

SEQ ID NO: 158527 - DNA, 25 bp, E. coli
agaagatgctgacccgctaataaat

SEQ ID NO: 158528 - DNA, 25 bp, E. coli
agatgagtgtattgatgagcggaaa

SEQ ID NO: 158529 - DNA, 25 bp, E. coli
agaagatgctgagccgctaataaat

SEQ ID NO: 158530 - DNA, 25 bp, E. coli
agatgagtgtatagatgagcggaaa

SEQ ID NO: 158531 - DNA, 25 bp, E. coli
tattgatgagcggaaattacgaggt

SEQ ID NO: 158532 - DNA, 25 bp, E. coli
tattgatgagcgcaaattacgaggt

SEQ ID NO: 158533 - DNA, 25 bp, E. coli
tgcgttgatttatataagagatgag

SEQ ID NO: 158534 - DNA, 25 bp, E. coli
tgctgacccgctaataaatgatgcg

SEQ ID NO: 158535 - DNA, 25 bp, E. coli
tgcgttgatttaaataagagatgag

SEQ ID NO: 158536 - DNA, 25 bp, E. coli
tgctgacccgcttataaatgatgcg

SEQ ID NO: 158537 - DNA, 25 bp, E. coli
gcaatttttaatggtgaactacaga

SEQ ID NO: 158538 - DNA, 25 bp, E. coli
gcaatttttaatcgtgaactacaga

SEQ ID NO: 158539 - DNA, 25 bp, E. coli
gaatcacctgaaactgtaatagcaa

SEQ ID NO: 158540 - DNA, 25 bp, E. coli
gaatcacctgaatctgtaatagcaa

SEQ ID NO: 158541 - DNA, 25 bp, E. coli
gaactacagaatttattcaaccaag

SEQ ID NO: 158542 - DNA, 25 bp, E. coli
gaactacagaatatattcaaccaag

SEQ ID NO: 158543 - DNA, 25 bp, E. coli
cccgctaataaaagatgcgttgatt

SEQ ID NO: 158544 - DNA, 25 bp, E. coli
cccgctaataaatgatgcgttgatt

SEQ ID NO: 158545 - DNA, 25 bp, E. coli
cggaaattacgacgtgaatcacctg

SEQ ID NO: 158546 - DNA, 25 bp, E. coli
cggaaattacgaggtgaatcacctg

SEQ ID NO: 158547 - DNA, 25 bp, E. coli
gatccgttttccttcagacttgaga

SEQ ID NO: 158548 - DNA, 25 bp, E. coli
gatccgttttccatcagacttgaga

SEQ ID NO: 158549 - DNA, 25 bp, E. coli
tacatctaagcactcatggcattac

SEQ ID NO: 158550 - DNA, 25 bp, E. coli
tacatctaagcagtcatggcattac

SEQ ID NO: 158551 - DNA, 25 bp, E. coli
aaagagtcgggtgtctctgtatccc

SEQ ID NO: 158552 - DNA, 25 bp, E. coli
aaagagtcgggtctctctgtatccc

SEQ ID NO: 158553 - DNA, 25 bp, E. coli
tccttgaaagattaaaagagtcggg

SEQ ID NO: 158554 - DNA, 25 bp, E. coli
tgcgaatgccgtcaagcgagtccac

SEQ ID NO: 158555 - DNA, 25 bp, E. coli
tgcgaatgccgtgaagcgagtccac

SEQ ID NO: 158556 - DNA, 25 bp, E. coli
tccttgaaagataaaaagagtcggg

SEQ ID NO: 158557 - DNA, 25 bp, E. coli
gccgatatacactacttcaacctga

SEQ ID NO: 158558 - DNA, 25 bp, E. coli
cctgactttatccttgtcgatagcg

SEQ ID NO: 158559 - DNA, 25 bp, E. coli
gccgatatacacaacttcaacctga

SEQ ID NO: 158560 - DNA, 25 bp, E. coli
cctgactttatcgttgtcgatagcg

SEQ ID NO: 158561 - DNA, 25 bp, E. coli
cgatagcgttaatgcgaatgccgtg

SEQ ID NO: 158562 - DNA, 25 bp, E. coli
cgatagcgttaaagcgaatgccgtg

SEQ ID NO: 158563 - DNA, 25 bp, E. coli
gtatcccggcattatccatcatata

SEQ ID NO: 158564 - DNA, 25 bp, E. coli
gtatcccggcataatccatcatata

SEQ ID NO: 158565 - DNA, 25 bp, E. coli
ggcattacattctgttaaacctaag

SEQ ID NO: 158566 - DNA, 25 bp, E. coli
ggcattacattcagttaaacctaag

SEQ ID NO: 158567 - DNA, 25 bp, E. coli
taacgccaaaaagtaagcaatgaca

SEQ ID NO: 158568 - DNA, 25 bp, E. coli
taacgccaaaaactaagcaatgaca

SEQ ID NO: 158569 - DNA, 25 bp, E. coli
gagtccacggcattgcctgacgctt

SEQ ID NO: 158570 - DNA, 25 bp, E. coli
gagtccacggcaatgcctgacgctt

SEQ ID NO: 158571 - DNA, 25 bp, E. coli
aatatcttacatttatgtgtgacct

SEQ ID NO: 158572 - DNA, 25 bp, E. coli
aatatcttacatatatgtgtgacct

SEQ ID NO: 158573 - DNA, 25 bp, E. coli
catatatgtgtgacctcaaaatggt

SEQ ID NO: 158574 - DNA, 25 bp, E. coli
catatatgtgtgtcctcaaaatggt

SEQ ID NO: 158575 - DNA, 25 bp, E. coli
tacatatatgtgagacctcaaaatg

SEQ ID NO: 158576 - DNA, 25 bp, E. coli
tacatatatgtgtgacctcaaaatg

SEQ ID NO: 158577 - DNA, 25 bp, E. coli
atatatgtgtgacctcaaaatggtt

SEQ ID NO: 158578 - DNA, 25 bp, E. coli
atcttacatataagtgtgacctcaa

SEQ ID NO: 158579 - DNA, 25 bp, E. coli
atcttacatatatgtgtgacctcaa

SEQ ID NO: 158580 - DNA, 25 bp, E. coli
atatatgtgtgagctcaaaatggtt

SEQ ID NO: 158581 - DNA, 25 bp, E. coli
acatatatgtgtgacctcaaaatgg

SEQ ID NO: 158582 - DNA, 25 bp, E. coli
acatatatgtgtcacctcaaaatgg

SEQ ID NO: 158583 - DNA, 25 bp, E. coli
tatcttacatatttgtgtgacctca

SEQ ID NO: 158584 - DNA, 25 bp, E. coli
tatcttacatatatgtgtgacctca

SEQ ID NO: 158585 - DNA, 25 bp, E. coli
ttacatatatgtgtgacctcaaaat

SEQ ID NO: 158586 - DNA, 25 bp, E. coli
ttacatatatgtctgacctcaaaat

SEQ ID NO: 158587 - DNA, 25 bp, E. coli
tcttacatatatgtgtgacctcaaa

SEQ ID NO: 158588 - DNA, 25 bp, E. coli
tcttacatatatctgtgacctcaaa

SEQ ID NO: 158589 - DNA, 25 bp, E. coli
gaatatcttacatatatgtgtgacc

SEQ ID NO: 158590 - DNA, 25 bp, E. coli
gaatatcttacaaatatgtgtgacc

SEQ ID NO: 158591 - DNA, 25 bp, E. coli
cttacatatatgtgtgacctcaaaa

SEQ ID NO: 158592 - DNA, 25 bp, E. coli
cttacatatatgagtgacctcaaaa

SEQ ID NO: 158593 - DNA, 25 bp, E. coli
tacaccgggaaaaaggtgcgccgca

SEQ ID NO: 158594 - DNA, 25 bp, E. coli
tacaccgggaaataggtgcgccgca

SEQ ID NO: 158595 - DNA, 25 bp, E. coli
tacaccttaggtgatggcttcagcg

SEQ ID NO: 158596 - DNA, 25 bp, E. coli
taagcgtaacgcagtcggaagaggc

SEQ ID NO: 158597 - DNA, 25 bp, E. coli
taagcgtaacgctgtcggaagaggc

SEQ ID NO: 158598 - DNA, 25 bp, E. coli
tattccgattactgcgacggtgccg

SEQ ID NO: 158599 - DNA, 25 bp, E. coli
tataaccgggtgagtgatgccatcc

SEQ ID NO: 158600 - DNA, 25 bp, E. coli
tataaccgggtgtgtgatgccatcc

SEQ ID NO: 158601 - DNA, 25 bp, E. coli
tatttgcaagtcagcggtagccagc

SEQ ID NO: 158602 - DNA, 25 bp, E. coli
tattccgattacagcgacggtgccg

SEQ ID NO: 158603 - DNA, 25 bp, E. coli
tatttgcaagtctgcggtagccagc

SEQ ID NO: 158604 - DNA, 25 bp, E. coli
tcaaaccgtgggagccgttaagcgt

SEQ ID NO: 158605 - DNA, 25 bp, E. coli
tcaaaccgtgggtgccgttaagcgt

SEQ ID NO: 158606 - DNA, 25 bp, E. coli
tgacggttcacataaagccgccggt

SEQ ID NO: 158607 - DNA, 25 bp, E. coli
tgacggttcacaaaaagccgccggt

SEQ ID NO: 158608 - DNA, 25 bp, E. coli
gctcaggcattaagtgtcgtccccg

SEQ ID NO: 158609 - DNA, 25 bp, E. coli
gctcaggcattatgtgtcgtccccg

SEQ ID NO: 158610 - DNA, 25 bp, E. coli
cattcaaaatcagaacagcggcacg

SEQ ID NO: 158611 - DNA, 25 bp, E. coli
cattcaaaatcacaacagcggcacg

SEQ ID NO: 158612 - DNA, 25 bp, E. coli
tacaccttaggtcatggcttcagcg

SEQ ID NO: 158613 - DNA, 25 bp, E. coli
taactggaaagaagacgtacaccgg

SEQ ID NO: 158614 - DNA, 25 bp, E. coli
taactggaaagatgacgtacaccgg

SEQ ID NO: 158615 - DNA, 25 bp, E. coli
taaaaaagcggattactcaaacgtg

SEQ ID NO: 158616 - DNA, 25 bp, E. coli
taaaaaagcggaatactcaaacgtg

SEQ ID NO: 158617 - DNA, 25 bp, E. coli
agacaaagcaactgatggcgtcccg

SEQ ID NO: 158618 - DNA, 25 bp, E. coli
gatggttttccatcaaccctttacg

SEQ ID NO: 158619 - DNA, 25 bp, E. coli
gatggttttccaacaaccctttacg

SEQ ID NO: 158620 - DNA, 25 bp, E. coli
agacaaagcaacagatggcgtcccg

SEQ ID NO: 158621 - DNA, 25 bp, E. coli
aaagcaacagatggcgtcccgcgcg

SEQ ID NO: 158622 - DNA, 25 bp, E. coli
aaagcaacagatcgcgtcccgcgcg

SEQ ID NO: 158623 - DNA, 25 bp, E. coli
ttatgagacaaaccaacagatggcg

SEQ ID NO: 158624 - DNA, 25 bp, E. coli
ttatgagacaaagcaacagatggcg

SEQ ID NO: 158625 - DNA, 25 bp, E. coli
tccatcaaccctttacggtgggatt

SEQ ID NO: 158626 - DNA, 25 bp, E. coli
tccatcaaccctatacggtgggatt

SEQ ID NO: 158627 - DNA, 25 bp, E. coli
ccagtcactctttcgctggatatag

SEQ ID NO: 158628 - DNA, 25 bp, E. coli
ccagtcactcttacgctggatatag

SEQ ID NO: 158629 - DNA, 25 bp, E. coli
gctgctgccagtgactcttacgctg

SEQ ID NO: 158630 - DNA, 25 bp, E. coli
gctgctgccagtcactcttacgctg

SEQ ID NO: 158631 - DNA, 25 bp, E. coli
ctttacggtgggtttttatgagaca

SEQ ID NO: 158632 - DNA, 25 bp, E. coli
cggcctcgttaatgcgctgctgcca

SEQ ID NO: 158633 - DNA, 25 bp, E. coli
ctttacggtgggattttatgagaca

SEQ ID NO: 158634 - DNA, 25 bp, E. coli
cggcctcgttaaagcgctgctgcca

SEQ ID NO: 158635 - DNA, 25 bp, E. coli
gattactcaaacgtgatggttttcc

SEQ ID NO: 158636 - DNA, 25 bp, E. coli
gattactcaaacctgatggttttcc

SEQ ID NO: 158637 - DNA, 25 bp, E. coli
caaacaagggagcgctcttgggatt

SEQ ID NO: 158638 - DNA, 25 bp, E. coli
caaaagccaaactagggagcgctct

SEQ ID NO: 158639 - DNA, 25 bp, E. coli
caaaagccaaacaagggagcgctct

SEQ ID NO: 158640 - DNA, 25 bp, E. coli
caaacaagggagggctcttgggatt

SEQ ID NO: 158641 - DNA, 25 bp, E. coli
agccaaacaaggcagcgctcttggg

SEQ ID NO: 158642 - DNA, 25 bp, E. coli
agccaaacaagggagcgctcttggg

SEQ ID NO: 158643 - DNA, 25 bp, E. coli
aaagccaaacaagggagcgctcttg

SEQ ID NO: 158644 - DNA, 25 bp, E. coli
aaagccaaacaacggagcgctcttg

SEQ ID NO: 158645 - DNA, 25 bp, E. coli
aaaagccaaacatgggagcgctctt

SEQ ID NO: 158646 - DNA, 25 bp, E. coli
aaaagccaaacaagggagcgctctt

SEQ ID NO: 158647 - DNA, 25 bp, E. coli
tttccaaaagccaaacaagggagcg

SEQ ID NO: 158648 - DNA, 25 bp, E. coli
tttccaaaagcctaacaagggagcg

SEQ ID NO: 158649 - DNA, 25 bp, E. coli
ttccaaaagccatacaagggagcgc

SEQ ID NO: 158650 - DNA, 25 bp, E. coli
ttccaaaagccaaacaagggagcgc

SEQ ID NO: 158651 - DNA, 25 bp, E. coli
tccaaaagccaatcaagggagcgct

SEQ ID NO: 158652 - DNA, 25 bp, E. coli
tccaaaagccaaacaagggagcgct

SEQ ID NO: 158653 - DNA, 25 bp, E. coli
ccaaacaagggagcgctcttgggat

SEQ ID NO: 158654 - DNA, 25 bp, E. coli
ccaaaagccaaagaagggagcgctc

SEQ ID NO: 158655 - DNA, 25 bp, E. coli
ccaaaagccaaacaagggagcgctc

SEQ ID NO: 158656 - DNA, 25 bp, E. coli
gccaaacaagggagcgctcttggga

SEQ ID NO: 158657 - DNA, 25 bp, E. coli
gccaaacaagggtgcgctcttggga

SEQ ID NO: 158658 - DNA, 25 bp, E. coli
ccaaacaagggaccgctcttgggat

SEQ ID NO: 158659 - DNA, 25 bp, E. coli
aatgtgctcacagcccgcaggtgat

SEQ ID NO: 158660 - DNA, 25 bp, E. coli
aatgtgctcacaccccgcaggtgat

SEQ ID NO: 158661 - DNA, 25 bp, E. coli
catgtctggcatttacgctgtacgg

SEQ ID NO: 158662 - DNA, 25 bp, E. coli
catgtctggcatatacgctgtacgg

SEQ ID NO: 158663 - DNA, 25 bp, E. coli
tacgctgtacggtcaccttaaaagg

SEQ ID NO: 158664 - DNA, 25 bp, E. coli
tacgctgtacggacaccttaaaagg

SEQ ID NO: 158665 - DNA, 25 bp, E. coli
tgttaaatctcatcgccgacgatcg

SEQ ID NO: 158666 - DNA, 25 bp, E. coli
tgttaaatctcaacgccgacgatcg

SEQ ID NO: 158667 - DNA, 25 bp, E. coli
tgaaatctgcccaataccggaagtg

SEQ ID NO: 158668 - DNA, 25 bp, E. coli
tgaaatctgccctataccggaagtg

SEQ ID NO: 158669 - DNA, 25 bp, E. coli
tctcacgtctctctgggccgggaaa

SEQ ID NO: 158670 - DNA, 25 bp, E. coli
tctcacgtctctgtgggccgggaaa

SEQ ID NO: 158671 - DNA, 25 bp, E. coli
gcgcagccgcacagcattaatctga

SEQ ID NO: 158672 - DNA, 25 bp, E. coli
gcgagagctataacaacgccacggg

SEQ ID NO: 158673 - DNA, 25 bp, E. coli
gcgcagccgcactgcattaatctga

SEQ ID NO: 158674 - DNA, 25 bp, E. coli
gcgagagctatatcaacgccacggg

SEQ ID NO: 158675 - DNA, 25 bp, E. coli
gaagatttggtcgactctgcgcagc

SEQ ID NO: 158676 - DNA, 25 bp, E. coli
gaagatttggtccactctgcgcagc

SEQ ID NO: 158677 - DNA, 25 bp, E. coli
cgtaccattggctatggcgagagct

SEQ ID NO: 158678 - DNA, 25 bp, E. coli
cgtaccattggcaatggcgagagct

SEQ ID NO: 158679 - DNA, 25 bp, E. coli
gaggcgatcttcagcggattatggc

SEQ ID NO: 158680 - DNA, 25 bp, E. coli
gaggcgatcttctgcggattatggc

SEQ ID NO: 158681 - DNA, 25 bp, E. coli
cacctgcaattcattgcatctagcg

SEQ ID NO: 158682 - DNA, 25 bp, E. coli
cacctgcaattctttgcatctagcg

SEQ ID NO: 158683 - DNA, 25 bp, E. coli
catctagcgtttgacctctgcggag

SEQ ID NO: 158684 - DNA, 25 bp, E. coli
catctagcgtttcacctctgcggag

SEQ ID NO: 158685 - DNA, 25 bp, E. coli
aaactctcttctcccttcacagatg

SEQ ID NO: 158686 - DNA, 25 bp, E. coli
aaactctcttctgccttcacagatg

SEQ ID NO: 158687 - DNA, 25 bp, E. coli
ttcacagatgcagaaatgcacctgc

SEQ ID NO: 158688 - DNA, 25 bp, E. coli
ttcacagatgcacaaatgcacctgc

SEQ ID NO: 158689 - DNA, 25 bp, E. coli
tccggtgacttctgcgctaaacggg

SEQ ID NO: 158690 - DNA, 25 bp, E. coli
tccggtgacttcagcgctaaacggg

SEQ ID NO: 158691 - DNA, 25 bp, E. coli
gcataattatgtcaccggagcctga

SEQ ID NO: 158692 - DNA, 25 bp, E. coli
gcgcacatacaaaccaaactctctt

SEQ ID NO: 158693 - DNA, 25 bp, E. coli
gcgcacatacaatccaaactctctt

SEQ ID NO: 158694 - DNA, 25 bp, E. coli
gcataattatgtgaccggagcctga

SEQ ID NO: 158695 - DNA, 25 bp, E. coli
gaaggagcaattctatcgattttga

SEQ ID NO: 158696 - DNA, 25 bp, E. coli
gaaggagcaattgtatcgattttga

SEQ ID NO: 158697 - DNA, 25 bp, E. coli
gacgtttatgcggacatacaatcca

SEQ ID NO: 158698 - DNA, 25 bp, E. coli
gacgtttatgcgcacatacaatcca

SEQ ID NO: 158699 - DNA, 25 bp, E. coli
gattttgggaaatcaacacggcata

SEQ ID NO: 158700 - DNA, 25 bp, E. coli
gattttgggaaaacaacacggcata

SEQ ID NO: 158701 - DNA, 25 bp, E. coli
ggagcctgaacaactccggtgactt

SEQ ID NO: 158702 - DNA, 25 bp, E. coli
ggagcctgaacatctccggtgactt

SEQ ID NO: 158703 - DNA, 25 bp, E. coli
caaaaactcacagcgggcttctagc

SEQ ID NO: 158704 - DNA, 25 bp, E. coli
caaaaactcacaccgggcttctagc

SEQ ID NO: 158705 - DNA, 25 bp, E. coli
acgccaacggcatggtgtatcaggg

SEQ ID NO: 158706 - DNA, 25 bp, E. coli
acgccaacggcaaggtgtatcaggg

SEQ ID NO: 158707 - DNA, 25 bp, E. coli
tagccagtaaagttaaaacccgacg

SEQ ID NO: 158708 - DNA, 25 bp, E. coli
tagccagtaaagataaaacccgacg

SEQ ID NO: 158709 - DNA, 25 bp, E. coli
tgaaaaagacaataactcacaccgg

SEQ ID NO: 158710 - DNA, 25 bp, E. coli
tgaaaaagacaaaaactcacaccgg

SEQ ID NO: 158711 - DNA, 25 bp, E. coli
tctacgaaacgccaacggcatggtg

SEQ ID NO: 158712 - DNA, 25 bp, E. coli
tctacgaaacgcgaacggcatggtg

SEQ ID NO: 158713 - DNA, 25 bp, E. coli
gacgtgtcagccactacgaaacgcc

SEQ ID NO: 158714 - DNA, 25 bp, E. coli
gacgtgtcagcctctacgaaacgcc

SEQ ID NO: 158715 - DNA, 25 bp, E. coli
cgggcttctagccagtaaagataaa

SEQ ID NO: 158716 - DNA, 25 bp, E. coli
cgggcttctagcgagtaaagataaa

SEQ ID NO: 158717 - DNA, 25 bp, E. coli
gataaaacccgacgtgtcagcctct

SEQ ID NO: 158718 - DNA, 25 bp, E. coli
gtaaagataaaacccgacgtgtcag

SEQ ID NO: 158719 - DNA, 25 bp, E. coli
gataaaacccgaggtgtcagcctct

SEQ ID NO: 158720 - DNA, 25 bp, E. coli
gtaaagataaaagccgacgtgtcag

SEQ ID NO: 158721 - DNA, 25 bp, E. coli
ggcaggagtgcttcagcaaaagtac

SEQ ID NO: 158722 - DNA, 25 bp, E. coli
ggcaggagtgctacagcaaaagtac

SEQ ID NO: 158723 - DNA, 25 bp, E. coli
tcacaccgggcttctagccagtaaa

SEQ ID NO: 158724 - DNA, 25 bp, E. coli
tcacaccgggctactagccagtaaa

SEQ ID NO: 158725 - DNA, 25 bp, E. coli
cagacgtttgtcgtgttgtgtgcct

SEQ ID NO: 158726 - DNA, 25 bp, E. coli
cagacgtttgtcctgttgtgtgcct

SEQ ID NO: 158727 - DNA, 25 bp, E. coli
atgctcggtagcgagacgtttgtcg

SEQ ID NO: 158728 - DNA, 25 bp, E. coli
agactgcggtcaagctcggtagcca

SEQ ID NO: 158729 - DNA, 25 bp, E. coli
atgctcggtagccagacgtttgtcg

SEQ ID NO: 158730 - DNA, 25 bp, E. coli
agactgcggtcatgctcggtagcca

SEQ ID NO: 158731 - DNA, 25 bp, E. coli
ttatttcgccacatgccattatcca

SEQ ID NO: 158732 - DNA, 25 bp, E. coli
ttatttcgccacttgccattatcca

SEQ ID NO: 158733 - DNA, 25 bp, E. coli
ttgtgcacaccttatgaaaacgact

SEQ ID NO: 158734 - DNA, 25 bp, E. coli
ttgtgcacacctaatgaaaacgact

SEQ ID NO: 158735 - DNA, 25 bp, E. coli
tgttgtgtgcctccgcaatattacg

SEQ ID NO: 158736 - DNA, 25 bp, E. coli
tgttgtgtgcctgcgcaatattacg

SEQ ID NO: 158737 - DNA, 25 bp, E. coli
tcttttttacagtctgcggtcatgc

SEQ ID NO: 158738 - DNA, 25 bp, E. coli
tcttttttacagactgcggtcatgc

SEQ ID NO: 158739 - DNA, 25 bp, E. coli
ggagcttctttgatttcccgctaaa

SEQ ID NO: 158740 - DNA, 25 bp, E. coli
ggtgctgatttcgtttagcgtttgc

SEQ ID NO: 158741 - DNA, 25 bp, E. coli
ggtatttgattggtcgcccgcagcc

SEQ ID NO: 158742 - DNA, 25 bp, E. coli
ggtgctgatttcctttagcgtttgc

SEQ ID NO: 158743 - DNA, 25 bp, E. coli
ggtatttgattgctcgcccgcagcc

SEQ ID NO: 158744 - DNA, 25 bp, E. coli
tggcagcgttaaccgtgctgctact

SEQ ID NO: 158745 - DNA, 25 bp, E. coli
ggagcttctttgttttcccgctaaa

SEQ ID NO: 158746 - DNA, 25 bp, E. coli
tggcagcgttaagcgtgctgctact

SEQ ID NO: 158747 - DNA, 25 bp, E. coli
caaagcttaacggtcaggcaggagt

SEQ ID NO: 158748 - DNA, 25 bp, E. coli
caaagcttaacgctcaggcaggagt

SEQ ID NO: 158749 - DNA, 25 bp, E. coli
caggagtgaggcaagtcttgatagt

SEQ ID NO: 158750 - DNA, 25 bp, E. coli
caggagtgaggctagtcttgatagt

SEQ ID NO: 158751 - DNA, 25 bp, E. coli
tatgtttaaacggaaagcttaacgg

SEQ ID NO: 158752 - DNA, 25 bp, E. coli
tatgtttaaacgcaaagcttaacgg

SEQ ID NO: 158753 - DNA, 25 bp, E. coli
tagccctctggtatgatgagtccaa

SEQ ID NO: 158754 - DNA, 25 bp, E. coli
tagccctctggtttgatgagtccaa

SEQ ID NO: 158755 - DNA, 25 bp, E. coli
ttctttttgtctcctatcagcgtag

SEQ ID NO: 158756 - DNA, 25 bp, E. coli
ttctttttgtctgctatcagcgtag

SEQ ID NO: 158757 - DNA, 25 bp, E. coli
tgaggcaagtctagatagtcaaggg

SEQ ID NO: 158758 - DNA, 25 bp, E. coli
tgatgagtccaactttgttttgctg

SEQ ID NO: 158759 - DNA, 25 bp, E. coli
tgatgagtccaagtttgttttgctg

SEQ ID NO: 158760 - DNA, 25 bp, E. coli
tgaggcaagtcttgatagtcaaggg

SEQ ID NO: 158761 - DNA, 25 bp, E. coli
gctatcagcgtacttagccctctgg

SEQ ID NO: 158762 - DNA, 25 bp, E. coli
gcggaaaatgaagccttgatccctt

SEQ ID NO: 158763 - DNA, 25 bp, E. coli
gctatcagcgtagttagccctctgg

SEQ ID NO: 158764 - DNA, 25 bp, E. coli
gcggaaaatgaacccttgatccctt

SEQ ID NO: 158765 - DNA, 25 bp, E. coli
gaaagagatgcggaaaatgaagcct

SEQ ID NO: 158766 - DNA, 25 bp, E. coli
gaaagagatgcgcaaaatgaagcct

SEQ ID NO: 158767 - DNA, 25 bp, E. coli
gttttgctgtgttatggaaatctca

SEQ ID NO: 158768 - DNA, 25 bp, E. coli
gttttgctgtgtaatggaaatctca

SEQ ID NO: 158769 - DNA, 25 bp, E. coli
cataacctgctgagggtgacgctgg

SEQ ID NO: 158770 - DNA, 25 bp, E. coli
cataacctgctgtgggtgacgctgg

SEQ ID NO: 158771 - DNA, 25 bp, E. coli
tagataccagcaacgttcactccgt

SEQ ID NO: 158772 - DNA, 25 bp, E. coli
tagataccagcatcgttcactccgt

SEQ ID NO: 158773 - DNA, 25 bp, E. coli
tattggtatgctacgccgaaagcga

SEQ ID NO: 158774 - DNA, 25 bp, E. coli
tattggtatgcttcgccgaaagcga

SEQ ID NO: 158775 - DNA, 25 bp, E. coli
gcaaacctggctgggtaacctggtc

SEQ ID NO: 158776 - DNA, 25 bp, E. coli
gcaaacctggctcggtaacctggtc

SEQ ID NO: 158777 - DNA, 25 bp, E. coli
gcaaatgtgggcaatcctgccgcaa

SEQ ID NO: 158778 - DNA, 25 bp, E. coli
gcaaatgtgggctatcctgccgcaa

SEQ ID NO: 158779 - DNA, 25 bp, E. coli
catttatcgcgtccggctacgagca

SEQ ID NO: 158780 - DNA, 25 bp, E. coli
catttatcgcgtgcggctacgagca

SEQ ID NO: 158781 - DNA, 25 bp, E. coli
ctggcaatctggttggcgctgcgca

SEQ ID NO: 158782 - DNA, 25 bp, E. coli
ctggcaatctggatggcgctgcgca

SEQ ID NO: 158783 - DNA, 25 bp, E. coli
tggttcggcaacgacagcgaagcct

SEQ ID NO: 158784 - DNA, 25 bp, E. coli
ggctaaaaccacagcaccggcaatg

SEQ ID NO: 158785 - DNA, 25 bp, E. coli
ggctaaaaccactgcaccggcaatg

SEQ ID NO: 158786 - DNA, 25 bp, E. coli
tggttcggcaaccacagcgaagcct

SEQ ID NO: 158787 - DNA, 25 bp, E. coli
taatcaaactgatacggctgccggt

SEQ ID NO: 158788 - DNA, 25 bp, E. coli
tcaaaggtgcattgtgtaactggct

SEQ ID NO: 158789 - DNA, 25 bp, E. coli
tcaaaggtgcatagtgtaactggct

SEQ ID NO: 158790 - DNA, 25 bp, E. coli
taatcaaactgaaacggctgccggt

SEQ ID NO: 158791 - DNA, 25 bp, E. coli
ttatgatcgggtcgccaaaatcgcc

SEQ ID NO: 158792 - DNA, 25 bp, E. coli
ttatgatcgggtggccaaaatcgcc

SEQ ID NO: 158793 - DNA, 25 bp, E. coli
tccaggcgcagggagaagtgcttta

SEQ ID NO: 158794 - DNA, 25 bp, E. coli
tccaggcgcaggcagaagtgcttta

SEQ ID NO: 158795 - DNA, 25 bp, E. coli
tctggtcagcggagcatctggcttc

SEQ ID NO: 158796 - DNA, 25 bp, E. coli
tctggtcagcggtgcatctggcttc

SEQ ID NO: 158797 - DNA, 25 bp, E. coli
gcaggtttaagtcagcaagcaggtt

SEQ ID NO: 158798 - DNA, 25 bp, E. coli
gcaggtttaagtgagcaagcaggtt

SEQ ID NO: 158799 - DNA, 25 bp, E. coli
gaatgaagtcgctccatatgccgcc

SEQ ID NO: 158800 - DNA, 25 bp, E. coli
gaatgaagtcgcaccatatgccgcc

SEQ ID NO: 158801 - DNA, 25 bp, E. coli
gaaaaagcgcgcctacactatgcca

SEQ ID NO: 158802 - DNA, 25 bp, E. coli
gaaaaagcgcgcgtacactatgcca

SEQ ID NO: 158803 - DNA, 25 bp, E. coli
cgccctgctgggtgaatatgacgcc

SEQ ID NO: 158804 - DNA, 25 bp, E. coli
cgccctgctgggagaatatgacgcc

SEQ ID NO: 158805 - DNA, 25 bp, E. coli
ctttaaagggatcgcagcacatgcc

SEQ ID NO: 158806 - DNA, 25 bp, E. coli
ctttaaagggatggcagcacatgcc

SEQ ID NO: 158807 - DNA, 25 bp, E. coli
gataacgtgcttccggcatcgactg

SEQ ID NO: 158808 - DNA, 25 bp, E. coli
gataacgtgcttgcggcatcgactg

SEQ ID NO: 158809 - DNA, 25 bp, E. coli
ggacacaatttggtgggaaccgccg

SEQ ID NO: 158810 - DNA, 25 bp, E. coli
ggacacaatttgctgggaaccgccg

SEQ ID NO: 158811 - DNA, 25 bp, E. coli
gatgccgtaacgatgatgaccactg

SEQ ID NO: 158812 - DNA, 25 bp, E. coli
gatgccgtaacgttgatgaccactg

SEQ ID NO: 158813 - DNA, 25 bp, E. coli
caaccacaggttattagcgccactg

SEQ ID NO: 158814 - DNA, 25 bp, E. coli
aaccacaggttattagcgccactgg

SEQ ID NO: 158815 - DNA, 25 bp, E. coli
aaccacaggttaatagcgccactgg

SEQ ID NO: 158816 - DNA, 25 bp, E. coli
caaccacaggtttttagcgccactg

SEQ ID NO: 158817 - DNA, 25 bp, E. coli
cacaggttattaccgccactggcgt

SEQ ID NO: 158818 - DNA, 25 bp, E. coli
cacaggttattagcgccactggcgt

SEQ ID NO: 158819 - DNA, 25 bp, E. coli
caggttattagcgccactggcgtgg

SEQ ID NO: 158820 - DNA, 25 bp, E. coli
caggttattagccccactggcgtgg

SEQ ID NO: 158821 - DNA, 25 bp, E. coli
accacaggttataagcgccactggc

SEQ ID NO: 158822 - DNA, 25 bp, E. coli
accacaggttattagcgccactggc

SEQ ID NO: 158823 - DNA, 25 bp, E. coli
acaaccacaggttattagcgccact

SEQ ID NO: 158824 - DNA, 25 bp, E. coli
acaaccacaggtaattagcgccact

SEQ ID NO: 158825 - DNA, 25 bp, E. coli
acaggttattagggccactggcgtg

SEQ ID NO: 158826 - DNA, 25 bp, E. coli
acaggttattagcgccactggcgtg

SEQ ID NO: 158827 - DNA, 25 bp, E. coli
ttattagcgccactggcgtggtaaa

SEQ ID NO: 158828 - DNA, 25 bp, E. coli
ttattagcgccagtggcgtggtaaa

SEQ ID NO: 158829 - DNA, 25 bp, E. coli
ccacaggttattagcgccactggcg

SEQ ID NO: 158830 - DNA, 25 bp, E. coli
ccacaggttatttgcgccactggcg

SEQ ID NO: 158831 - DNA, 25 bp, E. coli
gttattagcgccactggcgtggtaa

SEQ ID NO: 158832 - DNA, 25 bp, E. coli
gttattagcgcctctggcgtggtaa

SEQ ID NO: 158833 - DNA, 25 bp, E. coli
ggttattagcgccactggcgtggta

SEQ ID NO: 158834 - DNA, 25 bp, E. coli
ggttattagcgcgactggcgtggta

SEQ ID NO: 158835 - DNA, 25 bp, E. coli
cactgtgtggcggaaatcatggcaa

SEQ ID NO: 158836 - DNA, 25 bp, E. coli
cactgtgtggcgcaaatcatggcaa

SEQ ID NO: 158837 - DNA, 25 bp, E. coli
tgccttaattgccttgatgtcctcg

SEQ ID NO: 158838 - DNA, 25 bp, E. coli
tgccttaattgcgttgatgtcctcg

SEQ ID NO: 158839 - DNA, 25 bp, E. coli
gccgcgcaaatttatgacttagcaa

SEQ ID NO: 158840 - DNA, 25 bp, E. coli
gccgcgcaaattaatgacttagcaa

SEQ ID NO: 158841 - DNA, 25 bp, E. coli
gctgttcgcgccttagattcatgga

SEQ ID NO: 158842 - DNA, 25 bp, E. coli
gctgttcgcgccatagattcatgga

SEQ ID NO: 158843 - DNA, 25 bp, E. coli
gaagatttatgctcactgtgtggcg

SEQ ID NO: 158844 - DNA, 25 bp, E. coli
gaagatttatgcacactgtgtggcg

SEQ ID NO: 158845 - DNA, 25 bp, E. coli
cgagatgggtatagtgccgcgcaaa

SEQ ID NO: 158846 - DNA, 25 bp, E. coli
cgagatgggtattgtgccgcgcaaa

SEQ ID NO: 158847 - DNA, 25 bp, E. coli
gttacagaaatagcagccagaccct

SEQ ID NO: 158848 - DNA, 25 bp, E. coli
gttacagaaataccagccagaccct

SEQ ID NO: 158849 - DNA, 25 bp, E. coli
gataaaaagcgtagcgaggctgttc

SEQ ID NO: 158850 - DNA, 25 bp, E. coli
gataaaaagcgttgcgaggctgttc

SEQ ID NO: 158851 - DNA, 25 bp, E. coli
ggagatgattatggcctgttcaaca

SEQ ID NO: 158852 - DNA, 25 bp, E. coli
ggcaaagccgccatgatcgaatgta

SEQ ID NO: 158853 - DNA, 25 bp, E. coli
ggagatgattatcgcctgttcaaca

SEQ ID NO: 158854 - DNA, 25 bp, E. coli
ggcaaagccgccttgatcgaatgta

SEQ ID NO: 158855 - DNA, 25 bp, E. coli
tcaaaaggcgaattaccaggagtgc

SEQ ID NO: 158856 - DNA, 25 bp, E. coli
tcaaaaggcgaaataccaggagtgc

SEQ ID NO: 158857 - DNA, 25 bp, E. coli
caacgcgtgccggtgaaaacaggtt

SEQ ID NO: 158858 - DNA, 25 bp, E. coli
caatgacgacacactggatggcaac

SEQ ID NO: 158859 - DNA, 25 bp, E. coli
caatgacgacactctggatggcaac

SEQ ID NO: 158860 - DNA, 25 bp, E. coli
caacgcgtgccgctgaaaacaggtt

SEQ ID NO: 158861 - DNA, 25 bp, E. coli
caaactgaaaggtcatgcgcaacgc

SEQ ID NO: 158862 - DNA, 25 bp, E. coli
caaagccttgcatgacagtttcggg

SEQ ID NO: 158863 - DNA, 25 bp, E. coli
caaactgaaaggacatgcgcaacgc

SEQ ID NO: 158864 - DNA, 25 bp, E. coli
caaagccttgcaagacagtttcggg

SEQ ID NO: 158865 - DNA, 25 bp, E. coli
cagtttcgggattgaagtcggcacg

SEQ ID NO: 158866 - DNA, 25 bp, E. coli
cagtttcgggatagaagtcggcacg

SEQ ID NO: 158867 - DNA, 25 bp, E. coli
aaaacaggttcgctcactgaactgg

SEQ ID NO: 158868 - DNA, 25 bp, E. coli
aaaacaggttcggtcactgaactgg

SEQ ID NO: 158869 - DNA, 25 bp, E. coli
tgatcccggaactgagcggcaaact

SEQ ID NO: 158870 - DNA, 25 bp, E. coli
tgatcccggaacagagcggcaaact

SEQ ID NO: 158871 - DNA, 25 bp, E. coli
gaaaatatcattgcccacactacgg

SEQ ID NO: 158872 - DNA, 25 bp, E. coli
gaaaatatcattccccacactacgg

SEQ ID NO: 158873 - DNA, 25 bp, E. coli
ggtaaagatttaggtgcttcacgcg

SEQ ID NO: 158874 - DNA, 25 bp, E. coli
ggtaaagatttacgtgcttcacgcg

SEQ ID NO: 158875 - DNA, 25 bp, E. coli
ggcaaaagccataggtctggtgatc

SEQ ID NO: 158876 - DNA, 25 bp, E. coli
ggcaaaagccattggtctggtgatc

SEQ ID NO: 158877 - DNA, 25 bp, E. coli
gatggcaacgacaccattgtttccg

SEQ ID NO: 158878 - DNA, 25 bp, E. coli
gatggcaacgactccattgtttccg

SEQ ID NO: 158879 - DNA, 25 bp, E. coli
ttttccgaggtccttgttgcgaaga

SEQ ID NO: 158880 - DNA, 25 bp, E. coli
ttttccgaggtcgttgttgcgaaga

SEQ ID NO: 158881 - DNA, 25 bp, E. coli
ttgaaaccctgaaactgatccccat

SEQ ID NO: 158882 - DNA, 25 bp, E. coli
ttgaaaccctgatactgatccccat

SEQ ID NO: 158883 - DNA, 25 bp, E. coli
tccccataataaccgaagttagcga

SEQ ID NO: 158884 - DNA, 25 bp, E. coli
tccccataataagcgaagttagcga

SEQ ID NO: 158885 - DNA, 25 bp, E. coli
gaagttagcgagttgaatgcgaaaa

SEQ ID NO: 158886 - DNA, 25 bp, E. coli
gaagttagcgagatgaatgcgaaaa

SEQ ID NO: 158887 - DNA, 25 bp, E. coli
gacaatgtgagtgcttcccttgaaa

SEQ ID NO: 158888 - DNA, 25 bp, E. coli
gaaactgatcccgataataagcgaa

SEQ ID NO: 158889 - DNA, 25 bp, E. coli
gacaatgtgagtccttcccttgaaa

SEQ ID NO: 158890 - DNA, 25 bp, E. coli
gaaactgatccccataataagcgaa

SEQ ID NO: 158891 - DNA, 25 bp, E. coli
gattgatgacaaagtgagtgcttcc

SEQ ID NO: 158892 - DNA, 25 bp, E. coli
gattgatgacaatgtgagtgcttcc

SEQ ID NO: 158893 - DNA, 25 bp, E. coli
gtccttgttgcgtagattgatgaca

SEQ ID NO: 158894 - DNA, 25 bp, E. coli
gtccttgttgcgaagattgatgaca

SEQ ID NO: 158895 - DNA, 25 bp, E. coli
taagcgaagttagcgagatgaatgc

SEQ ID NO: 158896 - DNA, 25 bp, E. coli
taagcgaagttaccgagatgaatgc

SEQ ID NO: 158897 - DNA, 25 bp, E. coli
gatgaatgcgaataaaacgcggaga

SEQ ID NO: 158898 - DNA, 25 bp, E. coli
gatgaatgcgaaaaaaacgcggaga

SEQ ID NO: 158899 - DNA, 25 bp, E. coli
gagtgcttccctagaaaccctgaaa

SEQ ID NO: 158900 - DNA, 25 bp, E. coli
gagtgcttcccttgaaaccctgaaa

SEQ ID NO: 158901 - DNA, 25 bp, E. coli
caaggatggcatgaaaggagtgacc

SEQ ID NO: 158902 - DNA, 25 bp, E. coli
caaggatggcatcaaaggagtgacc

SEQ ID NO: 158903 - DNA, 25 bp, E. coli
cacggcaagaaactgggcttcatca

SEQ ID NO: 158904 - DNA, 25 bp, E. coli
cacggcaagaaagtgggcttcatca

SEQ ID NO: 158905 - DNA, 25 bp, E. coli
atcatcgtcggtgcagggcttgccg

SEQ ID NO: 158906 - DNA, 25 bp, E. coli
atcatcgtcggtccagggcttgccg

SEQ ID NO: 158907 - DNA, 25 bp, E. coli
taccattcgcggtatggatctggcg

SEQ ID NO: 158908 - DNA, 25 bp, E. coli
taccattcgcggaatggatctggcg

SEQ ID NO: 158909 - DNA, 25 bp, E. coli
tgattgaagcgaaaacggtgatcct

SEQ ID NO: 158910 - DNA, 25 bp, E. coli
tgattgaagcgataacggtgatcct

SEQ ID NO: 158911 - DNA, 25 bp, E. coli
gcgcgcagttaattaccgggatccg

SEQ ID NO: 158912 - DNA, 25 bp, E. coli
gcgcgcagttaaataccgggatccg

SEQ ID NO: 158913 - DNA, 25 bp, E. coli
gaagatatctttcacgccatcatcg

SEQ ID NO: 158914 - DNA, 25 bp, E. coli
gaatattccgctcacgtagtgccgg

SEQ ID NO: 158915 - DNA, 25 bp, E. coli
gaagatatctttgacgccatcatcg

SEQ ID NO: 158916 - DNA, 25 bp, E. coli
gcaattccgcagctgccaagaacgt

SEQ ID NO: 158917 - DNA, 25 bp, E. coli
gcaattccgcaggtgccaagaacgt

SEQ ID NO: 158918 - DNA, 25 bp, E. coli
gaatattccgctgacgtagtgccgg

SEQ ID NO: 158919 - DNA, 25 bp, E. coli
gataacctcgtacagcgcgatggca

SEQ ID NO: 158920 - DNA, 25 bp, E. coli
gataacctcgtagagcgcgatggca

SEQ ID NO: 158921 - DNA, 25 bp, E. coli
gtagaacgcctgatcacccatgaaa

SEQ ID NO: 158922 - DNA, 25 bp, E. coli
gtagaacgcctgttcacccatgaaa

SEQ ID NO: 158923 - DNA, 25 bp, E. coli
taaaattaccagctttagccacccg

SEQ ID NO: 158924 - DNA, 25 bp, E. coli
taaaattaccaggtttagccacccg

SEQ ID NO: 158925 - DNA, 25 bp, E. coli
accagctttagcgacccggaaatcg

SEQ ID NO: 158926 - DNA, 25 bp, E. coli
accagctttagccacccggaaatcg

SEQ ID NO: 158927 - DNA, 25 bp, E. coli
tgtcaatgaatgatacgtatcaacc

SEQ ID NO: 158928 - DNA, 25 bp, E. coli
tgattacgataatcttgagctcgcc

SEQ ID NO: 158929 - DNA, 25 bp, E. coli
tgtcaatgaatgttacgtatcaacc

SEQ ID NO: 158930 - DNA, 25 bp, E. coli
tgattacgataaacttgagctcgcc

SEQ ID NO: 158931 - DNA, 25 bp, E. coli
tgagctgaaagatggcgaaaaattg

SEQ ID NO: 158932 - DNA, 25 bp, E. coli
tgagctgaaagaaggcgaaaaattg

SEQ ID NO: 158933 - DNA, 25 bp, E. coli
tgctgacacttgagctgaaagatgg

SEQ ID NO: 158934 - DNA, 25 bp, E. coli
tgctgacacttgtgctgaaagatgg

SEQ ID NO: 158935 - DNA, 25 bp, E. coli
tttagtctcccgcaaaaatgtggag

SEQ ID NO: 158936 - DNA, 25 bp, E. coli
tttagtctcccggaaaaatgtggag

SEQ ID NO: 158937 - DNA, 25 bp, E. coli
ccaatcaattgtcatgattacgata

SEQ ID NO: 158938 - DNA, 25 bp, E. coli
ccaatcaattgtgatgattacgata

SEQ ID NO: 158939 - DNA, 25 bp, E. coli
gctcgcctgccaccatcatttaatg

SEQ ID NO: 158940 - DNA, 25 bp, E. coli
gctcgcctgccagcatcatttaatg

SEQ ID NO: 158941 - DNA, 25 bp, E. coli
gatacgtatcaaccaatcaattgtg

SEQ ID NO: 158942 - DNA, 25 bp, E. coli
gataatcttgaggtcgcctgccagc

SEQ ID NO: 158943 - DNA, 25 bp, E. coli
gataatcttgagctcgcctgccagc

SEQ ID NO: 158944 - DNA, 25 bp, E. coli
gatacgtatcaagcaatcaattgtg

SEQ ID NO: 158945 - DNA, 25 bp, E. coli
agaatcgttactgtctcccatccgg

SEQ ID NO: 158946 - DNA, 25 bp, E. coli
agaatcgttactctctcccatccgg

SEQ ID NO: 158947 - DNA, 25 bp, E. coli
actgagttgattaaccgccggtggg

SEQ ID NO: 158948 - DNA, 25 bp, E. coli
actgagttgatttaccgccggtggg

SEQ ID NO: 158949 - DNA, 25 bp, E. coli
tatggttaccagaatcagggcagtc

SEQ ID NO: 158950 - DNA, 25 bp, E. coli
tatggttaccagtatcagggcagtc

SEQ ID NO: 158951 - DNA, 25 bp, E. coli
tagccaaaataacgtgagcgggtcc

SEQ ID NO: 158952 - DNA, 25 bp, E. coli
tagccaaaataaggtgagcgggtcc

SEQ ID NO: 158953 - DNA, 25 bp, E. coli
tttcgccccgccctgagaataagcg

SEQ ID NO: 158954 - DNA, 25 bp, E. coli
tttcgccccgccgtgagaataagcg

SEQ ID NO: 158955 - DNA, 25 bp, E. coli
tgattagcggcaccaacgcatagct

SEQ ID NO: 158956 - DNA, 25 bp, E. coli
tgattagcggcagcaacgcatagct

SEQ ID NO: 158957 - DNA, 25 bp, E. coli
gctgtcctttgacttcgcacccaaa

SEQ ID NO: 158958 - DNA, 25 bp, E. coli
gctcgcgggcttacaactgagttga

SEQ ID NO: 158959 - DNA, 25 bp, E. coli
gctcgcgggctttcaactgagttga

SEQ ID NO: 158960 - DNA, 25 bp, E. coli
gctgtcctttgagttcgcacccaaa

SEQ ID NO: 158961 - DNA, 25 bp, E. coli
gcagtcttaggagtggcggcatata

SEQ ID NO: 158962 - DNA, 25 bp, E. coli
gcagtcttaggactggcggcatata

SEQ ID NO: 158963 - DNA, 25 bp, E. coli
gggtccatgccccacagaatcgtta

SEQ ID NO: 158964 - DNA, 25 bp, E. coli
gggtccatgcccgacagaatcgtta

SEQ ID NO: 158965 - DNA, 25 bp, E. coli
ggaattacaccggatctgctgtcct

SEQ ID NO: 158966 - DNA, 25 bp, E. coli
ggaattacaccgcatctgctgtcct

SEQ ID NO: 158967 - DNA, 25 bp, E. coli
aatattaactcggtcgccacttgcc

SEQ ID NO: 158968 - DNA, 25 bp, E. coli
aatattaactcgctcgccacttgcc

SEQ ID NO: 158969 - DNA, 25 bp, E. coli
aattgcccgctatttaacacctgca

SEQ ID NO: 158970 - DNA, 25 bp, E. coli
aattgcccgctaattaacacctgca

SEQ ID NO: 158971 - DNA, 25 bp, E. coli
tagaagttgcatagagaatcctggt

SEQ ID NO: 158972 - DNA, 25 bp, E. coli
tagaagttgcattgagaatcctggt

SEQ ID NO: 158973 - DNA, 25 bp, E. coli
tttcgctacgcaaatattaactcgg

SEQ ID NO: 158974 - DNA, 25 bp, E. coli
tttcgctacgcatatattaactcgg

SEQ ID NO: 158975 - DNA, 25 bp, E. coli
tgcttttccatagaagacctgatgc

SEQ ID NO: 158976 - DNA, 25 bp, E. coli
tgcttttccatacaagacctgatgc

SEQ ID NO: 158977 - DNA, 25 bp, E. coli
cctgcataaaacacaaggagagtgc

SEQ ID NO: 158978 - DNA, 25 bp, E. coli
cctgcataaaactcaaggagagtgc

SEQ ID NO: 158979 - DNA, 25 bp, E. coli
gcgatttgcccaagcctgaaggcca

SEQ ID NO: 158980 - DNA, 25 bp, E. coli
gcttaaccagggtacaattgcccgc

SEQ ID NO: 158981 - DNA, 25 bp, E. coli
gcttaaccagggaacaattgcccgc

SEQ ID NO: 158982 - DNA, 25 bp, E. coli
gcgatttgcccatgcctgaaggcca

SEQ ID NO: 158983 - DNA, 25 bp, E. coli
gaaggccagcaaatacctccgcttt

SEQ ID NO: 158984 - DNA, 25 bp, E. coli
gaaggccagcaattacctccgcttt

SEQ ID NO: 158985 - DNA, 25 bp, E. coli
ctgatgctgccagccgaggcttaac

SEQ ID NO: 158986 - DNA, 25 bp, E. coli
ctgatgctgccacccgaggcttaac

SEQ ID NO: 158987 - DNA, 25 bp, E. coli
gataattcacccattattgatctgg

SEQ ID NO: 158988 - DNA, 25 bp, E. coli
gataattcaccctttattgatctgg

SEQ ID NO: 158989 - DNA, 25 bp, E. coli
aagaggtctggatggtcatccgcga

SEQ ID NO: 158990 - DNA, 25 bp, E. coli
aagaggtctggaaggtcatccgcga

SEQ ID NO: 158991 - DNA, 25 bp, E. coli
tacgggcgaaaaatgaagcggcgat

SEQ ID NO: 158992 - DNA, 25 bp, E. coli
actgcggtcacatactggcgaagcg

SEQ ID NO: 158993 - DNA, 25 bp, E. coli
actgcggtcacaaactggcgaagcg

SEQ ID NO: 158994 - DNA, 25 bp, E. coli
tatgaccatcaatgggcaaaagctg

SEQ ID NO: 158995 - DNA, 25 bp, E. coli
tatgaccatcaaagggcaaaagctg

SEQ ID NO: 158996 - DNA, 25 bp, E. coli
tacgggcgaaaattgaagcggcgat

SEQ ID NO: 158997 - DNA, 25 bp, E. coli
tacctgttgctggaaagccaggcga

SEQ ID NO: 158998 - DNA, 25 bp, E. coli
tacctgttgctgcaaagccaggcga

SEQ ID NO: 158999 - DNA, 25 bp, E. coli
gctgctggcgctgatctgttacctg

SEQ ID NO: 159000 - DNA, 25 bp, E. coli
gctttcgcgaagcaccgccatatga

SEQ ID NO: 159001 - DNA, 25 bp, E. coli
gctttcgcgaaggaccgccatatga

SEQ ID NO: 159002 - DNA, 25 bp, E. coli
gctgctggcgctcatctgttacctg

SEQ ID NO: 159003 - DNA, 25 bp, E. coli
gactacaatcgccttgcgctgctta

SEQ ID NO: 159004 - DNA, 25 bp, E. coli
gactacaatcgcgttgcgctgctta

SEQ ID NO: 159005 - DNA, 25 bp, E. coli
gaactatttctttgtactgggcgtg

SEQ ID NO: 159006 - DNA, 25 bp, E. coli
gaactatttcttagtactgggcgtg

SEQ ID NO: 159007 - DNA, 25 bp, E. coli
gattgtgttgctcgtggtctacgcc

SEQ ID NO: 159008 - DNA, 25 bp, E. coli
gattgtgttgctggtggtctacgcc

SEQ ID NO: 159009 - DNA, 25 bp, E. coli
ggtctacgccaaaaaagtggactgg

SEQ ID NO: 159010 - DNA, 25 bp, E. coli
ggtctacgccaataaagtggactgg

SEQ ID NO: 159011 - DNA, 25 bp, E. coli
catgatgaacgttttacagagcgga

SEQ ID NO: 159012 - DNA, 25 bp, E. coli
catgatgaacgtattacagagcgga

SEQ ID NO: 159013 - DNA, 25 bp, E. coli
tacgttttcaacaagaggcgctcaa

SEQ ID NO: 159014 - DNA, 25 bp, E. coli
taaaaaagtcatccaacgtggacgg

SEQ ID NO: 159015 - DNA, 25 bp, E. coli
taaaaaagtcatgcaacgtggacgg

SEQ ID NO: 159016 - DNA, 25 bp, E. coli
taccgtcgatatggatcgcgaacgc

SEQ ID NO: 159017 - DNA, 25 bp, E. coli
taccgtcgatatcgatcgcgaacgc

SEQ ID NO: 159018 - DNA, 25 bp, E. coli
tacgttttcaactagaggcgctcaa

SEQ ID NO: 159019 - DNA, 25 bp, E. coli
tgcaataccgtaatccggaccagcc

SEQ ID NO: 159020 - DNA, 25 bp, E. coli
tcgccaatgccgatacccctggtta

SEQ ID NO: 159021 - DNA, 25 bp, E. coli
tcgccaatgccgttacccctggtta

SEQ ID NO: 159022 - DNA, 25 bp, E. coli
tgcaataccgtattccggaccagcc

SEQ ID NO: 159023 - DNA, 25 bp, E. coli
gcgaacgcaccctgtttgccgataa

SEQ ID NO: 159024 - DNA, 25 bp, E. coli
gcgaacgcacccagtttgccgataa

SEQ ID NO: 159025 - DNA, 25 bp, E. coli
gcaataccagatgagccttagcgcg

SEQ ID NO: 159026 - DNA, 25 bp, E. coli
gcaataccagatcagccttagcgcg

SEQ ID NO: 159027 - DNA, 25 bp, E. coli
gaccagccttcgcttgacggtaata

SEQ ID NO: 159028 - DNA, 25 bp, E. coli
gaccagccttcggttgacggtaata

SEQ ID NO: 159029 - DNA, 25 bp, E. coli
cgcgatatcgatattgccagtgaac

SEQ ID NO: 159030 - DNA, 25 bp, E. coli
cgcgatatcgattttgccagtgaac

SEQ ID NO: 159031 - DNA, 25 bp, E. coli
gacgatgacctctacgcaacacatt

SEQ ID NO: 159032 - DNA, 25 bp, E. coli
gacgatgacctcaacgcaacacatt

SEQ ID NO: 159033 - DNA, 25 bp, E. coli
tatacatcgccagaaaagcaatgca

SEQ ID NO: 159034 - DNA, 25 bp, E. coli
tatacatcgccacaaaagcaatgca

SEQ ID NO: 159035 - DNA, 25 bp, E. coli
tcgggattatcctgagaatcaggca

SEQ ID NO: 159036 - DNA, 25 bp, E. coli
tcgggattatccagagaatcaggca

SEQ ID NO: 159037 - DNA, 25 bp, E. coli
tccagagaatcacgcagaaagatcc

SEQ ID NO: 159038 - DNA, 25 bp, E. coli
tcgtctgaataatacgaatgtttgt

SEQ ID NO: 159039 - DNA, 25 bp, E. coli
tccagagaatcaggcagaaagatcc

SEQ ID NO: 159040 - DNA, 25 bp, E. coli
tcgtctgaataaaacgaatgtttgt

SEQ ID NO: 159041 - DNA, 25 bp, E. coli
tcaggcagaaagttccgacaatggg

SEQ ID NO: 159042 - DNA, 25 bp, E. coli
tctggctcagaaagatatcaaggtg

SEQ ID NO: 159043 - DNA, 25 bp, E. coli
tctggctcagaatgatatcaaggtg

SEQ ID NO: 159044 - DNA, 25 bp, E. coli
tcaggcagaaagatccgacaatggg

SEQ ID NO: 159045 - DNA, 25 bp, E. coli
gcaatgcatattgtcgggattatcc

SEQ ID NO: 159046 - DNA, 25 bp, E. coli
gaatgtttgttttcgtcatgaagcg

SEQ ID NO: 159047 - DNA, 25 bp, E. coli
gcaatgcatattctcgggattatcc

SEQ ID NO: 159048 - DNA, 25 bp, E. coli
gaatgtttgtttacgtcatgaagcg

SEQ ID NO: 159049 - DNA, 25 bp, E. coli
ccgacaatgggctgtgattatgcca

SEQ ID NO: 159050 - DNA, 25 bp, E. coli
ccgacaatgggcagtgattatgcca

SEQ ID NO: 159051 - DNA, 25 bp, E. coli
gattatgccatcaggctcagaatga

SEQ ID NO: 159052 - DNA, 25 bp, E. coli
gattatgccatctggctcagaatga

SEQ ID NO: 159053 - DNA, 25 bp, E. coli
gtcatgaagcgttccggctcccggg

SEQ ID NO: 159054 - DNA, 25 bp, E. coli
gtcatgaagcgtaccggctcccggg

SEQ ID NO: 159055 - DNA, 25 bp, E. coli
aataaaaacctgattatcaagcaga

SEQ ID NO: 159056 - DNA, 25 bp, E. coli
aataaaaacctgtttatcaagcaga

SEQ ID NO: 159057 - DNA, 25 bp, E. coli
catggttctttcgactatctgaaaa

SEQ ID NO: 159058 - DNA, 25 bp, E. coli
catggttctttccactatctgaaaa

SEQ ID NO: 159059 - DNA, 25 bp, E. coli
taaaatacctgacatgtaatacaga

SEQ ID NO: 159060 - DNA, 25 bp, E. coli
taaaatacctgagatgtaatacaga

SEQ ID NO: 159061 - DNA, 25 bp, E. coli
tatgcatggatatactacaagacga

SEQ ID NO: 159062 - DNA, 25 bp, E. coli
tatgcatggataaactacaagacga

SEQ ID NO: 159063 - DNA, 25 bp, E. coli
tgtaatacagaataaacacaaaact

SEQ ID NO: 159064 - DNA, 25 bp, E. coli
tgtaatacagaaaaaacacaaaact

SEQ ID NO: 159065 - DNA, 25 bp, E. coli
cctgattatcaagcagatatgcatg

SEQ ID NO: 159066 - DNA, 25 bp, E. coli
ccactatctgaataataattcttta

SEQ ID NO: 159067 - DNA, 25 bp, E. coli
ccactatctgaaaaataattcttta

SEQ ID NO: 159068 - DNA, 25 bp, E. coli
cctgattatcaaccagatatgcatg

SEQ ID NO: 159069 - DNA, 25 bp, E. coli
gcatggataaactacaagacgagat

SEQ ID NO: 159070 - DNA, 25 bp, E. coli
gcatggataaacaacaagacgagat

SEQ ID NO: 159071 - DNA, 25 bp, E. coli
ggataaactacaagacgagatataa

SEQ ID NO: 159072 - DNA, 25 bp, E. coli
ggataaactacatgacgagatataa

SEQ ID NO: 159073 - DNA, 25 bp, E. coli
tcaagcagatatccatggataaact

SEQ ID NO: 159074 - DNA, 25 bp, E. coli
taattctttaaaatacctgacatgt

SEQ ID NO: 159075 - DNA, 25 bp, E. coli
tcaagcagatatgcatggataaact

SEQ ID NO: 159076 - DNA, 25 bp, E. coli
taattctttaaattacctgacatgt

SEQ ID NO: 159077 - DNA, 25 bp, E. coli
aatacgagagtatagtcagtgcggt

SEQ ID NO: 159078 - DNA, 25 bp, E. coli
aatacgagagtaaagtcagtgcggt

SEQ ID NO: 159079 - DNA, 25 bp, E. coli
cagtgcggtgatcatttgcttaacc

SEQ ID NO: 159080 - DNA, 25 bp, E. coli
cagtgcggtgatgatttgcttaacc

SEQ ID NO: 159081 - DNA, 25 bp, E. coli
taaatcatctgcacgaatacgagag

SEQ ID NO: 159082 - DNA, 25 bp, E. coli
tagttaggaggtcaaaaatgctgtc

SEQ ID NO: 159083 - DNA, 25 bp, E. coli
taaatcatctgctcgaatacgagag

SEQ ID NO: 159084 - DNA, 25 bp, E. coli
tagttaggaggtgaaaaatgctgtc

SEQ ID NO: 159085 - DNA, 25 bp, E. coli
aagattactcacatctgggtactga

SEQ ID NO: 159086 - DNA, 25 bp, E. coli
aagattactcacttctgggtactga

SEQ ID NO: 159087 - DNA, 25 bp, E. coli
tatgaaaatcaatagcttactcgcg

SEQ ID NO: 159088 - DNA, 25 bp, E. coli
tatgaaaatcaaaagcttactcgcg

SEQ ID NO: 159089 - DNA, 25 bp, E. coli
tatttatggctatcattatccggct

SEQ ID NO: 159090 - DNA, 25 bp, E. coli
tatttatggctaacattatccggct

SEQ ID NO: 159091 - DNA, 25 bp, E. coli
tctaatgcgtcagttccaggtggcg

SEQ ID NO: 159092 - DNA, 25 bp, E. coli
tctaatgcgtcacttccaggtggcg

SEQ ID NO: 159093 - DNA, 25 bp, E. coli
ccaggtggcgtaagcaagattactc

SEQ ID NO: 159094 - DNA, 25 bp, E. coli
ccaggtggcgtatgcaagattactc

SEQ ID NO: 159095 - DNA, 25 bp, E. coli
tcaaaaggcgtattgtcagcgcgtc

SEQ ID NO: 159096 - DNA, 25 bp, E. coli
tcaaatttttgcaaagctgacacct

SEQ ID NO: 159097 - DNA, 25 bp, E. coli
tcaaaaggcgtaatgtcagcgcgtc

SEQ ID NO: 159098 - DNA, 25 bp, E. coli
tcaaatttttgctaagctgacacct

SEQ ID NO: 159099 - DNA, 25 bp, E. coli
caaaatgggcagttttgagcaggct

SEQ ID NO: 159100 - DNA, 25 bp, E. coli
caaaagcgaggattttgtgacggga

SEQ ID NO: 159101 - DNA, 25 bp, E. coli
caaaagcgaggaatttgtgacggga

SEQ ID NO: 159102 - DNA, 25 bp, E. coli
caaaatgggcagatttgagcaggct

SEQ ID NO: 159103 - DNA, 25 bp, E. coli
taaagtaaattagcgccagagaggc

SEQ ID NO: 159104 - DNA, 25 bp, E. coli
taaagtaaattaccgccagagaggc

SEQ ID NO: 159105 - DNA, 25 bp, E. coli
taaatgcctgaaatacaaaagcgag

SEQ ID NO: 159106 - DNA, 25 bp, E. coli
taaatgcctgaattacaaaagcgag

SEQ ID NO: 159107 - DNA, 25 bp, E. coli
aaaccggtcattctctttgcgctca

SEQ ID NO: 159108 - DNA, 25 bp, E. coli
aaaccggtcattgtctttgcgctca

SEQ ID NO: 159109 - DNA, 25 bp, E. coli
tgagcaggctcacaaaatgcgatta

SEQ ID NO: 159110 - DNA, 25 bp, E. coli
tgagcaggctcagaaaatgcgatta

SEQ ID NO: 159111 - DNA, 25 bp, E. coli
tctgcccttgagcaaataacctgag

SEQ ID NO: 159112 - DNA, 25 bp, E. coli
tctgcccttgaggaaataacctgag

SEQ ID NO: 159113 - DNA, 25 bp, E. coli
gctcatcaaatgttacaggacagga

SEQ ID NO: 159114 - DNA, 25 bp, E. coli
gctcatcaaatgatacaggacagga

SEQ ID NO: 159115 - DNA, 25 bp, E. coli
gaatatagatactgcaaagacggtt

SEQ ID NO: 159116 - DNA, 25 bp, E. coli
gaatatagatacagcaaagacggtt

SEQ ID NO: 159117 - DNA, 25 bp, E. coli
gaaatttctgccctgtaacacacct

SEQ ID NO: 159118 - DNA, 25 bp, E. coli
gacgggatgcacagaacagaacaat

SEQ ID NO: 159119 - DNA, 25 bp, E. coli
gaaatttctgccgtgtaacacacct

SEQ ID NO: 159120 - DNA, 25 bp, E. coli
gacgggatgcactgaacagaacaat

SEQ ID NO: 159121 - DNA, 25 bp, E. coli
caattaatttttagccctggcgaca

SEQ ID NO: 159122 - DNA, 25 bp, E. coli
caactcgcccgcagcttacagataa

SEQ ID NO: 159123 - DNA, 25 bp, E. coli
caattaattttttgccctggcgaca

SEQ ID NO: 159124 - DNA, 25 bp, E. coli
caactcgcccgctgcttacagataa

SEQ ID NO: 159125 - DNA, 25 bp, E. coli
agcgacaatttagccgcgactggca

SEQ ID NO: 159126 - DNA, 25 bp, E. coli
agcgacaatttacccgcgactggca

SEQ ID NO: 159127 - DNA, 25 bp, E. coli
tatcagttaacaaggaaggttagcg

SEQ ID NO: 159128 - DNA, 25 bp, E. coli
tatcagttaacatggaaggttagcg

SEQ ID NO: 159129 - DNA, 25 bp, E. coli
tgacaacgataacctggcagcaggg

SEQ ID NO: 159130 - DNA, 25 bp, E. coli
tgacaacgataagctggcagcaggg

SEQ ID NO: 159131 - DNA, 25 bp, E. coli
gctggccgtcggcataacgctaata

SEQ ID NO: 159132 - DNA, 25 bp, E. coli
gctggccgtcgggataacgctaata

SEQ ID NO: 159133 - DNA, 25 bp, E. coli
gctgatgttcgtagcgcctctgctg

SEQ ID NO: 159134 - DNA, 25 bp, E. coli
gctggaagcactcgcggcgctttta

SEQ ID NO: 159135 - DNA, 25 bp, E. coli
gctggaagcactggcggcgctttta

SEQ ID NO: 159136 - DNA, 25 bp, E. coli
gctgatgttcgttgcgcctctgctg

SEQ ID NO: 159137 - DNA, 25 bp, E. coli
gactggcaatctccgctggaagcac

SEQ ID NO: 159138 - DNA, 25 bp, E. coli
gactggcaatctgcgctggaagcac

SEQ ID NO: 159139 - DNA, 25 bp, E. coli
cgcagggacgctggcaatttgagta

SEQ ID NO: 159140 - DNA, 25 bp, E. coli
cgcagggacgctcgcaatttgagta

SEQ ID NO: 159141 - DNA, 25 bp, E. coli
ggaaggttagcgatgaacatgttct

SEQ ID NO: 159142 - DNA, 25 bp, E. coli
ggaaggttagcgttgaacatgttct

SEQ ID NO: 159143 - DNA, 25 bp, E. coli
caaaatatgcccagactgtcggtgt

SEQ ID NO: 159144 - DNA, 25 bp, E. coli
caaaatatgccctgactgtcggtgt

SEQ ID NO: 159145 - DNA, 25 bp, E. coli
catggacgaataagtcggtctgccg

SEQ ID NO: 159146 - DNA, 25 bp, E. coli
catggacgaatatgtcggtctgccg

SEQ ID NO: 159147 - DNA, 25 bp, E. coli
aaaaccctgactgatgacactcgcg

SEQ ID NO: 159148 - DNA, 25 bp, E. coli
aaaaccctgactcatgacactcgcg

SEQ ID NO: 159149 - DNA, 25 bp, E. coli
tcgaaatgcatatagcaggccaggt

SEQ ID NO: 159150 - DNA, 25 bp, E. coli
tcgaaatgcataaagcaggccaggt

SEQ ID NO: 159151 - DNA, 25 bp, E. coli
tcatattgcattaaacgaaccggcg

SEQ ID NO: 159152 - DNA, 25 bp, E. coli
tcatattgcatttaacgaaccggcg

SEQ ID NO: 159153 - DNA, 25 bp, E. coli
ccaccatggagcagaaagttaagac

SEQ ID NO: 159154 - DNA, 25 bp, E. coli
ccaccatggagctgaaagttaagac

SEQ ID NO: 159155 - DNA, 25 bp, E. coli
gcaggccaggtcagctttaagcacg

SEQ ID NO: 159156 - DNA, 25 bp, E. coli
gcaggccaggtctgctttaagcacg

SEQ ID NO: 159157 - DNA, 25 bp, E. coli
gactaccgctgaacaggtcggcaaa

SEQ ID NO: 159158 - DNA, 25 bp, E. coli
gactaccgctgatcaggtcggcaaa

SEQ ID NO: 159159 - DNA, 25 bp, E. coli
gatcacgttgattttccagcagaaa

SEQ ID NO: 159160 - DNA, 25 bp, E. coli
gatcacgttgatattccagcagaaa

SEQ ID NO: 159161 - DNA, 25 bp, E. coli
gggctgctcgccatatcgtcaatcg

SEQ ID NO: 159162 - DNA, 25 bp, E. coli
gggctgctcgccttatcgtcaatcg

SEQ ID NO: 159163 - DNA, 25 bp, E. coli
gagcatccggaatgctactacagct

SEQ ID NO: 159164 - DNA, 25 bp, E. coli
gagcatccggaaagctactacagct

SEQ ID NO: 159165 - DNA, 25 bp, E. coli
caacttaaatatctggtgccggacg

SEQ ID NO: 159166 - DNA, 25 bp, E. coli
caacttaaatatgtggtgccggacg

SEQ ID NO: 159167 - DNA, 25 bp, E. coli
aaatagatacctagcaccgcgagcg

SEQ ID NO: 159168 - DNA, 25 bp, E. coli
aaatagataccttgcaccgcgagcg

SEQ ID NO: 159169 - DNA, 25 bp, E. coli
tatgccgcgcattttgaacaactgg

SEQ ID NO: 159170 - DNA, 25 bp, E. coli
tatgccgcgcatattgaacaactgg

SEQ ID NO: 159171 - DNA, 25 bp, E. coli
tgatgatccgcaggtttttgccgcg

SEQ ID NO: 159172 - DNA, 25 bp, E. coli
tgatgatccgcacgtttttgccgcg

SEQ ID NO: 159173 - DNA, 25 bp, E. coli
tgagattgattctgcaccctgcgcg

SEQ ID NO: 159174 - DNA, 25 bp, E. coli
tgagattgattcagcaccctgcgcg

SEQ ID NO: 159175 - DNA, 25 bp, E. coli
gcgaccatgggccatcaacttaaat

SEQ ID NO: 159176 - DNA, 25 bp, E. coli
gcgaccatgggcgatcaacttaaat

SEQ ID NO: 159177 - DNA, 25 bp, E. coli
cgtgcgcgacgagtatcagttcagc

SEQ ID NO: 159178 - DNA, 25 bp, E. coli
cgtgcgcgacgactatcagttcagc

SEQ ID NO: 159179 - DNA, 25 bp, E. coli
ggcttgccgaacatcaacgaggcga

SEQ ID NO: 159180 - DNA, 25 bp, E. coli
ggcttgccgaacttcaacgaggcga

SEQ ID NO: 159181 - DNA, 25 bp, E. coli
taagatcagcggacctttcagcctg

SEQ ID NO: 159182 - DNA, 25 bp, E. coli
taagatcagcggtcctttcagcctg

SEQ ID NO: 159183 - DNA, 25 bp, E. coli
gagattttcaacactggctggcagc

SEQ ID NO: 159184 - DNA, 25 bp, E. coli
gagattttcaactctggctggcagc

SEQ ID NO: 159185 - DNA, 25 bp, E. coli
gaccatatcatcaggcaggcgtggg

SEQ ID NO: 159186 - DNA, 25 bp, E. coli
gaccatatcatctggcaggcgtggg

SEQ ID NO: 159187 - DNA, 25 bp, E. coli
actatcggtctcttgtttatcggtg

SEQ ID NO: 159188 - DNA, 25 bp, E. coli
actatcggtctcatgtttatcggtg

SEQ ID NO: 159189 - DNA, 25 bp, E. coli
tgtctgcttgtttggtcaaatgcgt

SEQ ID NO: 159190 - DNA, 25 bp, E. coli
tgtctgcttgttaggtcaaatgcgt

SEQ ID NO: 159191 - DNA, 25 bp, E. coli
tctggttgggctatggatctcatgc

SEQ ID NO: 159192 - DNA, 25 bp, E. coli
tctggttgggctttggatctcatgc

SEQ ID NO: 159193 - DNA, 25 bp, E. coli
gcgttaatcactatcggtctcttgt

SEQ ID NO: 159194 - DNA, 25 bp, E. coli
gcgttaatcactttcggtctcttgt

SEQ ID NO: 159195 - DNA, 25 bp, E. coli
gcaacttttggctactatgcatatc

SEQ ID NO: 159196 - DNA, 25 bp, E. coli
gcaacttttggcaactatgcatatc

SEQ ID NO: 159197 - DNA, 25 bp, E. coli
cgctggtttatcaggttgggctatg

SEQ ID NO: 159198 - DNA, 25 bp, E. coli
cgctggtttatctggttgggctatg

SEQ ID NO: 159199 - DNA, 25 bp, E. coli
ggtcaaatgcgtttgtttcgctcgg

SEQ ID NO: 159200 - DNA, 25 bp, E. coli
ggtcaaatgcgtatgtttcgctcgg

SEQ ID NO: 159201 - DNA, 25 bp, E. coli
ggctatggatctcatgcccattgtt

SEQ ID NO: 159202 - DNA, 25 bp, E. coli
ggcaaaactattatttgttgtcggg

SEQ ID NO: 159203 - DNA, 25 bp, E. coli
tggagatcgttatgaaaacctcaaa

SEQ ID NO: 159204 - DNA, 25 bp, E. coli
tggagatcgttaagaaaacctcaaa

SEQ ID NO: 159205 - DNA, 25 bp, E. coli
ggcaaaactattttttgttgtcggg

SEQ ID NO: 159206 - DNA, 25 bp, E. coli
ggctatggatctgatgcccattgtt

SEQ ID NO: 159207 - DNA, 25 bp, E. coli
tggcaactatgcatatcttcgcgca

SEQ ID NO: 159208 - DNA, 25 bp, E. coli
tggcaactatgcttatcttcgcgca

SEQ ID NO: 159209 - DNA, 25 bp, E. coli
atctccgccgtttataaagacattc

SEQ ID NO: 159210 - DNA, 25 bp, E. coli
acgctcctcccgtttgcagcagttg

SEQ ID NO: 159211 - DNA, 25 bp, E. coli
atctccgccgttaataaagacattc

SEQ ID NO: 159212 - DNA, 25 bp, E. coli
acgctcctcccgattgcagcagttg

SEQ ID NO: 159213 - DNA, 25 bp, E. coli
tttgcagcagttcatgcgcggcgac

SEQ ID NO: 159214 - DNA, 25 bp, E. coli
tttgcagcagttgatgcgcggcgac

SEQ ID NO: 159215 - DNA, 25 bp, E. coli
tcctcccgtttgcagcagttgatgc

SEQ ID NO: 159216 - DNA, 25 bp, E. coli
tcccgtttgcaggagttgatgcgcg

SEQ ID NO: 159217 - DNA, 25 bp, E. coli
tcccgtttgcagcagttgatgcgcg

SEQ ID NO: 159218 - DNA, 25 bp, E. coli
tcctcccgtttggagcagttgatgc

SEQ ID NO: 159219 - DNA, 25 bp, E. coli
ccgtttgcagcacttgatgcgcggc

SEQ ID NO: 159220 - DNA, 25 bp, E. coli
gctcctcccgttagcagcagttgat

SEQ ID NO: 159221 - DNA, 25 bp, E. coli
tcgaacgccgtaactccgccgttta

SEQ ID NO: 159222 - DNA, 25 bp, E. coli
tcgaacgccgtatctccgccgttta

SEQ ID NO: 159223 - DNA, 25 bp, E. coli
gctcctcccgtttgcagcagttgat

SEQ ID NO: 159224 - DNA, 25 bp, E. coli
gaacgccgtatctccgccgtttata

SEQ ID NO: 159225 - DNA, 25 bp, E. coli
gaacgccgtatcaccgccgtttata

SEQ ID NO: 159226 - DNA, 25 bp, E. coli
ccgtttgcagcagttgatgcgcggc

SEQ ID NO: 159227 - DNA, 25 bp, E. coli
cgtatctccgccgtttataaagaca

SEQ ID NO: 159228 - DNA, 25 bp, E. coli
cgtatctccgccctttataaagaca

SEQ ID NO: 159229 - DNA, 25 bp, E. coli
gatgcgtctcgaacgccgtatctcc

SEQ ID NO: 159230 - DNA, 25 bp, E. coli
gatgcgtctcgatcgccgtatctcc

SEQ ID NO: 159231 - DNA, 25 bp, E. coli
aagcaacacgatcacaaacgccctg

SEQ ID NO: 159232 - DNA, 25 bp, E. coli
aagcaacacgatgacaaacgccctg

SEQ ID NO: 159233 - DNA, 25 bp, E. coli
atcacaaacgccgtggacgcttgat

SEQ ID NO: 159234 - DNA, 25 bp, E. coli
atcacaaacgccctggacgcttgat

SEQ ID NO: 159235 - DNA, 25 bp, E. coli
tatcgccgccgtttttgtgtggaac

SEQ ID NO: 159236 - DNA, 25 bp, E. coli
tatcgccgccgtatttgtgtggaac

SEQ ID NO: 159237 - DNA, 25 bp, E. coli
tgacgcagccacgagcgcaagcgat

SEQ ID NO: 159238 - DNA, 25 bp, E. coli
tgacgcagccaccagcgcaagcgat

SEQ ID NO: 159239 - DNA, 25 bp, E. coli
gccacgagcgcaagcgatgagtgct

SEQ ID NO: 159240 - DNA, 25 bp, E. coli
ccgttgagcaagcaacacgatcaca

SEQ ID NO: 159241 - DNA, 25 bp, E. coli
gccaaccgccattcgtggtaatgct

SEQ ID NO: 159242 - DNA, 25 bp, E. coli
gccacgagcgcatgcgatgagtgct

SEQ ID NO: 159243 - DNA, 25 bp, E. coli
gccaaccgccatacgtggtaatgct

SEQ ID NO: 159244 - DNA, 25 bp, E. coli
ccgttgagcaaggaacacgatcaca

SEQ ID NO: 159245 - DNA, 25 bp, E. coli
gaacttctgtcccataagccaaccg

SEQ ID NO: 159246 - DNA, 25 bp, E. coli
gaacttctgtccgataagccaaccg

SEQ ID NO: 159247 - DNA, 25 bp, E. coli
cgcaagcgatgactgctgccgttga

SEQ ID NO: 159248 - DNA, 25 bp, E. coli
cgcaagcgatgagtgctgccgttga

SEQ ID NO: 159249 - DNA, 25 bp, E. coli
tgtgtggaacttctgtcccataagc

SEQ ID NO: 159250 - DNA, 25 bp, E. coli
tgtgtggaacttgtgtcccataagc

SEQ ID NO: 159251 - DNA, 25 bp, E. coli
taagccaaccgcgatacgtggtaat

SEQ ID NO: 159252 - DNA, 25 bp, E. coli
taagccaaccgccatacgtggtaat

SEQ ID NO: 159253 - DNA, 25 bp, E. coli
aatggtgtattagcaatgcatctct

SEQ ID NO: 159254 - DNA, 25 bp, E. coli
aatggtgtattaccaatgcatctct

SEQ ID NO: 159255 - DNA, 25 bp, E. coli
taaatggtgtattagcaatgcatct

SEQ ID NO: 159256 - DNA, 25 bp, E. coli
taaatggtgtataagcaatgcatct

SEQ ID NO: 159257 - DNA, 25 bp, E. coli
agcaatgcatctcttgataatgcac

SEQ ID NO: 159258 - DNA, 25 bp, E. coli
agataaatggtgaattagcaatgca

SEQ ID NO: 159259 - DNA, 25 bp, E. coli
agataaatggtgtattagcaatgca

SEQ ID NO: 159260 - DNA, 25 bp, E. coli
agcaatgcatctgttgataatgcac

SEQ ID NO: 159261 - DNA, 25 bp, E. coli
aaatggtgtattagcaatgcatctc

SEQ ID NO: 159262 - DNA, 25 bp, E. coli
aaatggtgtatttgcaatgcatctc

SEQ ID NO: 159263 - DNA, 25 bp, E. coli
tagcaatgcatcacttgataatgca

SEQ ID NO: 159264 - DNA, 25 bp, E. coli
tagcaatgcatctcttgataatgca

SEQ ID NO: 159265 - DNA, 25 bp, E. coli
ttagcaatgcatgtcttgataatgc

SEQ ID NO: 159266 - DNA, 25 bp, E. coli
ttagcaatgcatctcttgataatgc

SEQ ID NO: 159267 - DNA, 25 bp, E. coli
tggtgtattagctatgcatctcttg

SEQ ID NO: 159268 - DNA, 25 bp, E. coli
gtattagcaatgcatctcttgataa

SEQ ID NO: 159269 - DNA, 25 bp, E. coli
gtattagcaatggatctcttgataa

SEQ ID NO: 159270 - DNA, 25 bp, E. coli
gtgtattagcaatgcatctcttgat

SEQ ID NO: 159271 - DNA, 25 bp, E. coli
gtgtattagcaaagcatctcttgat

SEQ ID NO: 159272 - DNA, 25 bp, E. coli
ggtgtattagcaatgcatctcttga

SEQ ID NO: 159273 - DNA, 25 bp, E. coli
ggtgtattagcattgcatctcttga

SEQ ID NO: 159274 - DNA, 25 bp, E. coli
tggtgtattagcaatgcatctcttg

SEQ ID NO: 159275 - DNA, 25 bp, E. coli
aattgtatttcttgagttggcgagg

SEQ ID NO: 159276 - DNA, 25 bp, E. coli
aattgtatttctagagttggcgagg

SEQ ID NO: 159277 - DNA, 25 bp, E. coli
caagagcttatttgcctgaccaatc

SEQ ID NO: 159278 - DNA, 25 bp, E. coli
caagagcttattagcctgaccaatc

SEQ ID NO: 159279 - DNA, 25 bp, E. coli
tacggttatcgggagaacgccctgc

SEQ ID NO: 159280 - DNA, 25 bp, E. coli
tacggttatcggcagaacgccctgc

SEQ ID NO: 159281 - DNA, 25 bp, E. coli
tgtcacattcctgtcaatagcgtta

SEQ ID NO: 159282 - DNA, 25 bp, E. coli
tgtcacattcctctcaatagcgtta

SEQ ID NO: 159283 - DNA, 25 bp, E. coli
tgtcagttatcatcttcggttacgg

SEQ ID NO: 159284 - DNA, 25 bp, E. coli
tgtcaaatgcttgacggctcgccct

SEQ ID NO: 159285 - DNA, 25 bp, E. coli
tgtcaaatgcttcacggctcgccct

SEQ ID NO: 159286 - DNA, 25 bp, E. coli
tgtcagttatcaacttcggttacgg

SEQ ID NO: 159287 - DNA, 25 bp, E. coli
tgcctgaccaatgtactccacatga

SEQ ID NO: 159288 - DNA, 25 bp, E. coli
tgcctgaccaatctactccacatga

SEQ ID NO: 159289 - DNA, 25 bp, E. coli
tcatctatcgttggcatcagcgaca

SEQ ID NO: 159290 - DNA, 25 bp, E. coli
tcatctatcgttcgcatcagcgaca

SEQ ID NO: 159291 - DNA, 25 bp, E. coli
gccctgccgctgacaagagcttatt

SEQ ID NO: 159292 - DNA, 25 bp, E. coli
gccctgccgctgtcaagagcttatt

SEQ ID NO: 159293 - DNA, 25 bp, E. coli
gacggctcgcccaaattctctaaat

SEQ ID NO: 159294 - DNA, 25 bp, E. coli
gacggctcgccctaattctctaaat

SEQ ID NO: 159295 - DNA, 25 bp, E. coli
gagttggcgaggttttgaacagccc

SEQ ID NO: 159296 - DNA, 25 bp, E. coli
gagttggcgaggatttgaacagccc

SEQ ID NO: 159297 - DNA, 25 bp, E. coli
caccatatacttagtgacggtcagg

SEQ ID NO: 159298 - DNA, 25 bp, E. coli
cactgtccgcttagtgccaggagca

SEQ ID NO: 159299 - DNA, 25 bp, E. coli
caccatatactttgtgacggtcagg

SEQ ID NO: 159300 - DNA, 25 bp, E. coli
cactgtccgctttgtgccaggagca

SEQ ID NO: 159301 - DNA, 25 bp, E. coli
catgcttagggctagtcacgaagga

SEQ ID NO: 159302 - DNA, 25 bp, E. coli
catgcttagggcaagtcacgaagga

SEQ ID NO: 159303 - DNA, 25 bp, E. coli
agtatcgcactagaacatgcttagg

SEQ ID NO: 159304 - DNA, 25 bp, E. coli
agtatcgcactacaacatgcttagg

SEQ ID NO: 159305 - DNA, 25 bp, E. coli
tcgtttttaaagagtccggccatca

SEQ ID NO: 159306 - DNA, 25 bp, E. coli
tcgtttttaaagtgtccggccatca

SEQ ID NO: 159307 - DNA, 25 bp, E. coli
tcagtgttgcttactcgtcggcggg

SEQ ID NO: 159308 - DNA, 25 bp, E. coli
tcagtgttgctttctcgtcggcggg

SEQ ID NO: 159309 - DNA, 25 bp, E. coli
gacggtcaggcttcatatgcacaac

SEQ ID NO: 159310 - DNA, 25 bp, E. coli
gacggtcaggctacatatgcacaac

SEQ ID NO: 159311 - DNA, 25 bp, E. coli
gtaagaacggtgatcactgtccgct

SEQ ID NO: 159312 - DNA, 25 bp, E. coli
gtaagaacggtgttcactgtccgct

SEQ ID NO: 159313 - DNA, 25 bp, E. coli
ggccatcatctttctggtacagaca

SEQ ID NO: 159314 - DNA, 25 bp, E. coli
ggccatcatcttactggtacagaca

SEQ ID NO: 159315 - DNA, 25 bp, E. coli
tcacgaaggaagacagaaagtagtc

SEQ ID NO: 159316 - DNA, 25 bp, E. coli
tcacgaaggaagtcagaaagtagtc

SEQ ID NO: 159317 - DNA, 25 bp, E. coli
gagcggtgacctcacctgtcgataa

SEQ ID NO: 159318 - DNA, 25 bp, E. coli
gagcggtgacctgacctgtcgataa

SEQ ID NO: 159319 - DNA, 25 bp, E. coli
caaaccgcaaatgccgaaaagctgg

SEQ ID NO: 159320 - DNA, 25 bp, E. coli
cacaaccctgcgttgttattgcggg

SEQ ID NO: 159321 - DNA, 25 bp, E. coli
caaaccgcaaatcccgaaaagctgg

SEQ ID NO: 159322 - DNA, 25 bp, E. coli
cacaaccctgcgatgttattgcggg

SEQ ID NO: 159323 - DNA, 25 bp, E. coli
taaaccagacgataactggcgttgg

SEQ ID NO: 159324 - DNA, 25 bp, E. coli
taaaccagacgaaaactggcgttgg

SEQ ID NO: 159325 - DNA, 25 bp, E. coli
tgggcgacgccattaaaatcatgaa

SEQ ID NO: 159326 - DNA, 25 bp, E. coli
tgggcgacgccaataaaatcatgaa

SEQ ID NO: 159327 - DNA, 25 bp, E. coli
tcatgaacgacacgctgaaaccgca

SEQ ID NO: 159328 - DNA, 25 bp, E. coli
tctaaagaacaaaaagccgaactgg

SEQ ID NO: 159329 - DNA, 25 bp, E. coli
tctcttttgaagaaaagtgccgcga

SEQ ID NO: 159330 - DNA, 25 bp, E. coli
tctcttttgaagtaaagtgccgcga

SEQ ID NO: 159331 - DNA, 25 bp, E. coli
tctaaagaacaataagccgaactgg

SEQ ID NO: 159332 - DNA, 25 bp, E. coli
tcatgaacgacaggctgaaaccgca

SEQ ID NO: 159333 - DNA, 25 bp, E. coli
ccaatggtatgcaatttcgctcacg

SEQ ID NO: 159334 - DNA, 25 bp, E. coli
ccaatggtatgctatttcgctcacg

SEQ ID NO: 159335 - DNA, 25 bp, E. coli
gaaaccgcaggtaaatgttgacagc

SEQ ID NO: 159336 - DNA, 25 bp, E. coli
gaaaccgcaggttaatgttgacagc

SEQ ID NO: 159337 - DNA, 25 bp, E. coli
gttgacagcttctgcctcgaacagg

SEQ ID NO: 159338 - DNA, 25 bp, E. coli
gttgacagcttcagcctcgaacagg

SEQ ID NO: 159339 - DNA, 25 bp, E. coli
tggtattacgatcaagagcacgatc

SEQ ID NO: 159340 - DNA, 25 bp, E. coli
tggtattacgatgaagagcacgatc

SEQ ID NO: 159341 - DNA, 25 bp, E. coli
cacctgtgggatatccggtggctaa

SEQ ID NO: 159342 - DNA, 25 bp, E. coli
cacctgtgggatttccggtggctaa

SEQ ID NO: 159343 - DNA, 25 bp, E. coli
tacacggctcacgtgtgggatatcc

SEQ ID NO: 159344 - DNA, 25 bp, E. coli
taaacgcaagccaatcccaaaagaa

SEQ ID NO: 159345 - DNA, 25 bp, E. coli
taaacgcaagcctatcccaaaagaa

SEQ ID NO: 159346 - DNA, 25 bp, E. coli
tacacggctcacctgtgggatatcc

SEQ ID NO: 159347 - DNA, 25 bp, E. coli
tgcaaataccttccaacgaaacgct

SEQ ID NO: 159348 - DNA, 25 bp, E. coli
tgcaaataccttgcaacgaaacgct

SEQ ID NO: 159349 - DNA, 25 bp, E. coli
tccagaaataaaggcaagccaatcc

SEQ ID NO: 159350 - DNA, 25 bp, E. coli
tccagaaataaacgcaagccaatcc

SEQ ID NO: 159351 - DNA, 25 bp, E. coli
tctgcgaaaactgcaaataccttcc

SEQ ID NO: 159352 - DNA, 25 bp, E. coli
tctgcgaaaactccaaataccttcc

SEQ ID NO: 159353 - DNA, 25 bp, E. coli
gccaatcccaaaagaatctgacgta

SEQ ID NO: 159354 - DNA, 25 bp, E. coli
gccaatcccaaatgaatctgacgta

SEQ ID NO: 159355 - DNA, 25 bp, E. coli
gaaacgctccagaaataaacgcaag

SEQ ID NO: 159356 - DNA, 25 bp, E. coli
gaaacgctccagtaataaacgcaag

SEQ ID NO: 159357 - DNA, 25 bp, E. coli
gtgggatatccggtggctaagacat

SEQ ID NO: 159358 - DNA, 25 bp, E. coli
gtgggatatccgctggctaagacat

SEQ ID NO: 159359 - DNA, 25 bp, E. coli
taccttccaacgaaacgctccagaa

SEQ ID NO: 159360 - DNA, 25 bp, E. coli
taccttccaacgtaacgctccagaa

SEQ ID NO: 159361 - DNA, 25 bp, E. coli
tcaccgacatcatctgcgaaaactg

SEQ ID NO: 159362 - DNA, 25 bp, E. coli
tcaccgacatcaactgcgaaaactg

SEQ ID NO: 159363 - DNA, 25 bp, E. coli
cagcccagcctgatgtttaagtgga

SEQ ID NO: 159364 - DNA, 25 bp, E. coli
cagcccagcctgttgtttaagtgga

SEQ ID NO: 159365 - DNA, 25 bp, E. coli
cactgctgttgcagccggtgaagac

SEQ ID NO: 159366 - DNA, 25 bp, E. coli
cacgtggcacgtttgcatggcattc

SEQ ID NO: 159367 - DNA, 25 bp, E. coli
cactgctgttgctgccggtgaagac

SEQ ID NO: 159368 - DNA, 25 bp, E. coli
cacgtggcacgtatgcatggcattc

SEQ ID NO: 159369 - DNA, 25 bp, E. coli
tacctggaaggatgcctcactgctg

SEQ ID NO: 159370 - DNA, 25 bp, E. coli
tacctggaaggaagcctcactgctg

SEQ ID NO: 159371 - DNA, 25 bp, E. coli
tgcttctgaactcgccgctgcgata

SEQ ID NO: 159372 - DNA, 25 bp, E. coli
tgcttctgaactggccgctgcgata

SEQ ID NO: 159373 - DNA, 25 bp, E. coli
tcagcttcagcgattactgggcaag

SEQ ID NO: 159374 - DNA, 25 bp, E. coli
tcagcttcagcgtttactgggcaag

SEQ ID NO: 159375 - DNA, 25 bp, E. coli
gcatgtgcccttgttaccttcggac

SEQ ID NO: 159376 - DNA, 25 bp, E. coli
gcatgtgcccttcttaccttcggac

SEQ ID NO: 159377 - DNA, 25 bp, E. coli
gaagcggtggagaacgcacaatcgc

SEQ ID NO: 159378 - DNA, 25 bp, E. coli
gaagcggtggagtacgcacaatcgc

SEQ ID NO: 159379 - DNA, 25 bp, E. coli
cgaaaatggatagcgcatgtgccct

SEQ ID NO: 159380 - DNA, 25 bp, E. coli
cgaaaatggataccgcatgtgccct

SEQ ID NO: 159381 - DNA, 25 bp, E. coli
gttgagatcctcaaagaagcggtgg

SEQ ID NO: 159382 - DNA, 25 bp, E. coli
gttgagatcctctaagaagcggtgg

SEQ ID NO: 159383 - DNA, 25 bp, E. coli
tggcatgactgtgtcccacgtggca

SEQ ID NO: 159384 - DNA, 25 bp, E. coli
tggcatgactgtctcccacgtggca

SEQ ID NO: 159385 - DNA, 25 bp, E. coli
caatgtcgggcaacggctgtttgca

SEQ ID NO: 159386 - DNA, 25 bp, E. coli
caatgtcgggcatcggctgtttgca

SEQ ID NO: 159387 - DNA, 25 bp, E. coli
agcgtaatcatcctcggtggcggca

SEQ ID NO: 159388 - DNA, 25 bp, E. coli
agcgtaatcatcgtcggtggcggca

SEQ ID NO: 159389 - DNA, 25 bp, E. coli
tatcagcagcgtcgacagagcgatc

SEQ ID NO: 159390 - DNA, 25 bp, E. coli
tattacccatcgaaccgtgctggtg

SEQ ID NO: 159391 - DNA, 25 bp, E. coli
tattacccatcgtaccgtgctggtg

SEQ ID NO: 159392 - DNA, 25 bp, E. coli
tatcagcagcgtggacagagcgatc

SEQ ID NO: 159393 - DNA, 25 bp, E. coli
ttggctggcgacatgggaaaattac

SEQ ID NO: 159394 - DNA, 25 bp, E. coli
ttggctggcgacttgggaaaattac

SEQ ID NO: 159395 - DNA, 25 bp, E. coli
tgtcatccactgcaacggcgcgaag

SEQ ID NO: 159396 - DNA, 25 bp, E. coli
tgtcatccactggaacggcgcgaag

SEQ ID NO: 159397 - DNA, 25 bp, E. coli
tgcattgccctgttcgcgtggctaa

SEQ ID NO: 159398 - DNA, 25 bp, E. coli
tgcattgccctgatcgcgtggctaa

SEQ ID NO: 159399 - DNA, 25 bp, E. coli
tcgggcgcaacatcgggctgatgac

SEQ ID NO: 159400 - DNA, 25 bp, E. coli
tcgggcgcaacaacgggctgatgac

SEQ ID NO: 159401 - DNA, 25 bp, E. coli
gaagttttgccgtgaactccagtcg

SEQ ID NO: 159402 - DNA, 25 bp, E. coli
gaagttttgccgagaactccagtcg

SEQ ID NO: 159403 - DNA, 25 bp, E. coli
gtacctgtcagcaactggcgcgcat

SEQ ID NO: 159404 - DNA, 25 bp, E. coli
gtacctgtcagctactggcgcgcat

SEQ ID NO: 159405 - DNA, 25 bp, E. coli
tggcgctggctatttcccggttaag

SEQ ID NO: 159406 - DNA, 25 bp, E. coli
tggcgctggctaattcccggttaag

SEQ ID NO: 159407 - DNA, 25 bp, E. coli
caactgctgttctccagtggcgtga

SEQ ID NO: 159408 - DNA, 25 bp, E. coli
caactgctgttcaccagtggcgtga

SEQ ID NO: 159409 - DNA, 25 bp, E. coli
tacacccggaaattgacgcagctat

SEQ ID NO: 159410 - DNA, 25 bp, E. coli
tacacccggaaaatgacgcagctat

SEQ ID NO: 159411 - DNA, 25 bp, E. coli
tgatgaagtgttgcaggcattacgc

SEQ ID NO: 159412 - DNA, 25 bp, E. coli
tgtggagaaccgcatgcaactgctg

SEQ ID NO: 159413 - DNA, 25 bp, E. coli
tgatgaagtgttccaggcattacgc

SEQ ID NO: 159414 - DNA, 25 bp, E. coli
tgtggagaaccggatgcaactgctg

SEQ ID NO: 159415 - DNA, 25 bp, E. coli
tcccttgcgaagaaattgatgcctc

SEQ ID NO: 159416 - DNA, 25 bp, E. coli
tcccttgcgaagtaattgatgcctc

SEQ ID NO: 159417 - DNA, 25 bp, E. coli
tcaccggagcgttttgttgagttaa

SEQ ID NO: 159418 - DNA, 25 bp, E. coli
tcaccggagcgtattgttgagttaa

SEQ ID NO: 159419 - DNA, 25 bp, E. coli
gccagttgggtaccgatatttcgcc

SEQ ID NO: 159420 - DNA, 25 bp, E. coli
gccagttgggtagcgatatttcgcc

SEQ ID NO: 159421 - DNA, 25 bp, E. coli
gctttcacggtgacattcaacatat

SEQ ID NO: 159422 - DNA, 25 bp, E. coli
gctttcacggtgtcattcaacatat

SEQ ID NO: 159423 - DNA, 25 bp, E. coli
gatatttcgccggaactcccttgcg

SEQ ID NO: 159424 - DNA, 25 bp, E. coli
gatatttcgccgcaactcccttgcg

SEQ ID NO: 159425 - DNA, 25 bp, E. coli
taatgcagatggacaggcgaagcag

SEQ ID NO: 159426 - DNA, 25 bp, E. coli
taatgcagatggtcaggcgaagcag

SEQ ID NO: 159427 - DNA, 25 bp, E. coli
gatgacgggacgaatctcaccggag

SEQ ID NO: 159428 - DNA, 25 bp, E. coli
gatgacgggacgtatctcaccggag

SEQ ID NO: 159429 - DNA, 25 bp, E. coli
caggatatgaaaaacgcgactttaa

SEQ ID NO: 159430 - DNA, 25 bp, E. coli
caggatatgaaatacgcgactttaa

SEQ ID NO: 159431 - DNA, 25 bp, E. coli
tacaggatatgataaacgcgacttt

SEQ ID NO: 159432 - DNA, 25 bp, E. coli
tacaggatatgaaaaacgcgacttt

SEQ ID NO: 159433 - DNA, 25 bp, E. coli
tatgaaaaacgccactttaaaagcg

SEQ ID NO: 159434 - DNA, 25 bp, E. coli
tatgaaaaacgcgactttaaaagcg

SEQ ID NO: 159435 - DNA, 25 bp, E. coli
tgtatacaggatttgaaaaacgcga

SEQ ID NO: 159436 - DNA, 25 bp, E. coli
tgtatacaggatatgaaaaacgcga

SEQ ID NO: 159437 - DNA, 25 bp, E. coli
tgaaaaacgcgagtttaaaagcgat

SEQ ID NO: 159438 - DNA, 25 bp, E. coli
tgaaaaacgcgactttaaaagcgat

SEQ ID NO: 159439 - DNA, 25 bp, E. coli
tgcccgtccgcgacagctgtataca

SEQ ID NO: 159440 - DNA, 25 bp, E. coli
tgcccgtccgcgtcagctgtataca

SEQ ID NO: 159441 - DNA, 25 bp, E. coli
gcgactttaaaagcgatatcaagcg

SEQ ID NO: 159442 - DNA, 25 bp, E. coli
gcgactttaaaaccgatatcaagcg

SEQ ID NO: 159443 - DNA, 25 bp, E. coli
gactttaaaagccatatcaagcgtt

SEQ ID NO: 159444 - DNA, 25 bp, E. coli
gactttaaaagcgatatcaagcgtt

SEQ ID NO: 159445 - DNA, 25 bp, E. coli
cgcgtcagctgtttacaggatatga

SEQ ID NO: 159446 - DNA, 25 bp, E. coli
cgcgtcagctgtatacaggatatga

SEQ ID NO: 159447 - DNA, 25 bp, E. coli
cgtccgcgtcagctgtatacaggat

SEQ ID NO: 159448 - DNA, 25 bp, E. coli
ctttaaaagcgatatcaagcgttaa

SEQ ID NO: 159449 - DNA, 25 bp, E. coli
ctttaaaagcgaaatcaagcgttaa

SEQ ID NO: 159450 - DNA, 25 bp, E. coli
cgtccgcgtcaggtgtatacaggat

SEQ ID NO: 159451 - DNA, 25 bp, E. coli
attagacccgtaaattgttcgaccg

SEQ ID NO: 159452 - DNA, 25 bp, E. coli
attagacccgtatattgttcgaccg

SEQ ID NO: 159453 - DNA, 25 bp, E. coli
tattgatgttgctgggatggcgaac

SEQ ID NO: 159454 - DNA, 25 bp, E. coli
tattgatgttgcagggatggcgaac

SEQ ID NO: 159455 - DNA, 25 bp, E. coli
tgtcgcctggcgtgattatgttccg

SEQ ID NO: 159456 - DNA, 25 bp, E. coli
tgtcggcgcttgctctgggaactac

SEQ ID NO: 159457 - DNA, 25 bp, E. coli
tgtcggcgcttggtctgggaactac

SEQ ID NO: 159458 - DNA, 25 bp, E. coli
tgtcgcctggcgagattatgttccg

SEQ ID NO: 159459 - DNA, 25 bp, E. coli
tccggtacagatcagcaagggcgtt

SEQ ID NO: 159460 - DNA, 25 bp, E. coli
tccggtacagatgagcaagggcgtt

SEQ ID NO: 159461 - DNA, 25 bp, E. coli
gaagcgtacttcgagcgtcatgatt

SEQ ID NO: 159462 - DNA, 25 bp, E. coli
gaagcgtacttccagcgtcatgatt

SEQ ID NO: 159463 - DNA, 25 bp, E. coli
gaactcaaaccggaggaaaatccga

SEQ ID NO: 159464 - DNA, 25 bp, E. coli
gaactcaaaccgcaggaaaatccga

SEQ ID NO: 159465 - DNA, 25 bp, E. coli
ggactgaacctcaccgcttcggtag

SEQ ID NO: 159466 - DNA, 25 bp, E. coli
ggactgaacctctccgcttcggtag

SEQ ID NO: 159467 - DNA, 25 bp, E. coli
ggcaaccttgaagaacctgcggtga

SEQ ID NO: 159468 - DNA, 25 bp, E. coli
ggcaaccttgaacaacctgcggtga

SEQ ID NO: 159469 - DNA, 25 bp, E. coli
taactacttcttccagggcgaccct

SEQ ID NO: 159470 - DNA, 25 bp, E. coli
taactacttcttgcagggcgaccct

SEQ ID NO: 159471 - DNA, 25 bp, E. coli
gatggcgaacccgaaactgcaacgg

SEQ ID NO: 159472 - DNA, 25 bp, E. coli
gatggcgaaccccaaactgcaacgg

SEQ ID NO: 159473 - DNA, 25 bp, E. coli
caattatcgcggttgtctttgggca

SEQ ID NO: 159474 - DNA, 25 bp, E. coli
caattatcgcggatgtctttgggca

SEQ ID NO: 159475 - DNA, 25 bp, E. coli
taccgtgcggtagataaagatgcag

SEQ ID NO: 159476 - DNA, 25 bp, E. coli
taccgtgcggtacataaagatgcag

SEQ ID NO: 159477 - DNA, 25 bp, E. coli
tatttaaccggaaccatggtgtgct

SEQ ID NO: 159478 - DNA, 25 bp, E. coli
tatttaaccggatccatggtgtgct

SEQ ID NO: 159479 - DNA, 25 bp, E. coli
tgatcatgctgacgaaattcccggc

SEQ ID NO: 159480 - DNA, 25 bp, E. coli
tgatcatgctgaggaaattcccggc

SEQ ID NO: 159481 - DNA, 25 bp, E. coli
tgagtgcgtatatacacagcctggt

SEQ ID NO: 159482 - DNA, 25 bp, E. coli
tgagtgcgtataaacacagcctggt

SEQ ID NO: 159483 - DNA, 25 bp, E. coli
tattggtcgtttcaccggtacctgg

SEQ ID NO: 159484 - DNA, 25 bp, E. coli
tattggtcgtttgaccggtacctgg

SEQ ID NO: 159485 - DNA, 25 bp, E. coli
cattaagaatctcggccaggacacc

SEQ ID NO: 159486 - DNA, 25 bp, E. coli
cattaagaatctgggccaggacacc

SEQ ID NO: 159487 - DNA, 25 bp, E. coli
tgtctggaaactgccgcaaaccctt

SEQ ID NO: 159488 - DNA, 25 bp, E. coli
tgtctggaaactcccgcaaaccctt

SEQ ID NO: 159489 - DNA, 25 bp, E. coli
tggcccgccgcacaaataatgaact

SEQ ID NO: 159490 - DNA, 25 bp, E. coli
tgggcggtagccaataaccttaacg

SEQ ID NO: 159491 - DNA, 25 bp, E. coli
tggcccgccgcagaaataatgaact

SEQ ID NO: 159492 - DNA, 25 bp, E. coli
tgggcggtagcctataaccttaacg

SEQ ID NO: 159493 - DNA, 25 bp, E. coli
tcacagtgacgcgaaacaaggatcg

SEQ ID NO: 159494 - DNA, 25 bp, E. coli
tcacagtgacgccaaacaaggatcg

SEQ ID NO: 159495 - DNA, 25 bp, E. coli
atcctgcgtcagcaaggcacacaga

SEQ ID NO: 159496 - DNA, 25 bp, E. coli
atcctgcgtcaggaaggcacacaga

SEQ ID NO: 159497 - DNA, 25 bp, E. coli
acatgtctataagatcctgcgtcag

SEQ ID NO: 159498 - DNA, 25 bp, E. coli
acatgtctataacatcctgcgtcag

SEQ ID NO: 159499 - DNA, 25 bp, E. coli
acatcctgcgtctggaaggcacaca

SEQ ID NO: 159500 - DNA, 25 bp, E. coli
acatcctgcgtcaggaaggcacaca

SEQ ID NO: 159501 - DNA, 25 bp, E. coli
tgcacttagcaaagaaaccccgttg

SEQ ID NO: 159502 - DNA, 25 bp, E. coli
tgaacatgtctataacatcctgcgt

SEQ ID NO: 159503 - DNA, 25 bp, E. coli
tgcacttagcaatgaaaccccgttg

SEQ ID NO: 159504 - DNA, 25 bp, E. coli
tgaacatgtctaaaacatcctgcgt

SEQ ID NO: 159505 - DNA, 25 bp, E. coli
tcgacgacctgtatgcccgtggtca

SEQ ID NO: 159506 - DNA, 25 bp, E. coli
tcgacgacctgtttgcccgtggtca

SEQ ID NO: 159507 - DNA, 25 bp, E. coli
gctgcacttagctaagaaaccccgt

SEQ ID NO: 159508 - DNA, 25 bp, E. coli
gctgcacttagcaaagaaaccccgt

SEQ ID NO: 159509 - DNA, 25 bp, E. coli
gaaaccccgttggaaattgttggca

SEQ ID NO: 159510 - DNA, 25 bp, E. coli
gaaaccccgttgcaaattgttggca

SEQ ID NO: 159511 - DNA, 25 bp, E. coli
cccgttgcaaatagttggcaccatc

SEQ ID NO: 159512 - DNA, 25 bp, E. coli
cccgttgcaaattgttggcaccatc

SEQ ID NO: 159513 - DNA, 25 bp, E. coli
gtttcgcgctgcacttagcaaagaa

SEQ ID NO: 159514 - DNA, 25 bp, E. coli
gtttcgcgctgctcttagcaaagaa

SEQ ID NO: 159515 - DNA, 25 bp, E. coli
gacgacctgtttccccgtggtcagg

SEQ ID NO: 159516 - DNA, 25 bp, E. coli
gacgacctgtttgcccgtggtcagg

SEQ ID NO: 159517 - DNA, 25 bp, E. coli
caaaacacaggttttccactggtta

SEQ ID NO: 159518 - DNA, 25 bp, E. coli
caaaacacaggtattccactggtta

SEQ ID NO: 159519 - DNA, 25 bp, E. coli
tacgaacggacgcattatcagtgac

SEQ ID NO: 159520 - DNA, 25 bp, E. coli
tacgccattttgaatttacgaacgg

SEQ ID NO: 159521 - DNA, 25 bp, E. coli
tacgaacggacggattatcagtgac

SEQ ID NO: 159522 - DNA, 25 bp, E. coli
tacgccattttgtatttacgaacgg

SEQ ID NO: 159523 - DNA, 25 bp, E. coli
tatcagtgactttaacggcatgggc

SEQ ID NO: 159524 - DNA, 25 bp, E. coli
tatcagtgacttaaacggcatgggc

SEQ ID NO: 159525 - DNA, 25 bp, E. coli
tgtatcagacaaaaagcattcattc

SEQ ID NO: 159526 - DNA, 25 bp, E. coli
tgtatcagacaataagcattcattc

SEQ ID NO: 159527 - DNA, 25 bp, E. coli
cctttagaaataatcaaaacacagg

SEQ ID NO: 159528 - DNA, 25 bp, E. coli
cctttagaaatattcaaaacacagg

SEQ ID NO: 159529 - DNA, 25 bp, E. coli
gaatattttgattaatccccgtact

SEQ ID NO: 159530 - DNA, 25 bp, E. coli
gaatattttgataaatccccgtact

SEQ ID NO: 159531 - DNA, 25 bp, E. coli
ctttaacggcatgggcaaagtgaaa

SEQ ID NO: 159532 - DNA, 25 bp, E. coli
ctttaacggcatcggcaaagtgaaa

SEQ ID NO: 159533 - DNA, 25 bp, E. coli
gattattcttcaaaatcagtacggg

SEQ ID NO: 159534 - DNA, 25 bp, E. coli
gattattcttcataatcagtacggg

SEQ ID NO: 159535 - DNA, 25 bp, E. coli
taagcattcattcaaaacctttaga

SEQ ID NO: 159536 - DNA, 25 bp, E. coli
taagcattcattgaaaacctttaga

SEQ ID NO: 159537 - DNA, 25 bp, E. coli
gagtgttatttcttgtgtatcagac

SEQ ID NO: 159538 - DNA, 25 bp, E. coli
gagtgttatttcatgtgtatcagac

SEQ ID NO: 159539 - DNA, 25 bp, E. coli
caagccaggcttgaaaatacttata

SEQ ID NO: 159540 - DNA, 25 bp, E. coli
caagccaggcttcaaaatacttata

SEQ ID NO: 159541 - DNA, 25 bp, E. coli
catcattggaatcgattttcgggcg

SEQ ID NO: 159542 - DNA, 25 bp, E. coli
catcattggaatggattttcgggcg

SEQ ID NO: 159543 - DNA, 25 bp, E. coli
taaatccgtgagtgccgtagcgcag

SEQ ID NO: 159544 - DNA, 25 bp, E. coli
tacagagagagaatttggcaataca

SEQ ID NO: 159545 - DNA, 25 bp, E. coli
tacagagagagattttggcaataca

SEQ ID NO: 159546 - DNA, 25 bp, E. coli
taaatccgtgagagccgtagcgcag

SEQ ID NO: 159547 - DNA, 25 bp, E. coli
tatacattgtttccaacaagccagg

SEQ ID NO: 159548 - DNA, 25 bp, E. coli
tattcctgaagaacctcatcattgg

SEQ ID NO: 159549 - DNA, 25 bp, E. coli
tatacattgtttgcaacaagccagg

SEQ ID NO: 159550 - DNA, 25 bp, E. coli
tattcctgaagatcctcatcattgg

SEQ ID NO: 159551 - DNA, 25 bp, E. coli
tcatcaggactttcgaaaaatccga

SEQ ID NO: 159552 - DNA, 25 bp, E. coli
tcatcaggacttacgaaaaatccga

SEQ ID NO: 159553 - DNA, 25 bp, E. coli
gaaatcatgcatcggaatttactga

SEQ ID NO: 159554 - DNA, 25 bp, E. coli
gaaatcatgcatgggaatttactga

SEQ ID NO: 159555 - DNA, 25 bp, E. coli
cgtagcgcagcctttcatcaggact

SEQ ID NO: 159556 - DNA, 25 bp, E. coli
cgtagcgcagccattcatcaggact

SEQ ID NO: 159557 - DNA, 25 bp, E. coli
ggattttatatgcacactctgctca

SEQ ID NO: 159558 - DNA, 25 bp, E. coli
gggatttatgccctattcctgaaga

SEQ ID NO: 159559 - DNA, 25 bp, E. coli
ggattttatatggacactctgctca

SEQ ID NO: 159560 - DNA, 25 bp, E. coli
gggatttatgccgtattcctgaaga

SEQ ID NO: 159561 - DNA, 25 bp, E. coli
aagaagaggacgagcttgaccgcct

SEQ ID NO: 159562 - DNA, 25 bp, E. coli
aagaagaggacgtgcttgaccgcct

SEQ ID NO: 159563 - DNA, 25 bp, E. coli
cattgttaacagtcagggcggagag

SEQ ID NO: 159564 - DNA, 25 bp, E. coli
cattgttaacagacagggcggagag

SEQ ID NO: 159565 - DNA, 25 bp, E. coli
aaaaatcgcggctgcttgcggaacg

SEQ ID NO: 159566 - DNA, 25 bp, E. coli
aaaaatcgcggcagcttgcggaacg

SEQ ID NO: 159567 - DNA, 25 bp, E. coli
tacctggatgatatcgccgtgaagc

SEQ ID NO: 159568 - DNA, 25 bp, E. coli
tacctggatgatttcgccgtgaagc

SEQ ID NO: 159569 - DNA, 25 bp, E. coli
ttactcgatatagcggaaagccgtc

SEQ ID NO: 159570 - DNA, 25 bp, E. coli
ttactcgatataccggaaagccgtc

SEQ ID NO: 159571 - DNA, 25 bp, E. coli
tcccgccgactggagtaatctggaa

SEQ ID NO: 159572 - DNA, 25 bp, E. coli
tcccgccgactgcagtaatctggaa

SEQ ID NO: 159573 - DNA, 25 bp, E. coli
cattaagcgcgatatccgacgcgga

SEQ ID NO: 159574 - DNA, 25 bp, E. coli
cggcgcgcgggtacagcattgttaa

SEQ ID NO: 159575 - DNA, 25 bp, E. coli
cattaagcgcgaaatccgacgcgga

SEQ ID NO: 159576 - DNA, 25 bp, E. coli
cggcgcgcgggttcagcattgttaa

SEQ ID NO: 159577 - DNA, 25 bp, E. coli
gataagccgccgaaaaaatccaccg

SEQ ID NO: 159578 - DNA, 25 bp, E. coli
gtgatgataaaaatggcctccttgc

SEQ ID NO: 159579 - DNA, 25 bp, E. coli
gtgatgataaaattggcctccttgc

SEQ ID NO: 159580 - DNA, 25 bp, E. coli
gataagccgccgtaaaaatccaccg

SEQ ID NO: 159581 - DNA, 25 bp, E. coli
gagagagcagaatccccgcattaag

SEQ ID NO: 159582 - DNA, 25 bp, E. coli
gagagagcagaaaccccgcattaag

SEQ ID NO: 159583 - DNA, 25 bp, E. coli
aatcgcgccggacttggtgtttcct

SEQ ID NO: 159584 - DNA, 25 bp, E. coli
aatcgcgccggagttggtgtttcct

SEQ ID NO: 159585 - DNA, 25 bp, E. coli
aatgaagtgataaatactgaacgcc

SEQ ID NO: 159586 - DNA, 25 bp, E. coli
aatgaagtgatatatactgaacgcc

SEQ ID NO: 159587 - DNA, 25 bp, E. coli
catacaagagcaattgacaaattaa

SEQ ID NO: 159588 - DNA, 25 bp, E. coli
catacaagagcatttgacaaattaa

SEQ ID NO: 159589 - DNA, 25 bp, E. coli
gccgctgtttgaaatcgcgccggag

SEQ ID NO: 159590 - DNA, 25 bp, E. coli
gccgctgtttgatatcgcgccggag

SEQ ID NO: 159591 - DNA, 25 bp, E. coli
gcgtcaaatctttcatacaagagca

SEQ ID NO: 159592 - DNA, 25 bp, E. coli
gcgtcaaatcttacatacaagagca

SEQ ID NO: 159593 - DNA, 25 bp, E. coli
gctggaaacctctcttgcacctgaa

SEQ ID NO: 159594 - DNA, 25 bp, E. coli
gctggaaacctcacttgcacctgaa

SEQ ID NO: 159595 - DNA, 25 bp, E. coli
gaaacctctcttgcacctgaagagc

SEQ ID NO: 159596 - DNA, 25 bp, E. coli
gaaacctctcttccacctgaagagc

SEQ ID NO: 159597 - DNA, 25 bp, E. coli
cgcgccggagttggtgtttcctgat

SEQ ID NO: 159598 - DNA, 25 bp, E. coli
cgcgccggagttcgtgtttcctgat

SEQ ID NO: 159599 - DNA, 25 bp, E. coli
gggagatgttgcgtcaaatcttaca

SEQ ID NO: 159600 - DNA, 25 bp, E. coli
gtgataaatactgaacgcctgaccg

SEQ ID NO: 159601 - DNA, 25 bp, E. coli
gggagatgttgcctcaaatcttaca

SEQ ID NO: 159602 - DNA, 25 bp, E. coli
gtgataaatactcaacgcctgaccg

SEQ ID NO: 159603 - DNA, 25 bp, E. coli
gtggcgctggaatcctctcttgcac

SEQ ID NO: 159604 - DNA, 25 bp, E. coli
gtggcgctggaaacctctcttgcac

SEQ ID NO: 159605 - DNA, 25 bp, E. coli
caagcctgatggattttgctgtgcc

SEQ ID NO: 159606 - DNA, 25 bp, E. coli
caagcctgatggtttttgctgtgcc

SEQ ID NO: 159607 - DNA, 25 bp, E. coli
tagccggttgtacgttcttcattgc

SEQ ID NO: 159608 - DNA, 25 bp, E. coli
tagccggttgtaggttcttcattgc

SEQ ID NO: 159609 - DNA, 25 bp, E. coli
cctgatggattttgctgtgccggtg

SEQ ID NO: 159610 - DNA, 25 bp, E. coli
ccggtggtggcgagtctgctggtct

SEQ ID NO: 159611 - DNA, 25 bp, E. coli
cctgatggatttagctgtgccggtg

SEQ ID NO: 159612 - DNA, 25 bp, E. coli
ccggtggtggcgtgtctgctggtct

SEQ ID NO: 159613 - DNA, 25 bp, E. coli
gcgatagccggtagtacgttcttca

SEQ ID NO: 159614 - DNA, 25 bp, E. coli
gcgatagccggttgtacgttcttca

SEQ ID NO: 159615 - DNA, 25 bp, E. coli
ccggttgtacgttcttcattgcgcg

SEQ ID NO: 159616 - DNA, 25 bp, E. coli
ccggttgtacgtacttcattgcgcg

SEQ ID NO: 159617 - DNA, 25 bp, E. coli
ctggctgttggttaatcgtgggtga

SEQ ID NO: 159618 - DNA, 25 bp, E. coli
ctggctgttggtaaatcgtgggtga

SEQ ID NO: 159619 - DNA, 25 bp, E. coli
gtacgttcttcaatgcgcgtgaaca

SEQ ID NO: 159620 - DNA, 25 bp, E. coli
gtacgttcttcattgcgcgtgaaca

SEQ ID NO: 159621 - DNA, 25 bp, E. coli
ggttgtacgttcttcattgcgcgtg

SEQ ID NO: 159622 - DNA, 25 bp, E. coli
ggttgtacgttcatcattgcgcgtg

SEQ ID NO: 159623 - DNA, 25 bp, E. coli
ggcgtgtctgctggtctggctgttg

SEQ ID NO: 159624 - DNA, 25 bp, E. coli
tggattttgctgtgccggtggtggc

SEQ ID NO: 159625 - DNA, 25 bp, E. coli
ggcgtgtctgctcgtctggctgttg

SEQ ID NO: 159626 - DNA, 25 bp, E. coli
tggattttgctgagccggtggtggc

SEQ ID NO: 159627 - DNA, 25 bp, E. coli
taaatctgcgatgataagcctggtc

SEQ ID NO: 159628 - DNA, 25 bp, E. coli
taaaggcagttagcgcagctatggg

SEQ ID NO: 159629 - DNA, 25 bp, E. coli
taaaggcagttaccgcagctatggg

SEQ ID NO: 159630 - DNA, 25 bp, E. coli
taaatctgcgatcataagcctggtc

SEQ ID NO: 159631 - DNA, 25 bp, E. coli
tatgcctattgacggaatgccagcc

SEQ ID NO: 159632 - DNA, 25 bp, E. coli
tatgcctattgagggaatgccagcc

SEQ ID NO: 159633 - DNA, 25 bp, E. coli
tcgaaattaatgatgcccctgggat

SEQ ID NO: 159634 - DNA, 25 bp, E. coli
tcgaaattaatgttgcccctgggat

SEQ ID NO: 159635 - DNA, 25 bp, E. coli
tcatggcggcgctacaaaaaacccg

SEQ ID NO: 159636 - DNA, 25 bp, E. coli
tcatggcggcgcaacaaaaaacccg

SEQ ID NO: 159637 - DNA, 25 bp, E. coli
gaaatatcgccttcgttattccggg

SEQ ID NO: 159638 - DNA, 25 bp, E. coli
gaaatatcgcctacgttattccggg

SEQ ID NO: 159639 - DNA, 25 bp, E. coli
cgctttgcgctgctgaatctcatca

SEQ ID NO: 159640 - DNA, 25 bp, E. coli
cgctttgcgctggtgaatctcatca

SEQ ID NO: 159641 - DNA, 25 bp, E. coli
cattgccgcctgaactagccttggg

SEQ ID NO: 159642 - DNA, 25 bp, E. coli
cattgccgcctgtactagccttggg

SEQ ID NO: 159643 - DNA, 25 bp, E. coli
gatcgtgctgatgatgtcggacaaa

SEQ ID NO: 159644 - DNA, 25 bp, E. coli
gatcgtgctgatcatgtcggacaaa

SEQ ID NO: 159645 - DNA, 25 bp, E. coli
ggattcgtcaatccaagcgtggtga

SEQ ID NO: 159646 - DNA, 25 bp, E. coli
ggattcgtcaatgcaagcgtggtga

SEQ ID NO: 159647 - DNA, 25 bp, E. coli
tggcggcacgcgtggaaacgtttaa

SEQ ID NO: 159648 - DNA, 25 bp, E. coli
tggcggcacgcgaggaaacgtttaa

SEQ ID NO: 159649 - DNA, 25 bp, E. coli
aacgtactttcagccctgaattcag

SEQ ID NO: 159650 - DNA, 25 bp, E. coli
aacgtactttcacccctgaattcag

SEQ ID NO: 159651 - DNA, 25 bp, E. coli
taccacgcttgagagttgggtgcgc

SEQ ID NO: 159652 - DNA, 25 bp, E. coli
taccacgcttgacagttgggtgcgc

SEQ ID NO: 159653 - DNA, 25 bp, E. coli
tgcgccagctcaggcgagagcgtca

SEQ ID NO: 159654 - DNA, 25 bp, E. coli
tgcgccagctcacgcgagagcgtca

SEQ ID NO: 159655 - DNA, 25 bp, E. coli
ccagtgaagcgatgaatgtcggttc

SEQ ID NO: 159656 - DNA, 25 bp, E. coli
ccagtgaagcgaagaatgtcggttc

SEQ ID NO: 159657 - DNA, 25 bp, E. coli
gctactcatatccacaagccagtga

SEQ ID NO: 159658 - DNA, 25 bp, E. coli
gctaattgttgataagggctactca

SEQ ID NO: 159659 - DNA, 25 bp, E. coli
gctaattgttgaaaagggctactca

SEQ ID NO: 159660 - DNA, 25 bp, E. coli
gctactcatatcgacaagccagtga

SEQ ID NO: 159661 - DNA, 25 bp, E. coli
gaattcaggctggaatgtgcacagc

SEQ ID NO: 159662 - DNA, 25 bp, E. coli
gaattcaggctgcaatgtgcacagc

SEQ ID NO: 159663 - DNA, 25 bp, E. coli
gaatgtcggttctaccacgcttgag

SEQ ID NO: 159664 - DNA, 25 bp, E. coli
gaatgtcggttcaaccacgcttgag

SEQ ID NO: 159665 - DNA, 25 bp, E. coli
cttgagagttgggtgcgccagctca

SEQ ID NO: 159666 - DNA, 25 bp, E. coli
cttgagagttggctgcgccagctca

SEQ ID NO: 159667 - DNA, 25 bp, E. coli
gataagggctactcatatcgacaag

SEQ ID NO: 159668 - DNA, 25 bp, E. coli
gataagggctacacatatcgacaag

SEQ ID NO: 159669 - DNA, 25 bp, E. coli
tggaatgtgcactgctaattgttga

SEQ ID NO: 159670 - DNA, 25 bp, E. coli
tggaatgtgcacagctaattgttga

SEQ ID NO: 159671 - DNA, 25 bp, E. coli
caagtggccagctgcaacagtctca

SEQ ID NO: 159672 - DNA, 25 bp, E. coli
caagtggccagcagcaacagtctca

SEQ ID NO: 159673 - DNA, 25 bp, E. coli
ctttactgaacgagaaggcgggtgc

SEQ ID NO: 159674 - DNA, 25 bp, E. coli
cagtctcacctgatgaagcaagtgc

SEQ ID NO: 159675 - DNA, 25 bp, E. coli
ctttactgaacgtgaaggcgggtgc

SEQ ID NO: 159676 - DNA, 25 bp, E. coli
cagtctcacctgttgaagcaagtgc

SEQ ID NO: 159677 - DNA, 25 bp, E. coli
tatgcaggctgctagtggccagctg

SEQ ID NO: 159678 - DNA, 25 bp, E. coli
tatgcaggctgcaagtggccagctg

SEQ ID NO: 159679 - DNA, 25 bp, E. coli
tgtcgcacgcgttaagactttactg

SEQ ID NO: 159680 - DNA, 25 bp, E. coli
tgtcgcacgcgtaaagactttactg

SEQ ID NO: 159681 - DNA, 25 bp, E. coli
tgctgcgtgagctgttcaacctgcg

SEQ ID NO: 159682 - DNA, 25 bp, E. coli
tgctgcgtgagcagttcaacctgcg

SEQ ID NO: 159683 - DNA, 25 bp, E. coli
gctgaacaccgagctgctgaacctg

SEQ ID NO: 159684 - DNA, 25 bp, E. coli
gctgaacaccgacctgctgaacctg

SEQ ID NO: 159685 - DNA, 25 bp, E. coli
gaagagcgttgatgagctgaacacc

SEQ ID NO: 159686 - DNA, 25 bp, E. coli
gaagcaagtgcgacgcgatgtcgca

SEQ ID NO: 159687 - DNA, 25 bp, E. coli
gaagagcgttgaagagctgaacacc

SEQ ID NO: 159688 - DNA, 25 bp, E. coli
gaagcaagtgcgtcgcgatgtcgca

SEQ ID NO: 159689 - DNA, 25 bp, E. coli
ccgagctgctgatcctgctgcgtga

SEQ ID NO: 159690 - DNA, 25 bp, E. coli
ccgagctgctgaacctgctgcgtga

SEQ ID NO: 159691 - DNA, 25 bp, E. coli
tcaacctgcgtatgcaggctgcaag

SEQ ID NO: 159692 - DNA, 25 bp, E. coli
tcaacctgcgtaagcaggctgcaag

SEQ ID NO: 159693 - DNA, 25 bp, E. coli
caacagcgtgttggcattgcccgcg

SEQ ID NO: 159694 - DNA, 25 bp, E. coli
caacagcgtgttcgcattgcccgcg

SEQ ID NO: 159695 - DNA, 25 bp, E. coli
tacgttccatatgcagccgggtgag

SEQ ID NO: 159696 - DNA, 25 bp, E. coli
taaagtcgggctactggacaaagcg

SEQ ID NO: 159697 - DNA, 25 bp, E. coli
taaagtcgggcttctggacaaagcg

SEQ ID NO: 159698 - DNA, 25 bp, E. coli
tacgttccatatccagccgggtgag

SEQ ID NO: 159699 - DNA, 25 bp, E. coli
tcattccggcgctgggaaaagtacc

SEQ ID NO: 159700 - DNA, 25 bp, E. coli
tcattccggcgcagggaaaagtacc

SEQ ID NO: 159701 - DNA, 25 bp, E. coli
tcaccctgagcgatggtcacttgca

SEQ ID NO: 159702 - DNA, 25 bp, E. coli
tcaccctgagcgttggtcacttgca

SEQ ID NO: 159703 - DNA, 25 bp, E. coli
tcagcaaggcttatctcggtgggag

SEQ ID NO: 159704 - DNA, 25 bp, E. coli
gaaccgactggtaacctggacgacg

SEQ ID NO: 159705 - DNA, 25 bp, E. coli
gaaccgactggttacctggacgacg

SEQ ID NO: 159706 - DNA, 25 bp, E. coli
gaaaatctggtttagcggccatgac

SEQ ID NO: 159707 - DNA, 25 bp, E. coli
gaaaatctggttaagcggccatgac

SEQ ID NO: 159708 - DNA, 25 bp, E. coli
gaaaagtaccctgctgaagctgatc

SEQ ID NO: 159709 - DNA, 25 bp, E. coli
gaaaagtaccctcctgaagctgatc

SEQ ID NO: 159710 - DNA, 25 bp, E. coli
gtgaagttccgtatctgcgccgcca

SEQ ID NO: 159711 - DNA, 25 bp, E. coli
gtgaagttccgtttctgcgccgcca

SEQ ID NO: 159712 - DNA, 25 bp, E. coli
taaccgtattgatggcaacgcacga

SEQ ID NO: 159713 - DNA, 25 bp, E. coli
taaccgtattgaaggcaacgcacga

SEQ ID NO: 159714 - DNA, 25 bp, E. coli
tcagcaaggcttttctcggtgggag

SEQ ID NO: 159715 - DNA, 25 bp, E. coli
caggttatggcgactatttcggtca

SEQ ID NO: 159716 - DNA, 25 bp, E. coli
caggttatggcgtctatttcggtca

SEQ ID NO: 159717 - DNA, 25 bp, E. coli
attcgcgctattacgttgaggtgga

SEQ ID NO: 159718 - DNA, 25 bp, E. coli
attcgcgctatttcgttgaggtgga

SEQ ID NO: 159719 - DNA, 25 bp, E. coli
actatcgtcaatcaaatcattgccg

SEQ ID NO: 159720 - DNA, 25 bp, E. coli
actatcgtcaatgaaatcattgccg

SEQ ID NO: 159721 - DNA, 25 bp, E. coli
tattacgttgaggtggaagcccgtg

SEQ ID NO: 159722 - DNA, 25 bp, E. coli
tattacgttgagctggaagcccgtg

SEQ ID NO: 159723 - DNA, 25 bp, E. coli
tgacgcgacgaacacgcttaccact

SEQ ID NO: 159724 - DNA, 25 bp, E. coli
tgacgcgacgaagacgcttaccact

SEQ ID NO: 159725 - DNA, 25 bp, E. coli
tgcgcaaggctagcagctgcatttg

SEQ ID NO: 159726 - DNA, 25 bp, E. coli
tgcgcaaggctaccagctgcatttg

SEQ ID NO: 159727 - DNA, 25 bp, E. coli
gccgggtcattagagaagcaggtta

SEQ ID NO: 159728 - DNA, 25 bp, E. coli
gccgggtcattacagaagcaggtta

SEQ ID NO: 159729 - DNA, 25 bp, E. coli
gcgcgccgggtcattacagaagcag

SEQ ID NO: 159730 - DNA, 25 bp, E. coli
gcgcgccgggtctttacagaagcag

SEQ ID NO: 159731 - DNA, 25 bp, E. coli
gaacacgcttacgactatcgtcaat

SEQ ID NO: 159732 - DNA, 25 bp, E. coli
gaacacgcttaccactatcgtcaat

SEQ ID NO: 159733 - DNA, 25 bp, E. coli
cattacagaagctggttatggcgac

SEQ ID NO: 159734 - DNA, 25 bp, E. coli
cattacagaagcaggttatggcgac

SEQ ID NO: 159735 - DNA, 25 bp, E. coli
gtggaagcccgtgcgcaaggctacc

SEQ ID NO: 159736 - DNA, 25 bp, E. coli
gtggaagcccgtccgcaaggctacc

SEQ ID NO: 159737 - DNA, 25 bp, E. coli
tacggccaggaaagctgatgatgac

SEQ ID NO: 159738 - DNA, 25 bp, E. coli
tacggccaggaatgctgatgatgac

SEQ ID NO: 159739 - DNA, 25 bp, E. coli
tttcactaagccatccccgttggcg

SEQ ID NO: 159740 - DNA, 25 bp, E. coli
tatgcgtgtttcatttacggccagg

SEQ ID NO: 159741 - DNA, 25 bp, E. coli
tatgcgtgtttcttttacggccagg

SEQ ID NO: 159742 - DNA, 25 bp, E. coli
tttcactaagccttccccgttggcg

SEQ ID NO: 159743 - DNA, 25 bp, E. coli
tatagatcacacttatgagtatgcg

SEQ ID NO: 159744 - DNA, 25 bp, E. coli
tatagatcacacatatgagtatgcg

SEQ ID NO: 159745 - DNA, 25 bp, E. coli
tgttcctgcaacagaacaggcgtga

SEQ ID NO: 159746 - DNA, 25 bp, E. coli
tgatgatgacaacattactacccgt

SEQ ID NO: 159747 - DNA, 25 bp, E. coli
tgatgatgacaagattactacccgt

SEQ ID NO: 159748 - DNA, 25 bp, E. coli
tgttcctgcaactgaacaggcgtga

SEQ ID NO: 159749 - DNA, 25 bp, E. coli
tctggttgagacagttgataaaacg

SEQ ID NO: 159750 - DNA, 25 bp, E. coli
tctggttgagactgttgataaaacg

SEQ ID NO: 159751 - DNA, 25 bp, E. coli
gctcaatgctctccgcgctggtcgt

SEQ ID NO: 159752 - DNA, 25 bp, E. coli
gctcaatgctctgcgcgctggtcgt

SEQ ID NO: 159753 - DNA, 25 bp, E. coli
gataaaacgtaaaaaggaatgctct

SEQ ID NO: 159754 - DNA, 25 bp, E. coli
gataaaacgtaataaggaatgctct

SEQ ID NO: 159755 - DNA, 25 bp, E. coli
ggcgtgaaacgcaatccaacaggat

SEQ ID NO: 159756 - DNA, 25 bp, E. coli
ggcgtgaaacgctatccaacaggat

SEQ ID NO: 159757 - DNA, 25 bp, E. coli
gatggataccgttttgtcagccagt

SEQ ID NO: 159758 - DNA, 25 bp, E. coli
gatggataccgtattgtcagccagt

SEQ ID NO: 159759 - DNA, 25 bp, E. coli
tactcagtgatggtttgtggaaaag

SEQ ID NO: 159760 - DNA, 25 bp, E. coli
tactaacaataggtctaccacgtat

SEQ ID NO: 159761 - DNA, 25 bp, E. coli
tactaacaatagctctaccacgtat

SEQ ID NO: 159762 - DNA, 25 bp, E. coli
tactcagtgatgctttgtggaaaag

SEQ ID NO: 159763 - DNA, 25 bp, E. coli
tagcggatgtcaatgctcaattagc

SEQ ID NO: 159764 - DNA, 25 bp, E. coli
tagcggatgtcattgctcaattagc

SEQ ID NO: 159765 - DNA, 25 bp, E. coli
ttctattcctttgaatcgactgcgg

SEQ ID NO: 159766 - DNA, 25 bp, E. coli
ttctattcctttcaatcgactgcgg

SEQ ID NO: 159767 - DNA, 25 bp, E. coli
tgtggcaaagtggtctcaactcaaa

SEQ ID NO: 159768 - DNA, 25 bp, E. coli
tgtggcaaagtgctctcaactcaaa

SEQ ID NO: 159769 - DNA, 25 bp, E. coli
tcgactgcggatcaaatggttttaa

SEQ ID NO: 159770 - DNA, 25 bp, E. coli
tcgactgcggatgaaatggttttaa

SEQ ID NO: 159771 - DNA, 25 bp, E. coli
gaaaagtgtcaaataatatcctgga

SEQ ID NO: 159772 - DNA, 25 bp, E. coli
gaaatatattaatgctgcgagctat

SEQ ID NO: 159773 - DNA, 25 bp, E. coli
gaaaaacaataaacacttcggtagg

SEQ ID NO: 159774 - DNA, 25 bp, E. coli
gaaaagtgtcaattaatatcctgga

SEQ ID NO: 159775 - DNA, 25 bp, E. coli
gaaaaacaataatcacttcggtagg

SEQ ID NO: 159776 - DNA, 25 bp, E. coli
gaaatatattaaagctgcgagctat

SEQ ID NO: 159777 - DNA, 25 bp, E. coli
taacaggattttagctaacataacc

SEQ ID NO: 159778 - DNA, 25 bp, E. coli
taacaggatttttgctaacataacc

SEQ ID NO: 159779 - DNA, 25 bp, E. coli
gagagagatatcaaaggaaggccat

SEQ ID NO: 159780 - DNA, 25 bp, E. coli
gagagagatatctaaggaaggccat

SEQ ID NO: 159781 - DNA, 25 bp, E. coli
aattctgacgccttttccggaaaag

SEQ ID NO: 159782 - DNA, 25 bp, E. coli
aattctgacgccatttccggaaaag

SEQ ID NO: 159783 - DNA, 25 bp, E. coli
catcgactcactcagtatgtgcaga

SEQ ID NO: 159784 - DNA, 25 bp, E. coli
catcgactcactgagtatgtgcaga

SEQ ID NO: 159785 - DNA, 25 bp, E. coli
aaagaccctgcaagcgattgccaca

SEQ ID NO: 159786 - DNA, 25 bp, E. coli
aaagaccctgcatgcgattgccaca

SEQ ID NO: 159787 - DNA, 25 bp, E. coli
tatccagagaaacttgccgttggtg

SEQ ID NO: 159788 - DNA, 25 bp, E. coli
tatgtgcagaacttggtatccggaa

SEQ ID NO: 159789 - DNA, 25 bp, E. coli
tatccagagaaagttgccgttggtg

SEQ ID NO: 159790 - DNA, 25 bp, E. coli
tatgtgcagaacatggtatccggaa

SEQ ID NO: 159791 - DNA, 25 bp, E. coli
tgagattgcccgttatgaacaacgc

SEQ ID NO: 159792 - DNA, 25 bp, E. coli
tgaacaacgcagatcaaagaccctg

SEQ ID NO: 159793 - DNA, 25 bp, E. coli
tgagattgcccgatatgaacaacgc

SEQ ID NO: 159794 - DNA, 25 bp, E. coli
tgaacaacgcagttcaaagaccctg

SEQ ID NO: 159795 - DNA, 25 bp, E. coli
tctatacgggatccggtgacagcag

SEQ ID NO: 159796 - DNA, 25 bp, E. coli
tctatacgggatgcggtgacagcag

SEQ ID NO: 159797 - DNA, 25 bp, E. coli
gaaacggaatattcggctacatgca

SEQ ID NO: 159798 - DNA, 25 bp, E. coli
gaaacggaatatacggctacatgca

SEQ ID NO: 159799 - DNA, 25 bp, E. coli
cgatttcaggctgctctatacggga

SEQ ID NO: 159800 - DNA, 25 bp, E. coli
cgatttcaggctcctctatacggga

SEQ ID NO: 159801 - DNA, 25 bp, E. coli
cggtgacagcagtgtgaaacggaat

SEQ ID NO: 159802 - DNA, 25 bp, E. coli
cggtgacagcagagtgaaacggaat

SEQ ID NO: 159803 - DNA, 25 bp, E. coli
atattgcagacgacgcacaccccgg

SEQ ID NO: 159804 - DNA, 25 bp, E. coli
atattgcagacgtcgcacaccccgg

SEQ ID NO: 159805 - DNA, 25 bp, E. coli
acagcactgcaagcagcacggcaat

SEQ ID NO: 159806 - DNA, 25 bp, E. coli
acagcactgcaaccagcacggcaat

SEQ ID NO: 159807 - DNA, 25 bp, E. coli
tatacccatgaaacagcactgcaag

SEQ ID NO: 159808 - DNA, 25 bp, E. coli
tatacccatgaatcagcactgcaag

SEQ ID NO: 159809 - DNA, 25 bp, E. coli
tgataaatacgatattcctgtggtg

SEQ ID NO: 159810 - DNA, 25 bp, E. coli
tgataaatacgaaattcctgtggtg

SEQ ID NO: 159811 - DNA, 25 bp, E. coli
tgaaacagcactccaagcagcacgg

SEQ ID NO: 159812 - DNA, 25 bp, E. coli
tgaaacagcactgcaagcagcacgg

SEQ ID NO: 159813 - DNA, 25 bp, E. coli
gcacaccccggcagaagacttacaa

SEQ ID NO: 159814 - DNA, 25 bp, E. coli
gaagacttacaataatgtgaaagca

SEQ ID NO: 159815 - DNA, 25 bp, E. coli
gaagacttacaaaaatgtgaaagca

SEQ ID NO: 159816 - DNA, 25 bp, E. coli
gcacaccccggctgaagacttacaa

SEQ ID NO: 159817 - DNA, 25 bp, E. coli
cccggcagaagagttacaaaaatgt

SEQ ID NO: 159818 - DNA, 25 bp, E. coli
cccggcagaagacttacaaaaatgt

SEQ ID NO: 159819 - DNA, 25 bp, E. coli
cgtgatattgcagacgtcgcacacc

SEQ ID NO: 159820 - DNA, 25 bp, E. coli
cgtgatattgcacacgtcgcacacc

SEQ ID NO: 159821 - DNA, 25 bp, E. coli
ggttataagcagtgtctggaagatc

SEQ ID NO: 159822 - DNA, 25 bp, E. coli
ggttataagcagagtctggaagatc

SEQ ID NO: 159823 - DNA, 25 bp, E. coli
gagtctggaagaacataatattgca

SEQ ID NO: 159824 - DNA, 25 bp, E. coli
gagtctggaagatcataatattgca

SEQ ID NO: 159825 - DNA, 25 bp, E. coli
aatttctcctttgagaaattgagga

SEQ ID NO: 159826 - DNA, 25 bp, E. coli
aatttctcctttcagaaattgagga

SEQ ID NO: 159827 - DNA, 25 bp, E. coli
cagttaccgggcaggtctgggttat

SEQ ID NO: 159828 - DNA, 25 bp, E. coli
cagttaccgggctggtctgggttat

SEQ ID NO: 159829 - DNA, 25 bp, E. coli
atgacgagtatacccagttaccggg

SEQ ID NO: 159830 - DNA, 25 bp, E. coli
atgacgagtatagccagttaccggg

SEQ ID NO: 159831 - DNA, 25 bp, E. coli
tttttccggcgtcatcaatttctcc

SEQ ID NO: 159832 - DNA, 25 bp, E. coli
tttttccggcgtgatcaatttctcc

SEQ ID NO: 159833 - DNA, 25 bp, E. coli
tatagccagttaccgggctggtctg

SEQ ID NO: 159834 - DNA, 25 bp, E. coli
tatagccagttagcgggctggtctg

SEQ ID NO: 159835 - DNA, 25 bp, E. coli
tctgcaaaaagctaactactgattt

SEQ ID NO: 159836 - DNA, 25 bp, E. coli
tctgcaaaaagcaaactactgattt

SEQ ID NO: 159837 - DNA, 25 bp, E. coli
ccgggctggtctgggttattgcatc

SEQ ID NO: 159838 - DNA, 25 bp, E. coli
ccgggctggtctcggttattgcatc

SEQ ID NO: 159839 - DNA, 25 bp, E. coli
gctggtctgggttattgcatctgca

SEQ ID NO: 159840 - DNA, 25 bp, E. coli
gctggtctgggtaattgcatctgca

SEQ ID NO: 159841 - DNA, 25 bp, E. coli
cgagtatagccagttaccgggctgg

SEQ ID NO: 159842 - DNA, 25 bp, E. coli
cgagtatagccacttaccgggctgg

SEQ ID NO: 159843 - DNA, 25 bp, E. coli
gggttattgcatctgcaaaaagcaa

SEQ ID NO: 159844 - DNA, 25 bp, E. coli
gggttattgcatgtgcaaaaagcaa

SEQ ID NO: 159845 - DNA, 25 bp, E. coli
ggcgtgatcaatttctcctttgaga

SEQ ID NO: 159846 - DNA, 25 bp, E. coli
ggcgtgatcaatatctcctttgaga

SEQ ID NO: 159847 - DNA, 25 bp, E. coli
cagtaataccgccacggtactgcga

SEQ ID NO: 159848 - DNA, 25 bp, E. coli
cagtaataccgcgacggtactgcga

SEQ ID NO: 159849 - DNA, 25 bp, E. coli
cggtcccgccttgtttaagtgcgca

SEQ ID NO: 159850 - DNA, 25 bp, E. coli
agttatctgcaggtgcaggcgctgc

SEQ ID NO: 159851 - DNA, 25 bp, E. coli
cggtcccgccttctttaagtgcgca

SEQ ID NO: 159852 - DNA, 25 bp, E. coli
agttatctgcagctgcaggcgctgc

SEQ ID NO: 159853 - DNA, 25 bp, E. coli
tgatggctccggtggtgttgcttat

SEQ ID NO: 159854 - DNA, 25 bp, E. coli
tgatggctccggaggtgttgcttat

SEQ ID NO: 159855 - DNA, 25 bp, E. coli
tgaatgcggcggtcccgccttcttt

SEQ ID NO: 159856 - DNA, 25 bp, E. coli
tgaatgcggcggacccgccttcttt

SEQ ID NO: 159857 - DNA, 25 bp, E. coli
tctgcagctgcaggcgctgccgtta

SEQ ID NO: 159858 - DNA, 25 bp, E. coli
tctgcagctgcacgcgctgccgtta

SEQ ID NO: 159859 - DNA, 25 bp, E. coli
gctccggtggtgttgcttatcaatg

SEQ ID NO: 159860 - DNA, 25 bp, E. coli
gctccggtggtgatgcttatcaatg

SEQ ID NO: 159861 - DNA, 25 bp, E. coli
cgcgtggcgcagtcaagttgtcgaa

SEQ ID NO: 159862 - DNA, 25 bp, E. coli
cgcgtggcgcagacaagttgtcgaa

SEQ ID NO: 159863 - DNA, 25 bp, E. coli
cttatcaatggtaacactaaaggcg

SEQ ID NO: 159864 - DNA, 25 bp, E. coli
cttatcaatggttacactaaaggcg

SEQ ID NO: 159865 - DNA, 25 bp, E. coli
tggcgcagtcaagttgtcgaaacag

SEQ ID NO: 159866 - DNA, 25 bp, E. coli
tggcgcagtcaacttgtcgaaacag

SEQ ID NO: 159867 - DNA, 25 bp, E. coli
taatattttgctgaccattcttggt

SEQ ID NO: 159868 - DNA, 25 bp, E. coli
taatattttgctcaccattcttggt

SEQ ID NO: 159869 - DNA, 25 bp, E. coli
caaaaatcgctcattcaggtatgtg

SEQ ID NO: 159870 - DNA, 25 bp, E. coli
caaaaatcgctctttcaggtatgtg

SEQ ID NO: 159871 - DNA, 25 bp, E. coli
taaagctctcaaccttaagcagggt

SEQ ID NO: 159872 - DNA, 25 bp, E. coli
taaaaactcatgatgcgcgttctga

SEQ ID NO: 159873 - DNA, 25 bp, E. coli
taaagctctcaagcttaagcagggt

SEQ ID NO: 159874 - DNA, 25 bp, E. coli
taaaaactcatgttgcgcgttctga

SEQ ID NO: 159875 - DNA, 25 bp, E. coli
tataattccgctggtcgtaaagctc

SEQ ID NO: 159876 - DNA, 25 bp, E. coli
tataattccgctcgtcgtaaagctc

SEQ ID NO: 159877 - DNA, 25 bp, E. coli
ttctcaaagaagtgaccgccagggc

SEQ ID NO: 159878 - DNA, 25 bp, E. coli
ttctcaaagaagagaccgccagggc

SEQ ID NO: 159879 - DNA, 25 bp, E. coli
tagcctcgcattgagttaaaaactc

SEQ ID NO: 159880 - DNA, 25 bp, E. coli
tagcctcgcattcagttaaaaactc

SEQ ID NO: 159881 - DNA, 25 bp, E. coli
gccagggcggccacctttaatcgtg

SEQ ID NO: 159882 - DNA, 25 bp, E. coli
gccagggcggcctcctttaatcgtg

SEQ ID NO: 159883 - DNA, 25 bp, E. coli
cgtaaaccgtgctttgagcctgtcc

SEQ ID NO: 159884 - DNA, 25 bp, E. coli
cgtaaaccgtgcattgagcctgtcc

SEQ ID NO: 159885 - DNA, 25 bp, E. coli
taagcagggtcaacgcgataaaacc

SEQ ID NO: 159886 - DNA, 25 bp, E. coli
taatcgtgggcacttactcagcatc

SEQ ID NO: 159887 - DNA, 25 bp, E. coli
taagcagggtcatcgcgataaaacc

SEQ ID NO: 159888 - DNA, 25 bp, E. coli
taatcgtgggcagttactcagcatc

SEQ ID NO: 159889 - DNA, 25 bp, E. coli
gagcctgtccaccattctgagtaaa

SEQ ID NO: 159890 - DNA, 25 bp, E. coli
gagcctgtccacgattctgagtaaa

SEQ ID NO: 159891 - DNA, 25 bp, E. coli
tttccgagccacgaaaattacttcg

SEQ ID NO: 159892 - DNA, 25 bp, E. coli
tatttattgctctcgttaacgcctt

SEQ ID NO: 159893 - DNA, 25 bp, E. coli
tttccgagccaccaaaattacttcg

SEQ ID NO: 159894 - DNA, 25 bp, E. coli
tatttattgctcacgttaacgcctt

SEQ ID NO: 159895 - DNA, 25 bp, E. coli
tcgagctctccagggtatttaacct

SEQ ID NO: 159896 - DNA, 25 bp, E. coli
tcgagctctccacggtatttaacct

SEQ ID NO: 159897 - DNA, 25 bp, E. coli
cctactccggttttcgagacctatg

SEQ ID NO: 159898 - DNA, 25 bp, E. coli
cctactccggttatcgagacctatg

SEQ ID NO: 159899 - DNA, 25 bp, E. coli
gcacccgaacaattgataacgacag

SEQ ID NO: 159900 - DNA, 25 bp, E. coli
gcacccgaacaaatgataacgacag

SEQ ID NO: 159901 - DNA, 25 bp, E. coli
gacagaaaacgcgttttccgagcca

SEQ ID NO: 159902 - DNA, 25 bp, E. coli
gacagaaaacgccttttccgagcca

SEQ ID NO: 159903 - DNA, 25 bp, E. coli
gagacctatgctttgggttaataaa

SEQ ID NO: 159904 - DNA, 25 bp, E. coli
gagacctatgctatgggttaataaa

SEQ ID NO: 159905 - DNA, 25 bp, E. coli
taacgccttgtaaaactcgagctct

SEQ ID NO: 159906 - DNA, 25 bp, E. coli
taattccaataattctcgtcactga

SEQ ID NO: 159907 - DNA, 25 bp, E. coli
taacgccttgtataactcgagctct

SEQ ID NO: 159908 - DNA, 25 bp, E. coli
tcagaatattccaagcaaacaggtt

SEQ ID NO: 159909 - DNA, 25 bp, E. coli
tcagaatattcctagcaaacaggtt

SEQ ID NO: 159910 - DNA, 25 bp, E. coli
taattccaataaatctcgtcactga

SEQ ID NO: 159911 - DNA, 25 bp, E. coli
gatggttagcatcaaacaacctcag

SEQ ID NO: 159912 - DNA, 25 bp, E. coli
gatggttagcatgaaacaacctcag

SEQ ID NO: 159913 - DNA, 25 bp, E. coli
caaccttgctgatgacgttaatcgg

SEQ ID NO: 159914 - DNA, 25 bp, E. coli
aaccttgctgatgacgttaatcggc

SEQ ID NO: 159915 - DNA, 25 bp, E. coli
aaccttgctgatcacgttaatcggc

SEQ ID NO: 159916 - DNA, 25 bp, E. coli
caaccttgctgaagacgttaatcgg

SEQ ID NO: 159917 - DNA, 25 bp, E. coli
tatccaaccttgctgatgacgttaa

SEQ ID NO: 159918 - DNA, 25 bp, E. coli
tatccaaccttggtgatgacgttaa

SEQ ID NO: 159919 - DNA, 25 bp, E. coli
tgttggcctctaaccaaccttgctg

SEQ ID NO: 159920 - DNA, 25 bp, E. coli
tgttggcctctatccaaccttgctg

SEQ ID NO: 159921 - DNA, 25 bp, E. coli
tctatccaaccttgctgatgacgtt

SEQ ID NO: 159922 - DNA, 25 bp, E. coli
tctatccaacctagctgatgacgtt

SEQ ID NO: 159923 - DNA, 25 bp, E. coli
cgttgttggcctgtatccaaccttg

SEQ ID NO: 159924 - DNA, 25 bp, E. coli
cgccgtcgccatagtcgctatttac

SEQ ID NO: 159925 - DNA, 25 bp, E. coli
cgttgttggcctctatccaaccttg

SEQ ID NO: 159926 - DNA, 25 bp, E. coli
cgccgtcgccattgtcgctatttac

SEQ ID NO: 159927 - DNA, 25 bp, E. coli
cgtcgccattgtcgctatttacggg

SEQ ID NO: 159928 - DNA, 25 bp, E. coli
cgtcgccattgtggctatttacggg

SEQ ID NO: 159929 - DNA, 25 bp, E. coli
tccaaccttgctcatgacgttaatc

SEQ ID NO: 159930 - DNA, 25 bp, E. coli
tggcctctatcctaccttgctgatg

SEQ ID NO: 159931 - DNA, 25 bp, E. coli
ggcctctatccaaccttgctgatga

SEQ ID NO: 159932 - DNA, 25 bp, E. coli
ggcctctatccatccttgctgatga

SEQ ID NO: 159933 - DNA, 25 bp, E. coli
tggcctctatccaaccttgctgatg

SEQ ID NO: 159934 - DNA, 25 bp, E. coli
tccaaccttgctgatgacgttaatc

SEQ ID NO: 159935 - DNA, 25 bp, E. coli
aatgccgctcgtaatctgctgaaag

SEQ ID NO: 159936 - DNA, 25 bp, E. coli
aatgccgctcgttatctgctgaaag

SEQ ID NO: 159937 - DNA, 25 bp, E. coli
aatatacggcagaacgagggatcgc

SEQ ID NO: 159938 - DNA, 25 bp, E. coli
aatatacggcagtacgagggatcgc

SEQ ID NO: 159939 - DNA, 25 bp, E. coli
taaagagcagcagaagcaggatacg

SEQ ID NO: 159940 - DNA, 25 bp, E. coli
tactggcagatcgttgcagaagcag

SEQ ID NO: 159941 - DNA, 25 bp, E. coli
tactggcagatccttgcagaagcag

SEQ ID NO: 159942 - DNA, 25 bp, E. coli
taaagagcagcacaagcaggatacg

SEQ ID NO: 159943 - DNA, 25 bp, E. coli
ttgaggttgcactggaatatacggc

SEQ ID NO: 159944 - DNA, 25 bp, E. coli
ttgaggttgcacaggaatatacggc

SEQ ID NO: 159945 - DNA, 25 bp, E. coli
tcgccacattgagaaaatggatgcc

SEQ ID NO: 159946 - DNA, 25 bp, E. coli
tcgccacattgacaaaatggatgcc

SEQ ID NO: 159947 - DNA, 25 bp, E. coli
ccagcatcgcccagggtaaagagca

SEQ ID NO: 159948 - DNA, 25 bp, E. coli
ccagcatcgccctgggtaaagagca

SEQ ID NO: 159949 - DNA, 25 bp, E. coli
cgtaatgcattaatccgtcgccaca

SEQ ID NO: 159950 - DNA, 25 bp, E. coli
cgtaatgcattattccgtcgccaca

SEQ ID NO: 159951 - DNA, 25 bp, E. coli
cgatcagtatcgctcccgtaatgca

SEQ ID NO: 159952 - DNA, 25 bp, E. coli
cgatcagtatcggtcccgtaatgca

SEQ ID NO: 159953 - DNA, 25 bp, E. coli
gagggatcgcgctgcttaagcagaa

SEQ ID NO: 159954 - DNA, 25 bp, E. coli
gagggatcgcgcagcttaagcagaa

SEQ ID NO: 159955 - DNA, 25 bp, E. coli
gatgccagtttggacgtcggaacga

SEQ ID NO: 159956 - DNA, 25 bp, E. coli
gatgccagtttgcacgtcggaacga

SEQ ID NO: 159957 - DNA, 25 bp, E. coli
cagaacatgaattaaatcggcgtgg

SEQ ID NO: 159958 - DNA, 25 bp, E. coli
cagaacatgaataaaatcggcgtgg

SEQ ID NO: 159959 - DNA, 25 bp, E. coli
agcggtactgcgctaatttataagt

SEQ ID NO: 159960 - DNA, 25 bp, E. coli
agcggtactgcggtaatttataagt

SEQ ID NO: 159961 - DNA, 25 bp, E. coli
aataaaatcggcctggtttctgccg

SEQ ID NO: 159962 - DNA, 25 bp, E. coli
aacaataaattaagcggtactgcgg

SEQ ID NO: 159963 - DNA, 25 bp, E. coli
aacaataaattatgcggtactgcgg

SEQ ID NO: 159964 - DNA, 25 bp, E. coli
aataaaatcggcgtggtttctgccg

SEQ ID NO: 159965 - DNA, 25 bp, E. coli
tgttgttgctgcaatggctctttca

SEQ ID NO: 159966 - DNA, 25 bp, E. coli
tggtttctgccgttggcgcatccac

SEQ ID NO: 159967 - DNA, 25 bp, E. coli
tgttgttgctgctatggctctttca

SEQ ID NO: 159968 - DNA, 25 bp, E. coli
gcggaaccggtatcggcatcccagg

SEQ ID NO: 159969 - DNA, 25 bp, E. coli
gcggaaccggtaacggcatcccagg

SEQ ID NO: 159970 - DNA, 25 bp, E. coli
ccctcgatgcccaggaagcgaaact

SEQ ID NO: 159971 - DNA, 25 bp, E. coli
ccctcgatgccctggaagcgaaact

SEQ ID NO: 159972 - DNA, 25 bp, E. coli
ggcatcccaggcacagaacatgaat

SEQ ID NO: 159973 - DNA, 25 bp, E. coli
tggaagcgaaactggctgagaaagc

SEQ ID NO: 159974 - DNA, 25 bp, E. coli
tggtttctgccgatggcgcatccac

SEQ ID NO: 159975 - DNA, 25 bp, E. coli
tggaagcgaaacaggctgagaaagc

SEQ ID NO: 159976 - DNA, 25 bp, E. coli
ggcatcccaggctcagaacatgaat

SEQ ID NO: 159977 - DNA, 25 bp, E. coli
tcaatactgttgatgctgctatggc

SEQ ID NO: 159978 - DNA, 25 bp, E. coli
tcaatactgttgttgctgctatggc

SEQ ID NO: 159979 - DNA, 25 bp, E. coli
cactgccgttgcagacgcagttgaa

SEQ ID NO: 159980 - DNA, 25 bp, E. coli
cactgccgttgctgacgcagttgaa

SEQ ID NO: 159981 - DNA, 25 bp, E. coli
cactcagaaggccttttgcagcgta

SEQ ID NO: 159982 - DNA, 25 bp, E. coli
cactcagaaggcgttttgcagcgta

SEQ ID NO: 159983 - DNA, 25 bp, E. coli
tacgactcgtatcgttactggcgta

SEQ ID NO: 159984 - DNA, 25 bp, E. coli
tacgactcgtatggttactggcgta

SEQ ID NO: 159985 - DNA, 25 bp, E. coli
agaaggcgttttccagcgtatccgt

SEQ ID NO: 159986 - DNA, 25 bp, E. coli
agaaggcgttttgcagcgtatccgt

SEQ ID NO: 159987 - DNA, 25 bp, E. coli
ttgcagcgcggttaaagtcggtatc

SEQ ID NO: 159988 - DNA, 25 bp, E. coli
ttgcagcgcggtaaaagtcggtatc

SEQ ID NO: 159989 - DNA, 25 bp, E. coli
tgccgttgctgaggcagttgaagcc

SEQ ID NO: 159990 - DNA, 25 bp, E. coli
tgccgttgctgacgcagttgaagcc

SEQ ID NO: 159991 - DNA, 25 bp, E. coli
gactcgtatcgtaactggcgtaggt

SEQ ID NO: 159992 - DNA, 25 bp, E. coli
gactcgtatcgttactggcgtaggt

SEQ ID NO: 159993 - DNA, 25 bp, E. coli
cggtcactcagaaggcgttttgcag

SEQ ID NO: 159994 - DNA, 25 bp, E. coli
cggtcactcagatggcgttttgcag

SEQ ID NO: 159995 - DNA, 25 bp, E. coli
gatcactgccgtagctgacgcagtt

SEQ ID NO: 159996 - DNA, 25 bp, E. coli
ggtcactcagaaggcgttttgcagc

SEQ ID NO: 159997 - DNA, 25 bp, E. coli
ggtcactcagaacgcgttttgcagc

SEQ ID NO: 159998 - DNA, 25 bp, E. coli
tcagaaggcgttatgcagcgtatcc

SEQ ID NO: 159999 - DNA, 25 bp, E. coli
tcagaaggcgttttgcagcgtatcc

SEQ ID NO: 160000 - DNA, 25 bp, E. coli
gatcactgccgttgctgacgcagtt

SEQ ID NO: 160001 - DNA, 25 bp, E. coli
cacctgccggttgaatggtatcgat

SEQ ID NO: 160002 - DNA, 25 bp, E. coli
cacctgccggttcaatggtatcgat

SEQ ID NO: 160003 - DNA, 25 bp, E. coli
acctgccggttgaatggtatcgatc

SEQ ID NO: 160004 - DNA, 25 bp, E. coli
acctgccggttgtatggtatcgatc

SEQ ID NO: 160005 - DNA, 25 bp, E. coli
atcggcacctgcgggttgaatggta

SEQ ID NO: 160006 - DNA, 25 bp, E. coli
atcggcacctgccggttgaatggta

SEQ ID NO: 160007 - DNA, 25 bp, E. coli
tgccggttgaatggtatcgatccgg

SEQ ID NO: 160008 - DNA, 25 bp, E. coli
tgccggttgaatcgtatcgatccgg

SEQ ID NO: 160009 - DNA, 25 bp, E. coli
gccggttgaatgctatcgatccgga

SEQ ID NO: 160010 - DNA, 25 bp, E. coli
ccggttgaatggtatcgatccggaa

SEQ ID NO: 160011 - DNA, 25 bp, E. coli
cctgccggttgattggtatcgatcc

SEQ ID NO: 160012 - DNA, 25 bp, E. coli
ccggttgaatggaatcgatccggaa

SEQ ID NO: 160013 - DNA, 25 bp, E. coli
cctgccggttgaatggtatcgatcc

SEQ ID NO: 160014 - DNA, 25 bp, E. coli
gccggttgaatggtatcgatccgga

SEQ ID NO: 160015 - DNA, 25 bp, E. coli
gcacctgccggtagaatggtatcga

SEQ ID NO: 160016 - DNA, 25 bp, E. coli
gcacctgccggttgaatggtatcga

SEQ ID NO: 160017 - DNA, 25 bp, E. coli
cggcacctgccggttgaatggtatc

SEQ ID NO: 160018 - DNA, 25 bp, E. coli
cggcacctgccgcttgaatggtatc

SEQ ID NO: 160019 - DNA, 25 bp, E. coli
ctgccggttgaatggtatcgatccg

SEQ ID NO: 160020 - DNA, 25 bp, E. coli
ctgccggttgaaaggtatcgatccg

SEQ ID NO: 160021 - DNA, 25 bp, E. coli
ggcacctgccggttgaatggtatcg

SEQ ID NO: 160022 - DNA, 25 bp, E. coli
ggcacctgccggatgaatggtatcg

SEQ ID NO: 160023 - DNA, 25 bp, E. coli
caatggcgatgtggcgcgaaaataa

SEQ ID NO: 160024 - DNA, 25 bp, E. coli
caatggcgatgtcgcgcgaaaataa

SEQ ID NO: 160025 - DNA, 25 bp, E. coli
cagatgcgagaaccagacaaagaag

SEQ ID NO: 160026 - DNA, 25 bp, E. coli
cagatgcgagaagcagacaaagaag

SEQ ID NO: 160027 - DNA, 25 bp, E. coli
acgttttattgcgggcgcaaaatgc

SEQ ID NO: 160028 - DNA, 25 bp, E. coli
agaagcagacaaagaagcccgcgat

SEQ ID NO: 160029 - DNA, 25 bp, E. coli
agaagcagacaatgaagcccgcgat

SEQ ID NO: 160030 - DNA, 25 bp, E. coli
acgttttattgccggcgcaaaatgc

SEQ ID NO: 160031 - DNA, 25 bp, E. coli
tgtggcgcgaaattaatattgatat

SEQ ID NO: 160032 - DNA, 25 bp, E. coli
tgtggcgcgaaaataatattgatat

SEQ ID NO: 160033 - DNA, 25 bp, E. coli
tgcgagaagcagacaaagaagcccg

SEQ ID NO: 160034 - DNA, 25 bp, E. coli
tgcgagaagcagtcaaagaagcccg

SEQ ID NO: 160035 - DNA, 25 bp, E. coli
gcgcaaaatgccgggcctgtcaggc

SEQ ID NO: 160036 - DNA, 25 bp, E. coli
gcgcaaaatgcccggcctgtcaggc

SEQ ID NO: 160037 - DNA, 25 bp, E. coli
gcaatccgaaaaggttttattgcgg

SEQ ID NO: 160038 - DNA, 25 bp, E. coli
gcagacaaagaaccccgcgatcacg

SEQ ID NO: 160039 - DNA, 25 bp, E. coli
gcaatccgaaaacgttttattgcgg

SEQ ID NO: 160040 - DNA, 25 bp, E. coli
gcagacaaagaagcccgcgatcacg

SEQ ID NO: 160041 - DNA, 25 bp, E. coli
cgatgtggcgcgaaaataatattga

SEQ ID NO: 160042 - DNA, 25 bp, E. coli
cgatgtggcgcgtaaataatattga

SEQ ID NO: 160043 - DNA, 25 bp, E. coli
gattcaatggcgatgtggcgcgaaa

SEQ ID NO: 160044 - DNA, 25 bp, E. coli
gattcaatggcgttgtggcgcgaaa

SEQ ID NO: 160045 - DNA, 25 bp, E. coli
caacatggttttcctggattctggg

SEQ ID NO: 160046 - DNA, 25 bp, E. coli
caaatggttctatgagaaagaggta

SEQ ID NO: 160047 - DNA, 25 bp, E. coli
caacatggttttgctggattctggg

SEQ ID NO: 160048 - DNA, 25 bp, E. coli
cactaattggcgttaacattctggg

SEQ ID NO: 160049 - DNA, 25 bp, E. coli
caaatggttctaagagaaagaggta

SEQ ID NO: 160050 - DNA, 25 bp, E. coli
cactaattggcgataacattctggg

SEQ ID NO: 160051 - DNA, 25 bp, E. coli
taaagcattaaaagtaagacaacgc

SEQ ID NO: 160052 - DNA, 25 bp, E. coli
taaagcattaaatgtaagacaacgc

SEQ ID NO: 160053 - DNA, 25 bp, E. coli
tgctgttaacacgaacaaatggttc

SEQ ID NO: 160054 - DNA, 25 bp, E. coli
tgctgttaacaccaacaaatggttc

SEQ ID NO: 160055 - DNA, 25 bp, E. coli
ccgtagcagcctatgttgctgttaa

SEQ ID NO: 160056 - DNA, 25 bp, E. coli
ccgtagcagcctttgttgctgttaa

SEQ ID NO: 160057 - DNA, 25 bp, E. coli
gacaacgcttaactattcaaatgaa

SEQ ID NO: 160058 - DNA, 25 bp, E. coli
gacaacgcttaagtattcaaatgaa

SEQ ID NO: 160059 - DNA, 25 bp, E. coli
ctatttgttggtgcactaattggcg

SEQ ID NO: 160060 - DNA, 25 bp, E. coli
ctatttgttggtccactaattggcg

SEQ ID NO: 160061 - DNA, 25 bp, E. coli
cattgctttcttctgttcctggata

SEQ ID NO: 160062 - DNA, 25 bp, E. coli
cattgctttcttgtgttcctggata

SEQ ID NO: 160063 - DNA, 25 bp, E. coli
cattctgggaatagccgtagcagcc

SEQ ID NO: 160064 - DNA, 25 bp, E. coli
cattctgggaattgccgtagcagcc

SEQ ID NO: 160065 - DNA, 25 bp, E. coli
gggcaacaccagtatataaagcagc

SEQ ID NO: 160066 - DNA, 25 bp, E. coli
gggcaacaccagaatataaagcagc

SEQ ID NO: 160067 - DNA, 25 bp, E. coli
cagcgatatcagatcttaaagacaa

SEQ ID NO: 160068 - DNA, 25 bp, E. coli
caaagaattattacaaacagcgata

SEQ ID NO: 160069 - DNA, 25 bp, E. coli
caaagaattatttcaaacagcgata

SEQ ID NO: 160070 - DNA, 25 bp, E. coli
cagcgatatcagttcttaaagacaa

SEQ ID NO: 160071 - DNA, 25 bp, E. coli
tgaaatcaaaagacaccctaaagtg

SEQ ID NO: 160072 - DNA, 25 bp, E. coli
tgaaatcaaaagtcaccctaaagtg

SEQ ID NO: 160073 - DNA, 25 bp, E. coli
tcatggctggattacaaagaattat

SEQ ID NO: 160074 - DNA, 25 bp, E. coli
tcatggctggataacaaagaattat

SEQ ID NO: 160075 - DNA, 25 bp, E. coli
ccagaacattgcatgattacattga

SEQ ID NO: 160076 - DNA, 25 bp, E. coli
ccagaacattgcttgattacattga

SEQ ID NO: 160077 - DNA, 25 bp, E. coli
gacaccctaaagaggttccctgcgc

SEQ ID NO: 160078 - DNA, 25 bp, E. coli
gacaccctaaagtggttccctgcgc

SEQ ID NO: 160079 - DNA, 25 bp, E. coli
gattacattgaaggaaacataaaga

SEQ ID NO: 160080 - DNA, 25 bp, E. coli
gattacattgaacgaaacataaaga

SEQ ID NO: 160081 - DNA, 25 bp, E. coli
ggttccctgcgctgcttcctgaagt

SEQ ID NO: 160082 - DNA, 25 bp, E. coli
ggttccctgcgcagcttcctgaagt

SEQ ID NO: 160083 - DNA, 25 bp, E. coli
gggaagacctatcaataccagaaca

SEQ ID NO: 160084 - DNA, 25 bp, E. coli
gggaagacctatgaataccagaaca

SEQ ID NO: 160085 - DNA, 25 bp, E. coli
tggaagtagcaatacagggaagacc

SEQ ID NO: 160086 - DNA, 25 bp, E. coli
tggaagtagcaaaacagggaagacc

SEQ ID NO: 160087 - DNA, 25 bp, E. coli
taaggaatatcttcatgaaatcaaa

SEQ ID NO: 160088 - DNA, 25 bp, E. coli
taaggaatatctacatgaaatcaaa

SEQ ID NO: 160089 - DNA, 25 bp, E. coli
caggtgcggatatcaagacagcgac

SEQ ID NO: 160090 - DNA, 25 bp, E. coli
caggtgcggataacaagacagcgac

SEQ ID NO: 160091 - DNA, 25 bp, E. coli
catcacgcgaaagggacagctaagc

SEQ ID NO: 160092 - DNA, 25 bp, E. coli
catcacgcgaaacggacagctaagc

SEQ ID NO: 160093 - DNA, 25 bp, E. coli
taacaggcaaaattcacggtctcgg

SEQ ID NO: 160094 - DNA, 25 bp, E. coli
taacaggcaaaaatcacggtctcgg

SEQ ID NO: 160095 - DNA, 25 bp, E. coli
tactgatcgatgttttccgggaagc

SEQ ID NO: 160096 - DNA, 25 bp, E. coli
tactgatcgatgatttccgggaagc

SEQ ID NO: 160097 - DNA, 25 bp, E. coli
tattgcagcagaagcgaacagccgt

SEQ ID NO: 160098 - DNA, 25 bp, E. coli
tattgcagcagatgcgaacagccgt

SEQ ID NO: 160099 - DNA, 25 bp, E. coli
tgatgaacgttttggcaccagaccg

SEQ ID NO: 160100 - DNA, 25 bp, E. coli
tgatgaacgtttaggcaccagaccg

SEQ ID NO: 160101 - DNA, 25 bp, E. coli
tgcccggcagcaaatggaacaaatg

SEQ ID NO: 160102 - DNA, 25 bp, E. coli
tgcccggcagcatatggaacaaatg

SEQ ID NO: 160103 - DNA, 25 bp, E. coli
tctgtggattacaactggcgtgcta

SEQ ID NO: 160104 - DNA, 25 bp, E. coli
tctgtggattactactggcgtgcta

SEQ ID NO: 160105 - DNA, 25 bp, E. coli
gaagctcagcaatcgggcgatgtcc

SEQ ID NO: 160106 - DNA, 25 bp, E. coli
gaagctcagcaaacgggcgatgtcc

SEQ ID NO: 160107 - DNA, 25 bp, E. coli
gatatttacaacgacgcacgcggta

SEQ ID NO: 160108 - DNA, 25 bp, E. coli
gatatttacaaccacgcacgcggta

SEQ ID NO: 160109 - DNA, 25 bp, E. coli
ggctttaaccctccagaatcggcaa

SEQ ID NO: 160110 - DNA, 25 bp, E. coli
ggctttaaccctgcagaatcggcaa

SEQ ID NO: 160111 - DNA, 25 bp, E. coli
cacctatggcctgatggatggaata

SEQ ID NO: 160112 - DNA, 25 bp, E. coli
cacctatggcctcatggatggaata

SEQ ID NO: 160113 - DNA, 25 bp, E. coli
cagaaacaatttggtgaaaaccgca

SEQ ID NO: 160114 - DNA, 25 bp, E. coli
cagaaacaatttcgtgaaaaccgca

SEQ ID NO: 160115 - DNA, 25 bp, E. coli
aactacgtcgtggaatatctgatgg

SEQ ID NO: 160116 - DNA, 25 bp, E. coli
aactacgtcgtgcaatatctgatgg

SEQ ID NO: 160117 - DNA, 25 bp, E. coli
tatacagacacagatatgatgcctg

SEQ ID NO: 160118 - DNA, 25 bp, E. coli
tatacagacacacatatgatgcctg

SEQ ID NO: 160119 - DNA, 25 bp, E. coli
tattcgtgggctgaatggattcatg

SEQ ID NO: 160120 - DNA, 25 bp, E. coli
tattcgtgggctcaatggattcatg

SEQ ID NO: 160121 - DNA, 25 bp, E. coli
tgttgcttcgatcgaactatcctgc

SEQ ID NO: 160122 - DNA, 25 bp, E. coli
tgttgcttcgatggaactatcctgc

SEQ ID NO: 160123 - DNA, 25 bp, E. coli
tgatgcctgcatactctaaacaagt

SEQ ID NO: 160124 - DNA, 25 bp, E. coli
tgatgcctgcattctctaaacaagt

SEQ ID NO: 160125 - DNA, 25 bp, E. coli
tcttggaagatttgaaactacgtcg

SEQ ID NO: 160126 - DNA, 25 bp, E. coli
tcttggaagattagaaactacgtcg

SEQ ID NO: 160127 - DNA, 25 bp, E. coli
ccagaatcaggcatacagggaacta

SEQ ID NO: 160128 - DNA, 25 bp, E. coli
ccagaatcaggcttacagggaacta

SEQ ID NO: 160129 - DNA, 25 bp, E. coli
gattgatgctgttatcgcaggccag

SEQ ID NO: 160130 - DNA, 25 bp, E. coli
gattgatgctgtaatcgcaggccag

SEQ ID NO: 160131 - DNA, 25 bp, E. coli
ggattcctcgagtcacaatgcccat

SEQ ID NO: 160132 - DNA, 25 bp, E. coli
ggattcctcgagacacaatgcccat

SEQ ID NO: 160133 - DNA, 25 bp, E. coli
cgaggcggcgcacaaaacgttcgat

SEQ ID NO: 160134 - DNA, 25 bp, E. coli
cgaggcggcgcagaaaacgttcgat

SEQ ID NO: 160135 - DNA, 25 bp, E. coli
tacaggtgaaatacgccggtgcgct

SEQ ID NO: 160136 - DNA, 25 bp, E. coli
tacaggtgaaattcgccggtgcgct

SEQ ID NO: 160137 - DNA, 25 bp, E. coli
tgaaggcgtcagtatgatcaccacc

SEQ ID NO: 160138 - DNA, 25 bp, E. coli
tgaaggcgtcagaatgatcaccacc

SEQ ID NO: 160139 - DNA, 25 bp, E. coli
tgaagcaggctttcggtcaggcgct

SEQ ID NO: 160140 - DNA, 25 bp, E. coli
tgaagcaggcttacggtcaggcgct

SEQ ID NO: 160141 - DNA, 25 bp, E. coli
tgccgctttccgagagtacctgaag

SEQ ID NO: 160142 - DNA, 25 bp, E. coli
tgccgctttccgtgagtacctgaag

SEQ ID NO: 160143 - DNA, 25 bp, E. coli
gccagtattacaagagtgcgacccc

SEQ ID NO: 160144 - DNA, 25 bp, E. coli
gccagtattacatgagtgcgacccc

SEQ ID NO: 160145 - DNA, 25 bp, E. coli
gctggcgatgtatcacggtcaaacc

SEQ ID NO: 160146 - DNA, 25 bp, E. coli
gctggcgatgtaacacggtcaaacc

SEQ ID NO: 160147 - DNA, 25 bp, E. coli
gatcgcctgaagtatgagcaaccgc

SEQ ID NO: 160148 - DNA, 25 bp, E. coli
ggtcaaacctatcagattgcgccag

SEQ ID NO: 160149 - DNA, 25 bp, E. coli
ggtcaaacctatgagattgcgccag

SEQ ID NO: 160150 - DNA, 25 bp, E. coli
ggcagaccagaccaatccgtataag

SEQ ID NO: 160151 - DNA, 25 bp, E. coli
tggcgtaaaaacacccagacgggca

SEQ ID NO: 160152 - DNA, 25 bp, E. coli
tggcgtaaaaactcccagacgggca

SEQ ID NO: 160153 - DNA, 25 bp, E. coli
ggcagaccagacgaatccgtataag

SEQ ID NO: 160154 - DNA, 25 bp, E. coli
gatcgcctgaagaatgagcaaccgc

SEQ ID NO: 160155 - DNA, 25 bp, E. coli
catcgcgtgccgacgaatctcacta

SEQ ID NO: 160156 - DNA, 25 bp, E. coli
catcgcgtgccgtcgaatctcacta

SEQ ID NO: 160157 - DNA, 25 bp, E. coli
taacatttatgcgttccgcgccaat

SEQ ID NO: 160158 - DNA, 25 bp, E. coli
ttcaacgcggttcccgaagctggca

SEQ ID NO: 160159 - DNA, 25 bp, E. coli
ttcaacgcggttgccgaagctggca

SEQ ID NO: 160160 - DNA, 25 bp, E. coli
tggtttcatgctcacggtgccgctc

SEQ ID NO: 160161 - DNA, 25 bp, E. coli
tcgctggcgatgtgccgcaaggttt

SEQ ID NO: 160162 - DNA, 25 bp, E. coli
tcgctggcgatgagccgcaaggttt

SEQ ID NO: 160163 - DNA, 25 bp, E. coli
gccaattgttcgaatcgtcgccact

SEQ ID NO: 160164 - DNA, 25 bp, E. coli
cctgccgggcattactttttacgct

SEQ ID NO: 160165 - DNA, 25 bp, E. coli
gccaattgttcgtatcgtcgccact

SEQ ID NO: 160166 - DNA, 25 bp, E. coli
cctgccgggcataactttttacgct

SEQ ID NO: 160167 - DNA, 25 bp, E. coli
gcatcaccaggttgaagcgtggccg

SEQ ID NO: 160168 - DNA, 25 bp, E. coli
gaagcgtggccgttagctgagcaat

SEQ ID NO: 160169 - DNA, 25 bp, E. coli
gcatcaccaggtagaagcgtggccg

SEQ ID NO: 160170 - DNA, 25 bp, E. coli
gacccaactggagatgttcaacgcg

SEQ ID NO: 160171 - DNA, 25 bp, E. coli
gaagcgtggccgatagctgagcaat

SEQ ID NO: 160172 - DNA, 25 bp, E. coli
tggtttcatgctgacggtgccgctc

SEQ ID NO: 160173 - DNA, 25 bp, E. coli
taacatttatgccttccgcgccaat

SEQ ID NO: 160174 - DNA, 25 bp, E. coli
gacccaactggacatgttcaacgcg

SEQ ID NO: 160175 - DNA, 25 bp, E. coli
gatctgtttattcgcgagaatcagc

SEQ ID NO: 160176 - DNA, 25 bp, E. coli
gatctgtttattggcgagaatcagc

SEQ ID NO: 160177 - DNA, 25 bp, E. coli
tatcgcattttccttctcttttttt

SEQ ID NO: 160178 - DNA, 25 bp, E. coli
tatcgcattttcgttctcttttttt

SEQ ID NO: 160179 - DNA, 25 bp, E. coli
tttggtgtgggccgcaccagcgcaa

SEQ ID NO: 160180 - DNA, 25 bp, E. coli
tttggtgtgggcggcaccagcgcaa

SEQ ID NO: 160181 - DNA, 25 bp, E. coli
ttggtgtgggcgccaccagcgcaac

SEQ ID NO: 160182 - DNA, 25 bp, E. coli
ttggtgtgggcggcaccagcgcaac

SEQ ID NO: 160183 - DNA, 25 bp, E. coli
tggtgtgggcggcaccagcgcaacg

SEQ ID NO: 160184 - DNA, 25 bp, E. coli
tggtgtgggcgggaccagcgcaacg

SEQ ID NO: 160185 - DNA, 25 bp, E. coli
tctttggtgtggccggcaccagcgc

SEQ ID NO: 160186 - DNA, 25 bp, E. coli
tctttggtgtgggcggcaccagcgc

SEQ ID NO: 160187 - DNA, 25 bp, E. coli
cgggcgttttccgactggcaggtca

SEQ ID NO: 160188 - DNA, 25 bp, E. coli
ctttggtgtggggggcaccagcgca

SEQ ID NO: 160189 - DNA, 25 bp, E. coli
cgggcgttttcccactggcaggtca

SEQ ID NO: 160190 - DNA, 25 bp, E. coli
ctttggtgtgggcggcaccagcgca

SEQ ID NO: 160191 - DNA, 25 bp, E. coli
gtgtgggcggcaccagcgcaacggg

SEQ ID NO: 160192 - DNA, 25 bp, E. coli
gtctttggtgtgcgcggcaccagcg

SEQ ID NO: 160193 - DNA, 25 bp, E. coli
gggcgttttccgactggcaggtcac

SEQ ID NO: 160194 - DNA, 25 bp, E. coli
ggtgtgggcggcaccagcgcaacgg

SEQ ID NO: 160195 - DNA, 25 bp, E. coli
gtgtgggcggcagcagcgcaacggg

SEQ ID NO: 160196 - DNA, 25 bp, E. coli
gggcgttttccgtctggcaggtcac

SEQ ID NO: 160197 - DNA, 25 bp, E. coli
ggtgtgggcggctccagcgcaacgg

SEQ ID NO: 160198 - DNA, 25 bp, E. coli
gtctttggtgtgggcggcaccagcg

SEQ ID NO: 160199 - DNA, 25 bp, E. coli
caccgggctgttttttggactgcgc

SEQ ID NO: 160200 - DNA, 25 bp, E. coli
cactactgccgtaaacaccgggctg

SEQ ID NO: 160201 - DNA, 25 bp, E. coli
cactactgccgttaacaccgggctg

SEQ ID NO: 160202 - DNA, 25 bp, E. coli
caccgggctgttatttggactgcgc

SEQ ID NO: 160203 - DNA, 25 bp, E. coli
cagcgcctgcacgtcaggtagtcag

SEQ ID NO: 160204 - DNA, 25 bp, E. coli
cagcgcctgcacctcaggtagtcag

SEQ ID NO: 160205 - DNA, 25 bp, E. coli
agtggcaggtttacgacggcctgca

SEQ ID NO: 160206 - DNA, 25 bp, E. coli
atgccgcacacttctgccgttaaca

SEQ ID NO: 160207 - DNA, 25 bp, E. coli
atgccgcacactactgccgttaaca

SEQ ID NO: 160208 - DNA, 25 bp, E. coli
agtggcaggttttcgacggcctgca

SEQ ID NO: 160209 - DNA, 25 bp, E. coli
tatcggctacgcgtgggaagccatt

SEQ ID NO: 160210 - DNA, 25 bp, E. coli
tatcggctacgcctgggaagccatt

SEQ ID NO: 160211 - DNA, 25 bp, E. coli
tgttttttggacagcgcgggcgggt

SEQ ID NO: 160212 - DNA, 25 bp, E. coli
tgttttttggactgcgcgggcgggt

SEQ ID NO: 160213 - DNA, 25 bp, E. coli
tgcacgtcaggttgtcaggctatcg

SEQ ID NO: 160214 - DNA, 25 bp, E. coli
tgcacgtcaggtagtcaggctatcg

SEQ ID NO: 160215 - DNA, 25 bp, E. coli
cgtcaggtagtcaggctatcggcta

SEQ ID NO: 160216 - DNA, 25 bp, E. coli
cgtcaggtagtctggctatcggcta

SEQ ID NO: 160217 - DNA, 25 bp, E. coli
gtagtcaggctatcggctacgcgtg

SEQ ID NO: 160218 - DNA, 25 bp, E. coli
ggtgattccgacgtccagcgcctgc

SEQ ID NO: 160219 - DNA, 25 bp, E. coli
gtagtcaggctaacggctacgcgtg

SEQ ID NO: 160220 - DNA, 25 bp, E. coli
ggtgattccgacctccagcgcctgc

SEQ ID NO: 160221 - DNA, 25 bp, E. coli
catttagtgattcctgcccggatcg

SEQ ID NO: 160222 - DNA, 25 bp, E. coli
catttaccgaaatagcgagtctgga

SEQ ID NO: 160223 - DNA, 25 bp, E. coli
tacaaacgtgaagacgctggagagt

SEQ ID NO: 160224 - DNA, 25 bp, E. coli
tacaaacgtgaacacgctggagagt

SEQ ID NO: 160225 - DNA, 25 bp, E. coli
ttgagtacgatataaaggcgcttgc

SEQ ID NO: 160226 - DNA, 25 bp, E. coli
ttgagtacgataaaaaggcgcttgc

SEQ ID NO: 160227 - DNA, 25 bp, E. coli
tgttgtatgagggagcacagtaccc

SEQ ID NO: 160228 - DNA, 25 bp, E. coli
tgttgtatgaggcagcacagtaccc

SEQ ID NO: 160229 - DNA, 25 bp, E. coli
gccgcactcggaggcgtgagatatt

SEQ ID NO: 160230 - DNA, 25 bp, E. coli
gccgcactcggacgcgtgagatatt

SEQ ID NO: 160231 - DNA, 25 bp, E. coli
ctagccgggcaaatgaagaagatcc

SEQ ID NO: 160232 - DNA, 25 bp, E. coli
ctagccgggcaattgaagaagatcc

SEQ ID NO: 160233 - DNA, 25 bp, E. coli
catttaccgaaaaagcgagtctgga

SEQ ID NO: 160234 - DNA, 25 bp, E. coli
catttagtgattgctgcccggatcg

SEQ ID NO: 160235 - DNA, 25 bp, E. coli
gattggttatttacacagtcgccgc

SEQ ID NO: 160236 - DNA, 25 bp, E. coli
gattggttattttcacagtcgccgc

SEQ ID NO: 160237 - DNA, 25 bp, E. coli
ggttaagaatgctaatcgctccggg

SEQ ID NO: 160238 - DNA, 25 bp, E. coli
ggttaagaatgcaaatcgctccggg

SEQ ID NO: 160239 - DNA, 25 bp, E. coli
gggcacgtccgataaccagtgttgt

SEQ ID NO: 160240 - DNA, 25 bp, E. coli
gggcacgtccgaaaaccagtgttgt

SEQ ID NO: 160241 - DNA, 25 bp, E. coli
taatcgcattgatgttgcagcccca

SEQ ID NO: 160242 - DNA, 25 bp, E. coli
taatcgcattgaagttgcagcccca

SEQ ID NO: 160243 - DNA, 25 bp, E. coli
cagctttctggaccgccagttgact

SEQ ID NO: 160244 - DNA, 25 bp, E. coli
cagctttctggagcgccagttgact

SEQ ID NO: 160245 - DNA, 25 bp, E. coli
catctgccagctttctggagcgcca

SEQ ID NO: 160246 - DNA, 25 bp, E. coli
catctgccagctatctggagcgcca

SEQ ID NO: 160247 - DNA, 25 bp, E. coli
tagtagcgcatatttccgaccatgt

SEQ ID NO: 160248 - DNA, 25 bp, E. coli
tagtagcgcataattccgaccatgt

SEQ ID NO: 160249 - DNA, 25 bp, E. coli
gcccggatgtagtagcgcatatttc

SEQ ID NO: 160250 - DNA, 25 bp, E. coli
gctgcgcccggatgtagtagcgcat

SEQ ID NO: 160251 - DNA, 25 bp, E. coli
gcccggatgtagaagcgcatatttc

SEQ ID NO: 160252 - DNA, 25 bp, E. coli
gctgcgcccggaagtagtagcgcat

SEQ ID NO: 160253 - DNA, 25 bp, E. coli
gcatatttccgagcatgtgttctat

SEQ ID NO: 160254 - DNA, 25 bp, E. coli
gcatatttccgaccatgtgttctat

SEQ ID NO: 160255 - DNA, 25 bp, E. coli
ctttgatctggtggttccatctgcc

SEQ ID NO: 160256 - DNA, 25 bp, E. coli
ctttgatctggtcgttccatctgcc

SEQ ID NO: 160257 - DNA, 25 bp, E. coli
gtggttccatctgccagctttctgg

SEQ ID NO: 160258 - DNA, 25 bp, E. coli
ggagcgccagttgactgcgggagtt

SEQ ID NO: 160259 - DNA, 25 bp, E. coli
gtggttccatctcccagctttctgg

SEQ ID NO: 160260 - DNA, 25 bp, E. coli
ggagcgccagttcactgcgggagtt

SEQ ID NO: 160261 - DNA, 25 bp, E. coli
gatctggtggttccatctgccagct

SEQ ID NO: 160262 - DNA, 25 bp, E. coli
gatgtagtagcggatatttccgacc

SEQ ID NO: 160263 - DNA, 25 bp, E. coli
gatctggtggttgcatctgccagct

SEQ ID NO: 160264 - DNA, 25 bp, E. coli
gatgtagtagcgcatatttccgacc

SEQ ID NO: 160265 - DNA, 25 bp, E. coli
tacgtcgttccggattagtcattgc

SEQ ID NO: 160266 - DNA, 25 bp, E. coli
tacgtcgttccgcattagtcattgc

SEQ ID NO: 160267 - DNA, 25 bp, E. coli
aaacagtgcgatgcgtcgactggca

SEQ ID NO: 160268 - DNA, 25 bp, E. coli
aaacagtgcgatccgtcgactggca

SEQ ID NO: 160269 - DNA, 25 bp, E. coli
tatgcaagcaggcttaaaagaggtc

SEQ ID NO: 160270 - DNA, 25 bp, E. coli
tatgcatggatatatagcgcgcagg

SEQ ID NO: 160271 - DNA, 25 bp, E. coli
tatgcatggataaatagcgcgcagg

SEQ ID NO: 160272 - DNA, 25 bp, E. coli
tatgcaagcagggttaaaagaggtc

SEQ ID NO: 160273 - DNA, 25 bp, E. coli
tggtcaagaccgaacgttccggcaa

SEQ ID NO: 160274 - DNA, 25 bp, E. coli
tctttcagagcggaaggtactgcgg

SEQ ID NO: 160275 - DNA, 25 bp, E. coli
tctttcagagcgcaaggtactgcgg

SEQ ID NO: 160276 - DNA, 25 bp, E. coli
ccttctgtttatggagatgccgcag

SEQ ID NO: 160277 - DNA, 25 bp, E. coli
ccttctgtttatcgagatgccgcag

SEQ ID NO: 160278 - DNA, 25 bp, E. coli
gctcatgtgcccaacggcgacgtta

SEQ ID NO: 160279 - DNA, 25 bp, E. coli
gctcatgtgccctacggcgacgtta

SEQ ID NO: 160280 - DNA, 25 bp, E. coli
gaaataatatcctgcgcctctgcgg

SEQ ID NO: 160281 - DNA, 25 bp, E. coli
gaaataatatccagcgcctctgcgg

SEQ ID NO: 160282 - DNA, 25 bp, E. coli
cgcgcagggtgcaagagaacttaac

SEQ ID NO: 160283 - DNA, 25 bp, E. coli
cgcgcagggtgctagagaacttaac

SEQ ID NO: 160284 - DNA, 25 bp, E. coli
tggtcaagaccgtacgttccggcaa

SEQ ID NO: 160285 - DNA, 25 bp, E. coli
gactggcaattctcagcaacgctga

SEQ ID NO: 160286 - DNA, 25 bp, E. coli
gactggcaattcacagcaacgctga

SEQ ID NO: 160287 - DNA, 25 bp, E. coli
catagggtagattcttaagtcgcgt

SEQ ID NO: 160288 - DNA, 25 bp, E. coli
catagggtagatacttaagtcgcgt

SEQ ID NO: 160289 - DNA, 25 bp, E. coli
aaatagactaattgggagtgcgtcc

SEQ ID NO: 160290 - DNA, 25 bp, E. coli
aaatagactaatagggagtgcgtcc

SEQ ID NO: 160291 - DNA, 25 bp, E. coli
tctttaaagaaatggctgatggcga

SEQ ID NO: 160292 - DNA, 25 bp, E. coli
tctttaaagaaaaggctgatggcga

SEQ ID NO: 160293 - DNA, 25 bp, E. coli
ccaagatcgattgggttgagtgcat

SEQ ID NO: 160294 - DNA, 25 bp, E. coli
ccaagatcgattcggttgagtgcat

SEQ ID NO: 160295 - DNA, 25 bp, E. coli
ctgatggcgaaatgtggcccgatga

SEQ ID NO: 160296 - DNA, 25 bp, E. coli
ctgatggcgaaaagtggcccgatga

SEQ ID NO: 160297 - DNA, 25 bp, E. coli
gatcatgggttgacagttaaactcg

SEQ ID NO: 160298 - DNA, 25 bp, E. coli
gatatgccagaatcgcgctgagtca

SEQ ID NO: 160299 - DNA, 25 bp, E. coli
gatatgccagaaacgcgctgagtca

SEQ ID NO: 160300 - DNA, 25 bp, E. coli
tggactgtcccctcaaaagtgacta

SEQ ID NO: 160301 - DNA, 25 bp, E. coli
tggactgtccccacaaaagtgacta

SEQ ID NO: 160302 - DNA, 25 bp, E. coli
taatgtccgctatgagcaagaagcg

SEQ ID NO: 160303 - DNA, 25 bp, E. coli
taatgtccgctaagagcaagaagcg

SEQ ID NO: 160304 - DNA, 25 bp, E. coli
gatgagggccacaatacggctgtca

SEQ ID NO: 160305 - DNA, 25 bp, E. coli
gatgagggccactatacggctgtca

SEQ ID NO: 160306 - DNA, 25 bp, E. coli
gagtgcatatccattcatagggtag

SEQ ID NO: 160307 - DNA, 25 bp, E. coli
gatcatgggttgtcagttaaactcg

SEQ ID NO: 160308 - DNA, 25 bp, E. coli
gagtgcatatcctttcatagggtag

SEQ ID NO: 160309 - DNA, 25 bp, E. coli
catgtaacacaagtcaacctgctgg

SEQ ID NO: 160310 - DNA, 25 bp, E. coli
catgtaacacaactcaacctgctgg

SEQ ID NO: 160311 - DNA, 25 bp, E. coli
tactacggtaattcaacctgctgga

SEQ ID NO: 160312 - DNA, 25 bp, E. coli
tactacggtaatacaacctgctgga

SEQ ID NO: 160313 - DNA, 25 bp, E. coli
tactggcgagtaatgtctccgctga

SEQ ID NO: 160314 - DNA, 25 bp, E. coli
tactggcgagtattgtctccgctga

SEQ ID NO: 160315 - DNA, 25 bp, E. coli
aaagggccggtgacgataatacgct

SEQ ID NO: 160316 - DNA, 25 bp, E. coli
aaagggccggtgtcgataatacgct

SEQ ID NO: 160317 - DNA, 25 bp, E. coli
tattgtctccgctgagacgcgcttg

SEQ ID NO: 160318 - DNA, 25 bp, E. coli
tattgtctccgcagagacgcgcttg

SEQ ID NO: 160319 - DNA, 25 bp, E. coli
tgcttgacaaaaagagagttactgg

SEQ ID NO: 160320 - DNA, 25 bp, E. coli
tgcttgacaaaatgagagttactgg

SEQ ID NO: 160321 - DNA, 25 bp, E. coli
tctgaattcggactaataagccagg

SEQ ID NO: 160322 - DNA, 25 bp, E. coli
tctgaattcggagtaataagccagg

SEQ ID NO: 160323 - DNA, 25 bp, E. coli
gcttgacaaaaagagagttactggc

SEQ ID NO: 160324 - DNA, 25 bp, E. coli
gcttgacaaaaacagagttactggc

SEQ ID NO: 160325 - DNA, 25 bp, E. coli
cggaccagcaactaaaaaccgcctg

SEQ ID NO: 160326 - DNA, 25 bp, E. coli
cggaccagcaacaaaaaaccgcctg

SEQ ID NO: 160327 - DNA, 25 bp, E. coli
taataactctcttttgcttgacaaa

SEQ ID NO: 160328 - DNA, 25 bp, E. coli
taataactctctattgcttgacaaa

SEQ ID NO: 160329 - DNA, 25 bp, E. coli
gagacgcgcttgcattactacggta

SEQ ID NO: 160330 - DNA, 25 bp, E. coli
gagacgcgcttggattactacggta

SEQ ID NO: 160331 - DNA, 25 bp, E. coli
aaggcgccatttacatattgtagac

SEQ ID NO: 160332 - DNA, 25 bp, E. coli
aaggcgccattttcatattgtagac

SEQ ID NO: 160333 - DNA, 25 bp, E. coli
agacaacgtaggctttgttcatgcc

SEQ ID NO: 160334 - DNA, 25 bp, E. coli
agacaacgtagggtttgttcatgcc

SEQ ID NO: 160335 - DNA, 25 bp, E. coli
tagattgcagtgaacgtgtaggcct

SEQ ID NO: 160336 - DNA, 25 bp, E. coli
tagattgcagtgtacgtgtaggcct

SEQ ID NO: 160337 - DNA, 25 bp, E. coli
ttgtcatcagtttcaaatggcgctg

SEQ ID NO: 160338 - DNA, 25 bp, E. coli
ttgtcatcagttacaaatggcgctg

SEQ ID NO: 160339 - DNA, 25 bp, E. coli
tgaaaacccttcaaatccaatagat

SEQ ID NO: 160340 - DNA, 25 bp, E. coli
tgaaaacccttctaatccaatagat

SEQ ID NO: 160341 - DNA, 25 bp, E. coli
tctaaatggcgcattataaagtgcc

SEQ ID NO: 160342 - DNA, 25 bp, E. coli
tctaaatggcgctttataaagtgcc

SEQ ID NO: 160343 - DNA, 25 bp, E. coli
cgccttatccgggatgaaaaccctt

SEQ ID NO: 160344 - DNA, 25 bp, E. coli
cgccttatccggcatgaaaaccctt

SEQ ID NO: 160345 - DNA, 25 bp, E. coli
ctgaaaatggcgctgtaaaaggcgc

SEQ ID NO: 160346 - DNA, 25 bp, E. coli
ctgaaaatggcggtgtaaaaggcgc

SEQ ID NO: 160347 - DNA, 25 bp, E. coli
ttgaactttaagctgaaaatggcgc

SEQ ID NO: 160348 - DNA, 25 bp, E. coli
ttgaactttaaggtgaaaatggcgc

SEQ ID NO: 160349 - DNA, 25 bp, E. coli
gtttgtcatcagatctaaatggcgc

SEQ ID NO: 160350 - DNA, 25 bp, E. coli
gtttgtcatcagttctaaatggcgc

SEQ ID NO: 160351 - DNA, 25 bp, E. coli
tcaaatggcgctgtaaaaggcgtca

SEQ ID NO: 160352 - DNA, 25 bp, E. coli
tcaaatggcgctctaaaaggcgtca

SEQ ID NO: 160353 - DNA, 25 bp, E. coli
caacgaggaatgagcacagggatcc

SEQ ID NO: 160354 - DNA, 25 bp, E. coli
caaatcgtcagccaaagccgtcgaa

SEQ ID NO: 160355 - DNA, 25 bp, E. coli
cactaatgaccgctgagaaggccga

SEQ ID NO: 160356 - DNA, 25 bp, E. coli
caaatcgtcagcgaaagccgtcgaa

SEQ ID NO: 160357 - DNA, 25 bp, E. coli
caacgaggaatgtgcacagggatcc

SEQ ID NO: 160358 - DNA, 25 bp, E. coli
cactaatgaccggtgagaaggccga

SEQ ID NO: 160359 - DNA, 25 bp, E. coli
ttacggcatgatcaccaaaggactg

SEQ ID NO: 160360 - DNA, 25 bp, E. coli
ttacggcatgatgaccaaaggactg

SEQ ID NO: 160361 - DNA, 25 bp, E. coli
tgagaagcgattagacccgtcaggc

SEQ ID NO: 160362 - DNA, 25 bp, E. coli
tgagaagcgatttgacccgtcaggc

SEQ ID NO: 160363 - DNA, 25 bp, E. coli
tcgctgagatcggaaagaacacgcc

SEQ ID NO: 160364 - DNA, 25 bp, E. coli
tgcgcagtgcatcagaaaaagcccg

SEQ ID NO: 160365 - DNA, 25 bp, E. coli
tgcgcagtgcatgagaaaaagcccg

SEQ ID NO: 160366 - DNA, 25 bp, E. coli
tcgctgagatcgcaaagaacacgcc

SEQ ID NO: 160367 - DNA, 25 bp, E. coli
tcatggaagactgggttagcgacct

SEQ ID NO: 160368 - DNA, 25 bp, E. coli
tcatggaagactcggttagcgacct

SEQ ID NO: 160369 - DNA, 25 bp, E. coli
gcagtgagcgcgaccagaaagttct

SEQ ID NO: 160370 - DNA, 25 bp, E. coli
gcagtgagcgcgtccagaaagttct

SEQ ID NO: 160371 - DNA, 25 bp, E. coli
gaaataaccagaatgcaccgggagc

SEQ ID NO: 160372 - DNA, 25 bp, E. coli
gaaataaccagattgcaccgggagc

SEQ ID NO: 160373 - DNA, 25 bp, E. coli
tcaacagggcgaacgaaacagctaa

SEQ ID NO: 160374 - DNA, 25 bp, E. coli
tcaacagggcgatcgaaacagctaa

SEQ ID NO: 160375 - DNA, 25 bp, E. coli
aatatcacccggatgcaggtggcgc

SEQ ID NO: 160376 - DNA, 25 bp, E. coli
aatatcacccggttgcaggtggcgc

SEQ ID NO: 160377 - DNA, 25 bp, E. coli
cagccactggttagtgcgcgagaac

SEQ ID NO: 160378 - DNA, 25 bp, E. coli
cagccactggtttgtgcgcgagaac

SEQ ID NO: 160379 - DNA, 25 bp, E. coli
caggttgcgcgttttccggcagaca

SEQ ID NO: 160380 - DNA, 25 bp, E. coli
cagaagcatcgtgaatggccggtgt

SEQ ID NO: 160381 - DNA, 25 bp, E. coli
caggttgcgcgtattccggcagaca

SEQ ID NO: 160382 - DNA, 25 bp, E. coli
cagaagcatcgtcaatggccggtgt

SEQ ID NO: 160383 - DNA, 25 bp, E. coli
ttatcgcgggccagatgacgggctt

SEQ ID NO: 160384 - DNA, 25 bp, E. coli
ttatcgcgggcctgatgacgggctt

SEQ ID NO: 160385 - DNA, 25 bp, E. coli
tgacagtggatagcggcgcagataa

SEQ ID NO: 160386 - DNA, 25 bp, E. coli
tgacagtggataccggcgcagataa

SEQ ID NO: 160387 - DNA, 25 bp, E. coli
tgaaattaagcatctgttcggcgca

SEQ ID NO: 160388 - DNA, 25 bp, E. coli
tgaaattaagcaactgttcggcgca

SEQ ID NO: 160389 - DNA, 25 bp, E. coli
gataacgccgcacgaaagctgacct

SEQ ID NO: 160390 - DNA, 25 bp, E. coli
gataacgccgcaggaaagctgacct

SEQ ID NO: 160391 - DNA, 25 bp, E. coli
tggcgctgatgcaccctctggatgt

SEQ ID NO: 160392 - DNA, 25 bp, E. coli
tggcgctgatgctccctctggatgt

SEQ ID NO: 160393 - DNA, 25 bp, E. coli
gagggcaacaccacagaactgctgg

SEQ ID NO: 160394 - DNA, 25 bp, E. coli
gacctttaacattgacgggctggca

SEQ ID NO: 160395 - DNA, 25 bp, E. coli
gacctttaacatagacgggctggca

SEQ ID NO: 160396 - DNA, 25 bp, E. coli
gagggcaacacctcagaactgctgg

SEQ ID NO: 160397 - DNA, 25 bp, E. coli
caatgatgtttcgtccttcgttgca

SEQ ID NO: 160398 - DNA, 25 bp, E. coli
caatgatgtttcctccttcgttgca

SEQ ID NO: 160399 - DNA, 25 bp, E. coli
catgccgccagcaatgatgtttcct

SEQ ID NO: 160400 - DNA, 25 bp, E. coli
cttccatgccgccagcaatgatgtt

SEQ ID NO: 160401 - DNA, 25 bp, E. coli
catgccgccagctatgatgtttcct

SEQ ID NO: 160402 - DNA, 25 bp, E. coli
cttccatgccgcgagcaatgatgtt

SEQ ID NO: 160403 - DNA, 25 bp, E. coli
agcaacaccctgcatgccttccatg

SEQ ID NO: 160404 - DNA, 25 bp, E. coli
agcaacaccctggatgccttccatg

SEQ ID NO: 160405 - DNA, 25 bp, E. coli
tttcctccttcgatgcatatactgc

SEQ ID NO: 160406 - DNA, 25 bp, E. coli
tttcctccttcgttgcatatactgc

SEQ ID NO: 160407 - DNA, 25 bp, E. coli
tgccgccagcaatgatgtttcctcc

SEQ ID NO: 160408 - DNA, 25 bp, E. coli
tccatgccgccaccaatgatgtttc

SEQ ID NO: 160409 - DNA, 25 bp, E. coli
tgccgccagcaaagatgtttcctcc

SEQ ID NO: 160410 - DNA, 25 bp, E. coli
tccatgccgccagcaatgatgtttc

SEQ ID NO: 160411 - DNA, 25 bp, E. coli
gccagcaatgatgtttcctccttcg

SEQ ID NO: 160412 - DNA, 25 bp, E. coli
gccagcaatgatctttcctccttcg

SEQ ID NO: 160413 - DNA, 25 bp, E. coli
ctccttcgttgcatatactgctcac

SEQ ID NO: 160414 - DNA, 25 bp, E. coli
ctccttcgttgcttatactgctcac

SEQ ID NO: 160415 - DNA, 25 bp, E. coli
ggttcagcaacagcctgcatgcctt

SEQ ID NO: 160416 - DNA, 25 bp, E. coli
ggttcagcaacaccctgcatgcctt

SEQ ID NO: 160417 - DNA, 25 bp, E. coli
gatgtttcctccttcgttgcatata

SEQ ID NO: 160418 - DNA, 25 bp, E. coli
gatgtttcctccatcgttgcatata

SEQ ID NO: 160419 - DNA, 25 bp, E. coli
cacggcaaacgaaagcgcatcggaa

SEQ ID NO: 160420 - DNA, 25 bp, E. coli
cacggcaaacgatagcgcatcggaa

SEQ ID NO: 160421 - DNA, 25 bp, E. coli
atcacaccggcggaacagcggtacg

SEQ ID NO: 160422 - DNA, 25 bp, E. coli
atcacaccggcgcaacagcggtacg

SEQ ID NO: 160423 - DNA, 25 bp, E. coli
aatggtaagtggacgttatgtcacg

SEQ ID NO: 160424 - DNA, 25 bp, E. coli
aatggtaagtggtcgttatgtcacg

SEQ ID NO: 160425 - DNA, 25 bp, E. coli
tatggtgatcactccggcggaacag

SEQ ID NO: 160426 - DNA, 25 bp, E. coli
tatggtgatcacaccggcggaacag

SEQ ID NO: 160427 - DNA, 25 bp, E. coli
tagtaataaatttaatgagtctggt

SEQ ID NO: 160428 - DNA, 25 bp, E. coli
tagtaataaattaaatgagtctggt

SEQ ID NO: 160429 - DNA, 25 bp, E. coli
ttatgtcacggcaaacgaaagcgca

SEQ ID NO: 160430 - DNA, 25 bp, E. coli
ttatgtcacggctaacgaaagcgca

SEQ ID NO: 160431 - DNA, 25 bp, E. coli
gaacagcggtacgtctgacttcgca

SEQ ID NO: 160432 - DNA, 25 bp, E. coli
gaacagcggtacctctgacttcgca

SEQ ID NO: 160433 - DNA, 25 bp, E. coli
gaaaacgcagcgaactgatgccgca

SEQ ID NO: 160434 - DNA, 25 bp, E. coli
gaaaacgcagcgtactgatgccgca

SEQ ID NO: 160435 - DNA, 25 bp, E. coli
cgaagcctatattggcgatcatttc

SEQ ID NO: 160436 - DNA, 25 bp, E. coli
cgaagcctatataggcgatcatttc

SEQ ID NO: 160437 - DNA, 25 bp, E. coli
tggcgatcatttcattgtagctaac

SEQ ID NO: 160438 - DNA, 25 bp, E. coli
ggcgagaactatttgcagttctccg

SEQ ID NO: 160439 - DNA, 25 bp, E. coli
tggcgatcatttgattgtagctaac

SEQ ID NO: 160440 - DNA, 25 bp, E. coli
ggcgagaactatatgcagttctccg

SEQ ID NO: 160441 - DNA, 25 bp, E. coli
cagacacaaatacagctacgggcgt

SEQ ID NO: 160442 - DNA, 25 bp, E. coli
cagacacaaatagagctacgggcgt

SEQ ID NO: 160443 - DNA, 25 bp, E. coli
tacaggattcacgattttatagtgg

SEQ ID NO: 160444 - DNA, 25 bp, E. coli
tacaggattcaccattttatagtgg

SEQ ID NO: 160445 - DNA, 25 bp, E. coli
aaagttgaactgactctggaagaga

SEQ ID NO: 160446 - DNA, 25 bp, E. coli
aaagttgaactgtctctggaagaga

SEQ ID NO: 160447 - DNA, 25 bp, E. coli
tggtgtgacagggaaaataatatct

SEQ ID NO: 160448 - DNA, 25 bp, E. coli
tggtgtgacaggcaaaataatatct

SEQ ID NO: 160449 - DNA, 25 bp, E. coli
tgctcttgtatatgaagaaacagac

SEQ ID NO: 160450 - DNA, 25 bp, E. coli
tgctcttgtataagaagaaacagac

SEQ ID NO: 160451 - DNA, 25 bp, E. coli
tccggcatgggtatatggtgtgaca

SEQ ID NO: 160452 - DNA, 25 bp, E. coli
tccggcatgggtttatggtgtgaca

SEQ ID NO: 160453 - DNA, 25 bp, E. coli
tctggaagagaatttgtactactgc

SEQ ID NO: 160454 - DNA, 25 bp, E. coli
tctggaagagaaattgtactactgc

SEQ ID NO: 160455 - DNA, 25 bp, E. coli
tcattagattctgttccggcatggg

SEQ ID NO: 160456 - DNA, 25 bp, E. coli
tcattagattctcttccggcatggg

SEQ ID NO: 160457 - DNA, 25 bp, E. coli
gaagagatcttttttggttacgtcc

SEQ ID NO: 160458 - DNA, 25 bp, E. coli
gaacgctgaagaatttactggtacc

SEQ ID NO: 160459 - DNA, 25 bp, E. coli
gaagagatctttattggttacgtcc

SEQ ID NO: 160460 - DNA, 25 bp, E. coli
gaacgctgaagattttactggtacc

SEQ ID NO: 160461 - DNA, 25 bp, E. coli
ggcgtcaggcaatccgaacgctgaa

SEQ ID NO: 160462 - DNA, 25 bp, E. coli
ggcgtcaggcaaaccgaacgctgaa

SEQ ID NO: 160463 - DNA, 25 bp, E. coli
aacggagcacacttcgccgggttag

SEQ ID NO: 160464 - DNA, 25 bp, E. coli
catgcaaattctgggcgatcaggaa

SEQ ID NO: 160465 - DNA, 25 bp, E. coli
catgcaaattctcggcgatcaggaa

SEQ ID NO: 160466 - DNA, 25 bp, E. coli
aaagtggcattttcctgcaacgtgg

SEQ ID NO: 160467 - DNA, 25 bp, E. coli
aacggagcacacatcgccgggttag

SEQ ID NO: 160468 - DNA, 25 bp, E. coli
aaagtggcatttacctgcaacgtgg

SEQ ID NO: 160469 - DNA, 25 bp, E. coli
ttttctcgaaaagccggcagatccg

SEQ ID NO: 160470 - DNA, 25 bp, E. coli
ttttctcgaaaacccggcagatccg

SEQ ID NO: 160471 - DNA, 25 bp, E. coli
tgttgattacatcgcgacgcagggt

SEQ ID NO: 160472 - DNA, 25 bp, E. coli
tgttgattacatggcgacgcagggt

SEQ ID NO: 160473 - DNA, 25 bp, E. coli
tgcagcaaaaatacagcgggccgtg

SEQ ID NO: 160474 - DNA, 25 bp, E. coli
tgcagcaaaaattcagcgggccgtg

SEQ ID NO: 160475 - DNA, 25 bp, E. coli
cctgttaagcgggtatgtgcagcaa

SEQ ID NO: 160476 - DNA, 25 bp, E. coli
cctgctctggtgctggtatctcggc

SEQ ID NO: 160477 - DNA, 25 bp, E. coli
cctgttaagcggctatgtgcagcaa

SEQ ID NO: 160478 - DNA, 25 bp, E. coli
cctgctctggtggtggtatctcggc

SEQ ID NO: 160479 - DNA, 25 bp, E. coli
gcgctgatgggcaacgtctggctac

SEQ ID NO: 160480 - DNA, 25 bp, E. coli
gcgctgatgggctacgtctggctac

SEQ ID NO: 160481 - DNA, 25 bp, E. coli
taaccaaagcgatgtctggctggcg

SEQ ID NO: 160482 - DNA, 25 bp, E. coli
taaccaaagcgaagtctggctggcg

SEQ ID NO: 160483 - DNA, 25 bp, E. coli
gagttctggcgtaacttcacccacg

SEQ ID NO: 160484 - DNA, 25 bp, E. coli
gagttctggcgttacttcacccacg

SEQ ID NO: 160485 - DNA, 25 bp, E. coli
tacgaagaaattactgctagctgct

SEQ ID NO: 160486 - DNA, 25 bp, E. coli
acctcgacgtgtccagcaagtgcca

SEQ ID NO: 160487 - DNA, 25 bp, E. coli
acctcgacgtgtgcagcaagtgcca

SEQ ID NO: 160488 - DNA, 25 bp, E. coli
aaattactgctagctgctcttgcgg

SEQ ID NO: 160489 - DNA, 25 bp, E. coli
aaattactgctacctgctcttgcgg

SEQ ID NO: 160490 - DNA, 25 bp, E. coli
aatgaaaatccggtccaccgttggt

SEQ ID NO: 160491 - DNA, 25 bp, E. coli
aatgaaaatccgctccaccgttggt

SEQ ID NO: 160492 - DNA, 25 bp, E. coli
tacgaagaaatttctgctagctgct

SEQ ID NO: 160493 - DNA, 25 bp, E. coli
tgaacctcgacgagtgcagcaagtg

SEQ ID NO: 160494 - DNA, 25 bp, E. coli
tgaacctcgacgtgtgcagcaagtg

SEQ ID NO: 160495 - DNA, 25 bp, E. coli
tgaaaaaagataatcacccgaaata

SEQ ID NO: 160496 - DNA, 25 bp, E. coli
tgaaaaaagatattcacccgaaata

SEQ ID NO: 160497 - DNA, 25 bp, E. coli
tcatgacctgaagctcgacgtgtgc

SEQ ID NO: 160498 - DNA, 25 bp, E. coli
tcatgacctgaacctcgacgtgtgc

SEQ ID NO: 160499 - DNA, 25 bp, E. coli
gctagctgctcttgcggtaacgtaa

SEQ ID NO: 160500 - DNA, 25 bp, E. coli
gctagctgctctagcggtaacgtaa

SEQ ID NO: 160501 - DNA, 25 bp, E. coli
gctccaccgttggtcatgacctgaa

SEQ ID NO: 160502 - DNA, 25 bp, E. coli
gctccaccgttgctcatgacctgaa

SEQ ID NO: 160503 - DNA, 25 bp, E. coli
gatattcacccgtaatacgaagaaa

SEQ ID NO: 160504 - DNA, 25 bp, E. coli
gatattcacccgaaatacgaagaaa

SEQ ID NO: 160505 - DNA, 25 bp, E. coli
ggtaacgtaatgaaaatccgctcca

SEQ ID NO: 160506 - DNA, 25 bp, E. coli
ggtaacgtaatgtaaatccgctcca

SEQ ID NO: 160507 - DNA, 25 bp, E. coli
cagtaactccctcatggataacttc

SEQ ID NO: 160508 - DNA, 25 bp, E. coli
cagtaactccctgatggataacttc

SEQ ID NO: 160509 - DNA, 25 bp, E. coli
tacagtaactccctgatggataact

SEQ ID NO: 160510 - DNA, 25 bp, E. coli
tacagtaactccgtgatggataact

SEQ ID NO: 160511 - DNA, 25 bp, E. coli
taaatatattctcgcttacagtaac

SEQ ID NO: 160512 - DNA, 25 bp, E. coli
taaatatattctggcttacagtaac

SEQ ID NO: 160513 - DNA, 25 bp, E. coli
attattccgccacgtactaccttgc

SEQ ID NO: 160514 - DNA, 25 bp, E. coli
attattccgccaggtactaccttgc

SEQ ID NO: 160515 - DNA, 25 bp, E. coli
tattccgccaggtactaccttgctg

SEQ ID NO: 160516 - DNA, 25 bp, E. coli
tattctcgcttagagtaactccctg

SEQ ID NO: 160517 - DNA, 25 bp, E. coli
tattccgccaggaactaccttgctg

SEQ ID NO: 160518 - DNA, 25 bp, E. coli
tattctcgcttacagtaactccctg

SEQ ID NO: 160519 - DNA, 25 bp, E. coli
ttccgccaggtactaccttgctggc

SEQ ID NO: 160520 - DNA, 25 bp, E. coli
ttccgccaggtagtaccttgctggc

SEQ ID NO: 160521 - DNA, 25 bp, E. coli
tctcgcttacagtaactccctgatg

SEQ ID NO: 160522 - DNA, 25 bp, E. coli
tctcgcttacagaaactccctgatg

SEQ ID NO: 160523 - DNA, 25 bp, E. coli
gataaatatattctcgcttacagta

SEQ ID NO: 160524 - DNA, 25 bp, E. coli
gataaatatattgtcgcttacagta

SEQ ID NO: 160525 - DNA, 25 bp, E. coli
taactccctgatggataacttcatt

SEQ ID NO: 160526 - DNA, 25 bp, E. coli
taactccctgatcgataacttcatt

SEQ ID NO: 160527 - DNA, 25 bp, E. coli
gagtgataaatatattctcgcttac

SEQ ID NO: 160528 - DNA, 25 bp, E. coli
gagtgataaataaattctcgcttac

SEQ ID NO: 160529 - DNA, 25 bp, E. coli
cagcgggcgttagcagtggatttta

SEQ ID NO: 160530 - DNA, 25 bp, E. coli
cagcgggcgttaccagtggatttta

SEQ ID NO: 160531 - DNA, 25 bp, E. coli
actcgctggcaaacgtcaatgtgga

SEQ ID NO: 160532 - DNA, 25 bp, E. coli
actcgctggcaatcgtcaatgtgga

SEQ ID NO: 160533 - DNA, 25 bp, E. coli
tatccgactgcatcagcaagcgctg

SEQ ID NO: 160534 - DNA, 25 bp, E. coli
tatccgactgcaacagcaagcgctg

SEQ ID NO: 160535 - DNA, 25 bp, E. coli
ttacagcaactataagccagcgggc

SEQ ID NO: 160536 - DNA, 25 bp, E. coli
ttacagcaactaaaagccagcgggc

SEQ ID NO: 160537 - DNA, 25 bp, E. coli
tgtggatgccaagtgccatatccga

SEQ ID NO: 160538 - DNA, 25 bp, E. coli
tgtggatgccaactgccatatccga

SEQ ID NO: 160539 - DNA, 25 bp, E. coli
tcaggacgatatataccagctttgg

SEQ ID NO: 160540 - DNA, 25 bp, E. coli
tcaggacgatatttaccagctttgg

SEQ ID NO: 160541 - DNA, 25 bp, E. coli
ccagctgctgagattgtgcgatcac

SEQ ID NO: 160542 - DNA, 25 bp, E. coli
ccagctgctgagtttgtgcgatcac

SEQ ID NO: 160543 - DNA, 25 bp, E. coli
gaacaagaaaatccacagcactggc

SEQ ID NO: 160544 - DNA, 25 bp, E. coli
gaacaagaaaatgcacagcactggc

SEQ ID NO: 160545 - DNA, 25 bp, E. coli
ctttggttgcaaagccagcgccgat

SEQ ID NO: 160546 - DNA, 25 bp, E. coli
ctttggttgcaatgccagcgccgat

SEQ ID NO: 160547 - DNA, 25 bp, E. coli
gtgatgcctcgctgataacccacca

SEQ ID NO: 160548 - DNA, 25 bp, E. coli
gtgatgcctcgcagataacccacca

SEQ ID NO: 160549 - DNA, 25 bp, E. coli
tggcaaacccggctgagcgatattt

SEQ ID NO: 160550 - DNA, 25 bp, E. coli
tggcaaacccgggtgagcgatattt

SEQ ID NO: 160551 - DNA, 25 bp, E. coli
taaaaaacactagaaaaggacatgc

SEQ ID NO: 160552 - DNA, 25 bp, E. coli
taaaaaacactacaaaaggacatgc

SEQ ID NO: 160553 - DNA, 25 bp, E. coli
actttaaggattctgaaattgccca

SEQ ID NO: 160554 - DNA, 25 bp, E. coli
actttaaggattgtgaaattgccca

SEQ ID NO: 160555 - DNA, 25 bp, E. coli
tgccttatgtcgagaaaatgtacgt

SEQ ID NO: 160556 - DNA, 25 bp, E. coli
tcggaagggcttaacctgacagaag

SEQ ID NO: 160557 - DNA, 25 bp, E. coli
tgccttatgtcgtgaaaatgtacgt

SEQ ID NO: 160558 - DNA, 25 bp, E. coli
tcggaagggctttacctgacagaag

SEQ ID NO: 160559 - DNA, 25 bp, E. coli
tcatcatgaattggaaggagataca

SEQ ID NO: 160560 - DNA, 25 bp, E. coli
tcatcatgaattcgaaggagataca

SEQ ID NO: 160561 - DNA, 25 bp, E. coli
gacattccatggtgaatttctagtg

SEQ ID NO: 160562 - DNA, 25 bp, E. coli
gaaattgcccatacaatagaagctg

SEQ ID NO: 160563 - DNA, 25 bp, E. coli
gaaagaaccttctatcaatcggaag

SEQ ID NO: 160564 - DNA, 25 bp, E. coli
gacattccatggagaatttctagtg

SEQ ID NO: 160565 - DNA, 25 bp, E. coli
gaaattgcccattcaatagaagctg

SEQ ID NO: 160566 - DNA, 25 bp, E. coli
gaaagaaccttcaatcaatcggaag

SEQ ID NO: 160567 - DNA, 25 bp, E. coli
ggacatgcaatcttattaggtagaa

SEQ ID NO: 160568 - DNA, 25 bp, E. coli
ggacatgcaatcatattaggtagaa

SEQ ID NO: 160569 - DNA, 25 bp, E. coli
taatcggcaaggataacgacattcc

SEQ ID NO: 160570 - DNA, 25 bp, E. coli
taatcggcaaggttaacgacattcc

SEQ ID NO: 160571 - DNA, 25 bp, E. coli
gatggataagaatagagtaatcggc

SEQ ID NO: 160572 - DNA, 25 bp, E. coli
gatggataagaaaagagtaatcggc

SEQ ID NO: 160573 - DNA, 25 bp, E. coli
tgctgtacagcaggcgacgaaacct

SEQ ID NO: 160574 - DNA, 25 bp, E. coli
tgctgtacagcacgcgacgaaacct

SEQ ID NO: 160575 - DNA, 25 bp, E. coli
tctcgtgtgccgctaaagggatgac

SEQ ID NO: 160576 - DNA, 25 bp, E. coli
tcgcggtgttgatcgtcggcaagcc

SEQ ID NO: 160577 - DNA, 25 bp, E. coli
tcgcggtgttgaacgtcggcaagcc

SEQ ID NO: 160578 - DNA, 25 bp, E. coli
tctcgtgtgccggtaaagggatgac

SEQ ID NO: 160579 - DNA, 25 bp, E. coli
ccatgtactggtggtttgccgcgcg

SEQ ID NO: 160580 - DNA, 25 bp, E. coli
ccatgtactggtcgtttgccgcgcg

SEQ ID NO: 160581 - DNA, 25 bp, E. coli
gctgccgccgggatatttaaaatcg

SEQ ID NO: 160582 - DNA, 25 bp, E. coli
gctgccgccgggttatttaaaatcg

SEQ ID NO: 160583 - DNA, 25 bp, E. coli
gaatcggtattctggtggcgctcgc

SEQ ID NO: 160584 - DNA, 25 bp, E. coli
gaatcggtattcaggtggcgctcgc

SEQ ID NO: 160585 - DNA, 25 bp, E. coli
cccagaggtgatccgtttagatccg

SEQ ID NO: 160586 - DNA, 25 bp, E. coli
cccagaggtgatgcgtttagatccg

SEQ ID NO: 160587 - DNA, 25 bp, E. coli
gattgtgcaatcgtacgccaagtcg

SEQ ID NO: 160588 - DNA, 25 bp, E. coli
gattgtgcaatcctacgccaagtcg

SEQ ID NO: 160589 - DNA, 25 bp, E. coli
taagtatctcgatgcgtatgacctg

SEQ ID NO: 160590 - DNA, 25 bp, E. coli
taagtatctcgaagcgtatgacctg

SEQ ID NO: 160591 - DNA, 25 bp, E. coli
gagtctgcccgaaacattaaaggcg

SEQ ID NO: 160592 - DNA, 25 bp, E. coli
gagtctgcccgatacattaaaggcg

SEQ ID NO: 160593 - DNA, 25 bp, E. coli
gacgaaaccttttctgcgcgcagcg

SEQ ID NO: 160594 - DNA, 25 bp, E. coli
gacgaaacctttactgcgcgcagcg

SEQ ID NO: 160595 - DNA, 25 bp, E. coli
caggatgtgaagtataaagccgaca

SEQ ID NO: 160596 - DNA, 25 bp, E. coli
catttaaagggcctattggacgccg

SEQ ID NO: 160597 - DNA, 25 bp, E. coli
caggatgtgaagaataaagccgaca

SEQ ID NO: 160598 - DNA, 25 bp, E. coli
catttaaagggcgtattggacgccg

SEQ ID NO: 160599 - DNA, 25 bp, E. coli
tactcgatattctgaccgcggcgtt

SEQ ID NO: 160600 - DNA, 25 bp, E. coli
tactcgatattcagaccgcggcgtt

SEQ ID NO: 160601 - DNA, 25 bp, E. coli
ttaagcgcttgcatgatcgcgggcg

SEQ ID NO: 160602 - DNA, 25 bp, E. coli
ttaagcgcttgcttgatcgcgggcg

SEQ ID NO: 160603 - DNA, 25 bp, E. coli
ttttaccgggtgactggcaatgggc

SEQ ID NO: 160604 - DNA, 25 bp, E. coli
ttttaccgggtgtctggcaatgggc

SEQ ID NO: 160605 - DNA, 25 bp, E. coli
tgtcccgacgttcattctggtgatg

SEQ ID NO: 160606 - DNA, 25 bp, E. coli
tgtcccgacgttgattctggtgatg

SEQ ID NO: 160607 - DNA, 25 bp, E. coli
tgctggtgcttttctcactggcggg

SEQ ID NO: 160608 - DNA, 25 bp, E. coli
tgctggtgctttactcactggcggg

SEQ ID NO: 160609 - DNA, 25 bp, E. coli
gcgtttgttggctcacaaggcgaaa

SEQ ID NO: 160610 - DNA, 25 bp, E. coli
gcgtttgttggcacacaaggcgaaa

SEQ ID NO: 160611 - DNA, 25 bp, E. coli
cgttccggcgcatgggcatttctga

SEQ ID NO: 160612 - DNA, 25 bp, E. coli
cgttccggcgcaagggcatttctga

SEQ ID NO: 160613 - DNA, 25 bp, E. coli
ggacgccgtgatttctggatttgga

SEQ ID NO: 160614 - DNA, 25 bp, E. coli
ggacgccgtgatatctggatttgga

SEQ ID NO: 160615 - DNA, 25 bp, E. coli
gatgatgcttatcgatcttggtgcg

SEQ ID NO: 160616 - DNA, 25 bp, E. coli
gatgatgcttatggatcttggtgcg

SEQ ID NO: 160617 - DNA, 25 bp, E. coli
cagaaatattggtgacgggcatcgt

SEQ ID NO: 160618 - DNA, 25 bp, E. coli
cagaaatattggagacgggcatcgt

SEQ ID NO: 160619 - DNA, 25 bp, E. coli
taaatccgctggaacaggttcgtcg

SEQ ID NO: 160620 - DNA, 25 bp, E. coli
taaatccgctggtacaggttcgtcg

SEQ ID NO: 160621 - DNA, 25 bp, E. coli
tattcagcaggacattctggccaga

SEQ ID NO: 160622 - DNA, 25 bp, E. coli
tatttctggaggtcaaggactggac

SEQ ID NO: 160623 - DNA, 25 bp, E. coli
tatttctggaggacaaggactggac

SEQ ID NO: 160624 - DNA, 25 bp, E. coli
tattcagcaggagattctggccaga

SEQ ID NO: 160625 - DNA, 25 bp, E. coli
ttaatgccttacgtgctgacccgtg

SEQ ID NO: 160626 - DNA, 25 bp, E. coli
ttaatgccttacctgctgacccgtg

SEQ ID NO: 160627 - DNA, 25 bp, E. coli
tgcttacggcagaatgacggtcagt

SEQ ID NO: 160628 - DNA, 25 bp, E. coli
tgcttacggcagtatgacggtcagt

SEQ ID NO: 160629 - DNA, 25 bp, E. coli
tccactgaggagtgaatgacgccag

SEQ ID NO: 160630 - DNA, 25 bp, E. coli
tccactgaggagagaatgacgccag

SEQ ID NO: 160631 - DNA, 25 bp, E. coli
cctgaagtgaccctgaaacagaact

SEQ ID NO: 160632 - DNA, 25 bp, E. coli
cctgaagtgaccgtgaaacagaact

SEQ ID NO: 160633 - DNA, 25 bp, E. coli
cgcgcccatctgattcctgaagtga

SEQ ID NO: 160634 - DNA, 25 bp, E. coli
cccggatgagggttattctgcgcgc

SEQ ID NO: 160635 - DNA, 25 bp, E. coli
cgcgcccatctgtttcctgaagtga

SEQ ID NO: 160636 - DNA, 25 bp, E. coli
cccggatgagggatattctgcgcgc

SEQ ID NO: 160637 - DNA, 25 bp, E. coli
ggtgtttacccggattacccgtcag

SEQ ID NO: 160638 - DNA, 25 bp, E. coli
ggtgtttacccgcattacccgtcag

SEQ ID NO: 160639 - DNA, 25 bp, E. coli
catctaccgggtgatgtccgggaaa

SEQ ID NO: 160640 - DNA, 25 bp, E. coli
catctaccgggtcatgtccgggaaa

SEQ ID NO: 160641 - DNA, 25 bp, E. coli
tacagccatctaccgggtgatgtcc

SEQ ID NO: 160642 - DNA, 25 bp, E. coli
tacagccatctagcgggtgatgtcc

SEQ ID NO: 160643 - DNA, 25 bp, E. coli
taccgggtgatgtccgggaaacact

SEQ ID NO: 160644 - DNA, 25 bp, E. coli
taccgggtgatgaccgggaaacact

SEQ ID NO: 160645 - DNA, 25 bp, E. coli
tgccggagaggcacccgcggcgctg

SEQ ID NO: 160646 - DNA, 25 bp, E. coli
tgccggagaggctcccgcggcgctg

SEQ ID NO: 160647 - DNA, 25 bp, E. coli
tctaccgggtgatgtccgggaaaca

SEQ ID NO: 160648 - DNA, 25 bp, E. coli
tctaccgggtgaagtccgggaaaca

SEQ ID NO: 160649 - DNA, 25 bp, E. coli
cctacagccatcaaccgggtgatgt

SEQ ID NO: 160650 - DNA, 25 bp, E. coli
cctacagccatctaccgggtgatgt

SEQ ID NO: 160651 - DNA, 25 bp, E. coli
gccatctaccggctgatgtccggga

SEQ ID NO: 160652 - DNA, 25 bp, E. coli
gccatctaccgggtgatgtccggga

SEQ ID NO: 160653 - DNA, 25 bp, E. coli
gacagcctgactcccggagaggcac

SEQ ID NO: 160654 - DNA, 25 bp, E. coli
gacagcctgactgccggagaggcac

SEQ ID NO: 160655 - DNA, 25 bp, E. coli
ccctacagccatgtaccgggtgatg

SEQ ID NO: 160656 - DNA, 25 bp, E. coli
ccctacagccatctaccgggtgatg

SEQ ID NO: 160657 - DNA, 25 bp, E. coli
ggtgatgtccggcaaacactgcagt

SEQ ID NO: 160658 - DNA, 25 bp, E. coli
gtgatgtccgggaaacactgcagtc

SEQ ID NO: 160659 - DNA, 25 bp, E. coli
gtgatgtccgggtaacactgcagtc

SEQ ID NO: 160660 - DNA, 25 bp, E. coli
ggtgatgtccgggaaacactgcagt

SEQ ID NO: 160661 - DNA, 25 bp, E. coli
caaaagagcagtaaatcagtcatgt

SEQ ID NO: 160662 - DNA, 25 bp, E. coli
caaaagagcagttaatcagtcatgt

SEQ ID NO: 160663 - DNA, 25 bp, E. coli
agagcccgtgctatatatgaatcga

SEQ ID NO: 160664 - DNA, 25 bp, E. coli
agagcccgtgctttatatgaatcga

SEQ ID NO: 160665 - DNA, 25 bp, E. coli
tatacgtgccgcaatatgctgcccc

SEQ ID NO: 160666 - DNA, 25 bp, E. coli
tatacgtgccgctatatgctgcccc

SEQ ID NO: 160667 - DNA, 25 bp, E. coli
ttctcactggaagagcaacccggtg

SEQ ID NO: 160668 - DNA, 25 bp, E. coli
ttctcactggaacagcaacccggtg

SEQ ID NO: 160669 - DNA, 25 bp, E. coli
tgaaatttgcagtaaaacagacagc

SEQ ID NO: 160670 - DNA, 25 bp, E. coli
taaggaaccggaaatatacgtgccg

SEQ ID NO: 160671 - DNA, 25 bp, E. coli
tgaaatttgcagaaaaacagacagc

SEQ ID NO: 160672 - DNA, 25 bp, E. coli
taaggaaccggatatatacgtgccg

SEQ ID NO: 160673 - DNA, 25 bp, E. coli
ccttgttgctcacgcttcgctggaa

SEQ ID NO: 160674 - DNA, 25 bp, E. coli
ccttgttgctcaggcttcgctggaa

SEQ ID NO: 160675 - DNA, 25 bp, E. coli
gcaacccggtgcagataaggaaccg

SEQ ID NO: 160676 - DNA, 25 bp, E. coli
gcaacccggtgctgataaggaaccg

SEQ ID NO: 160677 - DNA, 25 bp, E. coli
gacagcattcaaaaattctctcgag

SEQ ID NO: 160678 - DNA, 25 bp, E. coli
gacagcattcaataattctctcgag

SEQ ID NO: 160679 - DNA, 25 bp, E. coli
gatttaccggaatgacattctcact

SEQ ID NO: 160680 - DNA, 25 bp, E. coli
gatttaccggaaagacattctcact

SEQ ID NO: 160681 - DNA, 25 bp, E. coli
gagttggatttaccactggcccttg

SEQ ID NO: 160682 - DNA, 25 bp, E. coli
gagttggatttagcactggcccttg

SEQ ID NO: 160683 - DNA, 25 bp, E. coli
caacgtctgtttgcgctggatgccg

SEQ ID NO: 160684 - DNA, 25 bp, E. coli
caacgtctgtttccgctggatgccg

SEQ ID NO: 160685 - DNA, 25 bp, E. coli
ttaagcgccgattccacgccagcag

SEQ ID NO: 160686 - DNA, 25 bp, E. coli
ttaagcgccgataccacgccagcag

SEQ ID NO: 160687 - DNA, 25 bp, E. coli
tgtgtaccgcgcttcaacgtctgtt

SEQ ID NO: 160688 - DNA, 25 bp, E. coli
tgataacgtccagaagctgaaagaa

SEQ ID NO: 160689 - DNA, 25 bp, E. coli
tgtgtaccgcgcatcaacgtctgtt

SEQ ID NO: 160690 - DNA, 25 bp, E. coli
tgataacgtccacaagctgaaagaa

SEQ ID NO: 160691 - DNA, 25 bp, E. coli
tgaactggtggtacctgccccggaa

SEQ ID NO: 160692 - DNA, 25 bp, E. coli
tgaactggtggttcctgccccggaa

SEQ ID NO: 160693 - DNA, 25 bp, E. coli
tctcggcattggatctgaaaaccaa

SEQ ID NO: 160694 - DNA, 25 bp, E. coli
tctcggcattggttctgaaaaccaa

SEQ ID NO: 160695 - DNA, 25 bp, E. coli
gctatatctcggcattggatctgaa

SEQ ID NO: 160696 - DNA, 25 bp, E. coli
gctatatctcgggattggatctgaa

SEQ ID NO: 160697 - DNA, 25 bp, E. coli
gcaaattaacgctgataacgtccac

SEQ ID NO: 160698 - DNA, 25 bp, E. coli
gcaaattaacgcagataacgtccac

SEQ ID NO: 160699 - DNA, 25 bp, E. coli
ggtgtctctttatggcaattaacaa

SEQ ID NO: 160700 - DNA, 25 bp, E. coli
ggtgtctctttaaggcaattaacaa

SEQ ID NO: 160701 - DNA, 25 bp, E. coli
taacgctgataaggtccacaagctg

SEQ ID NO: 160702 - DNA, 25 bp, E. coli
taacgctgataacgtccacaagctg

SEQ ID NO: 160703 - DNA, 25 bp, E. coli
taatggtgaactggtggttcctgcc

SEQ ID NO: 160704 - DNA, 25 bp, E. coli
taatggtgaactcgtggttcctgcc

SEQ ID NO: 160705 - DNA, 25 bp, E. coli
cagagaagagtaaccccggatgacg

SEQ ID NO: 160706 - DNA, 25 bp, E. coli
cagagaagagtatccccggatgacg

SEQ ID NO: 160707 - DNA, 25 bp, E. coli
aaaacagagaagagtatccccggat

SEQ ID NO: 160708 - DNA, 25 bp, E. coli
aaaacagagaagtgtatccccggat

SEQ ID NO: 160709 - DNA, 25 bp, E. coli
tgtagtcttggcggtaccagttttt

SEQ ID NO: 160710 - DNA, 25 bp, E. coli
tgtagtcttggccgtaccagttttt

SEQ ID NO: 160711 - DNA, 25 bp, E. coli
taacccgacccaacctgatagctgt

SEQ ID NO: 160712 - DNA, 25 bp, E. coli
taacccgacccatcctgatagctgt

SEQ ID NO: 160713 - DNA, 25 bp, E. coli
tcctgatagctgaggccacaggtgc

SEQ ID NO: 160714 - DNA, 25 bp, E. coli
tcctgatagctgtggccacaggtgc

SEQ ID NO: 160715 - DNA, 25 bp, E. coli
gctgtggccacaggtgctcttctct

SEQ ID NO: 160716 - DNA, 25 bp, E. coli
gctgtggccacacgtgctcttctct

SEQ ID NO: 160717 - DNA, 25 bp, E. coli
gagtatccccggttgacgggttaat

SEQ ID NO: 160718 - DNA, 25 bp, E. coli
gagtatccccggatgacgggttaat

SEQ ID NO: 160719 - DNA, 25 bp, E. coli
gggcacccgacagcacaactttatg

SEQ ID NO: 160720 - DNA, 25 bp, E. coli
ggttaataacccgacccatcctgat

SEQ ID NO: 160721 - DNA, 25 bp, E. coli
gggcacccgacaccacaactttatg

SEQ ID NO: 160722 - DNA, 25 bp, E. coli
ggttaataaccccacccatcctgat

SEQ ID NO: 160723 - DNA, 25 bp, E. coli
tggccacaggtggtcttctctgttt

SEQ ID NO: 160724 - DNA, 25 bp, E. coli
tggccacaggtgctcttctctgttt

SEQ ID NO: 160725 - DNA, 25 bp, E. coli
gacccatcctgatagctgtggccac

SEQ ID NO: 160726 - DNA, 25 bp, E. coli
gacccatcctgaaagctgtggccac

SEQ ID NO: 160727 - DNA, 25 bp, E. coli
tacgacgtgactgcggtttttcaac

SEQ ID NO: 160728 - DNA, 25 bp, E. coli
tacgacgtgactccggtttttcaac

SEQ ID NO: 160729 - DNA, 25 bp, E. coli
tccggcatgacgcatactcttctga

SEQ ID NO: 160730 - DNA, 25 bp, E. coli
tccggcatgacggatactcttctga

SEQ ID NO: 160731 - DNA, 25 bp, E. coli
tcatcagcgacaacaataagctacg

SEQ ID NO: 160732 - DNA, 25 bp, E. coli
tctgatgccataaaacgaattgagt

SEQ ID NO: 160733 - DNA, 25 bp, E. coli
tcatcagcgacatcaataagctacg

SEQ ID NO: 160734 - DNA, 25 bp, E. coli
tctgatgccatataacgaattgagt

SEQ ID NO: 160735 - DNA, 25 bp, E. coli
gctgcgggctttatgattcatttcg

SEQ ID NO: 160736 - DNA, 25 bp, E. coli
gctgcgggctttttgattcatttcg

SEQ ID NO: 160737 - DNA, 25 bp, E. coli
gaattgagtcgcatttaaatgtcgc

SEQ ID NO: 160738 - DNA, 25 bp, E. coli
gaattgagtcgcttttaaatgtcgc

SEQ ID NO: 160739 - DNA, 25 bp, E. coli
gatttcttatgcagggcgttccggc

SEQ ID NO: 160740 - DNA, 25 bp, E. coli
gatttcttatgctgggcgttccggc

SEQ ID NO: 160741 - DNA, 25 bp, E. coli
tacaacctgaactagtaagggcaaa

SEQ ID NO: 160742 - DNA, 25 bp, E. coli
taatccgtaccatacacgccacagt

SEQ ID NO: 160743 - DNA, 25 bp, E. coli
taagggcaaaaaacacaactctctg

SEQ ID NO: 160744 - DNA, 25 bp, E. coli
taagggcaaaaatcacaactctctg

SEQ ID NO: 160745 - DNA, 25 bp, E. coli
tacaacctgaacaagtaagggcaaa

SEQ ID NO: 160746 - DNA, 25 bp, E. coli
tcaatcaaagtcaaaccaaccgcag

SEQ ID NO: 160747 - DNA, 25 bp, E. coli
taatccgtaccaaacacgccacagt

SEQ ID NO: 160748 - DNA, 25 bp, E. coli
tcaatcaaagtctaaccaaccgcag

SEQ ID NO: 160749 - DNA, 25 bp, E. coli
aatatcagcgttatgaccgctggcg

SEQ ID NO: 160750 - DNA, 25 bp, E. coli
aatatcagcgttttgaccgctggcg

SEQ ID NO: 160751 - DNA, 25 bp, E. coli
agcaccaaaagtgccgaaatatcag

SEQ ID NO: 160752 - DNA, 25 bp, E. coli
agcaccaaaagtcccgaaatatcag

SEQ ID NO: 160753 - DNA, 25 bp, E. coli
tatcagcgttatgaccgctggcgtt

SEQ ID NO: 160754 - DNA, 25 bp, E. coli
ttaaagcaccaaaagtgccgaaata

SEQ ID NO: 160755 - DNA, 25 bp, E. coli
tatcagcgttatcaccgctggcgtt

SEQ ID NO: 160756 - DNA, 25 bp, E. coli
ttaaagcaccaatagtgccgaaata

SEQ ID NO: 160757 - DNA, 25 bp, E. coli
tgctggcattgatgattaagttgct

SEQ ID NO: 160758 - DNA, 25 bp, E. coli
tgctggcattgaagattaagttgct

SEQ ID NO: 160759 - DNA, 25 bp, E. coli
tcggcggtatgcaggcattgatgat

SEQ ID NO: 160760 - DNA, 25 bp, E. coli
tcggcggtatgctggcattgatgat

SEQ ID NO: 160761 - DNA, 25 bp, E. coli
gccgaaatatcagcgttatgaccgc

SEQ ID NO: 160762 - DNA, 25 bp, E. coli
gccgaaatatcaccgttatgaccgc

SEQ ID NO: 160763 - DNA, 25 bp, E. coli
gcggtatgctggcattgatgattaa

SEQ ID NO: 160764 - DNA, 25 bp, E. coli
gcggtatgctgggattgatgattaa

SEQ ID NO: 160765 - DNA, 25 bp, E. coli
gaaatatcagcgatatgaccgctgg

SEQ ID NO: 160766 - DNA, 25 bp, E. coli
gaaatatcagcgttatgaccgctgg

SEQ ID NO: 160767 - DNA, 25 bp, E. coli
gcgttatgaccggtggcgttactaa

SEQ ID NO: 160768 - DNA, 25 bp, E. coli
gcgttatgaccgctggcgttactaa

SEQ ID NO: 160769 - DNA, 25 bp, E. coli
tcagcgttatgagcgctggcgttac

SEQ ID NO: 160770 - DNA, 25 bp, E. coli
tcagcgttatgaccgctggcgttac

SEQ ID NO: 160771 - DNA, 25 bp, E. coli
catggtcgtcctggtttgcgggttc

SEQ ID NO: 160772 - DNA, 25 bp, E. coli
catggtcgtcctcgtttgcgggttc

SEQ ID NO: 160773 - DNA, 25 bp, E. coli
aaatcattaccactcccgcatcagg

SEQ ID NO: 160774 - DNA, 25 bp, E. coli
aaatcattaccagtcccgcatcagg

SEQ ID NO: 160775 - DNA, 25 bp, E. coli
tatgaccaaggttacaatgcgcgaa

SEQ ID NO: 160776 - DNA, 25 bp, E. coli
tatgaccaaggtaacaatgcgcgaa

SEQ ID NO: 160777 - DNA, 25 bp, E. coli
tattcatggctcacagacgtaaaga

SEQ ID NO: 160778 - DNA, 25 bp, E. coli
tattcatggctctcagacgtaaaga

SEQ ID NO: 160779 - DNA, 25 bp, E. coli
tgcatatcgcgacatggcagctcaa

SEQ ID NO: 160780 - DNA, 25 bp, E. coli
tgcatatcgcgagatggcagctcaa

SEQ ID NO: 160781 - DNA, 25 bp, E. coli
tgcgggttctggtacaccgaaaatc

SEQ ID NO: 160782 - DNA, 25 bp, E. coli
tgcgggttctggaacaccgaaaatc

SEQ ID NO: 160783 - DNA, 25 bp, E. coli
gaagatttttcttcgcctgaccaga

SEQ ID NO: 160784 - DNA, 25 bp, E. coli
gaagatttttctacgcctgaccaga

SEQ ID NO: 160785 - DNA, 25 bp, E. coli
cattggttacgtagctgctcctcgg

SEQ ID NO: 160786 - DNA, 25 bp, E. coli
cattggttacgttgctgctcctcgg

SEQ ID NO: 160787 - DNA, 25 bp, E. coli
gataaagatacggtcagataccatg

SEQ ID NO: 160788 - DNA, 25 bp, E. coli
gataaagatacgctcagataccatg

SEQ ID NO: 160789 - DNA, 25 bp, E. coli
tggctctcatacgatacatcagtgg

SEQ ID NO: 160790 - DNA, 25 bp, E. coli
tggctctcataccatacatcagtgg

SEQ ID NO: 160791 - DNA, 25 bp, E. coli
gagcatcaggaaactcagcatctgg

SEQ ID NO: 160792 - DNA, 25 bp, E. coli
gagcatcaggaatctcagcatctgg

SEQ ID NO: 160793 - DNA, 25 bp, E. coli
cagactatgtcacactgcaacgagg

SEQ ID NO: 160794 - DNA, 25 bp, E. coli
cagatgcgggcatctcgattttcac

SEQ ID NO: 160795 - DNA, 25 bp, E. coli
cagatgcgggcaactcgattttcac

SEQ ID NO: 160796 - DNA, 25 bp, E. coli
cagactatgtcagactgcaacgagg

SEQ ID NO: 160797 - DNA, 25 bp, E. coli
tattccagcgaataacacggtatcg

SEQ ID NO: 160798 - DNA, 25 bp, E. coli
tataattcgagaacggataagccgt

SEQ ID NO: 160799 - DNA, 25 bp, E. coli
tattgtgcgaaatgccaaaacctgg

SEQ ID NO: 160800 - DNA, 25 bp, E. coli
tattgtgcgaaaagccaaaacctgg

SEQ ID NO: 160801 - DNA, 25 bp, E. coli
tataattcgagatcggataagccgt

SEQ ID NO: 160802 - DNA, 25 bp, E. coli
tattccagcgaaaaacacggtatcg

SEQ ID NO: 160803 - DNA, 25 bp, E. coli
tgatgtcaccgtaactctgccggac

SEQ ID NO: 160804 - DNA, 25 bp, E. coli
tgatgtcaccgttactctgccggac

SEQ ID NO: 160805 - DNA, 25 bp, E. coli
gccgtgcttattttgcgacagacca

SEQ ID NO: 160806 - DNA, 25 bp, E. coli
cctgtttgctgtactgctgatgggc

SEQ ID NO: 160807 - DNA, 25 bp, E. coli
cctgtttgctgttctgctgatgggc

SEQ ID NO: 160808 - DNA, 25 bp, E. coli
gccgtgcttattatgcgacagacca

SEQ ID NO: 160809 - DNA, 25 bp, E. coli
gattttcaccaaaaccgcgtcgttt

SEQ ID NO: 160810 - DNA, 25 bp, E. coli
gattttcaccaataccgcgtcgttt

SEQ ID NO: 160811 - DNA, 25 bp, E. coli
ggtcattcgcctgtaaaaccgccaa

SEQ ID NO: 160812 - DNA, 25 bp, E. coli
ggtcattcgcctctaaaaccgccaa

SEQ ID NO: 160813 - DNA, 25 bp, E. coli
gacgcgcaacggtacgattattcca

SEQ ID NO: 160814 - DNA, 25 bp, E. coli
gacgcgcaacggaacgattattcca

SEQ ID NO: 160815 - DNA, 25 bp, E. coli
caggctattgactggaaagccagcg

SEQ ID NO: 160816 - DNA, 25 bp, E. coli
caggctattgacaggaaagccagcg

SEQ ID NO: 160817 - DNA, 25 bp, E. coli
aaccctgctgctgcgcgaaaaaatg

SEQ ID NO: 160818 - DNA, 25 bp, E. coli
aaccctgctgctccgcgaaaaaatg

SEQ ID NO: 160819 - DNA, 25 bp, E. coli
ttattcgcccgcaaagcgcaggcta

SEQ ID NO: 160820 - DNA, 25 bp, E. coli
ttattcgcccgctaagcgcaggcta

SEQ ID NO: 160821 - DNA, 25 bp, E. coli
cctgaatattcacggcaatggcgct

SEQ ID NO: 160822 - DNA, 25 bp, E. coli
cctgaatattcagggcaatggcgct

SEQ ID NO: 160823 - DNA, 25 bp, E. coli
gaatttattcatcaactgcaacagg

SEQ ID NO: 160824 - DNA, 25 bp, E. coli
gcaatggcgcttattccgttctgaa

SEQ ID NO: 160825 - DNA, 25 bp, E. coli
gcaatggcgctttttccgttctgaa

SEQ ID NO: 160826 - DNA, 25 bp, E. coli
gaatttattcatgaactgcaacagg

SEQ ID NO: 160827 - DNA, 25 bp, E. coli
gataccgaccaggtgcttgccttgt

SEQ ID NO: 160828 - DNA, 25 bp, E. coli
gataccgaccagctgcttgccttgt

SEQ ID NO: 160829 - DNA, 25 bp, E. coli
cttactgcaagcagtattgacctga

SEQ ID NO: 160830 - DNA, 25 bp, E. coli
cttactgcaagctgtattgacctga

SEQ ID NO: 160831 - DNA, 25 bp, E. coli
ggcacactgtgtcgcaaaattattc

SEQ ID NO: 160832 - DNA, 25 bp, E. coli
ggcacactgtgtggcaaaattattc

SEQ ID NO: 160833 - DNA, 25 bp, E. coli
tcaattgctggaactgcctcggcgt

SEQ ID NO: 160834 - DNA, 25 bp, E. coli
tcaattgctggatctgcctcggcgt

SEQ ID NO: 160835 - DNA, 25 bp, E. coli
gaggatcaggtcaaaatcatcggca

SEQ ID NO: 160836 - DNA, 25 bp, E. coli
gaggatcaggtctaaatcatcggca

SEQ ID NO: 160837 - DNA, 25 bp, E. coli
caaacagagtttggcgtcagccggg

SEQ ID NO: 160838 - DNA, 25 bp, E. coli
caaacagagtttcgcgtcagccggg

SEQ ID NO: 160839 - DNA, 25 bp, E. coli
taaacctggcgatgcgttacccact

SEQ ID NO: 160840 - DNA, 25 bp, E. coli
taaatttaccctgatagcgcagcga

SEQ ID NO: 160841 - DNA, 25 bp, E. coli
taaatttaccctcatagcgcagcga

SEQ ID NO: 160842 - DNA, 25 bp, E. coli
taaacctggcgaagcgttacccact

SEQ ID NO: 160843 - DNA, 25 bp, E. coli
ttgcgcgtggcgagcttaaacctgg

SEQ ID NO: 160844 - DNA, 25 bp, E. coli
tattcgaagtgattccggctgacga

SEQ ID NO: 160845 - DNA, 25 bp, E. coli
ttgcgcgtggcgtgcttaaacctgg

SEQ ID NO: 160846 - DNA, 25 bp, E. coli
tatcgcaagcaatagccaatggcgc

SEQ ID NO: 160847 - DNA, 25 bp, E. coli
tattcgaagtgaatccggctgacga

SEQ ID NO: 160848 - DNA, 25 bp, E. coli
tttgatgaaaaactgtcggaccgtc

SEQ ID NO: 160849 - DNA, 25 bp, E. coli
tatcgcaagcaaaagccaatggcgc

SEQ ID NO: 160850 - DNA, 25 bp, E. coli
tttgatgaaaaagtgtcggaccgtc

SEQ ID NO: 160851 - DNA, 25 bp, E. coli
tgccaaccgaagagatgagccgtct

SEQ ID NO: 160852 - DNA, 25 bp, E. coli
tgccaaccgaagtgatgagccgtct

SEQ ID NO: 160853 - DNA, 25 bp, E. coli
tcagggcagcgggacttacgtcaaa

SEQ ID NO: 160854 - DNA, 25 bp, E. coli
tcagggcagcggcacttacgtcaaa

SEQ ID NO: 160855 - DNA, 25 bp, E. coli
cctggcaggtcatggaaaattcgaa

SEQ ID NO: 160856 - DNA, 25 bp, E. coli
cctggcaggtcaaggaaaattcgaa

SEQ ID NO: 160857 - DNA, 25 bp, E. coli
gaagaaacctggttgccgcttgcgt

SEQ ID NO: 160858 - DNA, 25 bp, E. coli
gaagaaacctggatgccgcttgcgt

SEQ ID NO: 160859 - DNA, 25 bp, E. coli
taaagatcatgaagcctgtaaggct

SEQ ID NO: 160860 - DNA, 25 bp, E. coli
taaagatcatgatgcctgtaaggct

SEQ ID NO: 160861 - DNA, 25 bp, E. coli
aacagcggagagatttctgcatgca

SEQ ID NO: 160862 - DNA, 25 bp, E. coli
aacagcggagagttttctgcatgca

SEQ ID NO: 160863 - DNA, 25 bp, E. coli
tagagagttcgagcttaccagaagt

SEQ ID NO: 160864 - DNA, 25 bp, E. coli
tagagagttcgaccttaccagaagt

SEQ ID NO: 160865 - DNA, 25 bp, E. coli
tatttggcaaaatgtacatgcggag

SEQ ID NO: 160866 - DNA, 25 bp, E. coli
tatttggcaaaaagtacatgcggag

SEQ ID NO: 160867 - DNA, 25 bp, E. coli
gcagaagctagcaatactgaagcgt

SEQ ID NO: 160868 - DNA, 25 bp, E. coli
gcagaagctagctatactgaagcgt

SEQ ID NO: 160869 - DNA, 25 bp, E. coli
gacttcgtgcttgagaattaatccg

SEQ ID NO: 160870 - DNA, 25 bp, E. coli
gacttcgtgcttcagaattaatccg

SEQ ID NO: 160871 - DNA, 25 bp, E. coli
cgtggttagagctacaatcggcatc

SEQ ID NO: 160872 - DNA, 25 bp, E. coli
cgtggttagagcaacaatcggcatc

SEQ ID NO: 160873 - DNA, 25 bp, E. coli
ggttcaaacaatggcgttgctgggc

SEQ ID NO: 160874 - DNA, 25 bp, E. coli
ggttcaaacaatcgcgttgctgggc

SEQ ID NO: 160875 - DNA, 25 bp, E. coli
tggacttcgacaaaaacttctgcgg

SEQ ID NO: 160876 - DNA, 25 bp, E. coli
ggcatcaagccagatagagagttcg

SEQ ID NO: 160877 - DNA, 25 bp, E. coli
tggacttcgacataaacttctgcgg

SEQ ID NO: 160878 - DNA, 25 bp, E. coli
ggcatcaagccacatagagagttcg

SEQ ID NO: 160879 - DNA, 25 bp, E. coli
gatgatgacgatcgccctttgctta

SEQ ID NO: 160880 - DNA, 25 bp, E. coli
gatgatgacgatggccctttgctta

SEQ ID NO: 160881 - DNA, 25 bp, E. coli
cagcaggcgcggacggtgttttcac

SEQ ID NO: 160882 - DNA, 25 bp, E. coli
caggcgcggacggtgttttcacgca

SEQ ID NO: 160883 - DNA, 25 bp, E. coli
cagcaggcgcggtcggtgttttcac

SEQ ID NO: 160884 - DNA, 25 bp, E. coli
caggcgcggacgctgttttcacgca

SEQ ID NO: 160885 - DNA, 25 bp, E. coli
acggtgttttcacgcattcaaatct

SEQ ID NO: 160886 - DNA, 25 bp, E. coli
aggcgcggacggtgttttcacgcat

SEQ ID NO: 160887 - DNA, 25 bp, E. coli
aggcgcggacggagttttcacgcat

SEQ ID NO: 160888 - DNA, 25 bp, E. coli
acggtgttttcaggcattcaaatct

SEQ ID NO: 160889 - DNA, 25 bp, E. coli
aaatctgactggtaccagcatcccc

SEQ ID NO: 160890 - DNA, 25 bp, E. coli
aaatctgactggaaccagcatcccc

SEQ ID NO: 160891 - DNA, 25 bp, E. coli
tgactggtaccaccatcccccatgc

SEQ ID NO: 160892 - DNA, 25 bp, E. coli
tgactggtaccagcatcccccatgc

SEQ ID NO: 160893 - DNA, 25 bp, E. coli
gcgcggacggtgatttcacgcattc

SEQ ID NO: 160894 - DNA, 25 bp, E. coli
gcgcggacggtgttttcacgcattc

SEQ ID NO: 160895 - DNA, 25 bp, E. coli
cgcggacggtgttttcacgcattca

SEQ ID NO: 160896 - DNA, 25 bp, E. coli
cgcggacggtgtattcacgcattca

SEQ ID NO: 160897 - DNA, 25 bp, E. coli
gtgttttcacgcattcaaatctgac

SEQ ID NO: 160898 - DNA, 25 bp, E. coli
gtgttttcacgctttcaaatctgac

SEQ ID NO: 160899 - DNA, 25 bp, E. coli
ggtgttttcacgcattcaaatctga

SEQ ID NO: 160900 - DNA, 25 bp, E. coli
ggtgttttcacggattcaaatctga

SEQ ID NO: 160901 - DNA, 25 bp, E. coli
ggcgcggacggtcttttcacgcatt

SEQ ID NO: 160902 - DNA, 25 bp, E. coli
ggcgcggacggtgttttcacgcatt

SEQ ID NO: 160903 - DNA, 25 bp, E. coli
aaagagacgaccatgcaagttgcga

SEQ ID NO: 160904 - DNA, 25 bp, E. coli
aaagagacgaccttgcaagttgcga

SEQ ID NO: 160905 - DNA, 25 bp, E. coli
ttgtatcaccagaaggcactgcgcc

SEQ ID NO: 160906 - DNA, 25 bp, E. coli
ttgtatcaccagtaggcactgcgcc

SEQ ID NO: 160907 - DNA, 25 bp, E. coli
tgagtaaccctatgattctggcggg

SEQ ID NO: 160908 - DNA, 25 bp, E. coli
tgagtaaccctaagattctggcggg

SEQ ID NO: 160909 - DNA, 25 bp, E. coli
tgaagctggttgaccgccctaatca

SEQ ID NO: 160910 - DNA, 25 bp, E. coli
tgaagctggttgtccgccctaatca

SEQ ID NO: 160911 - DNA, 25 bp, E. coli
gctgtcgcacaacaaggaactttgg

SEQ ID NO: 160912 - DNA, 25 bp, E. coli
gctgtcgcacaagaaggaactttgg

SEQ ID NO: 160913 - DNA, 25 bp, E. coli
gaatggccggtccttgtatcaccag

SEQ ID NO: 160914 - DNA, 25 bp, E. coli
gaacgtaacgctaagccgggtgctg

SEQ ID NO: 160915 - DNA, 25 bp, E. coli
gaacgtaacgcttagccgggtgctg

SEQ ID NO: 160916 - DNA, 25 bp, E. coli
gaatggccggtcgttgtatcaccag

SEQ ID NO: 160917 - DNA, 25 bp, E. coli
gaaccgattggaatactgacccgcg

SEQ ID NO: 160918 - DNA, 25 bp, E. coli
gaaccgattggattactgacccgcg

SEQ ID NO: 160919 - DNA, 25 bp, E. coli
cggttataggtcagtttcatcagca

SEQ ID NO: 160920 - DNA, 25 bp, E. coli
cggttataggtctgtttcatcagca

SEQ ID NO: 160921 - DNA, 25 bp, E. coli
ggcgcgcggctgtaacccttaattt

SEQ ID NO: 160922 - DNA, 25 bp, E. coli
ggcgcgcggctgaaacccttaattt

SEQ ID NO: 160923 - DNA, 25 bp, E. coli
gatgcgacgttcacttctggttgcc

SEQ ID NO: 160924 - DNA, 25 bp, E. coli
gatgcgacgttctcttctggttgcc

SEQ ID NO: 160925 - DNA, 25 bp, E. coli
cacgaagtcgatgcttctgtcttta

SEQ ID NO: 160926 - DNA, 25 bp, E. coli
cacgaagtcgatccttctgtcttta

SEQ ID NO: 160927 - DNA, 25 bp, E. coli
cacggaaagtgataacggttgcaat

SEQ ID NO: 160928 - DNA, 25 bp, E. coli
cacggaaagtgaaaacggttgcaat

SEQ ID NO: 160929 - DNA, 25 bp, E. coli
tgctggcaaaccgtacacgaagtcg

SEQ ID NO: 160930 - DNA, 25 bp, E. coli
tgctggcaaaccctacacgaagtcg

SEQ ID NO: 160931 - DNA, 25 bp, E. coli
tgcaatcaggtggttaatccatgag

SEQ ID NO: 160932 - DNA, 25 bp, E. coli
tgcaatcaggtgcttaatccatgag

SEQ ID NO: 160933 - DNA, 25 bp, E. coli
tcggatcgatataagcacacaaagg

SEQ ID NO: 160934 - DNA, 25 bp, E. coli
tctgttgtcggaatggctggttatc

SEQ ID NO: 160935 - DNA, 25 bp, E. coli
tctgttgtcggattggctggttatc

SEQ ID NO: 160936 - DNA, 25 bp, E. coli
tctgtctttaggtgaagcacggaaa

SEQ ID NO: 160937 - DNA, 25 bp, E. coli
tctgtctttaggagaagcacggaaa

SEQ ID NO: 160938 - DNA, 25 bp, E. coli
tcggatcgatattagcacacaaagg

SEQ ID NO: 160939 - DNA, 25 bp, E. coli
ccctgtcgggttatgcctttaggct

SEQ ID NO: 160940 - DNA, 25 bp, E. coli
ccctgtcgggttttgcctttaggct

SEQ ID NO: 160941 - DNA, 25 bp, E. coli
cgtgctgaacgaaaccgggattctg

SEQ ID NO: 160942 - DNA, 25 bp, E. coli
cgtgctgaacgataccgggattctg

SEQ ID NO: 160943 - DNA, 25 bp, E. coli
gatttttcgtcttatccctgtcggg

SEQ ID NO: 160944 - DNA, 25 bp, E. coli
gatttttcgtctaatccctgtcggg

SEQ ID NO: 160945 - DNA, 25 bp, E. coli
taatccatgagcgagcgtgctgaac

SEQ ID NO: 160946 - DNA, 25 bp, E. coli
taatccatgagccagcgtgctgaac

SEQ ID NO: 160947 - DNA, 25 bp, E. coli
caaaaggtggagtcagaacaggatg

SEQ ID NO: 160948 - DNA, 25 bp, E. coli
caaaaggtggagacagaacaggatg

SEQ ID NO: 160949 - DNA, 25 bp, E. coli
catggagttaccgtgaagggcctca

SEQ ID NO: 160950 - DNA, 25 bp, E. coli
catggagttaccctgaagggcctca

SEQ ID NO: 160951 - DNA, 25 bp, E. coli
cagaacaggatgaaagtcggaggat

SEQ ID NO: 160952 - DNA, 25 bp, E. coli
cagaacaggatgtaagtcggaggat

SEQ ID NO: 160953 - DNA, 25 bp, E. coli
taaaaagtcagtacaagtatggagg

SEQ ID NO: 160954 - DNA, 25 bp, E. coli
taaaaagtcagttcaagtatggagg

SEQ ID NO: 160955 - DNA, 25 bp, E. coli
agcgaatactaacggctgccaccga

SEQ ID NO: 160956 - DNA, 25 bp, E. coli
agcgaatactaagggctgccaccga

SEQ ID NO: 160957 - DNA, 25 bp, E. coli
tatggaggattctgtggttaccacc

SEQ ID NO: 160958 - DNA, 25 bp, E. coli
tatggaggattcagtggttaccacc

SEQ ID NO: 160959 - DNA, 25 bp, E. coli
tgtagagcagaaaacaaaaggtgga

SEQ ID NO: 160960 - DNA, 25 bp, E. coli
tgtagagcagaatacaaaaggtgga

SEQ ID NO: 160961 - DNA, 25 bp, E. coli
gaagggcctcaaagtccgtaattcc

SEQ ID NO: 160962 - DNA, 25 bp, E. coli
gaagggcctcaatgtccgtaattcc

SEQ ID NO: 160963 - DNA, 25 bp, E. coli
tggttaccaccaggagcttgcaatg

SEQ ID NO: 160964 - DNA, 25 bp, E. coli
ggctgccaccgataaatttcaaaaa

SEQ ID NO: 160965 - DNA, 25 bp, E. coli
ggctgccaccgaaaaatttcaaaaa

SEQ ID NO: 160966 - DNA, 25 bp, E. coli
tggttaccaccacgagcttgcaatg

SEQ ID NO: 160967 - DNA, 25 bp, E. coli
taatattcaactaaacagtggcatc

SEQ ID NO: 160968 - DNA, 25 bp, E. coli
taatattcaacttaacagtggcatc

SEQ ID NO: 160969 - DNA, 25 bp, E. coli
caggccgattgcctgatccttgcag

SEQ ID NO: 160970 - DNA, 25 bp, E. coli
caggccgattgcgtgatccttgcag

SEQ ID NO: 160971 - DNA, 25 bp, E. coli
tacggctatcgttgttcaggacccc

SEQ ID NO: 160972 - DNA, 25 bp, E. coli
tacggctatcgtagttcaggacccc

SEQ ID NO: 160973 - DNA, 25 bp, E. coli
tatcaggccgattgcgtgatccttg

SEQ ID NO: 160974 - DNA, 25 bp, E. coli
tatcaggccgatagcgtgatccttg

SEQ ID NO: 160975 - DNA, 25 bp, E. coli
tgcgtgatccttccaggcaatgcgg

SEQ ID NO: 160976 - DNA, 25 bp, E. coli
tgcgtgatccttgcaggcaatgcgg

SEQ ID NO: 160977 - DNA, 25 bp, E. coli
tcatacggctatcgttgttcaggac

SEQ ID NO: 160978 - DNA, 25 bp, E. coli
tcatacggctatggttgttcaggac

SEQ ID NO: 160979 - DNA, 25 bp, E. coli
gccgattgcgtgttccttgcaggca

SEQ ID NO: 160980 - DNA, 25 bp, E. coli
gccgattgcgtgatccttgcaggca

SEQ ID NO: 160981 - DNA, 25 bp, E. coli
ccgtatcaggccgattgcgtgatcc

SEQ ID NO: 160982 - DNA, 25 bp, E. coli
ccgtatcaggcccattgcgtgatcc

SEQ ID NO: 160983 - DNA, 25 bp, E. coli
cgtgatccttgcaggcaatgcggtt

SEQ ID NO: 160984 - DNA, 25 bp, E. coli
cgtgatccttgctggcaatgcggtt

SEQ ID NO: 160985 - DNA, 25 bp, E. coli
gattgcgtgatcgttgcaggcaatg

SEQ ID NO: 160986 - DNA, 25 bp, E. coli
gattgcgtgatccttgcaggcaatg

SEQ ID NO: 160987 - DNA, 25 bp, E. coli
gtgatccttgcaggcaatgcggtta

SEQ ID NO: 160988 - DNA, 25 bp, E. coli
gtgatccttgcacgcaatgcggtta

SEQ ID NO: 160989 - DNA, 25 bp, E. coli
gagttcatacggctatcgttgttca

SEQ ID NO: 160990 - DNA, 25 bp, E. coli
gagttcatacgggtatcgttgttca

SEQ ID NO: 160991 - DNA, 25 bp, E. coli
aatggaggagttatcagaggcgaca

SEQ ID NO: 160992 - DNA, 25 bp, E. coli
aatggaggagttttcagaggcgaca

SEQ ID NO: 160993 - DNA, 25 bp, E. coli
tacaaagccgtgtatctgctcggtt

SEQ ID NO: 160994 - DNA, 25 bp, E. coli
tacaaagccgtgaatctgctcggtt

SEQ ID NO: 160995 - DNA, 25 bp, E. coli
tagaagtctttagaggttccaccca

SEQ ID NO: 160996 - DNA, 25 bp, E. coli
tagaagtctttacaggttccaccca

SEQ ID NO: 160997 - DNA, 25 bp, E. coli
acctgaatggttttccccgctgacg

SEQ ID NO: 160998 - DNA, 25 bp, E. coli
acctgaatggttatccccgctgacg

SEQ ID NO: 160999 - DNA, 25 bp, E. coli
aaatgctggtgagcgttaatgccgc

SEQ ID NO: 161000 - DNA, 25 bp, E. coli
aaatgctggtgaccgttaatgccgc

SEQ ID NO: 161001 - DNA, 25 bp, E. coli
tattcatcaacaccgtatagaggcg

SEQ ID NO: 161002 - DNA, 25 bp, E. coli
tattcatcaacagcgtatagaggcg

SEQ ID NO: 161003 - DNA, 25 bp, E. coli
tgcccggcctgaacatacctgaatg

SEQ ID NO: 161004 - DNA, 25 bp, E. coli
tgcccggcctgatcatacctgaatg

SEQ ID NO: 161005 - DNA, 25 bp, E. coli
tcagtagtctcgtcaggctccggtt

SEQ ID NO: 161006 - DNA, 25 bp, E. coli
tcagtagtctcgacaggctccggtt

SEQ ID NO: 161007 - DNA, 25 bp, E. coli
ccccgctgatgctgggaacataata

SEQ ID NO: 161008 - DNA, 25 bp, E. coli
ccccgctgatgcagggaacataata

SEQ ID NO: 161009 - DNA, 25 bp, E. coli
ggttatatggtgctttatccccgct

SEQ ID NO: 161010 - DNA, 25 bp, E. coli
ggttatatggtggtttatccccgct

SEQ ID NO: 161011 - DNA, 25 bp, E. coli
gggaacactggctctgcaacagcag

SEQ ID NO: 161012 - DNA, 25 bp, E. coli
gggaacactggcactgcaacagcag

SEQ ID NO: 161013 - DNA, 25 bp, E. coli
caatagggctgtgtgcgaaaaatgc

SEQ ID NO: 161014 - DNA, 25 bp, E. coli
aagtctatattcagggcgaacccgg

SEQ ID NO: 161015 - DNA, 25 bp, E. coli
caatagggctgtctgcgaaaaatgc

SEQ ID NO: 161016 - DNA, 25 bp, E. coli
aagtctatattctgggcgaacccgg

SEQ ID NO: 161017 - DNA, 25 bp, E. coli
cactggctgtctggactggagcaag

SEQ ID NO: 161018 - DNA, 25 bp, E. coli
cactggctgtctcgactggagcaag

SEQ ID NO: 161019 - DNA, 25 bp, E. coli
catcggataagagtgaagctgagca

SEQ ID NO: 161020 - DNA, 25 bp, E. coli
catcggataagactgaagctgagca

SEQ ID NO: 161021 - DNA, 25 bp, E. coli
taaactgagcatgagcgacgtcgac

SEQ ID NO: 161022 - DNA, 25 bp, E. coli
taaactgagcatcagcgacgtcgac

SEQ ID NO: 161023 - DNA, 25 bp, E. coli
ttaaacatggttggtcctaacggca

SEQ ID NO: 161024 - DNA, 25 bp, E. coli
ttaaacatggttcgtcctaacggca

SEQ ID NO: 161025 - DNA, 25 bp, E. coli
gacaacataatgacagcagcctggg

SEQ ID NO: 161026 - DNA, 25 bp, E. coli
gacaacataatgtcagcagcctggg

SEQ ID NO: 161027 - DNA, 25 bp, E. coli
gtatctctgctgtcgaaatcctggg

SEQ ID NO: 161028 - DNA, 25 bp, E. coli
gtatctctgctgacgaaatcctggg

SEQ ID NO: 161029 - DNA, 25 bp, E. coli
ggctcacgtataacaccgcaggatt

SEQ ID NO: 161030 - DNA, 25 bp, E. coli
ggctcacgtatatcaccgcaggatt

SEQ ID NO: 161031 - DNA, 25 bp, E. coli
taacggcatgaacgatgagcctcag

SEQ ID NO: 161032 - DNA, 25 bp, E. coli
taacggcatgaaggatgagcctcag

SEQ ID NO: 161033 - DNA, 25 bp, E. coli
taattgccgggttcttcagccgcag

SEQ ID NO: 161034 - DNA, 25 bp, E. coli
taattgccgggtacttcagccgcag

SEQ ID NO: 161035 - DNA, 25 bp, E. coli
acctgtttcttatggtgtggaggaa

SEQ ID NO: 161036 - DNA, 25 bp, E. coli
acctgtttcttaaggtgtggaggaa

SEQ ID NO: 161037 - DNA, 25 bp, E. coli
tagccgcgccacctgtttcttatgg

SEQ ID NO: 161038 - DNA, 25 bp, E. coli
tagccgcgccacgtgtttcttatgg

SEQ ID NO: 161039 - DNA, 25 bp, E. coli
tatcaccactgtgctgcaaatggtg

SEQ ID NO: 161040 - DNA, 25 bp, E. coli
tatcaccactgtcctgcaaatggtg

SEQ ID NO: 161041 - DNA, 25 bp, E. coli
ttgaataaagtgctgcaaccggcgt

SEQ ID NO: 161042 - DNA, 25 bp, E. coli
ttgaataaagtggtgcaaccggcgt

SEQ ID NO: 161043 - DNA, 25 bp, E. coli
tggtcaaggatgctaaaacctggct

SEQ ID NO: 161044 - DNA, 25 bp, E. coli
tggtcaaggatggtaaaacctggct

SEQ ID NO: 161045 - DNA, 25 bp, E. coli
tccggtacgcgcaaagcagggaatg

SEQ ID NO: 161046 - DNA, 25 bp, E. coli
tccggtacgcgctaagcagggaatg

SEQ ID NO: 161047 - DNA, 25 bp, E. coli
tcttccggcggtattcatatcgtac

SEQ ID NO: 161048 - DNA, 25 bp, E. coli
tcttccggcggttttcatatcgtac

SEQ ID NO: 161049 - DNA, 25 bp, E. coli
gcagtgaagtgctgccgaaccacga

SEQ ID NO: 161050 - DNA, 25 bp, E. coli
gcagtgaagtgcagccgaaccacga

SEQ ID NO: 161051 - DNA, 25 bp, E. coli
gaagtacggctttggcagtgccgac

SEQ ID NO: 161052 - DNA, 25 bp, E. coli
gaagtacggcttaggcagtgccgac

SEQ ID NO: 161053 - DNA, 25 bp, E. coli
ccgaaccacgaaaatagcaaagcta

SEQ ID NO: 161054 - DNA, 25 bp, E. coli
ccgaaccacgaatatagcaaagcta

SEQ ID NO: 161055 - DNA, 25 bp, E. coli
ggcggtagccggtttatcaccactg

SEQ ID NO: 161056 - DNA, 25 bp, E. coli
ggcggtagccggattatcaccactg

SEQ ID NO: 161057 - DNA, 25 bp, E. coli
catgactggttacggtgatgctgat

SEQ ID NO: 161058 - DNA, 25 bp, E. coli
catgactggttagggtgatgctgat

SEQ ID NO: 161059 - DNA, 25 bp, E. coli
agatcgcttcgatgcaactgctggc

SEQ ID NO: 161060 - DNA, 25 bp, E. coli
agatcgcttcgaagcaactgctggc

SEQ ID NO: 161061 - DNA, 25 bp, E. coli
tagtgataacttggacagccagggt

SEQ ID NO: 161062 - DNA, 25 bp, E. coli
tagtgataacttcgacagccagggt

SEQ ID NO: 161063 - DNA, 25 bp, E. coli
tagcagctatgtttgctgaaccccg

SEQ ID NO: 161064 - DNA, 25 bp, E. coli
tagcagctatgtatgctgaaccccg

SEQ ID NO: 161065 - DNA, 25 bp, E. coli
tgggcgctgctttctctaactctga

SEQ ID NO: 161066 - DNA, 25 bp, E. coli
tgctgaaccccgaaacatgactggt

SEQ ID NO: 161067 - DNA, 25 bp, E. coli
tgctgaaccccgtaacatgactggt

SEQ ID NO: 161068 - DNA, 25 bp, E. coli
gaaacagcagaaccatggaccgttg

SEQ ID NO: 161069 - DNA, 25 bp, E. coli
gacaatcaggttcacaaaggtactc

SEQ ID NO: 161070 - DNA, 25 bp, E. coli
gaaacagcagaagcatggaccgttg

SEQ ID NO: 161071 - DNA, 25 bp, E. coli
gacaatcaggttgacaaaggtactc

SEQ ID NO: 161072 - DNA, 25 bp, E. coli
ctttggtttaagactgggcgctgct

SEQ ID NO: 161073 - DNA, 25 bp, E. coli
ctttggtttaagtctgggcgctgct

SEQ ID NO: 161074 - DNA, 25 bp, E. coli
tgggcgctgcttactctaactctga

SEQ ID NO: 161075 - DNA, 25 bp, E. coli
taacactcgttaaggagatcgcttc

SEQ ID NO: 161076 - DNA, 25 bp, E. coli
taacactcgttatggagatcgcttc

SEQ ID NO: 161077 - DNA, 25 bp, E. coli
gaccgttggtgcaaaatacgacgct

SEQ ID NO: 161078 - DNA, 25 bp, E. coli
gaccgttggtgctaaatacgacgct

SEQ ID NO: 161079 - DNA, 25 bp, E. coli
caaacactggaacaatacgacatcg

SEQ ID NO: 161080 - DNA, 25 bp, E. coli
caaacactggaagaatacgacatcg

SEQ ID NO: 161081 - DNA, 25 bp, E. coli
tacgacatcgtcgtgacccaggatg

SEQ ID NO: 161082 - DNA, 25 bp, E. coli
tacgaacaggatgatgaaagcgcac

SEQ ID NO: 161083 - DNA, 25 bp, E. coli
tacgacatcgtcctgacccaggatg

SEQ ID NO: 161084 - DNA, 25 bp, E. coli
atcctcggtggctaagttgtcgcgg

SEQ ID NO: 161085 - DNA, 25 bp, E. coli
atcctcggtggcaaagttgtcgcgg

SEQ ID NO: 161086 - DNA, 25 bp, E. coli
tacgaacaggatcatgaaagcgcac

SEQ ID NO: 161087 - DNA, 25 bp, E. coli
tgatcaccgatggacgcttctccgg

SEQ ID NO: 161088 - DNA, 25 bp, E. coli
tgatcaccgatgcacgcttctccgg

SEQ ID NO: 161089 - DNA, 25 bp, E. coli
tcccgcaaagtaccgcagctgtgta

SEQ ID NO: 161090 - DNA, 25 bp, E. coli
tcccgcaaagtagcgcagctgtgta

SEQ ID NO: 161091 - DNA, 25 bp, E. coli
gctatcgatattgcgaaccgaggca

SEQ ID NO: 161092 - DNA, 25 bp, E. coli
gctatcgatattccgaaccgaggca

SEQ ID NO: 161093 - DNA, 25 bp, E. coli
gctgatcgcaagcaactgttcctca

SEQ ID NO: 161094 - DNA, 25 bp, E. coli
gctgatcgcaaggaactgttcctca

SEQ ID NO: 161095 - DNA, 25 bp, E. coli
cgatgtggtggtcatccgctatgaa

SEQ ID NO: 161096 - DNA, 25 bp, E. coli
cgatgtggtggtgatccgctatgaa

SEQ ID NO: 161097 - DNA, 25 bp, E. coli
ggccctgcgggcattcgtactacac

SEQ ID NO: 161098 - DNA, 25 bp, E. coli
ggccctgcgggctttcgtactacac

SEQ ID NO: 161099 - DNA, 25 bp, E. coli
gagcgctcaggtagaacgatccgcc

SEQ ID NO: 161100 - DNA, 25 bp, E. coli
gagcgctcaggttgaacgatccgcc

SEQ ID NO: 161101 - DNA, 25 bp, E. coli
taaagcggtgatggtagcaactctc

SEQ ID NO: 161102 - DNA, 25 bp, E. coli
taaagcggtgatcgtagcaactctc

SEQ ID NO: 161103 - DNA, 25 bp, E. coli
aactcgctgatgcttggtgctgcaa

SEQ ID NO: 161104 - DNA, 25 bp, E. coli
aactcgctgatggttggtgctgcaa

SEQ ID NO: 161105 - DNA, 25 bp, E. coli
ttaaatttatgcactgcctgcccgc

SEQ ID NO: 161106 - DNA, 25 bp, E. coli
ttaaatttatgctctgcctgcccgc

SEQ ID NO: 161107 - DNA, 25 bp, E. coli
cctttgatcaagctgcgcaggtgac

SEQ ID NO: 161108 - DNA, 25 bp, E. coli
cctttgatcaaggtgcgcaggtgac

SEQ ID NO: 161109 - DNA, 25 bp, E. coli
gaatcaatgaaacataccgctcgcg

SEQ ID NO: 161110 - DNA, 25 bp, E. coli
gaagaggtttttcaatcggcccact

SEQ ID NO: 161111 - DNA, 25 bp, E. coli
gaagaggtttttgaatcggcccact

SEQ ID NO: 161112 - DNA, 25 bp, E. coli
gaatcaatgaaagataccgctcgcg

SEQ ID NO: 161113 - DNA, 25 bp, E. coli
ggatatccgtctcgtggcacctaaa

SEQ ID NO: 161114 - DNA, 25 bp, E. coli
ggatatccgtctggtggcacctaaa

SEQ ID NO: 161115 - DNA, 25 bp, E. coli
tggaacatgcgcgaggcaaaacgct

SEQ ID NO: 161116 - DNA, 25 bp, E. coli
tggcctacggcctcaaaggactgga

SEQ ID NO: 161117 - DNA, 25 bp, E. coli
tggaacatgcgccaggcaaaacgct

SEQ ID NO: 161118 - DNA, 25 bp, E. coli
tggcctacggccacaaaggactgga

SEQ ID NO: 161119 - DNA, 25 bp, E. coli
taatgagcacacgacagtaggacgc

SEQ ID NO: 161120 - DNA, 25 bp, E. coli
taatgagcacaccacagtaggacgc

SEQ ID NO: 161121 - DNA, 25 bp, E. coli
taacacaatgccgtgagatcgccag

SEQ ID NO: 161122 - DNA, 25 bp, E. coli
taacacaatgccctgagatcgccag

SEQ ID NO: 161123 - DNA, 25 bp, E. coli
aaaaaatcgcgcatattatcggcag

SEQ ID NO: 161124 - DNA, 25 bp, E. coli
aaaaaatcgcgcttattatcggcag

SEQ ID NO: 161125 - DNA, 25 bp, E. coli
tgaaaaggtggtatccagcggcctg

SEQ ID NO: 161126 - DNA, 25 bp, E. coli
tgcgctctgaaagtgctacccatgc

SEQ ID NO: 161127 - DNA, 25 bp, E. coli
tgcgctctgaaactgctacccatgc

SEQ ID NO: 161128 - DNA, 25 bp, E. coli
tgaaaaggtggtttccagcggcctg

SEQ ID NO: 161129 - DNA, 25 bp, E. coli
tcgcctggctggtgaaagatgcctc

SEQ ID NO: 161130 - DNA, 25 bp, E. coli
tcgcctggctggagaaagatgcctc

SEQ ID NO: 161131 - DNA, 25 bp, E. coli
tctggaagtcgacaacgccgacgag

SEQ ID NO: 161132 - DNA, 25 bp, E. coli
tctggaagtcgagaacgccgacgag

SEQ ID NO: 161133 - DNA, 25 bp, E. coli
tctgcgcgcgggtatgaatatcgcc

SEQ ID NO: 161134 - DNA, 25 bp, E. coli
tctgcgcgcgggaatgaatatcgcc

SEQ ID NO: 161135 - DNA, 25 bp, E. coli
ccattgatggcgagatcaccgcgtt

SEQ ID NO: 161136 - DNA, 25 bp, E. coli
ccattgatggcgtgatcaccgcgtt

SEQ ID NO: 161137 - DNA, 25 bp, E. coli
gacaaggtgtatgcgcttaccgtgg

SEQ ID NO: 161138 - DNA, 25 bp, E. coli
gacaaggtgtatccgcttaccgtgg

SEQ ID NO: 161139 - DNA, 25 bp, E. coli
ccgaaatatgccgatgaagagagtt

SEQ ID NO: 161140 - DNA, 25 bp, E. coli
ccgaaatatgcccatgaagagagtt

SEQ ID NO: 161141 - DNA, 25 bp, E. coli
gtatttactgctgcgcgaaaccggc

SEQ ID NO: 161142 - DNA, 25 bp, E. coli
gtatttactgctccgcgaaaccggc

SEQ ID NO: 161143 - DNA, 25 bp, E. coli
gagtttcccggcgaatgtcagttac

SEQ ID NO: 161144 - DNA, 25 bp, E. coli
gagtttcccggccaatgtcagttac

SEQ ID NO: 161145 - DNA, 25 bp, E. coli
caccagtacgattttcaagggaaaa

SEQ ID NO: 161146 - DNA, 25 bp, E. coli
caccagtacgatattcaagggaaaa

SEQ ID NO: 161147 - DNA, 25 bp, E. coli
taaaagccagcttgcagattcatcg

SEQ ID NO: 161148 - DNA, 25 bp, E. coli
taaagacactaaaggatgcaaaagg

SEQ ID NO: 161149 - DNA, 25 bp, E. coli
taaagacactaatggatgcaaaagg

SEQ ID NO: 161150 - DNA, 25 bp, E. coli
taaaagccagctagcagattcatcg

SEQ ID NO: 161151 - DNA, 25 bp, E. coli
aactaacactcattacagacctctg

SEQ ID NO: 161152 - DNA, 25 bp, E. coli
aactaacactcaatacagacctctg

SEQ ID NO: 161153 - DNA, 25 bp, E. coli
tatagcgaatatacctaaagacact

SEQ ID NO: 161154 - DNA, 25 bp, E. coli
tatagcgaatattcctaaagacact

SEQ ID NO: 161155 - DNA, 25 bp, E. coli
ttcgaaagcatttgcaaattagcca

SEQ ID NO: 161156 - DNA, 25 bp, E. coli
ttcgaaagcattagcaaattagcca

SEQ ID NO: 161157 - DNA, 25 bp, E. coli
tgacgactcatctctttcgtggctg

SEQ ID NO: 161158 - DNA, 25 bp, E. coli
tgacgactcatcactttcgtggctg

SEQ ID NO: 161159 - DNA, 25 bp, E. coli
gcacaacccttattttatagcgaat

SEQ ID NO: 161160 - DNA, 25 bp, E. coli
gcacaacccttaatttatagcgaat

SEQ ID NO: 161161 - DNA, 25 bp, E. coli
cattgacagccacatcatgatgacc

SEQ ID NO: 161162 - DNA, 25 bp, E. coli
cattgacagccagatcatgatgacc

SEQ ID NO: 161163 - DNA, 25 bp, E. coli
gattcatcgttccatcaccagtacg

SEQ ID NO: 161164 - DNA, 25 bp, E. coli
gattcatcgttcgatcaccagtacg

SEQ ID NO: 161165 - DNA, 25 bp, E. coli
gatgaccgtggcagttagtttttga

SEQ ID NO: 161166 - DNA, 25 bp, E. coli
gatgaccgtggctgttagtttttga

SEQ ID NO: 161167 - DNA, 25 bp, E. coli
aagcagatttcagggcatttctcag

SEQ ID NO: 161168 - DNA, 25 bp, E. coli
aagcagatttcacggcatttctcag

SEQ ID NO: 161169 - DNA, 25 bp, E. coli
cacgttgcgtttgagtgataaagca

SEQ ID NO: 161170 - DNA, 25 bp, E. coli
cacgttgcgtttcagtgataaagca

SEQ ID NO: 161171 - DNA, 25 bp, E. coli
catttctcaggatacttaactggga

SEQ ID NO: 161172 - DNA, 25 bp, E. coli
cagatgtttctgatgacggagaacc

SEQ ID NO: 161173 - DNA, 25 bp, E. coli
catttctcaggaaacttaactggga

SEQ ID NO: 161174 - DNA, 25 bp, E. coli
cagatgtttctgttgacggagaacc

SEQ ID NO: 161175 - DNA, 25 bp, E. coli
tacacgcgaaacgaagggtactttg

SEQ ID NO: 161176 - DNA, 25 bp, E. coli
tacacgcgaaaccaagggtactttg

SEQ ID NO: 161177 - DNA, 25 bp, E. coli
ttaactgggaagaggacgaagagct

SEQ ID NO: 161178 - DNA, 25 bp, E. coli
ttaactgggaagtggacgaagagct

SEQ ID NO: 161179 - DNA, 25 bp, E. coli
tgttccgtgagtcggtggttacacc

SEQ ID NO: 161180 - DNA, 25 bp, E. coli
tgttccgtgagtgggtggttacacc

SEQ ID NO: 161181 - DNA, 25 bp, E. coli
gacgaagagctgcagaatgccgttc

SEQ ID NO: 161182 - DNA, 25 bp, E. coli
gacgaagagctggagaatgccgttc

SEQ ID NO: 161183 - DNA, 25 bp, E. coli
gatttgaggattccgtgttccgtga

SEQ ID NO: 161184 - DNA, 25 bp, E. coli
gatttgaggattgcgtgttccgtga

SEQ ID NO: 161185 - DNA, 25 bp, E. coli
gattggttttaccttcagggagaca

SEQ ID NO: 161186 - DNA, 25 bp, E. coli
gacggagaaccagaatacacgcgaa

SEQ ID NO: 161187 - DNA, 25 bp, E. coli
gacggagaaccacaatacacgcgaa

SEQ ID NO: 161188 - DNA, 25 bp, E. coli
gattggttttacgttcagggagaca

SEQ ID NO: 161189 - DNA, 25 bp, E. coli
taccgatatgtcgaaaggcgcgccg

SEQ ID NO: 161190 - DNA, 25 bp, E. coli
tacccgacaggataaagaggctgcc

SEQ ID NO: 161191 - DNA, 25 bp, E. coli
taccgatatgtccaaaggcgcgccg

SEQ ID NO: 161192 - DNA, 25 bp, E. coli
tacccgacaggaaaaagaggctgcc

SEQ ID NO: 161193 - DNA, 25 bp, E. coli
tatctggcgaaccacaaagcgctgc

SEQ ID NO: 161194 - DNA, 25 bp, E. coli
tatctggcgaacgacaaagcgctgc

SEQ ID NO: 161195 - DNA, 25 bp, E. coli
ttatgactggtacgccatcgtcggc

SEQ ID NO: 161196 - DNA, 25 bp, E. coli
ttatgactggtaggccatcgtcggc

SEQ ID NO: 161197 - DNA, 25 bp, E. coli
tgaaaggattgtcgttacgccgcaa

SEQ ID NO: 161198 - DNA, 25 bp, E. coli
tgaaaggattgtggttacgccgcaa

SEQ ID NO: 161199 - DNA, 25 bp, E. coli
tgcctcgtcgatagccgataaaccg

SEQ ID NO: 161200 - DNA, 25 bp, E. coli
tgcctcgtcgattgccgataaaccg

SEQ ID NO: 161201 - DNA, 25 bp, E. coli
tccatcaatgaactttgcggcagcg

SEQ ID NO: 161202 - DNA, 25 bp, E. coli
tcacttactacgttatcgggccggt

SEQ ID NO: 161203 - DNA, 25 bp, E. coli
tcacttactacgatatcgggccggt

SEQ ID NO: 161204 - DNA, 25 bp, E. coli
tccatcaatgaagtttgcggcagcg

SEQ ID NO: 161205 - DNA, 25 bp, E. coli
gaagccctggaacagaaagcccgtt

SEQ ID NO: 161206 - DNA, 25 bp, E. coli
gaagccctggaagagaaagcccgtt

SEQ ID NO: 161207 - DNA, 25 bp, E. coli
gataaaccggctttcgctccggcgt

SEQ ID NO: 161208 - DNA, 25 bp, E. coli
gataaaccggctatcgctccggcgt

SEQ ID NO: 161209 - DNA, 25 bp, E. coli
gagtcatccttaggtattgtcgcga

SEQ ID NO: 161210 - DNA, 25 bp, E. coli
gagtcatccttacgtattgtcgcga

SEQ ID NO: 161211 - DNA, 25 bp, E. coli
taaaagactggagtggaataccgcg

SEQ ID NO: 161212 - DNA, 25 bp, E. coli
taaaagactggactggaataccgcg

SEQ ID NO: 161213 - DNA, 25 bp, E. coli
agtactacgcgcatcttggtcgccg

SEQ ID NO: 161214 - DNA, 25 bp, E. coli
agtactacgcgcttcttggtcgccg

SEQ ID NO: 161215 - DNA, 25 bp, E. coli
tatcgtgacgatgtcgctgaagccg

SEQ ID NO: 161216 - DNA, 25 bp, E. coli
ttatctgaacaatgtcccctgggca

SEQ ID NO: 161217 - DNA, 25 bp, E. coli
ttatctgaacaaagtcccctgggca

SEQ ID NO: 161218 - DNA, 25 bp, E. coli
tatcgtgacgatctcgctgaagccg

SEQ ID NO: 161219 - DNA, 25 bp, E. coli
tgaaagcacattgattccactggcg

SEQ ID NO: 161220 - DNA, 25 bp, E. coli
tgaaagcacattcattccactggcg

SEQ ID NO: 161221 - DNA, 25 bp, E. coli
cctgggcaccggaagacatcggaaa

SEQ ID NO: 161222 - DNA, 25 bp, E. coli
cctgggcaccggtagacatcggaaa

SEQ ID NO: 161223 - DNA, 25 bp, E. coli
gaaacgatttatggcccaaccggcg

SEQ ID NO: 161224 - DNA, 25 bp, E. coli
gaaagatctgcaacctcgtgagagc

SEQ ID NO: 161225 - DNA, 25 bp, E. coli
gaaagatctgcatcctcgtgagagc

SEQ ID NO: 161226 - DNA, 25 bp, E. coli
gaaacgatttatcgcccaaccggcg

SEQ ID NO: 161227 - DNA, 25 bp, E. coli
ctcgtgagagcataacgctggccct

SEQ ID NO: 161228 - DNA, 25 bp, E. coli
ctcgtgagagcaaaacgctggccct

SEQ ID NO: 161229 - DNA, 25 bp, E. coli
ggaagatgcccatcgctgtatcaag

SEQ ID NO: 161230 - DNA, 25 bp, E. coli
ggaagatgcccaacgctgtatcaag

SEQ ID NO: 161231 - DNA, 25 bp, E. coli
tcaagattgtcttccatcgtggcga

SEQ ID NO: 161232 - DNA, 25 bp, E. coli
tcaagattgtctaccatcgtggcga

SEQ ID NO: 161233 - DNA, 25 bp, E. coli
caccgagatctaatgcgctgttatc

SEQ ID NO: 161234 - DNA, 25 bp, E. coli
caccgagatctattgcgctgttatc

SEQ ID NO: 161235 - DNA, 25 bp, E. coli
actggcgtaatgctcgcctgtctgc

SEQ ID NO: 161236 - DNA, 25 bp, E. coli
actggcgtaatggtcgcctgtctgc

SEQ ID NO: 161237 - DNA, 25 bp, E. coli
tcctcagcgttaattgaaaacattc

SEQ ID NO: 161238 - DNA, 25 bp, E. coli
tcctcagcgttatttgaaaacattc

SEQ ID NO: 161239 - DNA, 25 bp, E. coli
tcatcccagcatagctggcaggcgt

SEQ ID NO: 161240 - DNA, 25 bp, E. coli
tcatcacggactctattttgcggtt

SEQ ID NO: 161241 - DNA, 25 bp, E. coli
tcatcacggactgtattttgcggtt

SEQ ID NO: 161242 - DNA, 25 bp, E. coli
tcatcccagcattgctggcaggcgt

SEQ ID NO: 161243 - DNA, 25 bp, E. coli
gaaccgctgattcttttggtaataa

SEQ ID NO: 161244 - DNA, 25 bp, E. coli
gaaccgctgattgttttggtaataa

SEQ ID NO: 161245 - DNA, 25 bp, E. coli
gcaatgttaactcgcgtaatggtcg

SEQ ID NO: 161246 - DNA, 25 bp, E. coli
gcaatgttaactggcgtaatggtcg

SEQ ID NO: 161247 - DNA, 25 bp, E. coli
cgctgttatcgttcatattaaggac

SEQ ID NO: 161248 - DNA, 25 bp, E. coli
cgctgttatcgtacatattaaggac

SEQ ID NO: 161249 - DNA, 25 bp, E. coli
ggtaataatacacgtacttccattg

SEQ ID NO: 161250 - DNA, 25 bp, E. coli
gggagctattcctgcaatgttaact

SEQ ID NO: 161251 - DNA, 25 bp, E. coli
gggagctattccagcaatgttaact

SEQ ID NO: 161252 - DNA, 25 bp, E. coli
ggtaataatacaggtacttccattg

SEQ ID NO: 161253 - DNA, 25 bp, E. coli
taaggacatggcatcctcagcgtta

SEQ ID NO: 161254 - DNA, 25 bp, E. coli
taaggacatggcttcctcagcgtta

SEQ ID NO: 161255 - DNA, 25 bp, E. coli
cacgggcgctctttgggcaaactaa

SEQ ID NO: 161256 - DNA, 25 bp, E. coli
cagcgttgccagctatcagacacaa

SEQ ID NO: 161257 - DNA, 25 bp, E. coli
cacgggcgctctatgggcaaactaa

SEQ ID NO: 161258 - DNA, 25 bp, E. coli
cagcgttgccaggtatcagacacaa

SEQ ID NO: 161259 - DNA, 25 bp, E. coli
aaaatgcgctgatcttactggcagg

SEQ ID NO: 161260 - DNA, 25 bp, E. coli
aaaatgcgctgaacttactggcagg

SEQ ID NO: 161261 - DNA, 25 bp, E. coli
tgataagtctggttcctgcgggagt

SEQ ID NO: 161262 - DNA, 25 bp, E. coli
tgatattgactcagcacgggcgctc

SEQ ID NO: 161263 - DNA, 25 bp, E. coli
tgataagtctggatcctgcgggagt

SEQ ID NO: 161264 - DNA, 25 bp, E. coli
tgatattgactctgcacgggcgctc

SEQ ID NO: 161265 - DNA, 25 bp, E. coli
tgctgaaatcagcaccgcctggctg

SEQ ID NO: 161266 - DNA, 25 bp, E. coli
tgctgaaatcaggaccgcctggctg

SEQ ID NO: 161267 - DNA, 25 bp, E. coli
tgccagtgaattaacagcccagaac

SEQ ID NO: 161268 - DNA, 25 bp, E. coli
tgccagtgaatttacagcccagaac

SEQ ID NO: 161269 - DNA, 25 bp, E. coli
cctggccctggctaaagaaacgatg

SEQ ID NO: 161270 - DNA, 25 bp, E. coli
cctggccctggcaaaagaaacgatg

SEQ ID NO: 161271 - DNA, 25 bp, E. coli
ctaccgggaacagtggaaagcctgc

SEQ ID NO: 161272 - DNA, 25 bp, E. coli
ctaccgggaacactggaaagcctgc

SEQ ID NO: 161273 - DNA, 25 bp, E. coli
ggtgatccacgaaccccgattgcag

SEQ ID NO: 161274 - DNA, 25 bp, E. coli
ggtgatccacgatccccgattgcag

SEQ ID NO: 161275 - DNA, 25 bp, E. coli
taatcagagtttttctcgggcggcg

SEQ ID NO: 161276 - DNA, 25 bp, E. coli
taatcagagtttatctcgggcggcg

SEQ ID NO: 161277 - DNA, 25 bp, E. coli
aagtccttgaggctgaacgttccgg

SEQ ID NO: 161278 - DNA, 25 bp, E. coli
aagtccttgagggtgaacgttccgg

SEQ ID NO: 161279 - DNA, 25 bp, E. coli
caaggcagacaaaacggatatccgg

SEQ ID NO: 161280 - DNA, 25 bp, E. coli
caaggcagacaatacggatatccgg

SEQ ID NO: 161281 - DNA, 25 bp, E. coli
cagacgggcgataacaatgtggcac

SEQ ID NO: 161282 - DNA, 25 bp, E. coli
cagacgggcgattacaatgtggcac

SEQ ID NO: 161283 - DNA, 25 bp, E. coli
tattgacagtcaggcacaggacgtc

SEQ ID NO: 161284 - DNA, 25 bp, E. coli
tattgacagtcacgcacaggacgtc

SEQ ID NO: 161285 - DNA, 25 bp, E. coli
tgaacgtttcgctgaagtggcccgt

SEQ ID NO: 161286 - DNA, 25 bp, E. coli
tgaagaccgctgaacaggagcaggc

SEQ ID NO: 161287 - DNA, 25 bp, E. coli
tgaccccgcatggaaagacaaaacg

SEQ ID NO: 161288 - DNA, 25 bp, E. coli
tgaccccgcatgcaaagacaaaacg

SEQ ID NO: 161289 - DNA, 25 bp, E. coli
tgacgaatgctgaaatagacgcgct

SEQ ID NO: 161290 - DNA, 25 bp, E. coli
tgaagaccgctgtacaggagcaggc

SEQ ID NO: 161291 - DNA, 25 bp, E. coli
tgaacgtttcgcagaagtggcccgt

SEQ ID NO: 161292 - DNA, 25 bp, E. coli
tgacgaatgctgtaatagacgcgct

SEQ ID NO: 161293 - DNA, 25 bp, E. coli
gaagccgcacttgttcgtgggcaga

SEQ ID NO: 161294 - DNA, 25 bp, E. coli
gaagccgcacttcttcgtgggcaga

SEQ ID NO: 161295 - DNA, 25 bp, E. coli
gataccacggaataacatgcggatg

SEQ ID NO: 161296 - DNA, 25 bp, E. coli
gataccacggaaaaacatgcggatg

SEQ ID NO: 161297 - DNA, 25 bp, E. coli
gatgaatgccgtgccggtgctgaaa

SEQ ID NO: 161298 - DNA, 25 bp, E. coli
gatgaatgccgtcccggtgctgaaa

SEQ ID NO: 161299 - DNA, 25 bp, E. coli
aaaaaatgggtcaggctctgggccg

SEQ ID NO: 161300 - DNA, 25 bp, E. coli
aaaaaatgggtctggctctgggccg

SEQ ID NO: 161301 - DNA, 25 bp, E. coli
tgttatcgacatgtacccgctggag

SEQ ID NO: 161302 - DNA, 25 bp, E. coli
tgttatcgacatctacccgctggag

SEQ ID NO: 161303 - DNA, 25 bp, E. coli
tcctgaagtatgatgaagcgccgag

SEQ ID NO: 161304 - DNA, 25 bp, E. coli
tcctgaagtatgttgaagcgccgag

SEQ ID NO: 161305 - DNA, 25 bp, E. coli
tcggtgaagttcttgacggcgctgc

SEQ ID NO: 161306 - DNA, 25 bp, E. coli
tcggtgaagttcatgacggcgctgc

SEQ ID NO: 161307 - DNA, 25 bp, E. coli
gaatacgaagatatcccggcagaca

SEQ ID NO: 161308 - DNA, 25 bp, E. coli
gaagacccgtctttccgtgtatgga

SEQ ID NO: 161309 - DNA, 25 bp, E. coli
gaagacccgtctatccgtgtatgga

SEQ ID NO: 161310 - DNA, 25 bp, E. coli
gaatacgaagatttcccggcagaca

SEQ ID NO: 161311 - DNA, 25 bp, E. coli
gaaatcaaaggtcctctgcgtcagc

SEQ ID NO: 161312 - DNA, 25 bp, E. coli
gaaatcaaaggtgctctgcgtcagc

SEQ ID NO: 161313 - DNA, 25 bp, E. coli
ggtgataccgtactgaactccgtga

SEQ ID NO: 161314 - DNA, 25 bp, E. coli
gtaatccctggccaatacatcccgg

SEQ ID NO: 161315 - DNA, 25 bp, E. coli
ggtgataccgtagtgaactccgtga

SEQ ID NO: 161316 - DNA, 25 bp, E. coli
gtaatccctggcgaatacatcccgg

SEQ ID NO: 161317 - DNA, 25 bp, E. coli
taagatccacgctgaagtaccgctg

SEQ ID NO: 161318 - DNA, 25 bp, E. coli
taacatcggtatgagtgcgcacatc

SEQ ID NO: 161319 - DNA, 25 bp, E. coli
taacatcggtatcagtgcgcacatc

SEQ ID NO: 161320 - DNA, 25 bp, E. coli
taagatccacgcagaagtaccgctg

SEQ ID NO: 161321 - DNA, 25 bp, E. coli
tacgactttgtcaggcatccggcgt

SEQ ID NO: 161322 - DNA, 25 bp, E. coli
tacaaccaaggtcaacatgagtctg

SEQ ID NO: 161323 - DNA, 25 bp, E. coli
tacaaccaaggtgaacatgagtctg

SEQ ID NO: 161324 - DNA, 25 bp, E. coli
tacgactttgtctggcatccggcgt

SEQ ID NO: 161325 - DNA, 25 bp, E. coli
gccgggtacttgagccaacaggtat

SEQ ID NO: 161326 - DNA, 25 bp, E. coli
atgcccttctctccggcgacagatg

SEQ ID NO: 161327 - DNA, 25 bp, E. coli
atgcccttctctgcggcgacagatg

SEQ ID NO: 161328 - DNA, 25 bp, E. coli
gccgggtacttgtgccaacaggtat

SEQ ID NO: 161329 - DNA, 25 bp, E. coli
ttcaacaccgcgctctattgctgct

SEQ ID NO: 161330 - DNA, 25 bp, E. coli
ttttatttgatatcgcgactgttcg

SEQ ID NO: 161331 - DNA, 25 bp, E. coli
ttttatttgataacgcgactgttcg

SEQ ID NO: 161332 - DNA, 25 bp, E. coli
ttcaacaccgcggtctattgctgct

SEQ ID NO: 161333 - DNA, 25 bp, E. coli
tgcttttatcacaggcgattttctg

SEQ ID NO: 161334 - DNA, 25 bp, E. coli
tgcttttatcactggcgattttctg

SEQ ID NO: 161335 - DNA, 25 bp, E. coli
tgctgaaaataataacgcctgctct

SEQ ID NO: 161336 - DNA, 25 bp, E. coli
tgctgaaaataaaaacgcctgctct

SEQ ID NO: 161337 - DNA, 25 bp, E. coli
cgttatcgtggtctttgggctgtcc

SEQ ID NO: 161338 - DNA, 25 bp, E. coli
cgttatcgtggtgtttgggctgtcc

SEQ ID NO: 161339 - DNA, 25 bp, E. coli
tggcatccggcgttgttcaacaccg

SEQ ID NO: 161340 - DNA, 25 bp, E. coli
ggctgtccttcccaccgatattttt

SEQ ID NO: 161341 - DNA, 25 bp, E. coli
ggctgtccttccgaccgatattttt

SEQ ID NO: 161342 - DNA, 25 bp, E. coli
tggcatccggcgatgttcaacaccg

SEQ ID NO: 161343 - DNA, 25 bp, E. coli
caattgcggtcgcaaaacgtctgga

SEQ ID NO: 161344 - DNA, 25 bp, E. coli
caattgcggtcggaaaacgtctgga

SEQ ID NO: 161345 - DNA, 25 bp, E. coli
caatgccggaaaactggaagctgga

SEQ ID NO: 161346 - DNA, 25 bp, E. coli
caatgccggaaatctggaagctgga

SEQ ID NO: 161347 - DNA, 25 bp, E. coli
cagttagtcaaattggctcaggcct

SEQ ID NO: 161348 - DNA, 25 bp, E. coli
cagttagtcaaaatggctcaggcct

SEQ ID NO: 161349 - DNA, 25 bp, E. coli
taaaaacaaagctgaccgatggcgc

SEQ ID NO: 161350 - DNA, 25 bp, E. coli
taaaaacaaagcagaccgatggcgc

SEQ ID NO: 161351 - DNA, 25 bp, E. coli
tatttaaagataaagatcgccccgg

SEQ ID NO: 161352 - DNA, 25 bp, E. coli
tatttaaagatatagatcgccccgg

SEQ ID NO: 161353 - DNA, 25 bp, E. coli
ttcacaggaagagtacgcagagggt

SEQ ID NO: 161354 - DNA, 25 bp, E. coli
ttcacaggaagactacgcagagggt

SEQ ID NO: 161355 - DNA, 25 bp, E. coli
tttaacgaccatgaagaagcgcagt

SEQ ID NO: 161356 - DNA, 25 bp, E. coli
tttaacgaccatcaagaagcgcagt

SEQ ID NO: 161357 - DNA, 25 bp, E. coli
ccggagtggcacgtgaatgacgaac

SEQ ID NO: 161358 - DNA, 25 bp, E. coli
ccggagtggcacctgaatgacgaac

SEQ ID NO: 161359 - DNA, 25 bp, E. coli
ggtaaccggcctttccatgactgga

SEQ ID NO: 161360 - DNA, 25 bp, E. coli
ggtaaccggcctatccatgactgga

SEQ ID NO: 161361 - DNA, 25 bp, E. coli
ctggcaaaagcaggcgactgggtca

SEQ ID NO: 161362 - DNA, 25 bp, E. coli
ctggcaaaagcacgcgactgggtca

SEQ ID NO: 161363 - DNA, 25 bp, E. coli
gatcgctatctgcaaaacccggttg

SEQ ID NO: 161364 - DNA, 25 bp, E. coli
gatcgctatctggaaaacccggttg

SEQ ID NO: 161365 - DNA, 25 bp, E. coli
tagtcgtaacgggaagaaatgctcc

SEQ ID NO: 161366 - DNA, 25 bp, E. coli
tagtcgtaacggcaagaaatgctcc

SEQ ID NO: 161367 - DNA, 25 bp, E. coli
tatcggttcatctaagggagtcgtc

SEQ ID NO: 161368 - DNA, 25 bp, E. coli
tatcggttcatcaaagggagtcgtc

SEQ ID NO: 161369 - DNA, 25 bp, E. coli
tgagaaaattgttgtcgtaacggca

SEQ ID NO: 161370 - DNA, 25 bp, E. coli
tgtgaagcagcaaaaatatcggttc

SEQ ID NO: 161371 - DNA, 25 bp, E. coli
tgtgaagcagcataaatatcggttc

SEQ ID NO: 161372 - DNA, 25 bp, E. coli
tgagaaaattgtagtcgtaacggca

SEQ ID NO: 161373 - DNA, 25 bp, E. coli
tcccatttataacaagagcgtaacg

SEQ ID NO: 161374 - DNA, 25 bp, E. coli
tcccatttataagaagagcgtaacg

SEQ ID NO: 161375 - DNA, 25 bp, E. coli
cgccgtcatggttatgaaattgtaa

SEQ ID NO: 161376 - DNA, 25 bp, E. coli
cgccgtcatggtaatgaaattgtaa

SEQ ID NO: 161377 - DNA, 25 bp, E. coli
cttagcgaagcattgtgaagcagca

SEQ ID NO: 161378 - DNA, 25 bp, E. coli
cttagcgaagcaatgtgaagcagca

SEQ ID NO: 161379 - DNA, 25 bp, E. coli
tggaaaatgaaagggcacaatacgt

SEQ ID NO: 161380 - DNA, 25 bp, E. coli
tggaaaatgaaacggcacaatacgt

SEQ ID NO: 161381 - DNA, 25 bp, E. coli
ggcaagaaatgctccacatttgaga

SEQ ID NO: 161382 - DNA, 25 bp, E. coli
ggcaagaaatgcaccacatttgaga

SEQ ID NO: 161383 - DNA, 25 bp, E. coli
taagaatgggaaaacgccgtcatgg

SEQ ID NO: 161384 - DNA, 25 bp, E. coli
taacgatgattaggcttagcgaagc

SEQ ID NO: 161385 - DNA, 25 bp, E. coli
taacgatgattacgcttagcgaagc

SEQ ID NO: 161386 - DNA, 25 bp, E. coli
taagaatgggaatacgccgtcatgg

SEQ ID NO: 161387 - DNA, 25 bp, E. coli
caagagctgtgctaaaaattcctga

SEQ ID NO: 161388 - DNA, 25 bp, E. coli
caagagctgtgcaaaaaattcctga

SEQ ID NO: 161389 - DNA, 25 bp, E. coli
tagcaaaagcaggaacctatttccg

SEQ ID NO: 161390 - DNA, 25 bp, E. coli
tagcaaaagcagcaacctatttccg

SEQ ID NO: 161391 - DNA, 25 bp, E. coli
tatttccgaaacgtcatatgccaga

SEQ ID NO: 161392 - DNA, 25 bp, E. coli
tatttccgaaacctcatatgccaga

SEQ ID NO: 161393 - DNA, 25 bp, E. coli
tatctgcgaaaacagcactttcacc

SEQ ID NO: 161394 - DNA, 25 bp, E. coli
tatctgcgaaaagagcactttcacc

SEQ ID NO: 161395 - DNA, 25 bp, E. coli
tgacgttaaccccatgctcatatag

SEQ ID NO: 161396 - DNA, 25 bp, E. coli
tgacgttaacccgatgctcatatag

SEQ ID NO: 161397 - DNA, 25 bp, E. coli
gagattctccatcctagttatacga

SEQ ID NO: 161398 - DNA, 25 bp, E. coli
gagattctccatgctagttatacga

SEQ ID NO: 161399 - DNA, 25 bp, E. coli
gaaaaatcattttgcccgttgccat

SEQ ID NO: 161400 - DNA, 25 bp, E. coli
gaaaaatcatttagcccgttgccat

SEQ ID NO: 161401 - DNA, 25 bp, E. coli
gaacttggttacagggagattctcc

SEQ ID NO: 161402 - DNA, 25 bp, E. coli
gaacttggttactgggagattctcc

SEQ ID NO: 161403 - DNA, 25 bp, E. coli
gttcaatatttcaagtctaccgtgg

SEQ ID NO: 161404 - DNA, 25 bp, E. coli
gttcaatatttctagtctaccgtgg

SEQ ID NO: 161405 - DNA, 25 bp, E. coli
gatggctatcatcccggtcaatatg

SEQ ID NO: 161406 - DNA, 25 bp, E. coli
gatggctatcatgccggtcaatatg

SEQ ID NO: 161407 - DNA, 25 bp, E. coli
gttgccatacaactacatcatgctg

SEQ ID NO: 161408 - DNA, 25 bp, E. coli
gttgccatacaagtacatcatgctg

SEQ ID NO: 161409 - DNA, 25 bp, E. coli
cacacagcagggaaatgtcggccat

SEQ ID NO: 161410 - DNA, 25 bp, E. coli
cacacagcagggtaatgtcggccat

SEQ ID NO: 161411 - DNA, 25 bp, E. coli
cattattacgaagaactggcctccg

SEQ ID NO: 161412 - DNA, 25 bp, E. coli
cattattacgaacaactggcctccg

SEQ ID NO: 161413 - DNA, 25 bp, E. coli
taaaagcccggttcatctggcggct

SEQ ID NO: 161414 - DNA, 25 bp, E. coli
tacgatgaggaattggccactcccg

SEQ ID NO: 161415 - DNA, 25 bp, E. coli
taaaagcccggtacatctggcggct

SEQ ID NO: 161416 - DNA, 25 bp, E. coli
tacgatgaggaaatggccactcccg

SEQ ID NO: 161417 - DNA, 25 bp, E. coli
tatgaccgggtggttcgtgaaaaac

SEQ ID NO: 161418 - DNA, 25 bp, E. coli
taccgtgagcaaatccgacgatgcg

SEQ ID NO: 161419 - DNA, 25 bp, E. coli
tatgaccgggtgcttcgtgaaaaac

SEQ ID NO: 161420 - DNA, 25 bp, E. coli
taccgtgagcaattccgacgatgcg

SEQ ID NO: 161421 - DNA, 25 bp, E. coli
tgtttaacgaggtctacgcccaggt

SEQ ID NO: 161422 - DNA, 25 bp, E. coli
tgtttaacgaggactacgcccaggt

SEQ ID NO: 161423 - DNA, 25 bp, E. coli
tcggtacaggatcgtcagcagagca

SEQ ID NO: 161424 - DNA, 25 bp, E. coli
tgccggaagagaaactacagacgct

SEQ ID NO: 161425 - DNA, 25 bp, E. coli
tgccggaagagatactacagacgct

SEQ ID NO: 161426 - DNA, 25 bp, E. coli
tcggtacaggatggtcagcagagca

SEQ ID NO: 161427 - DNA, 25 bp, E. coli
ggagatattccccattacgatgagg

SEQ ID NO: 161428 - DNA, 25 bp, E. coli
ggagatattcccgattacgatgagg

SEQ ID NO: 161429 - DNA, 25 bp, E. coli
gatgtttgccgatggtaaaagcccg

SEQ ID NO: 161430 - DNA, 25 bp, E. coli
gatgtttgccgaaggtaaaagcccg

SEQ ID NO: 161431 - DNA, 25 bp, E. coli
tatcgcacaaagacaccttcacggg

SEQ ID NO: 161432 - DNA, 25 bp, E. coli
tatcgcacaaagtcaccttcacggg

SEQ ID NO: 161433 - DNA, 25 bp, E. coli
tgacacagagcgaactggcaaactg

SEQ ID NO: 161434 - DNA, 25 bp, E. coli
tgacgactgcctggtaatgacacgc

SEQ ID NO: 161435 - DNA, 25 bp, E. coli
tgacgactgcctcgtaatgacacgc

SEQ ID NO: 161436 - DNA, 25 bp, E. coli
tgaccttcgatttcacggagtgctg

SEQ ID NO: 161437 - DNA, 25 bp, E. coli
tgacacagagcgtactggcaaactg

SEQ ID NO: 161438 - DNA, 25 bp, E. coli
tgaccttcgattacacggagtgctg

SEQ ID NO: 161439 - DNA, 25 bp, E. coli
tgcgaagcactggaacatgaaaggc

SEQ ID NO: 161440 - DNA, 25 bp, E. coli
tgcgaagcactgcaacatgaaaggc

SEQ ID NO: 161441 - DNA, 25 bp, E. coli
tacttccaaacgttgtacgacatgg

SEQ ID NO: 161442 - DNA, 25 bp, E. coli
tacttccaaacgatgtacgacatgg

SEQ ID NO: 161443 - DNA, 25 bp, E. coli
ccaacgcgatgacttttctgaggat

SEQ ID NO: 161444 - DNA, 25 bp, E. coli
ccaacgcgatgagttttctgaggat

SEQ ID NO: 161445 - DNA, 25 bp, E. coli
gcgttaagccggagcatccagaata

SEQ ID NO: 161446 - DNA, 25 bp, E. coli
gcgttaagccggtgcatccagaata

SEQ ID NO: 161447 - DNA, 25 bp, E. coli
gatagccatgccaacgatccgaagt

SEQ ID NO: 161448 - DNA, 25 bp, E. coli
gatagccatgcctacgatccgaagt

SEQ ID NO: 161449 - DNA, 25 bp, E. coli
ggaacggcaaatgaacgcaaacctg

SEQ ID NO: 161450 - DNA, 25 bp, E. coli
ggaacggcaaatcaacgcaaacctg

SEQ ID NO: 161451 - DNA, 25 bp, E. coli
gagcctgatccggactgaaaccaga

SEQ ID NO: 161452 - DNA, 25 bp, E. coli
gagcctgatccgcactgaaaccaga

SEQ ID NO: 161453 - DNA, 25 bp, E. coli
cacaaatagtctacggccagggagc

SEQ ID NO: 161454 - DNA, 25 bp, E. coli
cacaaatagtcttcggccagggagc

SEQ ID NO: 161455 - DNA, 25 bp, E. coli
catatttcagccaatgcgcggtccg

SEQ ID NO: 161456 - DNA, 25 bp, E. coli
catatttcagcctatgcgcggtccg

SEQ ID NO: 161457 - DNA, 25 bp, E. coli
taaatgcccgcgatgttgccgaacg

SEQ ID NO: 161458 - DNA, 25 bp, E. coli
taaatgcccgcgttgttgccgaacg

SEQ ID NO: 161459 - DNA, 25 bp, E. coli
taaacgtcttctcgtgagtctcggc

SEQ ID NO: 161460 - DNA, 25 bp, E. coli
taaacgtcttctggtgagtctcggc

SEQ ID NO: 161461 - DNA, 25 bp, E. coli
accatctggtggagtttgccggaca

SEQ ID NO: 161462 - DNA, 25 bp, E. coli
accatctggtggtgtttgccggaca

SEQ ID NO: 161463 - DNA, 25 bp, E. coli
tttcattcatcatggcggagcaggc

SEQ ID NO: 161464 - DNA, 25 bp, E. coli
tttcattcatcaaggcggagcaggc

SEQ ID NO: 161465 - DNA, 25 bp, E. coli
tgtcttcctcaacggcgcagatggt

SEQ ID NO: 161466 - DNA, 25 bp, E. coli
tgtcttcctcaagggcgcagatggt

SEQ ID NO: 161467 - DNA, 25 bp, E. coli
tgcagtacgtccgatataacggtgg

SEQ ID NO: 161468 - DNA, 25 bp, E. coli
tgcagtacgtcccatataacggtgg

SEQ ID NO: 161469 - DNA, 25 bp, E. coli
tcttcagcgaagaaatggcagacca

SEQ ID NO: 161470 - DNA, 25 bp, E. coli
tcttcagcgaagtaatggcagacca

SEQ ID NO: 161471 - DNA, 25 bp, E. coli
gatatggcctggatcgacgtaacac

SEQ ID NO: 161472 - DNA, 25 bp, E. coli
gatatggcctggttcgacgtaacac

SEQ ID NO: 161473 - DNA, 25 bp, E. coli
gagaaggcccgatcgtaaacgtctt

SEQ ID NO: 161474 - DNA, 25 bp, E. coli
gagaaggcccgaacgtaaacgtctt

SEQ ID NO: 161475 - DNA, 25 bp, E. coli
catgatcgccgagggtatgcaggtc

SEQ ID NO: 161476 - DNA, 25 bp, E. coli
catgatcgccgacggtatgcaggtc

SEQ ID NO: 161477 - DNA, 25 bp, E. coli
tacaagcaccgagtcgtcagcactg

SEQ ID NO: 161478 - DNA, 25 bp, E. coli
tacaagcaccgactcgtcagcactg

SEQ ID NO: 161479 - DNA, 25 bp, E. coli
atttagcgggtatcattctggcggc

SEQ ID NO: 161480 - DNA, 25 bp, E. coli
atttagcgggtaacattctggcggc

SEQ ID NO: 161481 - DNA, 25 bp, E. coli
acagtgattatcttgccgccgcaga

SEQ ID NO: 161482 - DNA, 25 bp, E. coli
acagtgattatcatgccgccgcaga

SEQ ID NO: 161483 - DNA, 25 bp, E. coli
tgatcaatggtggattgccgccgct

SEQ ID NO: 161484 - DNA, 25 bp, E. coli
tgatcaatggtgcattgccgccgct

SEQ ID NO: 161485 - DNA, 25 bp, E. coli
tgcttatgcgcgacaggcacggagt

SEQ ID NO: 161486 - DNA, 25 bp, E. coli
tgcttatgcgcgtcaggcacggagt

SEQ ID NO: 161487 - DNA, 25 bp, E. coli
gcactgacagttacgggcgagacct

SEQ ID NO: 161488 - DNA, 25 bp, E. coli
gcactgacagtttcgggcgagacct

SEQ ID NO: 161489 - DNA, 25 bp, E. coli
gacaatcattactctcccggtcggt

SEQ ID NO: 161490 - DNA, 25 bp, E. coli
gacaatcattacactcccggtcggt

SEQ ID NO: 161491 - DNA, 25 bp, E. coli
ggagtgagatccaacgtctgcgaca

SEQ ID NO: 161492 - DNA, 25 bp, E. coli
ggagtgagatcctacgtctgcgaca

SEQ ID NO: 161493 - DNA, 25 bp, E. coli
ggcacctcacgaacctaactggcag

SEQ ID NO: 161494 - DNA, 25 bp, E. coli
ggcacctcacgatcctaactggcag

SEQ ID NO: 161495 - DNA, 25 bp, E. coli
tcacgtttaatcaacggcagccgtc

SEQ ID NO: 161496 - DNA, 25 bp, E. coli
tcacgtttaatctacggcagccgtc

SEQ ID NO: 161497 - DNA, 25 bp, E. coli
catggcggcacaaatgacggcggca

SEQ ID NO: 161498 - DNA, 25 bp, E. coli
catcggtgagaagattggtaagcgc

SEQ ID NO: 161499 - DNA, 25 bp, E. coli
catcctgatggcgtgggtatttact

SEQ ID NO: 161500 - DNA, 25 bp, E. coli
catggcggcacatatgacggcggca

SEQ ID NO: 161501 - DNA, 25 bp, E. coli
catcctgatggcctgggtatttact

SEQ ID NO: 161502 - DNA, 25 bp, E. coli
catcggtgagaacattggtaagcgc

SEQ ID NO: 161503 - DNA, 25 bp, E. coli
taaaacggtaacgagcatcctgatg

SEQ ID NO: 161504 - DNA, 25 bp, E. coli
taaaacggtaaccagcatcctgatg

SEQ ID NO: 161505 - DNA, 25 bp, E. coli
acgtatgcgcaaggcatggcggcac

SEQ ID NO: 161506 - DNA, 25 bp, E. coli
acgtatgcgcaacgcatggcggcac

SEQ ID NO: 161507 - DNA, 25 bp, E. coli
ttgggatgcccgtctccacaacaca

SEQ ID NO: 161508 - DNA, 25 bp, E. coli
ttgggatgcccgactccacaacaca

SEQ ID NO: 161509 - DNA, 25 bp, E. coli
tgtactggatagcattgcagttgat

SEQ ID NO: 161510 - DNA, 25 bp, E. coli
tgtactggataggattgcagttgat

SEQ ID NO: 161511 - DNA, 25 bp, E. coli
tcgactgatggcacgcaagtaacag

SEQ ID NO: 161512 - DNA, 25 bp, E. coli
tcgactgatggctcgcaagtaacag

SEQ ID NO: 161513 - DNA, 25 bp, E. coli
gcacgcaagtaagagagtttcactg

SEQ ID NO: 161514 - DNA, 25 bp, E. coli
gcacgcaagtaacagagtttcactg

SEQ ID NO: 161515 - DNA, 25 bp, E. coli
cttgccagttattttgggatgcccg

SEQ ID NO: 161516 - DNA, 25 bp, E. coli
cttgccagttatattgggatgcccg

SEQ ID NO: 161517 - DNA, 25 bp, E. coli
taagcgcggcatgacgtatgcgcaa

SEQ ID NO: 161518 - DNA, 25 bp, E. coli
taagcgcggcatcacgtatgcgcaa

SEQ ID NO: 161519 - DNA, 25 bp, E. coli
gaaaagtaatccacctgaaagggcg

SEQ ID NO: 161520 - DNA, 25 bp, E. coli
gaaaagtaatcctcctgaaagggcg

SEQ ID NO: 161521 - DNA, 25 bp, E. coli
cacagtgtgataatcgtattgtcaa

SEQ ID NO: 161522 - DNA, 25 bp, E. coli
cacagtgtgatattcgtattgtcaa

SEQ ID NO: 161523 - DNA, 25 bp, E. coli
tagagacctgagtaaagtaatccac

SEQ ID NO: 161524 - DNA, 25 bp, E. coli
tagagacctgagaaaagtaatccac

SEQ ID NO: 161525 - DNA, 25 bp, E. coli
tattatttcaattactagagacctg

SEQ ID NO: 161526 - DNA, 25 bp, E. coli
tattatttcaataactagagacctg

SEQ ID NO: 161527 - DNA, 25 bp, E. coli
ttaaaaagcagatgcgtgattactc

SEQ ID NO: 161528 - DNA, 25 bp, E. coli
ttaaaaagcagaagcgtgattactc

SEQ ID NO: 161529 - DNA, 25 bp, E. coli
tgtctattacaaatgggaatacgat

SEQ ID NO: 161530 - DNA, 25 bp, E. coli
tgtctattacaattgggaatacgat

SEQ ID NO: 161531 - DNA, 25 bp, E. coli
tgattactctcagacaacacctctg

SEQ ID NO: 161532 - DNA, 25 bp, E. coli
tgattactctcacacaacacctctg

SEQ ID NO: 161533 - DNA, 25 bp, E. coli
tgaaagggcggcttacttttctctt

SEQ ID NO: 161534 - DNA, 25 bp, E. coli
tgaaagggcggcatacttttctctt

SEQ ID NO: 161535 - DNA, 25 bp, E. coli
gctaatgtgatcctaatcacagtgt

SEQ ID NO: 161536 - DNA, 25 bp, E. coli
gctaatgtgatcgtaatcacagtgt

SEQ ID NO: 161537 - DNA, 25 bp, E. coli
ggagataatttttagcataagggca

SEQ ID NO: 161538 - DNA, 25 bp, E. coli
ggagataattttaagcataagggca

SEQ ID NO: 161539 - DNA, 25 bp, E. coli
taagggcataacagctaatgtgatc

SEQ ID NO: 161540 - DNA, 25 bp, E. coli
taagggcataactgctaatgtgatc

SEQ ID NO: 161541 - DNA, 25 bp, E. coli
caagcgggctgtgacattgttggca

SEQ ID NO: 161542 - DNA, 25 bp, E. coli
caagcgggctgtcacattgttggca

SEQ ID NO: 161543 - DNA, 25 bp, E. coli
cagatgaacaacgtagcgcggaaat

SEQ ID NO: 161544 - DNA, 25 bp, E. coli
cagatgaacaacctagcgcggaaat

SEQ ID NO: 161545 - DNA, 25 bp, E. coli
tattcttcatgtgtcaggcagcggc

SEQ ID NO: 161546 - DNA, 25 bp, E. coli
ttctctcgaaggtaaagttgcggtc

SEQ ID NO: 161547 - DNA, 25 bp, E. coli
ttctctcgaaggaaaagttgcggtc

SEQ ID NO: 161548 - DNA, 25 bp, E. coli
tattcttcatgtctcaggcagcggc

SEQ ID NO: 161549 - DNA, 25 bp, E. coli
ttgcctccagcggttcagattatgt

SEQ ID NO: 161550 - DNA, 25 bp, E. coli
tttttaagcctgaccgccgatctgc

SEQ ID NO: 161551 - DNA, 25 bp, E. coli
tttttaagcctgtccgccgatctgc

SEQ ID NO: 161552 - DNA, 25 bp, E. coli
ttgcctccagcgcttcagattatgt

SEQ ID NO: 161553 - DNA, 25 bp, E. coli
tcttataccgcatcaaaaagcggcg

SEQ ID NO: 161554 - DNA, 25 bp, E. coli
tcttataccgcaacaaaaagcggcg

SEQ ID NO: 161555 - DNA, 25 bp, E. coli
gcgggatccgtgtgccttcttatac

SEQ ID NO: 161556 - DNA, 25 bp, E. coli
gcgggatccgtgagccttcttatac

SEQ ID NO: 161557 - DNA, 25 bp, E. coli
gactgggacgatctcatgaacctga

SEQ ID NO: 161558 - DNA, 25 bp, E. coli
gactgggacgatgtcatgaacctga

SEQ ID NO: 161559 - DNA, 25 bp, E. coli
gtcaatgctctccttccagggcggg

SEQ ID NO: 161560 - DNA, 25 bp, E. coli
gtcaatgctctcgttccagggcggg

SEQ ID NO: 161561 - DNA, 25 bp, E. coli
ggcattaacatcgttgaaccgactg

SEQ ID NO: 161562 - DNA, 25 bp, E. coli
ggcattaacatccttgaaccgactg

SEQ ID NO: 161563 - DNA, 25 bp, E. coli
taggctgcgccaaactgggaaacgg

SEQ ID NO: 161564 - DNA, 25 bp, E. coli
taggctgcgccatactgggaaacgg

SEQ ID NO: 161565 - DNA, 25 bp, E. coli
ttttcgccggacagaagtacgcatg

SEQ ID NO: 161566 - DNA, 25 bp, E. coli
ttttcgccggactgaagtacgcatg

SEQ ID NO: 161567 - DNA, 25 bp, E. coli
gaaaatgcagtcttccgagttccag

SEQ ID NO: 161568 - DNA, 25 bp, E. coli
gaaaaatgcgggtatcactgtgcct

SEQ ID NO: 161569 - DNA, 25 bp, E. coli
gaaaatgcagtcatccgagttccag

SEQ ID NO: 161570 - DNA, 25 bp, E. coli
gaaaaatgcgggaatcactgtgcct

SEQ ID NO: 161571 - DNA, 25 bp, E. coli
cattgacctgtttttgcgggaggac

SEQ ID NO: 161572 - DNA, 25 bp, E. coli
cattgacctgttattgcgggaggac

SEQ ID NO: 161573 - DNA, 25 bp, E. coli
gattttgattgatgaggccgttacc

SEQ ID NO: 161574 - DNA, 25 bp, E. coli
gatttaccggattcttggctgcaga

SEQ ID NO: 161575 - DNA, 25 bp, E. coli
gataaggcgcttgcatataccgttg

SEQ ID NO: 161576 - DNA, 25 bp, E. coli
gataaggcgcttccatataccgttg

SEQ ID NO: 161577 - DNA, 25 bp, E. coli
gattttgattgaagaggccgttacc

SEQ ID NO: 161578 - DNA, 25 bp, E. coli
gatttaccggatacttggctgcaga

SEQ ID NO: 161579 - DNA, 25 bp, E. coli
taaaatctgcgatggagattgccgc

SEQ ID NO: 161580 - DNA, 25 bp, E. coli
taagattcatcacgaagcacagccg

SEQ ID NO: 161581 - DNA, 25 bp, E. coli
taaaatctgcgaaggagattgccgc

SEQ ID NO: 161582 - DNA, 25 bp, E. coli
taagattcatcaggaagcacagccg

SEQ ID NO: 161583 - DNA, 25 bp, E. coli
gatggctccatagaaggcttgcttg

SEQ ID NO: 161584 - DNA, 25 bp, E. coli
gatggctccatacaaggcttgcttg

SEQ ID NO: 161585 - DNA, 25 bp, E. coli
caccagatgaggaagccatgcgtga

SEQ ID NO: 161586 - DNA, 25 bp, E. coli
caccagatgaggtagccatgcgtga

SEQ ID NO: 161587 - DNA, 25 bp, E. coli
acctcctctggtactgtcgattggg

SEQ ID NO: 161588 - DNA, 25 bp, E. coli
acctcctctggttctgtcgattggg

SEQ ID NO: 161589 - DNA, 25 bp, E. coli
aaatacatgtcgtacctcctctggt

SEQ ID NO: 161590 - DNA, 25 bp, E. coli
aaatacatgtcgaacctcctctggt

SEQ ID NO: 161591 - DNA, 25 bp, E. coli
tatatccggaggtaggttcggcacc

SEQ ID NO: 161592 - DNA, 25 bp, E. coli
tatatccggaggaaggttcggcacc

SEQ ID NO: 161593 - DNA, 25 bp, E. coli
tccggaggaaggatcggcaccagat

SEQ ID NO: 161594 - DNA, 25 bp, E. coli
tccggaggaaggttcggcaccagat

SEQ ID NO: 161595 - DNA, 25 bp, E. coli
tcaaaaaatacatgtcgaacctcct

SEQ ID NO: 161596 - DNA, 25 bp, E. coli
tcaaaaaatacaagtcgaacctcct

SEQ ID NO: 161597 - DNA, 25 bp, E. coli
gaaccacagattttatccggaggaa

SEQ ID NO: 161598 - DNA, 25 bp, E. coli
gaaccacagattatatccggaggaa

SEQ ID NO: 161599 - DNA, 25 bp, E. coli
gattgggaaccagagattatatccg

SEQ ID NO: 161600 - DNA, 25 bp, E. coli
gattgggaaccacagattatatccg

SEQ ID NO: 161601 - DNA, 25 bp, E. coli
ggttctgtcgattgggaaccacaga

SEQ ID NO: 161602 - DNA, 25 bp, E. coli
ggttcggcaccacatgaggtagcca

SEQ ID NO: 161603 - DNA, 25 bp, E. coli
ggttcggcaccagatgaggtagcca

SEQ ID NO: 161604 - DNA, 25 bp, E. coli
ggttctgtcgatagggaaccacaga

SEQ ID NO: 161605 - DNA, 25 bp, E. coli
gatgaggtagccttgcgtgattacg

SEQ ID NO: 161606 - DNA, 25 bp, E. coli
gatgaggtagccatgcgtgattacg

SEQ ID NO: 161607 - DNA, 25 bp, E. coli
aacgtcgccatgtacaattactgca

SEQ ID NO: 161608 - DNA, 25 bp, E. coli
tacttcctttatcaatatgcaggta

SEQ ID NO: 161609 - DNA, 25 bp, E. coli
tacttcctttatgaatatgcaggta

SEQ ID NO: 161610 - DNA, 25 bp, E. coli
acgtcgccatgaacaattactgcaa

SEQ ID NO: 161611 - DNA, 25 bp, E. coli
aacgtcgccatgaacaattactgca

SEQ ID NO: 161612 - DNA, 25 bp, E. coli
acgtcgccatgatcaattactgcaa

SEQ ID NO: 161613 - DNA, 25 bp, E. coli
ttatgaatatgctggtattccgggc

SEQ ID NO: 161614 - DNA, 25 bp, E. coli
ttatgaatatgcaggtattccgggc

SEQ ID NO: 161615 - DNA, 25 bp, E. coli
tgccctttcgggcatctcgattgct

SEQ ID NO: 161616 - DNA, 25 bp, E. coli
tgccctttcggggatctcgattgct

SEQ ID NO: 161617 - DNA, 25 bp, E. coli
tcggggatctcgattgcttatggat

SEQ ID NO: 161618 - DNA, 25 bp, E. coli
tcggggatctcgtttgcttatggat

SEQ ID NO: 161619 - DNA, 25 bp, E. coli
cctgggcctacttcctttatgaata

SEQ ID NO: 161620 - DNA, 25 bp, E. coli
cctttatgaatatgcaggtattccg

SEQ ID NO: 161621 - DNA, 25 bp, E. coli
cctttatgaataagcaggtattccg

SEQ ID NO: 161622 - DNA, 25 bp, E. coli
cctacttcctttttgaatatgcagg

SEQ ID NO: 161623 - DNA, 25 bp, E. coli
cctgggcctactacctttatgaata

SEQ ID NO: 161624 - DNA, 25 bp, E. coli
cctacttcctttatgaatatgcagg

SEQ ID NO: 161625 - DNA, 25 bp, E. coli
gaaaaacgtcgccatgaacaattac

SEQ ID NO: 161626 - DNA, 25 bp, E. coli
gaaaaacgtcgcgatgaacaattac

SEQ ID NO: 161627 - DNA, 25 bp, E. coli
gggcctacttccattatgaatatgc

SEQ ID NO: 161628 - DNA, 25 bp, E. coli
gggcctacttcctttatgaatatgc

SEQ ID NO: 161629 - DNA, 25 bp, E. coli
caggtgttcacaacagcatcagaca

SEQ ID NO: 161630 - DNA, 25 bp, E. coli
catttgggcaggtgttcacatcagc

SEQ ID NO: 161631 - DNA, 25 bp, E. coli
catttgggcaggagttcacatcagc

SEQ ID NO: 161632 - DNA, 25 bp, E. coli
caggtgttcacatcagcatcagaca

SEQ ID NO: 161633 - DNA, 25 bp, E. coli
atcagacatgattgttcacctgcca

SEQ ID NO: 161634 - DNA, 25 bp, E. coli
atcagacatgatagttcacctgcca

SEQ ID NO: 161635 - DNA, 25 bp, E. coli
ttgggcaggtgtacacatcagcatc

SEQ ID NO: 161636 - DNA, 25 bp, E. coli
ttgggcaggtgttcacatcagcatc

SEQ ID NO: 161637 - DNA, 25 bp, E. coli
tgttcacatcaggatcagacatgat

SEQ ID NO: 161638 - DNA, 25 bp, E. coli
tgttcacatcagcatcagacatgat

SEQ ID NO: 161639 - DNA, 25 bp, E. coli
tcacatcagcatcagacatgattgt

SEQ ID NO: 161640 - DNA, 25 bp, E. coli
tcacatcagcatgagacatgattgt

SEQ ID NO: 161641 - DNA, 25 bp, E. coli
gctcatttgggcaggtgttcacatc

SEQ ID NO: 161642 - DNA, 25 bp, E. coli
gctcatttgggctggtgttcacatc

SEQ ID NO: 161643 - DNA, 25 bp, E. coli
ggtgttcacatctgcatcagacatg

SEQ ID NO: 161644 - DNA, 25 bp, E. coli
ggtgttcacatcagcatcagacatg

SEQ ID NO: 161645 - DNA, 25 bp, E. coli
ggcaggtgttcacatcagcatcaga

SEQ ID NO: 161646 - DNA, 25 bp, E. coli
ggcaggtgttcagatcagcatcaga

SEQ ID NO: 161647 - DNA, 25 bp, E. coli
tcagcatcagacttgattgttcacc

SEQ ID NO: 161648 - DNA, 25 bp, E. coli
tcagcatcagacatgattgttcacc

SEQ ID NO: 161649 - DNA, 25 bp, E. coli
gatggctcatttgggcaggtgttca

SEQ ID NO: 161650 - DNA, 25 bp, E. coli
gatggctcatttcggcaggtgttca

SEQ ID NO: 161651 - DNA, 25 bp, E. coli
tacgattcaggtaacccgtgaccag

SEQ ID NO: 161652 - DNA, 25 bp, E. coli
tacgattcaggttacccgtgaccag

SEQ ID NO: 161653 - DNA, 25 bp, E. coli
tttgtcagcaaagtactcggcaggc

SEQ ID NO: 161654 - DNA, 25 bp, E. coli
ttgattgatgacgaggcaaccaccg

SEQ ID NO: 161655 - DNA, 25 bp, E. coli
ttgattgatgaccaggcaaccaccg

SEQ ID NO: 161656 - DNA, 25 bp, E. coli
tttgtcagcaaactactcggcaggc

SEQ ID NO: 161657 - DNA, 25 bp, E. coli
tgtatttgatgatgtgcgccaccag

SEQ ID NO: 161658 - DNA, 25 bp, E. coli
tgtatttgatgaagtgcgccaccag

SEQ ID NO: 161659 - DNA, 25 bp, E. coli
tgacatcgctgaaagacgtaacccg

SEQ ID NO: 161660 - DNA, 25 bp, E. coli
tgacatcgctgatagacgtaacccg

SEQ ID NO: 161661 - DNA, 25 bp, E. coli
gaattcgtctggcagccgttcctgc

SEQ ID NO: 161662 - DNA, 25 bp, E. coli
gaattcgtctgggagccgttcctgc

SEQ ID NO: 161663 - DNA, 25 bp, E. coli
gaaaagacgtcgagttaccaacgca

SEQ ID NO: 161664 - DNA, 25 bp, E. coli
gaaaagacgtcgtgttaccaacgca

SEQ ID NO: 161665 - DNA, 25 bp, E. coli
taacgctgaccgtctggagtggcaa

SEQ ID NO: 161666 - DNA, 25 bp, E. coli
taacgctgaccgactggagtggcaa

SEQ ID NO: 161667 - DNA, 25 bp, E. coli
tcacccggttgaaggcacgttgctt

SEQ ID NO: 161668 - DNA, 25 bp, E. coli
taacttcacgagcagaatgggacat

SEQ ID NO: 161669 - DNA, 25 bp, E. coli
taacttcacgaggagaatgggacat

SEQ ID NO: 161670 - DNA, 25 bp, E. coli
tcacccggttgatggcacgttgctt

SEQ ID NO: 161671 - DNA, 25 bp, E. coli
gagttcaaggaacaacacagccacg

SEQ ID NO: 161672 - DNA, 25 bp, E. coli
gagttcaaggaagaacacagccacg

SEQ ID NO: 161673 - DNA, 25 bp, E. coli
caaaagccgagccggttatttgccg

SEQ ID NO: 161674 - DNA, 25 bp, E. coli
caaaagccgagcgggttatttgccg

SEQ ID NO: 161675 - DNA, 25 bp, E. coli
cagcgttaaggcgataccaaaggtc

SEQ ID NO: 161676 - DNA, 25 bp, E. coli
cagcgttaaggccataccaaaggtc

SEQ ID NO: 161677 - DNA, 25 bp, E. coli
aggatgatcccaagacccacatacg

SEQ ID NO: 161678 - DNA, 25 bp, E. coli
aggatgatcccatgacccacatacg

SEQ ID NO: 161679 - DNA, 25 bp, E. coli
aaaatcaggatgatcccaagaccca

SEQ ID NO: 161680 - DNA, 25 bp, E. coli
acaggcgtgcaaagcgcgcagcgtt

SEQ ID NO: 161681 - DNA, 25 bp, E. coli
acaggcgtgcaatgcgcgcagcgtt

SEQ ID NO: 161682 - DNA, 25 bp, E. coli
aaaatcaggatgttcccaagaccca

SEQ ID NO: 161683 - DNA, 25 bp, E. coli
tatttgccgacacgcgtgcaatgcg

SEQ ID NO: 161684 - DNA, 25 bp, E. coli
tatttgccgacaggcgtgcaatgcg

SEQ ID NO: 161685 - DNA, 25 bp, E. coli
tgcaatgcgcgctgcgttagccgca

SEQ ID NO: 161686 - DNA, 25 bp, E. coli
tgcaatgcgcgcagcgttagccgca

SEQ ID NO: 161687 - DNA, 25 bp, E. coli
gcgcgcagcgttagccgcacactta

SEQ ID NO: 161688 - DNA, 25 bp, E. coli
gcgcgcagcgtttgccgcacactta

SEQ ID NO: 161689 - DNA, 25 bp, E. coli
gagctgacccaaaagccgagcgggt

SEQ ID NO: 161690 - DNA, 25 bp, E. coli
gagctgacccaatagccgagcgggt

SEQ ID NO: 161691 - DNA, 25 bp, E. coli
cgataatcaccagcgttaaggcgat

SEQ ID NO: 161692 - DNA, 25 bp, E. coli
cgataatcaccaccgttaaggcgat

SEQ ID NO: 161693 - DNA, 25 bp, E. coli
taaggcgatacctaaggtcgcgccc

SEQ ID NO: 161694 - DNA, 25 bp, E. coli
taaggcgataccaaaggtcgcgccc

SEQ ID NO: 161695 - DNA, 25 bp, E. coli
accgactggtgtggaagcgtcattc

SEQ ID NO: 161696 - DNA, 25 bp, E. coli
accgactggtgtcgaagcgtcattc

SEQ ID NO: 161697 - DNA, 25 bp, E. coli
tatggcagacgtcgtggcgatcacg

SEQ ID NO: 161698 - DNA, 25 bp, E. coli
tatgctcagttctggttccccgatc

SEQ ID NO: 161699 - DNA, 25 bp, E. coli
tatggcagacgtggtggcgatcacg

SEQ ID NO: 161700 - DNA, 25 bp, E. coli
tatgctcagttcaggttccccgatc

SEQ ID NO: 161701 - DNA, 25 bp, E. coli
tgttcgtggtcgagttgctgacact

SEQ ID NO: 161702 - DNA, 25 bp, E. coli
tgttcgtggtcgtgttgctgacact

SEQ ID NO: 161703 - DNA, 25 bp, E. coli
gcgttctttgtgatcgtggtcgtgt

SEQ ID NO: 161704 - DNA, 25 bp, E. coli
gcgttctttgtgttcgtggtcgtgt

SEQ ID NO: 161705 - DNA, 25 bp, E. coli
gactgggtcgccacgctggcggtga

SEQ ID NO: 161706 - DNA, 25 bp, E. coli
gactgggtcgcctcgctggcggtga

SEQ ID NO: 161707 - DNA, 25 bp, E. coli
cggtgatagtgctgctgctgacgct

SEQ ID NO: 161708 - DNA, 25 bp, E. coli
cggtgatagtgcagctgctgacgct

SEQ ID NO: 161709 - DNA, 25 bp, E. coli
gtcgtgttgctgacactggaagatg

SEQ ID NO: 161710 - DNA, 25 bp, E. coli
ggttccccgatcactccgactgggt

SEQ ID NO: 161711 - DNA, 25 bp, E. coli
gtcgtgttgctgtcactggaagatg

SEQ ID NO: 161712 - DNA, 25 bp, E. coli
ggttccccgatctctccgactgggt

SEQ ID NO: 161713 - DNA, 25 bp, E. coli
tggaagcgtcattcgcgcatttgtg

SEQ ID NO: 161714 - DNA, 25 bp, E. coli
ggcgatcacggcttatgctcagttc

SEQ ID NO: 161715 - DNA, 25 bp, E. coli
tggaagcgtcatacgcgcatttgtg

SEQ ID NO: 161716 - DNA, 25 bp, E. coli
ggcgatcacggcatatgctcagttc

SEQ ID NO: 161717 - DNA, 25 bp, E. coli
aacgcagcactagacacagattgga

SEQ ID NO: 161718 - DNA, 25 bp, E. coli
aacgcagcactacacacagattgga

SEQ ID NO: 161719 - DNA, 25 bp, E. coli
aaaattactgatagccggaagtgcc

SEQ ID NO: 161720 - DNA, 25 bp, E. coli
aaaattactgattgccggaagtgcc

SEQ ID NO: 161721 - DNA, 25 bp, E. coli
tagtgccagcaatggtagccagacg

SEQ ID NO: 161722 - DNA, 25 bp, E. coli
tagtgccagcaaaggtagccagacg

SEQ ID NO: 161723 - DNA, 25 bp, E. coli
tataacttgcgattccgctaccggc

SEQ ID NO: 161724 - DNA, 25 bp, E. coli
tataacttgcgaatccgctaccggc

SEQ ID NO: 161725 - DNA, 25 bp, E. coli
tgtactccaatagtaagcaacggcg

SEQ ID NO: 161726 - DNA, 25 bp, E. coli
tgtactccaatactaagcaacggcg

SEQ ID NO: 161727 - DNA, 25 bp, E. coli
gaagtgccttttatgccatgtcagc

SEQ ID NO: 161728 - DNA, 25 bp, E. coli
gaagtgccttttttgccatgtcagc

SEQ ID NO: 161729 - DNA, 25 bp, E. coli
gacaacgcgcttattcggcttaggg

SEQ ID NO: 161730 - DNA, 25 bp, E. coli
gacaacgcgctttttcggcttaggg

SEQ ID NO: 161731 - DNA, 25 bp, E. coli
cattataccgcttcaggtgagcgca

SEQ ID NO: 161732 - DNA, 25 bp, E. coli
cattataccgctacaggtgagcgca

SEQ ID NO: 161733 - DNA, 25 bp, E. coli
cgttaaggtgactctggaagctgca

SEQ ID NO: 161734 - DNA, 25 bp, E. coli
cgttaaggtgacactggaagctgca

SEQ ID NO: 161735 - DNA, 25 bp, E. coli
tcaatagcaggtgcagatgccgtca

SEQ ID NO: 161736 - DNA, 25 bp, E. coli
tcaatagcaggtccagatgccgtca

SEQ ID NO: 161737 - DNA, 25 bp, E. coli
gaggttatattagccagacaacgcg

SEQ ID NO: 161738 - DNA, 25 bp, E. coli
gaggttatattacccagacaacgcg

SEQ ID NO: 161739 - DNA, 25 bp, E. coli
cagcctgaaagccatgacgaacgtc

SEQ ID NO: 161740 - DNA, 25 bp, E. coli
cagcctgaaagcgatgacgaacgtc

SEQ ID NO: 161741 - DNA, 25 bp, E. coli
atgcaaaaactaccctttttccgcg

SEQ ID NO: 161742 - DNA, 25 bp, E. coli
atgcaaaaactagcctttttccgcg

SEQ ID NO: 161743 - DNA, 25 bp, E. coli
ttttccgcgacgctcccgccccgtg

SEQ ID NO: 161744 - DNA, 25 bp, E. coli
ttttccgcgacggtcccgccccgtg

SEQ ID NO: 161745 - DNA, 25 bp, E. coli
gccgtcagcctgtaagccatgacga

SEQ ID NO: 161746 - DNA, 25 bp, E. coli
cctgaaagccatcacgaacgtctga

SEQ ID NO: 161747 - DNA, 25 bp, E. coli
cctgaaagccatgacgaacgtctga

SEQ ID NO: 161748 - DNA, 25 bp, E. coli
gcctgaaagccatgacgaacgtctg

SEQ ID NO: 161749 - DNA, 25 bp, E. coli
gcctgaaagccaagacgaacgtctg

SEQ ID NO: 161750 - DNA, 25 bp, E. coli
gccgtcagcctgaaagccatgacga

SEQ ID NO: 161751 - DNA, 25 bp, E. coli
gcaggccacccctccgggaggagcc

SEQ ID NO: 161752 - DNA, 25 bp, E. coli
gcaggccaccccaccgggaggagcc

SEQ ID NO: 161753 - DNA, 25 bp, E. coli
gtcagcctgaaagccatgacgaacg

SEQ ID NO: 161754 - DNA, 25 bp, E. coli
ggagccgtcagcgtgaaagccatga

SEQ ID NO: 161755 - DNA, 25 bp, E. coli
ggagccgtcagcctgaaagccatga

SEQ ID NO: 161756 - DNA, 25 bp, E. coli
gtcagcctgaaacccatgacgaacg

SEQ ID NO: 161757 - DNA, 25 bp, E. coli
gaggagccgtcagcctgaaagccat

SEQ ID NO: 161758 - DNA, 25 bp, E. coli
gaggagccgtcaccctgaaagccat

SEQ ID NO: 161759 - DNA, 25 bp, E. coli
gagccgtcagcctgaaagccatgac

SEQ ID NO: 161760 - DNA, 25 bp, E. coli
gagccgtcagccagaaagccatgac

SEQ ID NO: 161761 - DNA, 25 bp, E. coli
aatcactttggcttaacgccgccag

SEQ ID NO: 161762 - DNA, 25 bp, E. coli
aatcactttggcataacgccgccag

SEQ ID NO: 161763 - DNA, 25 bp, E. coli
cactaaccttgaaccgcatgacgtg

SEQ ID NO: 161764 - DNA, 25 bp, E. coli
cactaaccttgatccgcatgacgtg

SEQ ID NO: 161765 - DNA, 25 bp, E. coli
agaagtgctgtacccggcaatggaa

SEQ ID NO: 161766 - DNA, 25 bp, E. coli
accgcgtgggcgtatggcgacgacg

SEQ ID NO: 161767 - DNA, 25 bp, E. coli
accgcgtgggcgaatggcgacgacg

SEQ ID NO: 161768 - DNA, 25 bp, E. coli
acgacgcgggcgtggaatcactttg

SEQ ID NO: 161769 - DNA, 25 bp, E. coli
agaagtgctgtagccggcaatggaa

SEQ ID NO: 161770 - DNA, 25 bp, E. coli
acgacgcgggcgaggaatcactttg

SEQ ID NO: 161771 - DNA, 25 bp, E. coli
tttggctgcgatcctcactaacctt

SEQ ID NO: 161772 - DNA, 25 bp, E. coli
tttggctgcgatgctcactaacctt

SEQ ID NO: 161773 - DNA, 25 bp, E. coli
ttgttgaagaagagctgtacccggc

SEQ ID NO: 161774 - DNA, 25 bp, E. coli
ttgttgaagaagtgctgtacccggc

SEQ ID NO: 161775 - DNA, 25 bp, E. coli
ccttgaaccgcaagacgtgctgttt

SEQ ID NO: 161776 - DNA, 25 bp, E. coli
ccttgaaccgcatgacgtgctgttt

SEQ ID NO: 161777 - DNA, 25 bp, E. coli
ccgcatgacgtggtgtttattgatg

SEQ ID NO: 161778 - DNA, 25 bp, E. coli
cgatttggctgcgatgctcactaac

SEQ ID NO: 161779 - DNA, 25 bp, E. coli
ccgcatgacgtgctgtttattgatg

SEQ ID NO: 161780 - DNA, 25 bp, E. coli
cgatttggctgccatgctcactaac

SEQ ID NO: 161781 - DNA, 25 bp, E. coli
gtggaatcacttaggcataacgccg

SEQ ID NO: 161782 - DNA, 25 bp, E. coli
gtggaatcactttggcataacgccg

SEQ ID NO: 161783 - DNA, 25 bp, E. coli
catcatagcgagtaaaaacctgtca

SEQ ID NO: 161784 - DNA, 25 bp, E. coli
catcatagcgagaaaaaacctgtca

SEQ ID NO: 161785 - DNA, 25 bp, E. coli
tgttacattgggaacagaagcgcca

SEQ ID NO: 161786 - DNA, 25 bp, E. coli
tgttacattgggtacagaagcgcca

SEQ ID NO: 161787 - DNA, 25 bp, E. coli
tcgacagcacgggtaaaacgacagg

SEQ ID NO: 161788 - DNA, 25 bp, E. coli
tcgacagcacggctaaaacgacagg

SEQ ID NO: 161789 - DNA, 25 bp, E. coli
cctggatggaacagatggataacgc

SEQ ID NO: 161790 - DNA, 25 bp, E. coli
cctggatggaactgatggataacgc

SEQ ID NO: 161791 - DNA, 25 bp, E. coli
cgttaaacttctatgcctggatgga

SEQ ID NO: 161792 - DNA, 25 bp, E. coli
cgttaaacttctttgcctggatgga

SEQ ID NO: 161793 - DNA, 25 bp, E. coli
cattgacctgggagaagtaaccaca

SEQ ID NO: 161794 - DNA, 25 bp, E. coli
cgtggtctcaaaggtaggcgtgacc

SEQ ID NO: 161795 - DNA, 25 bp, E. coli
cattgacctgggtgaagtaaccaca

SEQ ID NO: 161796 - DNA, 25 bp, E. coli
cgtggtctcaaacgtaggcgtgacc

SEQ ID NO: 161797 - DNA, 25 bp, E. coli
gataacgcagttacggttaccgcgg

SEQ ID NO: 161798 - DNA, 25 bp, E. coli
ggcgttggcgtaggtctcatgaaca

SEQ ID NO: 161799 - DNA, 25 bp, E. coli
ggcgttggcgtacgtctcatgaaca

SEQ ID NO: 161800 - DNA, 25 bp, E. coli
taacatcagtgctggcgaggctacc

SEQ ID NO: 161801 - DNA, 25 bp, E. coli
tcaactgtgatattgcaggctggga

SEQ ID NO: 161802 - DNA, 25 bp, E. coli
taacatcagtgcaggcgaggctacc

SEQ ID NO: 161803 - DNA, 25 bp, E. coli
tcaactgtgataatgcaggctggga

SEQ ID NO: 161804 - DNA, 25 bp, E. coli
gataacgcagtttcggttaccgcgg

SEQ ID NO: 161805 - DNA, 25 bp, E. coli
caccgatgtgtgcacgtataaaccg

SEQ ID NO: 161806 - DNA, 25 bp, E. coli
caccgatgtgtggacgtataaaccg

SEQ ID NO: 161807 - DNA, 25 bp, E. coli
taaaccggtgcactactatccaggg

SEQ ID NO: 161808 - DNA, 25 bp, E. coli
tactatccagggtaacatccgtgcg

SEQ ID NO: 161809 - DNA, 25 bp, E. coli
tactatccagggaaacatccgtgcg

SEQ ID NO: 161810 - DNA, 25 bp, E. coli
taaaccggtgcagtactatccaggg

SEQ ID NO: 161811 - DNA, 25 bp, E. coli
tacgtatgcctctctgaaccgacag

SEQ ID NO: 161812 - DNA, 25 bp, E. coli
tacgtatgcctcactgaaccgacag

SEQ ID NO: 161813 - DNA, 25 bp, E. coli
tatcatctgggcaaagccgtccgga

SEQ ID NO: 161814 - DNA, 25 bp, E. coli
tatcatctgggctaagccgtccgga

SEQ ID NO: 161815 - DNA, 25 bp, E. coli
ttactttcgtgatgcgcgcgctgtc

SEQ ID NO: 161816 - DNA, 25 bp, E. coli
ttactttcgtgaagcgcgcgctgtc

SEQ ID NO: 161817 - DNA, 25 bp, E. coli
tgaaacagcatgagatggccccgct

SEQ ID NO: 161818 - DNA, 25 bp, E. coli
tgagttaatcaaggccgactgcctg

SEQ ID NO: 161819 - DNA, 25 bp, E. coli
tgaaacagcatgtgatggccccgct

SEQ ID NO: 161820 - DNA, 25 bp, E. coli
tgcaacaaggaatgcctgcgggcgt

SEQ ID NO: 161821 - DNA, 25 bp, E. coli
tgcaacaaggaaagcctgcgggcgt

SEQ ID NO: 161822 - DNA, 25 bp, E. coli
tgagttaatcaacgccgactgcctg

SEQ ID NO: 161823 - DNA, 25 bp, E. coli
cttcaaagtgaatcccgagggctgg

SEQ ID NO: 161824 - DNA, 25 bp, E. coli
cttcaaagtgaaacccgagggctgg

SEQ ID NO: 161825 - DNA, 25 bp, E. coli
gataatcagcgctagcagtcgtccg

SEQ ID NO: 161826 - DNA, 25 bp, E. coli
gataatcagcgcaagcagtcgtccg

SEQ ID NO: 161827 - DNA, 25 bp, E. coli
caagcggagattcgcgctaaagata

SEQ ID NO: 161828 - DNA, 25 bp, E. coli
caagcggagattggcgctaaagata

SEQ ID NO: 161829 - DNA, 25 bp, E. coli
gactcacacaaacaaacaccgtgcg

SEQ ID NO: 161830 - DNA, 25 bp, E. coli
gactcacacaaagaaacaccgtgcg

SEQ ID NO: 161831 - DNA, 25 bp, E. coli
cgctaaagatatgtcggtcttcagt

SEQ ID NO: 161832 - DNA, 25 bp, E. coli
cgctaaagatatctcggtcttcagt

SEQ ID NO: 161833 - DNA, 25 bp, E. coli
cgcgctaaagatttgtcggtcttca

SEQ ID NO: 161834 - DNA, 25 bp, E. coli
cgcgctaaagatatgtcggtcttca

SEQ ID NO: 161835 - DNA, 25 bp, E. coli
cttcagttcctttatccgcgaaaat

SEQ ID NO: 161836 - DNA, 25 bp, E. coli
cttcagttccttaatccgcgaaaat

SEQ ID NO: 161837 - DNA, 25 bp, E. coli
cggagattcgcggtaaagatatgtc

SEQ ID NO: 161838 - DNA, 25 bp, E. coli
cggagattcgcgctaaagatatgtc

SEQ ID NO: 161839 - DNA, 25 bp, E. coli
gatatgtcggtcatcagttccttaa

SEQ ID NO: 161840 - DNA, 25 bp, E. coli
gtaacggcagactcacacaaagaaa

SEQ ID NO: 161841 - DNA, 25 bp, E. coli
gattcgcgctaatgatatgtcggtc

SEQ ID NO: 161842 - DNA, 25 bp, E. coli
gattcgcgctaaagatatgtcggtc

SEQ ID NO: 161843 - DNA, 25 bp, E. coli
gtaacggcagacacacacaaagaaa

SEQ ID NO: 161844 - DNA, 25 bp, E. coli
gatatgtcggtcttcagttccttaa

SEQ ID NO: 161845 - DNA, 25 bp, E. coli
ggtcttcagttcgttaatccgcgaa

SEQ ID NO: 161846 - DNA, 25 bp, E. coli
ggtcttcagttccttaatccgcgaa

SEQ ID NO: 161847 - DNA, 25 bp, E. coli
ggcagactcacacaaagaaacaccg

SEQ ID NO: 161848 - DNA, 25 bp, E. coli
ggcagactcacagaaagaaacaccg

SEQ ID NO: 161849 - DNA, 25 bp, E. coli
caaccacgtttttgggagcacgcca

SEQ ID NO: 161850 - DNA, 25 bp, E. coli
caaccacgttttagggagcacgcca

SEQ ID NO: 161851 - DNA, 25 bp, E. coli
cacggtgaattttcgaaatcgtcga

SEQ ID NO: 161852 - DNA, 25 bp, E. coli
cacggtgaatttacgaaatcgtcga

SEQ ID NO: 161853 - DNA, 25 bp, E. coli
ttttgaccacccagtaccagatgct

SEQ ID NO: 161854 - DNA, 25 bp, E. coli
ttttgaccaccctgtaccagatgct

SEQ ID NO: 161855 - DNA, 25 bp, E. coli
ttctcaacgttccatcgcgatgtcg

SEQ ID NO: 161856 - DNA, 25 bp, E. coli
ttctcaacgttcgatcgcgatgtcg

SEQ ID NO: 161857 - DNA, 25 bp, E. coli
tgtatctggacaatacctgaaggcg

SEQ ID NO: 161858 - DNA, 25 bp, E. coli
tgtatctggacattacctgaaggcg

SEQ ID NO: 161859 - DNA, 25 bp, E. coli
ccagtaaagcatggttgggtaaagc

SEQ ID NO: 161860 - DNA, 25 bp, E. coli
ccagtaaagcatcgttgggtaaagc

SEQ ID NO: 161861 - DNA, 25 bp, E. coli
gcgctggcgggaaattaaaaagcaa

SEQ ID NO: 161862 - DNA, 25 bp, E. coli
gcgctggcgggatattaaaaagcaa

SEQ ID NO: 161863 - DNA, 25 bp, E. coli
gcaagtgagtgattggccattctca

SEQ ID NO: 161864 - DNA, 25 bp, E. coli
gcaagtgagtgaatggccattctca

SEQ ID NO: 161865 - DNA, 25 bp, E. coli
gttttgccagaggatatgcactgta

SEQ ID NO: 161866 - DNA, 25 bp, E. coli
gttttgccagagcatatgcactgta

SEQ ID NO: 161867 - DNA, 25 bp, E. coli
ggttatatcccaacgattgggcggg

SEQ ID NO: 161868 - DNA, 25 bp, E. coli
ggttatatcccatcgattgggcggg

SEQ ID NO: 161869 - DNA, 25 bp, E. coli
gatgtcgcgcgacggttatatccca

SEQ ID NO: 161870 - DNA, 25 bp, E. coli
gatgtcgcgcgagggttatatccca

SEQ ID NO: 161871 - DNA, 25 bp, E. coli
caggtaaatctggtatcggcgcagg

SEQ ID NO: 161872 - DNA, 25 bp, E. coli
caggtaaatctgctatcggcgcagg

SEQ ID NO: 161873 - DNA, 25 bp, E. coli
aaacgtgtttatcttattgccgccg

SEQ ID NO: 161874 - DNA, 25 bp, E. coli
aaacgtgtttatgttattgccgccg

SEQ ID NO: 161875 - DNA, 25 bp, E. coli
tatcctcaatatcccgaacaatgtg

SEQ ID NO: 161876 - DNA, 25 bp, E. coli
tatcctcaatatgccgaacaatgtg

SEQ ID NO: 161877 - DNA, 25 bp, E. coli
tattacatggatctgcaggaagcga

SEQ ID NO: 161878 - DNA, 25 bp, E. coli
tattacatggatgtgcaggaagcga

SEQ ID NO: 161879 - DNA, 25 bp, E. coli
tattggtgcgctctcttcttcgaag

SEQ ID NO: 161880 - DNA, 25 bp, E. coli
tattggtgcgctgtcttcttcgaag

SEQ ID NO: 161881 - DNA, 25 bp, E. coli
tcttcttcgaagtaagatcgcggta

SEQ ID NO: 161882 - DNA, 25 bp, E. coli
tcttcttcgaagaaagatcgcggta

SEQ ID NO: 161883 - DNA, 25 bp, E. coli
ccggcgaacgcgtagcaggtaaatc

SEQ ID NO: 161884 - DNA, 25 bp, E. coli
ccagcaacagcagcgcagaaggtaa

SEQ ID NO: 161885 - DNA, 25 bp, E. coli
ccggcgaacgcgaagcaggtaaatc

SEQ ID NO: 161886 - DNA, 25 bp, E. coli
ccagcaacagcaccgcagaaggtaa

SEQ ID NO: 161887 - DNA, 25 bp, E. coli
gcactggtgttagcgtaacccgcag

SEQ ID NO: 161888 - DNA, 25 bp, E. coli
gcactggtgttaccgtaacccgcag

SEQ ID NO: 161889 - DNA, 25 bp, E. coli
ctgaaagagtatgcgaaaacggcgg

SEQ ID NO: 161890 - DNA, 25 bp, E. coli
ctgaaagagtatccgaaaacggcgg

SEQ ID NO: 161891 - DNA, 25 bp, E. coli
gattccgttgccagcgcgttgatca

SEQ ID NO: 161892 - DNA, 25 bp, E. coli
gattccgttgcctgcgcgttgatca

SEQ ID NO: 161893 - DNA, 25 bp, E. coli
acgcccaggcgcgttttagccagaa

SEQ ID NO: 161894 - DNA, 25 bp, E. coli
acgcccaggcgccttttagccagaa

SEQ ID NO: 161895 - DNA, 25 bp, E. coli
aaaaaggctgggtacagcgccgtca

SEQ ID NO: 161896 - DNA, 25 bp, E. coli
aaaaaggctgggaacagcgccgtca

SEQ ID NO: 161897 - DNA, 25 bp, E. coli
tgatgcgcccgtacgattacccgct

SEQ ID NO: 161898 - DNA, 25 bp, E. coli
tgatgcgcccgttcgattacccgct

SEQ ID NO: 161899 - DNA, 25 bp, E. coli
tgcacgattttcagcgcgagcaaac

SEQ ID NO: 161900 - DNA, 25 bp, E. coli
tgagcaggagctacgtcaacactac

SEQ ID NO: 161901 - DNA, 25 bp, E. coli
tgagcaggagcttcgtcaacactac

SEQ ID NO: 161902 - DNA, 25 bp, E. coli
tgcacgattttctgcgcgagcaaac

SEQ ID NO: 161903 - DNA, 25 bp, E. coli
tcgaccaactggtggaaaaaggctg

SEQ ID NO: 161904 - DNA, 25 bp, E. coli
tcgaccaactggaggaaaaaggctg

SEQ ID NO: 161905 - DNA, 25 bp, E. coli
ccaggccaaagactgccagcgtctt

SEQ ID NO: 161906 - DNA, 25 bp, E. coli
ccaggccaaagagtgccagcgtctt

SEQ ID NO: 161907 - DNA, 25 bp, E. coli
gacgcgcgccgacatgattgaattc

SEQ ID NO: 161908 - DNA, 25 bp, E. coli
gattgaattcacaatggagcactga

SEQ ID NO: 161909 - DNA, 25 bp, E. coli
gattgaattcactatggagcactga

SEQ ID NO: 161910 - DNA, 25 bp, E. coli
tcaacactaccgctgcggcgactat

SEQ ID NO: 161911 - DNA, 25 bp, E. coli
tcaacactaccggtgcggcgactat

SEQ ID NO: 161912 - DNA, 25 bp, E. coli
gagatagccgcataacttgagcagg

SEQ ID NO: 161913 - DNA, 25 bp, E. coli
gacgcgcgccgagatgattgaattc

SEQ ID NO: 161914 - DNA, 25 bp, E. coli
gagatagccgcaaaacttgagcagg

SEQ ID NO: 161915 - DNA, 25 bp, E. coli
aacgccatgaacgtgcttaatattt

SEQ ID NO: 161916 - DNA, 25 bp, E. coli
cagtgggcagcctatgacgtcgatt

SEQ ID NO: 161917 - DNA, 25 bp, E. coli
cagtgggcagccaatgacgtcgatt

SEQ ID NO: 161918 - DNA, 25 bp, E. coli
atctccgcctgccttttaggtggcg

SEQ ID NO: 161919 - DNA, 25 bp, E. coli
atctccgcctgcgttttaggtggcg

SEQ ID NO: 161920 - DNA, 25 bp, E. coli
aacgccatgaacctgcttaatattt

SEQ ID NO: 161921 - DNA, 25 bp, E. coli
ttttaggtggcgattctctgaaagg

SEQ ID NO: 161922 - DNA, 25 bp, E. coli
ttttaggtggcgtttctctgaaagg

SEQ ID NO: 161923 - DNA, 25 bp, E. coli
tttaggcaccgtggaaaacgccatg

SEQ ID NO: 161924 - DNA, 25 bp, E. coli
ttcgaccgttactagcaaaaagcga

SEQ ID NO: 161925 - DNA, 25 bp, E. coli
tttaggcaccgtcgaaaacgccatg

SEQ ID NO: 161926 - DNA, 25 bp, E. coli
ttcgaccgttacaagcaaaaagcga

SEQ ID NO: 161927 - DNA, 25 bp, E. coli
tctcatatgtggaggcgggtatctt

SEQ ID NO: 161928 - DNA, 25 bp, E. coli
tctcatatgtggtggcgggtatctt

SEQ ID NO: 161929 - DNA, 25 bp, E. coli
gcgggtatcttatttttaggcaccg

SEQ ID NO: 161930 - DNA, 25 bp, E. coli
gcgggtatcttaattttaggcaccg

SEQ ID NO: 161931 - DNA, 25 bp, E. coli
gcaaaaagcgaaacgcactgtctga

SEQ ID NO: 161932 - DNA, 25 bp, E. coli
gcaaaaagcgaatcgcactgtctga

SEQ ID NO: 161933 - DNA, 25 bp, E. coli
gttcgcggcttattcctgctggcag

SEQ ID NO: 161934 - DNA, 25 bp, E. coli
gttcgcggcttaatcctgctggcag

SEQ ID NO: 161935 - DNA, 25 bp, E. coli
ggcatcggaaaaatctcatatgtgg

SEQ ID NO: 161936 - DNA, 25 bp, E. coli
ggcatcggaaaattctcatatgtgg

SEQ ID NO: 161937 - DNA, 25 bp, E. coli
caacggacattgagctgaccattcg

SEQ ID NO: 161938 - DNA, 25 bp, E. coli
caacggacattgtgctgaccattcg

SEQ ID NO: 161939 - DNA, 25 bp, E. coli
tgatgtcctcgcaacggacattgtg

SEQ ID NO: 161940 - DNA, 25 bp, E. coli
tgatgtcctcgctacggacattgtg

SEQ ID NO: 161941 - DNA, 25 bp, E. coli
tcctcgcaacggtcattgtgctgac

SEQ ID NO: 161942 - DNA, 25 bp, E. coli
tcgcaacggacattgtgctgaccat

SEQ ID NO: 161943 - DNA, 25 bp, E. coli
tcgcaacggacaatgtgctgaccat

SEQ ID NO: 161944 - DNA, 25 bp, E. coli
tcctcgcaacggacattgtgctgac

SEQ ID NO: 161945 - DNA, 25 bp, E. coli
gcctcgcagggaggcgaaggtgcga

SEQ ID NO: 161946 - DNA, 25 bp, E. coli
gcctcgcagggacgcgaaggtgcga

SEQ ID NO: 161947 - DNA, 25 bp, E. coli
gcacggtttgcatctgccgctcacg

SEQ ID NO: 161948 - DNA, 25 bp, E. coli
gcacggtttgcaactgccgctcacg

SEQ ID NO: 161949 - DNA, 25 bp, E. coli
cgttggcactgggtatgtggttacc

SEQ ID NO: 161950 - DNA, 25 bp, E. coli
cgttggcactggctatgtggttacc

SEQ ID NO: 161951 - DNA, 25 bp, E. coli
ctgatggcgcagctagcgcctcgca

SEQ ID NO: 161952 - DNA, 25 bp, E. coli
ctgatggcgcaggtagcgcctcgca

SEQ ID NO: 161953 - DNA, 25 bp, E. coli
gggcacggtttggaactgccgctca

SEQ ID NO: 161954 - DNA, 25 bp, E. coli
gggcacggtttgcaactgccgctca

SEQ ID NO: 161955 - DNA, 25 bp, E. coli
ggcactggctatgtggttaccatga

SEQ ID NO: 161956 - DNA, 25 bp, E. coli
ggcactggctatctggttaccatga

SEQ ID NO: 161957 - DNA, 25 bp, E. coli
taatgatgtcctggcaacggacatt

SEQ ID NO: 161958 - DNA, 25 bp, E. coli
taatgatgtcctcgcaacggacatt

SEQ ID NO: 161959 - DNA, 25 bp, E. coli
aagagtcattatgaccacggcaacg

SEQ ID NO: 161960 - DNA, 25 bp, E. coli
aagagtcattatcaccacggcaacg

SEQ ID NO: 161961 - DNA, 25 bp, E. coli
cagtacgtctgaaacgctggcggca

SEQ ID NO: 161962 - DNA, 25 bp, E. coli
cagtacgtctgatacgctggcggca

SEQ ID NO: 161963 - DNA, 25 bp, E. coli
caggtcttctgatacggcagcggga

SEQ ID NO: 161964 - DNA, 25 bp, E. coli
caggtcttctgaaacggcagcggga

SEQ ID NO: 161965 - DNA, 25 bp, E. coli
tatgtgcgggttaacgctcctgcag

SEQ ID NO: 161966 - DNA, 25 bp, E. coli
tatgtgcgggtttacgctcctgcag

SEQ ID NO: 161967 - DNA, 25 bp, E. coli
tgtgagcggctcaacaaactcggct

SEQ ID NO: 161968 - DNA, 25 bp, E. coli
tgtgagcggctctacaaactcggct

SEQ ID NO: 161969 - DNA, 25 bp, E. coli
tgaacacggctactgctaactccgg

SEQ ID NO: 161970 - DNA, 25 bp, E. coli
tgaacacggctagtgctaactccgg

SEQ ID NO: 161971 - DNA, 25 bp, E. coli
tgcttcctgaacaacattaacgcgg

SEQ ID NO: 161972 - DNA, 25 bp, E. coli
tgcttcctgaactacattaacgcgg

SEQ ID NO: 161973 - DNA, 25 bp, E. coli
tctgcagaaagaccagaacggcgct

SEQ ID NO: 161974 - DNA, 25 bp, E. coli
tctgcagaaagagcagaacggcgct

SEQ ID NO: 161975 - DNA, 25 bp, E. coli
gaagttgccggagcctgcagatgaa

SEQ ID NO: 161976 - DNA, 25 bp, E. coli
gaagttgccggaccctgcagatgaa

SEQ ID NO: 161977 - DNA, 25 bp, E. coli
gaagatggcctgacaatatccgcac

SEQ ID NO: 161978 - DNA, 25 bp, E. coli
gaagatggcctgtcaatatccgcac

SEQ ID NO: 161979 - DNA, 25 bp, E. coli
gatattactttatccgccgcgcatg

SEQ ID NO: 161980 - DNA, 25 bp, E. coli
gatattactttaaccgccgcgcatg

SEQ ID NO: 161981 - DNA, 25 bp, E. coli
cgttgtcccctcatggtcgctggtc

SEQ ID NO: 161982 - DNA, 25 bp, E. coli
cgttgtcccctcttggtcgctggtc

SEQ ID NO: 161983 - DNA, 25 bp, E. coli
tattcatgcgcgctattgtcgccgt

SEQ ID NO: 161984 - DNA, 25 bp, E. coli
tattcatgcgcggtattgtcgccgt

SEQ ID NO: 161985 - DNA, 25 bp, E. coli
tattcctgcattaacagagaccgca

SEQ ID NO: 161986 - DNA, 25 bp, E. coli
tattcctgcatttacagagaccgca

SEQ ID NO: 161987 - DNA, 25 bp, E. coli
tttaccgcgttatcggagcgcggcg

SEQ ID NO: 161988 - DNA, 25 bp, E. coli
tttaccgcgttaacggagcgcggcg

SEQ ID NO: 161989 - DNA, 25 bp, E. coli
tgagcgaccttattattcatgcgcg

SEQ ID NO: 161990 - DNA, 25 bp, E. coli
tgcattaacagagaccgcagcccga

SEQ ID NO: 161991 - DNA, 25 bp, E. coli
tgcattaacagacaccgcagcccga

SEQ ID NO: 161992 - DNA, 25 bp, E. coli
tgagcgaccttaatattcatgcgcg

SEQ ID NO: 161993 - DNA, 25 bp, E. coli
ccgggagaatccactgcgcgagtgt

SEQ ID NO: 161994 - DNA, 25 bp, E. coli
ccgggagaatcctctgcgcgagtgt

SEQ ID NO: 161995 - DNA, 25 bp, E. coli
gaagaagccggatgtttatcactat

SEQ ID NO: 161996 - DNA, 25 bp, E. coli
gaagaagccggaagtttatcactat

SEQ ID NO: 161997 - DNA, 25 bp, E. coli
ctcatggtcgctcgtccggtgcgat

SEQ ID NO: 161998 - DNA, 25 bp, E. coli
ctcatggtcgctggtccggtgcgat

SEQ ID NO: 161999 - DNA, 25 bp, E. coli
ggtattgtcgccctattcctgcatt

SEQ ID NO: 162000 - DNA, 25 bp, E. coli
ggtattgtcgccgtattcctgcatt

SEQ ID NO: 162001 - DNA, 25 bp, E. coli
gagcgcggcgttgtcccctcatggt

SEQ ID NO: 162002 - DNA, 25 bp, E. coli
gagcgcggcgttctcccctcatggt

SEQ ID NO: 162003 - DNA, 25 bp, E. coli
cagtacggacaatttgttgcaggca

SEQ ID NO: 162004 - DNA, 25 bp, E. coli
cagtacggacaaattgttgcaggca

SEQ ID NO: 162005 - DNA, 25 bp, E. coli
tacagtgcgggcagtattgcgacct

SEQ ID NO: 162006 - DNA, 25 bp, E. coli
taaagctacagggatctattacagt

SEQ ID NO: 162007 - DNA, 25 bp, E. coli
tacagtgcgggctgtattgcgacct

SEQ ID NO: 162008 - DNA, 25 bp, E. coli
taaagctacaggcatctattacagt

SEQ ID NO: 162009 - DNA, 25 bp, E. coli
tatcggcttacggagccgcaaaaaa

SEQ ID NO: 162010 - DNA, 25 bp, E. coli
tatcggcttacgcagccgcaaaaaa

SEQ ID NO: 162011 - DNA, 25 bp, E. coli
tattgcgacctttactattccgttg

SEQ ID NO: 162012 - DNA, 25 bp, E. coli
tattgctctgtttaccgtctgcctg

SEQ ID NO: 162013 - DNA, 25 bp, E. coli
tattgcgaccttaactattccgttg

SEQ ID NO: 162014 - DNA, 25 bp, E. coli
tattgctctgttaaccgtctgcctg

SEQ ID NO: 162015 - DNA, 25 bp, E. coli
tgttgcaggcatctcatacactatg

SEQ ID NO: 162016 - DNA, 25 bp, E. coli
tgttgcaggcatgtcatacactatg

SEQ ID NO: 162017 - DNA, 25 bp, E. coli
ccttacgctaaacgtaaagctacag

SEQ ID NO: 162018 - DNA, 25 bp, E. coli
ccttacgctaaaggtaaagctacag

SEQ ID NO: 162019 - DNA, 25 bp, E. coli
cgccatcgctgcgatcggtttttta

SEQ ID NO: 162020 - DNA, 25 bp, E. coli
cgccatcgctgccatcggtttttta

SEQ ID NO: 162021 - DNA, 25 bp, E. coli
ctggaggtgttgagcaaattggcct

SEQ ID NO: 162022 - DNA, 25 bp, E. coli
ctggaggtgttgtgcaaattggcct

SEQ ID NO: 162023 - DNA, 25 bp, E. coli
taatggctgaacgtttcccttacgc

SEQ ID NO: 162024 - DNA, 25 bp, E. coli
taatggctgaacctttcccttacgc

SEQ ID NO: 162025 - DNA, 25 bp, E. coli
caccaatttttgaagatgtcgcgca

SEQ ID NO: 162026 - DNA, 25 bp, E. coli
caccaatttttgtagatgtcgcgca

SEQ ID NO: 162027 - DNA, 25 bp, E. coli
caggttgtcgacatgcttaatggcg

SEQ ID NO: 162028 - DNA, 25 bp, E. coli
caggttgtcgacttgcttaatggcg

SEQ ID NO: 162029 - DNA, 25 bp, E. coli
aaagcgccgttccatagctggctga

SEQ ID NO: 162030 - DNA, 25 bp, E. coli
aaagcgccgttcgatagctggctga

SEQ ID NO: 162031 - DNA, 25 bp, E. coli
taccgaagctgatcgtgaattgagc

SEQ ID NO: 162032 - DNA, 25 bp, E. coli
taccgaagctgaacgtgaattgagc

SEQ ID NO: 162033 - DNA, 25 bp, E. coli
tgtcgcgcaagagcgtagcggtaaa

SEQ ID NO: 162034 - DNA, 25 bp, E. coli
tgatcgacttctcggcaccgtggtg

SEQ ID NO: 162035 - DNA, 25 bp, E. coli
tgtcgcgcaagaccgtagcggtaaa

SEQ ID NO: 162036 - DNA, 25 bp, E. coli
tgatcgacttctgggcaccgtggtg

SEQ ID NO: 162037 - DNA, 25 bp, E. coli
tgacggagaggtgattaatgcgacc

SEQ ID NO: 162038 - DNA, 25 bp, E. coli
tgacggagaggtcattaatgcgacc

SEQ ID NO: 162039 - DNA, 25 bp, E. coli
gaataccgtttgtacccattgtcag

SEQ ID NO: 162040 - DNA, 25 bp, E. coli
gaataccgtttgaacccattgtcag

SEQ ID NO: 162041 - DNA, 25 bp, E. coli
cgctttgtgaaactgaataccgaag

SEQ ID NO: 162042 - DNA, 25 bp, E. coli
cgatcggatcgatgatgcggcaaaa

SEQ ID NO: 162043 - DNA, 25 bp, E. coli
cgctttgtgaaagtgaataccgaag

SEQ ID NO: 162044 - DNA, 25 bp, E. coli
cgatcggatcgaagatgcggcaaaa

SEQ ID NO: 162045 - DNA, 25 bp, E. coli
ggcaaaatgcggtcgctgcggtcac

SEQ ID NO: 162046 - DNA, 25 bp, E. coli
ggcaaaatgcggacgctgcggtcac

SEQ ID NO: 162047 - DNA, 25 bp, E. coli
cacttacgtgcctgaactgaatgca

SEQ ID NO: 162048 - DNA, 25 bp, E. coli
cacttacgtgccagaactgaatgca

SEQ ID NO: 162049 - DNA, 25 bp, E. coli
actttccctgcgagagtatcttgag

SEQ ID NO: 162050 - DNA, 25 bp, E. coli
actttccctgcgtgagtatcttgag

SEQ ID NO: 162051 - DNA, 25 bp, E. coli
aactctatggagattgccgggcaac

SEQ ID NO: 162052 - DNA, 25 bp, E. coli
aactctatggagtttgccgggcaac

SEQ ID NO: 162053 - DNA, 25 bp, E. coli
tatccagaatcggtgagtgaacgcc

SEQ ID NO: 162054 - DNA, 25 bp, E. coli
tatccagaatcgctgagtgaacgcc

SEQ ID NO: 162055 - DNA, 25 bp, E. coli
tatcttgaggatagtaaagctgcgg

SEQ ID NO: 162056 - DNA, 25 bp, E. coli
tatcttgaggattgtaaagctgcgg

SEQ ID NO: 162057 - DNA, 25 bp, E. coli
tgatcaaactgaagacgccaaactc

SEQ ID NO: 162058 - DNA, 25 bp, E. coli
tgatcaaactgatgacgccaaactc

SEQ ID NO: 162059 - DNA, 25 bp, E. coli
tgcatttcgtgggaaattcctgggc

SEQ ID NO: 162060 - DNA, 25 bp, E. coli
tgcatttcgtggcaaattcctgggc

SEQ ID NO: 162061 - DNA, 25 bp, E. coli
tgaacgccttaaaaatgcggctgcg

SEQ ID NO: 162062 - DNA, 25 bp, E. coli
tgaacgccttaataatgcggctgcg

SEQ ID NO: 162063 - DNA, 25 bp, E. coli
tgcgcgtacagaaaagattaagacc

SEQ ID NO: 162064 - DNA, 25 bp, E. coli
tgcgcgtacagataagattaagacc

SEQ ID NO: 162065 - DNA, 25 bp, E. coli
ggtattgagccgtatgcgcgtacag

SEQ ID NO: 162066 - DNA, 25 bp, E. coli
ggtattgagccgaatgcgcgtacag

SEQ ID NO: 162067 - DNA, 25 bp, E. coli
ggctgcgcagcaacaagtctctgtt

SEQ ID NO: 162068 - DNA, 25 bp, E. coli
ggctgcgcagcatcaagtctctgtt

SEQ ID NO: 162069 - DNA, 25 bp, E. coli
ttaatgccttcagcaaagcctgcgg

SEQ ID NO: 162070 - DNA, 25 bp, E. coli
ttaatgccttcaccaaagcctgcgg

SEQ ID NO: 162071 - DNA, 25 bp, E. coli
tgaaatggcgcacgacacctggcac

SEQ ID NO: 162072 - DNA, 25 bp, E. coli
tgaaatggcgcaggacacctggcac

SEQ ID NO: 162073 - DNA, 25 bp, E. coli
tgcgcgccgctatcgtcaaaaactt

SEQ ID NO: 162074 - DNA, 25 bp, E. coli
tccacgtaatggatctggcggacgg

SEQ ID NO: 162075 - DNA, 25 bp, E. coli
tccacgtaatggttctggcggacgg

SEQ ID NO: 162076 - DNA, 25 bp, E. coli
tgcgcgccgctaacgtcaaaaactt

SEQ ID NO: 162077 - DNA, 25 bp, E. coli
tctgtaacagtatgcgcagcgtact

SEQ ID NO: 162078 - DNA, 25 bp, E. coli
tctgtaacagtaagcgcagcgtact

SEQ ID NO: 162079 - DNA, 25 bp, E. coli
gcgaagatccgcaaggcattccgaa

SEQ ID NO: 162080 - DNA, 25 bp, E. coli
gcgaagatccgctaggcattccgaa

SEQ ID NO: 162081 - DNA, 25 bp, E. coli
ctgttatcgagcgtttaggcggcaa

SEQ ID NO: 162082 - DNA, 25 bp, E. coli
ctgttatcgagcctttaggcggcaa

SEQ ID NO: 162083 - DNA, 25 bp, E. coli
tggcagtcacgcgatccacagggat

SEQ ID NO: 162084 - DNA, 25 bp, E. coli
tggcagtcacgccatccacagggat

SEQ ID NO: 162085 - DNA, 25 bp, E. coli
taacgaagcgttgatgaccgagatc

SEQ ID NO: 162086 - DNA, 25 bp, E. coli
taacgcgcacactcgatgaaatggc

SEQ ID NO: 162087 - DNA, 25 bp, E. coli
taacgcgcacacacgatgaaatggc

SEQ ID NO: 162088 - DNA, 25 bp, E. coli
taacgaagcgttcatgaccgagatc

SEQ ID NO: 162089 - DNA, 25 bp, E. coli
gaccgtgaactgtactggcgcgtaa

SEQ ID NO: 162090 - DNA, 25 bp, E. coli
gaccgtgaactgaactggcgcgtaa

SEQ ID NO: 162091 - DNA, 25 bp, E. coli
taaatggaatacgaaattaccgcca

SEQ ID NO: 162092 - DNA, 25 bp, E. coli
taaatggaataccaaattaccgcca

SEQ ID NO: 162093 - DNA, 25 bp, E. coli
aaattaccgccaccagtttcaacgc

SEQ ID NO: 162094 - DNA, 25 bp, E. coli
aaattaccgccagcagtttcaacgc

SEQ ID NO: 162095 - DNA, 25 bp, E. coli
aaatcaactcttattgctaaatgcc

SEQ ID NO: 162096 - DNA, 25 bp, E. coli
aaatcaactctttttgctaaatgcc

SEQ ID NO: 162097 - DNA, 25 bp, E. coli
tatcaaaatcgcatggtaagcagca

SEQ ID NO: 162098 - DNA, 25 bp, E. coli
tatcaaaatcgcttggtaagcagca

SEQ ID NO: 162099 - DNA, 25 bp, E. coli
tcgaagagtactttcccgggcatga

SEQ ID NO: 162100 - DNA, 25 bp, E. coli
tgaaagcaaccgtaagagcaagtac

SEQ ID NO: 162101 - DNA, 25 bp, E. coli
tcgaagagtactatcccgggcatga

SEQ ID NO: 162102 - DNA, 25 bp, E. coli
tgaaagcaaccgaaagagcaagtac

SEQ ID NO: 162103 - DNA, 25 bp, E. coli
taggcgagtctggagttaaaagtat

SEQ ID NO: 162104 - DNA, 25 bp, E. coli
taggcgagtctgcagttaaaagtat

SEQ ID NO: 162105 - DNA, 25 bp, E. coli
gagcaagtacaaatcgcgttaacta

SEQ ID NO: 162106 - DNA, 25 bp, E. coli
gagcaagtacaattcgcgttaacta

SEQ ID NO: 162107 - DNA, 25 bp, E. coli
cccgggcatgattttaataaatgga

SEQ ID NO: 162108 - DNA, 25 bp, E. coli
cccgggcatgatattaataaatgga

SEQ ID NO: 162109 - DNA, 25 bp, E. coli
tcaacgcgtattgtgaaagcaaccg

SEQ ID NO: 162110 - DNA, 25 bp, E. coli
taagcagcatttcaataggcgagtc

SEQ ID NO: 162111 - DNA, 25 bp, E. coli
tcaacgcgtattctgaaagcaaccg

SEQ ID NO: 162112 - DNA, 25 bp, E. coli
taagcagcatttgaataggcgagtc

SEQ ID NO: 162113 - DNA, 25 bp, E. coli
taaaagtgagtctgcccgtcttcgc

SEQ ID NO: 162114 - DNA, 25 bp, E. coli
aaaaacacgggttggaggtgctgct

SEQ ID NO: 162115 - DNA, 25 bp, E. coli
aaaaacacgggtaggaggtgctgct

SEQ ID NO: 162116 - DNA, 25 bp, E. coli
tttgacaaagcctgcctgaccagcg

SEQ ID NO: 162117 - DNA, 25 bp, E. coli
ttgaggctattcacagcgcagcggc

SEQ ID NO: 162118 - DNA, 25 bp, E. coli
ttgaggctattctcagcgcagcggc

SEQ ID NO: 162119 - DNA, 25 bp, E. coli
tttgacaaagccagcctgaccagcg

SEQ ID NO: 162120 - DNA, 25 bp, E. coli
tgaccagcgtgctagacttacaacc

SEQ ID NO: 162121 - DNA, 25 bp, E. coli
tgaccagcgtgcaagacttacaacc

SEQ ID NO: 162122 - DNA, 25 bp, E. coli
cctgttgagataaaagcactgcggg

SEQ ID NO: 162123 - DNA, 25 bp, E. coli
cctgttgagatataagcactgcggg

SEQ ID NO: 162124 - DNA, 25 bp, E. coli
gcgtcaatgctaattctgctgaaac

SEQ ID NO: 162125 - DNA, 25 bp, E. coli
gcgtcaatgctatttctgctgaaac

SEQ ID NO: 162126 - DNA, 25 bp, E. coli
gctcagcattgtgcaaaaacacggg

SEQ ID NO: 162127 - DNA, 25 bp, E. coli
gctcagcattgtccaaaaacacggg

SEQ ID NO: 162128 - DNA, 25 bp, E. coli
gaaacgatgcgtacttttgacaaag

SEQ ID NO: 162129 - DNA, 25 bp, E. coli
gaaagtggcgcttaacgccccaatg

SEQ ID NO: 162130 - DNA, 25 bp, E. coli
gaaagtggcgctaaacgccccaatg

SEQ ID NO: 162131 - DNA, 25 bp, E. coli
gaaacgatgcgttcttttgacaaag

SEQ ID NO: 162132 - DNA, 25 bp, E. coli
ctgtacaaaaatcggaaagtggcgc

SEQ ID NO: 162133 - DNA, 25 bp, E. coli
ctgtacaaaaatgggaaagtggcgc

SEQ ID NO: 162134 - DNA, 25 bp, E. coli
taaaagtgagtcagcccgtcttcgc

SEQ ID NO: 162135 - DNA, 25 bp, E. coli
caggcaatctaaaaccttaagagaa

SEQ ID NO: 162136 - DNA, 25 bp, E. coli
cagggttatcatctaaaaatactga

SEQ ID NO: 162137 - DNA, 25 bp, E. coli
cagggttatcatgtaaaaatactga

SEQ ID NO: 162138 - DNA, 25 bp, E. coli
caggcaatctaataccttaagagaa

SEQ ID NO: 162139 - DNA, 25 bp, E. coli
taaatcagaggataagaaaatcacg

SEQ ID NO: 162140 - DNA, 25 bp, E. coli
taaatcagaggaaaagaaaatcacg

SEQ ID NO: 162141 - DNA, 25 bp, E. coli
tttccaaaactacatttagtccaca

SEQ ID NO: 162142 - DNA, 25 bp, E. coli
tttccaaaactagatttagtccaca

SEQ ID NO: 162143 - DNA, 25 bp, E. coli
tgtccttgtaacttaattccgttca

SEQ ID NO: 162144 - DNA, 25 bp, E. coli
tgtccttgtaacataattccgttca

SEQ ID NO: 162145 - DNA, 25 bp, E. coli
gcttggtttcaataacaggcaatct

SEQ ID NO: 162146 - DNA, 25 bp, E. coli
gcttggtttcaaaaacaggcaatct

SEQ ID NO: 162147 - DNA, 25 bp, E. coli
gaacaacatcaatacaaaagttgga

SEQ ID NO: 162148 - DNA, 25 bp, E. coli
gaacaacatcaaaacaaaagttgga

SEQ ID NO: 162149 - DNA, 25 bp, E. coli
ccacaaattgaagagggttatcatg

SEQ ID NO: 162150 - DNA, 25 bp, E. coli
ccacaaattgaacagggttatcatg

SEQ ID NO: 162151 - DNA, 25 bp, E. coli
cgccgaccggtctgcttggtttcaa

SEQ ID NO: 162152 - DNA, 25 bp, E. coli
cgccgaccggtcagcttggtttcaa

SEQ ID NO: 162153 - DNA, 25 bp, E. coli
gataagaaaatctcgcaacttgcgg

SEQ ID NO: 162154 - DNA, 25 bp, E. coli
gatttagtccactaattgaacaggg

SEQ ID NO: 162155 - DNA, 25 bp, E. coli
gataagaaaatcacgcaacttgcgg

SEQ ID NO: 162156 - DNA, 25 bp, E. coli
gatttagtccacaaattgaacaggg

SEQ ID NO: 162157 - DNA, 25 bp, E. coli
aattttgtgcgttagcctgatgccg

SEQ ID NO: 162158 - DNA, 25 bp, E. coli
aattttgtgcgtaagcctgatgccg

SEQ ID NO: 162159 - DNA, 25 bp, E. coli
taaaagcgtctgtccggtagcggaa

SEQ ID NO: 162160 - DNA, 25 bp, E. coli
taaaagcgtctgaccggtagcggaa

SEQ ID NO: 162161 - DNA, 25 bp, E. coli
tacagtttaacgtcaccgctgaagc

SEQ ID NO: 162162 - DNA, 25 bp, E. coli
tacagtttaacgacaccgctgaagc

SEQ ID NO: 162163 - DNA, 25 bp, E. coli
atgtatgcattatcccagggccgga

SEQ ID NO: 162164 - DNA, 25 bp, E. coli
atgtatgcattaacccagggccgga

SEQ ID NO: 162165 - DNA, 25 bp, E. coli
tgccgccagagaacgaacaacgttc

SEQ ID NO: 162166 - DNA, 25 bp, E. coli
tgccgccagagatcgaacaacgttc

SEQ ID NO: 162167 - DNA, 25 bp, E. coli
tcatcagcaaactggcaaatgccgg

SEQ ID NO: 162168 - DNA, 25 bp, E. coli
tcatcagcaaacaggcaaatgccgg

SEQ ID NO: 162169 - DNA, 25 bp, E. coli
gcttatcaccacgagcgatgagctg

SEQ ID NO: 162170 - DNA, 25 bp, E. coli
gctgtactaactatctgccgacgct

SEQ ID NO: 162171 - DNA, 25 bp, E. coli
gcttatcaccaccagcgatgagctg

SEQ ID NO: 162172 - DNA, 25 bp, E. coli
gctgtactaactttctgccgacgct

SEQ ID NO: 162173 - DNA, 25 bp, E. coli
gaatttcttgatcaccacgcggttg

SEQ ID NO: 162174 - DNA, 25 bp, E. coli
gaatttcttgatgaccacgcggttg

SEQ ID NO: 162175 - DNA, 25 bp, E. coli
gaaggcgtgcgtaatctggtcgaac

SEQ ID NO: 162176 - DNA, 25 bp, E. coli
gaaggcgtgcgttatctggtcgaac

SEQ ID NO: 162177 - DNA, 25 bp, E. coli
cgcgttatgcgcgagtacctggcaa

SEQ ID NO: 162178 - DNA, 25 bp, E. coli
cgcgttatgcgccagtacctggcaa

SEQ ID NO: 162179 - DNA, 25 bp, E. coli
cagccgattctttggcatttttcag

SEQ ID NO: 162180 - DNA, 25 bp, E. coli
cagccgattcttaggcatttttcag

SEQ ID NO: 162181 - DNA, 25 bp, E. coli
cagaggaataccctcgagaatactg

SEQ ID NO: 162182 - DNA, 25 bp, E. coli
cagaggaataccgtcgagaatactg

SEQ ID NO: 162183 - DNA, 25 bp, E. coli
agctcaggaaaaggtcgctgcaccg

SEQ ID NO: 162184 - DNA, 25 bp, E. coli
agctcaggaaaacgtcgctgcaccg

SEQ ID NO: 162185 - DNA, 25 bp, E. coli
ttccaccacttcagccgattctttg

SEQ ID NO: 162186 - DNA, 25 bp, E. coli
ttccaccacttctgccgattctttg

SEQ ID NO: 162187 - DNA, 25 bp, E. coli
tcgctgcaccgacagaggaataccg

SEQ ID NO: 162188 - DNA, 25 bp, E. coli
tcccttgctatacgcgacagcacga

SEQ ID NO: 162189 - DNA, 25 bp, E. coli
tcgctgcaccgagagaggaataccg

SEQ ID NO: 162190 - DNA, 25 bp, E. coli
tgccggttatccagctcaggaaaac

SEQ ID NO: 162191 - DNA, 25 bp, E. coli
tcccttgctataggcgacagcacga

SEQ ID NO: 162192 - DNA, 25 bp, E. coli
tgccggttatcctgctcaggaaaac

SEQ ID NO: 162193 - DNA, 25 bp, E. coli
cgggtcaggcgatggcgctcaaatt

SEQ ID NO: 162194 - DNA, 25 bp, E. coli
cgggtcaggcgaaggcgctcaaatt

SEQ ID NO: 162195 - DNA, 25 bp, E. coli
cgtcgagaatactggatatttccct

SEQ ID NO: 162196 - DNA, 25 bp, E. coli
cgtcgagaatacaggatatttccct

SEQ ID NO: 162197 - DNA, 25 bp, E. coli
gatatttcccttcctatacgcgaca

SEQ ID NO: 162198 - DNA, 25 bp, E. coli
gatatttcccttgctatacgcgaca

SEQ ID NO: 162199 - DNA, 25 bp, E. coli
ggcgctcaaattcaagtgttccggg

SEQ ID NO: 162200 - DNA, 25 bp, E. coli
ggcgctcaaattgaagtgttccggg

SEQ ID NO: 162201 - DNA, 25 bp, E. coli
aacaactggtgcgtctcctggcgca

SEQ ID NO: 162202 - DNA, 25 bp, E. coli
aacaactggtgcctctcctggcgca

SEQ ID NO: 162203 - DNA, 25 bp, E. coli
aactggtgcgtcacctggcgcacct

SEQ ID NO: 162204 - DNA, 25 bp, E. coli
aactggtgcgtctcctggcgcacct

SEQ ID NO: 162205 - DNA, 25 bp, E. coli
tttgcaacaactcgtgcgtctcctg

SEQ ID NO: 162206 - DNA, 25 bp, E. coli
tttgcaacaactggtgcgtctcctg

SEQ ID NO: 162207 - DNA, 25 bp, E. coli
tttctcctcctgaactattgttgcg

SEQ ID NO: 162208 - DNA, 25 bp, E. coli
tttctcctcctgtactattgttgcg

SEQ ID NO: 162209 - DNA, 25 bp, E. coli
tgcaacaactggtgcgtctcctggc

SEQ ID NO: 162210 - DNA, 25 bp, E. coli
tgcaacaactggagcgtctcctggc

SEQ ID NO: 162211 - DNA, 25 bp, E. coli
tgctgattttgcaacaactggtgcg

SEQ ID NO: 162212 - DNA, 25 bp, E. coli
tgctgattttgctacaactggtgcg

SEQ ID NO: 162213 - DNA, 25 bp, E. coli
tctcctcctgtagtattgttgcgtt

SEQ ID NO: 162214 - DNA, 25 bp, E. coli
tctcctcctgtactattgttgcgtt

SEQ ID NO: 162215 - DNA, 25 bp, E. coli
ctcctgtactattgttgcgtttttg

SEQ ID NO: 162216 - DNA, 25 bp, E. coli
ctcctgtactatagttgcgtttttg

SEQ ID NO: 162217 - DNA, 25 bp, E. coli
gattttgcaacatctggtgcgtctc

SEQ ID NO: 162218 - DNA, 25 bp, E. coli
gattttgcaacaactggtgcgtctc

SEQ ID NO: 162219 - DNA, 25 bp, E. coli
ggtgcgtctcctggcgcaccttttt

SEQ ID NO: 162220 - DNA, 25 bp, E. coli
tggcgcacctttttttctcctcctg

SEQ ID NO: 162221 - DNA, 25 bp, E. coli
ggtgcgtctcctcgcgcaccttttt

SEQ ID NO: 162222 - DNA, 25 bp, E. coli
tggcgcacctttatttctcctcctg

SEQ ID NO: 162223 - DNA, 25 bp, E. coli
caagcaactgcttatctgcccggaa

SEQ ID NO: 162224 - DNA, 25 bp, E. coli
caagcaactgctaatctgcccggaa

SEQ ID NO: 162225 - DNA, 25 bp, E. coli
tataagctctgttggacggaatgtg

SEQ ID NO: 162226 - DNA, 25 bp, E. coli
taaagcataaccacacaggagccag

SEQ ID NO: 162227 - DNA, 25 bp, E. coli
tataagctctgtaggacggaatgtg

SEQ ID NO: 162228 - DNA, 25 bp, E. coli
taaagcataacctcacaggagccag

SEQ ID NO: 162229 - DNA, 25 bp, E. coli
tatgaaaaacggtctggatctgcca

SEQ ID NO: 162230 - DNA, 25 bp, E. coli
tatgaaaaacggactggatctgcca

SEQ ID NO: 162231 - DNA, 25 bp, E. coli
tattcaaaaagatcttcagccggac

SEQ ID NO: 162232 - DNA, 25 bp, E. coli
tattcaaaaagaacttcagccggac

SEQ ID NO: 162233 - DNA, 25 bp, E. coli
gcccggaacgcacaattaaagcata

SEQ ID NO: 162234 - DNA, 25 bp, E. coli
gcccggaacgcagaattaaagcata

SEQ ID NO: 162235 - DNA, 25 bp, E. coli
gacattaacacatgaaggattcctg

SEQ ID NO: 162236 - DNA, 25 bp, E. coli
gacattaacacaagaaggattcctg

SEQ ID NO: 162237 - DNA, 25 bp, E. coli
gaaataaaaatcaggccggtgcgaa

SEQ ID NO: 162238 - DNA, 25 bp, E. coli
gaaataaaaatctggccggtgcgaa

SEQ ID NO: 162239 - DNA, 25 bp, E. coli
taatccagggaaaggctataagctc

SEQ ID NO: 162240 - DNA, 25 bp, E. coli
tcagccggacaaagctataatccag

SEQ ID NO: 162241 - DNA, 25 bp, E. coli
taatccagggaatggctataagctc

SEQ ID NO: 162242 - DNA, 25 bp, E. coli
tcagccggacaatgctataatccag

SEQ ID NO: 162243 - DNA, 25 bp, E. coli
gagccagaatacagtggtcgtacgc

SEQ ID NO: 162244 - DNA, 25 bp, E. coli
gagccagaatactgtggtcgtacgc

SEQ ID NO: 162245 - DNA, 25 bp, E. coli
aatgatacccatgcggtactgtcga

SEQ ID NO: 162246 - DNA, 25 bp, E. coli
aatgatacccatccggtactgtcga

SEQ ID NO: 162247 - DNA, 25 bp, E. coli
taaaatcgcgattcatctcaatgat

SEQ ID NO: 162248 - DNA, 25 bp, E. coli
taaaatcgcgatacatctcaatgat

SEQ ID NO: 162249 - DNA, 25 bp, E. coli
ttcatctcaatgatacccatccggt

SEQ ID NO: 162250 - DNA, 25 bp, E. coli
ttcatctcaatgttacccatccggt

SEQ ID NO: 162251 - DNA, 25 bp, E. coli
tgaatgtggtggagaatccaaaggc

SEQ ID NO: 162252 - DNA, 25 bp, E. coli
tgaatgtggtggtgaatccaaaggc

SEQ ID NO: 162253 - DNA, 25 bp, E. coli
tctgatggtgcattcgttgtttgcc

SEQ ID NO: 162254 - DNA, 25 bp, E. coli
tctgatggtgcaatcgttgtttgcc

SEQ ID NO: 162255 - DNA, 25 bp, E. coli
cgtgctggacgaacacctgggccgt

SEQ ID NO: 162256 - DNA, 25 bp, E. coli
ctggacgaacacgtgggccgtaact

SEQ ID NO: 162257 - DNA, 25 bp, E. coli
ctctaatctgatggtgcaatcgttg

SEQ ID NO: 162258 - DNA, 25 bp, E. coli
ctctaatctgatcgtgcaatcgttg

SEQ ID NO: 162259 - DNA, 25 bp, E. coli
cgtgctggacgatcacctgggccgt

SEQ ID NO: 162260 - DNA, 25 bp, E. coli
ctggacgaacacctgggccgtaact

SEQ ID NO: 162261 - DNA, 25 bp, E. coli
ggtggtgaatccaaaggcgttgttc

SEQ ID NO: 162262 - DNA, 25 bp, E. coli
ggtggtgaatcctaaggcgttgttc

SEQ ID NO: 162263 - DNA, 25 bp, E. coli
ggtgaatccaaacgcgttgttcgat

SEQ ID NO: 162264 - DNA, 25 bp, E. coli
ggataaaatcgcgattcatctcaat

SEQ ID NO: 162265 - DNA, 25 bp, E. coli
ggtgaatccaaaggcgttgttcgat

SEQ ID NO: 162266 - DNA, 25 bp, E. coli
ggataaaatcgccattcatctcaat

SEQ ID NO: 162267 - DNA, 25 bp, E. coli
cagcggcaggtgagtttctcgatat

SEQ ID NO: 162268 - DNA, 25 bp, E. coli
cagcggcaggtgtgtttctcgatat

SEQ ID NO: 162269 - DNA, 25 bp, E. coli
cttcaaaaatggcaccgacggtacg

SEQ ID NO: 162270 - DNA, 25 bp, E. coli
cttcaaaaatgggaccgacggtacg

SEQ ID NO: 162271 - DNA, 25 bp, E. coli
tgagtttctcgaaatgatcacccca

SEQ ID NO: 162272 - DNA, 25 bp, E. coli
tgagtttctcgatatgatcacccca

SEQ ID NO: 162273 - DNA, 25 bp, E. coli
tgccagcggcagctgagtttctcga

SEQ ID NO: 162274 - DNA, 25 bp, E. coli
tgccagcggcaggtgagtttctcga

SEQ ID NO: 162275 - DNA, 25 bp, E. coli
tccggtcggcttcaaaaatggcacc

SEQ ID NO: 162276 - DNA, 25 bp, E. coli
tccggtcggcttgaaaaatggcacc

SEQ ID NO: 162277 - DNA, 25 bp, E. coli
tcagggctttctagtccggtcggct

SEQ ID NO: 162278 - DNA, 25 bp, E. coli
tcagggctttcttgtccggtcggct

SEQ ID NO: 162279 - DNA, 25 bp, E. coli
gcatcagggctttcttgtccggtcg

SEQ ID NO: 162280 - DNA, 25 bp, E. coli
gcatcagggcttacttgtccggtcg

SEQ ID NO: 162281 - DNA, 25 bp, E. coli
gcaccgcgaactggcatcagggctt

SEQ ID NO: 162282 - DNA, 25 bp, E. coli
gcaccgcgaactcgcatcagggctt

SEQ ID NO: 162283 - DNA, 25 bp, E. coli
cgcgaactggcaacagggctttctt

SEQ ID NO: 162284 - DNA, 25 bp, E. coli
cgcgaactggcatcagggctttctt

SEQ ID NO: 162285 - DNA, 25 bp, E. coli
gggctttcttgtccggtcggcttca

SEQ ID NO: 162286 - DNA, 25 bp, E. coli
gggctttcttgtgcggtcggcttca

SEQ ID NO: 162287 - DNA, 25 bp, E. coli
ggcttcaaaaatggcaccgacggta

SEQ ID NO: 162288 - DNA, 25 bp, E. coli
ggcttcaaaaatcgcaccgacggta

SEQ ID NO: 162289 - DNA, 25 bp, E. coli
catactggtactgccgcttgaaggc

SEQ ID NO: 162290 - DNA, 25 bp, E. coli
cagtgccctgagacacgcggcgctg

SEQ ID NO: 162291 - DNA, 25 bp, E. coli
cagtgccctgagtcacgcggcgctg

SEQ ID NO: 162292 - DNA, 25 bp, E. coli
catactggtactcccgcttgaaggc

SEQ ID NO: 162293 - DNA, 25 bp, E. coli
aaagtgtggatgaacacaaaaaggc

SEQ ID NO: 162294 - DNA, 25 bp, E. coli
aaagtgtggatgtacacaaaaaggc

SEQ ID NO: 162295 - DNA, 25 bp, E. coli
tttttgccggtattgatccggctca

SEQ ID NO: 162296 - DNA, 25 bp, E. coli
tttttgccggtaatgatccggctca

SEQ ID NO: 162297 - DNA, 25 bp, E. coli
tctgggacggacagaaagccggtag

SEQ ID NO: 162298 - DNA, 25 bp, E. coli
tctgggacggactgaaagccggtag

SEQ ID NO: 162299 - DNA, 25 bp, E. coli
gtgcggaagtacgtatttttgccgg

SEQ ID NO: 162300 - DNA, 25 bp, E. coli
gaagtacgtattattgccggtaatg

SEQ ID NO: 162301 - DNA, 25 bp, E. coli
gtgcggaagtacctatttttgccgg

SEQ ID NO: 162302 - DNA, 25 bp, E. coli
gaagtacgtatttttgccggtaatg

SEQ ID NO: 162303 - DNA, 25 bp, E. coli
ctggcctgaaagagtggatgaacac

SEQ ID NO: 162304 - DNA, 25 bp, E. coli
ctggcctgaaagtgtggatgaacac

SEQ ID NO: 162305 - DNA, 25 bp, E. coli
gttggcatactggtactgccgcttg

SEQ ID NO: 162306 - DNA, 25 bp, E. coli
gttggcatactgctactgccgcttg

SEQ ID NO: 162307 - DNA, 25 bp, E. coli
ggaaactggtggactgggacggaca

SEQ ID NO: 162308 - DNA, 25 bp, E. coli
ggtactgccgctagaaggcacagag

SEQ ID NO: 162309 - DNA, 25 bp, E. coli
ggaaactggtggtctgggacggaca

SEQ ID NO: 162310 - DNA, 25 bp, E. coli
ggtactgccgcttgaaggcacagag

SEQ ID NO: 162311 - DNA, 25 bp, E. coli
aatcaaatcactatggcgggcctgg

SEQ ID NO: 162312 - DNA, 25 bp, E. coli
aatcaaatcactttggcgggcctgg

SEQ ID NO: 162313 - DNA, 25 bp, E. coli
cacaaaacgtgcagctggaatgcgc

SEQ ID NO: 162314 - DNA, 25 bp, E. coli
cacaaaacgtgctgctggaatgcgc

SEQ ID NO: 162315 - DNA, 25 bp, E. coli
taaacttatttgtcgtgtaccgcgg

SEQ ID NO: 162316 - DNA, 25 bp, E. coli
tacgaagagcactggaacctggcaa

SEQ ID NO: 162317 - DNA, 25 bp, E. coli
tacgaagagcacaggaacctggcaa

SEQ ID NO: 162318 - DNA, 25 bp, E. coli
tacgtcgtagcaaactggatcgcct

SEQ ID NO: 162319 - DNA, 25 bp, E. coli
aaaaactgcgtccttgcgggatccg

SEQ ID NO: 162320 - DNA, 25 bp, E. coli
aaaaactgcgtcgttgcgggatccg

SEQ ID NO: 162321 - DNA, 25 bp, E. coli
tacgtcgtagcatactggatcgcct

SEQ ID NO: 162322 - DNA, 25 bp, E. coli
tatgagcgtggccttgatccggcac

SEQ ID NO: 162323 - DNA, 25 bp, E. coli
tatgagcgtggcgttgatccggcac

SEQ ID NO: 162324 - DNA, 25 bp, E. coli
tggtggtcgcagtaaacgttcccgc

SEQ ID NO: 162325 - DNA, 25 bp, E. coli
tgatatcaccaaggaagcaacgctg

SEQ ID NO: 162326 - DNA, 25 bp, E. coli
tggtggtcgcagaaaacgttcccgc

SEQ ID NO: 162327 - DNA, 25 bp, E. coli
tgatatcaccaacgaagcaacgctg

SEQ ID NO: 162328 - DNA, 25 bp, E. coli
tgaacccggcgattgatagcgatgc

SEQ ID NO: 162329 - DNA, 25 bp, E. coli
tgaacccggcgaatgatagcgatgc

SEQ ID NO: 162330 - DNA, 25 bp, E. coli
gaaatcgttccggttggtgcgacca

SEQ ID NO: 162331 - DNA, 25 bp, E. coli
gaaatcgttccgcttggtgcgacca

SEQ ID NO: 162332 - DNA, 25 bp, E. coli
taaacttatttgacgtgtaccgcgg

SEQ ID NO: 162333 - DNA, 25 bp, E. coli
ttttcactcgccgacaggatgcctt

SEQ ID NO: 162334 - DNA, 25 bp, E. coli
tttataacgatgtagttcgccggac

SEQ ID NO: 162335 - DNA, 25 bp, E. coli
ttttcactcgcccacaggatgcctt

SEQ ID NO: 162336 - DNA, 25 bp, E. coli
tttataacgatgaagttcgccggac

SEQ ID NO: 162337 - DNA, 25 bp, E. coli
tcgccggacattattgcgtcaggct

SEQ ID NO: 162338 - DNA, 25 bp, E. coli
tcgccggacatttttgcgtcaggct

SEQ ID NO: 162339 - DNA, 25 bp, E. coli
tcatactggattaacgcgtcgtagc

SEQ ID NO: 162340 - DNA, 25 bp, E. coli
tcatactggatttacgcgtcgtagc

SEQ ID NO: 162341 - DNA, 25 bp, E. coli
gaaggttaacgtggtcaatattgaa

SEQ ID NO: 162342 - DNA, 25 bp, E. coli
gaacattacgctggcccgcattgat

SEQ ID NO: 162343 - DNA, 25 bp, E. coli
gaacattacgctcgcccgcattgat

SEQ ID NO: 162344 - DNA, 25 bp, E. coli
gaaggttaacgtcgtcaatattgaa

SEQ ID NO: 162345 - DNA, 25 bp, E. coli
ccgcaatatcagcacgaaaccgttt

SEQ ID NO: 162346 - DNA, 25 bp, E. coli
ccgcaatatcaggacgaaaccgttt

SEQ ID NO: 162347 - DNA, 25 bp, E. coli
cgcattattatcagcaatgacgaag

SEQ ID NO: 162348 - DNA, 25 bp, E. coli
cgcattattatctgcaatgacgaag

SEQ ID NO: 162349 - DNA, 25 bp, E. coli
gtagcgtcagatccctcaatcaata

SEQ ID NO: 162350 - DNA, 25 bp, E. coli
ggtttatcacaacccgcaatatcag

SEQ ID NO: 162351 - DNA, 25 bp, E. coli
ggtttatcacaagccgcaatatcag

SEQ ID NO: 162352 - DNA, 25 bp, E. coli
gtagcgtcagatgcctcaatcaata

SEQ ID NO: 162353 - DNA, 25 bp, E. coli
tcaatattgaaaaagccgtcgcggt

SEQ ID NO: 162354 - DNA, 25 bp, E. coli
tcaatattgaaatagccgtcgcggt

SEQ ID NO: 162355 - DNA, 25 bp, E. coli
tatcaacaattaggctggacacgga

SEQ ID NO: 162356 - DNA, 25 bp, E. coli
tatcaacaattacgctggacacgga

SEQ ID NO: 162357 - DNA, 25 bp, E. coli
ttattctcctgatgcccggtacgac

SEQ ID NO: 162358 - DNA, 25 bp, E. coli
ttattctcctgaagcccggtacgac

SEQ ID NO: 162359 - DNA, 25 bp, E. coli
ttaagcattgcctgcgtgccatccg

SEQ ID NO: 162360 - DNA, 25 bp, E. coli
ttaagcattgccagcgtgccatccg

SEQ ID NO: 162361 - DNA, 25 bp, E. coli
tgctgagaacggaaagcgacatctt

SEQ ID NO: 162362 - DNA, 25 bp, E. coli
tgctgagaacggtaagcgacatctt

SEQ ID NO: 162363 - DNA, 25 bp, E. coli
tccggcagacagagaatcgatatct

SEQ ID NO: 162364 - DNA, 25 bp, E. coli
tccggcagacagtgaatcgatatct

SEQ ID NO: 162365 - DNA, 25 bp, E. coli
tcttgcctgtggatcgcgaaacgct

SEQ ID NO: 162366 - DNA, 25 bp, E. coli
tcttgcctgtggttcgcgaaacgct

SEQ ID NO: 162367 - DNA, 25 bp, E. coli
gacaggcacgttgcgcttgctgaga

SEQ ID NO: 162368 - DNA, 25 bp, E. coli
gaacgcgatttatctttccggcaga

SEQ ID NO: 162369 - DNA, 25 bp, E. coli
gacaggcacgttccgcttgctgaga

SEQ ID NO: 162370 - DNA, 25 bp, E. coli
gaacgcgatttaactttccggcaga

SEQ ID NO: 162371 - DNA, 25 bp, E. coli
gggcgacccgctggaagcttatcaa

SEQ ID NO: 162372 - DNA, 25 bp, E. coli
gggcgacccgctcgaagcttatcaa

SEQ ID NO: 162373 - DNA, 25 bp, E. coli
taatacgtggaagagattggcgctc

SEQ ID NO: 162374 - DNA, 25 bp, E. coli
taatacgtggaacagattggcgctc

SEQ ID NO: 162375 - DNA, 25 bp, E. coli
tcagagcgtaaatgtggcgatgcgc

SEQ ID NO: 162376 - DNA, 25 bp, E. coli
tcagagcgtaaaagtggcgatgcgc

SEQ ID NO: 162377 - DNA, 25 bp, E. coli
cagtcccgaaatcaaggcttgccgt

SEQ ID NO: 162378 - DNA, 25 bp, E. coli
cagtcccgaaatgaaggcttgccgt

SEQ ID NO: 162379 - DNA, 25 bp, E. coli
tacgggaggttaggataaagcgaca

SEQ ID NO: 162380 - DNA, 25 bp, E. coli
tacgggaggttacgataaagcgaca

SEQ ID NO: 162381 - DNA, 25 bp, E. coli
ataaagtgccggtagagcccatcca

SEQ ID NO: 162382 - DNA, 25 bp, E. coli
ataaagtgccggaagagcccatcca

SEQ ID NO: 162383 - DNA, 25 bp, E. coli
tatgccagcataagggtatcgccgt

SEQ ID NO: 162384 - DNA, 25 bp, E. coli
tatgccagcatatgggtatcgccgt

SEQ ID NO: 162385 - DNA, 25 bp, E. coli
tatcggtgaaggtaagcgaccagcg

SEQ ID NO: 162386 - DNA, 25 bp, E. coli
tatcggtgaaggaaagcgaccagcg

SEQ ID NO: 162387 - DNA, 25 bp, E. coli
tgtcgcgtgcgctgctaacattacg

SEQ ID NO: 162388 - DNA, 25 bp, E. coli
tgtcgcgtgcgcagctaacattacg

SEQ ID NO: 162389 - DNA, 25 bp, E. coli
tcgtgaagccatcgactgggcagcc

SEQ ID NO: 162390 - DNA, 25 bp, E. coli
tcgtgaagccatggactgggcagcc

SEQ ID NO: 162391 - DNA, 25 bp, E. coli
gcagaagtcttaacgcgcatcctgg

SEQ ID NO: 162392 - DNA, 25 bp, E. coli
gcagaagtcttatcgcgcatcctgg

SEQ ID NO: 162393 - DNA, 25 bp, E. coli
ccctggactgttctgatcgtgaagc

SEQ ID NO: 162394 - DNA, 25 bp, E. coli
ccctggactgttgtgatcgtgaagc

SEQ ID NO: 162395 - DNA, 25 bp, E. coli
gttacatgacaaaccatcacggctg

SEQ ID NO: 162396 - DNA, 25 bp, E. coli
gttacatgacaatccatcacggctg

SEQ ID NO: 162397 - DNA, 25 bp, E. coli
tgatggcgaaaaagtccgggttacg

SEQ ID NO: 162398 - DNA, 25 bp, E. coli
tgatggcgaaaatgtccgggttacg

SEQ ID NO: 162399 - DNA, 25 bp, E. coli
cttcccaacgaaaccgcaattaaat

SEQ ID NO: 162400 - DNA, 25 bp, E. coli
cccaacgaatccccaattaaatatt

SEQ ID NO: 162401 - DNA, 25 bp, E. coli
cccaacgaatccgcaattaaatatt

SEQ ID NO: 162402 - DNA, 25 bp, E. coli
cttcccaacgaatccgcaattaaat

SEQ ID NO: 162403 - DNA, 25 bp, E. coli
tgaacttcccaacgaatccgcaatt

SEQ ID NO: 162404 - DNA, 25 bp, E. coli
tgaacttcccaaggaatccgcaatt

SEQ ID NO: 162405 - DNA, 25 bp, E. coli
tcccaacgaatcggcaattaaatat

SEQ ID NO: 162406 - DNA, 25 bp, E. coli
tcccaacgaatccgcaattaaatat

SEQ ID NO: 162407 - DNA, 25 bp, E. coli
ttcccaacgaatgcgcaattaaata

SEQ ID NO: 162408 - DNA, 25 bp, E. coli
ttcccaacgaatccgcaattaaata

SEQ ID NO: 162409 - DNA, 25 bp, E. coli
gaacttcccaaccaatccgcaatta

SEQ ID NO: 162410 - DNA, 25 bp, E. coli
gaacttcccaacgaatccgcaatta

SEQ ID NO: 162411 - DNA, 25 bp, E. coli
cctgaacttcccaacgaatccgcaa

SEQ ID NO: 162412 - DNA, 25 bp, E. coli
ccctgaacttcccaacgaatccgca

SEQ ID NO: 162413 - DNA, 25 bp, E. coli
ccctgaacttccgaacgaatccgca

SEQ ID NO: 162414 - DNA, 25 bp, E. coli
cctgaacttccctacgaatccgcaa

SEQ ID NO: 162415 - DNA, 25 bp, E. coli
ctgaacttcccatcgaatccgcaat

SEQ ID NO: 162416 - DNA, 25 bp, E. coli
ctgaacttcccaacgaatccgcaat

SEQ ID NO: 162417 - DNA, 25 bp, E. coli
gtccctgaacttgccaacgaatccg

SEQ ID NO: 162418 - DNA, 25 bp, E. coli
gtccctgaacttcccaacgaatccg

SEQ ID NO: 162419 - DNA, 25 bp, E. coli
tccctgaacttcgcaacgaatccgc

SEQ ID NO: 162420 - DNA, 25 bp, E. coli
tccctgaacttcccaacgaatccgc

SEQ ID NO: 162421 - DNA, 25 bp, E. coli
caacggcgatgggggagagcatcaa

SEQ ID NO: 162422 - DNA, 25 bp, E. coli
caacggcgatggcggagagcatcaa

SEQ ID NO: 162423 - DNA, 25 bp, E. coli
atgacaacggcgatggcggagagca

SEQ ID NO: 162424 - DNA, 25 bp, E. coli
atgacaacggcgttggcggagagca

SEQ ID NO: 162425 - DNA, 25 bp, E. coli
agaagtggaactggccacactcacg

SEQ ID NO: 162426 - DNA, 25 bp, E. coli
agaagtggaactcgccacactcacg

SEQ ID NO: 162427 - DNA, 25 bp, E. coli
acaacggcgatgccggagagcatca

SEQ ID NO: 162428 - DNA, 25 bp, E. coli
acaacggcgatggcggagagcatca

SEQ ID NO: 162429 - DNA, 25 bp, E. coli
tgggtggactggtataacaatcgac

SEQ ID NO: 162430 - DNA, 25 bp, E. coli
tgggtggactggaataacaatcgac

SEQ ID NO: 162431 - DNA, 25 bp, E. coli
tgacaacggcgaaggcggagagcat

SEQ ID NO: 162432 - DNA, 25 bp, E. coli
tgctggaaaggctgggccatactcc

SEQ ID NO: 162433 - DNA, 25 bp, E. coli
tgacaacggcgatggcggagagcat

SEQ ID NO: 162434 - DNA, 25 bp, E. coli
tgctggaaaggcagggccatactcc

SEQ ID NO: 162435 - DNA, 25 bp, E. coli
gaaaggctgggccatactcctccgg

SEQ ID NO: 162436 - DNA, 25 bp, E. coli
gacaacggcgatggcggagagcatc

SEQ ID NO: 162437 - DNA, 25 bp, E. coli
gaaaggctgggcgatactcctccgg

SEQ ID NO: 162438 - DNA, 25 bp, E. coli
gacaacggcgatcgcggagagcatc

SEQ ID NO: 162439 - DNA, 25 bp, E. coli
ccgtaagagctgcgaaaaccgtgca

SEQ ID NO: 162440 - DNA, 25 bp, E. coli
ccgtaagagctgggaaaaccgtgca

SEQ ID NO: 162441 - DNA, 25 bp, E. coli
gattgctggaaaggctgggccatac

SEQ ID NO: 162442 - DNA, 25 bp, E. coli
gattgctggaaacgctgggccatac

SEQ ID NO: 162443 - DNA, 25 bp, E. coli
caactttcacatgacgggaagggac

SEQ ID NO: 162444 - DNA, 25 bp, E. coli
caactttcacatcacgggaagggac

SEQ ID NO: 162445 - DNA, 25 bp, E. coli
cattacagccaggagagttttcgaa

SEQ ID NO: 162446 - DNA, 25 bp, E. coli
cattacagccagcagagttttcgaa

SEQ ID NO: 162447 - DNA, 25 bp, E. coli
tagcgtcgcgaacgtgcagtttgtc

SEQ ID NO: 162448 - DNA, 25 bp, E. coli
tagcgtcgcgaaggtgcagtttgtc

SEQ ID NO: 162449 - DNA, 25 bp, E. coli
ttcactttcgcgctgatggcgctgt

SEQ ID NO: 162450 - DNA, 25 bp, E. coli
ttcactttcgcggtgatggcgctgt

SEQ ID NO: 162451 - DNA, 25 bp, E. coli
tcgcgacggcagtggtcaacattac

SEQ ID NO: 162452 - DNA, 25 bp, E. coli
tcgcgacggcagaggtcaacattac

SEQ ID NO: 162453 - DNA, 25 bp, E. coli
tcttgatgttgtgatgatccaccag

SEQ ID NO: 162454 - DNA, 25 bp, E. coli
tcagggtcacgactttttgatcggt

SEQ ID NO: 162455 - DNA, 25 bp, E. coli
tcttgatgttgtcatgatccaccag

SEQ ID NO: 162456 - DNA, 25 bp, E. coli
tcagggtcacgagtttttgatcggt

SEQ ID NO: 162457 - DNA, 25 bp, E. coli
gccctgcgctttcattggtagtctg

SEQ ID NO: 162458 - DNA, 25 bp, E. coli
gccctgcgctttgattggtagtctg

SEQ ID NO: 162459 - DNA, 25 bp, E. coli
ggctttcaacgataccgctcagggt

SEQ ID NO: 162460 - DNA, 25 bp, E. coli
ggctttcaacgaaaccgctcagggt

SEQ ID NO: 162461 - DNA, 25 bp, E. coli
ggcgctgtcatccatgaaattaccg

SEQ ID NO: 162462 - DNA, 25 bp, E. coli
ggcgctgtcatcgatgaaattaccg

SEQ ID NO: 162463 - DNA, 25 bp, E. coli
gagctatcgactatttgccctgcgc

SEQ ID NO: 162464 - DNA, 25 bp, E. coli
gagctatcgactttttgccctgcgc

SEQ ID NO: 162465 - DNA, 25 bp, E. coli
ctttacggtggataaaggtgacatt

SEQ ID NO: 162466 - DNA, 25 bp, E. coli
ctttacggtggaaaaaggtgacatt

SEQ ID NO: 162467 - DNA, 25 bp, E. coli
tgatagttctgttctggatatggcg

SEQ ID NO: 162468 - DNA, 25 bp, E. coli
tgatagttctgtactggatatggcg

SEQ ID NO: 162469 - DNA, 25 bp, E. coli
tgtcacgttaatggggccgtctggc

SEQ ID NO: 162470 - DNA, 25 bp, E. coli
tgtcacgttaatcgggccgtctggc

SEQ ID NO: 162471 - DNA, 25 bp, E. coli
tctccaggatgttcctgctgatagt

SEQ ID NO: 162472 - DNA, 25 bp, E. coli
tctccaggatgtacctgctgatagt

SEQ ID NO: 162473 - DNA, 25 bp, E. coli
tcaggtaacgcacgatctccaggat

SEQ ID NO: 162474 - DNA, 25 bp, E. coli
tcaggtaacgcaggatctccaggat

SEQ ID NO: 162475 - DNA, 25 bp, E. coli
cctgctgatagttctgttctggata

SEQ ID NO: 162476 - DNA, 25 bp, E. coli
cctgctgatagtactgttctggata

SEQ ID NO: 162477 - DNA, 25 bp, E. coli
ccgtcgttcaggtaacgcacgatct

SEQ ID NO: 162478 - DNA, 25 bp, E. coli
ccgtcgttcaggaaacgcacgatct

SEQ ID NO: 162479 - DNA, 25 bp, E. coli
gttcaggtaacggacgatctccagg

SEQ ID NO: 162480 - DNA, 25 bp, E. coli
gttcaggtaacgcacgatctccagg

SEQ ID NO: 162481 - DNA, 25 bp, E. coli
ggatgttcctgcagatagttctgtt

SEQ ID NO: 162482 - DNA, 25 bp, E. coli
ggatgttcctgctgatagttctgtt

SEQ ID NO: 162483 - DNA, 25 bp, E. coli
tggcgatccccgtcgttcaggtaac

SEQ ID NO: 162484 - DNA, 25 bp, E. coli
tggcgatccccgacgttcaggtaac

SEQ ID NO: 162485 - DNA, 25 bp, E. coli
gatccccgtcgtacaggtaacgcac

SEQ ID NO: 162486 - DNA, 25 bp, E. coli
gatccccgtcgttcaggtaacgcac

SEQ ID NO: 162487 - DNA, 25 bp, E. coli
caactgacggcggataaagtcgttc

SEQ ID NO: 162488 - DNA, 25 bp, E. coli
caactgacggcgcataaagtcgttc

SEQ ID NO: 162489 - DNA, 25 bp, E. coli
agtcgttcctgcgttaatcagccag

SEQ ID NO: 162490 - DNA, 25 bp, E. coli
agtcgttcctgccttaatcagccag

SEQ ID NO: 162491 - DNA, 25 bp, E. coli
tctctgacgggaacacaaaggtgga

SEQ ID NO: 162492 - DNA, 25 bp, E. coli
tctctgacgggatcacaaaggtgga

SEQ ID NO: 162493 - DNA, 25 bp, E. coli
ccagctggaggtattgcgtgatgaa

SEQ ID NO: 162494 - DNA, 25 bp, E. coli
ccagctggaggttttgcgtgatgaa

SEQ ID NO: 162495 - DNA, 25 bp, E. coli
gcggataaagtcgttcctgcgttaa

SEQ ID NO: 162496 - DNA, 25 bp, E. coli
gctcggcagcctgaatgcgtgaata

SEQ ID NO: 162497 - DNA, 25 bp, E. coli
gcggataaagtccttcctgcgttaa

SEQ ID NO: 162498 - DNA, 25 bp, E. coli
gctcggcagcctcaatgcgtgaata

SEQ ID NO: 162499 - DNA, 25 bp, E. coli
ccggaaacggtcactgacgggatca

SEQ ID NO: 162500 - DNA, 25 bp, E. coli
gcagtcatctgatgaattttcgtca

SEQ ID NO: 162501 - DNA, 25 bp, E. coli
cgatggcggacgttggtcaactgac

SEQ ID NO: 162502 - DNA, 25 bp, E. coli
ccggaaacggtctctgacgggatca

SEQ ID NO: 162503 - DNA, 25 bp, E. coli
gcagtcatctgaagaattttcgtca

SEQ ID NO: 162504 - DNA, 25 bp, E. coli
cgatggcggacgatggtcaactgac

SEQ ID NO: 162505 - DNA, 25 bp, E. coli
gtattgcgtgatgaatacgcggcca

SEQ ID NO: 162506 - DNA, 25 bp, E. coli
gtattgcgtgatcaatacgcggcca

SEQ ID NO: 162507 - DNA, 25 bp, E. coli
taatcagccagcaggaggtattgcg

SEQ ID NO: 162508 - DNA, 25 bp, E. coli
taatcagccagctggaggtattgcg

SEQ ID NO: 162509 - DNA, 25 bp, E. coli
caatagcctacgactggtggcggca

SEQ ID NO: 162510 - DNA, 25 bp, E. coli
caatagcctacgtctggtggcggca

SEQ ID NO: 162511 - DNA, 25 bp, E. coli
ctaaagccgtagtgcacaccgtcgg

SEQ ID NO: 162512 - DNA, 25 bp, E. coli
ctaaagccgtagagcacaccgtcgg

SEQ ID NO: 162513 - DNA, 25 bp, E. coli
aaaacgcgtattcatgttgtgcagg

SEQ ID NO: 162514 - DNA, 25 bp, E. coli
aactggccgttgatgtgattgtgaa

SEQ ID NO: 162515 - DNA, 25 bp, E. coli
aaaacgcgtattgatgttgtgcagg

SEQ ID NO: 162516 - DNA, 25 bp, E. coli
aactggccgttgttgtgattgtgaa

SEQ ID NO: 162517 - DNA, 25 bp, E. coli
tcagaatttattacccgtcacgctt

SEQ ID NO: 162518 - DNA, 25 bp, E. coli
tcagaatttatttcccgtcacgctt

SEQ ID NO: 162519 - DNA, 25 bp, E. coli
gcaggatgcctaactcaatagccta

SEQ ID NO: 162520 - DNA, 25 bp, E. coli
gcaggatgcctatctcaatagccta

SEQ ID NO: 162521 - DNA, 25 bp, E. coli
gaagaccagcttatgcaggatgcct

SEQ ID NO: 162522 - DNA, 25 bp, E. coli
gaagaccagcttttgcaggatgcct

SEQ ID NO: 162523 - DNA, 25 bp, E. coli
ggtggtgaacaatacgaagaccagc

SEQ ID NO: 162524 - DNA, 25 bp, E. coli
ggtggtgaacaaaacgaagaccagc

SEQ ID NO: 162525 - DNA, 25 bp, E. coli
ggctgaaatcgcagtaaaaaccgtt

SEQ ID NO: 162526 - DNA, 25 bp, E. coli
ggctgaaatcgctgtaaaaaccgtt

SEQ ID NO: 162527 - DNA, 25 bp, E. coli
ggcggcaaacagctatacgtcagtg

SEQ ID NO: 162528 - DNA, 25 bp, E. coli
ggcggcaaacaggtatacgtcagtg

SEQ ID NO: 162529 - DNA, 25 bp, E. coli
ggcttttcctgcaatcagtactggg

SEQ ID NO: 162530 - DNA, 25 bp, E. coli
ggcttttcctgctatcagtactggg

SEQ ID NO: 162531 - DNA, 25 bp, E. coli
tacaacctggaacaaattgatcgct

SEQ ID NO: 162532 - DNA, 25 bp, E. coli
tacaacctggaagaaattgatcgct

SEQ ID NO: 162533 - DNA, 25 bp, E. coli
aacagtccatgcatttacaacctgg

SEQ ID NO: 162534 - DNA, 25 bp, E. coli
aacagtccatgcttttacaacctgg

SEQ ID NO: 162535 - DNA, 25 bp, E. coli
tatccgaagagcagttaattgcgct

SEQ ID NO: 162536 - DNA, 25 bp, E. coli
tatccgaagagctgttaattgcgct

SEQ ID NO: 162537 - DNA, 25 bp, E. coli
tctcccggcaaatgggtatccgaag

SEQ ID NO: 162538 - DNA, 25 bp, E. coli
tctcccggcaaaagggtatccgaag

SEQ ID NO: 162539 - DNA, 25 bp, E. coli
gcatgtcgctcatgacggtatgcca

SEQ ID NO: 162540 - DNA, 25 bp, E. coli
gcatgtcgctcaagacggtatgcca

SEQ ID NO: 162541 - DNA, 25 bp, E. coli
gaaattgatcgctggattgagcgcc

SEQ ID NO: 162542 - DNA, 25 bp, E. coli
gaaattgatcgcaggattgagcgcc

SEQ ID NO: 162543 - DNA, 25 bp, E. coli
gattgagcgccacgcatcagcaaga

SEQ ID NO: 162544 - DNA, 25 bp, E. coli
gattgagcgccaggcatcagcaaga

SEQ ID NO: 162545 - DNA, 25 bp, E. coli
ggtatgccatggcataacagtccat

SEQ ID NO: 162546 - DNA, 25 bp, E. coli
gtaatcatgattgtctctcccggca

SEQ ID NO: 162547 - DNA, 25 bp, E. coli
gtaatcatgattctctctcccggca

SEQ ID NO: 162548 - DNA, 25 bp, E. coli
ggtatgccatgggataacagtccat

SEQ ID NO: 162549 - DNA, 25 bp, E. coli
ggcatcagcaagaccaagacgtcat

SEQ ID NO: 162550 - DNA, 25 bp, E. coli
ggaagggaatattagcatgtcgctc

SEQ ID NO: 162551 - DNA, 25 bp, E. coli
ggcatcagcaagtccaagacgtcat

SEQ ID NO: 162552 - DNA, 25 bp, E. coli
ggaagggaatataagcatgtcgctc

SEQ ID NO: 162553 - DNA, 25 bp, E. coli
aattagcggcactactcggtatcgg

SEQ ID NO: 162554 - DNA, 25 bp, E. coli
aattagcggcacaactcggtatcgg

SEQ ID NO: 162555 - DNA, 25 bp, E. coli
tatcgtccgtctgatggtaggccgc

SEQ ID NO: 162556 - DNA, 25 bp, E. coli
tatcgtccgtctcatggtaggccgc

SEQ ID NO: 162557 - DNA, 25 bp, E. coli
tatcgactggcgagaaatgcgtgtc

SEQ ID NO: 162558 - DNA, 25 bp, E. coli
tatcgactggcgtgaaatgcgtgtc

SEQ ID NO: 162559 - DNA, 25 bp, E. coli
ttacaaagtgatccgccaactggcg

SEQ ID NO: 162560 - DNA, 25 bp, E. coli
ttacaaagtgatgcgccaactggcg

SEQ ID NO: 162561 - DNA, 25 bp, E. coli
ttacatcactgaaagccgccgggat

SEQ ID NO: 162562 - DNA, 25 bp, E. coli
ttacatcactgatagccgccgggat

SEQ ID NO: 162563 - DNA, 25 bp, E. coli
tgaagttgacgaccaacgtaccgct

SEQ ID NO: 162564 - DNA, 25 bp, E. coli
tgaagttgacgagcaacgtaccgct

SEQ ID NO: 162565 - DNA, 25 bp, E. coli
gaaattatcaccctctgcgaccgca

SEQ ID NO: 162566 - DNA, 25 bp, E. coli
gaaagtcctgatgtccaaatggctg

SEQ ID NO: 162567 - DNA, 25 bp, E. coli
gaaattgccaaatcgctgatgctcg

SEQ ID NO: 162568 - DNA, 25 bp, E. coli
gaaagtcctgatctccaaatggctg

SEQ ID NO: 162569 - DNA, 25 bp, E. coli
gaaattatcaccgtctgcgaccgca

SEQ ID NO: 162570 - DNA, 25 bp, E. coli
gaaattgccaaaacgctgatgctcg

SEQ ID NO: 162571 - DNA, 25 bp, E. coli
gatatctcatttagcgtctgccggg

SEQ ID NO: 162572 - DNA, 25 bp, E. coli
gatatctcattttgcgtctgccggg

SEQ ID NO: 162573 - DNA, 25 bp, E. coli
tggtccggttcacgcattaaagtcg

SEQ ID NO: 162574 - DNA, 25 bp, E. coli
tggtccggttcaggcattaaagtcg

SEQ ID NO: 162575 - DNA, 25 bp, E. coli
ttctgtagcggaagaacgcagcaaa

SEQ ID NO: 162576 - DNA, 25 bp, E. coli
ttctgtagcggatgaacgcagcaaa

SEQ ID NO: 162577 - DNA, 25 bp, E. coli
tgtagcggaagaacgcagcaaaatt

SEQ ID NO: 162578 - DNA, 25 bp, E. coli
tgtagcggaagatcgcagcaaaatt

SEQ ID NO: 162579 - DNA, 25 bp, E. coli
tctgtagcggaacaacgcagcaaaa

SEQ ID NO: 162580 - DNA, 25 bp, E. coli
tctgtagcggaagaacgcagcaaaa

SEQ ID NO: 162581 - DNA, 25 bp, E. coli
ccttctgtagcgcaagaacgcagca

SEQ ID NO: 162582 - DNA, 25 bp, E. coli
ccttctgtagcggaagaacgcagca

SEQ ID NO: 162583 - DNA, 25 bp, E. coli
ctgtagcggaagtacgcagcaaaat

SEQ ID NO: 162584 - DNA, 25 bp, E. coli
cttctgtagcggtagaacgcagcaa

SEQ ID NO: 162585 - DNA, 25 bp, E. coli
cttctgtagcggaagaacgcagcaa

SEQ ID NO: 162586 - DNA, 25 bp, E. coli
ctgtagcggaagaacgcagcaaaat

SEQ ID NO: 162587 - DNA, 25 bp, E. coli
gtaaaccttctgaagcggaagaacg

SEQ ID NO: 162588 - DNA, 25 bp, E. coli
gtaaaccttctgtagcggaagaacg

SEQ ID NO: 162589 - DNA, 25 bp, E. coli
tgggtaaaccttctgtagcggaaga

SEQ ID NO: 162590 - DNA, 25 bp, E. coli
tgggtaaaccttgtgtagcggaaga

SEQ ID NO: 162591 - DNA, 25 bp, E. coli
taacgtgggtaaaccttctgtagcg

SEQ ID NO: 162592 - DNA, 25 bp, E. coli
taacgtgggtaatccttctgtagcg

SEQ ID NO: 162593 - DNA, 25 bp, E. coli
gtgggtaaacctactgtagcggaag

SEQ ID NO: 162594 - DNA, 25 bp, E. coli
gtgggtaaaccttctgtagcggaag

SEQ ID NO: 162595 - DNA, 25 bp, E. coli
cacattgaaggcgaagagcagcttg

SEQ ID NO: 162596 - DNA, 25 bp, E. coli
caaagtctggcaaattctgcagggc

SEQ ID NO: 162597 - DNA, 25 bp, E. coli
caaagtctggcatattctgcagggc

SEQ ID NO: 162598 - DNA, 25 bp, E. coli
cacattgaaggccaagagcagcttg

SEQ ID NO: 162599 - DNA, 25 bp, E. coli
tactatcgctttcaccaggtagggc

SEQ ID NO: 162600 - DNA, 25 bp, E. coli
taaaatcgtcgatgtgctgggcgac

SEQ ID NO: 162601 - DNA, 25 bp, E. coli
taaaatcgtcgaagtgctgggcgac

SEQ ID NO: 162602 - DNA, 25 bp, E. coli
tactatcgctttgaccaggtagggc

SEQ ID NO: 162603 - DNA, 25 bp, E. coli
tttagcctgatctccagcgaacgcg

SEQ ID NO: 162604 - DNA, 25 bp, E. coli
tttagcctgatcaccagcgaacgcg

SEQ ID NO: 162605 - DNA, 25 bp, E. coli
tgaaattccgtacatctggccgcag

SEQ ID NO: 162606 - DNA, 25 bp, E. coli
tgaaattccgtagatctggccgcag

SEQ ID NO: 162607 - DNA, 25 bp, E. coli
tctacgaagcggagatgagctctca

SEQ ID NO: 162608 - DNA, 25 bp, E. coli
tctacgaagcggtgatgagctctca

SEQ ID NO: 162609 - DNA, 25 bp, E. coli
gacttcatgctcgaccaggtaggta

SEQ ID NO: 162610 - DNA, 25 bp, E. coli
gacttcatgctccaccaggtaggta

SEQ ID NO: 162611 - DNA, 25 bp, E. coli
cgtattgtccgcgtactggtgccaa

SEQ ID NO: 162612 - DNA, 25 bp, E. coli
cgtattgtccgcctactggtgccaa

SEQ ID NO: 162613 - DNA, 25 bp, E. coli
cattcatggcgaacaggtgctggct

SEQ ID NO: 162614 - DNA, 25 bp, E. coli
cattcatggcgatcaggtgctggct

SEQ ID NO: 162615 - DNA, 25 bp, E. coli
gatttgtatctcaccagcgagcaga

SEQ ID NO: 162616 - DNA, 25 bp, E. coli
gatttgtatctctccagcgagcaga

SEQ ID NO: 162617 - DNA, 25 bp, E. coli
tacaagtcgcactgaggaggcagag

SEQ ID NO: 162618 - DNA, 25 bp, E. coli
tacaagtcgcacagaggaggcagag

SEQ ID NO: 162619 - DNA, 25 bp, E. coli
taaatccatgaactcgtcagcaggc

SEQ ID NO: 162620 - DNA, 25 bp, E. coli
taaatccatgaagtcgtcagcaggc

SEQ ID NO: 162621 - DNA, 25 bp, E. coli
aaaatttcgacactggctgagggcg

SEQ ID NO: 162622 - DNA, 25 bp, E. coli
actgcagcacaggtctttggcggaa

SEQ ID NO: 162623 - DNA, 25 bp, E. coli
aaaatttcgacagtggctgagggcg

SEQ ID NO: 162624 - DNA, 25 bp, E. coli
actgcagcacagctctttggcggaa

SEQ ID NO: 162625 - DNA, 25 bp, E. coli
tatggatgggcaaactaaagcgctg

SEQ ID NO: 162626 - DNA, 25 bp, E. coli
tagtgacgccctgtgctgctgagga

SEQ ID NO: 162627 - DNA, 25 bp, E. coli
tagtgacgccctctgctgctgagga

SEQ ID NO: 162628 - DNA, 25 bp, E. coli
tatggatgggcatactaaagcgctg

SEQ ID NO: 162629 - DNA, 25 bp, E. coli
tctatggccgcaagcattctgacag

SEQ ID NO: 162630 - DNA, 25 bp, E. coli
tctatggccgcatgcattctgacag

SEQ ID NO: 162631 - DNA, 25 bp, E. coli
gcgagttacaaattcaggcgagcta

SEQ ID NO: 162632 - DNA, 25 bp, E. coli
gcgagttacaaaatcaggcgagcta

SEQ ID NO: 162633 - DNA, 25 bp, E. coli
gaataatgaggctgcgcaactccaa

SEQ ID NO: 162634 - DNA, 25 bp, E. coli
gaagctcgagctggataaagcggca

SEQ ID NO: 162635 - DNA, 25 bp, E. coli
gaagctcgagctcgataaagcggca

SEQ ID NO: 162636 - DNA, 25 bp, E. coli
gaataatgaggcagcgcaactccaa

SEQ ID NO: 162637 - DNA, 25 bp, E. coli
ggtgaataccgtagaccctcagcaa

SEQ ID NO: 162638 - DNA, 25 bp, E. coli
ggtgaataccgttgaccctcagcaa

SEQ ID NO: 162639 - DNA, 25 bp, E. coli
cacggttttaattcatgtccacgta

SEQ ID NO: 162640 - DNA, 25 bp, E. coli
cacggttttaatacatgtccacgta

SEQ ID NO: 162641 - DNA, 25 bp, E. coli
acggttttaattgatgtccacgtat

SEQ ID NO: 162642 - DNA, 25 bp, E. coli
acggttttaattcatgtccacgtat

SEQ ID NO: 162643 - DNA, 25 bp, E. coli
tgcgcgtattttcacccattgacaa

SEQ ID NO: 162644 - DNA, 25 bp, E. coli
tgaaatttgaacttcctcacggttt

SEQ ID NO: 162645 - DNA, 25 bp, E. coli
tgaaatttgaacatcctcacggttt

SEQ ID NO: 162646 - DNA, 25 bp, E. coli
tgcgcgtattttgacccattgacaa

SEQ ID NO: 162647 - DNA, 25 bp, E. coli
gacaatgtttttcgcggtggcatga

SEQ ID NO: 162648 - DNA, 25 bp, E. coli
gacaatgtttttggcggtggcatga

SEQ ID NO: 162649 - DNA, 25 bp, E. coli
cggttttaattcatgtccacgtata

SEQ ID NO: 162650 - DNA, 25 bp, E. coli
cggttttaattcttgtccacgtata

SEQ ID NO: 162651 - DNA, 25 bp, E. coli
gttttaattcatgtccacgtatacc

SEQ ID NO: 162652 - DNA, 25 bp, E. coli
gttttaattcatctccacgtatacc

SEQ ID NO: 162653 - DNA, 25 bp, E. coli
ggttttaattcatgtccacgtatac

SEQ ID NO: 162654 - DNA, 25 bp, E. coli
ggttttaattcaagtccacgtatac

SEQ ID NO: 162655 - DNA, 25 bp, E. coli
ggcatgatgcgcttgaaatttgaac

SEQ ID NO: 162656 - DNA, 25 bp, E. coli
ggcatgatgcgcatgaaatttgaac

SEQ ID NO: 162657 - DNA, 25 bp, E. coli
tcacggttttaattcatgtccacgt

SEQ ID NO: 162658 - DNA, 25 bp, E. coli
tcacggttttaaatcatgtccacgt

SEQ ID NO: 162659 - DNA, 25 bp, E. coli
gatgcgcatgaattttgaacttcct

SEQ ID NO: 162660 - DNA, 25 bp, E. coli
gatgcgcatgaaatttgaacttcct

SEQ ID NO: 162661 - DNA, 25 bp, E. coli
caaacgtcgcgcccttactaaagca

SEQ ID NO: 162662 - DNA, 25 bp, E. coli
caaacgtcgcgcgcttactaaagca

SEQ ID NO: 162663 - DNA, 25 bp, E. coli
tactgttgttttgagcgaattaaga

SEQ ID NO: 162664 - DNA, 25 bp, E. coli
tactgttgttttcagcgaattaaga

SEQ ID NO: 162665 - DNA, 25 bp, E. coli
ttagcttgagcgcaaggattcagtt

SEQ ID NO: 162666 - DNA, 25 bp, E. coli
ttgagcggaaggattcagttgcaga

SEQ ID NO: 162667 - DNA, 25 bp, E. coli
ttagcttgagcggaaggattcagtt

SEQ ID NO: 162668 - DNA, 25 bp, E. coli
ttgagcggaaggtttcagttgcaga

SEQ ID NO: 162669 - DNA, 25 bp, E. coli
tccggcctacaatgggcgcaaacgt

SEQ ID NO: 162670 - DNA, 25 bp, E. coli
tccggcctacaaagggcgcaaacgt

SEQ ID NO: 162671 - DNA, 25 bp, E. coli
ctacaaagggcggaaacgtcgcgcc

SEQ ID NO: 162672 - DNA, 25 bp, E. coli
ctacaaagggcgcaaacgtcgcgcc

SEQ ID NO: 162673 - DNA, 25 bp, E. coli
gggcgcaaacgtcgcgcccttacta

SEQ ID NO: 162674 - DNA, 25 bp, E. coli
gggcgcaaacgtggcgcccttacta

SEQ ID NO: 162675 - DNA, 25 bp, E. coli
ggcatattcggtgcggcgtttcctg

SEQ ID NO: 162676 - DNA, 25 bp, E. coli
ggcatattcggtccggcgtttcctg

SEQ ID NO: 162677 - DNA, 25 bp, E. coli
tacttaagaggcttattcggtccgg

SEQ ID NO: 162678 - DNA, 25 bp, E. coli
taagaggcatatacggtccggcgtt

SEQ ID NO: 162679 - DNA, 25 bp, E. coli
tacttaagaggcatattcggtccgg

SEQ ID NO: 162680 - DNA, 25 bp, E. coli
taagaggcatattcggtccggcgtt

SEQ ID NO: 162681 - DNA, 25 bp, E. coli
gatgctttcctcattcttttactgt

SEQ ID NO: 162682 - DNA, 25 bp, E. coli
gatgctttcctctttcttttactgt

SEQ ID NO: 162683 - DNA, 25 bp, E. coli
cacactgggaacgattaaggtaagc

SEQ ID NO: 162684 - DNA, 25 bp, E. coli
cacactgggaaccattaaggtaagc

SEQ ID NO: 162685 - DNA, 25 bp, E. coli
cagcgaagctaggtcagcctgaaca

SEQ ID NO: 162686 - DNA, 25 bp, E. coli
cagcgaagctagctcagcctgaaca

SEQ ID NO: 162687 - DNA, 25 bp, E. coli
cattgttgggctaggtagtatatac

SEQ ID NO: 162688 - DNA, 25 bp, E. coli
cattgttgggcttggtagtatatac

SEQ ID NO: 162689 - DNA, 25 bp, E. coli
tacactatcctaaagcgtgactcag

SEQ ID NO: 162690 - DNA, 25 bp, E. coli
tactcctcctcgatacgtgctactg

SEQ ID NO: 162691 - DNA, 25 bp, E. coli
tacactatcctatagcgtgactcag

SEQ ID NO: 162692 - DNA, 25 bp, E. coli
tactcctcctcgttacgtgctactg

SEQ ID NO: 162693 - DNA, 25 bp, E. coli
ttcgttaacctctacattgttgggc

SEQ ID NO: 162694 - DNA, 25 bp, E. coli
ttcgttaacctcaacattgttgggc

SEQ ID NO: 162695 - DNA, 25 bp, E. coli
gaatatctgctataggcacactggg

SEQ ID NO: 162696 - DNA, 25 bp, E. coli
gaatatctgctaaaggcacactggg

SEQ ID NO: 162697 - DNA, 25 bp, E. coli
tcaatttcagatactcacccagcgt

SEQ ID NO: 162698 - DNA, 25 bp, E. coli
taagcatgtcgttagacaccatccg

SEQ ID NO: 162699 - DNA, 25 bp, E. coli
tcacccagcgtcaaatttgtagcgc

SEQ ID NO: 162700 - DNA, 25 bp, E. coli
taagcatgtcgtaagacaccatccg

SEQ ID NO: 162701 - DNA, 25 bp, E. coli
tcacaatattgtctgtcagcgaagc

SEQ ID NO: 162702 - DNA, 25 bp, E. coli
tcaatttcagattctcacccagcgt

SEQ ID NO: 162703 - DNA, 25 bp, E. coli
tcacaatattgtgtgtcagcgaagc

SEQ ID NO: 162704 - DNA, 25 bp, E. coli
tcacccagcgtctaatttgtagcgc

SEQ ID NO: 162705 - DNA, 25 bp, E. coli
tgattgctgtacaggctgcacgagc

SEQ ID NO: 162706 - DNA, 25 bp, E. coli
tgattgctgtactggctgcacgagc

SEQ ID NO: 162707 - DNA, 25 bp, E. coli
tgaacgaaggtataccgacgctgcc

SEQ ID NO: 162708 - DNA, 25 bp, E. coli
tgaacgaaggtaaaccgacgctgcc

SEQ ID NO: 162709 - DNA, 25 bp, E. coli
tcgaacagggtaacggtcgccatct

SEQ ID NO: 162710 - DNA, 25 bp, E. coli
tcgaacagggtatcggtcgccatct

SEQ ID NO: 162711 - DNA, 25 bp, E. coli
gccgtaaacgtcttcgcagaaggtg

SEQ ID NO: 162712 - DNA, 25 bp, E. coli
gccgtaaacgtcatcgcagaaggtg

SEQ ID NO: 162713 - DNA, 25 bp, E. coli
gaagtcatgtcagaagccgtaaacg

SEQ ID NO: 162714 - DNA, 25 bp, E. coli
gaagtcatgtcacaagccgtaaacg

SEQ ID NO: 162715 - DNA, 25 bp, E. coli
gatctcttgaatggacgcgtcagcg

SEQ ID NO: 162716 - DNA, 25 bp, E. coli
gattatgggcgctatctcggcactg

SEQ ID NO: 162717 - DNA, 25 bp, E. coli
gattatgggcgcaatctcggcactg

SEQ ID NO: 162718 - DNA, 25 bp, E. coli
gatctcttgaatcgacgcgtcagcg

SEQ ID NO: 162719 - DNA, 25 bp, E. coli
gatcgagtttatgcacacggcgact

SEQ ID NO: 162720 - DNA, 25 bp, E. coli
tcactgaagaaatctacatgcgcgt

SEQ ID NO: 162721 - DNA, 25 bp, E. coli
tcagcggcggcgctaaacgtattcg

SEQ ID NO: 162722 - DNA, 25 bp, E. coli
tcagcggcggcggtaaacgtattcg

SEQ ID NO: 162723 - DNA, 25 bp, E. coli
tcactgaagaaaactacatgcgcgt

SEQ ID NO: 162724 - DNA, 25 bp, E. coli
gatcgagtttatccacacggcgact

SEQ ID NO: 162725 - DNA, 25 bp, E. coli
gagcagcttaattccgacgtccaac

SEQ ID NO: 162726 - DNA, 25 bp, E. coli
gagcagcttaataccgacgtccaac

SEQ ID NO: 162727 - DNA, 25 bp, E. coli
cagtgatgtgaagtatgtgattgcc

SEQ ID NO: 162728 - DNA, 25 bp, E. coli
cagtgatgtgaactatgtgattgcc

SEQ ID NO: 162729 - DNA, 25 bp, E. coli
tacctgtggtgcagagcggtacaca

SEQ ID NO: 162730 - DNA, 25 bp, E. coli
tacctgtggtgctgagcggtacaca

SEQ ID NO: 162731 - DNA, 25 bp, E. coli
tgtctggagtcacgaagccgcttct

SEQ ID NO: 162732 - DNA, 25 bp, E. coli
tgtctggagtcaggaagccgcttct

SEQ ID NO: 162733 - DNA, 25 bp, E. coli
gcccaggacacggtcaatgttaccg

SEQ ID NO: 162734 - DNA, 25 bp, E. coli
gcccaggacacgctcaatgttaccg

SEQ ID NO: 162735 - DNA, 25 bp, E. coli
gcagctccggcgtaattaataaaaa

SEQ ID NO: 162736 - DNA, 25 bp, E. coli
gcagctccggcgaaattaataaaaa

SEQ ID NO: 162737 - DNA, 25 bp, E. coli
tcaaacgtccgttccgtctggaagg

SEQ ID NO: 162738 - DNA, 25 bp, E. coli
tcaaacgtccgtaccgtctggaagg

SEQ ID NO: 162739 - DNA, 25 bp, E. coli
cgatgagatggttaaagtgctggcc

SEQ ID NO: 162740 - DNA, 25 bp, E. coli
cgatgagatggtaaaagtgctggcc

SEQ ID NO: 162741 - DNA, 25 bp, E. coli
ggatcaacagttgcgcaacaccctg

SEQ ID NO: 162742 - DNA, 25 bp, E. coli
ggatcaacagttccgcaacaccctg

SEQ ID NO: 162743 - DNA, 25 bp, E. coli
gtgggccagccccttggatcaacag

SEQ ID NO: 162744 - DNA, 25 bp, E. coli
gtgggccagcccgttggatcaacag

SEQ ID NO: 162745 - DNA, 25 bp, E. coli
tggctgttgaacgaccagggacaac

SEQ ID NO: 162746 - DNA, 25 bp, E. coli
tggctgttgaaccaccagggacaac

SEQ ID NO: 162747 - DNA, 25 bp, E. coli
taacggtcgctatgatggcaaggtc

SEQ ID NO: 162748 - DNA, 25 bp, E. coli
taacggtcgctaagatggcaaggtc

SEQ ID NO: 162749 - DNA, 25 bp, E. coli
taacacgatgttctaattcggcaca

SEQ ID NO: 162750 - DNA, 25 bp, E. coli
taacacgatgttgtaattcggcaca

SEQ ID NO: 162751 - DNA, 25 bp, E. coli
tagctcattacactccattaacacg

SEQ ID NO: 162752 - DNA, 25 bp, E. coli
tagctcattacagtccattaacacg

SEQ ID NO: 162753 - DNA, 25 bp, E. coli
tttaagagataaaaccgtctgcgga

SEQ ID NO: 162754 - DNA, 25 bp, E. coli
tttaagagataataccgtctgcgga

SEQ ID NO: 162755 - DNA, 25 bp, E. coli
tgagatatatcgatggcgtcacaaa

SEQ ID NO: 162756 - DNA, 25 bp, E. coli
tgcggaatatttgccgcagacggct

SEQ ID NO: 162757 - DNA, 25 bp, E. coli
tgagatatatcgttggcgtcacaaa

SEQ ID NO: 162758 - DNA, 25 bp, E. coli
tgcggaatatttcccgcagacggct

SEQ ID NO: 162759 - DNA, 25 bp, E. coli
gaaataagatatgaccattgctggt

SEQ ID NO: 162760 - DNA, 25 bp, E. coli
gaaataagatatcaccattgctggt

SEQ ID NO: 162761 - DNA, 25 bp, E. coli
cgcagacggcttagttgtttttgaa

SEQ ID NO: 162762 - DNA, 25 bp, E. coli
cgcagacggctttgttgtttttgaa

SEQ ID NO: 162763 - DNA, 25 bp, E. coli
cattgctggttaattgaatagctca

SEQ ID NO: 162764 - DNA, 25 bp, E. coli
cattgctggttatttgaatagctca

SEQ ID NO: 162765 - DNA, 25 bp, E. coli
cgtaattcggaaataagatatgacc

SEQ ID NO: 162766 - DNA, 25 bp, E. coli
cgtaattcggaattaagatatgacc

SEQ ID NO: 162767 - DNA, 25 bp, E. coli
tggcgtcacaaaagcaaaataacgt

SEQ ID NO: 162768 - DNA, 25 bp, E. coli
tggcgtcacaaatgcaaaataacgt

SEQ ID NO: 162769 - DNA, 25 bp, E. coli
taattcggcacactacataagggtg

SEQ ID NO: 162770 - DNA, 25 bp, E. coli
taattcggcacagtacataagggtg

SEQ ID NO: 162771 - DNA, 25 bp, E. coli
caaatgctgatggagagcttccgta

SEQ ID NO: 162772 - DNA, 25 bp, E. coli
caaatgctgatgcagagcttccgta

SEQ ID NO: 162773 - DNA, 25 bp, E. coli
tacatccgcgaaaggagcgtctggt

SEQ ID NO: 162774 - DNA, 25 bp, E. coli
tacatccgcgaatggagcgtctggt

SEQ ID NO: 162775 - DNA, 25 bp, E. coli
aaatctaaaaaaccgcgagcgagcg

SEQ ID NO: 162776 - DNA, 25 bp, E. coli
aaatctaaaaaagcgcgagcgagcg

SEQ ID NO: 162777 - DNA, 25 bp, E. coli
tataacaagcgcatggtcgcggtgg

SEQ ID NO: 162778 - DNA, 25 bp, E. coli
tataacaagcgcttggtcgcggtgg

SEQ ID NO: 162779 - DNA, 25 bp, E. coli
gccgatcaaagtctggaagttccgt

SEQ ID NO: 162780 - DNA, 25 bp, E. coli
gccgatcaaagtgtggaagttccgt

SEQ ID NO: 162781 - DNA, 25 bp, E. coli
gcattaccggctgggcgcagattaa

SEQ ID NO: 162782 - DNA, 25 bp, E. coli
gcattaccggctcggcgcagattaa

SEQ ID NO: 162783 - DNA, 25 bp, E. coli
gctggagaaaatcgaaaaacgcgtc

SEQ ID NO: 162784 - DNA, 25 bp, E. coli
gctggagaaaatggaaaaacgcgtc

SEQ ID NO: 162785 - DNA, 25 bp, E. coli
gaaaaaactggtgcatcaactggcg

SEQ ID NO: 162786 - DNA, 25 bp, E. coli
gaaaaaactggtccatcaactggcg

SEQ ID NO: 162787 - DNA, 25 bp, E. coli
cgggctggctgcgtaatcatggcta

SEQ ID NO: 162788 - DNA, 25 bp, E. coli
cgggctggctgcctaatcatggcta

SEQ ID NO: 162789 - DNA, 25 bp, E. coli
gagaacgacaaagtggtgacccagg

SEQ ID NO: 162790 - DNA, 25 bp, E. coli
gagaacgacaaactggtgacccagg

SEQ ID NO: 162791 - DNA, 25 bp, E. coli
gagttcgaccttgagtacatccgcg

SEQ ID NO: 162792 - DNA, 25 bp, E. coli
gagttcgaccttcagtacatccgcg

SEQ ID NO: 162793 - DNA, 25 bp, E. coli
taaatactgcgagaaaccagacgcg

SEQ ID NO: 162794 - DNA, 25 bp, E. coli
taaatactgcgacaaaccagacgcg

SEQ ID NO: 162795 - DNA, 25 bp, E. coli
tgttagtattaatctttttggtggt

SEQ ID NO: 162796 - DNA, 25 bp, E. coli
tgttagtattaaactttttggtggt

SEQ ID NO: 162797 - DNA, 25 bp, E. coli
aaatactgcgactaaccagacgcga

SEQ ID NO: 162798 - DNA, 25 bp, E. coli
aaatactgcgacaaaccagacgcga

SEQ ID NO: 162799 - DNA, 25 bp, E. coli
tatgcttaaatactgcgacaaacca

SEQ ID NO: 162800 - DNA, 25 bp, E. coli
tatgcttaaatagtgcgacaaacca

SEQ ID NO: 162801 - DNA, 25 bp, E. coli
tgccctcatttcttcaggcagaaaa

SEQ ID NO: 162802 - DNA, 25 bp, E. coli
tgccctcatttcatcaggcagaaaa

SEQ ID NO: 162803 - DNA, 25 bp, E. coli
tcaggcagaaaattcaaaaaatcgc

SEQ ID NO: 162804 - DNA, 25 bp, E. coli
tcaggcagaaaaatcaaaaaatcgc

SEQ ID NO: 162805 - DNA, 25 bp, E. coli
tcttgttggcttcccgacaggtccg

SEQ ID NO: 162806 - DNA, 25 bp, E. coli
tcttgttggcttgccgacaggtccg

SEQ ID NO: 162807 - DNA, 25 bp, E. coli
gaaaaatcaaaatatcgctttatgc

SEQ ID NO: 162808 - DNA, 25 bp, E. coli
gaaaaatcaaaaaatcgctttatgc

SEQ ID NO: 162809 - DNA, 25 bp, E. coli
cgctttatgcttaaatactgcgaca

SEQ ID NO: 162810 - DNA, 25 bp, E. coli
cgctttatgctttaatactgcgaca

SEQ ID NO: 162811 - DNA, 25 bp, E. coli
cgtggtatcttgatggcttgccgac

SEQ ID NO: 162812 - DNA, 25 bp, E. coli
cgtggtatcttgttggcttgccgac

SEQ ID NO: 162813 - DNA, 25 bp, E. coli
tggcttgccgactggtccgggtatt

SEQ ID NO: 162814 - DNA, 25 bp, E. coli
tggcttgccgacaggtccgggtatt

SEQ ID NO: 162815 - DNA, 25 bp, E. coli
aaggcattgaagaggagacgccagc

SEQ ID NO: 162816 - DNA, 25 bp, E. coli
aaggcattgaagtggagacgccagc

SEQ ID NO: 162817 - DNA, 25 bp, E. coli
cagtctggattttacaagagcggca

SEQ ID NO: 162818 - DNA, 25 bp, E. coli
cagtctggatttaacaagagcggca

SEQ ID NO: 162819 - DNA, 25 bp, E. coli
taacaagagcgggagcttttgccat

SEQ ID NO: 162820 - DNA, 25 bp, E. coli
tattgtggccatagctgttctggtc

SEQ ID NO: 162821 - DNA, 25 bp, E. coli
tattgtggccattgctgttctggtc

SEQ ID NO: 162822 - DNA, 25 bp, E. coli
ttgaagtggagaggccagccagtct

SEQ ID NO: 162823 - DNA, 25 bp, E. coli
ttgaagtggagacgccagccagtct

SEQ ID NO: 162824 - DNA, 25 bp, E. coli
ccagccagtctggatttaacaagag

SEQ ID NO: 162825 - DNA, 25 bp, E. coli
ccagccagtctgcatttaacaagag

SEQ ID NO: 162826 - DNA, 25 bp, E. coli
gctgttctggtctgggcaatccgtt

SEQ ID NO: 162827 - DNA, 25 bp, E. coli
gctgttctggtcagggcaatccgtt

SEQ ID NO: 162828 - DNA, 25 bp, E. coli
cttttgccattcctattgtggccat

SEQ ID NO: 162829 - DNA, 25 bp, E. coli
cttttgccattcgtattgtggccat

SEQ ID NO: 162830 - DNA, 25 bp, E. coli
ggtctgggcaatgcgttggtggtga

SEQ ID NO: 162831 - DNA, 25 bp, E. coli
ggtctgggcaatccgttggtggtga

SEQ ID NO: 162832 - DNA, 25 bp, E. coli
tggatttaacaagagcggcagcttt

SEQ ID NO: 162833 - DNA, 25 bp, E. coli
tggatttaacaacagcggcagcttt

SEQ ID NO: 162834 - DNA, 25 bp, E. coli
taacaagagcggcagcttttgccat

SEQ ID NO: 162835 - DNA, 25 bp, E. coli
gagacgccagcctgtctggatttaa

SEQ ID NO: 162836 - DNA, 25 bp, E. coli
gagacgccagccagtctggatttaa

SEQ ID NO: 162837 - DNA, 25 bp, E. coli
caaactggaaagacatgatttcgac

SEQ ID NO: 162838 - DNA, 25 bp, E. coli
caaactggaaagtcatgatttcgac

SEQ ID NO: 162839 - DNA, 25 bp, E. coli
catcatccaaacaggaaagtcatga

SEQ ID NO: 162840 - DNA, 25 bp, E. coli
catccaaactggaaagtcatgattt

SEQ ID NO: 162841 - DNA, 25 bp, E. coli
catcatccaaactggaaagtcatga

SEQ ID NO: 162842 - DNA, 25 bp, E. coli
catccaaactggtaagtcatgattt

SEQ ID NO: 162843 - DNA, 25 bp, E. coli
tacaacatcatcgaaactggaaagt

SEQ ID NO: 162844 - DNA, 25 bp, E. coli
tacaacatcatccaaactggaaagt

SEQ ID NO: 162845 - DNA, 25 bp, E. coli
agcggttagccggacagctttcgtc

SEQ ID NO: 162846 - DNA, 25 bp, E. coli
agcggttagccgcacagctttcgtc

SEQ ID NO: 162847 - DNA, 25 bp, E. coli
ttagccggacagctttcgtcgaaca

SEQ ID NO: 162848 - DNA, 25 bp, E. coli
ttagccggacaggtttcgtcgaaca

SEQ ID NO: 162849 - DNA, 25 bp, E. coli
tccaaactggaaagtcatgatttcg

SEQ ID NO: 162850 - DNA, 25 bp, E. coli
tccaaactggaatgtcatgatttcg

SEQ ID NO: 162851 - DNA, 25 bp, E. coli
gaaaagcggttacccggacagcttt

SEQ ID NO: 162852 - DNA, 25 bp, E. coli
gaaaagcggttagccggacagcttt

SEQ ID NO: 162853 - DNA, 25 bp, E. coli
ggttagccggacagctttcgtcgaa

SEQ ID NO: 162854 - DNA, 25 bp, E. coli
ggttagccggactgctttcgtcgaa

SEQ ID NO: 162855 - DNA, 25 bp, E. coli
ggaaagtcatgaattcgactgacca

SEQ ID NO: 162856 - DNA, 25 bp, E. coli
tggaaagtcatgttttcgactgacc

SEQ ID NO: 162857 - DNA, 25 bp, E. coli
tggaaagtcatgatttcgactgacc

SEQ ID NO: 162858 - DNA, 25 bp, E. coli
ggaaagtcatgatttcgactgacca

SEQ ID NO: 162859 - DNA, 25 bp, E. coli
aagatttgccatatcagggcggcgc

SEQ ID NO: 162860 - DNA, 25 bp, E. coli
aagatttgccatttcagggcggcgc

SEQ ID NO: 162861 - DNA, 25 bp, E. coli
aattttaagcctatcgccagagcgg

SEQ ID NO: 162862 - DNA, 25 bp, E. coli
aattttaagcctttcgccagagcgg

SEQ ID NO: 162863 - DNA, 25 bp, E. coli
caggtgctggatcgcgcagacattc

SEQ ID NO: 162864 - DNA, 25 bp, E. coli
caggtgctggatggcgcagacattc

SEQ ID NO: 162865 - DNA, 25 bp, E. coli
tacaggaatatcagcacagcggtga

SEQ ID NO: 162866 - DNA, 25 bp, E. coli
tacaggaatatctgcacagcggtga

SEQ ID NO: 162867 - DNA, 25 bp, E. coli
ttttcctggtggctcaataaccggg

SEQ ID NO: 162868 - DNA, 25 bp, E. coli
ttttcctggtgggtcaataaccggg

SEQ ID NO: 162869 - DNA, 25 bp, E. coli
tgtttggctacgttctgggccgccg

SEQ ID NO: 162870 - DNA, 25 bp, E. coli
tgtttggctacgatctgggccgccg

SEQ ID NO: 162871 - DNA, 25 bp, E. coli
gaattgtcgccgatagccaggaaga

SEQ ID NO: 162872 - DNA, 25 bp, E. coli
gaattgtcgccgttagccaggaaga

SEQ ID NO: 162873 - DNA, 25 bp, E. coli
gaaaaacgcacaacgaccactgatg

SEQ ID NO: 162874 - DNA, 25 bp, E. coli
gaactcagcgaaagatcgtgccgaa

SEQ ID NO: 162875 - DNA, 25 bp, E. coli
gaactcagcgaatgatcgtgccgaa

SEQ ID NO: 162876 - DNA, 25 bp, E. coli
gaaaaacgcacatcgaccactgatg

SEQ ID NO: 162877 - DNA, 25 bp, E. coli
gataatagtgaaatccagacccgcc

SEQ ID NO: 162878 - DNA, 25 bp, E. coli
gataatagtgaattccagacccgcc

SEQ ID NO: 162879 - DNA, 25 bp, E. coli
tggcaatccaatttgacccgcgagc

SEQ ID NO: 162880 - DNA, 25 bp, E. coli
tggcaatccaatatgacccgcgagc

SEQ ID NO: 162881 - DNA, 25 bp, E. coli
caatatgtttgggaccgtggcggat

SEQ ID NO: 162882 - DNA, 25 bp, E. coli
caatatgtttggcaccgtggcggat

SEQ ID NO: 162883 - DNA, 25 bp, E. coli
cacccggatgtagaaaaagcaattc

SEQ ID NO: 162884 - DNA, 25 bp, E. coli
cacccggatgtacaaaaagcaattc

SEQ ID NO: 162885 - DNA, 25 bp, E. coli
acatttttaaccctgccagcgcgca

SEQ ID NO: 162886 - DNA, 25 bp, E. coli
acatttttaaccgtgccagcgcgca

SEQ ID NO: 162887 - DNA, 25 bp, E. coli
tattaagcgtcttctggatatcggt

SEQ ID NO: 162888 - DNA, 25 bp, E. coli
tattaagcgtctactggatatcggt

SEQ ID NO: 162889 - DNA, 25 bp, E. coli
tccagatagaaagtcagcagggcgt

SEQ ID NO: 162890 - DNA, 25 bp, E. coli
tcgctcagtcgatcaagaacatcac

SEQ ID NO: 162891 - DNA, 25 bp, E. coli
tccagatagaaactcagcagggcgt

SEQ ID NO: 162892 - DNA, 25 bp, E. coli
tcgctcagtcgaacaagaacatcac

SEQ ID NO: 162893 - DNA, 25 bp, E. coli
ccaacgagccggaaattattaagcg

SEQ ID NO: 162894 - DNA, 25 bp, E. coli
ccaacgagccggtaattattaagcg

SEQ ID NO: 162895 - DNA, 25 bp, E. coli
gcggcattaggcgatctcggcaatg

SEQ ID NO: 162896 - DNA, 25 bp, E. coli
gcggcattaggccatctcggcaatg

SEQ ID NO: 162897 - DNA, 25 bp, E. coli
gcactggctgcgtaacaggtacaaa

SEQ ID NO: 162898 - DNA, 25 bp, E. coli
gaataaattcaaagccgcactggct

SEQ ID NO: 162899 - DNA, 25 bp, E. coli
gcactggctgcgaaacaggtacaaa

SEQ ID NO: 162900 - DNA, 25 bp, E. coli
gaataaattcaatgccgcactggct

SEQ ID NO: 162901 - DNA, 25 bp, E. coli
gaacatcactatactggtccagata

SEQ ID NO: 162902 - DNA, 25 bp, E. coli
gaacatcactattctggtccagata

SEQ ID NO: 162903 - DNA, 25 bp, E. coli
aagtggaacattcccattgtttggc

SEQ ID NO: 162904 - DNA, 25 bp, E. coli
aagtggaacattgccattgtttggc

SEQ ID NO: 162905 - DNA, 25 bp, E. coli
ggtccaacttttcaaaactcttctg

SEQ ID NO: 162906 - DNA, 25 bp, E. coli
ggtccaacttttgaaaactcttctg

SEQ ID NO: 162907 - DNA, 25 bp, E. coli
tattatcatccctgcaaagtggaac

SEQ ID NO: 162908 - DNA, 25 bp, E. coli
tattatcatcccagcaaagtggaac

SEQ ID NO: 162909 - DNA, 25 bp, E. coli
tccctgcaaagtggaacattgccat

SEQ ID NO: 162910 - DNA, 25 bp, E. coli
tccctgcaaagtcgaacattgccat

SEQ ID NO: 162911 - DNA, 25 bp, E. coli
tctgaatcagatccccttattatca

SEQ ID NO: 162912 - DNA, 25 bp, E. coli
tctgaatcagatgcccttattatca

SEQ ID NO: 162913 - DNA, 25 bp, E. coli
gcctcgatggcggtccaacttttca

SEQ ID NO: 162914 - DNA, 25 bp, E. coli
ccattgtttggcaattcaggatggg

SEQ ID NO: 162915 - DNA, 25 bp, E. coli
gcctcgatggcgctccaacttttca

SEQ ID NO: 162916 - DNA, 25 bp, E. coli
ccattgtttggctattcaggatggg

SEQ ID NO: 162917 - DNA, 25 bp, E. coli
gttcgaggcctcgatggcggtccaa

SEQ ID NO: 162918 - DNA, 25 bp, E. coli
gttcgaggcctccatggcggtccaa

SEQ ID NO: 162919 - DNA, 25 bp, E. coli
gggcagaccaatgaaaaaagcccac

SEQ ID NO: 162920 - DNA, 25 bp, E. coli
gggcagaccaatcaaaaaagcccac

SEQ ID NO: 162921 - DNA, 25 bp, E. coli
gatggcggtccaacttttcaaaact

SEQ ID NO: 162922 - DNA, 25 bp, E. coli
gatggcggtccatcttttcaaaact

SEQ ID NO: 162923 - DNA, 25 bp, E. coli
gatccccttattatcatccctgcaa

SEQ ID NO: 162924 - DNA, 25 bp, E. coli
gatccccttattttcatccctgcaa

SEQ ID NO: 162925 - DNA, 25 bp, E. coli
tacaaaacgtagcatatctggcggg

SEQ ID NO: 162926 - DNA, 25 bp, E. coli
tacaaaacgtaggatatctggcggg

SEQ ID NO: 162927 - DNA, 25 bp, E. coli
aaaatattgccgtgctgtgggtgac

SEQ ID NO: 162928 - DNA, 25 bp, E. coli
aaaatattgccgagctgtgggtgac

SEQ ID NO: 162929 - DNA, 25 bp, E. coli
taccggtccttcaggttgtggcaaa

SEQ ID NO: 162930 - DNA, 25 bp, E. coli
taccggtccttctggttgtggcaaa

SEQ ID NO: 162931 - DNA, 25 bp, E. coli
tgtgggtgacactcgataaagacga

SEQ ID NO: 162932 - DNA, 25 bp, E. coli
tgattacactgcaaccgcatgccgg

SEQ ID NO: 162933 - DNA, 25 bp, E. coli
tgtgggtgacacacgataaagacga

SEQ ID NO: 162934 - DNA, 25 bp, E. coli
tgattacactgctaccgcatgccgg

SEQ ID NO: 162935 - DNA, 25 bp, E. coli
ccagtgcgctggttgaaagtaataa

SEQ ID NO: 162936 - DNA, 25 bp, E. coli
ccagtgcgctggatgaaagtaataa

SEQ ID NO: 162937 - DNA, 25 bp, E. coli
cgctgtttggcgttacggtatacga

SEQ ID NO: 162938 - DNA, 25 bp, E. coli
cgctgtttggcgatacggtatacga

SEQ ID NO: 162939 - DNA, 25 bp, E. coli
ctggcgggtgatccgaagattctta

SEQ ID NO: 162940 - DNA, 25 bp, E. coli
ctggcgggtgatgcgaagattctta

SEQ ID NO: 162941 - DNA, 25 bp, E. coli
gattcgtaacctgcaatttatgccg

SEQ ID NO: 162942 - DNA, 25 bp, E. coli
gataatctgatctttccctggcaga

SEQ ID NO: 162943 - DNA, 25 bp, E. coli
gattcgtaacctccaatttatgccg

SEQ ID NO: 162944 - DNA, 25 bp, E. coli
gataatctgatcattccctggcaga

SEQ ID NO: 162945 - DNA, 25 bp, E. coli
ggatgtcagcactctaaagccagaa

SEQ ID NO: 162946 - DNA, 25 bp, E. coli
ggatgtcagcacactaaagccagaa

SEQ ID NO: 162947 - DNA, 25 bp, E. coli
cattaccgaacgattgttggcagcg

SEQ ID NO: 162948 - DNA, 25 bp, E. coli
cattaccgaacgtttgttggcagcg

SEQ ID NO: 162949 - DNA, 25 bp, E. coli
cgtcattaccgatcgtttgttggca

SEQ ID NO: 162950 - DNA, 25 bp, E. coli
atgtcagtaggagcggaaaacagcg

SEQ ID NO: 162951 - DNA, 25 bp, E. coli
cgtcattaccgaacgtttgttggca

SEQ ID NO: 162952 - DNA, 25 bp, E. coli
atgtcagtaggaccggaaaacagcg

SEQ ID NO: 162953 - DNA, 25 bp, E. coli
aacagcgtcattaccgaacgtttgt

SEQ ID NO: 162954 - DNA, 25 bp, E. coli
aacgtttgttgggagcgacagccat

SEQ ID NO: 162955 - DNA, 25 bp, E. coli
aacagcgtcatttccgaacgtttgt

SEQ ID NO: 162956 - DNA, 25 bp, E. coli
aacgtttgttggcagcgacagccat

SEQ ID NO: 162957 - DNA, 25 bp, E. coli
taggaccggaaaacagcgtcattac

SEQ ID NO: 162958 - DNA, 25 bp, E. coli
taccgaacgtttcttggcagcgaca

SEQ ID NO: 162959 - DNA, 25 bp, E. coli
taccgaacgtttgttggcagcgaca

SEQ ID NO: 162960 - DNA, 25 bp, E. coli
taggaccggaaatcagcgtcattac

SEQ ID NO: 162961 - DNA, 25 bp, E. coli
tcagtaggaccggaaaacagcgtca

SEQ ID NO: 162962 - DNA, 25 bp, E. coli
tcagtaggaccgcaaaacagcgtca

SEQ ID NO: 162963 - DNA, 25 bp, E. coli
gaccggaaaacagcgtcattaccga

SEQ ID NO: 162964 - DNA, 25 bp, E. coli
gaccggaaaacaccgtcattaccga

SEQ ID NO: 162965 - DNA, 25 bp, E. coli
cgaacgtttgttggcagcgacagcc

SEQ ID NO: 162966 - DNA, 25 bp, E. coli
cgaacgtttgttcgcagcgacagcc

SEQ ID NO: 162967 - DNA, 25 bp, E. coli
ggaaaacagcgtcattaccgaacgt

SEQ ID NO: 162968 - DNA, 25 bp, E. coli
ggaaaacagcgtgattaccgaacgt

SEQ ID NO: 162969 - DNA, 25 bp, E. coli
catgtactaatgctctttgcggcac

SEQ ID NO: 162970 - DNA, 25 bp, E. coli
cattttatttaggtacgcccagtgg

SEQ ID NO: 162971 - DNA, 25 bp, E. coli
catgtactaatggtctttgcggcac

SEQ ID NO: 162972 - DNA, 25 bp, E. coli
taaagcaatagataaccacgggaag

SEQ ID NO: 162973 - DNA, 25 bp, E. coli
taaagcaatagaaaaccacgggaag

SEQ ID NO: 162974 - DNA, 25 bp, E. coli
tagatagcaccgcatatgacgcctt

SEQ ID NO: 162975 - DNA, 25 bp, E. coli
tagatagcaccggatatgacgcctt

SEQ ID NO: 162976 - DNA, 25 bp, E. coli
tacctaatgtctgcagagttcatgg

SEQ ID NO: 162977 - DNA, 25 bp, E. coli
tacctaatgtctccagagttcatgg

SEQ ID NO: 162978 - DNA, 25 bp, E. coli
ttctcaacagcagctaaccgaggag

SEQ ID NO: 162979 - DNA, 25 bp, E. coli
ttctcaacagcacctaaccgaggag

SEQ ID NO: 162980 - DNA, 25 bp, E. coli
tccgctatgataggtccagataaat

SEQ ID NO: 162981 - DNA, 25 bp, E. coli
tccgctatgatacgtccagataaat

SEQ ID NO: 162982 - DNA, 25 bp, E. coli
tcagcttatcatactcatggtgcag

SEQ ID NO: 162983 - DNA, 25 bp, E. coli
tctatgtgggaggatgcaaaatcgg

SEQ ID NO: 162984 - DNA, 25 bp, E. coli
tctatgtgggagcatgcaaaatcgg

SEQ ID NO: 162985 - DNA, 25 bp, E. coli
tcagcttatcattctcatggtgcag

SEQ ID NO: 162986 - DNA, 25 bp, E. coli
gcccttgccctaatggtactgagaa

SEQ ID NO: 162987 - DNA, 25 bp, E. coli
gcccttgccctattggtactgagaa

SEQ ID NO: 162988 - DNA, 25 bp, E. coli
cattttatttagctacgcccagtgg

SEQ ID NO: 162989 - DNA, 25 bp, E. coli
taaccgaggagaaagaaaaggatca

SEQ ID NO: 162990 - DNA, 25 bp, E. coli
taaccgaggagatagaaaaggatca

SEQ ID NO: 162991 - DNA, 25 bp, E. coli
cactggctgcgtaatgccgattcag

SEQ ID NO: 162992 - DNA, 25 bp, E. coli
cactggctgcgttatgccgattcag

SEQ ID NO: 162993 - DNA, 25 bp, E. coli
cattccaactgtggcgcgatgaccg

SEQ ID NO: 162994 - DNA, 25 bp, E. coli
cattccaactgtcgcgcgatgaccg

SEQ ID NO: 162995 - DNA, 25 bp, E. coli
tacgacattgaatgcggcagcatcg

SEQ ID NO: 162996 - DNA, 25 bp, E. coli
tacgacattgaaagcggcagcatcg

SEQ ID NO: 162997 - DNA, 25 bp, E. coli
tgcacggctgggtctacgacattga

SEQ ID NO: 162998 - DNA, 25 bp, E. coli
tgcacggctgggactacgacattga

SEQ ID NO: 162999 - DNA, 25 bp, E. coli
tgcggcgatggttcgtgaaaacgtc

SEQ ID NO: 163000 - DNA, 25 bp, E. coli
tgcggcgatggtacgtgaaaacgtc

SEQ ID NO: 163001 - DNA, 25 bp, E. coli
gcgcttcgggtatctgacattgtga

SEQ ID NO: 163002 - DNA, 25 bp, E. coli
gcgcttcgggtaactgacattgtga

SEQ ID NO: 163003 - DNA, 25 bp, E. coli
gaaaacgtcattgctcagttggcta

SEQ ID NO: 163004 - DNA, 25 bp, E. coli
gaaaacgtcattcctcagttggcta

SEQ ID NO: 163005 - DNA, 25 bp, E. coli
gatttaccgtcaaaagctgcggcga

SEQ ID NO: 163006 - DNA, 25 bp, E. coli
gatttaccgtcataagctgcggcga

SEQ ID NO: 163007 - DNA, 25 bp, E. coli
ggattccttaaaatccagcgcgagg

SEQ ID NO: 163008 - DNA, 25 bp, E. coli
ggattccttaaattccagcgcgagg

SEQ ID NO: 163009 - DNA, 25 bp, E. coli
taatttgcaaactcatccatcggtg

SEQ ID NO: 163010 - DNA, 25 bp, E. coli
taatcctcgcgtttgtgccataccg

SEQ ID NO: 163011 - DNA, 25 bp, E. coli
taatcctcgcgtatgtgccataccg

SEQ ID NO: 163012 - DNA, 25 bp, E. coli
taatttgcaaacacatccatcggtg

SEQ ID NO: 163013 - DNA, 25 bp, E. coli
caccaggttgttcttgcttatgcag

SEQ ID NO: 163014 - DNA, 25 bp, E. coli
caccaggttgttgttgcttatgcag

SEQ ID NO: 163015 - DNA, 25 bp, E. coli
ttaacaagaagaagtaccgcggcgc

SEQ ID NO: 163016 - DNA, 25 bp, E. coli
ttaacaagaagatgtaccgcggcgc

SEQ ID NO: 163017 - DNA, 25 bp, E. coli
tgcagctggtgcacgtcagggtact

SEQ ID NO: 163018 - DNA, 25 bp, E. coli
tgcagctggtgctcgtcagggtact

SEQ ID NO: 163019 - DNA, 25 bp, E. coli
tccgaactggtacgtcaggatcgtc

SEQ ID NO: 163020 - DNA, 25 bp, E. coli
tccgcaggaccagagtcaaaaagtt

SEQ ID NO: 163021 - DNA, 25 bp, E. coli
tccgcaggaccacagtcaaaaagtt

SEQ ID NO: 163022 - DNA, 25 bp, E. coli
tccgaactggtaggtcaggatcgtc

SEQ ID NO: 163023 - DNA, 25 bp, E. coli
gctgaaaagcatcctgtccgaactg

SEQ ID NO: 163024 - DNA, 25 bp, E. coli
gctgaaaagcatgctgtccgaactg

SEQ ID NO: 163025 - DNA, 25 bp, E. coli
gactcgtgctgatgtaactggttcc

SEQ ID NO: 163026 - DNA, 25 bp, E. coli
gactcgtgctgaagtaactggttcc

SEQ ID NO: 163027 - DNA, 25 bp, E. coli
gatttcaacgaagcgctggttcacc

SEQ ID NO: 163028 - DNA, 25 bp, E. coli
gatttcaacgaaccgctggttcacc

SEQ ID NO: 163029 - DNA, 25 bp, E. coli
ggtactcgtgctgagaagactcgtg

SEQ ID NO: 163030 - DNA, 25 bp, E. coli
ggttctatcaagtgcccgatctggc

SEQ ID NO: 163031 - DNA, 25 bp, E. coli
ggtactcgtgctcagaagactcgtg

SEQ ID NO: 163032 - DNA, 25 bp, E. coli
ggttctatcaagagcccgatctggc

SEQ ID NO: 163033 - DNA, 25 bp, E. coli
ggccgtgcgcgtactggttctatca

SEQ ID NO: 163034 - DNA, 25 bp, E. coli
ggccgtgcgcgttctggttctatca

SEQ ID NO: 163035 - DNA, 25 bp, E. coli
cagcgattttgagagggtgaaatca

SEQ ID NO: 163036 - DNA, 25 bp, E. coli
cagcgattttgacagggtgaaatca

SEQ ID NO: 163037 - DNA, 25 bp, E. coli
taaacagcgattttgacagggtgaa

SEQ ID NO: 163038 - DNA, 25 bp, E. coli
taaacagcgattatgacagggtgaa

SEQ ID NO: 163039 - DNA, 25 bp, E. coli
attttgacagggagaaatcagccat

SEQ ID NO: 163040 - DNA, 25 bp, E. coli
attttgacagggtgaaatcagccat

SEQ ID NO: 163041 - DNA, 25 bp, E. coli
aaacagcgattttgacagggtgaaa

SEQ ID NO: 163042 - DNA, 25 bp, E. coli
aaacagcgatttagacagggtgaaa

SEQ ID NO: 163043 - DNA, 25 bp, E. coli
tattttccgctaaacagcgattttg

SEQ ID NO: 163044 - DNA, 25 bp, E. coli
tattttccgctatacagcgattttg

SEQ ID NO: 163045 - DNA, 25 bp, E. coli
ttgcgatattttgcgctaaacagcg

SEQ ID NO: 163046 - DNA, 25 bp, E. coli
ttgcgatattttccgctaaacagcg

SEQ ID NO: 163047 - DNA, 25 bp, E. coli
gctaaacagcgaatttgacagggtg

SEQ ID NO: 163048 - DNA, 25 bp, E. coli
gcattgcgatattttccgctaaaca

SEQ ID NO: 163049 - DNA, 25 bp, E. coli
gcattgcgatatattccgctaaaca

SEQ ID NO: 163050 - DNA, 25 bp, E. coli
gctaaacagcgattttgacagggtg

SEQ ID NO: 163051 - DNA, 25 bp, E. coli
ccgctaaacagccattttgacaggg

SEQ ID NO: 163052 - DNA, 25 bp, E. coli
ccgctaaacagcgattttgacaggg

SEQ ID NO: 163053 - DNA, 25 bp, E. coli
cgatattttccgctaaacagcgatt

SEQ ID NO: 163054 - DNA, 25 bp, E. coli
cgatattttccggtaaacagcgatt

SEQ ID NO: 163055 - DNA, 25 bp, E. coli
gattttgacaggctgaaatcagcca

SEQ ID NO: 163056 - DNA, 25 bp, E. coli
gattttgacagggtgaaatcagcca

SEQ ID NO: 163057 - DNA, 25 bp, E. coli
caggtgtggcgcaactcttacggat

SEQ ID NO: 163058 - DNA, 25 bp, E. coli
caggtgtggcgctactcttacggat

SEQ ID NO: 163059 - DNA, 25 bp, E. coli
aagtagtacgtttcacgatcgcggc

SEQ ID NO: 163060 - DNA, 25 bp, E. coli
aagtagtacgttacacgatcgcggc

SEQ ID NO: 163061 - DNA, 25 bp, E. coli
tagccgcagcaaagcgtggcgttcg

SEQ ID NO: 163062 - DNA, 25 bp, E. coli
tagccgcagcaatgcgtggcgttcg

SEQ ID NO: 163063 - DNA, 25 bp, E. coli
tattcagagccactatgatgcggcc

SEQ ID NO: 163064 - DNA, 25 bp, E. coli
tatatgaactcaagccgacgcgtga

SEQ ID NO: 163065 - DNA, 25 bp, E. coli
tattcagagccagtatgatgcggcc

SEQ ID NO: 163066 - DNA, 25 bp, E. coli
tatatgaactcatgccgacgcgtga

SEQ ID NO: 163067 - DNA, 25 bp, E. coli
ttgctggacgactacaatacgcccg

SEQ ID NO: 163068 - DNA, 25 bp, E. coli
ttgctggacgacaacaatacgcccg

SEQ ID NO: 163069 - DNA, 25 bp, E. coli
tgttcgatatcaagggctcacccag

SEQ ID NO: 163070 - DNA, 25 bp, E. coli
tgtgttcgcaacttcccggtcagtg

SEQ ID NO: 163071 - DNA, 25 bp, E. coli
tgtgttcgcaacatcccggtcagtg

SEQ ID NO: 163072 - DNA, 25 bp, E. coli
tgttcgatatcatgggctcacccag

SEQ ID NO: 163073 - DNA, 25 bp, E. coli
tcgtgatagagagcgaaacgctggc

SEQ ID NO: 163074 - DNA, 25 bp, E. coli
tcgtgatagagaccgaaacgctggc

SEQ ID NO: 163075 - DNA, 25 bp, E. coli
gaaaagtctggatgcgtttgccgcc

SEQ ID NO: 163076 - DNA, 25 bp, E. coli
gaaaagtctggaagcgtttgccgcc

SEQ ID NO: 163077 - DNA, 25 bp, E. coli
gagggcaaggcataacggcattcac

SEQ ID NO: 163078 - DNA, 25 bp, E. coli
gagggcaaggcaaaacggcattcac

SEQ ID NO: 163079 - DNA, 25 bp, E. coli
aatatgagacgatgcagcatgacgg

SEQ ID NO: 163080 - DNA, 25 bp, E. coli
aatatgagacgaagcagcatgacgg

SEQ ID NO: 163081 - DNA, 25 bp, E. coli
cagcatgacggtactgggcaacgta

SEQ ID NO: 163082 - DNA, 25 bp, E. coli
cagcatgacggttctgggcaacgta

SEQ ID NO: 163083 - DNA, 25 bp, E. coli
taaacgacgtgcgaacaagcgtgtg

SEQ ID NO: 163084 - DNA, 25 bp, E. coli
taaacgacgtgccaacaagcgtgtg

SEQ ID NO: 163085 - DNA, 25 bp, E. coli
aactggcatggtccagtgctctgca

SEQ ID NO: 163086 - DNA, 25 bp, E. coli
aactggcatggtgcagtgctctgca

SEQ ID NO: 163087 - DNA, 25 bp, E. coli
tatggataccgatttagattcagcg

SEQ ID NO: 163088 - DNA, 25 bp, E. coli
tatggataccgaattagattcagcg

SEQ ID NO: 163089 - DNA, 25 bp, E. coli
tctgcatctcgacccctggcagggt

SEQ ID NO: 163090 - DNA, 25 bp, E. coli
tctgcatctcgagccctggcagggt

SEQ ID NO: 163091 - DNA, 25 bp, E. coli
gaaagtattctcaacagtgccctgg

SEQ ID NO: 163092 - DNA, 25 bp, E. coli
gaaagtattctctacagtgccctgg

SEQ ID NO: 163093 - DNA, 25 bp, E. coli
gatttcaccgttgcttcttcgctgg

SEQ ID NO: 163094 - DNA, 25 bp, E. coli
gatttcaccgttccttcttcgctgg

SEQ ID NO: 163095 - DNA, 25 bp, E. coli
gtgtgcgtgcaaccactctgcgtta

SEQ ID NO: 163096 - DNA, 25 bp, E. coli
gtgtgcgtgcaagcactctgcgtta

SEQ ID NO: 163097 - DNA, 25 bp, E. coli
tggcgacgctgatccaactggcatg

SEQ ID NO: 163098 - DNA, 25 bp, E. coli
ggcttaccagcgacataaacgacgt

SEQ ID NO: 163099 - DNA, 25 bp, E. coli
tggcgacgctgaaccaactggcatg

SEQ ID NO: 163100 - DNA, 25 bp, E. coli
ggcttaccagcgtcataaacgacgt

SEQ ID NO: 163101 - DNA, 25 bp, E. coli
aagacatacttatagaggtgatatg

SEQ ID NO: 163102 - DNA, 25 bp, E. coli
aagacatacttaaagaggtgatatg

SEQ ID NO: 163103 - DNA, 25 bp, E. coli
catacttaaagacgtgatatgggcg

SEQ ID NO: 163104 - DNA, 25 bp, E. coli
catacttaaagaggtgatatgggcg

SEQ ID NO: 163105 - DNA, 25 bp, E. coli
tacttaaagaggtgatatgggcgtt

SEQ ID NO: 163106 - DNA, 25 bp, E. coli
tacttaaagaggagatatgggcgtt

SEQ ID NO: 163107 - DNA, 25 bp, E. coli
acttaaagaggtgatatgggcgttc

SEQ ID NO: 163108 - DNA, 25 bp, E. coli
acttaaagaggtcatatgggcgttc

SEQ ID NO: 163109 - DNA, 25 bp, E. coli
atacttaaagagctgatatgggcgt

SEQ ID NO: 163110 - DNA, 25 bp, E. coli
agacatacttaaagaggtgatatgg

SEQ ID NO: 163111 - DNA, 25 bp, E. coli
atacttaaagaggtgatatgggcgt

SEQ ID NO: 163112 - DNA, 25 bp, E. coli
agacatacttaatgaggtgatatgg

SEQ ID NO: 163113 - DNA, 25 bp, E. coli
acatacttaaagtggtgatatgggc

SEQ ID NO: 163114 - DNA, 25 bp, E. coli
acatacttaaagaggtgatatgggc

SEQ ID NO: 163115 - DNA, 25 bp, E. coli
gaagacatactttaagaggtgatat

SEQ ID NO: 163116 - DNA, 25 bp, E. coli
gaagacatacttaaagaggtgatat

SEQ ID NO: 163117 - DNA, 25 bp, E. coli
gacatacttaaacaggtgatatggg

SEQ ID NO: 163118 - DNA, 25 bp, E. coli
gacatacttaaagaggtgatatggg

SEQ ID NO: 163119 - DNA, 25 bp, E. coli
cgaagacatactaaaagaggtgata

SEQ ID NO: 163120 - DNA, 25 bp, E. coli
cgaagacatacttaaagaggtgata

SEQ ID NO: 163121 - DNA, 25 bp, E. coli
caagcctggcttcttgcaaacaatg

SEQ ID NO: 163122 - DNA, 25 bp, E. coli
caagcctggcttgttgcaaacaatg

SEQ ID NO: 163123 - DNA, 25 bp, E. coli
caatgatgaggatcttcaggaatac

SEQ ID NO: 163124 - DNA, 25 bp, E. coli
caatgatgaggaacttcaggaatac

SEQ ID NO: 163125 - DNA, 25 bp, E. coli
caaacaatgtattaagcacttaggc

SEQ ID NO: 163126 - DNA, 25 bp, E. coli
caaacaatgtataaagcacttaggc

SEQ ID NO: 163127 - DNA, 25 bp, E. coli
taaacgcggaagagagacgtgaatt

SEQ ID NO: 163128 - DNA, 25 bp, E. coli
taaacgcggaagtgagacgtgaatt

SEQ ID NO: 163129 - DNA, 25 bp, E. coli
tttataagtattttcaagcctggct

SEQ ID NO: 163130 - DNA, 25 bp, E. coli
tttataagtattatcaagcctggct

SEQ ID NO: 163131 - DNA, 25 bp, E. coli
tgagcagagtgtgcatataaaatcc

SEQ ID NO: 163132 - DNA, 25 bp, E. coli
tgagcagagtgtccatataaaatcc

SEQ ID NO: 163133 - DNA, 25 bp, E. coli
tgcgctacggcactcacggatttaa

SEQ ID NO: 163134 - DNA, 25 bp, E. coli
tgcgctacggcagtcacggatttaa

SEQ ID NO: 163135 - DNA, 25 bp, E. coli
tcaggaatacgggataaatcccaat

SEQ ID NO: 163136 - DNA, 25 bp, E. coli
tcaggaatacggcataaatcccaat

SEQ ID NO: 163137 - DNA, 25 bp, E. coli
gaaagtcctgatgaaaggctgcgct

SEQ ID NO: 163138 - DNA, 25 bp, E. coli
gaaagtcctgatcaaaggctgcgct

SEQ ID NO: 163139 - DNA, 25 bp, E. coli
cgcccgaaaatccattccaatgatg

SEQ ID NO: 163140 - DNA, 25 bp, E. coli
cgcccgaaaatcgattccaatgatg

SEQ ID NO: 163141 - DNA, 25 bp, E. coli
gatatttttgcacctcataatccgt

SEQ ID NO: 163142 - DNA, 25 bp, E. coli
gatatttttgcagctcataatccgt

SEQ ID NO: 163143 - DNA, 25 bp, E. coli
aacctgctgccatacgtggtgatgg

SEQ ID NO: 163144 - DNA, 25 bp, E. coli
aacctgctgccaaacgtggtgatgg

SEQ ID NO: 163145 - DNA, 25 bp, E. coli
tatttaatgggcaacccggtgcaaa

SEQ ID NO: 163146 - DNA, 25 bp, E. coli
tatttaatgggctacccggtgcaaa

SEQ ID NO: 163147 - DNA, 25 bp, E. coli
ttaacgcattgctgtcgatctgggt

SEQ ID NO: 163148 - DNA, 25 bp, E. coli
ttaacgcattgcagtcgatctgggt

SEQ ID NO: 163149 - DNA, 25 bp, E. coli
tgcaaaatgtcggtcgctgcctggg

SEQ ID NO: 163150 - DNA, 25 bp, E. coli
tgcaaaatgtcgctcgctgcctggg

SEQ ID NO: 163151 - DNA, 25 bp, E. coli
tcattacggtctccgtgattaacgc

SEQ ID NO: 163152 - DNA, 25 bp, E. coli
tctgtgaacccgaaatggcgctgtg

SEQ ID NO: 163153 - DNA, 25 bp, E. coli
tctggcaaccgctggcgcattaacc

SEQ ID NO: 163154 - DNA, 25 bp, E. coli
tctgtgaacccgtaatggcgctgtg

SEQ ID NO: 163155 - DNA, 25 bp, E. coli
tcaggtccgcaaaaacgtcatggat

SEQ ID NO: 163156 - DNA, 25 bp, E. coli
tcaggtccgcaataacgtcatggat

SEQ ID NO: 163157 - DNA, 25 bp, E. coli
tcattacggtctgcgtgattaacgc

SEQ ID NO: 163158 - DNA, 25 bp, E. coli
tctggcaaccgcaggcgcattaacc

SEQ ID NO: 163159 - DNA, 25 bp, E. coli
gaagtgaatgccaaatattacccgc

SEQ ID NO: 163160 - DNA, 25 bp, E. coli
gaagtgaatgcctaatattacccgc

SEQ ID NO: 163161 - DNA, 25 bp, E. coli
ggtgaagcggcaaccgtccttttag

SEQ ID NO: 163162 - DNA, 25 bp, E. coli
ggtgaagcggcatccgtccttttag

SEQ ID NO: 163163 - DNA, 25 bp, E. coli
gatgtcaccgttttactgcccgcga

SEQ ID NO: 163164 - DNA, 25 bp, E. coli
gatgtcaccgttatactgcccgcga

SEQ ID NO: 163165 - DNA, 25 bp, E. coli
caaccgctggtatttgatgcagaac

SEQ ID NO: 163166 - DNA, 25 bp, E. coli
caccgtgcgtgagcgtcttggtagc

SEQ ID NO: 163167 - DNA, 25 bp, E. coli
caaccgctggtaattgatgcagaac

SEQ ID NO: 163168 - DNA, 25 bp, E. coli
caccgtgcgtgaccgtcttggtagc

SEQ ID NO: 163169 - DNA, 25 bp, E. coli
aactggacaccgagcgtgagcgtct

SEQ ID NO: 163170 - DNA, 25 bp, E. coli
aactggacaccgtgcgtgagcgtct

SEQ ID NO: 163171 - DNA, 25 bp, E. coli
tatttgatgcagaactggacaccgt

SEQ ID NO: 163172 - DNA, 25 bp, E. coli
tatttgatgcagtactggacaccgt

SEQ ID NO: 163173 - DNA, 25 bp, E. coli
ttgatgcagaacaggacaccgtgcg

SEQ ID NO: 163174 - DNA, 25 bp, E. coli
ttgatgcagaactggacaccgtgcg

SEQ ID NO: 163175 - DNA, 25 bp, E. coli
tgcgtgagcgtcttggtagcgtaaa

SEQ ID NO: 163176 - DNA, 25 bp, E. coli
tgcgtgagcgtcatggtagcgtaaa

SEQ ID NO: 163177 - DNA, 25 bp, E. coli
gctggtatttgatgcagaactggac

SEQ ID NO: 163178 - DNA, 25 bp, E. coli
gctggtatttgaagcagaactggac

SEQ ID NO: 163179 - DNA, 25 bp, E. coli
gcacaaccgctgctatttgatgcag

SEQ ID NO: 163180 - DNA, 25 bp, E. coli
gcacaaccgctggtatttgatgcag

SEQ ID NO: 163181 - DNA, 25 bp, E. coli
gcagaactggactccgtgcgtgagc

SEQ ID NO: 163182 - DNA, 25 bp, E. coli
gcagaactggacaccgtgcgtgagc

SEQ ID NO: 163183 - DNA, 25 bp, E. coli
gacaccgtgcgtgagcgtcttggta

SEQ ID NO: 163184 - DNA, 25 bp, E. coli
gacaccgtgcgtcagcgtcttggta

SEQ ID NO: 163185 - DNA, 25 bp, E. coli
gatgcagaactggacaccgtgcgtg

SEQ ID NO: 163186 - DNA, 25 bp, E. coli
gatgcagaactgcacaccgtgcgtg

SEQ ID NO: 163187 - DNA, 25 bp, E. coli
caagatgttagccagttactctcaa

SEQ ID NO: 163188 - DNA, 25 bp, E. coli
caagatgttagcgagttactctcaa

SEQ ID NO: 163189 - DNA, 25 bp, E. coli
caggaaatgccttttttgggactgg

SEQ ID NO: 163190 - DNA, 25 bp, E. coli
caggaaatgcctattttgggactgg

SEQ ID NO: 163191 - DNA, 25 bp, E. coli
cagaagatgtatatgatggcggtta

SEQ ID NO: 163192 - DNA, 25 bp, E. coli
cagaagatgtatttgatggcggtta

SEQ ID NO: 163193 - DNA, 25 bp, E. coli
tactaccggtagtgtcgacgaagaa

SEQ ID NO: 163194 - DNA, 25 bp, E. coli
tactaccggtagagtcgacgaagaa

SEQ ID NO: 163195 - DNA, 25 bp, E. coli
tattctcctttggaaggctatcaga

SEQ ID NO: 163196 - DNA, 25 bp, E. coli
tattctcctttgcaaggctatcaga

SEQ ID NO: 163197 - DNA, 25 bp, E. coli
tgtcgacgaagataaatccaaaagc

SEQ ID NO: 163198 - DNA, 25 bp, E. coli
tggtaccatttcttcaacatcgggt

SEQ ID NO: 163199 - DNA, 25 bp, E. coli
tgtcgacgaagaaaaatccaaaagc

SEQ ID NO: 163200 - DNA, 25 bp, E. coli
tgatgattgtgcacaggtaagggaa

SEQ ID NO: 163201 - DNA, 25 bp, E. coli
tgatgattgtgctcaggtaagggaa

SEQ ID NO: 163202 - DNA, 25 bp, E. coli
gattgatgaaattaccgcttgctta

SEQ ID NO: 163203 - DNA, 25 bp, E. coli
gattttacatttaccggtgccgcaa

SEQ ID NO: 163204 - DNA, 25 bp, E. coli
gattgatgaaataaccgcttgctta

SEQ ID NO: 163205 - DNA, 25 bp, E. coli
gattttacattttccggtgccgcaa

SEQ ID NO: 163206 - DNA, 25 bp, E. coli
ggtgccgcaacatctgctgatttat

SEQ ID NO: 163207 - DNA, 25 bp, E. coli
ggtgccgcaacaactgctgatttat

SEQ ID NO: 163208 - DNA, 25 bp, E. coli
tggtaccatttcatcaacatcgggt

SEQ ID NO: 163209 - DNA, 25 bp, E. coli
cacgaattgcaactgtcgggcatgg

SEQ ID NO: 163210 - DNA, 25 bp, E. coli
cacgaattgcaagtgtcgggcatgg

SEQ ID NO: 163211 - DNA, 25 bp, E. coli
atcaacacgacgcatcccgctaccg

SEQ ID NO: 163212 - DNA, 25 bp, E. coli
atcaacacgacggatcccgctaccg

SEQ ID NO: 163213 - DNA, 25 bp, E. coli
tttgatcctgaatgacacgcagtgc

SEQ ID NO: 163214 - DNA, 25 bp, E. coli
tttgatcctgaaagacacgcagtgc

SEQ ID NO: 163215 - DNA, 25 bp, E. coli
tttttgccacgaattgcaactgtcg

SEQ ID NO: 163216 - DNA, 25 bp, E. coli
tttttgccacgatttgcaactgtcg

SEQ ID NO: 163217 - DNA, 25 bp, E. coli
tttgccacgaattgcaactgtcggg

SEQ ID NO: 163218 - DNA, 25 bp, E. coli
tttgccacgaatagcaactgtcggg

SEQ ID NO: 163219 - DNA, 25 bp, E. coli
tgatcctgaaagacacgcagtgcag

SEQ ID NO: 163220 - DNA, 25 bp, E. coli
tgatcctgaaagtcacgcagtgcag

SEQ ID NO: 163221 - DNA, 25 bp, E. coli
cctttgatcctgtaagacacgcagt

SEQ ID NO: 163222 - DNA, 25 bp, E. coli
gccacgaattgctactgtcgggcat

SEQ ID NO: 163223 - DNA, 25 bp, E. coli
cctttgatcctgaaagacacgcagt

SEQ ID NO: 163224 - DNA, 25 bp, E. coli
gccacgaattgcaactgtcgggcat

SEQ ID NO: 163225 - DNA, 25 bp, E. coli
gcatttttgccaggaattgcaactg

SEQ ID NO: 163226 - DNA, 25 bp, E. coli
gcatttttgccacgaattgcaactg

SEQ ID NO: 163227 - DNA, 25 bp, E. coli
gaattgcaactgtcgggcatggtcg

SEQ ID NO: 163228 - DNA, 25 bp, E. coli
gaattgcaactgacgggcatggtcg

SEQ ID NO: 163229 - DNA, 25 bp, E. coli
gctaccgcgaaatcctttgatcctg

SEQ ID NO: 163230 - DNA, 25 bp, E. coli
gctaccgcgaaaacctttgatcctg

SEQ ID NO: 163231 - DNA, 25 bp, E. coli
catgtggaactttgcgatagcgggc

SEQ ID NO: 163232 - DNA, 25 bp, E. coli
catgtggaacttagcgatagcgggc

SEQ ID NO: 163233 - DNA, 25 bp, E. coli
taacgacttgcaccgtcaactggaa

SEQ ID NO: 163234 - DNA, 25 bp, E. coli
agaattaacaccaacgcagcgcgat

SEQ ID NO: 163235 - DNA, 25 bp, E. coli
agaattaacacctacgcagcgcgat

SEQ ID NO: 163236 - DNA, 25 bp, E. coli
tattctggtagaaaaacgtgcgctg

SEQ ID NO: 163237 - DNA, 25 bp, E. coli
tattctggtagataaacgtgcgctg

SEQ ID NO: 163238 - DNA, 25 bp, E. coli
tattttaagtgaaacgccgctggaa

SEQ ID NO: 163239 - DNA, 25 bp, E. coli
tattttaagtgatacgccgctggaa

SEQ ID NO: 163240 - DNA, 25 bp, E. coli
ttaatgcgcgatctaaccggtccga

SEQ ID NO: 163241 - DNA, 25 bp, E. coli
ttaatgcgcgatgtaaccggtccga

SEQ ID NO: 163242 - DNA, 25 bp, E. coli
tgatgattctgaacctggcaccgac

SEQ ID NO: 163243 - DNA, 25 bp, E. coli
tgaagtgcagattcgggataccggc

SEQ ID NO: 163244 - DNA, 25 bp, E. coli
tgaagtgcagatacgggataccggc

SEQ ID NO: 163245 - DNA, 25 bp, E. coli
tgatgattctgatcctggcaccgac

SEQ ID NO: 163246 - DNA, 25 bp, E. coli
gatatttcgttccatagccagccga

SEQ ID NO: 163247 - DNA, 25 bp, E. coli
gatatttcgttcgatagccagccga

SEQ ID NO: 163248 - DNA, 25 bp, E. coli
ggaaaaaccgatttagcgcgcgata

SEQ ID NO: 163249 - DNA, 25 bp, E. coli
ggcgcgtgtctgctgaaaccattaa

SEQ ID NO: 163250 - DNA, 25 bp, E. coli
ggaaaaaccgatatagcgcgcgata

SEQ ID NO: 163251 - DNA, 25 bp, E. coli
ggcgcgtgtctggtgaaaccattaa

SEQ ID NO: 163252 - DNA, 25 bp, E. coli
taacgacttgcagcgtcaactggaa

SEQ ID NO: 163253 - DNA, 25 bp, E. coli
catgcagtttggaatctggtacgaa

SEQ ID NO: 163254 - DNA, 25 bp, E. coli
catgtatgaagccttaaagggcgtt

SEQ ID NO: 163255 - DNA, 25 bp, E. coli
catgtatgaagcgttaaagggcgtt

SEQ ID NO: 163256 - DNA, 25 bp, E. coli
catgcagtttggtatctggtacgaa

SEQ ID NO: 163257 - DNA, 25 bp, E. coli
taaagggcgtttatctctccaccgc

SEQ ID NO: 163258 - DNA, 25 bp, E. coli
taaagggcgtttttctctccaccgc

SEQ ID NO: 163259 - DNA, 25 bp, E. coli
tgaagtacggctgctggttcggcct

SEQ ID NO: 163260 - DNA, 25 bp, E. coli
tgaagtacggctcctggttcggcct

SEQ ID NO: 163261 - DNA, 25 bp, E. coli
cctatattgaaggtggcctggagat

SEQ ID NO: 163262 - DNA, 25 bp, E. coli
cctatattgaagctggcctggagat

SEQ ID NO: 163263 - DNA, 25 bp, E. coli
gaaatcatgctctgtctgcgtcagg

SEQ ID NO: 163264 - DNA, 25 bp, E. coli
gacaaatacaccaatccggcaatga

SEQ ID NO: 163265 - DNA, 25 bp, E. coli
gaaatcatgctcagtctgcgtcagg

SEQ ID NO: 163266 - DNA, 25 bp, E. coli
gacaaatacacctatccggcaatga

SEQ ID NO: 163267 - DNA, 25 bp, E. coli
ctgatttacggcgaaggctggaccg

SEQ ID NO: 163268 - DNA, 25 bp, E. coli
ctgatttacggccaaggctggaccg

SEQ ID NO: 163269 - DNA, 25 bp, E. coli
gatagccgcttctacatgaaaaatg

SEQ ID NO: 163270 - DNA, 25 bp, E. coli
gatagccgcttcaacatgaaaaatg

SEQ ID NO: 163271 - DNA, 25 bp, E. coli
ggattcctcgctggatgacctgcaa

SEQ ID NO: 163272 - DNA, 25 bp, E. coli
ggattcctcgctcgatgacctgcaa

SEQ ID NO: 163273 - DNA, 25 bp, E. coli
taagcggcaactttcgttatagcgt

SEQ ID NO: 163274 - DNA, 25 bp, E. coli
taagcggcaactatcgttatagcgt

SEQ ID NO: 163275 - DNA, 25 bp, E. coli
cacccgtgccaggtaatgttattgg

SEQ ID NO: 163276 - DNA, 25 bp, E. coli
cacccgtgccagctaatgttattgg

SEQ ID NO: 163277 - DNA, 25 bp, E. coli
tgttcactctgaaagcgggacgcaa

SEQ ID NO: 163278 - DNA, 25 bp, E. coli
tgttcactctgatagcgggacgcaa

SEQ ID NO: 163279 - DNA, 25 bp, E. coli
tgaatacatcgccagtgagcacgac

SEQ ID NO: 163280 - DNA, 25 bp, E. coli
tgaatacatcgcgagtgagcacgac

SEQ ID NO: 163281 - DNA, 25 bp, E. coli
tcttatcacggacgaaagctggatc

SEQ ID NO: 163282 - DNA, 25 bp, E. coli
tcagtattatggatccgggagtgca

SEQ ID NO: 163283 - DNA, 25 bp, E. coli
tcagtattatggttccgggagtgca

SEQ ID NO: 163284 - DNA, 25 bp, E. coli
tcttatcacggaggaaagctggatc

SEQ ID NO: 163285 - DNA, 25 bp, E. coli
gcacgactatagtaagaggctctgt

SEQ ID NO: 163286 - DNA, 25 bp, E. coli
gcacgactatagaaagaggctctgt

SEQ ID NO: 163287 - DNA, 25 bp, E. coli
cggagttacctccagcggattatac

SEQ ID NO: 163288 - DNA, 25 bp, E. coli
cggagttacctcgagcggattatac

SEQ ID NO: 163289 - DNA, 25 bp, E. coli
gatattccatcaataccagcacaag

SEQ ID NO: 163290 - DNA, 25 bp, E. coli
gatattccatcattaccagcacaag

SEQ ID NO: 163291 - DNA, 25 bp, E. coli
ggttagcaacaataaatcacccgtg

SEQ ID NO: 163292 - DNA, 25 bp, E. coli
ggttagcaacaaaaaatcacccgtg

SEQ ID NO: 163293 - DNA, 25 bp, E. coli
tggattatgcgctgccggagttacc

SEQ ID NO: 163294 - DNA, 25 bp, E. coli
tggattatgcgcagccggagttacc

SEQ ID NO: 163295 - DNA, 25 bp, E. coli
tcaatcagagttcccgagggttagc

SEQ ID NO: 163296 - DNA, 25 bp, E. coli
tcaatcagagttgccgagggttagc

SEQ ID NO: 163297 - DNA, 25 bp, E. coli
cacagttttcgtcgcctgttaaagg

SEQ ID NO: 163298 - DNA, 25 bp, E. coli
cacagttttcgtggcctgttaaagg

SEQ ID NO: 163299 - DNA, 25 bp, E. coli
tttatgcttcccgtgcaggatgccc

SEQ ID NO: 163300 - DNA, 25 bp, E. coli
tttatgcttcccctgcaggatgccc

SEQ ID NO: 163301 - DNA, 25 bp, E. coli
tgattgtcgcccagcatcagctcaa

SEQ ID NO: 163302 - DNA, 25 bp, E. coli
tgattgtcgccctgcatcagctcaa

SEQ ID NO: 163303 - DNA, 25 bp, E. coli
tgctgctgacgctggccgataacga

SEQ ID NO: 163304 - DNA, 25 bp, E. coli
tgaccctggaaagcgcttttatgct

SEQ ID NO: 163305 - DNA, 25 bp, E. coli
tgaccctggaaaccgcttttatgct

SEQ ID NO: 163306 - DNA, 25 bp, E. coli
tgcaggatgccctgcacagttttcg

SEQ ID NO: 163307 - DNA, 25 bp, E. coli
tgcaggatgcccagcacagttttcg

SEQ ID NO: 163308 - DNA, 25 bp, E. coli
tccgcgaaccacacatgtggaggtg

SEQ ID NO: 163309 - DNA, 25 bp, E. coli
tccgcgaaccactcatgtggaggtg

SEQ ID NO: 163310 - DNA, 25 bp, E. coli
tgctgctgacgcaggccgataacga

SEQ ID NO: 163311 - DNA, 25 bp, E. coli
tcggcatcgacctgatcctgacctg

SEQ ID NO: 163312 - DNA, 25 bp, E. coli
tcggcatcgaccagatcctgacctg

SEQ ID NO: 163313 - DNA, 25 bp, E. coli
cgttttcatacctacgcgccgctgg

SEQ ID NO: 163314 - DNA, 25 bp, E. coli
ccgataacgacacgccggtgtggct

SEQ ID NO: 163315 - DNA, 25 bp, E. coli
cgttttcataccaacgcgccgctgg

SEQ ID NO: 163316 - DNA, 25 bp, E. coli
ccgataacgacaggccggtgtggct

SEQ ID NO: 163317 - DNA, 25 bp, E. coli
ctgttaaaggccatgagcgagccgg

SEQ ID NO: 163318 - DNA, 25 bp, E. coli
ctgttaaaggccttgagcgagccgg

SEQ ID NO: 163319 - DNA, 25 bp, E. coli
caacggcatgtctcttttgactatc

SEQ ID NO: 163320 - DNA, 25 bp, E. coli
aaccggcagtgtcttctctcacgca

SEQ ID NO: 163321 - DNA, 25 bp, E. coli
caacggcatgtcacttttgactatc

SEQ ID NO: 163322 - DNA, 25 bp, E. coli
aaccggcagtgtgttctctcacgca

SEQ ID NO: 163323 - DNA, 25 bp, E. coli
cagccgatggttgtacgattcttaa

SEQ ID NO: 163324 - DNA, 25 bp, E. coli
cagccgatggttctacgattcttaa

SEQ ID NO: 163325 - DNA, 25 bp, E. coli
ttcacaaagcttgagcaaattggcg

SEQ ID NO: 163326 - DNA, 25 bp, E. coli
ttttgactatctggcaaccggcagt

SEQ ID NO: 163327 - DNA, 25 bp, E. coli
ttgttcagaatgaatcagccgatgg

SEQ ID NO: 163328 - DNA, 25 bp, E. coli
ttcacaaagcttcagcaaattggcg

SEQ ID NO: 163329 - DNA, 25 bp, E. coli
ttgttcagaatgtatcagccgatgg

SEQ ID NO: 163330 - DNA, 25 bp, E. coli
ttttgactatctcgcaaccggcagt

SEQ ID NO: 163331 - DNA, 25 bp, E. coli
tctcacgcatcacaaaagcagcagg

SEQ ID NO: 163332 - DNA, 25 bp, E. coli
tctcacgcatcagaaaagcagcagg

SEQ ID NO: 163333 - DNA, 25 bp, E. coli
gcttgcgcgggcattttcacaaagc

SEQ ID NO: 163334 - DNA, 25 bp, E. coli
gcttgcgcgggctttttcacaaagc

SEQ ID NO: 163335 - DNA, 25 bp, E. coli
gaagagttcagaaagtacaacggca

SEQ ID NO: 163336 - DNA, 25 bp, E. coli
gaagagttcagatagtacaacggca

SEQ ID NO: 163337 - DNA, 25 bp, E. coli
gattcttaagcctcgaagagttcag

SEQ ID NO: 163338 - DNA, 25 bp, E. coli
gattcttaagccacgaagagttcag

SEQ ID NO: 163339 - DNA, 25 bp, E. coli
tggcagcatcacgtacctcaatgtg

SEQ ID NO: 163340 - DNA, 25 bp, E. coli
tggcagcatcacctacctcaatgtg

SEQ ID NO: 163341 - DNA, 25 bp, E. coli
aagtagtttgtcgttttgagtggca

SEQ ID NO: 163342 - DNA, 25 bp, E. coli
aagtagtttgtccttttgagtggca

SEQ ID NO: 163343 - DNA, 25 bp, E. coli
cagtcaatcgaattatcagaagcca

SEQ ID NO: 163344 - DNA, 25 bp, E. coli
catttttagtgcctgtagcatagcg

SEQ ID NO: 163345 - DNA, 25 bp, E. coli
catttttagtgcgtgtagcatagcg

SEQ ID NO: 163346 - DNA, 25 bp, E. coli
cagtcaatcgaaatatcagaagcca

SEQ ID NO: 163347 - DNA, 25 bp, E. coli
tagcatagcggatgaggatgtcaga

SEQ ID NO: 163348 - DNA, 25 bp, E. coli
tagcatagcggaagaggatgtcaga

SEQ ID NO: 163349 - DNA, 25 bp, E. coli
ttcaaagaaattcgcgccaggtaag

SEQ ID NO: 163350 - DNA, 25 bp, E. coli
ttcaaagaaattggcgccaggtaag

SEQ ID NO: 163351 - DNA, 25 bp, E. coli
tgtttgatgctgattgcccgatgcg

SEQ ID NO: 163352 - DNA, 25 bp, E. coli
tgtatatcgagagaaaagatgcgca

SEQ ID NO: 163353 - DNA, 25 bp, E. coli
tgtatatcgagacaaaagatgcgca

SEQ ID NO: 163354 - DNA, 25 bp, E. coli
tgtttgatgctgtttgcccgatgcg

SEQ ID NO: 163355 - DNA, 25 bp, E. coli
tcttctcaggccaacgattgtggtg

SEQ ID NO: 163356 - DNA, 25 bp, E. coli
tcttctcaggcctacgattgtggtg

SEQ ID NO: 163357 - DNA, 25 bp, E. coli
gcggtaggccgttattcaaagaaat

SEQ ID NO: 163358 - DNA, 25 bp, E. coli
gcggtaggccgtaattcaaagaaat

SEQ ID NO: 163359 - DNA, 25 bp, E. coli
cgcgccaggtaacgtatttactgta

SEQ ID NO: 163360 - DNA, 25 bp, E. coli
cgcgccaggtaaggtatttactgta

SEQ ID NO: 163361 - DNA, 25 bp, E. coli
cgcatccgccaacagtcaatcgaat

SEQ ID NO: 163362 - DNA, 25 bp, E. coli
cgcatccgccaagagtcaatcgaat

SEQ ID NO: 163363 - DNA, 25 bp, E. coli
tattctgctttccagcgttgtgcaa

SEQ ID NO: 163364 - DNA, 25 bp, E. coli
tttccagcgttgtgcaacctaactt

SEQ ID NO: 163365 - DNA, 25 bp, E. coli
tttccagcgttgagcaacctaactt

SEQ ID NO: 163366 - DNA, 25 bp, E. coli
tattctgctttcgagcgttgtgcaa

SEQ ID NO: 163367 - DNA, 25 bp, E. coli
ttattctgctttgcagcgttgtgca

SEQ ID NO: 163368 - DNA, 25 bp, E. coli
ttctgctttccaccgttgtgcaacc

SEQ ID NO: 163369 - DNA, 25 bp, E. coli
ttattctgctttccagcgttgtgca

SEQ ID NO: 163370 - DNA, 25 bp, E. coli
ttctgctttccagcgttgtgcaacc

SEQ ID NO: 163371 - DNA, 25 bp, E. coli
ttgattattctggtttccagcgttg

SEQ ID NO: 163372 - DNA, 25 bp, E. coli
ttgattattctgctttccagcgttg

SEQ ID NO: 163373 - DNA, 25 bp, E. coli
tgctttccagcgttgtgcaacctaa

SEQ ID NO: 163374 - DNA, 25 bp, E. coli
tgctttccagcgatgtgcaacctaa

SEQ ID NO: 163375 - DNA, 25 bp, E. coli
tccagcgttgtggaacctaacttct

SEQ ID NO: 163376 - DNA, 25 bp, E. coli
tccagcgttgtgcaacctaacttct

SEQ ID NO: 163377 - DNA, 25 bp, E. coli
gctttccagcgtagtgcaacctaac

SEQ ID NO: 163378 - DNA, 25 bp, E. coli
gctttccagcgttgtgcaacctaac

SEQ ID NO: 163379 - DNA, 25 bp, E. coli
cgttgtgcaaccaaacttctggtgg

SEQ ID NO: 163380 - DNA, 25 bp, E. coli
cgttgtgcaacctaacttctggtgg

SEQ ID NO: 163381 - DNA, 25 bp, E. coli
ctgctttccagcgttgtgcaaccta

SEQ ID NO: 163382 - DNA, 25 bp, E. coli
ctgctttccagccttgtgcaaccta

SEQ ID NO: 163383 - DNA, 25 bp, E. coli
gattattctgctttccagcgttgtg

SEQ ID NO: 163384 - DNA, 25 bp, E. coli
gattattctgctatccagcgttgtg

SEQ ID NO: 163385 - DNA, 25 bp, E. coli
cagccttccgcagaagaatctgatt

SEQ ID NO: 163386 - DNA, 25 bp, E. coli
cagccttccgcacaagaatctgatt

SEQ ID NO: 163387 - DNA, 25 bp, E. coli
tacagccttccggacaagaatctga

SEQ ID NO: 163388 - DNA, 25 bp, E. coli
tacagccttccgcacaagaatctga

SEQ ID NO: 163389 - DNA, 25 bp, E. coli
acgctggaatactgccttccgcaca

SEQ ID NO: 163390 - DNA, 25 bp, E. coli
acgctggaatacagccttccgcaca

SEQ ID NO: 163391 - DNA, 25 bp, E. coli
ttccgcacaagattctgattcaggg

SEQ ID NO: 163392 - DNA, 25 bp, E. coli
ttccgcacaagaatctgattcaggg

SEQ ID NO: 163393 - DNA, 25 bp, E. coli
gccttccgcacaagaatctgattca

SEQ ID NO: 163394 - DNA, 25 bp, E. coli
gccttccgcacatgaatctgattca

SEQ ID NO: 163395 - DNA, 25 bp, E. coli
gaatctgattcaggggattgctggt

SEQ ID NO: 163396 - DNA, 25 bp, E. coli
gaatctgattcacgggattgctggt

SEQ ID NO: 163397 - DNA, 25 bp, E. coli
gaatacagccttgcgcacaagaatc

SEQ ID NO: 163398 - DNA, 25 bp, E. coli
gaatacagccttccgcacaagaatc

SEQ ID NO: 163399 - DNA, 25 bp, E. coli
cggtacgctggaatacagccttccg

SEQ ID NO: 163400 - DNA, 25 bp, E. coli
cggtacgctggattacagccttccg

SEQ ID NO: 163401 - DNA, 25 bp, E. coli
gtacgctggaatacagccttccgca

SEQ ID NO: 163402 - DNA, 25 bp, E. coli
ggattgctggtggaatgcacttccg

SEQ ID NO: 163403 - DNA, 25 bp, E. coli
gtacgctggaattcagccttccgca

SEQ ID NO: 163404 - DNA, 25 bp, E. coli
ggattgctggtgcaatgcacttccg

SEQ ID NO: 163405 - DNA, 25 bp, E. coli
tggaatacagccttccgcacaagaa

SEQ ID NO: 163406 - DNA, 25 bp, E. coli
tggaatacagccatccgcacaagaa

SEQ ID NO: 163407 - DNA, 25 bp, E. coli
aagatgcggttttcttgttcctgca

SEQ ID NO: 163408 - DNA, 25 bp, E. coli
aagatgcggtttacttgttcctgca

SEQ ID NO: 163409 - DNA, 25 bp, E. coli
caggttgttgaagatgcggttttct

SEQ ID NO: 163410 - DNA, 25 bp, E. coli
caggttgttgaacatgcggttttct

SEQ ID NO: 163411 - DNA, 25 bp, E. coli
tacaggttgttgtagatgcggtttt

SEQ ID NO: 163412 - DNA, 25 bp, E. coli
tacaggttgttgaagatgcggtttt

SEQ ID NO: 163413 - DNA, 25 bp, E. coli
agatgcggttttcttgttcctgcac

SEQ ID NO: 163414 - DNA, 25 bp, E. coli
atgcggttttctagttcctgcacac

SEQ ID NO: 163415 - DNA, 25 bp, E. coli
agatgcggttttgttgttcctgcac

SEQ ID NO: 163416 - DNA, 25 bp, E. coli
atgcggttttcttgttcctgcacac

SEQ ID NO: 163417 - DNA, 25 bp, E. coli
acaggttgttgaagatgcggttttc

SEQ ID NO: 163418 - DNA, 25 bp, E. coli
acaggttgttgatgatgcggttttc

SEQ ID NO: 163419 - DNA, 25 bp, E. coli
ttacaggttgttgaagatgcggttt

SEQ ID NO: 163420 - DNA, 25 bp, E. coli
ttacaggttgttcaagatgcggttt

SEQ ID NO: 163421 - DNA, 25 bp, E. coli
tgcggttttcttcttcctgcacacg

SEQ ID NO: 163422 - DNA, 25 bp, E. coli
tgcggttttcttgttcctgcacacg

SEQ ID NO: 163423 - DNA, 25 bp, E. coli
gaagatgcggttttcttgttcctgc

SEQ ID NO: 163424 - DNA, 25 bp, E. coli
gaagatgcggttatcttgttcctgc

SEQ ID NO: 163425 - DNA, 25 bp, E. coli
ggttgttgaagaagcggttttcttg

SEQ ID NO: 163426 - DNA, 25 bp, E. coli
ggttgttgaagatgcggttttcttg

SEQ ID NO: 163427 - DNA, 25 bp, E. coli
gatgcggttttcttgttcctgcaca

SEQ ID NO: 163428 - DNA, 25 bp, E. coli
gatgcggttttcatgttcctgcaca

SEQ ID NO: 163429 - DNA, 25 bp, E. coli
caaagcgcaagaaaatgccgcctgg

SEQ ID NO: 163430 - DNA, 25 bp, E. coli
caaagcgcaagataatgccgcctgg

SEQ ID NO: 163431 - DNA, 25 bp, E. coli
catattcttcagcaactgcgtctgg

SEQ ID NO: 163432 - DNA, 25 bp, E. coli
catattcttcaggaactgcgtctgg

SEQ ID NO: 163433 - DNA, 25 bp, E. coli
ttgccagtcgacaaacgctattgct

SEQ ID NO: 163434 - DNA, 25 bp, E. coli
ttgccagtcgactaacgctattgct

SEQ ID NO: 163435 - DNA, 25 bp, E. coli
tgttattgcaggaaagccaggacgc

SEQ ID NO: 163436 - DNA, 25 bp, E. coli
tgttgatgggaaaaagtaagcgcgc

SEQ ID NO: 163437 - DNA, 25 bp, E. coli
tgttattgcaggtaagccaggacgc

SEQ ID NO: 163438 - DNA, 25 bp, E. coli
tgttgatgggaataagtaagcgcgc

SEQ ID NO: 163439 - DNA, 25 bp, E. coli
tgcgcgcgcaaatcagctcaactta

SEQ ID NO: 163440 - DNA, 25 bp, E. coli
tgcgcgcgcaaaacagctcaactta

SEQ ID NO: 163441 - DNA, 25 bp, E. coli
tccgcgcgcagctcaatgaagggct

SEQ ID NO: 163442 - DNA, 25 bp, E. coli
tccgcgcgcagcacaatgaagggct

SEQ ID NO: 163443 - DNA, 25 bp, E. coli
gaatcgcagcgtccaggtgacctgt

SEQ ID NO: 163444 - DNA, 25 bp, E. coli
gaatcgcagcgtgcaggtgacctgt

SEQ ID NO: 163445 - DNA, 25 bp, E. coli
cgaaccggttattttgttgcgcaca

SEQ ID NO: 163446 - DNA, 25 bp, E. coli
cgaaccggttatattgttgcgcaca

SEQ ID NO: 163447 - DNA, 25 bp, E. coli
taagcatcgggtatggcagaaccgc

SEQ ID NO: 163448 - DNA, 25 bp, E. coli
taagcatcgggtttggcagaaccgc

SEQ ID NO: 163449 - DNA, 25 bp, E. coli
gatcgtccgcggtaataaattaagc

SEQ ID NO: 163450 - DNA, 25 bp, E. coli
gatcgtccgcggaaataaattaagc

SEQ ID NO: 163451 - DNA, 25 bp, E. coli
catcgacgccgttgacatgattgtg

SEQ ID NO: 163452 - DNA, 25 bp, E. coli
catcgacgccgtagacatgattgtg

SEQ ID NO: 163453 - DNA, 25 bp, E. coli
taaagcagtgcgaacagtccaggat

SEQ ID NO: 163454 - DNA, 25 bp, E. coli
taaagcagtgcgtacagtccaggat

SEQ ID NO: 163455 - DNA, 25 bp, E. coli
tatcaggaagtcacagccctgctgg

SEQ ID NO: 163456 - DNA, 25 bp, E. coli
tatcaggaagtctcagccctgctgg

SEQ ID NO: 163457 - DNA, 25 bp, E. coli
tgtgcacctgcataagaaaaccggt

SEQ ID NO: 163458 - DNA, 25 bp, E. coli
tgtgcacctgcaaaagaaaaccggt

SEQ ID NO: 163459 - DNA, 25 bp, E. coli
tcgaggctgtagtacgcctgctaca

SEQ ID NO: 163460 - DNA, 25 bp, E. coli
tcgaggctgtagaacgcctgctaca

SEQ ID NO: 163461 - DNA, 25 bp, E. coli
ccggaagagtttaaagcagtgcgta

SEQ ID NO: 163462 - DNA, 25 bp, E. coli
ccggaagagttttaagcagtgcgta

SEQ ID NO: 163463 - DNA, 25 bp, E. coli
gccctgctggttaagctgtttgaaa

SEQ ID NO: 163464 - DNA, 25 bp, E. coli
gccctgctggtttagctgtttgaaa

SEQ ID NO: 163465 - DNA, 25 bp, E. coli
gctgtttgaaatggatccgcaggac

SEQ ID NO: 163466 - DNA, 25 bp, E. coli
gctgtttgaaatcgatccgcaggac

SEQ ID NO: 163467 - DNA, 25 bp, E. coli
cgttgacatgatagtgcacctgcaa

SEQ ID NO: 163468 - DNA, 25 bp, E. coli
cgatccgcaggagatcaaacctgaa

SEQ ID NO: 163469 - DNA, 25 bp, E. coli
cgttgacatgattgtgcacctgcaa

SEQ ID NO: 163470 - DNA, 25 bp, E. coli
cgatccgcaggacatcaaacctgaa

SEQ ID NO: 163471 - DNA, 25 bp, E. coli
taagaaaatcaagccggaagagttt

SEQ ID NO: 163472 - DNA, 25 bp, E. coli
taagaaaatcaacccggaagagttt

SEQ ID NO: 163473 - DNA, 25 bp, E. coli
aacggtctgattttcgcttatctca

SEQ ID NO: 163474 - DNA, 25 bp, E. coli
agtggcttctcttcctttgctcagg

SEQ ID NO: 163475 - DNA, 25 bp, E. coli
agtggcttctctacctttgctcagg

SEQ ID NO: 163476 - DNA, 25 bp, E. coli
aacggtctgattatcgcttatctca

SEQ ID NO: 163477 - DNA, 25 bp, E. coli
tacctttgctcacggctttgtcgcg

SEQ ID NO: 163478 - DNA, 25 bp, E. coli
tacctttgctcagggctttgtcgcg

SEQ ID NO: 163479 - DNA, 25 bp, E. coli
tttgctcagggctttgtcgcgctgg

SEQ ID NO: 163480 - DNA, 25 bp, E. coli
tttgctcagggcattgtcgcgctgg

SEQ ID NO: 163481 - DNA, 25 bp, E. coli
tgatcaacggtcagattatcgctta

SEQ ID NO: 163482 - DNA, 25 bp, E. coli
tgatcaacggtctgattatcgctta

SEQ ID NO: 163483 - DNA, 25 bp, E. coli
tctggttttgactgtggcttctcta

SEQ ID NO: 163484 - DNA, 25 bp, E. coli
tctggttttgacagtggcttctcta

SEQ ID NO: 163485 - DNA, 25 bp, E. coli
gctcggcacgatgatcatcgtctat

SEQ ID NO: 163486 - DNA, 25 bp, E. coli
gctcggcacgatcatcatcgtctat

SEQ ID NO: 163487 - DNA, 25 bp, E. coli
cgatgatcatcgtctatggcatcaa

SEQ ID NO: 163488 - DNA, 25 bp, E. coli
cgatgatcatcgactatggcatcaa

SEQ ID NO: 163489 - DNA, 25 bp, E. coli
cgttcgtctgggtgttgtggaacaa

SEQ ID NO: 163490 - DNA, 25 bp, E. coli
cgttcgtctgggagttgtggaacaa

SEQ ID NO: 163491 - DNA, 25 bp, E. coli
gatcatcgtctatggcatcaactcg

SEQ ID NO: 163492 - DNA, 25 bp, E. coli
gatcatcgtctaaggcatcaactcg

SEQ ID NO: 163493 - DNA, 25 bp, E. coli
gtctgattatcggttatctcaacgt

SEQ ID NO: 163494 - DNA, 25 bp, E. coli
gtctgattatcgcttatctcaacgt

SEQ ID NO: 163495 - DNA, 25 bp, E. coli
catattgagcgtcatgtgtcagtgc

SEQ ID NO: 163496 - DNA, 25 bp, E. coli
catattgagcgtgatgtgtcagtgc

SEQ ID NO: 163497 - DNA, 25 bp, E. coli
tacccgcatattgagcgtcatgtgt

SEQ ID NO: 163498 - DNA, 25 bp, E. coli
tacccgcatattcagcgtcatgtgt

SEQ ID NO: 163499 - DNA, 25 bp, E. coli
tattgagcgtcaagtgtcagtgcag

SEQ ID NO: 163500 - DNA, 25 bp, E. coli
tattgagcgtcatgtgtcagtgcag

SEQ ID NO: 163501 - DNA, 25 bp, E. coli
ttgagcgtcatgagtcagtgcaggc

SEQ ID NO: 163502 - DNA, 25 bp, E. coli
ttgagcgtcatgtgtcagtgcaggc

SEQ ID NO: 163503 - DNA, 25 bp, E. coli
tcatgtgtcagtccaggcttcggcg

SEQ ID NO: 163504 - DNA, 25 bp, E. coli
tcatgtgtcagtgcaggcttcggcg

SEQ ID NO: 163505 - DNA, 25 bp, E. coli
gcgtcatgtgtctgtgcaggcttcg

SEQ ID NO: 163506 - DNA, 25 bp, E. coli
gcgtcatgtgtcagtgcaggcttcg

SEQ ID NO: 163507 - DNA, 25 bp, E. coli
gcgttacccgcaaattgagcgtcat

SEQ ID NO: 163508 - DNA, 25 bp, E. coli
gcgttacccgcatattgagcgtcat

SEQ ID NO: 163509 - DNA, 25 bp, E. coli
cgcatattgagcctcatgtgtcagt

SEQ ID NO: 163510 - DNA, 25 bp, E. coli
cccgcatattgaccgtcatgtgtca

SEQ ID NO: 163511 - DNA, 25 bp, E. coli
cccgcatattgagcgtcatgtgtca

SEQ ID NO: 163512 - DNA, 25 bp, E. coli
cgcatattgagcgtcatgtgtcagt

SEQ ID NO: 163513 - DNA, 25 bp, E. coli
gttacccgcatattgagcgtcatgt

SEQ ID NO: 163514 - DNA, 25 bp, E. coli
gttacccgcataatgagcgtcatgt

SEQ ID NO: 163515 - DNA, 25 bp, E. coli
gagcgtcatgtgacagtgcaggctt

SEQ ID NO: 163516 - DNA, 25 bp, E. coli
gagcgtcatgtgtcagtgcaggctt

SEQ ID NO: 163517 - DNA, 25 bp, E. coli
cagtaagccctacgatgaaatgtga

SEQ ID NO: 163518 - DNA, 25 bp, E. coli
cagtaagccctaggatgaaatgtga

SEQ ID NO: 163519 - DNA, 25 bp, E. coli
aaattttcattgcaacatgacgagg

SEQ ID NO: 163520 - DNA, 25 bp, E. coli
aaattttcattggaacatgacgagg

SEQ ID NO: 163521 - DNA, 25 bp, E. coli
aaagcttatggtttactccgccgcc

SEQ ID NO: 163522 - DNA, 25 bp, E. coli
aaagcttatggtatactccgccgcc

SEQ ID NO: 163523 - DNA, 25 bp, E. coli
taccggatcgtttcacagtaagccc

SEQ ID NO: 163524 - DNA, 25 bp, E. coli
taccggatcgttacacagtaagccc

SEQ ID NO: 163525 - DNA, 25 bp, E. coli
tatagcactgcccatatcacgctca

SEQ ID NO: 163526 - DNA, 25 bp, E. coli
tatagcactgccgatatcacgctca

SEQ ID NO: 163527 - DNA, 25 bp, E. coli
tatcacgctcaataaacaaccactg

SEQ ID NO: 163528 - DNA, 25 bp, E. coli
tatcacgctcaaaaaacaaccactg

SEQ ID NO: 163529 - DNA, 25 bp, E. coli
tgtccacagttaaggtcacgcccgt

SEQ ID NO: 163530 - DNA, 25 bp, E. coli
tgtccacagttatggtcacgcccgt

SEQ ID NO: 163531 - DNA, 25 bp, E. coli
tctccagaaatagggataacgctac

SEQ ID NO: 163532 - DNA, 25 bp, E. coli
tctccagaaatacggataacgctac

SEQ ID NO: 163533 - DNA, 25 bp, E. coli
gccgccttaacaattttcaccgcaa

SEQ ID NO: 163534 - DNA, 25 bp, E. coli
gccgccttaacatttttcaccgcaa

SEQ ID NO: 163535 - DNA, 25 bp, E. coli
gcaaaaatgaaaatcagcccgctga

SEQ ID NO: 163536 - DNA, 25 bp, E. coli
gcaaaaatgaaattcagcccgctga

SEQ ID NO: 163537 - DNA, 25 bp, E. coli
gtcaccaacggcttaccggatcgtt

SEQ ID NO: 163538 - DNA, 25 bp, E. coli
gtcaccaacggcataccggatcgtt

SEQ ID NO: 163539 - DNA, 25 bp, E. coli
aagccacggcgttccgacggtgaat

SEQ ID NO: 163540 - DNA, 25 bp, E. coli
caaaaagctcgattcggagcacaac

SEQ ID NO: 163541 - DNA, 25 bp, E. coli
caaaaagctcgaatcggagcacaac

SEQ ID NO: 163542 - DNA, 25 bp, E. coli
agtccgtgttgacggagtatccgca

SEQ ID NO: 163543 - DNA, 25 bp, E. coli
agtccgtgttgagggagtatccgca

SEQ ID NO: 163544 - DNA, 25 bp, E. coli
actgacggcccggtagcggcgctgg

SEQ ID NO: 163545 - DNA, 25 bp, E. coli
aagccacggcgtaccgacggtgaat

SEQ ID NO: 163546 - DNA, 25 bp, E. coli
actgacggcccgctagcggcgctgg

SEQ ID NO: 163547 - DNA, 25 bp, E. coli
ttcggagcacaacaagttaatctgg

SEQ ID NO: 163548 - DNA, 25 bp, E. coli
ttcggagcacaagaagttaatctgg

SEQ ID NO: 163549 - DNA, 25 bp, E. coli
tgctggaaagccacggcgtaccgac

SEQ ID NO: 163550 - DNA, 25 bp, E. coli
tgctggaaagcctcggcgtaccgac

SEQ ID NO: 163551 - DNA, 25 bp, E. coli
cgtaccgacggtgaataaagtgcaa

SEQ ID NO: 163552 - DNA, 25 bp, E. coli
cgtgttgagggactatccgcaaatg

SEQ ID NO: 163553 - DNA, 25 bp, E. coli
cgtaccgacggtcaataaagtgcaa

SEQ ID NO: 163554 - DNA, 25 bp, E. coli
ctcgattcggagcacaacaagttaa

SEQ ID NO: 163555 - DNA, 25 bp, E. coli
cgtgttgagggagtatccgcaaatg

SEQ ID NO: 163556 - DNA, 25 bp, E. coli
ctcgattcggaggacaacaagttaa

SEQ ID NO: 163557 - DNA, 25 bp, E. coli
gacggtgaataatgtgcaactcgga

SEQ ID NO: 163558 - DNA, 25 bp, E. coli
gagaaagtcaaaaagctcgattcgg

SEQ ID NO: 163559 - DNA, 25 bp, E. coli
gagaaagtcaaatagctcgattcgg

SEQ ID NO: 163560 - DNA, 25 bp, E. coli
gacggtgaataaagtgcaactcgga

SEQ ID NO: 163561 - DNA, 25 bp, E. coli
aacactgctcgtccaattgccatgg

SEQ ID NO: 163562 - DNA, 25 bp, E. coli
aaaataatgagtaatagcctggtgg

SEQ ID NO: 163563 - DNA, 25 bp, E. coli
aacactgctcgtgcaattgccatgg

SEQ ID NO: 163564 - DNA, 25 bp, E. coli
aaaataatgagttatagcctggtgg

SEQ ID NO: 163565 - DNA, 25 bp, E. coli
tcaccttatttactcgttgtcatcg

SEQ ID NO: 163566 - DNA, 25 bp, E. coli
gccatgggtgcattttttaaggagt

SEQ ID NO: 163567 - DNA, 25 bp, E. coli
gccatgggtgcaatttttaaggagt

SEQ ID NO: 163568 - DNA, 25 bp, E. coli
gcatgactgcaattaacatacaggg

SEQ ID NO: 163569 - DNA, 25 bp, E. coli
gcatgactgcaaataacatacaggg

SEQ ID NO: 163570 - DNA, 25 bp, E. coli
gttgtcatcgataccgtaatcgcca

SEQ ID NO: 163571 - DNA, 25 bp, E. coli
gataatccgctctcttttaacctga

SEQ ID NO: 163572 - DNA, 25 bp, E. coli
gattatgtgatccagacaggcaaaa

SEQ ID NO: 163573 - DNA, 25 bp, E. coli
gattatgtgatcgagacaggcaaaa

SEQ ID NO: 163574 - DNA, 25 bp, E. coli
gataatccgctcacttttaacctga

SEQ ID NO: 163575 - DNA, 25 bp, E. coli
gttgtcatcgattccgtaatcgcca

SEQ ID NO: 163576 - DNA, 25 bp, E. coli
gtaatcgccacaataacactgctcg

SEQ ID NO: 163577 - DNA, 25 bp, E. coli
gtaatcgccacattaacactgctcg

SEQ ID NO: 163578 - DNA, 25 bp, E. coli
tgtcttcctttttaacgacggtgtg

SEQ ID NO: 163579 - DNA, 25 bp, E. coli
tgtcttccttttaaacgacggtgtg

SEQ ID NO: 163580 - DNA, 25 bp, E. coli
taacgacggtgtgaagcatgactgc

SEQ ID NO: 163581 - DNA, 25 bp, E. coli
tcaccttatttagtcgttgtcatcg

SEQ ID NO: 163582 - DNA, 25 bp, E. coli
taacgacggtgtcaagcatgactgc

SEQ ID NO: 163583 - DNA, 25 bp, E. coli
cataatccggttggcttgctggaag

SEQ ID NO: 163584 - DNA, 25 bp, E. coli
cataatccggttcgcttgctggaag

SEQ ID NO: 163585 - DNA, 25 bp, E. coli
tattgccggtaaagcctacgtgatg

SEQ ID NO: 163586 - DNA, 25 bp, E. coli
tattgccggtaatgcctacgtgatg

SEQ ID NO: 163587 - DNA, 25 bp, E. coli
tgccggtaatgcgtacgtgatggat

SEQ ID NO: 163588 - DNA, 25 bp, E. coli
tgccggtaatgcctacgtgatggat

SEQ ID NO: 163589 - DNA, 25 bp, E. coli
gccgagcgagcaaaatccggttggc

SEQ ID NO: 163590 - DNA, 25 bp, E. coli
gccgagcgagcataatccggttggc

SEQ ID NO: 163591 - DNA, 25 bp, E. coli
gcataatccggttggcttgctggaa

SEQ ID NO: 163592 - DNA, 25 bp, E. coli
gcataatccggtaggcttgctggaa

SEQ ID NO: 163593 - DNA, 25 bp, E. coli
gaacgccacccgatcccgcattggt

SEQ ID NO: 163594 - DNA, 25 bp, E. coli
gaacgccacccgttcccgcattggt

SEQ ID NO: 163595 - DNA, 25 bp, E. coli
gaaacgtcgcgagcgcatctcggcc

SEQ ID NO: 163596 - DNA, 25 bp, E. coli
gaaacgtcgcgaccgcatctcggcc

SEQ ID NO: 163597 - DNA, 25 bp, E. coli
cgcgtattgccgctaatgcctacgt

SEQ ID NO: 163598 - DNA, 25 bp, E. coli
cgcgtattgccggtaatgcctacgt

SEQ ID NO: 163599 - DNA, 25 bp, E. coli
gcgagcgcatctcggcccgtctggg

SEQ ID NO: 163600 - DNA, 25 bp, E. coli
gcgagcgcatctgggcccgtctggg

SEQ ID NO: 163601 - DNA, 25 bp, E. coli
ggtaatgcctacctgatggatgctg

SEQ ID NO: 163602 - DNA, 25 bp, E. coli
ggtaatgcctacgtgatggatgctg

SEQ ID NO: 163603 - DNA, 25 bp, E. coli
gagcgagcataatccggttggcttg

SEQ ID NO: 163604 - DNA, 25 bp, E. coli
gagcgagcataaaccggttggcttg

SEQ ID NO: 163605 - DNA, 25 bp, E. coli
cacgagtcctttgcacttgcttact

SEQ ID NO: 163606 - DNA, 25 bp, E. coli
cacgagtcctttccacttgcttact

SEQ ID NO: 163607 - DNA, 25 bp, E. coli
cagaatgcgcattaaaataacagca

SEQ ID NO: 163608 - DNA, 25 bp, E. coli
cagaatgcgcataaaaataacagca

SEQ ID NO: 163609 - DNA, 25 bp, E. coli
taacagcataaatcaccttaccacc

SEQ ID NO: 163610 - DNA, 25 bp, E. coli
aacagccccgtcaacacatcgttgg

SEQ ID NO: 163611 - DNA, 25 bp, E. coli
aacagccccgtctacacatcgttgg

SEQ ID NO: 163612 - DNA, 25 bp, E. coli
ttaccaccacccaagaatttcatat

SEQ ID NO: 163613 - DNA, 25 bp, E. coli
ttaccaccaccctagaatttcatat

SEQ ID NO: 163614 - DNA, 25 bp, E. coli
tatctcacgataaataacattagga

SEQ ID NO: 163615 - DNA, 25 bp, E. coli
tattattcgcgtaatatctcacgat

SEQ ID NO: 163616 - DNA, 25 bp, E. coli
tatctcacgatatataacattagga

SEQ ID NO: 163617 - DNA, 25 bp, E. coli
tattattcgcgttatatctcacgat

SEQ ID NO: 163618 - DNA, 25 bp, E. coli
tgcgttcaaaattataatcaagtac

SEQ ID NO: 163619 - DNA, 25 bp, E. coli
tgcgttcaaaataataatcaagtac

SEQ ID NO: 163620 - DNA, 25 bp, E. coli
gatttttacgtgttaattcaggaga

SEQ ID NO: 163621 - DNA, 25 bp, E. coli
gttatttaaacaggagtcctttgca

SEQ ID NO: 163622 - DNA, 25 bp, E. coli
gttatttaaacacgagtcctttgca

SEQ ID NO: 163623 - DNA, 25 bp, E. coli
gatttttacgtgataattcaggaga

SEQ ID NO: 163624 - DNA, 25 bp, E. coli
taacagcataaaacaccttaccacc

SEQ ID NO: 163625 - DNA, 25 bp, E. coli
taattcaggagagacagaatgcgca

SEQ ID NO: 163626 - DNA, 25 bp, E. coli
taattcaggagacacagaatgcgca

SEQ ID NO: 163627 - DNA, 25 bp, E. coli
aatacgctgctgactctgtccccaa

SEQ ID NO: 163628 - DNA, 25 bp, E. coli
aatacgctgctgtctctgtccccaa

SEQ ID NO: 163629 - DNA, 25 bp, E. coli
tagaatgattaagtggaccgcaact

SEQ ID NO: 163630 - DNA, 25 bp, E. coli
tagtgtatgagaaaagattaacgcc

SEQ ID NO: 163631 - DNA, 25 bp, E. coli
tagaatgattaactggaccgcaact

SEQ ID NO: 163632 - DNA, 25 bp, E. coli
tagtgtatgagataagattaacgcc

SEQ ID NO: 163633 - DNA, 25 bp, E. coli
tattctgagcccttaacattgatcg

SEQ ID NO: 163634 - DNA, 25 bp, E. coli
tattctgagcccataacattgatcg

SEQ ID NO: 163635 - DNA, 25 bp, E. coli
tcgcatcctcttcgcaaacacagtg

SEQ ID NO: 163636 - DNA, 25 bp, E. coli
tcgcatcctcttggcaaacacagtg

SEQ ID NO: 163637 - DNA, 25 bp, E. coli
gaagcttaccgcgtcatcctgaatg

SEQ ID NO: 163638 - DNA, 25 bp, E. coli
gaatatcaggatcaagcttaccgcc

SEQ ID NO: 163639 - DNA, 25 bp, E. coli
gaatatcaggatgaagcttaccgcc

SEQ ID NO: 163640 - DNA, 25 bp, E. coli
gaagcttaccgcctcatcctgaatg

SEQ ID NO: 163641 - DNA, 25 bp, E. coli
gatattttccctaacccgatagtgt

SEQ ID NO: 163642 - DNA, 25 bp, E. coli
gatattttcccttacccgatagtgt

SEQ ID NO: 163643 - DNA, 25 bp, E. coli
ggaccgcaactgaagcaagaatatc

SEQ ID NO: 163644 - DNA, 25 bp, E. coli
ggaccgcaactgtagcaagaatatc

SEQ ID NO: 163645 - DNA, 25 bp, E. coli
tcagcagcctgatattaagcattca

SEQ ID NO: 163646 - DNA, 25 bp, E. coli
tcagcagcctgaaattaagcattca

SEQ ID NO: 163647 - DNA, 25 bp, E. coli
taagcattcaactaatacgctgctg

SEQ ID NO: 163648 - DNA, 25 bp, E. coli
taagcattcaacaaatacgctgctg

SEQ ID NO: 163649 - DNA, 25 bp, E. coli
atgaacagcgcaacagcttctggcc

SEQ ID NO: 163650 - DNA, 25 bp, E. coli
atctggaatctgtacaccctgaaca

SEQ ID NO: 163651 - DNA, 25 bp, E. coli
atgaacagcgcatcagcttctggcc

SEQ ID NO: 163652 - DNA, 25 bp, E. coli
atctggaatctgaacaccctgaaca

SEQ ID NO: 163653 - DNA, 25 bp, E. coli
acagcgcatcagcttctggccgcag

SEQ ID NO: 163654 - DNA, 25 bp, E. coli
acagcgcatcaggttctggccgcag

SEQ ID NO: 163655 - DNA, 25 bp, E. coli
tatctggaatctgtacaccctgaac

SEQ ID NO: 163656 - DNA, 25 bp, E. coli
tatctggaatctctacaccctgaac

SEQ ID NO: 163657 - DNA, 25 bp, E. coli
tgaacagcgcatcagcttctggccg

SEQ ID NO: 163658 - DNA, 25 bp, E. coli
tgaacagcgcatgagcttctggccg

SEQ ID NO: 163659 - DNA, 25 bp, E. coli
tctggaatctgtacaccctgaacaa

SEQ ID NO: 163660 - DNA, 25 bp, E. coli
tctggaatctgttcaccctgaacaa

SEQ ID NO: 163661 - DNA, 25 bp, E. coli
gaacagcgcatcagcttctggccgc

SEQ ID NO: 163662 - DNA, 25 bp, E. coli
gaacagcgcatctgcttctggccgc

SEQ ID NO: 163663 - DNA, 25 bp, E. coli
gtatctggaatcagtacaccctgaa

SEQ ID NO: 163664 - DNA, 25 bp, E. coli
gtatctggaatctgtacaccctgaa

SEQ ID NO: 163665 - DNA, 25 bp, E. coli
tggaatctgtactccctgaacaacg

SEQ ID NO: 163666 - DNA, 25 bp, E. coli
tggaatctgtacaccctgaacaacg

SEQ ID NO: 163667 - DNA, 25 bp, E. coli
ggtatctggaatgtgtacaccctga

SEQ ID NO: 163668 - DNA, 25 bp, E. coli
ggtatctggaatctgtacaccctga

SEQ ID NO: 163669 - DNA, 25 bp, E. coli
ggaatctgtacagcctgaacaacgg

SEQ ID NO: 163670 - DNA, 25 bp, E. coli
ggaatctgtacaccctgaacaacgg

SEQ ID NO: 163671 - DNA, 25 bp, E. coli
catggcaagcgctgaatagagaatt

SEQ ID NO: 163672 - DNA, 25 bp, E. coli
catggcaagcgcagaatagagaatt

SEQ ID NO: 163673 - DNA, 25 bp, E. coli
taaaggctttttctggctaccagga

SEQ ID NO: 163674 - DNA, 25 bp, E. coli
taaaggctttttgtggctaccagga

SEQ ID NO: 163675 - DNA, 25 bp, E. coli
ataatcacctgagccacgaagagcg

SEQ ID NO: 163676 - DNA, 25 bp, E. coli
ataatcacctgacccacgaagagcg

SEQ ID NO: 163677 - DNA, 25 bp, E. coli
tttgtcgaaacatccggaggtagcc

SEQ ID NO: 163678 - DNA, 25 bp, E. coli
tttgtcgaaacaaccggaggtagcc

SEQ ID NO: 163679 - DNA, 25 bp, E. coli
tgtggcgaaagcaatccatcctctg

SEQ ID NO: 163680 - DNA, 25 bp, E. coli
tgtggcgaaagctatccatcctctg

SEQ ID NO: 163681 - DNA, 25 bp, E. coli
ccagagtgggattaagacggtcgac

SEQ ID NO: 163682 - DNA, 25 bp, E. coli
ccagagtgggataaagacggtcgac

SEQ ID NO: 163683 - DNA, 25 bp, E. coli
gaattccggtgttttggcagaccct

SEQ ID NO: 163684 - DNA, 25 bp, E. coli
gaattccggtgtattggcagaccct

SEQ ID NO: 163685 - DNA, 25 bp, E. coli
gactataacggacggaaagcactga

SEQ ID NO: 163686 - DNA, 25 bp, E. coli
gactataacggagggaaagcactga

SEQ ID NO: 163687 - DNA, 25 bp, E. coli
gatagtatcagctgccagagtggga

SEQ ID NO: 163688 - DNA, 25 bp, E. coli
gatagtatcagcagccagagtggga

SEQ ID NO: 163689 - DNA, 25 bp, E. coli
ggcgcaggaaaaaccactcttatga

SEQ ID NO: 163690 - DNA, 25 bp, E. coli
ggcgcaggaaaatccactcttatga

SEQ ID NO: 163691 - DNA, 25 bp, E. coli
gacctgacatgggtctgctctggaa

SEQ ID NO: 163692 - DNA, 25 bp, E. coli
gacctgacatggctctgctctggaa

SEQ ID NO: 163693 - DNA, 25 bp, E. coli
aaaaccatgccaggagcgctgattg

SEQ ID NO: 163694 - DNA, 25 bp, E. coli
aaaaccatgccacgagcgctgattg

SEQ ID NO: 163695 - DNA, 25 bp, E. coli
tacgcgatggcgaaagacaacctgt

SEQ ID NO: 163696 - DNA, 25 bp, E. coli
tacgcgatggcgtaagacaacctgt

SEQ ID NO: 163697 - DNA, 25 bp, E. coli
tatcgctatgggaagccaggaactc

SEQ ID NO: 163698 - DNA, 25 bp, E. coli
tatcgctatgggtagccaggaactc

SEQ ID NO: 163699 - DNA, 25 bp, E. coli
tatctgaaaaatcccggaagccgac

SEQ ID NO: 163700 - DNA, 25 bp, E. coli
tatctgaaaaatgccggaagccgac

SEQ ID NO: 163701 - DNA, 25 bp, E. coli
tgtgcatccgaattacaacacgccg

SEQ ID NO: 163702 - DNA, 25 bp, E. coli
tgggatctttgtagccatcacggcg

SEQ ID NO: 163703 - DNA, 25 bp, E. coli
tgtgcatccgaaatacaacacgccg

SEQ ID NO: 163704 - DNA, 25 bp, E. coli
tgggatctttgttgccatcacggcg

SEQ ID NO: 163705 - DNA, 25 bp, E. coli
tcggtaaatttaacgccgccggatt

SEQ ID NO: 163706 - DNA, 25 bp, E. coli
tcggtaaatttatcgccgccggatt

SEQ ID NO: 163707 - DNA, 25 bp, E. coli
ccatcatctggtgtcgtaaacgcga

SEQ ID NO: 163708 - DNA, 25 bp, E. coli
ccatcatctggtctcgtaaacgcga

SEQ ID NO: 163709 - DNA, 25 bp, E. coli
gcttatccggaatatggcgcagatt

SEQ ID NO: 163710 - DNA, 25 bp, E. coli
gcttatccggaaaatggcgcagatt

SEQ ID NO: 163711 - DNA, 25 bp, E. coli
taacgcctatcgttccgttgctcgg

SEQ ID NO: 163712 - DNA, 25 bp, E. coli
taacgcctatcgatccgttgctcgg

SEQ ID NO: 163713 - DNA, 25 bp, E. coli
gacgattacaaagcgctgtggcgta

SEQ ID NO: 163714 - DNA, 25 bp, E. coli
gacgattacaaaccgctgtggcgta

SEQ ID NO: 163715 - DNA, 25 bp, E. coli
cacatagctgtgttgacggtatcca

SEQ ID NO: 163716 - DNA, 25 bp, E. coli
cacatagctgtgatgacggtatcca

SEQ ID NO: 163717 - DNA, 25 bp, E. coli
cagacccgtgggatgtatctggcag

SEQ ID NO: 163718 - DNA, 25 bp, E. coli
cagacccgtgggttgtatctggcag

SEQ ID NO: 163719 - DNA, 25 bp, E. coli
cagggctttatcttcgggcgggtaa

SEQ ID NO: 163720 - DNA, 25 bp, E. coli
cagggctttatcatcgggcgggtaa

SEQ ID NO: 163721 - DNA, 25 bp, E. coli
ttcacgcaggtgagacgctgacgct

SEQ ID NO: 163722 - DNA, 25 bp, E. coli
ttcacgcaggtgtgacgctgacgct

SEQ ID NO: 163723 - DNA, 25 bp, E. coli
tgtacctcaaagaactgctgctgcc

SEQ ID NO: 163724 - DNA, 25 bp, E. coli
tgtacctcaaagtactgctgctgcc

SEQ ID NO: 163725 - DNA, 25 bp, E. coli
tcagtttggctgtagcgacgacgcg

SEQ ID NO: 163726 - DNA, 25 bp, E. coli
tcagtttggctgaagcgacgacgcg

SEQ ID NO: 163727 - DNA, 25 bp, E. coli
cgctgacgctgctaaaacgggtgtg

SEQ ID NO: 163728 - DNA, 25 bp, E. coli
cgctgacgctgcaaaaacgggtgtg

SEQ ID NO: 163729 - DNA, 25 bp, E. coli
gattttctcgttatcccgcgaagca

SEQ ID NO: 163730 - DNA, 25 bp, E. coli
gattttctcgttttcccgcgaagca

SEQ ID NO: 163731 - DNA, 25 bp, E. coli
gggacgacagactagccgctttaga

SEQ ID NO: 163732 - DNA, 25 bp, E. coli
gggacgacagacaagccgctttaga

SEQ ID NO: 163733 - DNA, 25 bp, E. coli
tggcgtattacaacgtccagcaggc

SEQ ID NO: 163734 - DNA, 25 bp, E. coli
tggcgtattacatcgtccagcaggc

SEQ ID NO: 163735 - DNA, 25 bp, E. coli
gacgcgtttattgatcgtgcagaaa

SEQ ID NO: 163736 - DNA, 25 bp, E. coli
gacgcgtttattcatcgtgcagaaa

SEQ ID NO: 163737 - DNA, 25 bp, E. coli
taacaaactataaactgccaacaag

SEQ ID NO: 163738 - DNA, 25 bp, E. coli
taacaaactatatactgccaacaag

SEQ ID NO: 163739 - DNA, 25 bp, E. coli
aaatataatggagaaacttatcggg

SEQ ID NO: 163740 - DNA, 25 bp, E. coli
actatgagatggaaaatgatgcccc

SEQ ID NO: 163741 - DNA, 25 bp, E. coli
aaatataatggacaaacttatcggg

SEQ ID NO: 163742 - DNA, 25 bp, E. coli
actatgagatggtaaatgatgcccc

SEQ ID NO: 163743 - DNA, 25 bp, E. coli
tatatgagaaaaccttaactttccg

SEQ ID NO: 163744 - DNA, 25 bp, E. coli
tatatgagaaaagcttaactttccg

SEQ ID NO: 163745 - DNA, 25 bp, E. coli
tttaatcagacaaacaaatgaccct

SEQ ID NO: 163746 - DNA, 25 bp, E. coli
tttaatcagacatacaaatgaccct

SEQ ID NO: 163747 - DNA, 25 bp, E. coli
tctgcagcatatattacataatgac

SEQ ID NO: 163748 - DNA, 25 bp, E. coli
tcatattgactttgacaaaagagct

SEQ ID NO: 163749 - DNA, 25 bp, E. coli
tctcaactataaaatcatgggacac

SEQ ID NO: 163750 - DNA, 25 bp, E. coli
tcatattgacttagacaaaagagct

SEQ ID NO: 163751 - DNA, 25 bp, E. coli
tctcaactataatatcatgggacac

SEQ ID NO: 163752 - DNA, 25 bp, E. coli
tctgcagcatattttacataatgac

SEQ ID NO: 163753 - DNA, 25 bp, E. coli
gccaacaagtcgtactcatggttca

SEQ ID NO: 163754 - DNA, 25 bp, E. coli
gccaacaagtcgaactcatggttca

SEQ ID NO: 163755 - DNA, 25 bp, E. coli
tgtaagattttagcagcatatgctt

SEQ ID NO: 163756 - DNA, 25 bp, E. coli
tgtaagattttaccagcatatgctt

SEQ ID NO: 163757 - DNA, 25 bp, E. coli
taatgacatacaagaacaaacatcg

SEQ ID NO: 163758 - DNA, 25 bp, E. coli
taatgacatacatgaacaaacatcg

SEQ ID NO: 163759 - DNA, 25 bp, E. coli
caatataagttttagagcgacgcca

SEQ ID NO: 163760 - DNA, 25 bp, E. coli
caatataagtttaagagcgacgcca

SEQ ID NO: 163761 - DNA, 25 bp, E. coli
catcatgattaggaaaacttaacca

SEQ ID NO: 163762 - DNA, 25 bp, E. coli
caggtggtttgattgaatgtagcaa

SEQ ID NO: 163763 - DNA, 25 bp, E. coli
caggtggtttgaatgaatgtagcaa

SEQ ID NO: 163764 - DNA, 25 bp, E. coli
catcatgattagcaaaacttaacca

SEQ ID NO: 163765 - DNA, 25 bp, E. coli
aaaggcagctttttgttacaggtgg

SEQ ID NO: 163766 - DNA, 25 bp, E. coli
aaaggcagctttatgttacaggtgg

SEQ ID NO: 163767 - DNA, 25 bp, E. coli
tagcaacgaaattcagaatttcagg

SEQ ID NO: 163768 - DNA, 25 bp, E. coli
tagcaacgaaatacagaatttcagg

SEQ ID NO: 163769 - DNA, 25 bp, E. coli
tatagcaatagaacgtcaaaggcag

SEQ ID NO: 163770 - DNA, 25 bp, E. coli
tatagcaatagatcgtcaaaggcag

SEQ ID NO: 163771 - DNA, 25 bp, E. coli
gccacaggatgaactatcaaaaata

SEQ ID NO: 163772 - DNA, 25 bp, E. coli
gccacaggatgatctatcaaaaata

SEQ ID NO: 163773 - DNA, 25 bp, E. coli
gaatttcaggtcttgtaactcccgg

SEQ ID NO: 163774 - DNA, 25 bp, E. coli
gaatttcaggtcatgtaactcccgg

SEQ ID NO: 163775 - DNA, 25 bp, E. coli
ggtcatgtaactgccggcaaaaccg

SEQ ID NO: 163776 - DNA, 25 bp, E. coli
ggtcatgtaactcccggcaaaaccg

SEQ ID NO: 163777 - DNA, 25 bp, E. coli
tcaaaaatagctgatcatgattagc

SEQ ID NO: 163778 - DNA, 25 bp, E. coli
tcaaaaatagctcatcatgattagc

SEQ ID NO: 163779 - DNA, 25 bp, E. coli
gagcgacgccactggatgaactatc

SEQ ID NO: 163780 - DNA, 25 bp, E. coli
gagcgacgccacaggatgaactatc

SEQ ID NO: 163781 - DNA, 25 bp, E. coli
cagacggattaatgcaggagatcga

SEQ ID NO: 163782 - DNA, 25 bp, E. coli
cagggactgccgtattcgctcaaat

SEQ ID NO: 163783 - DNA, 25 bp, E. coli
cagggactgccgaattcgctcaaat

SEQ ID NO: 163784 - DNA, 25 bp, E. coli
cagacggattaaagcaggagatcga

SEQ ID NO: 163785 - DNA, 25 bp, E. coli
agggactgccgttttcgctcaaata

SEQ ID NO: 163786 - DNA, 25 bp, E. coli
acatcagagtgccactgaccgaacc

SEQ ID NO: 163787 - DNA, 25 bp, E. coli
acatcagagtgcgactgaccgaacc

SEQ ID NO: 163788 - DNA, 25 bp, E. coli
agggactgccgtattcgctcaaata

SEQ ID NO: 163789 - DNA, 25 bp, E. coli
tcgaaaaggtgcgtgcgaagctatt

SEQ ID NO: 163790 - DNA, 25 bp, E. coli
tcgaaaaggtgcctgcgaagctatt

SEQ ID NO: 163791 - DNA, 25 bp, E. coli
cctgcgaagctaatcgctggtggat

SEQ ID NO: 163792 - DNA, 25 bp, E. coli
cctgcgaagctattcgctggtggat

SEQ ID NO: 163793 - DNA, 25 bp, E. coli
gaaaaggtgcctccgaagctattcg

SEQ ID NO: 163794 - DNA, 25 bp, E. coli
gaaaaggtgcctgcgaagctattcg

SEQ ID NO: 163795 - DNA, 25 bp, E. coli
gggactgccgtattcgctcaaataa

SEQ ID NO: 163796 - DNA, 25 bp, E. coli
ggactgccgtattcgctcaaataac

SEQ ID NO: 163797 - DNA, 25 bp, E. coli
gggactgccgtaatcgctcaaataa

SEQ ID NO: 163798 - DNA, 25 bp, E. coli
tggagaaaaacaacagagtgccact

SEQ ID NO: 163799 - DNA, 25 bp, E. coli
ggactgccgtatacgctcaaataac

SEQ ID NO: 163800 - DNA, 25 bp, E. coli
tggagaaaaacatcagagtgccact

SEQ ID NO: 163801 - DNA, 25 bp, E. coli
taactgttacggtcaggtatcccgt

SEQ ID NO: 163802 - DNA, 25 bp, E. coli
taactgttacggacaggtatcccgt

SEQ ID NO: 163803 - DNA, 25 bp, E. coli
caaatgcaacgtcctggtgtgggcc

SEQ ID NO: 163804 - DNA, 25 bp, E. coli
caaatgcaacgtgctggtgtgggcc

SEQ ID NO: 163805 - DNA, 25 bp, E. coli
tacttacagcgtcacattccggcaa

SEQ ID NO: 163806 - DNA, 25 bp, E. coli
tacttacagcgtgacattccggcaa

SEQ ID NO: 163807 - DNA, 25 bp, E. coli
tatagcctcgattaaaacgccggcg

SEQ ID NO: 163808 - DNA, 25 bp, E. coli
tatagcctcgataaaaacgccggcg

SEQ ID NO: 163809 - DNA, 25 bp, E. coli
tgtaagttgcactaccagttcccgg

SEQ ID NO: 163810 - DNA, 25 bp, E. coli
tgtaagttgcacaaccagttcccgg

SEQ ID NO: 163811 - DNA, 25 bp, E. coli
tgggtatcaacagcagcatcggcgc

SEQ ID NO: 163812 - DNA, 25 bp, E. coli
tgggtatcaacaccagcatcggcgc

SEQ ID NO: 163813 - DNA, 25 bp, E. coli
tgtcagcccataacgtgaaaaccgg

SEQ ID NO: 163814 - DNA, 25 bp, E. coli
tgtcagcccatatcgtgaaaaccgg

SEQ ID NO: 163815 - DNA, 25 bp, E. coli
tctggcaaagtcttacgaaaaggcg

SEQ ID NO: 163816 - DNA, 25 bp, E. coli
tcgtgcgcgcggaaactataactgg

SEQ ID NO: 163817 - DNA, 25 bp, E. coli
tctggcaaagtcatacgaaaaggcg

SEQ ID NO: 163818 - DNA, 25 bp, E. coli
tcgtgcgcgcggtaactataactgg

SEQ ID NO: 163819 - DNA, 25 bp, E. coli
ggtgttaatcaaggccctaggtgct

SEQ ID NO: 163820 - DNA, 25 bp, E. coli
ggtgttaatcaacgccctaggtgct

SEQ ID NO: 163821 - DNA, 25 bp, E. coli
gggacatcatttaacctcgcggcgt

SEQ ID NO: 163822 - DNA, 25 bp, E. coli
gggacatcattttacctcgcggcgt

SEQ ID NO: 163823 - DNA, 25 bp, E. coli
ggaatcgggaattaacgctgccaca

SEQ ID NO: 163824 - DNA, 25 bp, E. coli
ggaatcgggaataaacgctgccaca

SEQ ID NO: 163825 - DNA, 25 bp, E. coli
atcacctatccaggcgccagtaaaa

SEQ ID NO: 163826 - DNA, 25 bp, E. coli
atcacctatccacgcgccagtaaaa

SEQ ID NO: 163827 - DNA, 25 bp, E. coli
tatcaaccgctgaatgccgcattgg

SEQ ID NO: 163828 - DNA, 25 bp, E. coli
tatcaaccgctgtatgccgcattgg

SEQ ID NO: 163829 - DNA, 25 bp, E. coli
tgtcatcgcaaatttaccgctggca

SEQ ID NO: 163830 - DNA, 25 bp, E. coli
tgcatcctggtaagttggaaaaaca

SEQ ID NO: 163831 - DNA, 25 bp, E. coli
tgtcatcgcaaaattaccgctggca

SEQ ID NO: 163832 - DNA, 25 bp, E. coli
tgcatcctggtatgttggaaaaaca

SEQ ID NO: 163833 - DNA, 25 bp, E. coli
tccgcaatttgagaggcagcagtgg

SEQ ID NO: 163834 - DNA, 25 bp, E. coli
tccgcaatttgacaggcagcagtgg

SEQ ID NO: 163835 - DNA, 25 bp, E. coli
gccgcattgggcttgcatcctggta

SEQ ID NO: 163836 - DNA, 25 bp, E. coli
gccgcattgggcatgcatcctggta

SEQ ID NO: 163837 - DNA, 25 bp, E. coli
gcgatgcatcttaaacgccacgatt

SEQ ID NO: 163838 - DNA, 25 bp, E. coli
gcgatgcatctttaacgccacgatt

SEQ ID NO: 163839 - DNA, 25 bp, E. coli
gcgaaacgctaccatctgccggtga

SEQ ID NO: 163840 - DNA, 25 bp, E. coli
gcgaaacgctacgatctgccggtga

SEQ ID NO: 163841 - DNA, 25 bp, E. coli
gaacaactgaaactggcgaaacgct

SEQ ID NO: 163842 - DNA, 25 bp, E. coli
gaacaactgaaagtggcgaaacgct

SEQ ID NO: 163843 - DNA, 25 bp, E. coli
gtttttccggcagcctgcaacaggc

SEQ ID NO: 163844 - DNA, 25 bp, E. coli
gtttttccggcaccctgcaacaggc

SEQ ID NO: 163845 - DNA, 25 bp, E. coli
tggaaaaacataccgatgtgtctct

SEQ ID NO: 163846 - DNA, 25 bp, E. coli
tggaaaaacatagcgatgtgtctct

SEQ ID NO: 163847 - DNA, 25 bp, E. coli
caatggcagaaaattgcaaaagata

SEQ ID NO: 163848 - DNA, 25 bp, E. coli
caatggcagaaatttgcaaaagata

SEQ ID NO: 163849 - DNA, 25 bp, E. coli
ttgtcaggaaaattttccagccacg

SEQ ID NO: 163850 - DNA, 25 bp, E. coli
ttgtcaggaaaaatttccagccacg

SEQ ID NO: 163851 - DNA, 25 bp, E. coli
tccagccacgttattaacagaatga

SEQ ID NO: 163852 - DNA, 25 bp, E. coli
tccagccacgtttttaacagaatga

SEQ ID NO: 163853 - DNA, 25 bp, E. coli
tcaggaaaaattaccagccacgttt

SEQ ID NO: 163854 - DNA, 25 bp, E. coli
tcaggaaaaatttccagccacgttt

SEQ ID NO: 163855 - DNA, 25 bp, E. coli
ccacaatggcagtaaattgcaaaag

SEQ ID NO: 163856 - DNA, 25 bp, E. coli
ccacaatggcagaaaattgcaaaag

SEQ ID NO: 163857 - DNA, 25 bp, E. coli
gcgccgcgttttttaccccacaatg

SEQ ID NO: 163858 - DNA, 25 bp, E. coli
gcgccgcgttttataccccacaatg

SEQ ID NO: 163859 - DNA, 25 bp, E. coli
gcattgtcaggataaatttccagcc

SEQ ID NO: 163860 - DNA, 25 bp, E. coli
gcattgtcaggaaaaatttccagcc

SEQ ID NO: 163861 - DNA, 25 bp, E. coli
gaaaattgcaaatgataaatacgca

SEQ ID NO: 163862 - DNA, 25 bp, E. coli
gaaaattgcaaaagataaatacgca

SEQ ID NO: 163863 - DNA, 25 bp, E. coli
gcaaaagataaaaacgcagaatgcc

SEQ ID NO: 163864 - DNA, 25 bp, E. coli
gcaaaagataaatacgcagaatgcc

SEQ ID NO: 163865 - DNA, 25 bp, E. coli
ccgcgttttataccccacaatggca

SEQ ID NO: 163866 - DNA, 25 bp, E. coli
cgttttataccccacaatggcagaa

SEQ ID NO: 163867 - DNA, 25 bp, E. coli
cgttttatacccgacaatggcagaa

SEQ ID NO: 163868 - DNA, 25 bp, E. coli
ccgcgttttatagcccacaatggca

SEQ ID NO: 163869 - DNA, 25 bp, E. coli
catgggtagaaccacacaggctcaa

SEQ ID NO: 163870 - DNA, 25 bp, E. coli
catgggtagaacgacacaggctcaa

SEQ ID NO: 163871 - DNA, 25 bp, E. coli
tacagagagcatccggaaaatcttg

SEQ ID NO: 163872 - DNA, 25 bp, E. coli
tactgacgattttagccctccgggt

SEQ ID NO: 163873 - DNA, 25 bp, E. coli
taaaaatgcggatacaacatctgct

SEQ ID NO: 163874 - DNA, 25 bp, E. coli
taaaaatgcggaaacaacatctgct

SEQ ID NO: 163875 - DNA, 25 bp, E. coli
tacagagagcatgcggaaaatcttg

SEQ ID NO: 163876 - DNA, 25 bp, E. coli
tactgacgatttaagccctccgggt

SEQ ID NO: 163877 - DNA, 25 bp, E. coli
tatttttgccaaagtgcagggaggg

SEQ ID NO: 163878 - DNA, 25 bp, E. coli
tatttttgccaatgtgcagggaggg

SEQ ID NO: 163879 - DNA, 25 bp, E. coli
tgccgcggttaaaggatacgattcc

SEQ ID NO: 163880 - DNA, 25 bp, E. coli
tgccgcggttaatggatacgattcc

SEQ ID NO: 163881 - DNA, 25 bp, E. coli
ccaatgctttgggtgaacaactagt

SEQ ID NO: 163882 - DNA, 25 bp, E. coli
ccaatgctttggctgaacaactagt

SEQ ID NO: 163883 - DNA, 25 bp, E. coli
gaatcctgttatagtaggccctaaa

SEQ ID NO: 163884 - DNA, 25 bp, E. coli
gaatcctgttattgtaggccctaaa

SEQ ID NO: 163885 - DNA, 25 bp, E. coli
ccaaagcccggtgtaaatgtctgca

SEQ ID NO: 163886 - DNA, 25 bp, E. coli
ccaaagcccggtctaaatgtctgca

SEQ ID NO: 163887 - DNA, 25 bp, E. coli
ctaataaatggcagctgagaggcgt

SEQ ID NO: 163888 - DNA, 25 bp, E. coli
ctaataaatggctgctgagaggcgt

SEQ ID NO: 163889 - DNA, 25 bp, E. coli
taagcgaagttctgtatactgacga

SEQ ID NO: 163890 - DNA, 25 bp, E. coli
taagcgaagttcagtatactgacga

SEQ ID NO: 163891 - DNA, 25 bp, E. coli
catcgatggtagaggtgggtaactt

SEQ ID NO: 163892 - DNA, 25 bp, E. coli
catcgatggtagtggtgggtaactt

SEQ ID NO: 163893 - DNA, 25 bp, E. coli
cagtggctttgggatcagaaccgga

SEQ ID NO: 163894 - DNA, 25 bp, E. coli
cagtggctttggcatcagaaccgga

SEQ ID NO: 163895 - DNA, 25 bp, E. coli
tagcactaccctcggtctgggttac

SEQ ID NO: 163896 - DNA, 25 bp, E. coli
ttaagcgccgcgtttgtaaccacag

SEQ ID NO: 163897 - DNA, 25 bp, E. coli
ttaagcgccgcgattgtaaccacag

SEQ ID NO: 163898 - DNA, 25 bp, E. coli
tgttaattgccgtcgccgcatcgat

SEQ ID NO: 163899 - DNA, 25 bp, E. coli
tgttaattgccgacgccgcatcgat

SEQ ID NO: 163900 - DNA, 25 bp, E. coli
tgccgtcgccgcatcgatggtagtg

SEQ ID NO: 163901 - DNA, 25 bp, E. coli
tgccgtcgccgcttcgatggtagtg

SEQ ID NO: 163902 - DNA, 25 bp, E. coli
tctgcgtttactataagcgccgcgt

SEQ ID NO: 163903 - DNA, 25 bp, E. coli
tctgcgtttactttaagcgccgcgt

SEQ ID NO: 163904 - DNA, 25 bp, E. coli
gccgcgtttgtatccacaggcttag

SEQ ID NO: 163905 - DNA, 25 bp, E. coli
gccgcgtttgtaaccacaggcttag

SEQ ID NO: 163906 - DNA, 25 bp, E. coli
ggtaaaattggtagcactaccctgg

SEQ ID NO: 163907 - DNA, 25 bp, E. coli
ggtaaaattggttgcactaccctgg

SEQ ID NO: 163908 - DNA, 25 bp, E. coli
tggctggtgtttactgcgtttactt

SEQ ID NO: 163909 - DNA, 25 bp, E. coli
tggctggtgttttctgcgtttactt

SEQ ID NO: 163910 - DNA, 25 bp, E. coli
taaccacaggctaaggtaaacgtat

SEQ ID NO: 163911 - DNA, 25 bp, E. coli
tagcactaccctgggtctgggttac

SEQ ID NO: 163912 - DNA, 25 bp, E. coli
taaccacaggcttaggtaaacgtat

SEQ ID NO: 163913 - DNA, 25 bp, E. coli
catgatgacccaaggcactttggtg

SEQ ID NO: 163914 - DNA, 25 bp, E. coli
catgatgacccatggcactttggtg

SEQ ID NO: 163915 - DNA, 25 bp, E. coli
taaaaaccttgaagcagaatccgcg

SEQ ID NO: 163916 - DNA, 25 bp, E. coli
tacaacctgagcgacggtgccatgg

SEQ ID NO: 163917 - DNA, 25 bp, E. coli
tacaacctgagccacggtgccatgg

SEQ ID NO: 163918 - DNA, 25 bp, E. coli
taaaaaccttgatgcagaatccgcg

SEQ ID NO: 163919 - DNA, 25 bp, E. coli
aaaaccttgaagcagaatccgcgca

SEQ ID NO: 163920 - DNA, 25 bp, E. coli
aaaaccttgaaggagaatccgcgca

SEQ ID NO: 163921 - DNA, 25 bp, E. coli
ttgaagcagaatgcgcgcaagaaca

SEQ ID NO: 163922 - DNA, 25 bp, E. coli
ttgaagcagaatccgcgcaagaaca

SEQ ID NO: 163923 - DNA, 25 bp, E. coli
tgccatggaagaagccctgtacgaa

SEQ ID NO: 163924 - DNA, 25 bp, E. coli
tgccatggaagatgccctgtacgaa

SEQ ID NO: 163925 - DNA, 25 bp, E. coli
cctgagcgacggtgccatggaagat

SEQ ID NO: 163926 - DNA, 25 bp, E. coli
cctgagcgacggagccatggaagat

SEQ ID NO: 163927 - DNA, 25 bp, E. coli
ccaaggcactttggtggatgccacc

SEQ ID NO: 163928 - DNA, 25 bp, E. coli
ccaaggcactttcgtggatgccacc

SEQ ID NO: 163929 - DNA, 25 bp, E. coli
gcagaatccgcggaagaacaaaacg

SEQ ID NO: 163930 - DNA, 25 bp, E. coli
gcgacggtgccatggaagatgccct

SEQ ID NO: 163931 - DNA, 25 bp, E. coli
gcagaatccgcgcaagaacaaaacg

SEQ ID NO: 163932 - DNA, 25 bp, E. coli
gcgacggtgccaaggaagatgccct

SEQ ID NO: 163933 - DNA, 25 bp, E. coli
cggtgccatggatgatgccctgtac

SEQ ID NO: 163934 - DNA, 25 bp, E. coli
cggtgccatggaagatgccctgtac

SEQ ID NO: 163935 - DNA, 25 bp, E. coli
aatcagctgggctttaccagtattc

SEQ ID NO: 163936 - DNA, 25 bp, E. coli
aatcagctgggcattaccagtattc

SEQ ID NO: 163937 - DNA, 25 bp, E. coli
tacgagcagttctctcacggctggc

SEQ ID NO: 163938 - DNA, 25 bp, E. coli
agctgggcattaccagtattctggt

SEQ ID NO: 163939 - DNA, 25 bp, E. coli
agatctggggatgcgcaaacctgaa

SEQ ID NO: 163940 - DNA, 25 bp, E. coli
agatctggggatccgcaaacctgaa

SEQ ID NO: 163941 - DNA, 25 bp, E. coli
agctgggcattagcagtattctggt

SEQ ID NO: 163942 - DNA, 25 bp, E. coli
tacgagcagttcactcacggctggc

SEQ ID NO: 163943 - DNA, 25 bp, E. coli
tatctgtcgcaacatctggggatgc

SEQ ID NO: 163944 - DNA, 25 bp, E. coli
tatctgtcgcaagatctggggatgc

SEQ ID NO: 163945 - DNA, 25 bp, E. coli
ttcatatgggggtggcgtttcatca

SEQ ID NO: 163946 - DNA, 25 bp, E. coli
ttcatatgggggaggcgtttcatca

SEQ ID NO: 163947 - DNA, 25 bp, E. coli
tgtttgttgcgctgcgcccggaagt

SEQ ID NO: 163948 - DNA, 25 bp, E. coli
tgtttgttgcgcagcgcccggaagt

SEQ ID NO: 163949 - DNA, 25 bp, E. coli
tgagatggctctaccgctaagctac

SEQ ID NO: 163950 - DNA, 25 bp, E. coli
tgagatggctcttccgctaagctac

SEQ ID NO: 163951 - DNA, 25 bp, E. coli
tctaccgctaagctacgagcagttc

SEQ ID NO: 163952 - DNA, 25 bp, E. coli
tctctcacggctggcaggcggtgtt

SEQ ID NO: 163953 - DNA, 25 bp, E. coli
tctaccgctaaggtacgagcagttc

SEQ ID NO: 163954 - DNA, 25 bp, E. coli
tctctcacggctcgcaggcggtgtt

SEQ ID NO: 163955 - DNA, 25 bp, E. coli
cgagcagttctctcacggctggcag

SEQ ID NO: 163956 - DNA, 25 bp, E. coli
cgagcagttctcacacggctggcag

SEQ ID NO: 163957 - DNA, 25 bp, E. coli
caatcgttatggtattctttgtcct

SEQ ID NO: 163958 - DNA, 25 bp, E. coli
caatcgttatggaattctttgtcct

SEQ ID NO: 163959 - DNA, 25 bp, E. coli
caggctaacgaacgtattgtgtttg

SEQ ID NO: 163960 - DNA, 25 bp, E. coli
caggctaacgaaggtattgtgtttg

SEQ ID NO: 163961 - DNA, 25 bp, E. coli
cgaacgtattgtgtttgttgaaggt

SEQ ID NO: 163962 - DNA, 25 bp, E. coli
cgaacgtattgtctttgttgaaggt

SEQ ID NO: 163963 - DNA, 25 bp, E. coli
ttttcgacgttgttttccatctggg

SEQ ID NO: 163964 - DNA, 25 bp, E. coli
ttttcgacgttgatttccatctggg

SEQ ID NO: 163965 - DNA, 25 bp, E. coli
ttgtcctgatctgcccgctttgcgg

SEQ ID NO: 163966 - DNA, 25 bp, E. coli
ttgtcctgatctccccgctttgcgg

SEQ ID NO: 163967 - DNA, 25 bp, E. coli
tgcgggcaggctaacgaacgtattg

SEQ ID NO: 163968 - DNA, 25 bp, E. coli
tgcgggcaggcttacgaacgtattg

SEQ ID NO: 163969 - DNA, 25 bp, E. coli
tctgatgacaaatacaatcgttatg

SEQ ID NO: 163970 - DNA, 25 bp, E. coli
tctttgtcctgaactgcccgctttg

SEQ ID NO: 163971 - DNA, 25 bp, E. coli
tctttgtcctgatctgcccgctttg

SEQ ID NO: 163972 - DNA, 25 bp, E. coli
tctgatgacaaaaacaatcgttatg

SEQ ID NO: 163973 - DNA, 25 bp, E. coli
gctttgcgggcaggctaacgaacgt

SEQ ID NO: 163974 - DNA, 25 bp, E. coli
gctttgcgggcacgctaacgaacgt

SEQ ID NO: 163975 - DNA, 25 bp, E. coli
gaattctttgtcctgatctgcccgc

SEQ ID NO: 163976 - DNA, 25 bp, E. coli
gaatttctgatgacaaaaacaatcg

SEQ ID NO: 163977 - DNA, 25 bp, E. coli
gaatttctgatgtcaaaaacaatcg

SEQ ID NO: 163978 - DNA, 25 bp, E. coli
gaattctttgtcgtgatctgcccgc

SEQ ID NO: 163979 - DNA, 25 bp, E. coli
aagaccgtgagaaggcatccgacgc

SEQ ID NO: 163980 - DNA, 25 bp, E. coli
aagaccgtgagatggcatccgacgc

SEQ ID NO: 163981 - DNA, 25 bp, E. coli
aggcggtcaacatagcggtggtaat

SEQ ID NO: 163982 - DNA, 25 bp, E. coli
agaaggcatccgtcgcaggccgtaa

SEQ ID NO: 163983 - DNA, 25 bp, E. coli
aggcggtcaacaaagcggtggtaat

SEQ ID NO: 163984 - DNA, 25 bp, E. coli
agaaggcatccgacgcaggccgtaa

SEQ ID NO: 163985 - DNA, 25 bp, E. coli
aacaaagcggtgctaataaatcagg

SEQ ID NO: 163986 - DNA, 25 bp, E. coli
aaatttcgccgaagaccgtgagaag

SEQ ID NO: 163987 - DNA, 25 bp, E. coli
aacaaagcggtggtaataaatcagg

SEQ ID NO: 163988 - DNA, 25 bp, E. coli
aaatttcgccgatgaccgtgagaag

SEQ ID NO: 163989 - DNA, 25 bp, E. coli
ttttaaaaatgatccgcaacgcgca

SEQ ID NO: 163990 - DNA, 25 bp, E. coli
ttttaaaaatgaaccgcaacgcgca

SEQ ID NO: 163991 - DNA, 25 bp, E. coli
tccgcaacgcgcttctgaagcgggt

SEQ ID NO: 163992 - DNA, 25 bp, E. coli
tcgtggtggttctggaaatttcgcc

SEQ ID NO: 163993 - DNA, 25 bp, E. coli
tccgcaacgcgcatctgaagcgggt

SEQ ID NO: 163994 - DNA, 25 bp, E. coli
tcgtggtggttcaggaaatttcgcc

SEQ ID NO: 163995 - DNA, 25 bp, E. coli
gccgaacatcgtcgtggttcaggaa

SEQ ID NO: 163996 - DNA, 25 bp, E. coli
gccgaacatcgtggtggttcaggaa

SEQ ID NO: 163997 - DNA, 25 bp, E. coli
gcggtcagcatagcggcggtaattt

SEQ ID NO: 163998 - DNA, 25 bp, E. coli
gcggtcagcataccggcggtaattt

SEQ ID NO: 163999 - DNA, 25 bp, E. coli
cgcaggccgtaaaggcggtcagcat

SEQ ID NO: 164000 - DNA, 25 bp, E. coli
cgcaggccgtaatggcggtcagcat

SEQ ID NO: 164001 - DNA, 25 bp, E. coli
caactggcctgggtctgaaagaagc

SEQ ID NO: 164002 - DNA, 25 bp, E. coli
caactggcctggctctgaaagaagc

SEQ ID NO: 164003 - DNA, 25 bp, E. coli
aaaaagctctggaagaagctggcgc

SEQ ID NO: 164004 - DNA, 25 bp, E. coli
aaaaattcggtgtttccgctgctgc

SEQ ID NO: 164005 - DNA, 25 bp, E. coli
aaaaattcggtgattccgctgctgc

SEQ ID NO: 164006 - DNA, 25 bp, E. coli
aaaaagctctggtagaagctggcgc

SEQ ID NO: 164007 - DNA, 25 bp, E. coli
tgttatcaaagctgtacgtggcgca

SEQ ID NO: 164008 - DNA, 25 bp, E. coli
tgttatcaaagcagtacgtggcgca

SEQ ID NO: 164009 - DNA, 25 bp, E. coli
tgagcaaagacgtcgcagaagcact

SEQ ID NO: 164010 - DNA, 25 bp, E. coli
tgcaccggctgctctgaaagaaggc

SEQ ID NO: 164011 - DNA, 25 bp, E. coli
tgagcaaagacgacgcagaagcact

SEQ ID NO: 164012 - DNA, 25 bp, E. coli
tgcaccggctgcactgaaagaaggc

SEQ ID NO: 164013 - DNA, 25 bp, E. coli
tgctgtagctgtagctgctggcccg

SEQ ID NO: 164014 - DNA, 25 bp, E. coli
tgctggcccggtagaagctgctgaa

SEQ ID NO: 164015 - DNA, 25 bp, E. coli
tgctgtagctgttgctgctggcccg

SEQ ID NO: 164016 - DNA, 25 bp, E. coli
tgctggcccggttgaagctgctgaa

SEQ ID NO: 164017 - DNA, 25 bp, E. coli
ctgctggcgctaacaaagttgctgt

SEQ ID NO: 164018 - DNA, 25 bp, E. coli
ctgctggcgctatcaaagttgctgt

SEQ ID NO: 164019 - DNA, 25 bp, E. coli
ggacgttgtagaactgatctctgca

SEQ ID NO: 164020 - DNA, 25 bp, E. coli
ggacgttgtagatctgatctctgca

SEQ ID NO: 164021 - DNA, 25 bp, E. coli
gacgtaattctgaaagctgctggcg

SEQ ID NO: 164022 - DNA, 25 bp, E. coli
gacgtaattctgtaagctgctggcg

SEQ ID NO: 164023 - DNA, 25 bp, E. coli
caatactgattttcgcgcgctgggc

SEQ ID NO: 164024 - DNA, 25 bp, E. coli
caatactgatttacgcgcgctgggc

SEQ ID NO: 164025 - DNA, 25 bp, E. coli
cagtttactgcgtgtgatgccgcca

SEQ ID NO: 164026 - DNA, 25 bp, E. coli
cagtttactgcgagtgatgccgcca

SEQ ID NO: 164027 - DNA, 25 bp, E. coli
tatcagtcttgaagaagcggcggcc

SEQ ID NO: 164028 - DNA, 25 bp, E. coli
tatcagtcttgatgaagcggcggcc

SEQ ID NO: 164029 - DNA, 25 bp, E. coli
ttatggaaaggcagaccccgttgcg

SEQ ID NO: 164030 - DNA, 25 bp, E. coli
ttatggaaaggctgaccccgttgcg

SEQ ID NO: 164031 - DNA, 25 bp, E. coli
tgatgcagcagtaaagcacccggct

SEQ ID NO: 164032 - DNA, 25 bp, E. coli
tgaaaaatctcgacagcgcatggga

SEQ ID NO: 164033 - DNA, 25 bp, E. coli
tgaaaaaatcacctcgctggcgcag

SEQ ID NO: 164034 - DNA, 25 bp, E. coli
tgatgcagcagttaagcacccggct

SEQ ID NO: 164035 - DNA, 25 bp, E. coli
tgaaaaatctcgtcagcgcatggga

SEQ ID NO: 164036 - DNA, 25 bp, E. coli
tgaaaaaatcacgtcgctggcgcag

SEQ ID NO: 164037 - DNA, 25 bp, E. coli
tgccaataatggacttcgcggaagc

SEQ ID NO: 164038 - DNA, 25 bp, E. coli
tgccaataatggtcttcgcggaagc

SEQ ID NO: 164039 - DNA, 25 bp, E. coli
gatcaaaaatctggagcgtcaggcg

SEQ ID NO: 164040 - DNA, 25 bp, E. coli
gatcaaaaatctcgagcgtcaggcg

SEQ ID NO: 164041 - DNA, 25 bp, E. coli
ggttttactccggaggccattcagg

SEQ ID NO: 164042 - DNA, 25 bp, E. coli
ggttttactccgcaggccattcagg

SEQ ID NO: 164043 - DNA, 25 bp, E. coli
taatcggaagcggttcagccaggtg

SEQ ID NO: 164044 - DNA, 25 bp, E. coli
taatcggaagcgcttcagccaggtg

SEQ ID NO: 164045 - DNA, 25 bp, E. coli
caaattttatcacgtgacgttccgt

SEQ ID NO: 164046 - DNA, 25 bp, E. coli
caaattttatcaggtgacgttccgt

SEQ ID NO: 164047 - DNA, 25 bp, E. coli
tatggagttctccatgcagtcggcg

SEQ ID NO: 164048 - DNA, 25 bp, E. coli
tatggagttctcgatgcagtcggcg

SEQ ID NO: 164049 - DNA, 25 bp, E. coli
tatttcctctttgtttcccggcaag

SEQ ID NO: 164050 - DNA, 25 bp, E. coli
tatttcctctttctttcccggcaag

SEQ ID NO: 164051 - DNA, 25 bp, E. coli
tattcatcgtctgagctatatggct

SEQ ID NO: 164052 - DNA, 25 bp, E. coli
tattcatcgtctcagctatatggct

SEQ ID NO: 164053 - DNA, 25 bp, E. coli
tgcagtcggcgccactatcagtacc

SEQ ID NO: 164054 - DNA, 25 bp, E. coli
tgacgttccgtataaagttgtatgg

SEQ ID NO: 164055 - DNA, 25 bp, E. coli
tgacgttccgtaaaaagttgtatgg

SEQ ID NO: 164056 - DNA, 25 bp, E. coli
tgcagtcggcgcgactatcagtacc

SEQ ID NO: 164057 - DNA, 25 bp, E. coli
tcagatatcgtaaaagaccagtgca

SEQ ID NO: 164058 - DNA, 25 bp, E. coli
tcagatatcgtataagaccagtgca

SEQ ID NO: 164059 - DNA, 25 bp, E. coli
gctgaaccctggactatcgggccgc

SEQ ID NO: 164060 - DNA, 25 bp, E. coli
gctgaaccctggtctatcgggccgc

SEQ ID NO: 164061 - DNA, 25 bp, E. coli
tgttgtttcagggtcggaactcacc

SEQ ID NO: 164062 - DNA, 25 bp, E. coli
ggaactcaccctcaataaacaactg

SEQ ID NO: 164063 - DNA, 25 bp, E. coli
tgttgtttcaggctcggaactcacc

SEQ ID NO: 164064 - DNA, 25 bp, E. coli
ggaactcaccctgaataaacaactg

SEQ ID NO: 164065 - DNA, 25 bp, E. coli
gatagggactcagattaaacacgta

SEQ ID NO: 164066 - DNA, 25 bp, E. coli
gatagggactcacattaaacacgta

SEQ ID NO: 164067 - DNA, 25 bp, E. coli
aatattgaactggtgccggaaggcc

SEQ ID NO: 164068 - DNA, 25 bp, E. coli
aatattgaactgctgccggaaggcc

SEQ ID NO: 164069 - DNA, 25 bp, E. coli
catattggcgaacaaaccgggatga

SEQ ID NO: 164070 - DNA, 25 bp, E. coli
catattggcgaagaaaccgggatga

SEQ ID NO: 164071 - DNA, 25 bp, E. coli
tactgaccgacaagctggaaagtgg

SEQ ID NO: 164072 - DNA, 25 bp, E. coli
tactgaccgacatgctggaaagtgg

SEQ ID NO: 164073 - DNA, 25 bp, E. coli
tattgcactaacaaacggcagccag

SEQ ID NO: 164074 - DNA, 25 bp, E. coli
tattgcactaactaacggcagccag

SEQ ID NO: 164075 - DNA, 25 bp, E. coli
tctgaacgacggtttacgcacgcct

SEQ ID NO: 164076 - DNA, 25 bp, E. coli
tctgaacgacggattacgcacgcct

SEQ ID NO: 164077 - DNA, 25 bp, E. coli
gcatgaactacgtaccagagccgga

SEQ ID NO: 164078 - DNA, 25 bp, E. coli
gcatgaactacgaaccagagccgga

SEQ ID NO: 164079 - DNA, 25 bp, E. coli
ccgatggtcgggtcaaaaaagtgct

SEQ ID NO: 164080 - DNA, 25 bp, E. coli
ccgatggtcgggacaaaaaagtgct

SEQ ID NO: 164081 - DNA, 25 bp, E. coli
ggaaaacggagctactcacactgct

SEQ ID NO: 164082 - DNA, 25 bp, E. coli
ggaaaacggagcaactcacactgct

SEQ ID NO: 164083 - DNA, 25 bp, E. coli
taagcgtaacgaactgctgcgcctg

SEQ ID NO: 164084 - DNA, 25 bp, E. coli
taagcgtaacgatctgctgcgcctg

SEQ ID NO: 164085 - DNA, 25 bp, E. coli
gatctgtttgtcactgcgcgtccga

SEQ ID NO: 164086 - DNA, 25 bp, E. coli
gatctgtttgtctctgcgcgtccga

SEQ ID NO: 164087 - DNA, 25 bp, E. coli
gacgccggactggaagaagatctgt

SEQ ID NO: 164088 - DNA, 25 bp, E. coli
gacgccggactgcaagaagatctgt

SEQ ID NO: 164089 - DNA, 25 bp, E. coli
caatgggcggcacaaggcgtcttta

SEQ ID NO: 164090 - DNA, 25 bp, E. coli
caagttatccgtgcatccagcaagg

SEQ ID NO: 164091 - DNA, 25 bp, E. coli
caatgggcggcagaaggcgtcttta

SEQ ID NO: 164092 - DNA, 25 bp, E. coli
caagttatccgtccatccagcaagg

SEQ ID NO: 164093 - DNA, 25 bp, E. coli
caaaagccgatgaaggttacgacgt

SEQ ID NO: 164094 - DNA, 25 bp, E. coli
caaaagccgatgtaggttacgacgt

SEQ ID NO: 164095 - DNA, 25 bp, E. coli
tacgtatgctgagtctgctcggcag

SEQ ID NO: 164096 - DNA, 25 bp, E. coli
tacgacgtggtagggactgtacgcc

SEQ ID NO: 164097 - DNA, 25 bp, E. coli
taccggaattaatcaggcgcaccac

SEQ ID NO: 164098 - DNA, 25 bp, E. coli
tacgtatgctgactctgctcggcag

SEQ ID NO: 164099 - DNA, 25 bp, E. coli
taccggaattaaacaggcgcaccac

SEQ ID NO: 164100 - DNA, 25 bp, E. coli
tacgacgtggtacggactgtacgcc

SEQ ID NO: 164101 - DNA, 25 bp, E. coli
tataacgagcagcaaagcttaccgg

SEQ ID NO: 164102 - DNA, 25 bp, E. coli
tataacgagcaggaaagcttaccgg

SEQ ID NO: 164103 - DNA, 25 bp, E. coli
tgattttacgccagaccttcggacc

SEQ ID NO: 164104 - DNA, 25 bp, E. coli
tgattttacgcctgaccttcggacc

SEQ ID NO: 164105 - DNA, 25 bp, E. coli
gcaattacgggctacattcagcgat

SEQ ID NO: 164106 - DNA, 25 bp, E. coli
gcaattacgggcaacattcagcgat

SEQ ID NO: 164107 - DNA, 25 bp, E. coli
gattaaccggcttattcagcgcacc

SEQ ID NO: 164108 - DNA, 25 bp, E. coli
gattaaccggctaattcagcgcacc

SEQ ID NO: 164109 - DNA, 25 bp, E. coli
taatttgatgtaggacctggtgacc

SEQ ID NO: 164110 - DNA, 25 bp, E. coli
taatttgatgtacgacctggtgacc

SEQ ID NO: 164111 - DNA, 25 bp, E. coli
cactggacgtacgtggtggatatcg

SEQ ID NO: 164112 - DNA, 25 bp, E. coli
caaaccataagaaatgggcgacgga

SEQ ID NO: 164113 - DNA, 25 bp, E. coli
caaaccataagatatgggcgacgga

SEQ ID NO: 164114 - DNA, 25 bp, E. coli
caaagtcagtgagggatggcaaaat

SEQ ID NO: 164115 - DNA, 25 bp, E. coli
caaagtcagtgacggatggcaaaat

SEQ ID NO: 164116 - DNA, 25 bp, E. coli
cactggacgtacctggtggatatcg

SEQ ID NO: 164117 - DNA, 25 bp, E. coli
tatcgttacgacaggaaagcttacc

SEQ ID NO: 164118 - DNA, 25 bp, E. coli
tatcgttacgactggaaagcttacc

SEQ ID NO: 164119 - DNA, 25 bp, E. coli
ttgatgatcaatggacggtgcgccc

SEQ ID NO: 164120 - DNA, 25 bp, E. coli
ttgatgatcaatcgacggtgcgccc

SEQ ID NO: 164121 - DNA, 25 bp, E. coli
tgatttcaccttggcatggcaaacg

SEQ ID NO: 164122 - DNA, 25 bp, E. coli
tgatttcaccttcgcatggcaaacg

SEQ ID NO: 164123 - DNA, 25 bp, E. coli
tcctgggacgcgacaaaagatctta

SEQ ID NO: 164124 - DNA, 25 bp, E. coli
tccggtgatatgtctcgtgataacg

SEQ ID NO: 164125 - DNA, 25 bp, E. coli
tccggtgatatgactcgtgataacg

SEQ ID NO: 164126 - DNA, 25 bp, E. coli
tcctgggacgcgtcaaaagatctta

SEQ ID NO: 164127 - DNA, 25 bp, E. coli
cgttgggatggatatgtcacttacc

SEQ ID NO: 164128 - DNA, 25 bp, E. coli
cgttgggatggaaatgtcacttacc

SEQ ID NO: 164129 - DNA, 25 bp, E. coli
taacgcattttagcagcaacggcac

SEQ ID NO: 164130 - DNA, 25 bp, E. coli
taataaaaaggataatgccgcactc

SEQ ID NO: 164131 - DNA, 25 bp, E. coli
taacgcattttaccagcaacggcac

SEQ ID NO: 164132 - DNA, 25 bp, E. coli
taataaaaaggaaaatgccgcactc

SEQ ID NO: 164133 - DNA, 25 bp, E. coli
caaaatcagagctgggaaatcgtcg

SEQ ID NO: 164134 - DNA, 25 bp, E. coli
caaaatcagagcagggaaatcgtcg

SEQ ID NO: 164135 - DNA, 25 bp, E. coli
atgatctggaaaggccatttaacgc

SEQ ID NO: 164136 - DNA, 25 bp, E. coli
atcgatggccggatttatgatgacc

SEQ ID NO: 164137 - DNA, 25 bp, E. coli
atgatctggaaacgccatttaacgc

SEQ ID NO: 164138 - DNA, 25 bp, E. coli
atcgatggccggttttatgatgacc

SEQ ID NO: 164139 - DNA, 25 bp, E. coli
aacgctgggatcgatggccggattt

SEQ ID NO: 164140 - DNA, 25 bp, E. coli
aacgctgggatccatggccggattt

SEQ ID NO: 164141 - DNA, 25 bp, E. coli
tgtatacccgtctgggcgatgatgt

SEQ ID NO: 164142 - DNA, 25 bp, E. coli
tgtatacccgtcagggcgatgatgt

SEQ ID NO: 164143 - DNA, 25 bp, E. coli
tgaacgccaccaccgataacacaat

SEQ ID NO: 164144 - DNA, 25 bp, E. coli
tgaacgccaccagcgataacacaat

SEQ ID NO: 164145 - DNA, 25 bp, E. coli
gaaatcgtcgttatcgatgaacagg

SEQ ID NO: 164146 - DNA, 25 bp, E. coli
gaaatcgtcgttttcgatgaacagg

SEQ ID NO: 164147 - DNA, 25 bp, E. coli
gataacacaatggtggcgcatctgg

SEQ ID NO: 164148 - DNA, 25 bp, E. coli
gataacacaatgctggcgcatctgg

SEQ ID NO: 164149 - DNA, 25 bp, E. coli
ggaaacgccatttaacgctcgacga

SEQ ID NO: 164150 - DNA, 25 bp, E. coli
ggaaacgccattaaacgctcgacga

SEQ ID NO: 164151 - DNA, 25 bp, E. coli
tggcgcatctggcaattgtgtatac

SEQ ID NO: 164152 - DNA, 25 bp, E. coli
ggaattgtgtatacccgtctgggcg

SEQ ID NO: 164153 - DNA, 25 bp, E. coli
tggcgcatctgggaattgtgtatac

SEQ ID NO: 164154 - DNA, 25 bp, E. coli
ggaattgtgtattcccgtctgggcg

SEQ ID NO: 164155 - DNA, 25 bp, E. coli
catcgcgcagaattcgacgtggcac

SEQ ID NO: 164156 - DNA, 25 bp, E. coli
catcgcgcagaaatcgacgtggcac

SEQ ID NO: 164157 - DNA, 25 bp, E. coli
cattatctggccgataaaccgacgg

SEQ ID NO: 164158 - DNA, 25 bp, E. coli
aaaccgacggtgatggcagcgatga

SEQ ID NO: 164159 - DNA, 25 bp, E. coli
aaaccgacggtgttggcagcgatga

SEQ ID NO: 164160 - DNA, 25 bp, E. coli
tgataaagcggatacctgggcgctg

SEQ ID NO: 164161 - DNA, 25 bp, E. coli
tgataaagcggaaacctgggcgctg

SEQ ID NO: 164162 - DNA, 25 bp, E. coli
tgacgcgtgacaccattccggtgcc

SEQ ID NO: 164163 - DNA, 25 bp, E. coli
tgacgcgtgacagcattccggtgcc

SEQ ID NO: 164164 - DNA, 25 bp, E. coli
tcccgaatacgtttgtcccagggcg

SEQ ID NO: 164165 - DNA, 25 bp, E. coli
tcccgaatacgtatgtcccagggcg

SEQ ID NO: 164166 - DNA, 25 bp, E. coli
gcctgattatgaacctgaagccgat

SEQ ID NO: 164167 - DNA, 25 bp, E. coli
gcctgattatgatcctgaagccgat

SEQ ID NO: 164168 - DNA, 25 bp, E. coli
gaaacgccgctgttgtggattgata

SEQ ID NO: 164169 - DNA, 25 bp, E. coli
gaaacgccgctgatgtggattgata

SEQ ID NO: 164170 - DNA, 25 bp, E. coli
cgtatcaggtaatagcagaagccgt

SEQ ID NO: 164171 - DNA, 25 bp, E. coli
cgtatcaggtaaaagcagaagccgt

SEQ ID NO: 164172 - DNA, 25 bp, E. coli
cattatctggcccataaaccgacgg

SEQ ID NO: 164173 - DNA, 25 bp, E. coli
cggattgccgcgttgagtttgtgaa

SEQ ID NO: 164174 - DNA, 25 bp, E. coli
cggattgccgcgatgagtttgtgaa

SEQ ID NO: 164175 - DNA, 25 bp, E. coli
gggcgctggcagtttattacggcaa

SEQ ID NO: 164176 - DNA, 25 bp, E. coli
gggcgctggcagattattacggcaa

SEQ ID NO: 164177 - DNA, 25 bp, E. coli
caatgtcaattctgcagcagcgaaa

SEQ ID NO: 164178 - DNA, 25 bp, E. coli
caatgtcaattcagcagcagcgaaa

SEQ ID NO: 164179 - DNA, 25 bp, E. coli
catgacggatagcaacgggactgca

SEQ ID NO: 164180 - DNA, 25 bp, E. coli
catgacggataggaacgggactgca

SEQ ID NO: 164181 - DNA, 25 bp, E. coli
tactaacgacagtggtgtggccgaa

SEQ ID NO: 164182 - DNA, 25 bp, E. coli
tactaacgacagaggtgtggccgaa

SEQ ID NO: 164183 - DNA, 25 bp, E. coli
ttaagtagccagtcgttgagcgcgg

SEQ ID NO: 164184 - DNA, 25 bp, E. coli
ttaagtagccagacgttgagcgcgg

SEQ ID NO: 164185 - DNA, 25 bp, E. coli
tgcttaacggcatcagagatacgaa

SEQ ID NO: 164186 - DNA, 25 bp, E. coli
tgcttaacggcaacagagatacgaa

SEQ ID NO: 164187 - DNA, 25 bp, E. coli
ccttcgtggcggataaggacagcgc

SEQ ID NO: 164188 - DNA, 25 bp, E. coli
ccttcgtggcggttaaggacagcgc

SEQ ID NO: 164189 - DNA, 25 bp, E. coli
gcaactgagtctgaacgcgcgtaat

SEQ ID NO: 164190 - DNA, 25 bp, E. coli
gcaactgagtctcaacgcgcgtaat

SEQ ID NO: 164191 - DNA, 25 bp, E. coli
gtgaccgccacgctgggtaacaata

SEQ ID NO: 164192 - DNA, 25 bp, E. coli
gtgccacaatgagcgcgacagttcg

SEQ ID NO: 164193 - DNA, 25 bp, E. coli
ggtaacaataatcccagcgatgcgc

SEQ ID NO: 164194 - DNA, 25 bp, E. coli
ggtaacaataatgccagcgatgcgc

SEQ ID NO: 164195 - DNA, 25 bp, E. coli
gtgaccgccacggtgggtaacaata

SEQ ID NO: 164196 - DNA, 25 bp, E. coli
gtgccacaatgaccgcgacagttcg

SEQ ID NO: 164197 - DNA, 25 bp, E. coli
gatgcgcaaccactcaccttcgtgg

SEQ ID NO: 164198 - DNA, 25 bp, E. coli
gatgcgcaaccagtcaccttcgtgg

SEQ ID NO: 164199 - DNA, 25 bp, E. coli
taccgtcagaaattaaactgtcgcc

SEQ ID NO: 164200 - DNA, 25 bp, E. coli
taccgtcagaaaataaactgtcgcc

SEQ ID NO: 164201 - DNA, 25 bp, E. coli
ttatggtcatcgtttgggccggtac

SEQ ID NO: 164202 - DNA, 25 bp, E. coli
ttatggtcatcgattgggccggtac

SEQ ID NO: 164203 - DNA, 25 bp, E. coli
tgtgcaatgaaaaacaggagccatc

SEQ ID NO: 164204 - DNA, 25 bp, E. coli
tgtgcaatgaaatacaggagccatc

SEQ ID NO: 164205 - DNA, 25 bp, E. coli
tgaagtcattcacgcgtaacagtaa

SEQ ID NO: 164206 - DNA, 25 bp, E. coli
tgaagtcattcaggcgtaacagtaa

SEQ ID NO: 164207 - DNA, 25 bp, E. coli
tcgccgatatgacacacttgtaagt

SEQ ID NO: 164208 - DNA, 25 bp, E. coli
tcgccgatatgagacacttgtaagt

SEQ ID NO: 164209 - DNA, 25 bp, E. coli
tttaaggtcgctttgcccggtgtca

SEQ ID NO: 164210 - DNA, 25 bp, E. coli
tttaaggtcgctatgcccggtgtca

SEQ ID NO: 164211 - DNA, 25 bp, E. coli
gccctgatgatctaaaagcaaactg

SEQ ID NO: 164212 - DNA, 25 bp, E. coli
gccctgatgatcaaaaagcaaactg

SEQ ID NO: 164213 - DNA, 25 bp, E. coli
cctgtttgcattactgacgacggtg

SEQ ID NO: 164214 - DNA, 25 bp, E. coli
cctgtttgcatttctgacgacggtg

SEQ ID NO: 164215 - DNA, 25 bp, E. coli
cattagcgccgtctcgagcagttta

SEQ ID NO: 164216 - DNA, 25 bp, E. coli
cattagcgccgtgtcgagcagttta

SEQ ID NO: 164217 - DNA, 25 bp, E. coli
ggtgtcaactcagtgtatcaggtgt

SEQ ID NO: 164218 - DNA, 25 bp, E. coli
ggtgtcaactcactgtatcaggtgt

SEQ ID NO: 164219 - DNA, 25 bp, E. coli
gggtgatgcccagggtaaaatacag

SEQ ID NO: 164220 - DNA, 25 bp, E. coli
gggtgatgcccacggtaaaatacag

SEQ ID NO: 164221 - DNA, 25 bp, E. coli
tagactgagagttccctgccaggat

SEQ ID NO: 164222 - DNA, 25 bp, E. coli
tagactgagagtaccctgccaggat

SEQ ID NO: 164223 - DNA, 25 bp, E. coli
tcccttcggcgatgacaaatttcac

SEQ ID NO: 164224 - DNA, 25 bp, E. coli
tcccttcggcgaagacaaatttcac

SEQ ID NO: 164225 - DNA, 25 bp, E. coli
tcggtgccgcaataacgataacgtc

SEQ ID NO: 164226 - DNA, 25 bp, E. coli
tcggtgccgcaaaaacgataacgtc

SEQ ID NO: 164227 - DNA, 25 bp, E. coli
ccaggatgctggttttaagaactaa

SEQ ID NO: 164228 - DNA, 25 bp, E. coli
ccaggatgctggatttaagaactaa

SEQ ID NO: 164229 - DNA, 25 bp, E. coli
gcaaccaggtcaaaatagtttttca

SEQ ID NO: 164230 - DNA, 25 bp, E. coli
gcaaccaggtcataatagtttttca

SEQ ID NO: 164231 - DNA, 25 bp, E. coli
gacaaatttcacttcggtaatgccg

SEQ ID NO: 164232 - DNA, 25 bp, E. coli
gacaaatttcacatcggtaatgccg

SEQ ID NO: 164233 - DNA, 25 bp, E. coli
ctcggtatagcggaaagtaacgcct

SEQ ID NO: 164234 - DNA, 25 bp, E. coli
cggtgatttcatcagcggagtgctt

SEQ ID NO: 164235 - DNA, 25 bp, E. coli
ctcggtatagcgcaaagtaacgcct

SEQ ID NO: 164236 - DNA, 25 bp, E. coli
cggtgatttcatgagcggagtgctt

SEQ ID NO: 164237 - DNA, 25 bp, E. coli
cggagtgcttttggcgccattgttc

SEQ ID NO: 164238 - DNA, 25 bp, E. coli
cggagtgcttttcgcgccattgttc

SEQ ID NO: 164239 - DNA, 25 bp, E. coli
gttgaagttatagatcggtgccgca

SEQ ID NO: 164240 - DNA, 25 bp, E. coli
gttgaagttatacatcggtgccgca

SEQ ID NO: 164241 - DNA, 25 bp, E. coli
taatcggacaactgattagactgag

SEQ ID NO: 164242 - DNA, 25 bp, E. coli
taatcggacaacagattagactgag

SEQ ID NO: 164243 - DNA, 25 bp, E. coli
cacaaggtcaattaaaacgtcctgg

SEQ ID NO: 164244 - DNA, 25 bp, E. coli
cacaaggtcaataaaaacgtcctgg

SEQ ID NO: 164245 - DNA, 25 bp, E. coli
cagaagtttaccaggaccagcctga

SEQ ID NO: 164246 - DNA, 25 bp, E. coli
cagttgatacagaaacgaaaccccg

SEQ ID NO: 164247 - DNA, 25 bp, E. coli
cagttgatacagtaacgaaaccccg

SEQ ID NO: 164248 - DNA, 25 bp, E. coli
cagaagtttacctggaccagcctga

SEQ ID NO: 164249 - DNA, 25 bp, E. coli
tatttaagcggccatagtacggctc

SEQ ID NO: 164250 - DNA, 25 bp, E. coli
tatttaagcggcgatagtacggctc

SEQ ID NO: 164251 - DNA, 25 bp, E. coli
tgatttcaccattccgccagaagtt

SEQ ID NO: 164252 - DNA, 25 bp, E. coli
tgatttcaccataccgccagaagtt

SEQ ID NO: 164253 - DNA, 25 bp, E. coli
tgcctctgccatctcgctgattatg

SEQ ID NO: 164254 - DNA, 25 bp, E. coli
tgcctctgccatgtcgctgattatg

SEQ ID NO: 164255 - DNA, 25 bp, E. coli
tccggatgaagaccaaaaaagtatg

SEQ ID NO: 164256 - DNA, 25 bp, E. coli
tccggatgaagagcaaaaaagtatg

SEQ ID NO: 164257 - DNA, 25 bp, E. coli
gaaaccccgatcagttagccgaatg

SEQ ID NO: 164258 - DNA, 25 bp, E. coli
gaaaccccgatctgttagccgaatg

SEQ ID NO: 164259 - DNA, 25 bp, E. coli
gaaagggtgggtgtatacgcaacac

SEQ ID NO: 164260 - DNA, 25 bp, E. coli
gaaagggtgggtctatacgcaacac

SEQ ID NO: 164261 - DNA, 25 bp, E. coli
cgttcgaaccggtcgacagtgtgga

SEQ ID NO: 164262 - DNA, 25 bp, E. coli
cgttcgaaccggacgacagtgtgga

SEQ ID NO: 164263 - DNA, 25 bp, E. coli
taatgaaatgaatctggaccgggca

SEQ ID NO: 164264 - DNA, 25 bp, E. coli
taatgaaatgaaactggaccgggca

SEQ ID NO: 164265 - DNA, 25 bp, E. coli
aactggcggaaaaagcgggcatcga

SEQ ID NO: 164266 - DNA, 25 bp, E. coli
aactggcggaaatagcgggcatcga

SEQ ID NO: 164267 - DNA, 25 bp, E. coli
tagtggccgagaccttcgaacaggc

SEQ ID NO: 164268 - DNA, 25 bp, E. coli
tagtggccgagagcttcgaacaggc

SEQ ID NO: 164269 - DNA, 25 bp, E. coli
tgaaagctggtcaggaaacctgccc

SEQ ID NO: 164270 - DNA, 25 bp, E. coli
tgaaagctggtctggaaacctgccc

SEQ ID NO: 164271 - DNA, 25 bp, E. coli
tcagatgattgactggtgccgcacc

SEQ ID NO: 164272 - DNA, 25 bp, E. coli
tcagctgaaggttgtcggtcgtccc

SEQ ID NO: 164273 - DNA, 25 bp, E. coli
tcagatgattgagtggtgccgcacc

SEQ ID NO: 164274 - DNA, 25 bp, E. coli
tcagctgaaggtagtcggtcgtccc

SEQ ID NO: 164275 - DNA, 25 bp, E. coli
gaaatgcttggcctaccgctggagc

SEQ ID NO: 164276 - DNA, 25 bp, E. coli
gaaatgcttggcgtaccgctggagc

SEQ ID NO: 164277 - DNA, 25 bp, E. coli
cttgatttgccgcaagggaacgcca

SEQ ID NO: 164278 - DNA, 25 bp, E. coli
cttgatttgccggaagggaacgcca

SEQ ID NO: 164279 - DNA, 25 bp, E. coli
gataagctgctcgataagctgccgg

SEQ ID NO: 164280 - DNA, 25 bp, E. coli
gataagctgctccataagctgccgg

SEQ ID NO: 164281 - DNA, 25 bp, E. coli
gtgtataacgccaccggtattcggg

SEQ ID NO: 164282 - DNA, 25 bp, E. coli
gtgtataacgcctccggtattcggg

SEQ ID NO: 164283 - DNA, 25 bp, E. coli
taataaaggagcttactccctggcg

SEQ ID NO: 164284 - DNA, 25 bp, E. coli
tatcctccccgaagaaggccaaagg

SEQ ID NO: 164285 - DNA, 25 bp, E. coli
tatcctccccgatgaaggccaaagg

SEQ ID NO: 164286 - DNA, 25 bp, E. coli
taataaaggagcatactccctggcg

SEQ ID NO: 164287 - DNA, 25 bp, E. coli
caacagcgattatggatcagtgtac

SEQ ID NO: 164288 - DNA, 25 bp, E. coli
cagtcggacgcacctttaataacta

SEQ ID NO: 164289 - DNA, 25 bp, E. coli
caacagcgattaaggatcagtgtac

SEQ ID NO: 164290 - DNA, 25 bp, E. coli
cagtcggacgcagctttaataacta

SEQ ID NO: 164291 - DNA, 25 bp, E. coli
tacttaaggtgcgtccggtgaacca

SEQ ID NO: 164292 - DNA, 25 bp, E. coli
tacttaaggtgcctccggtgaacca

SEQ ID NO: 164293 - DNA, 25 bp, E. coli
atataatggcgttaaggcttcccag

SEQ ID NO: 164294 - DNA, 25 bp, E. coli
atataatggcgtaaaggcttcccag

SEQ ID NO: 164295 - DNA, 25 bp, E. coli
tataaataagtgtctgggcagatac

SEQ ID NO: 164296 - DNA, 25 bp, E. coli
tataaataagtgactgggcagatac

SEQ ID NO: 164297 - DNA, 25 bp, E. coli
ttaaacgggtcatcaaaatcatcat

SEQ ID NO: 164298 - DNA, 25 bp, E. coli
ttaaacgggtcaacaaaatcatcat

SEQ ID NO: 164299 - DNA, 25 bp, E. coli
tgatggaaagataaacgtgaccgcc

SEQ ID NO: 164300 - DNA, 25 bp, E. coli
tgatggaaagattaacgtgaccgcc

SEQ ID NO: 164301 - DNA, 25 bp, E. coli
gcatgcaccctcaacaacagcgatt

SEQ ID NO: 164302 - DNA, 25 bp, E. coli
gaatgactgattcccgatacctgat

SEQ ID NO: 164303 - DNA, 25 bp, E. coli
gaagattttgctgtgctttacacca

SEQ ID NO: 164304 - DNA, 25 bp, E. coli
gcatgcaccctctacaacagcgatt

SEQ ID NO: 164305 - DNA, 25 bp, E. coli
gaatgactgattgccgatacctgat

SEQ ID NO: 164306 - DNA, 25 bp, E. coli
gaagattttgctctgctttacacca

SEQ ID NO: 164307 - DNA, 25 bp, E. coli
cgtgaccgccaaatcgtaagtacat

SEQ ID NO: 164308 - DNA, 25 bp, E. coli
cgtgaccgccaattcgtaagtacat

SEQ ID NO: 164309 - DNA, 25 bp, E. coli
caacctttgatgatccgcgaaaaca

SEQ ID NO: 164310 - DNA, 25 bp, E. coli
caacctttgatgttccgcgaaaaca

SEQ ID NO: 164311 - DNA, 25 bp, E. coli
caacgggagagaataacggcaaact

SEQ ID NO: 164312 - DNA, 25 bp, E. coli
caacgggagagattaacggcaaact

SEQ ID NO: 164313 - DNA, 25 bp, E. coli
atgtccacgttgtgtttcacgaaac

SEQ ID NO: 164314 - DNA, 25 bp, E. coli
atgtccacgttgagtttcacgaaac

SEQ ID NO: 164315 - DNA, 25 bp, E. coli
tatctaccgcaaccaacctttgatg

SEQ ID NO: 164316 - DNA, 25 bp, E. coli
tatctaccgcaagcaacctttgatg
